United States Patent 7,250,289 (METHODS OF GENETIC ANALYSIS OF MOUSE) - sequence listing, part 21

SEQ ID NO: 803849 - DNA, 25 bp, Mus musculus
tcagctttcagtctgggtagctact

SEQ ID NO: 803850 - DNA, 25 bp, Mus musculus
tcagctttcagtgtgggtagctact

SEQ ID NO: 803851 - DNA, 25 bp, Mus musculus
tcagctttccacacactagttacaa

SEQ ID NO: 803852 - DNA, 25 bp, Mus musculus
tcagctttccactcactagttacaa

SEQ ID NO: 803853 - DNA, 25 bp, Mus musculus
tcagctttcccacagtagacccagg

SEQ ID NO: 803854 - DNA, 25 bp, Mus musculus
tcagctttcccacctggaataagtt

SEQ ID NO: 803855 - DNA, 25 bp, Mus musculus
tcagctttcccactgatgtttaaat

SEQ ID NO: 803856 - DNA, 25 bp, Mus musculus
tcagctttcccagagtagacccagg

SEQ ID NO: 803857 - DNA, 25 bp, Mus musculus
tcagctttcccagctggaataagtt

SEQ ID NO: 803858 - DNA, 25 bp, Mus musculus
tcagctttcccagtgatgtttaaat

SEQ ID NO: 803859 - DNA, 25 bp, Mus musculus
tcagctttctgcatcagtcacaatg

SEQ ID NO: 803860 - DNA, 25 bp, Mus musculus
tcagctttctgcttcagtcacaatg

SEQ ID NO: 803861 - DNA, 25 bp, Mus musculus
tcagctttcttcagacatagtctgt

SEQ ID NO: 803862 - DNA, 25 bp, Mus musculus
tcagctttcttctgacatagtctgt

SEQ ID NO: 803863 - DNA, 25 bp, Mus musculus
tcagctttgaatacccgctctgtag

SEQ ID NO: 803864 - DNA, 25 bp, Mus musculus
tcagctttgaattcccgctctgtag

SEQ ID NO: 803865 - DNA, 25 bp, Mus musculus
tcagctttgaggagccctgtgacca

SEQ ID NO: 803866 - DNA, 25 bp, Mus musculus
tcagctttgaggtgccctgtgacca

SEQ ID NO: 803867 - DNA, 25 bp, Mus musculus
tcagctttgctcatgtcttattttt

SEQ ID NO: 803868 - DNA, 25 bp, Mus musculus
tcagctttgctcttgtcttattttt

SEQ ID NO: 803869 - DNA, 25 bp, Mus musculus
tcagctttgctgaatgttcagaacg

SEQ ID NO: 803870 - DNA, 25 bp, Mus musculus
tcagctttgctgtatgttcagaacg

SEQ ID NO: 803871 - DNA, 25 bp, Mus musculus
tcagctttggctatgatttttctct

SEQ ID NO: 803872 - DNA, 25 bp, Mus musculus
tcagctttggctttgatttttctct

SEQ ID NO: 803873 - DNA, 25 bp, Mus musculus
tcagctttgggcaatagacctctta

SEQ ID NO: 803874 - DNA, 25 bp, Mus musculus
tcagctttgggctatagacctctta

SEQ ID NO: 803875 - DNA, 25 bp, Mus musculus
tcagctttggtgactttgaacaatt

SEQ ID NO: 803876 - DNA, 25 bp, Mus musculus
tcagctttggtgtctttgaacaatt

SEQ ID NO: 803877 - DNA, 25 bp, Mus musculus
tcagctttgtgactgctcagattaa

SEQ ID NO: 803878 - DNA, 25 bp, Mus musculus
tcagctttgtgagtgctcagattaa

SEQ ID NO: 803879 - DNA, 25 bp, Mus musculus
tcagctttgtgtctgtggcaacttc

SEQ ID NO: 803880 - DNA, 25 bp, Mus musculus
tcagctttgtgtgtgtggcaacttc

SEQ ID NO: 803881 - DNA, 25 bp, Mus musculus
tcagcttttactacaaaagatcctg

SEQ ID NO: 803882 - DNA, 25 bp, Mus musculus
tcagcttttacttcaaaagatcctg

SEQ ID NO: 803883 - DNA, 25 bp, Mus musculus
tcagcttttcatcgctgtgacaaaa

SEQ ID NO: 803884 - DNA, 25 bp, Mus musculus
tcagcttttcatggctgtgacaaaa

SEQ ID NO: 803885 - DNA, 25 bp, Mus musculus
tcagcttttcctagtcatcacacat

SEQ ID NO: 803886 - DNA, 25 bp, Mus musculus
tcagcttttcctctaccatgtctgt

SEQ ID NO: 803887 - DNA, 25 bp, Mus musculus
tcagcttttcctgtaccatgtctgt

SEQ ID NO: 803888 - DNA, 25 bp, Mus musculus
tcagcttttccttgtcatcacacat

SEQ ID NO: 803889 - DNA, 25 bp, Mus musculus
tcagctttttgaaaaccactggaaa

SEQ ID NO: 803890 - DNA, 25 bp, Mus musculus
tcagctttttgataaccactggaaa

SEQ ID NO: 803891 - DNA, 25 bp, Mus musculus
tcagcttttttcagaagctcttgtg

SEQ ID NO: 803892 - DNA, 25 bp, Mus musculus
tcagcttttttctgaagctcttgtg

SEQ ID NO: 803893 - DNA, 25 bp, Mus musculus
tcaggaaaccttatggtgggttaca

SEQ ID NO: 803894 - DNA, 25 bp, Mus musculus
tcaggaaaccttcgcctctgctact

SEQ ID NO: 803895 - DNA, 25 bp, Mus musculus
tcaggaaaccttggcctctgctact

SEQ ID NO: 803896 - DNA, 25 bp, Mus musculus
tcaggaaaccttttggtgggttaca

SEQ ID NO: 803897 - DNA, 25 bp, Mus musculus
tcaggaaacttcctggtcctacaaa

SEQ ID NO: 803898 - DNA, 25 bp, Mus musculus
tcaggaaacttcgtggtcctacaaa

SEQ ID NO: 803899 - DNA, 25 bp, Mus musculus
tcaggaaagctgaatctccctctag

SEQ ID NO: 803900 - DNA, 25 bp, Mus musculus
tcaggaaagctgtatctccctctag

SEQ ID NO: 803901 - DNA, 25 bp, Mus musculus
tcaggaaatgataatttacgtccat

SEQ ID NO: 803902 - DNA, 25 bp, Mus musculus
tcaggaaatgattatttacgtccat

SEQ ID NO: 803903 - DNA, 25 bp, Mus musculus
tcaggaaatggaagcacccagccca

SEQ ID NO: 803904 - DNA, 25 bp, Mus musculus
tcaggaaatggatgcacccagccca

SEQ ID NO: 803905 - DNA, 25 bp, Mus musculus
tcaggaaatgggattctactttttt

SEQ ID NO: 803906 - DNA, 25 bp, Mus musculus
tcaggaaatgggtttctactttttt

SEQ ID NO: 803907 - DNA, 25 bp, Mus musculus
tcaggaaatggtcgccgactgctca

SEQ ID NO: 803908 - DNA, 25 bp, Mus musculus
tcaggaaatggtggccgactgctca

SEQ ID NO: 803909 - DNA, 25 bp, Mus musculus
tcaggaaattgtactctccacaccg

SEQ ID NO: 803910 - DNA, 25 bp, Mus musculus
tcaggaaattgttctctccacaccg

SEQ ID NO: 803911 - DNA, 25 bp, Mus musculus
tcaggaacacatccccactgggtca

SEQ ID NO: 803912 - DNA, 25 bp, Mus musculus
tcaggaacacatgcccactgggtca

SEQ ID NO: 803913 - DNA, 25 bp, Mus musculus
tcaggaacagttccatccaggcagc

SEQ ID NO: 803914 - DNA, 25 bp, Mus musculus
tcaggaacagttgcatccaggcagc

SEQ ID NO: 803915 - DNA, 25 bp, Mus musculus
tcaggaaccaggagaactatttgtg

SEQ ID NO: 803916 - DNA, 25 bp, Mus musculus
tcaggaaccaggtgaactatttgtg

SEQ ID NO: 803917 - DNA, 25 bp, Mus musculus
tcaggaaccccgagaggaacttgcc

SEQ ID NO: 803918 - DNA, 25 bp, Mus musculus
tcaggaaccccgtgaggaacttgcc

SEQ ID NO: 803919 - DNA, 25 bp, Mus musculus
tcaggaacgaggagtcaatagagca

SEQ ID NO: 803920 - DNA, 25 bp, Mus musculus
tcaggaacgaggtgtcaatagagca

SEQ ID NO: 803921 - DNA, 25 bp, Mus musculus
tcaggaactctcagttgactctccc

SEQ ID NO: 803922 - DNA, 25 bp, Mus musculus
tcaggaactctctgttgactctccc

SEQ ID NO: 803923 - DNA, 25 bp, Mus musculus
tcaggaactcttattcctcctagga

SEQ ID NO: 803924 - DNA, 25 bp, Mus musculus
tcaggaactctttttcctcctagga

SEQ ID NO: 803925 - DNA, 25 bp, Mus musculus
tcaggaactgacatgtctccaaccg

SEQ ID NO: 803926 - DNA, 25 bp, Mus musculus
tcaggaactgacttgtctccaaccg

SEQ ID NO: 803927 - DNA, 25 bp, Mus musculus
tcaggaactggccatgacttttcca

SEQ ID NO: 803928 - DNA, 25 bp, Mus musculus
tcaggaactggcgatgacttttcca

SEQ ID NO: 803929 - DNA, 25 bp, Mus musculus
tcaggaacttctcagaggtgtccgc

SEQ ID NO: 803930 - DNA, 25 bp, Mus musculus
tcaggaacttctgagaggtgtccgc

SEQ ID NO: 803931 - DNA, 25 bp, Mus musculus
tcaggaagaatccttctgaccccag

SEQ ID NO: 803932 - DNA, 25 bp, Mus musculus
tcaggaagaatcgttctgaccccag

SEQ ID NO: 803933 - DNA, 25 bp, Mus musculus
tcaggaagagtaacagggccgccct

SEQ ID NO: 803934 - DNA, 25 bp, Mus musculus
tcaggaagagtatcagggccgccct

SEQ ID NO: 803935 - DNA, 25 bp, Mus musculus
tcaggaagcattagtacctcccgta

SEQ ID NO: 803936 - DNA, 25 bp, Mus musculus
tcaggaagcatttgtacctcccgta

SEQ ID NO: 803937 - DNA, 25 bp, Mus musculus
tcaggaaggaggacaaaggtcataa

SEQ ID NO: 803938 - DNA, 25 bp, Mus musculus
tcaggaaggaggtcaaaggtcataa

SEQ ID NO: 803939 - DNA, 25 bp, Mus musculus
tcaggaagggtaagcttgtagatct

SEQ ID NO: 803940 - DNA, 25 bp, Mus musculus
tcaggaagggtatgcttgtagatct

SEQ ID NO: 803941 - DNA, 25 bp, Mus musculus
tcaggaagggtgatattgcagacat

SEQ ID NO: 803942 - DNA, 25 bp, Mus musculus
tcaggaagggtgttattgcagacat

SEQ ID NO: 803943 - DNA, 25 bp, Mus musculus
tcaggaagtagaaaccctttccagt

SEQ ID NO: 803944 - DNA, 25 bp, Mus musculus
tcaggaagtagataccctttccagt

SEQ ID NO: 803945 - DNA, 25 bp, Mus musculus
tcaggaatcctgagcttttggctca

SEQ ID NO: 803946 - DNA, 25 bp, Mus musculus
tcaggaatcctgtgcttttggctca

SEQ ID NO: 803947 - DNA, 25 bp, Mus musculus
tcaggaatctaaaccccttttctgc

SEQ ID NO: 803948 - DNA, 25 bp, Mus musculus
tcaggaatctaatccccttttctgc

SEQ ID NO: 803949 - DNA, 25 bp, Mus musculus
tcaggaatgaggagtccccgaaggc

SEQ ID NO: 803950 - DNA, 25 bp, Mus musculus
tcaggaatgaggtgtccccgaaggc

SEQ ID NO: 803951 - DNA, 25 bp, Mus musculus
tcaggaatggtgactgcctcatcgc

SEQ ID NO: 803952 - DNA, 25 bp, Mus musculus
tcaggaatggtgtctgcctcatcgc

SEQ ID NO: 803953 - DNA, 25 bp, Mus musculus
tcaggaatgttcacagtacggcttc

SEQ ID NO: 803954 - DNA, 25 bp, Mus musculus
tcaggaatgttctcagtacggcttc

SEQ ID NO: 803955 - DNA, 25 bp, Mus musculus
tcaggaattctccagctacccagag

SEQ ID NO: 803956 - DNA, 25 bp, Mus musculus
tcaggaattctcgagctacccagag

SEQ ID NO: 803957 - DNA, 25 bp, Mus musculus
tcaggaattgatcccattttaaaag

SEQ ID NO: 803958 - DNA, 25 bp, Mus musculus
tcaggaattgatgccattttaaaag

SEQ ID NO: 803959 - DNA, 25 bp, Mus musculus
tcaggaattgcaccctcctctctag

SEQ ID NO: 803960 - DNA, 25 bp, Mus musculus
tcaggaattgcagcctcctctctag

SEQ ID NO: 803961 - DNA, 25 bp, Mus musculus
tcaggaattgctaaggctcattaac

SEQ ID NO: 803962 - DNA, 25 bp, Mus musculus
tcaggaattgcttaggctcattaac

SEQ ID NO: 803963 - DNA, 25 bp, Mus musculus
tcaggaattggccagttcagataat

SEQ ID NO: 803964 - DNA, 25 bp, Mus musculus
tcaggaattggcgagttcagataat

SEQ ID NO: 803965 - DNA, 25 bp, Mus musculus
tcaggaatttgtagattggcagcag

SEQ ID NO: 803966 - DNA, 25 bp, Mus musculus
tcaggaatttgtcgcattgtgggct

SEQ ID NO: 803967 - DNA, 25 bp, Mus musculus
tcaggaatttgtggcattgtgggct

SEQ ID NO: 803968 - DNA, 25 bp, Mus musculus
tcaggaatttgttgattggcagcag

SEQ ID NO: 803969 - DNA, 25 bp, Mus musculus
tcaggaattttccaggccttcagca

SEQ ID NO: 803970 - DNA, 25 bp, Mus musculus
tcaggaattttcgaggccttcagca

SEQ ID NO: 803971 - DNA, 25 bp, Mus musculus
tcaggacaaataatttttcaacctt

SEQ ID NO: 803972 - DNA, 25 bp, Mus musculus
tcaggacaaatattttttcaacctt

SEQ ID NO: 803973 - DNA, 25 bp, Mus musculus
tcaggacaacgacgcgtgacaccct

SEQ ID NO: 803974 - DNA, 25 bp, Mus musculus
tcaggacaacgaggcgtgacaccct

SEQ ID NO: 803975 - DNA, 25 bp, Mus musculus
tcaggacaagccaaggaccccagaa

SEQ ID NO: 803976 - DNA, 25 bp, Mus musculus
tcaggacaagcctaggaccccagaa

SEQ ID NO: 803977 - DNA, 25 bp, Mus musculus
tcaggacacagtctcacagaaatgt

SEQ ID NO: 803978 - DNA, 25 bp, Mus musculus
tcaggacacagtgtcacagaaatgt

SEQ ID NO: 803979 - DNA, 25 bp, Mus musculus
tcaggacaccatatggctctggaga

SEQ ID NO: 803980 - DNA, 25 bp, Mus musculus
tcaggacaccatttggctctggaga

SEQ ID NO: 803981 - DNA, 25 bp, Mus musculus
tcaggacactgcagggagctcgcca

SEQ ID NO: 803982 - DNA, 25 bp, Mus musculus
tcaggacactgctgggagctcgcca

SEQ ID NO: 803983 - DNA, 25 bp, Mus musculus
tcaggacagcttagagcacagagca

SEQ ID NO: 803984 - DNA, 25 bp, Mus musculus
tcaggacagctttgagcacagagca

SEQ ID NO: 803985 - DNA, 25 bp, Mus musculus
tcaggacaggaacacatggcccttg

SEQ ID NO: 803986 - DNA, 25 bp, Mus musculus
tcaggacaggaagacatggcccttg

SEQ ID NO: 803987 - DNA, 25 bp, Mus musculus
tcaggacagtcccatgggcagtgta

SEQ ID NO: 803988 - DNA, 25 bp, Mus musculus
tcaggacagtccgatgggcagtgta

SEQ ID NO: 803989 - DNA, 25 bp, Mus musculus
tcaggacatggcatgttagcttggg

SEQ ID NO: 803990 - DNA, 25 bp, Mus musculus
tcaggacatggcttgttagcttggg

SEQ ID NO: 803991 - DNA, 25 bp, Mus musculus
tcaggaccacccagtcttccaggtg

SEQ ID NO: 803992 - DNA, 25 bp, Mus musculus
tcaggaccaccctgtcttccaggtg

SEQ ID NO: 803993 - DNA, 25 bp, Mus musculus
tcaggaccagaacagccatgcacta

SEQ ID NO: 803994 - DNA, 25 bp, Mus musculus
tcaggaccagaagagccatgcacta

SEQ ID NO: 803995 - DNA, 25 bp, Mus musculus
tcaggaccaggtatccaaggccatt

SEQ ID NO: 803996 - DNA, 25 bp, Mus musculus
tcaggaccaggtttccaaggccatt

SEQ ID NO: 803997 - DNA, 25 bp, Mus musculus
tcaggaccagtcatacttagtaaag

SEQ ID NO: 803998 - DNA, 25 bp, Mus musculus
tcaggaccagtcttacttagtaaag

SEQ ID NO: 803999 - DNA, 25 bp, Mus musculus
tcaggaccatgacagtcatcacata

SEQ ID NO: 804000 - DNA, 25 bp, Mus musculus
tcaggaccatgagagtcatcacata

SEQ ID NO: 804001 - DNA, 25 bp, Mus musculus
tcaggaccattaagctccagcatgc

SEQ ID NO: 804002 - DNA, 25 bp, Mus musculus
tcaggaccattatgctccagcatgc

SEQ ID NO: 804003 - DNA, 25 bp, Mus musculus
tcaggaccatttcttcccctttgct

SEQ ID NO: 804004 - DNA, 25 bp, Mus musculus
tcaggaccatttgttcccctttgct

SEQ ID NO: 804005 - DNA, 25 bp, Mus musculus
tcaggacccagtcaaataccgaatt

SEQ ID NO: 804006 - DNA, 25 bp, Mus musculus
tcaggacccagtgaaataccgaatt

SEQ ID NO: 804007 - DNA, 25 bp, Mus musculus
tcaggaccctgacgcccttgtagat

SEQ ID NO: 804008 - DNA, 25 bp, Mus musculus
tcaggaccctgaggcccttgtagat

SEQ ID NO: 804009 - DNA, 25 bp, Mus musculus
tcaggaccggtgacgtgtggaacaa

SEQ ID NO: 804010 - DNA, 25 bp, Mus musculus
tcaggaccggtgtcgtgtggaacaa

SEQ ID NO: 804011 - DNA, 25 bp, Mus musculus
tcaggaccggttagaagtgaatgta

SEQ ID NO: 804012 - DNA, 25 bp, Mus musculus
tcaggaccggtttgaagtgaatgta

SEQ ID NO: 804013 - DNA, 25 bp, Mus musculus
tcaggacctattcggcacagtgggc

SEQ ID NO: 804014 - DNA, 25 bp, Mus musculus
tcaggacctattgggcacagtgggc

SEQ ID NO: 804015 - DNA, 25 bp, Mus musculus
tcaggacctcatcggcctgcgattg

SEQ ID NO: 804016 - DNA, 25 bp, Mus musculus
tcaggacctcatgggcctgcgattg

SEQ ID NO: 804017 - DNA, 25 bp, Mus musculus
tcaggacctgaaatcacatctccag

SEQ ID NO: 804018 - DNA, 25 bp, Mus musculus
tcaggacctgaattcacatctccag

SEQ ID NO: 804019 - DNA, 25 bp, Mus musculus
tcaggacctgagctgtttgtagcct

SEQ ID NO: 804020 - DNA, 25 bp, Mus musculus
tcaggacctgaggtgtttgtagcct

SEQ ID NO: 804021 - DNA, 25 bp, Mus musculus
tcaggacctggaactcccggtagca

SEQ ID NO: 804022 - DNA, 25 bp, Mus musculus
tcaggacctggatctcccggtagca

SEQ ID NO: 804023 - DNA, 25 bp, Mus musculus
tcaggacctgggactggctctgcag

SEQ ID NO: 804024 - DNA, 25 bp, Mus musculus
tcaggacctgggtctggctctgcag

SEQ ID NO: 804025 - DNA, 25 bp, Mus musculus
tcaggacctgtgacaacctcacatt

SEQ ID NO: 804026 - DNA, 25 bp, Mus musculus
tcaggacctgtgtcaacctcacatt

SEQ ID NO: 804027 - DNA, 25 bp, Mus musculus
tcaggaccttaactcacttcataat

SEQ ID NO: 804028 - DNA, 25 bp, Mus musculus
tcaggaccttaagtcacttcataat

SEQ ID NO: 804029 - DNA, 25 bp, Mus musculus
tcaggaccttccaagactctataag

SEQ ID NO: 804030 - DNA, 25 bp, Mus musculus
tcaggaccttcctagactctataag

SEQ ID NO: 804031 - DNA, 25 bp, Mus musculus
tcaggaccttggcagacaactcagt

SEQ ID NO: 804032 - DNA, 25 bp, Mus musculus
tcaggaccttgggagacaactcagt

SEQ ID NO: 804033 - DNA, 25 bp, Mus musculus
tcaggacgaagcaaccgaacttgaa

SEQ ID NO: 804034 - DNA, 25 bp, Mus musculus
tcaggacgaagctaccgaacttgaa

SEQ ID NO: 804035 - DNA, 25 bp, Mus musculus
tcaggacgtgtgatgatgactcagt

SEQ ID NO: 804036 - DNA, 25 bp, Mus musculus
tcaggacgtgtgttgatgactcagt

SEQ ID NO: 804037 - DNA, 25 bp, Mus musculus
tcaggactaccaacctctgagtctg

SEQ ID NO: 804038 - DNA, 25 bp, Mus musculus
tcaggactaccatcctctgagtctg

SEQ ID NO: 804039 - DNA, 25 bp, Mus musculus
tcaggactcaaacgcctcttctgag

SEQ ID NO: 804040 - DNA, 25 bp, Mus musculus
tcaggactcaaaggcctcttctgag

SEQ ID NO: 804041 - DNA, 25 bp, Mus musculus
tcaggactcccgatggaatacagat

SEQ ID NO: 804042 - DNA, 25 bp, Mus musculus
tcaggactcccgctagaccagaaga

SEQ ID NO: 804043 - DNA, 25 bp, Mus musculus
tcaggactcccggtagaccagaaga

SEQ ID NO: 804044 - DNA, 25 bp, Mus musculus
tcaggactcccgttggaatacagat

SEQ ID NO: 804045 - DNA, 25 bp, Mus musculus
tcaggactcgctccttctgggaaat

SEQ ID NO: 804046 - DNA, 25 bp, Mus musculus
tcaggactcgctgcttctgggaaat

SEQ ID NO: 804047 - DNA, 25 bp, Mus musculus
tcaggactcggaaggtgaaccaccc

SEQ ID NO: 804048 - DNA, 25 bp, Mus musculus
tcaggactcggatggtgaaccaccc

SEQ ID NO: 804049 - DNA, 25 bp, Mus musculus
tcaggactctgactgcgtatgctct

SEQ ID NO: 804050 - DNA, 25 bp, Mus musculus
tcaggactctgagtgcgtatgctct

SEQ ID NO: 804051 - DNA, 25 bp, Mus musculus
tcaggactggccatctatacagtga

SEQ ID NO: 804052 - DNA, 25 bp, Mus musculus
tcaggactggccttctatacagtga

SEQ ID NO: 804053 - DNA, 25 bp, Mus musculus
tcaggactgggccttgttgcactcg

SEQ ID NO: 804054 - DNA, 25 bp, Mus musculus
tcaggactgggcgttgttgcactcg

SEQ ID NO: 804055 - DNA, 25 bp, Mus musculus
tcaggactgtgccacccacacccaa

SEQ ID NO: 804056 - DNA, 25 bp, Mus musculus
tcaggactgtgcgacccacacccaa

SEQ ID NO: 804057 - DNA, 25 bp, Mus musculus
tcaggacttacaaggaattttattt

SEQ ID NO: 804058 - DNA, 25 bp, Mus musculus
tcaggacttacatggaattttattt

SEQ ID NO: 804059 - DNA, 25 bp, Mus musculus
tcaggacttacgaggaaaattattt

SEQ ID NO: 804060 - DNA, 25 bp, Mus musculus
tcaggacttacgtggaaaattattt

SEQ ID NO: 804061 - DNA, 25 bp, Mus musculus
tcaggacttccgctgaattccagcg

SEQ ID NO: 804062 - DNA, 25 bp, Mus musculus
tcaggacttccggtgaattccagcg

SEQ ID NO: 804063 - DNA, 25 bp, Mus musculus
tcaggacttcttaaccacctaactt

SEQ ID NO: 804064 - DNA, 25 bp, Mus musculus
tcaggacttctttaccacctaactt

SEQ ID NO: 804065 - DNA, 25 bp, Mus musculus
tcaggacttggaaatttctcaggat

SEQ ID NO: 804066 - DNA, 25 bp, Mus musculus
tcaggacttggatatttctcaggat

SEQ ID NO: 804067 - DNA, 25 bp, Mus musculus
tcaggactttatcagaccttccaag

SEQ ID NO: 804068 - DNA, 25 bp, Mus musculus
tcaggactttatgagaccttccaag

SEQ ID NO: 804069 - DNA, 25 bp, Mus musculus
tcaggagaaggtctgacctgcagca

SEQ ID NO: 804070 - DNA, 25 bp, Mus musculus
tcaggagaaggtgtgacctgcagca

SEQ ID NO: 804071 - DNA, 25 bp, Mus musculus
tcaggagaatctaaaaccaggctta

SEQ ID NO: 804072 - DNA, 25 bp, Mus musculus
tcaggagaatcttaaaccaggctta

SEQ ID NO: 804073 - DNA, 25 bp, Mus musculus
tcaggagacagaagacgggatcacc

SEQ ID NO: 804074 - DNA, 25 bp, Mus musculus
tcaggagacagatgacgggatcacc

SEQ ID NO: 804075 - DNA, 25 bp, Mus musculus
tcaggagactctcgagagcgttcct

SEQ ID NO: 804076 - DNA, 25 bp, Mus musculus
tcaggagactctggagagcgttcct

SEQ ID NO: 804077 - DNA, 25 bp, Mus musculus
tcaggagactgtcccctcgggaacc

SEQ ID NO: 804078 - DNA, 25 bp, Mus musculus
tcaggagactgtgccctcgggaacc

SEQ ID NO: 804079 - DNA, 25 bp, Mus musculus
tcaggagagctgcagtacactgtat

SEQ ID NO: 804080 - DNA, 25 bp, Mus musculus
tcaggagagctggagtacactgtat

SEQ ID NO: 804081 - DNA, 25 bp, Mus musculus
tcaggagatctcactggagctggaa

SEQ ID NO: 804082 - DNA, 25 bp, Mus musculus
tcaggagatctctctggagctggaa

SEQ ID NO: 804083 - DNA, 25 bp, Mus musculus
tcaggagatggaacctgccctggca

SEQ ID NO: 804084 - DNA, 25 bp, Mus musculus
tcaggagatggatcctgccctggca

SEQ ID NO: 804085 - DNA, 25 bp, Mus musculus
tcaggagattctccctttggattga

SEQ ID NO: 804086 - DNA, 25 bp, Mus musculus
tcaggagattctgcctttggattga

SEQ ID NO: 804087 - DNA, 25 bp, Mus musculus
tcaggagcacggatacccagagggc

SEQ ID NO: 804088 - DNA, 25 bp, Mus musculus
tcaggagcacggttacccagagggc

SEQ ID NO: 804089 - DNA, 25 bp, Mus musculus
tcaggagcagatcaccgtccaggag

SEQ ID NO: 804090 - DNA, 25 bp, Mus musculus
tcaggagcagatgaccgtccaggag

SEQ ID NO: 804091 - DNA, 25 bp, Mus musculus
tcaggagcatggcagtaactccctg

SEQ ID NO: 804092 - DNA, 25 bp, Mus musculus
tcaggagcatgggagtaactccctg

SEQ ID NO: 804093 - DNA, 25 bp, Mus musculus
tcaggagcccggatgtttgctttac

SEQ ID NO: 804094 - DNA, 25 bp, Mus musculus
tcaggagcccggttgtttgctttac

SEQ ID NO: 804095 - DNA, 25 bp, Mus musculus
tcaggagcctcaagtccagaagcat

SEQ ID NO: 804096 - DNA, 25 bp, Mus musculus
tcaggagcctcatgtccagaagcat

SEQ ID NO: 804097 - DNA, 25 bp, Mus musculus
tcaggagcctccatctgcaagctta

SEQ ID NO: 804098 - DNA, 25 bp, Mus musculus
tcaggagcctccttctgcaagctta

SEQ ID NO: 804099 - DNA, 25 bp, Mus musculus
tcaggagcctctctcttgctcaatg

SEQ ID NO: 804100 - DNA, 25 bp, Mus musculus
tcaggagcctctgtcttgctcaatg

SEQ ID NO: 804101 - DNA, 25 bp, Mus musculus
tcaggagcggtcagtggcctcagat

SEQ ID NO: 804102 - DNA, 25 bp, Mus musculus
tcaggagcggtctgtggcctcagat

SEQ ID NO: 804103 - DNA, 25 bp, Mus musculus
tcaggagctcagcttgtgggaccaa

SEQ ID NO: 804104 - DNA, 25 bp, Mus musculus
tcaggagctcaggttgtgggaccaa

SEQ ID NO: 804105 - DNA, 25 bp, Mus musculus
tcaggagctctgaaggctgcacctt

SEQ ID NO: 804106 - DNA, 25 bp, Mus musculus
tcaggagctctgtaggctgcacctt

SEQ ID NO: 804107 - DNA, 25 bp, Mus musculus
tcaggagctggccagactgttcagt

SEQ ID NO: 804108 - DNA, 25 bp, Mus musculus
tcaggagctggccaggccaccaaaa

SEQ ID NO: 804109 - DNA, 25 bp, Mus musculus
tcaggagctggcgagactgttcagt

SEQ ID NO: 804110 - DNA, 25 bp, Mus musculus
tcaggagctggcgaggccaccaaaa

SEQ ID NO: 804111 - DNA, 25 bp, Mus musculus
tcaggagctgtgaaccggagacgaa

SEQ ID NO: 804112 - DNA, 25 bp, Mus musculus
tcaggagctgtgtaccggagacgaa

SEQ ID NO: 804113 - DNA, 25 bp, Mus musculus
tcaggagcttagcaccatgaacctt

SEQ ID NO: 804114 - DNA, 25 bp, Mus musculus
tcaggagcttaggaccatgaacctt

SEQ ID NO: 804115 - DNA, 25 bp, Mus musculus
tcaggagcttgcagtggtaatgtct

SEQ ID NO: 804116 - DNA, 25 bp, Mus musculus
tcaggagcttgctgtggtaatgtct

SEQ ID NO: 804117 - DNA, 25 bp, Mus musculus
tcaggaggagtgaccgtctcagtcc

SEQ ID NO: 804118 - DNA, 25 bp, Mus musculus
tcaggaggagtgtccgtctcagtcc

SEQ ID NO: 804119 - DNA, 25 bp, Mus musculus
tcaggaggatctaccacaacacggg

SEQ ID NO: 804120 - DNA, 25 bp, Mus musculus
tcaggaggatcttccacaacacggg

SEQ ID NO: 804121 - DNA, 25 bp, Mus musculus
tcaggaggcattaccgtgggtcttt

SEQ ID NO: 804122 - DNA, 25 bp, Mus musculus
tcaggaggcatttccgtgggtcttt

SEQ ID NO: 804123 - DNA, 25 bp, Mus musculus
tcaggaggcccactgatctgtgatg

SEQ ID NO: 804124 - DNA, 25 bp, Mus musculus
tcaggaggcccagtgatctgtgatg

SEQ ID NO: 804125 - DNA, 25 bp, Mus musculus
tcaggaggccctctggctgctacaa

SEQ ID NO: 804126 - DNA, 25 bp, Mus musculus
tcaggaggccctgtggctgctacaa

SEQ ID NO: 804127 - DNA, 25 bp, Mus musculus
tcaggaggcctgctaatctgtctac

SEQ ID NO: 804128 - DNA, 25 bp, Mus musculus
tcaggaggcctggtaatctgtctac

SEQ ID NO: 804129 - DNA, 25 bp, Mus musculus
tcaggaggctctcgtagctctgcgt

SEQ ID NO: 804130 - DNA, 25 bp, Mus musculus
tcaggaggctctggtagctctgcgt

SEQ ID NO: 804131 - DNA, 25 bp, Mus musculus
tcaggaggctggacctttctcagta

SEQ ID NO: 804132 - DNA, 25 bp, Mus musculus
tcaggaggctggtcctttctcagta

SEQ ID NO: 804133 - DNA, 25 bp, Mus musculus
tcaggaggtggaaaccgaaataaat

SEQ ID NO: 804134 - DNA, 25 bp, Mus musculus
tcaggaggtggataccgaaataaat

SEQ ID NO: 804135 - DNA, 25 bp, Mus musculus
tcaggagtcataatccttccctata

SEQ ID NO: 804136 - DNA, 25 bp, Mus musculus
tcaggagtcatattccttccctata

SEQ ID NO: 804137 - DNA, 25 bp, Mus musculus
tcaggagtcctgagagtccgaggcc

SEQ ID NO: 804138 - DNA, 25 bp, Mus musculus
tcaggagtcctgtgagtccgaggcc

SEQ ID NO: 804139 - DNA, 25 bp, Mus musculus
tcaggagtctttagtcactgtgctg

SEQ ID NO: 804140 - DNA, 25 bp, Mus musculus
tcaggagtctttcttaacgctttag

SEQ ID NO: 804141 - DNA, 25 bp, Mus musculus
tcaggagtctttgttaacgctttag

SEQ ID NO: 804142 - DNA, 25 bp, Mus musculus
tcaggagtcttttgtcactgtgctg

SEQ ID NO: 804143 - DNA, 25 bp, Mus musculus
tcaggagttatcactggtggagcca

SEQ ID NO: 804144 - DNA, 25 bp, Mus musculus
tcaggagttatctctggtggagcca

SEQ ID NO: 804145 - DNA, 25 bp, Mus musculus
tcaggagttgatcggcagcgtttaa

SEQ ID NO: 804146 - DNA, 25 bp, Mus musculus
tcaggagttgatgggcagcgtttaa

SEQ ID NO: 804147 - DNA, 25 bp, Mus musculus
tcaggagttgctagggcatccccat

SEQ ID NO: 804148 - DNA, 25 bp, Mus musculus
tcaggagttgcttgggcatccccat

SEQ ID NO: 804149 - DNA, 25 bp, Mus musculus
tcaggagttgtcagccaaggaccag

SEQ ID NO: 804150 - DNA, 25 bp, Mus musculus
tcaggagttgtctgccaaggaccag

SEQ ID NO: 804151 - DNA, 25 bp, Mus musculus
tcaggagtttccagagtctgtctcc

SEQ ID NO: 804152 - DNA, 25 bp, Mus musculus
tcaggagtttcctgagtctgtctcc

SEQ ID NO: 804153 - DNA, 25 bp, Mus musculus
tcaggagtttctacgacaggaagat

SEQ ID NO: 804154 - DNA, 25 bp, Mus musculus
tcaggagtttcttcgacaggaagat

SEQ ID NO: 804155 - DNA, 25 bp, Mus musculus
tcaggagtttgaatcctacaggatt

SEQ ID NO: 804156 - DNA, 25 bp, Mus musculus
tcaggagtttgattcctacaggatt

SEQ ID NO: 804157 - DNA, 25 bp, Mus musculus
tcaggataaacaagcagacacacat

SEQ ID NO: 804158 - DNA, 25 bp, Mus musculus
tcaggataaacatgcagacacacat

SEQ ID NO: 804159 - DNA, 25 bp, Mus musculus
tcaggataagctagctgctggcagc

SEQ ID NO: 804160 - DNA, 25 bp, Mus musculus
tcaggataagcttgctgctggcagc

SEQ ID NO: 804161 - DNA, 25 bp, Mus musculus
tcaggatacctccattagaatttat

SEQ ID NO: 804162 - DNA, 25 bp, Mus musculus
tcaggatacctcgattagaatttat

SEQ ID NO: 804163 - DNA, 25 bp, Mus musculus
tcaggatacttcatgtaactcaaca

SEQ ID NO: 804164 - DNA, 25 bp, Mus musculus
tcaggatacttcttgtaactcaaca

SEQ ID NO: 804165 - DNA, 25 bp, Mus musculus
tcaggataggctcagtcccagcgct

SEQ ID NO: 804166 - DNA, 25 bp, Mus musculus
tcaggataggctgagtcccagcgct

SEQ ID NO: 804167 - DNA, 25 bp, Mus musculus
tcaggatatcctcatcacttcattg

SEQ ID NO: 804168 - DNA, 25 bp, Mus musculus
tcaggatatcctgatcacttcattg

SEQ ID NO: 804169 - DNA, 25 bp, Mus musculus
tcaggatcaaggagggtgctttcat

SEQ ID NO: 804170 - DNA, 25 bp, Mus musculus
tcaggatcaaggtgggtgctttcat

SEQ ID NO: 804171 - DNA, 25 bp, Mus musculus
tcaggatcagatactcttcttcaaa

SEQ ID NO: 804172 - DNA, 25 bp, Mus musculus
tcaggatcagattctcttcttcaaa

SEQ ID NO: 804173 - DNA, 25 bp, Mus musculus
tcaggatcatccatagatatatagg

SEQ ID NO: 804174 - DNA, 25 bp, Mus musculus
tcaggatcatccttagatatatagg

SEQ ID NO: 804175 - DNA, 25 bp, Mus musculus
tcaggatcatctacacagctctagg

SEQ ID NO: 804176 - DNA, 25 bp, Mus musculus
tcaggatcatcttcacagctctagg

SEQ ID NO: 804177 - DNA, 25 bp, Mus musculus
tcaggatccaggatagcatgccaca

SEQ ID NO: 804178 - DNA, 25 bp, Mus musculus
tcaggatccaggttagcatgccaca

SEQ ID NO: 804179 - DNA, 25 bp, Mus musculus
tcaggatccctgcttgccagaggtg

SEQ ID NO: 804180 - DNA, 25 bp, Mus musculus
tcaggatccctggttgccagaggtg

SEQ ID NO: 804181 - DNA, 25 bp, Mus musculus
tcaggatccggaatatgcttggcat

SEQ ID NO: 804182 - DNA, 25 bp, Mus musculus
tcaggatccggattatgcttggcat

SEQ ID NO: 804183 - DNA, 25 bp, Mus musculus
tcaggatcgccaccagaggagtcag

SEQ ID NO: 804184 - DNA, 25 bp, Mus musculus
tcaggatcgccagcagaggagtcag

SEQ ID NO: 804185 - DNA, 25 bp, Mus musculus
tcaggatctcagaaacgggccgacc

SEQ ID NO: 804186 - DNA, 25 bp, Mus musculus
tcaggatctcagtaacgggccgacc

SEQ ID NO: 804187 - DNA, 25 bp, Mus musculus
tcaggatctgggaacttttgccaaa

SEQ ID NO: 804188 - DNA, 25 bp, Mus musculus
tcaggatctgggtacttttgccaaa

SEQ ID NO: 804189 - DNA, 25 bp, Mus musculus
tcaggatgaaatacccaaaggctca

SEQ ID NO: 804190 - DNA, 25 bp, Mus musculus
tcaggatgaaattcccaaaggctca

SEQ ID NO: 804191 - DNA, 25 bp, Mus musculus
tcaggatgcactcaaggtggcccag

SEQ ID NO: 804192 - DNA, 25 bp, Mus musculus
tcaggatgcactgaaggtggcccag

SEQ ID NO: 804193 - DNA, 25 bp, Mus musculus
tcaggatgccctctgctgaaagcag

SEQ ID NO: 804194 - DNA, 25 bp, Mus musculus
tcaggatgccctgtgctgaaagcag

SEQ ID NO: 804195 - DNA, 25 bp, Mus musculus
tcaggatgcggaccttagccgatgc

SEQ ID NO: 804196 - DNA, 25 bp, Mus musculus
tcaggatgcggagcttagccgatgc

SEQ ID NO: 804197 - DNA, 25 bp, Mus musculus
tcaggatggagaaccggctccgcat

SEQ ID NO: 804198 - DNA, 25 bp, Mus musculus
tcaggatggagatccggctccgcat

SEQ ID NO: 804199 - DNA, 25 bp, Mus musculus
tcaggatggctaccctgcagcaggg

SEQ ID NO: 804200 - DNA, 25 bp, Mus musculus
tcaggatggctagcctgcagcaggg

SEQ ID NO: 804201 - DNA, 25 bp, Mus musculus
tcaggatggctgactgcctttcgaa

SEQ ID NO: 804202 - DNA, 25 bp, Mus musculus
tcaggatggctgtctgcctttcgaa

SEQ ID NO: 804203 - DNA, 25 bp, Mus musculus
tcaggatgtataaaagaaccgagct

SEQ ID NO: 804204 - DNA, 25 bp, Mus musculus
tcaggatgtatataagaaccgagct

SEQ ID NO: 804205 - DNA, 25 bp, Mus musculus
tcaggatgtatgctttgggataaca

SEQ ID NO: 804206 - DNA, 25 bp, Mus musculus
tcaggatgtatggtttgggataaca

SEQ ID NO: 804207 - DNA, 25 bp, Mus musculus
tcaggatgtccaatgccctttgtac

SEQ ID NO: 804208 - DNA, 25 bp, Mus musculus
tcaggatgtccattgccctttgtac

SEQ ID NO: 804209 - DNA, 25 bp, Mus musculus
tcaggatgtctaccctaccagcaag

SEQ ID NO: 804210 - DNA, 25 bp, Mus musculus
tcaggatgtctagcctaccagcaag

SEQ ID NO: 804211 - DNA, 25 bp, Mus musculus
tcaggatgtgcaaagcccgggactc

SEQ ID NO: 804212 - DNA, 25 bp, Mus musculus
tcaggatgtgcatagcccgggactc

SEQ ID NO: 804213 - DNA, 25 bp, Mus musculus
tcaggatgttctcaagataccttct

SEQ ID NO: 804214 - DNA, 25 bp, Mus musculus
tcaggatgttctgaagataccttct

SEQ ID NO: 804215 - DNA, 25 bp, Mus musculus
tcaggattcatcaccctggatgagt

SEQ ID NO: 804216 - DNA, 25 bp, Mus musculus
tcaggattcatctccctggatgagt

SEQ ID NO: 804217 - DNA, 25 bp, Mus musculus
tcaggattccagaaggtgacctttt

SEQ ID NO: 804218 - DNA, 25 bp, Mus musculus
tcaggattccagtaggtgacctttt

SEQ ID NO: 804219 - DNA, 25 bp, Mus musculus
tcaggattcccgacgatactggtgt

SEQ ID NO: 804220 - DNA, 25 bp, Mus musculus
tcaggattcccgtcgatactggtgt

SEQ ID NO: 804221 - DNA, 25 bp, Mus musculus
tcaggattccctccagggctttaag

SEQ ID NO: 804222 - DNA, 25 bp, Mus musculus
tcaggattccctgcagggctttaag

SEQ ID NO: 804223 - DNA, 25 bp, Mus musculus
tcaggattccgtattagtgaaagtt

SEQ ID NO: 804224 - DNA, 25 bp, Mus musculus
tcaggattccgttttagtgaaagtt

SEQ ID NO: 804225 - DNA, 25 bp, Mus musculus
tcaggattcgagagagcccagccaa

SEQ ID NO: 804226 - DNA, 25 bp, Mus musculus
tcaggattcgagtgagcccagccaa

SEQ ID NO: 804227 - DNA, 25 bp, Mus musculus
tcaggattggacacatacacagcat

SEQ ID NO: 804228 - DNA, 25 bp, Mus musculus
tcaggattggactcatacacagcat

SEQ ID NO: 804229 - DNA, 25 bp, Mus musculus
tcaggattgtgaactcctctgtgct

SEQ ID NO: 804230 - DNA, 25 bp, Mus musculus
tcaggattgtgatctcctctgtgct

SEQ ID NO: 804231 - DNA, 25 bp, Mus musculus
tcaggatttaatactttcttaaact

SEQ ID NO: 804232 - DNA, 25 bp, Mus musculus
tcaggatttaattctttcttaaact

SEQ ID NO: 804233 - DNA, 25 bp, Mus musculus
tcaggatttcctcctgaggatacag

SEQ ID NO: 804234 - DNA, 25 bp, Mus musculus
tcaggatttcctgctgaggatacag

SEQ ID NO: 804235 - DNA, 25 bp, Mus musculus
tcaggattttatctagagactagca

SEQ ID NO: 804236 - DNA, 25 bp, Mus musculus
tcaggattttatgtagagactagca

SEQ ID NO: 804237 - DNA, 25 bp, Mus musculus
tcaggcaaccatcggcatagagtat

SEQ ID NO: 804238 - DNA, 25 bp, Mus musculus
tcaggcaaccatgggcatagagtat

SEQ ID NO: 804239 - DNA, 25 bp, Mus musculus
tcaggcaacgttctcttgtggttcc

SEQ ID NO: 804240 - DNA, 25 bp, Mus musculus
tcaggcaacgttgtcttgtggttcc

SEQ ID NO: 804241 - DNA, 25 bp, Mus musculus
tcaggcaagagtcatgatgtcacca

SEQ ID NO: 804242 - DNA, 25 bp, Mus musculus
tcaggcaagagtgatgatgtcacca

SEQ ID NO: 804243 - DNA, 25 bp, Mus musculus
tcaggcaagccgatccatgagagaa

SEQ ID NO: 804244 - DNA, 25 bp, Mus musculus
tcaggcaagccgttccatgagagaa

SEQ ID NO: 804245 - DNA, 25 bp, Mus musculus
tcaggcaagcctcattgcagtggtt

SEQ ID NO: 804246 - DNA, 25 bp, Mus musculus
tcaggcaagcctgattgcagtggtt

SEQ ID NO: 804247 - DNA, 25 bp, Mus musculus
tcaggcaatagaccctcatgtctct

SEQ ID NO: 804248 - DNA, 25 bp, Mus musculus
tcaggcaatagagcctcatgtctct

SEQ ID NO: 804249 - DNA, 25 bp, Mus musculus
tcaggcaatcccaaaaactggtatt

SEQ ID NO: 804250 - DNA, 25 bp, Mus musculus
tcaggcaatccctaaaactggtatt

SEQ ID NO: 804251 - DNA, 25 bp, Mus musculus
tcaggcaatgccataaacctcaatt

SEQ ID NO: 804252 - DNA, 25 bp, Mus musculus
tcaggcaatgccttaaacctcaatt

SEQ ID NO: 804253 - DNA, 25 bp, Mus musculus
tcaggcacactgaccgggactactt

SEQ ID NO: 804254 - DNA, 25 bp, Mus musculus
tcaggcacactgtccgggactactt

SEQ ID NO: 804255 - DNA, 25 bp, Mus musculus
tcaggcacagctaccatgtcagtga

SEQ ID NO: 804256 - DNA, 25 bp, Mus musculus
tcaggcacagcttccatgtcagtga

SEQ ID NO: 804257 - DNA, 25 bp, Mus musculus
tcaggcacatcgagcgttgtcgctt

SEQ ID NO: 804258 - DNA, 25 bp, Mus musculus
tcaggcacatcgtgcgttgtcgctt

SEQ ID NO: 804259 - DNA, 25 bp, Mus musculus
tcaggcaccaacactggtacttgga

SEQ ID NO: 804260 - DNA, 25 bp, Mus musculus
tcaggcaccaactctggtacttgga

SEQ ID NO: 804261 - DNA, 25 bp, Mus musculus
tcaggcaccctgataagtctccaag

SEQ ID NO: 804262 - DNA, 25 bp, Mus musculus
tcaggcaccctgttaagtctccaag

SEQ ID NO: 804263 - DNA, 25 bp, Mus musculus
tcaggcacgctgctgcttaactcta

SEQ ID NO: 804264 - DNA, 25 bp, Mus musculus
tcaggcacgctggtgcttaactcta

SEQ ID NO: 804265 - DNA, 25 bp, Mus musculus
tcaggcactagaacattctgggagt

SEQ ID NO: 804266 - DNA, 25 bp, Mus musculus
tcaggcactagatcattctgggagt

SEQ ID NO: 804267 - DNA, 25 bp, Mus musculus
tcaggcactaggaaccaaccttttc

SEQ ID NO: 804268 - DNA, 25 bp, Mus musculus
tcaggcactaggtaccaaccttttc

SEQ ID NO: 804269 - DNA, 25 bp, Mus musculus
tcaggcactcaacacatcaagtaag

SEQ ID NO: 804270 - DNA, 25 bp, Mus musculus
tcaggcactcaagacatcaagtaag

SEQ ID NO: 804271 - DNA, 25 bp, Mus musculus
tcaggcactctccagtcagagcaaa

SEQ ID NO: 804272 - DNA, 25 bp, Mus musculus
tcaggcactctcgagtcagagcaaa

SEQ ID NO: 804273 - DNA, 25 bp, Mus musculus
tcaggcactggaatacgttgtgttt

SEQ ID NO: 804274 - DNA, 25 bp, Mus musculus
tcaggcactggattacgttgtgttt

SEQ ID NO: 804275 - DNA, 25 bp, Mus musculus
tcaggcactggcagttccaggatct

SEQ ID NO: 804276 - DNA, 25 bp, Mus musculus
tcaggcactggctgttccaggatct

SEQ ID NO: 804277 - DNA, 25 bp, Mus musculus
tcaggcactgtcaagcagcacttta

SEQ ID NO: 804278 - DNA, 25 bp, Mus musculus
tcaggcactgtctagcagcacttta

SEQ ID NO: 804279 - DNA, 25 bp, Mus musculus
tcaggcacttctacccttttgattt

SEQ ID NO: 804280 - DNA, 25 bp, Mus musculus
tcaggcacttcttcccttttgattt

SEQ ID NO: 804281 - DNA, 25 bp, Mus musculus
tcaggcacttttccttgaccaaatg

SEQ ID NO: 804282 - DNA, 25 bp, Mus musculus
tcaggcacttttgcttgaccaaatg

SEQ ID NO: 804283 - DNA, 25 bp, Mus musculus
tcaggcagacaaccgctgtgcgcgt

SEQ ID NO: 804284 - DNA, 25 bp, Mus musculus
tcaggcagacaagcgctgtgcgcgt

SEQ ID NO: 804285 - DNA, 25 bp, Mus musculus
tcaggcagacatcaatccatcagag

SEQ ID NO: 804286 - DNA, 25 bp, Mus musculus
tcaggcagacatgaatccatcagag

SEQ ID NO: 804287 - DNA, 25 bp, Mus musculus
tcaggcagactcctctgacctggat

SEQ ID NO: 804288 - DNA, 25 bp, Mus musculus
tcaggcagactcgtctgacctggat

SEQ ID NO: 804289 - DNA, 25 bp, Mus musculus
tcaggcagagtgagcgtcagccacc

SEQ ID NO: 804290 - DNA, 25 bp, Mus musculus
tcaggcagagtgtgcgtcagccacc

SEQ ID NO: 804291 - DNA, 25 bp, Mus musculus
tcaggcagccatcttattaagcttt

SEQ ID NO: 804292 - DNA, 25 bp, Mus musculus
tcaggcagccatgttattaagcttt

SEQ ID NO: 804293 - DNA, 25 bp, Mus musculus
tcaggcagcctgactgtggttgtac

SEQ ID NO: 804294 - DNA, 25 bp, Mus musculus
tcaggcagcctgtctgtggttgtac

SEQ ID NO: 804295 - DNA, 25 bp, Mus musculus
tcaggcagctgaatcgggacaatat

SEQ ID NO: 804296 - DNA, 25 bp, Mus musculus
tcaggcagctgacgctaggacacct

SEQ ID NO: 804297 - DNA, 25 bp, Mus musculus
tcaggcagctgaggctaggacacct

SEQ ID NO: 804298 - DNA, 25 bp, Mus musculus
tcaggcagctgattcgggacaatat

SEQ ID NO: 804299 - DNA, 25 bp, Mus musculus
tcaggcagggtccattcttatgaag

SEQ ID NO: 804300 - DNA, 25 bp, Mus musculus
tcaggcagggtcgattcttatgaag

SEQ ID NO: 804301 - DNA, 25 bp, Mus musculus
tcaggcagtgcaccagacgtaacat

SEQ ID NO: 804302 - DNA, 25 bp, Mus musculus
tcaggcagtgcagcagacgtaacat

SEQ ID NO: 804303 - DNA, 25 bp, Mus musculus
tcaggcagtgttacagtctagcagt

SEQ ID NO: 804304 - DNA, 25 bp, Mus musculus
tcaggcagtgtttcagtctagcagt

SEQ ID NO: 804305 - DNA, 25 bp, Mus musculus
tcaggcataaccaccagcaaagcaa

SEQ ID NO: 804306 - DNA, 25 bp, Mus musculus
tcaggcataacctccagcaaagcaa

SEQ ID NO: 804307 - DNA, 25 bp, Mus musculus
tcaggcatagaaacagtgcaggttt

SEQ ID NO: 804308 - DNA, 25 bp, Mus musculus
tcaggcatagaatcagtgcaggttt

SEQ ID NO: 804309 - DNA, 25 bp, Mus musculus
tcaggcatcaatcgaaggagaggac

SEQ ID NO: 804310 - DNA, 25 bp, Mus musculus
tcaggcatcaatggaaggagaggac

SEQ ID NO: 804311 - DNA, 25 bp, Mus musculus
tcaggcatccgtctctttggtggag

SEQ ID NO: 804312 - DNA, 25 bp, Mus musculus
tcaggcatccgtgtctttggtggag

SEQ ID NO: 804313 - DNA, 25 bp, Mus musculus
tcaggcatctccagtggcaatgcac

SEQ ID NO: 804314 - DNA, 25 bp, Mus musculus
tcaggcatctcctgtggcaatgcac

SEQ ID NO: 804315 - DNA, 25 bp, Mus musculus
tcaggcatcttcatccatgttggga

SEQ ID NO: 804316 - DNA, 25 bp, Mus musculus
tcaggcatcttcttccatgttggga

SEQ ID NO: 804317 - DNA, 25 bp, Mus musculus
tcaggcatgacactgttcaaacata

SEQ ID NO: 804318 - DNA, 25 bp, Mus musculus
tcaggcatgacagtgttcaaacata

SEQ ID NO: 804319 - DNA, 25 bp, Mus musculus
tcaggcatgcctattcttttagaaa

SEQ ID NO: 804320 - DNA, 25 bp, Mus musculus
tcaggcatgccttttcttttagaaa

SEQ ID NO: 804321 - DNA, 25 bp, Mus musculus
tcaggcatgctgaatatggaaggca

SEQ ID NO: 804322 - DNA, 25 bp, Mus musculus
tcaggcatgctgtatatggaaggca

SEQ ID NO: 804323 - DNA, 25 bp, Mus musculus
tcaggcattcatcaggtacacagac

SEQ ID NO: 804324 - DNA, 25 bp, Mus musculus
tcaggcattcatgaggtacacagac

SEQ ID NO: 804325 - DNA, 25 bp, Mus musculus
tcaggcatttctaaccagcttggtg

SEQ ID NO: 804326 - DNA, 25 bp, Mus musculus
tcaggcatttcttaccagcttggtg

SEQ ID NO: 804327 - DNA, 25 bp, Mus musculus
tcaggcattttgacaccttgtcaag

SEQ ID NO: 804328 - DNA, 25 bp, Mus musculus
tcaggcattttgtcaccttgtcaag

SEQ ID NO: 804329 - DNA, 25 bp, Mus musculus
tcaggccaacgactctcatgtagaa

SEQ ID NO: 804330 - DNA, 25 bp, Mus musculus
tcaggccaacgagtctcatgtagaa

SEQ ID NO: 804331 - DNA, 25 bp, Mus musculus
tcaggccaagccatccaattttaaa

SEQ ID NO: 804332 - DNA, 25 bp, Mus musculus
tcaggccaagccttccaattttaaa

SEQ ID NO: 804333 - DNA, 25 bp, Mus musculus
tcaggccaatccaccacagtatata

SEQ ID NO: 804334 - DNA, 25 bp, Mus musculus
tcaggccaatcctccacagtatata

SEQ ID NO: 804335 - DNA, 25 bp, Mus musculus
tcaggccacagcaatcatcctttct

SEQ ID NO: 804336 - DNA, 25 bp, Mus musculus
tcaggccacagcagcatgttgcatt

SEQ ID NO: 804337 - DNA, 25 bp, Mus musculus
tcaggccacagctatcatcctttct

SEQ ID NO: 804338 - DNA, 25 bp, Mus musculus
tcaggccacagctgcatgttgcatt

SEQ ID NO: 804339 - DNA, 25 bp, Mus musculus
tcaggccaccagagttgccctcttc

SEQ ID NO: 804340 - DNA, 25 bp, Mus musculus
tcaggccaccagtgttgccctcttc

SEQ ID NO: 804341 - DNA, 25 bp, Mus musculus
tcaggccaccgacttagttccagct

SEQ ID NO: 804342 - DNA, 25 bp, Mus musculus
tcaggccaccgagttagttccagct

SEQ ID NO: 804343 - DNA, 25 bp, Mus musculus
tcaggccaccttctttgaggtacaa

SEQ ID NO: 804344 - DNA, 25 bp, Mus musculus
tcaggccaccttgtttgaggtacaa

SEQ ID NO: 804345 - DNA, 25 bp, Mus musculus
tcaggccacgcccacggcgatggaa

SEQ ID NO: 804346 - DNA, 25 bp, Mus musculus
tcaggccacgccgacggcgatggaa

SEQ ID NO: 804347 - DNA, 25 bp, Mus musculus
tcaggccactgcaacccgtaaagtc

SEQ ID NO: 804348 - DNA, 25 bp, Mus musculus
tcaggccactgctacccgtaaagtc

SEQ ID NO: 804349 - DNA, 25 bp, Mus musculus
tcaggccacttcagtacactcagac

SEQ ID NO: 804350 - DNA, 25 bp, Mus musculus
tcaggccacttctgtacactcagac

SEQ ID NO: 804351 - DNA, 25 bp, Mus musculus
tcaggccacttgactacccaataaa

SEQ ID NO: 804352 - DNA, 25 bp, Mus musculus
tcaggccacttgtctacccaataaa

SEQ ID NO: 804353 - DNA, 25 bp, Mus musculus
tcaggccagagcatgaggatcggat

SEQ ID NO: 804354 - DNA, 25 bp, Mus musculus
tcaggccagagcttgaggatcggat

SEQ ID NO: 804355 - DNA, 25 bp, Mus musculus
tcaggccagcttcaagctcttgatc

SEQ ID NO: 804356 - DNA, 25 bp, Mus musculus
tcaggccagcttgaagctcttgatc

SEQ ID NO: 804357 - DNA, 25 bp, Mus musculus
tcaggccaggagcacgaatcattgt

SEQ ID NO: 804358 - DNA, 25 bp, Mus musculus
tcaggccaggaggacgaatcattgt

SEQ ID NO: 804359 - DNA, 25 bp, Mus musculus
tcaggccaggcccagagtatttcta

SEQ ID NO: 804360 - DNA, 25 bp, Mus musculus
tcaggccaggccgagagtatttcta

SEQ ID NO: 804361 - DNA, 25 bp, Mus musculus
tcaggccaggtgcttttctgtcaat

SEQ ID NO: 804362 - DNA, 25 bp, Mus musculus
tcaggccaggtggttttctgtcaat

SEQ ID NO: 804363 - DNA, 25 bp, Mus musculus
tcaggccaggttctcaatcaaggtt

SEQ ID NO: 804364 - DNA, 25 bp, Mus musculus
tcaggccaggttgtcaatcaaggtt

SEQ ID NO: 804365 - DNA, 25 bp, Mus musculus
tcaggccatgcaaatgcggcaggca

SEQ ID NO: 804366 - DNA, 25 bp, Mus musculus
tcaggccatgcatatgcggcaggca

SEQ ID NO: 804367 - DNA, 25 bp, Mus musculus
tcaggcccaaccaaacgctaatgaa

SEQ ID NO: 804368 - DNA, 25 bp, Mus musculus
tcaggcccaacctaacgctaatgaa

SEQ ID NO: 804369 - DNA, 25 bp, Mus musculus
tcaggcccaaggctttcgagaacct

SEQ ID NO: 804370 - DNA, 25 bp, Mus musculus
tcaggcccaagggtttcgagaacct

SEQ ID NO: 804371 - DNA, 25 bp, Mus musculus
tcaggcccaggacatcttgatgcgg

SEQ ID NO: 804372 - DNA, 25 bp, Mus musculus
tcaggcccaggagatcttgatgcgg

SEQ ID NO: 804373 - DNA, 25 bp, Mus musculus
tcaggcccctgtattattcatagtc

SEQ ID NO: 804374 - DNA, 25 bp, Mus musculus
tcaggcccctgtcatggtggtaaca

SEQ ID NO: 804375 - DNA, 25 bp, Mus musculus
tcaggcccctgtgatggtggtaaca

SEQ ID NO: 804376 - DNA, 25 bp, Mus musculus
tcaggcccctgttttattcatagtc

SEQ ID NO: 804377 - DNA, 25 bp, Mus musculus
tcaggcccgggccttttcgttcaca

SEQ ID NO: 804378 - DNA, 25 bp, Mus musculus
tcaggcccgggcgttttcgttcaca

SEQ ID NO: 804379 - DNA, 25 bp, Mus musculus
tcaggcccgtgtcgatgcttctgac

SEQ ID NO: 804380 - DNA, 25 bp, Mus musculus
tcaggcccgtgtggatgcttctgac

SEQ ID NO: 804381 - DNA, 25 bp, Mus musculus
tcaggccctggaattcatctttgct

SEQ ID NO: 804382 - DNA, 25 bp, Mus musculus
tcaggccctggatttcatctttgct

SEQ ID NO: 804383 - DNA, 25 bp, Mus musculus
tcaggccctgttctgtaataggact

SEQ ID NO: 804384 - DNA, 25 bp, Mus musculus
tcaggccctgttgtgtaataggact

SEQ ID NO: 804385 - DNA, 25 bp, Mus musculus
tcaggcccttggatcaaattccata

SEQ ID NO: 804386 - DNA, 25 bp, Mus musculus
tcaggcccttggttcaaattccata

SEQ ID NO: 804387 - DNA, 25 bp, Mus musculus
tcaggccctttcactacataggtaa

SEQ ID NO: 804388 - DNA, 25 bp, Mus musculus
tcaggccctttctctacataggtaa

SEQ ID NO: 804389 - DNA, 25 bp, Mus musculus
tcaggccgcctgaatgtagcgggca

SEQ ID NO: 804390 - DNA, 25 bp, Mus musculus
tcaggccgcctgtatgtagcgggca

SEQ ID NO: 804391 - DNA, 25 bp, Mus musculus
tcaggcctaactcgaaacttctcaa

SEQ ID NO: 804392 - DNA, 25 bp, Mus musculus
tcaggcctaactggaaacttctcaa

SEQ ID NO: 804393 - DNA, 25 bp, Mus musculus
tcaggcctacaacgagagcaattat

SEQ ID NO: 804394 - DNA, 25 bp, Mus musculus
tcaggcctacaaggagagcaattat

SEQ ID NO: 804395 - DNA, 25 bp, Mus musculus
tcaggcctacagctacatccaagaa

SEQ ID NO: 804396 - DNA, 25 bp, Mus musculus
tcaggcctacaggtacatccaagaa

SEQ ID NO: 804397 - DNA, 25 bp, Mus musculus
tcaggcctacatcttactcacaaaa

SEQ ID NO: 804398 - DNA, 25 bp, Mus musculus
tcaggcctacatgttactcacaaaa

SEQ ID NO: 804399 - DNA, 25 bp, Mus musculus
tcaggcctagctacctaggatacag

SEQ ID NO: 804400 - DNA, 25 bp, Mus musculus
tcaggcctagcttcctaggatacag

SEQ ID NO: 804401 - DNA, 25 bp, Mus musculus
tcaggcctagttaaggtggcctctt

SEQ ID NO: 804402 - DNA, 25 bp, Mus musculus
tcaggcctagttatcaacataaata

SEQ ID NO: 804403 - DNA, 25 bp, Mus musculus
tcaggcctagtttaggtggcctctt

SEQ ID NO: 804404 - DNA, 25 bp, Mus musculus
tcaggcctagttttcaacataaata

SEQ ID NO: 804405 - DNA, 25 bp, Mus musculus
tcaggcctcaggcttcactttattt

SEQ ID NO: 804406 - DNA, 25 bp, Mus musculus
tcaggcctcagggttcactttattt

SEQ ID NO: 804407 - DNA, 25 bp, Mus musculus
tcaggcctccagcaagtctgaagca

SEQ ID NO: 804408 - DNA, 25 bp, Mus musculus
tcaggcctccaggaagtctgaagca

SEQ ID NO: 804409 - DNA, 25 bp, Mus musculus
tcaggcctcccaagtctgtagtgag

SEQ ID NO: 804410 - DNA, 25 bp, Mus musculus
tcaggcctcccatgtctgtagtgag

SEQ ID NO: 804411 - DNA, 25 bp, Mus musculus
tcaggcctcctgctaatacactact

SEQ ID NO: 804412 - DNA, 25 bp, Mus musculus
tcaggcctcctggtaatacactact

SEQ ID NO: 804413 - DNA, 25 bp, Mus musculus
tcaggcctctgacttgagactactg

SEQ ID NO: 804414 - DNA, 25 bp, Mus musculus
tcaggcctctgagttgagactactg

SEQ ID NO: 804415 - DNA, 25 bp, Mus musculus
tcaggcctctttaggatacctttag

SEQ ID NO: 804416 - DNA, 25 bp, Mus musculus
tcaggcctcttttggatacctttag

SEQ ID NO: 804417 - DNA, 25 bp, Mus musculus
tcaggcctgactcgacaccagagaa

SEQ ID NO: 804418 - DNA, 25 bp, Mus musculus
tcaggcctgactggacaccagagaa

SEQ ID NO: 804419 - DNA, 25 bp, Mus musculus
tcaggcctgagtcggacatccacat

SEQ ID NO: 804420 - DNA, 25 bp, Mus musculus
tcaggcctgagtgggacatccacat

SEQ ID NO: 804421 - DNA, 25 bp, Mus musculus
tcaggcctggaaattttgttgcaat

SEQ ID NO: 804422 - DNA, 25 bp, Mus musculus
tcaggcctggaatttttgttgcaat

SEQ ID NO: 804423 - DNA, 25 bp, Mus musculus
tcaggcctggccaccggctcataga

SEQ ID NO: 804424 - DNA, 25 bp, Mus musculus
tcaggcctggcctccggctcataga

SEQ ID NO: 804425 - DNA, 25 bp, Mus musculus
tcaggcctgtaaatatagctatttg

SEQ ID NO: 804426 - DNA, 25 bp, Mus musculus
tcaggcctgtaattatagctatttg

SEQ ID NO: 804427 - DNA, 25 bp, Mus musculus
tcaggccttagtatctctatttaga

SEQ ID NO: 804428 - DNA, 25 bp, Mus musculus
tcaggccttagtttctctatttaga

SEQ ID NO: 804429 - DNA, 25 bp, Mus musculus
tcaggccttcagatgtgacgttgta

SEQ ID NO: 804430 - DNA, 25 bp, Mus musculus
tcaggccttcagttgtgacgttgta

SEQ ID NO: 804431 - DNA, 25 bp, Mus musculus
tcaggccttcctcggattgtaaagt

SEQ ID NO: 804432 - DNA, 25 bp, Mus musculus
tcaggccttcctgggattgtaaagt

SEQ ID NO: 804433 - DNA, 25 bp, Mus musculus
tcaggccttgagactcatgtcttag

SEQ ID NO: 804434 - DNA, 25 bp, Mus musculus
tcaggccttgagtctcatgtcttag

SEQ ID NO: 804435 - DNA, 25 bp, Mus musculus
tcaggccttgccagcacaggtcaca

SEQ ID NO: 804436 - DNA, 25 bp, Mus musculus
tcaggccttgcctgcacaggtcaca

SEQ ID NO: 804437 - DNA, 25 bp, Mus musculus
tcaggcctttagcagctgtgcacag

SEQ ID NO: 804438 - DNA, 25 bp, Mus musculus
tcaggcctttaggagctgtgcacag

SEQ ID NO: 804439 - DNA, 25 bp, Mus musculus
tcaggcgaagtgactagcagcagca

SEQ ID NO: 804440 - DNA, 25 bp, Mus musculus
tcaggcgaagtgtctagcagcagca

SEQ ID NO: 804441 - DNA, 25 bp, Mus musculus
tcaggcgagacaagttctgacagct

SEQ ID NO: 804442 - DNA, 25 bp, Mus musculus
tcaggcgagacatgttctgacagct

SEQ ID NO: 804443 - DNA, 25 bp, Mus musculus
tcaggcgaggccctgtgtctcaatg

SEQ ID NO: 804444 - DNA, 25 bp, Mus musculus
tcaggcgaggccgtgtgtctcaatg

SEQ ID NO: 804445 - DNA, 25 bp, Mus musculus
tcaggcgagtttaccagtccagtaa

SEQ ID NO: 804446 - DNA, 25 bp, Mus musculus
tcaggcgagttttccagtccagtaa

SEQ ID NO: 804447 - DNA, 25 bp, Mus musculus
tcaggcgatgtgctttatggcaggc

SEQ ID NO: 804448 - DNA, 25 bp, Mus musculus
tcaggcgatgtggtttatggcaggc

SEQ ID NO: 804449 - DNA, 25 bp, Mus musculus
tcaggcgcaccaagcaggccctgga

SEQ ID NO: 804450 - DNA, 25 bp, Mus musculus
tcaggcgcaccatgcaggccctgga

SEQ ID NO: 804451 - DNA, 25 bp, Mus musculus
tcaggcgcctggcacatttcaggga

SEQ ID NO: 804452 - DNA, 25 bp, Mus musculus
tcaggcgcctgggacatttcaggga

SEQ ID NO: 804453 - DNA, 25 bp, Mus musculus
tcaggcgccttcaggaggaagacca

SEQ ID NO: 804454 - DNA, 25 bp, Mus musculus
tcaggcgccttcagggaactgctgt

SEQ ID NO: 804455 - DNA, 25 bp, Mus musculus
tcaggcgccttctggaggaagacca

SEQ ID NO: 804456 - DNA, 25 bp, Mus musculus
tcaggcgccttctgggaactgctgt

SEQ ID NO: 804457 - DNA, 25 bp, Mus musculus
tcaggcgctctgcacagtattatat

SEQ ID NO: 804458 - DNA, 25 bp, Mus musculus
tcaggcgctctggacagtattatat

SEQ ID NO: 804459 - DNA, 25 bp, Mus musculus
tcaggcggagaactactctcaaaaa

SEQ ID NO: 804460 - DNA, 25 bp, Mus musculus
tcaggcggagaagtactctcaaaaa

SEQ ID NO: 804461 - DNA, 25 bp, Mus musculus
tcaggcggcatcacggacagcgacc

SEQ ID NO: 804462 - DNA, 25 bp, Mus musculus
tcaggcggcatctcggacagcgacc

SEQ ID NO: 804463 - DNA, 25 bp, Mus musculus
tcaggcggccacataagatgtctaa

SEQ ID NO: 804464 - DNA, 25 bp, Mus musculus
tcaggcggccacttaagatgtctaa

SEQ ID NO: 804465 - DNA, 25 bp, Mus musculus
tcaggcggcgcaacctcgcaggaga

SEQ ID NO: 804466 - DNA, 25 bp, Mus musculus
tcaggcggcgcatcctcgcaggaga

SEQ ID NO: 804467 - DNA, 25 bp, Mus musculus
tcaggcggcgcgattttctttttag

SEQ ID NO: 804468 - DNA, 25 bp, Mus musculus
tcaggcggcgcgtttttctttttag

SEQ ID NO: 804469 - DNA, 25 bp, Mus musculus
tcaggcgggcatcccgaaggagttg

SEQ ID NO: 804470 - DNA, 25 bp, Mus musculus
tcaggcgggcatgccgaaggagttg

SEQ ID NO: 804471 - DNA, 25 bp, Mus musculus
tcaggcggtgacagagccctcagca

SEQ ID NO: 804472 - DNA, 25 bp, Mus musculus
tcaggcggtgactgagccctcagca

SEQ ID NO: 804473 - DNA, 25 bp, Mus musculus
tcaggcgtgagcatcagagcgctgt

SEQ ID NO: 804474 - DNA, 25 bp, Mus musculus
tcaggcgtgagcttcagagcgctgt

SEQ ID NO: 804475 - DNA, 25 bp, Mus musculus
tcaggctaataaccttaaatgtcag

SEQ ID NO: 804476 - DNA, 25 bp, Mus musculus
tcaggctaataagcttaaatgtcag

SEQ ID NO: 804477 - DNA, 25 bp, Mus musculus
tcaggctacctacagcgggagagca

SEQ ID NO: 804478 - DNA, 25 bp, Mus musculus
tcaggctacctagagcgggagagca

SEQ ID NO: 804479 - DNA, 25 bp, Mus musculus
tcaggctagcacaatatactcaggc

SEQ ID NO: 804480 - DNA, 25 bp, Mus musculus
tcaggctagcactatatactcaggc

SEQ ID NO: 804481 - DNA, 25 bp, Mus musculus
tcaggctagcatcacatgacttgag

SEQ ID NO: 804482 - DNA, 25 bp, Mus musculus
tcaggctagcatgacatgacttgag

SEQ ID NO: 804483 - DNA, 25 bp, Mus musculus
tcaggctataatacgtcttcaggtt

SEQ ID NO: 804484 - DNA, 25 bp, Mus musculus
tcaggctataattcgtcttcaggtt

SEQ ID NO: 804485 - DNA, 25 bp, Mus musculus
tcaggctatcccaatgatcccaaga

SEQ ID NO: 804486 - DNA, 25 bp, Mus musculus
tcaggctatccctatgatcccaaga

SEQ ID NO: 804487 - DNA, 25 bp, Mus musculus
tcaggctatgaaagtcgtaatctcc

SEQ ID NO: 804488 - DNA, 25 bp, Mus musculus
tcaggctatgaatgtcgtaatctcc

SEQ ID NO: 804489 - DNA, 25 bp, Mus musculus
tcaggctcaattcgttggttgttcc

SEQ ID NO: 804490 - DNA, 25 bp, Mus musculus
tcaggctcaattggttggttgttcc

SEQ ID NO: 804491 - DNA, 25 bp, Mus musculus
tcaggctcactcacaacacatttgc

SEQ ID NO: 804492 - DNA, 25 bp, Mus musculus
tcaggctcactctcaacacatttgc

SEQ ID NO: 804493 - DNA, 25 bp, Mus musculus
tcaggctcacttagcaagagtccac

SEQ ID NO: 804494 - DNA, 25 bp, Mus musculus
tcaggctcactttgcaagagtccac

SEQ ID NO: 804495 - DNA, 25 bp, Mus musculus
tcaggctcagacaacaggcacgggt

SEQ ID NO: 804496 - DNA, 25 bp, Mus musculus
tcaggctcagacagggttaggtttt

SEQ ID NO: 804497 - DNA, 25 bp, Mus musculus
tcaggctcagactacaggcacgggt

SEQ ID NO: 804498 - DNA, 25 bp, Mus musculus
tcaggctcagactgggttaggtttt

SEQ ID NO: 804499 - DNA, 25 bp, Mus musculus
tcaggctcagagatgtctggacttt

SEQ ID NO: 804500 - DNA, 25 bp, Mus musculus
tcaggctcagagttgtctggacttt

SEQ ID NO: 804501 - DNA, 25 bp, Mus musculus
tcaggctcaggcacagccaaagtca

SEQ ID NO: 804502 - DNA, 25 bp, Mus musculus
tcaggctcaggctcagccaaagtca

SEQ ID NO: 804503 - DNA, 25 bp, Mus musculus
tcaggctcaggtcttaaagcacata

SEQ ID NO: 804504 - DNA, 25 bp, Mus musculus
tcaggctcaggtcttcaggacagta

SEQ ID NO: 804505 - DNA, 25 bp, Mus musculus
tcaggctcaggtgttaaagcacata

SEQ ID NO: 804506 - DNA, 25 bp, Mus musculus
tcaggctcaggtgttcaggacagta

SEQ ID NO: 804507 - DNA, 25 bp, Mus musculus
tcaggctcagtaccgcatgaagact

SEQ ID NO: 804508 - DNA, 25 bp, Mus musculus
tcaggctcagtagcgcatgaagact

SEQ ID NO: 804509 - DNA, 25 bp, Mus musculus
tcaggctccacgcaccaaataaaag

SEQ ID NO: 804510 - DNA, 25 bp, Mus musculus
tcaggctccacggaccaaataaaag

SEQ ID NO: 804511 - DNA, 25 bp, Mus musculus
tcaggctccatgcatttgaacatct

SEQ ID NO: 804512 - DNA, 25 bp, Mus musculus
tcaggctccatggatttgaacatct

SEQ ID NO: 804513 - DNA, 25 bp, Mus musculus
tcaggctccggaactatgtcccaga

SEQ ID NO: 804514 - DNA, 25 bp, Mus musculus
tcaggctccggatctatgtcccaga

SEQ ID NO: 804515 - DNA, 25 bp, Mus musculus
tcaggctcctatcggcacaggtgta

SEQ ID NO: 804516 - DNA, 25 bp, Mus musculus
tcaggctcctatgggcacaggtgta

SEQ ID NO: 804517 - DNA, 25 bp, Mus musculus
tcaggctcctgcctgcatgtctaat

SEQ ID NO: 804518 - DNA, 25 bp, Mus musculus
tcaggctcctgcgtgcatgtctaat

SEQ ID NO: 804519 - DNA, 25 bp, Mus musculus
tcaggctccttaatactgtaaacta

SEQ ID NO: 804520 - DNA, 25 bp, Mus musculus
tcaggctccttattactgtaaacta

SEQ ID NO: 804521 - DNA, 25 bp, Mus musculus
tcaggctcgacgagccacccgaagg

SEQ ID NO: 804522 - DNA, 25 bp, Mus musculus
tcaggctcgacgtgccacccgaagg

SEQ ID NO: 804523 - DNA, 25 bp, Mus musculus
tcaggctcggttcagccacatggtg

SEQ ID NO: 804524 - DNA, 25 bp, Mus musculus
tcaggctcggttgagccacatggtg

SEQ ID NO: 804525 - DNA, 25 bp, Mus musculus
tcaggctctccaaaccagatcctga

SEQ ID NO: 804526 - DNA, 25 bp, Mus musculus
tcaggctctccataccagatcctga

SEQ ID NO: 804527 - DNA, 25 bp, Mus musculus
tcaggctctcttactggtgtgatgt

SEQ ID NO: 804528 - DNA, 25 bp, Mus musculus
tcaggctctctttctggtgtgatgt

SEQ ID NO: 804529 - DNA, 25 bp, Mus musculus
tcaggctctgctaggaaaacttggt

SEQ ID NO: 804530 - DNA, 25 bp, Mus musculus
tcaggctctgcttggaaaacttggt

SEQ ID NO: 804531 - DNA, 25 bp, Mus musculus
tcaggctcttcactatccatcagaa

SEQ ID NO: 804532 - DNA, 25 bp, Mus musculus
tcaggctcttcagtatccatcagaa

SEQ ID NO: 804533 - DNA, 25 bp, Mus musculus
tcaggctctttgacctgaggcccag

SEQ ID NO: 804534 - DNA, 25 bp, Mus musculus
tcaggctctttgtcctgaggcccag

SEQ ID NO: 804535 - DNA, 25 bp, Mus musculus
tcaggctgctacaggccacagcagt

SEQ ID NO: 804536 - DNA, 25 bp, Mus musculus
tcaggctgctactggccacagcagt

SEQ ID NO: 804537 - DNA, 25 bp, Mus musculus
tcaggctgctcacctactgatttga

SEQ ID NO: 804538 - DNA, 25 bp, Mus musculus
tcaggctgctcagctactgatttga

SEQ ID NO: 804539 - DNA, 25 bp, Mus musculus
tcaggctgctgtcaaatcgggtact

SEQ ID NO: 804540 - DNA, 25 bp, Mus musculus
tcaggctgctgtgaaatcgggtact

SEQ ID NO: 804541 - DNA, 25 bp, Mus musculus
tcaggctggagcaaagtcacttttt

SEQ ID NO: 804542 - DNA, 25 bp, Mus musculus
tcaggctggagctaagtcacttttt

SEQ ID NO: 804543 - DNA, 25 bp, Mus musculus
tcaggctggatcaatgccacactca

SEQ ID NO: 804544 - DNA, 25 bp, Mus musculus
tcaggctggatctatgccacactca

SEQ ID NO: 804545 - DNA, 25 bp, Mus musculus
tcaggctggcaaatgaggagatcgc

SEQ ID NO: 804546 - DNA, 25 bp, Mus musculus
tcaggctggcaattgaggagatcgc

SEQ ID NO: 804547 - DNA, 25 bp, Mus musculus
tcaggctggccgcaattcatagaga

SEQ ID NO: 804548 - DNA, 25 bp, Mus musculus
tcaggctggccggaattcatagaga

SEQ ID NO: 804549 - DNA, 25 bp, Mus musculus
tcaggctggtctaaactgggacagt

SEQ ID NO: 804550 - DNA, 25 bp, Mus musculus
tcaggctggtcttaactgggacagt

SEQ ID NO: 804551 - DNA, 25 bp, Mus musculus
tcaggctggtggcaattgaattgac

SEQ ID NO: 804552 - DNA, 25 bp, Mus musculus
tcaggctggtgggaattgaattgac

SEQ ID NO: 804553 - DNA, 25 bp, Mus musculus
tcaggctgtatacaattaatgatac

SEQ ID NO: 804554 - DNA, 25 bp, Mus musculus
tcaggctgtatagaattaatgatac

SEQ ID NO: 804555 - DNA, 25 bp, Mus musculus
tcaggctgtcccctaaagagtctaa

SEQ ID NO: 804556 - DNA, 25 bp, Mus musculus
tcaggctgtcccgtaaagagtctaa

SEQ ID NO: 804557 - DNA, 25 bp, Mus musculus
tcaggctgtcgtagctgctgctctg

SEQ ID NO: 804558 - DNA, 25 bp, Mus musculus
tcaggctgtcgttgctgctgctctg

SEQ ID NO: 804559 - DNA, 25 bp, Mus musculus
tcaggctgtctcatcttacatgaat

SEQ ID NO: 804560 - DNA, 25 bp, Mus musculus
tcaggctgtctcttcttacatgaat

SEQ ID NO: 804561 - DNA, 25 bp, Mus musculus
tcaggctgtctgacaggttgggtct

SEQ ID NO: 804562 - DNA, 25 bp, Mus musculus
tcaggctgtctgtcaggttgggtct

SEQ ID NO: 804563 - DNA, 25 bp, Mus musculus
tcaggctgtgccataattcagaaca

SEQ ID NO: 804564 - DNA, 25 bp, Mus musculus
tcaggctgtgccttaattcagaaca

SEQ ID NO: 804565 - DNA, 25 bp, Mus musculus
tcaggctgtggcctcaagcccagtg

SEQ ID NO: 804566 - DNA, 25 bp, Mus musculus
tcaggctgtggcgtcaagcccagtg

SEQ ID NO: 804567 - DNA, 25 bp, Mus musculus
tcaggctgtggtatacacgtccaac

SEQ ID NO: 804568 - DNA, 25 bp, Mus musculus
tcaggctgtggtttacacgtccaac

SEQ ID NO: 804569 - DNA, 25 bp, Mus musculus
tcaggctgttgcatcgaattcctct

SEQ ID NO: 804570 - DNA, 25 bp, Mus musculus
tcaggctgttgcttcgaattcctct

SEQ ID NO: 804571 - DNA, 25 bp, Mus musculus
tcaggcttaactaccaccaaacaac

SEQ ID NO: 804572 - DNA, 25 bp, Mus musculus
tcaggcttaacttccaccaaacaac

SEQ ID NO: 804573 - DNA, 25 bp, Mus musculus
tcaggcttagcaccacgtgcccttt

SEQ ID NO: 804574 - DNA, 25 bp, Mus musculus
tcaggcttagcagcacgtgcccttt

SEQ ID NO: 804575 - DNA, 25 bp, Mus musculus
tcaggcttatgtccaccagcgagga

SEQ ID NO: 804576 - DNA, 25 bp, Mus musculus
tcaggcttatgtgcaccagcgagga

SEQ ID NO: 804577 - DNA, 25 bp, Mus musculus
tcaggcttccacactcctttaaaaa

SEQ ID NO: 804578 - DNA, 25 bp, Mus musculus
tcaggcttccactctcctttaaaaa

SEQ ID NO: 804579 - DNA, 25 bp, Mus musculus
tcaggcttccgcaagtgagatgtgt

SEQ ID NO: 804580 - DNA, 25 bp, Mus musculus
tcaggcttccgctagtgagatgtgt

SEQ ID NO: 804581 - DNA, 25 bp, Mus musculus
tcaggcttcctgctgacaggtgact

SEQ ID NO: 804582 - DNA, 25 bp, Mus musculus
tcaggcttcctggtgacaggtgact

SEQ ID NO: 804583 - DNA, 25 bp, Mus musculus
tcaggcttctagatcaatgctgtgt

SEQ ID NO: 804584 - DNA, 25 bp, Mus musculus
tcaggcttctagttcaatgctgtgt

SEQ ID NO: 804585 - DNA, 25 bp, Mus musculus
tcaggcttcttcaagtggctcagga

SEQ ID NO: 804586 - DNA, 25 bp, Mus musculus
tcaggcttcttctagtggctcagga

SEQ ID NO: 804587 - DNA, 25 bp, Mus musculus
tcaggcttgcctaagagtactacac

SEQ ID NO: 804588 - DNA, 25 bp, Mus musculus
tcaggcttgccttagagtactacac

SEQ ID NO: 804589 - DNA, 25 bp, Mus musculus
tcaggcttggttatctacttaccag

SEQ ID NO: 804590 - DNA, 25 bp, Mus musculus
tcaggcttggttttctacttaccag

SEQ ID NO: 804591 - DNA, 25 bp, Mus musculus
tcaggcttgtcacttcaaaggatga

SEQ ID NO: 804592 - DNA, 25 bp, Mus musculus
tcaggcttgtcagttcaaaggatga

SEQ ID NO: 804593 - DNA, 25 bp, Mus musculus
tcaggctttctgagcacagggctgg

SEQ ID NO: 804594 - DNA, 25 bp, Mus musculus
tcaggctttctgtgcacagggctgg

SEQ ID NO: 804595 - DNA, 25 bp, Mus musculus
tcaggctttgagatgtaggtcccca

SEQ ID NO: 804596 - DNA, 25 bp, Mus musculus
tcaggctttgagttgtaggtcccca

SEQ ID NO: 804597 - DNA, 25 bp, Mus musculus
tcaggcttttaaatggtgtgctcgt

SEQ ID NO: 804598 - DNA, 25 bp, Mus musculus
tcaggcttttaattggtgtgctcgt

SEQ ID NO: 804599 - DNA, 25 bp, Mus musculus
tcagggaaacctattgtcgtgtgta

SEQ ID NO: 804600 - DNA, 25 bp, Mus musculus
tcagggaaaccttttgtcgtgtgta

SEQ ID NO: 804601 - DNA, 25 bp, Mus musculus
tcagggaaactgaggaatgctaatt

SEQ ID NO: 804602 - DNA, 25 bp, Mus musculus
tcagggaaactgtggaatgctaatt

SEQ ID NO: 804603 - DNA, 25 bp, Mus musculus
tcagggaacaagactagaaagttac

SEQ ID NO: 804604 - DNA, 25 bp, Mus musculus
tcagggaacaagtctagaaagttac

SEQ ID NO: 804605 - DNA, 25 bp, Mus musculus
tcagggaacagacccagcagcacag

SEQ ID NO: 804606 - DNA, 25 bp, Mus musculus
tcagggaacagagccagcagcacag

SEQ ID NO: 804607 - DNA, 25 bp, Mus musculus
tcagggaaccctatggaagagttat

SEQ ID NO: 804608 - DNA, 25 bp, Mus musculus
tcagggaaccctttggaagagttat

SEQ ID NO: 804609 - DNA, 25 bp, Mus musculus
tcagggaagaccatgtacaccggga

SEQ ID NO: 804610 - DNA, 25 bp, Mus musculus
tcagggaagaccttgtacaccggga

SEQ ID NO: 804611 - DNA, 25 bp, Mus musculus
tcagggaagcagctttcctgcacgt

SEQ ID NO: 804612 - DNA, 25 bp, Mus musculus
tcagggaagcaggtttcctgcacgt

SEQ ID NO: 804613 - DNA, 25 bp, Mus musculus
tcagggaagcctattttatcggtct

SEQ ID NO: 804614 - DNA, 25 bp, Mus musculus
tcagggaagccttttttatcggtct

SEQ ID NO: 804615 - DNA, 25 bp, Mus musculus
tcagggaagtagcaccagccccagc

SEQ ID NO: 804616 - DNA, 25 bp, Mus musculus
tcagggaagtaggaccagccccagc

SEQ ID NO: 804617 - DNA, 25 bp, Mus musculus
tcagggaagtgccatcaagcctcat

SEQ ID NO: 804618 - DNA, 25 bp, Mus musculus
tcagggaagtgcgatcaagcctcat

SEQ ID NO: 804619 - DNA, 25 bp, Mus musculus
tcagggaatcccagtgcttgaagct

SEQ ID NO: 804620 - DNA, 25 bp, Mus musculus
tcagggaatccctgtgcttgaagct

SEQ ID NO: 804621 - DNA, 25 bp, Mus musculus
tcagggaatgtcacacgtttcgggc

SEQ ID NO: 804622 - DNA, 25 bp, Mus musculus
tcagggaatgtctcacgtttcgggc

SEQ ID NO: 804623 - DNA, 25 bp, Mus musculus
tcagggacacacagtgcgggttcaa

SEQ ID NO: 804624 - DNA, 25 bp, Mus musculus
tcagggacacactgtgcgggttcaa

SEQ ID NO: 804625 - DNA, 25 bp, Mus musculus
tcagggacacctcttgggattcccc

SEQ ID NO: 804626 - DNA, 25 bp, Mus musculus
tcagggacacctgttgggattcccc

SEQ ID NO: 804627 - DNA, 25 bp, Mus musculus
tcagggacagtcacccagggaaata

SEQ ID NO: 804628 - DNA, 25 bp, Mus musculus
tcagggacagtctcccagggaaata

SEQ ID NO: 804629 - DNA, 25 bp, Mus musculus
tcagggacagttcaggctcagcctc

SEQ ID NO: 804630 - DNA, 25 bp, Mus musculus
tcagggacagttgaggctcagcctc

SEQ ID NO: 804631 - DNA, 25 bp, Mus musculus
tcagggacatccatagctttcaaaa

SEQ ID NO: 804632 - DNA, 25 bp, Mus musculus
tcagggacatccttagctttcaaaa

SEQ ID NO: 804633 - DNA, 25 bp, Mus musculus
tcagggacatgcactagccaggctt

SEQ ID NO: 804634 - DNA, 25 bp, Mus musculus
tcagggacatgctctagccaggctt

SEQ ID NO: 804635 - DNA, 25 bp, Mus musculus
tcagggacatggaatctctaatgga

SEQ ID NO: 804636 - DNA, 25 bp, Mus musculus
tcagggacatggtatctctaatgga

SEQ ID NO: 804637 - DNA, 25 bp, Mus musculus
tcagggaccaggctgggctactttt

SEQ ID NO: 804638 - DNA, 25 bp, Mus musculus
tcagggaccagggtgggctactttt

SEQ ID NO: 804639 - DNA, 25 bp, Mus musculus
tcagggaccgcaaacttcgctcgtc

SEQ ID NO: 804640 - DNA, 25 bp, Mus musculus
tcagggaccgcatacttcgctcgtc

SEQ ID NO: 804641 - DNA, 25 bp, Mus musculus
tcagggaccgtcaggctctgaggat

SEQ ID NO: 804642 - DNA, 25 bp, Mus musculus
tcagggaccgtctggctctgaggat

SEQ ID NO: 804643 - DNA, 25 bp, Mus musculus
tcagggacctatactcttggcttaa

SEQ ID NO: 804644 - DNA, 25 bp, Mus musculus
tcagggacctattctcttggcttaa

SEQ ID NO: 804645 - DNA, 25 bp, Mus musculus
tcagggacctcacggccagctgtgc

SEQ ID NO: 804646 - DNA, 25 bp, Mus musculus
tcagggacctcacttgcctagaact

SEQ ID NO: 804647 - DNA, 25 bp, Mus musculus
tcagggacctcagggccagctgtgc

SEQ ID NO: 804648 - DNA, 25 bp, Mus musculus
tcagggacctcagttgcctagaact

SEQ ID NO: 804649 - DNA, 25 bp, Mus musculus
tcagggacctctagccggctggagc

SEQ ID NO: 804650 - DNA, 25 bp, Mus musculus
tcagggacctcttgccggctggagc

SEQ ID NO: 804651 - DNA, 25 bp, Mus musculus
tcagggacctggaagtttcacttat

SEQ ID NO: 804652 - DNA, 25 bp, Mus musculus
tcagggacctggctacgaaccccaa

SEQ ID NO: 804653 - DNA, 25 bp, Mus musculus
tcagggacctgggtacgaaccccaa

SEQ ID NO: 804654 - DNA, 25 bp, Mus musculus
tcagggacctggtagtttcacttat

SEQ ID NO: 804655 - DNA, 25 bp, Mus musculus
tcagggactctcagccccattgttg

SEQ ID NO: 804656 - DNA, 25 bp, Mus musculus
tcagggactctctgccccattgttg

SEQ ID NO: 804657 - DNA, 25 bp, Mus musculus
tcagggactctgacttgatagccat

SEQ ID NO: 804658 - DNA, 25 bp, Mus musculus
tcagggactctgatggcaagtgcat

SEQ ID NO: 804659 - DNA, 25 bp, Mus musculus
tcagggactctgctagctcacagcc

SEQ ID NO: 804660 - DNA, 25 bp, Mus musculus
tcagggactctggtagctcacagcc

SEQ ID NO: 804661 - DNA, 25 bp, Mus musculus
tcagggactctgtcttgatagccat

SEQ ID NO: 804662 - DNA, 25 bp, Mus musculus
tcagggactctgttggcaagtgcat

SEQ ID NO: 804663 - DNA, 25 bp, Mus musculus
tcagggactggaaaggtcacactcc

SEQ ID NO: 804664 - DNA, 25 bp, Mus musculus
tcagggactggataggtcacactcc

SEQ ID NO: 804665 - DNA, 25 bp, Mus musculus
tcagggagaatgcaaatgctttttt

SEQ ID NO: 804666 - DNA, 25 bp, Mus musculus
tcagggagaatggaaatgctttttt

SEQ ID NO: 804667 - DNA, 25 bp, Mus musculus
tcagggagacctaatttcctttctt

SEQ ID NO: 804668 - DNA, 25 bp, Mus musculus
tcagggagaccttatttcctttctt

SEQ ID NO: 804669 - DNA, 25 bp, Mus musculus
tcagggagagagaaagcacagaacc

SEQ ID NO: 804670 - DNA, 25 bp, Mus musculus
tcagggagagagagaaaatccttct

SEQ ID NO: 804671 - DNA, 25 bp, Mus musculus
tcagggagagagtaagcacagaacc

SEQ ID NO: 804672 - DNA, 25 bp, Mus musculus
tcagggagagagtgaaaatccttct

SEQ ID NO: 804673 - DNA, 25 bp, Mus musculus
tcagggagccctagcttaatgtcat

SEQ ID NO: 804674 - DNA, 25 bp, Mus musculus
tcagggagcccttgcttaatgtcat

SEQ ID NO: 804675 - DNA, 25 bp, Mus musculus
tcagggagcggcagccagtctgcaa

SEQ ID NO: 804676 - DNA, 25 bp, Mus musculus
tcagggagcggctgccagtctgcaa

SEQ ID NO: 804677 - DNA, 25 bp, Mus musculus
tcagggagctttcgtcttttcaaac

SEQ ID NO: 804678 - DNA, 25 bp, Mus musculus
tcagggagctttggtcttttcaaac

SEQ ID NO: 804679 - DNA, 25 bp, Mus musculus
tcagggagtccaaatgaagccttct

SEQ ID NO: 804680 - DNA, 25 bp, Mus musculus
tcagggagtccatatgaagccttct

SEQ ID NO: 804681 - DNA, 25 bp, Mus musculus
tcagggagttccaccagggacattt

SEQ ID NO: 804682 - DNA, 25 bp, Mus musculus
tcagggagttcctccagggacattt

SEQ ID NO: 804683 - DNA, 25 bp, Mus musculus
tcagggagttctcctgtgagctgtc

SEQ ID NO: 804684 - DNA, 25 bp, Mus musculus
tcagggagttctgctgtgagctgtc

SEQ ID NO: 804685 - DNA, 25 bp, Mus musculus
tcagggatccatctctctgccttat

SEQ ID NO: 804686 - DNA, 25 bp, Mus musculus
tcagggatccatgtctctgccttat

SEQ ID NO: 804687 - DNA, 25 bp, Mus musculus
tcagggatctagcatgactctctaa

SEQ ID NO: 804688 - DNA, 25 bp, Mus musculus
tcagggatctaggatgactctctaa

SEQ ID NO: 804689 - DNA, 25 bp, Mus musculus
tcagggatctcgaagtcttccttgg

SEQ ID NO: 804690 - DNA, 25 bp, Mus musculus
tcagggatctcgtagtcttccttgg

SEQ ID NO: 804691 - DNA, 25 bp, Mus musculus
tcagggatctttattccagattgtt

SEQ ID NO: 804692 - DNA, 25 bp, Mus musculus
tcagggatcttttttccagattgtt

SEQ ID NO: 804693 - DNA, 25 bp, Mus musculus
tcagggatgactcctgttcacccat

SEQ ID NO: 804694 - DNA, 25 bp, Mus musculus
tcagggatgactgctgttcacccat

SEQ ID NO: 804695 - DNA, 25 bp, Mus musculus
tcagggatgcaccactgtgtaccat

SEQ ID NO: 804696 - DNA, 25 bp, Mus musculus
tcagggatgcacgactgtgtaccat

SEQ ID NO: 804697 - DNA, 25 bp, Mus musculus
tcagggatggacaatgcagagctct

SEQ ID NO: 804698 - DNA, 25 bp, Mus musculus
tcagggatggactatgcagagctct

SEQ ID NO: 804699 - DNA, 25 bp, Mus musculus
tcagggatggccatagaacagatgt

SEQ ID NO: 804700 - DNA, 25 bp, Mus musculus
tcagggatggccttagaacagatgt

SEQ ID NO: 804701 - DNA, 25 bp, Mus musculus
tcagggatgggcacctcacgcctgt

SEQ ID NO: 804702 - DNA, 25 bp, Mus musculus
tcagggatgggctcctcacgcctgt

SEQ ID NO: 804703 - DNA, 25 bp, Mus musculus
tcagggatggtgaggtatagtcaca

SEQ ID NO: 804704 - DNA, 25 bp, Mus musculus
tcagggatggtgtggtatagtcaca

SEQ ID NO: 804705 - DNA, 25 bp, Mus musculus
tcagggattcccatccatgtttcca

SEQ ID NO: 804706 - DNA, 25 bp, Mus musculus
tcagggattcccttccatgtttcca

SEQ ID NO: 804707 - DNA, 25 bp, Mus musculus
tcagggattgtgattccaccagaat

SEQ ID NO: 804708 - DNA, 25 bp, Mus musculus
tcagggattgtgtttccaccagaat

SEQ ID NO: 804709 - DNA, 25 bp, Mus musculus
tcagggcaacagctgcggcttgtac

SEQ ID NO: 804710 - DNA, 25 bp, Mus musculus
tcagggcaacaggtgcggcttgtac

SEQ ID NO: 804711 - DNA, 25 bp, Mus musculus
tcagggcacagaaacaggtggctct

SEQ ID NO: 804712 - DNA, 25 bp, Mus musculus
tcagggcacagacatttctaacttt

SEQ ID NO: 804713 - DNA, 25 bp, Mus musculus
tcagggcacagagatttctaacttt

SEQ ID NO: 804714 - DNA, 25 bp, Mus musculus
tcagggcacagatacaggtggctct

SEQ ID NO: 804715 - DNA, 25 bp, Mus musculus
tcagggcaccgactcgaacttaggg

SEQ ID NO: 804716 - DNA, 25 bp, Mus musculus
tcagggcaccgagtcgaacttaggg

SEQ ID NO: 804717 - DNA, 25 bp, Mus musculus
tcagggcagacacaggcaaatctct

SEQ ID NO: 804718 - DNA, 25 bp, Mus musculus
tcagggcagacagaggcaaatctct

SEQ ID NO: 804719 - DNA, 25 bp, Mus musculus
tcagggcagacgaggaccacaaggc

SEQ ID NO: 804720 - DNA, 25 bp, Mus musculus
tcagggcagacgtggaccacaaggc

SEQ ID NO: 804721 - DNA, 25 bp, Mus musculus
tcagggcagcaacggcatgtctcca

SEQ ID NO: 804722 - DNA, 25 bp, Mus musculus
tcagggcagcaagggcatgtctcca

SEQ ID NO: 804723 - DNA, 25 bp, Mus musculus
tcagggcaggccagcactgcagatc

SEQ ID NO: 804724 - DNA, 25 bp, Mus musculus
tcagggcaggcctgcactgcagatc

SEQ ID NO: 804725 - DNA, 25 bp, Mus musculus
tcagggcagtacacaggcttcaatg

SEQ ID NO: 804726 - DNA, 25 bp, Mus musculus
tcagggcagtactcaggcttcaatg

SEQ ID NO: 804727 - DNA, 25 bp, Mus musculus
tcagggccaagaccttccatggttg

SEQ ID NO: 804728 - DNA, 25 bp, Mus musculus
tcagggccaagagcttccatggttg

SEQ ID NO: 804729 - DNA, 25 bp, Mus musculus
tcagggccagaacacttgaccaatc

SEQ ID NO: 804730 - DNA, 25 bp, Mus musculus
tcagggccagaagacttgaccaatc

SEQ ID NO: 804731 - DNA, 25 bp, Mus musculus
tcagggccagatcccttgcacacag

SEQ ID NO: 804732 - DNA, 25 bp, Mus musculus
tcagggccagatgccttgcacacag

SEQ ID NO: 804733 - DNA, 25 bp, Mus musculus
tcagggccaggaaaagcagctcgtg

SEQ ID NO: 804734 - DNA, 25 bp, Mus musculus
tcagggccaggataagcagctcgtg

SEQ ID NO: 804735 - DNA, 25 bp, Mus musculus
tcagggccatgcagtatccttttta

SEQ ID NO: 804736 - DNA, 25 bp, Mus musculus
tcagggccatgctgtatccttttta

SEQ ID NO: 804737 - DNA, 25 bp, Mus musculus
tcagggcccttcaggtaaatgaaaa

SEQ ID NO: 804738 - DNA, 25 bp, Mus musculus
tcagggcccttctggtaaatgaaaa

SEQ ID NO: 804739 - DNA, 25 bp, Mus musculus
tcagggccggtacttgccatggtct

SEQ ID NO: 804740 - DNA, 25 bp, Mus musculus
tcagggccggtagttgccatggtct

SEQ ID NO: 804741 - DNA, 25 bp, Mus musculus
tcagggcctctaagttcaagggcat

SEQ ID NO: 804742 - DNA, 25 bp, Mus musculus
tcagggcctctatgttcaagggcat

SEQ ID NO: 804743 - DNA, 25 bp, Mus musculus
tcagggcctctgaactgcctgcact

SEQ ID NO: 804744 - DNA, 25 bp, Mus musculus
tcagggcctctgagtgaaggctgtc

SEQ ID NO: 804745 - DNA, 25 bp, Mus musculus
tcagggcctctgtactgcctgcact

SEQ ID NO: 804746 - DNA, 25 bp, Mus musculus
tcagggcctctgtgtgaaggctgtc

SEQ ID NO: 804747 - DNA, 25 bp, Mus musculus
tcagggccttgcacctgtgtcgtga

SEQ ID NO: 804748 - DNA, 25 bp, Mus musculus
tcagggccttgctcctgtgtcgtga

SEQ ID NO: 804749 - DNA, 25 bp, Mus musculus
tcagggcgagacatcccagctaggt

SEQ ID NO: 804750 - DNA, 25 bp, Mus musculus
tcagggcgagacttcccagctaggt

SEQ ID NO: 804751 - DNA, 25 bp, Mus musculus
tcagggcgaggcagttttgccccag

SEQ ID NO: 804752 - DNA, 25 bp, Mus musculus
tcagggcgaggctgttttgccccag

SEQ ID NO: 804753 - DNA, 25 bp, Mus musculus
tcagggcgcaaaatcaagtgatttc

SEQ ID NO: 804754 - DNA, 25 bp, Mus musculus
tcagggcgcaaattcaagtgatttc

SEQ ID NO: 804755 - DNA, 25 bp, Mus musculus
tcagggcgtcacagacagcctagga

SEQ ID NO: 804756 - DNA, 25 bp, Mus musculus
tcagggcgtcactgacagcctagga

SEQ ID NO: 804757 - DNA, 25 bp, Mus musculus
tcagggcgtcccacagtgactgtat

SEQ ID NO: 804758 - DNA, 25 bp, Mus musculus
tcagggcgtccctcagtgactgtat

SEQ ID NO: 804759 - DNA, 25 bp, Mus musculus
tcagggcgtgctatactctacaata

SEQ ID NO: 804760 - DNA, 25 bp, Mus musculus
tcagggcgtgctttactctacaata

SEQ ID NO: 804761 - DNA, 25 bp, Mus musculus
tcagggctacggcaaatactggtaa

SEQ ID NO: 804762 - DNA, 25 bp, Mus musculus
tcagggctacgggaaatactggtaa

SEQ ID NO: 804763 - DNA, 25 bp, Mus musculus
tcagggctactgctgtgtctgtgca

SEQ ID NO: 804764 - DNA, 25 bp, Mus musculus
tcagggctactggtgtgtctgtgca

SEQ ID NO: 804765 - DNA, 25 bp, Mus musculus
tcagggctagagaatatcacacagg

SEQ ID NO: 804766 - DNA, 25 bp, Mus musculus
tcagggctagagtatatcacacagg

SEQ ID NO: 804767 - DNA, 25 bp, Mus musculus
tcagggctattcctaccaggacatt

SEQ ID NO: 804768 - DNA, 25 bp, Mus musculus
tcagggctattcgtaccaggacatt

SEQ ID NO: 804769 - DNA, 25 bp, Mus musculus
tcagggctcagtcactaggctacaa

SEQ ID NO: 804770 - DNA, 25 bp, Mus musculus
tcagggctcagtgactaggctacaa

SEQ ID NO: 804771 - DNA, 25 bp, Mus musculus
tcagggctcatccatatccaggtct

SEQ ID NO: 804772 - DNA, 25 bp, Mus musculus
tcagggctcatcgatatccaggtct

SEQ ID NO: 804773 - DNA, 25 bp, Mus musculus
tcagggctccgtctgggctcttttt

SEQ ID NO: 804774 - DNA, 25 bp, Mus musculus
tcagggctccgtgtgggctcttttt

SEQ ID NO: 804775 - DNA, 25 bp, Mus musculus
tcagggctctatcctccattatgag

SEQ ID NO: 804776 - DNA, 25 bp, Mus musculus
tcagggctctatgctccattatgag

SEQ ID NO: 804777 - DNA, 25 bp, Mus musculus
tcagggctcttcatccaccctagag

SEQ ID NO: 804778 - DNA, 25 bp, Mus musculus
tcagggctcttcttccaccctagag

SEQ ID NO: 804779 - DNA, 25 bp, Mus musculus
tcagggctgagacccgacgcgactt

SEQ ID NO: 804780 - DNA, 25 bp, Mus musculus
tcagggctgagagccgacgcgactt

SEQ ID NO: 804781 - DNA, 25 bp, Mus musculus
tcagggctgaggaggctctgcaccc

SEQ ID NO: 804782 - DNA, 25 bp, Mus musculus
tcagggctgaggtggctctgcaccc

SEQ ID NO: 804783 - DNA, 25 bp, Mus musculus
tcagggctgagtacagtcgccggca

SEQ ID NO: 804784 - DNA, 25 bp, Mus musculus
tcagggctgagttcagtcgccggca

SEQ ID NO: 804785 - DNA, 25 bp, Mus musculus
tcagggctgcagcttccatgatggc

SEQ ID NO: 804786 - DNA, 25 bp, Mus musculus
tcagggctgcaggttccatgatggc

SEQ ID NO: 804787 - DNA, 25 bp, Mus musculus
tcagggctgtggatccaacttctac

SEQ ID NO: 804788 - DNA, 25 bp, Mus musculus
tcagggctgtggttccaacttctac

SEQ ID NO: 804789 - DNA, 25 bp, Mus musculus
tcagggctgtttatcaggttccttc

SEQ ID NO: 804790 - DNA, 25 bp, Mus musculus
tcagggctgtttttcaggttccttc

SEQ ID NO: 804791 - DNA, 25 bp, Mus musculus
tcagggcttaagactacattgttag

SEQ ID NO: 804792 - DNA, 25 bp, Mus musculus
tcagggcttaagtctacattgttag

SEQ ID NO: 804793 - DNA, 25 bp, Mus musculus
tcagggcttagtcacctcaaaggag

SEQ ID NO: 804794 - DNA, 25 bp, Mus musculus
tcagggcttagtgacctcaaaggag

SEQ ID NO: 804795 - DNA, 25 bp, Mus musculus
tcagggcttcaacgcagtaccaagt

SEQ ID NO: 804796 - DNA, 25 bp, Mus musculus
tcagggcttcaaggcagtaccaagt

SEQ ID NO: 804797 - DNA, 25 bp, Mus musculus
tcagggcttgacatttgtacaaatt

SEQ ID NO: 804798 - DNA, 25 bp, Mus musculus
tcagggcttgacttttgtacaaatt

SEQ ID NO: 804799 - DNA, 25 bp, Mus musculus
tcagggcttttcatggtctttcctt

SEQ ID NO: 804800 - DNA, 25 bp, Mus musculus
tcagggcttttcttggtctttcctt

SEQ ID NO: 804801 - DNA, 25 bp, Mus musculus
tcaggggcttcacatatgtgggcac

SEQ ID NO: 804802 - DNA, 25 bp, Mus musculus
tcaggggcttcagatatgtgggcac

SEQ ID NO: 804803 - DNA, 25 bp, Mus musculus
tcagggtaacaaccatgtccgtctt

SEQ ID NO: 804804 - DNA, 25 bp, Mus musculus
tcagggtaacaagcatgtccgtctt

SEQ ID NO: 804805 - DNA, 25 bp, Mus musculus
tcagggtactaaccatagggtattt

SEQ ID NO: 804806 - DNA, 25 bp, Mus musculus
tcagggtactaagcatagggtattt

SEQ ID NO: 804807 - DNA, 25 bp, Mus musculus
tcagggtagccacgactcttcccat

SEQ ID NO: 804808 - DNA, 25 bp, Mus musculus
tcagggtagccaggactcttcccat

SEQ ID NO: 804809 - DNA, 25 bp, Mus musculus
tcagggtagctgagaaaccagatgg

SEQ ID NO: 804810 - DNA, 25 bp, Mus musculus
tcagggtagctgtgaaaccagatgg

SEQ ID NO: 804811 - DNA, 25 bp, Mus musculus
tcagggtagggtctccagttaaaat

SEQ ID NO: 804812 - DNA, 25 bp, Mus musculus
tcagggtagggtgtccagttaaaat

SEQ ID NO: 804813 - DNA, 25 bp, Mus musculus
tcagggtatccccagaactcctttc

SEQ ID NO: 804814 - DNA, 25 bp, Mus musculus
tcagggtatcccgagaactcctttc

SEQ ID NO: 804815 - DNA, 25 bp, Mus musculus
tcagggtattttcaggacctcccag

SEQ ID NO: 804816 - DNA, 25 bp, Mus musculus
tcagggtattttgaggacctcccag

SEQ ID NO: 804817 - DNA, 25 bp, Mus musculus
tcagggtcaaacatgttgccagttg

SEQ ID NO: 804818 - DNA, 25 bp, Mus musculus
tcagggtcaaacttgttgccagttg

SEQ ID NO: 804819 - DNA, 25 bp, Mus musculus
tcagggtcacacacattgcactaga

SEQ ID NO: 804820 - DNA, 25 bp, Mus musculus
tcagggtcacactcattgcactaga

SEQ ID NO: 804821 - DNA, 25 bp, Mus musculus
tcagggtcacagaaaccggcgatga

SEQ ID NO: 804822 - DNA, 25 bp, Mus musculus
tcagggtcacagacgaacagttgtt

SEQ ID NO: 804823 - DNA, 25 bp, Mus musculus
tcagggtcacagtaaccggcgatga

SEQ ID NO: 804824 - DNA, 25 bp, Mus musculus
tcagggtcacagtcgaacagttgtt

SEQ ID NO: 804825 - DNA, 25 bp, Mus musculus
tcagggtccaatcccgagcctgtta

SEQ ID NO: 804826 - DNA, 25 bp, Mus musculus
tcagggtccaatgccgagcctgtta

SEQ ID NO: 804827 - DNA, 25 bp, Mus musculus
tcagggtcccagaccttctagaaaa

SEQ ID NO: 804828 - DNA, 25 bp, Mus musculus
tcagggtcccagtccttctagaaaa

SEQ ID NO: 804829 - DNA, 25 bp, Mus musculus
tcagggtcctctccatgctaggcaa

SEQ ID NO: 804830 - DNA, 25 bp, Mus musculus
tcagggtcctctgcatgctaggcaa

SEQ ID NO: 804831 - DNA, 25 bp, Mus musculus
tcagggtccttcaacagtagatgct

SEQ ID NO: 804832 - DNA, 25 bp, Mus musculus
tcagggtccttctacagtagatgct

SEQ ID NO: 804833 - DNA, 25 bp, Mus musculus
tcagggtctcgtcacccgaagacag

SEQ ID NO: 804834 - DNA, 25 bp, Mus musculus
tcagggtctcgtgacccgaagacag

SEQ ID NO: 804835 - DNA, 25 bp, Mus musculus
tcagggtgaagtaccctgtgtgtct

SEQ ID NO: 804836 - DNA, 25 bp, Mus musculus
tcagggtgaagttccctgtgtgtct

SEQ ID NO: 804837 - DNA, 25 bp, Mus musculus
tcagggtgcaccaacctgacatttt

SEQ ID NO: 804838 - DNA, 25 bp, Mus musculus
tcagggtgcacctacctgacatttt

SEQ ID NO: 804839 - DNA, 25 bp, Mus musculus
tcagggtggactcgccctgttagca

SEQ ID NO: 804840 - DNA, 25 bp, Mus musculus
tcagggtggactggccctgttagca

SEQ ID NO: 804841 - DNA, 25 bp, Mus musculus
tcagggtggatcaagttcagtactc

SEQ ID NO: 804842 - DNA, 25 bp, Mus musculus
tcagggtggatctagttcagtactc

SEQ ID NO: 804843 - DNA, 25 bp, Mus musculus
tcagggtgggatcttccgaagacat

SEQ ID NO: 804844 - DNA, 25 bp, Mus musculus
tcagggtgggatgttccgaagacat

SEQ ID NO: 804845 - DNA, 25 bp, Mus musculus
tcagggtggtccaagcttctcctta

SEQ ID NO: 804846 - DNA, 25 bp, Mus musculus
tcagggtggtcctagcttctcctta

SEQ ID NO: 804847 - DNA, 25 bp, Mus musculus
tcagggtggtggatcctcccaatat

SEQ ID NO: 804848 - DNA, 25 bp, Mus musculus
tcagggtggtggttcctcccaatat

SEQ ID NO: 804849 - DNA, 25 bp, Mus musculus
tcagggtggtgtatcctattggcac

SEQ ID NO: 804850 - DNA, 25 bp, Mus musculus
tcagggtggtgtttcctattggcac

SEQ ID NO: 804851 - DNA, 25 bp, Mus musculus
tcagggtgtggcattttggtccctt

SEQ ID NO: 804852 - DNA, 25 bp, Mus musculus
tcagggtgtggctttttggtccctt

SEQ ID NO: 804853 - DNA, 25 bp, Mus musculus
tcagggtgtggtcaaattggtacta

SEQ ID NO: 804854 - DNA, 25 bp, Mus musculus
tcagggtgtggtgaaattggtacta

SEQ ID NO: 804855 - DNA, 25 bp, Mus musculus
tcagggtgtgtcacctcaaggtcag

SEQ ID NO: 804856 - DNA, 25 bp, Mus musculus
tcagggtgtgtctcctcaaggtcag

SEQ ID NO: 804857 - DNA, 25 bp, Mus musculus
tcagggttaaaaccgttctgtcctc

SEQ ID NO: 804858 - DNA, 25 bp, Mus musculus
tcagggttaaaagcgttctgtcctc

SEQ ID NO: 804859 - DNA, 25 bp, Mus musculus
tcagggttaaagagccacgtacctc

SEQ ID NO: 804860 - DNA, 25 bp, Mus musculus
tcagggttaaagatatctcacgtac

SEQ ID NO: 804861 - DNA, 25 bp, Mus musculus
tcagggttaaagtgccacgtacctc

SEQ ID NO: 804862 - DNA, 25 bp, Mus musculus
tcagggttaaagttatctcacgtac

SEQ ID NO: 804863 - DNA, 25 bp, Mus musculus
tcagggttaccccaaaggagctgtt

SEQ ID NO: 804864 - DNA, 25 bp, Mus musculus
tcagggttacccgaaaggagctgtt

SEQ ID NO: 804865 - DNA, 25 bp, Mus musculus
tcagggttactgacctactgtccag

SEQ ID NO: 804866 - DNA, 25 bp, Mus musculus
tcagggttactgtcctactgtccag

SEQ ID NO: 804867 - DNA, 25 bp, Mus musculus
tcagggttagccataggtcccagct

SEQ ID NO: 804868 - DNA, 25 bp, Mus musculus
tcagggttagccttaggtcccagct

SEQ ID NO: 804869 - DNA, 25 bp, Mus musculus
tcagggttccagctgagcatctcaa

SEQ ID NO: 804870 - DNA, 25 bp, Mus musculus
tcagggttccaggtgagcatctcaa

SEQ ID NO: 804871 - DNA, 25 bp, Mus musculus
tcagggttctgtatgatggcccaag

SEQ ID NO: 804872 - DNA, 25 bp, Mus musculus
tcagggttctgtttgatggcccaag

SEQ ID NO: 804873 - DNA, 25 bp, Mus musculus
tcagggttgcagacatggtggccat

SEQ ID NO: 804874 - DNA, 25 bp, Mus musculus
tcagggttgcagtcatggtggccat

SEQ ID NO: 804875 - DNA, 25 bp, Mus musculus
tcagggttggtaccaggttccctta

SEQ ID NO: 804876 - DNA, 25 bp, Mus musculus
tcagggttggtagcaggttccctta

SEQ ID NO: 804877 - DNA, 25 bp, Mus musculus
tcagggtttcacaacttcttacttt

SEQ ID NO: 804878 - DNA, 25 bp, Mus musculus
tcagggtttcactacttcttacttt

SEQ ID NO: 804879 - DNA, 25 bp, Mus musculus
tcagggtttccaacttccttgccct

SEQ ID NO: 804880 - DNA, 25 bp, Mus musculus
tcagggtttccatcttccttgccct

SEQ ID NO: 804881 - DNA, 25 bp, Mus musculus
tcagggtttctgctttgcacctttg

SEQ ID NO: 804882 - DNA, 25 bp, Mus musculus
tcagggtttctggtttgcacctttg

SEQ ID NO: 804883 - DNA, 25 bp, Mus musculus
tcagggtttgaaccccactactact

SEQ ID NO: 804884 - DNA, 25 bp, Mus musculus
tcagggtttgaagcccactactact

SEQ ID NO: 804885 - DNA, 25 bp, Mus musculus
tcaggtaaacccatggatgatgccc

SEQ ID NO: 804886 - DNA, 25 bp, Mus musculus
tcaggtaaacccttggatgatgccc

SEQ ID NO: 804887 - DNA, 25 bp, Mus musculus
tcaggtaacattcttctgctgtaaa

SEQ ID NO: 804888 - DNA, 25 bp, Mus musculus
tcaggtaacattgttctgctgtaaa

SEQ ID NO: 804889 - DNA, 25 bp, Mus musculus
tcaggtaacccaaaacgcgcttaat

SEQ ID NO: 804890 - DNA, 25 bp, Mus musculus
tcaggtaacccataacgcgcttaat

SEQ ID NO: 804891 - DNA, 25 bp, Mus musculus
tcaggtaactatattgaattgcaaa

SEQ ID NO: 804892 - DNA, 25 bp, Mus musculus
tcaggtaactattttgaattgcaaa

SEQ ID NO: 804893 - DNA, 25 bp, Mus musculus
tcaggtaactttcgactgaccttcc

SEQ ID NO: 804894 - DNA, 25 bp, Mus musculus
tcaggtaactttggactgaccttcc

SEQ ID NO: 804895 - DNA, 25 bp, Mus musculus
tcaggtaatgggaccatgtcaccat

SEQ ID NO: 804896 - DNA, 25 bp, Mus musculus
tcaggtaatgggtccatgtcaccat

SEQ ID NO: 804897 - DNA, 25 bp, Mus musculus
tcaggtaattttcacgtcaaagaga

SEQ ID NO: 804898 - DNA, 25 bp, Mus musculus
tcaggtaattttgacgtcaaagaga

SEQ ID NO: 804899 - DNA, 25 bp, Mus musculus
tcaggtaccatacccagcctggttt

SEQ ID NO: 804900 - DNA, 25 bp, Mus musculus
tcaggtaccatagccagcctggttt

SEQ ID NO: 804901 - DNA, 25 bp, Mus musculus
tcaggtactactatctaattcatgg

SEQ ID NO: 804902 - DNA, 25 bp, Mus musculus
tcaggtactactttctaattcatgg

SEQ ID NO: 804903 - DNA, 25 bp, Mus musculus
tcaggtagacacatttgtttcccca

SEQ ID NO: 804904 - DNA, 25 bp, Mus musculus
tcaggtagacacttttgtttcccca

SEQ ID NO: 804905 - DNA, 25 bp, Mus musculus
tcaggtagatcaatccagtgggtta

SEQ ID NO: 804906 - DNA, 25 bp, Mus musculus
tcaggtagatcattccagtgggtta

SEQ ID NO: 804907 - DNA, 25 bp, Mus musculus
tcaggtagcctgcaaatccttgtgg

SEQ ID NO: 804908 - DNA, 25 bp, Mus musculus
tcaggtagcctggaaatccttgtgg

SEQ ID NO: 804909 - DNA, 25 bp, Mus musculus
tcaggtagggatcttgccgctcaac

SEQ ID NO: 804910 - DNA, 25 bp, Mus musculus
tcaggtagggatgttgccgctcaac

SEQ ID NO: 804911 - DNA, 25 bp, Mus musculus
tcaggtatagtgaccccaactggga

SEQ ID NO: 804912 - DNA, 25 bp, Mus musculus
tcaggtatagtgtccccaactggga

SEQ ID NO: 804913 - DNA, 25 bp, Mus musculus
tcaggtatgaccatgttcaccaaaa

SEQ ID NO: 804914 - DNA, 25 bp, Mus musculus
tcaggtatgaccttgttcaccaaaa

SEQ ID NO: 804915 - DNA, 25 bp, Mus musculus
tcaggtatgtcaacagctgatgatg

SEQ ID NO: 804916 - DNA, 25 bp, Mus musculus
tcaggtatgtcatcagctgatgatg

SEQ ID NO: 804917 - DNA, 25 bp, Mus musculus
tcaggtattcccagacctgttggga

SEQ ID NO: 804918 - DNA, 25 bp, Mus musculus
tcaggtattccctgacctgttggga

SEQ ID NO: 804919 - DNA, 25 bp, Mus musculus
tcaggtatttgcacccagttggtta

SEQ ID NO: 804920 - DNA, 25 bp, Mus musculus
tcaggtatttgccatcaggtttgcc

SEQ ID NO: 804921 - DNA, 25 bp, Mus musculus
tcaggtatttgcgatcaggtttgcc

SEQ ID NO: 804922 - DNA, 25 bp, Mus musculus
tcaggtatttgctcccagttggtta

SEQ ID NO: 804923 - DNA, 25 bp, Mus musculus
tcaggtattttcacttttaagtgtg

SEQ ID NO: 804924 - DNA, 25 bp, Mus musculus
tcaggtattttctcttttaagtgtg

SEQ ID NO: 804925 - DNA, 25 bp, Mus musculus
tcaggtcaaaccataccaagcacaa

SEQ ID NO: 804926 - DNA, 25 bp, Mus musculus
tcaggtcaaaccttaccaagcacaa

SEQ ID NO: 804927 - DNA, 25 bp, Mus musculus
tcaggtcaacttcatggcttcacag

SEQ ID NO: 804928 - DNA, 25 bp, Mus musculus
tcaggtcaacttgatggcttcacag

SEQ ID NO: 804929 - DNA, 25 bp, Mus musculus
tcaggtcagagcagtggacgccttg

SEQ ID NO: 804930 - DNA, 25 bp, Mus musculus
tcaggtcagagctgtggacgccttg

SEQ ID NO: 804931 - DNA, 25 bp, Mus musculus
tcaggtcagattcagtgtcagtggt

SEQ ID NO: 804932 - DNA, 25 bp, Mus musculus
tcaggtcagattgagtgtcagtggt

SEQ ID NO: 804933 - DNA, 25 bp, Mus musculus
tcaggtcaggtgagtttagccggat

SEQ ID NO: 804934 - DNA, 25 bp, Mus musculus
tcaggtcaggtgtgtttagccggat

SEQ ID NO: 804935 - DNA, 25 bp, Mus musculus
tcaggtcagtccatactccaacaga

SEQ ID NO: 804936 - DNA, 25 bp, Mus musculus
tcaggtcagtccttactccaacaga

SEQ ID NO: 804937 - DNA, 25 bp, Mus musculus
tcaggtcatcaactgtggaggcaat

SEQ ID NO: 804938 - DNA, 25 bp, Mus musculus
tcaggtcatcaagtgtggaggcaat

SEQ ID NO: 804939 - DNA, 25 bp, Mus musculus
tcaggtccatctacagaggagctct

SEQ ID NO: 804940 - DNA, 25 bp, Mus musculus
tcaggtccatcttcagaggagctct

SEQ ID NO: 804941 - DNA, 25 bp, Mus musculus
tcaggtccatgtcaagatgagctct

SEQ ID NO: 804942 - DNA, 25 bp, Mus musculus
tcaggtccatgtgaagatgagctct

SEQ ID NO: 804943 - DNA, 25 bp, Mus musculus
tcaggtcccagtctctgagaataac

SEQ ID NO: 804944 - DNA, 25 bp, Mus musculus
tcaggtcccagtgtctgagaataac

SEQ ID NO: 804945 - DNA, 25 bp, Mus musculus
tcaggtccccacagtcaccgaaggg

SEQ ID NO: 804946 - DNA, 25 bp, Mus musculus
tcaggtccccactgtcaccgaaggg

SEQ ID NO: 804947 - DNA, 25 bp, Mus musculus
tcaggtcccctaaacttgagaagga

SEQ ID NO: 804948 - DNA, 25 bp, Mus musculus
tcaggtcccctatacttgagaagga

SEQ ID NO: 804949 - DNA, 25 bp, Mus musculus
tcaggtcccttcatttgtactttgg

SEQ ID NO: 804950 - DNA, 25 bp, Mus musculus
tcaggtcccttcttttgtactttgg

SEQ ID NO: 804951 - DNA, 25 bp, Mus musculus
tcaggtccgcgtccttacatagcag

SEQ ID NO: 804952 - DNA, 25 bp, Mus musculus
tcaggtccgcgtgcttacatagcag

SEQ ID NO: 804953 - DNA, 25 bp, Mus musculus
tcaggtcctggtaggtaagtgctgc

SEQ ID NO: 804954 - DNA, 25 bp, Mus musculus
tcaggtcctggttggtaagtgctgc

SEQ ID NO: 804955 - DNA, 25 bp, Mus musculus
tcaggtccttgaccggttgcagcaa

SEQ ID NO: 804956 - DNA, 25 bp, Mus musculus
tcaggtccttgagcggttgcagcaa

SEQ ID NO: 804957 - DNA, 25 bp, Mus musculus
tcaggtccttgcacacgagaagcaa

SEQ ID NO: 804958 - DNA, 25 bp, Mus musculus
tcaggtccttgctcacgagaagcaa

SEQ ID NO: 804959 - DNA, 25 bp, Mus musculus
tcaggtcgaggccaatcttggctct

SEQ ID NO: 804960 - DNA, 25 bp, Mus musculus
tcaggtcgaggcgaatcttggctct

SEQ ID NO: 804961 - DNA, 25 bp, Mus musculus
tcaggtcgctcaaacatcttcaggt

SEQ ID NO: 804962 - DNA, 25 bp, Mus musculus
tcaggtcgctcatacatcttcaggt

SEQ ID NO: 804963 - DNA, 25 bp, Mus musculus
tcaggtcgctctctggtctacagaa

SEQ ID NO: 804964 - DNA, 25 bp, Mus musculus
tcaggtcgctctgtggtctacagaa

SEQ ID NO: 804965 - DNA, 25 bp, Mus musculus
tcaggtctaccacgcccatgtaaaa

SEQ ID NO: 804966 - DNA, 25 bp, Mus musculus
tcaggtctaccaggcccatgtaaaa

SEQ ID NO: 804967 - DNA, 25 bp, Mus musculus
tcaggtctctctcggtcaaaattga

SEQ ID NO: 804968 - DNA, 25 bp, Mus musculus
tcaggtctctctgggtcaaaattga

SEQ ID NO: 804969 - DNA, 25 bp, Mus musculus
tcaggtctctgacagcattcaaagg

SEQ ID NO: 804970 - DNA, 25 bp, Mus musculus
tcaggtctctgacgagcccttgggc

SEQ ID NO: 804971 - DNA, 25 bp, Mus musculus
tcaggtctctgagagcattcaaagg

SEQ ID NO: 804972 - DNA, 25 bp, Mus musculus
tcaggtctctgaggagcccttgggc

SEQ ID NO: 804973 - DNA, 25 bp, Mus musculus
tcaggtctgaatcctcatcatcttc

SEQ ID NO: 804974 - DNA, 25 bp, Mus musculus
tcaggtctgaatgctcatcatcttc

SEQ ID NO: 804975 - DNA, 25 bp, Mus musculus
tcaggtctgctgatcatgggagctg

SEQ ID NO: 804976 - DNA, 25 bp, Mus musculus
tcaggtctgctgttcatgggagctg

SEQ ID NO: 804977 - DNA, 25 bp, Mus musculus
tcaggtctggttatggtcccaagga

SEQ ID NO: 804978 - DNA, 25 bp, Mus musculus
tcaggtctggttttggtcccaagga

SEQ ID NO: 804979 - DNA, 25 bp, Mus musculus
tcaggtcttataaccagatggccag

SEQ ID NO: 804980 - DNA, 25 bp, Mus musculus
tcaggtcttatatccagatggccag

SEQ ID NO: 804981 - DNA, 25 bp, Mus musculus
tcaggtcttcaaatgagcatagcaa

SEQ ID NO: 804982 - DNA, 25 bp, Mus musculus
tcaggtcttcaattgagcatagcaa

SEQ ID NO: 804983 - DNA, 25 bp, Mus musculus
tcaggtcttcatctcactgttggat

SEQ ID NO: 804984 - DNA, 25 bp, Mus musculus
tcaggtcttcatgtcactgttggat

SEQ ID NO: 804985 - DNA, 25 bp, Mus musculus
tcaggtcttctcagcaagagtagaa

SEQ ID NO: 804986 - DNA, 25 bp, Mus musculus
tcaggtcttctctgcaagagtagaa

SEQ ID NO: 804987 - DNA, 25 bp, Mus musculus
tcaggtcttctgaaaatgagtattc

SEQ ID NO: 804988 - DNA, 25 bp, Mus musculus
tcaggtcttctgtaaatgagtattc

SEQ ID NO: 804989 - DNA, 25 bp, Mus musculus
tcaggtctttctcactgcagcctgc

SEQ ID NO: 804990 - DNA, 25 bp, Mus musculus
tcaggtctttctgactgcagcctgc

SEQ ID NO: 804991 - DNA, 25 bp, Mus musculus
tcaggtgaagacagcgctgtctgaa

SEQ ID NO: 804992 - DNA, 25 bp, Mus musculus
tcaggtgaagactgcgctgtctgaa

SEQ ID NO: 804993 - DNA, 25 bp, Mus musculus
tcaggtgacctaagctatagcagtc

SEQ ID NO: 804994 - DNA, 25 bp, Mus musculus
tcaggtgacctatgctatagcagtc

SEQ ID NO: 804995 - DNA, 25 bp, Mus musculus
tcaggtgacctgagtttgccctcct

SEQ ID NO: 804996 - DNA, 25 bp, Mus musculus
tcaggtgacctgtgtttgccctcct

SEQ ID NO: 804997 - DNA, 25 bp, Mus musculus
tcaggtgactcgatttcctagctca

SEQ ID NO: 804998 - DNA, 25 bp, Mus musculus
tcaggtgactcgttttcctagctca

SEQ ID NO: 804999 - DNA, 25 bp, Mus musculus
tcaggtgatcctagaaccgttcatg

SEQ ID NO: 805000 - DNA, 25 bp, Mus musculus
tcaggtgatccttgaaccgttcatg

SEQ ID NO: 805001 - DNA, 25 bp, Mus musculus
tcaggtgatcggctcttagagacat

SEQ ID NO: 805002 - DNA, 25 bp, Mus musculus
tcaggtgatcgggtcttagagacat

SEQ ID NO: 805003 - DNA, 25 bp, Mus musculus
tcaggtgatgcaaaaatcccctcct

SEQ ID NO: 805004 - DNA, 25 bp, Mus musculus
tcaggtgatgcataaatcccctcct

SEQ ID NO: 805005 - DNA, 25 bp, Mus musculus
tcaggtgattagatgatacccctaa

SEQ ID NO: 805006 - DNA, 25 bp, Mus musculus
tcaggtgattagttgatacccctaa

SEQ ID NO: 805007 - DNA, 25 bp, Mus musculus
tcaggtgcaactacatttccacagt

SEQ ID NO: 805008 - DNA, 25 bp, Mus musculus
tcaggtgcaacttcatttccacagt

SEQ ID NO: 805009 - DNA, 25 bp, Mus musculus
tcaggtgcagagaacttgccacgat

SEQ ID NO: 805010 - DNA, 25 bp, Mus musculus
tcaggtgcagagtacttgccacgat

SEQ ID NO: 805011 - DNA, 25 bp, Mus musculus
tcaggtgcatttcctcacactggcc

SEQ ID NO: 805012 - DNA, 25 bp, Mus musculus
tcaggtgcatttgctcacactggcc

SEQ ID NO: 805013 - DNA, 25 bp, Mus musculus
tcaggtgccaaaagagccctcttat

SEQ ID NO: 805014 - DNA, 25 bp, Mus musculus
tcaggtgccaaatgagccctcttat

SEQ ID NO: 805015 - DNA, 25 bp, Mus musculus
tcaggtgccatgacccatatgcaaa

SEQ ID NO: 805016 - DNA, 25 bp, Mus musculus
tcaggtgccatgtcccatatgcaaa

SEQ ID NO: 805017 - DNA, 25 bp, Mus musculus
tcaggtgccctgcatggattccaca

SEQ ID NO: 805018 - DNA, 25 bp, Mus musculus
tcaggtgccctggatggattccaca

SEQ ID NO: 805019 - DNA, 25 bp, Mus musculus
tcaggtgcctttcacagatgcttca

SEQ ID NO: 805020 - DNA, 25 bp, Mus musculus
tcaggtgcctttgacagatgcttca

SEQ ID NO: 805021 - DNA, 25 bp, Mus musculus
tcaggtgcgggtccatcttttaaat

SEQ ID NO: 805022 - DNA, 25 bp, Mus musculus
tcaggtgcgggtgcatcttttaaat

SEQ ID NO: 805023 - DNA, 25 bp, Mus musculus
tcaggtgctggaaatcacatcgtca

SEQ ID NO: 805024 - DNA, 25 bp, Mus musculus
tcaggtgctggatatcacatcgtca

SEQ ID NO: 805025 - DNA, 25 bp, Mus musculus
tcaggtggaagacgctcttgccagc

SEQ ID NO: 805026 - DNA, 25 bp, Mus musculus
tcaggtggaagaggctcttgccagc

SEQ ID NO: 805027 - DNA, 25 bp, Mus musculus
tcaggtggaattcaggctgcctcag

SEQ ID NO: 805028 - DNA, 25 bp, Mus musculus
tcaggtggaattgaggctgcctcag

SEQ ID NO: 805029 - DNA, 25 bp, Mus musculus
tcaggtggaccacggagtagctaca

SEQ ID NO: 805030 - DNA, 25 bp, Mus musculus
tcaggtggaccagggagtagctaca

SEQ ID NO: 805031 - DNA, 25 bp, Mus musculus
tcaggtggactcaagtgtctgtctt

SEQ ID NO: 805032 - DNA, 25 bp, Mus musculus
tcaggtggactctagtgtctgtctt

SEQ ID NO: 805033 - DNA, 25 bp, Mus musculus
tcaggtggatgacacgcaacagcag

SEQ ID NO: 805034 - DNA, 25 bp, Mus musculus
tcaggtggatgagacgcaacagcag

SEQ ID NO: 805035 - DNA, 25 bp, Mus musculus
tcaggtggcaatcacatcacatttt

SEQ ID NO: 805036 - DNA, 25 bp, Mus musculus
tcaggtggcaatgacatcacatttt

SEQ ID NO: 805037 - DNA, 25 bp, Mus musculus
tcaggtggcagtacttcttaggaac

SEQ ID NO: 805038 - DNA, 25 bp, Mus musculus
tcaggtggcagttcttcttaggaac

SEQ ID NO: 805039 - DNA, 25 bp, Mus musculus
tcaggtggcctgagtgttcacaggt

SEQ ID NO: 805040 - DNA, 25 bp, Mus musculus
tcaggtggcctgtgtgttcacaggt

SEQ ID NO: 805041 - DNA, 25 bp, Mus musculus
tcaggtggctgcctaggtatcaagt

SEQ ID NO: 805042 - DNA, 25 bp, Mus musculus
tcaggtggctgcgtaggtatcaagt

SEQ ID NO: 805043 - DNA, 25 bp, Mus musculus
tcaggtggctgtcgcattgaacttc

SEQ ID NO: 805044 - DNA, 25 bp, Mus musculus
tcaggtggctgtggcattgaacttc

SEQ ID NO: 805045 - DNA, 25 bp, Mus musculus
tcaggtgggctcatggctgatgatt

SEQ ID NO: 805046 - DNA, 25 bp, Mus musculus
tcaggtgggctcttggctgatgatt

SEQ ID NO: 805047 - DNA, 25 bp, Mus musculus
tcaggtgggttaaccagccacgggt

SEQ ID NO: 805048 - DNA, 25 bp, Mus musculus
tcaggtgggttatccagccacgggt

SEQ ID NO: 805049 - DNA, 25 bp, Mus musculus
tcaggtggtatcacgggaaggacaa

SEQ ID NO: 805050 - DNA, 25 bp, Mus musculus
tcaggtggtatctcgggaaggacaa

SEQ ID NO: 805051 - DNA, 25 bp, Mus musculus
tcaggtggtcggagacgcccgggac

SEQ ID NO: 805052 - DNA, 25 bp, Mus musculus
tcaggtggtcggtgacgcccgggac

SEQ ID NO: 805053 - DNA, 25 bp, Mus musculus
tcaggtggtgaacatggactcccgc

SEQ ID NO: 805054 - DNA, 25 bp, Mus musculus
tcaggtggtgaagatggactcccgc

SEQ ID NO: 805055 - DNA, 25 bp, Mus musculus
tcaggtggttcacgactgcctataa

SEQ ID NO: 805056 - DNA, 25 bp, Mus musculus
tcaggtggttcaggactgcctataa

SEQ ID NO: 805057 - DNA, 25 bp, Mus musculus
tcaggtggttgtctagaattgaact

SEQ ID NO: 805058 - DNA, 25 bp, Mus musculus
tcaggtggttgtgtagaattgaact

SEQ ID NO: 805059 - DNA, 25 bp, Mus musculus
tcaggtgtacctctgagcactgtct

SEQ ID NO: 805060 - DNA, 25 bp, Mus musculus
tcaggtgtacctgtgagcactgtct

SEQ ID NO: 805061 - DNA, 25 bp, Mus musculus
tcaggtgtagggaacgaagcttaat

SEQ ID NO: 805062 - DNA, 25 bp, Mus musculus
tcaggtgtagggtacgaagcttaat

SEQ ID NO: 805063 - DNA, 25 bp, Mus musculus
tcaggtgtatgtcgctacagcctct

SEQ ID NO: 805064 - DNA, 25 bp, Mus musculus
tcaggtgtatgtggctacagcctct

SEQ ID NO: 805065 - DNA, 25 bp, Mus musculus
tcaggtgtcacacgtcctttcacta

SEQ ID NO: 805066 - DNA, 25 bp, Mus musculus
tcaggtgtcacaggtcctttcacta

SEQ ID NO: 805067 - DNA, 25 bp, Mus musculus
tcaggtgtccccagcccgggaaact

SEQ ID NO: 805068 - DNA, 25 bp, Mus musculus
tcaggtgtcccctgcccgggaaact

SEQ ID NO: 805069 - DNA, 25 bp, Mus musculus
tcaggtgtctgtagctgtgccatgg

SEQ ID NO: 805070 - DNA, 25 bp, Mus musculus
tcaggtgtctgttgctgtgccatgg

SEQ ID NO: 805071 - DNA, 25 bp, Mus musculus
tcaggtgtcttgacttgctttcaat

SEQ ID NO: 805072 - DNA, 25 bp, Mus musculus
tcaggtgtcttgtcttgctttcaat

SEQ ID NO: 805073 - DNA, 25 bp, Mus musculus
tcaggtgtctttcacttcctcagtc

SEQ ID NO: 805074 - DNA, 25 bp, Mus musculus
tcaggtgtctttgacttcctcagtc

SEQ ID NO: 805075 - DNA, 25 bp, Mus musculus
tcaggtgtgacaaggtttgataacc

SEQ ID NO: 805076 - DNA, 25 bp, Mus musculus
tcaggtgtgacatggtttgataacc

SEQ ID NO: 805077 - DNA, 25 bp, Mus musculus
tcaggtgtgacgctccacacagcaa

SEQ ID NO: 805078 - DNA, 25 bp, Mus musculus
tcaggtgtgacggtccacacagcaa

SEQ ID NO: 805079 - DNA, 25 bp, Mus musculus
tcaggtgtgctacctctcagcatca

SEQ ID NO: 805080 - DNA, 25 bp, Mus musculus
tcaggtgtgctagctctcagcatca

SEQ ID NO: 805081 - DNA, 25 bp, Mus musculus
tcaggtgtgggcaccaggcttgaaa

SEQ ID NO: 805082 - DNA, 25 bp, Mus musculus
tcaggtgtgggctccaggcttgaaa

SEQ ID NO: 805083 - DNA, 25 bp, Mus musculus
tcaggtgtgtgactcccagttccaa

SEQ ID NO: 805084 - DNA, 25 bp, Mus musculus
tcaggtgtgtgagtcccagttccaa

SEQ ID NO: 805085 - DNA, 25 bp, Mus musculus
tcaggtgtgtgcaacaatacccaaa

SEQ ID NO: 805086 - DNA, 25 bp, Mus musculus
tcaggtgtgtgctacaatacccaaa

SEQ ID NO: 805087 - DNA, 25 bp, Mus musculus
tcaggtgtgttcagtgtcacggagc

SEQ ID NO: 805088 - DNA, 25 bp, Mus musculus
tcaggtgtgttctgtgtcacggagc

SEQ ID NO: 805089 - DNA, 25 bp, Mus musculus
tcaggtgttttacactgtcccacta

SEQ ID NO: 805090 - DNA, 25 bp, Mus musculus
tcaggtgttttagactgtcccacta

SEQ ID NO: 805091 - DNA, 25 bp, Mus musculus
tcaggttaacatagttactccctgt

SEQ ID NO: 805092 - DNA, 25 bp, Mus musculus
tcaggttaacattgttactccctgt

SEQ ID NO: 805093 - DNA, 25 bp, Mus musculus
tcaggttaactgacgccttttcttc

SEQ ID NO: 805094 - DNA, 25 bp, Mus musculus
tcaggttaactgtcgccttttcttc

SEQ ID NO: 805095 - DNA, 25 bp, Mus musculus
tcaggttaccatccataaagctctt

SEQ ID NO: 805096 - DNA, 25 bp, Mus musculus
tcaggttaccatgcataaagctctt

SEQ ID NO: 805097 - DNA, 25 bp, Mus musculus
tcaggttacgcacttcatcttggat

SEQ ID NO: 805098 - DNA, 25 bp, Mus musculus
tcaggttacgcagttcatcttggat

SEQ ID NO: 805099 - DNA, 25 bp, Mus musculus
tcaggttactctagactgtggtcca

SEQ ID NO: 805100 - DNA, 25 bp, Mus musculus
tcaggttactcttgactgtggtcca

SEQ ID NO: 805101 - DNA, 25 bp, Mus musculus
tcaggttagctaaggccacagccca

SEQ ID NO: 805102 - DNA, 25 bp, Mus musculus
tcaggttagctatggccacagccca

SEQ ID NO: 805103 - DNA, 25 bp, Mus musculus
tcaggttaggatccagtggtcacga

SEQ ID NO: 805104 - DNA, 25 bp, Mus musculus
tcaggttaggatgcagtggtcacga

SEQ ID NO: 805105 - DNA, 25 bp, Mus musculus
tcaggttatgataacagccacactt

SEQ ID NO: 805106 - DNA, 25 bp, Mus musculus
tcaggttatgattacagccacactt

SEQ ID NO: 805107 - DNA, 25 bp, Mus musculus
tcaggttattctagacgccatttca

SEQ ID NO: 805108 - DNA, 25 bp, Mus musculus
tcaggttattcttgacgccatttca

SEQ ID NO: 805109 - DNA, 25 bp, Mus musculus
tcaggttcaactctgtggtcaccaa

SEQ ID NO: 805110 - DNA, 25 bp, Mus musculus
tcaggttcaactgtgtggtcaccaa

SEQ ID NO: 805111 - DNA, 25 bp, Mus musculus
tcaggttcaatgcaaaccctgttgt

SEQ ID NO: 805112 - DNA, 25 bp, Mus musculus
tcaggttcaatggaaaccctgttgt

SEQ ID NO: 805113 - DNA, 25 bp, Mus musculus
tcaggttcacctagttgcacagtta

SEQ ID NO: 805114 - DNA, 25 bp, Mus musculus
tcaggttcaccttgttgcacagtta

SEQ ID NO: 805115 - DNA, 25 bp, Mus musculus
tcaggttccacactaagaaggcaaa

SEQ ID NO: 805116 - DNA, 25 bp, Mus musculus
tcaggttccacagtaagaaggcaaa

SEQ ID NO: 805117 - DNA, 25 bp, Mus musculus
tcaggttcccagaagtggcccaata

SEQ ID NO: 805118 - DNA, 25 bp, Mus musculus
tcaggttcccagtagtggcccaata

SEQ ID NO: 805119 - DNA, 25 bp, Mus musculus
tcaggttcccgtaggcctgtgggca

SEQ ID NO: 805120 - DNA, 25 bp, Mus musculus
tcaggttcccgttggcctgtgggca

SEQ ID NO: 805121 - DNA, 25 bp, Mus musculus
tcaggttcctggaggccaatgtcca

SEQ ID NO: 805122 - DNA, 25 bp, Mus musculus
tcaggttcctggtggccaatgtcca

SEQ ID NO: 805123 - DNA, 25 bp, Mus musculus
tcaggttcggccagagactggccag

SEQ ID NO: 805124 - DNA, 25 bp, Mus musculus
tcaggttcggcctgagactggccag

SEQ ID NO: 805125 - DNA, 25 bp, Mus musculus
tcaggttctcgtacggcaggtggtc

SEQ ID NO: 805126 - DNA, 25 bp, Mus musculus
tcaggttctcgttcggcaggtggtc

SEQ ID NO: 805127 - DNA, 25 bp, Mus musculus
tcaggttctgacatacgacgtcact

SEQ ID NO: 805128 - DNA, 25 bp, Mus musculus
tcaggttctgacttacgacgtcact

SEQ ID NO: 805129 - DNA, 25 bp, Mus musculus
tcaggttctttacagaattgcttca

SEQ ID NO: 805130 - DNA, 25 bp, Mus musculus
tcaggttctttagagaattgcttca

SEQ ID NO: 805131 - DNA, 25 bp, Mus musculus
tcaggttgatcgctaggacccacac

SEQ ID NO: 805132 - DNA, 25 bp, Mus musculus
tcaggttgatcggtaggacccacac

SEQ ID NO: 805133 - DNA, 25 bp, Mus musculus
tcaggttgctcaaaaagtcggtgct

SEQ ID NO: 805134 - DNA, 25 bp, Mus musculus
tcaggttgctcataaagtcggtgct

SEQ ID NO: 805135 - DNA, 25 bp, Mus musculus
tcaggttgcttcattgaaactgcct

SEQ ID NO: 805136 - DNA, 25 bp, Mus musculus
tcaggttgcttctttgaaactgcct

SEQ ID NO: 805137 - DNA, 25 bp, Mus musculus
tcaggttggattcctagtgcctaca

SEQ ID NO: 805138 - DNA, 25 bp, Mus musculus
tcaggttggattgctagtgcctaca

SEQ ID NO: 805139 - DNA, 25 bp, Mus musculus
tcaggttggccactgtccctcagtg

SEQ ID NO: 805140 - DNA, 25 bp, Mus musculus
tcaggttggccagtgtccctcagtg

SEQ ID NO: 805141 - DNA, 25 bp, Mus musculus
tcaggttgggatacgttctctcaga

SEQ ID NO: 805142 - DNA, 25 bp, Mus musculus
tcaggttgggattcgttctctcaga

SEQ ID NO: 805143 - DNA, 25 bp, Mus musculus
tcaggttgggtcagtcttgcactgc

SEQ ID NO: 805144 - DNA, 25 bp, Mus musculus
tcaggttgggtctgtcttgcactgc

SEQ ID NO: 805145 - DNA, 25 bp, Mus musculus
tcaggttggtgcacacttcttgaaa

SEQ ID NO: 805146 - DNA, 25 bp, Mus musculus
tcaggttggtgctcacttcttgaaa

SEQ ID NO: 805147 - DNA, 25 bp, Mus musculus
tcaggttgttttctcacagtgacca

SEQ ID NO: 805148 - DNA, 25 bp, Mus musculus
tcaggttgttttgtcacagtgacca

SEQ ID NO: 805149 - DNA, 25 bp, Mus musculus
tcaggtttaagtcttccctcttttg

SEQ ID NO: 805150 - DNA, 25 bp, Mus musculus
tcaggtttaagtgttccctcttttg

SEQ ID NO: 805151 - DNA, 25 bp, Mus musculus
tcaggtttacctctcagccgagcag

SEQ ID NO: 805152 - DNA, 25 bp, Mus musculus
tcaggtttacctgtcagccgagcag

SEQ ID NO: 805153 - DNA, 25 bp, Mus musculus
tcaggtttagagaggtcccttgctt

SEQ ID NO: 805154 - DNA, 25 bp, Mus musculus
tcaggtttagagtggtcccttgctt

SEQ ID NO: 805155 - DNA, 25 bp, Mus musculus
tcaggtttcagtcttagagagcatt

SEQ ID NO: 805156 - DNA, 25 bp, Mus musculus
tcaggtttcagtgttagagagcatt

SEQ ID NO: 805157 - DNA, 25 bp, Mus musculus
tcaggtttcattatcccggaccctg

SEQ ID NO: 805158 - DNA, 25 bp, Mus musculus
tcaggtttcattttcccggaccctg

SEQ ID NO: 805159 - DNA, 25 bp, Mus musculus
tcaggtttccacatggtcgaggttc

SEQ ID NO: 805160 - DNA, 25 bp, Mus musculus
tcaggtttccacttggtcgaggttc

SEQ ID NO: 805161 - DNA, 25 bp, Mus musculus
tcaggtttcctactgagccctttac

SEQ ID NO: 805162 - DNA, 25 bp, Mus musculus
tcaggtttcctagtgagccctttac

SEQ ID NO: 805163 - DNA, 25 bp, Mus musculus
tcaggtttccttccccagaagaggt

SEQ ID NO: 805164 - DNA, 25 bp, Mus musculus
tcaggtttccttccgttagcttttg

SEQ ID NO: 805165 - DNA, 25 bp, Mus musculus
tcaggtttccttgcccagaagaggt

SEQ ID NO: 805166 - DNA, 25 bp, Mus musculus
tcaggtttccttgcgttagcttttg

SEQ ID NO: 805167 - DNA, 25 bp, Mus musculus
tcaggtttctctctcaaagcagtca

SEQ ID NO: 805168 - DNA, 25 bp, Mus musculus
tcaggtttctctgtcaaagcagtca

SEQ ID NO: 805169 - DNA, 25 bp, Mus musculus
tcaggtttctgtaccagggtggagt

SEQ ID NO: 805170 - DNA, 25 bp, Mus musculus
tcaggtttctgttccagggtggagt

SEQ ID NO: 805171 - DNA, 25 bp, Mus musculus
tcaggtttgaggacctgccaaaagg

SEQ ID NO: 805172 - DNA, 25 bp, Mus musculus
tcaggtttgaggtcctgccaaaagg

SEQ ID NO: 805173 - DNA, 25 bp, Mus musculus
tcaggtttgcaaaggtccatggact

SEQ ID NO: 805174 - DNA, 25 bp, Mus musculus
tcaggtttgcaatggtccatggact

SEQ ID NO: 805175 - DNA, 25 bp, Mus musculus
tcaggtttgcacaccttccactcag

SEQ ID NO: 805176 - DNA, 25 bp, Mus musculus
tcaggtttgcaccacaagcacttgt

SEQ ID NO: 805177 - DNA, 25 bp, Mus musculus
tcaggtttgcacgacaagcacttgt

SEQ ID NO: 805178 - DNA, 25 bp, Mus musculus
tcaggtttgcactccttccactcag

SEQ ID NO: 805179 - DNA, 25 bp, Mus musculus
tcaggtttggtcacagttgcgcgga

SEQ ID NO: 805180 - DNA, 25 bp, Mus musculus
tcaggtttggtctcagttgcgcgga

SEQ ID NO: 805181 - DNA, 25 bp, Mus musculus
tcaggttttcctactggtacagcat

SEQ ID NO: 805182 - DNA, 25 bp, Mus musculus
tcaggttttccttctggtacagcat

SEQ ID NO: 805183 - DNA, 25 bp, Mus musculus
tcaggtttttatcaccaagagcaaa

SEQ ID NO: 805184 - DNA, 25 bp, Mus musculus
tcaggtttttatgaccaagagcaaa

SEQ ID NO: 805185 - DNA, 25 bp, Mus musculus
tcagtaaagagtcttgtaatcaatc

SEQ ID NO: 805186 - DNA, 25 bp, Mus musculus
tcagtaaagagtgttgtaatcaatc

SEQ ID NO: 805187 - DNA, 25 bp, Mus musculus
tcagtaacaaccatggcaagtaaag

SEQ ID NO: 805188 - DNA, 25 bp, Mus musculus
tcagtaacaaccttggcaagtaaag

SEQ ID NO: 805189 - DNA, 25 bp, Mus musculus
tcagtaacaggaccttgctaattgg

SEQ ID NO: 805190 - DNA, 25 bp, Mus musculus
tcagtaacaggagcttgctaattgg

SEQ ID NO: 805191 - DNA, 25 bp, Mus musculus
tcagtaacatcgattctcctttcca

SEQ ID NO: 805192 - DNA, 25 bp, Mus musculus
tcagtaacatcgtttctcctttcca

SEQ ID NO: 805193 - DNA, 25 bp, Mus musculus
tcagtaaccttacgctacctgaagg

SEQ ID NO: 805194 - DNA, 25 bp, Mus musculus
tcagtaaccttaggctacctgaagg

SEQ ID NO: 805195 - DNA, 25 bp, Mus musculus
tcagtaactcatacctggctttgaa

SEQ ID NO: 805196 - DNA, 25 bp, Mus musculus
tcagtaactcattcctggctttgaa

SEQ ID NO: 805197 - DNA, 25 bp, Mus musculus
tcagtaactgaacctttcattttca

SEQ ID NO: 805198 - DNA, 25 bp, Mus musculus
tcagtaactgaagctttcattttca

SEQ ID NO: 805199 - DNA, 25 bp, Mus musculus
tcagtaagaagccagcagaccgcag

SEQ ID NO: 805200 - DNA, 25 bp, Mus musculus
tcagtaagaagcgagcagaccgcag

SEQ ID NO: 805201 - DNA, 25 bp, Mus musculus
tcagtaagaccaatcaccaaagccc

SEQ ID NO: 805202 - DNA, 25 bp, Mus musculus
tcagtaagaccattcaccaaagccc

SEQ ID NO: 805203 - DNA, 25 bp, Mus musculus
tcagtaagacctaccctagggaaca

SEQ ID NO: 805204 - DNA, 25 bp, Mus musculus
tcagtaagaccttccctagggaaca

SEQ ID NO: 805205 - DNA, 25 bp, Mus musculus
tcagtaagcgtgaccctcagtgtga

SEQ ID NO: 805206 - DNA, 25 bp, Mus musculus
tcagtaagcgtgtccctcagtgtga

SEQ ID NO: 805207 - DNA, 25 bp, Mus musculus
tcagtaaggtctaacttgcccgggt

SEQ ID NO: 805208 - DNA, 25 bp, Mus musculus
tcagtaaggtcttacttgcccgggt

SEQ ID NO: 805209 - DNA, 25 bp, Mus musculus
tcagtaagtgacactctcctggtct

SEQ ID NO: 805210 - DNA, 25 bp, Mus musculus
tcagtaagtgactctctcctggtct

SEQ ID NO: 805211 - DNA, 25 bp, Mus musculus
tcagtaagtggtcggcgaccttcct

SEQ ID NO: 805212 - DNA, 25 bp, Mus musculus
tcagtaagtggtgggcgaccttcct

SEQ ID NO: 805213 - DNA, 25 bp, Mus musculus
tcagtaatatcaaggtgcagaggac

SEQ ID NO: 805214 - DNA, 25 bp, Mus musculus
tcagtaatatcacctgctggactat

SEQ ID NO: 805215 - DNA, 25 bp, Mus musculus
tcagtaatatcagctgctggactat

SEQ ID NO: 805216 - DNA, 25 bp, Mus musculus
tcagtaatatcatggtgcagaggac

SEQ ID NO: 805217 - DNA, 25 bp, Mus musculus
tcagtaatcatgcttcctggcacac

SEQ ID NO: 805218 - DNA, 25 bp, Mus musculus
tcagtaatcatggttcctggcacac

SEQ ID NO: 805219 - DNA, 25 bp, Mus musculus
tcagtaatgcttactgtatttctat

SEQ ID NO: 805220 - DNA, 25 bp, Mus musculus
tcagtaatgctttctgtatttctat

SEQ ID NO: 805221 - DNA, 25 bp, Mus musculus
tcagtaatggatatagatttccttt

SEQ ID NO: 805222 - DNA, 25 bp, Mus musculus
tcagtaatggatttagatttccttt

SEQ ID NO: 805223 - DNA, 25 bp, Mus musculus
tcagtaattgatcctggagagccca

SEQ ID NO: 805224 - DNA, 25 bp, Mus musculus
tcagtaattgatgctggagagccca

SEQ ID NO: 805225 - DNA, 25 bp, Mus musculus
tcagtacaaccgaaaagacaccagt

SEQ ID NO: 805226 - DNA, 25 bp, Mus musculus
tcagtacaaccgtaaagacaccagt

SEQ ID NO: 805227 - DNA, 25 bp, Mus musculus
tcagtacacgtgcaggcagaagcta

SEQ ID NO: 805228 - DNA, 25 bp, Mus musculus
tcagtacacgtggaggcagaagcta

SEQ ID NO: 805229 - DNA, 25 bp, Mus musculus
tcagtacagataatccagtgctggt

SEQ ID NO: 805230 - DNA, 25 bp, Mus musculus
tcagtacagatattccagtgctggt

SEQ ID NO: 805231 - DNA, 25 bp, Mus musculus
tcagtacagcatccagcttgacaat

SEQ ID NO: 805232 - DNA, 25 bp, Mus musculus
tcagtacagcatgcagcttgacaat

SEQ ID NO: 805233 - DNA, 25 bp, Mus musculus
tcagtacatctgactccgtcactgt

SEQ ID NO: 805234 - DNA, 25 bp, Mus musculus
tcagtacatctgtctccgtcactgt

SEQ ID NO: 805235 - DNA, 25 bp, Mus musculus
tcagtacatgacacccgacatgggt

SEQ ID NO: 805236 - DNA, 25 bp, Mus musculus
tcagtacatgactcccgacatgggt

SEQ ID NO: 805237 - DNA, 25 bp, Mus musculus
tcagtacatttcacctcgaccaaaa

SEQ ID NO: 805238 - DNA, 25 bp, Mus musculus
tcagtacatttctcctcgaccaaaa

SEQ ID NO: 805239 - DNA, 25 bp, Mus musculus
tcagtaccaaggcaagagcttccaa

SEQ ID NO: 805240 - DNA, 25 bp, Mus musculus
tcagtaccaagggaagagcttccaa

SEQ ID NO: 805241 - DNA, 25 bp, Mus musculus
tcagtaccactaagagacatccttg

SEQ ID NO: 805242 - DNA, 25 bp, Mus musculus
tcagtaccactatgagacatccttg

SEQ ID NO: 805243 - DNA, 25 bp, Mus musculus
tcagtaccagatcctaggaggacct

SEQ ID NO: 805244 - DNA, 25 bp, Mus musculus
tcagtaccagatgctaggaggacct

SEQ ID NO: 805245 - DNA, 25 bp, Mus musculus
tcagtaccatcaccttgcagggact

SEQ ID NO: 805246 - DNA, 25 bp, Mus musculus
tcagtaccatcagcttgcagggact

SEQ ID NO: 805247 - DNA, 25 bp, Mus musculus
tcagtaccccaacaaccttaaaatg

SEQ ID NO: 805248 - DNA, 25 bp, Mus musculus
tcagtaccccaagaaccttaaaatg

SEQ ID NO: 805249 - DNA, 25 bp, Mus musculus
tcagtaccccccagtagggacctgg

SEQ ID NO: 805250 - DNA, 25 bp, Mus musculus
tcagtacccccctgtagggacctgg

SEQ ID NO: 805251 - DNA, 25 bp, Mus musculus
tcagtaccctgacttgaaatttaca

SEQ ID NO: 805252 - DNA, 25 bp, Mus musculus
tcagtaccctgagttgaaatttaca

SEQ ID NO: 805253 - DNA, 25 bp, Mus musculus
tcagtacctttgcaactgcctcttt

SEQ ID NO: 805254 - DNA, 25 bp, Mus musculus
tcagtacctttggaactgcctcttt

SEQ ID NO: 805255 - DNA, 25 bp, Mus musculus
tcagtacgagccagtgccatgtgaa

SEQ ID NO: 805256 - DNA, 25 bp, Mus musculus
tcagtacgagcctgtgccatgtgaa

SEQ ID NO: 805257 - DNA, 25 bp, Mus musculus
tcagtacggatcactaagcctagaa

SEQ ID NO: 805258 - DNA, 25 bp, Mus musculus
tcagtacggatctctaagcctagaa

SEQ ID NO: 805259 - DNA, 25 bp, Mus musculus
tcagtactactgaggtgttctctac

SEQ ID NO: 805260 - DNA, 25 bp, Mus musculus
tcagtactactgtggtgttctctac

SEQ ID NO: 805261 - DNA, 25 bp, Mus musculus
tcagtactcaggctccacagacggg

SEQ ID NO: 805262 - DNA, 25 bp, Mus musculus
tcagtactcagggtccacagacggg

SEQ ID NO: 805263 - DNA, 25 bp, Mus musculus
tcagtactcagtccaatgcgcagca

SEQ ID NO: 805264 - DNA, 25 bp, Mus musculus
tcagtactcagtgcaatgcgcagca

SEQ ID NO: 805265 - DNA, 25 bp, Mus musculus
tcagtactcctacctcaagatgaga

SEQ ID NO: 805266 - DNA, 25 bp, Mus musculus
tcagtactcctagctcaagatgaga

SEQ ID NO: 805267 - DNA, 25 bp, Mus musculus
tcagtactccttagttttctctacc

SEQ ID NO: 805268 - DNA, 25 bp, Mus musculus
tcagtactcctttgttttctctacc

SEQ ID NO: 805269 - DNA, 25 bp, Mus musculus
tcagtactcggtcgccatcgtgcgc

SEQ ID NO: 805270 - DNA, 25 bp, Mus musculus
tcagtactcggtggccatcgtgcgc

SEQ ID NO: 805271 - DNA, 25 bp, Mus musculus
tcagtactcgtccatgccaggacac

SEQ ID NO: 805272 - DNA, 25 bp, Mus musculus
tcagtactcgtcgatgccaggacac

SEQ ID NO: 805273 - DNA, 25 bp, Mus musculus
tcagtactggcgcagggacgttaac

SEQ ID NO: 805274 - DNA, 25 bp, Mus musculus
tcagtactggcggagggacgttaac

SEQ ID NO: 805275 - DNA, 25 bp, Mus musculus
tcagtactgtgaagctttggcggat

SEQ ID NO: 805276 - DNA, 25 bp, Mus musculus
tcagtactgtgatgctttggcggat

SEQ ID NO: 805277 - DNA, 25 bp, Mus musculus
tcagtagaccttctgtgaggccagt

SEQ ID NO: 805278 - DNA, 25 bp, Mus musculus
tcagtagaccttgtgtgaggccagt

SEQ ID NO: 805279 - DNA, 25 bp, Mus musculus
tcagtagactttataacccttgtgg

SEQ ID NO: 805280 - DNA, 25 bp, Mus musculus
tcagtagactttttaacccttgtgg

SEQ ID NO: 805281 - DNA, 25 bp, Mus musculus
tcagtagagtttcctgtggctcagt

SEQ ID NO: 805282 - DNA, 25 bp, Mus musculus
tcagtagagtttgctgtggctcagt

SEQ ID NO: 805283 - DNA, 25 bp, Mus musculus
tcagtagatctgacagtagctgcca

SEQ ID NO: 805284 - DNA, 25 bp, Mus musculus
tcagtagatctgtcagtagctgcca

SEQ ID NO: 805285 - DNA, 25 bp, Mus musculus
tcagtagatgaacacacttgctgcc

SEQ ID NO: 805286 - DNA, 25 bp, Mus musculus
tcagtagatgaagacacttgctgcc

SEQ ID NO: 805287 - DNA, 25 bp, Mus musculus
tcagtagcacagctttcagccaggt

SEQ ID NO: 805288 - DNA, 25 bp, Mus musculus
tcagtagcacaggtttcagccaggt

SEQ ID NO: 805289 - DNA, 25 bp, Mus musculus
tcagtagccacccaggagctgaagt

SEQ ID NO: 805290 - DNA, 25 bp, Mus musculus
tcagtagccaccgaggagctgaagt

SEQ ID NO: 805291 - DNA, 25 bp, Mus musculus
tcagtagcccagacggtgggccaat

SEQ ID NO: 805292 - DNA, 25 bp, Mus musculus
tcagtagcccagtcggtgggccaat

SEQ ID NO: 805293 - DNA, 25 bp, Mus musculus
tcagtagcccctcacaagtgggatc

SEQ ID NO: 805294 - DNA, 25 bp, Mus musculus
tcagtagcccctgacaagtgggatc

SEQ ID NO: 805295 - DNA, 25 bp, Mus musculus
tcagtagccggcaccattaatcctg

SEQ ID NO: 805296 - DNA, 25 bp, Mus musculus
tcagtagccggctccattaatcctg

SEQ ID NO: 805297 - DNA, 25 bp, Mus musculus
tcagtaggcgtaaagttcccactaa

SEQ ID NO: 805298 - DNA, 25 bp, Mus musculus
tcagtaggcgtatagttcccactaa

SEQ ID NO: 805299 - DNA, 25 bp, Mus musculus
tcagtagggagaccacgtcccatcc

SEQ ID NO: 805300 - DNA, 25 bp, Mus musculus
tcagtagggagagcacgtcccatcc

SEQ ID NO: 805301 - DNA, 25 bp, Mus musculus
tcagtagggcacctgtaacctgcat

SEQ ID NO: 805302 - DNA, 25 bp, Mus musculus
tcagtagggcacgtgtaacctgcat

SEQ ID NO: 805303 - DNA, 25 bp, Mus musculus
tcagtagggtgtagtcctggctcac

SEQ ID NO: 805304 - DNA, 25 bp, Mus musculus
tcagtagggtgttgtcctggctcac

SEQ ID NO: 805305 - DNA, 25 bp, Mus musculus
tcagtaggtagtatgcacacaggcc

SEQ ID NO: 805306 - DNA, 25 bp, Mus musculus
tcagtaggtagtttgcacacaggcc

SEQ ID NO: 805307 - DNA, 25 bp, Mus musculus
tcagtaggtcatcttgccatttggg

SEQ ID NO: 805308 - DNA, 25 bp, Mus musculus
tcagtaggtcatgttgccatttggg

SEQ ID NO: 805309 - DNA, 25 bp, Mus musculus
tcagtagtaactctctcagattccc

SEQ ID NO: 805310 - DNA, 25 bp, Mus musculus
tcagtagtaactgtctcagattccc

SEQ ID NO: 805311 - DNA, 25 bp, Mus musculus
tcagtagtcaacatttcaattagaa

SEQ ID NO: 805312 - DNA, 25 bp, Mus musculus
tcagtagtcaacttttcaattagaa

SEQ ID NO: 805313 - DNA, 25 bp, Mus musculus
tcagtagtcaggatgatcggttaaa

SEQ ID NO: 805314 - DNA, 25 bp, Mus musculus
tcagtagtcaggttgatcggttaaa

SEQ ID NO: 805315 - DNA, 25 bp, Mus musculus
tcagtagtggagactcacccagcgt

SEQ ID NO: 805316 - DNA, 25 bp, Mus musculus
tcagtagtggagtctcacccagcgt

SEQ ID NO: 805317 - DNA, 25 bp, Mus musculus
tcagtagttaaacgcgcttgttgct

SEQ ID NO: 805318 - DNA, 25 bp, Mus musculus
tcagtagttaaaggcgcttgttgct

SEQ ID NO: 805319 - DNA, 25 bp, Mus musculus
tcagtataatttcgaaacccgggag

SEQ ID NO: 805320 - DNA, 25 bp, Mus musculus
tcagtataatttggaaacccgggag

SEQ ID NO: 805321 - DNA, 25 bp, Mus musculus
tcagtatactgtcccctcggagtgt

SEQ ID NO: 805322 - DNA, 25 bp, Mus musculus
tcagtatactgtgccctcggagtgt

SEQ ID NO: 805323 - DNA, 25 bp, Mus musculus
tcagtatatgcaaacacattggact

SEQ ID NO: 805324 - DNA, 25 bp, Mus musculus
tcagtatatgcatacacattggact

SEQ ID NO: 805325 - DNA, 25 bp, Mus musculus
tcagtatcagcaccatggccgggcc

SEQ ID NO: 805326 - DNA, 25 bp, Mus musculus
tcagtatcagcagcatggccgggcc

SEQ ID NO: 805327 - DNA, 25 bp, Mus musculus
tcagtatccaccatggttttcaata

SEQ ID NO: 805328 - DNA, 25 bp, Mus musculus
tcagtatccaccttggttttcaata

SEQ ID NO: 805329 - DNA, 25 bp, Mus musculus
tcagtatccatcattatggcaccgt

SEQ ID NO: 805330 - DNA, 25 bp, Mus musculus
tcagtatccatccatcagtggcgag

SEQ ID NO: 805331 - DNA, 25 bp, Mus musculus
tcagtatccatcgatcagtggcgag

SEQ ID NO: 805332 - DNA, 25 bp, Mus musculus
tcagtatccatctttatggcaccgt

SEQ ID NO: 805333 - DNA, 25 bp, Mus musculus
tcagtatccatgattgccagtagaa

SEQ ID NO: 805334 - DNA, 25 bp, Mus musculus
tcagtatccatgtttgccagtagaa

SEQ ID NO: 805335 - DNA, 25 bp, Mus musculus
tcagtatccctcattagaattgggt

SEQ ID NO: 805336 - DNA, 25 bp, Mus musculus
tcagtatccctctttagaattgggt

SEQ ID NO: 805337 - DNA, 25 bp, Mus musculus
tcagtatccggcagtgacctaggtt

SEQ ID NO: 805338 - DNA, 25 bp, Mus musculus
tcagtatccggctgtgacctaggtt

SEQ ID NO: 805339 - DNA, 25 bp, Mus musculus
tcagtatcctgccagtcagatcatc

SEQ ID NO: 805340 - DNA, 25 bp, Mus musculus
tcagtatcctgcgagtcagatcatc

SEQ ID NO: 805341 - DNA, 25 bp, Mus musculus
tcagtatctacaacaaaaaggctat

SEQ ID NO: 805342 - DNA, 25 bp, Mus musculus
tcagtatctacatcaaaaaggctat

SEQ ID NO: 805343 - DNA, 25 bp, Mus musculus
tcagtatctcgaagtacctcccgaa

SEQ ID NO: 805344 - DNA, 25 bp, Mus musculus
tcagtatctcgatgtacctcccgaa

SEQ ID NO: 805345 - DNA, 25 bp, Mus musculus
tcagtatctgcacctcttggacgtt

SEQ ID NO: 805346 - DNA, 25 bp, Mus musculus
tcagtatctgcagctcttggacgtt

SEQ ID NO: 805347 - DNA, 25 bp, Mus musculus
tcagtatctggaacccacggaaggg

SEQ ID NO: 805348 - DNA, 25 bp, Mus musculus
tcagtatctggatcccacggaaggg

SEQ ID NO: 805349 - DNA, 25 bp, Mus musculus
tcagtatggaaaaccacgtgacagg

SEQ ID NO: 805350 - DNA, 25 bp, Mus musculus
tcagtatggaaatccacgtgacagg

SEQ ID NO: 805351 - DNA, 25 bp, Mus musculus
tcagtatgtatcctatcccacactg

SEQ ID NO: 805352 - DNA, 25 bp, Mus musculus
tcagtatgtatcgtatcccacactg

SEQ ID NO: 805353 - DNA, 25 bp, Mus musculus
tcagtatgtctgatatgtgcgaatt

SEQ ID NO: 805354 - DNA, 25 bp, Mus musculus
tcagtatgtctgttatgtgcgaatt

SEQ ID NO: 805355 - DNA, 25 bp, Mus musculus
tcagtatgtgctatccccaagagag

SEQ ID NO: 805356 - DNA, 25 bp, Mus musculus
tcagtatgtgctttccccaagagag

SEQ ID NO: 805357 - DNA, 25 bp, Mus musculus
tcagtatgtgtaactaccctgaccc

SEQ ID NO: 805358 - DNA, 25 bp, Mus musculus
tcagtatgtgtatctaccctgaccc

SEQ ID NO: 805359 - DNA, 25 bp, Mus musculus
tcagtattaattacccctcctcagt

SEQ ID NO: 805360 - DNA, 25 bp, Mus musculus
tcagtattaatttcccctcctcagt

SEQ ID NO: 805361 - DNA, 25 bp, Mus musculus
tcagtattagtaagaagtgcgttat

SEQ ID NO: 805362 - DNA, 25 bp, Mus musculus
tcagtattagtatgaagtgcgttat

SEQ ID NO: 805363 - DNA, 25 bp, Mus musculus
tcagtattcgatatggtgtgctaca

SEQ ID NO: 805364 - DNA, 25 bp, Mus musculus
tcagtattcgatttggtgtgctaca

SEQ ID NO: 805365 - DNA, 25 bp, Mus musculus
tcagtattcggacaaggcttccctg

SEQ ID NO: 805366 - DNA, 25 bp, Mus musculus
tcagtattcggagaaggcttccctg

SEQ ID NO: 805367 - DNA, 25 bp, Mus musculus
tcagtattctctcatcctgcatcac

SEQ ID NO: 805368 - DNA, 25 bp, Mus musculus
tcagtattctctgatcctgcatcac

SEQ ID NO: 805369 - DNA, 25 bp, Mus musculus
tcagtattgcccctgctggtcattt

SEQ ID NO: 805370 - DNA, 25 bp, Mus musculus
tcagtattgcccgtgctggtcattt

SEQ ID NO: 805371 - DNA, 25 bp, Mus musculus
tcagtattgtgactgcatgtgaaat

SEQ ID NO: 805372 - DNA, 25 bp, Mus musculus
tcagtattgtgagtgcatgtgaaat

SEQ ID NO: 805373 - DNA, 25 bp, Mus musculus
tcagtatttaatcctgccagtcaat

SEQ ID NO: 805374 - DNA, 25 bp, Mus musculus
tcagtatttaatgctgccagtcaat

SEQ ID NO: 805375 - DNA, 25 bp, Mus musculus
tcagtatttctgatcctggctactt

SEQ ID NO: 805376 - DNA, 25 bp, Mus musculus
tcagtatttctgttcctggctactt

SEQ ID NO: 805377 - DNA, 25 bp, Mus musculus
tcagtatttgacacgtctttcccca

SEQ ID NO: 805378 - DNA, 25 bp, Mus musculus
tcagtatttgactcgtctttcccca

SEQ ID NO: 805379 - DNA, 25 bp, Mus musculus
tcagtatttgcaaaaccacgagggt

SEQ ID NO: 805380 - DNA, 25 bp, Mus musculus
tcagtatttgcataaccacgagggt

SEQ ID NO: 805381 - DNA, 25 bp, Mus musculus
tcagtattttacatactggccgtgg

SEQ ID NO: 805382 - DNA, 25 bp, Mus musculus
tcagtattttacttactggccgtgg

SEQ ID NO: 805383 - DNA, 25 bp, Mus musculus
tcagtcaaccctaaccgcattgaag

SEQ ID NO: 805384 - DNA, 25 bp, Mus musculus
tcagtcaacccttaccgcattgaag

SEQ ID NO: 805385 - DNA, 25 bp, Mus musculus
tcagtcaacgccctggtcttcgtag

SEQ ID NO: 805386 - DNA, 25 bp, Mus musculus
tcagtcaacgccgtggtcttcgtag

SEQ ID NO: 805387 - DNA, 25 bp, Mus musculus
tcagtcaagttgacctgcacagctt

SEQ ID NO: 805388 - DNA, 25 bp, Mus musculus
tcagtcaagttgtcctgcacagctt

SEQ ID NO: 805389 - DNA, 25 bp, Mus musculus
tcagtcaatgttccataatgtgatt

SEQ ID NO: 805390 - DNA, 25 bp, Mus musculus
tcagtcaatgttgcataatgtgatt

SEQ ID NO: 805391 - DNA, 25 bp, Mus musculus
tcagtcacagaaaacaacctgttaa

SEQ ID NO: 805392 - DNA, 25 bp, Mus musculus
tcagtcacagaatacaacctgttaa

SEQ ID NO: 805393 - DNA, 25 bp, Mus musculus
tcagtcacatctcgcagctggcagc

SEQ ID NO: 805394 - DNA, 25 bp, Mus musculus
tcagtcacatctggcagctggcagc

SEQ ID NO: 805395 - DNA, 25 bp, Mus musculus
tcagtcaccctgagaacagaccatc

SEQ ID NO: 805396 - DNA, 25 bp, Mus musculus
tcagtcaccctgtgaacagaccatc

SEQ ID NO: 805397 - DNA, 25 bp, Mus musculus
tcagtcaccgttactaattcttgct

SEQ ID NO: 805398 - DNA, 25 bp, Mus musculus
tcagtcaccgtttctaattcttgct

SEQ ID NO: 805399 - DNA, 25 bp, Mus musculus
tcagtcacggcactcaactcagata

SEQ ID NO: 805400 - DNA, 25 bp, Mus musculus
tcagtcacggcagtcaactcagata

SEQ ID NO: 805401 - DNA, 25 bp, Mus musculus
tcagtcactaagaccgtccttcagt

SEQ ID NO: 805402 - DNA, 25 bp, Mus musculus
tcagtcactaagtccgtccttcagt

SEQ ID NO: 805403 - DNA, 25 bp, Mus musculus
tcagtcactgacaagctctccgtgt

SEQ ID NO: 805404 - DNA, 25 bp, Mus musculus
tcagtcactgactagctctccgtgt

SEQ ID NO: 805405 - DNA, 25 bp, Mus musculus
tcagtcactgatcaataaagttctt

SEQ ID NO: 805406 - DNA, 25 bp, Mus musculus
tcagtcactgatgaataaagttctt

SEQ ID NO: 805407 - DNA, 25 bp, Mus musculus
tcagtcactggcctactagttaatt

SEQ ID NO: 805408 - DNA, 25 bp, Mus musculus
tcagtcactggcgtactagttaatt

SEQ ID NO: 805409 - DNA, 25 bp, Mus musculus
tcagtcagaaacaactgataatctg

SEQ ID NO: 805410 - DNA, 25 bp, Mus musculus
tcagtcagaaactactgataatctg

SEQ ID NO: 805411 - DNA, 25 bp, Mus musculus
tcagtcagagagcacacctcatcca

SEQ ID NO: 805412 - DNA, 25 bp, Mus musculus
tcagtcagagaggacacctcatcca

SEQ ID NO: 805413 - DNA, 25 bp, Mus musculus
tcagtcagaggaactgtcggtgccc

SEQ ID NO: 805414 - DNA, 25 bp, Mus musculus
tcagtcagaggaagcggagatgcca

SEQ ID NO: 805415 - DNA, 25 bp, Mus musculus
tcagtcagaggatctgtcggtgccc

SEQ ID NO: 805416 - DNA, 25 bp, Mus musculus
tcagtcagaggatgcggagatgcca

SEQ ID NO: 805417 - DNA, 25 bp, Mus musculus
tcagtcagggacatgagcatgcggt

SEQ ID NO: 805418 - DNA, 25 bp, Mus musculus
tcagtcagggacttgagcatgcggt

SEQ ID NO: 805419 - DNA, 25 bp, Mus musculus
tcagtcaggtctaggtagggcttcc

SEQ ID NO: 805420 - DNA, 25 bp, Mus musculus
tcagtcaggtcttggtagggcttcc

SEQ ID NO: 805421 - DNA, 25 bp, Mus musculus
tcagtcagtctaacactttaccaac

SEQ ID NO: 805422 - DNA, 25 bp, Mus musculus
tcagtcagtctatcactttaccaac

SEQ ID NO: 805423 - DNA, 25 bp, Mus musculus
tcagtcagtgatcttctgcttgtat

SEQ ID NO: 805424 - DNA, 25 bp, Mus musculus
tcagtcagtgatgttctgcttgtat

SEQ ID NO: 805425 - DNA, 25 bp, Mus musculus
tcagtcatctccattacccttgtta

SEQ ID NO: 805426 - DNA, 25 bp, Mus musculus
tcagtcatctcctttacccttgtta

SEQ ID NO: 805427 - DNA, 25 bp, Mus musculus
tcagtcatctctccatgcacctagg

SEQ ID NO: 805428 - DNA, 25 bp, Mus musculus
tcagtcatctctgcatgcacctagg

SEQ ID NO: 805429 - DNA, 25 bp, Mus musculus
tcagtcatcttgaatcaccagtctt

SEQ ID NO: 805430 - DNA, 25 bp, Mus musculus
tcagtcatcttgtatcaccagtctt

SEQ ID NO: 805431 - DNA, 25 bp, Mus musculus
tcagtcatgccgaagcacgagttct

SEQ ID NO: 805432 - DNA, 25 bp, Mus musculus
tcagtcatgccgtagcacgagttct

SEQ ID NO: 805433 - DNA, 25 bp, Mus musculus
tcagtcattcacatacatgtgtaaa

SEQ ID NO: 805434 - DNA, 25 bp, Mus musculus
tcagtcattcacttacatgtgtaaa

SEQ ID NO: 805435 - DNA, 25 bp, Mus musculus
tcagtcatttccattggacctacaa

SEQ ID NO: 805436 - DNA, 25 bp, Mus musculus
tcagtcatttcctttggacctacaa

SEQ ID NO: 805437 - DNA, 25 bp, Mus musculus
tcagtcatttgacattcctctgtta

SEQ ID NO: 805438 - DNA, 25 bp, Mus musculus
tcagtcatttgagattcctctgtta

SEQ ID NO: 805439 - DNA, 25 bp, Mus musculus
tcagtccaatcaattagggtatgtt

SEQ ID NO: 805440 - DNA, 25 bp, Mus musculus
tcagtccaatcatttagggtatgtt

SEQ ID NO: 805441 - DNA, 25 bp, Mus musculus
tcagtccaccatctggctacttgga

SEQ ID NO: 805442 - DNA, 25 bp, Mus musculus
tcagtccaccatgtggctacttgga

SEQ ID NO: 805443 - DNA, 25 bp, Mus musculus
tcagtccagcttctgcttaaaggcc

SEQ ID NO: 805444 - DNA, 25 bp, Mus musculus
tcagtccagcttgtgcttaaaggcc

SEQ ID NO: 805445 - DNA, 25 bp, Mus musculus
tcagtccagtctcaggtctcacgat

SEQ ID NO: 805446 - DNA, 25 bp, Mus musculus
tcagtccagtctgaggtctcacgat

SEQ ID NO: 805447 - DNA, 25 bp, Mus musculus
tcagtccatcctctactttctttta

SEQ ID NO: 805448 - DNA, 25 bp, Mus musculus
tcagtccatcctgtactttctttta

SEQ ID NO: 805449 - DNA, 25 bp, Mus musculus
tcagtccattggatgtctagtttac

SEQ ID NO: 805450 - DNA, 25 bp, Mus musculus
tcagtccattggttgtctagtttac

SEQ ID NO: 805451 - DNA, 25 bp, Mus musculus
tcagtcccagcaatcggaaaacagg

SEQ ID NO: 805452 - DNA, 25 bp, Mus musculus
tcagtcccagcattcggaaaacagg

SEQ ID NO: 805453 - DNA, 25 bp, Mus musculus
tcagtcccagttaaacacccagttt

SEQ ID NO: 805454 - DNA, 25 bp, Mus musculus
tcagtcccagtttaacacccagttt

SEQ ID NO: 805455 - DNA, 25 bp, Mus musculus
tcagtccccaagctctcttagagaa

SEQ ID NO: 805456 - DNA, 25 bp, Mus musculus
tcagtccccaaggtctcttagagaa

SEQ ID NO: 805457 - DNA, 25 bp, Mus musculus
tcagtccccagaagatagttgtttg

SEQ ID NO: 805458 - DNA, 25 bp, Mus musculus
tcagtccccagaatgtgtgctagct

SEQ ID NO: 805459 - DNA, 25 bp, Mus musculus
tcagtccccagatgatagttgtttg

SEQ ID NO: 805460 - DNA, 25 bp, Mus musculus
tcagtccccagattgtgtgctagct

SEQ ID NO: 805461 - DNA, 25 bp, Mus musculus
tcagtccccgctctgacgttggtgg

SEQ ID NO: 805462 - DNA, 25 bp, Mus musculus
tcagtccccgctgtgacgttggtgg

SEQ ID NO: 805463 - DNA, 25 bp, Mus musculus
tcagtcccctccatactttggataa

SEQ ID NO: 805464 - DNA, 25 bp, Mus musculus
tcagtcccctccttactttggataa

SEQ ID NO: 805465 - DNA, 25 bp, Mus musculus
tcagtcccggaccttaaattcttag

SEQ ID NO: 805466 - DNA, 25 bp, Mus musculus
tcagtcccggacgttaaattcttag

SEQ ID NO: 805467 - DNA, 25 bp, Mus musculus
tcagtcccgggcagccaagggttaa

SEQ ID NO: 805468 - DNA, 25 bp, Mus musculus
tcagtcccgggctgccaagggttaa

SEQ ID NO: 805469 - DNA, 25 bp, Mus musculus
tcagtccctaacagcttcaggttaa

SEQ ID NO: 805470 - DNA, 25 bp, Mus musculus
tcagtccctaactgcttcaggttaa

SEQ ID NO: 805471 - DNA, 25 bp, Mus musculus
tcagtccctcttactatggaggata

SEQ ID NO: 805472 - DNA, 25 bp, Mus musculus
tcagtccctctttctatggaggata

SEQ ID NO: 805473 - DNA, 25 bp, Mus musculus
tcagtccctgccaaagcactaaaat

SEQ ID NO: 805474 - DNA, 25 bp, Mus musculus
tcagtccctgcctaagcactaaaat

SEQ ID NO: 805475 - DNA, 25 bp, Mus musculus
tcagtccctgggacacacaagtggg

SEQ ID NO: 805476 - DNA, 25 bp, Mus musculus
tcagtccctgggatccacattagca

SEQ ID NO: 805477 - DNA, 25 bp, Mus musculus
tcagtccctgggtcacacaagtggg

SEQ ID NO: 805478 - DNA, 25 bp, Mus musculus
tcagtccctgggttccacattagca

SEQ ID NO: 805479 - DNA, 25 bp, Mus musculus
tcagtcccttagattttacctctat

SEQ ID NO: 805480 - DNA, 25 bp, Mus musculus
tcagtcccttagtttttacctctat

SEQ ID NO: 805481 - DNA, 25 bp, Mus musculus
tcagtcccttttcctgagggcgagg

SEQ ID NO: 805482 - DNA, 25 bp, Mus musculus
tcagtcccttttgctgagggcgagg

SEQ ID NO: 805483 - DNA, 25 bp, Mus musculus
tcagtccgccttcacggagatgggc

SEQ ID NO: 805484 - DNA, 25 bp, Mus musculus
tcagtccgccttgacggagatgggc

SEQ ID NO: 805485 - DNA, 25 bp, Mus musculus
tcagtccggcctagaagtgtctatt

SEQ ID NO: 805486 - DNA, 25 bp, Mus musculus
tcagtccggccttgaagtgtctatt

SEQ ID NO: 805487 - DNA, 25 bp, Mus musculus
tcagtcctataaagaccatctctta

SEQ ID NO: 805488 - DNA, 25 bp, Mus musculus
tcagtcctataatgaccatctctta

SEQ ID NO: 805489 - DNA, 25 bp, Mus musculus
tcagtcctcagcattttctggtcag

SEQ ID NO: 805490 - DNA, 25 bp, Mus musculus
tcagtcctcagctttttctggtcag

SEQ ID NO: 805491 - DNA, 25 bp, Mus musculus
tcagtcctccagcatctaaggaaga

SEQ ID NO: 805492 - DNA, 25 bp, Mus musculus
tcagtcctccaggatctaaggaaga

SEQ ID NO: 805493 - DNA, 25 bp, Mus musculus
tcagtcctcccaattaaacacagaa

SEQ ID NO: 805494 - DNA, 25 bp, Mus musculus
tcagtcctcccatttaaacacagaa

SEQ ID NO: 805495 - DNA, 25 bp, Mus musculus
tcagtcctcgtgcttctaacgggaa

SEQ ID NO: 805496 - DNA, 25 bp, Mus musculus
tcagtcctcgtggttctaacgggaa

SEQ ID NO: 805497 - DNA, 25 bp, Mus musculus
tcagtcctctggactcttgaatgta

SEQ ID NO: 805498 - DNA, 25 bp, Mus musculus
tcagtcctctggtctcttgaatgta

SEQ ID NO: 805499 - DNA, 25 bp, Mus musculus
tcagtcctgaccagcttcccgatga

SEQ ID NO: 805500 - DNA, 25 bp, Mus musculus
tcagtcctgacctgcttcccgatga

SEQ ID NO: 805501 - DNA, 25 bp, Mus musculus
tcagtcctgcaaaaccgagaagatc

SEQ ID NO: 805502 - DNA, 25 bp, Mus musculus
tcagtcctgcaataccgagaagatc

SEQ ID NO: 805503 - DNA, 25 bp, Mus musculus
tcagtcctgctcagcttgggcctgt

SEQ ID NO: 805504 - DNA, 25 bp, Mus musculus
tcagtcctgctctgcttgggcctgt

SEQ ID NO: 805505 - DNA, 25 bp, Mus musculus
tcagtcctggtgatttagacagtct

SEQ ID NO: 805506 - DNA, 25 bp, Mus musculus
tcagtcctggtgttttagacagtct

SEQ ID NO: 805507 - DNA, 25 bp, Mus musculus
tcagtcctgtgaatagattggctct

SEQ ID NO: 805508 - DNA, 25 bp, Mus musculus
tcagtcctgtgattagattggctct

SEQ ID NO: 805509 - DNA, 25 bp, Mus musculus
tcagtcctgtgtcagtccagacgta

SEQ ID NO: 805510 - DNA, 25 bp, Mus musculus
tcagtcctgtgtgagtccagacgta

SEQ ID NO: 805511 - DNA, 25 bp, Mus musculus
tcagtcctgttgctttcacttcgtc

SEQ ID NO: 805512 - DNA, 25 bp, Mus musculus
tcagtcctgttggtttcacttcgtc

SEQ ID NO: 805513 - DNA, 25 bp, Mus musculus
tcagtccttaaaaccccaggagttg

SEQ ID NO: 805514 - DNA, 25 bp, Mus musculus
tcagtccttaaatccccaggagttg

SEQ ID NO: 805515 - DNA, 25 bp, Mus musculus
tcagtccttaatatcataccacacc

SEQ ID NO: 805516 - DNA, 25 bp, Mus musculus
tcagtccttaatttcataccacacc

SEQ ID NO: 805517 - DNA, 25 bp, Mus musculus
tcagtccttcccatgagtctaggga

SEQ ID NO: 805518 - DNA, 25 bp, Mus musculus
tcagtccttcccttgagtctaggga

SEQ ID NO: 805519 - DNA, 25 bp, Mus musculus
tcagtcctttatacttaggtgtaac

SEQ ID NO: 805520 - DNA, 25 bp, Mus musculus
tcagtcctttatctcctgtataatt

SEQ ID NO: 805521 - DNA, 25 bp, Mus musculus
tcagtcctttatgtcctgtataatt

SEQ ID NO: 805522 - DNA, 25 bp, Mus musculus
tcagtcctttattcttaggtgtaac

SEQ ID NO: 805523 - DNA, 25 bp, Mus musculus
tcagtcctttccaagtgagctctag

SEQ ID NO: 805524 - DNA, 25 bp, Mus musculus
tcagtcctttcctagtgagctctag

SEQ ID NO: 805525 - DNA, 25 bp, Mus musculus
tcagtcctttgacttcttttcctta

SEQ ID NO: 805526 - DNA, 25 bp, Mus musculus
tcagtcctttgagttcttttcctta

SEQ ID NO: 805527 - DNA, 25 bp, Mus musculus
tcagtcctttggacagacgctgaag

SEQ ID NO: 805528 - DNA, 25 bp, Mus musculus
tcagtcctttggtcagacgctgaag

SEQ ID NO: 805529 - DNA, 25 bp, Mus musculus
tcagtcgaaagacccctgagcagga

SEQ ID NO: 805530 - DNA, 25 bp, Mus musculus
tcagtcgaaagagccctgagcagga

SEQ ID NO: 805531 - DNA, 25 bp, Mus musculus
tcagtcgattgaatttgctttgtct

SEQ ID NO: 805532 - DNA, 25 bp, Mus musculus
tcagtcgattgattttgctttgtct

SEQ ID NO: 805533 - DNA, 25 bp, Mus musculus
tcagtcgcatcacttctttcaggaa

SEQ ID NO: 805534 - DNA, 25 bp, Mus musculus
tcagtcgcatcagttctttcaggaa

SEQ ID NO: 805535 - DNA, 25 bp, Mus musculus
tcagtcgcctgtacctgttttcctt

SEQ ID NO: 805536 - DNA, 25 bp, Mus musculus
tcagtcgcctgttcctgttttcctt

SEQ ID NO: 805537 - DNA, 25 bp, Mus musculus
tcagtcgctataccttagcaccgtg

SEQ ID NO: 805538 - DNA, 25 bp, Mus musculus
tcagtcgctatagcttagcaccgtg

SEQ ID NO: 805539 - DNA, 25 bp, Mus musculus
tcagtcgctgtgagctggccaaaga

SEQ ID NO: 805540 - DNA, 25 bp, Mus musculus
tcagtcgctgtgtgctggccaaaga

SEQ ID NO: 805541 - DNA, 25 bp, Mus musculus
tcagtcgcttcaacagttcccagca

SEQ ID NO: 805542 - DNA, 25 bp, Mus musculus
tcagtcgcttcatcagttcccagca

SEQ ID NO: 805543 - DNA, 25 bp, Mus musculus
tcagtcggaatgccgctcagcagat

SEQ ID NO: 805544 - DNA, 25 bp, Mus musculus
tcagtcggaatggcgctcagcagat

SEQ ID NO: 805545 - DNA, 25 bp, Mus musculus
tcagtcggccgtcggttccacgaga

SEQ ID NO: 805546 - DNA, 25 bp, Mus musculus
tcagtcggccgtgggttccacgaga

SEQ ID NO: 805547 - DNA, 25 bp, Mus musculus
tcagtcggccttctttcaagggaaa

SEQ ID NO: 805548 - DNA, 25 bp, Mus musculus
tcagtcggccttgtttcaagggaaa

SEQ ID NO: 805549 - DNA, 25 bp, Mus musculus
tcagtcggctcaccaggcgagctag

SEQ ID NO: 805550 - DNA, 25 bp, Mus musculus
tcagtcggctcagcaggcgagctag

SEQ ID NO: 805551 - DNA, 25 bp, Mus musculus
tcagtcggtcctagggcgtatgttc

SEQ ID NO: 805552 - DNA, 25 bp, Mus musculus
tcagtcggtccttgggcgtatgttc

SEQ ID NO: 805553 - DNA, 25 bp, Mus musculus
tcagtcgtccgcaatgtgcagctgc

SEQ ID NO: 805554 - DNA, 25 bp, Mus musculus
tcagtcgtccgctatgtgcagctgc

SEQ ID NO: 805555 - DNA, 25 bp, Mus musculus
tcagtctacctgacattacctaggc

SEQ ID NO: 805556 - DNA, 25 bp, Mus musculus
tcagtctacctgtcattacctaggc

SEQ ID NO: 805557 - DNA, 25 bp, Mus musculus
tcagtctagtgactccttcctggga

SEQ ID NO: 805558 - DNA, 25 bp, Mus musculus
tcagtctagtgagtccttcctggga

SEQ ID NO: 805559 - DNA, 25 bp, Mus musculus
tcagtctatcgcactctattgggaa

SEQ ID NO: 805560 - DNA, 25 bp, Mus musculus
tcagtctatcgctctctattgggaa

SEQ ID NO: 805561 - DNA, 25 bp, Mus musculus
tcagtctatgatccacaggtccctc

SEQ ID NO: 805562 - DNA, 25 bp, Mus musculus
tcagtctatgatgcacaggtccctc

SEQ ID NO: 805563 - DNA, 25 bp, Mus musculus
tcagtctcagcgaagcccctcagaa

SEQ ID NO: 805564 - DNA, 25 bp, Mus musculus
tcagtctcagcgtagcccctcagaa

SEQ ID NO: 805565 - DNA, 25 bp, Mus musculus
tcagtctccaatcccataaaaaaat

SEQ ID NO: 805566 - DNA, 25 bp, Mus musculus
tcagtctccaatgccataaaaaaat

SEQ ID NO: 805567 - DNA, 25 bp, Mus musculus
tcagtctccagacctgtatgtggca

SEQ ID NO: 805568 - DNA, 25 bp, Mus musculus
tcagtctccagagctgtatgtggca

SEQ ID NO: 805569 - DNA, 25 bp, Mus musculus
tcagtctccatcaagtctcattact

SEQ ID NO: 805570 - DNA, 25 bp, Mus musculus
tcagtctccatctagtctcattact

SEQ ID NO: 805571 - DNA, 25 bp, Mus musculus
tcagtctcccttcaggaagtgacat

SEQ ID NO: 805572 - DNA, 25 bp, Mus musculus
tcagtctcccttgaggaagtgacat

SEQ ID NO: 805573 - DNA, 25 bp, Mus musculus
tcagtctccggaaccaaagccaaag

SEQ ID NO: 805574 - DNA, 25 bp, Mus musculus
tcagtctccggatccaaagccaaag

SEQ ID NO: 805575 - DNA, 25 bp, Mus musculus
tcagtctccggcacagcaaggagga

SEQ ID NO: 805576 - DNA, 25 bp, Mus musculus
tcagtctccggctcagcaaggagga

SEQ ID NO: 805577 - DNA, 25 bp, Mus musculus
tcagtctcctgtagggatgctcaga

SEQ ID NO: 805578 - DNA, 25 bp, Mus musculus
tcagtctcctgtcgtcaacaccaaa

SEQ ID NO: 805579 - DNA, 25 bp, Mus musculus
tcagtctcctgtggtcaacaccaaa

SEQ ID NO: 805580 - DNA, 25 bp, Mus musculus
tcagtctcctgttgggatgctcaga

SEQ ID NO: 805581 - DNA, 25 bp, Mus musculus
tcagtctctacgattgtcattgctc

SEQ ID NO: 805582 - DNA, 25 bp, Mus musculus
tcagtctctacgtttgtcattgctc

SEQ ID NO: 805583 - DNA, 25 bp, Mus musculus
tcagtctctcggctttacaggcaga

SEQ ID NO: 805584 - DNA, 25 bp, Mus musculus
tcagtctctcgggtttacaggcaga

SEQ ID NO: 805585 - DNA, 25 bp, Mus musculus
tcagtctcttgcattagcctccagg

SEQ ID NO: 805586 - DNA, 25 bp, Mus musculus
tcagtctcttgctttagcctccagg

SEQ ID NO: 805587 - DNA, 25 bp, Mus musculus
tcagtctgacttaacaacgcaacct

SEQ ID NO: 805588 - DNA, 25 bp, Mus musculus
tcagtctgactttacaacgcaacct

SEQ ID NO: 805589 - DNA, 25 bp, Mus musculus
tcagtctggctacatgggacctcgt

SEQ ID NO: 805590 - DNA, 25 bp, Mus musculus
tcagtctggctagatgggacctcgt

SEQ ID NO: 805591 - DNA, 25 bp, Mus musculus
tcagtctgtaggcaactccgttaat

SEQ ID NO: 805592 - DNA, 25 bp, Mus musculus
tcagtctgtagggaactccgttaat

SEQ ID NO: 805593 - DNA, 25 bp, Mus musculus
tcagtctgtattctcaccctctgaa

SEQ ID NO: 805594 - DNA, 25 bp, Mus musculus
tcagtctgtattgtcaccctctgaa

SEQ ID NO: 805595 - DNA, 25 bp, Mus musculus
tcagtctgtcggcacctttggagac

SEQ ID NO: 805596 - DNA, 25 bp, Mus musculus
tcagtctgtcgggacctttggagac

SEQ ID NO: 805597 - DNA, 25 bp, Mus musculus
tcagtctgtcgtccaccgatgagaa

SEQ ID NO: 805598 - DNA, 25 bp, Mus musculus
tcagtctgtcgtgcaccgatgagaa

SEQ ID NO: 805599 - DNA, 25 bp, Mus musculus
tcagtctgttaacaacctccatttc

SEQ ID NO: 805600 - DNA, 25 bp, Mus musculus
tcagtctgttaagaacctccatttc

SEQ ID NO: 805601 - DNA, 25 bp, Mus musculus
tcagtctgttggcttataccgtgca

SEQ ID NO: 805602 - DNA, 25 bp, Mus musculus
tcagtctgttgggttataccgtgca

SEQ ID NO: 805603 - DNA, 25 bp, Mus musculus
tcagtctgttgtctcctggagggct

SEQ ID NO: 805604 - DNA, 25 bp, Mus musculus
tcagtctgttgtgtcctggagggct

SEQ ID NO: 805605 - DNA, 25 bp, Mus musculus
tcagtcttagtgaagatgacccaaa

SEQ ID NO: 805606 - DNA, 25 bp, Mus musculus
tcagtcttagtgtagatgacccaaa

SEQ ID NO: 805607 - DNA, 25 bp, Mus musculus
tcagtcttcaagaaccccgatcaaa

SEQ ID NO: 805608 - DNA, 25 bp, Mus musculus
tcagtcttcaagtaccccgatcaaa

SEQ ID NO: 805609 - DNA, 25 bp, Mus musculus
tcagtcttcatcaggcgttctgctg

SEQ ID NO: 805610 - DNA, 25 bp, Mus musculus
tcagtcttcatctggcgttctgctg

SEQ ID NO: 805611 - DNA, 25 bp, Mus musculus
tcagtcttccaaatttgggccgatg

SEQ ID NO: 805612 - DNA, 25 bp, Mus musculus
tcagtcttccaattttgggccgatg

SEQ ID NO: 805613 - DNA, 25 bp, Mus musculus
tcagtcttccctcgcagtatgaagg

SEQ ID NO: 805614 - DNA, 25 bp, Mus musculus
tcagtcttccctggcagtatgaagg

SEQ ID NO: 805615 - DNA, 25 bp, Mus musculus
tcagtcttccggactgtaacacaga

SEQ ID NO: 805616 - DNA, 25 bp, Mus musculus
tcagtcttccggtctgtaacacaga

SEQ ID NO: 805617 - DNA, 25 bp, Mus musculus
tcagtcttccttacaacttgaggta

SEQ ID NO: 805618 - DNA, 25 bp, Mus musculus
tcagtcttcctttcaacttgaggta

SEQ ID NO: 805619 - DNA, 25 bp, Mus musculus
tcagtcttctctaaaagatcagcag

SEQ ID NO: 805620 - DNA, 25 bp, Mus musculus
tcagtcttctcttaaagatcagcag

SEQ ID NO: 805621 - DNA, 25 bp, Mus musculus
tcagtcttcttcctttgcttagtta

SEQ ID NO: 805622 - DNA, 25 bp, Mus musculus
tcagtcttcttcgtttgcttagtta

SEQ ID NO: 805623 - DNA, 25 bp, Mus musculus
tcagtcttgattctttctgccttct

SEQ ID NO: 805624 - DNA, 25 bp, Mus musculus
tcagtcttgattgtttctgccttct

SEQ ID NO: 805625 - DNA, 25 bp, Mus musculus
tcagtcttgcagctatcaggatggg

SEQ ID NO: 805626 - DNA, 25 bp, Mus musculus
tcagtcttgcaggtatcaggatggg

SEQ ID NO: 805627 - DNA, 25 bp, Mus musculus
tcagtcttggagatcaagcctccat

SEQ ID NO: 805628 - DNA, 25 bp, Mus musculus
tcagtcttggagttcaagcctccat

SEQ ID NO: 805629 - DNA, 25 bp, Mus musculus
tcagtcttgtcgcaaggttgccatg

SEQ ID NO: 805630 - DNA, 25 bp, Mus musculus
tcagtcttgtcggaaggttgccatg

SEQ ID NO: 805631 - DNA, 25 bp, Mus musculus
tcagtctttattcccacaccagagg

SEQ ID NO: 805632 - DNA, 25 bp, Mus musculus
tcagtctttattgccacaccagagg

SEQ ID NO: 805633 - DNA, 25 bp, Mus musculus
tcagtctttgcacctgctttcagtg

SEQ ID NO: 805634 - DNA, 25 bp, Mus musculus
tcagtctttgcagctgctttcagtg

SEQ ID NO: 805635 - DNA, 25 bp, Mus musculus
tcagtctttgtgctgtaaggtccca

SEQ ID NO: 805636 - DNA, 25 bp, Mus musculus
tcagtctttgtggtgtaaggtccca

SEQ ID NO: 805637 - DNA, 25 bp, Mus musculus
tcagtgaaaatcaaccaggctcctc

SEQ ID NO: 805638 - DNA, 25 bp, Mus musculus
tcagtgaaaatctaccaggctcctc

SEQ ID NO: 805639 - DNA, 25 bp, Mus musculus
tcagtgaaatgtcccttgtgctccc

SEQ ID NO: 805640 - DNA, 25 bp, Mus musculus
tcagtgaaatgtgccttgtgctccc

SEQ ID NO: 805641 - DNA, 25 bp, Mus musculus
tcagtgaacactacctgggtgccag

SEQ ID NO: 805642 - DNA, 25 bp, Mus musculus
tcagtgaacacttcctgggtgccag

SEQ ID NO: 805643 - DNA, 25 bp, Mus musculus
tcagtgaacgctagccccaaggact

SEQ ID NO: 805644 - DNA, 25 bp, Mus musculus
tcagtgaacgcttgccccaaggact

SEQ ID NO: 805645 - DNA, 25 bp, Mus musculus
tcagtgaatattcccctgggtcctg

SEQ ID NO: 805646 - DNA, 25 bp, Mus musculus
tcagtgaatattgccctgggtcctg

SEQ ID NO: 805647 - DNA, 25 bp, Mus musculus
tcagtgaatcacacacccctggagg

SEQ ID NO: 805648 - DNA, 25 bp, Mus musculus
tcagtgaatcactcacccctggagg

SEQ ID NO: 805649 - DNA, 25 bp, Mus musculus
tcagtgaatcagatgaggcttgact

SEQ ID NO: 805650 - DNA, 25 bp, Mus musculus
tcagtgaatcagttgaggcttgact

SEQ ID NO: 805651 - DNA, 25 bp, Mus musculus
tcagtgaattacagctatcagcatt

SEQ ID NO: 805652 - DNA, 25 bp, Mus musculus
tcagtgaattactgctatcagcatt

SEQ ID NO: 805653 - DNA, 25 bp, Mus musculus
tcagtgacactgcaggttcagacaa

SEQ ID NO: 805654 - DNA, 25 bp, Mus musculus
tcagtgacactggaggttcagacaa

SEQ ID NO: 805655 - DNA, 25 bp, Mus musculus
tcagtgacagcaagccgtctgtagc

SEQ ID NO: 805656 - DNA, 25 bp, Mus musculus
tcagtgacagcatgccgtctgtagc

SEQ ID NO: 805657 - DNA, 25 bp, Mus musculus
tcagtgacagccacaaagggaaatt

SEQ ID NO: 805658 - DNA, 25 bp, Mus musculus
tcagtgacagcctcaaagggaaatt

SEQ ID NO: 805659 - DNA, 25 bp, Mus musculus
tcagtgacaggtcagcttggcaaac

SEQ ID NO: 805660 - DNA, 25 bp, Mus musculus
tcagtgacaggtgagcttggcaaac

SEQ ID NO: 805661 - DNA, 25 bp, Mus musculus
tcagtgacatcgagtggcacatcta

SEQ ID NO: 805662 - DNA, 25 bp, Mus musculus
tcagtgacatcgtgtggcacatcta

SEQ ID NO: 805663 - DNA, 25 bp, Mus musculus
tcagtgaccacgctgtgttgacatc

SEQ ID NO: 805664 - DNA, 25 bp, Mus musculus
tcagtgaccacggtgtgttgacatc

SEQ ID NO: 805665 - DNA, 25 bp, Mus musculus
tcagtgacccttagcggctcaggat

SEQ ID NO: 805666 - DNA, 25 bp, Mus musculus
tcagtgaccctttgcggctcaggat

SEQ ID NO: 805667 - DNA, 25 bp, Mus musculus
tcagtgaccgacaacagtgctttct

SEQ ID NO: 805668 - DNA, 25 bp, Mus musculus
tcagtgaccgactacagtgctttct

SEQ ID NO: 805669 - DNA, 25 bp, Mus musculus
tcagtgaccttcagcaatcgggtgt

SEQ ID NO: 805670 - DNA, 25 bp, Mus musculus
tcagtgaccttctgcaatcgggtgt

SEQ ID NO: 805671 - DNA, 25 bp, Mus musculus
tcagtgacgagtacgcctgcgttga

SEQ ID NO: 805672 - DNA, 25 bp, Mus musculus
tcagtgacgagttcgcctgcgttga

SEQ ID NO: 805673 - DNA, 25 bp, Mus musculus
tcagtgacggccacatcttcctcgg

SEQ ID NO: 805674 - DNA, 25 bp, Mus musculus
tcagtgacggcctcatcttcctcgg

SEQ ID NO: 805675 - DNA, 25 bp, Mus musculus
tcagtgactactcggatggccagga

SEQ ID NO: 805676 - DNA, 25 bp, Mus musculus
tcagtgactactgggatggccagga

SEQ ID NO: 805677 - DNA, 25 bp, Mus musculus
tcagtgactcatccagcgtcggaga

SEQ ID NO: 805678 - DNA, 25 bp, Mus musculus
tcagtgactcatgcagcgtcggaga

SEQ ID NO: 805679 - DNA, 25 bp, Mus musculus
tcagtgactgaacgtttagagttgg

SEQ ID NO: 805680 - DNA, 25 bp, Mus musculus
tcagtgactgaaggtttagagttgg

SEQ ID NO: 805681 - DNA, 25 bp, Mus musculus
tcagtgactggcaggtcctctacaa

SEQ ID NO: 805682 - DNA, 25 bp, Mus musculus
tcagtgactggctggtcctctacaa

SEQ ID NO: 805683 - DNA, 25 bp, Mus musculus
tcagtgactgtgacttggaactctg

SEQ ID NO: 805684 - DNA, 25 bp, Mus musculus
tcagtgactgtgtcttggaactctg

SEQ ID NO: 805685 - DNA, 25 bp, Mus musculus
tcagtgacttcaccgagcccgagga

SEQ ID NO: 805686 - DNA, 25 bp, Mus musculus
tcagtgacttcagcgagcccgagga

SEQ ID NO: 805687 - DNA, 25 bp, Mus musculus
tcagtgagatcaacatagaaatggt

SEQ ID NO: 805688 - DNA, 25 bp, Mus musculus
tcagtgagatcatcatagaaatggt

SEQ ID NO: 805689 - DNA, 25 bp, Mus musculus
tcagtgagatccactgtctgtatgg

SEQ ID NO: 805690 - DNA, 25 bp, Mus musculus
tcagtgagatcctctgtctgtatgg

SEQ ID NO: 805691 - DNA, 25 bp, Mus musculus
tcagtgagcctacctatcgtaagtt

SEQ ID NO: 805692 - DNA, 25 bp, Mus musculus
tcagtgagcctagctatcgtaagtt

SEQ ID NO: 805693 - DNA, 25 bp, Mus musculus
tcagtgagcctgaagcttccccaaa

SEQ ID NO: 805694 - DNA, 25 bp, Mus musculus
tcagtgagcctgtagcttccccaaa

SEQ ID NO: 805695 - DNA, 25 bp, Mus musculus
tcagtgagctctaagtttgaccaag

SEQ ID NO: 805696 - DNA, 25 bp, Mus musculus
tcagtgagctcttagtttgaccaag

SEQ ID NO: 805697 - DNA, 25 bp, Mus musculus
tcagtgaggaaacccctgggtttca

SEQ ID NO: 805698 - DNA, 25 bp, Mus musculus
tcagtgaggaaagccctgggtttca

SEQ ID NO: 805699 - DNA, 25 bp, Mus musculus
tcagtgaggtatagaggttaaaacc

SEQ ID NO: 805700 - DNA, 25 bp, Mus musculus
tcagtgaggtattgaggttaaaacc

SEQ ID NO: 805701 - DNA, 25 bp, Mus musculus
tcagtgagtggaagccaaccccttg

SEQ ID NO: 805702 - DNA, 25 bp, Mus musculus
tcagtgagtggatgccaaccccttg

SEQ ID NO: 805703 - DNA, 25 bp, Mus musculus
tcagtgataactcccatgctatgtt

SEQ ID NO: 805704 - DNA, 25 bp, Mus musculus
tcagtgataactgccatgctatgtt

SEQ ID NO: 805705 - DNA, 25 bp, Mus musculus
tcagtgataggccaagaccccgtgt

SEQ ID NO: 805706 - DNA, 25 bp, Mus musculus
tcagtgataggcgaagaccccgtgt

SEQ ID NO: 805707 - DNA, 25 bp, Mus musculus
tcagtgatccagaggttcttgcagc

SEQ ID NO: 805708 - DNA, 25 bp, Mus musculus
tcagtgatccagtggttcttgcagc

SEQ ID NO: 805709 - DNA, 25 bp, Mus musculus
tcagtgatccccacgggtgcccaga

SEQ ID NO: 805710 - DNA, 25 bp, Mus musculus
tcagtgatcccctcgggtgcccaga

SEQ ID NO: 805711 - DNA, 25 bp, Mus musculus
tcagtgatctcacgctggaacttca

SEQ ID NO: 805712 - DNA, 25 bp, Mus musculus
tcagtgatctcaggctggaacttca

SEQ ID NO: 805713 - DNA, 25 bp, Mus musculus
tcagtgatcttgaagagatgtgcac

SEQ ID NO: 805714 - DNA, 25 bp, Mus musculus
tcagtgatcttgtagagatgtgcac

SEQ ID NO: 805715 - DNA, 25 bp, Mus musculus
tcagtgatgaccactaataagtaat

SEQ ID NO: 805716 - DNA, 25 bp, Mus musculus
tcagtgatgacctctaataagtaat

SEQ ID NO: 805717 - DNA, 25 bp, Mus musculus
tcagtgatgatgacatggtgattga

SEQ ID NO: 805718 - DNA, 25 bp, Mus musculus
tcagtgatgatgtcatggtgattga

SEQ ID NO: 805719 - DNA, 25 bp, Mus musculus
tcagtgatgtcaccaccttccaaga

SEQ ID NO: 805720 - DNA, 25 bp, Mus musculus
tcagtgatgtcagcaccttccaaga

SEQ ID NO: 805721 - DNA, 25 bp, Mus musculus
tcagtgatgtgcagtttcttcaaca

SEQ ID NO: 805722 - DNA, 25 bp, Mus musculus
tcagtgatgtgctgtttcttcaaca

SEQ ID NO: 805723 - DNA, 25 bp, Mus musculus
tcagtgatgtttccgctacctggca

SEQ ID NO: 805724 - DNA, 25 bp, Mus musculus
tcagtgatgtttgcgctacctggca

SEQ ID NO: 805725 - DNA, 25 bp, Mus musculus
tcagtgcaaccccaaataattttat

SEQ ID NO: 805726 - DNA, 25 bp, Mus musculus
tcagtgcaacccgaaataattttat

SEQ ID NO: 805727 - DNA, 25 bp, Mus musculus
tcagtgcaatgccttgtttcttcat

SEQ ID NO: 805728 - DNA, 25 bp, Mus musculus
tcagtgcaatgcgttgtttcttcat

SEQ ID NO: 805729 - DNA, 25 bp, Mus musculus
tcagtgcacactcaccgaggcattg

SEQ ID NO: 805730 - DNA, 25 bp, Mus musculus
tcagtgcacactgaccgaggcattg

SEQ ID NO: 805731 - DNA, 25 bp, Mus musculus
tcagtgcaccgacgttgtcctgcca

SEQ ID NO: 805732 - DNA, 25 bp, Mus musculus
tcagtgcaccgaggttgtcctgcca

SEQ ID NO: 805733 - DNA, 25 bp, Mus musculus
tcagtgcacgagaaacagagtatca

SEQ ID NO: 805734 - DNA, 25 bp, Mus musculus
tcagtgcacgagtaacagagtatca

SEQ ID NO: 805735 - DNA, 25 bp, Mus musculus
tcagtgcagtgtagaatgtctcatt

SEQ ID NO: 805736 - DNA, 25 bp, Mus musculus
tcagtgcagtgttgaatgtctcatt

SEQ ID NO: 805737 - DNA, 25 bp, Mus musculus
tcagtgccaacacagtgcttccaag

SEQ ID NO: 805738 - DNA, 25 bp, Mus musculus
tcagtgccaacagagtgcttccaag

SEQ ID NO: 805739 - DNA, 25 bp, Mus musculus
tcagtgccaccaaggtctgggtcaa

SEQ ID NO: 805740 - DNA, 25 bp, Mus musculus
tcagtgccaccaagttagaggaatt

SEQ ID NO: 805741 - DNA, 25 bp, Mus musculus
tcagtgccaccatggtctgggtcaa

SEQ ID NO: 805742 - DNA, 25 bp, Mus musculus
tcagtgccaccatgttagaggaatt

SEQ ID NO: 805743 - DNA, 25 bp, Mus musculus
tcagtgccaggactgtttactggat

SEQ ID NO: 805744 - DNA, 25 bp, Mus musculus
tcagtgccaggagtgtttactggat

SEQ ID NO: 805745 - DNA, 25 bp, Mus musculus
tcagtgccaggcctatatgtttcaa

SEQ ID NO: 805746 - DNA, 25 bp, Mus musculus
tcagtgccaggcgtatatgtttcaa

SEQ ID NO: 805747 - DNA, 25 bp, Mus musculus
tcagtgccattgatctaataagact

SEQ ID NO: 805748 - DNA, 25 bp, Mus musculus
tcagtgccattgttctaataagact

SEQ ID NO: 805749 - DNA, 25 bp, Mus musculus
tcagtgcccatcactatctggcgtt

SEQ ID NO: 805750 - DNA, 25 bp, Mus musculus
tcagtgcccatctctatctggcgtt

SEQ ID NO: 805751 - DNA, 25 bp, Mus musculus
tcagtgcccatgacataggccagat

SEQ ID NO: 805752 - DNA, 25 bp, Mus musculus
tcagtgcccatgcaatgtcgcctag

SEQ ID NO: 805753 - DNA, 25 bp, Mus musculus
tcagtgcccatgctgcgaagctgta

SEQ ID NO: 805754 - DNA, 25 bp, Mus musculus
tcagtgcccatggaatgtcgcctag

SEQ ID NO: 805755 - DNA, 25 bp, Mus musculus
tcagtgcccatggtgcgaagctgta

SEQ ID NO: 805756 - DNA, 25 bp, Mus musculus
tcagtgcccatgtcataggccagat

SEQ ID NO: 805757 - DNA, 25 bp, Mus musculus
tcagtgccccaacaggtgggacgtt

SEQ ID NO: 805758 - DNA, 25 bp, Mus musculus
tcagtgccccaagaggtgggacgtt

SEQ ID NO: 805759 - DNA, 25 bp, Mus musculus
tcagtgccccggagcagcagacagg

SEQ ID NO: 805760 - DNA, 25 bp, Mus musculus
tcagtgccccggtgcagcagacagg

SEQ ID NO: 805761 - DNA, 25 bp, Mus musculus
tcagtgcccgccagctggagaacaa

SEQ ID NO: 805762 - DNA, 25 bp, Mus musculus
tcagtgcccgcctgctggagaacaa

SEQ ID NO: 805763 - DNA, 25 bp, Mus musculus
tcagtgccctgcctggaacgtagaa

SEQ ID NO: 805764 - DNA, 25 bp, Mus musculus
tcagtgccctgcgtggaacgtagaa

SEQ ID NO: 805765 - DNA, 25 bp, Mus musculus
tcagtgccctggacagatcatctgg

SEQ ID NO: 805766 - DNA, 25 bp, Mus musculus
tcagtgccctggtcagatcatctgg

SEQ ID NO: 805767 - DNA, 25 bp, Mus musculus
tcagtgccgcacagggccacatgga

SEQ ID NO: 805768 - DNA, 25 bp, Mus musculus
tcagtgccgcactgggccacatgga

SEQ ID NO: 805769 - DNA, 25 bp, Mus musculus
tcagtgccgctgcttgcaaggagaa

SEQ ID NO: 805770 - DNA, 25 bp, Mus musculus
tcagtgccgctggttgcaaggagaa

SEQ ID NO: 805771 - DNA, 25 bp, Mus musculus
tcagtgccgtcgctatccgggtctt

SEQ ID NO: 805772 - DNA, 25 bp, Mus musculus
tcagtgccgtcggtatccgggtctt

SEQ ID NO: 805773 - DNA, 25 bp, Mus musculus
tcagtgccttccatggacacagagg

SEQ ID NO: 805774 - DNA, 25 bp, Mus musculus
tcagtgccttccttggacacagagg

SEQ ID NO: 805775 - DNA, 25 bp, Mus musculus
tcagtgccttggctagttgacacat

SEQ ID NO: 805776 - DNA, 25 bp, Mus musculus
tcagtgccttgggtagttgacacat

SEQ ID NO: 805777 - DNA, 25 bp, Mus musculus
tcagtgcgctggactccgggacaca

SEQ ID NO: 805778 - DNA, 25 bp, Mus musculus
tcagtgcgctggtctccgggacaca

SEQ ID NO: 805779 - DNA, 25 bp, Mus musculus
tcagtgcggcctccaaaaggcccta

SEQ ID NO: 805780 - DNA, 25 bp, Mus musculus
tcagtgcggcctgcaaaaggcccta

SEQ ID NO: 805781 - DNA, 25 bp, Mus musculus
tcagtgcgtttgaatgaacctccag

SEQ ID NO: 805782 - DNA, 25 bp, Mus musculus
tcagtgcgtttgtatgaacctccag

SEQ ID NO: 805783 - DNA, 25 bp, Mus musculus
tcagtgctaggccacctgctacgct

SEQ ID NO: 805784 - DNA, 25 bp, Mus musculus
tcagtgctaggcgacctgctacgct

SEQ ID NO: 805785 - DNA, 25 bp, Mus musculus
tcagtgctcactccagcggaaaggt

SEQ ID NO: 805786 - DNA, 25 bp, Mus musculus
tcagtgctcactgcagcggaaaggt

SEQ ID NO: 805787 - DNA, 25 bp, Mus musculus
tcagtgctcagacacagcaggccaa

SEQ ID NO: 805788 - DNA, 25 bp, Mus musculus
tcagtgctcagagacagcaggccaa

SEQ ID NO: 805789 - DNA, 25 bp, Mus musculus
tcagtgctcaggagccatgtccaga

SEQ ID NO: 805790 - DNA, 25 bp, Mus musculus
tcagtgctcaggtgccatgtccaga

SEQ ID NO: 805791 - DNA, 25 bp, Mus musculus
tcagtgctcctcagagattctggga

SEQ ID NO: 805792 - DNA, 25 bp, Mus musculus
tcagtgctcctctgagattctggga

SEQ ID NO: 805793 - DNA, 25 bp, Mus musculus
tcagtgctcgtgaatgacttcttcc

SEQ ID NO: 805794 - DNA, 25 bp, Mus musculus
tcagtgctcgtgtatgacttcttcc

SEQ ID NO: 805795 - DNA, 25 bp, Mus musculus
tcagtgctgagacttcctgtgtcca

SEQ ID NO: 805796 - DNA, 25 bp, Mus musculus
tcagtgctgagagttcctgtgtcca

SEQ ID NO: 805797 - DNA, 25 bp, Mus musculus
tcagtgctgcacattagacagctgt

SEQ ID NO: 805798 - DNA, 25 bp, Mus musculus
tcagtgctgcactttagacagctgt

SEQ ID NO: 805799 - DNA, 25 bp, Mus musculus
tcagtgctgcatcgcctctggtcat

SEQ ID NO: 805800 - DNA, 25 bp, Mus musculus
tcagtgctgcatggcctctggtcat

SEQ ID NO: 805801 - DNA, 25 bp, Mus musculus
tcagtgctgggcataccactgtgca

SEQ ID NO: 805802 - DNA, 25 bp, Mus musculus
tcagtgctgggcttaccactgtgca

SEQ ID NO: 805803 - DNA, 25 bp, Mus musculus
tcagtgctgtgaaagtacttgtcat

SEQ ID NO: 805804 - DNA, 25 bp, Mus musculus
tcagtgctgtgatagtacttgtcat

SEQ ID NO: 805805 - DNA, 25 bp, Mus musculus
tcagtgcttcatcccatttgcagag

SEQ ID NO: 805806 - DNA, 25 bp, Mus musculus
tcagtgcttcatgccatttgcagag

SEQ ID NO: 805807 - DNA, 25 bp, Mus musculus
tcagtgcttgacattggaaaccgca

SEQ ID NO: 805808 - DNA, 25 bp, Mus musculus
tcagtgcttgactttggaaaccgca

SEQ ID NO: 805809 - DNA, 25 bp, Mus musculus
tcagtggaaactcgcagtgtattga

SEQ ID NO: 805810 - DNA, 25 bp, Mus musculus
tcagtggaaactggcagtgtattga

SEQ ID NO: 805811 - DNA, 25 bp, Mus musculus
tcagtggaagttccattaccctatt

SEQ ID NO: 805812 - DNA, 25 bp, Mus musculus
tcagtggaagttgcattaccctatt

SEQ ID NO: 805813 - DNA, 25 bp, Mus musculus
tcagtggaatgacgtcccctgcaat

SEQ ID NO: 805814 - DNA, 25 bp, Mus musculus
tcagtggaatgaggtcccctgcaat

SEQ ID NO: 805815 - DNA, 25 bp, Mus musculus
tcagtggacagcagatataacagaa

SEQ ID NO: 805816 - DNA, 25 bp, Mus musculus
tcagtggacagctgatataacagaa

SEQ ID NO: 805817 - DNA, 25 bp, Mus musculus
tcagtggacagtatccgcagccgct

SEQ ID NO: 805818 - DNA, 25 bp, Mus musculus
tcagtggacagtttccgcagccgct

SEQ ID NO: 805819 - DNA, 25 bp, Mus musculus
tcagtggactgtccgtggctccttc

SEQ ID NO: 805820 - DNA, 25 bp, Mus musculus
tcagtggactgtgcgtggctccttc

SEQ ID NO: 805821 - DNA, 25 bp, Mus musculus
tcagtggagactcctttctttccct

SEQ ID NO: 805822 - DNA, 25 bp, Mus musculus
tcagtggagactgctttctttccct

SEQ ID NO: 805823 - DNA, 25 bp, Mus musculus
tcagtggaggcacatgaatggatct

SEQ ID NO: 805824 - DNA, 25 bp, Mus musculus
tcagtggaggcagatgaatggatct

SEQ ID NO: 805825 - DNA, 25 bp, Mus musculus
tcagtggagtagaaacccgctcacg

SEQ ID NO: 805826 - DNA, 25 bp, Mus musculus
tcagtggagtagtaacccgctcacg

SEQ ID NO: 805827 - DNA, 25 bp, Mus musculus
tcagtggcaacaaatgtttcgacca

SEQ ID NO: 805828 - DNA, 25 bp, Mus musculus
tcagtggcaacatatgtttcgacca

SEQ ID NO: 805829 - DNA, 25 bp, Mus musculus
tcagtggcacagcaccatcttcatt

SEQ ID NO: 805830 - DNA, 25 bp, Mus musculus
tcagtggcacaggaccatcttcatt

SEQ ID NO: 805831 - DNA, 25 bp, Mus musculus
tcagtggcaccactggttttttcta

SEQ ID NO: 805832 - DNA, 25 bp, Mus musculus
tcagtggcaccagtggttttttcta

SEQ ID NO: 805833 - DNA, 25 bp, Mus musculus
tcagtggcacctatcggacaaaata

SEQ ID NO: 805834 - DNA, 25 bp, Mus musculus
tcagtggcacctttcggacaaaata

SEQ ID NO: 805835 - DNA, 25 bp, Mus musculus
tcagtggcagaacagattattttta

SEQ ID NO: 805836 - DNA, 25 bp, Mus musculus
tcagtggcagaagagattattttta

SEQ ID NO: 805837 - DNA, 25 bp, Mus musculus
tcagtggcagccaattgtgtagcaa

SEQ ID NO: 805838 - DNA, 25 bp, Mus musculus
tcagtggcagcctattgtgtagcaa

SEQ ID NO: 805839 - DNA, 25 bp, Mus musculus
tcagtggcattgaggtcaccatctg

SEQ ID NO: 805840 - DNA, 25 bp, Mus musculus
tcagtggcattgtggtcaccatctg

SEQ ID NO: 805841 - DNA, 25 bp, Mus musculus
tcagtggccagcaaagctccagtgg

SEQ ID NO: 805842 - DNA, 25 bp, Mus musculus
tcagtggccagcactcacgacggtt

SEQ ID NO: 805843 - DNA, 25 bp, Mus musculus
tcagtggccagctaagctccagtgg

SEQ ID NO: 805844 - DNA, 25 bp, Mus musculus
tcagtggccagctctcacgacggtt

SEQ ID NO: 805845 - DNA, 25 bp, Mus musculus
tcagtggcccaaaatctgcgtggta

SEQ ID NO: 805846 - DNA, 25 bp, Mus musculus
tcagtggcccaatatctgcgtggta

SEQ ID NO: 805847 - DNA, 25 bp, Mus musculus
tcagtggcccacactcaaggagaag

SEQ ID NO: 805848 - DNA, 25 bp, Mus musculus
tcagtggcccactctcaaggagaag

SEQ ID NO: 805849 - DNA, 25 bp, Mus musculus
tcagtggcctaaccttcattttgct

SEQ ID NO: 805850 - DNA, 25 bp, Mus musculus
tcagtggcctaagcttcattttgct

SEQ ID NO: 805851 - DNA, 25 bp, Mus musculus
tcagtggcctttcggccctggtctt

SEQ ID NO: 805852 - DNA, 25 bp, Mus musculus
tcagtggcctttgggccctggtctt

SEQ ID NO: 805853 - DNA, 25 bp, Mus musculus
tcagtggcgagacctcagtgacctt

SEQ ID NO: 805854 - DNA, 25 bp, Mus musculus
tcagtggcgagagctcagtgacctt

SEQ ID NO: 805855 - DNA, 25 bp, Mus musculus
tcagtggcgctcagagtgtatcgtc

SEQ ID NO: 805856 - DNA, 25 bp, Mus musculus
tcagtggcgctctgagtgtatcgtc

SEQ ID NO: 805857 - DNA, 25 bp, Mus musculus
tcagtggctacacggcatcaaataa

SEQ ID NO: 805858 - DNA, 25 bp, Mus musculus
tcagtggctacagggcatcaaataa

SEQ ID NO: 805859 - DNA, 25 bp, Mus musculus
tcagtggctgccacttttgaccgca

SEQ ID NO: 805860 - DNA, 25 bp, Mus musculus
tcagtggctgcctcttttgaccgca

SEQ ID NO: 805861 - DNA, 25 bp, Mus musculus
tcagtggctttcaaagagacttttt

SEQ ID NO: 805862 - DNA, 25 bp, Mus musculus
tcagtggctttctaagagacttttt

SEQ ID NO: 805863 - DNA, 25 bp, Mus musculus
tcagtggctttgaatgaaatccagt

SEQ ID NO: 805864 - DNA, 25 bp, Mus musculus
tcagtggctttgtatgaaatccagt

SEQ ID NO: 805865 - DNA, 25 bp, Mus musculus
tcagtgggacagacaggttagcatc

SEQ ID NO: 805866 - DNA, 25 bp, Mus musculus
tcagtgggacagtcaggttagcatc

SEQ ID NO: 805867 - DNA, 25 bp, Mus musculus
tcagtgggaggtcccactttgtacc

SEQ ID NO: 805868 - DNA, 25 bp, Mus musculus
tcagtgggaggtgccactttgtacc

SEQ ID NO: 805869 - DNA, 25 bp, Mus musculus
tcagtgggcacaaatgtgtcccctt

SEQ ID NO: 805870 - DNA, 25 bp, Mus musculus
tcagtgggcacatatgtgtcccctt

SEQ ID NO: 805871 - DNA, 25 bp, Mus musculus
tcagtgggccacctcagattgggaa

SEQ ID NO: 805872 - DNA, 25 bp, Mus musculus
tcagtgggccacgtcagattgggaa

SEQ ID NO: 805873 - DNA, 25 bp, Mus musculus
tcagtgggctccaatcttactatca

SEQ ID NO: 805874 - DNA, 25 bp, Mus musculus
tcagtgggctcctatcttactatca

SEQ ID NO: 805875 - DNA, 25 bp, Mus musculus
tcagtgggcttaagacttcagacaa

SEQ ID NO: 805876 - DNA, 25 bp, Mus musculus
tcagtgggcttatgacttcagacaa

SEQ ID NO: 805877 - DNA, 25 bp, Mus musculus
tcagtggggatccttggactctcca

SEQ ID NO: 805878 - DNA, 25 bp, Mus musculus
tcagtggggatcgttggactctcca

SEQ ID NO: 805879 - DNA, 25 bp, Mus musculus
tcagtgggtaagcacatttgtcacc

SEQ ID NO: 805880 - DNA, 25 bp, Mus musculus
tcagtgggtaaggacatttgtcacc

SEQ ID NO: 805881 - DNA, 25 bp, Mus musculus
tcagtgggtccacgttgtggtccat

SEQ ID NO: 805882 - DNA, 25 bp, Mus musculus
tcagtgggtccaggttgtggtccat

SEQ ID NO: 805883 - DNA, 25 bp, Mus musculus
tcagtgggtcctatgttttaaggag

SEQ ID NO: 805884 - DNA, 25 bp, Mus musculus
tcagtgggtcctttgttttaaggag

SEQ ID NO: 805885 - DNA, 25 bp, Mus musculus
tcagtggtagagcgcttgcctagca

SEQ ID NO: 805886 - DNA, 25 bp, Mus musculus
tcagtggtagagctcactcttaaca

SEQ ID NO: 805887 - DNA, 25 bp, Mus musculus
tcagtggtagagggcttgcctagca

SEQ ID NO: 805888 - DNA, 25 bp, Mus musculus
tcagtggtagaggtcactcttaaca

SEQ ID NO: 805889 - DNA, 25 bp, Mus musculus
tcagtggtagcaagcgttccaagcc

SEQ ID NO: 805890 - DNA, 25 bp, Mus musculus
tcagtggtagcatgcgttccaagcc

SEQ ID NO: 805891 - DNA, 25 bp, Mus musculus
tcagtggtaggcctctaacttgcct

SEQ ID NO: 805892 - DNA, 25 bp, Mus musculus
tcagtggtaggcgtctaacttgcct

SEQ ID NO: 805893 - DNA, 25 bp, Mus musculus
tcagtggtccggaaggaaattggca

SEQ ID NO: 805894 - DNA, 25 bp, Mus musculus
tcagtggtccggtaggaaattggca

SEQ ID NO: 805895 - DNA, 25 bp, Mus musculus
tcagtggtcctcacaggtggttata

SEQ ID NO: 805896 - DNA, 25 bp, Mus musculus
tcagtggtcctctcaggtggttata

SEQ ID NO: 805897 - DNA, 25 bp, Mus musculus
tcagtggtcggaagtgctagcccct

SEQ ID NO: 805898 - DNA, 25 bp, Mus musculus
tcagtggtcggatgtgctagcccct

SEQ ID NO: 805899 - DNA, 25 bp, Mus musculus
tcagtggtgataaatccagtaacac

SEQ ID NO: 805900 - DNA, 25 bp, Mus musculus
tcagtggtgatatatccagtaacac

SEQ ID NO: 805901 - DNA, 25 bp, Mus musculus
tcagtggtgctgacgcagtactgag

SEQ ID NO: 805902 - DNA, 25 bp, Mus musculus
tcagtggtgctgtcgcagtactgag

SEQ ID NO: 805903 - DNA, 25 bp, Mus musculus
tcagtggttgcgaggtagccttgta

SEQ ID NO: 805904 - DNA, 25 bp, Mus musculus
tcagtggttgcgtggtagccttgta

SEQ ID NO: 805905 - DNA, 25 bp, Mus musculus
tcagtggtttgtcttctttggaatc

SEQ ID NO: 805906 - DNA, 25 bp, Mus musculus
tcagtggtttgtgttctttggaatc

SEQ ID NO: 805907 - DNA, 25 bp, Mus musculus
tcagtgtaagtgcattcccaataaa

SEQ ID NO: 805908 - DNA, 25 bp, Mus musculus
tcagtgtaagtggattcccaataaa

SEQ ID NO: 805909 - DNA, 25 bp, Mus musculus
tcagtgtacagcagaggagggcctt

SEQ ID NO: 805910 - DNA, 25 bp, Mus musculus
tcagtgtacagctgaggagggcctt

SEQ ID NO: 805911 - DNA, 25 bp, Mus musculus
tcagtgtaggcacttagcacccttt

SEQ ID NO: 805912 - DNA, 25 bp, Mus musculus
tcagtgtaggcagttagcacccttt

SEQ ID NO: 805913 - DNA, 25 bp, Mus musculus
tcagtgtagtacatttcatattggt

SEQ ID NO: 805914 - DNA, 25 bp, Mus musculus
tcagtgtagtacttttcatattggt

SEQ ID NO: 805915 - DNA, 25 bp, Mus musculus
tcagtgtattacatccaggtgcttt

SEQ ID NO: 805916 - DNA, 25 bp, Mus musculus
tcagtgtattacttccaggtgcttt

SEQ ID NO: 805917 - DNA, 25 bp, Mus musculus
tcagtgtcaaccacaggcaggtctg

SEQ ID NO: 805918 - DNA, 25 bp, Mus musculus
tcagtgtcaacctcaggcaggtctg

SEQ ID NO: 805919 - DNA, 25 bp, Mus musculus
tcagtgtcagcacatctccttgtag

SEQ ID NO: 805920 - DNA, 25 bp, Mus musculus
tcagtgtcagcagatctccttgtag

SEQ ID NO: 805921 - DNA, 25 bp, Mus musculus
tcagtgtcaggaaacggctctcgga

SEQ ID NO: 805922 - DNA, 25 bp, Mus musculus
tcagtgtcaggatacggctctcgga

SEQ ID NO: 805923 - DNA, 25 bp, Mus musculus
tcagtgtcaggccactgagcctatt

SEQ ID NO: 805924 - DNA, 25 bp, Mus musculus
tcagtgtcaggcgactgagcctatt

SEQ ID NO: 805925 - DNA, 25 bp, Mus musculus
tcagtgtcaggtcctctcagtgagg

SEQ ID NO: 805926 - DNA, 25 bp, Mus musculus
tcagtgtcaggtgctctcagtgagg

SEQ ID NO: 805927 - DNA, 25 bp, Mus musculus
tcagtgtcatctcgtcatctgtgat

SEQ ID NO: 805928 - DNA, 25 bp, Mus musculus
tcagtgtcatctggtcatctgtgat

SEQ ID NO: 805929 - DNA, 25 bp, Mus musculus
tcagtgtcattaccaaagctggcag

SEQ ID NO: 805930 - DNA, 25 bp, Mus musculus
tcagtgtcattagcaaagctggcag

SEQ ID NO: 805931 - DNA, 25 bp, Mus musculus
tcagtgtccagaccctctgagcgat

SEQ ID NO: 805932 - DNA, 25 bp, Mus musculus
tcagtgtccagagcctctgagcgat

SEQ ID NO: 805933 - DNA, 25 bp, Mus musculus
tcagtgtccaggctgcagtcagact

SEQ ID NO: 805934 - DNA, 25 bp, Mus musculus
tcagtgtccagggtgcagtcagact

SEQ ID NO: 805935 - DNA, 25 bp, Mus musculus
tcagtgtccctacatctcaagtgag

SEQ ID NO: 805936 - DNA, 25 bp, Mus musculus
tcagtgtccctagatctcaagtgag

SEQ ID NO: 805937 - DNA, 25 bp, Mus musculus
tcagtgtcctagaggatgacgtcat

SEQ ID NO: 805938 - DNA, 25 bp, Mus musculus
tcagtgtcctagtggatgacgtcat

SEQ ID NO: 805939 - DNA, 25 bp, Mus musculus
tcagtgtcctgcagcggagcgtcac

SEQ ID NO: 805940 - DNA, 25 bp, Mus musculus
tcagtgtcctgctgcggagcgtcac

SEQ ID NO: 805941 - DNA, 25 bp, Mus musculus
tcagtgtcgggtagctgctgaccat

SEQ ID NO: 805942 - DNA, 25 bp, Mus musculus
tcagtgtcgggttgctgctgaccat

SEQ ID NO: 805943 - DNA, 25 bp, Mus musculus
tcagtgtcgtgcacagaggtttttc

SEQ ID NO: 805944 - DNA, 25 bp, Mus musculus
tcagtgtcgtgctcagaggtttttc

SEQ ID NO: 805945 - DNA, 25 bp, Mus musculus
tcagtgtctactccaccaggaggaa

SEQ ID NO: 805946 - DNA, 25 bp, Mus musculus
tcagtgtctactgcaccaggaggaa

SEQ ID NO: 805947 - DNA, 25 bp, Mus musculus
tcagtgtctcacactggagtagaag

SEQ ID NO: 805948 - DNA, 25 bp, Mus musculus
tcagtgtctcactctggagtagaag

SEQ ID NO: 805949 - DNA, 25 bp, Mus musculus
tcagtgtctgcacagtctttaagaa

SEQ ID NO: 805950 - DNA, 25 bp, Mus musculus
tcagtgtctgcagagtctttaagaa

SEQ ID NO: 805951 - DNA, 25 bp, Mus musculus
tcagtgtctgctaccaatgtgtcat

SEQ ID NO: 805952 - DNA, 25 bp, Mus musculus
tcagtgtctgcttccaatgtgtcat

SEQ ID NO: 805953 - DNA, 25 bp, Mus musculus
tcagtgtctggtcagatcctttgct

SEQ ID NO: 805954 - DNA, 25 bp, Mus musculus
tcagtgtctggtgagatcctttgct

SEQ ID NO: 805955 - DNA, 25 bp, Mus musculus
tcagtgtcttgcctgctatatggag

SEQ ID NO: 805956 - DNA, 25 bp, Mus musculus
tcagtgtcttgcgtgctatatggag

SEQ ID NO: 805957 - DNA, 25 bp, Mus musculus
tcagtgtgaaagatgactccgtcct

SEQ ID NO: 805958 - DNA, 25 bp, Mus musculus
tcagtgtgaaagttgactccgtcct

SEQ ID NO: 805959 - DNA, 25 bp, Mus musculus
tcagtgtgaagccatgaccatggtt

SEQ ID NO: 805960 - DNA, 25 bp, Mus musculus
tcagtgtgaagcgatgaccatggtt

SEQ ID NO: 805961 - DNA, 25 bp, Mus musculus
tcagtgtgacctcagacccaaagga

SEQ ID NO: 805962 - DNA, 25 bp, Mus musculus
tcagtgtgacctgagacccaaagga

SEQ ID NO: 805963 - DNA, 25 bp, Mus musculus
tcagtgtgaggcaccgtgcacaggc

SEQ ID NO: 805964 - DNA, 25 bp, Mus musculus
tcagtgtgaggctccgtgcacaggc

SEQ ID NO: 805965 - DNA, 25 bp, Mus musculus
tcagtgtgctcacttctcaatatac

SEQ ID NO: 805966 - DNA, 25 bp, Mus musculus
tcagtgtgctcagttctcaatatac

SEQ ID NO: 805967 - DNA, 25 bp, Mus musculus
tcagtgtggcgtcgctttatttgct

SEQ ID NO: 805968 - DNA, 25 bp, Mus musculus
tcagtgtggcgtggctttatttgct

SEQ ID NO: 805969 - DNA, 25 bp, Mus musculus
tcagtgtgggagaatttcccctcct

SEQ ID NO: 805970 - DNA, 25 bp, Mus musculus
tcagtgtgggagtatttcccctcct

SEQ ID NO: 805971 - DNA, 25 bp, Mus musculus
tcagtgtgggttcatgggaccttca

SEQ ID NO: 805972 - DNA, 25 bp, Mus musculus
tcagtgtgggttgatgggaccttca

SEQ ID NO: 805973 - DNA, 25 bp, Mus musculus
tcagtgtggtggagagcgccctcta

SEQ ID NO: 805974 - DNA, 25 bp, Mus musculus
tcagtgtggtggtgagcgccctcta

SEQ ID NO: 805975 - DNA, 25 bp, Mus musculus
tcagtgtgtatcaagttggcagttc

SEQ ID NO: 805976 - DNA, 25 bp, Mus musculus
tcagtgtgtatctagttggcagttc

SEQ ID NO: 805977 - DNA, 25 bp, Mus musculus
tcagtgtgtcccagtggccctcttc

SEQ ID NO: 805978 - DNA, 25 bp, Mus musculus
tcagtgtgtccctgtggccctcttc

SEQ ID NO: 805979 - DNA, 25 bp, Mus musculus
tcagtgtgtcttatccagggaactt

SEQ ID NO: 805980 - DNA, 25 bp, Mus musculus
tcagtgtgtcttttccagggaactt

SEQ ID NO: 805981 - DNA, 25 bp, Mus musculus
tcagtgtgtggacgtcccaggacat

SEQ ID NO: 805982 - DNA, 25 bp, Mus musculus
tcagtgtgtggaggtcccaggacat

SEQ ID NO: 805983 - DNA, 25 bp, Mus musculus
tcagtgtgtgtgattagggacagaa

SEQ ID NO: 805984 - DNA, 25 bp, Mus musculus
tcagtgtgtgtgtttagggacagaa

SEQ ID NO: 805985 - DNA, 25 bp, Mus musculus
tcagtgtgttgaacattgcatggaa

SEQ ID NO: 805986 - DNA, 25 bp, Mus musculus
tcagtgtgttgatcattgcatggaa

SEQ ID NO: 805987 - DNA, 25 bp, Mus musculus
tcagtgttacagaaggtgccggttt

SEQ ID NO: 805988 - DNA, 25 bp, Mus musculus
tcagtgttacagtaggtgccggttt

SEQ ID NO: 805989 - DNA, 25 bp, Mus musculus
tcagtgttagagcaagcatgaggcc

SEQ ID NO: 805990 - DNA, 25 bp, Mus musculus
tcagtgttagaggaagcatgaggcc

SEQ ID NO: 805991 - DNA, 25 bp, Mus musculus
tcagtgttcactagcttggcgatag

SEQ ID NO: 805992 - DNA, 25 bp, Mus musculus
tcagtgttcacttgcttggcgatag

SEQ ID NO: 805993 - DNA, 25 bp, Mus musculus
tcagtgttgctcctggaccagatga

SEQ ID NO: 805994 - DNA, 25 bp, Mus musculus
tcagtgttgctcgtggaccagatga

SEQ ID NO: 805995 - DNA, 25 bp, Mus musculus
tcagtgttgtgtcactcctatgtgt

SEQ ID NO: 805996 - DNA, 25 bp, Mus musculus
tcagtgttgtgtgactcctatgtgt

SEQ ID NO: 805997 - DNA, 25 bp, Mus musculus
tcagtgtttactccaacgtcaccgc

SEQ ID NO: 805998 - DNA, 25 bp, Mus musculus
tcagtgtttactgcaacgtcaccgc

SEQ ID NO: 805999 - DNA, 25 bp, Mus musculus
tcagtgtttccacccatttgaacct

SEQ ID NO: 806000 - DNA, 25 bp, Mus musculus
tcagtgtttccagccatttgaacct

SEQ ID NO: 806001 - DNA, 25 bp, Mus musculus
tcagtgtttctacagaccggagacg

SEQ ID NO: 806002 - DNA, 25 bp, Mus musculus
tcagtgtttctagagaccggagacg

SEQ ID NO: 806003 - DNA, 25 bp, Mus musculus
tcagtgtttctgacaagactttaaa

SEQ ID NO: 806004 - DNA, 25 bp, Mus musculus
tcagtgtttctgtcaagactttaaa

SEQ ID NO: 806005 - DNA, 25 bp, Mus musculus
tcagtgtttgaaacccacgggtggc

SEQ ID NO: 806006 - DNA, 25 bp, Mus musculus
tcagtgtttgaaattcccctgttcc

SEQ ID NO: 806007 - DNA, 25 bp, Mus musculus
tcagtgtttgaatcccacgggtggc

SEQ ID NO: 806008 - DNA, 25 bp, Mus musculus
tcagtgtttgaatttcccctgttcc

SEQ ID NO: 806009 - DNA, 25 bp, Mus musculus
tcagtgtttgtgacttatgggctta

SEQ ID NO: 806010 - DNA, 25 bp, Mus musculus
tcagtgtttgtgtcttatgggctta

SEQ ID NO: 806011 - DNA, 25 bp, Mus musculus
tcagtgttttctaatggcaatttct

SEQ ID NO: 806012 - DNA, 25 bp, Mus musculus
tcagtgttttcttatggcaatttct

SEQ ID NO: 806013 - DNA, 25 bp, Mus musculus
tcagttaaaccaccggtgggattac

SEQ ID NO: 806014 - DNA, 25 bp, Mus musculus
tcagttaaaccagcggtgggattac

SEQ ID NO: 806015 - DNA, 25 bp, Mus musculus
tcagttaaggtccatctttattaag

SEQ ID NO: 806016 - DNA, 25 bp, Mus musculus
tcagttaaggtcgatctttattaag

SEQ ID NO: 806017 - DNA, 25 bp, Mus musculus
tcagttaatacaaagctaatagctc

SEQ ID NO: 806018 - DNA, 25 bp, Mus musculus
tcagttaatacatagctaatagctc

SEQ ID NO: 806019 - DNA, 25 bp, Mus musculus
tcagttaatagaccgcttgcctcag

SEQ ID NO: 806020 - DNA, 25 bp, Mus musculus
tcagttaatagagcgcttgcctcag

SEQ ID NO: 806021 - DNA, 25 bp, Mus musculus
tcagttacacctcgcaacctaatgc

SEQ ID NO: 806022 - DNA, 25 bp, Mus musculus
tcagttacacctggcaacctaatgc

SEQ ID NO: 806023 - DNA, 25 bp, Mus musculus
tcagttacaggcctatgtccagcac

SEQ ID NO: 806024 - DNA, 25 bp, Mus musculus
tcagttacaggcgtatgtccagcac

SEQ ID NO: 806025 - DNA, 25 bp, Mus musculus
tcagttaccagacacggatgagaac

SEQ ID NO: 806026 - DNA, 25 bp, Mus musculus
tcagttaccagagacggatgagaac

SEQ ID NO: 806027 - DNA, 25 bp, Mus musculus
tcagttaccagcaccagcttgacag

SEQ ID NO: 806028 - DNA, 25 bp, Mus musculus
tcagttaccagctccagcttgacag

SEQ ID NO: 806029 - DNA, 25 bp, Mus musculus
tcagttaccattagaaagttcccct

SEQ ID NO: 806030 - DNA, 25 bp, Mus musculus
tcagttaccatttgaaagttcccct

SEQ ID NO: 806031 - DNA, 25 bp, Mus musculus
tcagttaccctgcaggctagtggca

SEQ ID NO: 806032 - DNA, 25 bp, Mus musculus
tcagttaccctggaggctagtggca

SEQ ID NO: 806033 - DNA, 25 bp, Mus musculus
tcagttacccttctgtggtccagca

SEQ ID NO: 806034 - DNA, 25 bp, Mus musculus
tcagttacccttgtgtggtccagca

SEQ ID NO: 806035 - DNA, 25 bp, Mus musculus
tcagttacctgcattattgctccat

SEQ ID NO: 806036 - DNA, 25 bp, Mus musculus
tcagttacctgctttattgctccat

SEQ ID NO: 806037 - DNA, 25 bp, Mus musculus
tcagttacctggatcctacaaatcc

SEQ ID NO: 806038 - DNA, 25 bp, Mus musculus
tcagttacctggttcctacaaatcc

SEQ ID NO: 806039 - DNA, 25 bp, Mus musculus
tcagttactaagatggacggtgtcc

SEQ ID NO: 806040 - DNA, 25 bp, Mus musculus
tcagttactaagttggacggtgtcc

SEQ ID NO: 806041 - DNA, 25 bp, Mus musculus
tcagttactcttaatgctcatgtgg

SEQ ID NO: 806042 - DNA, 25 bp, Mus musculus
tcagttactctttatgctcatgtgg

SEQ ID NO: 806043 - DNA, 25 bp, Mus musculus
tcagttagacttacagtgatctgtg

SEQ ID NO: 806044 - DNA, 25 bp, Mus musculus
tcagttagactttcagtgatctgtg

SEQ ID NO: 806045 - DNA, 25 bp, Mus musculus
tcagttagctcaccaccatttgttg

SEQ ID NO: 806046 - DNA, 25 bp, Mus musculus
tcagttagctcagcaccatttgttg

SEQ ID NO: 806047 - DNA, 25 bp, Mus musculus
tcagttaggactccatccctgtgaa

SEQ ID NO: 806048 - DNA, 25 bp, Mus musculus
tcagttaggactgcatccctgtgaa

SEQ ID NO: 806049 - DNA, 25 bp, Mus musculus
tcagttatacacatttcaaagacaa

SEQ ID NO: 806050 - DNA, 25 bp, Mus musculus
tcagttatacacttttcaaagacaa

SEQ ID NO: 806051 - DNA, 25 bp, Mus musculus
tcagttatacatctagcaccttcat

SEQ ID NO: 806052 - DNA, 25 bp, Mus musculus
tcagttatacatgtagcaccttcat

SEQ ID NO: 806053 - DNA, 25 bp, Mus musculus
tcagttatagctcgcatttccacac

SEQ ID NO: 806054 - DNA, 25 bp, Mus musculus
tcagttatagctggcatttccacac

SEQ ID NO: 806055 - DNA, 25 bp, Mus musculus
tcagttatccccagaggaccagtta

SEQ ID NO: 806056 - DNA, 25 bp, Mus musculus
tcagttatcccctgaggaccagtta

SEQ ID NO: 806057 - DNA, 25 bp, Mus musculus
tcagttatgaaaccatagcttgtgt

SEQ ID NO: 806058 - DNA, 25 bp, Mus musculus
tcagttatgaaagcatagcttgtgt

SEQ ID NO: 806059 - DNA, 25 bp, Mus musculus
tcagttatgggacggctggccagct

SEQ ID NO: 806060 - DNA, 25 bp, Mus musculus
tcagttatgggagggctggccagct

SEQ ID NO: 806061 - DNA, 25 bp, Mus musculus
tcagttattgaaactttccgatgtt

SEQ ID NO: 806062 - DNA, 25 bp, Mus musculus
tcagttattgaatctttccgatgtt

SEQ ID NO: 806063 - DNA, 25 bp, Mus musculus
tcagttcaagagaacagcccacggg

SEQ ID NO: 806064 - DNA, 25 bp, Mus musculus
tcagttcaagagtacagcccacggg

SEQ ID NO: 806065 - DNA, 25 bp, Mus musculus
tcagttcaaggtctagcacagataa

SEQ ID NO: 806066 - DNA, 25 bp, Mus musculus
tcagttcaaggtgtagcacagataa

SEQ ID NO: 806067 - DNA, 25 bp, Mus musculus
tcagttcaatgacgtgctggccgcc

SEQ ID NO: 806068 - DNA, 25 bp, Mus musculus
tcagttcaatgaggtgctggccgcc

SEQ ID NO: 806069 - DNA, 25 bp, Mus musculus
tcagttcactctcacctgtaagtac

SEQ ID NO: 806070 - DNA, 25 bp, Mus musculus
tcagttcactctgacctgtaagtac

SEQ ID NO: 806071 - DNA, 25 bp, Mus musculus
tcagttcacttcaggcttgtctcca

SEQ ID NO: 806072 - DNA, 25 bp, Mus musculus
tcagttcacttctggcttgtctcca

SEQ ID NO: 806073 - DNA, 25 bp, Mus musculus
tcagttcagaatactgcccttccca

SEQ ID NO: 806074 - DNA, 25 bp, Mus musculus
tcagttcagaattctgcccttccca

SEQ ID NO: 806075 - DNA, 25 bp, Mus musculus
tcagttcagagacgcagtctgtagg

SEQ ID NO: 806076 - DNA, 25 bp, Mus musculus
tcagttcagagaggcagtctgtagg

SEQ ID NO: 806077 - DNA, 25 bp, Mus musculus
tcagttcagcgtatgggtgggtcct

SEQ ID NO: 806078 - DNA, 25 bp, Mus musculus
tcagttcagcgtttgggtgggtcct

SEQ ID NO: 806079 - DNA, 25 bp, Mus musculus
tcagttcagggcatgaccttcatga

SEQ ID NO: 806080 - DNA, 25 bp, Mus musculus
tcagttcagggcttgaccttcatga

SEQ ID NO: 806081 - DNA, 25 bp, Mus musculus
tcagttcagtgacagctccatcata

SEQ ID NO: 806082 - DNA, 25 bp, Mus musculus
tcagttcagtgagagctccatcata

SEQ ID NO: 806083 - DNA, 25 bp, Mus musculus
tcagttcagtgcctttgagcttaga

SEQ ID NO: 806084 - DNA, 25 bp, Mus musculus
tcagttcagtgcgtttgagcttaga

SEQ ID NO: 806085 - DNA, 25 bp, Mus musculus
tcagttcatacgactttagccacac

SEQ ID NO: 806086 - DNA, 25 bp, Mus musculus
tcagttcatacgtctttagccacac

SEQ ID NO: 806087 - DNA, 25 bp, Mus musculus
tcagttcatcaaactcgtggcagag

SEQ ID NO: 806088 - DNA, 25 bp, Mus musculus
tcagttcatcaatctcgtggcagag

SEQ ID NO: 806089 - DNA, 25 bp, Mus musculus
tcagttcatgtgacctttgaaacac

SEQ ID NO: 806090 - DNA, 25 bp, Mus musculus
tcagttcatgtgtcctttgaaacac

SEQ ID NO: 806091 - DNA, 25 bp, Mus musculus
tcagttcattcccagcattcataat

SEQ ID NO: 806092 - DNA, 25 bp, Mus musculus
tcagttcattccgagcattcataat

SEQ ID NO: 806093 - DNA, 25 bp, Mus musculus
tcagttcatttcacgctcacaagaa

SEQ ID NO: 806094 - DNA, 25 bp, Mus musculus
tcagttcatttctcgctcacaagaa

SEQ ID NO: 806095 - DNA, 25 bp, Mus musculus
tcagttccagaaatccagtgcgttc

SEQ ID NO: 806096 - DNA, 25 bp, Mus musculus
tcagttccagaattccagtgcgttc

SEQ ID NO: 806097 - DNA, 25 bp, Mus musculus
tcagttcccagtactggtacatcat

SEQ ID NO: 806098 - DNA, 25 bp, Mus musculus
tcagttcccagttctggtacatcat

SEQ ID NO: 806099 - DNA, 25 bp, Mus musculus
tcagttccccttagaagataacaaa

SEQ ID NO: 806100 - DNA, 25 bp, Mus musculus
tcagttcccctttgaagataacaaa

SEQ ID NO: 806101 - DNA, 25 bp, Mus musculus
tcagttccctctaaaggccttttat

SEQ ID NO: 806102 - DNA, 25 bp, Mus musculus
tcagttccctcttaaggccttttat

SEQ ID NO: 806103 - DNA, 25 bp, Mus musculus
tcagttccctgacaggcaagtgggt

SEQ ID NO: 806104 - DNA, 25 bp, Mus musculus
tcagttccctgagaggcaagtgggt

SEQ ID NO: 806105 - DNA, 25 bp, Mus musculus
tcagttccctttctcagagctggac

SEQ ID NO: 806106 - DNA, 25 bp, Mus musculus
tcagttccctttgtcagagctggac

SEQ ID NO: 806107 - DNA, 25 bp, Mus musculus
tcagttccgactccactggtttgca

SEQ ID NO: 806108 - DNA, 25 bp, Mus musculus
tcagttccgactgcactggtttgca

SEQ ID NO: 806109 - DNA, 25 bp, Mus musculus
tcagttcctgaacattgccaagccc

SEQ ID NO: 806110 - DNA, 25 bp, Mus musculus
tcagttcctgaagattgccaagccc

SEQ ID NO: 806111 - DNA, 25 bp, Mus musculus
tcagttccttcacggaaaactaatg

SEQ ID NO: 806112 - DNA, 25 bp, Mus musculus
tcagttccttcagggaaaactaatg

SEQ ID NO: 806113 - DNA, 25 bp, Mus musculus
tcagttccttttcctaaccgcagaa

SEQ ID NO: 806114 - DNA, 25 bp, Mus musculus
tcagttccttttgctaaccgcagaa

SEQ ID NO: 806115 - DNA, 25 bp, Mus musculus
tcagttcgggagactggccatgctt

SEQ ID NO: 806116 - DNA, 25 bp, Mus musculus
tcagttcgggagtctggccatgctt

SEQ ID NO: 806117 - DNA, 25 bp, Mus musculus
tcagttctaagtctggctgtctcag

SEQ ID NO: 806118 - DNA, 25 bp, Mus musculus
tcagttctaagtgtggctgtctcag

SEQ ID NO: 806119 - DNA, 25 bp, Mus musculus
tcagttctcactatagttggtaagt

SEQ ID NO: 806120 - DNA, 25 bp, Mus musculus
tcagttctcactttagttggtaagt

SEQ ID NO: 806121 - DNA, 25 bp, Mus musculus
tcagttctccttagacatccataat

SEQ ID NO: 806122 - DNA, 25 bp, Mus musculus
tcagttctcctttgacatccataat

SEQ ID NO: 806123 - DNA, 25 bp, Mus musculus
tcagttctctttacacaacgttgtc

SEQ ID NO: 806124 - DNA, 25 bp, Mus musculus
tcagttctcttttcacaacgttgtc

SEQ ID NO: 806125 - DNA, 25 bp, Mus musculus
tcagttctgcacaatttggtttcaa

SEQ ID NO: 806126 - DNA, 25 bp, Mus musculus
tcagttctgcactatttggtttcaa

SEQ ID NO: 806127 - DNA, 25 bp, Mus musculus
tcagttctgcagacccaggcaacca

SEQ ID NO: 806128 - DNA, 25 bp, Mus musculus
tcagttctgcagtcccaggcaacca

SEQ ID NO: 806129 - DNA, 25 bp, Mus musculus
tcagttctgcttacaggccaagagc

SEQ ID NO: 806130 - DNA, 25 bp, Mus musculus
tcagttctgcttcttcagtttaaag

SEQ ID NO: 806131 - DNA, 25 bp, Mus musculus
tcagttctgcttgttcagtttaaag

SEQ ID NO: 806132 - DNA, 25 bp, Mus musculus
tcagttctgctttcaggccaagagc

SEQ ID NO: 806133 - DNA, 25 bp, Mus musculus
tcagttctgggaccgcagaccctac

SEQ ID NO: 806134 - DNA, 25 bp, Mus musculus
tcagttctgggagcgcagaccctac

SEQ ID NO: 806135 - DNA, 25 bp, Mus musculus
tcagttctgtgaccgtgaccaaagt

SEQ ID NO: 806136 - DNA, 25 bp, Mus musculus
tcagttctgtgagcgtgaccaaagt

SEQ ID NO: 806137 - DNA, 25 bp, Mus musculus
tcagttctgtggattaagaggccaa

SEQ ID NO: 806138 - DNA, 25 bp, Mus musculus
tcagttctgtggtttaagaggccaa

SEQ ID NO: 806139 - DNA, 25 bp, Mus musculus
tcagttctgtttcactctccaatat

SEQ ID NO: 806140 - DNA, 25 bp, Mus musculus
tcagttctgtttgactctccaatat

SEQ ID NO: 806141 - DNA, 25 bp, Mus musculus
tcagttcttctaattctaacacctt

SEQ ID NO: 806142 - DNA, 25 bp, Mus musculus
tcagttcttctatttctaacacctt

SEQ ID NO: 806143 - DNA, 25 bp, Mus musculus
tcagttcttgcacctgtgttttaga

SEQ ID NO: 806144 - DNA, 25 bp, Mus musculus
tcagttcttgcagctgtgttttaga

SEQ ID NO: 806145 - DNA, 25 bp, Mus musculus
tcagttctttctatagtgtgtattg

SEQ ID NO: 806146 - DNA, 25 bp, Mus musculus
tcagttctttctttagtgtgtattg

SEQ ID NO: 806147 - DNA, 25 bp, Mus musculus
tcagttgacacacattatgcggact

SEQ ID NO: 806148 - DNA, 25 bp, Mus musculus
tcagttgacacagattatgcggact

SEQ ID NO: 806149 - DNA, 25 bp, Mus musculus
tcagttgactggatttatttttgta

SEQ ID NO: 806150 - DNA, 25 bp, Mus musculus
tcagttgactggttttatttttgta

SEQ ID NO: 806151 - DNA, 25 bp, Mus musculus
tcagttgaggcaattgtaaccttct

SEQ ID NO: 806152 - DNA, 25 bp, Mus musculus
tcagttgaggcatttgtaaccttct

SEQ ID NO: 806153 - DNA, 25 bp, Mus musculus
tcagttgatacccactacctggaag

SEQ ID NO: 806154 - DNA, 25 bp, Mus musculus
tcagttgataccgactacctggaag

SEQ ID NO: 806155 - DNA, 25 bp, Mus musculus
tcagttgcacccagcaagagggagt

SEQ ID NO: 806156 - DNA, 25 bp, Mus musculus
tcagttgcaccctgcaagagggagt

SEQ ID NO: 806157 - DNA, 25 bp, Mus musculus
tcagttgcagtaccggtagctttct

SEQ ID NO: 806158 - DNA, 25 bp, Mus musculus
tcagttgcagtagcggtagctttct

SEQ ID NO: 806159 - DNA, 25 bp, Mus musculus
tcagttgcagtccttgttctggcca

SEQ ID NO: 806160 - DNA, 25 bp, Mus musculus
tcagttgcagtcgttgttctggcca

SEQ ID NO: 806161 - DNA, 25 bp, Mus musculus
tcagttgcatgaacaccacggtgtc

SEQ ID NO: 806162 - DNA, 25 bp, Mus musculus
tcagttgcatgatcaccacggtgtc

SEQ ID NO: 806163 - DNA, 25 bp, Mus musculus
tcagttgccaagctagcgggacaat

SEQ ID NO: 806164 - DNA, 25 bp, Mus musculus
tcagttgccaaggtagcgggacaat

SEQ ID NO: 806165 - DNA, 25 bp, Mus musculus
tcagttgccatcactttgactttca

SEQ ID NO: 806166 - DNA, 25 bp, Mus musculus
tcagttgccatctctttgactttca

SEQ ID NO: 806167 - DNA, 25 bp, Mus musculus
tcagttgcccaacgatcagaaatct

SEQ ID NO: 806168 - DNA, 25 bp, Mus musculus
tcagttgcccaaggatcagaaatct

SEQ ID NO: 806169 - DNA, 25 bp, Mus musculus
tcagttgcctgaattcccatacaaa

SEQ ID NO: 806170 - DNA, 25 bp, Mus musculus
tcagttgcctgatttcccatacaaa

SEQ ID NO: 806171 - DNA, 25 bp, Mus musculus
tcagttgccttacctcatgaagagt

SEQ ID NO: 806172 - DNA, 25 bp, Mus musculus
tcagttgccttagctcatgaagagt

SEQ ID NO: 806173 - DNA, 25 bp, Mus musculus
tcagttgccttcacgtagtcattat

SEQ ID NO: 806174 - DNA, 25 bp, Mus musculus
tcagttgccttctcgtagtcattat

SEQ ID NO: 806175 - DNA, 25 bp, Mus musculus
tcagttgctctcaaacctgctcata

SEQ ID NO: 806176 - DNA, 25 bp, Mus musculus
tcagttgctctcagccttaagttct

SEQ ID NO: 806177 - DNA, 25 bp, Mus musculus
tcagttgctctctaacctgctcata

SEQ ID NO: 806178 - DNA, 25 bp, Mus musculus
tcagttgctctctgccttaagttct

SEQ ID NO: 806179 - DNA, 25 bp, Mus musculus
tcagttgctgtaaatcttaagtcta

SEQ ID NO: 806180 - DNA, 25 bp, Mus musculus
tcagttgctgtatatcttaagtcta

SEQ ID NO: 806181 - DNA, 25 bp, Mus musculus
tcagttgctgtgcaatctttaaaaa

SEQ ID NO: 806182 - DNA, 25 bp, Mus musculus
tcagttgctgtggaatctttaaaaa

SEQ ID NO: 806183 - DNA, 25 bp, Mus musculus
tcagttgcttaacgccacagagccc

SEQ ID NO: 806184 - DNA, 25 bp, Mus musculus
tcagttgcttaaggccacagagccc

SEQ ID NO: 806185 - DNA, 25 bp, Mus musculus
tcagttgcttaccttaagtgatgga

SEQ ID NO: 806186 - DNA, 25 bp, Mus musculus
tcagttgcttacgttaagtgatgga

SEQ ID NO: 806187 - DNA, 25 bp, Mus musculus
tcagttggaggcattgcagccacca

SEQ ID NO: 806188 - DNA, 25 bp, Mus musculus
tcagttggaggctttgcagccacca

SEQ ID NO: 806189 - DNA, 25 bp, Mus musculus
tcagttggcggactgtttgcagaac

SEQ ID NO: 806190 - DNA, 25 bp, Mus musculus
tcagttggcggagtgtttgcagaac

SEQ ID NO: 806191 - DNA, 25 bp, Mus musculus
tcagttgggaaacctgagccttata

SEQ ID NO: 806192 - DNA, 25 bp, Mus musculus
tcagttgggaaagctgagccttata

SEQ ID NO: 806193 - DNA, 25 bp, Mus musculus
tcagttgggcccagtcacgtggttt

SEQ ID NO: 806194 - DNA, 25 bp, Mus musculus
tcagttgggccctgtcacgtggttt

SEQ ID NO: 806195 - DNA, 25 bp, Mus musculus
tcagttgggctgaagggtacctatt

SEQ ID NO: 806196 - DNA, 25 bp, Mus musculus
tcagttgggctgtagggtacctatt

SEQ ID NO: 806197 - DNA, 25 bp, Mus musculus
tcagttgggtccaccatgaaggaag

SEQ ID NO: 806198 - DNA, 25 bp, Mus musculus
tcagttgggtcctccatgaaggaag

SEQ ID NO: 806199 - DNA, 25 bp, Mus musculus
tcagttggtcaaaatttggctttaa

SEQ ID NO: 806200 - DNA, 25 bp, Mus musculus
tcagttggtcaatatttggctttaa

SEQ ID NO: 806201 - DNA, 25 bp, Mus musculus
tcagttggtgccacttagggttgaa

SEQ ID NO: 806202 - DNA, 25 bp, Mus musculus
tcagttggtgcctcttagggttgaa

SEQ ID NO: 806203 - DNA, 25 bp, Mus musculus
tcagttggtggtcctttaactaccc

SEQ ID NO: 806204 - DNA, 25 bp, Mus musculus
tcagttggtggtgctttaactaccc

SEQ ID NO: 806205 - DNA, 25 bp, Mus musculus
tcagttgtaacacggcctcagttgt

SEQ ID NO: 806206 - DNA, 25 bp, Mus musculus
tcagttgtaacagggcctcagttgt

SEQ ID NO: 806207 - DNA, 25 bp, Mus musculus
tcagttgtaactatctctttgcttt

SEQ ID NO: 806208 - DNA, 25 bp, Mus musculus
tcagttgtaactttctctttgcttt

SEQ ID NO: 806209 - DNA, 25 bp, Mus musculus
tcagttgtagttcccggtcagcgtg

SEQ ID NO: 806210 - DNA, 25 bp, Mus musculus
tcagttgtagttgccggtcagcgtg

SEQ ID NO: 806211 - DNA, 25 bp, Mus musculus
tcagttgtccagaacaggccagcat

SEQ ID NO: 806212 - DNA, 25 bp, Mus musculus
tcagttgtccagtacaggccagcat

SEQ ID NO: 806213 - DNA, 25 bp, Mus musculus
tcagttgtccccagggttgaggtcc

SEQ ID NO: 806214 - DNA, 25 bp, Mus musculus
tcagttgtcccctgggttgaggtcc

SEQ ID NO: 806215 - DNA, 25 bp, Mus musculus
tcagttgtcgacagaggactcctgc

SEQ ID NO: 806216 - DNA, 25 bp, Mus musculus
tcagttgtcgactgaggactcctgc

SEQ ID NO: 806217 - DNA, 25 bp, Mus musculus
tcagttgtcgcgctttggtttcatc

SEQ ID NO: 806218 - DNA, 25 bp, Mus musculus
tcagttgtcgcggtttggtttcatc

SEQ ID NO: 806219 - DNA, 25 bp, Mus musculus
tcagtttattagacctttcgttatt

SEQ ID NO: 806220 - DNA, 25 bp, Mus musculus
tcagtttattagtcctttcgttatt

SEQ ID NO: 806221 - DNA, 25 bp, Mus musculus
tcagtttcaaatatagacccgacca

SEQ ID NO: 806222 - DNA, 25 bp, Mus musculus
tcagtttcaaatttagacccgacca

SEQ ID NO: 806223 - DNA, 25 bp, Mus musculus
tcagtttcaaccctattgacaacct

SEQ ID NO: 806224 - DNA, 25 bp, Mus musculus
tcagtttcaaccgtattgacaacct

SEQ ID NO: 806225 - DNA, 25 bp, Mus musculus
tcagtttcatctcgcttacagctgc

SEQ ID NO: 806226 - DNA, 25 bp, Mus musculus
tcagtttcatctggcttacagctgc

SEQ ID NO: 806227 - DNA, 25 bp, Mus musculus
tcagtttcatgaaaagtgtcttgct

SEQ ID NO: 806228 - DNA, 25 bp, Mus musculus
tcagtttcatgataagtgtcttgct

SEQ ID NO: 806229 - DNA, 25 bp, Mus musculus
tcagtttcatgtcccgcttgtctag

SEQ ID NO: 806230 - DNA, 25 bp, Mus musculus
tcagtttcatgtgccgcttgtctag

SEQ ID NO: 806231 - DNA, 25 bp, Mus musculus
tcagtttcattcaccgacaatgtga

SEQ ID NO: 806232 - DNA, 25 bp, Mus musculus
tcagtttcattctccgacaatgtga

SEQ ID NO: 806233 - DNA, 25 bp, Mus musculus
tcagtttccaacacacagggcagag

SEQ ID NO: 806234 - DNA, 25 bp, Mus musculus
tcagtttccaactcacagggcagag

SEQ ID NO: 806235 - DNA, 25 bp, Mus musculus
tcagtttccattccatgaaaaattt

SEQ ID NO: 806236 - DNA, 25 bp, Mus musculus
tcagtttccattgcatgaaaaattt

SEQ ID NO: 806237 - DNA, 25 bp, Mus musculus
tcagtttcccaaaatgaacccctcg

SEQ ID NO: 806238 - DNA, 25 bp, Mus musculus
tcagtttcccaacaacctttgctac

SEQ ID NO: 806239 - DNA, 25 bp, Mus musculus
tcagtttcccaagaacctttgctac

SEQ ID NO: 806240 - DNA, 25 bp, Mus musculus
tcagtttcccaatatgaacccctcg

SEQ ID NO: 806241 - DNA, 25 bp, Mus musculus
tcagtttcccacctatcgagtaaag

SEQ ID NO: 806242 - DNA, 25 bp, Mus musculus
tcagtttcccacgtatcgagtaaag

SEQ ID NO: 806243 - DNA, 25 bp, Mus musculus
tcagtttcccatatctcccctaata

SEQ ID NO: 806244 - DNA, 25 bp, Mus musculus
tcagtttcccatttctcccctaata

SEQ ID NO: 806245 - DNA, 25 bp, Mus musculus
tcagtttccccacatttcaaggcct

SEQ ID NO: 806246 - DNA, 25 bp, Mus musculus
tcagtttccccagatttcaaggcct

SEQ ID NO: 806247 - DNA, 25 bp, Mus musculus
tcagtttcccccaaaggtcagacaa

SEQ ID NO: 806248 - DNA, 25 bp, Mus musculus
tcagtttccccctaaggtcagacaa

SEQ ID NO: 806249 - DNA, 25 bp, Mus musculus
tcagtttcccgcaaaagacagaatt

SEQ ID NO: 806250 - DNA, 25 bp, Mus musculus
tcagtttcccgctaaagacagaatt

SEQ ID NO: 806251 - DNA, 25 bp, Mus musculus
tcagtttcccgtatcaagggagttg

SEQ ID NO: 806252 - DNA, 25 bp, Mus musculus
tcagtttcccgtttcaagggagttg

SEQ ID NO: 806253 - DNA, 25 bp, Mus musculus
tcagtttccctacgtgaacgcgttt

SEQ ID NO: 806254 - DNA, 25 bp, Mus musculus
tcagtttccctaggtgaacgcgttt

SEQ ID NO: 806255 - DNA, 25 bp, Mus musculus
tcagtttccgacagacctggtcaga

SEQ ID NO: 806256 - DNA, 25 bp, Mus musculus
tcagtttccgactgacctggtcaga

SEQ ID NO: 806257 - DNA, 25 bp, Mus musculus
tcagtttccggaagcctacgggaag

SEQ ID NO: 806258 - DNA, 25 bp, Mus musculus
tcagtttccggatgcctacgggaag

SEQ ID NO: 806259 - DNA, 25 bp, Mus musculus
tcagtttcctcaatgcttagacagt

SEQ ID NO: 806260 - DNA, 25 bp, Mus musculus
tcagtttcctcattgcttagacagt

SEQ ID NO: 806261 - DNA, 25 bp, Mus musculus
tcagtttcctggcacttcagcagta

SEQ ID NO: 806262 - DNA, 25 bp, Mus musculus
tcagtttcctgggacttcagcagta

SEQ ID NO: 806263 - DNA, 25 bp, Mus musculus
tcagtttccttgatttttgcacatt

SEQ ID NO: 806264 - DNA, 25 bp, Mus musculus
tcagtttccttgttttttgcacatt

SEQ ID NO: 806265 - DNA, 25 bp, Mus musculus
tcagtttcgctgatgttggttatta

SEQ ID NO: 806266 - DNA, 25 bp, Mus musculus
tcagtttcgctgttgttggttatta

SEQ ID NO: 806267 - DNA, 25 bp, Mus musculus
tcagtttctactatcttaagctttc

SEQ ID NO: 806268 - DNA, 25 bp, Mus musculus
tcagtttctactttcttaagctttc

SEQ ID NO: 806269 - DNA, 25 bp, Mus musculus
tcagtttctaggctcagtttgtctc

SEQ ID NO: 806270 - DNA, 25 bp, Mus musculus
tcagtttctagggtcagtttgtctc

SEQ ID NO: 806271 - DNA, 25 bp, Mus musculus
tcagtttctcccatgatatccatat

SEQ ID NO: 806272 - DNA, 25 bp, Mus musculus
tcagtttctcccttgatatccatat

SEQ ID NO: 806273 - DNA, 25 bp, Mus musculus
tcagtttcttcaaccacataacagg

SEQ ID NO: 806274 - DNA, 25 bp, Mus musculus
tcagtttcttcatccacataacagg

SEQ ID NO: 806275 - DNA, 25 bp, Mus musculus
tcagtttgaaccaccttgttcctaa

SEQ ID NO: 806276 - DNA, 25 bp, Mus musculus
tcagtttgaacctccttgttcctaa

SEQ ID NO: 806277 - DNA, 25 bp, Mus musculus
tcagtttgaatcatccgcagctcag

SEQ ID NO: 806278 - DNA, 25 bp, Mus musculus
tcagtttgaatcttccgcagctcag

SEQ ID NO: 806279 - DNA, 25 bp, Mus musculus
tcagtttgactgcagtgctatcact

SEQ ID NO: 806280 - DNA, 25 bp, Mus musculus
tcagtttgactggagtgctatcact

SEQ ID NO: 806281 - DNA, 25 bp, Mus musculus
tcagtttgattcatgcttcttccat

SEQ ID NO: 806282 - DNA, 25 bp, Mus musculus
tcagtttgattcttgcttcttccat

SEQ ID NO: 806283 - DNA, 25 bp, Mus musculus
tcagtttgatttcccgaaggcttaa

SEQ ID NO: 806284 - DNA, 25 bp, Mus musculus
tcagtttgatttgccgaaggcttaa

SEQ ID NO: 806285 - DNA, 25 bp, Mus musculus
tcagtttgcagcagccgagcggctc

SEQ ID NO: 806286 - DNA, 25 bp, Mus musculus
tcagtttgcagcagctctagaaccc

SEQ ID NO: 806287 - DNA, 25 bp, Mus musculus
tcagtttgcagctgccgagcggctc

SEQ ID NO: 806288 - DNA, 25 bp, Mus musculus
tcagtttgcagctgctctagaaccc

SEQ ID NO: 806289 - DNA, 25 bp, Mus musculus
tcagtttgcaggctccagtgcggat

SEQ ID NO: 806290 - DNA, 25 bp, Mus musculus
tcagtttgcagggtccagtgcggat

SEQ ID NO: 806291 - DNA, 25 bp, Mus musculus
tcagtttgcataccccatcccaggt

SEQ ID NO: 806292 - DNA, 25 bp, Mus musculus
tcagtttgcatagcccatcccaggt

SEQ ID NO: 806293 - DNA, 25 bp, Mus musculus
tcagtttgtatcagcctgctgggtt

SEQ ID NO: 806294 - DNA, 25 bp, Mus musculus
tcagtttgtatccaaagctggcctt

SEQ ID NO: 806295 - DNA, 25 bp, Mus musculus
tcagtttgtatcgaaagctggcctt

SEQ ID NO: 806296 - DNA, 25 bp, Mus musculus
tcagtttgtatctgcctgctgggtt

SEQ ID NO: 806297 - DNA, 25 bp, Mus musculus
tcagtttgtttgagccctggcattt

SEQ ID NO: 806298 - DNA, 25 bp, Mus musculus
tcagtttgtttgtgccctggcattt

SEQ ID NO: 806299 - DNA, 25 bp, Mus musculus
tcagttttaactcgaaatcatcaca

SEQ ID NO: 806300 - DNA, 25 bp, Mus musculus
tcagttttaactggaaatcatcaca

SEQ ID NO: 806301 - DNA, 25 bp, Mus musculus
tcagttttacagaaggctttgtttc

SEQ ID NO: 806302 - DNA, 25 bp, Mus musculus
tcagttttacagtaggctttgtttc

SEQ ID NO: 806303 - DNA, 25 bp, Mus musculus
tcagttttcaaaaacccacaggcgc

SEQ ID NO: 806304 - DNA, 25 bp, Mus musculus
tcagttttcaaatacccacaggcgc

SEQ ID NO: 806305 - DNA, 25 bp, Mus musculus
tcagttttccccctgattagcattt

SEQ ID NO: 806306 - DNA, 25 bp, Mus musculus
tcagttttccccgtgattagcattt

SEQ ID NO: 806307 - DNA, 25 bp, Mus musculus
tcagttttccggacgcagcgcggag

SEQ ID NO: 806308 - DNA, 25 bp, Mus musculus
tcagttttccggtcgcagcgcggag

SEQ ID NO: 806309 - DNA, 25 bp, Mus musculus
tcagttttcctcaagcttcatgtga

SEQ ID NO: 806310 - DNA, 25 bp, Mus musculus
tcagttttcctctagcttcatgtga

SEQ ID NO: 806311 - DNA, 25 bp, Mus musculus
tcagttttcgctatacctaattcat

SEQ ID NO: 806312 - DNA, 25 bp, Mus musculus
tcagttttcgctttacctaattcat

SEQ ID NO: 806313 - DNA, 25 bp, Mus musculus
tcagttttcggcctcggttagttgg

SEQ ID NO: 806314 - DNA, 25 bp, Mus musculus
tcagttttcggcgtcggttagttgg

SEQ ID NO: 806315 - DNA, 25 bp, Mus musculus
tcagttttgaaaagccagccgccgc

SEQ ID NO: 806316 - DNA, 25 bp, Mus musculus
tcagttttgaaatgccagccgccgc

SEQ ID NO: 806317 - DNA, 25 bp, Mus musculus
tcagttttgaagcttcttccccgca

SEQ ID NO: 806318 - DNA, 25 bp, Mus musculus
tcagttttgaaggttcttccccgca

SEQ ID NO: 806319 - DNA, 25 bp, Mus musculus
tcagttttgattctgtttccccagt

SEQ ID NO: 806320 - DNA, 25 bp, Mus musculus
tcagttttgattgtgtttccccagt

SEQ ID NO: 806321 - DNA, 25 bp, Mus musculus
tcagttttggtcactggtgatggca

SEQ ID NO: 806322 - DNA, 25 bp, Mus musculus
tcagttttggtctctggtgatggca

SEQ ID NO: 806323 - DNA, 25 bp, Mus musculus
tcagttttggttccctgggtccaat

SEQ ID NO: 806324 - DNA, 25 bp, Mus musculus
tcagttttggttgcctgggtccaat

SEQ ID NO: 806325 - DNA, 25 bp, Mus musculus
tcagttttgtcaccagccctttttg

SEQ ID NO: 806326 - DNA, 25 bp, Mus musculus
tcagttttgtcagcagccctttttg

SEQ ID NO: 806327 - DNA, 25 bp, Mus musculus
tcagttttgtgaagtgctggtaatt

SEQ ID NO: 806328 - DNA, 25 bp, Mus musculus
tcagttttgtgatgtgctggtaatt

SEQ ID NO: 806329 - DNA, 25 bp, Mus musculus
tcagttttgttacacccagcccctg

SEQ ID NO: 806330 - DNA, 25 bp, Mus musculus
tcagttttgttagacccagcccctg

SEQ ID NO: 806331 - DNA, 25 bp, Mus musculus
tcagttttgtttacaaccctcaact

SEQ ID NO: 806332 - DNA, 25 bp, Mus musculus
tcagttttgttttcaaccctcaact

SEQ ID NO: 806333 - DNA, 25 bp, Mus musculus
tcagtttttagtagaagtttcttag

SEQ ID NO: 806334 - DNA, 25 bp, Mus musculus
tcagtttttagttgaagtttcttag

SEQ ID NO: 806335 - DNA, 25 bp, Mus musculus
tcagtttttcatagtcttgacctta

SEQ ID NO: 806336 - DNA, 25 bp, Mus musculus
tcagtttttcattgtcttgacctta

SEQ ID NO: 806337 - DNA, 25 bp, Mus musculus
tcagtttttcccagtagggcttcca

SEQ ID NO: 806338 - DNA, 25 bp, Mus musculus
tcagtttttcccctgaggaggccag

SEQ ID NO: 806339 - DNA, 25 bp, Mus musculus
tcagtttttcccgtgaggaggccag

SEQ ID NO: 806340 - DNA, 25 bp, Mus musculus
tcagtttttccctgtagggcttcca

SEQ ID NO: 806341 - DNA, 25 bp, Mus musculus
tcagtttttggaaccggttgtgtgg

SEQ ID NO: 806342 - DNA, 25 bp, Mus musculus
tcagtttttggatccggttgtgtgg

SEQ ID NO: 806343 - DNA, 25 bp, Mus musculus
tcagttttttgaaatcttgctcagc

SEQ ID NO: 806344 - DNA, 25 bp, Mus musculus
tcagttttttgatatcttgctcagc

SEQ ID NO: 806345 - DNA, 25 bp, Mus musculus
tcataaacccctagaagcaatctcc

SEQ ID NO: 806346 - DNA, 25 bp, Mus musculus
tcataaaccccttgaagcaatctcc

SEQ ID NO: 806347 - DNA, 25 bp, Mus musculus
tcataaacggttatgcctcttttgg

SEQ ID NO: 806348 - DNA, 25 bp, Mus musculus
tcataaacggttttgcctcttttgg

SEQ ID NO: 806349 - DNA, 25 bp, Mus musculus
tcataaagccagactcttcagatgt

SEQ ID NO: 806350 - DNA, 25 bp, Mus musculus
tcataaagccagtctcttcagatgt

SEQ ID NO: 806351 - DNA, 25 bp, Mus musculus
tcataaagcccaagatgctcccgtg

SEQ ID NO: 806352 - DNA, 25 bp, Mus musculus
tcataaagcccatgatgctcccgtg

SEQ ID NO: 806353 - DNA, 25 bp, Mus musculus
tcataaaggactcacctgattctcc

SEQ ID NO: 806354 - DNA, 25 bp, Mus musculus
tcataaaggactgacctgattctcc

SEQ ID NO: 806355 - DNA, 25 bp, Mus musculus
tcataaagtaaaacgccccccgctg

SEQ ID NO: 806356 - DNA, 25 bp, Mus musculus
tcataaagtaaatcgccccccgctg

SEQ ID NO: 806357 - DNA, 25 bp, Mus musculus
tcataaagtgttattagccacctct

SEQ ID NO: 806358 - DNA, 25 bp, Mus musculus
tcataaagtgtttttagccacctct

SEQ ID NO: 806359 - DNA, 25 bp, Mus musculus
tcataaagttgtctcccagatctcc

SEQ ID NO: 806360 - DNA, 25 bp, Mus musculus
tcataaagttgtgtcccagatctcc

SEQ ID NO: 806361 - DNA, 25 bp, Mus musculus
tcataaagtttaaagcagcatcata

SEQ ID NO: 806362 - DNA, 25 bp, Mus musculus
tcataaagtttatagcagcatcata

SEQ ID NO: 806363 - DNA, 25 bp, Mus musculus
tcataaatctgactgttccccatct

SEQ ID NO: 806364 - DNA, 25 bp, Mus musculus
tcataaatctgagtgttccccatct

SEQ ID NO: 806365 - DNA, 25 bp, Mus musculus
tcataaatgcttatctaacagggtt

SEQ ID NO: 806366 - DNA, 25 bp, Mus musculus
tcataaatgcttttctaacagggtt

SEQ ID NO: 806367 - DNA, 25 bp, Mus musculus
tcataacccattactttaacctctt

SEQ ID NO: 806368 - DNA, 25 bp, Mus musculus
tcataacccatttctttaacctctt

SEQ ID NO: 806369 - DNA, 25 bp, Mus musculus
tcataaccgggcacttccttttaag

SEQ ID NO: 806370 - DNA, 25 bp, Mus musculus
tcataaccgggctcttccttttaag

SEQ ID NO: 806371 - DNA, 25 bp, Mus musculus
tcataacctgagatttaagttgtgc

SEQ ID NO: 806372 - DNA, 25 bp, Mus musculus
tcataacctgagttttaagttgtgc

SEQ ID NO: 806373 - DNA, 25 bp, Mus musculus
tcataacgcaacagacctcctaggg

SEQ ID NO: 806374 - DNA, 25 bp, Mus musculus
tcataacgcaactgacctcctaggg

SEQ ID NO: 806375 - DNA, 25 bp, Mus musculus
tcataacgttgcagtgagaactata

SEQ ID NO: 806376 - DNA, 25 bp, Mus musculus
tcataacgttgctgtgagaactata

SEQ ID NO: 806377 - DNA, 25 bp, Mus musculus
tcataactatatcacccccataaga

SEQ ID NO: 806378 - DNA, 25 bp, Mus musculus
tcataactatatgacccccataaga

SEQ ID NO: 806379 - DNA, 25 bp, Mus musculus
tcataactgaacatacctaagcata

SEQ ID NO: 806380 - DNA, 25 bp, Mus musculus
tcataactgaacttacctaagcata

SEQ ID NO: 806381 - DNA, 25 bp, Mus musculus
tcataactttgcactgctctcctgg

SEQ ID NO: 806382 - DNA, 25 bp, Mus musculus
tcataactttgctctgctctcctgg

SEQ ID NO: 806383 - DNA, 25 bp, Mus musculus
tcataacttttacaacgaaacaatt

SEQ ID NO: 806384 - DNA, 25 bp, Mus musculus
tcataacttttagaacgaaacaatt

SEQ ID NO: 806385 - DNA, 25 bp, Mus musculus
tcataagaaggtcccttcctagttt

SEQ ID NO: 806386 - DNA, 25 bp, Mus musculus
tcataagaaggtgccttcctagttt

SEQ ID NO: 806387 - DNA, 25 bp, Mus musculus
tcataagaatccatccttggtcctg

SEQ ID NO: 806388 - DNA, 25 bp, Mus musculus
tcataagaatccttccttggtcctg

SEQ ID NO: 806389 - DNA, 25 bp, Mus musculus
tcataagatgatcggacaggccagg

SEQ ID NO: 806390 - DNA, 25 bp, Mus musculus
tcataagatgatgggacaggccagg

SEQ ID NO: 806391 - DNA, 25 bp, Mus musculus
tcataagatgctatcaccccacatt

SEQ ID NO: 806392 - DNA, 25 bp, Mus musculus
tcataagatgctttcaccccacatt

SEQ ID NO: 806393 - DNA, 25 bp, Mus musculus
tcataagattgccaaaatggagcat

SEQ ID NO: 806394 - DNA, 25 bp, Mus musculus
tcataagattgcgaaaatggagcat

SEQ ID NO: 806395 - DNA, 25 bp, Mus musculus
tcataagccagaactgtacctgaga

SEQ ID NO: 806396 - DNA, 25 bp, Mus musculus
tcataagccagatctgtacctgaga

SEQ ID NO: 806397 - DNA, 25 bp, Mus musculus
tcataaggacatcccagcttctggt

SEQ ID NO: 806398 - DNA, 25 bp, Mus musculus
tcataaggacatgccagcttctggt

SEQ ID NO: 806399 - DNA, 25 bp, Mus musculus
tcataaggacttagaccactacatc

SEQ ID NO: 806400 - DNA, 25 bp, Mus musculus
tcataaggactttgaccactacatc

SEQ ID NO: 806401 - DNA, 25 bp, Mus musculus
tcataaggcttacccagctaactgc

SEQ ID NO: 806402 - DNA, 25 bp, Mus musculus
tcataaggcttagccagctaactgc

SEQ ID NO: 806403 - DNA, 25 bp, Mus musculus
tcataagttactcccttttgtttgc

SEQ ID NO: 806404 - DNA, 25 bp, Mus musculus
tcataagttactgccttttgtttgc

SEQ ID NO: 806405 - DNA, 25 bp, Mus musculus
tcataagttatccaacatttcctca

SEQ ID NO: 806406 - DNA, 25 bp, Mus musculus
tcataagttatcgaacatttcctca

SEQ ID NO: 806407 - DNA, 25 bp, Mus musculus
tcataagttatgattcagattttca

SEQ ID NO: 806408 - DNA, 25 bp, Mus musculus
tcataagttatgtttcagattttca

SEQ ID NO: 806409 - DNA, 25 bp, Mus musculus
tcataagttcaactacagcctgcat

SEQ ID NO: 806410 - DNA, 25 bp, Mus musculus
tcataagttcaagtacagcctgcat

SEQ ID NO: 806411 - DNA, 25 bp, Mus musculus
tcataagttgataatttgtgactca

SEQ ID NO: 806412 - DNA, 25 bp, Mus musculus
tcataagttgattatttgtgactca

SEQ ID NO: 806413 - DNA, 25 bp, Mus musculus
tcataataatttcccgttttctctg

SEQ ID NO: 806414 - DNA, 25 bp, Mus musculus
tcataataatttgccgttttctctg

SEQ ID NO: 806415 - DNA, 25 bp, Mus musculus
tcataatacccacctttcgtcatat

SEQ ID NO: 806416 - DNA, 25 bp, Mus musculus
tcataatacccagctttcgtcatat

SEQ ID NO: 806417 - DNA, 25 bp, Mus musculus
tcataatatactcattgcctgctct

SEQ ID NO: 806418 - DNA, 25 bp, Mus musculus
tcataatatactgattgcctgctct

SEQ ID NO: 806419 - DNA, 25 bp, Mus musculus
tcataatatagcacaggttgccttc

SEQ ID NO: 806420 - DNA, 25 bp, Mus musculus
tcataatatagctcaggttgccttc

SEQ ID NO: 806421 - DNA, 25 bp, Mus musculus
tcataatatgccacgaattccaccc

SEQ ID NO: 806422 - DNA, 25 bp, Mus musculus
tcataatatgcctcgaattccaccc

SEQ ID NO: 806423 - DNA, 25 bp, Mus musculus
tcataatatgttaacacttcttcag

SEQ ID NO: 806424 - DNA, 25 bp, Mus musculus
tcataatatgtttacacttcttcag

SEQ ID NO: 806425 - DNA, 25 bp, Mus musculus
tcataatcagcccatagccatgcat

SEQ ID NO: 806426 - DNA, 25 bp, Mus musculus
tcataatcagccgatagccatgcat

SEQ ID NO: 806427 - DNA, 25 bp, Mus musculus
tcataatcagctagggcagggccct

SEQ ID NO: 806428 - DNA, 25 bp, Mus musculus
tcataatcagcttgggcagggccct

SEQ ID NO: 806429 - DNA, 25 bp, Mus musculus
tcataatccacaacccagaacctga

SEQ ID NO: 806430 - DNA, 25 bp, Mus musculus
tcataatccacatcccagaacctga

SEQ ID NO: 806431 - DNA, 25 bp, Mus musculus
tcataatcctttatccctttgactc

SEQ ID NO: 806432 - DNA, 25 bp, Mus musculus
tcataatcctttttccctttgactc

SEQ ID NO: 806433 - DNA, 25 bp, Mus musculus
tcataatctcatagtggccagtccc

SEQ ID NO: 806434 - DNA, 25 bp, Mus musculus
tcataatctcattgtggccagtccc

SEQ ID NO: 806435 - DNA, 25 bp, Mus musculus
tcataatctggtacttgtgcccggg

SEQ ID NO: 806436 - DNA, 25 bp, Mus musculus
tcataatctggttcttgtgcccggg

SEQ ID NO: 806437 - DNA, 25 bp, Mus musculus
tcataatcttacatgcttcttttct

SEQ ID NO: 806438 - DNA, 25 bp, Mus musculus
tcataatcttacttgcttcttttct

SEQ ID NO: 806439 - DNA, 25 bp, Mus musculus
tcataatcttctcacccatgctgga

SEQ ID NO: 806440 - DNA, 25 bp, Mus musculus
tcataatcttctgacccatgctgga

SEQ ID NO: 806441 - DNA, 25 bp, Mus musculus
tcataatgaaacatacaactttgta

SEQ ID NO: 806442 - DNA, 25 bp, Mus musculus
tcataatgaaacttacaactttgta

SEQ ID NO: 806443 - DNA, 25 bp, Mus musculus
tcataattagtgacgtatgcgacgt

SEQ ID NO: 806444 - DNA, 25 bp, Mus musculus
tcataattagtgtcgtatgcgacgt

SEQ ID NO: 806445 - DNA, 25 bp, Mus musculus
tcataattattcctgtgatggtaac

SEQ ID NO: 806446 - DNA, 25 bp, Mus musculus
tcataattattcgtgtgatggtaac

SEQ ID NO: 806447 - DNA, 25 bp, Mus musculus
tcataatttagacgcgtagacagtt

SEQ ID NO: 806448 - DNA, 25 bp, Mus musculus
tcataatttagaggcgtagacagtt

SEQ ID NO: 806449 - DNA, 25 bp, Mus musculus
tcataatttgccagggttcccatat

SEQ ID NO: 806450 - DNA, 25 bp, Mus musculus
tcataatttgcctgggttcccatat

SEQ ID NO: 806451 - DNA, 25 bp, Mus musculus
tcataattttccagctcctgagtat

SEQ ID NO: 806452 - DNA, 25 bp, Mus musculus
tcataattttcctgctcctgagtat

SEQ ID NO: 806453 - DNA, 25 bp, Mus musculus
tcataattttctcccagttcactgg

SEQ ID NO: 806454 - DNA, 25 bp, Mus musculus
tcataattttctgccagttcactgg

SEQ ID NO: 806455 - DNA, 25 bp, Mus musculus
tcatacaaagctagcctcagggtcc

SEQ ID NO: 806456 - DNA, 25 bp, Mus musculus
tcatacaaagcttgcctcagggtcc

SEQ ID NO: 806457 - DNA, 25 bp, Mus musculus
tcatacaagtttagctaatgctgtt

SEQ ID NO: 806458 - DNA, 25 bp, Mus musculus
tcatacaagttttgctaatgctgtt

SEQ ID NO: 806459 - DNA, 25 bp, Mus musculus
tcatacacatggattcgaggacaca

SEQ ID NO: 806460 - DNA, 25 bp, Mus musculus
tcatacacatggtttcgaggacaca

SEQ ID NO: 806461 - DNA, 25 bp, Mus musculus
tcatacaccggcacacgtgtttcag

SEQ ID NO: 806462 - DNA, 25 bp, Mus musculus
tcatacaccggctcacgtgtttcag

SEQ ID NO: 806463 - DNA, 25 bp, Mus musculus
tcatacacctgaatgattcctataa

SEQ ID NO: 806464 - DNA, 25 bp, Mus musculus
tcatacacctgattgattcctataa

SEQ ID NO: 806465 - DNA, 25 bp, Mus musculus
tcatacacttgtcttgctcatttcc

SEQ ID NO: 806466 - DNA, 25 bp, Mus musculus
tcatacacttgtgttgctcatttcc

SEQ ID NO: 806467 - DNA, 25 bp, Mus musculus
tcatacagttgcacccaagttgctg

SEQ ID NO: 806468 - DNA, 25 bp, Mus musculus
tcatacagttgctcccaagttgctg

SEQ ID NO: 806469 - DNA, 25 bp, Mus musculus
tcatacatgtagctactgggaccca

SEQ ID NO: 806470 - DNA, 25 bp, Mus musculus
tcatacatgtaggtactgggaccca

SEQ ID NO: 806471 - DNA, 25 bp, Mus musculus
tcatacattctcagtgatactcaat

SEQ ID NO: 806472 - DNA, 25 bp, Mus musculus
tcatacattctctgtgatactcaat

SEQ ID NO: 806473 - DNA, 25 bp, Mus musculus
tcatacatttaaacccttagtccca

SEQ ID NO: 806474 - DNA, 25 bp, Mus musculus
tcatacatttaatcccttagtccca

SEQ ID NO: 806475 - DNA, 25 bp, Mus musculus
tcataccaacatatcctctgaggaa

SEQ ID NO: 806476 - DNA, 25 bp, Mus musculus
tcataccaacatttcctctgaggaa

SEQ ID NO: 806477 - DNA, 25 bp, Mus musculus
tcataccacctgaaagctgcctgca

SEQ ID NO: 806478 - DNA, 25 bp, Mus musculus
tcataccacctgtaagctgcctgca

SEQ ID NO: 806479 - DNA, 25 bp, Mus musculus
tcataccagcacatcactatgcatc

SEQ ID NO: 806480 - DNA, 25 bp, Mus musculus
tcataccagcacttcactatgcatc

SEQ ID NO: 806481 - DNA, 25 bp, Mus musculus
tcataccatgccctatttttaccat

SEQ ID NO: 806482 - DNA, 25 bp, Mus musculus
tcataccatgccgtatttttaccat

SEQ ID NO: 806483 - DNA, 25 bp, Mus musculus
tcataccattccatgcctggtgaag

SEQ ID NO: 806484 - DNA, 25 bp, Mus musculus
tcataccattccttgcctggtgaag

SEQ ID NO: 806485 - DNA, 25 bp, Mus musculus
tcataccattctatttccactaata

SEQ ID NO: 806486 - DNA, 25 bp, Mus musculus
tcataccattctttttccactaata

SEQ ID NO: 806487 - DNA, 25 bp, Mus musculus
tcatacccaatgaggagatcctaca

SEQ ID NO: 806488 - DNA, 25 bp, Mus musculus
tcatacccaatgtggagatcctaca

SEQ ID NO: 806489 - DNA, 25 bp, Mus musculus
tcatacccagtcatacctacaaaat

SEQ ID NO: 806490 - DNA, 25 bp, Mus musculus
tcatacccagtcttacctacaaaat

SEQ ID NO: 806491 - DNA, 25 bp, Mus musculus
tcatacccataacatggcactcagt

SEQ ID NO: 806492 - DNA, 25 bp, Mus musculus
tcatacccataagatggcactcagt

SEQ ID NO: 806493 - DNA, 25 bp, Mus musculus
tcatacccctcaaaaggtctgctat

SEQ ID NO: 806494 - DNA, 25 bp, Mus musculus
tcatacccctcataaggtctgctat

SEQ ID NO: 806495 - DNA, 25 bp, Mus musculus
tcatacccgttgcagctggttctgg

SEQ ID NO: 806496 - DNA, 25 bp, Mus musculus
tcatacccgttggagctggttctgg

SEQ ID NO: 806497 - DNA, 25 bp, Mus musculus
tcataccctatgactactgaagcag

SEQ ID NO: 806498 - DNA, 25 bp, Mus musculus
tcataccctatgtctactgaagcag

SEQ ID NO: 806499 - DNA, 25 bp, Mus musculus
tcataccctgagctattcttatatt

SEQ ID NO: 806500 - DNA, 25 bp, Mus musculus
tcataccctgaggtattcttatatt

SEQ ID NO: 806501 - DNA, 25 bp, Mus musculus
tcataccgccttcggagcactgagc

SEQ ID NO: 806502 - DNA, 25 bp, Mus musculus
tcataccgccttgggagcactgagc

SEQ ID NO: 806503 - DNA, 25 bp, Mus musculus
tcatacctagctctgaagtgctgtg

SEQ ID NO: 806504 - DNA, 25 bp, Mus musculus
tcatacctagctgtgaagtgctgtg

SEQ ID NO: 806505 - DNA, 25 bp, Mus musculus
tcatacctagggactgctccgaagc

SEQ ID NO: 806506 - DNA, 25 bp, Mus musculus
tcatacctagggtctgctccgaagc

SEQ ID NO: 806507 - DNA, 25 bp, Mus musculus
tcatacctctcccaatggtggcttt

SEQ ID NO: 806508 - DNA, 25 bp, Mus musculus
tcatacctctccgaatggtggcttt

SEQ ID NO: 806509 - DNA, 25 bp, Mus musculus
tcatacctgaccaaatagccgcctt

SEQ ID NO: 806510 - DNA, 25 bp, Mus musculus
tcatacctgacctaatagccgcctt

SEQ ID NO: 806511 - DNA, 25 bp, Mus musculus
tcatacctggcaagtgaccccggga

SEQ ID NO: 806512 - DNA, 25 bp, Mus musculus
tcatacctggcatgtgaccccggga

SEQ ID NO: 806513 - DNA, 25 bp, Mus musculus
tcatacctgtgtcctcgagggcctc

SEQ ID NO: 806514 - DNA, 25 bp, Mus musculus
tcatacctgtgtgctcgagggcctc

SEQ ID NO: 806515 - DNA, 25 bp, Mus musculus
tcataccttagcaccgtccagtgtt

SEQ ID NO: 806516 - DNA, 25 bp, Mus musculus
tcataccttagctccgtccagtgtt

SEQ ID NO: 806517 - DNA, 25 bp, Mus musculus
tcataccttaggatactccttcccg

SEQ ID NO: 806518 - DNA, 25 bp, Mus musculus
tcataccttaggttactccttcccg

SEQ ID NO: 806519 - DNA, 25 bp, Mus musculus
tcataccttattaggcattgctggg

SEQ ID NO: 806520 - DNA, 25 bp, Mus musculus
tcataccttatttggcattgctggg

SEQ ID NO: 806521 - DNA, 25 bp, Mus musculus
tcatacgacacgacctaagcgggaa

SEQ ID NO: 806522 - DNA, 25 bp, Mus musculus
tcatacgacacgtcctaagcgggaa

SEQ ID NO: 806523 - DNA, 25 bp, Mus musculus
tcatacgatcctacttcatgtaaag

SEQ ID NO: 806524 - DNA, 25 bp, Mus musculus
tcatacgatccttcttcatgtaaag

SEQ ID NO: 806525 - DNA, 25 bp, Mus musculus
tcatacgcagctcatcttaaaccaa

SEQ ID NO: 806526 - DNA, 25 bp, Mus musculus
tcatacgcagctgatcttaaaccaa

SEQ ID NO: 806527 - DNA, 25 bp, Mus musculus
tcatacgctgagcagaacgagtgct

SEQ ID NO: 806528 - DNA, 25 bp, Mus musculus
tcatacgctgaggagaacgagtgct

SEQ ID NO: 806529 - DNA, 25 bp, Mus musculus
tcatacgtatggcacctacacttaa

SEQ ID NO: 806530 - DNA, 25 bp, Mus musculus
tcatacgtatgggacctacacttaa

SEQ ID NO: 806531 - DNA, 25 bp, Mus musculus
tcatactaccagaagctcatgtttt

SEQ ID NO: 806532 - DNA, 25 bp, Mus musculus
tcatactaccagtagctcatgtttt

SEQ ID NO: 806533 - DNA, 25 bp, Mus musculus
tcatactatagcagggcagaggcat

SEQ ID NO: 806534 - DNA, 25 bp, Mus musculus
tcatactatagctgggcagaggcat

SEQ ID NO: 806535 - DNA, 25 bp, Mus musculus
tcatactattctaaccaggctggct

SEQ ID NO: 806536 - DNA, 25 bp, Mus musculus
tcatactattcttaccaggctggct

SEQ ID NO: 806537 - DNA, 25 bp, Mus musculus
tcatactcacaactggacgctctgt

SEQ ID NO: 806538 - DNA, 25 bp, Mus musculus
tcatactcacaagtggacgctctgt

SEQ ID NO: 806539 - DNA, 25 bp, Mus musculus
tcatactcatagctctgggagccag

SEQ ID NO: 806540 - DNA, 25 bp, Mus musculus
tcatactcataggtctgggagccag

SEQ ID NO: 806541 - DNA, 25 bp, Mus musculus
tcatactcccagaaaccagctacaa

SEQ ID NO: 806542 - DNA, 25 bp, Mus musculus
tcatactcccagtaaccagctacaa

SEQ ID NO: 806543 - DNA, 25 bp, Mus musculus
tcatactctctcaacaccggttgtg

SEQ ID NO: 806544 - DNA, 25 bp, Mus musculus
tcatactctctctacaccggttgtg

SEQ ID NO: 806545 - DNA, 25 bp, Mus musculus
tcatactgaaagctgtgggacagca

SEQ ID NO: 806546 - DNA, 25 bp, Mus musculus
tcatactgaaaggtgtgggacagca

SEQ ID NO: 806547 - DNA, 25 bp, Mus musculus
tcatactgcaaccaatatggacaga

SEQ ID NO: 806548 - DNA, 25 bp, Mus musculus
tcatactgcaacgaatatggacaga

SEQ ID NO: 806549 - DNA, 25 bp, Mus musculus
tcatactgtcagaggaagcaagtgt

SEQ ID NO: 806550 - DNA, 25 bp, Mus musculus
tcatactgtcagtggaagcaagtgt

SEQ ID NO: 806551 - DNA, 25 bp, Mus musculus
tcatacttaaagctacactggtttt

SEQ ID NO: 806552 - DNA, 25 bp, Mus musculus
tcatacttaaaggtacactggtttt

SEQ ID NO: 806553 - DNA, 25 bp, Mus musculus
tcatacttgagactccgcagagaag

SEQ ID NO: 806554 - DNA, 25 bp, Mus musculus
tcatacttgagagtccgcagagaag

SEQ ID NO: 806555 - DNA, 25 bp, Mus musculus
tcatacttggaacaaacccctttgg

SEQ ID NO: 806556 - DNA, 25 bp, Mus musculus
tcatacttggaagaaacccctttgg

SEQ ID NO: 806557 - DNA, 25 bp, Mus musculus
tcatacttgtttcttctacaatggg

SEQ ID NO: 806558 - DNA, 25 bp, Mus musculus
tcatacttgtttgttctacaatggg

SEQ ID NO: 806559 - DNA, 25 bp, Mus musculus
tcatactttttactttaggacttgg

SEQ ID NO: 806560 - DNA, 25 bp, Mus musculus
tcatactttttagtttaggacttgg

SEQ ID NO: 806561 - DNA, 25 bp, Mus musculus
tcatagaaaaacacatacctaagag

SEQ ID NO: 806562 - DNA, 25 bp, Mus musculus
tcatagaaaaactcatacctaagag

SEQ ID NO: 806563 - DNA, 25 bp, Mus musculus
tcatagaacacaaaggtaccccacc

SEQ ID NO: 806564 - DNA, 25 bp, Mus musculus
tcatagaacacataggtaccccacc

SEQ ID NO: 806565 - DNA, 25 bp, Mus musculus
tcatagaacaggaccctggcacttt

SEQ ID NO: 806566 - DNA, 25 bp, Mus musculus
tcatagaacaggtccctggcacttt

SEQ ID NO: 806567 - DNA, 25 bp, Mus musculus
tcatagaagctgacaccaacctccg

SEQ ID NO: 806568 - DNA, 25 bp, Mus musculus
tcatagaagctgtcaccaacctccg

SEQ ID NO: 806569 - DNA, 25 bp, Mus musculus
tcatagaattctaacactgttttgt

SEQ ID NO: 806570 - DNA, 25 bp, Mus musculus
tcatagaattcttacactgttttgt

SEQ ID NO: 806571 - DNA, 25 bp, Mus musculus
tcatagacatctacttgcccagcac

SEQ ID NO: 806572 - DNA, 25 bp, Mus musculus
tcatagacatcttcttgcccagcac

SEQ ID NO: 806573 - DNA, 25 bp, Mus musculus
tcatagacggtcactttgctgtaca

SEQ ID NO: 806574 - DNA, 25 bp, Mus musculus
tcatagacggtctctttgctgtaca

SEQ ID NO: 806575 - DNA, 25 bp, Mus musculus
tcatagactcccagagttcttccta

SEQ ID NO: 806576 - DNA, 25 bp, Mus musculus
tcatagactccctgagttcttccta

SEQ ID NO: 806577 - DNA, 25 bp, Mus musculus
tcatagactgaaccctgatcctggt

SEQ ID NO: 806578 - DNA, 25 bp, Mus musculus
tcatagactgaagcctgatcctggt

SEQ ID NO: 806579 - DNA, 25 bp, Mus musculus
tcatagagatctcgctgactctgct

SEQ ID NO: 806580 - DNA, 25 bp, Mus musculus
tcatagagatctggctgactctgct

SEQ ID NO: 806581 - DNA, 25 bp, Mus musculus
tcatagaggcgcaggacaggctcct

SEQ ID NO: 806582 - DNA, 25 bp, Mus musculus
tcatagaggcgctggacaggctcct

SEQ ID NO: 806583 - DNA, 25 bp, Mus musculus
tcatagatgacgatattccccttcc

SEQ ID NO: 806584 - DNA, 25 bp, Mus musculus
tcatagatgacgttattccccttcc

SEQ ID NO: 806585 - DNA, 25 bp, Mus musculus
tcatagatgcccatggaaaatcaaa

SEQ ID NO: 806586 - DNA, 25 bp, Mus musculus
tcatagatgcccttggaaaatcaaa

SEQ ID NO: 806587 - DNA, 25 bp, Mus musculus
tcatagatgcctctctcatgcactg

SEQ ID NO: 806588 - DNA, 25 bp, Mus musculus
tcatagatgcctgtctcatgcactg

SEQ ID NO: 806589 - DNA, 25 bp, Mus musculus
tcatagattcctctgcttctacctc

SEQ ID NO: 806590 - DNA, 25 bp, Mus musculus
tcatagattcctgtgcttctacctc

SEQ ID NO: 806591 - DNA, 25 bp, Mus musculus
tcatagcactttcttggcatctgcc

SEQ ID NO: 806592 - DNA, 25 bp, Mus musculus
tcatagcactttgttggcatctgcc

SEQ ID NO: 806593 - DNA, 25 bp, Mus musculus
tcatagcagcaaagccttaggaggg

SEQ ID NO: 806594 - DNA, 25 bp, Mus musculus
tcatagcagcaatgccttaggaggg

SEQ ID NO: 806595 - DNA, 25 bp, Mus musculus
tcatagcagcgtagcctgccttctt

SEQ ID NO: 806596 - DNA, 25 bp, Mus musculus
tcatagcagcgttgcctgccttctt

SEQ ID NO: 806597 - DNA, 25 bp, Mus musculus
tcatagccagcgattctcagtcagt

SEQ ID NO: 806598 - DNA, 25 bp, Mus musculus
tcatagccagcgtttctcagtcagt

SEQ ID NO: 806599 - DNA, 25 bp, Mus musculus
tcatagccagctaaacactcaataa

SEQ ID NO: 806600 - DNA, 25 bp, Mus musculus
tcatagccagcttaacactcaataa

SEQ ID NO: 806601 - DNA, 25 bp, Mus musculus
tcatagccatgcctgttccaaggaa

SEQ ID NO: 806602 - DNA, 25 bp, Mus musculus
tcatagccatgcgtgttccaaggaa

SEQ ID NO: 806603 - DNA, 25 bp, Mus musculus
tcatagccccacacttcttacgagg

SEQ ID NO: 806604 - DNA, 25 bp, Mus musculus
tcatagccccactcttcttacgagg

SEQ ID NO: 806605 - DNA, 25 bp, Mus musculus
tcatagccctggcatctgggcttaa

SEQ ID NO: 806606 - DNA, 25 bp, Mus musculus
tcatagccctgggatctgggcttaa

SEQ ID NO: 806607 - DNA, 25 bp, Mus musculus
tcatagcctcacaccatttggaatc

SEQ ID NO: 806608 - DNA, 25 bp, Mus musculus
tcatagcctcactccatttggaatc

SEQ ID NO: 806609 - DNA, 25 bp, Mus musculus
tcatagcctcagaccttcatgggaa

SEQ ID NO: 806610 - DNA, 25 bp, Mus musculus
tcatagcctcagtccttcatgggaa

SEQ ID NO: 806611 - DNA, 25 bp, Mus musculus
tcatagcgcttgctacgtgacaagt

SEQ ID NO: 806612 - DNA, 25 bp, Mus musculus
tcatagcgcttggtacgtgacaagt

SEQ ID NO: 806613 - DNA, 25 bp, Mus musculus
tcatagctagttctcttggtaattc

SEQ ID NO: 806614 - DNA, 25 bp, Mus musculus
tcatagctagttgtcttggtaattc

SEQ ID NO: 806615 - DNA, 25 bp, Mus musculus
tcatagctgcatagcattccattgc

SEQ ID NO: 806616 - DNA, 25 bp, Mus musculus
tcatagctgcattgcattccattgc

SEQ ID NO: 806617 - DNA, 25 bp, Mus musculus
tcatagctgcgcagtgagggtcaca

SEQ ID NO: 806618 - DNA, 25 bp, Mus musculus
tcatagctgcgctgtgagggtcaca

SEQ ID NO: 806619 - DNA, 25 bp, Mus musculus
tcatagctggcccacttgacggtcc

SEQ ID NO: 806620 - DNA, 25 bp, Mus musculus
tcatagctggccgacttgacggtcc

SEQ ID NO: 806621 - DNA, 25 bp, Mus musculus
tcatagctgtctcggactagtctct

SEQ ID NO: 806622 - DNA, 25 bp, Mus musculus
tcatagctgtctgggactagtctct

SEQ ID NO: 806623 - DNA, 25 bp, Mus musculus
tcatagcttattccgtggtcggcat

SEQ ID NO: 806624 - DNA, 25 bp, Mus musculus
tcatagcttattgcgtggtcggcat

SEQ ID NO: 806625 - DNA, 25 bp, Mus musculus
tcatagcttctcagcgtctctgaaa

SEQ ID NO: 806626 - DNA, 25 bp, Mus musculus
tcatagcttctctgcgtctctgaaa

SEQ ID NO: 806627 - DNA, 25 bp, Mus musculus
tcataggacatcagatgtgttcagt

SEQ ID NO: 806628 - DNA, 25 bp, Mus musculus
tcataggacatctgatgtgttcagt

SEQ ID NO: 806629 - DNA, 25 bp, Mus musculus
tcataggagcttaattttggtattt

SEQ ID NO: 806630 - DNA, 25 bp, Mus musculus
tcataggagctttattttggtattt

SEQ ID NO: 806631 - DNA, 25 bp, Mus musculus
tcataggcacttcggtgagggtacc

SEQ ID NO: 806632 - DNA, 25 bp, Mus musculus
tcataggcacttgggtgagggtacc

SEQ ID NO: 806633 - DNA, 25 bp, Mus musculus
tcataggccatgagaacgtgaaagg

SEQ ID NO: 806634 - DNA, 25 bp, Mus musculus
tcataggccatgtgaacgtgaaagg

SEQ ID NO: 806635 - DNA, 25 bp, Mus musculus
tcataggccggtaccttttatttga

SEQ ID NO: 806636 - DNA, 25 bp, Mus musculus
tcataggccggttccttttatttga

SEQ ID NO: 806637 - DNA, 25 bp, Mus musculus
tcataggcctgacccagaaggacct

SEQ ID NO: 806638 - DNA, 25 bp, Mus musculus
tcataggcctgagccagaaggacct

SEQ ID NO: 806639 - DNA, 25 bp, Mus musculus
tcataggcgggaaggcattttctta

SEQ ID NO: 806640 - DNA, 25 bp, Mus musculus
tcataggcgggatggcattttctta

SEQ ID NO: 806641 - DNA, 25 bp, Mus musculus
tcataggcgtttagccaacctgcct

SEQ ID NO: 806642 - DNA, 25 bp, Mus musculus
tcataggcgttttgccaacctgcct

SEQ ID NO: 806643 - DNA, 25 bp, Mus musculus
tcataggcttgtatgctattcactt

SEQ ID NO: 806644 - DNA, 25 bp, Mus musculus
tcataggcttgtttgctattcactt

SEQ ID NO: 806645 - DNA, 25 bp, Mus musculus
tcatagggccctcgctggaggtcaa

SEQ ID NO: 806646 - DNA, 25 bp, Mus musculus
tcatagggccctggctggaggtcaa

SEQ ID NO: 806647 - DNA, 25 bp, Mus musculus
tcatagggtaatcccttcttgggac

SEQ ID NO: 806648 - DNA, 25 bp, Mus musculus
tcatagggtaatgccttcttgggac

SEQ ID NO: 806649 - DNA, 25 bp, Mus musculus
tcatagggtggtctttttatcccct

SEQ ID NO: 806650 - DNA, 25 bp, Mus musculus
tcatagggtggtgtttttatcccct

SEQ ID NO: 806651 - DNA, 25 bp, Mus musculus
tcataggttacgattgatacaagcc

SEQ ID NO: 806652 - DNA, 25 bp, Mus musculus
tcataggttacgtttgatacaagcc

SEQ ID NO: 806653 - DNA, 25 bp, Mus musculus
tcataggtttcacacataatttctt

SEQ ID NO: 806654 - DNA, 25 bp, Mus musculus
tcataggtttcagacataatttctt

SEQ ID NO: 806655 - DNA, 25 bp, Mus musculus
tcatagtaatttccactttgtgcac

SEQ ID NO: 806656 - DNA, 25 bp, Mus musculus
tcatagtaatttgcactttgtgcac

SEQ ID NO: 806657 - DNA, 25 bp, Mus musculus
tcatagtaccagattgtcttttctt

SEQ ID NO: 806658 - DNA, 25 bp, Mus musculus
tcatagtaccagtttgtcttttctt

SEQ ID NO: 806659 - DNA, 25 bp, Mus musculus
tcatagtatccaagtttcagcttga

SEQ ID NO: 806660 - DNA, 25 bp, Mus musculus
tcatagtatccatgtttcagcttga

SEQ ID NO: 806661 - DNA, 25 bp, Mus musculus
tcatagtcacacaggatggcgtctc

SEQ ID NO: 806662 - DNA, 25 bp, Mus musculus
tcatagtcacactggatggcgtctc

SEQ ID NO: 806663 - DNA, 25 bp, Mus musculus
tcatagtccttcatatctcttcaga

SEQ ID NO: 806664 - DNA, 25 bp, Mus musculus
tcatagtccttcttatctcttcaga

SEQ ID NO: 806665 - DNA, 25 bp, Mus musculus
tcatagtctgacatttacatattta

SEQ ID NO: 806666 - DNA, 25 bp, Mus musculus
tcatagtctgacttttacatattta

SEQ ID NO: 806667 - DNA, 25 bp, Mus musculus
tcatagtggagccaacgttttctct

SEQ ID NO: 806668 - DNA, 25 bp, Mus musculus
tcatagtggagcgaacgttttctct

SEQ ID NO: 806669 - DNA, 25 bp, Mus musculus
tcatagtgtattaggagtccgtcca

SEQ ID NO: 806670 - DNA, 25 bp, Mus musculus
tcatagtgtatttggagtccgtcca

SEQ ID NO: 806671 - DNA, 25 bp, Mus musculus
tcatagtgtcaactgaggtcggtga

SEQ ID NO: 806672 - DNA, 25 bp, Mus musculus
tcatagtgtcaagtgaggtcggtga

SEQ ID NO: 806673 - DNA, 25 bp, Mus musculus
tcatagtgtgacacatccaaaacaa

SEQ ID NO: 806674 - DNA, 25 bp, Mus musculus
tcatagtgtgactcatccaaaacaa

SEQ ID NO: 806675 - DNA, 25 bp, Mus musculus
tcatagtgtggtatccgggctccaa

SEQ ID NO: 806676 - DNA, 25 bp, Mus musculus
tcatagtgtggtttccgggctccaa

SEQ ID NO: 806677 - DNA, 25 bp, Mus musculus
tcatagttaggaaacacttaagccc

SEQ ID NO: 806678 - DNA, 25 bp, Mus musculus
tcatagttaggatacacttaagccc

SEQ ID NO: 806679 - DNA, 25 bp, Mus musculus
tcatagttagttccttcacgtcttt

SEQ ID NO: 806680 - DNA, 25 bp, Mus musculus
tcatagttagttgcttcacgtcttt

SEQ ID NO: 806681 - DNA, 25 bp, Mus musculus
tcatagttgccacgcccaagattaa

SEQ ID NO: 806682 - DNA, 25 bp, Mus musculus
tcatagttgccaggcccaagattaa

SEQ ID NO: 806683 - DNA, 25 bp, Mus musculus
tcatataaagtcattgtggtaccga

SEQ ID NO: 806684 - DNA, 25 bp, Mus musculus
tcatataaagtctttgtggtaccga

SEQ ID NO: 806685 - DNA, 25 bp, Mus musculus
tcatataagaagaggctcgggctgg

SEQ ID NO: 806686 - DNA, 25 bp, Mus musculus
tcatataagaagtggctcgggctgg

SEQ ID NO: 806687 - DNA, 25 bp, Mus musculus
tcatataagtcaatgtggttaccga

SEQ ID NO: 806688 - DNA, 25 bp, Mus musculus
tcatataagtcattgtggttaccga

SEQ ID NO: 806689 - DNA, 25 bp, Mus musculus
tcatataatgtactctttcccctcc

SEQ ID NO: 806690 - DNA, 25 bp, Mus musculus
tcatataatgtagtctttcccctcc

SEQ ID NO: 806691 - DNA, 25 bp, Mus musculus
tcatatacattgagcttactgttgt

SEQ ID NO: 806692 - DNA, 25 bp, Mus musculus
tcatatacattgtgcttactgttgt

SEQ ID NO: 806693 - DNA, 25 bp, Mus musculus
tcatatacgaacccgcagatgatct

SEQ ID NO: 806694 - DNA, 25 bp, Mus musculus
tcatatacgaacgcgcagatgatct

SEQ ID NO: 806695 - DNA, 25 bp, Mus musculus
tcatatactggcagaccttccacct

SEQ ID NO: 806696 - DNA, 25 bp, Mus musculus
tcatatactggctgaccttccacct

SEQ ID NO: 806697 - DNA, 25 bp, Mus musculus
tcatataggaagcacgcactgccca

SEQ ID NO: 806698 - DNA, 25 bp, Mus musculus
tcatataggaaggacgcactgccca

SEQ ID NO: 806699 - DNA, 25 bp, Mus musculus
tcatataggctgacccctaaatcaa

SEQ ID NO: 806700 - DNA, 25 bp, Mus musculus
tcatataggctgtcccctaaatcaa

SEQ ID NO: 806701 - DNA, 25 bp, Mus musculus
tcatatatacatccccacaggcatg

SEQ ID NO: 806702 - DNA, 25 bp, Mus musculus
tcatatatacatgcccacaggcatg

SEQ ID NO: 806703 - DNA, 25 bp, Mus musculus
tcatatcaaagcacgctcctatgat

SEQ ID NO: 806704 - DNA, 25 bp, Mus musculus
tcatatcaaagctcgctcctatgat

SEQ ID NO: 806705 - DNA, 25 bp, Mus musculus
tcatatcaaattaggcctccttcac

SEQ ID NO: 806706 - DNA, 25 bp, Mus musculus
tcatatcaaatttggcctccttcac

SEQ ID NO: 806707 - DNA, 25 bp, Mus musculus
tcatatcaattaatgcttaccccaa

SEQ ID NO: 806708 - DNA, 25 bp, Mus musculus
tcatatcaattattgcttaccccaa

SEQ ID NO: 806709 - DNA, 25 bp, Mus musculus
tcatatcaccgcattctctgagtac

SEQ ID NO: 806710 - DNA, 25 bp, Mus musculus
tcatatcaccgctttctctgagtac

SEQ ID NO: 806711 - DNA, 25 bp, Mus musculus
tcatatcactccatagactcttgtt

SEQ ID NO: 806712 - DNA, 25 bp, Mus musculus
tcatatcactccttagactcttgtt

SEQ ID NO: 806713 - DNA, 25 bp, Mus musculus
tcatatcatgacctggctgaacctc

SEQ ID NO: 806714 - DNA, 25 bp, Mus musculus
tcatatcatgacgtggctgaacctc

SEQ ID NO: 806715 - DNA, 25 bp, Mus musculus
tcatatccaagcatgacctgggcca

SEQ ID NO: 806716 - DNA, 25 bp, Mus musculus
tcatatccaagcttgacctgggcca

SEQ ID NO: 806717 - DNA, 25 bp, Mus musculus
tcatatccaatgaagcaatctctta

SEQ ID NO: 806718 - DNA, 25 bp, Mus musculus
tcatatccaatgtagcaatctctta

SEQ ID NO: 806719 - DNA, 25 bp, Mus musculus
tcatatccatggcatcggccttgct

SEQ ID NO: 806720 - DNA, 25 bp, Mus musculus
tcatatccatgggatcggccttgct

SEQ ID NO: 806721 - DNA, 25 bp, Mus musculus
tcatatcccagtctgcattatcaca

SEQ ID NO: 806722 - DNA, 25 bp, Mus musculus
tcatatcccagtgtgcattatcaca

SEQ ID NO: 806723 - DNA, 25 bp, Mus musculus
tcatatccccacaccagggattaaa

SEQ ID NO: 806724 - DNA, 25 bp, Mus musculus
tcatatccccactccagggattaaa

SEQ ID NO: 806725 - DNA, 25 bp, Mus musculus
tcatatccgattaacttgtgttctc

SEQ ID NO: 806726 - DNA, 25 bp, Mus musculus
tcatatccgatttacttgtgttctc

SEQ ID NO: 806727 - DNA, 25 bp, Mus musculus
tcatatcctctaatatcaacaccca

SEQ ID NO: 806728 - DNA, 25 bp, Mus musculus
tcatatcctctattatcaacaccca

SEQ ID NO: 806729 - DNA, 25 bp, Mus musculus
tcatatcgcctactcagcttgcttt

SEQ ID NO: 806730 - DNA, 25 bp, Mus musculus
tcatatcgcctagtcagcttgcttt

SEQ ID NO: 806731 - DNA, 25 bp, Mus musculus
tcatatctatgcacatactccagcc

SEQ ID NO: 806732 - DNA, 25 bp, Mus musculus
tcatatctatgctcatactccagcc

SEQ ID NO: 806733 - DNA, 25 bp, Mus musculus
tcatatgagtctaccatggtgctgt

SEQ ID NO: 806734 - DNA, 25 bp, Mus musculus
tcatatgagtcttccatggtgctgt

SEQ ID NO: 806735 - DNA, 25 bp, Mus musculus
tcatatgcagatccttgttggccaa

SEQ ID NO: 806736 - DNA, 25 bp, Mus musculus
tcatatgcagatgcttgttggccaa

SEQ ID NO: 806737 - DNA, 25 bp, Mus musculus
tcatatgctgcaaaggaaacctcgt

SEQ ID NO: 806738 - DNA, 25 bp, Mus musculus
tcatatgctgcataggaaacctcgt

SEQ ID NO: 806739 - DNA, 25 bp, Mus musculus
tcatatgtactacctgtttgccttc

SEQ ID NO: 806740 - DNA, 25 bp, Mus musculus
tcatatgtactagctgtttgccttc

SEQ ID NO: 806741 - DNA, 25 bp, Mus musculus
tcatattaaatgctcccagtccgga

SEQ ID NO: 806742 - DNA, 25 bp, Mus musculus
tcatattaaatggtcccagtccgga

SEQ ID NO: 806743 - DNA, 25 bp, Mus musculus
tcatattagtataccctgttcaaag

SEQ ID NO: 806744 - DNA, 25 bp, Mus musculus
tcatattagtattccctgttcaaag

SEQ ID NO: 806745 - DNA, 25 bp, Mus musculus
tcatattatatgatgcttgcatatc

SEQ ID NO: 806746 - DNA, 25 bp, Mus musculus
tcatattatatgttgcttgcatatc

SEQ ID NO: 806747 - DNA, 25 bp, Mus musculus
tcatattcaagtccagtatcagtat

SEQ ID NO: 806748 - DNA, 25 bp, Mus musculus
tcatattcaagtgcagtatcagtat

SEQ ID NO: 806749 - DNA, 25 bp, Mus musculus
tcatattcacagaaggcagactgct

SEQ ID NO: 806750 - DNA, 25 bp, Mus musculus
tcatattcacagtaggcagactgct

SEQ ID NO: 806751 - DNA, 25 bp, Mus musculus
tcatattcactgaatgtggcagaca

SEQ ID NO: 806752 - DNA, 25 bp, Mus musculus
tcatattcactgtatgtggcagaca

SEQ ID NO: 806753 - DNA, 25 bp, Mus musculus
tcatattcagcccatcacgctgtgg

SEQ ID NO: 806754 - DNA, 25 bp, Mus musculus
tcatattcagccgatcacgctgtgg

SEQ ID NO: 806755 - DNA, 25 bp, Mus musculus
tcatattcatccagacaggatctga

SEQ ID NO: 806756 - DNA, 25 bp, Mus musculus
tcatattcatcctgacaggatctga

SEQ ID NO: 806757 - DNA, 25 bp, Mus musculus
tcatattctgaccatacccctaaga

SEQ ID NO: 806758 - DNA, 25 bp, Mus musculus
tcatattctgacgatacccctaaga

SEQ ID NO: 806759 - DNA, 25 bp, Mus musculus
tcatattgaggtaacgtgtttgtat

SEQ ID NO: 806760 - DNA, 25 bp, Mus musculus
tcatattgaggttacgtgtttgtat

SEQ ID NO: 806761 - DNA, 25 bp, Mus musculus
tcatattgccgtacccatgttcttt

SEQ ID NO: 806762 - DNA, 25 bp, Mus musculus
tcatattgccgttcccatgttcttt

SEQ ID NO: 806763 - DNA, 25 bp, Mus musculus
tcatattgctccagggacagtcggg

SEQ ID NO: 806764 - DNA, 25 bp, Mus musculus
tcatattgctcctgggacagtcggg

SEQ ID NO: 806765 - DNA, 25 bp, Mus musculus
tcatatttggctaagatggctttat

SEQ ID NO: 806766 - DNA, 25 bp, Mus musculus
tcatatttggcttagatggctttat

SEQ ID NO: 806767 - DNA, 25 bp, Mus musculus
tcatattttatgacctatacctttt

SEQ ID NO: 806768 - DNA, 25 bp, Mus musculus
tcatattttatgtcctatacctttt

SEQ ID NO: 806769 - DNA, 25 bp, Mus musculus
tcatattttcacagtttgatatctg

SEQ ID NO: 806770 - DNA, 25 bp, Mus musculus
tcatattttcactgtttgatatctg

SEQ ID NO: 806771 - DNA, 25 bp, Mus musculus
tcatattttcctcccacgggtggaa

SEQ ID NO: 806772 - DNA, 25 bp, Mus musculus
tcatattttcctgccacgggtggaa

SEQ ID NO: 806773 - DNA, 25 bp, Mus musculus
tcatattttctgaccatccacacgt

SEQ ID NO: 806774 - DNA, 25 bp, Mus musculus
tcatattttctgtccatccacacgt

SEQ ID NO: 806775 - DNA, 25 bp, Mus musculus
tcatatttttgacttttagaaggga

SEQ ID NO: 806776 - DNA, 25 bp, Mus musculus
tcatatttttgagttttagaaggga

SEQ ID NO: 806777 - DNA, 25 bp, Mus musculus
tcatatttttgtcggaatgggccct

SEQ ID NO: 806778 - DNA, 25 bp, Mus musculus
tcatatttttgtgggaatgggccct

SEQ ID NO: 806779 - DNA, 25 bp, Mus musculus
tcatcaaactgcagctcttgcatgg

SEQ ID NO: 806780 - DNA, 25 bp, Mus musculus
tcatcaaactgctgctcttgcatgg

SEQ ID NO: 806781 - DNA, 25 bp, Mus musculus
tcatcaaatggcaacctttagaagg

SEQ ID NO: 806782 - DNA, 25 bp, Mus musculus
tcatcaaatggctacctttagaagg

SEQ ID NO: 806783 - DNA, 25 bp, Mus musculus
tcatcaacaataacccattcttcct

SEQ ID NO: 806784 - DNA, 25 bp, Mus musculus
tcatcaacaatatcccattcttcct

SEQ ID NO: 806785 - DNA, 25 bp, Mus musculus
tcatcaaccatgatattctcacaga

SEQ ID NO: 806786 - DNA, 25 bp, Mus musculus
tcatcaaccatgttattctcacaga

SEQ ID NO: 806787 - DNA, 25 bp, Mus musculus
tcatcaaccctcaactaaggacttt

SEQ ID NO: 806788 - DNA, 25 bp, Mus musculus
tcatcaaccctctactaaggacttt

SEQ ID NO: 806789 - DNA, 25 bp, Mus musculus
tcatcaacgtgacattcacaccaca

SEQ ID NO: 806790 - DNA, 25 bp, Mus musculus
tcatcaacgtgagattcacaccaca

SEQ ID NO: 806791 - DNA, 25 bp, Mus musculus
tcatcaactacaccggacaacattt

SEQ ID NO: 806792 - DNA, 25 bp, Mus musculus
tcatcaactacagcggacaacattt

SEQ ID NO: 806793 - DNA, 25 bp, Mus musculus
tcatcaagaaaaagtggagccagct

SEQ ID NO: 806794 - DNA, 25 bp, Mus musculus
tcatcaagaaaatgtggagccagct

SEQ ID NO: 806795 - DNA, 25 bp, Mus musculus
tcatcaagacagatcacagttagct

SEQ ID NO: 806796 - DNA, 25 bp, Mus musculus
tcatcaagacagttcacagttagct

SEQ ID NO: 806797 - DNA, 25 bp, Mus musculus
tcatcaagcacaaccgggacatgca

SEQ ID NO: 806798 - DNA, 25 bp, Mus musculus
tcatcaagcacatccgggacatgca

SEQ ID NO: 806799 - DNA, 25 bp, Mus musculus
tcatcaagccggagtcatagagagt

SEQ ID NO: 806800 - DNA, 25 bp, Mus musculus
tcatcaagccggtgtcatagagagt

SEQ ID NO: 806801 - DNA, 25 bp, Mus musculus
tcatcaagcctcaggaagaccccgt

SEQ ID NO: 806802 - DNA, 25 bp, Mus musculus
tcatcaagcctctggaagaccccgt

SEQ ID NO: 806803 - DNA, 25 bp, Mus musculus
tcatcaagcgtccagacctcaagta

SEQ ID NO: 806804 - DNA, 25 bp, Mus musculus
tcatcaagcgtcgagacctcaagta

SEQ ID NO: 806805 - DNA, 25 bp, Mus musculus
tcatcaagctgtacctatgagccga

SEQ ID NO: 806806 - DNA, 25 bp, Mus musculus
tcatcaagctgttcctatgagccga

SEQ ID NO: 806807 - DNA, 25 bp, Mus musculus
tcatcaaggcgccacctatttatta

SEQ ID NO: 806808 - DNA, 25 bp, Mus musculus
tcatcaaggcgcgacctatttatta

SEQ ID NO: 806809 - DNA, 25 bp, Mus musculus
tcatcaagggagacattgcatcact

SEQ ID NO: 806810 - DNA, 25 bp, Mus musculus
tcatcaagggagacggcgaggtttt

SEQ ID NO: 806811 - DNA, 25 bp, Mus musculus
tcatcaagggagtcattgcatcact

SEQ ID NO: 806812 - DNA, 25 bp, Mus musculus
tcatcaagggagtcggcgaggtttt

SEQ ID NO: 806813 - DNA, 25 bp, Mus musculus
tcatcaagttttacagttcaccccg

SEQ ID NO: 806814 - DNA, 25 bp, Mus musculus
tcatcaagtttttcagttcaccccg

SEQ ID NO: 806815 - DNA, 25 bp, Mus musculus
tcatcaatatcacagagcacgagct

SEQ ID NO: 806816 - DNA, 25 bp, Mus musculus
tcatcaatatcagagagcacgagct

SEQ ID NO: 806817 - DNA, 25 bp, Mus musculus
tcatcaatcagtcctaccagatgga

SEQ ID NO: 806818 - DNA, 25 bp, Mus musculus
tcatcaatcagtgctaccagatgga

SEQ ID NO: 806819 - DNA, 25 bp, Mus musculus
tcatcaatctccagtatgcgcaaat

SEQ ID NO: 806820 - DNA, 25 bp, Mus musculus
tcatcaatctcctgtatgcgcaaat

SEQ ID NO: 806821 - DNA, 25 bp, Mus musculus
tcatcaatgatcaaccgtcagcagc

SEQ ID NO: 806822 - DNA, 25 bp, Mus musculus
tcatcaatgatctaccgtcagcagc

SEQ ID NO: 806823 - DNA, 25 bp, Mus musculus
tcatcaatggctccgtggctgctgt

SEQ ID NO: 806824 - DNA, 25 bp, Mus musculus
tcatcaatggctgcgtggctgctgt

SEQ ID NO: 806825 - DNA, 25 bp, Mus musculus
tcatcaatgggcctcaatccttgaa

SEQ ID NO: 806826 - DNA, 25 bp, Mus musculus
tcatcaatgggcgtcaatccttgaa

SEQ ID NO: 806827 - DNA, 25 bp, Mus musculus
tcatcaattaccatttatagccgaa

SEQ ID NO: 806828 - DNA, 25 bp, Mus musculus
tcatcaattaccttttatagccgaa

SEQ ID NO: 806829 - DNA, 25 bp, Mus musculus
tcatcaattctactccaggtctctt

SEQ ID NO: 806830 - DNA, 25 bp, Mus musculus
tcatcaattctagtccaggtctctt

SEQ ID NO: 806831 - DNA, 25 bp, Mus musculus
tcatcaattctgagtagttactcaa

SEQ ID NO: 806832 - DNA, 25 bp, Mus musculus
tcatcaattctgtgtagttactcaa

SEQ ID NO: 806833 - DNA, 25 bp, Mus musculus
tcatcacaactgcttggacctattc

SEQ ID NO: 806834 - DNA, 25 bp, Mus musculus
tcatcacaactggttggacctattc

SEQ ID NO: 806835 - DNA, 25 bp, Mus musculus
tcatcacaagagcaccagacttggg

SEQ ID NO: 806836 - DNA, 25 bp, Mus musculus
tcatcacaagaggaccagacttggg

SEQ ID NO: 806837 - DNA, 25 bp, Mus musculus
tcatcacaagcgcaacctattcttg

SEQ ID NO: 806838 - DNA, 25 bp, Mus musculus
tcatcacaagcggaacctattcttg

SEQ ID NO: 806839 - DNA, 25 bp, Mus musculus
tcatcacaatctatatgcttttctt

SEQ ID NO: 806840 - DNA, 25 bp, Mus musculus
tcatcacaatctttatgcttttctt

SEQ ID NO: 806841 - DNA, 25 bp, Mus musculus
tcatcacaccgaagcttctacagaa

SEQ ID NO: 806842 - DNA, 25 bp, Mus musculus
tcatcacaccgatgcttctacagaa

SEQ ID NO: 806843 - DNA, 25 bp, Mus musculus
tcatcacaccgccagccttttgtgg

SEQ ID NO: 806844 - DNA, 25 bp, Mus musculus
tcatcacaccgcgagccttttgtgg

SEQ ID NO: 806845 - DNA, 25 bp, Mus musculus
tcatcacagcttctaaaacaatatt

SEQ ID NO: 806846 - DNA, 25 bp, Mus musculus
tcatcacagcttgtaaaacaatatt

SEQ ID NO: 806847 - DNA, 25 bp, Mus musculus
tcatcacaggccacattccaaagat

SEQ ID NO: 806848 - DNA, 25 bp, Mus musculus
tcatcacaggcctcattccaaagat

SEQ ID NO: 806849 - DNA, 25 bp, Mus musculus
tcatcacaggctcacacccttagta

SEQ ID NO: 806850 - DNA, 25 bp, Mus musculus
tcatcacaggctgacacccttagta

SEQ ID NO: 806851 - DNA, 25 bp, Mus musculus
tcatcacagggcaccactgaacatg

SEQ ID NO: 806852 - DNA, 25 bp, Mus musculus
tcatcacagggctccactgaacatg

SEQ ID NO: 806853 - DNA, 25 bp, Mus musculus
tcatcacagtgtctagcttcagctt

SEQ ID NO: 806854 - DNA, 25 bp, Mus musculus
tcatcacagtgtgtagcttcagctt

SEQ ID NO: 806855 - DNA, 25 bp, Mus musculus
tcatcacatagaagcctgacaggaa

SEQ ID NO: 806856 - DNA, 25 bp, Mus musculus
tcatcacatagatgcctgacaggaa

SEQ ID NO: 806857 - DNA, 25 bp, Mus musculus
tcatcacatatcaggtgccattctt

SEQ ID NO: 806858 - DNA, 25 bp, Mus musculus
tcatcacatatctggtgccattctt

SEQ ID NO: 806859 - DNA, 25 bp, Mus musculus
tcatcacatccaagaccgaggtcat

SEQ ID NO: 806860 - DNA, 25 bp, Mus musculus
tcatcacatccatgaccgaggtcat

SEQ ID NO: 806861 - DNA, 25 bp, Mus musculus
tcatcacatgggaatctcagcacat

SEQ ID NO: 806862 - DNA, 25 bp, Mus musculus
tcatcacatgggtatctcagcacat

SEQ ID NO: 806863 - DNA, 25 bp, Mus musculus
tcatcacatggtcaaagcaagagga

SEQ ID NO: 806864 - DNA, 25 bp, Mus musculus
tcatcacatggtgaaagcaagagga

SEQ ID NO: 806865 - DNA, 25 bp, Mus musculus
tcatcaccaactctggaactcagca

SEQ ID NO: 806866 - DNA, 25 bp, Mus musculus
tcatcaccaactgtggaactcagca

SEQ ID NO: 806867 - DNA, 25 bp, Mus musculus
tcatcaccaccaatcctattgaaaa

SEQ ID NO: 806868 - DNA, 25 bp, Mus musculus
tcatcaccaccattcctattgaaaa

SEQ ID NO: 806869 - DNA, 25 bp, Mus musculus
tcatcaccaggacagcaggtcgaga

SEQ ID NO: 806870 - DNA, 25 bp, Mus musculus
tcatcaccaggagagcaggtcgaga

SEQ ID NO: 806871 - DNA, 25 bp, Mus musculus
tcatcaccaggtactgagcatcttc

SEQ ID NO: 806872 - DNA, 25 bp, Mus musculus
tcatcaccaggttctgagcatcttc

SEQ ID NO: 806873 - DNA, 25 bp, Mus musculus
tcatcacccgttaacagagcacttc

SEQ ID NO: 806874 - DNA, 25 bp, Mus musculus
tcatcacccgtttacagagcacttc

SEQ ID NO: 806875 - DNA, 25 bp, Mus musculus
tcatcaccctgaagagcgggattca

SEQ ID NO: 806876 - DNA, 25 bp, Mus musculus
tcatcaccctgatgagcgggattca

SEQ ID NO: 806877 - DNA, 25 bp, Mus musculus
tcatcaccgacgactgtagtggccg

SEQ ID NO: 806878 - DNA, 25 bp, Mus musculus
tcatcaccgacgtctgtagtggccg

SEQ ID NO: 806879 - DNA, 25 bp, Mus musculus
tcatcacgaatccaggttccagctc

SEQ ID NO: 806880 - DNA, 25 bp, Mus musculus
tcatcacgaatcgaggttccagctc

SEQ ID NO: 806881 - DNA, 25 bp, Mus musculus
tcatcacgactcattcagcaaacct

SEQ ID NO: 806882 - DNA, 25 bp, Mus musculus
tcatcacgactctttcagcaaacct

SEQ ID NO: 806883 - DNA, 25 bp, Mus musculus
tcatcacgctgcaagtgcctgaggc

SEQ ID NO: 806884 - DNA, 25 bp, Mus musculus
tcatcacgctgctagtgcctgaggc

SEQ ID NO: 806885 - DNA, 25 bp, Mus musculus
tcatcacggcccaggagtgggaccc

SEQ ID NO: 806886 - DNA, 25 bp, Mus musculus
tcatcacggccctggagtgggaccc

SEQ ID NO: 806887 - DNA, 25 bp, Mus musculus
tcatcacgggcaatgggcgagtgtc

SEQ ID NO: 806888 - DNA, 25 bp, Mus musculus
tcatcacgggcattgggcgagtgtc

SEQ ID NO: 806889 - DNA, 25 bp, Mus musculus
tcatcactaactccagcggctagaa

SEQ ID NO: 806890 - DNA, 25 bp, Mus musculus
tcatcactaactgcagcggctagaa

SEQ ID NO: 806891 - DNA, 25 bp, Mus musculus
tcatcactgactctcttgggtgaga

SEQ ID NO: 806892 - DNA, 25 bp, Mus musculus
tcatcactgactgtcttgggtgaga

SEQ ID NO: 806893 - DNA, 25 bp, Mus musculus
tcatcactgcagcttcctctgagac

SEQ ID NO: 806894 - DNA, 25 bp, Mus musculus
tcatcactgcaggttcctctgagac

SEQ ID NO: 806895 - DNA, 25 bp, Mus musculus
tcatcactggtgacgctgagtaact

SEQ ID NO: 806896 - DNA, 25 bp, Mus musculus
tcatcactggtgtcgctgagtaact

SEQ ID NO: 806897 - DNA, 25 bp, Mus musculus
tcatcactgtgtccaaggccaagat

SEQ ID NO: 806898 - DNA, 25 bp, Mus musculus
tcatcactgtgtgcaaggccaagat

SEQ ID NO: 806899 - DNA, 25 bp, Mus musculus
tcatcacttcatagccacggtatat

SEQ ID NO: 806900 - DNA, 25 bp, Mus musculus
tcatcacttcattgccacggtatat

SEQ ID NO: 806901 - DNA, 25 bp, Mus musculus
tcatcagaaggtccatggccatggt

SEQ ID NO: 806902 - DNA, 25 bp, Mus musculus
tcatcagaaggtgcatggccatggt

SEQ ID NO: 806903 - DNA, 25 bp, Mus musculus
tcatcagaatgaagcctggaggctt

SEQ ID NO: 806904 - DNA, 25 bp, Mus musculus
tcatcagaatgatgcctggaggctt

SEQ ID NO: 806905 - DNA, 25 bp, Mus musculus
tcatcagacaaacagcttccggcag

SEQ ID NO: 806906 - DNA, 25 bp, Mus musculus
tcatcagacaaagagcttccggcag

SEQ ID NO: 806907 - DNA, 25 bp, Mus musculus
tcatcagacaccagccagagggatg

SEQ ID NO: 806908 - DNA, 25 bp, Mus musculus
tcatcagacacctgccagagggatg

SEQ ID NO: 806909 - DNA, 25 bp, Mus musculus
tcatcagacagcctcgggtcctact

SEQ ID NO: 806910 - DNA, 25 bp, Mus musculus
tcatcagacagcgtcgggtcctact

SEQ ID NO: 806911 - DNA, 25 bp, Mus musculus
tcatcagacgagcaggcactgctgt

SEQ ID NO: 806912 - DNA, 25 bp, Mus musculus
tcatcagacgaggaggcactgctgt

SEQ ID NO: 806913 - DNA, 25 bp, Mus musculus
tcatcagactggctggttacaacat

SEQ ID NO: 806914 - DNA, 25 bp, Mus musculus
tcatcagactgggtggttacaacat

SEQ ID NO: 806915 - DNA, 25 bp, Mus musculus
tcatcagagaaaacctacaaggtag

SEQ ID NO: 806916 - DNA, 25 bp, Mus musculus
tcatcagagaaatcctacaaggtag

SEQ ID NO: 806917 - DNA, 25 bp, Mus musculus
tcatcagagaggacgggaccttccc

SEQ ID NO: 806918 - DNA, 25 bp, Mus musculus
tcatcagagaggtcgggaccttccc

SEQ ID NO: 806919 - DNA, 25 bp, Mus musculus
tcatcagagtcacaggcagttcccc

SEQ ID NO: 806920 - DNA, 25 bp, Mus musculus
tcatcagagtcagaggcagttcccc

SEQ ID NO: 806921 - DNA, 25 bp, Mus musculus
tcatcagatggcctggtgtctttaa

SEQ ID NO: 806922 - DNA, 25 bp, Mus musculus
tcatcagatggcgtggtgtctttaa

SEQ ID NO: 806923 - DNA, 25 bp, Mus musculus
tcatcagatgtgatcactgctggcc

SEQ ID NO: 806924 - DNA, 25 bp, Mus musculus
tcatcagatgtgttcactgctggcc

SEQ ID NO: 806925 - DNA, 25 bp, Mus musculus
tcatcagcaaacaatccaagtgact

SEQ ID NO: 806926 - DNA, 25 bp, Mus musculus
tcatcagcaaactatccaagtgact

SEQ ID NO: 806927 - DNA, 25 bp, Mus musculus
tcatcagcacacatttggccaagct

SEQ ID NO: 806928 - DNA, 25 bp, Mus musculus
tcatcagcacacttttggccaagct

SEQ ID NO: 806929 - DNA, 25 bp, Mus musculus
tcatcagcacagcaaggaacagagg

SEQ ID NO: 806930 - DNA, 25 bp, Mus musculus
tcatcagcacaggaaggaacagagg

SEQ ID NO: 806931 - DNA, 25 bp, Mus musculus
tcatcagcactgaggttccgggtct

SEQ ID NO: 806932 - DNA, 25 bp, Mus musculus
tcatcagcactgtggttccgggtct

SEQ ID NO: 806933 - DNA, 25 bp, Mus musculus
tcatcagccaaaacacccttgtgat

SEQ ID NO: 806934 - DNA, 25 bp, Mus musculus
tcatcagccaaatcacccttgtgat

SEQ ID NO: 806935 - DNA, 25 bp, Mus musculus
tcatcagccaagataaacccctgct

SEQ ID NO: 806936 - DNA, 25 bp, Mus musculus
tcatcagccaagttaaacccctgct

SEQ ID NO: 806937 - DNA, 25 bp, Mus musculus
tcatcagcccatagtttcggatcaa

SEQ ID NO: 806938 - DNA, 25 bp, Mus musculus
tcatcagcccattgtttcggatcaa

SEQ ID NO: 806939 - DNA, 25 bp, Mus musculus
tcatcagccccacaagtacttttaa

SEQ ID NO: 806940 - DNA, 25 bp, Mus musculus
tcatcagccccagaagtacttttaa

SEQ ID NO: 806941 - DNA, 25 bp, Mus musculus
tcatcagcccctagataagtatatc

SEQ ID NO: 806942 - DNA, 25 bp, Mus musculus
tcatcagccccttgataagtatatc

SEQ ID NO: 806943 - DNA, 25 bp, Mus musculus
tcatcagcccttccctaggataaag

SEQ ID NO: 806944 - DNA, 25 bp, Mus musculus
tcatcagcccttgcctaggataaag

SEQ ID NO: 806945 - DNA, 25 bp, Mus musculus
tcatcagccggaatttgttattgat

SEQ ID NO: 806946 - DNA, 25 bp, Mus musculus
tcatcagccggattttgttattgat

SEQ ID NO: 806947 - DNA, 25 bp, Mus musculus
tcatcagcggccacatgtacatgat

SEQ ID NO: 806948 - DNA, 25 bp, Mus musculus
tcatcagcggcctcatgtacatgat

SEQ ID NO: 806949 - DNA, 25 bp, Mus musculus
tcatcagctctgatttctttccttt

SEQ ID NO: 806950 - DNA, 25 bp, Mus musculus
tcatcagctctgttttctttccttt

SEQ ID NO: 806951 - DNA, 25 bp, Mus musculus
tcatcagctggactgccctacatgg

SEQ ID NO: 806952 - DNA, 25 bp, Mus musculus
tcatcagctggagtgccctacatgg

SEQ ID NO: 806953 - DNA, 25 bp, Mus musculus
tcatcagcttggaggtcactggcct

SEQ ID NO: 806954 - DNA, 25 bp, Mus musculus
tcatcagcttggtggtcactggcct

SEQ ID NO: 806955 - DNA, 25 bp, Mus musculus
tcatcaggaatgaccaataggctgg

SEQ ID NO: 806956 - DNA, 25 bp, Mus musculus
tcatcaggaatgtccaataggctgg

SEQ ID NO: 806957 - DNA, 25 bp, Mus musculus
tcatcaggactccaagctgcgggta

SEQ ID NO: 806958 - DNA, 25 bp, Mus musculus
tcatcaggactcgaagctgcgggta

SEQ ID NO: 806959 - DNA, 25 bp, Mus musculus
tcatcaggaggtattaaaggccata

SEQ ID NO: 806960 - DNA, 25 bp, Mus musculus
tcatcaggaggttttaaaggccata

SEQ ID NO: 806961 - DNA, 25 bp, Mus musculus
tcatcaggccgtatgactacacaag

SEQ ID NO: 806962 - DNA, 25 bp, Mus musculus
tcatcaggccgtttgactacacaag

SEQ ID NO: 806963 - DNA, 25 bp, Mus musculus
tcatcaggcctgctatgcggcggaa

SEQ ID NO: 806964 - DNA, 25 bp, Mus musculus
tcatcaggcctggtatgcggcggaa

SEQ ID NO: 806965 - DNA, 25 bp, Mus musculus
tcatcaggctcaaggcaagtgttct

SEQ ID NO: 806966 - DNA, 25 bp, Mus musculus
tcatcaggctcatggcaagtgttct

SEQ ID NO: 806967 - DNA, 25 bp, Mus musculus
tcatcaggctctctggtgagaactg

SEQ ID NO: 806968 - DNA, 25 bp, Mus musculus
tcatcaggctctgtggtgagaactg

SEQ ID NO: 806969 - DNA, 25 bp, Mus musculus
tcatcagggagcactttgaacagat

SEQ ID NO: 806970 - DNA, 25 bp, Mus musculus
tcatcagggagctctttgaacagat

SEQ ID NO: 806971 - DNA, 25 bp, Mus musculus
tcatcagggattacgggagaggctt

SEQ ID NO: 806972 - DNA, 25 bp, Mus musculus
tcatcagggatttcgggagaggctt

SEQ ID NO: 806973 - DNA, 25 bp, Mus musculus
tcatcagggccaatgttctctcaaa

SEQ ID NO: 806974 - DNA, 25 bp, Mus musculus
tcatcagggccattgttctctcaaa

SEQ ID NO: 806975 - DNA, 25 bp, Mus musculus
tcatcagtatacctggttggcgtat

SEQ ID NO: 806976 - DNA, 25 bp, Mus musculus
tcatcagtatacgtggttggcgtat

SEQ ID NO: 806977 - DNA, 25 bp, Mus musculus
tcatcagtctccaatactaagtgaa

SEQ ID NO: 806978 - DNA, 25 bp, Mus musculus
tcatcagtctcctatactaagtgaa

SEQ ID NO: 806979 - DNA, 25 bp, Mus musculus
tcatcagtctttcctctggtgtcaa

SEQ ID NO: 806980 - DNA, 25 bp, Mus musculus
tcatcagtctttgctctggtgtcaa

SEQ ID NO: 806981 - DNA, 25 bp, Mus musculus
tcatcagtgaatcacagccttttct

SEQ ID NO: 806982 - DNA, 25 bp, Mus musculus
tcatcagtgaatgacagccttttct

SEQ ID NO: 806983 - DNA, 25 bp, Mus musculus
tcatcagtgaccacccctacagaag

SEQ ID NO: 806984 - DNA, 25 bp, Mus musculus
tcatcagtgacctcccctacagaag

SEQ ID NO: 806985 - DNA, 25 bp, Mus musculus
tcatcagtgcgtaactttggtgttt

SEQ ID NO: 806986 - DNA, 25 bp, Mus musculus
tcatcagtgcgttactttggtgttt

SEQ ID NO: 806987 - DNA, 25 bp, Mus musculus
tcatcagttcttaaatttttccact

SEQ ID NO: 806988 - DNA, 25 bp, Mus musculus
tcatcagttctttaatttttccact

SEQ ID NO: 806989 - DNA, 25 bp, Mus musculus
tcatcagtttatattgcaagtctca

SEQ ID NO: 806990 - DNA, 25 bp, Mus musculus
tcatcagtttattttgcaagtctca

SEQ ID NO: 806991 - DNA, 25 bp, Mus musculus
tcatcagtttgactgctcggtacca

SEQ ID NO: 806992 - DNA, 25 bp, Mus musculus
tcatcagtttgagtgctcggtacca

SEQ ID NO: 806993 - DNA, 25 bp, Mus musculus
tcatcatactccagaccatgtatcc

SEQ ID NO: 806994 - DNA, 25 bp, Mus musculus
tcatcatactcctgaccatgtatcc

SEQ ID NO: 806995 - DNA, 25 bp, Mus musculus
tcatcatactgaacgcagcgctgat

SEQ ID NO: 806996 - DNA, 25 bp, Mus musculus
tcatcatactgatcgcagcgctgat

SEQ ID NO: 806997 - DNA, 25 bp, Mus musculus
tcatcatagaccacagatatccccg

SEQ ID NO: 806998 - DNA, 25 bp, Mus musculus
tcatcatagacctcagatatccccg

SEQ ID NO: 806999 - DNA, 25 bp, Mus musculus
tcatcatatactcgctgaccttcca

SEQ ID NO: 807000 - DNA, 25 bp, Mus musculus
tcatcatatactggctgaccttcca

SEQ ID NO: 807001 - DNA, 25 bp, Mus musculus
tcatcatatggcaaccgagcagtgg

SEQ ID NO: 807002 - DNA, 25 bp, Mus musculus
tcatcatatggctaccgagcagtgg

SEQ ID NO: 807003 - DNA, 25 bp, Mus musculus
tcatcatcacctatggagagccact

SEQ ID NO: 807004 - DNA, 25 bp, Mus musculus
tcatcatcacctttggagagccact

SEQ ID NO: 807005 - DNA, 25 bp, Mus musculus
tcatcatcaggaattggcagctaca

SEQ ID NO: 807006 - DNA, 25 bp, Mus musculus
tcatcatcaggatttggcagctaca

SEQ ID NO: 807007 - DNA, 25 bp, Mus musculus
tcatcatccaatagagagagacgct

SEQ ID NO: 807008 - DNA, 25 bp, Mus musculus
tcatcatccaatccagcgcttctga

SEQ ID NO: 807009 - DNA, 25 bp, Mus musculus
tcatcatccaatgcagcgcttctga

SEQ ID NO: 807010 - DNA, 25 bp, Mus musculus
tcatcatccaattgagagagacgct

SEQ ID NO: 807011 - DNA, 25 bp, Mus musculus
tcatcatccccaatccaaactgtga

SEQ ID NO: 807012 - DNA, 25 bp, Mus musculus
tcatcatccccattccaaactgtga

SEQ ID NO: 807013 - DNA, 25 bp, Mus musculus
tcatcatcctatagtattacttaga

SEQ ID NO: 807014 - DNA, 25 bp, Mus musculus
tcatcatcctattgtattacttaga

SEQ ID NO: 807015 - DNA, 25 bp, Mus musculus
tcatcatcctcaacagcgtctgaga

SEQ ID NO: 807016 - DNA, 25 bp, Mus musculus
tcatcatcctcatcagcgtctgaga

SEQ ID NO: 807017 - DNA, 25 bp, Mus musculus
tcatcatcctgacccttatctaatc

SEQ ID NO: 807018 - DNA, 25 bp, Mus musculus
tcatcatcctgagccttatctaatc

SEQ ID NO: 807019 - DNA, 25 bp, Mus musculus
tcatcatctctcactggttttgttt

SEQ ID NO: 807020 - DNA, 25 bp, Mus musculus
tcatcatctctctctggttttgttt

SEQ ID NO: 807021 - DNA, 25 bp, Mus musculus
tcatcatctgggacagctagaactt

SEQ ID NO: 807022 - DNA, 25 bp, Mus musculus
tcatcatctgggtcagctagaactt

SEQ ID NO: 807023 - DNA, 25 bp, Mus musculus
tcatcatcttgtaggtatagggcac

SEQ ID NO: 807024 - DNA, 25 bp, Mus musculus
tcatcatcttgttggtatagggcac

SEQ ID NO: 807025 - DNA, 25 bp, Mus musculus
tcatcatgaccacaagcttgacgca

SEQ ID NO: 807026 - DNA, 25 bp, Mus musculus
tcatcatgaccagaagcttgacgca

SEQ ID NO: 807027 - DNA, 25 bp, Mus musculus
tcatcatgagttacaccacacccta

SEQ ID NO: 807028 - DNA, 25 bp, Mus musculus
tcatcatgagtttcaccacacccta

SEQ ID NO: 807029 - DNA, 25 bp, Mus musculus
tcatcatggactcggcaggttctga

SEQ ID NO: 807030 - DNA, 25 bp, Mus musculus
tcatcatggactgggcaggttctga

SEQ ID NO: 807031 - DNA, 25 bp, Mus musculus
tcatcatgggaccagtgagccagag

SEQ ID NO: 807032 - DNA, 25 bp, Mus musculus
tcatcatgggacgagtgagccagag

SEQ ID NO: 807033 - DNA, 25 bp, Mus musculus
tcatcatgtgccatacactcagagg

SEQ ID NO: 807034 - DNA, 25 bp, Mus musculus
tcatcatgtgccttacactcagagg

SEQ ID NO: 807035 - DNA, 25 bp, Mus musculus
tcatcatgtgtgagatattaaggat

SEQ ID NO: 807036 - DNA, 25 bp, Mus musculus
tcatcatgtgtgtgatattaaggat

SEQ ID NO: 807037 - DNA, 25 bp, Mus musculus
tcatcattaccaaagagggcagcct

SEQ ID NO: 807038 - DNA, 25 bp, Mus musculus
tcatcattaccatagagggcagcct

SEQ ID NO: 807039 - DNA, 25 bp, Mus musculus
tcatcattctaaagagcggctctga

SEQ ID NO: 807040 - DNA, 25 bp, Mus musculus
tcatcattctaatgagcggctctga

SEQ ID NO: 807041 - DNA, 25 bp, Mus musculus
tcatcattctttctcacaccgtgta

SEQ ID NO: 807042 - DNA, 25 bp, Mus musculus
tcatcattctttgtcacaccgtgta

SEQ ID NO: 807043 - DNA, 25 bp, Mus musculus
tcatcattgaccaattgggaagaat

SEQ ID NO: 807044 - DNA, 25 bp, Mus musculus
tcatcattgacctattgggaagaat

SEQ ID NO: 807045 - DNA, 25 bp, Mus musculus
tcatcattgagtatgggctagctgt

SEQ ID NO: 807046 - DNA, 25 bp, Mus musculus
tcatcattgagtttgggctagctgt

SEQ ID NO: 807047 - DNA, 25 bp, Mus musculus
tcatcattgcagacttcccttagag

SEQ ID NO: 807048 - DNA, 25 bp, Mus musculus
tcatcattgcagtcttcccttagag

SEQ ID NO: 807049 - DNA, 25 bp, Mus musculus
tcatcattggctcctttgtggcagt

SEQ ID NO: 807050 - DNA, 25 bp, Mus musculus
tcatcattggctgctttgtggcagt

SEQ ID NO: 807051 - DNA, 25 bp, Mus musculus
tcatcattggttccgggatcctgac

SEQ ID NO: 807052 - DNA, 25 bp, Mus musculus
tcatcattggttgcgggatcctgac

SEQ ID NO: 807053 - DNA, 25 bp, Mus musculus
tcatcattgttaatcccattgttaa

SEQ ID NO: 807054 - DNA, 25 bp, Mus musculus
tcatcattgttattcccattgttaa

SEQ ID NO: 807055 - DNA, 25 bp, Mus musculus
tcatcatttgctatcctatcccact

SEQ ID NO: 807056 - DNA, 25 bp, Mus musculus
tcatcatttgctttcctatcccact

SEQ ID NO: 807057 - DNA, 25 bp, Mus musculus
tcatcattttttcggctagttgaca

SEQ ID NO: 807058 - DNA, 25 bp, Mus musculus
tcatcattttttgggctagttgaca

SEQ ID NO: 807059 - DNA, 25 bp, Mus musculus
tcatccaaaccaccatactaggcta

SEQ ID NO: 807060 - DNA, 25 bp, Mus musculus
tcatccaaaccagcatactaggcta

SEQ ID NO: 807061 - DNA, 25 bp, Mus musculus
tcatccaaagttacaggagcttcag

SEQ ID NO: 807062 - DNA, 25 bp, Mus musculus
tcatccaaagtttcaggagcttcag

SEQ ID NO: 807063 - DNA, 25 bp, Mus musculus
tcatccaagatcaagcggcacgtgt

SEQ ID NO: 807064 - DNA, 25 bp, Mus musculus
tcatccaagatctagcggcacgtgt

SEQ ID NO: 807065 - DNA, 25 bp, Mus musculus
tcatccaagggacgagcgtggtttt

SEQ ID NO: 807066 - DNA, 25 bp, Mus musculus
tcatccaagggaggagcgtggtttt

SEQ ID NO: 807067 - DNA, 25 bp, Mus musculus
tcatccaagtgcctcctctataaga

SEQ ID NO: 807068 - DNA, 25 bp, Mus musculus
tcatccaagtgcgtcctctataaga

SEQ ID NO: 807069 - DNA, 25 bp, Mus musculus
tcatccaatgctaagttaccagctt

SEQ ID NO: 807070 - DNA, 25 bp, Mus musculus
tcatccaatgcttagttaccagctt

SEQ ID NO: 807071 - DNA, 25 bp, Mus musculus
tcatccacagtgaacttctctcagt

SEQ ID NO: 807072 - DNA, 25 bp, Mus musculus
tcatccacagtgtacttctctcagt

SEQ ID NO: 807073 - DNA, 25 bp, Mus musculus
tcatccacatggctctgctcaagag

SEQ ID NO: 807074 - DNA, 25 bp, Mus musculus
tcatccacatgggtctgctcaagag

SEQ ID NO: 807075 - DNA, 25 bp, Mus musculus
tcatccaccaacattttgccttaga

SEQ ID NO: 807076 - DNA, 25 bp, Mus musculus
tcatccaccaactttttgccttaga

SEQ ID NO: 807077 - DNA, 25 bp, Mus musculus
tcatccacccttagaactggctgga

SEQ ID NO: 807078 - DNA, 25 bp, Mus musculus
tcatccaccctttgaactggctgga

SEQ ID NO: 807079 - DNA, 25 bp, Mus musculus
tcatccaccgccaggagaaggctgc

SEQ ID NO: 807080 - DNA, 25 bp, Mus musculus
tcatccaccgcctggagaaggctgc

SEQ ID NO: 807081 - DNA, 25 bp, Mus musculus
tcatccacctggcagagggaatttc

SEQ ID NO: 807082 - DNA, 25 bp, Mus musculus
tcatccacctgggagagggaatttc

SEQ ID NO: 807083 - DNA, 25 bp, Mus musculus
tcatccacgatgctcagagccagag

SEQ ID NO: 807084 - DNA, 25 bp, Mus musculus
tcatccacgatggtcagagccagag

SEQ ID NO: 807085 - DNA, 25 bp, Mus musculus
tcatccagagatccgtttcttgtag

SEQ ID NO: 807086 - DNA, 25 bp, Mus musculus
tcatccagagatgcgtttcttgtag

SEQ ID NO: 807087 - DNA, 25 bp, Mus musculus
tcatccagatgactacaaagagggc

SEQ ID NO: 807088 - DNA, 25 bp, Mus musculus
tcatccagatgagtacaaagagggc

SEQ ID NO: 807089 - DNA, 25 bp, Mus musculus
tcatccagattgcacaccttaacca

SEQ ID NO: 807090 - DNA, 25 bp, Mus musculus
tcatccagattggacaccttaacca

SEQ ID NO: 807091 - DNA, 25 bp, Mus musculus
tcatccagcccactagacccttggg

SEQ ID NO: 807092 - DNA, 25 bp, Mus musculus
tcatccagcccagtagacccttggg

SEQ ID NO: 807093 - DNA, 25 bp, Mus musculus
tcatccagcggccagtccagcaaga

SEQ ID NO: 807094 - DNA, 25 bp, Mus musculus
tcatccagcggcgagtccagcaaga

SEQ ID NO: 807095 - DNA, 25 bp, Mus musculus
tcatccaggcctccggtggtgagca

SEQ ID NO: 807096 - DNA, 25 bp, Mus musculus
tcatccaggcctgcggtggtgagca

SEQ ID NO: 807097 - DNA, 25 bp, Mus musculus
tcatccaggtggctttagggtccta

SEQ ID NO: 807098 - DNA, 25 bp, Mus musculus
tcatccaggtgggtttagggtccta

SEQ ID NO: 807099 - DNA, 25 bp, Mus musculus
tcatccagtaatacacacctgtggg

SEQ ID NO: 807100 - DNA, 25 bp, Mus musculus
tcatccagtaattcacacctgtggg

SEQ ID NO: 807101 - DNA, 25 bp, Mus musculus
tcatccagtcacaatgtaccctcat

SEQ ID NO: 807102 - DNA, 25 bp, Mus musculus
tcatccagtcactatgtaccctcat

SEQ ID NO: 807103 - DNA, 25 bp, Mus musculus
tcatccagtctgcaggctgtgccca

SEQ ID NO: 807104 - DNA, 25 bp, Mus musculus
tcatccagtctggaggctgtgccca

SEQ ID NO: 807105 - DNA, 25 bp, Mus musculus
tcatccagttccagatccatgttgg

SEQ ID NO: 807106 - DNA, 25 bp, Mus musculus
tcatccagttcctgatccatgttgg

SEQ ID NO: 807107 - DNA, 25 bp, Mus musculus
tcatccatagctcaaattaccctaa

SEQ ID NO: 807108 - DNA, 25 bp, Mus musculus
tcatccatagctgaaattaccctaa

SEQ ID NO: 807109 - DNA, 25 bp, Mus musculus
tcatccatatcaattgttctctctc

SEQ ID NO: 807110 - DNA, 25 bp, Mus musculus
tcatccatatcatttgttctctctc

SEQ ID NO: 807111 - DNA, 25 bp, Mus musculus
tcatccatcagtactgccagggtta

SEQ ID NO: 807112 - DNA, 25 bp, Mus musculus
tcatccatcagttctgccagggtta

SEQ ID NO: 807113 - DNA, 25 bp, Mus musculus
tcatccatcccaatattcattcatc

SEQ ID NO: 807114 - DNA, 25 bp, Mus musculus
tcatccatcccattattcattcatc

SEQ ID NO: 807115 - DNA, 25 bp, Mus musculus
tcatccatccgtatcaggcaggttt

SEQ ID NO: 807116 - DNA, 25 bp, Mus musculus
tcatccatccgtttcaggcaggttt

SEQ ID NO: 807117 - DNA, 25 bp, Mus musculus
tcatccatctctccctaagggacaa

SEQ ID NO: 807118 - DNA, 25 bp, Mus musculus
tcatccatctctgcctaagggacaa

SEQ ID NO: 807119 - DNA, 25 bp, Mus musculus
tcatccatgcatagtctctttctaa

SEQ ID NO: 807120 - DNA, 25 bp, Mus musculus
tcatccatgcattgtctctttctaa

SEQ ID NO: 807121 - DNA, 25 bp, Mus musculus
tcatccattccgatgtcatggcaga

SEQ ID NO: 807122 - DNA, 25 bp, Mus musculus
tcatccattccgttgtcatggcaga

SEQ ID NO: 807123 - DNA, 25 bp, Mus musculus
tcatccattgtcaaccgtgtggcac

SEQ ID NO: 807124 - DNA, 25 bp, Mus musculus
tcatccattgtctaccgtgtggcac

SEQ ID NO: 807125 - DNA, 25 bp, Mus musculus
tcatcccaacagatcctgggcttgt

SEQ ID NO: 807126 - DNA, 25 bp, Mus musculus
tcatcccaacagcagttaccatgga

SEQ ID NO: 807127 - DNA, 25 bp, Mus musculus
tcatcccaacaggagttaccatgga

SEQ ID NO: 807128 - DNA, 25 bp, Mus musculus
tcatcccaacagttcctgggcttgt

SEQ ID NO: 807129 - DNA, 25 bp, Mus musculus
tcatcccaagtcagtctcaaaattc

SEQ ID NO: 807130 - DNA, 25 bp, Mus musculus
tcatcccaagtcatagggttgcaag

SEQ ID NO: 807131 - DNA, 25 bp, Mus musculus
tcatcccaagtctgtctcaaaattc

SEQ ID NO: 807132 - DNA, 25 bp, Mus musculus
tcatcccaagtcttagggttgcaag

SEQ ID NO: 807133 - DNA, 25 bp, Mus musculus
tcatcccaccagagttcaaggcagg

SEQ ID NO: 807134 - DNA, 25 bp, Mus musculus
tcatcccaccagtgttcaaggcagg

SEQ ID NO: 807135 - DNA, 25 bp, Mus musculus
tcatcccagaacagcagtttcaggg

SEQ ID NO: 807136 - DNA, 25 bp, Mus musculus
tcatcccagaactgcagtttcaggg

SEQ ID NO: 807137 - DNA, 25 bp, Mus musculus
tcatcccagagcctaccctgaaaag

SEQ ID NO: 807138 - DNA, 25 bp, Mus musculus
tcatcccagagcgtaccctgaaaag

SEQ ID NO: 807139 - DNA, 25 bp, Mus musculus
tcatcccagatgattgtgacggtca

SEQ ID NO: 807140 - DNA, 25 bp, Mus musculus
tcatcccagatgtttgtgacggtca

SEQ ID NO: 807141 - DNA, 25 bp, Mus musculus
tcatcccagcacacttctaatagac

SEQ ID NO: 807142 - DNA, 25 bp, Mus musculus
tcatcccagcactcttctaatagac

SEQ ID NO: 807143 - DNA, 25 bp, Mus musculus
tcatcccaggacaggctccataaca

SEQ ID NO: 807144 - DNA, 25 bp, Mus musculus
tcatcccaggactggctccataaca

SEQ ID NO: 807145 - DNA, 25 bp, Mus musculus
tcatcccagtctcagggtggaggca

SEQ ID NO: 807146 - DNA, 25 bp, Mus musculus
tcatcccagtctgagggtggaggca

SEQ ID NO: 807147 - DNA, 25 bp, Mus musculus
tcatcccagtgcctgcctcagaaaa

SEQ ID NO: 807148 - DNA, 25 bp, Mus musculus
tcatcccagtgcgtgcctcagaaaa

SEQ ID NO: 807149 - DNA, 25 bp, Mus musculus
tcatcccagttgagcctttgtcagc

SEQ ID NO: 807150 - DNA, 25 bp, Mus musculus
tcatcccagttgtgcctttgtcagc

SEQ ID NO: 807151 - DNA, 25 bp, Mus musculus
tcatcccatcacatagggagactaa

SEQ ID NO: 807152 - DNA, 25 bp, Mus musculus
tcatcccatcacttagggagactaa

SEQ ID NO: 807153 - DNA, 25 bp, Mus musculus
tcatcccatctcattttatctctag

SEQ ID NO: 807154 - DNA, 25 bp, Mus musculus
tcatcccatctctttttatctctag

SEQ ID NO: 807155 - DNA, 25 bp, Mus musculus
tcatccccaataaagatctcccagt

SEQ ID NO: 807156 - DNA, 25 bp, Mus musculus
tcatccccaatatagatctcccagt

SEQ ID NO: 807157 - DNA, 25 bp, Mus musculus
tcatccccagtgaaaaacagagaga

SEQ ID NO: 807158 - DNA, 25 bp, Mus musculus
tcatccccagtgtaaaacagagaga

SEQ ID NO: 807159 - DNA, 25 bp, Mus musculus
tcatccccatagaggcctctgtagg

SEQ ID NO: 807160 - DNA, 25 bp, Mus musculus
tcatccccatagtggcctctgtagg

SEQ ID NO: 807161 - DNA, 25 bp, Mus musculus
tcatccccgggtagcagtacagaag

SEQ ID NO: 807162 - DNA, 25 bp, Mus musculus
tcatccccgggttgcagtacagaag

SEQ ID NO: 807163 - DNA, 25 bp, Mus musculus
tcatcccctgatagctggagacaga

SEQ ID NO: 807164 - DNA, 25 bp, Mus musculus
tcatcccctgattgctggagacaga

SEQ ID NO: 807165 - DNA, 25 bp, Mus musculus
tcatccccttcgagagcattaacta

SEQ ID NO: 807166 - DNA, 25 bp, Mus musculus
tcatccccttcgtgagcattaacta

SEQ ID NO: 807167 - DNA, 25 bp, Mus musculus
tcatcccctttgcactgtaatgagg

SEQ ID NO: 807168 - DNA, 25 bp, Mus musculus
tcatcccctttggactgtaatgagg

SEQ ID NO: 807169 - DNA, 25 bp, Mus musculus
tcatccccttttcaatacgacacat

SEQ ID NO: 807170 - DNA, 25 bp, Mus musculus
tcatccccttttgaatacgacacat

SEQ ID NO: 807171 - DNA, 25 bp, Mus musculus
tcatcccgaaaccatgtgaattcaa

SEQ ID NO: 807172 - DNA, 25 bp, Mus musculus
tcatcccgaaacgatgtgaattcaa

SEQ ID NO: 807173 - DNA, 25 bp, Mus musculus
tcatcccgaaggatcttgctcagaa

SEQ ID NO: 807174 - DNA, 25 bp, Mus musculus
tcatcccgaaggttcttgctcagaa

SEQ ID NO: 807175 - DNA, 25 bp, Mus musculus
tcatcccgcaaactatttctctatt

SEQ ID NO: 807176 - DNA, 25 bp, Mus musculus
tcatcccgcaaagtatttctctatt

SEQ ID NO: 807177 - DNA, 25 bp, Mus musculus
tcatcccgtggtccagatctggcta

SEQ ID NO: 807178 - DNA, 25 bp, Mus musculus
tcatcccgtggtgcagatctggcta

SEQ ID NO: 807179 - DNA, 25 bp, Mus musculus
tcatccctaagcctacttgctgtag

SEQ ID NO: 807180 - DNA, 25 bp, Mus musculus
tcatccctaagcgtacttgctgtag

SEQ ID NO: 807181 - DNA, 25 bp, Mus musculus
tcatccctaccaccatagtggagtt

SEQ ID NO: 807182 - DNA, 25 bp, Mus musculus
tcatccctaccagcatagtggagtt

SEQ ID NO: 807183 - DNA, 25 bp, Mus musculus
tcatccctctacattgtaccagaag

SEQ ID NO: 807184 - DNA, 25 bp, Mus musculus
tcatccctctactttgtaccagaag

SEQ ID NO: 807185 - DNA, 25 bp, Mus musculus
tcatccctctctaacatcattgatt

SEQ ID NO: 807186 - DNA, 25 bp, Mus musculus
tcatccctctcttacatcattgatt

SEQ ID NO: 807187 - DNA, 25 bp, Mus musculus
tcatccctctgaactagcccatgct

SEQ ID NO: 807188 - DNA, 25 bp, Mus musculus
tcatccctctgatctagcccatgct

SEQ ID NO: 807189 - DNA, 25 bp, Mus musculus
tcatccctctttacagcaatagcat

SEQ ID NO: 807190 - DNA, 25 bp, Mus musculus
tcatccctcttttcagcaatagcat

SEQ ID NO: 807191 - DNA, 25 bp, Mus musculus
tcatccctgcagctattggcattga

SEQ ID NO: 807192 - DNA, 25 bp, Mus musculus
tcatccctgcaggtattggcattga

SEQ ID NO: 807193 - DNA, 25 bp, Mus musculus
tcatccctggacagcaatgaccaga

SEQ ID NO: 807194 - DNA, 25 bp, Mus musculus
tcatccctggactgcaatgaccaga

SEQ ID NO: 807195 - DNA, 25 bp, Mus musculus
tcatcccttcaaagcttttccaaag

SEQ ID NO: 807196 - DNA, 25 bp, Mus musculus
tcatcccttcaatgcttttccaaag

SEQ ID NO: 807197 - DNA, 25 bp, Mus musculus
tcatcccttgccaaactgaggagag

SEQ ID NO: 807198 - DNA, 25 bp, Mus musculus
tcatcccttgcctaactgaggagag

SEQ ID NO: 807199 - DNA, 25 bp, Mus musculus
tcatcccttgtcattctactgtgtc

SEQ ID NO: 807200 - DNA, 25 bp, Mus musculus
tcatcccttgtctttctactgtgtc

SEQ ID NO: 807201 - DNA, 25 bp, Mus musculus
tcatccctttctcttcagataaatg

SEQ ID NO: 807202 - DNA, 25 bp, Mus musculus
tcatccctttctgttcagataaatg

SEQ ID NO: 807203 - DNA, 25 bp, Mus musculus
tcatccgatgcaaggtggaccccaa

SEQ ID NO: 807204 - DNA, 25 bp, Mus musculus
tcatccgatgcatggtggaccccaa

SEQ ID NO: 807205 - DNA, 25 bp, Mus musculus
tcatccgctgctagttatttacctg

SEQ ID NO: 807206 - DNA, 25 bp, Mus musculus
tcatccgctgcttgttatttacctg

SEQ ID NO: 807207 - DNA, 25 bp, Mus musculus
tcatccggaaagcaaatgtgaggtt

SEQ ID NO: 807208 - DNA, 25 bp, Mus musculus
tcatccggaaaggaaatgtgaggtt

SEQ ID NO: 807209 - DNA, 25 bp, Mus musculus
tcatccggctgcagaagtgcaagcg

SEQ ID NO: 807210 - DNA, 25 bp, Mus musculus
tcatccggctgctgaagtgcaagcg

SEQ ID NO: 807211 - DNA, 25 bp, Mus musculus
tcatccgggactagctgagcatcac

SEQ ID NO: 807212 - DNA, 25 bp, Mus musculus
tcatccgggacttgctgagcatcac

SEQ ID NO: 807213 - DNA, 25 bp, Mus musculus
tcatccgggctgaggctgccaagat

SEQ ID NO: 807214 - DNA, 25 bp, Mus musculus
tcatccgggctgtggctgccaagat

SEQ ID NO: 807215 - DNA, 25 bp, Mus musculus
tcatccgggttcctagagagccgat

SEQ ID NO: 807216 - DNA, 25 bp, Mus musculus
tcatccgggttcgtagagagccgat

SEQ ID NO: 807217 - DNA, 25 bp, Mus musculus
tcatccggttacagggttacgtgtt

SEQ ID NO: 807218 - DNA, 25 bp, Mus musculus
tcatccggttactgggttacgtgtt

SEQ ID NO: 807219 - DNA, 25 bp, Mus musculus
tcatccgtacctaagttatgcttaa

SEQ ID NO: 807220 - DNA, 25 bp, Mus musculus
tcatccgtaccttagttatgcttaa

SEQ ID NO: 807221 - DNA, 25 bp, Mus musculus
tcatccgtcatcatccgctagaggg

SEQ ID NO: 807222 - DNA, 25 bp, Mus musculus
tcatccgtcatcttccgctagaggg

SEQ ID NO: 807223 - DNA, 25 bp, Mus musculus
tcatccgtgttcagccgtttctgaa

SEQ ID NO: 807224 - DNA, 25 bp, Mus musculus
tcatccgtgttctgccgtttctgaa

SEQ ID NO: 807225 - DNA, 25 bp, Mus musculus
tcatccgttattcctgaactttggg

SEQ ID NO: 807226 - DNA, 25 bp, Mus musculus
tcatccgttattgctgaactttggg

SEQ ID NO: 807227 - DNA, 25 bp, Mus musculus
tcatcctacccaatcgtggtgtgaa

SEQ ID NO: 807228 - DNA, 25 bp, Mus musculus
tcatcctacccattcgtggtgtgaa

SEQ ID NO: 807229 - DNA, 25 bp, Mus musculus
tcatcctacttcaccaacatgtttg

SEQ ID NO: 807230 - DNA, 25 bp, Mus musculus
tcatcctacttctccaacatgtttg

SEQ ID NO: 807231 - DNA, 25 bp, Mus musculus
tcatcctagagtaattttgtttgtt

SEQ ID NO: 807232 - DNA, 25 bp, Mus musculus
tcatcctagagttattttgtttgtt

SEQ ID NO: 807233 - DNA, 25 bp, Mus musculus
tcatcctagtctctctgctaagtgt

SEQ ID NO: 807234 - DNA, 25 bp, Mus musculus
tcatcctagtctgtctgctaagtgt

SEQ ID NO: 807235 - DNA, 25 bp, Mus musculus
tcatcctcaagacattccttcggga

SEQ ID NO: 807236 - DNA, 25 bp, Mus musculus
tcatcctcaagacgagcagcgcagt

SEQ ID NO: 807237 - DNA, 25 bp, Mus musculus
tcatcctcaagagattccttcggga

SEQ ID NO: 807238 - DNA, 25 bp, Mus musculus
tcatcctcaagaggagcagcgcagt

SEQ ID NO: 807239 - DNA, 25 bp, Mus musculus
tcatcctcacatattagaatcttaa

SEQ ID NO: 807240 - DNA, 25 bp, Mus musculus
tcatcctcacattttagaatcttaa

SEQ ID NO: 807241 - DNA, 25 bp, Mus musculus
tcatcctcaggcattgtgtgtgctt

SEQ ID NO: 807242 - DNA, 25 bp, Mus musculus
tcatcctcaggctttgtgtgtgctt

SEQ ID NO: 807243 - DNA, 25 bp, Mus musculus
tcatcctcagggaagcactatctct

SEQ ID NO: 807244 - DNA, 25 bp, Mus musculus
tcatcctcagggtagcactatctct

SEQ ID NO: 807245 - DNA, 25 bp, Mus musculus
tcatcctcattgctaatttacagca

SEQ ID NO: 807246 - DNA, 25 bp, Mus musculus
tcatcctcattggtaatttacagca

SEQ ID NO: 807247 - DNA, 25 bp, Mus musculus
tcatcctcctgaccatgcacaggaa

SEQ ID NO: 807248 - DNA, 25 bp, Mus musculus
tcatcctcctgagcatgcacaggaa

SEQ ID NO: 807249 - DNA, 25 bp, Mus musculus
tcatcctcctggaaccagtgttaca

SEQ ID NO: 807250 - DNA, 25 bp, Mus musculus
tcatcctcctggtaccagtgttaca

SEQ ID NO: 807251 - DNA, 25 bp, Mus musculus
tcatcctcctgtcgtcggtactggt

SEQ ID NO: 807252 - DNA, 25 bp, Mus musculus
tcatcctcctgtggtcggtactggt

SEQ ID NO: 807253 - DNA, 25 bp, Mus musculus
tcatcctcctttatcgaactcgaaa

SEQ ID NO: 807254 - DNA, 25 bp, Mus musculus
tcatcctcctttttcgaactcgaaa

SEQ ID NO: 807255 - DNA, 25 bp, Mus musculus
tcatcctctaaccagaagcctgtgg

SEQ ID NO: 807256 - DNA, 25 bp, Mus musculus
tcatcctctaacgagaagcctgtgg

SEQ ID NO: 807257 - DNA, 25 bp, Mus musculus
tcatcctctatgaggaccttgtgca

SEQ ID NO: 807258 - DNA, 25 bp, Mus musculus
tcatcctctatgtggaccttgtgca

SEQ ID NO: 807259 - DNA, 25 bp, Mus musculus
tcatcctctcgcatgtttgtttaaa

SEQ ID NO: 807260 - DNA, 25 bp, Mus musculus
tcatcctctcgcttgtttgtttaaa

SEQ ID NO: 807261 - DNA, 25 bp, Mus musculus
tcatcctctgcgagggcaccaggca

SEQ ID NO: 807262 - DNA, 25 bp, Mus musculus
tcatcctctgcgtgggcaccaggca

SEQ ID NO: 807263 - DNA, 25 bp, Mus musculus
tcatcctctggcacagcttcctaag

SEQ ID NO: 807264 - DNA, 25 bp, Mus musculus
tcatcctctggctcagcttcctaag

SEQ ID NO: 807265 - DNA, 25 bp, Mus musculus
tcatcctctgggagattgcaaggag

SEQ ID NO: 807266 - DNA, 25 bp, Mus musculus
tcatcctctgggtgattgcaaggag

SEQ ID NO: 807267 - DNA, 25 bp, Mus musculus
tcatcctcttaaattgctccgacca

SEQ ID NO: 807268 - DNA, 25 bp, Mus musculus
tcatcctcttaatttgctccgacca

SEQ ID NO: 807269 - DNA, 25 bp, Mus musculus
tcatcctctttgaggcagaagccta

SEQ ID NO: 807270 - DNA, 25 bp, Mus musculus
tcatcctctttgtggcagaagccta

SEQ ID NO: 807271 - DNA, 25 bp, Mus musculus
tcatcctgaaggacctacaacttag

SEQ ID NO: 807272 - DNA, 25 bp, Mus musculus
tcatcctgaaggtcctacaacttag

SEQ ID NO: 807273 - DNA, 25 bp, Mus musculus
tcatcctgaatgagtgacttcctgc

SEQ ID NO: 807274 - DNA, 25 bp, Mus musculus
tcatcctgaatgtgtgacttcctgc

SEQ ID NO: 807275 - DNA, 25 bp, Mus musculus
tcatcctgagatctaagcaagtatc

SEQ ID NO: 807276 - DNA, 25 bp, Mus musculus
tcatcctgagatgtaagcaagtatc

SEQ ID NO: 807277 - DNA, 25 bp, Mus musculus
tcatcctgagccatatctaatccag

SEQ ID NO: 807278 - DNA, 25 bp, Mus musculus
tcatcctgagccttatctaatccag

SEQ ID NO: 807279 - DNA, 25 bp, Mus musculus
tcatcctgatgacatacccctttga

SEQ ID NO: 807280 - DNA, 25 bp, Mus musculus
tcatcctgatgagatacccctttga

SEQ ID NO: 807281 - DNA, 25 bp, Mus musculus
tcatcctgcacccacctgatttggg

SEQ ID NO: 807282 - DNA, 25 bp, Mus musculus
tcatcctgcaccgacctgatttggg

SEQ ID NO: 807283 - DNA, 25 bp, Mus musculus
tcatcctgcagacaaattgggaaca

SEQ ID NO: 807284 - DNA, 25 bp, Mus musculus
tcatcctgcagagaaattgggaaca

SEQ ID NO: 807285 - DNA, 25 bp, Mus musculus
tcatcctgccacacaggtggtagaa

SEQ ID NO: 807286 - DNA, 25 bp, Mus musculus
tcatcctgccactcaggtggtagaa

SEQ ID NO: 807287 - DNA, 25 bp, Mus musculus
tcatcctgcctaagcgcttgggaag

SEQ ID NO: 807288 - DNA, 25 bp, Mus musculus
tcatcctgcctatgcgcttgggaag

SEQ ID NO: 807289 - DNA, 25 bp, Mus musculus
tcatcctgcctgaacctaggatttc

SEQ ID NO: 807290 - DNA, 25 bp, Mus musculus
tcatcctgcctgtacctaggatttc

SEQ ID NO: 807291 - DNA, 25 bp, Mus musculus
tcatcctgctgtatcagttctgatt

SEQ ID NO: 807292 - DNA, 25 bp, Mus musculus
tcatcctgctgtttcagttctgatt

SEQ ID NO: 807293 - DNA, 25 bp, Mus musculus
tcatcctgctttccattctaaaggt

SEQ ID NO: 807294 - DNA, 25 bp, Mus musculus
tcatcctgctttgcattctaaaggt

SEQ ID NO: 807295 - DNA, 25 bp, Mus musculus
tcatcctggcctcatttctggtgta

SEQ ID NO: 807296 - DNA, 25 bp, Mus musculus
tcatcctggcctgatttctggtgta

SEQ ID NO: 807297 - DNA, 25 bp, Mus musculus
tcatcctggctgaactggttgacta

SEQ ID NO: 807298 - DNA, 25 bp, Mus musculus
tcatcctggctgtactggttgacta

SEQ ID NO: 807299 - DNA, 25 bp, Mus musculus
tcatcctgggatccttctaacttca

SEQ ID NO: 807300 - DNA, 25 bp, Mus musculus
tcatcctgggatgcttctaacttca

SEQ ID NO: 807301 - DNA, 25 bp, Mus musculus
tcatcctgggtgattttatgcttca

SEQ ID NO: 807302 - DNA, 25 bp, Mus musculus
tcatcctgggtgtttttatgcttca

SEQ ID NO: 807303 - DNA, 25 bp, Mus musculus
tcatcctggtacagcaaggacgggt

SEQ ID NO: 807304 - DNA, 25 bp, Mus musculus
tcatcctggtactgcaaggacgggt

SEQ ID NO: 807305 - DNA, 25 bp, Mus musculus
tcatcctggtctaggttctttgtca

SEQ ID NO: 807306 - DNA, 25 bp, Mus musculus
tcatcctggtcttggttctttgtca

SEQ ID NO: 807307 - DNA, 25 bp, Mus musculus
tcatcctgtactagaccctgtggaa

SEQ ID NO: 807308 - DNA, 25 bp, Mus musculus
tcatcctgtactccgtggtgacatc

SEQ ID NO: 807309 - DNA, 25 bp, Mus musculus
tcatcctgtactgcgtggtgacatc

SEQ ID NO: 807310 - DNA, 25 bp, Mus musculus
tcatcctgtacttgaccctgtggaa

SEQ ID NO: 807311 - DNA, 25 bp, Mus musculus
tcatcctgtcaaacaccctggaagg

SEQ ID NO: 807312 - DNA, 25 bp, Mus musculus
tcatcctgtcaatcaccctggaagg

SEQ ID NO: 807313 - DNA, 25 bp, Mus musculus
tcatcctgtccaacgtgtgcctgat

SEQ ID NO: 807314 - DNA, 25 bp, Mus musculus
tcatcctgtccatcgtgtgcctgat

SEQ ID NO: 807315 - DNA, 25 bp, Mus musculus
tcatcctgtctaccatttctgtgac

SEQ ID NO: 807316 - DNA, 25 bp, Mus musculus
tcatcctgtctagcatttctgtgac

SEQ ID NO: 807317 - DNA, 25 bp, Mus musculus
tcatcctgtctgagtgccaagccta

SEQ ID NO: 807318 - DNA, 25 bp, Mus musculus
tcatcctgtctgtgtgccaagccta

SEQ ID NO: 807319 - DNA, 25 bp, Mus musculus
tcatcctgtgcacctagaaaagttg

SEQ ID NO: 807320 - DNA, 25 bp, Mus musculus
tcatcctgtgcagctagaaaagttg

SEQ ID NO: 807321 - DNA, 25 bp, Mus musculus
tcatcctgtgctacttggctgttca

SEQ ID NO: 807322 - DNA, 25 bp, Mus musculus
tcatcctgtgcttcttggctgttca

SEQ ID NO: 807323 - DNA, 25 bp, Mus musculus
tcatcctgttgtctggcgcttgtga

SEQ ID NO: 807324 - DNA, 25 bp, Mus musculus
tcatcctgttgtgtggcgcttgtga

SEQ ID NO: 807325 - DNA, 25 bp, Mus musculus
tcatccttaactcctgatgcaggga

SEQ ID NO: 807326 - DNA, 25 bp, Mus musculus
tcatccttaactgctgatgcaggga

SEQ ID NO: 807327 - DNA, 25 bp, Mus musculus
tcatccttagctacctgagttccag

SEQ ID NO: 807328 - DNA, 25 bp, Mus musculus
tcatccttagcttcctgagttccag

SEQ ID NO: 807329 - DNA, 25 bp, Mus musculus
tcatccttcaccagtcttagaaaca

SEQ ID NO: 807330 - DNA, 25 bp, Mus musculus
tcatccttcacctgtcttagaaaca

SEQ ID NO: 807331 - DNA, 25 bp, Mus musculus
tcatccttccaacggcagtgcttac

SEQ ID NO: 807332 - DNA, 25 bp, Mus musculus
tcatccttccaagggcagtgcttac

SEQ ID NO: 807333 - DNA, 25 bp, Mus musculus
tcatccttctcaaccttttaactca

SEQ ID NO: 807334 - DNA, 25 bp, Mus musculus
tcatccttctcatccttttaactca

SEQ ID NO: 807335 - DNA, 25 bp, Mus musculus
tcatccttctctctcaaagtctgac

SEQ ID NO: 807336 - DNA, 25 bp, Mus musculus
tcatccttctctgtcaaagtctgac

SEQ ID NO: 807337 - DNA, 25 bp, Mus musculus
tcatccttctgccattagccagagg

SEQ ID NO: 807338 - DNA, 25 bp, Mus musculus
tcatccttctgcgattagccagagg

SEQ ID NO: 807339 - DNA, 25 bp, Mus musculus
tcatccttctgtcccttggctaagg

SEQ ID NO: 807340 - DNA, 25 bp, Mus musculus
tcatccttctgtgccttggctaagg

SEQ ID NO: 807341 - DNA, 25 bp, Mus musculus
tcatccttgccaacactgttcaaat

SEQ ID NO: 807342 - DNA, 25 bp, Mus musculus
tcatccttgccatcactgttcaaat

SEQ ID NO: 807343 - DNA, 25 bp, Mus musculus
tcatccttggctatacagcaacttc

SEQ ID NO: 807344 - DNA, 25 bp, Mus musculus
tcatccttggctttacagcaacttc

SEQ ID NO: 807345 - DNA, 25 bp, Mus musculus
tcatccttggtgcttagtgctgcag

SEQ ID NO: 807346 - DNA, 25 bp, Mus musculus
tcatccttggtggttagtgctgcag

SEQ ID NO: 807347 - DNA, 25 bp, Mus musculus
tcatccttgtggagcttacacacac

SEQ ID NO: 807348 - DNA, 25 bp, Mus musculus
tcatccttgtggtgcttacacacac

SEQ ID NO: 807349 - DNA, 25 bp, Mus musculus
tcatcctttatcacggctcctacga

SEQ ID NO: 807350 - DNA, 25 bp, Mus musculus
tcatcctttatctcggctcctacga

SEQ ID NO: 807351 - DNA, 25 bp, Mus musculus
tcatcctttcagagagccgaggcgt

SEQ ID NO: 807352 - DNA, 25 bp, Mus musculus
tcatcctttcagtgagccgaggcgt

SEQ ID NO: 807353 - DNA, 25 bp, Mus musculus
tcatcctttctgatcccttaatgtt

SEQ ID NO: 807354 - DNA, 25 bp, Mus musculus
tcatcctttctgttcccttaatgtt

SEQ ID NO: 807355 - DNA, 25 bp, Mus musculus
tcatcctttgggaatttttcctgaa

SEQ ID NO: 807356 - DNA, 25 bp, Mus musculus
tcatcctttgggtatttttcctgaa

SEQ ID NO: 807357 - DNA, 25 bp, Mus musculus
tcatccttttcgacttgtattttat

SEQ ID NO: 807358 - DNA, 25 bp, Mus musculus
tcatccttttcgtcttgtattttat

SEQ ID NO: 807359 - DNA, 25 bp, Mus musculus
tcatccttttgcctctgatagggag

SEQ ID NO: 807360 - DNA, 25 bp, Mus musculus
tcatccttttgcgtctgatagggag

SEQ ID NO: 807361 - DNA, 25 bp, Mus musculus
tcatcgacacgacccaaattaattc

SEQ ID NO: 807362 - DNA, 25 bp, Mus musculus
tcatcgacacgagccaaattaattc

SEQ ID NO: 807363 - DNA, 25 bp, Mus musculus
tcatcgacggctagtactgggactc

SEQ ID NO: 807364 - DNA, 25 bp, Mus musculus
tcatcgacggcttgtactgggactc

SEQ ID NO: 807365 - DNA, 25 bp, Mus musculus
tcatcgactcctaggcatttgcagc

SEQ ID NO: 807366 - DNA, 25 bp, Mus musculus
tcatcgactccttggcatttgcagc

SEQ ID NO: 807367 - DNA, 25 bp, Mus musculus
tcatcgagcagtccttggttctgtg

SEQ ID NO: 807368 - DNA, 25 bp, Mus musculus
tcatcgagcagtgcttggttctgtg

SEQ ID NO: 807369 - DNA, 25 bp, Mus musculus
tcatcgagctatagcttgaaacgct

SEQ ID NO: 807370 - DNA, 25 bp, Mus musculus
tcatcgagctattgcttgaaacgct

SEQ ID NO: 807371 - DNA, 25 bp, Mus musculus
tcatcgaggagacgcacgctgtgct

SEQ ID NO: 807372 - DNA, 25 bp, Mus musculus
tcatcgaggagaggcacgctgtgct

SEQ ID NO: 807373 - DNA, 25 bp, Mus musculus
tcatcgaggagcacagctgggcaca

SEQ ID NO: 807374 - DNA, 25 bp, Mus musculus
tcatcgaggagctcagctgggcaca

SEQ ID NO: 807375 - DNA, 25 bp, Mus musculus
tcatcgagtcccctacgctgagtgt

SEQ ID NO: 807376 - DNA, 25 bp, Mus musculus
tcatcgagtcccgtacgctgagtgt

SEQ ID NO: 807377 - DNA, 25 bp, Mus musculus
tcatcgatgacaccgacctggaaga

SEQ ID NO: 807378 - DNA, 25 bp, Mus musculus
tcatcgatgacagcgacctggaaga

SEQ ID NO: 807379 - DNA, 25 bp, Mus musculus
tcatcgatgaccaattctacatccc

SEQ ID NO: 807380 - DNA, 25 bp, Mus musculus
tcatcgatgacctattctacatccc

SEQ ID NO: 807381 - DNA, 25 bp, Mus musculus
tcatcgatgattaccaagccttgct

SEQ ID NO: 807382 - DNA, 25 bp, Mus musculus
tcatcgatgatttccaagccttgct

SEQ ID NO: 807383 - DNA, 25 bp, Mus musculus
tcatcgcaagcaagcaagcaggaat

SEQ ID NO: 807384 - DNA, 25 bp, Mus musculus
tcatcgcaagcatgcaagcaggaat

SEQ ID NO: 807385 - DNA, 25 bp, Mus musculus
tcatcgcactcgctagggtgatcat

SEQ ID NO: 807386 - DNA, 25 bp, Mus musculus
tcatcgcactcggtagggtgatcat

SEQ ID NO: 807387 - DNA, 25 bp, Mus musculus
tcatcgcagccgagaagccgctcag

SEQ ID NO: 807388 - DNA, 25 bp, Mus musculus
tcatcgcagccgaggcgggtctcac

SEQ ID NO: 807389 - DNA, 25 bp, Mus musculus
tcatcgcagccgtgaagccgctcag

SEQ ID NO: 807390 - DNA, 25 bp, Mus musculus
tcatcgcagccgtggcgggtctcac

SEQ ID NO: 807391 - DNA, 25 bp, Mus musculus
tcatcgcaggaaaaacatcatcaat

SEQ ID NO: 807392 - DNA, 25 bp, Mus musculus
tcatcgcaggaataacatcatcaat

SEQ ID NO: 807393 - DNA, 25 bp, Mus musculus
tcatcgcaggccagagaatgctctg

SEQ ID NO: 807394 - DNA, 25 bp, Mus musculus
tcatcgcaggcctgagaatgctctg

SEQ ID NO: 807395 - DNA, 25 bp, Mus musculus
tcatcgccacagaggaaggcttcaa

SEQ ID NO: 807396 - DNA, 25 bp, Mus musculus
tcatcgccacagtggaaggcttcaa

SEQ ID NO: 807397 - DNA, 25 bp, Mus musculus
tcatcgccatcaaccgacatgggtt

SEQ ID NO: 807398 - DNA, 25 bp, Mus musculus
tcatcgccatcatccgacatgggtt

SEQ ID NO: 807399 - DNA, 25 bp, Mus musculus
tcatcgccatgcaggttgtcctgga

SEQ ID NO: 807400 - DNA, 25 bp, Mus musculus
tcatcgccatgctggttgtcctgga

SEQ ID NO: 807401 - DNA, 25 bp, Mus musculus
tcatcgcctctgagctataggttgt

SEQ ID NO: 807402 - DNA, 25 bp, Mus musculus
tcatcgcctctgtgctataggttgt

SEQ ID NO: 807403 - DNA, 25 bp, Mus musculus
tcatcgcgccaaattttgcgctcgg

SEQ ID NO: 807404 - DNA, 25 bp, Mus musculus
tcatcgcgccaatttttgcgctcgg

SEQ ID NO: 807405 - DNA, 25 bp, Mus musculus
tcatcgctccagctgttttgcaatg

SEQ ID NO: 807406 - DNA, 25 bp, Mus musculus
tcatcgctccaggtgttttgcaatg

SEQ ID NO: 807407 - DNA, 25 bp, Mus musculus
tcatcgctctaacaacgaccagttg

SEQ ID NO: 807408 - DNA, 25 bp, Mus musculus
tcatcgctctaagaacgaccagttg

SEQ ID NO: 807409 - DNA, 25 bp, Mus musculus
tcatcggaagtgctgctgccttgtg

SEQ ID NO: 807410 - DNA, 25 bp, Mus musculus
tcatcggaagtggtgctgccttgtg

SEQ ID NO: 807411 - DNA, 25 bp, Mus musculus
tcatcggcgaggacaccatcacatg

SEQ ID NO: 807412 - DNA, 25 bp, Mus musculus
tcatcggcgaggtcaccatcacatg

SEQ ID NO: 807413 - DNA, 25 bp, Mus musculus
tcatcggcgcgtccactcaggcgag

SEQ ID NO: 807414 - DNA, 25 bp, Mus musculus
tcatcggcgcgtgcactcaggcgag

SEQ ID NO: 807415 - DNA, 25 bp, Mus musculus
tcatcgggagacaccgcagagttct

SEQ ID NO: 807416 - DNA, 25 bp, Mus musculus
tcatcgggagactccgcagagttct

SEQ ID NO: 807417 - DNA, 25 bp, Mus musculus
tcatcggtgggtacattgattggta

SEQ ID NO: 807418 - DNA, 25 bp, Mus musculus
tcatcggtgggttcattgattggta

SEQ ID NO: 807419 - DNA, 25 bp, Mus musculus
tcatcgtcagggagagatctatgcc

SEQ ID NO: 807420 - DNA, 25 bp, Mus musculus
tcatcgtcagggtgagatctatgcc

SEQ ID NO: 807421 - DNA, 25 bp, Mus musculus
tcatcgtcatgcacactcaatgcaa

SEQ ID NO: 807422 - DNA, 25 bp, Mus musculus
tcatcgtcatgctcactcaatgcaa

SEQ ID NO: 807423 - DNA, 25 bp, Mus musculus
tcatcgtcatggaaactcgtgtccc

SEQ ID NO: 807424 - DNA, 25 bp, Mus musculus
tcatcgtcatggtaactcgtgtccc

SEQ ID NO: 807425 - DNA, 25 bp, Mus musculus
tcatcgtcccaacgtcagaggttct

SEQ ID NO: 807426 - DNA, 25 bp, Mus musculus
tcatcgtcccaaggtcagaggttct

SEQ ID NO: 807427 - DNA, 25 bp, Mus musculus
tcatcgtctcctcgttggagcaaag

SEQ ID NO: 807428 - DNA, 25 bp, Mus musculus
tcatcgtctcctggttggagcaaag

SEQ ID NO: 807429 - DNA, 25 bp, Mus musculus
tcatcgtgctgaactggaccggaag

SEQ ID NO: 807430 - DNA, 25 bp, Mus musculus
tcatcgtgctgatctggaccggaag

SEQ ID NO: 807431 - DNA, 25 bp, Mus musculus
tcatcgtgctgtacccaatgggagt

SEQ ID NO: 807432 - DNA, 25 bp, Mus musculus
tcatcgtgctgttcccaatgggagt

SEQ ID NO: 807433 - DNA, 25 bp, Mus musculus
tcatcgtgtcctccaagttatggtg

SEQ ID NO: 807434 - DNA, 25 bp, Mus musculus
tcatcgtgtcctgcaagttatggtg

SEQ ID NO: 807435 - DNA, 25 bp, Mus musculus
tcatcgttcccgctatttttggaaa

SEQ ID NO: 807436 - DNA, 25 bp, Mus musculus
tcatcgttcccggtatttttggaaa

SEQ ID NO: 807437 - DNA, 25 bp, Mus musculus
tcatcgttcctaattattatctctg

SEQ ID NO: 807438 - DNA, 25 bp, Mus musculus
tcatcgttcctatttattatctctg

SEQ ID NO: 807439 - DNA, 25 bp, Mus musculus
tcatcgttgttgacgtcctcagagc

SEQ ID NO: 807440 - DNA, 25 bp, Mus musculus
tcatcgttgttgtcgtcctcagagc

SEQ ID NO: 807441 - DNA, 25 bp, Mus musculus
tcatcgttttaaaagctgtgtggct

SEQ ID NO: 807442 - DNA, 25 bp, Mus musculus
tcatcgttttaatagctgtgtggct

SEQ ID NO: 807443 - DNA, 25 bp, Mus musculus
tcatctaaaactcaagcctttggtt

SEQ ID NO: 807444 - DNA, 25 bp, Mus musculus
tcatctaaaactgaagcctttggtt

SEQ ID NO: 807445 - DNA, 25 bp, Mus musculus
tcatctaaaagtcttcctgctcttg

SEQ ID NO: 807446 - DNA, 25 bp, Mus musculus
tcatctaaaagtgttcctgctcttg

SEQ ID NO: 807447 - DNA, 25 bp, Mus musculus
tcatctaaaggcagagcatggtcaa

SEQ ID NO: 807448 - DNA, 25 bp, Mus musculus
tcatctaaaggctgagcatggtcaa

SEQ ID NO: 807449 - DNA, 25 bp, Mus musculus
tcatctaacaggaatggcggcattc

SEQ ID NO: 807450 - DNA, 25 bp, Mus musculus
tcatctaacaggtatggcggcattc

SEQ ID NO: 807451 - DNA, 25 bp, Mus musculus
tcatctaatcccatcaagtcgtatt

SEQ ID NO: 807452 - DNA, 25 bp, Mus musculus
tcatctaatcccttcaagtcgtatt

SEQ ID NO: 807453 - DNA, 25 bp, Mus musculus
tcatctacaaacaagggtgcaccgg

SEQ ID NO: 807454 - DNA, 25 bp, Mus musculus
tcatctacaaactagggtgcaccgg

SEQ ID NO: 807455 - DNA, 25 bp, Mus musculus
tcatctacagcacgtttcaggaagt

SEQ ID NO: 807456 - DNA, 25 bp, Mus musculus
tcatctacagcaggtttcaggaagt

SEQ ID NO: 807457 - DNA, 25 bp, Mus musculus
tcatctacatggcatctttccttac

SEQ ID NO: 807458 - DNA, 25 bp, Mus musculus
tcatctacatgggatctttccttac

SEQ ID NO: 807459 - DNA, 25 bp, Mus musculus
tcatctaccagcaggaactgtctca

SEQ ID NO: 807460 - DNA, 25 bp, Mus musculus
tcatctaccagctggaactgtctca

SEQ ID NO: 807461 - DNA, 25 bp, Mus musculus
tcatctacccccctgcagaggtggg

SEQ ID NO: 807462 - DNA, 25 bp, Mus musculus
tcatctacccccgtgcagaggtggg

SEQ ID NO: 807463 - DNA, 25 bp, Mus musculus
tcatctacccctcgaggcagagaga

SEQ ID NO: 807464 - DNA, 25 bp, Mus musculus
tcatctacccctggaggcagagaga

SEQ ID NO: 807465 - DNA, 25 bp, Mus musculus
tcatctaccctgacatcggaggaga

SEQ ID NO: 807466 - DNA, 25 bp, Mus musculus
tcatctaccctgtcatcggaggaga

SEQ ID NO: 807467 - DNA, 25 bp, Mus musculus
tcatctacgaggagacccgcggtgt

SEQ ID NO: 807468 - DNA, 25 bp, Mus musculus
tcatctacgaggtgacccgcggtgt

SEQ ID NO: 807469 - DNA, 25 bp, Mus musculus
tcatctactgatcctgcggagcgag

SEQ ID NO: 807470 - DNA, 25 bp, Mus musculus
tcatctactgatgctgcggagcgag

SEQ ID NO: 807471 - DNA, 25 bp, Mus musculus
tcatctactggaaacaggacaccca

SEQ ID NO: 807472 - DNA, 25 bp, Mus musculus
tcatctactggatacaggacaccca

SEQ ID NO: 807473 - DNA, 25 bp, Mus musculus
tcatctagactgcagtggccactct

SEQ ID NO: 807474 - DNA, 25 bp, Mus musculus
tcatctagactggagtggccactct

SEQ ID NO: 807475 - DNA, 25 bp, Mus musculus
tcatctagtgggaagtgtgcctgtt

SEQ ID NO: 807476 - DNA, 25 bp, Mus musculus
tcatctagtgggtagtgtgcctgtt

SEQ ID NO: 807477 - DNA, 25 bp, Mus musculus
tcatctagtttgatcatttcttcca

SEQ ID NO: 807478 - DNA, 25 bp, Mus musculus
tcatctagtttgttcatttcttcca

SEQ ID NO: 807479 - DNA, 25 bp, Mus musculus
tcatctataacacagtccccttttt

SEQ ID NO: 807480 - DNA, 25 bp, Mus musculus
tcatctataacagagtccccttttt

SEQ ID NO: 807481 - DNA, 25 bp, Mus musculus
tcatctatatgtagagcccacacag

SEQ ID NO: 807482 - DNA, 25 bp, Mus musculus
tcatctatatgttgagcccacacag

SEQ ID NO: 807483 - DNA, 25 bp, Mus musculus
tcatctatgaccctgaccaatcagt

SEQ ID NO: 807484 - DNA, 25 bp, Mus musculus
tcatctatgaccgtgaccaatcagt

SEQ ID NO: 807485 - DNA, 25 bp, Mus musculus
tcatctatgccaagcaagctggcac

SEQ ID NO: 807486 - DNA, 25 bp, Mus musculus
tcatctatgccatgcaagctggcac

SEQ ID NO: 807487 - DNA, 25 bp, Mus musculus
tcatctatgctgaccagccggatgg

SEQ ID NO: 807488 - DNA, 25 bp, Mus musculus
tcatctatgctgtccagccggatgg

SEQ ID NO: 807489 - DNA, 25 bp, Mus musculus
tcatctatgcttaccgcagccagga

SEQ ID NO: 807490 - DNA, 25 bp, Mus musculus
tcatctatgctttccgcagccagga

SEQ ID NO: 807491 - DNA, 25 bp, Mus musculus
tcatctattctgcaggtgtctaccg

SEQ ID NO: 807492 - DNA, 25 bp, Mus musculus
tcatctattctggaggtgtctaccg

SEQ ID NO: 807493 - DNA, 25 bp, Mus musculus
tcatctattgaaaggaacacagagt

SEQ ID NO: 807494 - DNA, 25 bp, Mus musculus
tcatctattgaatggaacacagagt

SEQ ID NO: 807495 - DNA, 25 bp, Mus musculus
tcatctatttctattcgggacccca

SEQ ID NO: 807496 - DNA, 25 bp, Mus musculus
tcatctatttcttttcgggacccca

SEQ ID NO: 807497 - DNA, 25 bp, Mus musculus
tcatctcaacacaacacagctagag

SEQ ID NO: 807498 - DNA, 25 bp, Mus musculus
tcatctcaacactacacagctagag

SEQ ID NO: 807499 - DNA, 25 bp, Mus musculus
tcatctcaacccagaccctggtagg

SEQ ID NO: 807500 - DNA, 25 bp, Mus musculus
tcatctcaaccctgaccctggtagg

SEQ ID NO: 807501 - DNA, 25 bp, Mus musculus
tcatctcaactgcacccaaaacaga

SEQ ID NO: 807502 - DNA, 25 bp, Mus musculus
tcatctcaactggacccaaaacaga

SEQ ID NO: 807503 - DNA, 25 bp, Mus musculus
tcatctcaagatcccctgggactca

SEQ ID NO: 807504 - DNA, 25 bp, Mus musculus
tcatctcaagatgccctgggactca

SEQ ID NO: 807505 - DNA, 25 bp, Mus musculus
tcatctcaagctcgactccaaggaa

SEQ ID NO: 807506 - DNA, 25 bp, Mus musculus
tcatctcaagctggactccaaggaa

SEQ ID NO: 807507 - DNA, 25 bp, Mus musculus
tcatctcaagtaaagccagtcattc

SEQ ID NO: 807508 - DNA, 25 bp, Mus musculus
tcatctcaagtatagccagtcattc

SEQ ID NO: 807509 - DNA, 25 bp, Mus musculus
tcatctcaatgcatttccaggtctt

SEQ ID NO: 807510 - DNA, 25 bp, Mus musculus
tcatctcaatgcttttccaggtctt

SEQ ID NO: 807511 - DNA, 25 bp, Mus musculus
tcatctcacagccttgccttttctt

SEQ ID NO: 807512 - DNA, 25 bp, Mus musculus
tcatctcacagcgttgccttttctt

SEQ ID NO: 807513 - DNA, 25 bp, Mus musculus
tcatctcaccatccttccagaggag

SEQ ID NO: 807514 - DNA, 25 bp, Mus musculus
tcatctcaccatgcttccagaggag

SEQ ID NO: 807515 - DNA, 25 bp, Mus musculus
tcatctcactatacccggaactggg

SEQ ID NO: 807516 - DNA, 25 bp, Mus musculus
tcatctcactatcggcacagcagct

SEQ ID NO: 807517 - DNA, 25 bp, Mus musculus
tcatctcactatgggcacagcagct

SEQ ID NO: 807518 - DNA, 25 bp, Mus musculus
tcatctcactattcccggaactggg

SEQ ID NO: 807519 - DNA, 25 bp, Mus musculus
tcatctcactttctacgaagtaaag

SEQ ID NO: 807520 - DNA, 25 bp, Mus musculus
tcatctcactttgtacgaagtaaag

SEQ ID NO: 807521 - DNA, 25 bp, Mus musculus
tcatctcagaggcacccacgtggaa

SEQ ID NO: 807522 - DNA, 25 bp, Mus musculus
tcatctcagagggacccacgtggaa

SEQ ID NO: 807523 - DNA, 25 bp, Mus musculus
tcatctcaggccactggacatgtat

SEQ ID NO: 807524 - DNA, 25 bp, Mus musculus
tcatctcaggcctctggacatgtat

SEQ ID NO: 807525 - DNA, 25 bp, Mus musculus
tcatctcagtctctaagcctctgga

SEQ ID NO: 807526 - DNA, 25 bp, Mus musculus
tcatctcagtctgtaagcctctgga

SEQ ID NO: 807527 - DNA, 25 bp, Mus musculus
tcatctcatccgactgattggaaat

SEQ ID NO: 807528 - DNA, 25 bp, Mus musculus
tcatctcatccgtctgattggaaat

SEQ ID NO: 807529 - DNA, 25 bp, Mus musculus
tcatctcatctgaaggtgacgaaga

SEQ ID NO: 807530 - DNA, 25 bp, Mus musculus
tcatctcatctgtaggtgacgaaga

SEQ ID NO: 807531 - DNA, 25 bp, Mus musculus
tcatctcatgatcttacctgggtat

SEQ ID NO: 807532 - DNA, 25 bp, Mus musculus
tcatctcatgatgttacctgggtat

SEQ ID NO: 807533 - DNA, 25 bp, Mus musculus
tcatctccaagaccacctggcaagg

SEQ ID NO: 807534 - DNA, 25 bp, Mus musculus
tcatctccaagagcacctggcaagg

SEQ ID NO: 807535 - DNA, 25 bp, Mus musculus
tcatctccacaacctggaaaaccat

SEQ ID NO: 807536 - DNA, 25 bp, Mus musculus
tcatctccacaagctggaaaaccat

SEQ ID NO: 807537 - DNA, 25 bp, Mus musculus
tcatctccacgcaggagagcacgga

SEQ ID NO: 807538 - DNA, 25 bp, Mus musculus
tcatctccacgctggagagcacgga

SEQ ID NO: 807539 - DNA, 25 bp, Mus musculus
tcatctccatggcttacgatctggg

SEQ ID NO: 807540 - DNA, 25 bp, Mus musculus
tcatctccatgggttacgatctggg

SEQ ID NO: 807541 - DNA, 25 bp, Mus musculus
tcatctccattcatacacctcaaat

SEQ ID NO: 807542 - DNA, 25 bp, Mus musculus
tcatctccattcttacacctcaaat

SEQ ID NO: 807543 - DNA, 25 bp, Mus musculus
tcatctcccatcatgttctttatgt

SEQ ID NO: 807544 - DNA, 25 bp, Mus musculus
tcatctcccatcttgttctttatgt

SEQ ID NO: 807545 - DNA, 25 bp, Mus musculus
tcatctcctagacggctgatactta

SEQ ID NO: 807546 - DNA, 25 bp, Mus musculus
tcatctcctagagggctgatactta

SEQ ID NO: 807547 - DNA, 25 bp, Mus musculus
tcatctcctcacaggtgggttattt

SEQ ID NO: 807548 - DNA, 25 bp, Mus musculus
tcatctcctcactggtgggttattt

SEQ ID NO: 807549 - DNA, 25 bp, Mus musculus
tcatctcctcttctcttgtctatgg

SEQ ID NO: 807550 - DNA, 25 bp, Mus musculus
tcatctcctcttgtcttgtctatgg

SEQ ID NO: 807551 - DNA, 25 bp, Mus musculus
tcatctcctggaccttggactttag

SEQ ID NO: 807552 - DNA, 25 bp, Mus musculus
tcatctcctggagcttggactttag

SEQ ID NO: 807553 - DNA, 25 bp, Mus musculus
tcatctccttcactggtcatcgtag

SEQ ID NO: 807554 - DNA, 25 bp, Mus musculus
tcatctccttcagtggtcatcgtag

SEQ ID NO: 807555 - DNA, 25 bp, Mus musculus
tcatctctacctactacaacgtgat

SEQ ID NO: 807556 - DNA, 25 bp, Mus musculus
tcatctctaccttctacaacgtgat

SEQ ID NO: 807557 - DNA, 25 bp, Mus musculus
tcatctctagatacaaattgcttat

SEQ ID NO: 807558 - DNA, 25 bp, Mus musculus
tcatctctagattcaaattgcttat

SEQ ID NO: 807559 - DNA, 25 bp, Mus musculus
tcatctctcagaaggcacgtgggct

SEQ ID NO: 807560 - DNA, 25 bp, Mus musculus
tcatctctcagatggcacgtgggct

SEQ ID NO: 807561 - DNA, 25 bp, Mus musculus
tcatctctcaggcttacattaagtg

SEQ ID NO: 807562 - DNA, 25 bp, Mus musculus
tcatctctcagggttacattaagtg

SEQ ID NO: 807563 - DNA, 25 bp, Mus musculus
tcatctctcatgcagtctatgtaac

SEQ ID NO: 807564 - DNA, 25 bp, Mus musculus
tcatctctcatggagtctatgtaac

SEQ ID NO: 807565 - DNA, 25 bp, Mus musculus
tcatctctccaactatgcagtcact

SEQ ID NO: 807566 - DNA, 25 bp, Mus musculus
tcatctctccaagtatgcagtcact

SEQ ID NO: 807567 - DNA, 25 bp, Mus musculus
tcatctctccggaggcatggactcc

SEQ ID NO: 807568 - DNA, 25 bp, Mus musculus
tcatctctccggtggcatggactcc

SEQ ID NO: 807569 - DNA, 25 bp, Mus musculus
tcatctctctcgatgtcaggagtga

SEQ ID NO: 807570 - DNA, 25 bp, Mus musculus
tcatctctctcgttgtcaggagtga

SEQ ID NO: 807571 - DNA, 25 bp, Mus musculus
tcatctctcttgcaaccaacctaga

SEQ ID NO: 807572 - DNA, 25 bp, Mus musculus
tcatctctcttggaaccaacctaga

SEQ ID NO: 807573 - DNA, 25 bp, Mus musculus
tcatctctgccaacacttagttagg

SEQ ID NO: 807574 - DNA, 25 bp, Mus musculus
tcatctctgccatcacttagttagg

SEQ ID NO: 807575 - DNA, 25 bp, Mus musculus
tcatctctgctcaggttacacagaa

SEQ ID NO: 807576 - DNA, 25 bp, Mus musculus
tcatctctgctctggttacacagaa

SEQ ID NO: 807577 - DNA, 25 bp, Mus musculus
tcatctctgcttcgtttctctttca

SEQ ID NO: 807578 - DNA, 25 bp, Mus musculus
tcatctctgcttggtttctctttca

SEQ ID NO: 807579 - DNA, 25 bp, Mus musculus
tcatctctggtccttgtgagcacct

SEQ ID NO: 807580 - DNA, 25 bp, Mus musculus
tcatctctggtcgttgtgagcacct

SEQ ID NO: 807581 - DNA, 25 bp, Mus musculus
tcatctctgttgctctccatgttaa

SEQ ID NO: 807582 - DNA, 25 bp, Mus musculus
tcatctctgttggtctccatgttaa

SEQ ID NO: 807583 - DNA, 25 bp, Mus musculus
tcatctcttcacagtgccaatctaa

SEQ ID NO: 807584 - DNA, 25 bp, Mus musculus
tcatctcttcactgtgccaatctaa

SEQ ID NO: 807585 - DNA, 25 bp, Mus musculus
tcatctcttcttacctggtttaagg

SEQ ID NO: 807586 - DNA, 25 bp, Mus musculus
tcatctcttctttcctggtttaagg

SEQ ID NO: 807587 - DNA, 25 bp, Mus musculus
tcatctgaattcatctcctttggca

SEQ ID NO: 807588 - DNA, 25 bp, Mus musculus
tcatctgaattcttctcctttggca

SEQ ID NO: 807589 - DNA, 25 bp, Mus musculus
tcatctgaccttattgtgaatggag

SEQ ID NO: 807590 - DNA, 25 bp, Mus musculus
tcatctgacctttttgtgaatggag

SEQ ID NO: 807591 - DNA, 25 bp, Mus musculus
tcatctgacttaatatgcatttaaa

SEQ ID NO: 807592 - DNA, 25 bp, Mus musculus
tcatctgacttattatgcatttaaa

SEQ ID NO: 807593 - DNA, 25 bp, Mus musculus
tcatctgagaacctccacaacagga

SEQ ID NO: 807594 - DNA, 25 bp, Mus musculus
tcatctgagaacgtccacaacagga

SEQ ID NO: 807595 - DNA, 25 bp, Mus musculus
tcatctgaggctcttagctccacat

SEQ ID NO: 807596 - DNA, 25 bp, Mus musculus
tcatctgaggctgttagctccacat

SEQ ID NO: 807597 - DNA, 25 bp, Mus musculus
tcatctgatacaccatttagctcca

SEQ ID NO: 807598 - DNA, 25 bp, Mus musculus
tcatctgatacagcatttagctcca

SEQ ID NO: 807599 - DNA, 25 bp, Mus musculus
tcatctgattctatgtatctaccca

SEQ ID NO: 807600 - DNA, 25 bp, Mus musculus
tcatctgattctttgtatctaccca

SEQ ID NO: 807601 - DNA, 25 bp, Mus musculus
tcatctgatttcaaatgcactgcct

SEQ ID NO: 807602 - DNA, 25 bp, Mus musculus
tcatctgatttctaatgcactgcct

SEQ ID NO: 807603 - DNA, 25 bp, Mus musculus
tcatctgcaatgagatctgacaccc

SEQ ID NO: 807604 - DNA, 25 bp, Mus musculus
tcatctgcaatgtgatctgacaccc

SEQ ID NO: 807605 - DNA, 25 bp, Mus musculus
tcatctgcacctccggacactttgt

SEQ ID NO: 807606 - DNA, 25 bp, Mus musculus
tcatctgcacctgcggacactttgt

SEQ ID NO: 807607 - DNA, 25 bp, Mus musculus
tcatctgcagaccttcggatacgaa

SEQ ID NO: 807608 - DNA, 25 bp, Mus musculus
tcatctgcagacgttcggatacgaa

SEQ ID NO: 807609 - DNA, 25 bp, Mus musculus
tcatctgcagctctagcctggattc

SEQ ID NO: 807610 - DNA, 25 bp, Mus musculus
tcatctgcagctgtagcctggattc

SEQ ID NO: 807611 - DNA, 25 bp, Mus musculus
tcatctgcagggatactgggtgata

SEQ ID NO: 807612 - DNA, 25 bp, Mus musculus
tcatctgcagggttactgggtgata

SEQ ID NO: 807613 - DNA, 25 bp, Mus musculus
tcatctgccagtcccaacatgtatg

SEQ ID NO: 807614 - DNA, 25 bp, Mus musculus
tcatctgccagtgccaacatgtatg

SEQ ID NO: 807615 - DNA, 25 bp, Mus musculus
tcatctgcccacattacgaggacga

SEQ ID NO: 807616 - DNA, 25 bp, Mus musculus
tcatctgcccactttacgaggacga

SEQ ID NO: 807617 - DNA, 25 bp, Mus musculus
tcatctgccggcacgagaagcccag

SEQ ID NO: 807618 - DNA, 25 bp, Mus musculus
tcatctgccggctcgagaagcccag

SEQ ID NO: 807619 - DNA, 25 bp, Mus musculus
tcatctgcctccataaggctattgg

SEQ ID NO: 807620 - DNA, 25 bp, Mus musculus
tcatctgcctccttaaggctattgg

SEQ ID NO: 807621 - DNA, 25 bp, Mus musculus
tcatctgcctgtcctacatgctgat

SEQ ID NO: 807622 - DNA, 25 bp, Mus musculus
tcatctgcctgtgctacatgctgat

SEQ ID NO: 807623 - DNA, 25 bp, Mus musculus
tcatctgccttcagaacgattgttt

SEQ ID NO: 807624 - DNA, 25 bp, Mus musculus
tcatctgccttctgaacgattgttt

SEQ ID NO: 807625 - DNA, 25 bp, Mus musculus
tcatctgctactcccgagatcatag

SEQ ID NO: 807626 - DNA, 25 bp, Mus musculus
tcatctgctactgccgagatcatag

SEQ ID NO: 807627 - DNA, 25 bp, Mus musculus
tcatctgctagacgttcacaacaaa

SEQ ID NO: 807628 - DNA, 25 bp, Mus musculus
tcatctgctagaggttcacaacaaa

SEQ ID NO: 807629 - DNA, 25 bp, Mus musculus
tcatctgctcagacctaaagaacat

SEQ ID NO: 807630 - DNA, 25 bp, Mus musculus
tcatctgctcagtcctaaagaacat

SEQ ID NO: 807631 - DNA, 25 bp, Mus musculus
tcatctgctctacctactgctttct

SEQ ID NO: 807632 - DNA, 25 bp, Mus musculus
tcatctgctctagctactgctttct

SEQ ID NO: 807633 - DNA, 25 bp, Mus musculus
tcatctgctgcgctttgggaagtac

SEQ ID NO: 807634 - DNA, 25 bp, Mus musculus
tcatctgctgcggtttgggaagtac

SEQ ID NO: 807635 - DNA, 25 bp, Mus musculus
tcatctggagcgacccagtggaata

SEQ ID NO: 807636 - DNA, 25 bp, Mus musculus
tcatctggagcgcagggtcttactg

SEQ ID NO: 807637 - DNA, 25 bp, Mus musculus
tcatctggagcggagggtcttactg

SEQ ID NO: 807638 - DNA, 25 bp, Mus musculus
tcatctggagcgtcccagtggaata

SEQ ID NO: 807639 - DNA, 25 bp, Mus musculus
tcatctggatgcatacacacatttg

SEQ ID NO: 807640 - DNA, 25 bp, Mus musculus
tcatctggatgcttacacacatttg

SEQ ID NO: 807641 - DNA, 25 bp, Mus musculus
tcatctggattcaacaccacacaca

SEQ ID NO: 807642 - DNA, 25 bp, Mus musculus
tcatctggattctacaccacacaca

SEQ ID NO: 807643 - DNA, 25 bp, Mus musculus
tcatctggcgggaaagctcctagct

SEQ ID NO: 807644 - DNA, 25 bp, Mus musculus
tcatctggcgggtaagctcctagct

SEQ ID NO: 807645 - DNA, 25 bp, Mus musculus
tcatctggtcagaggctcttttgat

SEQ ID NO: 807646 - DNA, 25 bp, Mus musculus
tcatctggtcagtggctcttttgat

SEQ ID NO: 807647 - DNA, 25 bp, Mus musculus
tcatctggtcccagtctctgatgac

SEQ ID NO: 807648 - DNA, 25 bp, Mus musculus
tcatctggtccctgtctctgatgac

SEQ ID NO: 807649 - DNA, 25 bp, Mus musculus
tcatctggtgccagggcagtcttct

SEQ ID NO: 807650 - DNA, 25 bp, Mus musculus
tcatctggtgcctgggcagtcttct

SEQ ID NO: 807651 - DNA, 25 bp, Mus musculus
tcatctgtaaccctgagcttttcca

SEQ ID NO: 807652 - DNA, 25 bp, Mus musculus
tcatctgtaaccgtgagcttttcca

SEQ ID NO: 807653 - DNA, 25 bp, Mus musculus
tcatctgtacatatctttacttggt

SEQ ID NO: 807654 - DNA, 25 bp, Mus musculus
tcatctgtacatttctttacttggt

SEQ ID NO: 807655 - DNA, 25 bp, Mus musculus
tcatctgtacggcagagttgttaca

SEQ ID NO: 807656 - DNA, 25 bp, Mus musculus
tcatctgtacgggagagttgttaca

SEQ ID NO: 807657 - DNA, 25 bp, Mus musculus
tcatctgtagatacaaccttgcatt

SEQ ID NO: 807658 - DNA, 25 bp, Mus musculus
tcatctgtagattcaaccttgcatt

SEQ ID NO: 807659 - DNA, 25 bp, Mus musculus
tcatctgtagccagtgtcacaggac

SEQ ID NO: 807660 - DNA, 25 bp, Mus musculus
tcatctgtagccagtttaatctccc

SEQ ID NO: 807661 - DNA, 25 bp, Mus musculus
tcatctgtagcctgtgtcacaggac

SEQ ID NO: 807662 - DNA, 25 bp, Mus musculus
tcatctgtagcctgtttaatctccc

SEQ ID NO: 807663 - DNA, 25 bp, Mus musculus
tcatctgtatcaccacatgtctgtt

SEQ ID NO: 807664 - DNA, 25 bp, Mus musculus
tcatctgtatcagcacatgtctgtt

SEQ ID NO: 807665 - DNA, 25 bp, Mus musculus
tcatctgtccaacgcctttctaata

SEQ ID NO: 807666 - DNA, 25 bp, Mus musculus
tcatctgtccaaggcctttctaata

SEQ ID NO: 807667 - DNA, 25 bp, Mus musculus
tcatctgtccatccagagctggcat

SEQ ID NO: 807668 - DNA, 25 bp, Mus musculus
tcatctgtccatgcagagctggcat

SEQ ID NO: 807669 - DNA, 25 bp, Mus musculus
tcatctgtctgcaaacctcagaagc

SEQ ID NO: 807670 - DNA, 25 bp, Mus musculus
tcatctgtctgctaacctcagaagc

SEQ ID NO: 807671 - DNA, 25 bp, Mus musculus
tcatctgtgaacagccagagcctgt

SEQ ID NO: 807672 - DNA, 25 bp, Mus musculus
tcatctgtgaactgccagagcctgt

SEQ ID NO: 807673 - DNA, 25 bp, Mus musculus
tcatctgtgcttccattttctatgg

SEQ ID NO: 807674 - DNA, 25 bp, Mus musculus
tcatctgtgcttgcattttctatgg

SEQ ID NO: 807675 - DNA, 25 bp, Mus musculus
tcatctgtgtgtcctgtcctagatc

SEQ ID NO: 807676 - DNA, 25 bp, Mus musculus
tcatctgtgtgtgctgtcctagatc

SEQ ID NO: 807677 - DNA, 25 bp, Mus musculus
tcatctgtgttacacctttaccata

SEQ ID NO: 807678 - DNA, 25 bp, Mus musculus
tcatctgtgttagacctttaccata

SEQ ID NO: 807679 - DNA, 25 bp, Mus musculus
tcatctgtgttcactccagcaaaat

SEQ ID NO: 807680 - DNA, 25 bp, Mus musculus
tcatctgtgttctctccagcaaaat

SEQ ID NO: 807681 - DNA, 25 bp, Mus musculus
tcatctgtgttgcctgggtaactcc

SEQ ID NO: 807682 - DNA, 25 bp, Mus musculus
tcatctgtgttggctgggtaactcc

SEQ ID NO: 807683 - DNA, 25 bp, Mus musculus
tcatctgttaccaggccttggattg

SEQ ID NO: 807684 - DNA, 25 bp, Mus musculus
tcatctgttacctggccttggattg

SEQ ID NO: 807685 - DNA, 25 bp, Mus musculus
tcatctgttcgtagaaatggtactt

SEQ ID NO: 807686 - DNA, 25 bp, Mus musculus
tcatctgttcgttgaaatggtactt

SEQ ID NO: 807687 - DNA, 25 bp, Mus musculus
tcatctgttctgaagctggctagtg

SEQ ID NO: 807688 - DNA, 25 bp, Mus musculus
tcatctgttctgtagctggctagtg

SEQ ID NO: 807689 - DNA, 25 bp, Mus musculus
tcatctgttgtgatgggtcagcctg

SEQ ID NO: 807690 - DNA, 25 bp, Mus musculus
tcatctgttgtgttgggtcagcctg

SEQ ID NO: 807691 - DNA, 25 bp, Mus musculus
tcatctgtttgactagagctggcat

SEQ ID NO: 807692 - DNA, 25 bp, Mus musculus
tcatctgtttgagtagagctggcat

SEQ ID NO: 807693 - DNA, 25 bp, Mus musculus
tcatcttagcccctgatatgaggtt

SEQ ID NO: 807694 - DNA, 25 bp, Mus musculus
tcatcttagcccgtgatatgaggtt

SEQ ID NO: 807695 - DNA, 25 bp, Mus musculus
tcatcttattctcggcacctgaggt

SEQ ID NO: 807696 - DNA, 25 bp, Mus musculus
tcatcttattctgggcacctgaggt

SEQ ID NO: 807697 - DNA, 25 bp, Mus musculus
tcatcttattttcaggtgatcatac

SEQ ID NO: 807698 - DNA, 25 bp, Mus musculus
tcatcttattttgaggtgatcatac

SEQ ID NO: 807699 - DNA, 25 bp, Mus musculus
tcatcttcactcaacatggctattt

SEQ ID NO: 807700 - DNA, 25 bp, Mus musculus
tcatcttcactctacatggctattt

SEQ ID NO: 807701 - DNA, 25 bp, Mus musculus
tcatcttcactgacaacgtggctag

SEQ ID NO: 807702 - DNA, 25 bp, Mus musculus
tcatcttcactgtcaacgtggctag

SEQ ID NO: 807703 - DNA, 25 bp, Mus musculus
tcatcttcagaaagggaacagtggg

SEQ ID NO: 807704 - DNA, 25 bp, Mus musculus
tcatcttcagaatgggaacagtggg

SEQ ID NO: 807705 - DNA, 25 bp, Mus musculus
tcatcttcagagctgttggctagct

SEQ ID NO: 807706 - DNA, 25 bp, Mus musculus
tcatcttcagaggtgttggctagct

SEQ ID NO: 807707 - DNA, 25 bp, Mus musculus
tcatcttcagccactcgaagggaaa

SEQ ID NO: 807708 - DNA, 25 bp, Mus musculus
tcatcttcagcctctcgaagggaaa

SEQ ID NO: 807709 - DNA, 25 bp, Mus musculus
tcatcttcaggtaactcctgtcacg

SEQ ID NO: 807710 - DNA, 25 bp, Mus musculus
tcatcttcaggttactcctgtcacg

SEQ ID NO: 807711 - DNA, 25 bp, Mus musculus
tcatcttcatcactctcatagccat

SEQ ID NO: 807712 - DNA, 25 bp, Mus musculus
tcatcttcatcagtctcatagccat

SEQ ID NO: 807713 - DNA, 25 bp, Mus musculus
tcatcttcccttctagtttcttttc

SEQ ID NO: 807714 - DNA, 25 bp, Mus musculus
tcatcttcccttgtagtttcttttc

SEQ ID NO: 807715 - DNA, 25 bp, Mus musculus
tcatcttcgaggcacccaaggactt

SEQ ID NO: 807716 - DNA, 25 bp, Mus musculus
tcatcttcgagggacccaaggactt

SEQ ID NO: 807717 - DNA, 25 bp, Mus musculus
tcatcttcggtgctgagcggctgac

SEQ ID NO: 807718 - DNA, 25 bp, Mus musculus
tcatcttcggtggtgagcggctgac

SEQ ID NO: 807719 - DNA, 25 bp, Mus musculus
tcatcttcgtttatgtacttcattg

SEQ ID NO: 807720 - DNA, 25 bp, Mus musculus
tcatcttcgtttttgtacttcattg

SEQ ID NO: 807721 - DNA, 25 bp, Mus musculus
tcatcttctcatattttatcttcag

SEQ ID NO: 807722 - DNA, 25 bp, Mus musculus
tcatcttctcattttttatcttcag

SEQ ID NO: 807723 - DNA, 25 bp, Mus musculus
tcatcttctgcaacaccaagcggaa

SEQ ID NO: 807724 - DNA, 25 bp, Mus musculus
tcatcttctgcatcaccaagcggaa

SEQ ID NO: 807725 - DNA, 25 bp, Mus musculus
tcatcttcttccattgagctcaaat

SEQ ID NO: 807726 - DNA, 25 bp, Mus musculus
tcatcttcttcctttgagctcaaat

SEQ ID NO: 807727 - DNA, 25 bp, Mus musculus
tcatcttcttgtcccatttcttaaa

SEQ ID NO: 807728 - DNA, 25 bp, Mus musculus
tcatcttcttgtgccatttcttaaa

SEQ ID NO: 807729 - DNA, 25 bp, Mus musculus
tcatcttctttcaatgtactctgaa

SEQ ID NO: 807730 - DNA, 25 bp, Mus musculus
tcatcttctttctatgtactctgaa

SEQ ID NO: 807731 - DNA, 25 bp, Mus musculus
tcatcttgaaagactggcctctagc

SEQ ID NO: 807732 - DNA, 25 bp, Mus musculus
tcatcttgaaagtctggcctctagc

SEQ ID NO: 807733 - DNA, 25 bp, Mus musculus
tcatcttgagccagaccaaaacaaa

SEQ ID NO: 807734 - DNA, 25 bp, Mus musculus
tcatcttgagcctgaccaaaacaaa

SEQ ID NO: 807735 - DNA, 25 bp, Mus musculus
tcatcttgcatgattcacttcttca

SEQ ID NO: 807736 - DNA, 25 bp, Mus musculus
tcatcttgcatgtttcacttcttca

SEQ ID NO: 807737 - DNA, 25 bp, Mus musculus
tcatcttgcctcactctagcttggg

SEQ ID NO: 807738 - DNA, 25 bp, Mus musculus
tcatcttgcctctctctagcttggg

SEQ ID NO: 807739 - DNA, 25 bp, Mus musculus
tcatcttgctacagagtcactttaa

SEQ ID NO: 807740 - DNA, 25 bp, Mus musculus
tcatcttgctactgagtcactttaa

SEQ ID NO: 807741 - DNA, 25 bp, Mus musculus
tcatcttgctgcacgtcctttattt

SEQ ID NO: 807742 - DNA, 25 bp, Mus musculus
tcatcttgctgctcgtcctttattt

SEQ ID NO: 807743 - DNA, 25 bp, Mus musculus
tcatcttgcttgctcctggagatta

SEQ ID NO: 807744 - DNA, 25 bp, Mus musculus
tcatcttgcttggtcctggagatta

SEQ ID NO: 807745 - DNA, 25 bp, Mus musculus
tcatcttgctttcaaatgcccattc

SEQ ID NO: 807746 - DNA, 25 bp, Mus musculus
tcatcttgctttgaaatgcccattc

SEQ ID NO: 807747 - DNA, 25 bp, Mus musculus
tcatcttggactactatcctctagg

SEQ ID NO: 807748 - DNA, 25 bp, Mus musculus
tcatcttggacttctatcctctagg

SEQ ID NO: 807749 - DNA, 25 bp, Mus musculus
tcatcttggatgagctgctgcccga

SEQ ID NO: 807750 - DNA, 25 bp, Mus musculus
tcatcttggatgtgctgctgcccga

SEQ ID NO: 807751 - DNA, 25 bp, Mus musculus
tcatcttgggcaacgtgtaccgctc

SEQ ID NO: 807752 - DNA, 25 bp, Mus musculus
tcatcttgggcatcgtgtaccgctc

SEQ ID NO: 807753 - DNA, 25 bp, Mus musculus
tcatcttgggtcacctactgaggaa

SEQ ID NO: 807754 - DNA, 25 bp, Mus musculus
tcatcttgggtctcctactgaggaa

SEQ ID NO: 807755 - DNA, 25 bp, Mus musculus
tcatctttacctacaaaagctttgg

SEQ ID NO: 807756 - DNA, 25 bp, Mus musculus
tcatctttaccttcaaaagctttgg

SEQ ID NO: 807757 - DNA, 25 bp, Mus musculus
tcatctttactaaacggtttttggt

SEQ ID NO: 807758 - DNA, 25 bp, Mus musculus
tcatctttactatacggtttttggt

SEQ ID NO: 807759 - DNA, 25 bp, Mus musculus
tcatctttcaaaccatcatctccag

SEQ ID NO: 807760 - DNA, 25 bp, Mus musculus
tcatctttcaaagcatcatctccag

SEQ ID NO: 807761 - DNA, 25 bp, Mus musculus
tcatctttcagcaagcaagccaact

SEQ ID NO: 807762 - DNA, 25 bp, Mus musculus
tcatctttcagctagcaagccaact

SEQ ID NO: 807763 - DNA, 25 bp, Mus musculus
tcatctttcatgattgggcaagcct

SEQ ID NO: 807764 - DNA, 25 bp, Mus musculus
tcatctttcatgtttgggcaagcct

SEQ ID NO: 807765 - DNA, 25 bp, Mus musculus
tcatctttcattcgttgtgtctgat

SEQ ID NO: 807766 - DNA, 25 bp, Mus musculus
tcatctttcattggttgtgtctgat

SEQ ID NO: 807767 - DNA, 25 bp, Mus musculus
tcatctttccggaatgtcctcacgt

SEQ ID NO: 807768 - DNA, 25 bp, Mus musculus
tcatctttccggtatgtcctcacgt

SEQ ID NO: 807769 - DNA, 25 bp, Mus musculus
tcatctttctcccatcaggtttcac

SEQ ID NO: 807770 - DNA, 25 bp, Mus musculus
tcatctttctccgatcaggtttcac

SEQ ID NO: 807771 - DNA, 25 bp, Mus musculus
tcatctttctggaagcacaaaatag

SEQ ID NO: 807772 - DNA, 25 bp, Mus musculus
tcatctttctggtagcacaaaatag

SEQ ID NO: 807773 - DNA, 25 bp, Mus musculus
tcatctttgacgaggagctgctcag

SEQ ID NO: 807774 - DNA, 25 bp, Mus musculus
tcatctttgacgtggagctgctcag

SEQ ID NO: 807775 - DNA, 25 bp, Mus musculus
tcatctttgcctactgacacacttg

SEQ ID NO: 807776 - DNA, 25 bp, Mus musculus
tcatctttgcctaggcctgttttca

SEQ ID NO: 807777 - DNA, 25 bp, Mus musculus
tcatctttgccttctgacacacttg

SEQ ID NO: 807778 - DNA, 25 bp, Mus musculus
tcatctttgccttggcctgttttca

SEQ ID NO: 807779 - DNA, 25 bp, Mus musculus
tcatctttgtgacttctatctgcag

SEQ ID NO: 807780 - DNA, 25 bp, Mus musculus
tcatctttgtgagttctatctgcag

SEQ ID NO: 807781 - DNA, 25 bp, Mus musculus
tcatctttgtggattgctgaaacaa

SEQ ID NO: 807782 - DNA, 25 bp, Mus musculus
tcatctttgtggtttgctgaaacaa

SEQ ID NO: 807783 - DNA, 25 bp, Mus musculus
tcatcttttagaacgctggcaatgc

SEQ ID NO: 807784 - DNA, 25 bp, Mus musculus
tcatcttttagatcgctggcaatgc

SEQ ID NO: 807785 - DNA, 25 bp, Mus musculus
tcatctttttcaaccggcttcacga

SEQ ID NO: 807786 - DNA, 25 bp, Mus musculus
tcatctttttcatccggcttcacga

SEQ ID NO: 807787 - DNA, 25 bp, Mus musculus
tcatctttttgtccccttgtaaaat

SEQ ID NO: 807788 - DNA, 25 bp, Mus musculus
tcatctttttgtgcccttgtaaaat

SEQ ID NO: 807789 - DNA, 25 bp, Mus musculus
tcatgaaaacacactagccctgggt

SEQ ID NO: 807790 - DNA, 25 bp, Mus musculus
tcatgaaaacactctagccctgggt

SEQ ID NO: 807791 - DNA, 25 bp, Mus musculus
tcatgaaaagaaacctacttgtggt

SEQ ID NO: 807792 - DNA, 25 bp, Mus musculus
tcatgaaaagaatcctacttgtggt

SEQ ID NO: 807793 - DNA, 25 bp, Mus musculus
tcatgaaagctacgaccgcaccggg

SEQ ID NO: 807794 - DNA, 25 bp, Mus musculus
tcatgaaagctaggaccgcaccggg

SEQ ID NO: 807795 - DNA, 25 bp, Mus musculus
tcatgaaatctgctttgattattaa

SEQ ID NO: 807796 - DNA, 25 bp, Mus musculus
tcatgaaatctggtttgattattaa

SEQ ID NO: 807797 - DNA, 25 bp, Mus musculus
tcatgaacacatatgtagaggccag

SEQ ID NO: 807798 - DNA, 25 bp, Mus musculus
tcatgaacacatcagctagcaacag

SEQ ID NO: 807799 - DNA, 25 bp, Mus musculus
tcatgaacacatgagctagcaacag

SEQ ID NO: 807800 - DNA, 25 bp, Mus musculus
tcatgaacacatttgtagaggccag

SEQ ID NO: 807801 - DNA, 25 bp, Mus musculus
tcatgaacacgtatttgccagtttc

SEQ ID NO: 807802 - DNA, 25 bp, Mus musculus
tcatgaacacgtttttgccagtttc

SEQ ID NO: 807803 - DNA, 25 bp, Mus musculus
tcatgaaccggtatggcacccggtt

SEQ ID NO: 807804 - DNA, 25 bp, Mus musculus
tcatgaaccggtttggcacccggtt

SEQ ID NO: 807805 - DNA, 25 bp, Mus musculus
tcatgaacggtgacttcatatttcc

SEQ ID NO: 807806 - DNA, 25 bp, Mus musculus
tcatgaacggtgtcttcatatttcc

SEQ ID NO: 807807 - DNA, 25 bp, Mus musculus
tcatgaacgtttaagtggtaacccg

SEQ ID NO: 807808 - DNA, 25 bp, Mus musculus
tcatgaacgttttagtggtaacccg

SEQ ID NO: 807809 - DNA, 25 bp, Mus musculus
tcatgaactagtcctctgtggcttt

SEQ ID NO: 807810 - DNA, 25 bp, Mus musculus
tcatgaactagtgctctgtggcttt

SEQ ID NO: 807811 - DNA, 25 bp, Mus musculus
tcatgaactcatcacccttctgtca

SEQ ID NO: 807812 - DNA, 25 bp, Mus musculus
tcatgaactcatgacccttctgtca

SEQ ID NO: 807813 - DNA, 25 bp, Mus musculus
tcatgaactgacataaccctgatca

SEQ ID NO: 807814 - DNA, 25 bp, Mus musculus
tcatgaactgacttaaccctgatca

SEQ ID NO: 807815 - DNA, 25 bp, Mus musculus
tcatgaagaggtatctcctggccac

SEQ ID NO: 807816 - DNA, 25 bp, Mus musculus
tcatgaagaggtttctcctggccac

SEQ ID NO: 807817 - DNA, 25 bp, Mus musculus
tcatgaagatccagaccgagcgtgg

SEQ ID NO: 807818 - DNA, 25 bp, Mus musculus
tcatgaagatcctgaccgagcgtgg

SEQ ID NO: 807819 - DNA, 25 bp, Mus musculus
tcatgaagcattcttgtcctcactg

SEQ ID NO: 807820 - DNA, 25 bp, Mus musculus
tcatgaagcattgttgtcctcactg

SEQ ID NO: 807821 - DNA, 25 bp, Mus musculus
tcatgaagccaaacagctgtgagct

SEQ ID NO: 807822 - DNA, 25 bp, Mus musculus
tcatgaagccaatcagctgtgagct

SEQ ID NO: 807823 - DNA, 25 bp, Mus musculus
tcatgaagcccgccaaagacattgt

SEQ ID NO: 807824 - DNA, 25 bp, Mus musculus
tcatgaagcccggcaaagacattgt

SEQ ID NO: 807825 - DNA, 25 bp, Mus musculus
tcatgaagctgaataaccgccccat

SEQ ID NO: 807826 - DNA, 25 bp, Mus musculus
tcatgaagctgacgactgacctcgg

SEQ ID NO: 807827 - DNA, 25 bp, Mus musculus
tcatgaagctgaggactgacctcgg

SEQ ID NO: 807828 - DNA, 25 bp, Mus musculus
tcatgaagctgattaaccgccccat

SEQ ID NO: 807829 - DNA, 25 bp, Mus musculus
tcatgaaggcttagcttgctctgtg

SEQ ID NO: 807830 - DNA, 25 bp, Mus musculus
tcatgaaggctttgcttgctctgtg

SEQ ID NO: 807831 - DNA, 25 bp, Mus musculus
tcatgaagggaaactatgtcagtga

SEQ ID NO: 807832 - DNA, 25 bp, Mus musculus
tcatgaagggaatctatgtcagtga

SEQ ID NO: 807833 - DNA, 25 bp, Mus musculus
tcatgaaggttcagtgtcctagttc

SEQ ID NO: 807834 - DNA, 25 bp, Mus musculus
tcatgaaggttctgtgtcctagttc

SEQ ID NO: 807835 - DNA, 25 bp, Mus musculus
tcatgaagtataacagacctggaag

SEQ ID NO: 807836 - DNA, 25 bp, Mus musculus
tcatgaagtatatcagacctggaag

SEQ ID NO: 807837 - DNA, 25 bp, Mus musculus
tcatgaagtcttcaccctggactgt

SEQ ID NO: 807838 - DNA, 25 bp, Mus musculus
tcatgaagtcttgaccctggactgt

SEQ ID NO: 807839 - DNA, 25 bp, Mus musculus
tcatgaagttcaagcccgactgtgt

SEQ ID NO: 807840 - DNA, 25 bp, Mus musculus
tcatgaagttcatgcccgactgtgt

SEQ ID NO: 807841 - DNA, 25 bp, Mus musculus
tcatgaatataaccgtccctggatt

SEQ ID NO: 807842 - DNA, 25 bp, Mus musculus
tcatgaatataagcgtccctggatt

SEQ ID NO: 807843 - DNA, 25 bp, Mus musculus
tcatgaatattgagcggcccctgtt

SEQ ID NO: 807844 - DNA, 25 bp, Mus musculus
tcatgaatattgtgcggcccctgtt

SEQ ID NO: 807845 - DNA, 25 bp, Mus musculus
tcatgaatgcgcacttaccaaagga

SEQ ID NO: 807846 - DNA, 25 bp, Mus musculus
tcatgaatgcgctcttaccaaagga

SEQ ID NO: 807847 - DNA, 25 bp, Mus musculus
tcatgaatggcccttagcatttctt

SEQ ID NO: 807848 - DNA, 25 bp, Mus musculus
tcatgaatggccgttagcatttctt

SEQ ID NO: 807849 - DNA, 25 bp, Mus musculus
tcatgaattcatcccgttgctggtt

SEQ ID NO: 807850 - DNA, 25 bp, Mus musculus
tcatgaattcatgccgttgctggtt

SEQ ID NO: 807851 - DNA, 25 bp, Mus musculus
tcatgaattttaacctgcagagaag

SEQ ID NO: 807852 - DNA, 25 bp, Mus musculus
tcatgaattttatcctgcagagaag

SEQ ID NO: 807853 - DNA, 25 bp, Mus musculus
tcatgacaacacaggtccagtcttg

SEQ ID NO: 807854 - DNA, 25 bp, Mus musculus
tcatgacaacactggtccagtcttg

SEQ ID NO: 807855 - DNA, 25 bp, Mus musculus
tcatgacagatgacctcccttgcca

SEQ ID NO: 807856 - DNA, 25 bp, Mus musculus
tcatgacagatgtcctcccttgcca

SEQ ID NO: 807857 - DNA, 25 bp, Mus musculus
tcatgacagtttcctttaagtatta

SEQ ID NO: 807858 - DNA, 25 bp, Mus musculus
tcatgacagtttgctttaagtatta

SEQ ID NO: 807859 - DNA, 25 bp, Mus musculus
tcatgacatgacaccttatattatt

SEQ ID NO: 807860 - DNA, 25 bp, Mus musculus
tcatgacatgactccttatattatt

SEQ ID NO: 807861 - DNA, 25 bp, Mus musculus
tcatgacattccacagattttttgg

SEQ ID NO: 807862 - DNA, 25 bp, Mus musculus
tcatgacattcctcagattttttgg

SEQ ID NO: 807863 - DNA, 25 bp, Mus musculus
tcatgacatttacgagctgagacat

SEQ ID NO: 807864 - DNA, 25 bp, Mus musculus
tcatgacatttaggagctgagacat

SEQ ID NO: 807865 - DNA, 25 bp, Mus musculus
tcatgaccaagaaggcaacgttggg

SEQ ID NO: 807866 - DNA, 25 bp, Mus musculus
tcatgaccaagacaggccggccatt

SEQ ID NO: 807867 - DNA, 25 bp, Mus musculus
tcatgaccaagagaggccggccatt

SEQ ID NO: 807868 - DNA, 25 bp, Mus musculus
tcatgaccaagatggcaacgttggg

SEQ ID NO: 807869 - DNA, 25 bp, Mus musculus
tcatgaccaccacatacatatttgt

SEQ ID NO: 807870 - DNA, 25 bp, Mus musculus
tcatgaccaccagatacatatttgt

SEQ ID NO: 807871 - DNA, 25 bp, Mus musculus
tcatgaccagctacatctccgctag

SEQ ID NO: 807872 - DNA, 25 bp, Mus musculus
tcatgaccagcttcatctccgctag

SEQ ID NO: 807873 - DNA, 25 bp, Mus musculus
tcatgaccattgcaacctttgggat

SEQ ID NO: 807874 - DNA, 25 bp, Mus musculus
tcatgaccattggaacctttgggat

SEQ ID NO: 807875 - DNA, 25 bp, Mus musculus
tcatgacccatcatcagagactgac

SEQ ID NO: 807876 - DNA, 25 bp, Mus musculus
tcatgacccatcttcagagactgac

SEQ ID NO: 807877 - DNA, 25 bp, Mus musculus
tcatgacccatgacagcaacggctg

SEQ ID NO: 807878 - DNA, 25 bp, Mus musculus
tcatgacccatgtcagcaacggctg

SEQ ID NO: 807879 - DNA, 25 bp, Mus musculus
tcatgaccccagagcccaagtgttt

SEQ ID NO: 807880 - DNA, 25 bp, Mus musculus
tcatgaccccagtgcccaagtgttt

SEQ ID NO: 807881 - DNA, 25 bp, Mus musculus
tcatgacccctaatatagacgatag

SEQ ID NO: 807882 - DNA, 25 bp, Mus musculus
tcatgacccctattatagacgatag

SEQ ID NO: 807883 - DNA, 25 bp, Mus musculus
tcatgaccccttaggtactcaaact

SEQ ID NO: 807884 - DNA, 25 bp, Mus musculus
tcatgacccctttggtactcaaact

SEQ ID NO: 807885 - DNA, 25 bp, Mus musculus
tcatgaccctaccagctcaaaagaa

SEQ ID NO: 807886 - DNA, 25 bp, Mus musculus
tcatgaccctacgagctcaaaagaa

SEQ ID NO: 807887 - DNA, 25 bp, Mus musculus
tcatgaccctcaatctctagcgtga

SEQ ID NO: 807888 - DNA, 25 bp, Mus musculus
tcatgaccctcattctctagcgtga

SEQ ID NO: 807889 - DNA, 25 bp, Mus musculus
tcatgaccgagaacaacgactatct

SEQ ID NO: 807890 - DNA, 25 bp, Mus musculus
tcatgaccgagatcaacgactatct

SEQ ID NO: 807891 - DNA, 25 bp, Mus musculus
tcatgaccgagtcggtgtgtgcaca

SEQ ID NO: 807892 - DNA, 25 bp, Mus musculus
tcatgaccgagtgggtgtgtgcaca

SEQ ID NO: 807893 - DNA, 25 bp, Mus musculus
tcatgacctggacctactgagaaag

SEQ ID NO: 807894 - DNA, 25 bp, Mus musculus
tcatgacctggagctactgagaaag

SEQ ID NO: 807895 - DNA, 25 bp, Mus musculus
tcatgacctttcacaagccagggag

SEQ ID NO: 807896 - DNA, 25 bp, Mus musculus
tcatgacctttcacccatctgataa

SEQ ID NO: 807897 - DNA, 25 bp, Mus musculus
tcatgacctttctcaagccagggag

SEQ ID NO: 807898 - DNA, 25 bp, Mus musculus
tcatgacctttctcccatctgataa

SEQ ID NO: 807899 - DNA, 25 bp, Mus musculus
tcatgacctttgctcgcaatctctt

SEQ ID NO: 807900 - DNA, 25 bp, Mus musculus
tcatgacctttggtcgcaatctctt

SEQ ID NO: 807901 - DNA, 25 bp, Mus musculus
tcatgacgctcaacgtgggcatcac

SEQ ID NO: 807902 - DNA, 25 bp, Mus musculus
tcatgacgctcatcgtgggcatcac

SEQ ID NO: 807903 - DNA, 25 bp, Mus musculus
tcatgacggcttagtactgtggaat

SEQ ID NO: 807904 - DNA, 25 bp, Mus musculus
tcatgacggctttgtactgtggaat

SEQ ID NO: 807905 - DNA, 25 bp, Mus musculus
tcatgactacctccgcagcaagttg

SEQ ID NO: 807906 - DNA, 25 bp, Mus musculus
tcatgactacctcgcacagtgacat

SEQ ID NO: 807907 - DNA, 25 bp, Mus musculus
tcatgactacctgcgcagcaagttg

SEQ ID NO: 807908 - DNA, 25 bp, Mus musculus
tcatgactacctggcacagtgacat

SEQ ID NO: 807909 - DNA, 25 bp, Mus musculus
tcatgactatgcctgatacccacag

SEQ ID NO: 807910 - DNA, 25 bp, Mus musculus
tcatgactatgcgtgatacccacag

SEQ ID NO: 807911 - DNA, 25 bp, Mus musculus
tcatgactctctctgcttggtgctt

SEQ ID NO: 807912 - DNA, 25 bp, Mus musculus
tcatgactctctgtgcttggtgctt

SEQ ID NO: 807913 - DNA, 25 bp, Mus musculus
tcatgactgaagcaataaacctttt

SEQ ID NO: 807914 - DNA, 25 bp, Mus musculus
tcatgactgaaggaataaacctttt

SEQ ID NO: 807915 - DNA, 25 bp, Mus musculus
tcatgactggctattcagtgacaag

SEQ ID NO: 807916 - DNA, 25 bp, Mus musculus
tcatgactggcttttcagtgacaag

SEQ ID NO: 807917 - DNA, 25 bp, Mus musculus
tcatgactgtagagcctcgtttgag

SEQ ID NO: 807918 - DNA, 25 bp, Mus musculus
tcatgactgtagtgcctcgtttgag

SEQ ID NO: 807919 - DNA, 25 bp, Mus musculus
tcatgacttccgagacgctttgtaa

SEQ ID NO: 807920 - DNA, 25 bp, Mus musculus
tcatgacttccgtgacgctttgtaa

SEQ ID NO: 807921 - DNA, 25 bp, Mus musculus
tcatgactttgtacttagagatctt

SEQ ID NO: 807922 - DNA, 25 bp, Mus musculus
tcatgactttgttcttagagatctt

SEQ ID NO: 807923 - DNA, 25 bp, Mus musculus
tcatgacttttgaagcagcagctcc

SEQ ID NO: 807924 - DNA, 25 bp, Mus musculus
tcatgacttttgcatctgcgaacat

SEQ ID NO: 807925 - DNA, 25 bp, Mus musculus
tcatgacttttggatctgcgaacat

SEQ ID NO: 807926 - DNA, 25 bp, Mus musculus
tcatgacttttgtagcagcagctcc

SEQ ID NO: 807927 - DNA, 25 bp, Mus musculus
tcatgagaatcaacccgctgctgga

SEQ ID NO: 807928 - DNA, 25 bp, Mus musculus
tcatgagaatcacctgcccagttgt

SEQ ID NO: 807929 - DNA, 25 bp, Mus musculus
tcatgagaatcagctgcccagttgt

SEQ ID NO: 807930 - DNA, 25 bp, Mus musculus
tcatgagaatcatcccgctgctgga

SEQ ID NO: 807931 - DNA, 25 bp, Mus musculus
tcatgagaattcaactggtctactg

SEQ ID NO: 807932 - DNA, 25 bp, Mus musculus
tcatgagaattctactggtctactg

SEQ ID NO: 807933 - DNA, 25 bp, Mus musculus
tcatgagacagtctgatcaaccttt

SEQ ID NO: 807934 - DNA, 25 bp, Mus musculus
tcatgagacagtgtgatcaaccttt

SEQ ID NO: 807935 - DNA, 25 bp, Mus musculus
tcatgagacataccttgcttgcttc

SEQ ID NO: 807936 - DNA, 25 bp, Mus musculus
tcatgagacatagcttgcttgcttc

SEQ ID NO: 807937 - DNA, 25 bp, Mus musculus
tcatgagaccttatatactgttttt

SEQ ID NO: 807938 - DNA, 25 bp, Mus musculus
tcatgagaccttttatactgttttt

SEQ ID NO: 807939 - DNA, 25 bp, Mus musculus
tcatgagagagtctgtatccgcccc

SEQ ID NO: 807940 - DNA, 25 bp, Mus musculus
tcatgagagagtgtgtatccgcccc

SEQ ID NO: 807941 - DNA, 25 bp, Mus musculus
tcatgagagctgacttagggttcca

SEQ ID NO: 807942 - DNA, 25 bp, Mus musculus
tcatgagagctgtcttagggttcca

SEQ ID NO: 807943 - DNA, 25 bp, Mus musculus
tcatgagatgccagctcttctacaa

SEQ ID NO: 807944 - DNA, 25 bp, Mus musculus
tcatgagatgcctgctcttctacaa

SEQ ID NO: 807945 - DNA, 25 bp, Mus musculus
tcatgagcagcacaaggtcgtcttc

SEQ ID NO: 807946 - DNA, 25 bp, Mus musculus
tcatgagcagcagaaggtcgtcttc

SEQ ID NO: 807947 - DNA, 25 bp, Mus musculus
tcatgagcaggtaatatttcggaat

SEQ ID NO: 807948 - DNA, 25 bp, Mus musculus
tcatgagcaggttatatttcggaat

SEQ ID NO: 807949 - DNA, 25 bp, Mus musculus
tcatgagcattgaagaccccaaccg

SEQ ID NO: 807950 - DNA, 25 bp, Mus musculus
tcatgagcattgtagaccccaaccg

SEQ ID NO: 807951 - DNA, 25 bp, Mus musculus
tcatgagctcatcttgcctttgacc

SEQ ID NO: 807952 - DNA, 25 bp, Mus musculus
tcatgagctcatgttgcctttgacc

SEQ ID NO: 807953 - DNA, 25 bp, Mus musculus
tcatgagctggtcttctcggaactc

SEQ ID NO: 807954 - DNA, 25 bp, Mus musculus
tcatgagctggtgttctcggaactc

SEQ ID NO: 807955 - DNA, 25 bp, Mus musculus
tcatgaggaattacagcggttactg

SEQ ID NO: 807956 - DNA, 25 bp, Mus musculus
tcatgaggaatttcagcggttactg

SEQ ID NO: 807957 - DNA, 25 bp, Mus musculus
tcatgagggtgcaggactcctacgg

SEQ ID NO: 807958 - DNA, 25 bp, Mus musculus
tcatgagggtgctggactcctacgg

SEQ ID NO: 807959 - DNA, 25 bp, Mus musculus
tcatgaggtgatcacagctggccct

SEQ ID NO: 807960 - DNA, 25 bp, Mus musculus
tcatgaggtgatgacagctggccct

SEQ ID NO: 807961 - DNA, 25 bp, Mus musculus
tcatgagtaccaccttacggttact

SEQ ID NO: 807962 - DNA, 25 bp, Mus musculus
tcatgagtaccagcttacggttact

SEQ ID NO: 807963 - DNA, 25 bp, Mus musculus
tcatgagtcattatgcagcagcacc

SEQ ID NO: 807964 - DNA, 25 bp, Mus musculus
tcatgagtcattttgcagcagcacc

SEQ ID NO: 807965 - DNA, 25 bp, Mus musculus
tcatgagtccataggcatttgaatt

SEQ ID NO: 807966 - DNA, 25 bp, Mus musculus
tcatgagtccattggcatttgaatt

SEQ ID NO: 807967 - DNA, 25 bp, Mus musculus
tcatgagtgttaccgctggctgata

SEQ ID NO: 807968 - DNA, 25 bp, Mus musculus
tcatgagtgttagcgctggctgata

SEQ ID NO: 807969 - DNA, 25 bp, Mus musculus
tcatgagttcacaacatctgctcgt

SEQ ID NO: 807970 - DNA, 25 bp, Mus musculus
tcatgagttcactacatctgctcgt

SEQ ID NO: 807971 - DNA, 25 bp, Mus musculus
tcatgagttcagacaagccttgctt

SEQ ID NO: 807972 - DNA, 25 bp, Mus musculus
tcatgagttcagtcaagccttgctt

SEQ ID NO: 807973 - DNA, 25 bp, Mus musculus
tcatgagtttgtcttccgggacttt

SEQ ID NO: 807974 - DNA, 25 bp, Mus musculus
tcatgagtttgtgttccgggacttt

SEQ ID NO: 807975 - DNA, 25 bp, Mus musculus
tcatgatacactccatcctctctag

SEQ ID NO: 807976 - DNA, 25 bp, Mus musculus
tcatgatacactgcatcctctctag

SEQ ID NO: 807977 - DNA, 25 bp, Mus musculus
tcatgatacctacgagatgccagga

SEQ ID NO: 807978 - DNA, 25 bp, Mus musculus
tcatgatacctaggagatgccagga

SEQ ID NO: 807979 - DNA, 25 bp, Mus musculus
tcatgatagactcttcctttaaaag

SEQ ID NO: 807980 - DNA, 25 bp, Mus musculus
tcatgatagactgttcctttaaaag

SEQ ID NO: 807981 - DNA, 25 bp, Mus musculus
tcatgatagtccacgggctttccaa

SEQ ID NO: 807982 - DNA, 25 bp, Mus musculus
tcatgatagtcctcgggctttccaa

SEQ ID NO: 807983 - DNA, 25 bp, Mus musculus
tcatgatcacaaaaactccactaat

SEQ ID NO: 807984 - DNA, 25 bp, Mus musculus
tcatgatcacaataactccactaat

SEQ ID NO: 807985 - DNA, 25 bp, Mus musculus
tcatgatcaggtacatcatgtaaac

SEQ ID NO: 807986 - DNA, 25 bp, Mus musculus
tcatgatcaggttcatcatgtaaac

SEQ ID NO: 807987 - DNA, 25 bp, Mus musculus
tcatgatccagtacccgagcagtca

SEQ ID NO: 807988 - DNA, 25 bp, Mus musculus
tcatgatccagttcccgagcagtca

SEQ ID NO: 807989 - DNA, 25 bp, Mus musculus
tcatgatctatacgcaaccggaacc

SEQ ID NO: 807990 - DNA, 25 bp, Mus musculus
tcatgatctataggcaaccggaacc

SEQ ID NO: 807991 - DNA, 25 bp, Mus musculus
tcatgatctcgtccagttcggcaac

SEQ ID NO: 807992 - DNA, 25 bp, Mus musculus
tcatgatctcgtgcagttcggcaac

SEQ ID NO: 807993 - DNA, 25 bp, Mus musculus
tcatgatcttttcctgtgataagtg

SEQ ID NO: 807994 - DNA, 25 bp, Mus musculus
tcatgatcttttgctgtgataagtg

SEQ ID NO: 807995 - DNA, 25 bp, Mus musculus
tcatgatgaccgaggctgtgttcct

SEQ ID NO: 807996 - DNA, 25 bp, Mus musculus
tcatgatgaccgtggctgtgttcct

SEQ ID NO: 807997 - DNA, 25 bp, Mus musculus
tcatgatgatgtatcctgtggcatt

SEQ ID NO: 807998 - DNA, 25 bp, Mus musculus
tcatgatgatgtttcctgtggcatt

SEQ ID NO: 807999 - DNA, 25 bp, Mus musculus
tcatgatgcccaagccttggcatgt

SEQ ID NO: 808000 - DNA, 25 bp, Mus musculus
tcatgatgcccatgccttggcatgt

SEQ ID NO: 808001 - DNA, 25 bp, Mus musculus
tcatgatgggtgcttcggtttgaac

SEQ ID NO: 808002 - DNA, 25 bp, Mus musculus
tcatgatgggtggttcggtttgaac

SEQ ID NO: 808003 - DNA, 25 bp, Mus musculus
tcatgatgtgttctaggcgctgctc

SEQ ID NO: 808004 - DNA, 25 bp, Mus musculus
tcatgatgtgttgtaggcgctgctc

SEQ ID NO: 808005 - DNA, 25 bp, Mus musculus
tcatgattaaagagcgcgtgggcca

SEQ ID NO: 808006 - DNA, 25 bp, Mus musculus
tcatgattaaagtgcgcgtgggcca

SEQ ID NO: 808007 - DNA, 25 bp, Mus musculus
tcatgattcaaactacattttgctt

SEQ ID NO: 808008 - DNA, 25 bp, Mus musculus
tcatgattcaaagtacattttgctt

SEQ ID NO: 808009 - DNA, 25 bp, Mus musculus
tcatgattccttattcttaaacatc

SEQ ID NO: 808010 - DNA, 25 bp, Mus musculus
tcatgattcctttttcttaaacatc

SEQ ID NO: 808011 - DNA, 25 bp, Mus musculus
tcatgcaaacccataatggactaaa

SEQ ID NO: 808012 - DNA, 25 bp, Mus musculus
tcatgcaaacccttaatggactaaa

SEQ ID NO: 808013 - DNA, 25 bp, Mus musculus
tcatgcaaagaccaggatgtagaca

SEQ ID NO: 808014 - DNA, 25 bp, Mus musculus
tcatgcaaagacgaggatgtagaca

SEQ ID NO: 808015 - DNA, 25 bp, Mus musculus
tcatgcaataagctgttgatcctga

SEQ ID NO: 808016 - DNA, 25 bp, Mus musculus
tcatgcaataaggtgttgatcctga

SEQ ID NO: 808017 - DNA, 25 bp, Mus musculus
tcatgcaatactacacttgaccctg

SEQ ID NO: 808018 - DNA, 25 bp, Mus musculus
tcatgcaatacttcacttgaccctg

SEQ ID NO: 808019 - DNA, 25 bp, Mus musculus
tcatgcaccatacctctcctaggga

SEQ ID NO: 808020 - DNA, 25 bp, Mus musculus
tcatgcaccatagctctcctaggga

SEQ ID NO: 808021 - DNA, 25 bp, Mus musculus
tcatgcacgtggagtatgcacatgc

SEQ ID NO: 808022 - DNA, 25 bp, Mus musculus
tcatgcacgtggtgtatgcacatgc

SEQ ID NO: 808023 - DNA, 25 bp, Mus musculus
tcatgcactgcgactccatcactga

SEQ ID NO: 808024 - DNA, 25 bp, Mus musculus
tcatgcactgcgtctccatcactga

SEQ ID NO: 808025 - DNA, 25 bp, Mus musculus
tcatgcagaacacgattggggctag

SEQ ID NO: 808026 - DNA, 25 bp, Mus musculus
tcatgcagaacaggattggggctag

SEQ ID NO: 808027 - DNA, 25 bp, Mus musculus
tcatgcagaatgacggattggtcct

SEQ ID NO: 808028 - DNA, 25 bp, Mus musculus
tcatgcagaatgtcggattggtcct

SEQ ID NO: 808029 - DNA, 25 bp, Mus musculus
tcatgcagacttatttaatgatttt

SEQ ID NO: 808030 - DNA, 25 bp, Mus musculus
tcatgcagacttttttaatgatttt

SEQ ID NO: 808031 - DNA, 25 bp, Mus musculus
tcatgcagagggatcagctggcgcc

SEQ ID NO: 808032 - DNA, 25 bp, Mus musculus
tcatgcagagggttcagctggcgcc

SEQ ID NO: 808033 - DNA, 25 bp, Mus musculus
tcatgcagatttcagtgccctttgc

SEQ ID NO: 808034 - DNA, 25 bp, Mus musculus
tcatgcagatttgagtgccctttgc

SEQ ID NO: 808035 - DNA, 25 bp, Mus musculus
tcatgcagctgcacagggacaatct

SEQ ID NO: 808036 - DNA, 25 bp, Mus musculus
tcatgcagctgctcagggacaatct

SEQ ID NO: 808037 - DNA, 25 bp, Mus musculus
tcatgcagctggagccttcagaatt

SEQ ID NO: 808038 - DNA, 25 bp, Mus musculus
tcatgcagctggtgccttcagaatt

SEQ ID NO: 808039 - DNA, 25 bp, Mus musculus
tcatgcaggcagatccccaggtggc

SEQ ID NO: 808040 - DNA, 25 bp, Mus musculus
tcatgcaggcagttccccaggtggc

SEQ ID NO: 808041 - DNA, 25 bp, Mus musculus
tcatgcaggcccacagtgaaacgtt

SEQ ID NO: 808042 - DNA, 25 bp, Mus musculus
tcatgcaggccctcagtgaaacgtt

SEQ ID NO: 808043 - DNA, 25 bp, Mus musculus
tcatgcaggttgacagaccgacttt

SEQ ID NO: 808044 - DNA, 25 bp, Mus musculus
tcatgcaggttgtcagaccgacttt

SEQ ID NO: 808045 - DNA, 25 bp, Mus musculus
tcatgcagtactattgctcaagccc

SEQ ID NO: 808046 - DNA, 25 bp, Mus musculus
tcatgcagtacttttgctcaagccc

SEQ ID NO: 808047 - DNA, 25 bp, Mus musculus
tcatgcagttatcaagaatcgcctg

SEQ ID NO: 808048 - DNA, 25 bp, Mus musculus
tcatgcagttatgaagaatcgcctg

SEQ ID NO: 808049 - DNA, 25 bp, Mus musculus
tcatgcatcaaactggaacccctac

SEQ ID NO: 808050 - DNA, 25 bp, Mus musculus
tcatgcatcaaagtggaacccctac

SEQ ID NO: 808051 - DNA, 25 bp, Mus musculus
tcatgcatccaccagaggcttggct

SEQ ID NO: 808052 - DNA, 25 bp, Mus musculus
tcatgcatccacgagaggcttggct

SEQ ID NO: 808053 - DNA, 25 bp, Mus musculus
tcatgcatccgaacgagccaggaga

SEQ ID NO: 808054 - DNA, 25 bp, Mus musculus
tcatgcatccgatcgagccaggaga

SEQ ID NO: 808055 - DNA, 25 bp, Mus musculus
tcatgcatcctgatcacactcattt

SEQ ID NO: 808056 - DNA, 25 bp, Mus musculus
tcatgcatcctgttcacactcattt

SEQ ID NO: 808057 - DNA, 25 bp, Mus musculus
tcatgcatgcccacaagagtatcac

SEQ ID NO: 808058 - DNA, 25 bp, Mus musculus
tcatgcatgccctcaagagtatcac

SEQ ID NO: 808059 - DNA, 25 bp, Mus musculus
tcatgcattccacactccaaggctg

SEQ ID NO: 808060 - DNA, 25 bp, Mus musculus
tcatgcattccagactccaaggctg

SEQ ID NO: 808061 - DNA, 25 bp, Mus musculus
tcatgcattgttacttttcaactga

SEQ ID NO: 808062 - DNA, 25 bp, Mus musculus
tcatgcattgtttcttttcaactga

SEQ ID NO: 808063 - DNA, 25 bp, Mus musculus
tcatgccaaaacaagccaaccgttg

SEQ ID NO: 808064 - DNA, 25 bp, Mus musculus
tcatgccaaaactagccaaccgttg

SEQ ID NO: 808065 - DNA, 25 bp, Mus musculus
tcatgccaacaaaaggagtctgcca

SEQ ID NO: 808066 - DNA, 25 bp, Mus musculus
tcatgccaacaataggagtctgcca

SEQ ID NO: 808067 - DNA, 25 bp, Mus musculus
tcatgccaagacacagaagccctgt

SEQ ID NO: 808068 - DNA, 25 bp, Mus musculus
tcatgccaagactcagaagccctgt

SEQ ID NO: 808069 - DNA, 25 bp, Mus musculus
tcatgccaccgcaagctagtatcac

SEQ ID NO: 808070 - DNA, 25 bp, Mus musculus
tcatgccaccgctagctagtatcac

SEQ ID NO: 808071 - DNA, 25 bp, Mus musculus
tcatgccacctcagtccaaagatgg

SEQ ID NO: 808072 - DNA, 25 bp, Mus musculus
tcatgccacctcagttgttaactat

SEQ ID NO: 808073 - DNA, 25 bp, Mus musculus
tcatgccacctctgtccaaagatgg

SEQ ID NO: 808074 - DNA, 25 bp, Mus musculus
tcatgccacctctgttgttaactat

SEQ ID NO: 808075 - DNA, 25 bp, Mus musculus
tcatgccactgaatacgttgaaaaa

SEQ ID NO: 808076 - DNA, 25 bp, Mus musculus
tcatgccactgattacgttgaaaaa

SEQ ID NO: 808077 - DNA, 25 bp, Mus musculus
tcatgccactggagcaggtcatcaa

SEQ ID NO: 808078 - DNA, 25 bp, Mus musculus
tcatgccactggtgcaggtcatcaa

SEQ ID NO: 808079 - DNA, 25 bp, Mus musculus
tcatgccagagccaggacacaagac

SEQ ID NO: 808080 - DNA, 25 bp, Mus musculus
tcatgccagagcgaggacacaagac

SEQ ID NO: 808081 - DNA, 25 bp, Mus musculus
tcatgccagcatcaagagcctgctt

SEQ ID NO: 808082 - DNA, 25 bp, Mus musculus
tcatgccagcatgaagagcctgctt

SEQ ID NO: 808083 - DNA, 25 bp, Mus musculus
tcatgccagcctcctcaatgtagat

SEQ ID NO: 808084 - DNA, 25 bp, Mus musculus
tcatgccagcctgctcaatgtagat

SEQ ID NO: 808085 - DNA, 25 bp, Mus musculus
tcatgccagcttagtctggagtggc

SEQ ID NO: 808086 - DNA, 25 bp, Mus musculus
tcatgccagctttgtctggagtggc

SEQ ID NO: 808087 - DNA, 25 bp, Mus musculus
tcatgccaggtaaccacactctttt

SEQ ID NO: 808088 - DNA, 25 bp, Mus musculus
tcatgccaggtatccacactctttt

SEQ ID NO: 808089 - DNA, 25 bp, Mus musculus
tcatgccatcctaggagggctgcac

SEQ ID NO: 808090 - DNA, 25 bp, Mus musculus
tcatgccatccttggagggctgcac

SEQ ID NO: 808091 - DNA, 25 bp, Mus musculus
tcatgccatgcgacactctggcacg

SEQ ID NO: 808092 - DNA, 25 bp, Mus musculus
tcatgccatgcgtcactctggcacg

SEQ ID NO: 808093 - DNA, 25 bp, Mus musculus
tcatgcccacataaaacatgtatag

SEQ ID NO: 808094 - DNA, 25 bp, Mus musculus
tcatgcccacattaaacatgtatag

SEQ ID NO: 808095 - DNA, 25 bp, Mus musculus
tcatgcccaccgatgtctttgagat

SEQ ID NO: 808096 - DNA, 25 bp, Mus musculus
tcatgcccaccgttgtctttgagat

SEQ ID NO: 808097 - DNA, 25 bp, Mus musculus
tcatgcccagagacacaatcattgt

SEQ ID NO: 808098 - DNA, 25 bp, Mus musculus
tcatgcccagagtcacaatcattgt

SEQ ID NO: 808099 - DNA, 25 bp, Mus musculus
tcatgcccaggccaatgagtgcaag

SEQ ID NO: 808100 - DNA, 25 bp, Mus musculus
tcatgcccaggcgaatgagtgcaag

SEQ ID NO: 808101 - DNA, 25 bp, Mus musculus
tcatgcccagtaatgttttgtggaa

SEQ ID NO: 808102 - DNA, 25 bp, Mus musculus
tcatgcccagtattgttttgtggaa

SEQ ID NO: 808103 - DNA, 25 bp, Mus musculus
tcatgcccatctaccaatgaatgct

SEQ ID NO: 808104 - DNA, 25 bp, Mus musculus
tcatgcccatcttccaatgaatgct

SEQ ID NO: 808105 - DNA, 25 bp, Mus musculus
tcatgccccattcatttcacttgat

SEQ ID NO: 808106 - DNA, 25 bp, Mus musculus
tcatgccccattgatttcacttgat

SEQ ID NO: 808107 - DNA, 25 bp, Mus musculus
tcatgccccgagctgctctttcttt

SEQ ID NO: 808108 - DNA, 25 bp, Mus musculus
tcatgccccgaggtgctctttcttt

SEQ ID NO: 808109 - DNA, 25 bp, Mus musculus
tcatgccccggtcagtggaaaatgg

SEQ ID NO: 808110 - DNA, 25 bp, Mus musculus
tcatgccccggtgagtggaaaatgg

SEQ ID NO: 808111 - DNA, 25 bp, Mus musculus
tcatgccctcaccttggtgataatg

SEQ ID NO: 808112 - DNA, 25 bp, Mus musculus
tcatgccctcacgttggtgataatg

SEQ ID NO: 808113 - DNA, 25 bp, Mus musculus
tcatgccctcgactactgctctggg

SEQ ID NO: 808114 - DNA, 25 bp, Mus musculus
tcatgccctcgagtactgctctggg

SEQ ID NO: 808115 - DNA, 25 bp, Mus musculus
tcatgccctgaaagtctgactttct

SEQ ID NO: 808116 - DNA, 25 bp, Mus musculus
tcatgccctgaatgtctgactttct

SEQ ID NO: 808117 - DNA, 25 bp, Mus musculus
tcatgccctggactctagagctgtg

SEQ ID NO: 808118 - DNA, 25 bp, Mus musculus
tcatgccctggagtctagagctgtg

SEQ ID NO: 808119 - DNA, 25 bp, Mus musculus
tcatgccctgggatcaggagatctt

SEQ ID NO: 808120 - DNA, 25 bp, Mus musculus
tcatgccctgggttcaggagatctt

SEQ ID NO: 808121 - DNA, 25 bp, Mus musculus
tcatgccgacaactagcgtggacct

SEQ ID NO: 808122 - DNA, 25 bp, Mus musculus
tcatgccgacaagtagcgtggacct

SEQ ID NO: 808123 - DNA, 25 bp, Mus musculus
tcatgccgagtgatggaacccgaca

SEQ ID NO: 808124 - DNA, 25 bp, Mus musculus
tcatgccgagtgttggaacccgaca

SEQ ID NO: 808125 - DNA, 25 bp, Mus musculus
tcatgccgcgtcaccaaagacaaaa

SEQ ID NO: 808126 - DNA, 25 bp, Mus musculus
tcatgccgcgtctccaaagacaaaa

SEQ ID NO: 808127 - DNA, 25 bp, Mus musculus
tcatgccgggtcaaatacagggtta

SEQ ID NO: 808128 - DNA, 25 bp, Mus musculus
tcatgccgggtctaatacagggtta

SEQ ID NO: 808129 - DNA, 25 bp, Mus musculus
tcatgccgtggcatcaggcaacaag

SEQ ID NO: 808130 - DNA, 25 bp, Mus musculus
tcatgccgtggcttcaggcaacaag

SEQ ID NO: 808131 - DNA, 25 bp, Mus musculus
tcatgcctaccaagctggatggctt

SEQ ID NO: 808132 - DNA, 25 bp, Mus musculus
tcatgcctaccatgctggatggctt

SEQ ID NO: 808133 - DNA, 25 bp, Mus musculus
tcatgcctagctacagagttctgga

SEQ ID NO: 808134 - DNA, 25 bp, Mus musculus
tcatgcctagcttcagagttctgga

SEQ ID NO: 808135 - DNA, 25 bp, Mus musculus
tcatgcctccatatcttcatttata

SEQ ID NO: 808136 - DNA, 25 bp, Mus musculus
tcatgcctccatttcttcatttata

SEQ ID NO: 808137 - DNA, 25 bp, Mus musculus
tcatgcctcccaagggcagtaattg

SEQ ID NO: 808138 - DNA, 25 bp, Mus musculus
tcatgcctcccatgggcagtaattg

SEQ ID NO: 808139 - DNA, 25 bp, Mus musculus
tcatgcctcgagaaactgctctggg

SEQ ID NO: 808140 - DNA, 25 bp, Mus musculus
tcatgcctcgagtaactgctctggg

SEQ ID NO: 808141 - DNA, 25 bp, Mus musculus
tcatgcctctaaattcagcatttgg

SEQ ID NO: 808142 - DNA, 25 bp, Mus musculus
tcatgcctctaatttcagcatttgg

SEQ ID NO: 808143 - DNA, 25 bp, Mus musculus
tcatgcctctatctgctgagtacaa

SEQ ID NO: 808144 - DNA, 25 bp, Mus musculus
tcatgcctctatgtgctgagtacaa

SEQ ID NO: 808145 - DNA, 25 bp, Mus musculus
tcatgcctgaagacatttacgtgga

SEQ ID NO: 808146 - DNA, 25 bp, Mus musculus
tcatgcctgaagtcatttacgtgga

SEQ ID NO: 808147 - DNA, 25 bp, Mus musculus
tcatgcctgatgattaccgtgtact

SEQ ID NO: 808148 - DNA, 25 bp, Mus musculus
tcatgcctgatgtttaccgtgtact

SEQ ID NO: 808149 - DNA, 25 bp, Mus musculus
tcatgcctgcagactagcctctggg

SEQ ID NO: 808150 - DNA, 25 bp, Mus musculus
tcatgcctgcagtctagcctctggg

SEQ ID NO: 808151 - DNA, 25 bp, Mus musculus
tcatgcctgtctcttgagtgtgaaa

SEQ ID NO: 808152 - DNA, 25 bp, Mus musculus
tcatgcctgtctgttgagtgtgaaa

SEQ ID NO: 808153 - DNA, 25 bp, Mus musculus
tcatgccttccaccaaacttcagag

SEQ ID NO: 808154 - DNA, 25 bp, Mus musculus
tcatgccttccagcaaacttcagag

SEQ ID NO: 808155 - DNA, 25 bp, Mus musculus
tcatgccttctgagtgctcacggag

SEQ ID NO: 808156 - DNA, 25 bp, Mus musculus
tcatgccttctgtgtgctcacggag

SEQ ID NO: 808157 - DNA, 25 bp, Mus musculus
tcatgccttgcccatgttccgtgag

SEQ ID NO: 808158 - DNA, 25 bp, Mus musculus
tcatgccttgccgatgttccgtgag

SEQ ID NO: 808159 - DNA, 25 bp, Mus musculus
tcatgcgacctcatctttctgggct

SEQ ID NO: 808160 - DNA, 25 bp, Mus musculus
tcatgcgacctcttctttctgggct

SEQ ID NO: 808161 - DNA, 25 bp, Mus musculus
tcatgcgccagtcccagcaggagcg

SEQ ID NO: 808162 - DNA, 25 bp, Mus musculus
tcatgcgccagtgccagcaggagcg

SEQ ID NO: 808163 - DNA, 25 bp, Mus musculus
tcatgcgccgcaacagcaggtgagg

SEQ ID NO: 808164 - DNA, 25 bp, Mus musculus
tcatgcgccgcatcagcaggtgagg

SEQ ID NO: 808165 - DNA, 25 bp, Mus musculus
tcatgcgcggcaaggagcaggccaa

SEQ ID NO: 808166 - DNA, 25 bp, Mus musculus
tcatgcgcggcatggagcaggccaa

SEQ ID NO: 808167 - DNA, 25 bp, Mus musculus
tcatgcggatgcacacaaggtgaca

SEQ ID NO: 808168 - DNA, 25 bp, Mus musculus
tcatgcggatgctcacaaggtgaca

SEQ ID NO: 808169 - DNA, 25 bp, Mus musculus
tcatgcgtgctaatccagcagcagc

SEQ ID NO: 808170 - DNA, 25 bp, Mus musculus
tcatgcgtgctattccagcagcagc

SEQ ID NO: 808171 - DNA, 25 bp, Mus musculus
tcatgcgtgcttagctctggtgccc

SEQ ID NO: 808172 - DNA, 25 bp, Mus musculus
tcatgcgtgctttgctctggtgccc

SEQ ID NO: 808173 - DNA, 25 bp, Mus musculus
tcatgctaagtacaagtggaattta

SEQ ID NO: 808174 - DNA, 25 bp, Mus musculus
tcatgctaagtagaagtggaattta

SEQ ID NO: 808175 - DNA, 25 bp, Mus musculus
tcatgctaccatcttgcctttgaag

SEQ ID NO: 808176 - DNA, 25 bp, Mus musculus
tcatgctaccatgttgcctttgaag

SEQ ID NO: 808177 - DNA, 25 bp, Mus musculus
tcatgctacctgcttcttttttaaa

SEQ ID NO: 808178 - DNA, 25 bp, Mus musculus
tcatgctacctggttcttttttaaa

SEQ ID NO: 808179 - DNA, 25 bp, Mus musculus
tcatgctactacagagctatgtccc

SEQ ID NO: 808180 - DNA, 25 bp, Mus musculus
tcatgctactactgagctatgtccc

SEQ ID NO: 808181 - DNA, 25 bp, Mus musculus
tcatgctagcatcccaatattttaa

SEQ ID NO: 808182 - DNA, 25 bp, Mus musculus
tcatgctagcatgccaatattttaa

SEQ ID NO: 808183 - DNA, 25 bp, Mus musculus
tcatgctagggcctggcatccacag

SEQ ID NO: 808184 - DNA, 25 bp, Mus musculus
tcatgctagggcgtggcatccacag

SEQ ID NO: 808185 - DNA, 25 bp, Mus musculus
tcatgctagtggattgcgtgctggt

SEQ ID NO: 808186 - DNA, 25 bp, Mus musculus
tcatgctagtggtttgcgtgctggt

SEQ ID NO: 808187 - DNA, 25 bp, Mus musculus
tcatgctatttcaacctcactttgg

SEQ ID NO: 808188 - DNA, 25 bp, Mus musculus
tcatgctatttctacctcactttgg

SEQ ID NO: 808189 - DNA, 25 bp, Mus musculus
tcatgctcaactcctattttatctc

SEQ ID NO: 808190 - DNA, 25 bp, Mus musculus
tcatgctcaactgctattttatctc

SEQ ID NO: 808191 - DNA, 25 bp, Mus musculus
tcatgctcacacctgccagtcagaa

SEQ ID NO: 808192 - DNA, 25 bp, Mus musculus
tcatgctcacacgtgccagtcagaa

SEQ ID NO: 808193 - DNA, 25 bp, Mus musculus
tcatgctccaagacccagattcagg

SEQ ID NO: 808194 - DNA, 25 bp, Mus musculus
tcatgctccaagtcccagattcagg

SEQ ID NO: 808195 - DNA, 25 bp, Mus musculus
tcatgctcctctctagattttcctg

SEQ ID NO: 808196 - DNA, 25 bp, Mus musculus
tcatgctcctctgtagattttcctg

SEQ ID NO: 808197 - DNA, 25 bp, Mus musculus
tcatgctctaatctaaatgaccaaa

SEQ ID NO: 808198 - DNA, 25 bp, Mus musculus
tcatgctctaatgtaaatgaccaaa

SEQ ID NO: 808199 - DNA, 25 bp, Mus musculus
tcatgctctactactcatatctgtg

SEQ ID NO: 808200 - DNA, 25 bp, Mus musculus
tcatgctctacttctcatatctgtg

SEQ ID NO: 808201 - DNA, 25 bp, Mus musculus
tcatgctctagcaagaccaggtcca

SEQ ID NO: 808202 - DNA, 25 bp, Mus musculus
tcatgctctagctagaccaggtcca

SEQ ID NO: 808203 - DNA, 25 bp, Mus musculus
tcatgctctggacatactattgatg

SEQ ID NO: 808204 - DNA, 25 bp, Mus musculus
tcatgctctggagatactattgatg

SEQ ID NO: 808205 - DNA, 25 bp, Mus musculus
tcatgctcttccactaaggttgatt

SEQ ID NO: 808206 - DNA, 25 bp, Mus musculus
tcatgctcttcctctaaggttgatt

SEQ ID NO: 808207 - DNA, 25 bp, Mus musculus
tcatgctcttgactttgatcacaaa

SEQ ID NO: 808208 - DNA, 25 bp, Mus musculus
tcatgctcttgagtttgatcacaaa

SEQ ID NO: 808209 - DNA, 25 bp, Mus musculus
tcatgctgatggacccagggatgtc

SEQ ID NO: 808210 - DNA, 25 bp, Mus musculus
tcatgctgatggtcccagggatgtc

SEQ ID NO: 808211 - DNA, 25 bp, Mus musculus
tcatgctgattcctagcgcctctgg

SEQ ID NO: 808212 - DNA, 25 bp, Mus musculus
tcatgctgattcgtagcgcctctgg

SEQ ID NO: 808213 - DNA, 25 bp, Mus musculus
tcatgctgccatcgttgggtgctga

SEQ ID NO: 808214 - DNA, 25 bp, Mus musculus
tcatgctgccatggttgggtgctga

SEQ ID NO: 808215 - DNA, 25 bp, Mus musculus
tcatgctgcctcatggacttaagac

SEQ ID NO: 808216 - DNA, 25 bp, Mus musculus
tcatgctgcctcttggacttaagac

SEQ ID NO: 808217 - DNA, 25 bp, Mus musculus
tcatgctggcctacggcagccttgc

SEQ ID NO: 808218 - DNA, 25 bp, Mus musculus
tcatgctggccttcggcagccttgc

SEQ ID NO: 808219 - DNA, 25 bp, Mus musculus
tcatgctggcttaatcacggtccat

SEQ ID NO: 808220 - DNA, 25 bp, Mus musculus
tcatgctggctttatcacggtccat

SEQ ID NO: 808221 - DNA, 25 bp, Mus musculus
tcatgctgggaacgcaagtccaact

SEQ ID NO: 808222 - DNA, 25 bp, Mus musculus
tcatgctgggaaggcaagtccaact

SEQ ID NO: 808223 - DNA, 25 bp, Mus musculus
tcatgctgggagctatctgtgccat

SEQ ID NO: 808224 - DNA, 25 bp, Mus musculus
tcatgctgggaggtatctgtgccat

SEQ ID NO: 808225 - DNA, 25 bp, Mus musculus
tcatgctggtacatcctgccagtgg

SEQ ID NO: 808226 - DNA, 25 bp, Mus musculus
tcatgctggtacttcctgccagtgg

SEQ ID NO: 808227 - DNA, 25 bp, Mus musculus
tcatgctggtccctttacctctgtg

SEQ ID NO: 808228 - DNA, 25 bp, Mus musculus
tcatgctggtccgtttacctctgtg

SEQ ID NO: 808229 - DNA, 25 bp, Mus musculus
tcatgctgtcccagtggataacaaa

SEQ ID NO: 808230 - DNA, 25 bp, Mus musculus
tcatgctgtccctgtggataacaaa

SEQ ID NO: 808231 - DNA, 25 bp, Mus musculus
tcatgcttacagacctagcacttga

SEQ ID NO: 808232 - DNA, 25 bp, Mus musculus
tcatgcttacagtcctagcacttga

SEQ ID NO: 808233 - DNA, 25 bp, Mus musculus
tcatgcttatagatcccaggacaat

SEQ ID NO: 808234 - DNA, 25 bp, Mus musculus
tcatgcttatagttcccaggacaat

SEQ ID NO: 808235 - DNA, 25 bp, Mus musculus
tcatgcttcatcaaatcgggtcttc

SEQ ID NO: 808236 - DNA, 25 bp, Mus musculus
tcatgcttcatctaatcgggtcttc

SEQ ID NO: 808237 - DNA, 25 bp, Mus musculus
tcatgcttcattataacagcagcaa

SEQ ID NO: 808238 - DNA, 25 bp, Mus musculus
tcatgcttcattttaacagcagcaa

SEQ ID NO: 808239 - DNA, 25 bp, Mus musculus
tcatgcttccataactcttcgatta

SEQ ID NO: 808240 - DNA, 25 bp, Mus musculus
tcatgcttccattactcttcgatta

SEQ ID NO: 808241 - DNA, 25 bp, Mus musculus
tcatgcttccctcctgaatatttaa

SEQ ID NO: 808242 - DNA, 25 bp, Mus musculus
tcatgcttccctgctgaatatttaa

SEQ ID NO: 808243 - DNA, 25 bp, Mus musculus
tcatgcttccgtcggctgacgatac

SEQ ID NO: 808244 - DNA, 25 bp, Mus musculus
tcatgcttccgtgggctgacgatac

SEQ ID NO: 808245 - DNA, 25 bp, Mus musculus
tcatgcttcggaagtcttggagacc

SEQ ID NO: 808246 - DNA, 25 bp, Mus musculus
tcatgcttcggatgtcttggagacc

SEQ ID NO: 808247 - DNA, 25 bp, Mus musculus
tcatgcttgacacccatggctgaaa

SEQ ID NO: 808248 - DNA, 25 bp, Mus musculus
tcatgcttgacagccatggctgaaa

SEQ ID NO: 808249 - DNA, 25 bp, Mus musculus
tcatgcttgaccattttatacaaat

SEQ ID NO: 808250 - DNA, 25 bp, Mus musculus
tcatgcttgacctttttatacaaat

SEQ ID NO: 808251 - DNA, 25 bp, Mus musculus
tcatgcttgcctagacctgtttcta

SEQ ID NO: 808252 - DNA, 25 bp, Mus musculus
tcatgcttgccttgacctgtttcta

SEQ ID NO: 808253 - DNA, 25 bp, Mus musculus
tcatgcttgtgcacaggcacgctac

SEQ ID NO: 808254 - DNA, 25 bp, Mus musculus
tcatgcttgtgctcaggcacgctac

SEQ ID NO: 808255 - DNA, 25 bp, Mus musculus
tcatgcttgtttagactgcctgggc

SEQ ID NO: 808256 - DNA, 25 bp, Mus musculus
tcatgcttgttttgactgcctgggc

SEQ ID NO: 808257 - DNA, 25 bp, Mus musculus
tcatgctttcctagtttctattgac

SEQ ID NO: 808258 - DNA, 25 bp, Mus musculus
tcatgctttccttgtttctattgac

SEQ ID NO: 808259 - DNA, 25 bp, Mus musculus
tcatgctttcttctgcctctggttc

SEQ ID NO: 808260 - DNA, 25 bp, Mus musculus
tcatgctttcttgtgcctctggttc

SEQ ID NO: 808261 - DNA, 25 bp, Mus musculus
tcatgctttgccctcctttgtaatt

SEQ ID NO: 808262 - DNA, 25 bp, Mus musculus
tcatgctttgccgtcctttgtaatt

SEQ ID NO: 808263 - DNA, 25 bp, Mus musculus
tcatgctttggaagtaacagttgaa

SEQ ID NO: 808264 - DNA, 25 bp, Mus musculus
tcatgctttggatgtaacagttgaa

SEQ ID NO: 808265 - DNA, 25 bp, Mus musculus
tcatgctttgggaagtacacttact

SEQ ID NO: 808266 - DNA, 25 bp, Mus musculus
tcatgctttgggtagtacacttact

SEQ ID NO: 808267 - DNA, 25 bp, Mus musculus
tcatgcttttatcaccattgggcct

SEQ ID NO: 808268 - DNA, 25 bp, Mus musculus
tcatgcttttatgaccattgggcct

SEQ ID NO: 808269 - DNA, 25 bp, Mus musculus
tcatggaaaattcggtccttcctta

SEQ ID NO: 808270 - DNA, 25 bp, Mus musculus
tcatggaaaattgggtccttcctta

SEQ ID NO: 808271 - DNA, 25 bp, Mus musculus
tcatggaacagcaacctttcctaag

SEQ ID NO: 808272 - DNA, 25 bp, Mus musculus
tcatggaacagctacctttcctaag

SEQ ID NO: 808273 - DNA, 25 bp, Mus musculus
tcatggaaccatatttgcagctgtg

SEQ ID NO: 808274 - DNA, 25 bp, Mus musculus
tcatggaaccatttttgcagctgtg

SEQ ID NO: 808275 - DNA, 25 bp, Mus musculus
tcatggaacgggagttccctgggtt

SEQ ID NO: 808276 - DNA, 25 bp, Mus musculus
tcatggaacgggtgttccctgggtt

SEQ ID NO: 808277 - DNA, 25 bp, Mus musculus
tcatggaagcatcagatccaggaaa

SEQ ID NO: 808278 - DNA, 25 bp, Mus musculus
tcatggaagcatgagatccaggaaa

SEQ ID NO: 808279 - DNA, 25 bp, Mus musculus
tcatggaagggcatgcgtccagctt

SEQ ID NO: 808280 - DNA, 25 bp, Mus musculus
tcatggaagggcttgcgtccagctt

SEQ ID NO: 808281 - DNA, 25 bp, Mus musculus
tcatggaagtagcttcaggcctcca

SEQ ID NO: 808282 - DNA, 25 bp, Mus musculus
tcatggaagtaggttcaggcctcca

SEQ ID NO: 808283 - DNA, 25 bp, Mus musculus
tcatggacaatcagaaagcaagcct

SEQ ID NO: 808284 - DNA, 25 bp, Mus musculus
tcatggacaatctgaaagcaagcct

SEQ ID NO: 808285 - DNA, 25 bp, Mus musculus
tcatggacactcaggtatttacgaa

SEQ ID NO: 808286 - DNA, 25 bp, Mus musculus
tcatggacactctggtatttacgaa

SEQ ID NO: 808287 - DNA, 25 bp, Mus musculus
tcatggaccaatcgagtgagacttc

SEQ ID NO: 808288 - DNA, 25 bp, Mus musculus
tcatggaccaatggagtgagacttc

SEQ ID NO: 808289 - DNA, 25 bp, Mus musculus
tcatggaccagaaccgcgatggctt

SEQ ID NO: 808290 - DNA, 25 bp, Mus musculus
tcatggaccagatccgcgatggctt

SEQ ID NO: 808291 - DNA, 25 bp, Mus musculus
tcatggaccagtatagtctggactc

SEQ ID NO: 808292 - DNA, 25 bp, Mus musculus
tcatggaccagtttagtctggactc

SEQ ID NO: 808293 - DNA, 25 bp, Mus musculus
tcatggacccacctatagggcttgg

SEQ ID NO: 808294 - DNA, 25 bp, Mus musculus
tcatggacccacgtatagggcttgg

SEQ ID NO: 808295 - DNA, 25 bp, Mus musculus
tcatggaccctgatctggacgtatc

SEQ ID NO: 808296 - DNA, 25 bp, Mus musculus
tcatggaccctgttctggacgtatc

SEQ ID NO: 808297 - DNA, 25 bp, Mus musculus
tcatggaccgctccagtggttggat

SEQ ID NO: 808298 - DNA, 25 bp, Mus musculus
tcatggaccgctgcagtggttggat

SEQ ID NO: 808299 - DNA, 25 bp, Mus musculus
tcatggaccgttctatcatcctgcg

SEQ ID NO: 808300 - DNA, 25 bp, Mus musculus
tcatggaccgttgtatcatcctgcg

SEQ ID NO: 808301 - DNA, 25 bp, Mus musculus
tcatggacctcaactgaacccaaca

SEQ ID NO: 808302 - DNA, 25 bp, Mus musculus
tcatggacctcatctgaacccaaca

SEQ ID NO: 808303 - DNA, 25 bp, Mus musculus
tcatggactcatatattcagcgggt

SEQ ID NO: 808304 - DNA, 25 bp, Mus musculus
tcatggactcatttattcagcgggt

SEQ ID NO: 808305 - DNA, 25 bp, Mus musculus
tcatggacttccaccaaagttcgag

SEQ ID NO: 808306 - DNA, 25 bp, Mus musculus
tcatggacttcctccaaagttcgag

SEQ ID NO: 808307 - DNA, 25 bp, Mus musculus
tcatggagaaggcaacaggctctac

SEQ ID NO: 808308 - DNA, 25 bp, Mus musculus
tcatggagaagggaacaggctctac

SEQ ID NO: 808309 - DNA, 25 bp, Mus musculus
tcatggagacctacaaggccctgaa

SEQ ID NO: 808310 - DNA, 25 bp, Mus musculus
tcatggagaccttcaaggccctgaa

SEQ ID NO: 808311 - DNA, 25 bp, Mus musculus
tcatggagcacgaccagctgtcctt

SEQ ID NO: 808312 - DNA, 25 bp, Mus musculus
tcatggagcacgtccagctgtcctt

SEQ ID NO: 808313 - DNA, 25 bp, Mus musculus
tcatggagcagtaccgcaaggagga

SEQ ID NO: 808314 - DNA, 25 bp, Mus musculus
tcatggagcagttccgcaaggagga

SEQ ID NO: 808315 - DNA, 25 bp, Mus musculus
tcatggagcctgaatcaataattca

SEQ ID NO: 808316 - DNA, 25 bp, Mus musculus
tcatggagcctgtatcaataattca

SEQ ID NO: 808317 - DNA, 25 bp, Mus musculus
tcatggagctggagaatgcctactt

SEQ ID NO: 808318 - DNA, 25 bp, Mus musculus
tcatggagctggtgaatgcctactt

SEQ ID NO: 808319 - DNA, 25 bp, Mus musculus
tcatggagggctaccccagcagctg

SEQ ID NO: 808320 - DNA, 25 bp, Mus musculus
tcatggagggcttccccagcagctg

SEQ ID NO: 808321 - DNA, 25 bp, Mus musculus
tcatggagggtcattctgcattcct

SEQ ID NO: 808322 - DNA, 25 bp, Mus musculus
tcatggagggtctttctgcattcct

SEQ ID NO: 808323 - DNA, 25 bp, Mus musculus
tcatggagtcccaacttcaatctac

SEQ ID NO: 808324 - DNA, 25 bp, Mus musculus
tcatggagtccctacttcaatctac

SEQ ID NO: 808325 - DNA, 25 bp, Mus musculus
tcatggagtccgagttggcagcatc

SEQ ID NO: 808326 - DNA, 25 bp, Mus musculus
tcatggagtccgtgttggcagcatc

SEQ ID NO: 808327 - DNA, 25 bp, Mus musculus
tcatggagtcctcgtggttggttac

SEQ ID NO: 808328 - DNA, 25 bp, Mus musculus
tcatggagtcctggtggttggttac

SEQ ID NO: 808329 - DNA, 25 bp, Mus musculus
tcatggatatgcagctttactcttt

SEQ ID NO: 808330 - DNA, 25 bp, Mus musculus
tcatggatatgctgctttactcttt

SEQ ID NO: 808331 - DNA, 25 bp, Mus musculus
tcatggatcgacaccgcagacggct

SEQ ID NO: 808332 - DNA, 25 bp, Mus musculus
tcatggatcgactccgcagacggct

SEQ ID NO: 808333 - DNA, 25 bp, Mus musculus
tcatggatcgtcagaagctgcttct

SEQ ID NO: 808334 - DNA, 25 bp, Mus musculus
tcatggatcgtctgaagctgcttct

SEQ ID NO: 808335 - DNA, 25 bp, Mus musculus
tcatggatctataagcttgcccgct

SEQ ID NO: 808336 - DNA, 25 bp, Mus musculus
tcatggatctattagcttgcccgct

SEQ ID NO: 808337 - DNA, 25 bp, Mus musculus
tcatggatcttgctgtagttttgtt

SEQ ID NO: 808338 - DNA, 25 bp, Mus musculus
tcatggatcttggtgtagttttgtt

SEQ ID NO: 808339 - DNA, 25 bp, Mus musculus
tcatggatgccaactacttcggacc

SEQ ID NO: 808340 - DNA, 25 bp, Mus musculus
tcatggatgccatctacttcggacc

SEQ ID NO: 808341 - DNA, 25 bp, Mus musculus
tcatggatgcccagaaactcgttgt

SEQ ID NO: 808342 - DNA, 25 bp, Mus musculus
tcatggatgccctgaaactcgttgt

SEQ ID NO: 808343 - DNA, 25 bp, Mus musculus
tcatggatgcttaggtacccctccc

SEQ ID NO: 808344 - DNA, 25 bp, Mus musculus
tcatggatgctttggtacccctccc

SEQ ID NO: 808345 - DNA, 25 bp, Mus musculus
tcatggattcaaacagggccttaaa

SEQ ID NO: 808346 - DNA, 25 bp, Mus musculus
tcatggattcaatcagggccttaaa

SEQ ID NO: 808347 - DNA, 25 bp, Mus musculus
tcatggcaaaccatagctagtcctc

SEQ ID NO: 808348 - DNA, 25 bp, Mus musculus
tcatggcaaaccttagctagtcctc

SEQ ID NO: 808349 - DNA, 25 bp, Mus musculus
tcatggcaaactagctgcttctctt

SEQ ID NO: 808350 - DNA, 25 bp, Mus musculus
tcatggcaaacttgctgcttctctt

SEQ ID NO: 808351 - DNA, 25 bp, Mus musculus
tcatggcaaagaaccctctcctggt

SEQ ID NO: 808352 - DNA, 25 bp, Mus musculus
tcatggcaaagatccctctcctggt

SEQ ID NO: 808353 - DNA, 25 bp, Mus musculus
tcatggcaaccccatttctagtttc

SEQ ID NO: 808354 - DNA, 25 bp, Mus musculus
tcatggcaacccgatttctagtttc

SEQ ID NO: 808355 - DNA, 25 bp, Mus musculus
tcatggcaagtcacggaagtcaccg

SEQ ID NO: 808356 - DNA, 25 bp, Mus musculus
tcatggcaagtctcggaagtcaccg

SEQ ID NO: 808357 - DNA, 25 bp, Mus musculus
tcatggcaatccaaagttcacttca

SEQ ID NO: 808358 - DNA, 25 bp, Mus musculus
tcatggcaatcctaagttcacttca

SEQ ID NO: 808359 - DNA, 25 bp, Mus musculus
tcatggcacccacttcctgaaaggc

SEQ ID NO: 808360 - DNA, 25 bp, Mus musculus
tcatggcacccagttcctgaaaggc

SEQ ID NO: 808361 - DNA, 25 bp, Mus musculus
tcatggcactgaccagacatccatc

SEQ ID NO: 808362 - DNA, 25 bp, Mus musculus
tcatggcactgagcagacatccatc

SEQ ID NO: 808363 - DNA, 25 bp, Mus musculus
tcatggccaccacctaatttattgc

SEQ ID NO: 808364 - DNA, 25 bp, Mus musculus
tcatggccaccagctaatttattgc

SEQ ID NO: 808365 - DNA, 25 bp, Mus musculus
tcatggcccatgactacaatcctaa

SEQ ID NO: 808366 - DNA, 25 bp, Mus musculus
tcatggcccatgcttgaaactttag

SEQ ID NO: 808367 - DNA, 25 bp, Mus musculus
tcatggcccatggttgaaactttag

SEQ ID NO: 808368 - DNA, 25 bp, Mus musculus
tcatggcccatgtctacaatcctaa

SEQ ID NO: 808369 - DNA, 25 bp, Mus musculus
tcatggcccgggaataaattcagca

SEQ ID NO: 808370 - DNA, 25 bp, Mus musculus
tcatggcccgggtataaattcagca

SEQ ID NO: 808371 - DNA, 25 bp, Mus musculus
tcatggccctagaggtgccagagcc

SEQ ID NO: 808372 - DNA, 25 bp, Mus musculus
tcatggccctagtggtgccagagcc

SEQ ID NO: 808373 - DNA, 25 bp, Mus musculus
tcatggccctgacgcatacttctct

SEQ ID NO: 808374 - DNA, 25 bp, Mus musculus
tcatggccctgaggcatacttctct

SEQ ID NO: 808375 - DNA, 25 bp, Mus musculus
tcatggccggaaagcccagtgcaag

SEQ ID NO: 808376 - DNA, 25 bp, Mus musculus
tcatggccggaatgcccagtgcaag

SEQ ID NO: 808377 - DNA, 25 bp, Mus musculus
tcatggccggacagcaccaggtgaa

SEQ ID NO: 808378 - DNA, 25 bp, Mus musculus
tcatggccggactgcaccaggtgaa

SEQ ID NO: 808379 - DNA, 25 bp, Mus musculus
tcatggccggatccgctaaagcaaa

SEQ ID NO: 808380 - DNA, 25 bp, Mus musculus
tcatggccggatgcgctaaagcaaa

SEQ ID NO: 808381 - DNA, 25 bp, Mus musculus
tcatggcgacacctggtctgatgag

SEQ ID NO: 808382 - DNA, 25 bp, Mus musculus
tcatggcgacacgtggtctgatgag

SEQ ID NO: 808383 - DNA, 25 bp, Mus musculus
tcatggcgatggagtgcgcgttcca

SEQ ID NO: 808384 - DNA, 25 bp, Mus musculus
tcatggcgatggtgtgcgcgttcca

SEQ ID NO: 808385 - DNA, 25 bp, Mus musculus
tcatggcggctgcaaatggcaacac

SEQ ID NO: 808386 - DNA, 25 bp, Mus musculus
tcatggcggctggaaatggcaacac

SEQ ID NO: 808387 - DNA, 25 bp, Mus musculus
tcatggcggtaacgccttcccagtc

SEQ ID NO: 808388 - DNA, 25 bp, Mus musculus
tcatggcggtaaggccttcccagtc

SEQ ID NO: 808389 - DNA, 25 bp, Mus musculus
tcatggctatctactttcaccacat

SEQ ID NO: 808390 - DNA, 25 bp, Mus musculus
tcatggctatcttctttcaccacat

SEQ ID NO: 808391 - DNA, 25 bp, Mus musculus
tcatggctatttagggcagctgtgt

SEQ ID NO: 808392 - DNA, 25 bp, Mus musculus
tcatggctattttgggcagctgtgt

SEQ ID NO: 808393 - DNA, 25 bp, Mus musculus
tcatggctcaggcaactctgctaaa

SEQ ID NO: 808394 - DNA, 25 bp, Mus musculus
tcatggctcagggaactctgctaaa

SEQ ID NO: 808395 - DNA, 25 bp, Mus musculus
tcatggctccatccttttggtccct

SEQ ID NO: 808396 - DNA, 25 bp, Mus musculus
tcatggctccatgcttttggtccct

SEQ ID NO: 808397 - DNA, 25 bp, Mus musculus
tcatggctccctcatggttgtggaa

SEQ ID NO: 808398 - DNA, 25 bp, Mus musculus
tcatggctccctgatggttgtggaa

SEQ ID NO: 808399 - DNA, 25 bp, Mus musculus
tcatggctctccctgtgatgaccaa

SEQ ID NO: 808400 - DNA, 25 bp, Mus musculus
tcatggctctccgtgtgatgaccaa

SEQ ID NO: 808401 - DNA, 25 bp, Mus musculus
tcatggctgctgagagaccctgctt

SEQ ID NO: 808402 - DNA, 25 bp, Mus musculus
tcatggctgctgtgagaccctgctt

SEQ ID NO: 808403 - DNA, 25 bp, Mus musculus
tcatggctggacaagcttttaggaa

SEQ ID NO: 808404 - DNA, 25 bp, Mus musculus
tcatggctggactagcttttaggaa

SEQ ID NO: 808405 - DNA, 25 bp, Mus musculus
tcatggctgggcacccctaaagatg

SEQ ID NO: 808406 - DNA, 25 bp, Mus musculus
tcatggctgggctcccctaaagatg

SEQ ID NO: 808407 - DNA, 25 bp, Mus musculus
tcatggctgtggatcagtcaaccgt

SEQ ID NO: 808408 - DNA, 25 bp, Mus musculus
tcatggctgtggttcagtcaaccgt

SEQ ID NO: 808409 - DNA, 25 bp, Mus musculus
tcatggcttatgcaacaacgatatt

SEQ ID NO: 808410 - DNA, 25 bp, Mus musculus
tcatggcttatggaacaacgatatt

SEQ ID NO: 808411 - DNA, 25 bp, Mus musculus
tcatggcttcacagatgctcaaggt

SEQ ID NO: 808412 - DNA, 25 bp, Mus musculus
tcatggcttcactgatgctcaaggt

SEQ ID NO: 808413 - DNA, 25 bp, Mus musculus
tcatggcttcccatttcatagctgg

SEQ ID NO: 808414 - DNA, 25 bp, Mus musculus
tcatggcttcccttttcatagctgg

SEQ ID NO: 808415 - DNA, 25 bp, Mus musculus
tcatggcttctcaggaccgcagagg

SEQ ID NO: 808416 - DNA, 25 bp, Mus musculus
tcatggcttctctggaccgcagagg

SEQ ID NO: 808417 - DNA, 25 bp, Mus musculus
tcatggctttccctgggaacttggt

SEQ ID NO: 808418 - DNA, 25 bp, Mus musculus
tcatggctttccgtgggaacttggt

SEQ ID NO: 808419 - DNA, 25 bp, Mus musculus
tcatggctttttccgttggatcgat

SEQ ID NO: 808420 - DNA, 25 bp, Mus musculus
tcatggctttttctctgagtttcat

SEQ ID NO: 808421 - DNA, 25 bp, Mus musculus
tcatggctttttgcgttggatcgat

SEQ ID NO: 808422 - DNA, 25 bp, Mus musculus
tcatggctttttgtctgagtttcat

SEQ ID NO: 808423 - DNA, 25 bp, Mus musculus
tcatgggaacccagggacttggaaa

SEQ ID NO: 808424 - DNA, 25 bp, Mus musculus
tcatgggaaccctgggacttggaaa

SEQ ID NO: 808425 - DNA, 25 bp, Mus musculus
tcatgggaacctacggaaaacctct

SEQ ID NO: 808426 - DNA, 25 bp, Mus musculus
tcatgggaaccttcggaaaacctct

SEQ ID NO: 808427 - DNA, 25 bp, Mus musculus
tcatgggaaggcatcggagcacaga

SEQ ID NO: 808428 - DNA, 25 bp, Mus musculus
tcatgggaaggcttcggagcacaga

SEQ ID NO: 808429 - DNA, 25 bp, Mus musculus
tcatgggaagtgcacgcagttgcta

SEQ ID NO: 808430 - DNA, 25 bp, Mus musculus
tcatgggaagtggacgcagttgcta

SEQ ID NO: 808431 - DNA, 25 bp, Mus musculus
tcatgggaatgtctgatgtcaactt

SEQ ID NO: 808432 - DNA, 25 bp, Mus musculus
tcatgggaatgtgtgatgtcaactt

SEQ ID NO: 808433 - DNA, 25 bp, Mus musculus
tcatgggacagtcacccgccattac

SEQ ID NO: 808434 - DNA, 25 bp, Mus musculus
tcatgggacagtgacccgccattac

SEQ ID NO: 808435 - DNA, 25 bp, Mus musculus
tcatgggaccaactgcctatgctgt

SEQ ID NO: 808436 - DNA, 25 bp, Mus musculus
tcatgggaccaagtgcctatgctgt

SEQ ID NO: 808437 - DNA, 25 bp, Mus musculus
tcatgggacgctactgtacctttct

SEQ ID NO: 808438 - DNA, 25 bp, Mus musculus
tcatgggacgcttctgtacctttct

SEQ ID NO: 808439 - DNA, 25 bp, Mus musculus
tcatgggacttgaaatcaggattca

SEQ ID NO: 808440 - DNA, 25 bp, Mus musculus
tcatgggacttgtaatcaggattca

SEQ ID NO: 808441 - DNA, 25 bp, Mus musculus
tcatgggagtaaacacgggactttg

SEQ ID NO: 808442 - DNA, 25 bp, Mus musculus
tcatgggagtaatcacgggactttg

SEQ ID NO: 808443 - DNA, 25 bp, Mus musculus
tcatgggagtttatgttggcctttt

SEQ ID NO: 808444 - DNA, 25 bp, Mus musculus
tcatgggagtttttgttggcctttt

SEQ ID NO: 808445 - DNA, 25 bp, Mus musculus
tcatgggatatcaggttcttgttca

SEQ ID NO: 808446 - DNA, 25 bp, Mus musculus
tcatgggatatctggttcttgttca

SEQ ID NO: 808447 - DNA, 25 bp, Mus musculus
tcatgggcaagcactgcattaatat

SEQ ID NO: 808448 - DNA, 25 bp, Mus musculus
tcatgggcaagctctgcattaatat

SEQ ID NO: 808449 - DNA, 25 bp, Mus musculus
tcatgggcaattaacaaagttatag

SEQ ID NO: 808450 - DNA, 25 bp, Mus musculus
tcatgggcaatttacaaagttatag

SEQ ID NO: 808451 - DNA, 25 bp, Mus musculus
tcatgggcactgaggaaggtcatcc

SEQ ID NO: 808452 - DNA, 25 bp, Mus musculus
tcatgggcactgtggaaggtcatcc

SEQ ID NO: 808453 - DNA, 25 bp, Mus musculus
tcatgggcaggacggcaccacagct

SEQ ID NO: 808454 - DNA, 25 bp, Mus musculus
tcatgggcaggagggcaccacagct

SEQ ID NO: 808455 - DNA, 25 bp, Mus musculus
tcatgggccagcaatcctggagtat

SEQ ID NO: 808456 - DNA, 25 bp, Mus musculus
tcatgggccagctatcctggagtat

SEQ ID NO: 808457 - DNA, 25 bp, Mus musculus
tcatgggcccccagtgtactcaggg

SEQ ID NO: 808458 - DNA, 25 bp, Mus musculus
tcatgggccccctgtgtactcaggg

SEQ ID NO: 808459 - DNA, 25 bp, Mus musculus
tcatgggccgctcactctttcagga

SEQ ID NO: 808460 - DNA, 25 bp, Mus musculus
tcatgggccgctgactctttcagga

SEQ ID NO: 808461 - DNA, 25 bp, Mus musculus
tcatgggcgctcacctgaagttact

SEQ ID NO: 808462 - DNA, 25 bp, Mus musculus
tcatgggcgctctcctgaagttact

SEQ ID NO: 808463 - DNA, 25 bp, Mus musculus
tcatgggcggataaacaactaatgt

SEQ ID NO: 808464 - DNA, 25 bp, Mus musculus
tcatgggcggattaacaactaatgt

SEQ ID NO: 808465 - DNA, 25 bp, Mus musculus
tcatgggctggtaagtttcttctca

SEQ ID NO: 808466 - DNA, 25 bp, Mus musculus
tcatgggctggttagtttcttctca

SEQ ID NO: 808467 - DNA, 25 bp, Mus musculus
tcatgggtgcccataatctcatggg

SEQ ID NO: 808468 - DNA, 25 bp, Mus musculus
tcatgggtgcccttaatctcatggg

SEQ ID NO: 808469 - DNA, 25 bp, Mus musculus
tcatgggtgggacacattaaaaggt

SEQ ID NO: 808470 - DNA, 25 bp, Mus musculus
tcatgggtgggagacattaaaaggt

SEQ ID NO: 808471 - DNA, 25 bp, Mus musculus
tcatgggtgttgagggcccttaacc

SEQ ID NO: 808472 - DNA, 25 bp, Mus musculus
tcatgggtgttgtgggcccttaacc

SEQ ID NO: 808473 - DNA, 25 bp, Mus musculus
tcatgggttcacatcttgctcaaag

SEQ ID NO: 808474 - DNA, 25 bp, Mus musculus
tcatgggttcacttcttgctcaaag

SEQ ID NO: 808475 - DNA, 25 bp, Mus musculus
tcatgggttcccacctgaatgcagg

SEQ ID NO: 808476 - DNA, 25 bp, Mus musculus
tcatgggttccctcctgaatgcagg

SEQ ID NO: 808477 - DNA, 25 bp, Mus musculus
tcatgggttccgaacccaaattcaa

SEQ ID NO: 808478 - DNA, 25 bp, Mus musculus
tcatgggttccgtacccaaattcaa

SEQ ID NO: 808479 - DNA, 25 bp, Mus musculus
tcatgggttctaatcactgagctgt

SEQ ID NO: 808480 - DNA, 25 bp, Mus musculus
tcatgggttctattcactgagctgt

SEQ ID NO: 808481 - DNA, 25 bp, Mus musculus
tcatggtaagttccccgactgagac

SEQ ID NO: 808482 - DNA, 25 bp, Mus musculus
tcatggtaagttgcccgactgagac

SEQ ID NO: 808483 - DNA, 25 bp, Mus musculus
tcatggtataccaccgtaatttttt

SEQ ID NO: 808484 - DNA, 25 bp, Mus musculus
tcatggtatacctccgtaatttttt

SEQ ID NO: 808485 - DNA, 25 bp, Mus musculus
tcatggtatgttattaaaacttcag

SEQ ID NO: 808486 - DNA, 25 bp, Mus musculus
tcatggtatgtttttaaaacttcag

SEQ ID NO: 808487 - DNA, 25 bp, Mus musculus
tcatggtattaacagtgctgtcaaa

SEQ ID NO: 808488 - DNA, 25 bp, Mus musculus
tcatggtattaagagtgctgtcaaa

SEQ ID NO: 808489 - DNA, 25 bp, Mus musculus
tcatggtcaagtacccagcaagtca

SEQ ID NO: 808490 - DNA, 25 bp, Mus musculus
tcatggtcaagttcccagcaagtca

SEQ ID NO: 808491 - DNA, 25 bp, Mus musculus
tcatggtcacaaccctggtgtgcaa

SEQ ID NO: 808492 - DNA, 25 bp, Mus musculus
tcatggtcacaagcctggtgtgcaa

SEQ ID NO: 808493 - DNA, 25 bp, Mus musculus
tcatggtcacatattgcccaggctg

SEQ ID NO: 808494 - DNA, 25 bp, Mus musculus
tcatggtcacattttgcccaggctg

SEQ ID NO: 808495 - DNA, 25 bp, Mus musculus
tcatggtcacttcgcctcattaatg

SEQ ID NO: 808496 - DNA, 25 bp, Mus musculus
tcatggtcacttggcctcattaatg

SEQ ID NO: 808497 - DNA, 25 bp, Mus musculus
tcatggtcatgtcctgctacccaga

SEQ ID NO: 808498 - DNA, 25 bp, Mus musculus
tcatggtcatgtgctgctacccaga

SEQ ID NO: 808499 - DNA, 25 bp, Mus musculus
tcatggtcctctctaattggtacat

SEQ ID NO: 808500 - DNA, 25 bp, Mus musculus
tcatggtcctctgtaattggtacat

SEQ ID NO: 808501 - DNA, 25 bp, Mus musculus
tcatggtcgagcagcaaggacaagt

SEQ ID NO: 808502 - DNA, 25 bp, Mus musculus
tcatggtcgagctgcaaggacaagt

SEQ ID NO: 808503 - DNA, 25 bp, Mus musculus
tcatggtctcttctggatcaggagt

SEQ ID NO: 808504 - DNA, 25 bp, Mus musculus
tcatggtctcttgtggatcaggagt

SEQ ID NO: 808505 - DNA, 25 bp, Mus musculus
tcatggtcttcacagtttgcccctt

SEQ ID NO: 808506 - DNA, 25 bp, Mus musculus
tcatggtcttcagagtttgcccctt

SEQ ID NO: 808507 - DNA, 25 bp, Mus musculus
tcatggtcttctctttcttccgagt

SEQ ID NO: 808508 - DNA, 25 bp, Mus musculus
tcatggtcttctgtttcttccgagt

SEQ ID NO: 808509 - DNA, 25 bp, Mus musculus
tcatggtgacagaattgacatcccc

SEQ ID NO: 808510 - DNA, 25 bp, Mus musculus
tcatggtgacagtattgacatcccc

SEQ ID NO: 808511 - DNA, 25 bp, Mus musculus
tcatggtgacggagcttgtctcaga

SEQ ID NO: 808512 - DNA, 25 bp, Mus musculus
tcatggtgacggtgcttgtctcaga

SEQ ID NO: 808513 - DNA, 25 bp, Mus musculus
tcatggtgactgcaaatctcgggat

SEQ ID NO: 808514 - DNA, 25 bp, Mus musculus
tcatggtgactggaaatctcgggat

SEQ ID NO: 808515 - DNA, 25 bp, Mus musculus
tcatggtgatgtagcaggttaacct

SEQ ID NO: 808516 - DNA, 25 bp, Mus musculus
tcatggtgatgttgcaggttaacct

SEQ ID NO: 808517 - DNA, 25 bp, Mus musculus
tcatggtgcactctgaggctgaagt

SEQ ID NO: 808518 - DNA, 25 bp, Mus musculus
tcatggtgcactgtgaggctgaagt

SEQ ID NO: 808519 - DNA, 25 bp, Mus musculus
tcatggtgcgcaatggcgtcttctc

SEQ ID NO: 808520 - DNA, 25 bp, Mus musculus
tcatggtgcgcattggcgtcttctc

SEQ ID NO: 808521 - DNA, 25 bp, Mus musculus
tcatggtggaacatgctgctgggcc

SEQ ID NO: 808522 - DNA, 25 bp, Mus musculus
tcatggtggaacttgctgctgggcc

SEQ ID NO: 808523 - DNA, 25 bp, Mus musculus
tcatggtgggcgacagcggctacat

SEQ ID NO: 808524 - DNA, 25 bp, Mus musculus
tcatggtgggcgtcagcggctacat

SEQ ID NO: 808525 - DNA, 25 bp, Mus musculus
tcatggtggtaacctgactggatct

SEQ ID NO: 808526 - DNA, 25 bp, Mus musculus
tcatggtggtaagctgactggatct

SEQ ID NO: 808527 - DNA, 25 bp, Mus musculus
tcatggtgtctgagggcatcgtctt

SEQ ID NO: 808528 - DNA, 25 bp, Mus musculus
tcatggtgtctgtgggcatcgtctt

SEQ ID NO: 808529 - DNA, 25 bp, Mus musculus
tcatggtgtgggatcatctgctagg

SEQ ID NO: 808530 - DNA, 25 bp, Mus musculus
tcatggtgtgggttcatctgctagg

SEQ ID NO: 808531 - DNA, 25 bp, Mus musculus
tcatggttacagagagcttgcagct

SEQ ID NO: 808532 - DNA, 25 bp, Mus musculus
tcatggttacagtgagcttgcagct

SEQ ID NO: 808533 - DNA, 25 bp, Mus musculus
tcatggttcatgagccccacaatta

SEQ ID NO: 808534 - DNA, 25 bp, Mus musculus
tcatggttcatgtgccccacaatta

SEQ ID NO: 808535 - DNA, 25 bp, Mus musculus
tcatggttccatcacctgtgtccaa

SEQ ID NO: 808536 - DNA, 25 bp, Mus musculus
tcatggttccatgacctgtgtccaa

SEQ ID NO: 808537 - DNA, 25 bp, Mus musculus
tcatggttcttgagaaccagtgtat

SEQ ID NO: 808538 - DNA, 25 bp, Mus musculus
tcatggttcttgtgaaccagtgtat

SEQ ID NO: 808539 - DNA, 25 bp, Mus musculus
tcatggttgcttacggctttgcaag

SEQ ID NO: 808540 - DNA, 25 bp, Mus musculus
tcatggttgctttcggctttgcaag

SEQ ID NO: 808541 - DNA, 25 bp, Mus musculus
tcatggtttgagcatgtccgtggct

SEQ ID NO: 808542 - DNA, 25 bp, Mus musculus
tcatggtttgaggatgtccgtggct

SEQ ID NO: 808543 - DNA, 25 bp, Mus musculus
tcatggttttgactccctattcatg

SEQ ID NO: 808544 - DNA, 25 bp, Mus musculus
tcatggttttgagtccctattcatg

SEQ ID NO: 808545 - DNA, 25 bp, Mus musculus
tcatggttttgtacttgctatagtt

SEQ ID NO: 808546 - DNA, 25 bp, Mus musculus
tcatggttttgttcttgctatagtt

SEQ ID NO: 808547 - DNA, 25 bp, Mus musculus
tcatgtaaacttccttaattcccct

SEQ ID NO: 808548 - DNA, 25 bp, Mus musculus
tcatgtaaacttgcttaattcccct

SEQ ID NO: 808549 - DNA, 25 bp, Mus musculus
tcatgtaatcccctcacacaagaat

SEQ ID NO: 808550 - DNA, 25 bp, Mus musculus
tcatgtaatcccgtcacacaagaat

SEQ ID NO: 808551 - DNA, 25 bp, Mus musculus
tcatgtaatgaacgccatgcagtct

SEQ ID NO: 808552 - DNA, 25 bp, Mus musculus
tcatgtaatgaaggccatgcagtct

SEQ ID NO: 808553 - DNA, 25 bp, Mus musculus
tcatgtacaggtctgagggagccca

SEQ ID NO: 808554 - DNA, 25 bp, Mus musculus
tcatgtacaggtgtgagggagccca

SEQ ID NO: 808555 - DNA, 25 bp, Mus musculus
tcatgtacggtcctttactcgatag

SEQ ID NO: 808556 - DNA, 25 bp, Mus musculus
tcatgtacggtcgtttactcgatag

SEQ ID NO: 808557 - DNA, 25 bp, Mus musculus
tcatgtactcatccctgccctggta

SEQ ID NO: 808558 - DNA, 25 bp, Mus musculus
tcatgtactcatgcctgccctggta

SEQ ID NO: 808559 - DNA, 25 bp, Mus musculus
tcatgtagaaaccagctgggcttgt

SEQ ID NO: 808560 - DNA, 25 bp, Mus musculus
tcatgtagaaacgagctgggcttgt

SEQ ID NO: 808561 - DNA, 25 bp, Mus musculus
tcatgtagcagtaggtttgatccac

SEQ ID NO: 808562 - DNA, 25 bp, Mus musculus
tcatgtagcagttggtttgatccac

SEQ ID NO: 808563 - DNA, 25 bp, Mus musculus
tcatgtagcgtcacaggactgttat

SEQ ID NO: 808564 - DNA, 25 bp, Mus musculus
tcatgtagcgtctcaggactgttat

SEQ ID NO: 808565 - DNA, 25 bp, Mus musculus
tcatgtagctacaataatttttaaa

SEQ ID NO: 808566 - DNA, 25 bp, Mus musculus
tcatgtagctactataatttttaaa

SEQ ID NO: 808567 - DNA, 25 bp, Mus musculus
tcatgtagctctcctttgtgaaacc

SEQ ID NO: 808568 - DNA, 25 bp, Mus musculus
tcatgtagctctgctttgtgaaacc

SEQ ID NO: 808569 - DNA, 25 bp, Mus musculus
tcatgtagctggaacctaccttctt

SEQ ID NO: 808570 - DNA, 25 bp, Mus musculus
tcatgtagctggtacctaccttctt

SEQ ID NO: 808571 - DNA, 25 bp, Mus musculus
tcatgtagtccaagctggcttccaa

SEQ ID NO: 808572 - DNA, 25 bp, Mus musculus
tcatgtagtccatgctggcttccaa

SEQ ID NO: 808573 - DNA, 25 bp, Mus musculus
tcatgtatagttagcccctggcata

SEQ ID NO: 808574 - DNA, 25 bp, Mus musculus
tcatgtatagtttgcccctggcata

SEQ ID NO: 808575 - DNA, 25 bp, Mus musculus
tcatgtatcccaatgtgaacacagg

SEQ ID NO: 808576 - DNA, 25 bp, Mus musculus
tcatgtatcccattgtgaacacagg

SEQ ID NO: 808577 - DNA, 25 bp, Mus musculus
tcatgtatcctcatcccatgtacag

SEQ ID NO: 808578 - DNA, 25 bp, Mus musculus
tcatgtatcctcctgattattgtgt

SEQ ID NO: 808579 - DNA, 25 bp, Mus musculus
tcatgtatcctcgtgattattgtgt

SEQ ID NO: 808580 - DNA, 25 bp, Mus musculus
tcatgtatcctcttcccatgtacag

SEQ ID NO: 808581 - DNA, 25 bp, Mus musculus
tcatgtatgcacctggctctctgac

SEQ ID NO: 808582 - DNA, 25 bp, Mus musculus
tcatgtatgcacgtggctctctgac

SEQ ID NO: 808583 - DNA, 25 bp, Mus musculus
tcatgtatgtttctagctttcccca

SEQ ID NO: 808584 - DNA, 25 bp, Mus musculus
tcatgtatgtttgtagctttcccca

SEQ ID NO: 808585 - DNA, 25 bp, Mus musculus
tcatgtattaagattcccatagcct

SEQ ID NO: 808586 - DNA, 25 bp, Mus musculus
tcatgtattaagtttcccatagcct

SEQ ID NO: 808587 - DNA, 25 bp, Mus musculus
tcatgtattcaaaacgttggctttt

SEQ ID NO: 808588 - DNA, 25 bp, Mus musculus
tcatgtattcaatacgttggctttt

SEQ ID NO: 808589 - DNA, 25 bp, Mus musculus
tcatgtattcatatgcagtctttgt

SEQ ID NO: 808590 - DNA, 25 bp, Mus musculus
tcatgtattcatttgcagtctttgt

SEQ ID NO: 808591 - DNA, 25 bp, Mus musculus
tcatgtattttgagccccattcctg

SEQ ID NO: 808592 - DNA, 25 bp, Mus musculus
tcatgtattttgtgccccattcctg

SEQ ID NO: 808593 - DNA, 25 bp, Mus musculus
tcatgtcaactactgttaaagtatg

SEQ ID NO: 808594 - DNA, 25 bp, Mus musculus
tcatgtcaactagtgttaaagtatg

SEQ ID NO: 808595 - DNA, 25 bp, Mus musculus
tcatgtcaacttctactatgtcagt

SEQ ID NO: 808596 - DNA, 25 bp, Mus musculus
tcatgtcaacttgtactatgtcagt

SEQ ID NO: 808597 - DNA, 25 bp, Mus musculus
tcatgtcaatgcatggcgtgggaag

SEQ ID NO: 808598 - DNA, 25 bp, Mus musculus
tcatgtcaatgcttggcgtgggaag

SEQ ID NO: 808599 - DNA, 25 bp, Mus musculus
tcatgtcaggttcaaggcaatctct

SEQ ID NO: 808600 - DNA, 25 bp, Mus musculus
tcatgtcaggttgaaggcaatctct

SEQ ID NO: 808601 - DNA, 25 bp, Mus musculus
tcatgtcagtccctgcttagagagg

SEQ ID NO: 808602 - DNA, 25 bp, Mus musculus
tcatgtcagtccgtgcttagagagg

SEQ ID NO: 808603 - DNA, 25 bp, Mus musculus
tcatgtcagtgtcaactttccatca

SEQ ID NO: 808604 - DNA, 25 bp, Mus musculus
tcatgtcagtgtgaactttccatca

SEQ ID NO: 808605 - DNA, 25 bp, Mus musculus
tcatgtcataacatgtttgcttcaa

SEQ ID NO: 808606 - DNA, 25 bp, Mus musculus
tcatgtcataacttgtttgcttcaa

SEQ ID NO: 808607 - DNA, 25 bp, Mus musculus
tcatgtcatcccacctctgagagga

SEQ ID NO: 808608 - DNA, 25 bp, Mus musculus
tcatgtcatccctcctctgagagga

SEQ ID NO: 808609 - DNA, 25 bp, Mus musculus
tcatgtcatggcactgggaggcact

SEQ ID NO: 808610 - DNA, 25 bp, Mus musculus
tcatgtcatggctctgggaggcact

SEQ ID NO: 808611 - DNA, 25 bp, Mus musculus
tcatgtccagagacgggaagctccc

SEQ ID NO: 808612 - DNA, 25 bp, Mus musculus
tcatgtccagagtcgggaagctccc

SEQ ID NO: 808613 - DNA, 25 bp, Mus musculus
tcatgtccaggactttaaaaccagg

SEQ ID NO: 808614 - DNA, 25 bp, Mus musculus
tcatgtccaggagtttaaaaccagg

SEQ ID NO: 808615 - DNA, 25 bp, Mus musculus
tcatgtccatgcacagtgtattttt

SEQ ID NO: 808616 - DNA, 25 bp, Mus musculus
tcatgtccatgctcagtgtattttt

SEQ ID NO: 808617 - DNA, 25 bp, Mus musculus
tcatgtccatttagtaaggtttttt

SEQ ID NO: 808618 - DNA, 25 bp, Mus musculus
tcatgtccattttgtaaggtttttt

SEQ ID NO: 808619 - DNA, 25 bp, Mus musculus
tcatgtcccattactctgtaccttt

SEQ ID NO: 808620 - DNA, 25 bp, Mus musculus
tcatgtcccatttctctgtaccttt

SEQ ID NO: 808621 - DNA, 25 bp, Mus musculus
tcatgtccctccaaagttcacaata

SEQ ID NO: 808622 - DNA, 25 bp, Mus musculus
tcatgtccctcctaagttcacaata

SEQ ID NO: 808623 - DNA, 25 bp, Mus musculus
tcatgtccgagtatttgtctttcac

SEQ ID NO: 808624 - DNA, 25 bp, Mus musculus
tcatgtccgagtttttgtctttcac

SEQ ID NO: 808625 - DNA, 25 bp, Mus musculus
tcatgtcctagtcacactgggcgag

SEQ ID NO: 808626 - DNA, 25 bp, Mus musculus
tcatgtcctagtgacactgggcgag

SEQ ID NO: 808627 - DNA, 25 bp, Mus musculus
tcatgtcctcctatcaagacttcta

SEQ ID NO: 808628 - DNA, 25 bp, Mus musculus
tcatgtcctcctttcaagacttcta

SEQ ID NO: 808629 - DNA, 25 bp, Mus musculus
tcatgtcctcttcttgctagccctt

SEQ ID NO: 808630 - DNA, 25 bp, Mus musculus
tcatgtcctcttgttgctagccctt

SEQ ID NO: 808631 - DNA, 25 bp, Mus musculus
tcatgtcctgcaccattgggatgtg

SEQ ID NO: 808632 - DNA, 25 bp, Mus musculus
tcatgtcctgcagcattgggatgtg

SEQ ID NO: 808633 - DNA, 25 bp, Mus musculus
tcatgtccttcaccctgtatgatgg

SEQ ID NO: 808634 - DNA, 25 bp, Mus musculus
tcatgtccttcagcctgtatgatgg

SEQ ID NO: 808635 - DNA, 25 bp, Mus musculus
tcatgtccttccaggtggcttccca

SEQ ID NO: 808636 - DNA, 25 bp, Mus musculus
tcatgtccttcctggtggcttccca

SEQ ID NO: 808637 - DNA, 25 bp, Mus musculus
tcatgtcggataacttgttgctcag

SEQ ID NO: 808638 - DNA, 25 bp, Mus musculus
tcatgtcggatatcttgttgctcag

SEQ ID NO: 808639 - DNA, 25 bp, Mus musculus
tcatgtctaggcagagagttccaaa

SEQ ID NO: 808640 - DNA, 25 bp, Mus musculus
tcatgtctaggctgagagttccaaa

SEQ ID NO: 808641 - DNA, 25 bp, Mus musculus
tcatgtctatgaaggccgaggctgg

SEQ ID NO: 808642 - DNA, 25 bp, Mus musculus
tcatgtctatgaaggtctcttctcc

SEQ ID NO: 808643 - DNA, 25 bp, Mus musculus
tcatgtctatgatggccgaggctgg

SEQ ID NO: 808644 - DNA, 25 bp, Mus musculus
tcatgtctatgatggtctcttctcc

SEQ ID NO: 808645 - DNA, 25 bp, Mus musculus
tcatgtctcaacatatcacacggcc

SEQ ID NO: 808646 - DNA, 25 bp, Mus musculus
tcatgtctcaacttatcacacggcc

SEQ ID NO: 808647 - DNA, 25 bp, Mus musculus
tcatgtctcacaccaagtttaccaa

SEQ ID NO: 808648 - DNA, 25 bp, Mus musculus
tcatgtctcacagcaagtttaccaa

SEQ ID NO: 808649 - DNA, 25 bp, Mus musculus
tcatgtctccacatatatttcgaaa

SEQ ID NO: 808650 - DNA, 25 bp, Mus musculus
tcatgtctccacttatatttcgaaa

SEQ ID NO: 808651 - DNA, 25 bp, Mus musculus
tcatgtctccttagcactgttacta

SEQ ID NO: 808652 - DNA, 25 bp, Mus musculus
tcatgtctcctttgcactgttacta

SEQ ID NO: 808653 - DNA, 25 bp, Mus musculus
tcatgtctctatctccatactgctg

SEQ ID NO: 808654 - DNA, 25 bp, Mus musculus
tcatgtctctatgtccatactgctg

SEQ ID NO: 808655 - DNA, 25 bp, Mus musculus
tcatgtctctcacttaacctgctgt

SEQ ID NO: 808656 - DNA, 25 bp, Mus musculus
tcatgtctctcagttaacctgctgt

SEQ ID NO: 808657 - DNA, 25 bp, Mus musculus
tcatgtctgagcctgatcacagcat

SEQ ID NO: 808658 - DNA, 25 bp, Mus musculus
tcatgtctgagcgtgatcacagcat

SEQ ID NO: 808659 - DNA, 25 bp, Mus musculus
tcatgtctgagtaatgcagtgccta

SEQ ID NO: 808660 - DNA, 25 bp, Mus musculus
tcatgtctgagttatgcagtgccta

SEQ ID NO: 808661 - DNA, 25 bp, Mus musculus
tcatgtcttctcaggtggcagcaac

SEQ ID NO: 808662 - DNA, 25 bp, Mus musculus
tcatgtcttctctggtggcagcaac

SEQ ID NO: 808663 - DNA, 25 bp, Mus musculus
tcatgtgaccaaccacagactgtgc

SEQ ID NO: 808664 - DNA, 25 bp, Mus musculus
tcatgtgaccaagcacagactgtgc

SEQ ID NO: 808665 - DNA, 25 bp, Mus musculus
tcatgtgaccacagatagggcagtt

SEQ ID NO: 808666 - DNA, 25 bp, Mus musculus
tcatgtgaccactgatagggcagtt

SEQ ID NO: 808667 - DNA, 25 bp, Mus musculus
tcatgtgacctgagcgtttgcatac

SEQ ID NO: 808668 - DNA, 25 bp, Mus musculus
tcatgtgacctgtgcgtttgcatac

SEQ ID NO: 808669 - DNA, 25 bp, Mus musculus
tcatgtgacgacagacttttaaagt

SEQ ID NO: 808670 - DNA, 25 bp, Mus musculus
tcatgtgacgactgacttttaaagt

SEQ ID NO: 808671 - DNA, 25 bp, Mus musculus
tcatgtgactcgctcatactccatc

SEQ ID NO: 808672 - DNA, 25 bp, Mus musculus
tcatgtgactcggtcatactccatc

SEQ ID NO: 808673 - DNA, 25 bp, Mus musculus
tcatgtgagaccaaccattcctggg

SEQ ID NO: 808674 - DNA, 25 bp, Mus musculus
tcatgtgagacctaccattcctggg

SEQ ID NO: 808675 - DNA, 25 bp, Mus musculus
tcatgtgagcatcgtggaacctaaa

SEQ ID NO: 808676 - DNA, 25 bp, Mus musculus
tcatgtgagcatggtggaacctaaa

SEQ ID NO: 808677 - DNA, 25 bp, Mus musculus
tcatgtgagtcccaactgtctcaaa

SEQ ID NO: 808678 - DNA, 25 bp, Mus musculus
tcatgtgagtccgaactgtctcaaa

SEQ ID NO: 808679 - DNA, 25 bp, Mus musculus
tcatgtgatcgaattccttgagcct

SEQ ID NO: 808680 - DNA, 25 bp, Mus musculus
tcatgtgatcgatttccttgagcct

SEQ ID NO: 808681 - DNA, 25 bp, Mus musculus
tcatgtgattgtaggtttccgagaa

SEQ ID NO: 808682 - DNA, 25 bp, Mus musculus
tcatgtgattgttggtttccgagaa

SEQ ID NO: 808683 - DNA, 25 bp, Mus musculus
tcatgtgcaaccagggctttgacaa

SEQ ID NO: 808684 - DNA, 25 bp, Mus musculus
tcatgtgcaacctgggctttgacaa

SEQ ID NO: 808685 - DNA, 25 bp, Mus musculus
tcatgtgcaatgcttgcttcctcct

SEQ ID NO: 808686 - DNA, 25 bp, Mus musculus
tcatgtgcaatggttgcttcctcct

SEQ ID NO: 808687 - DNA, 25 bp, Mus musculus
tcatgtgcctgactgtgtgagagta

SEQ ID NO: 808688 - DNA, 25 bp, Mus musculus
tcatgtgcctgagtgtgtgagagta

SEQ ID NO: 808689 - DNA, 25 bp, Mus musculus
tcatgtgccttcactgatgccaaaa

SEQ ID NO: 808690 - DNA, 25 bp, Mus musculus
tcatgtgccttctctgatgccaaaa

SEQ ID NO: 808691 - DNA, 25 bp, Mus musculus
tcatgtgctattagactgacttgag

SEQ ID NO: 808692 - DNA, 25 bp, Mus musculus
tcatgtgctatttgactgacttgag

SEQ ID NO: 808693 - DNA, 25 bp, Mus musculus
tcatgtgctccacaacttgctatgt

SEQ ID NO: 808694 - DNA, 25 bp, Mus musculus
tcatgtgctccagaacttgctatgt

SEQ ID NO: 808695 - DNA, 25 bp, Mus musculus
tcatgtgctctgactatcactttac

SEQ ID NO: 808696 - DNA, 25 bp, Mus musculus
tcatgtgctctgtctatcactttac

SEQ ID NO: 808697 - DNA, 25 bp, Mus musculus
tcatgtgctgtgacctagtgtacta

SEQ ID NO: 808698 - DNA, 25 bp, Mus musculus
tcatgtgctgtgcacttcctaggaa

SEQ ID NO: 808699 - DNA, 25 bp, Mus musculus
tcatgtgctgtggacttcctaggaa

SEQ ID NO: 808700 - DNA, 25 bp, Mus musculus
tcatgtgctgtgtcctagtgtacta

SEQ ID NO: 808701 - DNA, 25 bp, Mus musculus
tcatgtgctttacagggcggccttc

SEQ ID NO: 808702 - DNA, 25 bp, Mus musculus
tcatgtgctttagagggcggccttc

SEQ ID NO: 808703 - DNA, 25 bp, Mus musculus
tcatgtgctttgagccttgtcttcc

SEQ ID NO: 808704 - DNA, 25 bp, Mus musculus
tcatgtgctttgtgccttgtcttcc

SEQ ID NO: 808705 - DNA, 25 bp, Mus musculus
tcatgtggacagatctacctgtagt

SEQ ID NO: 808706 - DNA, 25 bp, Mus musculus
tcatgtggacagttctacctgtagt

SEQ ID NO: 808707 - DNA, 25 bp, Mus musculus
tcatgtggattgcatctgttagtaa

SEQ ID NO: 808708 - DNA, 25 bp, Mus musculus
tcatgtggattggatctgttagtaa

SEQ ID NO: 808709 - DNA, 25 bp, Mus musculus
tcatgtggcccaataaggtcctttg

SEQ ID NO: 808710 - DNA, 25 bp, Mus musculus
tcatgtggcccattaaggtcctttg

SEQ ID NO: 808711 - DNA, 25 bp, Mus musculus
tcatgtggctgtatcctggtatcct

SEQ ID NO: 808712 - DNA, 25 bp, Mus musculus
tcatgtggctgtttcctggtatcct

SEQ ID NO: 808713 - DNA, 25 bp, Mus musculus
tcatgtgggaacatcttatctttga

SEQ ID NO: 808714 - DNA, 25 bp, Mus musculus
tcatgtgggaacttcttatctttga

SEQ ID NO: 808715 - DNA, 25 bp, Mus musculus
tcatgtgggacaacaacagcttcga

SEQ ID NO: 808716 - DNA, 25 bp, Mus musculus
tcatgtgggacatcaacagcttcga

SEQ ID NO: 808717 - DNA, 25 bp, Mus musculus
tcatgtggttttcggtgtttttctc

SEQ ID NO: 808718 - DNA, 25 bp, Mus musculus
tcatgtggttttgggtgtttttctc

SEQ ID NO: 808719 - DNA, 25 bp, Mus musculus
tcatgtgtaaccacgcaaattcctt

SEQ ID NO: 808720 - DNA, 25 bp, Mus musculus
tcatgtgtaacctcgcaaattcctt

SEQ ID NO: 808721 - DNA, 25 bp, Mus musculus
tcatgtgtaattcggagttggctgt

SEQ ID NO: 808722 - DNA, 25 bp, Mus musculus
tcatgtgtaattgggagttggctgt

SEQ ID NO: 808723 - DNA, 25 bp, Mus musculus
tcatgtgtacttaatacttgtgaga

SEQ ID NO: 808724 - DNA, 25 bp, Mus musculus
tcatgtgtactttatacttgtgaga

SEQ ID NO: 808725 - DNA, 25 bp, Mus musculus
tcatgtgtagtgcactttttcatct

SEQ ID NO: 808726 - DNA, 25 bp, Mus musculus
tcatgtgtagtggactttttcatct

SEQ ID NO: 808727 - DNA, 25 bp, Mus musculus
tcatgtgtatacacaagagaccggg

SEQ ID NO: 808728 - DNA, 25 bp, Mus musculus
tcatgtgtatactcaagagaccggg

SEQ ID NO: 808729 - DNA, 25 bp, Mus musculus
tcatgtgtcaggcacagctctctat

SEQ ID NO: 808730 - DNA, 25 bp, Mus musculus
tcatgtgtcagggacagctctctat

SEQ ID NO: 808731 - DNA, 25 bp, Mus musculus
tcatgtgtccttagaaacaccacct

SEQ ID NO: 808732 - DNA, 25 bp, Mus musculus
tcatgtgtcctttgaaacaccacct

SEQ ID NO: 808733 - DNA, 25 bp, Mus musculus
tcatgtgtctccaggtaactctgct

SEQ ID NO: 808734 - DNA, 25 bp, Mus musculus
tcatgtgtctcctggtaactctgct

SEQ ID NO: 808735 - DNA, 25 bp, Mus musculus
tcatgtgtgaaaaatggccactcag

SEQ ID NO: 808736 - DNA, 25 bp, Mus musculus
tcatgtgtgaaatatggccactcag

SEQ ID NO: 808737 - DNA, 25 bp, Mus musculus
tcatgtgtgacacctgtctcagctt

SEQ ID NO: 808738 - DNA, 25 bp, Mus musculus
tcatgtgtgacagctgtctcagctt

SEQ ID NO: 808739 - DNA, 25 bp, Mus musculus
tcatgtgtgagtatgctgcatcaaa

SEQ ID NO: 808740 - DNA, 25 bp, Mus musculus
tcatgtgtgagtttgctgcatcaaa

SEQ ID NO: 808741 - DNA, 25 bp, Mus musculus
tcatgtgtgcttactgcggtactac

SEQ ID NO: 808742 - DNA, 25 bp, Mus musculus
tcatgtgtgctttctgcggtactac

SEQ ID NO: 808743 - DNA, 25 bp, Mus musculus
tcatgtgttacaaaatggcaggtca

SEQ ID NO: 808744 - DNA, 25 bp, Mus musculus
tcatgtgttacaatctcttctatag

SEQ ID NO: 808745 - DNA, 25 bp, Mus musculus
tcatgtgttacataatggcaggtca

SEQ ID NO: 808746 - DNA, 25 bp, Mus musculus
tcatgtgttacattctcttctatag

SEQ ID NO: 808747 - DNA, 25 bp, Mus musculus
tcatgtgttgtgcacacccaccttg

SEQ ID NO: 808748 - DNA, 25 bp, Mus musculus
tcatgtgttgtggacacccaccttg

SEQ ID NO: 808749 - DNA, 25 bp, Mus musculus
tcatgtgtttctaattatctctccc

SEQ ID NO: 808750 - DNA, 25 bp, Mus musculus
tcatgtgtttcttattatctctccc

SEQ ID NO: 808751 - DNA, 25 bp, Mus musculus
tcatgttaaaacactgaacgtctga

SEQ ID NO: 808752 - DNA, 25 bp, Mus musculus
tcatgttaaaactctgaacgtctga

SEQ ID NO: 808753 - DNA, 25 bp, Mus musculus
tcatgttacctcagtccagacacca

SEQ ID NO: 808754 - DNA, 25 bp, Mus musculus
tcatgttacctctgtccagacacca

SEQ ID NO: 808755 - DNA, 25 bp, Mus musculus
tcatgttagctgctccaactgggtt

SEQ ID NO: 808756 - DNA, 25 bp, Mus musculus
tcatgttagctggtccaactgggtt

SEQ ID NO: 808757 - DNA, 25 bp, Mus musculus
tcatgttatactctacccacgggta

SEQ ID NO: 808758 - DNA, 25 bp, Mus musculus
tcatgttatactgtacccacgggta

SEQ ID NO: 808759 - DNA, 25 bp, Mus musculus
tcatgttcaattcttccagcacctc

SEQ ID NO: 808760 - DNA, 25 bp, Mus musculus
tcatgttcaattgttccagcacctc

SEQ ID NO: 808761 - DNA, 25 bp, Mus musculus
tcatgttcacatcctgtctgctttt

SEQ ID NO: 808762 - DNA, 25 bp, Mus musculus
tcatgttcacatgctgtctgctttt

SEQ ID NO: 808763 - DNA, 25 bp, Mus musculus
tcatgttcacgtacagggagcggga

SEQ ID NO: 808764 - DNA, 25 bp, Mus musculus
tcatgttcacgttcagggagcggga

SEQ ID NO: 808765 - DNA, 25 bp, Mus musculus
tcatgttcagcaacgcagaggcaga

SEQ ID NO: 808766 - DNA, 25 bp, Mus musculus
tcatgttcagcatcgcagaggcaga

SEQ ID NO: 808767 - DNA, 25 bp, Mus musculus
tcatgttcagctacattgcatgtaa

SEQ ID NO: 808768 - DNA, 25 bp, Mus musculus
tcatgttcagcttcattgcatgtaa

SEQ ID NO: 808769 - DNA, 25 bp, Mus musculus
tcatgttcatggacatctgctccga

SEQ ID NO: 808770 - DNA, 25 bp, Mus musculus
tcatgttcatggtcatctgctccga

SEQ ID NO: 808771 - DNA, 25 bp, Mus musculus
tcatgttcccagcacagtctctgta

SEQ ID NO: 808772 - DNA, 25 bp, Mus musculus
tcatgttcccaggacagtctctgta

SEQ ID NO: 808773 - DNA, 25 bp, Mus musculus
tcatgttccccactcacagagaaag

SEQ ID NO: 808774 - DNA, 25 bp, Mus musculus
tcatgttccccagtcacagagaaag

SEQ ID NO: 808775 - DNA, 25 bp, Mus musculus
tcatgttccctgcacactgtgtgaa

SEQ ID NO: 808776 - DNA, 25 bp, Mus musculus
tcatgttccctggacactgtgtgaa

SEQ ID NO: 808777 - DNA, 25 bp, Mus musculus
tcatgttccttaattccaattggca

SEQ ID NO: 808778 - DNA, 25 bp, Mus musculus
tcatgttccttatttccaattggca

SEQ ID NO: 808779 - DNA, 25 bp, Mus musculus
tcatgttcgcaccccagggttccct

SEQ ID NO: 808780 - DNA, 25 bp, Mus musculus
tcatgttcgcacgccagggttccct

SEQ ID NO: 808781 - DNA, 25 bp, Mus musculus
tcatgttctaaaattaaggctgaga

SEQ ID NO: 808782 - DNA, 25 bp, Mus musculus
tcatgttctaaatttaaggctgaga

SEQ ID NO: 808783 - DNA, 25 bp, Mus musculus
tcatgttctaacactaaggaccctt

SEQ ID NO: 808784 - DNA, 25 bp, Mus musculus
tcatgttctaactctaaggaccctt

SEQ ID NO: 808785 - DNA, 25 bp, Mus musculus
tcatgttcttgcaccctttttaaat

SEQ ID NO: 808786 - DNA, 25 bp, Mus musculus
tcatgttcttgctccctttttaaat

SEQ ID NO: 808787 - DNA, 25 bp, Mus musculus
tcatgttcttgtaggactactgaaa

SEQ ID NO: 808788 - DNA, 25 bp, Mus musculus
tcatgttcttgttggactactgaaa

SEQ ID NO: 808789 - DNA, 25 bp, Mus musculus
tcatgttgactgctgtatttgtacc

SEQ ID NO: 808790 - DNA, 25 bp, Mus musculus
tcatgttgactggtgtatttgtacc

SEQ ID NO: 808791 - DNA, 25 bp, Mus musculus
tcatgttgatgaccccagggtccag

SEQ ID NO: 808792 - DNA, 25 bp, Mus musculus
tcatgttgatgagcccagggtccag

SEQ ID NO: 808793 - DNA, 25 bp, Mus musculus
tcatgttgccatctctaaatatata

SEQ ID NO: 808794 - DNA, 25 bp, Mus musculus
tcatgttgccatgtctaaatatata

SEQ ID NO: 808795 - DNA, 25 bp, Mus musculus
tcatgttgcctactgttactctaaa

SEQ ID NO: 808796 - DNA, 25 bp, Mus musculus
tcatgttgcctagtgttactctaaa

SEQ ID NO: 808797 - DNA, 25 bp, Mus musculus
tcatgttgctgtatatagtctggcc

SEQ ID NO: 808798 - DNA, 25 bp, Mus musculus
tcatgttgctgtcctaccgtggcat

SEQ ID NO: 808799 - DNA, 25 bp, Mus musculus
tcatgttgctgtgctaccgtggcat

SEQ ID NO: 808800 - DNA, 25 bp, Mus musculus
tcatgttgctgtttatagtctggcc

SEQ ID NO: 808801 - DNA, 25 bp, Mus musculus
tcatgttggcatacccaaagctggg

SEQ ID NO: 808802 - DNA, 25 bp, Mus musculus
tcatgttggcattcccaaagctggg

SEQ ID NO: 808803 - DNA, 25 bp, Mus musculus
tcatgttggtgcatctgtggattaa

SEQ ID NO: 808804 - DNA, 25 bp, Mus musculus
tcatgttggtgcttctgtggattaa

SEQ ID NO: 808805 - DNA, 25 bp, Mus musculus
tcatgttgtaaacccagatcactag

SEQ ID NO: 808806 - DNA, 25 bp, Mus musculus
tcatgttgtaaagccagatcactag

SEQ ID NO: 808807 - DNA, 25 bp, Mus musculus
tcatgttgtgctcctatctgtgcat

SEQ ID NO: 808808 - DNA, 25 bp, Mus musculus
tcatgttgtgctgctatctgtgcat

SEQ ID NO: 808809 - DNA, 25 bp, Mus musculus
tcatgtttgcataatttggtctgtg

SEQ ID NO: 808810 - DNA, 25 bp, Mus musculus
tcatgtttgcattatttggtctgtg

SEQ ID NO: 808811 - DNA, 25 bp, Mus musculus
tcatgtttgtataagtctggactct

SEQ ID NO: 808812 - DNA, 25 bp, Mus musculus
tcatgtttgtattagtctggactct

SEQ ID NO: 808813 - DNA, 25 bp, Mus musculus
tcatgttttctaaatattcataaaa

SEQ ID NO: 808814 - DNA, 25 bp, Mus musculus
tcatgttttctatatattcataaaa

SEQ ID NO: 808815 - DNA, 25 bp, Mus musculus
tcatgttttctcatgctctaatgta

SEQ ID NO: 808816 - DNA, 25 bp, Mus musculus
tcatgttttctcttgctctaatgta

SEQ ID NO: 808817 - DNA, 25 bp, Mus musculus
tcatgttttgcaaaactctgcccgg

SEQ ID NO: 808818 - DNA, 25 bp, Mus musculus
tcatgttttgcataactctgcccgg

SEQ ID NO: 808819 - DNA, 25 bp, Mus musculus
tcatgtttttcacggtgctgcccag

SEQ ID NO: 808820 - DNA, 25 bp, Mus musculus
tcatgtttttcagggtgctgcccag

SEQ ID NO: 808821 - DNA, 25 bp, Mus musculus
tcattaaaaggtctcgctgtcccca

SEQ ID NO: 808822 - DNA, 25 bp, Mus musculus
tcattaaaaggtgtcgctgtcccca

SEQ ID NO: 808823 - DNA, 25 bp, Mus musculus
tcattaaactgaaacctggcatgag

SEQ ID NO: 808824 - DNA, 25 bp, Mus musculus
tcattaaactgatacctggcatgag

SEQ ID NO: 808825 - DNA, 25 bp, Mus musculus
tcattaaactttattcagctagaag

SEQ ID NO: 808826 - DNA, 25 bp, Mus musculus
tcattaaacttttttcagctagaag

SEQ ID NO: 808827 - DNA, 25 bp, Mus musculus
tcattaacaagactgccaccggcta

SEQ ID NO: 808828 - DNA, 25 bp, Mus musculus
tcattaacaagagtgccaccggcta

SEQ ID NO: 808829 - DNA, 25 bp, Mus musculus
tcattaacacccaaggccattacta

SEQ ID NO: 808830 - DNA, 25 bp, Mus musculus
tcattaacaccctaggccattacta

SEQ ID NO: 808831 - DNA, 25 bp, Mus musculus
tcattaaccatcagcgtatccacac

SEQ ID NO: 808832 - DNA, 25 bp, Mus musculus
tcattaaccatctgcgtatccacac

SEQ ID NO: 808833 - DNA, 25 bp, Mus musculus
tcattaagatcgagcaacagaacct

SEQ ID NO: 808834 - DNA, 25 bp, Mus musculus
tcattaagatcgtgcaacagaacct

SEQ ID NO: 808835 - DNA, 25 bp, Mus musculus
tcattaatacttcaccgattgtgcc

SEQ ID NO: 808836 - DNA, 25 bp, Mus musculus
tcattaatacttgaccgattgtgcc

SEQ ID NO: 808837 - DNA, 25 bp, Mus musculus
tcattaatcccaccgctaaagagac

SEQ ID NO: 808838 - DNA, 25 bp, Mus musculus
tcattaatcccagcgctaaagagac

SEQ ID NO: 808839 - DNA, 25 bp, Mus musculus
tcattaatccttctaacctgcttcc

SEQ ID NO: 808840 - DNA, 25 bp, Mus musculus
tcattaatccttgtaacctgcttcc

SEQ ID NO: 808841 - DNA, 25 bp, Mus musculus
tcattacaaaccctgaagatcctaa

SEQ ID NO: 808842 - DNA, 25 bp, Mus musculus
tcattacaaaccgtgaagatcctaa

SEQ ID NO: 808843 - DNA, 25 bp, Mus musculus
tcattacactctctccgctactgag

SEQ ID NO: 808844 - DNA, 25 bp, Mus musculus
tcattacactctgtccgctactgag

SEQ ID NO: 808845 - DNA, 25 bp, Mus musculus
tcattacactgccttttcttttttc

SEQ ID NO: 808846 - DNA, 25 bp, Mus musculus
tcattacactgcgttttcttttttc

SEQ ID NO: 808847 - DNA, 25 bp, Mus musculus
tcattacagtggagtggaccccata

SEQ ID NO: 808848 - DNA, 25 bp, Mus musculus
tcattacagtggtgtggaccccata

SEQ ID NO: 808849 - DNA, 25 bp, Mus musculus
tcattacatccacctttccttgtga

SEQ ID NO: 808850 - DNA, 25 bp, Mus musculus
tcattacatccactataccatagat

SEQ ID NO: 808851 - DNA, 25 bp, Mus musculus
tcattacatccagctttccttgtga

SEQ ID NO: 808852 - DNA, 25 bp, Mus musculus
tcattacatccagtataccatagat

SEQ ID NO: 808853 - DNA, 25 bp, Mus musculus
tcattacccaagagggtgtctcctt

SEQ ID NO: 808854 - DNA, 25 bp, Mus musculus
tcattacccaagtgggtgtctcctt

SEQ ID NO: 808855 - DNA, 25 bp, Mus musculus
tcattacccacaatctgcaactttg

SEQ ID NO: 808856 - DNA, 25 bp, Mus musculus
tcattacccacattctgcaactttg

SEQ ID NO: 808857 - DNA, 25 bp, Mus musculus
tcattaccgatgaagcgcagcttcc

SEQ ID NO: 808858 - DNA, 25 bp, Mus musculus
tcattaccgatgtagcgcagcttcc

SEQ ID NO: 808859 - DNA, 25 bp, Mus musculus
tcattaccggtcaggagactcagct

SEQ ID NO: 808860 - DNA, 25 bp, Mus musculus
tcattaccggtctggagactcagct

SEQ ID NO: 808861 - DNA, 25 bp, Mus musculus
tcattacctctacctgtaccttcta

SEQ ID NO: 808862 - DNA, 25 bp, Mus musculus
tcattacctctagctgtaccttcta

SEQ ID NO: 808863 - DNA, 25 bp, Mus musculus
tcattacgcgttcatttttcagctg

SEQ ID NO: 808864 - DNA, 25 bp, Mus musculus
tcattacgcgttgatttttcagctg

SEQ ID NO: 808865 - DNA, 25 bp, Mus musculus
tcattactaactcttgtgcctggga

SEQ ID NO: 808866 - DNA, 25 bp, Mus musculus
tcattactaactgttgtgcctggga

SEQ ID NO: 808867 - DNA, 25 bp, Mus musculus
tcattactaagtaattgtgttacaa

SEQ ID NO: 808868 - DNA, 25 bp, Mus musculus
tcattactaagttattgtgttacaa

SEQ ID NO: 808869 - DNA, 25 bp, Mus musculus
tcattactcagcagctcgctgctaa

SEQ ID NO: 808870 - DNA, 25 bp, Mus musculus
tcattactcagctgctcgctgctaa

SEQ ID NO: 808871 - DNA, 25 bp, Mus musculus
tcattactttctcacatttacctaa

SEQ ID NO: 808872 - DNA, 25 bp, Mus musculus
tcattactttctgacatttacctaa

SEQ ID NO: 808873 - DNA, 25 bp, Mus musculus
tcattactttggcttcttatatttt

SEQ ID NO: 808874 - DNA, 25 bp, Mus musculus
tcattactttgggttcttatatttt

SEQ ID NO: 808875 - DNA, 25 bp, Mus musculus
tcattacttttgacctccctgggag

SEQ ID NO: 808876 - DNA, 25 bp, Mus musculus
tcattacttttgtcctccctgggag

SEQ ID NO: 808877 - DNA, 25 bp, Mus musculus
tcattagattttcccttggtatctt

SEQ ID NO: 808878 - DNA, 25 bp, Mus musculus
tcattagattttgccttggtatctt

SEQ ID NO: 808879 - DNA, 25 bp, Mus musculus
tcattagcacagcaaggatcattac

SEQ ID NO: 808880 - DNA, 25 bp, Mus musculus
tcattagcacaggaaggatcattac

SEQ ID NO: 808881 - DNA, 25 bp, Mus musculus
tcattagcactaacaagcctctggc

SEQ ID NO: 808882 - DNA, 25 bp, Mus musculus
tcattagcactatcaagcctctggc

SEQ ID NO: 808883 - DNA, 25 bp, Mus musculus
tcattagcctcaccaactctgatga

SEQ ID NO: 808884 - DNA, 25 bp, Mus musculus
tcattagcctcagcaactctgatga

SEQ ID NO: 808885 - DNA, 25 bp, Mus musculus
tcattagctcctcctgcatatcaaa

SEQ ID NO: 808886 - DNA, 25 bp, Mus musculus
tcattagctcctgctgcatatcaaa

SEQ ID NO: 808887 - DNA, 25 bp, Mus musculus
tcattaggaagtctgagaacccctg

SEQ ID NO: 808888 - DNA, 25 bp, Mus musculus
tcattaggaagtgtgagaacccctg

SEQ ID NO: 808889 - DNA, 25 bp, Mus musculus
tcattagtaactaagagggctcagt

SEQ ID NO: 808890 - DNA, 25 bp, Mus musculus
tcattagtaacttagagggctcagt

SEQ ID NO: 808891 - DNA, 25 bp, Mus musculus
tcattagtctctatgccctgtgcag

SEQ ID NO: 808892 - DNA, 25 bp, Mus musculus
tcattagtctctttgccctgtgcag

SEQ ID NO: 808893 - DNA, 25 bp, Mus musculus
tcattagtgggccatctggctctgc

SEQ ID NO: 808894 - DNA, 25 bp, Mus musculus
tcattagtgggcgatctggctctgc

SEQ ID NO: 808895 - DNA, 25 bp, Mus musculus
tcattagttcaaccatcccattctc

SEQ ID NO: 808896 - DNA, 25 bp, Mus musculus
tcattagttcaagcatcccattctc

SEQ ID NO: 808897 - DNA, 25 bp, Mus musculus
tcattagttccgactattaggagga

SEQ ID NO: 808898 - DNA, 25 bp, Mus musculus
tcattagttccgtctattaggagga

SEQ ID NO: 808899 - DNA, 25 bp, Mus musculus
tcattatagcttatgctagagcatc

SEQ ID NO: 808900 - DNA, 25 bp, Mus musculus
tcattatagcttttgctagagcatc

SEQ ID NO: 808901 - DNA, 25 bp, Mus musculus
tcattatatgttctggttggccttg

SEQ ID NO: 808902 - DNA, 25 bp, Mus musculus
tcattatatgttgtggttggccttg

SEQ ID NO: 808903 - DNA, 25 bp, Mus musculus
tcattatcctcccatttttaagcca

SEQ ID NO: 808904 - DNA, 25 bp, Mus musculus
tcattatcctccgatttttaagcca

SEQ ID NO: 808905 - DNA, 25 bp, Mus musculus
tcattatcttcccagttgaaagtca

SEQ ID NO: 808906 - DNA, 25 bp, Mus musculus
tcattatcttccgagttgaaagtca

SEQ ID NO: 808907 - DNA, 25 bp, Mus musculus
tcattatgactactgtgggctgcgt

SEQ ID NO: 808908 - DNA, 25 bp, Mus musculus
tcattatgactagtgtgggctgcgt

SEQ ID NO: 808909 - DNA, 25 bp, Mus musculus
tcattatgctgactggcgagtaccc

SEQ ID NO: 808910 - DNA, 25 bp, Mus musculus
tcattatgctgagtggcgagtaccc

SEQ ID NO: 808911 - DNA, 25 bp, Mus musculus
tcattatggcctatccatctacttc

SEQ ID NO: 808912 - DNA, 25 bp, Mus musculus
tcattatggcctttccatctacttc

SEQ ID NO: 808913 - DNA, 25 bp, Mus musculus
tcattatgggtcctgaccatttttt

SEQ ID NO: 808914 - DNA, 25 bp, Mus musculus
tcattatgggtcgtgaccatttttt

SEQ ID NO: 808915 - DNA, 25 bp, Mus musculus
tcattatgtagaacaggcagacctt

SEQ ID NO: 808916 - DNA, 25 bp, Mus musculus
tcattatgtagatcaggcagacctt

SEQ ID NO: 808917 - DNA, 25 bp, Mus musculus
tcattatgtagccacttctagcatg

SEQ ID NO: 808918 - DNA, 25 bp, Mus musculus
tcattatgtagcgacttctagcatg

SEQ ID NO: 808919 - DNA, 25 bp, Mus musculus
tcattatgtatcatgggtgtcccta

SEQ ID NO: 808920 - DNA, 25 bp, Mus musculus
tcattatgtatcttgggtgtcccta

SEQ ID NO: 808921 - DNA, 25 bp, Mus musculus
tcattattaccgaagagggctcagt

SEQ ID NO: 808922 - DNA, 25 bp, Mus musculus
tcattattaccgtagagggctcagt

SEQ ID NO: 808923 - DNA, 25 bp, Mus musculus
tcattattcagactattttcattac

SEQ ID NO: 808924 - DNA, 25 bp, Mus musculus
tcattattcagagtattttcattac

SEQ ID NO: 808925 - DNA, 25 bp, Mus musculus
tcattattccacaaagtctcctcat

SEQ ID NO: 808926 - DNA, 25 bp, Mus musculus
tcattattccactaagtctcctcat

SEQ ID NO: 808927 - DNA, 25 bp, Mus musculus
tcattattctcgacttcaggtggga

SEQ ID NO: 808928 - DNA, 25 bp, Mus musculus
tcattattctcgtcttcaggtggga

SEQ ID NO: 808929 - DNA, 25 bp, Mus musculus
tcattattttcacctcagccaccaa

SEQ ID NO: 808930 - DNA, 25 bp, Mus musculus
tcattattttcagctcagccaccaa

SEQ ID NO: 808931 - DNA, 25 bp, Mus musculus
tcattattttcgatccctccacttc

SEQ ID NO: 808932 - DNA, 25 bp, Mus musculus
tcattattttcgttccctccacttc

SEQ ID NO: 808933 - DNA, 25 bp, Mus musculus
tcattattttctcggctgctaacaa

SEQ ID NO: 808934 - DNA, 25 bp, Mus musculus
tcattattttctgggctgctaacaa

SEQ ID NO: 808935 - DNA, 25 bp, Mus musculus
tcattcaacttaattggctattcca

SEQ ID NO: 808936 - DNA, 25 bp, Mus musculus
tcattcaacttatttggctattcca

SEQ ID NO: 808937 - DNA, 25 bp, Mus musculus
tcattcaagtagattctgtgggaca

SEQ ID NO: 808938 - DNA, 25 bp, Mus musculus
tcattcaagtagtttctgtgggaca

SEQ ID NO: 808939 - DNA, 25 bp, Mus musculus
tcattcaagtctactgtctgggtcc

SEQ ID NO: 808940 - DNA, 25 bp, Mus musculus
tcattcaagtcttctgtctgggtcc

SEQ ID NO: 808941 - DNA, 25 bp, Mus musculus
tcattcacagctctaccctcagtta

SEQ ID NO: 808942 - DNA, 25 bp, Mus musculus
tcattcacagctgtaccctcagtta

SEQ ID NO: 808943 - DNA, 25 bp, Mus musculus
tcattcacaggacgcgatcttcttt

SEQ ID NO: 808944 - DNA, 25 bp, Mus musculus
tcattcacaggaggcgatcttcttt

SEQ ID NO: 808945 - DNA, 25 bp, Mus musculus
tcattcacagttatagaacttaata

SEQ ID NO: 808946 - DNA, 25 bp, Mus musculus
tcattcacagttttagaacttaata

SEQ ID NO: 808947 - DNA, 25 bp, Mus musculus
tcattcaccctccatcacagaatta

SEQ ID NO: 808948 - DNA, 25 bp, Mus musculus
tcattcaccctcgatcacagaatta

SEQ ID NO: 808949 - DNA, 25 bp, Mus musculus
tcattcaccgggacctcaagtccat

SEQ ID NO: 808950 - DNA, 25 bp, Mus musculus
tcattcaccgggtcctcaagtccat

SEQ ID NO: 808951 - DNA, 25 bp, Mus musculus
tcattcacgagtccgcctgctggag

SEQ ID NO: 808952 - DNA, 25 bp, Mus musculus
tcattcacgagtgcgcctgctggag

SEQ ID NO: 808953 - DNA, 25 bp, Mus musculus
tcattcacgccaaggtctgagcatg

SEQ ID NO: 808954 - DNA, 25 bp, Mus musculus
tcattcacgccatggtctgagcatg

SEQ ID NO: 808955 - DNA, 25 bp, Mus musculus
tcattcactaatcccgagatgtact

SEQ ID NO: 808956 - DNA, 25 bp, Mus musculus
tcattcactaatgccgagatgtact

SEQ ID NO: 808957 - DNA, 25 bp, Mus musculus
tcattcactgcactttgtaaacaaa

SEQ ID NO: 808958 - DNA, 25 bp, Mus musculus
tcattcactgcagtttgtaaacaaa

SEQ ID NO: 808959 - DNA, 25 bp, Mus musculus
tcattcactgtgatctaggccctag

SEQ ID NO: 808960 - DNA, 25 bp, Mus musculus
tcattcactgtgttctaggccctag

SEQ ID NO: 808961 - DNA, 25 bp, Mus musculus
tcattcacttcaatctttgccaatc

SEQ ID NO: 808962 - DNA, 25 bp, Mus musculus
tcattcacttcattctttgccaatc

SEQ ID NO: 808963 - DNA, 25 bp, Mus musculus
tcattcacttttctacgaggtccct

SEQ ID NO: 808964 - DNA, 25 bp, Mus musculus
tcattcacttttgtacgaggtccct

SEQ ID NO: 808965 - DNA, 25 bp, Mus musculus
tcattcagaacaaagtcgccacggc

SEQ ID NO: 808966 - DNA, 25 bp, Mus musculus
tcattcagaacatagtcgccacggc

SEQ ID NO: 808967 - DNA, 25 bp, Mus musculus
tcattcagagaaccacccctaggat

SEQ ID NO: 808968 - DNA, 25 bp, Mus musculus
tcattcagagaagcacccctaggat

SEQ ID NO: 808969 - DNA, 25 bp, Mus musculus
tcattcagcacgcagcagcatggga

SEQ ID NO: 808970 - DNA, 25 bp, Mus musculus
tcattcagcacggagcagcatggga

SEQ ID NO: 808971 - DNA, 25 bp, Mus musculus
tcattcagcatcacgttggtgtttc

SEQ ID NO: 808972 - DNA, 25 bp, Mus musculus
tcattcagcatctcgttggtgtttc

SEQ ID NO: 808973 - DNA, 25 bp, Mus musculus
tcattcagcatgaggcaggtcaccc

SEQ ID NO: 808974 - DNA, 25 bp, Mus musculus
tcattcagcatgtggcaggtcaccc

SEQ ID NO: 808975 - DNA, 25 bp, Mus musculus
tcattcaggcaaacacgaccagtgt

SEQ ID NO: 808976 - DNA, 25 bp, Mus musculus
tcattcaggcaatcacgaccagtgt

SEQ ID NO: 808977 - DNA, 25 bp, Mus musculus
tcattcagggagctgctatggctat

SEQ ID NO: 808978 - DNA, 25 bp, Mus musculus
tcattcagggaggtgctatggctat

SEQ ID NO: 808979 - DNA, 25 bp, Mus musculus
tcattcaggttaacttccccatggg

SEQ ID NO: 808980 - DNA, 25 bp, Mus musculus
tcattcaggttatcttccccatggg

SEQ ID NO: 808981 - DNA, 25 bp, Mus musculus
tcattcagtcacatggttcccagtt

SEQ ID NO: 808982 - DNA, 25 bp, Mus musculus
tcattcagtcacttggttcccagtt

SEQ ID NO: 808983 - DNA, 25 bp, Mus musculus
tcattcataagccataatcattgtc

SEQ ID NO: 808984 - DNA, 25 bp, Mus musculus
tcattcataagcgataatcattgtc

SEQ ID NO: 808985 - DNA, 25 bp, Mus musculus
tcattcatagctcacacttgaccag

SEQ ID NO: 808986 - DNA, 25 bp, Mus musculus
tcattcatagctgacacttgaccag

SEQ ID NO: 808987 - DNA, 25 bp, Mus musculus
tcattcatccaaattgaccaataaa

SEQ ID NO: 808988 - DNA, 25 bp, Mus musculus
tcattcatccaatttgaccaataaa

SEQ ID NO: 808989 - DNA, 25 bp, Mus musculus
tcattcatgggaaccttcggaaaac

SEQ ID NO: 808990 - DNA, 25 bp, Mus musculus
tcattcatgggatccttcggaaaac

SEQ ID NO: 808991 - DNA, 25 bp, Mus musculus
tcattcatggtcagcccctgggaac

SEQ ID NO: 808992 - DNA, 25 bp, Mus musculus
tcattcatggtctgcccctgggaac

SEQ ID NO: 808993 - DNA, 25 bp, Mus musculus
tcattcattacaactgtttcatgtt

SEQ ID NO: 808994 - DNA, 25 bp, Mus musculus
tcattcattacatctgtttcatgtt

SEQ ID NO: 808995 - DNA, 25 bp, Mus musculus
tcattcatttgcatgcacataaaca

SEQ ID NO: 808996 - DNA, 25 bp, Mus musculus
tcattcatttgcttgcacataaaca

SEQ ID NO: 808997 - DNA, 25 bp, Mus musculus
tcattccagtatctacatggtggct

SEQ ID NO: 808998 - DNA, 25 bp, Mus musculus
tcattccagtatgtacatggtggct

SEQ ID NO: 808999 - DNA, 25 bp, Mus musculus
tcattccagtgacctcagtggtcat

SEQ ID NO: 809000 - DNA, 25 bp, Mus musculus
tcattccagtgagctcagtggtcat

SEQ ID NO: 809001 - DNA, 25 bp, Mus musculus
tcattccatcccagagctttgacag

SEQ ID NO: 809002 - DNA, 25 bp, Mus musculus
tcattccatccctgagctttgacag

SEQ ID NO: 809003 - DNA, 25 bp, Mus musculus
tcattcccaagaaatgctgtggtta

SEQ ID NO: 809004 - DNA, 25 bp, Mus musculus
tcattcccaagatatgctgtggtta

SEQ ID NO: 809005 - DNA, 25 bp, Mus musculus
tcattcccagtgacgcctttagaaa

SEQ ID NO: 809006 - DNA, 25 bp, Mus musculus
tcattcccagtgtcgcctttagaaa

SEQ ID NO: 809007 - DNA, 25 bp, Mus musculus
tcattcccatcgctgggatccagat

SEQ ID NO: 809008 - DNA, 25 bp, Mus musculus
tcattcccatcggtgggatccagat

SEQ ID NO: 809009 - DNA, 25 bp, Mus musculus
tcattcccatttaaaaggtaccatt

SEQ ID NO: 809010 - DNA, 25 bp, Mus musculus
tcattcccattttaaaggtaccatt

SEQ ID NO: 809011 - DNA, 25 bp, Mus musculus
tcattccccagactcttgattttga

SEQ ID NO: 809012 - DNA, 25 bp, Mus musculus
tcattccccagagtcttgattttga

SEQ ID NO: 809013 - DNA, 25 bp, Mus musculus
tcattccccaggcttattcatcagg

SEQ ID NO: 809014 - DNA, 25 bp, Mus musculus
tcattccccagggttattcatcagg

SEQ ID NO: 809015 - DNA, 25 bp, Mus musculus
tcattcccctttatgctagagtgaa

SEQ ID NO: 809016 - DNA, 25 bp, Mus musculus
tcattcccctttttgctagagtgaa

SEQ ID NO: 809017 - DNA, 25 bp, Mus musculus
tcattccctacaaggcatagaacat

SEQ ID NO: 809018 - DNA, 25 bp, Mus musculus
tcattccctacatggcatagaacat

SEQ ID NO: 809019 - DNA, 25 bp, Mus musculus
tcattccctacgcttttccctgtgg

SEQ ID NO: 809020 - DNA, 25 bp, Mus musculus
tcattccctacggttttccctgtgg

SEQ ID NO: 809021 - DNA, 25 bp, Mus musculus
tcattccctgagattttaatagtga

SEQ ID NO: 809022 - DNA, 25 bp, Mus musculus
tcattccctgagtttttaatagtga

SEQ ID NO: 809023 - DNA, 25 bp, Mus musculus
tcattcccttctactggaggttatg

SEQ ID NO: 809024 - DNA, 25 bp, Mus musculus
tcattcccttcttctggaggttatg

SEQ ID NO: 809025 - DNA, 25 bp, Mus musculus
tcattccctttcactacctcgactt

SEQ ID NO: 809026 - DNA, 25 bp, Mus musculus
tcattccctttctctacctcgactt

SEQ ID NO: 809027 - DNA, 25 bp, Mus musculus
tcattccgggtcatcggatgggcct

SEQ ID NO: 809028 - DNA, 25 bp, Mus musculus
tcattccgggtcttcggatgggcct

SEQ ID NO: 809029 - DNA, 25 bp, Mus musculus
tcattccgtagtcatcggctacagt

SEQ ID NO: 809030 - DNA, 25 bp, Mus musculus
tcattccgtagtgatcggctacagt

SEQ ID NO: 809031 - DNA, 25 bp, Mus musculus
tcattcctactacgcagtaagaatt

SEQ ID NO: 809032 - DNA, 25 bp, Mus musculus
tcattcctactaggcagtaagaatt

SEQ ID NO: 809033 - DNA, 25 bp, Mus musculus
tcattcctaggaagcccattcctcg

SEQ ID NO: 809034 - DNA, 25 bp, Mus musculus
tcattcctaggatgcccattcctcg

SEQ ID NO: 809035 - DNA, 25 bp, Mus musculus
tcattcctcgccacctaggtgacat

SEQ ID NO: 809036 - DNA, 25 bp, Mus musculus
tcattcctcgcctcctaggtgacat

SEQ ID NO: 809037 - DNA, 25 bp, Mus musculus
tcattcctctatatttaaacctagc

SEQ ID NO: 809038 - DNA, 25 bp, Mus musculus
tcattcctctatttttaaacctagc

SEQ ID NO: 809039 - DNA, 25 bp, Mus musculus
tcattcctgagaccgagcaccaagg

SEQ ID NO: 809040 - DNA, 25 bp, Mus musculus
tcattcctgagagcgagcaccaagg

SEQ ID NO: 809041 - DNA, 25 bp, Mus musculus
tcattcctgaggaagcccctagatt

SEQ ID NO: 809042 - DNA, 25 bp, Mus musculus
tcattcctgaggagagaccctggct

SEQ ID NO: 809043 - DNA, 25 bp, Mus musculus
tcattcctgaggtagcccctagatt

SEQ ID NO: 809044 - DNA, 25 bp, Mus musculus
tcattcctgaggtgagaccctggct

SEQ ID NO: 809045 - DNA, 25 bp, Mus musculus
tcattcctgttgactataagagttt

SEQ ID NO: 809046 - DNA, 25 bp, Mus musculus
tcattcctgttgtctataagagttt

SEQ ID NO: 809047 - DNA, 25 bp, Mus musculus
tcattcctgtttacttagggcctaa

SEQ ID NO: 809048 - DNA, 25 bp, Mus musculus
tcattcctgttttcttagggcctaa

SEQ ID NO: 809049 - DNA, 25 bp, Mus musculus
tcattccttcatacttatcctctaa

SEQ ID NO: 809050 - DNA, 25 bp, Mus musculus
tcattccttcattcttatcctctaa

SEQ ID NO: 809051 - DNA, 25 bp, Mus musculus
tcattccttgtgatagcctctgcta

SEQ ID NO: 809052 - DNA, 25 bp, Mus musculus
tcattccttgtgttagcctctgcta

SEQ ID NO: 809053 - DNA, 25 bp, Mus musculus
tcattccttttcatgttcaaatttt

SEQ ID NO: 809054 - DNA, 25 bp, Mus musculus
tcattccttttcttgttcaaatttt

SEQ ID NO: 809055 - DNA, 25 bp, Mus musculus
tcattcgacataccccttaacaaat

SEQ ID NO: 809056 - DNA, 25 bp, Mus musculus
tcattcgacatagcccttaacaaat

SEQ ID NO: 809057 - DNA, 25 bp, Mus musculus
tcattcgagatgatatgaaaacact

SEQ ID NO: 809058 - DNA, 25 bp, Mus musculus
tcattcgagatgttatgaaaacact

SEQ ID NO: 809059 - DNA, 25 bp, Mus musculus
tcattcgccatgcaaaatgccctta

SEQ ID NO: 809060 - DNA, 25 bp, Mus musculus
tcattcgccatggaaaatgccctta

SEQ ID NO: 809061 - DNA, 25 bp, Mus musculus
tcattcgctcacatctggccacgtg

SEQ ID NO: 809062 - DNA, 25 bp, Mus musculus
tcattcgctcacttctggccacgtg

SEQ ID NO: 809063 - DNA, 25 bp, Mus musculus
tcattcgctgcaaggtgatcactaa

SEQ ID NO: 809064 - DNA, 25 bp, Mus musculus
tcattcgctgcatggtgatcactaa

SEQ ID NO: 809065 - DNA, 25 bp, Mus musculus
tcattcgcttgcaagtgtctgctaa

SEQ ID NO: 809066 - DNA, 25 bp, Mus musculus
tcattcgcttgctagtgtctgctaa

SEQ ID NO: 809067 - DNA, 25 bp, Mus musculus
tcattcggaagcagtttttcccacc

SEQ ID NO: 809068 - DNA, 25 bp, Mus musculus
tcattcggaagctgtttttcccacc

SEQ ID NO: 809069 - DNA, 25 bp, Mus musculus
tcattcggcgctcaggacctgtggt

SEQ ID NO: 809070 - DNA, 25 bp, Mus musculus
tcattcggcgctgaggacctgtggt

SEQ ID NO: 809071 - DNA, 25 bp, Mus musculus
tcattcgtcagcacttattcaacac

SEQ ID NO: 809072 - DNA, 25 bp, Mus musculus
tcattcgtcagctcttattcaacac

SEQ ID NO: 809073 - DNA, 25 bp, Mus musculus
tcattcgtcatcctatcagcactgg

SEQ ID NO: 809074 - DNA, 25 bp, Mus musculus
tcattcgtcatcgtatcagcactgg

SEQ ID NO: 809075 - DNA, 25 bp, Mus musculus
tcattcgtgaatctgctgggtgtca

SEQ ID NO: 809076 - DNA, 25 bp, Mus musculus
tcattcgtgaatgtgctgggtgtca

SEQ ID NO: 809077 - DNA, 25 bp, Mus musculus
tcattcgtggccagccgtgctcagg

SEQ ID NO: 809078 - DNA, 25 bp, Mus musculus
tcattcgtggcctgccgtgctcagg

SEQ ID NO: 809079 - DNA, 25 bp, Mus musculus
tcattcgtttgtagtgtttcttccc

SEQ ID NO: 809080 - DNA, 25 bp, Mus musculus
tcattcgtttgttgtgtttcttccc

SEQ ID NO: 809081 - DNA, 25 bp, Mus musculus
tcattctaccacatgttcactaacc

SEQ ID NO: 809082 - DNA, 25 bp, Mus musculus
tcattctaccacttgttcactaacc

SEQ ID NO: 809083 - DNA, 25 bp, Mus musculus
tcattctacccacgccttagtactt

SEQ ID NO: 809084 - DNA, 25 bp, Mus musculus
tcattctacccaggccttagtactt

SEQ ID NO: 809085 - DNA, 25 bp, Mus musculus
tcattctactgaagtgcttgactga

SEQ ID NO: 809086 - DNA, 25 bp, Mus musculus
tcattctactgatgtgcttgactga

SEQ ID NO: 809087 - DNA, 25 bp, Mus musculus
tcattctagaccaagggagaaaaac

SEQ ID NO: 809088 - DNA, 25 bp, Mus musculus
tcattctagacctagggagaaaaac

SEQ ID NO: 809089 - DNA, 25 bp, Mus musculus
tcattctaggacaggctcagttctc

SEQ ID NO: 809090 - DNA, 25 bp, Mus musculus
tcattctaggactggctcagttctc

SEQ ID NO: 809091 - DNA, 25 bp, Mus musculus
tcattctatcttagctcaaattgtt

SEQ ID NO: 809092 - DNA, 25 bp, Mus musculus
tcattctatctttgctcaaattgtt

SEQ ID NO: 809093 - DNA, 25 bp, Mus musculus
tcattctcaattacacttcctatct

SEQ ID NO: 809094 - DNA, 25 bp, Mus musculus
tcattctcaatttcacttcctatct

SEQ ID NO: 809095 - DNA, 25 bp, Mus musculus
tcattctcagccagggttataccaa

SEQ ID NO: 809096 - DNA, 25 bp, Mus musculus
tcattctcagccatgcatggtggta

SEQ ID NO: 809097 - DNA, 25 bp, Mus musculus
tcattctcagcctgggttataccaa

SEQ ID NO: 809098 - DNA, 25 bp, Mus musculus
tcattctcagccttgcatggtggta

SEQ ID NO: 809099 - DNA, 25 bp, Mus musculus
tcattctcattcaaaagtctcagca

SEQ ID NO: 809100 - DNA, 25 bp, Mus musculus
tcattctcattctaaagtctcagca

SEQ ID NO: 809101 - DNA, 25 bp, Mus musculus
tcattctcccggagcagcagctttc

SEQ ID NO: 809102 - DNA, 25 bp, Mus musculus
tcattctcccggtgcagcagctttc

SEQ ID NO: 809103 - DNA, 25 bp, Mus musculus
tcattctccgagctcttaaagtagt

SEQ ID NO: 809104 - DNA, 25 bp, Mus musculus
tcattctccgaggtcttaaagtagt

SEQ ID NO: 809105 - DNA, 25 bp, Mus musculus
tcattctccgttccctgtgtgttgc

SEQ ID NO: 809106 - DNA, 25 bp, Mus musculus
tcattctccgttgcctgtgtgttgc

SEQ ID NO: 809107 - DNA, 25 bp, Mus musculus
tcattctcctcacctggcagtaatt

SEQ ID NO: 809108 - DNA, 25 bp, Mus musculus
tcattctcctcagctggcagtaatt

SEQ ID NO: 809109 - DNA, 25 bp, Mus musculus
tcattctccttgagcattgagtaca

SEQ ID NO: 809110 - DNA, 25 bp, Mus musculus
tcattctccttgtgcattgagtaca

SEQ ID NO: 809111 - DNA, 25 bp, Mus musculus
tcattctcgctgaagatagcctgaa

SEQ ID NO: 809112 - DNA, 25 bp, Mus musculus
tcattctcgctgtagatagcctgaa

SEQ ID NO: 809113 - DNA, 25 bp, Mus musculus
tcattctctcccaatgacaggtaga

SEQ ID NO: 809114 - DNA, 25 bp, Mus musculus
tcattctctccctatgacaggtaga

SEQ ID NO: 809115 - DNA, 25 bp, Mus musculus
tcattctctgctccaaacttggcat

SEQ ID NO: 809116 - DNA, 25 bp, Mus musculus
tcattctctgctgcaaacttggcat

SEQ ID NO: 809117 - DNA, 25 bp, Mus musculus
tcattctcttgacttcctttactat

SEQ ID NO: 809118 - DNA, 25 bp, Mus musculus
tcattctcttgagttcctttactat

SEQ ID NO: 809119 - DNA, 25 bp, Mus musculus
tcattctcttttcaccatcagcttc

SEQ ID NO: 809120 - DNA, 25 bp, Mus musculus
tcattctcttttgaccatcagcttc

SEQ ID NO: 809121 - DNA, 25 bp, Mus musculus
tcattctgaaacatctagacttaag

SEQ ID NO: 809122 - DNA, 25 bp, Mus musculus
tcattctgaaacttctagacttaag

SEQ ID NO: 809123 - DNA, 25 bp, Mus musculus
tcattctgagtgcatctgcttttgt

SEQ ID NO: 809124 - DNA, 25 bp, Mus musculus
tcattctgagtggatctgcttttgt

SEQ ID NO: 809125 - DNA, 25 bp, Mus musculus
tcattctgctgccatattcgctcgc

SEQ ID NO: 809126 - DNA, 25 bp, Mus musculus
tcattctgctgcgatattcgctcgc

SEQ ID NO: 809127 - DNA, 25 bp, Mus musculus
tcattctgggagagctggtgtccat

SEQ ID NO: 809128 - DNA, 25 bp, Mus musculus
tcattctgggagtgctggtgtccat

SEQ ID NO: 809129 - DNA, 25 bp, Mus musculus
tcattctgtcttaagagcctctagg

SEQ ID NO: 809130 - DNA, 25 bp, Mus musculus
tcattctgtctttagagcctctagg

SEQ ID NO: 809131 - DNA, 25 bp, Mus musculus
tcattcttaacacgagtacatctct

SEQ ID NO: 809132 - DNA, 25 bp, Mus musculus
tcattcttaacaggagtacatctct

SEQ ID NO: 809133 - DNA, 25 bp, Mus musculus
tcattcttacctcagcacacagtct

SEQ ID NO: 809134 - DNA, 25 bp, Mus musculus
tcattcttacctgagcacacagtct

SEQ ID NO: 809135 - DNA, 25 bp, Mus musculus
tcattcttatctacagttctgtaat

SEQ ID NO: 809136 - DNA, 25 bp, Mus musculus
tcattcttatcttcagttctgtaat

SEQ ID NO: 809137 - DNA, 25 bp, Mus musculus
tcattcttattgaaaccgtcggtgt

SEQ ID NO: 809138 - DNA, 25 bp, Mus musculus
tcattcttattgtaaccgtcggtgt

SEQ ID NO: 809139 - DNA, 25 bp, Mus musculus
tcattcttcaacattcccgacaata

SEQ ID NO: 809140 - DNA, 25 bp, Mus musculus
tcattcttcaactttcccgacaata

SEQ ID NO: 809141 - DNA, 25 bp, Mus musculus
tcattcttcactcaagaggaaataa

SEQ ID NO: 809142 - DNA, 25 bp, Mus musculus
tcattcttcactgaagaggaaataa

SEQ ID NO: 809143 - DNA, 25 bp, Mus musculus
tcattcttcatccactgttaggcca

SEQ ID NO: 809144 - DNA, 25 bp, Mus musculus
tcattcttcatcgactgttaggcca

SEQ ID NO: 809145 - DNA, 25 bp, Mus musculus
tcattcttcctgctacagtgaaaga

SEQ ID NO: 809146 - DNA, 25 bp, Mus musculus
tcattcttcctggtacagtgaaaga

SEQ ID NO: 809147 - DNA, 25 bp, Mus musculus
tcattcttctgtatcatgtccctga

SEQ ID NO: 809148 - DNA, 25 bp, Mus musculus
tcattcttctgtttcatgtccctga

SEQ ID NO: 809149 - DNA, 25 bp, Mus musculus
tcattcttgcgcagggccccaagag

SEQ ID NO: 809150 - DNA, 25 bp, Mus musculus
tcattcttgcgctgggccccaagag

SEQ ID NO: 809151 - DNA, 25 bp, Mus musculus
tcattcttggacagggtgacaataa

SEQ ID NO: 809152 - DNA, 25 bp, Mus musculus
tcattcttggactgggtgacaataa

SEQ ID NO: 809153 - DNA, 25 bp, Mus musculus
tcattcttggatctgatgtgttctt

SEQ ID NO: 809154 - DNA, 25 bp, Mus musculus
tcattcttggatgtgatgtgttctt

SEQ ID NO: 809155 - DNA, 25 bp, Mus musculus
tcattcttggtgaatcagggctgaa

SEQ ID NO: 809156 - DNA, 25 bp, Mus musculus
tcattcttggtgtatcagggctgaa

SEQ ID NO: 809157 - DNA, 25 bp, Mus musculus
tcattcttgtccaccatggtgaaga

SEQ ID NO: 809158 - DNA, 25 bp, Mus musculus
tcattcttgtcctccatggtgaaga

SEQ ID NO: 809159 - DNA, 25 bp, Mus musculus
tcattcttgtgcagtcattggactg

SEQ ID NO: 809160 - DNA, 25 bp, Mus musculus
tcattcttgtgctgtcattggactg

SEQ ID NO: 809161 - DNA, 25 bp, Mus musculus
tcattcttgtttccccttcctagtt

SEQ ID NO: 809162 - DNA, 25 bp, Mus musculus
tcattcttgtttgcccttcctagtt

SEQ ID NO: 809163 - DNA, 25 bp, Mus musculus
tcattctttactatactcggatggg

SEQ ID NO: 809164 - DNA, 25 bp, Mus musculus
tcattctttactttactcggatggg

SEQ ID NO: 809165 - DNA, 25 bp, Mus musculus
tcattctttagacatatttcccagt

SEQ ID NO: 809166 - DNA, 25 bp, Mus musculus
tcattctttagagatatttcccagt

SEQ ID NO: 809167 - DNA, 25 bp, Mus musculus
tcattctttcacacacagggttccc

SEQ ID NO: 809168 - DNA, 25 bp, Mus musculus
tcattctttcactcacagggttccc

SEQ ID NO: 809169 - DNA, 25 bp, Mus musculus
tcattctttttaatggctacataga

SEQ ID NO: 809170 - DNA, 25 bp, Mus musculus
tcattctttttattggctacataga

SEQ ID NO: 809171 - DNA, 25 bp, Mus musculus
tcattgaaaatgacagtgacctgtt

SEQ ID NO: 809172 - DNA, 25 bp, Mus musculus
tcattgaaaatgtcagtgacctgtt

SEQ ID NO: 809173 - DNA, 25 bp, Mus musculus
tcattgaaactgcacctttgaaagg

SEQ ID NO: 809174 - DNA, 25 bp, Mus musculus
tcattgaaactggacctttgaaagg

SEQ ID NO: 809175 - DNA, 25 bp, Mus musculus
tcattgaacgcaaccagagatatgt

SEQ ID NO: 809176 - DNA, 25 bp, Mus musculus
tcattgaacgcatccagagatatgt

SEQ ID NO: 809177 - DNA, 25 bp, Mus musculus
tcattgaagagtccttaaaaactta

SEQ ID NO: 809178 - DNA, 25 bp, Mus musculus
tcattgaagagtgcttaaaaactta

SEQ ID NO: 809179 - DNA, 25 bp, Mus musculus
tcattgaagatgaccgccggcgggc

SEQ ID NO: 809180 - DNA, 25 bp, Mus musculus
tcattgaagatgtccgccggcgggc

SEQ ID NO: 809181 - DNA, 25 bp, Mus musculus
tcattgaagcccacaaggagtgcat

SEQ ID NO: 809182 - DNA, 25 bp, Mus musculus
tcattgaagccctcaaggagtgcat

SEQ ID NO: 809183 - DNA, 25 bp, Mus musculus
tcattgaaggagacaggatggacat

SEQ ID NO: 809184 - DNA, 25 bp, Mus musculus
tcattgaaggagtcaggatggacat

SEQ ID NO: 809185 - DNA, 25 bp, Mus musculus
tcattgaatccccagtgtgcaggcc

SEQ ID NO: 809186 - DNA, 25 bp, Mus musculus
tcattgaatcccgagtgtgcaggcc

SEQ ID NO: 809187 - DNA, 25 bp, Mus musculus
tcattgaatgctcacacctggctaa

SEQ ID NO: 809188 - DNA, 25 bp, Mus musculus
tcattgaatgctgacacctggctaa

SEQ ID NO: 809189 - DNA, 25 bp, Mus musculus
tcattgaatgtgagcccactccatt

SEQ ID NO: 809190 - DNA, 25 bp, Mus musculus
tcattgaatgtgtgcccactccatt

SEQ ID NO: 809191 - DNA, 25 bp, Mus musculus
tcattgaattcacccaagaaagcac

SEQ ID NO: 809192 - DNA, 25 bp, Mus musculus
tcattgaattcagccaagaaagcac

SEQ ID NO: 809193 - DNA, 25 bp, Mus musculus
tcattgacattcatagaagcaaagg

SEQ ID NO: 809194 - DNA, 25 bp, Mus musculus
tcattgacattcttagaagcaaagg

SEQ ID NO: 809195 - DNA, 25 bp, Mus musculus
tcattgaccattcataatgctgcaa

SEQ ID NO: 809196 - DNA, 25 bp, Mus musculus
tcattgaccattgataatgctgcaa

SEQ ID NO: 809197 - DNA, 25 bp, Mus musculus
tcattgaccccactggagccaggaa

SEQ ID NO: 809198 - DNA, 25 bp, Mus musculus
tcattgaccccagtggagccaggaa

SEQ ID NO: 809199 - DNA, 25 bp, Mus musculus
tcattgacctcacacagctccttga

SEQ ID NO: 809200 - DNA, 25 bp, Mus musculus
tcattgacctcagacagctccttga

SEQ ID NO: 809201 - DNA, 25 bp, Mus musculus
tcattgacctggacccctatggcag

SEQ ID NO: 809202 - DNA, 25 bp, Mus musculus
tcattgacctggtcccctatggcag

SEQ ID NO: 809203 - DNA, 25 bp, Mus musculus
tcattgactcgcaagtgaatgttaa

SEQ ID NO: 809204 - DNA, 25 bp, Mus musculus
tcattgactcgctagtgaatgttaa

SEQ ID NO: 809205 - DNA, 25 bp, Mus musculus
tcattgactgtaaacctggacttgg

SEQ ID NO: 809206 - DNA, 25 bp, Mus musculus
tcattgactgtatacctggacttgg

SEQ ID NO: 809207 - DNA, 25 bp, Mus musculus
tcattgacttgtatgtggctgtgca

SEQ ID NO: 809208 - DNA, 25 bp, Mus musculus
tcattgacttgtttgtggctgtgca

SEQ ID NO: 809209 - DNA, 25 bp, Mus musculus
tcattgactttaaaattggtgctat

SEQ ID NO: 809210 - DNA, 25 bp, Mus musculus
tcattgactttataattggtgctat

SEQ ID NO: 809211 - DNA, 25 bp, Mus musculus
tcattgagaaggatcccgttcatcc

SEQ ID NO: 809212 - DNA, 25 bp, Mus musculus
tcattgagaaggttcccgttcatcc

SEQ ID NO: 809213 - DNA, 25 bp, Mus musculus
tcattgagactaccccacagactgg

SEQ ID NO: 809214 - DNA, 25 bp, Mus musculus
tcattgagactagcccacagactgg

SEQ ID NO: 809215 - DNA, 25 bp, Mus musculus
tcattgagcacacacttgatataat

SEQ ID NO: 809216 - DNA, 25 bp, Mus musculus
tcattgagcacagacttgatataat

SEQ ID NO: 809217 - DNA, 25 bp, Mus musculus
tcattgagccagagttagcagaact

SEQ ID NO: 809218 - DNA, 25 bp, Mus musculus
tcattgagccagtgttagcagaact

SEQ ID NO: 809219 - DNA, 25 bp, Mus musculus
tcattgaggaacaccctggctgaac

SEQ ID NO: 809220 - DNA, 25 bp, Mus musculus
tcattgaggaactccctggctgaac

SEQ ID NO: 809221 - DNA, 25 bp, Mus musculus
tcattgaggtcaacgggcagagcgt

SEQ ID NO: 809222 - DNA, 25 bp, Mus musculus
tcattgaggtcatcgggcagagcgt

SEQ ID NO: 809223 - DNA, 25 bp, Mus musculus
tcattgagtcaaaagcctacgtggg

SEQ ID NO: 809224 - DNA, 25 bp, Mus musculus
tcattgagtcaatagcctacgtggg

SEQ ID NO: 809225 - DNA, 25 bp, Mus musculus
tcattgagtcatacggtggcagaac

SEQ ID NO: 809226 - DNA, 25 bp, Mus musculus
tcattgagtcattcggtggcagaac

SEQ ID NO: 809227 - DNA, 25 bp, Mus musculus
tcattgagtctcactacactgcttt

SEQ ID NO: 809228 - DNA, 25 bp, Mus musculus
tcattgagtctctctacactgcttt

SEQ ID NO: 809229 - DNA, 25 bp, Mus musculus
tcattgatactgaacatcttaaatt

SEQ ID NO: 809230 - DNA, 25 bp, Mus musculus
tcattgatactgtacatcttaaatt

SEQ ID NO: 809231 - DNA, 25 bp, Mus musculus
tcattgatatgtacccatcaccacc

SEQ ID NO: 809232 - DNA, 25 bp, Mus musculus
tcattgatatgttcccatcaccacc

SEQ ID NO: 809233 - DNA, 25 bp, Mus musculus
tcattgatctgaatcaccctagaaa

SEQ ID NO: 809234 - DNA, 25 bp, Mus musculus
tcattgatctgattcaccctagaaa

SEQ ID NO: 809235 - DNA, 25 bp, Mus musculus
tcattgatctgtcattcttttccaa

SEQ ID NO: 809236 - DNA, 25 bp, Mus musculus
tcattgatctgtgattcttttccaa

SEQ ID NO: 809237 - DNA, 25 bp, Mus musculus
tcattgatgatcacagagctgggaa

SEQ ID NO: 809238 - DNA, 25 bp, Mus musculus
tcattgatgatctcagagctgggaa

SEQ ID NO: 809239 - DNA, 25 bp, Mus musculus
tcattgattcgcacatctaccattc

SEQ ID NO: 809240 - DNA, 25 bp, Mus musculus
tcattgattcgctcatctaccattc

SEQ ID NO: 809241 - DNA, 25 bp, Mus musculus
tcattgatttgacacactacatagt

SEQ ID NO: 809242 - DNA, 25 bp, Mus musculus
tcattgatttgagacactacatagt

SEQ ID NO: 809243 - DNA, 25 bp, Mus musculus
tcattgcaaatgaacaggctttttt

SEQ ID NO: 809244 - DNA, 25 bp, Mus musculus
tcattgcaaatgtacaggctttttt

SEQ ID NO: 809245 - DNA, 25 bp, Mus musculus
tcattgcaaccgactctttctcatt

SEQ ID NO: 809246 - DNA, 25 bp, Mus musculus
tcattgcaaccgtctctttctcatt

SEQ ID NO: 809247 - DNA, 25 bp, Mus musculus
tcattgcatgtgataaggtgatcat

SEQ ID NO: 809248 - DNA, 25 bp, Mus musculus
tcattgcatgtgttaaggtgatcat

SEQ ID NO: 809249 - DNA, 25 bp, Mus musculus
tcattgcattctcctcgcctaaaat

SEQ ID NO: 809250 - DNA, 25 bp, Mus musculus
tcattgcattctgctcgcctaaaat

SEQ ID NO: 809251 - DNA, 25 bp, Mus musculus
tcattgccacaaagcccaagtgaac

SEQ ID NO: 809252 - DNA, 25 bp, Mus musculus
tcattgccacaatgcccaagtgaac

SEQ ID NO: 809253 - DNA, 25 bp, Mus musculus
tcattgccatggacactccttagaa

SEQ ID NO: 809254 - DNA, 25 bp, Mus musculus
tcattgccatggtcactccttagaa

SEQ ID NO: 809255 - DNA, 25 bp, Mus musculus
tcattgcccctccagaacgcaagta

SEQ ID NO: 809256 - DNA, 25 bp, Mus musculus
tcattgcccctcgagaacgcaagta

SEQ ID NO: 809257 - DNA, 25 bp, Mus musculus
tcattgccctccattgtgatgttaa

SEQ ID NO: 809258 - DNA, 25 bp, Mus musculus
tcattgccctcctttgtgatgttaa

SEQ ID NO: 809259 - DNA, 25 bp, Mus musculus
tcattgcccttcacctgaagagggt

SEQ ID NO: 809260 - DNA, 25 bp, Mus musculus
tcattgcccttctcctgaagagggt

SEQ ID NO: 809261 - DNA, 25 bp, Mus musculus
tcattgcctgatacctggctggcta

SEQ ID NO: 809262 - DNA, 25 bp, Mus musculus
tcattgcctgattcctggctggcta

SEQ ID NO: 809263 - DNA, 25 bp, Mus musculus
tcattgcctgggactatcagcacat

SEQ ID NO: 809264 - DNA, 25 bp, Mus musculus
tcattgcctgggtctatcagcacat

SEQ ID NO: 809265 - DNA, 25 bp, Mus musculus
tcattgcctgtgattctttgtcact

SEQ ID NO: 809266 - DNA, 25 bp, Mus musculus
tcattgcctgtgtttctttgtcact

SEQ ID NO: 809267 - DNA, 25 bp, Mus musculus
tcattgcgcgaaaataaagccatag

SEQ ID NO: 809268 - DNA, 25 bp, Mus musculus
tcattgcgcgaatataaagccatag

SEQ ID NO: 809269 - DNA, 25 bp, Mus musculus
tcattgctaagaatgacataacggc

SEQ ID NO: 809270 - DNA, 25 bp, Mus musculus
tcattgctaagattgacataacggc

SEQ ID NO: 809271 - DNA, 25 bp, Mus musculus
tcattgctagtaccattgacttctt

SEQ ID NO: 809272 - DNA, 25 bp, Mus musculus
tcattgctagtagcattgacttctt

SEQ ID NO: 809273 - DNA, 25 bp, Mus musculus
tcattgctctttctaactggaaccg

SEQ ID NO: 809274 - DNA, 25 bp, Mus musculus
tcattgctctttgtaactggaaccg

SEQ ID NO: 809275 - DNA, 25 bp, Mus musculus
tcattgctgaggacgcaccacccat

SEQ ID NO: 809276 - DNA, 25 bp, Mus musculus
tcattgctgaggtcgcaccacccat

SEQ ID NO: 809277 - DNA, 25 bp, Mus musculus
tcattgctgatcagtgttggtgctc

SEQ ID NO: 809278 - DNA, 25 bp, Mus musculus
tcattgctgatctgtgttggtgctc

SEQ ID NO: 809279 - DNA, 25 bp, Mus musculus
tcattgctgatgaccgctgggccct

SEQ ID NO: 809280 - DNA, 25 bp, Mus musculus
tcattgctgatgtccgctgggccct

SEQ ID NO: 809281 - DNA, 25 bp, Mus musculus
tcattgctgcaaagttcacgttcag

SEQ ID NO: 809282 - DNA, 25 bp, Mus musculus
tcattgctgcaatgttcacgttcag

SEQ ID NO: 809283 - DNA, 25 bp, Mus musculus
tcattgctgcgacgtgtgtctgacc

SEQ ID NO: 809284 - DNA, 25 bp, Mus musculus
tcattgctgcgaggtgtgtctgacc

SEQ ID NO: 809285 - DNA, 25 bp, Mus musculus
tcattgctgtgtatgaacgtgcaga

SEQ ID NO: 809286 - DNA, 25 bp, Mus musculus
tcattgctgtgtttgaacgtgcaga

SEQ ID NO: 809287 - DNA, 25 bp, Mus musculus
tcattgcttgtgaatgacttggaag

SEQ ID NO: 809288 - DNA, 25 bp, Mus musculus
tcattgcttgtgtatgacttggaag

SEQ ID NO: 809289 - DNA, 25 bp, Mus musculus
tcattgcttttgatcagatggcatc

SEQ ID NO: 809290 - DNA, 25 bp, Mus musculus
tcattgcttttgttcagatggcatc

SEQ ID NO: 809291 - DNA, 25 bp, Mus musculus
tcattggaactgattctgaggatgc

SEQ ID NO: 809292 - DNA, 25 bp, Mus musculus
tcattggaactgtttctgaggatgc

SEQ ID NO: 809293 - DNA, 25 bp, Mus musculus
tcattggaaggacagggcgagcttc

SEQ ID NO: 809294 - DNA, 25 bp, Mus musculus
tcattggaaggagagggcgagcttc

SEQ ID NO: 809295 - DNA, 25 bp, Mus musculus
tcattggactgacgcttcaccctac

SEQ ID NO: 809296 - DNA, 25 bp, Mus musculus
tcattggactgaggcttcaccctac

SEQ ID NO: 809297 - DNA, 25 bp, Mus musculus
tcattggactttcttctcaccctat

SEQ ID NO: 809298 - DNA, 25 bp, Mus musculus
tcattggactttgttctcaccctat

SEQ ID NO: 809299 - DNA, 25 bp, Mus musculus
tcattggatggcaccctccatgcac

SEQ ID NO: 809300 - DNA, 25 bp, Mus musculus
tcattggatggctccctccatgcac

SEQ ID NO: 809301 - DNA, 25 bp, Mus musculus
tcattggcatttaaacagctgtgtt

SEQ ID NO: 809302 - DNA, 25 bp, Mus musculus
tcattggcattttaacagctgtgtt

SEQ ID NO: 809303 - DNA, 25 bp, Mus musculus
tcattggcccatagtattaaaagct

SEQ ID NO: 809304 - DNA, 25 bp, Mus musculus
tcattggcccattgtattaaaagct

SEQ ID NO: 809305 - DNA, 25 bp, Mus musculus
tcattggccgagacctgagtggctt

SEQ ID NO: 809306 - DNA, 25 bp, Mus musculus
tcattggccgagtcctgagtggctt

SEQ ID NO: 809307 - DNA, 25 bp, Mus musculus
tcattggccttgactgttcagcagg

SEQ ID NO: 809308 - DNA, 25 bp, Mus musculus
tcattggccttgtctgttcagcagg

SEQ ID NO: 809309 - DNA, 25 bp, Mus musculus
tcattggcgagaaggcagctggaaa

SEQ ID NO: 809310 - DNA, 25 bp, Mus musculus
tcattggcgagatggcagctggaaa

SEQ ID NO: 809311 - DNA, 25 bp, Mus musculus
tcattggctcttccgtgtcagtttc

SEQ ID NO: 809312 - DNA, 25 bp, Mus musculus
tcattggctcttgcgtgtcagtttc

SEQ ID NO: 809313 - DNA, 25 bp, Mus musculus
tcattggctgctctgaattttactt

SEQ ID NO: 809314 - DNA, 25 bp, Mus musculus
tcattggctgctgtgaattttactt

SEQ ID NO: 809315 - DNA, 25 bp, Mus musculus
tcattggcttctcttactgctgtac

SEQ ID NO: 809316 - DNA, 25 bp, Mus musculus
tcattggcttctgttactgctgtac

SEQ ID NO: 809317 - DNA, 25 bp, Mus musculus
tcattgggagccagccttggattgg

SEQ ID NO: 809318 - DNA, 25 bp, Mus musculus
tcattgggagcctgccttggattgg

SEQ ID NO: 809319 - DNA, 25 bp, Mus musculus
tcattggtaaagactctcctgtgcc

SEQ ID NO: 809320 - DNA, 25 bp, Mus musculus
tcattggtaaagtctctcctgtgcc

SEQ ID NO: 809321 - DNA, 25 bp, Mus musculus
tcattggtaaatccccaaggaccag

SEQ ID NO: 809322 - DNA, 25 bp, Mus musculus
tcattggtaaatgcccaaggaccag

SEQ ID NO: 809323 - DNA, 25 bp, Mus musculus
tcattggtcagtcgagcagattctc

SEQ ID NO: 809324 - DNA, 25 bp, Mus musculus
tcattggtcagtggagcagattctc

SEQ ID NO: 809325 - DNA, 25 bp, Mus musculus
tcattggtctaaaactgtgtccctc

SEQ ID NO: 809326 - DNA, 25 bp, Mus musculus
tcattggtctaatactgtgtccctc

SEQ ID NO: 809327 - DNA, 25 bp, Mus musculus
tcattggtgacccaaagcattcaaa

SEQ ID NO: 809328 - DNA, 25 bp, Mus musculus
tcattggtgaccgaaagcattcaaa

SEQ ID NO: 809329 - DNA, 25 bp, Mus musculus
tcattggtgattagactacatgtct

SEQ ID NO: 809330 - DNA, 25 bp, Mus musculus
tcattggtgatttgactacatgtct

SEQ ID NO: 809331 - DNA, 25 bp, Mus musculus
tcattggtgcggctgtcctaaaccc

SEQ ID NO: 809332 - DNA, 25 bp, Mus musculus
tcattggtgcgggtgtcctaaaccc

SEQ ID NO: 809333 - DNA, 25 bp, Mus musculus
tcattggttattcagcagtgcctaa

SEQ ID NO: 809334 - DNA, 25 bp, Mus musculus
tcattggttattgagcagtgcctaa

SEQ ID NO: 809335 - DNA, 25 bp, Mus musculus
tcattggttcaaagcccttacagtt

SEQ ID NO: 809336 - DNA, 25 bp, Mus musculus
tcattggttcaatgcccttacagtt

SEQ ID NO: 809337 - DNA, 25 bp, Mus musculus
tcattggttcgtacattctgcagtt

SEQ ID NO: 809338 - DNA, 25 bp, Mus musculus
tcattggttcgttcattctgcagtt

SEQ ID NO: 809339 - DNA, 25 bp, Mus musculus
tcattggttggcctgagtctcatag

SEQ ID NO: 809340 - DNA, 25 bp, Mus musculus
tcattggttggcgtgagtctcatag

SEQ ID NO: 809341 - DNA, 25 bp, Mus musculus
tcattggtttctaagacctctcctg

SEQ ID NO: 809342 - DNA, 25 bp, Mus musculus
tcattggtttcttagacctctcctg

SEQ ID NO: 809343 - DNA, 25 bp, Mus musculus
tcattgtagttcaggccccaagaag

SEQ ID NO: 809344 - DNA, 25 bp, Mus musculus
tcattgtagttctggccccaagaag

SEQ ID NO: 809345 - DNA, 25 bp, Mus musculus
tcattgtataatctgtgctatgtgt

SEQ ID NO: 809346 - DNA, 25 bp, Mus musculus
tcattgtataatgtgtgctatgtgt

SEQ ID NO: 809347 - DNA, 25 bp, Mus musculus
tcattgtatctgactgtctttatct

SEQ ID NO: 809348 - DNA, 25 bp, Mus musculus
tcattgtatctgtctgtctttatct

SEQ ID NO: 809349 - DNA, 25 bp, Mus musculus
tcattgtcaccaagacttccttgtc

SEQ ID NO: 809350 - DNA, 25 bp, Mus musculus
tcattgtcaccatgacttccttgtc

SEQ ID NO: 809351 - DNA, 25 bp, Mus musculus
tcattgtcatcaatttcatctggtc

SEQ ID NO: 809352 - DNA, 25 bp, Mus musculus
tcattgtcatcattttcatctggtc

SEQ ID NO: 809353 - DNA, 25 bp, Mus musculus
tcattgtcatgacggttaacttgga

SEQ ID NO: 809354 - DNA, 25 bp, Mus musculus
tcattgtcatgagggttaacttgga

SEQ ID NO: 809355 - DNA, 25 bp, Mus musculus
tcattgtcattgacatctgtggctg

SEQ ID NO: 809356 - DNA, 25 bp, Mus musculus
tcattgtcattgtcatctgtggctg

SEQ ID NO: 809357 - DNA, 25 bp, Mus musculus
tcattgtccccaattcagtcgaaag

SEQ ID NO: 809358 - DNA, 25 bp, Mus musculus
tcattgtccccatttcagtcgaaag

SEQ ID NO: 809359 - DNA, 25 bp, Mus musculus
tcattgtcctgaaagtatgcatcat

SEQ ID NO: 809360 - DNA, 25 bp, Mus musculus
tcattgtcctgatagtatgcatcat

SEQ ID NO: 809361 - DNA, 25 bp, Mus musculus
tcattgtctcctatcagttgctgta

SEQ ID NO: 809362 - DNA, 25 bp, Mus musculus
tcattgtctcctttcagttgctgta

SEQ ID NO: 809363 - DNA, 25 bp, Mus musculus
tcattgtctctcctgattccaagga

SEQ ID NO: 809364 - DNA, 25 bp, Mus musculus
tcattgtctctcgtgattccaagga

SEQ ID NO: 809365 - DNA, 25 bp, Mus musculus
tcattgtctctgactgtactaccca

SEQ ID NO: 809366 - DNA, 25 bp, Mus musculus
tcattgtctctgtctgtactaccca

SEQ ID NO: 809367 - DNA, 25 bp, Mus musculus
tcattgtctttgctttaccttgaat

SEQ ID NO: 809368 - DNA, 25 bp, Mus musculus
tcattgtctttggtttaccttgaat

SEQ ID NO: 809369 - DNA, 25 bp, Mus musculus
tcattgtgatggacccacttcggaa

SEQ ID NO: 809370 - DNA, 25 bp, Mus musculus
tcattgtgatggtcccacttcggaa

SEQ ID NO: 809371 - DNA, 25 bp, Mus musculus
tcattgtgccatctttcaccggtga

SEQ ID NO: 809372 - DNA, 25 bp, Mus musculus
tcattgtgccatgtttcaccggtga

SEQ ID NO: 809373 - DNA, 25 bp, Mus musculus
tcattgtgcgggactatgtggagct

SEQ ID NO: 809374 - DNA, 25 bp, Mus musculus
tcattgtgcgggtctatgtggagct

SEQ ID NO: 809375 - DNA, 25 bp, Mus musculus
tcattgtggagtccctgacccaggg

SEQ ID NO: 809376 - DNA, 25 bp, Mus musculus
tcattgtggagtgcctgacccaggg

SEQ ID NO: 809377 - DNA, 25 bp, Mus musculus
tcattgtggcagctcttgctgcctt

SEQ ID NO: 809378 - DNA, 25 bp, Mus musculus
tcattgtggcaggtcttgctgcctt

SEQ ID NO: 809379 - DNA, 25 bp, Mus musculus
tcattgtggtgcctctctccagaaa

SEQ ID NO: 809380 - DNA, 25 bp, Mus musculus
tcattgtggtgcgtctctccagaaa

SEQ ID NO: 809381 - DNA, 25 bp, Mus musculus
tcattgtggttaccgactgcccaga

SEQ ID NO: 809382 - DNA, 25 bp, Mus musculus
tcattgtggttagcgactgcccaga

SEQ ID NO: 809383 - DNA, 25 bp, Mus musculus
tcattgtgtgcacacgtctatacac

SEQ ID NO: 809384 - DNA, 25 bp, Mus musculus
tcattgtgtgcagacgtctatacac

SEQ ID NO: 809385 - DNA, 25 bp, Mus musculus
tcattgtgttcaacgcacctactga

SEQ ID NO: 809386 - DNA, 25 bp, Mus musculus
tcattgtgttcatcgcacctactga

SEQ ID NO: 809387 - DNA, 25 bp, Mus musculus
tcattgtgtttcctcgcccggctta

SEQ ID NO: 809388 - DNA, 25 bp, Mus musculus
tcattgtgtttcgtcgcccggctta

SEQ ID NO: 809389 - DNA, 25 bp, Mus musculus
tcattgttatatatttccacctcat

SEQ ID NO: 809390 - DNA, 25 bp, Mus musculus
tcattgttatatcatcctgcctgtc

SEQ ID NO: 809391 - DNA, 25 bp, Mus musculus
tcattgttatatgatcctgcctgtc

SEQ ID NO: 809392 - DNA, 25 bp, Mus musculus
tcattgttatatttttccacctcat

SEQ ID NO: 809393 - DNA, 25 bp, Mus musculus
tcattgtttcttacctaccctaata

SEQ ID NO: 809394 - DNA, 25 bp, Mus musculus
tcattgtttctttcctaccctaata

SEQ ID NO: 809395 - DNA, 25 bp, Mus musculus
tcattgtttgagacgcagcgataaa

SEQ ID NO: 809396 - DNA, 25 bp, Mus musculus
tcattgtttgagtcgcagcgataaa

SEQ ID NO: 809397 - DNA, 25 bp, Mus musculus
tcattgtttttcactagctacccta

SEQ ID NO: 809398 - DNA, 25 bp, Mus musculus
tcattgtttttctctagctacccta

SEQ ID NO: 809399 - DNA, 25 bp, Mus musculus
tcatttaactttacaaccctatcag

SEQ ID NO: 809400 - DNA, 25 bp, Mus musculus
tcatttaacttttcaaccctatcag

SEQ ID NO: 809401 - DNA, 25 bp, Mus musculus
tcatttaagaatcctcattggctaa

SEQ ID NO: 809402 - DNA, 25 bp, Mus musculus
tcatttaagaatgctcattggctaa

SEQ ID NO: 809403 - DNA, 25 bp, Mus musculus
tcatttaaggttaatcaagttcctc

SEQ ID NO: 809404 - DNA, 25 bp, Mus musculus
tcatttaaggtttatcaagttcctc

SEQ ID NO: 809405 - DNA, 25 bp, Mus musculus
tcatttaagttgatctccccattac

SEQ ID NO: 809406 - DNA, 25 bp, Mus musculus
tcatttaagttgttctccccattac

SEQ ID NO: 809407 - DNA, 25 bp, Mus musculus
tcatttaatgtaacgaccggtgtgc

SEQ ID NO: 809408 - DNA, 25 bp, Mus musculus
tcatttaatgtatcgaccggtgtgc

SEQ ID NO: 809409 - DNA, 25 bp, Mus musculus
tcatttacaacacggttctttttat

SEQ ID NO: 809410 - DNA, 25 bp, Mus musculus
tcatttacaacagggttctttttat

SEQ ID NO: 809411 - DNA, 25 bp, Mus musculus
tcatttacaatgagtgtgcgccctg

SEQ ID NO: 809412 - DNA, 25 bp, Mus musculus
tcatttacaatgtgtgtgcgccctg

SEQ ID NO: 809413 - DNA, 25 bp, Mus musculus
tcatttacacacagctgactccaca

SEQ ID NO: 809414 - DNA, 25 bp, Mus musculus
tcatttacacactgctgactccaca

SEQ ID NO: 809415 - DNA, 25 bp, Mus musculus
tcatttaccctccttgtgaattcca

SEQ ID NO: 809416 - DNA, 25 bp, Mus musculus
tcatttaccctcgttgtgaattcca

SEQ ID NO: 809417 - DNA, 25 bp, Mus musculus
tcatttacctccatgtgactccttg

SEQ ID NO: 809418 - DNA, 25 bp, Mus musculus
tcatttacctccttgtgactccttg

SEQ ID NO: 809419 - DNA, 25 bp, Mus musculus
tcatttactgttcttccgtaaacct

SEQ ID NO: 809420 - DNA, 25 bp, Mus musculus
tcatttactgttgttccgtaaacct

SEQ ID NO: 809421 - DNA, 25 bp, Mus musculus
tcatttagccaccaatccatctttt

SEQ ID NO: 809422 - DNA, 25 bp, Mus musculus
tcatttagccacgaatccatctttt

SEQ ID NO: 809423 - DNA, 25 bp, Mus musculus
tcatttagcttgagacacctaggat

SEQ ID NO: 809424 - DNA, 25 bp, Mus musculus
tcatttagcttgtgacacctaggat

SEQ ID NO: 809425 - DNA, 25 bp, Mus musculus
tcatttaggtgtattctggctctcc

SEQ ID NO: 809426 - DNA, 25 bp, Mus musculus
tcatttaggtgttttctggctctcc

SEQ ID NO: 809427 - DNA, 25 bp, Mus musculus
tcatttatatggagtcacctactgt

SEQ ID NO: 809428 - DNA, 25 bp, Mus musculus
tcatttatatggtgtcacctactgt

SEQ ID NO: 809429 - DNA, 25 bp, Mus musculus
tcatttattgagagaccaggcagtc

SEQ ID NO: 809430 - DNA, 25 bp, Mus musculus
tcatttattgagtgaccaggcagtc

SEQ ID NO: 809431 - DNA, 25 bp, Mus musculus
tcatttattgtgcatctggcattct

SEQ ID NO: 809432 - DNA, 25 bp, Mus musculus
tcatttattgtggatctggcattct

SEQ ID NO: 809433 - DNA, 25 bp, Mus musculus
tcatttatttcactctgtttcatcc

SEQ ID NO: 809434 - DNA, 25 bp, Mus musculus
tcatttatttcagtctgtttcatcc

SEQ ID NO: 809435 - DNA, 25 bp, Mus musculus
tcatttcaaagcaacactgcagttg

SEQ ID NO: 809436 - DNA, 25 bp, Mus musculus
tcatttcaaagctacactgcagttg

SEQ ID NO: 809437 - DNA, 25 bp, Mus musculus
tcatttcaagttctatgagggccaa

SEQ ID NO: 809438 - DNA, 25 bp, Mus musculus
tcatttcaagttgtatgagggccaa

SEQ ID NO: 809439 - DNA, 25 bp, Mus musculus
tcatttcacatgaaccatacccgta

SEQ ID NO: 809440 - DNA, 25 bp, Mus musculus
tcatttcacatgtaccatacccgta

SEQ ID NO: 809441 - DNA, 25 bp, Mus musculus
tcatttcacggcatccctcagtaga

SEQ ID NO: 809442 - DNA, 25 bp, Mus musculus
tcatttcacggcttccctcagtaga

SEQ ID NO: 809443 - DNA, 25 bp, Mus musculus
tcatttcagttcatcccatagtgct

SEQ ID NO: 809444 - DNA, 25 bp, Mus musculus
tcatttcagttcttcccatagtgct

SEQ ID NO: 809445 - DNA, 25 bp, Mus musculus
tcatttcataccatgcgacagacca

SEQ ID NO: 809446 - DNA, 25 bp, Mus musculus
tcatttcataccttgcgacagacca

SEQ ID NO: 809447 - DNA, 25 bp, Mus musculus
tcatttcatccaatcagcctgtgac

SEQ ID NO: 809448 - DNA, 25 bp, Mus musculus
tcatttcatccattcagcctgtgac

SEQ ID NO: 809449 - DNA, 25 bp, Mus musculus
tcatttcatgatctaacgaccctga

SEQ ID NO: 809450 - DNA, 25 bp, Mus musculus
tcatttcatgatgtaacgaccctga

SEQ ID NO: 809451 - DNA, 25 bp, Mus musculus
tcatttccagaaaagcctgagacca

SEQ ID NO: 809452 - DNA, 25 bp, Mus musculus
tcatttccagaatagcctgagacca

SEQ ID NO: 809453 - DNA, 25 bp, Mus musculus
tcatttccaggcattttgttataca

SEQ ID NO: 809454 - DNA, 25 bp, Mus musculus
tcatttccaggctttttgttataca

SEQ ID NO: 809455 - DNA, 25 bp, Mus musculus
tcatttccagtcaatacattttatt

SEQ ID NO: 809456 - DNA, 25 bp, Mus musculus
tcatttccagtctatacattttatt

SEQ ID NO: 809457 - DNA, 25 bp, Mus musculus
tcatttccatggagggttgccctga

SEQ ID NO: 809458 - DNA, 25 bp, Mus musculus
tcatttccatggtgggttgccctga

SEQ ID NO: 809459 - DNA, 25 bp, Mus musculus
tcatttcccaatattatgtgcacac

SEQ ID NO: 809460 - DNA, 25 bp, Mus musculus
tcatttcccaattttatgtgcacac

SEQ ID NO: 809461 - DNA, 25 bp, Mus musculus
tcatttcccagtacgcctacggtga

SEQ ID NO: 809462 - DNA, 25 bp, Mus musculus
tcatttcccagttcgcctacggtga

SEQ ID NO: 809463 - DNA, 25 bp, Mus musculus
tcatttccccaaatactgtacattt

SEQ ID NO: 809464 - DNA, 25 bp, Mus musculus
tcatttccccaattactgtacattt

SEQ ID NO: 809465 - DNA, 25 bp, Mus musculus
tcatttccccagacacaaaaacaga

SEQ ID NO: 809466 - DNA, 25 bp, Mus musculus
tcatttccccagtcacaaaaacaga

SEQ ID NO: 809467 - DNA, 25 bp, Mus musculus
tcatttccccggattctactgtgga

SEQ ID NO: 809468 - DNA, 25 bp, Mus musculus
tcatttccccggtttctactgtgga

SEQ ID NO: 809469 - DNA, 25 bp, Mus musculus
tcatttccccttacatcatctggaa

SEQ ID NO: 809470 - DNA, 25 bp, Mus musculus
tcatttcccctttcatcatctggaa

SEQ ID NO: 809471 - DNA, 25 bp, Mus musculus
tcatttccctggagggcaagccttt

SEQ ID NO: 809472 - DNA, 25 bp, Mus musculus
tcatttccctggtgggcaagccttt

SEQ ID NO: 809473 - DNA, 25 bp, Mus musculus
tcatttccgcccaaggttgtatgca

SEQ ID NO: 809474 - DNA, 25 bp, Mus musculus
tcatttccgccctaggttgtatgca

SEQ ID NO: 809475 - DNA, 25 bp, Mus musculus
tcatttccggaacccagcaaatgat

SEQ ID NO: 809476 - DNA, 25 bp, Mus musculus
tcatttccggaagccagcaaatgat

SEQ ID NO: 809477 - DNA, 25 bp, Mus musculus
tcatttcctactatatcagaagact

SEQ ID NO: 809478 - DNA, 25 bp, Mus musculus
tcatttcctactttatcagaagact

SEQ ID NO: 809479 - DNA, 25 bp, Mus musculus
tcatttcctcacagccatggtcatt

SEQ ID NO: 809480 - DNA, 25 bp, Mus musculus
tcatttcctcactgccatggtcatt

SEQ ID NO: 809481 - DNA, 25 bp, Mus musculus
tcatttcctccaatggcaagagttt

SEQ ID NO: 809482 - DNA, 25 bp, Mus musculus
tcatttcctccattggcaagagttt

SEQ ID NO: 809483 - DNA, 25 bp, Mus musculus
tcatttcctctgacatcacctgaaa

SEQ ID NO: 809484 - DNA, 25 bp, Mus musculus
tcatttcctctgtcatcacctgaaa

SEQ ID NO: 809485 - DNA, 25 bp, Mus musculus
tcatttcctgacctgacttgaccat

SEQ ID NO: 809486 - DNA, 25 bp, Mus musculus
tcatttcctgacgtgacttgaccat

SEQ ID NO: 809487 - DNA, 25 bp, Mus musculus
tcatttcgggccagtaggaccatgg

SEQ ID NO: 809488 - DNA, 25 bp, Mus musculus
tcatttcgggcctgtaggaccatgg

SEQ ID NO: 809489 - DNA, 25 bp, Mus musculus
tcatttcggttaattggaagggagt

SEQ ID NO: 809490 - DNA, 25 bp, Mus musculus
tcatttcggttatttggaagggagt

SEQ ID NO: 809491 - DNA, 25 bp, Mus musculus
tcatttctacacattcatgcagtat

SEQ ID NO: 809492 - DNA, 25 bp, Mus musculus
tcatttctacactttcatgcagtat

SEQ ID NO: 809493 - DNA, 25 bp, Mus musculus
tcatttctactaagcggatgccagg

SEQ ID NO: 809494 - DNA, 25 bp, Mus musculus
tcatttctactatgcggatgccagg

SEQ ID NO: 809495 - DNA, 25 bp, Mus musculus
tcatttctcagtacagtggatatat

SEQ ID NO: 809496 - DNA, 25 bp, Mus musculus
tcatttctcagtagtgtcaccttag

SEQ ID NO: 809497 - DNA, 25 bp, Mus musculus
tcatttctcagttcagtggatatat

SEQ ID NO: 809498 - DNA, 25 bp, Mus musculus
tcatttctcagttgtgtcaccttag

SEQ ID NO: 809499 - DNA, 25 bp, Mus musculus
tcatttctccctcacttgtgaacaa

SEQ ID NO: 809500 - DNA, 25 bp, Mus musculus
tcatttctccctgacttgtgaacaa

SEQ ID NO: 809501 - DNA, 25 bp, Mus musculus
tcatttctcctgaacactgggttaa

SEQ ID NO: 809502 - DNA, 25 bp, Mus musculus
tcatttctcctgtacactgggttaa

SEQ ID NO: 809503 - DNA, 25 bp, Mus musculus
tcatttctcggcaggactgggtagg

SEQ ID NO: 809504 - DNA, 25 bp, Mus musculus
tcatttctcggctggactgggtagg

SEQ ID NO: 809505 - DNA, 25 bp, Mus musculus
tcatttctcgtgagctgtttctgtc

SEQ ID NO: 809506 - DNA, 25 bp, Mus musculus
tcatttctcgtgtgctgtttctgtc

SEQ ID NO: 809507 - DNA, 25 bp, Mus musculus
tcatttctgagccattgttctgtct

SEQ ID NO: 809508 - DNA, 25 bp, Mus musculus
tcatttctgagcgattgttctgtct

SEQ ID NO: 809509 - DNA, 25 bp, Mus musculus
tcatttctgctgagggggacgctaa

SEQ ID NO: 809510 - DNA, 25 bp, Mus musculus
tcatttctgctgtgggggacgctaa

SEQ ID NO: 809511 - DNA, 25 bp, Mus musculus
tcatttctgcttaggcagagggcag

SEQ ID NO: 809512 - DNA, 25 bp, Mus musculus
tcatttctgcttatgaggcttcagt

SEQ ID NO: 809513 - DNA, 25 bp, Mus musculus
tcatttctgctttggcagagggcag

SEQ ID NO: 809514 - DNA, 25 bp, Mus musculus
tcatttctgcttttgaggcttcagt

SEQ ID NO: 809515 - DNA, 25 bp, Mus musculus
tcatttctggacatgccttgtgaga

SEQ ID NO: 809516 - DNA, 25 bp, Mus musculus
tcatttctggacttgccttgtgaga

SEQ ID NO: 809517 - DNA, 25 bp, Mus musculus
tcatttctgtgcagcaaagcaatgg

SEQ ID NO: 809518 - DNA, 25 bp, Mus musculus
tcatttctgtgctgcaaagcaatgg

SEQ ID NO: 809519 - DNA, 25 bp, Mus musculus
tcatttctgtgtacgggtgccttca

SEQ ID NO: 809520 - DNA, 25 bp, Mus musculus
tcatttctgtgttcgggtgccttca

SEQ ID NO: 809521 - DNA, 25 bp, Mus musculus
tcatttcttcacctgggactgtcag

SEQ ID NO: 809522 - DNA, 25 bp, Mus musculus
tcatttcttcacgtgggactgtcag

SEQ ID NO: 809523 - DNA, 25 bp, Mus musculus
tcatttcttgatagtcatgtgacct

SEQ ID NO: 809524 - DNA, 25 bp, Mus musculus
tcatttcttgattgtcatgtgacct

SEQ ID NO: 809525 - DNA, 25 bp, Mus musculus
tcatttctttgtcgctgtgtaactc

SEQ ID NO: 809526 - DNA, 25 bp, Mus musculus
tcatttctttgtggctgtgtaactc

SEQ ID NO: 809527 - DNA, 25 bp, Mus musculus
tcatttctttttctgtgccctattc

SEQ ID NO: 809528 - DNA, 25 bp, Mus musculus
tcatttctttttgtgtgccctattc

SEQ ID NO: 809529 - DNA, 25 bp, Mus musculus
tcatttgacaccacagtacagtttt

SEQ ID NO: 809530 - DNA, 25 bp, Mus musculus
tcatttgacacctcagtacagtttt

SEQ ID NO: 809531 - DNA, 25 bp, Mus musculus
tcatttgacgtcattattccctgag

SEQ ID NO: 809532 - DNA, 25 bp, Mus musculus
tcatttgacgtctttattccctgag

SEQ ID NO: 809533 - DNA, 25 bp, Mus musculus
tcatttgactatatacattcccgat

SEQ ID NO: 809534 - DNA, 25 bp, Mus musculus
tcatttgactatttacattcccgat

SEQ ID NO: 809535 - DNA, 25 bp, Mus musculus
tcatttgactccactgagcaggtcc

SEQ ID NO: 809536 - DNA, 25 bp, Mus musculus
tcatttgactcctctgagcaggtcc

SEQ ID NO: 809537 - DNA, 25 bp, Mus musculus
tcatttgagactacccagcaggtct

SEQ ID NO: 809538 - DNA, 25 bp, Mus musculus
tcatttgagacttcccagcaggtct

SEQ ID NO: 809539 - DNA, 25 bp, Mus musculus
tcatttgaggctcgaaggttcaccc

SEQ ID NO: 809540 - DNA, 25 bp, Mus musculus
tcatttgaggctggaaggttcaccc

SEQ ID NO: 809541 - DNA, 25 bp, Mus musculus
tcatttgatatccaactttctgaag

SEQ ID NO: 809542 - DNA, 25 bp, Mus musculus
tcatttgatatcgaactttctgaag

SEQ ID NO: 809543 - DNA, 25 bp, Mus musculus
tcatttgcaatcacagcccaggaag

SEQ ID NO: 809544 - DNA, 25 bp, Mus musculus
tcatttgcaatctcagcccaggaag

SEQ ID NO: 809545 - DNA, 25 bp, Mus musculus
tcatttgcacatacctgagtagagg

SEQ ID NO: 809546 - DNA, 25 bp, Mus musculus
tcatttgcacattcctgagtagagg

SEQ ID NO: 809547 - DNA, 25 bp, Mus musculus
tcatttgcctccctgaatgtgcaat

SEQ ID NO: 809548 - DNA, 25 bp, Mus musculus
tcatttgcctccgtgaatgtgcaat

SEQ ID NO: 809549 - DNA, 25 bp, Mus musculus
tcatttgcctcgagggattgggctt

SEQ ID NO: 809550 - DNA, 25 bp, Mus musculus
tcatttgcctcgtgggattgggctt

SEQ ID NO: 809551 - DNA, 25 bp, Mus musculus
tcatttgccttcagggctgttgtga

SEQ ID NO: 809552 - DNA, 25 bp, Mus musculus
tcatttgccttctgggctgttgtga

SEQ ID NO: 809553 - DNA, 25 bp, Mus musculus
tcatttgcggttattactgtgctga

SEQ ID NO: 809554 - DNA, 25 bp, Mus musculus
tcatttgcggtttttactgtgctga

SEQ ID NO: 809555 - DNA, 25 bp, Mus musculus
tcatttgctactattgctcttcagg

SEQ ID NO: 809556 - DNA, 25 bp, Mus musculus
tcatttgctacttttgctcttcagg

SEQ ID NO: 809557 - DNA, 25 bp, Mus musculus
tcatttgcttgaaccagaattacag

SEQ ID NO: 809558 - DNA, 25 bp, Mus musculus
tcatttgcttgatccagaattacag

SEQ ID NO: 809559 - DNA, 25 bp, Mus musculus
tcatttgcttttaaaggaccacaca

SEQ ID NO: 809560 - DNA, 25 bp, Mus musculus
tcatttgctttttaaggaccacaca

SEQ ID NO: 809561 - DNA, 25 bp, Mus musculus
tcatttggagagctctttctcccca

SEQ ID NO: 809562 - DNA, 25 bp, Mus musculus
tcatttggagaggtctttctcccca

SEQ ID NO: 809563 - DNA, 25 bp, Mus musculus
tcatttggagttatgtcggctttta

SEQ ID NO: 809564 - DNA, 25 bp, Mus musculus
tcatttggagttttgtcggctttta

SEQ ID NO: 809565 - DNA, 25 bp, Mus musculus
tcatttggcagcatcttttcctttt

SEQ ID NO: 809566 - DNA, 25 bp, Mus musculus
tcatttggcagcttcttttcctttt

SEQ ID NO: 809567 - DNA, 25 bp, Mus musculus
tcatttggctttaaagtaccacagg

SEQ ID NO: 809568 - DNA, 25 bp, Mus musculus
tcatttggcttttaagtaccacagg

SEQ ID NO: 809569 - DNA, 25 bp, Mus musculus
tcatttgggattactagagagacct

SEQ ID NO: 809570 - DNA, 25 bp, Mus musculus
tcatttgggatttctagagagacct

SEQ ID NO: 809571 - DNA, 25 bp, Mus musculus
tcatttgggcaaattttacgtaaag

SEQ ID NO: 809572 - DNA, 25 bp, Mus musculus
tcatttgggcaatttttacgtaaag

SEQ ID NO: 809573 - DNA, 25 bp, Mus musculus
tcatttggtccaagcttcctagaag

SEQ ID NO: 809574 - DNA, 25 bp, Mus musculus
tcatttggtccatgcttcctagaag

SEQ ID NO: 809575 - DNA, 25 bp, Mus musculus
tcatttggtccccaaagggttcgtg

SEQ ID NO: 809576 - DNA, 25 bp, Mus musculus
tcatttggtcccgaaagggttcgtg

SEQ ID NO: 809577 - DNA, 25 bp, Mus musculus
tcatttgtaactccgtttccgggtc

SEQ ID NO: 809578 - DNA, 25 bp, Mus musculus
tcatttgtaactgcgtttccgggtc

SEQ ID NO: 809579 - DNA, 25 bp, Mus musculus
tcatttgtacctaaaccatttgcta

SEQ ID NO: 809580 - DNA, 25 bp, Mus musculus
tcatttgtaccttaaccatttgcta

SEQ ID NO: 809581 - DNA, 25 bp, Mus musculus
tcatttgtactcaaacccagtcaga

SEQ ID NO: 809582 - DNA, 25 bp, Mus musculus
tcatttgtactctaacccagtcaga

SEQ ID NO: 809583 - DNA, 25 bp, Mus musculus
tcatttgtactgatgctactggcat

SEQ ID NO: 809584 - DNA, 25 bp, Mus musculus
tcatttgtactgttgctactggcat

SEQ ID NO: 809585 - DNA, 25 bp, Mus musculus
tcatttgtagaaaaactgttgtaaa

SEQ ID NO: 809586 - DNA, 25 bp, Mus musculus
tcatttgtagaataactgttgtaaa

SEQ ID NO: 809587 - DNA, 25 bp, Mus musculus
tcatttgtagctatgttcctcaaga

SEQ ID NO: 809588 - DNA, 25 bp, Mus musculus
tcatttgtagctttgttcctcaaga

SEQ ID NO: 809589 - DNA, 25 bp, Mus musculus
tcatttgtaggcagccttctgtatt

SEQ ID NO: 809590 - DNA, 25 bp, Mus musculus
tcatttgtaggctgccttctgtatt

SEQ ID NO: 809591 - DNA, 25 bp, Mus musculus
tcatttgtatatagtttcctcgaag

SEQ ID NO: 809592 - DNA, 25 bp, Mus musculus
tcatttgtatattgtttcctcgaag

SEQ ID NO: 809593 - DNA, 25 bp, Mus musculus
tcatttgtatgtctgcttcttgcgt

SEQ ID NO: 809594 - DNA, 25 bp, Mus musculus
tcatttgtatgtgtgcttcttgcgt

SEQ ID NO: 809595 - DNA, 25 bp, Mus musculus
tcatttgtcatcaggtttttgggtt

SEQ ID NO: 809596 - DNA, 25 bp, Mus musculus
tcatttgtcatctggtttttgggtt

SEQ ID NO: 809597 - DNA, 25 bp, Mus musculus
tcatttgtcctaagttttcatttac

SEQ ID NO: 809598 - DNA, 25 bp, Mus musculus
tcatttgtcctatgttttcatttac

SEQ ID NO: 809599 - DNA, 25 bp, Mus musculus
tcatttgtcgttagaggctagacca

SEQ ID NO: 809600 - DNA, 25 bp, Mus musculus
tcatttgtcgtttgaggctagacca

SEQ ID NO: 809601 - DNA, 25 bp, Mus musculus
tcatttgtgcacctgtacagctcaa

SEQ ID NO: 809602 - DNA, 25 bp, Mus musculus
tcatttgtgcacgtgtacagctcaa

SEQ ID NO: 809603 - DNA, 25 bp, Mus musculus
tcatttgtgcgcctgttagtccaaa

SEQ ID NO: 809604 - DNA, 25 bp, Mus musculus
tcatttgtgcgcgtgttagtccaaa

SEQ ID NO: 809605 - DNA, 25 bp, Mus musculus
tcatttgtgcggactgccacgtgaa

SEQ ID NO: 809606 - DNA, 25 bp, Mus musculus
tcatttgtgcggtctgccacgtgaa

SEQ ID NO: 809607 - DNA, 25 bp, Mus musculus
tcatttgtgtatatggtgggacctt

SEQ ID NO: 809608 - DNA, 25 bp, Mus musculus
tcatttgtgtatttggtgggacctt

SEQ ID NO: 809609 - DNA, 25 bp, Mus musculus
tcatttgttagaaagctggaagcgt

SEQ ID NO: 809610 - DNA, 25 bp, Mus musculus
tcatttgttagatagctggaagcgt

SEQ ID NO: 809611 - DNA, 25 bp, Mus musculus
tcatttgttcaccaggctttccaag

SEQ ID NO: 809612 - DNA, 25 bp, Mus musculus
tcatttgttcacgaggctttccaag

SEQ ID NO: 809613 - DNA, 25 bp, Mus musculus
tcattttaaaacaaggtgtggtggc

SEQ ID NO: 809614 - DNA, 25 bp, Mus musculus
tcattttaaaacctgcaggctccaa

SEQ ID NO: 809615 - DNA, 25 bp, Mus musculus
tcattttaaaacgtgcaggctccaa

SEQ ID NO: 809616 - DNA, 25 bp, Mus musculus
tcattttaaaactaggtgtggtggc

SEQ ID NO: 809617 - DNA, 25 bp, Mus musculus
tcattttaaaatctcctctcttcag

SEQ ID NO: 809618 - DNA, 25 bp, Mus musculus
tcattttaaaatgtcctctcttcag

SEQ ID NO: 809619 - DNA, 25 bp, Mus musculus
tcattttaaatcctttcgctcctca

SEQ ID NO: 809620 - DNA, 25 bp, Mus musculus
tcattttaaatcgtttcgctcctca

SEQ ID NO: 809621 - DNA, 25 bp, Mus musculus
tcattttaacctctgatctttctaa

SEQ ID NO: 809622 - DNA, 25 bp, Mus musculus
tcattttaacctgtgatctttctaa

SEQ ID NO: 809623 - DNA, 25 bp, Mus musculus
tcattttaaggcattgaaccacata

SEQ ID NO: 809624 - DNA, 25 bp, Mus musculus
tcattttaaggctttgaaccacata

SEQ ID NO: 809625 - DNA, 25 bp, Mus musculus
tcattttaatcgacccaactttctt

SEQ ID NO: 809626 - DNA, 25 bp, Mus musculus
tcattttaatcgtcccaactttctt

SEQ ID NO: 809627 - DNA, 25 bp, Mus musculus
tcattttacattcatgtcggaaaaa

SEQ ID NO: 809628 - DNA, 25 bp, Mus musculus
tcattttacattgatgtcggaaaaa

SEQ ID NO: 809629 - DNA, 25 bp, Mus musculus
tcattttaccacagtgaagctccgc

SEQ ID NO: 809630 - DNA, 25 bp, Mus musculus
tcattttaccactgtgaagctccgc

SEQ ID NO: 809631 - DNA, 25 bp, Mus musculus
tcattttagcacctttccatcgaaa

SEQ ID NO: 809632 - DNA, 25 bp, Mus musculus
tcattttagcacgtttccatcgaaa

SEQ ID NO: 809633 - DNA, 25 bp, Mus musculus
tcattttagggcacccctgaaaaat

SEQ ID NO: 809634 - DNA, 25 bp, Mus musculus
tcattttagggctcccctgaaaaat

SEQ ID NO: 809635 - DNA, 25 bp, Mus musculus
tcattttaggtccaagtaagatgtt

SEQ ID NO: 809636 - DNA, 25 bp, Mus musculus
tcattttaggtcgaagtaagatgtt

SEQ ID NO: 809637 - DNA, 25 bp, Mus musculus
tcattttataacacctgaggtactc

SEQ ID NO: 809638 - DNA, 25 bp, Mus musculus
tcattttataactcctgaggtactc

SEQ ID NO: 809639 - DNA, 25 bp, Mus musculus
tcattttatcctatgtaacacgctt

SEQ ID NO: 809640 - DNA, 25 bp, Mus musculus
tcattttatcctttgtaacacgctt

SEQ ID NO: 809641 - DNA, 25 bp, Mus musculus
tcattttatgcactggaccccatgg

SEQ ID NO: 809642 - DNA, 25 bp, Mus musculus
tcattttatgcagtggaccccatgg

SEQ ID NO: 809643 - DNA, 25 bp, Mus musculus
tcattttatttgaccttcctggttt

SEQ ID NO: 809644 - DNA, 25 bp, Mus musculus
tcattttatttgtccttcctggttt

SEQ ID NO: 809645 - DNA, 25 bp, Mus musculus
tcattttcaccacatttttgagcaa

SEQ ID NO: 809646 - DNA, 25 bp, Mus musculus
tcattttcaccagatttttgagcaa

SEQ ID NO: 809647 - DNA, 25 bp, Mus musculus
tcattttcacgtaaagttcctattt

SEQ ID NO: 809648 - DNA, 25 bp, Mus musculus
tcattttcacgttaagttcctattt

SEQ ID NO: 809649 - DNA, 25 bp, Mus musculus
tcattttcagcaatccaaattcttg

SEQ ID NO: 809650 - DNA, 25 bp, Mus musculus
tcattttcagcattccaaattcttg

SEQ ID NO: 809651 - DNA, 25 bp, Mus musculus
tcattttcaggcctgtgccctttct

SEQ ID NO: 809652 - DNA, 25 bp, Mus musculus
tcattttcaggcgtgtgccctttct

SEQ ID NO: 809653 - DNA, 25 bp, Mus musculus
tcattttcatggaactcatggctct

SEQ ID NO: 809654 - DNA, 25 bp, Mus musculus
tcattttcatggtactcatggctct

SEQ ID NO: 809655 - DNA, 25 bp, Mus musculus
tcattttcatgtcacccagaccctt

SEQ ID NO: 809656 - DNA, 25 bp, Mus musculus
tcattttcatgtgacccagaccctt

SEQ ID NO: 809657 - DNA, 25 bp, Mus musculus
tcattttccaacatgaccgtgctag

SEQ ID NO: 809658 - DNA, 25 bp, Mus musculus
tcattttccaacttgaccgtgctag

SEQ ID NO: 809659 - DNA, 25 bp, Mus musculus
tcattttccatcacctggcagcaac

SEQ ID NO: 809660 - DNA, 25 bp, Mus musculus
tcattttccatctcctggcagcaac

SEQ ID NO: 809661 - DNA, 25 bp, Mus musculus
tcattttcccaacccagagctaggg

SEQ ID NO: 809662 - DNA, 25 bp, Mus musculus
tcattttcccaagccagagctaggg

SEQ ID NO: 809663 - DNA, 25 bp, Mus musculus
tcattttcccctaatgtttatggaa

SEQ ID NO: 809664 - DNA, 25 bp, Mus musculus
tcattttccccttatgtttatggaa

SEQ ID NO: 809665 - DNA, 25 bp, Mus musculus
tcattttcccttcacaggtgtgtat

SEQ ID NO: 809666 - DNA, 25 bp, Mus musculus
tcattttcccttgacaggtgtgtat

SEQ ID NO: 809667 - DNA, 25 bp, Mus musculus
tcattttccgtgagctttaaaaagg

SEQ ID NO: 809668 - DNA, 25 bp, Mus musculus
tcattttccgtgtgctttaaaaagg

SEQ ID NO: 809669 - DNA, 25 bp, Mus musculus
tcattttcctgcagtaactgacatg

SEQ ID NO: 809670 - DNA, 25 bp, Mus musculus
tcattttcctgccttttggctaaaa

SEQ ID NO: 809671 - DNA, 25 bp, Mus musculus
tcattttcctgcgttttggctaaaa

SEQ ID NO: 809672 - DNA, 25 bp, Mus musculus
tcattttcctgctgtaactgacatg

SEQ ID NO: 809673 - DNA, 25 bp, Mus musculus
tcattttctacccacaaatttcagg

SEQ ID NO: 809674 - DNA, 25 bp, Mus musculus
tcattttctaccgacaaatttcagg

SEQ ID NO: 809675 - DNA, 25 bp, Mus musculus
tcattttctagccaggacaggaaat

SEQ ID NO: 809676 - DNA, 25 bp, Mus musculus
tcattttctagcgaggacaggaaat

SEQ ID NO: 809677 - DNA, 25 bp, Mus musculus
tcattttctctcactgaagtcatta

SEQ ID NO: 809678 - DNA, 25 bp, Mus musculus
tcattttctctctctgaagtcatta

SEQ ID NO: 809679 - DNA, 25 bp, Mus musculus
tcattttctgataatgtaggtttta

SEQ ID NO: 809680 - DNA, 25 bp, Mus musculus
tcattttctgattatgtaggtttta

SEQ ID NO: 809681 - DNA, 25 bp, Mus musculus
tcattttcttacatgcttagcacag

SEQ ID NO: 809682 - DNA, 25 bp, Mus musculus
tcattttcttacttgcttagcacag

SEQ ID NO: 809683 - DNA, 25 bp, Mus musculus
tcattttctttgaatgtcagtcaaa

SEQ ID NO: 809684 - DNA, 25 bp, Mus musculus
tcattttctttgagtgtctccagat

SEQ ID NO: 809685 - DNA, 25 bp, Mus musculus
tcattttctttgtatgtcagtcaaa

SEQ ID NO: 809686 - DNA, 25 bp, Mus musculus
tcattttctttgtgtgtctccagat

SEQ ID NO: 809687 - DNA, 25 bp, Mus musculus
tcattttcttttcgtcattttgtgc

SEQ ID NO: 809688 - DNA, 25 bp, Mus musculus
tcattttcttttggtcattttgtgc

SEQ ID NO: 809689 - DNA, 25 bp, Mus musculus
tcattttgaccaccggaatctccca

SEQ ID NO: 809690 - DNA, 25 bp, Mus musculus
tcattttgaccagcggaatctccca

SEQ ID NO: 809691 - DNA, 25 bp, Mus musculus
tcattttgagtcatccaccgtgagg

SEQ ID NO: 809692 - DNA, 25 bp, Mus musculus
tcattttgagtcttccaccgtgagg

SEQ ID NO: 809693 - DNA, 25 bp, Mus musculus
tcattttgcatcagtctggccactt

SEQ ID NO: 809694 - DNA, 25 bp, Mus musculus
tcattttgcatctgtctggccactt

SEQ ID NO: 809695 - DNA, 25 bp, Mus musculus
tcattttgccaacgaattcacccca

SEQ ID NO: 809696 - DNA, 25 bp, Mus musculus
tcattttgccaaggaattcacccca

SEQ ID NO: 809697 - DNA, 25 bp, Mus musculus
tcattttgccctaggagagcttaat

SEQ ID NO: 809698 - DNA, 25 bp, Mus musculus
tcattttgccctccaatctacgtag

SEQ ID NO: 809699 - DNA, 25 bp, Mus musculus
tcattttgccctgcaatctacgtag

SEQ ID NO: 809700 - DNA, 25 bp, Mus musculus
tcattttgcccttggagagcttaat

SEQ ID NO: 809701 - DNA, 25 bp, Mus musculus
tcattttggctgctatgtgtagatt

SEQ ID NO: 809702 - DNA, 25 bp, Mus musculus
tcattttggctggtatgtgtagatt

SEQ ID NO: 809703 - DNA, 25 bp, Mus musculus
tcattttgtaagacgaccctgcagt

SEQ ID NO: 809704 - DNA, 25 bp, Mus musculus
tcattttgtaagtcgaccctgcagt

SEQ ID NO: 809705 - DNA, 25 bp, Mus musculus
tcattttgtaatctaccccagattt

SEQ ID NO: 809706 - DNA, 25 bp, Mus musculus
tcattttgtaatgtaccccagattt

SEQ ID NO: 809707 - DNA, 25 bp, Mus musculus
tcattttgtggaactactattagct

SEQ ID NO: 809708 - DNA, 25 bp, Mus musculus
tcattttgtggatctactattagct

SEQ ID NO: 809709 - DNA, 25 bp, Mus musculus
tcattttgtttgaaaccggtggctt

SEQ ID NO: 809710 - DNA, 25 bp, Mus musculus
tcattttgtttgtaaccggtggctt

SEQ ID NO: 809711 - DNA, 25 bp, Mus musculus
tcatttttaatgacttctaagatgt

SEQ ID NO: 809712 - DNA, 25 bp, Mus musculus
tcatttttaatgtcttctaagatgt

SEQ ID NO: 809713 - DNA, 25 bp, Mus musculus
tcatttttaccgagggcacttccag

SEQ ID NO: 809714 - DNA, 25 bp, Mus musculus
tcatttttaccgtgggcacttccag

SEQ ID NO: 809715 - DNA, 25 bp, Mus musculus
tcatttttacttcttggctccctgt

SEQ ID NO: 809716 - DNA, 25 bp, Mus musculus
tcatttttacttgttggctccctgt

SEQ ID NO: 809717 - DNA, 25 bp, Mus musculus
tcatttttcaatcaacccgagacca

SEQ ID NO: 809718 - DNA, 25 bp, Mus musculus
tcatttttcaatgaacccgagacca

SEQ ID NO: 809719 - DNA, 25 bp, Mus musculus
tcatttttcacaatgcaagctagag

SEQ ID NO: 809720 - DNA, 25 bp, Mus musculus
tcatttttcacattgcaagctagag

SEQ ID NO: 809721 - DNA, 25 bp, Mus musculus
tcatttttccctacctgacttttct

SEQ ID NO: 809722 - DNA, 25 bp, Mus musculus
tcatttttcccttcctgacttttct

SEQ ID NO: 809723 - DNA, 25 bp, Mus musculus
tcatttttccttaactctctctctt

SEQ ID NO: 809724 - DNA, 25 bp, Mus musculus
tcatttttcctttactctctctctt

SEQ ID NO: 809725 - DNA, 25 bp, Mus musculus
tcatttttgatgatgtccttatagc

SEQ ID NO: 809726 - DNA, 25 bp, Mus musculus
tcatttttgatgttgtccttatagc

SEQ ID NO: 809727 - DNA, 25 bp, Mus musculus
tcatttttggatcgactgtgtcccc

SEQ ID NO: 809728 - DNA, 25 bp, Mus musculus
tcatttttggatggactgtgtcccc

SEQ ID NO: 809729 - DNA, 25 bp, Mus musculus
tcatttttggctatcgttctagaag

SEQ ID NO: 809730 - DNA, 25 bp, Mus musculus
tcatttttggctttcgttctagaag

SEQ ID NO: 809731 - DNA, 25 bp, Mus musculus
tcatttttgggcactgcctgtgcac

SEQ ID NO: 809732 - DNA, 25 bp, Mus musculus
tcatttttgggctctgcctgtgcac

SEQ ID NO: 809733 - DNA, 25 bp, Mus musculus
tcatttttgtatccttccgttctag

SEQ ID NO: 809734 - DNA, 25 bp, Mus musculus
tcatttttgtatgcttccgttctag

SEQ ID NO: 809735 - DNA, 25 bp, Mus musculus
tcattttttacaactggacctccac

SEQ ID NO: 809736 - DNA, 25 bp, Mus musculus
tcattttttacatctggacctccac

SEQ ID NO: 809737 - DNA, 25 bp, Mus musculus
tcattttttctgattgcgtgtgcgg

SEQ ID NO: 809738 - DNA, 25 bp, Mus musculus
tcattttttctgtttgcgtgtgcgg

SEQ ID NO: 809739 - DNA, 25 bp, Mus musculus
tcattttttgacactggagagttct

SEQ ID NO: 809740 - DNA, 25 bp, Mus musculus
tcattttttgactctggagagttct

SEQ ID NO: 809741 - DNA, 25 bp, Mus musculus
tcattttttgagctcccaacaggtt

SEQ ID NO: 809742 - DNA, 25 bp, Mus musculus
tcattttttgaggtcccaacaggtt

SEQ ID NO: 809743 - DNA, 25 bp, Mus musculus
tcattttttgcccatcgctttggag

SEQ ID NO: 809744 - DNA, 25 bp, Mus musculus
tcattttttgccgatcgctttggag

SEQ ID NO: 809745 - DNA, 25 bp, Mus musculus
tcattttttgttataggctggcctc

SEQ ID NO: 809746 - DNA, 25 bp, Mus musculus
tcattttttgttttaggctggcctc

SEQ ID NO: 809747 - DNA, 25 bp, Mus musculus
tccaaaaacaagcactgcatccaaa

SEQ ID NO: 809748 - DNA, 25 bp, Mus musculus
tccaaaaacaaggactgcatccaaa

SEQ ID NO: 809749 - DNA, 25 bp, Mus musculus
tccaaaaacttgaacgatgccgata

SEQ ID NO: 809750 - DNA, 25 bp, Mus musculus
tccaaaaacttgtacgatgccgata

SEQ ID NO: 809751 - DNA, 25 bp, Mus musculus
tccaaaaatgtgcaaggcctcccaa

SEQ ID NO: 809752 - DNA, 25 bp, Mus musculus
tccaaaaatgtggaaggcctcccaa

SEQ ID NO: 809753 - DNA, 25 bp, Mus musculus
tccaaaacccttctagagacccttg

SEQ ID NO: 809754 - DNA, 25 bp, Mus musculus
tccaaaacccttgtagagacccttg

SEQ ID NO: 809755 - DNA, 25 bp, Mus musculus
tccaaaagacttcattattttccta

SEQ ID NO: 809756 - DNA, 25 bp, Mus musculus
tccaaaagacttgattattttccta

SEQ ID NO: 809757 - DNA, 25 bp, Mus musculus
tccaaaagctgtaggaattcacatt

SEQ ID NO: 809758 - DNA, 25 bp, Mus musculus
tccaaaagctgttggaattcacatt

SEQ ID NO: 809759 - DNA, 25 bp, Mus musculus
tccaaaaggttcagtgtggtggttt

SEQ ID NO: 809760 - DNA, 25 bp, Mus musculus
tccaaaaggttctgtgtggtggttt

SEQ ID NO: 809761 - DNA, 25 bp, Mus musculus
tccaaaatgtccacagagctggcct

SEQ ID NO: 809762 - DNA, 25 bp, Mus musculus
tccaaaatgtcctcagagctggcct

SEQ ID NO: 809763 - DNA, 25 bp, Mus musculus
tccaaaattagtctctgcgtcagtg

SEQ ID NO: 809764 - DNA, 25 bp, Mus musculus
tccaaaattagtgtctgcgtcagtg

SEQ ID NO: 809765 - DNA, 25 bp, Mus musculus
tccaaaattgtcctcttccatcgtc

SEQ ID NO: 809766 - DNA, 25 bp, Mus musculus
tccaaaattgtcgtcttccatcgtc

SEQ ID NO: 809767 - DNA, 25 bp, Mus musculus
tccaaacactaaccttgtttatctg

SEQ ID NO: 809768 - DNA, 25 bp, Mus musculus
tccaaacactaagcttgtttatctg

SEQ ID NO: 809769 - DNA, 25 bp, Mus musculus
tccaaacatcagaatctcctcttct

SEQ ID NO: 809770 - DNA, 25 bp, Mus musculus
tccaaacatcagtatctcctcttct

SEQ ID NO: 809771 - DNA, 25 bp, Mus musculus
tccaaacatttcatctctcttctat

SEQ ID NO: 809772 - DNA, 25 bp, Mus musculus
tccaaacatttcttctctcttctat

SEQ ID NO: 809773 - DNA, 25 bp, Mus musculus
tccaaaccacacccaggcatttggg

SEQ ID NO: 809774 - DNA, 25 bp, Mus musculus
tccaaaccacacgcaggcatttggg

SEQ ID NO: 809775 - DNA, 25 bp, Mus musculus
tccaaaccagcaattcctccagttg

SEQ ID NO: 809776 - DNA, 25 bp, Mus musculus
tccaaaccagcatttcctccagttg

SEQ ID NO: 809777 - DNA, 25 bp, Mus musculus
tccaaaccaggccaccagagatggt

SEQ ID NO: 809778 - DNA, 25 bp, Mus musculus
tccaaaccaggcgaccagagatggt

SEQ ID NO: 809779 - DNA, 25 bp, Mus musculus
tccaaaccatgaaccttactcagaa

SEQ ID NO: 809780 - DNA, 25 bp, Mus musculus
tccaaaccatgatccttactcagaa

SEQ ID NO: 809781 - DNA, 25 bp, Mus musculus
tccaaacccacacagctcaaggaga

SEQ ID NO: 809782 - DNA, 25 bp, Mus musculus
tccaaacccacagagctcaaggaga

SEQ ID NO: 809783 - DNA, 25 bp, Mus musculus
tccaaacccattagtacctttgagg

SEQ ID NO: 809784 - DNA, 25 bp, Mus musculus
tccaaacccatttgtacctttgagg

SEQ ID NO: 809785 - DNA, 25 bp, Mus musculus
tccaaaccccatacataagcttcat

SEQ ID NO: 809786 - DNA, 25 bp, Mus musculus
tccaaaccccattcataagcttcat

SEQ ID NO: 809787 - DNA, 25 bp, Mus musculus
tccaaaccctctagctgcaaagggt

SEQ ID NO: 809788 - DNA, 25 bp, Mus musculus
tccaaaccctcttgctgcaaagggt

SEQ ID NO: 809789 - DNA, 25 bp, Mus musculus
tccaaaccggcaagatattaatcaa

SEQ ID NO: 809790 - DNA, 25 bp, Mus musculus
tccaaaccggcatgatattaatcaa

SEQ ID NO: 809791 - DNA, 25 bp, Mus musculus
tccaaacctaaaactcatcccaggt

SEQ ID NO: 809792 - DNA, 25 bp, Mus musculus
tccaaacctaaatctcatcccaggt

SEQ ID NO: 809793 - DNA, 25 bp, Mus musculus
tccaaacctaatcaaccaggatgct

SEQ ID NO: 809794 - DNA, 25 bp, Mus musculus
tccaaacctaatgaaccaggatgct

SEQ ID NO: 809795 - DNA, 25 bp, Mus musculus
tccaaacggaggcacgagtgacttc

SEQ ID NO: 809796 - DNA, 25 bp, Mus musculus
tccaaacggagggacgagtgacttc

SEQ ID NO: 809797 - DNA, 25 bp, Mus musculus
tccaaactaaaaatctcttataatc

SEQ ID NO: 809798 - DNA, 25 bp, Mus musculus
tccaaactaaaattctcttataatc

SEQ ID NO: 809799 - DNA, 25 bp, Mus musculus
tccaaactcagcaattgtcctcaat

SEQ ID NO: 809800 - DNA, 25 bp, Mus musculus
tccaaactcagctattgtcctcaat

SEQ ID NO: 809801 - DNA, 25 bp, Mus musculus
tccaaactccgtcaagaagagcagg

SEQ ID NO: 809802 - DNA, 25 bp, Mus musculus
tccaaactccgtgaagaagagcagg

SEQ ID NO: 809803 - DNA, 25 bp, Mus musculus
tccaaactgattacacaatgactgt

SEQ ID NO: 809804 - DNA, 25 bp, Mus musculus
tccaaactgatttcacaatgactgt

SEQ ID NO: 809805 - DNA, 25 bp, Mus musculus
tccaaactgcctctgtcattaaaac

SEQ ID NO: 809806 - DNA, 25 bp, Mus musculus
tccaaactgcctgtgtcattaaaac

SEQ ID NO: 809807 - DNA, 25 bp, Mus musculus
tccaaactggttctgctgacagcct

SEQ ID NO: 809808 - DNA, 25 bp, Mus musculus
tccaaactggttgtgctgacagcct

SEQ ID NO: 809809 - DNA, 25 bp, Mus musculus
tccaaactgtggcagcattgctgct

SEQ ID NO: 809810 - DNA, 25 bp, Mus musculus
tccaaactgtgggagcattgctgct

SEQ ID NO: 809811 - DNA, 25 bp, Mus musculus
tccaaagactccatcttatctctgt

SEQ ID NO: 809812 - DNA, 25 bp, Mus musculus
tccaaagactccttcttatctctgt

SEQ ID NO: 809813 - DNA, 25 bp, Mus musculus
tccaaagatgatattcctgaaggtt

SEQ ID NO: 809814 - DNA, 25 bp, Mus musculus
tccaaagatgattttcctgaaggtt

SEQ ID NO: 809815 - DNA, 25 bp, Mus musculus
tccaaagcaggcaaacccaattcct

SEQ ID NO: 809816 - DNA, 25 bp, Mus musculus
tccaaagcaggctaacccaattcct

SEQ ID NO: 809817 - DNA, 25 bp, Mus musculus
tccaaagcatgtacacactaataaa

SEQ ID NO: 809818 - DNA, 25 bp, Mus musculus
tccaaagcatgttcacactaataaa

SEQ ID NO: 809819 - DNA, 25 bp, Mus musculus
tccaaagcgaggcagaatcctgttt

SEQ ID NO: 809820 - DNA, 25 bp, Mus musculus
tccaaagcgagggagaatcctgttt

SEQ ID NO: 809821 - DNA, 25 bp, Mus musculus
tccaaagctctgacaggatgggcaa

SEQ ID NO: 809822 - DNA, 25 bp, Mus musculus
tccaaagctctgtcaggatgggcaa

SEQ ID NO: 809823 - DNA, 25 bp, Mus musculus
tccaaagctcttaatcttagtaaat

SEQ ID NO: 809824 - DNA, 25 bp, Mus musculus
tccaaagctctttatcttagtaaat

SEQ ID NO: 809825 - DNA, 25 bp, Mus musculus
tccaaagctggcctgagtcataaaa

SEQ ID NO: 809826 - DNA, 25 bp, Mus musculus
tccaaagctggcgtgagtcataaaa

SEQ ID NO: 809827 - DNA, 25 bp, Mus musculus
tccaaaggcaagagtccctccttga

SEQ ID NO: 809828 - DNA, 25 bp, Mus musculus
tccaaaggcaagtgtccctccttga

SEQ ID NO: 809829 - DNA, 25 bp, Mus musculus
tccaaaggcggcaggcaagaaagcg

SEQ ID NO: 809830 - DNA, 25 bp, Mus musculus
tccaaaggcggctggcaagaaagcg

SEQ ID NO: 809831 - DNA, 25 bp, Mus musculus
tccaaagggaaaagccggccagaca

SEQ ID NO: 809832 - DNA, 25 bp, Mus musculus
tccaaagggaaatgccggccagaca

SEQ ID NO: 809833 - DNA, 25 bp, Mus musculus
tccaaaggtctcagcagtcagggtg

SEQ ID NO: 809834 - DNA, 25 bp, Mus musculus
tccaaaggtctctgcagtcagggtg

SEQ ID NO: 809835 - DNA, 25 bp, Mus musculus
tccaaaggtgctacgcgggatgcct

SEQ ID NO: 809836 - DNA, 25 bp, Mus musculus
tccaaaggtgcttcgcgggatgcct

SEQ ID NO: 809837 - DNA, 25 bp, Mus musculus
tccaaaggtgtgaaacttattttgt

SEQ ID NO: 809838 - DNA, 25 bp, Mus musculus
tccaaaggtgtgtaacttattttgt

SEQ ID NO: 809839 - DNA, 25 bp, Mus musculus
tccaaagtcccaacagctgtggcag

SEQ ID NO: 809840 - DNA, 25 bp, Mus musculus
tccaaagtcccatcagctgtggcag

SEQ ID NO: 809841 - DNA, 25 bp, Mus musculus
tccaaagtcttgctacttgcacttg

SEQ ID NO: 809842 - DNA, 25 bp, Mus musculus
tccaaagtcttggtacttgcacttg

SEQ ID NO: 809843 - DNA, 25 bp, Mus musculus
tccaaagtgaagactctgtgcacag

SEQ ID NO: 809844 - DNA, 25 bp, Mus musculus
tccaaagtgaagtctctgtgcacag

SEQ ID NO: 809845 - DNA, 25 bp, Mus musculus
tccaaagtgattccctaaggcaatt

SEQ ID NO: 809846 - DNA, 25 bp, Mus musculus
tccaaagtgattgcctaaggcaatt

SEQ ID NO: 809847 - DNA, 25 bp, Mus musculus
tccaaagtgctgctccgtagggtca

SEQ ID NO: 809848 - DNA, 25 bp, Mus musculus
tccaaagtgctggtccgtagggtca

SEQ ID NO: 809849 - DNA, 25 bp, Mus musculus
tccaaagttaggagccacccaggag

SEQ ID NO: 809850 - DNA, 25 bp, Mus musculus
tccaaagttaggtgccacccaggag

SEQ ID NO: 809851 - DNA, 25 bp, Mus musculus
tccaaagttgtaaaatctgtctaat

SEQ ID NO: 809852 - DNA, 25 bp, Mus musculus
tccaaagttgtataatctgtctaat

SEQ ID NO: 809853 - DNA, 25 bp, Mus musculus
tccaaagtttagattcgtgtccatt

SEQ ID NO: 809854 - DNA, 25 bp, Mus musculus
tccaaagtttagtttcgtgtccatt

SEQ ID NO: 809855 - DNA, 25 bp, Mus musculus
tccaaataagggattctttccagat

SEQ ID NO: 809856 - DNA, 25 bp, Mus musculus
tccaaataagggtttctttccagat

SEQ ID NO: 809857 - DNA, 25 bp, Mus musculus
tccaaatagcttaacagatctccca

SEQ ID NO: 809858 - DNA, 25 bp, Mus musculus
tccaaatagctttacagatctccca

SEQ ID NO: 809859 - DNA, 25 bp, Mus musculus
tccaaatcaaaactggtggcccatt

SEQ ID NO: 809860 - DNA, 25 bp, Mus musculus
tccaaatcaaaagtggtggcccatt

SEQ ID NO: 809861 - DNA, 25 bp, Mus musculus
tccaaatcacccaggtggaatgggt

SEQ ID NO: 809862 - DNA, 25 bp, Mus musculus
tccaaatcaccctggtggaatgggt

SEQ ID NO: 809863 - DNA, 25 bp, Mus musculus
tccaaatccaaaagcttgtcccctt

SEQ ID NO: 809864 - DNA, 25 bp, Mus musculus
tccaaatccaaatgcttgtcccctt

SEQ ID NO: 809865 - DNA, 25 bp, Mus musculus
tccaaatctgatagtcactggtgtt

SEQ ID NO: 809866 - DNA, 25 bp, Mus musculus
tccaaatctgattgtcactggtgtt

SEQ ID NO: 809867 - DNA, 25 bp, Mus musculus
tccaaatctttaatttacaccacct

SEQ ID NO: 809868 - DNA, 25 bp, Mus musculus
tccaaatctttattttacaccacct

SEQ ID NO: 809869 - DNA, 25 bp, Mus musculus
tccaaatgacaaccttatgaagagg

SEQ ID NO: 809870 - DNA, 25 bp, Mus musculus
tccaaatgacaagcttatgaagagg

SEQ ID NO: 809871 - DNA, 25 bp, Mus musculus
tccaaatgacagcaagggtacccag

SEQ ID NO: 809872 - DNA, 25 bp, Mus musculus
tccaaatgacaggaagggtacccag

SEQ ID NO: 809873 - DNA, 25 bp, Mus musculus
tccaaatgcccaaggactggctgtt

SEQ ID NO: 809874 - DNA, 25 bp, Mus musculus
tccaaatgcccatggactggctgtt

SEQ ID NO: 809875 - DNA, 25 bp, Mus musculus
tccaaatgctgcagtcagtgtgcat

SEQ ID NO: 809876 - DNA, 25 bp, Mus musculus
tccaaatgctgctgtcagtgtgcat

SEQ ID NO: 809877 - DNA, 25 bp, Mus musculus
tccaaatgggctatacccgtccaag

SEQ ID NO: 809878 - DNA, 25 bp, Mus musculus
tccaaatgggctttacccgtccaag

SEQ ID NO: 809879 - DNA, 25 bp, Mus musculus
tccaaatgttaacactttccctggt

SEQ ID NO: 809880 - DNA, 25 bp, Mus musculus
tccaaatgttaagactttccctggt

SEQ ID NO: 809881 - DNA, 25 bp, Mus musculus
tccaaattcacccaaagtttactag

SEQ ID NO: 809882 - DNA, 25 bp, Mus musculus
tccaaattcaccgaaagtttactag

SEQ ID NO: 809883 - DNA, 25 bp, Mus musculus
tccaaattccaaattccttccgtct

SEQ ID NO: 809884 - DNA, 25 bp, Mus musculus
tccaaattccaatttccttccgtct

SEQ ID NO: 809885 - DNA, 25 bp, Mus musculus
tccaaattccacacccttagaaatc

SEQ ID NO: 809886 - DNA, 25 bp, Mus musculus
tccaaattccactcccttagaaatc

SEQ ID NO: 809887 - DNA, 25 bp, Mus musculus
tccaaattcccacttgtttcctaag

SEQ ID NO: 809888 - DNA, 25 bp, Mus musculus
tccaaattcccagttgtttcctaag

SEQ ID NO: 809889 - DNA, 25 bp, Mus musculus
tccaaattcttgatctttactttct

SEQ ID NO: 809890 - DNA, 25 bp, Mus musculus
tccaaattcttgttctttactttct

SEQ ID NO: 809891 - DNA, 25 bp, Mus musculus
tccaaattgggacagttacatgaca

SEQ ID NO: 809892 - DNA, 25 bp, Mus musculus
tccaaattgggagagttacatgaca

SEQ ID NO: 809893 - DNA, 25 bp, Mus musculus
tccaacaaagatcgcctcgggactg

SEQ ID NO: 809894 - DNA, 25 bp, Mus musculus
tccaacaaagatggcctcgggactg

SEQ ID NO: 809895 - DNA, 25 bp, Mus musculus
tccaacaaattcactacacttctct

SEQ ID NO: 809896 - DNA, 25 bp, Mus musculus
tccaacaaattctctacacttctct

SEQ ID NO: 809897 - DNA, 25 bp, Mus musculus
tccaacaacaagcaccagggaggtt

SEQ ID NO: 809898 - DNA, 25 bp, Mus musculus
tccaacaacaaggaccagggaggtt

SEQ ID NO: 809899 - DNA, 25 bp, Mus musculus
tccaacaagtccatagtgccctgag

SEQ ID NO: 809900 - DNA, 25 bp, Mus musculus
tccaacaagtccttagtgccctgag

SEQ ID NO: 809901 - DNA, 25 bp, Mus musculus
tccaacaatcacatgaaggttccca

SEQ ID NO: 809902 - DNA, 25 bp, Mus musculus
tccaacaatcacttgaaggttccca

SEQ ID NO: 809903 - DNA, 25 bp, Mus musculus
tccaacacaatacttacggaccttg

SEQ ID NO: 809904 - DNA, 25 bp, Mus musculus
tccaacacaatagttacggaccttg

SEQ ID NO: 809905 - DNA, 25 bp, Mus musculus
tccaacacacacacagtgccatgtg

SEQ ID NO: 809906 - DNA, 25 bp, Mus musculus
tccaacacacacctttatcttacta

SEQ ID NO: 809907 - DNA, 25 bp, Mus musculus
tccaacacacacgtttatcttacta

SEQ ID NO: 809908 - DNA, 25 bp, Mus musculus
tccaacacacactcagtgccatgtg

SEQ ID NO: 809909 - DNA, 25 bp, Mus musculus
tccaacacaggacaaccggaccggg

SEQ ID NO: 809910 - DNA, 25 bp, Mus musculus
tccaacacaggagaaccggaccggg

SEQ ID NO: 809911 - DNA, 25 bp, Mus musculus
tccaacacccttagtttcagggtag

SEQ ID NO: 809912 - DNA, 25 bp, Mus musculus
tccaacaccctttgtttcagggtag

SEQ ID NO: 809913 - DNA, 25 bp, Mus musculus
tccaacacctgactccttgagctga

SEQ ID NO: 809914 - DNA, 25 bp, Mus musculus
tccaacacctgagtccttgagctga

SEQ ID NO: 809915 - DNA, 25 bp, Mus musculus
tccaacactgaaattgtctgtcctg

SEQ ID NO: 809916 - DNA, 25 bp, Mus musculus
tccaacactgaatttgtctgtcctg

SEQ ID NO: 809917 - DNA, 25 bp, Mus musculus
tccaacacttggaaggaatgtcgaa

SEQ ID NO: 809918 - DNA, 25 bp, Mus musculus
tccaacacttggtaggaatgtcgaa

SEQ ID NO: 809919 - DNA, 25 bp, Mus musculus
tccaacagaggaagctattcagcca

SEQ ID NO: 809920 - DNA, 25 bp, Mus musculus
tccaacagaggatgctattcagcca

SEQ ID NO: 809921 - DNA, 25 bp, Mus musculus
tccaacagccatccttaacgtaatt

SEQ ID NO: 809922 - DNA, 25 bp, Mus musculus
tccaacagccatgcttaacgtaatt

SEQ ID NO: 809923 - DNA, 25 bp, Mus musculus
tccaacaggcctactttcaatcgaa

SEQ ID NO: 809924 - DNA, 25 bp, Mus musculus
tccaacaggccttctttcaatcgaa

SEQ ID NO: 809925 - DNA, 25 bp, Mus musculus
tccaacagggacataccagaacggt

SEQ ID NO: 809926 - DNA, 25 bp, Mus musculus
tccaacagggacttaccagaacggt

SEQ ID NO: 809927 - DNA, 25 bp, Mus musculus
tccaacagggcaagagacaacatct

SEQ ID NO: 809928 - DNA, 25 bp, Mus musculus
tccaacagggcatgagacaacatct

SEQ ID NO: 809929 - DNA, 25 bp, Mus musculus
tccaacagtagaatgcggtgactat

SEQ ID NO: 809930 - DNA, 25 bp, Mus musculus
tccaacagtagattgcggtgactat

SEQ ID NO: 809931 - DNA, 25 bp, Mus musculus
tccaacatatatcctgctagattat

SEQ ID NO: 809932 - DNA, 25 bp, Mus musculus
tccaacatatatgctgctagattat

SEQ ID NO: 809933 - DNA, 25 bp, Mus musculus
tccaacatccacatatggtggttca

SEQ ID NO: 809934 - DNA, 25 bp, Mus musculus
tccaacatccacttatggtggttca

SEQ ID NO: 809935 - DNA, 25 bp, Mus musculus
tccaacatgaaacggtccataccaa

SEQ ID NO: 809936 - DNA, 25 bp, Mus musculus
tccaacatgaaagggtccataccaa

SEQ ID NO: 809937 - DNA, 25 bp, Mus musculus
tccaacatgagaccaaagcccacag

SEQ ID NO: 809938 - DNA, 25 bp, Mus musculus
tccaacatgagagcaaagcccacag

SEQ ID NO: 809939 - DNA, 25 bp, Mus musculus
tccaacatgccaatacctccaaata

SEQ ID NO: 809940 - DNA, 25 bp, Mus musculus
tccaacatgccattacctccaaata

SEQ ID NO: 809941 - DNA, 25 bp, Mus musculus
tccaacatggcgaccattgctgttg

SEQ ID NO: 809942 - DNA, 25 bp, Mus musculus
tccaacatggcgtccattgctgttg

SEQ ID NO: 809943 - DNA, 25 bp, Mus musculus
tccaacattggaatacaaggtctgt

SEQ ID NO: 809944 - DNA, 25 bp, Mus musculus
tccaacattggattacaaggtctgt

SEQ ID NO: 809945 - DNA, 25 bp, Mus musculus
tccaacattgtcacctgcaacattt

SEQ ID NO: 809946 - DNA, 25 bp, Mus musculus
tccaacattgtctcctgcaacattt

SEQ ID NO: 809947 - DNA, 25 bp, Mus musculus
tccaacatttacatttgtcgttgtt

SEQ ID NO: 809948 - DNA, 25 bp, Mus musculus
tccaacatttacttttgtcgttgtt

SEQ ID NO: 809949 - DNA, 25 bp, Mus musculus
tccaacatttcaactgtgtatgaat

SEQ ID NO: 809950 - DNA, 25 bp, Mus musculus
tccaacatttcatctgtgtatgaat

SEQ ID NO: 809951 - DNA, 25 bp, Mus musculus
tccaacatttggatgacgatgagtt

SEQ ID NO: 809952 - DNA, 25 bp, Mus musculus
tccaacatttggttgacgatgagtt

SEQ ID NO: 809953 - DNA, 25 bp, Mus musculus
tccaaccaagccacaaccaaataat

SEQ ID NO: 809954 - DNA, 25 bp, Mus musculus
tccaaccaagcctcaaccaaataat

SEQ ID NO: 809955 - DNA, 25 bp, Mus musculus
tccaaccacagccacataggatgag

SEQ ID NO: 809956 - DNA, 25 bp, Mus musculus
tccaaccacagcgacataggatgag

SEQ ID NO: 809957 - DNA, 25 bp, Mus musculus
tccaaccacccactttgcttgtttt

SEQ ID NO: 809958 - DNA, 25 bp, Mus musculus
tccaaccacccagtttgcttgtttt

SEQ ID NO: 809959 - DNA, 25 bp, Mus musculus
tccaaccactaaatcagctgtctgt

SEQ ID NO: 809960 - DNA, 25 bp, Mus musculus
tccaaccactaattcagctgtctgt

SEQ ID NO: 809961 - DNA, 25 bp, Mus musculus
tccaaccaggaaaccttcagagggt

SEQ ID NO: 809962 - DNA, 25 bp, Mus musculus
tccaaccaggaatccttcagagggt

SEQ ID NO: 809963 - DNA, 25 bp, Mus musculus
tccaacccatggacctcaggaatac

SEQ ID NO: 809964 - DNA, 25 bp, Mus musculus
tccaacccatggtcctcaggaatac

SEQ ID NO: 809965 - DNA, 25 bp, Mus musculus
tccaaccccagaccaggtagcttat

SEQ ID NO: 809966 - DNA, 25 bp, Mus musculus
tccaaccccagagcaggtagcttat

SEQ ID NO: 809967 - DNA, 25 bp, Mus musculus
tccaaccccgatcagattgagattg

SEQ ID NO: 809968 - DNA, 25 bp, Mus musculus
tccaaccccgatgagattgagattg

SEQ ID NO: 809969 - DNA, 25 bp, Mus musculus
tccaaccccgtgaggccaggcagtg

SEQ ID NO: 809970 - DNA, 25 bp, Mus musculus
tccaaccccgtgtggccaggcagtg

SEQ ID NO: 809971 - DNA, 25 bp, Mus musculus
tccaacccctccattatatttttgt

SEQ ID NO: 809972 - DNA, 25 bp, Mus musculus
tccaacccctcctttatatttttgt

SEQ ID NO: 809973 - DNA, 25 bp, Mus musculus
tccaacccttctaacatgaaccaga

SEQ ID NO: 809974 - DNA, 25 bp, Mus musculus
tccaacccttcttacatgaaccaga

SEQ ID NO: 809975 - DNA, 25 bp, Mus musculus
tccaaccgaggcaactgtgtcatca

SEQ ID NO: 809976 - DNA, 25 bp, Mus musculus
tccaaccgaggctactgtgtcatca

SEQ ID NO: 809977 - DNA, 25 bp, Mus musculus
tccaaccgatttactggggtcccag

SEQ ID NO: 809978 - DNA, 25 bp, Mus musculus
tccaaccgattttctggggtcccag

SEQ ID NO: 809979 - DNA, 25 bp, Mus musculus
tccaacctacttagaaagtctctag

SEQ ID NO: 809980 - DNA, 25 bp, Mus musculus
tccaacctactttgaaagtctctag

SEQ ID NO: 809981 - DNA, 25 bp, Mus musculus
tccaacctaggtcctccaaggtggg

SEQ ID NO: 809982 - DNA, 25 bp, Mus musculus
tccaacctaggtgctccaaggtggg

SEQ ID NO: 809983 - DNA, 25 bp, Mus musculus
tccaacctcatcagtgctgattatg

SEQ ID NO: 809984 - DNA, 25 bp, Mus musculus
tccaacctcatctgtgctgattatg

SEQ ID NO: 809985 - DNA, 25 bp, Mus musculus
tccaacctggaacggctgcttcaag

SEQ ID NO: 809986 - DNA, 25 bp, Mus musculus
tccaacctggaagggctgcttcaag

SEQ ID NO: 809987 - DNA, 25 bp, Mus musculus
tccaacctgtggcatgtcgtcagga

SEQ ID NO: 809988 - DNA, 25 bp, Mus musculus
tccaacctgtgggatgtcgtcagga

SEQ ID NO: 809989 - DNA, 25 bp, Mus musculus
tccaaccttggactgaaggatcgca

SEQ ID NO: 809990 - DNA, 25 bp, Mus musculus
tccaaccttggagtgaaggatcgca

SEQ ID NO: 809991 - DNA, 25 bp, Mus musculus
tccaacgactaacattacacctttt

SEQ ID NO: 809992 - DNA, 25 bp, Mus musculus
tccaacgactaagattacacctttt

SEQ ID NO: 809993 - DNA, 25 bp, Mus musculus
tccaacgtatcccaccaaatatttt

SEQ ID NO: 809994 - DNA, 25 bp, Mus musculus
tccaacgtatccgaccaaatatttt

SEQ ID NO: 809995 - DNA, 25 bp, Mus musculus
tccaacgtcgaactctacatgcaat

SEQ ID NO: 809996 - DNA, 25 bp, Mus musculus
tccaacgtcgaagtctacatgcaat

SEQ ID NO: 809997 - DNA, 25 bp, Mus musculus
tccaacgtgttgcatgctgggagtt

SEQ ID NO: 809998 - DNA, 25 bp, Mus musculus
tccaacgtgttggatgctgggagtt

SEQ ID NO: 809999 - DNA, 25 bp, Mus musculus
tccaactatccgctgcctaggaaac

SEQ ID NO: 810000 - DNA, 25 bp, Mus musculus
tccaactatccggtgcctaggaaac

SEQ ID NO: 810001 - DNA, 25 bp, Mus musculus
tccaactcaagcaggttccgggaga

SEQ ID NO: 810002 - DNA, 25 bp, Mus musculus
tccaactcaagctggttccgggaga

SEQ ID NO: 810003 - DNA, 25 bp, Mus musculus
tccaactcccctatcaagtgtgaga

SEQ ID NO: 810004 - DNA, 25 bp, Mus musculus
tccaactcccctttcaagtgtgaga

SEQ ID NO: 810005 - DNA, 25 bp, Mus musculus
tccaactccgatccagattcttcaa

SEQ ID NO: 810006 - DNA, 25 bp, Mus musculus
tccaactccgatgcagattcttcaa

SEQ ID NO: 810007 - DNA, 25 bp, Mus musculus
tccaactccttcagcttcaaaatta

SEQ ID NO: 810008 - DNA, 25 bp, Mus musculus
tccaactccttctgcttcaaaatta

SEQ ID NO: 810009 - DNA, 25 bp, Mus musculus
tccaactgatctctttccacatgga

SEQ ID NO: 810010 - DNA, 25 bp, Mus musculus
tccaactgatctgtttccacatgga

SEQ ID NO: 810011 - DNA, 25 bp, Mus musculus
tccaactgccctacatatatcatga

SEQ ID NO: 810012 - DNA, 25 bp, Mus musculus
tccaactgcccttcatatatcatga

SEQ ID NO: 810013 - DNA, 25 bp, Mus musculus
tccaactgctggaggcctgggttat

SEQ ID NO: 810014 - DNA, 25 bp, Mus musculus
tccaactgctggtggcctgggttat

SEQ ID NO: 810015 - DNA, 25 bp, Mus musculus
tccaactgttccattgtgttctata

SEQ ID NO: 810016 - DNA, 25 bp, Mus musculus
tccaactgttcctttgtgttctata

SEQ ID NO: 810017 - DNA, 25 bp, Mus musculus
tccaacttaaccacagtaatgtagt

SEQ ID NO: 810018 - DNA, 25 bp, Mus musculus
tccaacttaacctcagtaatgtagt

SEQ ID NO: 810019 - DNA, 25 bp, Mus musculus
tccaacttccggagcttccagggac

SEQ ID NO: 810020 - DNA, 25 bp, Mus musculus
tccaacttccggtgcttccagggac

SEQ ID NO: 810021 - DNA, 25 bp, Mus musculus
tccaacttcctgaaacccagctatt

SEQ ID NO: 810022 - DNA, 25 bp, Mus musculus
tccaacttcctgtaacccagctatt

SEQ ID NO: 810023 - DNA, 25 bp, Mus musculus
tccaacttcggactgctgaggttaa

SEQ ID NO: 810024 - DNA, 25 bp, Mus musculus
tccaacttcggagtgctgaggttaa

SEQ ID NO: 810025 - DNA, 25 bp, Mus musculus
tccaacttgtcactgctacttttag

SEQ ID NO: 810026 - DNA, 25 bp, Mus musculus
tccaacttgtcagtgctacttttag

SEQ ID NO: 810027 - DNA, 25 bp, Mus musculus
tccaactttgagacttatccagaga

SEQ ID NO: 810028 - DNA, 25 bp, Mus musculus
tccaactttgagtcttatccagaga

SEQ ID NO: 810029 - DNA, 25 bp, Mus musculus
tccaacttttccccgagtggtgtga

SEQ ID NO: 810030 - DNA, 25 bp, Mus musculus
tccaacttttccgcgagtggtgtga

SEQ ID NO: 810031 - DNA, 25 bp, Mus musculus
tccaagaaaacacacttcccgggtg

SEQ ID NO: 810032 - DNA, 25 bp, Mus musculus
tccaagaaaacagacttcccgggtg

SEQ ID NO: 810033 - DNA, 25 bp, Mus musculus
tccaagaaagcgcttcactcgacag

SEQ ID NO: 810034 - DNA, 25 bp, Mus musculus
tccaagaaagcggttcactcgacag

SEQ ID NO: 810035 - DNA, 25 bp, Mus musculus
tccaagaaggtgaagctttgttcca

SEQ ID NO: 810036 - DNA, 25 bp, Mus musculus
tccaagaaggtgtagctttgttcca

SEQ ID NO: 810037 - DNA, 25 bp, Mus musculus
tccaagaatggacccatcaggtctt

SEQ ID NO: 810038 - DNA, 25 bp, Mus musculus
tccaagaatggagccatcaggtctt

SEQ ID NO: 810039 - DNA, 25 bp, Mus musculus
tccaagacactcacgaggatattgc

SEQ ID NO: 810040 - DNA, 25 bp, Mus musculus
tccaagacactctcgaggatattgc

SEQ ID NO: 810041 - DNA, 25 bp, Mus musculus
tccaagagccctctgacattttctg

SEQ ID NO: 810042 - DNA, 25 bp, Mus musculus
tccaagagccctgtgacattttctg

SEQ ID NO: 810043 - DNA, 25 bp, Mus musculus
tccaagagggacacctccagttggc

SEQ ID NO: 810044 - DNA, 25 bp, Mus musculus
tccaagagggactcctccagttggc

SEQ ID NO: 810045 - DNA, 25 bp, Mus musculus
tccaagatgcggcttcctgctgaga

SEQ ID NO: 810046 - DNA, 25 bp, Mus musculus
tccaagatgcgggttcctgctgaga

SEQ ID NO: 810047 - DNA, 25 bp, Mus musculus
tccaagattcttcctcattaacaaa

SEQ ID NO: 810048 - DNA, 25 bp, Mus musculus
tccaagattcttgctcattaacaaa

SEQ ID NO: 810049 - DNA, 25 bp, Mus musculus
tccaagattttgagggaattgttgc

SEQ ID NO: 810050 - DNA, 25 bp, Mus musculus
tccaagattttgtgggaattgttgc

SEQ ID NO: 810051 - DNA, 25 bp, Mus musculus
tccaagcaacagcacacttgacgtg

SEQ ID NO: 810052 - DNA, 25 bp, Mus musculus
tccaagcaacaggacacttgacgtg

SEQ ID NO: 810053 - DNA, 25 bp, Mus musculus
tccaagcaagtgagtcgtcatctaa

SEQ ID NO: 810054 - DNA, 25 bp, Mus musculus
tccaagcaagtgtgtcgtcatctaa

SEQ ID NO: 810055 - DNA, 25 bp, Mus musculus
tccaagcacccaagcgatggagaca

SEQ ID NO: 810056 - DNA, 25 bp, Mus musculus
tccaagcacccatgcgatggagaca

SEQ ID NO: 810057 - DNA, 25 bp, Mus musculus
tccaagcacgacacacaggtttgaa

SEQ ID NO: 810058 - DNA, 25 bp, Mus musculus
tccaagcacgactcacaggtttgaa

SEQ ID NO: 810059 - DNA, 25 bp, Mus musculus
tccaagcacggactcttctgtcctt

SEQ ID NO: 810060 - DNA, 25 bp, Mus musculus
tccaagcacggagtcttctgtcctt

SEQ ID NO: 810061 - DNA, 25 bp, Mus musculus
tccaagcagggcagggtcgaagatt

SEQ ID NO: 810062 - DNA, 25 bp, Mus musculus
tccaagcagggctgggtcgaagatt

SEQ ID NO: 810063 - DNA, 25 bp, Mus musculus
tccaagcagggtcccggtctgcagt

SEQ ID NO: 810064 - DNA, 25 bp, Mus musculus
tccaagcagggtgccggtctgcagt

SEQ ID NO: 810065 - DNA, 25 bp, Mus musculus
tccaagcagtgacatcacgcagtta

SEQ ID NO: 810066 - DNA, 25 bp, Mus musculus
tccaagcagtgagatcacgcagtta

SEQ ID NO: 810067 - DNA, 25 bp, Mus musculus
tccaagccacttaaggtccttttgt

SEQ ID NO: 810068 - DNA, 25 bp, Mus musculus
tccaagccactttaggtccttttgt

SEQ ID NO: 810069 - DNA, 25 bp, Mus musculus
tccaagccagagacacagcctgggt

SEQ ID NO: 810070 - DNA, 25 bp, Mus musculus
tccaagccagagtcacagcctgggt

SEQ ID NO: 810071 - DNA, 25 bp, Mus musculus
tccaagccagggacagctgcagaag

SEQ ID NO: 810072 - DNA, 25 bp, Mus musculus
tccaagccagggtcagctgcagaag

SEQ ID NO: 810073 - DNA, 25 bp, Mus musculus
tccaagccatccaggtctatacagt

SEQ ID NO: 810074 - DNA, 25 bp, Mus musculus
tccaagccatcctggtctatacagt

SEQ ID NO: 810075 - DNA, 25 bp, Mus musculus
tccaagcctgcacttcaatactttt

SEQ ID NO: 810076 - DNA, 25 bp, Mus musculus
tccaagcctgcagttcaatactttt

SEQ ID NO: 810077 - DNA, 25 bp, Mus musculus
tccaagcctgctaggcttccgtagc

SEQ ID NO: 810078 - DNA, 25 bp, Mus musculus
tccaagcctgcttggcttccgtagc

SEQ ID NO: 810079 - DNA, 25 bp, Mus musculus
tccaagcctggactgaattagtaat

SEQ ID NO: 810080 - DNA, 25 bp, Mus musculus
tccaagcctggagtgaattagtaat

SEQ ID NO: 810081 - DNA, 25 bp, Mus musculus
tccaagcctggcaactatgacggtg

SEQ ID NO: 810082 - DNA, 25 bp, Mus musculus
tccaagcctggctactatgacggtg

SEQ ID NO: 810083 - DNA, 25 bp, Mus musculus
tccaagccttaaaccactgtgttag

SEQ ID NO: 810084 - DNA, 25 bp, Mus musculus
tccaagccttaatccactgtgttag

SEQ ID NO: 810085 - DNA, 25 bp, Mus musculus
tccaagcgaggaagacgactcacct

SEQ ID NO: 810086 - DNA, 25 bp, Mus musculus
tccaagcgaggatgacgactcacct

SEQ ID NO: 810087 - DNA, 25 bp, Mus musculus
tccaagctcctgcagccggacatgt

SEQ ID NO: 810088 - DNA, 25 bp, Mus musculus
tccaagctcctggagccggacatgt

SEQ ID NO: 810089 - DNA, 25 bp, Mus musculus
tccaagctgccccaaatgaaaggag

SEQ ID NO: 810090 - DNA, 25 bp, Mus musculus
tccaagctgcccgaaatgaaaggag

SEQ ID NO: 810091 - DNA, 25 bp, Mus musculus
tccaagctgctgaggcttttgtgga

SEQ ID NO: 810092 - DNA, 25 bp, Mus musculus
tccaagctgctgatgaataaaaccc

SEQ ID NO: 810093 - DNA, 25 bp, Mus musculus
tccaagctgctgtggcttttgtgga

SEQ ID NO: 810094 - DNA, 25 bp, Mus musculus
tccaagctgctgttgaataaaaccc

SEQ ID NO: 810095 - DNA, 25 bp, Mus musculus
tccaagctggccaggcattctggat

SEQ ID NO: 810096 - DNA, 25 bp, Mus musculus
tccaagctggcctggcattctggat

SEQ ID NO: 810097 - DNA, 25 bp, Mus musculus
tccaaggaaccacaatgcacactaa

SEQ ID NO: 810098 - DNA, 25 bp, Mus musculus
tccaaggaaccagaatgcacactaa

SEQ ID NO: 810099 - DNA, 25 bp, Mus musculus
tccaaggacactcggatcatttacc

SEQ ID NO: 810100 - DNA, 25 bp, Mus musculus
tccaaggacactgggatcatttacc

SEQ ID NO: 810101 - DNA, 25 bp, Mus musculus
tccaaggacctgattaagggctttg

SEQ ID NO: 810102 - DNA, 25 bp, Mus musculus
tccaaggacctgtttaagggctttg

SEQ ID NO: 810103 - DNA, 25 bp, Mus musculus
tccaaggactctatgcacagtacaa

SEQ ID NO: 810104 - DNA, 25 bp, Mus musculus
tccaaggactctttgcacagtacaa

SEQ ID NO: 810105 - DNA, 25 bp, Mus musculus
tccaaggacttgcacctttatcctt

SEQ ID NO: 810106 - DNA, 25 bp, Mus musculus
tccaaggacttggacctttatcctt

SEQ ID NO: 810107 - DNA, 25 bp, Mus musculus
tccaaggagcctccagtcctcatgg

SEQ ID NO: 810108 - DNA, 25 bp, Mus musculus
tccaaggagcctgcagtcctcatgg

SEQ ID NO: 810109 - DNA, 25 bp, Mus musculus
tccaaggaggacattaaaccaatct

SEQ ID NO: 810110 - DNA, 25 bp, Mus musculus
tccaaggaggactttaaaccaatct

SEQ ID NO: 810111 - DNA, 25 bp, Mus musculus
tccaaggataaactttcactctcag

SEQ ID NO: 810112 - DNA, 25 bp, Mus musculus
tccaaggataaagtttcactctcag

SEQ ID NO: 810113 - DNA, 25 bp, Mus musculus
tccaaggatatcaccaactggcaga

SEQ ID NO: 810114 - DNA, 25 bp, Mus musculus
tccaaggatatctccaactggcaga

SEQ ID NO: 810115 - DNA, 25 bp, Mus musculus
tccaaggatccaactcagcttggct

SEQ ID NO: 810116 - DNA, 25 bp, Mus musculus
tccaaggatccatctcagcttggct

SEQ ID NO: 810117 - DNA, 25 bp, Mus musculus
tccaaggatggaacttcaggtctcc

SEQ ID NO: 810118 - DNA, 25 bp, Mus musculus
tccaaggatggatcttcaggtctcc

SEQ ID NO: 810119 - DNA, 25 bp, Mus musculus
tccaaggcacccagctttatgattg

SEQ ID NO: 810120 - DNA, 25 bp, Mus musculus
tccaaggcaccctgctttatgattg

SEQ ID NO: 810121 - DNA, 25 bp, Mus musculus
tccaaggcatggagtgctgtgcata

SEQ ID NO: 810122 - DNA, 25 bp, Mus musculus
tccaaggcatggtgtgctgtgcata

SEQ ID NO: 810123 - DNA, 25 bp, Mus musculus
tccaaggccaagcattggtctgggt

SEQ ID NO: 810124 - DNA, 25 bp, Mus musculus
tccaaggccaaggattggtctgggt

SEQ ID NO: 810125 - DNA, 25 bp, Mus musculus
tccaaggccaatattatggtggtct

SEQ ID NO: 810126 - DNA, 25 bp, Mus musculus
tccaaggccaattttatggtggtct

SEQ ID NO: 810127 - DNA, 25 bp, Mus musculus
tccaaggccagtataaatttcgttt

SEQ ID NO: 810128 - DNA, 25 bp, Mus musculus
tccaaggccagtttaaatttcgttt

SEQ ID NO: 810129 - DNA, 25 bp, Mus musculus
tccaaggcgatccagagaatcccgg

SEQ ID NO: 810130 - DNA, 25 bp, Mus musculus
tccaaggcgatcgagagaatcccgg

SEQ ID NO: 810131 - DNA, 25 bp, Mus musculus
tccaaggcgcccaggcaggacctgg

SEQ ID NO: 810132 - DNA, 25 bp, Mus musculus
tccaaggcgccctggcaggacctgg

SEQ ID NO: 810133 - DNA, 25 bp, Mus musculus
tccaaggcttcaaggctctgcaagg

SEQ ID NO: 810134 - DNA, 25 bp, Mus musculus
tccaaggcttcatggctctgcaagg

SEQ ID NO: 810135 - DNA, 25 bp, Mus musculus
tccaagggacgaccgtggttttgtt

SEQ ID NO: 810136 - DNA, 25 bp, Mus musculus
tccaagggacgagcgtggttttgtt

SEQ ID NO: 810137 - DNA, 25 bp, Mus musculus
tccaagggagaacccttcttccttt

SEQ ID NO: 810138 - DNA, 25 bp, Mus musculus
tccaagggagaagccttcttccttt

SEQ ID NO: 810139 - DNA, 25 bp, Mus musculus
tccaagggcaggactatgcttctgg

SEQ ID NO: 810140 - DNA, 25 bp, Mus musculus
tccaagggcaggtctatgcttctgg

SEQ ID NO: 810141 - DNA, 25 bp, Mus musculus
tccaaggtcccgaacaacaaggaat

SEQ ID NO: 810142 - DNA, 25 bp, Mus musculus
tccaaggtcccgtacaacaaggaat

SEQ ID NO: 810143 - DNA, 25 bp, Mus musculus
tccaaggtctttagtacttactaag

SEQ ID NO: 810144 - DNA, 25 bp, Mus musculus
tccaaggtcttttgtacttactaag

SEQ ID NO: 810145 - DNA, 25 bp, Mus musculus
tccaaggtgcccagcccggaggcag

SEQ ID NO: 810146 - DNA, 25 bp, Mus musculus
tccaaggtgccctgcccggaggcag

SEQ ID NO: 810147 - DNA, 25 bp, Mus musculus
tccaaggtgctacgctaagggtttt

SEQ ID NO: 810148 - DNA, 25 bp, Mus musculus
tccaaggtgctaggctaagggtttt

SEQ ID NO: 810149 - DNA, 25 bp, Mus musculus
tccaaggtggatctcggaagcacgt

SEQ ID NO: 810150 - DNA, 25 bp, Mus musculus
tccaaggtggatgtcggaagcacgt

SEQ ID NO: 810151 - DNA, 25 bp, Mus musculus
tccaaggttaccaggttacgatgaa

SEQ ID NO: 810152 - DNA, 25 bp, Mus musculus
tccaaggttacctggttacgatgaa

SEQ ID NO: 810153 - DNA, 25 bp, Mus musculus
tccaaggttctcagggtcctgggtg

SEQ ID NO: 810154 - DNA, 25 bp, Mus musculus
tccaaggttctctgggtcctgggtg

SEQ ID NO: 810155 - DNA, 25 bp, Mus musculus
tccaagtaaataaacctggaaattg

SEQ ID NO: 810156 - DNA, 25 bp, Mus musculus
tccaagtaaatatacctggaaattg

SEQ ID NO: 810157 - DNA, 25 bp, Mus musculus
tccaagtacaacatggctagtatgc

SEQ ID NO: 810158 - DNA, 25 bp, Mus musculus
tccaagtacaacttggctagtatgc

SEQ ID NO: 810159 - DNA, 25 bp, Mus musculus
tccaagtacactatgagggcccgac

SEQ ID NO: 810160 - DNA, 25 bp, Mus musculus
tccaagtacactttgagggcccgac

SEQ ID NO: 810161 - DNA, 25 bp, Mus musculus
tccaagtaccggcaccgctgcaagg

SEQ ID NO: 810162 - DNA, 25 bp, Mus musculus
tccaagtaccgggaccgctgcaagg

SEQ ID NO: 810163 - DNA, 25 bp, Mus musculus
tccaagtacgatatagcctggcctt

SEQ ID NO: 810164 - DNA, 25 bp, Mus musculus
tccaagtacgatttagcctggcctt

SEQ ID NO: 810165 - DNA, 25 bp, Mus musculus
tccaagtactgaagcctgttagaat

SEQ ID NO: 810166 - DNA, 25 bp, Mus musculus
tccaagtactgatgcctgttagaat

SEQ ID NO: 810167 - DNA, 25 bp, Mus musculus
tccaagtcacagctcaagtactgat

SEQ ID NO: 810168 - DNA, 25 bp, Mus musculus
tccaagtcacaggtcaagtactgat

SEQ ID NO: 810169 - DNA, 25 bp, Mus musculus
tccaagtcatttacctacttatttt

SEQ ID NO: 810170 - DNA, 25 bp, Mus musculus
tccaagtcattttcctacttatttt

SEQ ID NO: 810171 - DNA, 25 bp, Mus musculus
tccaagtccaagagggtaccttcag

SEQ ID NO: 810172 - DNA, 25 bp, Mus musculus
tccaagtccaagtgggtaccttcag

SEQ ID NO: 810173 - DNA, 25 bp, Mus musculus
tccaagtcccctctgacatgtacag

SEQ ID NO: 810174 - DNA, 25 bp, Mus musculus
tccaagtcccctgtgacatgtacag

SEQ ID NO: 810175 - DNA, 25 bp, Mus musculus
tccaagtctgaacagcatcatttgt

SEQ ID NO: 810176 - DNA, 25 bp, Mus musculus
tccaagtctgaagagcatcatttgt

SEQ ID NO: 810177 - DNA, 25 bp, Mus musculus
tccaagtgagcgaactcggcgggcc

SEQ ID NO: 810178 - DNA, 25 bp, Mus musculus
tccaagtgagcgtactcggcgggcc

SEQ ID NO: 810179 - DNA, 25 bp, Mus musculus
tccaagtgatggctaagcaggcaaa

SEQ ID NO: 810180 - DNA, 25 bp, Mus musculus
tccaagtgatgggtaagcaggcaaa

SEQ ID NO: 810181 - DNA, 25 bp, Mus musculus
tccaagtgtatgagcatgtgccagc

SEQ ID NO: 810182 - DNA, 25 bp, Mus musculus
tccaagtgtatgtgcatgtgccagc

SEQ ID NO: 810183 - DNA, 25 bp, Mus musculus
tccaagtgtgatatgcatttttacc

SEQ ID NO: 810184 - DNA, 25 bp, Mus musculus
tccaagtgtgatttgcatttttacc

SEQ ID NO: 810185 - DNA, 25 bp, Mus musculus
tccaagtgtggcacgttagggaaca

SEQ ID NO: 810186 - DNA, 25 bp, Mus musculus
tccaagtgtggctcgttagggaaca

SEQ ID NO: 810187 - DNA, 25 bp, Mus musculus
tccaagtgtggtcggtcctatgttt

SEQ ID NO: 810188 - DNA, 25 bp, Mus musculus
tccaagtgtggtgggtcctatgttt

SEQ ID NO: 810189 - DNA, 25 bp, Mus musculus
tccaagttacatatactgcagactt

SEQ ID NO: 810190 - DNA, 25 bp, Mus musculus
tccaagttacatttactgcagactt

SEQ ID NO: 810191 - DNA, 25 bp, Mus musculus
tccaagttcaaacgtcctctaaagc

SEQ ID NO: 810192 - DNA, 25 bp, Mus musculus
tccaagttcaaaggtcctctaaagc

SEQ ID NO: 810193 - DNA, 25 bp, Mus musculus
tccaagttcctgctaaagaggccca

SEQ ID NO: 810194 - DNA, 25 bp, Mus musculus
tccaagttcctggtaaagaggccca

SEQ ID NO: 810195 - DNA, 25 bp, Mus musculus
tccaagttctgaaaacaaggtatct

SEQ ID NO: 810196 - DNA, 25 bp, Mus musculus
tccaagttctgataacaaggtatct

SEQ ID NO: 810197 - DNA, 25 bp, Mus musculus
tccaagttctggagcatgcgctgta

SEQ ID NO: 810198 - DNA, 25 bp, Mus musculus
tccaagttctggtgcatgcgctgta

SEQ ID NO: 810199 - DNA, 25 bp, Mus musculus
tccaagttgaggagcatgtgtagcc

SEQ ID NO: 810200 - DNA, 25 bp, Mus musculus
tccaagttgaggtgcatgtgtagcc

SEQ ID NO: 810201 - DNA, 25 bp, Mus musculus
tccaagttggccaaaccctaattct

SEQ ID NO: 810202 - DNA, 25 bp, Mus musculus
tccaagttggcctaaccctaattct

SEQ ID NO: 810203 - DNA, 25 bp, Mus musculus
tccaagttggtaacttatgctctca

SEQ ID NO: 810204 - DNA, 25 bp, Mus musculus
tccaagttggtatcttatgctctca

SEQ ID NO: 810205 - DNA, 25 bp, Mus musculus
tccaagtttggaaatacacaagaaa

SEQ ID NO: 810206 - DNA, 25 bp, Mus musculus
tccaagtttggatatacacaagaaa

SEQ ID NO: 810207 - DNA, 25 bp, Mus musculus
tccaagttttggaagagccacaaga

SEQ ID NO: 810208 - DNA, 25 bp, Mus musculus
tccaagttttggtagagccacaaga

SEQ ID NO: 810209 - DNA, 25 bp, Mus musculus
tccaataaaagtacacagagtgatg

SEQ ID NO: 810210 - DNA, 25 bp, Mus musculus
tccaataaaagttcacagagtgatg

SEQ ID NO: 810211 - DNA, 25 bp, Mus musculus
tccaataacaaaaagccactccctg

SEQ ID NO: 810212 - DNA, 25 bp, Mus musculus
tccaataacaaatagccactccctg

SEQ ID NO: 810213 - DNA, 25 bp, Mus musculus
tccaataggagaaaaccagggtgac

SEQ ID NO: 810214 - DNA, 25 bp, Mus musculus
tccaataggagataaccagggtgac

SEQ ID NO: 810215 - DNA, 25 bp, Mus musculus
tccaataggcatccttctctaacac

SEQ ID NO: 810216 - DNA, 25 bp, Mus musculus
tccaataggcatgcttctctaacac

SEQ ID NO: 810217 - DNA, 25 bp, Mus musculus
tccaatagggaacctggagcactgg

SEQ ID NO: 810218 - DNA, 25 bp, Mus musculus
tccaatagggaagctggagcactgg

SEQ ID NO: 810219 - DNA, 25 bp, Mus musculus
tccaataggttccatctctgggtat

SEQ ID NO: 810220 - DNA, 25 bp, Mus musculus
tccaataggttcgatctctgggtat

SEQ ID NO: 810221 - DNA, 25 bp, Mus musculus
tccaatatctatcaatggcacatgt

SEQ ID NO: 810222 - DNA, 25 bp, Mus musculus
tccaatatctatgaatggcacatgt

SEQ ID NO: 810223 - DNA, 25 bp, Mus musculus
tccaatcagaaaaggcggagcccag

SEQ ID NO: 810224 - DNA, 25 bp, Mus musculus
tccaatcagaaatggcggagcccag

SEQ ID NO: 810225 - DNA, 25 bp, Mus musculus
tccaatccagaacttcctgccagaa

SEQ ID NO: 810226 - DNA, 25 bp, Mus musculus
tccaatccagaagttcctgccagaa

SEQ ID NO: 810227 - DNA, 25 bp, Mus musculus
tccaatcccaagagcccatggtgta

SEQ ID NO: 810228 - DNA, 25 bp, Mus musculus
tccaatcccaagtgcccatggtgta

SEQ ID NO: 810229 - DNA, 25 bp, Mus musculus
tccaatcccacccttgctgagtgac

SEQ ID NO: 810230 - DNA, 25 bp, Mus musculus
tccaatcccaccgttgctgagtgac

SEQ ID NO: 810231 - DNA, 25 bp, Mus musculus
tccaatccccagcaggcgaagtaga

SEQ ID NO: 810232 - DNA, 25 bp, Mus musculus
tccaatccccaggaggcgaagtaga

SEQ ID NO: 810233 - DNA, 25 bp, Mus musculus
tccaatccgttgaagaatttatact

SEQ ID NO: 810234 - DNA, 25 bp, Mus musculus
tccaatccgttgtagaatttatact

SEQ ID NO: 810235 - DNA, 25 bp, Mus musculus
tccaatctaggcatctgtgtacctg

SEQ ID NO: 810236 - DNA, 25 bp, Mus musculus
tccaatctaggcttctgtgtacctg

SEQ ID NO: 810237 - DNA, 25 bp, Mus musculus
tccaatctatttagcttctcgatcc

SEQ ID NO: 810238 - DNA, 25 bp, Mus musculus
tccaatctattttgcttctcgatcc

SEQ ID NO: 810239 - DNA, 25 bp, Mus musculus
tccaatctctggaagcaccgcaaga

SEQ ID NO: 810240 - DNA, 25 bp, Mus musculus
tccaatctctggtagcaccgcaaga

SEQ ID NO: 810241 - DNA, 25 bp, Mus musculus
tccaatcttgttcttcacggtgaca

SEQ ID NO: 810242 - DNA, 25 bp, Mus musculus
tccaatcttgttgttcacggtgaca

SEQ ID NO: 810243 - DNA, 25 bp, Mus musculus
tccaatctttcccacctatcctttt

SEQ ID NO: 810244 - DNA, 25 bp, Mus musculus
tccaatctttccgacctatcctttt

SEQ ID NO: 810245 - DNA, 25 bp, Mus musculus
tccaatgaccctagggccaccaaat

SEQ ID NO: 810246 - DNA, 25 bp, Mus musculus
tccaatgaccctctgcttgtagagt

SEQ ID NO: 810247 - DNA, 25 bp, Mus musculus
tccaatgaccctgtgcttgtagagt

SEQ ID NO: 810248 - DNA, 25 bp, Mus musculus
tccaatgacccttgggccaccaaat

SEQ ID NO: 810249 - DNA, 25 bp, Mus musculus
tccaatgcagccagtggcatctcta

SEQ ID NO: 810250 - DNA, 25 bp, Mus musculus
tccaatgcagcctgtggcatctcta

SEQ ID NO: 810251 - DNA, 25 bp, Mus musculus
tccaatgcggaaaagacaggcccgt

SEQ ID NO: 810252 - DNA, 25 bp, Mus musculus
tccaatgcggaatagacaggcccgt

SEQ ID NO: 810253 - DNA, 25 bp, Mus musculus
tccaatgctcttagaaattaggtaa

SEQ ID NO: 810254 - DNA, 25 bp, Mus musculus
tccaatgctctttgaaattaggtaa

SEQ ID NO: 810255 - DNA, 25 bp, Mus musculus
tccaatgctgagatggcccatagtt

SEQ ID NO: 810256 - DNA, 25 bp, Mus musculus
tccaatgctgagttggcccatagtt

SEQ ID NO: 810257 - DNA, 25 bp, Mus musculus
tccaatgctgataccctttcgaata

SEQ ID NO: 810258 - DNA, 25 bp, Mus musculus
tccaatgctgattccctttcgaata

SEQ ID NO: 810259 - DNA, 25 bp, Mus musculus
tccaatggacggctctcagagcagt

SEQ ID NO: 810260 - DNA, 25 bp, Mus musculus
tccaatggacgggtctcagagcagt

SEQ ID NO: 810261 - DNA, 25 bp, Mus musculus
tccaatggctttatgctaagaccga

SEQ ID NO: 810262 - DNA, 25 bp, Mus musculus
tccaatggctttcaacagaagcgct

SEQ ID NO: 810263 - DNA, 25 bp, Mus musculus
tccaatggctttgaacagaagcgct

SEQ ID NO: 810264 - DNA, 25 bp, Mus musculus
tccaatggctttttgctaagaccga

SEQ ID NO: 810265 - DNA, 25 bp, Mus musculus
tccaatgtaatacccgtcttctgta

SEQ ID NO: 810266 - DNA, 25 bp, Mus musculus
tccaatgtaatagccgtcttctgta

SEQ ID NO: 810267 - DNA, 25 bp, Mus musculus
tccaatgtctggctcaggcatagtg

SEQ ID NO: 810268 - DNA, 25 bp, Mus musculus
tccaatgtctgggtcaggcatagtg

SEQ ID NO: 810269 - DNA, 25 bp, Mus musculus
tccaatgtgtttccagcccgtggtg

SEQ ID NO: 810270 - DNA, 25 bp, Mus musculus
tccaatgtgtttgcagcccgtggtg

SEQ ID NO: 810271 - DNA, 25 bp, Mus musculus
tccaattcatggatttagccccgtg

SEQ ID NO: 810272 - DNA, 25 bp, Mus musculus
tccaattcatggttttagccccgtg

SEQ ID NO: 810273 - DNA, 25 bp, Mus musculus
tccaattcccacataggtcaatcct

SEQ ID NO: 810274 - DNA, 25 bp, Mus musculus
tccaattcccacttaggtcaatcct

SEQ ID NO: 810275 - DNA, 25 bp, Mus musculus
tccaattcgtgtaagttattagtta

SEQ ID NO: 810276 - DNA, 25 bp, Mus musculus
tccaattcgtgttagttattagtta

SEQ ID NO: 810277 - DNA, 25 bp, Mus musculus
tccaattgaagcctgtcattttgtc

SEQ ID NO: 810278 - DNA, 25 bp, Mus musculus
tccaattgaagcgtgtcattttgtc

SEQ ID NO: 810279 - DNA, 25 bp, Mus musculus
tccaattgagtgcagtaagacccga

SEQ ID NO: 810280 - DNA, 25 bp, Mus musculus
tccaattgagtggagtaagacccga

SEQ ID NO: 810281 - DNA, 25 bp, Mus musculus
tccaattggcccagtggtcccacag

SEQ ID NO: 810282 - DNA, 25 bp, Mus musculus
tccaattggccctgtggtcccacag

SEQ ID NO: 810283 - DNA, 25 bp, Mus musculus
tccaattggcctatgaggcagaact

SEQ ID NO: 810284 - DNA, 25 bp, Mus musculus
tccaattggcctttgaggcagaact

SEQ ID NO: 810285 - DNA, 25 bp, Mus musculus
tccaattggcggctcggagatgaca

SEQ ID NO: 810286 - DNA, 25 bp, Mus musculus
tccaattggcgggtcggagatgaca

SEQ ID NO: 810287 - DNA, 25 bp, Mus musculus
tccaattgtaccaaacagttctgtt

SEQ ID NO: 810288 - DNA, 25 bp, Mus musculus
tccaattgtacctaacagttctgtt

SEQ ID NO: 810289 - DNA, 25 bp, Mus musculus
tccaatttcattcaccttctgtatg

SEQ ID NO: 810290 - DNA, 25 bp, Mus musculus
tccaatttcattgaccttctgtatg

SEQ ID NO: 810291 - DNA, 25 bp, Mus musculus
tccaatttctctcaccattctagtg

SEQ ID NO: 810292 - DNA, 25 bp, Mus musculus
tccaatttctctgaccattctagtg

SEQ ID NO: 810293 - DNA, 25 bp, Mus musculus
tccaatttgcccaattctgccttac

SEQ ID NO: 810294 - DNA, 25 bp, Mus musculus
tccaatttgccctattctgccttac

SEQ ID NO: 810295 - DNA, 25 bp, Mus musculus
tccaatttggttacacccaactcaa

SEQ ID NO: 810296 - DNA, 25 bp, Mus musculus
tccaatttggtttcacccaactcaa

SEQ ID NO: 810297 - DNA, 25 bp, Mus musculus
tccaatttgtttagtctcctaccac

SEQ ID NO: 810298 - DNA, 25 bp, Mus musculus
tccaatttgttttgtctcctaccac

SEQ ID NO: 810299 - DNA, 25 bp, Mus musculus
tccaatttttgtatcttttctcagg

SEQ ID NO: 810300 - DNA, 25 bp, Mus musculus
tccaatttttgtttcttttctcagg

SEQ ID NO: 810301 - DNA, 25 bp, Mus musculus
tccacaaaacccaaaccagcttgtt

SEQ ID NO: 810302 - DNA, 25 bp, Mus musculus
tccacaaaaccctaaccagcttgtt

SEQ ID NO: 810303 - DNA, 25 bp, Mus musculus
tccacaaactggacacctgcagtac

SEQ ID NO: 810304 - DNA, 25 bp, Mus musculus
tccacaaactggtcacctgcagtac

SEQ ID NO: 810305 - DNA, 25 bp, Mus musculus
tccacaaactgtcctgcatgtgtgc

SEQ ID NO: 810306 - DNA, 25 bp, Mus musculus
tccacaaactgtgctgcatgtgtgc

SEQ ID NO: 810307 - DNA, 25 bp, Mus musculus
tccacaaacttcctggcatttcttt

SEQ ID NO: 810308 - DNA, 25 bp, Mus musculus
tccacaaacttcgtggcatttcttt

SEQ ID NO: 810309 - DNA, 25 bp, Mus musculus
tccacaaagtggacactggcaccat

SEQ ID NO: 810310 - DNA, 25 bp, Mus musculus
tccacaaagtggtcactggcaccat

SEQ ID NO: 810311 - DNA, 25 bp, Mus musculus
tccacaaattctcactgtacatagg

SEQ ID NO: 810312 - DNA, 25 bp, Mus musculus
tccacaaattctgactgtacatagg

SEQ ID NO: 810313 - DNA, 25 bp, Mus musculus
tccacaacagggacgtttttctact

SEQ ID NO: 810314 - DNA, 25 bp, Mus musculus
tccacaacagggtcgtttttctact

SEQ ID NO: 810315 - DNA, 25 bp, Mus musculus
tccacaacagtcagctcataggcct

SEQ ID NO: 810316 - DNA, 25 bp, Mus musculus
tccacaacagtctgctcataggcct

SEQ ID NO: 810317 - DNA, 25 bp, Mus musculus
tccacaacatccattgaagccttgg

SEQ ID NO: 810318 - DNA, 25 bp, Mus musculus
tccacaacatcctttgaagccttgg

SEQ ID NO: 810319 - DNA, 25 bp, Mus musculus
tccacaaccagacaggcagcgggtc

SEQ ID NO: 810320 - DNA, 25 bp, Mus musculus
tccacaaccagagaggcagcgggtc

SEQ ID NO: 810321 - DNA, 25 bp, Mus musculus
tccacaacccctaattctattattt

SEQ ID NO: 810322 - DNA, 25 bp, Mus musculus
tccacaaccccttattctattattt

SEQ ID NO: 810323 - DNA, 25 bp, Mus musculus
tccacaagacgcaacactcacaagt

SEQ ID NO: 810324 - DNA, 25 bp, Mus musculus
tccacaagacgctacactcacaagt

SEQ ID NO: 810325 - DNA, 25 bp, Mus musculus
tccacaagagttaatgaaagggcat

SEQ ID NO: 810326 - DNA, 25 bp, Mus musculus
tccacaagagtttatgaaagggcat

SEQ ID NO: 810327 - DNA, 25 bp, Mus musculus
tccacaagcatgatgcccactaatt

SEQ ID NO: 810328 - DNA, 25 bp, Mus musculus
tccacaagcatgttgcccactaatt

SEQ ID NO: 810329 - DNA, 25 bp, Mus musculus
tccacaagtactctggcaaggaagg

SEQ ID NO: 810330 - DNA, 25 bp, Mus musculus
tccacaagtactgtggcaaggaagg

SEQ ID NO: 810331 - DNA, 25 bp, Mus musculus
tccacaatattgacaggactttggg

SEQ ID NO: 810332 - DNA, 25 bp, Mus musculus
tccacaatattgtcaggactttggg

SEQ ID NO: 810333 - DNA, 25 bp, Mus musculus
tccacaatgaggcaaatggcatcaa

SEQ ID NO: 810334 - DNA, 25 bp, Mus musculus
tccacaatgagggaaatggcatcaa

SEQ ID NO: 810335 - DNA, 25 bp, Mus musculus
tccacaatgagtactcttccagaca

SEQ ID NO: 810336 - DNA, 25 bp, Mus musculus
tccacaatgagttctcttccagaca

SEQ ID NO: 810337 - DNA, 25 bp, Mus musculus
tccacaatgattcactgtatcctag

SEQ ID NO: 810338 - DNA, 25 bp, Mus musculus
tccacaatgattgactgtatcctag

SEQ ID NO: 810339 - DNA, 25 bp, Mus musculus
tccacaatgtttaaagtctgaagct

SEQ ID NO: 810340 - DNA, 25 bp, Mus musculus
tccacaatgttttaagtctgaagct

SEQ ID NO: 810341 - DNA, 25 bp, Mus musculus
tccacaattagtctagctctacctt

SEQ ID NO: 810342 - DNA, 25 bp, Mus musculus
tccacaattagtgtagctctacctt

SEQ ID NO: 810343 - DNA, 25 bp, Mus musculus
tccacacaagcaatcccggttaaag

SEQ ID NO: 810344 - DNA, 25 bp, Mus musculus
tccacacaagcattcccggttaaag

SEQ ID NO: 810345 - DNA, 25 bp, Mus musculus
tccacacacaggagcgggcagtaga

SEQ ID NO: 810346 - DNA, 25 bp, Mus musculus
tccacacacaggtgcgggcagtaga

SEQ ID NO: 810347 - DNA, 25 bp, Mus musculus
tccacacagatactttttacagttt

SEQ ID NO: 810348 - DNA, 25 bp, Mus musculus
tccacacagatagtttttacagttt

SEQ ID NO: 810349 - DNA, 25 bp, Mus musculus
tccacacagatgacaggccactttc

SEQ ID NO: 810350 - DNA, 25 bp, Mus musculus
tccacacagatgtcaggccactttc

SEQ ID NO: 810351 - DNA, 25 bp, Mus musculus
tccacacagcacagtggtgcccaga

SEQ ID NO: 810352 - DNA, 25 bp, Mus musculus
tccacacagcactgtggtgcccaga

SEQ ID NO: 810353 - DNA, 25 bp, Mus musculus
tccacacatctgagataaacagctg

SEQ ID NO: 810354 - DNA, 25 bp, Mus musculus
tccacacatctgtgataaacagctg

SEQ ID NO: 810355 - DNA, 25 bp, Mus musculus
tccacacattagctttcttgcctaa

SEQ ID NO: 810356 - DNA, 25 bp, Mus musculus
tccacacattaggtttcttgcctaa

SEQ ID NO: 810357 - DNA, 25 bp, Mus musculus
tccacaccagccagatctagttcaa

SEQ ID NO: 810358 - DNA, 25 bp, Mus musculus
tccacaccagcctgatctagttcaa

SEQ ID NO: 810359 - DNA, 25 bp, Mus musculus
tccacaccattcaccattcgagaga

SEQ ID NO: 810360 - DNA, 25 bp, Mus musculus
tccacaccattctccattcgagaga

SEQ ID NO: 810361 - DNA, 25 bp, Mus musculus
tccacaccgagacaacgatccaatt

SEQ ID NO: 810362 - DNA, 25 bp, Mus musculus
tccacaccgagagaacgatccaatt

SEQ ID NO: 810363 - DNA, 25 bp, Mus musculus
tccacaccggtacccatcagggaaa

SEQ ID NO: 810364 - DNA, 25 bp, Mus musculus
tccacaccggtagccatcagggaaa

SEQ ID NO: 810365 - DNA, 25 bp, Mus musculus
tccacaccgtgcagacaatcatttt

SEQ ID NO: 810366 - DNA, 25 bp, Mus musculus
tccacaccgtgctgacaatcatttt

SEQ ID NO: 810367 - DNA, 25 bp, Mus musculus
tccacacctatacataatttcattt

SEQ ID NO: 810368 - DNA, 25 bp, Mus musculus
tccacacctatagataatttcattt

SEQ ID NO: 810369 - DNA, 25 bp, Mus musculus
tccacacctgagaccagattcttgt

SEQ ID NO: 810370 - DNA, 25 bp, Mus musculus
tccacacctgagtccagattcttgt

SEQ ID NO: 810371 - DNA, 25 bp, Mus musculus
tccacacctgatagtaggcaggaaa

SEQ ID NO: 810372 - DNA, 25 bp, Mus musculus
tccacacctgattgtaggcaggaaa

SEQ ID NO: 810373 - DNA, 25 bp, Mus musculus
tccacacctgctctgcttaggacag

SEQ ID NO: 810374 - DNA, 25 bp, Mus musculus
tccacacctgctgtgcttaggacag

SEQ ID NO: 810375 - DNA, 25 bp, Mus musculus
tccacacctttgacaccaacagtga

SEQ ID NO: 810376 - DNA, 25 bp, Mus musculus
tccacacctttgtcaccaacagtga

SEQ ID NO: 810377 - DNA, 25 bp, Mus musculus
tccacacgatctccatgaaaccgag

SEQ ID NO: 810378 - DNA, 25 bp, Mus musculus
tccacacgatctgcatgaaaccgag

SEQ ID NO: 810379 - DNA, 25 bp, Mus musculus
tccacacgcagtagtttggccacat

SEQ ID NO: 810380 - DNA, 25 bp, Mus musculus
tccacacgcagttgtttggccacat

SEQ ID NO: 810381 - DNA, 25 bp, Mus musculus
tccacacgcctaacaggacgtacta

SEQ ID NO: 810382 - DNA, 25 bp, Mus musculus
tccacacgcctatcaggacgtacta

SEQ ID NO: 810383 - DNA, 25 bp, Mus musculus
tccacacgctgcacgaacaatcaaa

SEQ ID NO: 810384 - DNA, 25 bp, Mus musculus
tccacacgctgctcgaacaatcaaa

SEQ ID NO: 810385 - DNA, 25 bp, Mus musculus
tccacacggcaccaaatgcctgtgt

SEQ ID NO: 810386 - DNA, 25 bp, Mus musculus
tccacacggcacgaaatgcctgtgt

SEQ ID NO: 810387 - DNA, 25 bp, Mus musculus
tccacactaaacacaagctgctatg

SEQ ID NO: 810388 - DNA, 25 bp, Mus musculus
tccacactaaactcaagctgctatg

SEQ ID NO: 810389 - DNA, 25 bp, Mus musculus
tccacactaatcacagctccaaggg

SEQ ID NO: 810390 - DNA, 25 bp, Mus musculus
tccacactaatctcagctccaaggg

SEQ ID NO: 810391 - DNA, 25 bp, Mus musculus
tccacactaccgactgccagggtga

SEQ ID NO: 810392 - DNA, 25 bp, Mus musculus
tccacactaccgtctgccagggtga

SEQ ID NO: 810393 - DNA, 25 bp, Mus musculus
tccacactaggtagccctctgtctg

SEQ ID NO: 810394 - DNA, 25 bp, Mus musculus
tccacactaggttgccctctgtctg

SEQ ID NO: 810395 - DNA, 25 bp, Mus musculus
tccacactcaggagtgagcatcctg

SEQ ID NO: 810396 - DNA, 25 bp, Mus musculus
tccacactcaggtgtgagcatcctg

SEQ ID NO: 810397 - DNA, 25 bp, Mus musculus
tccacactggaaacactgactttta

SEQ ID NO: 810398 - DNA, 25 bp, Mus musculus
tccacactggaatcactgactttta

SEQ ID NO: 810399 - DNA, 25 bp, Mus musculus
tccacactggacacactgcttttta

SEQ ID NO: 810400 - DNA, 25 bp, Mus musculus
tccacactggactcactgcttttta

SEQ ID NO: 810401 - DNA, 25 bp, Mus musculus
tccacactggccaggtagactcagg

SEQ ID NO: 810402 - DNA, 25 bp, Mus musculus
tccacactggcctggtagactcagg

SEQ ID NO: 810403 - DNA, 25 bp, Mus musculus
tccacactgtggcttctgctatagg

SEQ ID NO: 810404 - DNA, 25 bp, Mus musculus
tccacactgtgggttctgctatagg

SEQ ID NO: 810405 - DNA, 25 bp, Mus musculus
tccacactgttcactggacagcagg

SEQ ID NO: 810406 - DNA, 25 bp, Mus musculus
tccacactgttctctggacagcagg

SEQ ID NO: 810407 - DNA, 25 bp, Mus musculus
tccacacttaacacacctattgctg

SEQ ID NO: 810408 - DNA, 25 bp, Mus musculus
tccacacttaactcacctattgctg

SEQ ID NO: 810409 - DNA, 25 bp, Mus musculus
tccacacttagaacgaattgcagcc

SEQ ID NO: 810410 - DNA, 25 bp, Mus musculus
tccacacttagatcgaattgcagcc

SEQ ID NO: 810411 - DNA, 25 bp, Mus musculus
tccacacttgtaacatcctatactc

SEQ ID NO: 810412 - DNA, 25 bp, Mus musculus
tccacacttgtatcatcctatactc

SEQ ID NO: 810413 - DNA, 25 bp, Mus musculus
tccacacttttcataccctgagcta

SEQ ID NO: 810414 - DNA, 25 bp, Mus musculus
tccacacttttcttaccctgagcta

SEQ ID NO: 810415 - DNA, 25 bp, Mus musculus
tccacagaaccaatgttacgctttg

SEQ ID NO: 810416 - DNA, 25 bp, Mus musculus
tccacagaaccattgttacgctttg

SEQ ID NO: 810417 - DNA, 25 bp, Mus musculus
tccacagaacctcagatgggcctct

SEQ ID NO: 810418 - DNA, 25 bp, Mus musculus
tccacagaacctgagatgggcctct

SEQ ID NO: 810419 - DNA, 25 bp, Mus musculus
tccacagacacgctttagtcaatga

SEQ ID NO: 810420 - DNA, 25 bp, Mus musculus
tccacagacacggtttagtcaatga

SEQ ID NO: 810421 - DNA, 25 bp, Mus musculus
tccacagaccagagctgggtgtgac

SEQ ID NO: 810422 - DNA, 25 bp, Mus musculus
tccacagaccagtgctgggtgtgac

SEQ ID NO: 810423 - DNA, 25 bp, Mus musculus
tccacagacttgcaggccctgagga

SEQ ID NO: 810424 - DNA, 25 bp, Mus musculus
tccacagacttggaggccctgagga

SEQ ID NO: 810425 - DNA, 25 bp, Mus musculus
tccacagagctccttgaaccttaga

SEQ ID NO: 810426 - DNA, 25 bp, Mus musculus
tccacagagctcgttgaaccttaga

SEQ ID NO: 810427 - DNA, 25 bp, Mus musculus
tccacagatttcacagctctctgaa

SEQ ID NO: 810428 - DNA, 25 bp, Mus musculus
tccacagatttctcagctctctgaa

SEQ ID NO: 810429 - DNA, 25 bp, Mus musculus
tccacagcactgatttctgaggcca

SEQ ID NO: 810430 - DNA, 25 bp, Mus musculus
tccacagcactgttttctgaggcca

SEQ ID NO: 810431 - DNA, 25 bp, Mus musculus
tccacagcacttagatacgacgttt

SEQ ID NO: 810432 - DNA, 25 bp, Mus musculus
tccacagcactttgatacgacgttt

SEQ ID NO: 810433 - DNA, 25 bp, Mus musculus
tccacagcaggcctgtatccagggc

SEQ ID NO: 810434 - DNA, 25 bp, Mus musculus
tccacagcaggcgtgtatccagggc

SEQ ID NO: 810435 - DNA, 25 bp, Mus musculus
tccacagcatgaacctagcctttgg

SEQ ID NO: 810436 - DNA, 25 bp, Mus musculus
tccacagcatgatcctagcctttgg

SEQ ID NO: 810437 - DNA, 25 bp, Mus musculus
tccacagccactagcaggcggtaat

SEQ ID NO: 810438 - DNA, 25 bp, Mus musculus
tccacagccacttgcaggcggtaat

SEQ ID NO: 810439 - DNA, 25 bp, Mus musculus
tccacagcccctaacgtggatgttt

SEQ ID NO: 810440 - DNA, 25 bp, Mus musculus
tccacagccccttacgtggatgttt

SEQ ID NO: 810441 - DNA, 25 bp, Mus musculus
tccacagccgctccagaggagacag

SEQ ID NO: 810442 - DNA, 25 bp, Mus musculus
tccacagccgctgcagaggagacag

SEQ ID NO: 810443 - DNA, 25 bp, Mus musculus
tccacagcctccattcgtacgagaa

SEQ ID NO: 810444 - DNA, 25 bp, Mus musculus
tccacagcctcctttcgtacgagaa

SEQ ID NO: 810445 - DNA, 25 bp, Mus musculus
tccacagccttgcgcattcttgtat

SEQ ID NO: 810446 - DNA, 25 bp, Mus musculus
tccacagccttgggcattcttgtat

SEQ ID NO: 810447 - DNA, 25 bp, Mus musculus
tccacagcgatacccatcagggaag

SEQ ID NO: 810448 - DNA, 25 bp, Mus musculus
tccacagcgatagccatcagggaag

SEQ ID NO: 810449 - DNA, 25 bp, Mus musculus
tccacagcggctaggagttgacttc

SEQ ID NO: 810450 - DNA, 25 bp, Mus musculus
tccacagcggcttggagttgacttc

SEQ ID NO: 810451 - DNA, 25 bp, Mus musculus
tccacagcgggcacagcagatgaca

SEQ ID NO: 810452 - DNA, 25 bp, Mus musculus
tccacagcgggctcagcagatgaca

SEQ ID NO: 810453 - DNA, 25 bp, Mus musculus
tccacagcgtgtacattgcactaaa

SEQ ID NO: 810454 - DNA, 25 bp, Mus musculus
tccacagcgtgttcattgcactaaa

SEQ ID NO: 810455 - DNA, 25 bp, Mus musculus
tccacagctcacaactccaagtttg

SEQ ID NO: 810456 - DNA, 25 bp, Mus musculus
tccacagctcactactccaagtttg

SEQ ID NO: 810457 - DNA, 25 bp, Mus musculus
tccacagctccaatacagtgctttg

SEQ ID NO: 810458 - DNA, 25 bp, Mus musculus
tccacagctccattacagtgctttg

SEQ ID NO: 810459 - DNA, 25 bp, Mus musculus
tccacagcttaactgcataagactg

SEQ ID NO: 810460 - DNA, 25 bp, Mus musculus
tccacagcttaagtgcataagactg

SEQ ID NO: 810461 - DNA, 25 bp, Mus musculus
tccacagcttctctgggatttgcca

SEQ ID NO: 810462 - DNA, 25 bp, Mus musculus
tccacagcttctgtgggatttgcca

SEQ ID NO: 810463 - DNA, 25 bp, Mus musculus
tccacagctttccaaacagactcat

SEQ ID NO: 810464 - DNA, 25 bp, Mus musculus
tccacagctttcgaaacagactcat

SEQ ID NO: 810465 - DNA, 25 bp, Mus musculus
tccacaggaatgctgtttctctttt

SEQ ID NO: 810466 - DNA, 25 bp, Mus musculus
tccacaggaatggtgtttctctttt

SEQ ID NO: 810467 - DNA, 25 bp, Mus musculus
tccacaggactgactagaacttcta

SEQ ID NO: 810468 - DNA, 25 bp, Mus musculus
tccacaggactgtctagaacttcta

SEQ ID NO: 810469 - DNA, 25 bp, Mus musculus
tccacaggagttcccgctacaggag

SEQ ID NO: 810470 - DNA, 25 bp, Mus musculus
tccacaggagttgccgctacaggag

SEQ ID NO: 810471 - DNA, 25 bp, Mus musculus
tccacaggcacaacattcagccgta

SEQ ID NO: 810472 - DNA, 25 bp, Mus musculus
tccacaggcacatcattcagccgta

SEQ ID NO: 810473 - DNA, 25 bp, Mus musculus
tccacaggccagatccatgtgaaag

SEQ ID NO: 810474 - DNA, 25 bp, Mus musculus
tccacaggccagttccatgtgaaag

SEQ ID NO: 810475 - DNA, 25 bp, Mus musculus
tccacaggctgactgggcacaggta

SEQ ID NO: 810476 - DNA, 25 bp, Mus musculus
tccacaggctgagtgggcacaggta

SEQ ID NO: 810477 - DNA, 25 bp, Mus musculus
tccacaggctttacttcactattta

SEQ ID NO: 810478 - DNA, 25 bp, Mus musculus
tccacaggcttttcttcactattta

SEQ ID NO: 810479 - DNA, 25 bp, Mus musculus
tccacagggaaaatgtgtagcagct

SEQ ID NO: 810480 - DNA, 25 bp, Mus musculus
tccacagggaaattgtgtagcagct

SEQ ID NO: 810481 - DNA, 25 bp, Mus musculus
tccacagggaacactgcacctacag

SEQ ID NO: 810482 - DNA, 25 bp, Mus musculus
tccacagggaactctgcacctacag

SEQ ID NO: 810483 - DNA, 25 bp, Mus musculus
tccacaggtatcagtactcacacat

SEQ ID NO: 810484 - DNA, 25 bp, Mus musculus
tccacaggtatctgtactcacacat

SEQ ID NO: 810485 - DNA, 25 bp, Mus musculus
tccacaggtctgacaccatgaaggt

SEQ ID NO: 810486 - DNA, 25 bp, Mus musculus
tccacaggtctgtcaccatgaaggt

SEQ ID NO: 810487 - DNA, 25 bp, Mus musculus
tccacaggtgaacgctggagtctgc

SEQ ID NO: 810488 - DNA, 25 bp, Mus musculus
tccacaggtgaaggctggagtctgc

SEQ ID NO: 810489 - DNA, 25 bp, Mus musculus
tccacaggtgttagagcagcgcatc

SEQ ID NO: 810490 - DNA, 25 bp, Mus musculus
tccacaggtgtttgagcagcgcatc

SEQ ID NO: 810491 - DNA, 25 bp, Mus musculus
tccacagtaatgacatccacttcaa

SEQ ID NO: 810492 - DNA, 25 bp, Mus musculus
tccacagtaatgtcatccacttcaa

SEQ ID NO: 810493 - DNA, 25 bp, Mus musculus
tccacagtagagcaatgcttccaga

SEQ ID NO: 810494 - DNA, 25 bp, Mus musculus
tccacagtagaggaatgcttccaga

SEQ ID NO: 810495 - DNA, 25 bp, Mus musculus
tccacagtagctaccatgttgctga

SEQ ID NO: 810496 - DNA, 25 bp, Mus musculus
tccacagtagcttccatgttgctga

SEQ ID NO: 810497 - DNA, 25 bp, Mus musculus
tccacagtaggcatgataggttaat

SEQ ID NO: 810498 - DNA, 25 bp, Mus musculus
tccacagtaggcttgataggttaat

SEQ ID NO: 810499 - DNA, 25 bp, Mus musculus
tccacagtatgaatatccaccacct

SEQ ID NO: 810500 - DNA, 25 bp, Mus musculus
tccacagtatgattatccaccacct

SEQ ID NO: 810501 - DNA, 25 bp, Mus musculus
tccacagtattcagcttgcatagcc

SEQ ID NO: 810502 - DNA, 25 bp, Mus musculus
tccacagtattctgcttgcatagcc

SEQ ID NO: 810503 - DNA, 25 bp, Mus musculus
tccacagtcatgactccatagttgt

SEQ ID NO: 810504 - DNA, 25 bp, Mus musculus
tccacagtcatgtctccatagttgt

SEQ ID NO: 810505 - DNA, 25 bp, Mus musculus
tccacagtccagatccatatcttag

SEQ ID NO: 810506 - DNA, 25 bp, Mus musculus
tccacagtccagttccatatcttag

SEQ ID NO: 810507 - DNA, 25 bp, Mus musculus
tccacagtcctgcttgttgagagat

SEQ ID NO: 810508 - DNA, 25 bp, Mus musculus
tccacagtcctggttgttgagagat

SEQ ID NO: 810509 - DNA, 25 bp, Mus musculus
tccacagtgaccaccagtgcagggt

SEQ ID NO: 810510 - DNA, 25 bp, Mus musculus
tccacagtgacctccagtgcagggt

SEQ ID NO: 810511 - DNA, 25 bp, Mus musculus
tccacagtgccactaagacctacag

SEQ ID NO: 810512 - DNA, 25 bp, Mus musculus
tccacagtgccagtaagacctacag

SEQ ID NO: 810513 - DNA, 25 bp, Mus musculus
tccacagtggcaagtctgcctagcc

SEQ ID NO: 810514 - DNA, 25 bp, Mus musculus
tccacagtggcatgtctgcctagcc

SEQ ID NO: 810515 - DNA, 25 bp, Mus musculus
tccacagtgtacagtaggcttactg

SEQ ID NO: 810516 - DNA, 25 bp, Mus musculus
tccacagtgtactgtaggcttactg

SEQ ID NO: 810517 - DNA, 25 bp, Mus musculus
tccacagtgtccataggtgtctaca

SEQ ID NO: 810518 - DNA, 25 bp, Mus musculus
tccacagtgtccttaggtgtctaca

SEQ ID NO: 810519 - DNA, 25 bp, Mus musculus
tccacagtgtctaccctgtaaggta

SEQ ID NO: 810520 - DNA, 25 bp, Mus musculus
tccacagtgtcttccctgtaaggta

SEQ ID NO: 810521 - DNA, 25 bp, Mus musculus
tccacagttgacaccatctgaagtt

SEQ ID NO: 810522 - DNA, 25 bp, Mus musculus
tccacagttgactccatctgaagtt

SEQ ID NO: 810523 - DNA, 25 bp, Mus musculus
tccacataagtgaaacatcagccta

SEQ ID NO: 810524 - DNA, 25 bp, Mus musculus
tccacataagtgtaacatcagccta

SEQ ID NO: 810525 - DNA, 25 bp, Mus musculus
tccacatacatgcaacagaaagcag

SEQ ID NO: 810526 - DNA, 25 bp, Mus musculus
tccacatacatggaacagaaagcag

SEQ ID NO: 810527 - DNA, 25 bp, Mus musculus
tccacataccataggcttcccggat

SEQ ID NO: 810528 - DNA, 25 bp, Mus musculus
tccacataccattggcttcccggat

SEQ ID NO: 810529 - DNA, 25 bp, Mus musculus
tccacataccccaatagacagacag

SEQ ID NO: 810530 - DNA, 25 bp, Mus musculus
tccacatacccctatagacagacag

SEQ ID NO: 810531 - DNA, 25 bp, Mus musculus
tccacataccttctcagacatgaac

SEQ ID NO: 810532 - DNA, 25 bp, Mus musculus
tccacataccttgtcagacatgaac

SEQ ID NO: 810533 - DNA, 25 bp, Mus musculus
tccacatcaacaaatgccatcctag

SEQ ID NO: 810534 - DNA, 25 bp, Mus musculus
tccacatcaacatatgccatcctag

SEQ ID NO: 810535 - DNA, 25 bp, Mus musculus
tccacatcacgcatcttttgagaat

SEQ ID NO: 810536 - DNA, 25 bp, Mus musculus
tccacatcacgcttcttttgagaat

SEQ ID NO: 810537 - DNA, 25 bp, Mus musculus
tccacatcatgaccctccttgagaa

SEQ ID NO: 810538 - DNA, 25 bp, Mus musculus
tccacatcatgagcctccttgagaa

SEQ ID NO: 810539 - DNA, 25 bp, Mus musculus
tccacatcccagactagcaggttag

SEQ ID NO: 810540 - DNA, 25 bp, Mus musculus
tccacatcccagtctagcaggttag

SEQ ID NO: 810541 - DNA, 25 bp, Mus musculus
tccacatccctcatgttacatagtt

SEQ ID NO: 810542 - DNA, 25 bp, Mus musculus
tccacatccctcttgttacatagtt

SEQ ID NO: 810543 - DNA, 25 bp, Mus musculus
tccacatcctaacccttgtgtgtta

SEQ ID NO: 810544 - DNA, 25 bp, Mus musculus
tccacatcctaagccttgtgtgtta

SEQ ID NO: 810545 - DNA, 25 bp, Mus musculus
tccacatcctcacgtctaacataga

SEQ ID NO: 810546 - DNA, 25 bp, Mus musculus
tccacatcctcaggtctaacataga

SEQ ID NO: 810547 - DNA, 25 bp, Mus musculus
tccacatcctttagtttgtcacttt

SEQ ID NO: 810548 - DNA, 25 bp, Mus musculus
tccacatccttttgtttgtcacttt

SEQ ID NO: 810549 - DNA, 25 bp, Mus musculus
tccacatctcttcggccactgaagg

SEQ ID NO: 810550 - DNA, 25 bp, Mus musculus
tccacatctcttgggccactgaagg

SEQ ID NO: 810551 - DNA, 25 bp, Mus musculus
tccacatctggcctcaaagtgttat

SEQ ID NO: 810552 - DNA, 25 bp, Mus musculus
tccacatctggcgtcaaagtgttat

SEQ ID NO: 810553 - DNA, 25 bp, Mus musculus
tccacatcttccagcggtgaaaaga

SEQ ID NO: 810554 - DNA, 25 bp, Mus musculus
tccacatcttcctgcggtgaaaaga

SEQ ID NO: 810555 - DNA, 25 bp, Mus musculus
tccacatgaacaagccccaggtggt

SEQ ID NO: 810556 - DNA, 25 bp, Mus musculus
tccacatgaacatgccccaggtggt

SEQ ID NO: 810557 - DNA, 25 bp, Mus musculus
tccacatgcaggagattcgatttca

SEQ ID NO: 810558 - DNA, 25 bp, Mus musculus
tccacatgcaggtgattcgatttca

SEQ ID NO: 810559 - DNA, 25 bp, Mus musculus
tccacatgcctgaatggagccaata

SEQ ID NO: 810560 - DNA, 25 bp, Mus musculus
tccacatgcctgtatggagccaata

SEQ ID NO: 810561 - DNA, 25 bp, Mus musculus
tccacatgcgtgaggagtctccaag

SEQ ID NO: 810562 - DNA, 25 bp, Mus musculus
tccacatgcgtgtggagtctccaag

SEQ ID NO: 810563 - DNA, 25 bp, Mus musculus
tccacatgctagagcgtggctgctg

SEQ ID NO: 810564 - DNA, 25 bp, Mus musculus
tccacatgctagtgcgtggctgctg

SEQ ID NO: 810565 - DNA, 25 bp, Mus musculus
tccacatgctctctcttagctaaga

SEQ ID NO: 810566 - DNA, 25 bp, Mus musculus
tccacatgctctgtcttagctaaga

SEQ ID NO: 810567 - DNA, 25 bp, Mus musculus
tccacatgctggcaccgggactgga

SEQ ID NO: 810568 - DNA, 25 bp, Mus musculus
tccacatgctgggaccgggactgga

SEQ ID NO: 810569 - DNA, 25 bp, Mus musculus
tccacatggcggcagaaactctttc

SEQ ID NO: 810570 - DNA, 25 bp, Mus musculus
tccacatggcgggagaaactctttc

SEQ ID NO: 810571 - DNA, 25 bp, Mus musculus
tccacatgggccatggagccttcct

SEQ ID NO: 810572 - DNA, 25 bp, Mus musculus
tccacatgggccttggagccttcct

SEQ ID NO: 810573 - DNA, 25 bp, Mus musculus
tccacatgggttcatttgagtaatt

SEQ ID NO: 810574 - DNA, 25 bp, Mus musculus
tccacatgggttgatttgagtaatt

SEQ ID NO: 810575 - DNA, 25 bp, Mus musculus
tccacatggtgtcttaggtacctgc

SEQ ID NO: 810576 - DNA, 25 bp, Mus musculus
tccacatggtgtgttaggtacctgc

SEQ ID NO: 810577 - DNA, 25 bp, Mus musculus
tccacatgtggacactttcagggtg

SEQ ID NO: 810578 - DNA, 25 bp, Mus musculus
tccacatgtggagactttcagggtg

SEQ ID NO: 810579 - DNA, 25 bp, Mus musculus
tccacatgtgtgcagttgtcttctg

SEQ ID NO: 810580 - DNA, 25 bp, Mus musculus
tccacatgtgtgctcatatctatgc

SEQ ID NO: 810581 - DNA, 25 bp, Mus musculus
tccacatgtgtggagttgtcttctg

SEQ ID NO: 810582 - DNA, 25 bp, Mus musculus
tccacatgtgtggtcatatctatgc

SEQ ID NO: 810583 - DNA, 25 bp, Mus musculus
tccacatgttggcttcccatggaac

SEQ ID NO: 810584 - DNA, 25 bp, Mus musculus
tccacatgttgggttcccatggaac

SEQ ID NO: 810585 - DNA, 25 bp, Mus musculus
tccacatgttttacaactacagtgc

SEQ ID NO: 810586 - DNA, 25 bp, Mus musculus
tccacatgtttttcaactacagtgc

SEQ ID NO: 810587 - DNA, 25 bp, Mus musculus
tccacattaaagattattgggacct

SEQ ID NO: 810588 - DNA, 25 bp, Mus musculus
tccacattaaagtttattgggacct

SEQ ID NO: 810589 - DNA, 25 bp, Mus musculus
tccacattatcgaccagtacaacag

SEQ ID NO: 810590 - DNA, 25 bp, Mus musculus
tccacattatcgtccagtacaacag

SEQ ID NO: 810591 - DNA, 25 bp, Mus musculus
tccacattcaaacggcccaggagag

SEQ ID NO: 810592 - DNA, 25 bp, Mus musculus
tccacattcaaagggcccaggagag

SEQ ID NO: 810593 - DNA, 25 bp, Mus musculus
tccacattcactatcatcacagcgg

SEQ ID NO: 810594 - DNA, 25 bp, Mus musculus
tccacattcactttcatcacagcgg

SEQ ID NO: 810595 - DNA, 25 bp, Mus musculus
tccacattccctctgaatcttcatt

SEQ ID NO: 810596 - DNA, 25 bp, Mus musculus
tccacattccctgtgaatcttcatt

SEQ ID NO: 810597 - DNA, 25 bp, Mus musculus
tccacattccttatgatttttcatt

SEQ ID NO: 810598 - DNA, 25 bp, Mus musculus
tccacattccttttgatttttcatt

SEQ ID NO: 810599 - DNA, 25 bp, Mus musculus
tccacattctgtaaagcaccatcaa

SEQ ID NO: 810600 - DNA, 25 bp, Mus musculus
tccacattctgttaagcaccatcaa

SEQ ID NO: 810601 - DNA, 25 bp, Mus musculus
tccacattgatgatcactcgactgt

SEQ ID NO: 810602 - DNA, 25 bp, Mus musculus
tccacattgatgttcactcgactgt

SEQ ID NO: 810603 - DNA, 25 bp, Mus musculus
tccacatttgatcgcactcgtgaga

SEQ ID NO: 810604 - DNA, 25 bp, Mus musculus
tccacatttgatggcactcgtgaga

SEQ ID NO: 810605 - DNA, 25 bp, Mus musculus
tccacatttgccaatgctcctgtcg

SEQ ID NO: 810606 - DNA, 25 bp, Mus musculus
tccacatttgcctatgctcctgtcg

SEQ ID NO: 810607 - DNA, 25 bp, Mus musculus
tccacatttgctcaacgccatcagt

SEQ ID NO: 810608 - DNA, 25 bp, Mus musculus
tccacatttgctgaacgccatcagt

SEQ ID NO: 810609 - DNA, 25 bp, Mus musculus
tccacatttttgagaagttaccttt

SEQ ID NO: 810610 - DNA, 25 bp, Mus musculus
tccacatttttgtgaagttaccttt

SEQ ID NO: 810611 - DNA, 25 bp, Mus musculus
tccaccaaacatatctcaggcttct

SEQ ID NO: 810612 - DNA, 25 bp, Mus musculus
tccaccaaacatttctcaggcttct

SEQ ID NO: 810613 - DNA, 25 bp, Mus musculus
tccaccaaaggcaaacgggcaccaa

SEQ ID NO: 810614 - DNA, 25 bp, Mus musculus
tccaccaaaggctaacgggcaccaa

SEQ ID NO: 810615 - DNA, 25 bp, Mus musculus
tccaccaacgtgctttttgtggcct

SEQ ID NO: 810616 - DNA, 25 bp, Mus musculus
tccaccaacgtggtttttgtggcct

SEQ ID NO: 810617 - DNA, 25 bp, Mus musculus
tccaccaactcaagaggcccaggag

SEQ ID NO: 810618 - DNA, 25 bp, Mus musculus
tccaccaactcatgaggcccaggag

SEQ ID NO: 810619 - DNA, 25 bp, Mus musculus
tccaccaagaagaaccaaacccagt

SEQ ID NO: 810620 - DNA, 25 bp, Mus musculus
tccaccaagaagtaccaaacccagt

SEQ ID NO: 810621 - DNA, 25 bp, Mus musculus
tccaccaagcacatgtgtacctgtt

SEQ ID NO: 810622 - DNA, 25 bp, Mus musculus
tccaccaagcacttgtgtacctgtt

SEQ ID NO: 810623 - DNA, 25 bp, Mus musculus
tccaccaagcatactcttctgctgg

SEQ ID NO: 810624 - DNA, 25 bp, Mus musculus
tccaccaagcattctcttctgctgg

SEQ ID NO: 810625 - DNA, 25 bp, Mus musculus
tccaccaaggcaaccgttgaacaaa

SEQ ID NO: 810626 - DNA, 25 bp, Mus musculus
tccaccaaggcatccgttgaacaaa

SEQ ID NO: 810627 - DNA, 25 bp, Mus musculus
tccaccaagtgaatacagccctctg

SEQ ID NO: 810628 - DNA, 25 bp, Mus musculus
tccaccaagtgattacagccctctg

SEQ ID NO: 810629 - DNA, 25 bp, Mus musculus
tccaccacaacccaagatctaagag

SEQ ID NO: 810630 - DNA, 25 bp, Mus musculus
tccaccacaaccgaagatctaagag

SEQ ID NO: 810631 - DNA, 25 bp, Mus musculus
tccaccacattgacctgcaaatcat

SEQ ID NO: 810632 - DNA, 25 bp, Mus musculus
tccaccacattgtcctgcaaatcat

SEQ ID NO: 810633 - DNA, 25 bp, Mus musculus
tccaccaccatcagcatgtcagttc

SEQ ID NO: 810634 - DNA, 25 bp, Mus musculus
tccaccaccatctgcatgtcagttc

SEQ ID NO: 810635 - DNA, 25 bp, Mus musculus
tccaccaccatgagagaatccacag

SEQ ID NO: 810636 - DNA, 25 bp, Mus musculus
tccaccaccatgtgagaatccacag

SEQ ID NO: 810637 - DNA, 25 bp, Mus musculus
tccaccacccaaccatgaaacaata

SEQ ID NO: 810638 - DNA, 25 bp, Mus musculus
tccaccacccaagcatgaaacaata

SEQ ID NO: 810639 - DNA, 25 bp, Mus musculus
tccaccacccagcattacagaataa

SEQ ID NO: 810640 - DNA, 25 bp, Mus musculus
tccaccacccaggattacagaataa

SEQ ID NO: 810641 - DNA, 25 bp, Mus musculus
tccaccaccctcaagaagtaatcat

SEQ ID NO: 810642 - DNA, 25 bp, Mus musculus
tccaccaccctctagaagtaatcat

SEQ ID NO: 810643 - DNA, 25 bp, Mus musculus
tccaccaccttaagagttctgtaac

SEQ ID NO: 810644 - DNA, 25 bp, Mus musculus
tccaccaccttactttcctgagtct

SEQ ID NO: 810645 - DNA, 25 bp, Mus musculus
tccaccaccttagtttcctgagtct

SEQ ID NO: 810646 - DNA, 25 bp, Mus musculus
tccaccaccttatgagttctgtaac

SEQ ID NO: 810647 - DNA, 25 bp, Mus musculus
tccaccagaggcactatggaaaggt

SEQ ID NO: 810648 - DNA, 25 bp, Mus musculus
tccaccagaggctctatggaaaggt

SEQ ID NO: 810649 - DNA, 25 bp, Mus musculus
tccaccagcgccatataattccaag

SEQ ID NO: 810650 - DNA, 25 bp, Mus musculus
tccaccagcgccttataattccaag

SEQ ID NO: 810651 - DNA, 25 bp, Mus musculus
tccaccagcgttctcatgaggagca

SEQ ID NO: 810652 - DNA, 25 bp, Mus musculus
tccaccagcgttgtcatgaggagca

SEQ ID NO: 810653 - DNA, 25 bp, Mus musculus
tccaccagctgcaattgacgtcaag

SEQ ID NO: 810654 - DNA, 25 bp, Mus musculus
tccaccagctgctattgacgtcaag

SEQ ID NO: 810655 - DNA, 25 bp, Mus musculus
tccaccaggatgattgatgattctt

SEQ ID NO: 810656 - DNA, 25 bp, Mus musculus
tccaccaggatgtttgatgattctt

SEQ ID NO: 810657 - DNA, 25 bp, Mus musculus
tccaccagggacagcagtcagcttg

SEQ ID NO: 810658 - DNA, 25 bp, Mus musculus
tccaccagggactgcagtcagcttg

SEQ ID NO: 810659 - DNA, 25 bp, Mus musculus
tccaccaggtccctgtgagcatggg

SEQ ID NO: 810660 - DNA, 25 bp, Mus musculus
tccaccaggtccgtgtgagcatggg

SEQ ID NO: 810661 - DNA, 25 bp, Mus musculus
tccaccataatgagtgtccaccgcg

SEQ ID NO: 810662 - DNA, 25 bp, Mus musculus
tccaccataatgtgtgtccaccgcg

SEQ ID NO: 810663 - DNA, 25 bp, Mus musculus
tccaccatcaaactgttcctgtaca

SEQ ID NO: 810664 - DNA, 25 bp, Mus musculus
tccaccatcaaagtgttcctgtaca

SEQ ID NO: 810665 - DNA, 25 bp, Mus musculus
tccaccatgagcagcagaattcagt

SEQ ID NO: 810666 - DNA, 25 bp, Mus musculus
tccaccatgagctgcagaattcagt

SEQ ID NO: 810667 - DNA, 25 bp, Mus musculus
tccaccatgatcagcagtttctaca

SEQ ID NO: 810668 - DNA, 25 bp, Mus musculus
tccaccatgatctgcagtttctaca

SEQ ID NO: 810669 - DNA, 25 bp, Mus musculus
tccaccatgcatagacagtgaccag

SEQ ID NO: 810670 - DNA, 25 bp, Mus musculus
tccaccatgcattgacagtgaccag

SEQ ID NO: 810671 - DNA, 25 bp, Mus musculus
tccaccattgaacattgcacatagg

SEQ ID NO: 810672 - DNA, 25 bp, Mus musculus
tccaccattgaagattgcacatagg

SEQ ID NO: 810673 - DNA, 25 bp, Mus musculus
tccaccatttgtaccaggcatgcat

SEQ ID NO: 810674 - DNA, 25 bp, Mus musculus
tccaccatttgttccaggcatgcat

SEQ ID NO: 810675 - DNA, 25 bp, Mus musculus
tccacccaaactaaccttatagagc

SEQ ID NO: 810676 - DNA, 25 bp, Mus musculus
tccacccaaacttaccttatagagc

SEQ ID NO: 810677 - DNA, 25 bp, Mus musculus
tccacccaaatgagggccccaatgg

SEQ ID NO: 810678 - DNA, 25 bp, Mus musculus
tccacccaaatgtgggccccaatgg

SEQ ID NO: 810679 - DNA, 25 bp, Mus musculus
tccacccaaggcagtttgtcagagc

SEQ ID NO: 810680 - DNA, 25 bp, Mus musculus
tccacccaaggctgtttgtcagagc

SEQ ID NO: 810681 - DNA, 25 bp, Mus musculus
tccacccacattatcttgcataaag

SEQ ID NO: 810682 - DNA, 25 bp, Mus musculus
tccacccacattttcttgcataaag

SEQ ID NO: 810683 - DNA, 25 bp, Mus musculus
tccacccactggcagaatttgcata

SEQ ID NO: 810684 - DNA, 25 bp, Mus musculus
tccacccactgggagaatttgcata

SEQ ID NO: 810685 - DNA, 25 bp, Mus musculus
tccacccagcttacctgttaagaaa

SEQ ID NO: 810686 - DNA, 25 bp, Mus musculus
tccacccagctttcctgttaagaaa

SEQ ID NO: 810687 - DNA, 25 bp, Mus musculus
tccacccaggttcagtcttaatctt

SEQ ID NO: 810688 - DNA, 25 bp, Mus musculus
tccacccaggttgagtcttaatctt

SEQ ID NO: 810689 - DNA, 25 bp, Mus musculus
tccacccagtagagttctaaaattt

SEQ ID NO: 810690 - DNA, 25 bp, Mus musculus
tccacccagtagtgttctaaaattt

SEQ ID NO: 810691 - DNA, 25 bp, Mus musculus
tccacccagtgaattagctaagcct

SEQ ID NO: 810692 - DNA, 25 bp, Mus musculus
tccacccagtgatttagctaagcct

SEQ ID NO: 810693 - DNA, 25 bp, Mus musculus
tccacccagtgtaaaccgtacagaa

SEQ ID NO: 810694 - DNA, 25 bp, Mus musculus
tccacccagtgttaaccgtacagaa

SEQ ID NO: 810695 - DNA, 25 bp, Mus musculus
tccacccatctgactatcacagagg

SEQ ID NO: 810696 - DNA, 25 bp, Mus musculus
tccacccatctgtctatcacagagg

SEQ ID NO: 810697 - DNA, 25 bp, Mus musculus
tccacccatgcacctgggtactggg

SEQ ID NO: 810698 - DNA, 25 bp, Mus musculus
tccacccatgcagctgggtactggg

SEQ ID NO: 810699 - DNA, 25 bp, Mus musculus
tccacccatgctacaacagaactgt

SEQ ID NO: 810700 - DNA, 25 bp, Mus musculus
tccacccatgcttcaacagaactgt

SEQ ID NO: 810701 - DNA, 25 bp, Mus musculus
tccacccatgtcatgatgcctttat

SEQ ID NO: 810702 - DNA, 25 bp, Mus musculus
tccacccatgtcttgatgcctttat

SEQ ID NO: 810703 - DNA, 25 bp, Mus musculus
tccacccattttcagtgagtagctg

SEQ ID NO: 810704 - DNA, 25 bp, Mus musculus
tccacccattttgagtgagtagctg

SEQ ID NO: 810705 - DNA, 25 bp, Mus musculus
tccaccccaactactctgaaaataa

SEQ ID NO: 810706 - DNA, 25 bp, Mus musculus
tccaccccaacttctctgaaaataa

SEQ ID NO: 810707 - DNA, 25 bp, Mus musculus
tccaccccaatgatgttctcaagat

SEQ ID NO: 810708 - DNA, 25 bp, Mus musculus
tccaccccaatgttgttctcaagat

SEQ ID NO: 810709 - DNA, 25 bp, Mus musculus
tccaccccacagatgtgcttggaag

SEQ ID NO: 810710 - DNA, 25 bp, Mus musculus
tccaccccacagttgtgcttggaag

SEQ ID NO: 810711 - DNA, 25 bp, Mus musculus
tccaccccactgaattgtccagaga

SEQ ID NO: 810712 - DNA, 25 bp, Mus musculus
tccaccccactgtattgtccagaga

SEQ ID NO: 810713 - DNA, 25 bp, Mus musculus
tccaccccggaacattcaagagcaa

SEQ ID NO: 810714 - DNA, 25 bp, Mus musculus
tccaccccggaagattcaagagcaa

SEQ ID NO: 810715 - DNA, 25 bp, Mus musculus
tccacccctgctagacagaggttgt

SEQ ID NO: 810716 - DNA, 25 bp, Mus musculus
tccacccctgcttgacagaggttgt

SEQ ID NO: 810717 - DNA, 25 bp, Mus musculus
tccacccctggtagtacttgactaa

SEQ ID NO: 810718 - DNA, 25 bp, Mus musculus
tccacccctggttgtacttgactaa

SEQ ID NO: 810719 - DNA, 25 bp, Mus musculus
tccacccctgtgagagcaagttatt

SEQ ID NO: 810720 - DNA, 25 bp, Mus musculus
tccacccctgtgtgagcaagttatt

SEQ ID NO: 810721 - DNA, 25 bp, Mus musculus
tccacccctgttacaactgtgtgct

SEQ ID NO: 810722 - DNA, 25 bp, Mus musculus
tccacccctgtttcaactgtgtgct

SEQ ID NO: 810723 - DNA, 25 bp, Mus musculus
tccaccccttagccacagtgagaaa

SEQ ID NO: 810724 - DNA, 25 bp, Mus musculus
tccaccccttaggcacagtgagaaa

SEQ ID NO: 810725 - DNA, 25 bp, Mus musculus
tccacccggattcgaattactgaca

SEQ ID NO: 810726 - DNA, 25 bp, Mus musculus
tccacccggattggaattactgaca

SEQ ID NO: 810727 - DNA, 25 bp, Mus musculus
tccacccggcacacaggaagtgagt

SEQ ID NO: 810728 - DNA, 25 bp, Mus musculus
tccacccggcactcaggaagtgagt

SEQ ID NO: 810729 - DNA, 25 bp, Mus musculus
tccacccggcagaagatcgtagagc

SEQ ID NO: 810730 - DNA, 25 bp, Mus musculus
tccacccggcagtagatcgtagagc

SEQ ID NO: 810731 - DNA, 25 bp, Mus musculus
tccacccgtggaatttatgcgaatg

SEQ ID NO: 810732 - DNA, 25 bp, Mus musculus
tccacccgtggattttatgcgaatg

SEQ ID NO: 810733 - DNA, 25 bp, Mus musculus
tccaccctagatctcgcatggttgg

SEQ ID NO: 810734 - DNA, 25 bp, Mus musculus
tccaccctagatgtcgcatggttgg

SEQ ID NO: 810735 - DNA, 25 bp, Mus musculus
tccaccctatgaccaatcaggacat

SEQ ID NO: 810736 - DNA, 25 bp, Mus musculus
tccaccctatgagcaatcaggacat

SEQ ID NO: 810737 - DNA, 25 bp, Mus musculus
tccaccctcattctgttgagcatag

SEQ ID NO: 810738 - DNA, 25 bp, Mus musculus
tccaccctcattgtgttgagcatag

SEQ ID NO: 810739 - DNA, 25 bp, Mus musculus
tccaccctctgactgagctttgcat

SEQ ID NO: 810740 - DNA, 25 bp, Mus musculus
tccaccctctgagtgagctttgcat

SEQ ID NO: 810741 - DNA, 25 bp, Mus musculus
tccaccctgtcacgaagtctgcaag

SEQ ID NO: 810742 - DNA, 25 bp, Mus musculus
tccaccctgtcaggaagtctgcaag

SEQ ID NO: 810743 - DNA, 25 bp, Mus musculus
tccaccctgtgacgtgcagggctgc

SEQ ID NO: 810744 - DNA, 25 bp, Mus musculus
tccaccctgtgaggtgcagggctgc

SEQ ID NO: 810745 - DNA, 25 bp, Mus musculus
tccacccttcagcaattcggtttat

SEQ ID NO: 810746 - DNA, 25 bp, Mus musculus
tccacccttcaggaattcggtttat

SEQ ID NO: 810747 - DNA, 25 bp, Mus musculus
tccacccttcatcattttcacagtt

SEQ ID NO: 810748 - DNA, 25 bp, Mus musculus
tccacccttcatgattttcacagtt

SEQ ID NO: 810749 - DNA, 25 bp, Mus musculus
tccaccctttcacctttgtgaattt

SEQ ID NO: 810750 - DNA, 25 bp, Mus musculus
tccaccctttcagctttgtgaattt

SEQ ID NO: 810751 - DNA, 25 bp, Mus musculus
tccaccctttgtaagaagcggttca

SEQ ID NO: 810752 - DNA, 25 bp, Mus musculus
tccaccctttgttagaagcggttca

SEQ ID NO: 810753 - DNA, 25 bp, Mus musculus
tccaccgagccacattgatgactta

SEQ ID NO: 810754 - DNA, 25 bp, Mus musculus
tccaccgagccagattgatgactta

SEQ ID NO: 810755 - DNA, 25 bp, Mus musculus
tccaccgagtggctcaccattcagg

SEQ ID NO: 810756 - DNA, 25 bp, Mus musculus
tccaccgagtgggtcaccattcagg

SEQ ID NO: 810757 - DNA, 25 bp, Mus musculus
tccaccgagttgagtgccatgctgg

SEQ ID NO: 810758 - DNA, 25 bp, Mus musculus
tccaccgagttgtgtgccatgctgg

SEQ ID NO: 810759 - DNA, 25 bp, Mus musculus
tccaccgatgcaagtcactggtcat

SEQ ID NO: 810760 - DNA, 25 bp, Mus musculus
tccaccgatgcactccaagagtgaa

SEQ ID NO: 810761 - DNA, 25 bp, Mus musculus
tccaccgatgcagtccaagagtgaa

SEQ ID NO: 810762 - DNA, 25 bp, Mus musculus
tccaccgatgcatgtcactggtcat

SEQ ID NO: 810763 - DNA, 25 bp, Mus musculus
tccaccgcaacacctgcagatgttg

SEQ ID NO: 810764 - DNA, 25 bp, Mus musculus
tccaccgcaacagctgcagatgttg

SEQ ID NO: 810765 - DNA, 25 bp, Mus musculus
tccaccgcagatcgaacgcctaaga

SEQ ID NO: 810766 - DNA, 25 bp, Mus musculus
tccaccgcagatggaacgcctaaga

SEQ ID NO: 810767 - DNA, 25 bp, Mus musculus
tccaccgtacagagcacgcgaggag

SEQ ID NO: 810768 - DNA, 25 bp, Mus musculus
tccaccgtacagtgcacgcgaggag

SEQ ID NO: 810769 - DNA, 25 bp, Mus musculus
tccaccgtatgcctatatcttttac

SEQ ID NO: 810770 - DNA, 25 bp, Mus musculus
tccaccgtatgcgtatatcttttac

SEQ ID NO: 810771 - DNA, 25 bp, Mus musculus
tccaccgtcctgaatactgttcaaa

SEQ ID NO: 810772 - DNA, 25 bp, Mus musculus
tccaccgtcctgtatactgttcaaa

SEQ ID NO: 810773 - DNA, 25 bp, Mus musculus
tccaccgtcgtcctatggattggca

SEQ ID NO: 810774 - DNA, 25 bp, Mus musculus
tccaccgtcgtcgtatggattggca

SEQ ID NO: 810775 - DNA, 25 bp, Mus musculus
tccaccgtggttagaagtcagcttt

SEQ ID NO: 810776 - DNA, 25 bp, Mus musculus
tccaccgtggtttgaagtcagcttt

SEQ ID NO: 810777 - DNA, 25 bp, Mus musculus
tccaccgttcctactgaatgttttt

SEQ ID NO: 810778 - DNA, 25 bp, Mus musculus
tccaccgttccttctgaatgttttt

SEQ ID NO: 810779 - DNA, 25 bp, Mus musculus
tccaccgttttcagcatatgttgct

SEQ ID NO: 810780 - DNA, 25 bp, Mus musculus
tccaccgttttctgcatatgttgct

SEQ ID NO: 810781 - DNA, 25 bp, Mus musculus
tccacctacagacactcagtggata

SEQ ID NO: 810782 - DNA, 25 bp, Mus musculus
tccacctacagagactcagtggata

SEQ ID NO: 810783 - DNA, 25 bp, Mus musculus
tccacctacgtcaagcttctaaatg

SEQ ID NO: 810784 - DNA, 25 bp, Mus musculus
tccacctacgtctagcttctaaatg

SEQ ID NO: 810785 - DNA, 25 bp, Mus musculus
tccacctagaatccagcaacgatct

SEQ ID NO: 810786 - DNA, 25 bp, Mus musculus
tccacctagaatgcagcaacgatct

SEQ ID NO: 810787 - DNA, 25 bp, Mus musculus
tccacctatgcacaatgctaagaat

SEQ ID NO: 810788 - DNA, 25 bp, Mus musculus
tccacctatgcagaatgctaagaat

SEQ ID NO: 810789 - DNA, 25 bp, Mus musculus
tccacctcaagtagcattggctctg

SEQ ID NO: 810790 - DNA, 25 bp, Mus musculus
tccacctcaagttgcattggctctg

SEQ ID NO: 810791 - DNA, 25 bp, Mus musculus
tccacctcaggacatcaggaaacca

SEQ ID NO: 810792 - DNA, 25 bp, Mus musculus
tccacctcaggagatcaggaaacca

SEQ ID NO: 810793 - DNA, 25 bp, Mus musculus
tccacctccaaaagttgactatcca

SEQ ID NO: 810794 - DNA, 25 bp, Mus musculus
tccacctccaaatgttgactatcca

SEQ ID NO: 810795 - DNA, 25 bp, Mus musculus
tccacctcggtcagccctaagaatt

SEQ ID NO: 810796 - DNA, 25 bp, Mus musculus
tccacctcggtctgccctaagaatt

SEQ ID NO: 810797 - DNA, 25 bp, Mus musculus
tccacctctctgagtattacggaat

SEQ ID NO: 810798 - DNA, 25 bp, Mus musculus
tccacctctctgtgtattacggaat

SEQ ID NO: 810799 - DNA, 25 bp, Mus musculus
tccacctcttacactaacgctaggg

SEQ ID NO: 810800 - DNA, 25 bp, Mus musculus
tccacctcttactctaacgctaggg

SEQ ID NO: 810801 - DNA, 25 bp, Mus musculus
tccacctcttccagacgtgaggaag

SEQ ID NO: 810802 - DNA, 25 bp, Mus musculus
tccacctcttcctgacgtgaggaag

SEQ ID NO: 810803 - DNA, 25 bp, Mus musculus
tccacctgagaaatccttctttttt

SEQ ID NO: 810804 - DNA, 25 bp, Mus musculus
tccacctgagaattccttctttttt

SEQ ID NO: 810805 - DNA, 25 bp, Mus musculus
tccacctgagccctcagacataggg

SEQ ID NO: 810806 - DNA, 25 bp, Mus musculus
tccacctgagccgtcagacataggg

SEQ ID NO: 810807 - DNA, 25 bp, Mus musculus
tccacctgaggcatctcgtcttttc

SEQ ID NO: 810808 - DNA, 25 bp, Mus musculus
tccacctgaggcttctcgtcttttc

SEQ ID NO: 810809 - DNA, 25 bp, Mus musculus
tccacctgatatccctgggcagcag

SEQ ID NO: 810810 - DNA, 25 bp, Mus musculus
tccacctgatatgcctgggcagcag

SEQ ID NO: 810811 - DNA, 25 bp, Mus musculus
tccacctgcaagctttctaacagtt

SEQ ID NO: 810812 - DNA, 25 bp, Mus musculus
tccacctgcaaggtttctaacagtt

SEQ ID NO: 810813 - DNA, 25 bp, Mus musculus
tccacctggctaatcttcactgaca

SEQ ID NO: 810814 - DNA, 25 bp, Mus musculus
tccacctggctattcttcactgaca

SEQ ID NO: 810815 - DNA, 25 bp, Mus musculus
tccacctggctcagcgaggcagaga

SEQ ID NO: 810816 - DNA, 25 bp, Mus musculus
tccacctggctctgcgaggcagaga

SEQ ID NO: 810817 - DNA, 25 bp, Mus musculus
tccacctggcttaatacatgtacta

SEQ ID NO: 810818 - DNA, 25 bp, Mus musculus
tccacctggcttatcagctgtataa

SEQ ID NO: 810819 - DNA, 25 bp, Mus musculus
tccacctggctttatacatgtacta

SEQ ID NO: 810820 - DNA, 25 bp, Mus musculus
tccacctggcttttcagctgtataa

SEQ ID NO: 810821 - DNA, 25 bp, Mus musculus
tccacctggtggaattagctcagct

SEQ ID NO: 810822 - DNA, 25 bp, Mus musculus
tccacctggtggtattagctcagct

SEQ ID NO: 810823 - DNA, 25 bp, Mus musculus
tccacctgtgacattccaacaagtg

SEQ ID NO: 810824 - DNA, 25 bp, Mus musculus
tccacctgtgactttccaacaagtg

SEQ ID NO: 810825 - DNA, 25 bp, Mus musculus
tccacctgttgtaaccggtccttga

SEQ ID NO: 810826 - DNA, 25 bp, Mus musculus
tccacctgttgttaccggtccttga

SEQ ID NO: 810827 - DNA, 25 bp, Mus musculus
tccaccttaccgattaggtcagtca

SEQ ID NO: 810828 - DNA, 25 bp, Mus musculus
tccaccttaccgtttaggtcagtca

SEQ ID NO: 810829 - DNA, 25 bp, Mus musculus
tccaccttagggaccaatgtcaggc

SEQ ID NO: 810830 - DNA, 25 bp, Mus musculus
tccaccttagggtccaatgtcaggc

SEQ ID NO: 810831 - DNA, 25 bp, Mus musculus
tccaccttaggtatagtacacgtgt

SEQ ID NO: 810832 - DNA, 25 bp, Mus musculus
tccaccttaggtttagtacacgtgt

SEQ ID NO: 810833 - DNA, 25 bp, Mus musculus
tccaccttatacactgctgtctgaa

SEQ ID NO: 810834 - DNA, 25 bp, Mus musculus
tccaccttatactctgctgtctgaa

SEQ ID NO: 810835 - DNA, 25 bp, Mus musculus
tccaccttatgcatcccaggaaaga

SEQ ID NO: 810836 - DNA, 25 bp, Mus musculus
tccaccttatgcttcccaggaaaga

SEQ ID NO: 810837 - DNA, 25 bp, Mus musculus
tccaccttccagagtaagcactgtg

SEQ ID NO: 810838 - DNA, 25 bp, Mus musculus
tccaccttccagtgtaagcactgtg

SEQ ID NO: 810839 - DNA, 25 bp, Mus musculus
tccaccttcgaacgctgcaattaca

SEQ ID NO: 810840 - DNA, 25 bp, Mus musculus
tccaccttcgaaggctgcaattaca

SEQ ID NO: 810841 - DNA, 25 bp, Mus musculus
tccaccttctacagaaaggctgaac

SEQ ID NO: 810842 - DNA, 25 bp, Mus musculus
tccaccttctactgaaaggctgaac

SEQ ID NO: 810843 - DNA, 25 bp, Mus musculus
tccaccttgagcatctggcattttg

SEQ ID NO: 810844 - DNA, 25 bp, Mus musculus
tccaccttgagcttctggcattttg

SEQ ID NO: 810845 - DNA, 25 bp, Mus musculus
tccaccttggcaatggcaataaagg

SEQ ID NO: 810846 - DNA, 25 bp, Mus musculus
tccaccttggcattggcaataaagg

SEQ ID NO: 810847 - DNA, 25 bp, Mus musculus
tccaccttggcgatcgtcagataag

SEQ ID NO: 810848 - DNA, 25 bp, Mus musculus
tccaccttggcgttcgtcagataag

SEQ ID NO: 810849 - DNA, 25 bp, Mus musculus
tccaccttgggccatagtcatagta

SEQ ID NO: 810850 - DNA, 25 bp, Mus musculus
tccaccttgggcgatagtcatagta

SEQ ID NO: 810851 - DNA, 25 bp, Mus musculus
tccaccttgtcaagttcagccgcat

SEQ ID NO: 810852 - DNA, 25 bp, Mus musculus
tccaccttgtcatgttcagccgcat

SEQ ID NO: 810853 - DNA, 25 bp, Mus musculus
tccaccttgtgactgccagggttat

SEQ ID NO: 810854 - DNA, 25 bp, Mus musculus
tccaccttgtgagtgccagggttat

SEQ ID NO: 810855 - DNA, 25 bp, Mus musculus
tccacctttattagcttctgagttc

SEQ ID NO: 810856 - DNA, 25 bp, Mus musculus
tccacctttatttgcttctgagttc

SEQ ID NO: 810857 - DNA, 25 bp, Mus musculus
tccacctttgacactgtgatgactc

SEQ ID NO: 810858 - DNA, 25 bp, Mus musculus
tccacctttgactctgtgatgactc

SEQ ID NO: 810859 - DNA, 25 bp, Mus musculus
tccaccttttcaacctgtttgggtg

SEQ ID NO: 810860 - DNA, 25 bp, Mus musculus
tccaccttttcacctataagtaggg

SEQ ID NO: 810861 - DNA, 25 bp, Mus musculus
tccaccttttcagctataagtaggg

SEQ ID NO: 810862 - DNA, 25 bp, Mus musculus
tccaccttttcatcctgtttgggtg

SEQ ID NO: 810863 - DNA, 25 bp, Mus musculus
tccacgaaagtcctacctttacctg

SEQ ID NO: 810864 - DNA, 25 bp, Mus musculus
tccacgaaagtcgtacctttacctg

SEQ ID NO: 810865 - DNA, 25 bp, Mus musculus
tccacgaatccaaaagctgctctca

SEQ ID NO: 810866 - DNA, 25 bp, Mus musculus
tccacgaatccataagctgctctca

SEQ ID NO: 810867 - DNA, 25 bp, Mus musculus
tccacgacaccacagtctgactgtt

SEQ ID NO: 810868 - DNA, 25 bp, Mus musculus
tccacgacaccagagtctgactgtt

SEQ ID NO: 810869 - DNA, 25 bp, Mus musculus
tccacgactaggcagaagggattcc

SEQ ID NO: 810870 - DNA, 25 bp, Mus musculus
tccacgactagggagaagggattcc

SEQ ID NO: 810871 - DNA, 25 bp, Mus musculus
tccacgacttcaagcctgaactgtt

SEQ ID NO: 810872 - DNA, 25 bp, Mus musculus
tccacgacttcatgcctgaactgtt

SEQ ID NO: 810873 - DNA, 25 bp, Mus musculus
tccacgagaccaacttactgaaatt

SEQ ID NO: 810874 - DNA, 25 bp, Mus musculus
tccacgagaccatcttactgaaatt

SEQ ID NO: 810875 - DNA, 25 bp, Mus musculus
tccacgagaggcctggataccgcgt

SEQ ID NO: 810876 - DNA, 25 bp, Mus musculus
tccacgagaggcgtggataccgcgt

SEQ ID NO: 810877 - DNA, 25 bp, Mus musculus
tccacgagtggaagtaaagcgccct

SEQ ID NO: 810878 - DNA, 25 bp, Mus musculus
tccacgagtggatgtaaagcgccct

SEQ ID NO: 810879 - DNA, 25 bp, Mus musculus
tccacgagtttacagagtgcttata

SEQ ID NO: 810880 - DNA, 25 bp, Mus musculus
tccacgagtttagagagtgcttata

SEQ ID NO: 810881 - DNA, 25 bp, Mus musculus
tccacgatacagaggactgtcccac

SEQ ID NO: 810882 - DNA, 25 bp, Mus musculus
tccacgatacagtggactgtcccac

SEQ ID NO: 810883 - DNA, 25 bp, Mus musculus
tccacgataggtcggttagcctgta

SEQ ID NO: 810884 - DNA, 25 bp, Mus musculus
tccacgataggtgggttagcctgta

SEQ ID NO: 810885 - DNA, 25 bp, Mus musculus
tccacgatgatccttaaaggattcc

SEQ ID NO: 810886 - DNA, 25 bp, Mus musculus
tccacgatgatcgttaaaggattcc

SEQ ID NO: 810887 - DNA, 25 bp, Mus musculus
tccacgcaacctcaaaatggcattc

SEQ ID NO: 810888 - DNA, 25 bp, Mus musculus
tccacgcaacctgaaaatggcattc

SEQ ID NO: 810889 - DNA, 25 bp, Mus musculus
tccacgcagctgatgcagagttaca

SEQ ID NO: 810890 - DNA, 25 bp, Mus musculus
tccacgcagctgttgcagagttaca

SEQ ID NO: 810891 - DNA, 25 bp, Mus musculus
tccacgcaggatatgtgatgtcccc

SEQ ID NO: 810892 - DNA, 25 bp, Mus musculus
tccacgcaggatttgtgatgtcccc

SEQ ID NO: 810893 - DNA, 25 bp, Mus musculus
tccacgccacaaaagagaagatccg

SEQ ID NO: 810894 - DNA, 25 bp, Mus musculus
tccacgccacaatagagaagatccg

SEQ ID NO: 810895 - DNA, 25 bp, Mus musculus
tccacgccatttctggagaggccat

SEQ ID NO: 810896 - DNA, 25 bp, Mus musculus
tccacgccatttgtggagaggccat

SEQ ID NO: 810897 - DNA, 25 bp, Mus musculus
tccacgcccgttccacaaggaagaa

SEQ ID NO: 810898 - DNA, 25 bp, Mus musculus
tccacgcccgttgcacaaggaagaa

SEQ ID NO: 810899 - DNA, 25 bp, Mus musculus
tccacgccttagctattacctgatg

SEQ ID NO: 810900 - DNA, 25 bp, Mus musculus
tccacgccttaggtattacctgatg

SEQ ID NO: 810901 - DNA, 25 bp, Mus musculus
tccacgcgtgggactgtgaaaccga

SEQ ID NO: 810902 - DNA, 25 bp, Mus musculus
tccacgcgtgggtctgtgaaaccga

SEQ ID NO: 810903 - DNA, 25 bp, Mus musculus
tccacgctatggagaggacagttgt

SEQ ID NO: 810904 - DNA, 25 bp, Mus musculus
tccacgctatggtgaggacagttgt

SEQ ID NO: 810905 - DNA, 25 bp, Mus musculus
tccacggagggcaccatgggatgat

SEQ ID NO: 810906 - DNA, 25 bp, Mus musculus
tccacggagggctccatgggatgat

SEQ ID NO: 810907 - DNA, 25 bp, Mus musculus
tccacggatcatcgtctaatcacat

SEQ ID NO: 810908 - DNA, 25 bp, Mus musculus
tccacggatcatggtctaatcacat

SEQ ID NO: 810909 - DNA, 25 bp, Mus musculus
tccacggattccacggatgctgatt

SEQ ID NO: 810910 - DNA, 25 bp, Mus musculus
tccacggattcctcggatgctgatt

SEQ ID NO: 810911 - DNA, 25 bp, Mus musculus
tccacggcaattccactgtacagat

SEQ ID NO: 810912 - DNA, 25 bp, Mus musculus
tccacggcaattgcactgtacagat

SEQ ID NO: 810913 - DNA, 25 bp, Mus musculus
tccacggcaggaattcttaccaaaa

SEQ ID NO: 810914 - DNA, 25 bp, Mus musculus
tccacggcaggatttcttaccaaaa

SEQ ID NO: 810915 - DNA, 25 bp, Mus musculus
tccacggccagtaattcatcagact

SEQ ID NO: 810916 - DNA, 25 bp, Mus musculus
tccacggccagttattcatcagact

SEQ ID NO: 810917 - DNA, 25 bp, Mus musculus
tccacggccggtcgtaagccgtcgg

SEQ ID NO: 810918 - DNA, 25 bp, Mus musculus
tccacggccggtggtaagccgtcgg

SEQ ID NO: 810919 - DNA, 25 bp, Mus musculus
tccacggcgcgcagcgattagcagt

SEQ ID NO: 810920 - DNA, 25 bp, Mus musculus
tccacggcgcgctgcgattagcagt

SEQ ID NO: 810921 - DNA, 25 bp, Mus musculus
tccacgggacagaaacccagctggc

SEQ ID NO: 810922 - DNA, 25 bp, Mus musculus
tccacgggacagtaacccagctggc

SEQ ID NO: 810923 - DNA, 25 bp, Mus musculus
tccacgggacccatttagataactg

SEQ ID NO: 810924 - DNA, 25 bp, Mus musculus
tccacgggacccttttagataactg

SEQ ID NO: 810925 - DNA, 25 bp, Mus musculus
tccacgggctcgctgttaattgaaa

SEQ ID NO: 810926 - DNA, 25 bp, Mus musculus
tccacgggctcggtgttaattgaaa

SEQ ID NO: 810927 - DNA, 25 bp, Mus musculus
tccacgggtgaccaggaacacggca

SEQ ID NO: 810928 - DNA, 25 bp, Mus musculus
tccacgggtgacgaggaacacggca

SEQ ID NO: 810929 - DNA, 25 bp, Mus musculus
tccacgggtgctaagtggcacacat

SEQ ID NO: 810930 - DNA, 25 bp, Mus musculus
tccacgggtgcttagtggcacacat

SEQ ID NO: 810931 - DNA, 25 bp, Mus musculus
tccacggtcaggcaggttttaagtc

SEQ ID NO: 810932 - DNA, 25 bp, Mus musculus
tccacggtcagggaggttttaagtc

SEQ ID NO: 810933 - DNA, 25 bp, Mus musculus
tccacggtgccacgatactctgagg

SEQ ID NO: 810934 - DNA, 25 bp, Mus musculus
tccacggtgccaggatactctgagg

SEQ ID NO: 810935 - DNA, 25 bp, Mus musculus
tccacggtgggcattatctcattta

SEQ ID NO: 810936 - DNA, 25 bp, Mus musculus
tccacggtgggctttatctcattta

SEQ ID NO: 810937 - DNA, 25 bp, Mus musculus
tccacgtccagtcacatcaggaagg

SEQ ID NO: 810938 - DNA, 25 bp, Mus musculus
tccacgtccagtcccatttggagaa

SEQ ID NO: 810939 - DNA, 25 bp, Mus musculus
tccacgtccagtgacatcaggaagg

SEQ ID NO: 810940 - DNA, 25 bp, Mus musculus
tccacgtccagtgccatttggagaa

SEQ ID NO: 810941 - DNA, 25 bp, Mus musculus
tccacgtcttagctccttaatatga

SEQ ID NO: 810942 - DNA, 25 bp, Mus musculus
tccacgtcttaggtccttaatatga

SEQ ID NO: 810943 - DNA, 25 bp, Mus musculus
tccacgtgagtaaaccttccttatt

SEQ ID NO: 810944 - DNA, 25 bp, Mus musculus
tccacgtgagtataccttccttatt

SEQ ID NO: 810945 - DNA, 25 bp, Mus musculus
tccacgtgcctgcatggacatgttc

SEQ ID NO: 810946 - DNA, 25 bp, Mus musculus
tccacgtgcctggatggacatgttc

SEQ ID NO: 810947 - DNA, 25 bp, Mus musculus
tccacgtgcttgctgtgagttgttt

SEQ ID NO: 810948 - DNA, 25 bp, Mus musculus
tccacgtgcttggtgtgagttgttt

SEQ ID NO: 810949 - DNA, 25 bp, Mus musculus
tccacgtggaaacttctgacggctc

SEQ ID NO: 810950 - DNA, 25 bp, Mus musculus
tccacgtggaaagttctgacggctc

SEQ ID NO: 810951 - DNA, 25 bp, Mus musculus
tccacgtggtatattctaatcgcgc

SEQ ID NO: 810952 - DNA, 25 bp, Mus musculus
tccacgtggtattttctaatcgcgc

SEQ ID NO: 810953 - DNA, 25 bp, Mus musculus
tccacgttacacactaccttaattt

SEQ ID NO: 810954 - DNA, 25 bp, Mus musculus
tccacgttacactctaccttaattt

SEQ ID NO: 810955 - DNA, 25 bp, Mus musculus
tccacgttagtgagaacgcctctgt

SEQ ID NO: 810956 - DNA, 25 bp, Mus musculus
tccacgttagtgtgaacgcctctgt

SEQ ID NO: 810957 - DNA, 25 bp, Mus musculus
tccacgttctttccagattgctttt

SEQ ID NO: 810958 - DNA, 25 bp, Mus musculus
tccacgttctttgcagattgctttt

SEQ ID NO: 810959 - DNA, 25 bp, Mus musculus
tccacgtttttcaagaccgttactg

SEQ ID NO: 810960 - DNA, 25 bp, Mus musculus
tccacgtttttctagaccgttactg

SEQ ID NO: 810961 - DNA, 25 bp, Mus musculus
tccactaaacataaaacactttgct

SEQ ID NO: 810962 - DNA, 25 bp, Mus musculus
tccactaaacattaaacactttgct

SEQ ID NO: 810963 - DNA, 25 bp, Mus musculus
tccactaatcggactgccaaatttc

SEQ ID NO: 810964 - DNA, 25 bp, Mus musculus
tccactaatcggtctgccaaatttc

SEQ ID NO: 810965 - DNA, 25 bp, Mus musculus
tccactaccgtgatttgcatcgaga

SEQ ID NO: 810966 - DNA, 25 bp, Mus musculus
tccactaccgtgttttgcatcgaga

SEQ ID NO: 810967 - DNA, 25 bp, Mus musculus
tccactacctccagatagcgtggag

SEQ ID NO: 810968 - DNA, 25 bp, Mus musculus
tccactacctcctgatagcgtggag

SEQ ID NO: 810969 - DNA, 25 bp, Mus musculus
tccactactgcgaggttttcctgca

SEQ ID NO: 810970 - DNA, 25 bp, Mus musculus
tccactactgcgtggttttcctgca

SEQ ID NO: 810971 - DNA, 25 bp, Mus musculus
tccactagagggatatgaggccttg

SEQ ID NO: 810972 - DNA, 25 bp, Mus musculus
tccactagagggttatgaggccttg

SEQ ID NO: 810973 - DNA, 25 bp, Mus musculus
tccactagtattaagctgagccctg

SEQ ID NO: 810974 - DNA, 25 bp, Mus musculus
tccactagtatttagctgagccctg

SEQ ID NO: 810975 - DNA, 25 bp, Mus musculus
tccactagtggcatgctcattcagc

SEQ ID NO: 810976 - DNA, 25 bp, Mus musculus
tccactagtggcttgctcattcagc

SEQ ID NO: 810977 - DNA, 25 bp, Mus musculus
tccactataagaaatctttttcagt

SEQ ID NO: 810978 - DNA, 25 bp, Mus musculus
tccactataagatatctttttcagt

SEQ ID NO: 810979 - DNA, 25 bp, Mus musculus
tccactatgtgaacccagggatcaa

SEQ ID NO: 810980 - DNA, 25 bp, Mus musculus
tccactatgtgatcccagggatcaa

SEQ ID NO: 810981 - DNA, 25 bp, Mus musculus
tccactcaagtgacctaactgcaga

SEQ ID NO: 810982 - DNA, 25 bp, Mus musculus
tccactcaagtgatctccacatgtg

SEQ ID NO: 810983 - DNA, 25 bp, Mus musculus
tccactcaagtgtcctaactgcaga

SEQ ID NO: 810984 - DNA, 25 bp, Mus musculus
tccactcaagtgttctccacatgtg

SEQ ID NO: 810985 - DNA, 25 bp, Mus musculus
tccactcacagtagagggccctaag

SEQ ID NO: 810986 - DNA, 25 bp, Mus musculus
tccactcacagttgagggccctaag

SEQ ID NO: 810987 - DNA, 25 bp, Mus musculus
tccactcaccgtatgcaaatgttgc

SEQ ID NO: 810988 - DNA, 25 bp, Mus musculus
tccactcaccgtttgcaaatgttgc

SEQ ID NO: 810989 - DNA, 25 bp, Mus musculus
tccactcactatatctagaactttc

SEQ ID NO: 810990 - DNA, 25 bp, Mus musculus
tccactcactatttctagaactttc

SEQ ID NO: 810991 - DNA, 25 bp, Mus musculus
tccactcactgccatgcagttgggt

SEQ ID NO: 810992 - DNA, 25 bp, Mus musculus
tccactcactgcgatgcagttgggt

SEQ ID NO: 810993 - DNA, 25 bp, Mus musculus
tccactcatctgatacctgttatag

SEQ ID NO: 810994 - DNA, 25 bp, Mus musculus
tccactcatctgttacctgttatag

SEQ ID NO: 810995 - DNA, 25 bp, Mus musculus
tccactcatgtcatagctcttctaa

SEQ ID NO: 810996 - DNA, 25 bp, Mus musculus
tccactcatgtcttagctcttctaa

SEQ ID NO: 810997 - DNA, 25 bp, Mus musculus
tccactcattccaacaaagcatcag

SEQ ID NO: 810998 - DNA, 25 bp, Mus musculus
tccactcattcctacaaagcatcag

SEQ ID NO: 810999 - DNA, 25 bp, Mus musculus
tccactccacaacgcagcaaaggtt

SEQ ID NO: 811000 - DNA, 25 bp, Mus musculus
tccactccacaaggcagcaaaggtt

SEQ ID NO: 811001 - DNA, 25 bp, Mus musculus
tccactccagttaacaccactgagg

SEQ ID NO: 811002 - DNA, 25 bp, Mus musculus
tccactccagtttacaccactgagg

SEQ ID NO: 811003 - DNA, 25 bp, Mus musculus
tccactccatcgctaaagggcctgg

SEQ ID NO: 811004 - DNA, 25 bp, Mus musculus
tccactccatcggtaaagggcctgg

SEQ ID NO: 811005 - DNA, 25 bp, Mus musculus
tccactccattaagcagcttcgaag

SEQ ID NO: 811006 - DNA, 25 bp, Mus musculus
tccactccattatgcagcttcgaag

SEQ ID NO: 811007 - DNA, 25 bp, Mus musculus
tccactcccattaggaaaggtttct

SEQ ID NO: 811008 - DNA, 25 bp, Mus musculus
tccactcccatttggaaaggtttct

SEQ ID NO: 811009 - DNA, 25 bp, Mus musculus
tccactcccttgattcattgtatct

SEQ ID NO: 811010 - DNA, 25 bp, Mus musculus
tccactcccttgtttcattgtatct

SEQ ID NO: 811011 - DNA, 25 bp, Mus musculus
tccactccgatcctcaggaaacagt

SEQ ID NO: 811012 - DNA, 25 bp, Mus musculus
tccactccgatcgtcaggaaacagt

SEQ ID NO: 811013 - DNA, 25 bp, Mus musculus
tccactcctggcatagataccaaag

SEQ ID NO: 811014 - DNA, 25 bp, Mus musculus
tccactcctggcttagataccaaag

SEQ ID NO: 811015 - DNA, 25 bp, Mus musculus
tccactccttccagaacgacaatta

SEQ ID NO: 811016 - DNA, 25 bp, Mus musculus
tccactccttcctgaacgacaatta

SEQ ID NO: 811017 - DNA, 25 bp, Mus musculus
tccactcgctggcagttgcagaaga

SEQ ID NO: 811018 - DNA, 25 bp, Mus musculus
tccactcgctgggagttgcagaaga

SEQ ID NO: 811019 - DNA, 25 bp, Mus musculus
tccactcggaggactggttgtgctg

SEQ ID NO: 811020 - DNA, 25 bp, Mus musculus
tccactcggaggtctggttgtgctg

SEQ ID NO: 811021 - DNA, 25 bp, Mus musculus
tccactcggtcaagctcacgaggaa

SEQ ID NO: 811022 - DNA, 25 bp, Mus musculus
tccactcggtcatgctcacgaggaa

SEQ ID NO: 811023 - DNA, 25 bp, Mus musculus
tccactcgtggaaacatttatgccg

SEQ ID NO: 811024 - DNA, 25 bp, Mus musculus
tccactcgtggaaggtgttcatgtg

SEQ ID NO: 811025 - DNA, 25 bp, Mus musculus
tccactcgtggatacatttatgccg

SEQ ID NO: 811026 - DNA, 25 bp, Mus musculus
tccactcgtggatggtgttcatgtg

SEQ ID NO: 811027 - DNA, 25 bp, Mus musculus
tccactctaactcagctttatcagg

SEQ ID NO: 811028 - DNA, 25 bp, Mus musculus
tccactctaactgagctttatcagg

SEQ ID NO: 811029 - DNA, 25 bp, Mus musculus
tccactctacctcttattaggcatt

SEQ ID NO: 811030 - DNA, 25 bp, Mus musculus
tccactctacctgttattaggcatt

SEQ ID NO: 811031 - DNA, 25 bp, Mus musculus
tccactctagaaaatcttttatctc

SEQ ID NO: 811032 - DNA, 25 bp, Mus musculus
tccactctagaatatcttttatctc

SEQ ID NO: 811033 - DNA, 25 bp, Mus musculus
tccactctcaggagatctgtgctga

SEQ ID NO: 811034 - DNA, 25 bp, Mus musculus
tccactctcaggtgatctgtgctga

SEQ ID NO: 811035 - DNA, 25 bp, Mus musculus
tccactctcggaaaatgaacttgac

SEQ ID NO: 811036 - DNA, 25 bp, Mus musculus
tccactctcggataatgaacttgac

SEQ ID NO: 811037 - DNA, 25 bp, Mus musculus
tccactctcggtcatttgtattttt

SEQ ID NO: 811038 - DNA, 25 bp, Mus musculus
tccactctcggtgatttgtattttt

SEQ ID NO: 811039 - DNA, 25 bp, Mus musculus
tccactctctaaacgctgggcttaa

SEQ ID NO: 811040 - DNA, 25 bp, Mus musculus
tccactctctaatcgctgggcttaa

SEQ ID NO: 811041 - DNA, 25 bp, Mus musculus
tccactctctgcctggtgttgaagg

SEQ ID NO: 811042 - DNA, 25 bp, Mus musculus
tccactctctgcgtggtgttgaagg

SEQ ID NO: 811043 - DNA, 25 bp, Mus musculus
tccactctggagcttgtaatcatga

SEQ ID NO: 811044 - DNA, 25 bp, Mus musculus
tccactctggaggttgtaatcatga

SEQ ID NO: 811045 - DNA, 25 bp, Mus musculus
tccactctggtcattgttttgggtc

SEQ ID NO: 811046 - DNA, 25 bp, Mus musculus
tccactctggtctttgttttgggtc

SEQ ID NO: 811047 - DNA, 25 bp, Mus musculus
tccactcttccaacaggagcactgt

SEQ ID NO: 811048 - DNA, 25 bp, Mus musculus
tccactcttccatcaggagcactgt

SEQ ID NO: 811049 - DNA, 25 bp, Mus musculus
tccactcttgagagcagcaaggcca

SEQ ID NO: 811050 - DNA, 25 bp, Mus musculus
tccactcttgagtgcagcaaggcca

SEQ ID NO: 811051 - DNA, 25 bp, Mus musculus
tccactcttggcagtaagcaccttt

SEQ ID NO: 811052 - DNA, 25 bp, Mus musculus
tccactcttggctgtaagcaccttt

SEQ ID NO: 811053 - DNA, 25 bp, Mus musculus
tccactcttggtctgtagggggctc

SEQ ID NO: 811054 - DNA, 25 bp, Mus musculus
tccactcttggtgtgtagggggctc

SEQ ID NO: 811055 - DNA, 25 bp, Mus musculus
tccactgacagcaggcatggtcatt

SEQ ID NO: 811056 - DNA, 25 bp, Mus musculus
tccactgacagctggcatggtcatt

SEQ ID NO: 811057 - DNA, 25 bp, Mus musculus
tccactgacctaattctgaagccaa

SEQ ID NO: 811058 - DNA, 25 bp, Mus musculus
tccactgacctatttctgaagccaa

SEQ ID NO: 811059 - DNA, 25 bp, Mus musculus
tccactgactacagactcaaaaatt

SEQ ID NO: 811060 - DNA, 25 bp, Mus musculus
tccactgactactgactcaaaaatt

SEQ ID NO: 811061 - DNA, 25 bp, Mus musculus
tccactgactctatcatgtcacaca

SEQ ID NO: 811062 - DNA, 25 bp, Mus musculus
tccactgactctttcatgtcacaca

SEQ ID NO: 811063 - DNA, 25 bp, Mus musculus
tccactgactgtaaaaatgccgccc

SEQ ID NO: 811064 - DNA, 25 bp, Mus musculus
tccactgactgttaaaatgccgccc

SEQ ID NO: 811065 - DNA, 25 bp, Mus musculus
tccactgagaacagctaagacaagg

SEQ ID NO: 811066 - DNA, 25 bp, Mus musculus
tccactgagaactgctaagacaagg

SEQ ID NO: 811067 - DNA, 25 bp, Mus musculus
tccactgagcgccatgcagaagatg

SEQ ID NO: 811068 - DNA, 25 bp, Mus musculus
tccactgagcgcgatgcagaagatg

SEQ ID NO: 811069 - DNA, 25 bp, Mus musculus
tccactgagtgaattctccctctaa

SEQ ID NO: 811070 - DNA, 25 bp, Mus musculus
tccactgagtgatttctccctctaa

SEQ ID NO: 811071 - DNA, 25 bp, Mus musculus
tccactgagtgtcggcactagctca

SEQ ID NO: 811072 - DNA, 25 bp, Mus musculus
tccactgagtgtctcccattcttcg

SEQ ID NO: 811073 - DNA, 25 bp, Mus musculus
tccactgagtgtgggcactagctca

SEQ ID NO: 811074 - DNA, 25 bp, Mus musculus
tccactgagtgtgtcccattcttcg

SEQ ID NO: 811075 - DNA, 25 bp, Mus musculus
tccactgatgtaccaatgtaaatac

SEQ ID NO: 811076 - DNA, 25 bp, Mus musculus
tccactgatgtagcaatgtaaatac

SEQ ID NO: 811077 - DNA, 25 bp, Mus musculus
tccactgcaaggatgcccggagaga

SEQ ID NO: 811078 - DNA, 25 bp, Mus musculus
tccactgcaaggttgcccggagaga

SEQ ID NO: 811079 - DNA, 25 bp, Mus musculus
tccactgccagtattgtttgtataa

SEQ ID NO: 811080 - DNA, 25 bp, Mus musculus
tccactgccagttttgtttgtataa

SEQ ID NO: 811081 - DNA, 25 bp, Mus musculus
tccactgccttaattattacaaaac

SEQ ID NO: 811082 - DNA, 25 bp, Mus musculus
tccactgccttatttattacaaaac

SEQ ID NO: 811083 - DNA, 25 bp, Mus musculus
tccactgcgtacaacatgttacatg

SEQ ID NO: 811084 - DNA, 25 bp, Mus musculus
tccactgcgtactacatgttacatg

SEQ ID NO: 811085 - DNA, 25 bp, Mus musculus
tccactgctagtactggttccagaa

SEQ ID NO: 811086 - DNA, 25 bp, Mus musculus
tccactgctagttctggttccagaa

SEQ ID NO: 811087 - DNA, 25 bp, Mus musculus
tccactgctggacaagaaggtctca

SEQ ID NO: 811088 - DNA, 25 bp, Mus musculus
tccactgctggagaagaaggtctca

SEQ ID NO: 811089 - DNA, 25 bp, Mus musculus
tccactgctggtagtgtggtgagga

SEQ ID NO: 811090 - DNA, 25 bp, Mus musculus
tccactgctggttgtgtggtgagga

SEQ ID NO: 811091 - DNA, 25 bp, Mus musculus
tccactgctgttcggttgcttagtc

SEQ ID NO: 811092 - DNA, 25 bp, Mus musculus
tccactgctgttgggttgcttagtc

SEQ ID NO: 811093 - DNA, 25 bp, Mus musculus
tccactgctttccatactgaacaca

SEQ ID NO: 811094 - DNA, 25 bp, Mus musculus
tccactgctttcgatactgaacaca

SEQ ID NO: 811095 - DNA, 25 bp, Mus musculus
tccactggaagtcaagaatctcgtt

SEQ ID NO: 811096 - DNA, 25 bp, Mus musculus
tccactggaagtgaagaatctcgtt

SEQ ID NO: 811097 - DNA, 25 bp, Mus musculus
tccactggactaatgtttgttgatg

SEQ ID NO: 811098 - DNA, 25 bp, Mus musculus
tccactggactattgtttgttgatg

SEQ ID NO: 811099 - DNA, 25 bp, Mus musculus
tccactggaggcaactttctgtcaa

SEQ ID NO: 811100 - DNA, 25 bp, Mus musculus
tccactggaggctactttctgtcaa

SEQ ID NO: 811101 - DNA, 25 bp, Mus musculus
tccactggatcaccttactgtacaa

SEQ ID NO: 811102 - DNA, 25 bp, Mus musculus
tccactggatcagcttactgtacaa

SEQ ID NO: 811103 - DNA, 25 bp, Mus musculus
tccactgggcctcggaattcttgag

SEQ ID NO: 811104 - DNA, 25 bp, Mus musculus
tccactgggcctgggaattcttgag

SEQ ID NO: 811105 - DNA, 25 bp, Mus musculus
tccactgggttccttaagtcaccaa

SEQ ID NO: 811106 - DNA, 25 bp, Mus musculus
tccactgggttcgttaagtcaccaa

SEQ ID NO: 811107 - DNA, 25 bp, Mus musculus
tccactggtaaacccacactgtaca

SEQ ID NO: 811108 - DNA, 25 bp, Mus musculus
tccactggtaaagccacactgtaca

SEQ ID NO: 811109 - DNA, 25 bp, Mus musculus
tccactggtactcaaattcctcttg

SEQ ID NO: 811110 - DNA, 25 bp, Mus musculus
tccactggtactgaaattcctcttg

SEQ ID NO: 811111 - DNA, 25 bp, Mus musculus
tccactggtgacattgtgctgacac

SEQ ID NO: 811112 - DNA, 25 bp, Mus musculus
tccactggtgactttgtgctgacac

SEQ ID NO: 811113 - DNA, 25 bp, Mus musculus
tccactggtgccaataggtgtagca

SEQ ID NO: 811114 - DNA, 25 bp, Mus musculus
tccactggtgcctataggtgtagca

SEQ ID NO: 811115 - DNA, 25 bp, Mus musculus
tccactgtagtgactgaccctctta

SEQ ID NO: 811116 - DNA, 25 bp, Mus musculus
tccactgtagtgtctgaccctctta

SEQ ID NO: 811117 - DNA, 25 bp, Mus musculus
tccactgtccatatgtgttgggtaa

SEQ ID NO: 811118 - DNA, 25 bp, Mus musculus
tccactgtccatttgtgttgggtaa

SEQ ID NO: 811119 - DNA, 25 bp, Mus musculus
tccactgtccctatacacatttttt

SEQ ID NO: 811120 - DNA, 25 bp, Mus musculus
tccactgtccctctacaaggacttt

SEQ ID NO: 811121 - DNA, 25 bp, Mus musculus
tccactgtccctgtacaaggacttt

SEQ ID NO: 811122 - DNA, 25 bp, Mus musculus
tccactgtccctttacacatttttt

SEQ ID NO: 811123 - DNA, 25 bp, Mus musculus
tccactgtccggcagaaaagggatg

SEQ ID NO: 811124 - DNA, 25 bp, Mus musculus
tccactgtccgggagaaaagggatg

SEQ ID NO: 811125 - DNA, 25 bp, Mus musculus
tccactgtcctgagtttgactacgt

SEQ ID NO: 811126 - DNA, 25 bp, Mus musculus
tccactgtcctgtgtttgactacgt

SEQ ID NO: 811127 - DNA, 25 bp, Mus musculus
tccactgtctcacagatagatttaa

SEQ ID NO: 811128 - DNA, 25 bp, Mus musculus
tccactgtctcagagatagatttaa

SEQ ID NO: 811129 - DNA, 25 bp, Mus musculus
tccactgtctgcaggaaggaaggtc

SEQ ID NO: 811130 - DNA, 25 bp, Mus musculus
tccactgtctgctggaaggaaggtc

SEQ ID NO: 811131 - DNA, 25 bp, Mus musculus
tccactgtctggcaagccgatggag

SEQ ID NO: 811132 - DNA, 25 bp, Mus musculus
tccactgtctgggaagccgatggag

SEQ ID NO: 811133 - DNA, 25 bp, Mus musculus
tccactgtgattaatagaatttagg

SEQ ID NO: 811134 - DNA, 25 bp, Mus musculus
tccactgtgatttatagaatttagg

SEQ ID NO: 811135 - DNA, 25 bp, Mus musculus
tccactgtgcatatgctgtcctgtg

SEQ ID NO: 811136 - DNA, 25 bp, Mus musculus
tccactgtgcatttgctgtcctgtg

SEQ ID NO: 811137 - DNA, 25 bp, Mus musculus
tccactgtgcttctgagttcatgtt

SEQ ID NO: 811138 - DNA, 25 bp, Mus musculus
tccactgtgcttgtgagttcatgtt

SEQ ID NO: 811139 - DNA, 25 bp, Mus musculus
tccactgtggaacctgtgctcagtt

SEQ ID NO: 811140 - DNA, 25 bp, Mus musculus
tccactgtggaagctgtgctcagtt

SEQ ID NO: 811141 - DNA, 25 bp, Mus musculus
tccactgtggctcaacacctgatag

SEQ ID NO: 811142 - DNA, 25 bp, Mus musculus
tccactgtggctgaacacctgatag

SEQ ID NO: 811143 - DNA, 25 bp, Mus musculus
tccactgtgggaagcaggtcgtcat

SEQ ID NO: 811144 - DNA, 25 bp, Mus musculus
tccactgtgggatgcaggtcgtcat

SEQ ID NO: 811145 - DNA, 25 bp, Mus musculus
tccactgtggtgagaggcaggtaca

SEQ ID NO: 811146 - DNA, 25 bp, Mus musculus
tccactgtggtgtgaggcaggtaca

SEQ ID NO: 811147 - DNA, 25 bp, Mus musculus
tccactgtgtgtcaccggcccgagg

SEQ ID NO: 811148 - DNA, 25 bp, Mus musculus
tccactgtgtgtgaccggcccgagg

SEQ ID NO: 811149 - DNA, 25 bp, Mus musculus
tccactgttagacgtttgaggttac

SEQ ID NO: 811150 - DNA, 25 bp, Mus musculus
tccactgttagaggtttgaggttac

SEQ ID NO: 811151 - DNA, 25 bp, Mus musculus
tccactgttcagagggctacctgtg

SEQ ID NO: 811152 - DNA, 25 bp, Mus musculus
tccactgttcagtgggctacctgtg

SEQ ID NO: 811153 - DNA, 25 bp, Mus musculus
tccactgttgttaaatcacatacct

SEQ ID NO: 811154 - DNA, 25 bp, Mus musculus
tccactgttgtttaatcacatacct

SEQ ID NO: 811155 - DNA, 25 bp, Mus musculus
tccactgtttaaccagccctcttgt

SEQ ID NO: 811156 - DNA, 25 bp, Mus musculus
tccactgtttaagcagccctcttgt

SEQ ID NO: 811157 - DNA, 25 bp, Mus musculus
tccacttaagtgactgtgttcctgc

SEQ ID NO: 811158 - DNA, 25 bp, Mus musculus
tccacttaagtgtctgtgttcctgc

SEQ ID NO: 811159 - DNA, 25 bp, Mus musculus
tccacttagcctattaagcgaaggt

SEQ ID NO: 811160 - DNA, 25 bp, Mus musculus
tccacttagccttttaagcgaaggt

SEQ ID NO: 811161 - DNA, 25 bp, Mus musculus
tccacttagcggagactctgtgaaa

SEQ ID NO: 811162 - DNA, 25 bp, Mus musculus
tccacttagcggtgactctgtgaaa

SEQ ID NO: 811163 - DNA, 25 bp, Mus musculus
tccacttatagtcgtgcattcccac

SEQ ID NO: 811164 - DNA, 25 bp, Mus musculus
tccacttatagtggtgcattcccac

SEQ ID NO: 811165 - DNA, 25 bp, Mus musculus
tccacttcaaccctgatgaaggagg

SEQ ID NO: 811166 - DNA, 25 bp, Mus musculus
tccacttcaaccgtgatgaaggagg

SEQ ID NO: 811167 - DNA, 25 bp, Mus musculus
tccacttcacagataaaagtacatc

SEQ ID NO: 811168 - DNA, 25 bp, Mus musculus
tccacttcacagttaaaagtacatc

SEQ ID NO: 811169 - DNA, 25 bp, Mus musculus
tccacttcagtcaccctgtgaacag

SEQ ID NO: 811170 - DNA, 25 bp, Mus musculus
tccacttcagtctccctgtgaacag

SEQ ID NO: 811171 - DNA, 25 bp, Mus musculus
tccacttccagtatgaggtcaccga

SEQ ID NO: 811172 - DNA, 25 bp, Mus musculus
tccacttccagtttgaggtcaccga

SEQ ID NO: 811173 - DNA, 25 bp, Mus musculus
tccacttcccagagctgaggtatga

SEQ ID NO: 811174 - DNA, 25 bp, Mus musculus
tccacttcccagtgctgaggtatga

SEQ ID NO: 811175 - DNA, 25 bp, Mus musculus
tccacttctcatatcagcagagtag

SEQ ID NO: 811176 - DNA, 25 bp, Mus musculus
tccacttctcatttcagcagagtag

SEQ ID NO: 811177 - DNA, 25 bp, Mus musculus
tccacttctccaaagctgcttgttt

SEQ ID NO: 811178 - DNA, 25 bp, Mus musculus
tccacttctccaaggtgttattggt

SEQ ID NO: 811179 - DNA, 25 bp, Mus musculus
tccacttctccatagctgcttgttt

SEQ ID NO: 811180 - DNA, 25 bp, Mus musculus
tccacttctccatggtgttattggt

SEQ ID NO: 811181 - DNA, 25 bp, Mus musculus
tccacttctggaatcattgtaggca

SEQ ID NO: 811182 - DNA, 25 bp, Mus musculus
tccacttctggattcattgtaggca

SEQ ID NO: 811183 - DNA, 25 bp, Mus musculus
tccacttgaagccacttggtcctaa

SEQ ID NO: 811184 - DNA, 25 bp, Mus musculus
tccacttgaagcgacttggtcctaa

SEQ ID NO: 811185 - DNA, 25 bp, Mus musculus
tccacttgagttcagggtctgacca

SEQ ID NO: 811186 - DNA, 25 bp, Mus musculus
tccacttgagttgagggtctgacca

SEQ ID NO: 811187 - DNA, 25 bp, Mus musculus
tccacttgcacacgacttcatttca

SEQ ID NO: 811188 - DNA, 25 bp, Mus musculus
tccacttgcacaggacttcatttca

SEQ ID NO: 811189 - DNA, 25 bp, Mus musculus
tccacttgcctccaaagctttatga

SEQ ID NO: 811190 - DNA, 25 bp, Mus musculus
tccacttgcctcgaaagctttatga

SEQ ID NO: 811191 - DNA, 25 bp, Mus musculus
tccacttggaaccacagggacgata

SEQ ID NO: 811192 - DNA, 25 bp, Mus musculus
tccacttggaacgacagggacgata

SEQ ID NO: 811193 - DNA, 25 bp, Mus musculus
tccacttggcctcaggattgcctgg

SEQ ID NO: 811194 - DNA, 25 bp, Mus musculus
tccacttggcctgaggattgcctgg

SEQ ID NO: 811195 - DNA, 25 bp, Mus musculus
tccacttgggaaatactcgcttata

SEQ ID NO: 811196 - DNA, 25 bp, Mus musculus
tccacttgggaattactcgcttata

SEQ ID NO: 811197 - DNA, 25 bp, Mus musculus
tccacttgggcacacgaggtctcag

SEQ ID NO: 811198 - DNA, 25 bp, Mus musculus
tccacttgggcagacgaggtctcag

SEQ ID NO: 811199 - DNA, 25 bp, Mus musculus
tccacttggtaacccctgttaggga

SEQ ID NO: 811200 - DNA, 25 bp, Mus musculus
tccacttggtaagccctgttaggga

SEQ ID NO: 811201 - DNA, 25 bp, Mus musculus
tccacttgtgagatgaacgccttga

SEQ ID NO: 811202 - DNA, 25 bp, Mus musculus
tccacttgtgagttgaacgccttga

SEQ ID NO: 811203 - DNA, 25 bp, Mus musculus
tccacttgtggtcgagggtatagaa

SEQ ID NO: 811204 - DNA, 25 bp, Mus musculus
tccacttgtggtggagggtatagaa

SEQ ID NO: 811205 - DNA, 25 bp, Mus musculus
tccactttagccacagtttataaat

SEQ ID NO: 811206 - DNA, 25 bp, Mus musculus
tccactttagcctcagtttataaat

SEQ ID NO: 811207 - DNA, 25 bp, Mus musculus
tccactttcattcccttctagggat

SEQ ID NO: 811208 - DNA, 25 bp, Mus musculus
tccactttcattgccttctagggat

SEQ ID NO: 811209 - DNA, 25 bp, Mus musculus
tccactttccagactatccagatag

SEQ ID NO: 811210 - DNA, 25 bp, Mus musculus
tccactttccagtctatccagatag

SEQ ID NO: 811211 - DNA, 25 bp, Mus musculus
tccactttcctcagacatctgtgaa

SEQ ID NO: 811212 - DNA, 25 bp, Mus musculus
tccactttcctctgacatctgtgaa

SEQ ID NO: 811213 - DNA, 25 bp, Mus musculus
tccactttctacctatgcgcttttt

SEQ ID NO: 811214 - DNA, 25 bp, Mus musculus
tccactttctacgtatgcgcttttt

SEQ ID NO: 811215 - DNA, 25 bp, Mus musculus
tccactttctcccaggccgagatgg

SEQ ID NO: 811216 - DNA, 25 bp, Mus musculus
tccactttctccgaggccgagatgg

SEQ ID NO: 811217 - DNA, 25 bp, Mus musculus
tccactttgagcagtaggaacttaa

SEQ ID NO: 811218 - DNA, 25 bp, Mus musculus
tccactttgagctgtaggaacttaa

SEQ ID NO: 811219 - DNA, 25 bp, Mus musculus
tccactttgcccctaaatttgagac

SEQ ID NO: 811220 - DNA, 25 bp, Mus musculus
tccactttgcccgtaaatttgagac

SEQ ID NO: 811221 - DNA, 25 bp, Mus musculus
tccactttgctcacaacagttgctt

SEQ ID NO: 811222 - DNA, 25 bp, Mus musculus
tccactttgctctcaacagttgctt

SEQ ID NO: 811223 - DNA, 25 bp, Mus musculus
tccactttgtcaactttgtgttcag

SEQ ID NO: 811224 - DNA, 25 bp, Mus musculus
tccactttgtcatctttgtgttcag

SEQ ID NO: 811225 - DNA, 25 bp, Mus musculus
tccacttttattacactgtgtgagt

SEQ ID NO: 811226 - DNA, 25 bp, Mus musculus
tccacttttatttcactgtgtgagt

SEQ ID NO: 811227 - DNA, 25 bp, Mus musculus
tccacttttctgaccttaagtaaat

SEQ ID NO: 811228 - DNA, 25 bp, Mus musculus
tccacttttctgtccttaagtaaat

SEQ ID NO: 811229 - DNA, 25 bp, Mus musculus
tccacttttgacattccactatgtg

SEQ ID NO: 811230 - DNA, 25 bp, Mus musculus
tccacttttgactttccactatgtg

SEQ ID NO: 811231 - DNA, 25 bp, Mus musculus
tccacttttggcatgttaaatatag

SEQ ID NO: 811232 - DNA, 25 bp, Mus musculus
tccacttttggcttgttaaatatag

SEQ ID NO: 811233 - DNA, 25 bp, Mus musculus
tccacttttgggagcttttctgtat

SEQ ID NO: 811234 - DNA, 25 bp, Mus musculus
tccacttttgggtgcttttctgtat

SEQ ID NO: 811235 - DNA, 25 bp, Mus musculus
tccagaaaaagtatatggcccctat

SEQ ID NO: 811236 - DNA, 25 bp, Mus musculus
tccagaaaaagtttatggcccctat

SEQ ID NO: 811237 - DNA, 25 bp, Mus musculus
tccagaaaaccaacgcttgtatcag

SEQ ID NO: 811238 - DNA, 25 bp, Mus musculus
tccagaaaaccatcgcttgtatcag

SEQ ID NO: 811239 - DNA, 25 bp, Mus musculus
tccagaaaatacctatgcctcccat

SEQ ID NO: 811240 - DNA, 25 bp, Mus musculus
tccagaaaatacgtatgcctcccat

SEQ ID NO: 811241 - DNA, 25 bp, Mus musculus
tccagaaaatgtatataagaaccac

SEQ ID NO: 811242 - DNA, 25 bp, Mus musculus
tccagaaaatgtttataagaaccac

SEQ ID NO: 811243 - DNA, 25 bp, Mus musculus
tccagaaaatttcgtgctgtggttg

SEQ ID NO: 811244 - DNA, 25 bp, Mus musculus
tccagaaaatttggtgctgtggttg

SEQ ID NO: 811245 - DNA, 25 bp, Mus musculus
tccagaaactgcaagctgtgtcctt

SEQ ID NO: 811246 - DNA, 25 bp, Mus musculus
tccagaaactgctagctgtgtcctt

SEQ ID NO: 811247 - DNA, 25 bp, Mus musculus
tccagaaactggcttggtaagcaca

SEQ ID NO: 811248 - DNA, 25 bp, Mus musculus
tccagaaactgggttggtaagcaca

SEQ ID NO: 811249 - DNA, 25 bp, Mus musculus
tccagaaagatgcatttgaaggttt

SEQ ID NO: 811250 - DNA, 25 bp, Mus musculus
tccagaaagatggatttgaaggttt

SEQ ID NO: 811251 - DNA, 25 bp, Mus musculus
tccagaaaggtaactccccttcttg

SEQ ID NO: 811252 - DNA, 25 bp, Mus musculus
tccagaaaggtatctccccttcttg

SEQ ID NO: 811253 - DNA, 25 bp, Mus musculus
tccagaaaggttcctccaggtggga

SEQ ID NO: 811254 - DNA, 25 bp, Mus musculus
tccagaaaggttgctccaggtggga

SEQ ID NO: 811255 - DNA, 25 bp, Mus musculus
tccagaaagtggaatactagagatg

SEQ ID NO: 811256 - DNA, 25 bp, Mus musculus
tccagaaagtggtatactagagatg

SEQ ID NO: 811257 - DNA, 25 bp, Mus musculus
tccagaaatgtaatggctcacagtt

SEQ ID NO: 811258 - DNA, 25 bp, Mus musculus
tccagaaatgtattggctcacagtt

SEQ ID NO: 811259 - DNA, 25 bp, Mus musculus
tccagaacacggacaccgcagggtg

SEQ ID NO: 811260 - DNA, 25 bp, Mus musculus
tccagaacacggtcaccgcagggtg

SEQ ID NO: 811261 - DNA, 25 bp, Mus musculus
tccagaacagacaaaaccttaaaca

SEQ ID NO: 811262 - DNA, 25 bp, Mus musculus
tccagaacagactaaaccttaaaca

SEQ ID NO: 811263 - DNA, 25 bp, Mus musculus
tccagaacagtacaggcccagaatc

SEQ ID NO: 811264 - DNA, 25 bp, Mus musculus
tccagaacagtagaggcccagaatc

SEQ ID NO: 811265 - DNA, 25 bp, Mus musculus
tccagaacattcattgtctcctttc

SEQ ID NO: 811266 - DNA, 25 bp, Mus musculus
tccagaacattctttgtctcctttc

SEQ ID NO: 811267 - DNA, 25 bp, Mus musculus
tccagaacccagagcaaagcgagtt

SEQ ID NO: 811268 - DNA, 25 bp, Mus musculus
tccagaacccagtgcaaagcgagtt

SEQ ID NO: 811269 - DNA, 25 bp, Mus musculus
tccagaacccgcatcagaggcgtga

SEQ ID NO: 811270 - DNA, 25 bp, Mus musculus
tccagaacccgcttcagaggcgtga

SEQ ID NO: 811271 - DNA, 25 bp, Mus musculus
tccagaaccgatcactagaccacga

SEQ ID NO: 811272 - DNA, 25 bp, Mus musculus
tccagaaccgatgactagaccacga

SEQ ID NO: 811273 - DNA, 25 bp, Mus musculus
tccagaaccgtccagagtgtgctat

SEQ ID NO: 811274 - DNA, 25 bp, Mus musculus
tccagaaccgtcgagagtgtgctat

SEQ ID NO: 811275 - DNA, 25 bp, Mus musculus
tccagaacgtacatgatggctccca

SEQ ID NO: 811276 - DNA, 25 bp, Mus musculus
tccagaacgtacttgatggctccca

SEQ ID NO: 811277 - DNA, 25 bp, Mus musculus
tccagaactaccattaaaaactcag

SEQ ID NO: 811278 - DNA, 25 bp, Mus musculus
tccagaactacctttaaaaactcag

SEQ ID NO: 811279 - DNA, 25 bp, Mus musculus
tccagaactagcagccattcgggtt

SEQ ID NO: 811280 - DNA, 25 bp, Mus musculus
tccagaactagctgccattcgggtt

SEQ ID NO: 811281 - DNA, 25 bp, Mus musculus
tccagaactcccaagggtgcttaaa

SEQ ID NO: 811282 - DNA, 25 bp, Mus musculus
tccagaactccctagggtgcttaaa

SEQ ID NO: 811283 - DNA, 25 bp, Mus musculus
tccagaactgcgatggagctccaga

SEQ ID NO: 811284 - DNA, 25 bp, Mus musculus
tccagaactgcgttggagctccaga

SEQ ID NO: 811285 - DNA, 25 bp, Mus musculus
tccagaagacaacagcccaatcact

SEQ ID NO: 811286 - DNA, 25 bp, Mus musculus
tccagaagacaagagcccaatcact

SEQ ID NO: 811287 - DNA, 25 bp, Mus musculus
tccagaagagcgctgtgtttcaata

SEQ ID NO: 811288 - DNA, 25 bp, Mus musculus
tccagaagagcggtgtgtttcaata

SEQ ID NO: 811289 - DNA, 25 bp, Mus musculus
tccagaagatacactctcttctcca

SEQ ID NO: 811290 - DNA, 25 bp, Mus musculus
tccagaagatactctctcttctcca

SEQ ID NO: 811291 - DNA, 25 bp, Mus musculus
tccagaagcccacacgtgtagccat

SEQ ID NO: 811292 - DNA, 25 bp, Mus musculus
tccagaagcccagacgtgtagccat

SEQ ID NO: 811293 - DNA, 25 bp, Mus musculus
tccagaagccgcatgtagtcggtca

SEQ ID NO: 811294 - DNA, 25 bp, Mus musculus
tccagaagccgcttgtagtcggtca

SEQ ID NO: 811295 - DNA, 25 bp, Mus musculus
tccagaagccggacaagttccaggt

SEQ ID NO: 811296 - DNA, 25 bp, Mus musculus
tccagaagccggtcaagttccaggt

SEQ ID NO: 811297 - DNA, 25 bp, Mus musculus
tccagaagctgtcaggacacccagt

SEQ ID NO: 811298 - DNA, 25 bp, Mus musculus
tccagaagctgtgaggacacccagt

SEQ ID NO: 811299 - DNA, 25 bp, Mus musculus
tccagaaggaagaggctacaagctt

SEQ ID NO: 811300 - DNA, 25 bp, Mus musculus
tccagaaggaagtggctacaagctt

SEQ ID NO: 811301 - DNA, 25 bp, Mus musculus
tccagaaggatcaagcggcgaggtc

SEQ ID NO: 811302 - DNA, 25 bp, Mus musculus
tccagaaggatctagcggcgaggtc

SEQ ID NO: 811303 - DNA, 25 bp, Mus musculus
tccagaaggcacacggctagctagc

SEQ ID NO: 811304 - DNA, 25 bp, Mus musculus
tccagaaggcactcggctagctagc

SEQ ID NO: 811305 - DNA, 25 bp, Mus musculus
tccagaagtataatggtttcgcccc

SEQ ID NO: 811306 - DNA, 25 bp, Mus musculus
tccagaagtatattggtttcgcccc

SEQ ID NO: 811307 - DNA, 25 bp, Mus musculus
tccagaagtgatccagactctcaga

SEQ ID NO: 811308 - DNA, 25 bp, Mus musculus
tccagaagtgatgcagactctcaga

SEQ ID NO: 811309 - DNA, 25 bp, Mus musculus
tccagaagtggaattacagaagagg

SEQ ID NO: 811310 - DNA, 25 bp, Mus musculus
tccagaagtggatttacagaagagg

SEQ ID NO: 811311 - DNA, 25 bp, Mus musculus
tccagaagttatcctctgatatcag

SEQ ID NO: 811312 - DNA, 25 bp, Mus musculus
tccagaagttatgctctgatatcag

SEQ ID NO: 811313 - DNA, 25 bp, Mus musculus
tccagaagttggaaatcaagtcaac

SEQ ID NO: 811314 - DNA, 25 bp, Mus musculus
tccagaagttggtaatcaagtcaac

SEQ ID NO: 811315 - DNA, 25 bp, Mus musculus
tccagaagttttcattgtaccgaaa

SEQ ID NO: 811316 - DNA, 25 bp, Mus musculus
tccagaagttttgattgtaccgaaa

SEQ ID NO: 811317 - DNA, 25 bp, Mus musculus
tccagaatagacctggctaacagga

SEQ ID NO: 811318 - DNA, 25 bp, Mus musculus
tccagaatagacgtggctaacagga

SEQ ID NO: 811319 - DNA, 25 bp, Mus musculus
tccagaatccacatttagtgtgtga

SEQ ID NO: 811320 - DNA, 25 bp, Mus musculus
tccagaatccacttttagtgtgtga

SEQ ID NO: 811321 - DNA, 25 bp, Mus musculus
tccagaatgaagaagcccggcagtt

SEQ ID NO: 811322 - DNA, 25 bp, Mus musculus
tccagaatgaagtagcccggcagtt

SEQ ID NO: 811323 - DNA, 25 bp, Mus musculus
tccagaatgaatcgcaagctttatt

SEQ ID NO: 811324 - DNA, 25 bp, Mus musculus
tccagaatgaatggcaagctttatt

SEQ ID NO: 811325 - DNA, 25 bp, Mus musculus
tccagaattcctaggctgctgtatt

SEQ ID NO: 811326 - DNA, 25 bp, Mus musculus
tccagaattccttggctgctgtatt

SEQ ID NO: 811327 - DNA, 25 bp, Mus musculus
tccagaatttacctaatctggttgt

SEQ ID NO: 811328 - DNA, 25 bp, Mus musculus
tccagaatttacgtaatctggttgt

SEQ ID NO: 811329 - DNA, 25 bp, Mus musculus
tccagaatttccacatcaaccacaa

SEQ ID NO: 811330 - DNA, 25 bp, Mus musculus
tccagaatttcctcatcaaccacaa

SEQ ID NO: 811331 - DNA, 25 bp, Mus musculus
tccagaatttggatagtggaggcaa

SEQ ID NO: 811332 - DNA, 25 bp, Mus musculus
tccagaatttggttagtggaggcaa

SEQ ID NO: 811333 - DNA, 25 bp, Mus musculus
tccagacaaaaaccacacatagttt

SEQ ID NO: 811334 - DNA, 25 bp, Mus musculus
tccagacaaaaagcacacatagttt

SEQ ID NO: 811335 - DNA, 25 bp, Mus musculus
tccagacaccaacccatctttgata

SEQ ID NO: 811336 - DNA, 25 bp, Mus musculus
tccagacaccaagccatctttgata

SEQ ID NO: 811337 - DNA, 25 bp, Mus musculus
tccagacactatcacctcaaaagat

SEQ ID NO: 811338 - DNA, 25 bp, Mus musculus
tccagacactatgacctcaaaagat

SEQ ID NO: 811339 - DNA, 25 bp, Mus musculus
tccagacactgcctcaatgtgatgt

SEQ ID NO: 811340 - DNA, 25 bp, Mus musculus
tccagacactgcgtcaatgtgatgt

SEQ ID NO: 811341 - DNA, 25 bp, Mus musculus
tccagacagaaccatagggagagtt

SEQ ID NO: 811342 - DNA, 25 bp, Mus musculus
tccagacagaacgatagggagagtt

SEQ ID NO: 811343 - DNA, 25 bp, Mus musculus
tccagacagcgcagctgcagtatgg

SEQ ID NO: 811344 - DNA, 25 bp, Mus musculus
tccagacagcgctgctgcagtatgg

SEQ ID NO: 811345 - DNA, 25 bp, Mus musculus
tccagacagggaaaagagcagcagc

SEQ ID NO: 811346 - DNA, 25 bp, Mus musculus
tccagacagggataagagcagcagc

SEQ ID NO: 811347 - DNA, 25 bp, Mus musculus
tccagacagtcgctgctagtgaact

SEQ ID NO: 811348 - DNA, 25 bp, Mus musculus
tccagacagtcggtgctagtgaact

SEQ ID NO: 811349 - DNA, 25 bp, Mus musculus
tccagacagtgtaactttccagtgt

SEQ ID NO: 811350 - DNA, 25 bp, Mus musculus
tccagacagtgttactttccagtgt

SEQ ID NO: 811351 - DNA, 25 bp, Mus musculus
tccagacatcagagtttgatctaat

SEQ ID NO: 811352 - DNA, 25 bp, Mus musculus
tccagacatcagtgtttgatctaat

SEQ ID NO: 811353 - DNA, 25 bp, Mus musculus
tccagacatcatagcttgtgccaag

SEQ ID NO: 811354 - DNA, 25 bp, Mus musculus
tccagacatcattgcttgtgccaag

SEQ ID NO: 811355 - DNA, 25 bp, Mus musculus
tccagaccaaggatgggtggctaga

SEQ ID NO: 811356 - DNA, 25 bp, Mus musculus
tccagaccaaggttgggtggctaga

SEQ ID NO: 811357 - DNA, 25 bp, Mus musculus
tccagacccaggaggctagatttct

SEQ ID NO: 811358 - DNA, 25 bp, Mus musculus
tccagacccaggtggctagatttct

SEQ ID NO: 811359 - DNA, 25 bp, Mus musculus
tccagacccattctgaagtcagcgt

SEQ ID NO: 811360 - DNA, 25 bp, Mus musculus
tccagacccattgtgaagtcagcgt

SEQ ID NO: 811361 - DNA, 25 bp, Mus musculus
tccagaccggtcaccctttcgtagg

SEQ ID NO: 811362 - DNA, 25 bp, Mus musculus
tccagaccggtctccctttcgtagg

SEQ ID NO: 811363 - DNA, 25 bp, Mus musculus
tccagacctgtaacttcctactttt

SEQ ID NO: 811364 - DNA, 25 bp, Mus musculus
tccagacctgtatcttcctactttt

SEQ ID NO: 811365 - DNA, 25 bp, Mus musculus
tccagacctgtgagggctgcagcac

SEQ ID NO: 811366 - DNA, 25 bp, Mus musculus
tccagacctgtgtgggctgcagcac

SEQ ID NO: 811367 - DNA, 25 bp, Mus musculus
tccagacgcacactggcaggaacaa

SEQ ID NO: 811368 - DNA, 25 bp, Mus musculus
tccagacgcacagtggcaggaacaa

SEQ ID NO: 811369 - DNA, 25 bp, Mus musculus
tccagactaataaagctctcagttg

SEQ ID NO: 811370 - DNA, 25 bp, Mus musculus
tccagactaatatagctctcagttg

SEQ ID NO: 811371 - DNA, 25 bp, Mus musculus
tccagactcagtactaacctttatt

SEQ ID NO: 811372 - DNA, 25 bp, Mus musculus
tccagactcagtactttcacagatt

SEQ ID NO: 811373 - DNA, 25 bp, Mus musculus
tccagactcagttctaacctttatt

SEQ ID NO: 811374 - DNA, 25 bp, Mus musculus
tccagactcagttctttcacagatt

SEQ ID NO: 811375 - DNA, 25 bp, Mus musculus
tccagactcggaacgcaaatgaaaa

SEQ ID NO: 811376 - DNA, 25 bp, Mus musculus
tccagactcggatcgcaaatgaaaa

SEQ ID NO: 811377 - DNA, 25 bp, Mus musculus
tccagactctgcatctcgtctaagt

SEQ ID NO: 811378 - DNA, 25 bp, Mus musculus
tccagactctgcttctcgtctaagt

SEQ ID NO: 811379 - DNA, 25 bp, Mus musculus
tccagactcttgagtgggaccccta

SEQ ID NO: 811380 - DNA, 25 bp, Mus musculus
tccagactcttgtgtgggaccccta

SEQ ID NO: 811381 - DNA, 25 bp, Mus musculus
tccagactggaaaggaatggcttcc

SEQ ID NO: 811382 - DNA, 25 bp, Mus musculus
tccagactggaatggaatggcttcc

SEQ ID NO: 811383 - DNA, 25 bp, Mus musculus
tccagacttactccgagtttgagga

SEQ ID NO: 811384 - DNA, 25 bp, Mus musculus
tccagacttactgcgagtttgagga

SEQ ID NO: 811385 - DNA, 25 bp, Mus musculus
tccagacttatgacctatggtagtt

SEQ ID NO: 811386 - DNA, 25 bp, Mus musculus
tccagacttatgtcctatggtagtt

SEQ ID NO: 811387 - DNA, 25 bp, Mus musculus
tccagacttggcagaaccgttctag

SEQ ID NO: 811388 - DNA, 25 bp, Mus musculus
tccagacttggctgaaccgttctag

SEQ ID NO: 811389 - DNA, 25 bp, Mus musculus
tccagagaagccacttccagagact

SEQ ID NO: 811390 - DNA, 25 bp, Mus musculus
tccagagaagcctcttccagagact

SEQ ID NO: 811391 - DNA, 25 bp, Mus musculus
tccagagacagtaaggccaaatatg

SEQ ID NO: 811392 - DNA, 25 bp, Mus musculus
tccagagacagtccagaactggatt

SEQ ID NO: 811393 - DNA, 25 bp, Mus musculus
tccagagacagtgcagaactggatt

SEQ ID NO: 811394 - DNA, 25 bp, Mus musculus
tccagagacagttaggccaaatatg

SEQ ID NO: 811395 - DNA, 25 bp, Mus musculus
tccagagactcaattgctttgctgt

SEQ ID NO: 811396 - DNA, 25 bp, Mus musculus
tccagagactcatttgctttgctgt

SEQ ID NO: 811397 - DNA, 25 bp, Mus musculus
tccagagactgaatttgtaggcata

SEQ ID NO: 811398 - DNA, 25 bp, Mus musculus
tccagagactgattttgtaggcata

SEQ ID NO: 811399 - DNA, 25 bp, Mus musculus
tccagagagcatccctagtcttgag

SEQ ID NO: 811400 - DNA, 25 bp, Mus musculus
tccagagagcatgcctagtcttgag

SEQ ID NO: 811401 - DNA, 25 bp, Mus musculus
tccagagataagatccagagtgccc

SEQ ID NO: 811402 - DNA, 25 bp, Mus musculus
tccagagataagttccagagtgccc

SEQ ID NO: 811403 - DNA, 25 bp, Mus musculus
tccagagatacaaccccatcagaac

SEQ ID NO: 811404 - DNA, 25 bp, Mus musculus
tccagagatacatccccatcagaac

SEQ ID NO: 811405 - DNA, 25 bp, Mus musculus
tccagagatgtgaccacacaatgag

SEQ ID NO: 811406 - DNA, 25 bp, Mus musculus
tccagagatgtgacctccaccaacc

SEQ ID NO: 811407 - DNA, 25 bp, Mus musculus
tccagagatgtgtccacacaatgag

SEQ ID NO: 811408 - DNA, 25 bp, Mus musculus
tccagagatgtgtcctccaccaacc

SEQ ID NO: 811409 - DNA, 25 bp, Mus musculus
tccagagcacagcactgatgctaag

SEQ ID NO: 811410 - DNA, 25 bp, Mus musculus
tccagagcacaggactgatgctaag

SEQ ID NO: 811411 - DNA, 25 bp, Mus musculus
tccagagcagcaacaccaaccagat

SEQ ID NO: 811412 - DNA, 25 bp, Mus musculus
tccagagcagcacttacatgactaa

SEQ ID NO: 811413 - DNA, 25 bp, Mus musculus
tccagagcagcagttacatgactaa

SEQ ID NO: 811414 - DNA, 25 bp, Mus musculus
tccagagcagcatcaccaaccagat

SEQ ID NO: 811415 - DNA, 25 bp, Mus musculus
tccagagcatccaggaggtcactaa

SEQ ID NO: 811416 - DNA, 25 bp, Mus musculus
tccagagcatcctggaggtcactaa

SEQ ID NO: 811417 - DNA, 25 bp, Mus musculus
tccagagcatgacccggctagtagt

SEQ ID NO: 811418 - DNA, 25 bp, Mus musculus
tccagagcatgagccggctagtagt

SEQ ID NO: 811419 - DNA, 25 bp, Mus musculus
tccagagcatgccagaggctagtct

SEQ ID NO: 811420 - DNA, 25 bp, Mus musculus
tccagagcatgcgagaggctagtct

SEQ ID NO: 811421 - DNA, 25 bp, Mus musculus
tccagagccacacccaaaagttatt

SEQ ID NO: 811422 - DNA, 25 bp, Mus musculus
tccagagccacagccaaaagttatt

SEQ ID NO: 811423 - DNA, 25 bp, Mus musculus
tccagagccgccactgagcaggctg

SEQ ID NO: 811424 - DNA, 25 bp, Mus musculus
tccagagccgcctctgagcaggctg

SEQ ID NO: 811425 - DNA, 25 bp, Mus musculus
tccagagcctccaatatgttcttta

SEQ ID NO: 811426 - DNA, 25 bp, Mus musculus
tccagagcctcctatatgttcttta

SEQ ID NO: 811427 - DNA, 25 bp, Mus musculus
tccagagcctggctgaacgcatcaa

SEQ ID NO: 811428 - DNA, 25 bp, Mus musculus
tccagagcctgggtgaacgcatcaa

SEQ ID NO: 811429 - DNA, 25 bp, Mus musculus
tccagagcctgtacaggtgggcctg

SEQ ID NO: 811430 - DNA, 25 bp, Mus musculus
tccagagcctgttcaggtgggcctg

SEQ ID NO: 811431 - DNA, 25 bp, Mus musculus
tccagagcgattcgccagaagtttc

SEQ ID NO: 811432 - DNA, 25 bp, Mus musculus
tccagagcgattggccagaagtttc

SEQ ID NO: 811433 - DNA, 25 bp, Mus musculus
tccagagctccgaaaggccttggtt

SEQ ID NO: 811434 - DNA, 25 bp, Mus musculus
tccagagctccgagtctgtgagctg

SEQ ID NO: 811435 - DNA, 25 bp, Mus musculus
tccagagctccgtaaggccttggtt

SEQ ID NO: 811436 - DNA, 25 bp, Mus musculus
tccagagctccgtgtctgtgagctg

SEQ ID NO: 811437 - DNA, 25 bp, Mus musculus
tccagagctgtaagtggcagctagt

SEQ ID NO: 811438 - DNA, 25 bp, Mus musculus
tccagagctgtatgtggcagctagt

SEQ ID NO: 811439 - DNA, 25 bp, Mus musculus
tccagagctgtgacgcctgtgaaga

SEQ ID NO: 811440 - DNA, 25 bp, Mus musculus
tccagagctgtgtcgcctgtgaaga

SEQ ID NO: 811441 - DNA, 25 bp, Mus musculus
tccagagcttccagaaagcacccag

SEQ ID NO: 811442 - DNA, 25 bp, Mus musculus
tccagagcttcctgaaagcacccag

SEQ ID NO: 811443 - DNA, 25 bp, Mus musculus
tccagagcttctagttccctgtggt

SEQ ID NO: 811444 - DNA, 25 bp, Mus musculus
tccagagcttcttgttccctgtggt

SEQ ID NO: 811445 - DNA, 25 bp, Mus musculus
tccagagcttgaagaggcacccagt

SEQ ID NO: 811446 - DNA, 25 bp, Mus musculus
tccagagcttgatgaggcacccagt

SEQ ID NO: 811447 - DNA, 25 bp, Mus musculus
tccagaggaaaccaccacgctgatt

SEQ ID NO: 811448 - DNA, 25 bp, Mus musculus
tccagaggaaacctttccacaaagg

SEQ ID NO: 811449 - DNA, 25 bp, Mus musculus
tccagaggaaacgaccacgctgatt

SEQ ID NO: 811450 - DNA, 25 bp, Mus musculus
tccagaggaaacgtttccacaaagg

SEQ ID NO: 811451 - DNA, 25 bp, Mus musculus
tccagaggaattccttctgcacagc

SEQ ID NO: 811452 - DNA, 25 bp, Mus musculus
tccagaggaattgcttctgcacagc

SEQ ID NO: 811453 - DNA, 25 bp, Mus musculus
tccagaggactcaccagcagtgaca

SEQ ID NO: 811454 - DNA, 25 bp, Mus musculus
tccagaggactctccagcagtgaca

SEQ ID NO: 811455 - DNA, 25 bp, Mus musculus
tccagaggagaacacaccggcgcct

SEQ ID NO: 811456 - DNA, 25 bp, Mus musculus
tccagaggagaagacaccggcgcct

SEQ ID NO: 811457 - DNA, 25 bp, Mus musculus
tccagaggagccagcatcttaaata

SEQ ID NO: 811458 - DNA, 25 bp, Mus musculus
tccagaggagcctgcatcttaaata

SEQ ID NO: 811459 - DNA, 25 bp, Mus musculus
tccagaggagttagtctttgccaaa

SEQ ID NO: 811460 - DNA, 25 bp, Mus musculus
tccagaggagtttgtctttgccaaa

SEQ ID NO: 811461 - DNA, 25 bp, Mus musculus
tccagaggcaaaccccaacacacct

SEQ ID NO: 811462 - DNA, 25 bp, Mus musculus
tccagaggcaaagcccaacacacct

SEQ ID NO: 811463 - DNA, 25 bp, Mus musculus
tccagaggctggctgactttgcttt

SEQ ID NO: 811464 - DNA, 25 bp, Mus musculus
tccagaggctgggtgactttgcttt

SEQ ID NO: 811465 - DNA, 25 bp, Mus musculus
tccagagggcagaaccttagttttt

SEQ ID NO: 811466 - DNA, 25 bp, Mus musculus
tccagagggcagtaccttagttttt

SEQ ID NO: 811467 - DNA, 25 bp, Mus musculus
tccagagggctcaaaggtgacatca

SEQ ID NO: 811468 - DNA, 25 bp, Mus musculus
tccagagggctcaagagggctacaa

SEQ ID NO: 811469 - DNA, 25 bp, Mus musculus
tccagagggctctaaggtgacatca

SEQ ID NO: 811470 - DNA, 25 bp, Mus musculus
tccagagggctctagagggctacaa

SEQ ID NO: 811471 - DNA, 25 bp, Mus musculus
tccagaggtaccacttgttaaagcg

SEQ ID NO: 811472 - DNA, 25 bp, Mus musculus
tccagaggtacctcttgttaaagcg

SEQ ID NO: 811473 - DNA, 25 bp, Mus musculus
tccagaggtggactacagcagcatg

SEQ ID NO: 811474 - DNA, 25 bp, Mus musculus
tccagaggtggagtacagcagcatg

SEQ ID NO: 811475 - DNA, 25 bp, Mus musculus
tccagagtcagcatctccttgatgc

SEQ ID NO: 811476 - DNA, 25 bp, Mus musculus
tccagagtcagcttctccttgatgc

SEQ ID NO: 811477 - DNA, 25 bp, Mus musculus
tccagagtcagtaatgtaaagtttt

SEQ ID NO: 811478 - DNA, 25 bp, Mus musculus
tccagagtcagttatgtaaagtttt

SEQ ID NO: 811479 - DNA, 25 bp, Mus musculus
tccagagtcccacggtggacttcag

SEQ ID NO: 811480 - DNA, 25 bp, Mus musculus
tccagagtcccagggtggacttcag

SEQ ID NO: 811481 - DNA, 25 bp, Mus musculus
tccagagtccgcatgagagttcata

SEQ ID NO: 811482 - DNA, 25 bp, Mus musculus
tccagagtccgcttgagagttcata

SEQ ID NO: 811483 - DNA, 25 bp, Mus musculus
tccagagtcttcagttgagcaacca

SEQ ID NO: 811484 - DNA, 25 bp, Mus musculus
tccagagtcttcatttctcactaac

SEQ ID NO: 811485 - DNA, 25 bp, Mus musculus
tccagagtcttctgttgagcaacca

SEQ ID NO: 811486 - DNA, 25 bp, Mus musculus
tccagagtcttcttttctcactaac

SEQ ID NO: 811487 - DNA, 25 bp, Mus musculus
tccagagtcttgactccttcatgaa

SEQ ID NO: 811488 - DNA, 25 bp, Mus musculus
tccagagtcttgtctccttcatgaa

SEQ ID NO: 811489 - DNA, 25 bp, Mus musculus
tccagagtgaagatgggtgactaga

SEQ ID NO: 811490 - DNA, 25 bp, Mus musculus
tccagagtgaagttgggtgactaga

SEQ ID NO: 811491 - DNA, 25 bp, Mus musculus
tccagagtgacgatcaggagagcct

SEQ ID NO: 811492 - DNA, 25 bp, Mus musculus
tccagagtgacgttcaggagagcct

SEQ ID NO: 811493 - DNA, 25 bp, Mus musculus
tccagagtgcagctattggtgcttt

SEQ ID NO: 811494 - DNA, 25 bp, Mus musculus
tccagagtgcaggtattggtgcttt

SEQ ID NO: 811495 - DNA, 25 bp, Mus musculus
tccagagtgctgagccctgatgggc

SEQ ID NO: 811496 - DNA, 25 bp, Mus musculus
tccagagtgctgtgccctgatgggc

SEQ ID NO: 811497 - DNA, 25 bp, Mus musculus
tccagagtgggcatcggtcctaaaa

SEQ ID NO: 811498 - DNA, 25 bp, Mus musculus
tccagagtgggcttcggtcctaaaa

SEQ ID NO: 811499 - DNA, 25 bp, Mus musculus
tccagagtggttactcctccatggg

SEQ ID NO: 811500 - DNA, 25 bp, Mus musculus
tccagagtggtttctcctccatggg

SEQ ID NO: 811501 - DNA, 25 bp, Mus musculus
tccagagtgtggacaggttcttcat

SEQ ID NO: 811502 - DNA, 25 bp, Mus musculus
tccagagtgtggtcaggttcttcat

SEQ ID NO: 811503 - DNA, 25 bp, Mus musculus
tccagagttcaaatcccagcaacca

SEQ ID NO: 811504 - DNA, 25 bp, Mus musculus
tccagagttcaattcccagcaacca

SEQ ID NO: 811505 - DNA, 25 bp, Mus musculus
tccagagttcatatccagggatgat

SEQ ID NO: 811506 - DNA, 25 bp, Mus musculus
tccagagttcatttccagggatgat

SEQ ID NO: 811507 - DNA, 25 bp, Mus musculus
tccagagttcccctacccgattggt

SEQ ID NO: 811508 - DNA, 25 bp, Mus musculus
tccagagttcccgtacccgattggt

SEQ ID NO: 811509 - DNA, 25 bp, Mus musculus
tccagataacctagaagagaacctt

SEQ ID NO: 811510 - DNA, 25 bp, Mus musculus
tccagataaccttgaagagaacctt

SEQ ID NO: 811511 - DNA, 25 bp, Mus musculus
tccagatacctgaccttactgggtc

SEQ ID NO: 811512 - DNA, 25 bp, Mus musculus
tccagatacctgtccttactgggtc

SEQ ID NO: 811513 - DNA, 25 bp, Mus musculus
tccagatacggaaaacaatctcagt

SEQ ID NO: 811514 - DNA, 25 bp, Mus musculus
tccagatacggataacaatctcagt

SEQ ID NO: 811515 - DNA, 25 bp, Mus musculus
tccagatacttcagcagctcgtctg

SEQ ID NO: 811516 - DNA, 25 bp, Mus musculus
tccagatacttctgcagctcgtctg

SEQ ID NO: 811517 - DNA, 25 bp, Mus musculus
tccagatatgcgcactatagttctc

SEQ ID NO: 811518 - DNA, 25 bp, Mus musculus
tccagatatgcggactatagttctc

SEQ ID NO: 811519 - DNA, 25 bp, Mus musculus
tccagatatttcactgccagccaga

SEQ ID NO: 811520 - DNA, 25 bp, Mus musculus
tccagatatttctctgccagccaga

SEQ ID NO: 811521 - DNA, 25 bp, Mus musculus
tccagatcagtacctgtgtgccagt

SEQ ID NO: 811522 - DNA, 25 bp, Mus musculus
tccagatcagtagctgtgtgccagt

SEQ ID NO: 811523 - DNA, 25 bp, Mus musculus
tccagatcatacatcacgtggtagg

SEQ ID NO: 811524 - DNA, 25 bp, Mus musculus
tccagatcatacttcacgtggtagg

SEQ ID NO: 811525 - DNA, 25 bp, Mus musculus
tccagatccaaacgcccctgagaat

SEQ ID NO: 811526 - DNA, 25 bp, Mus musculus
tccagatccaaaggcccctgagaat

SEQ ID NO: 811527 - DNA, 25 bp, Mus musculus
tccagatcccgcacgaggtcaaggt

SEQ ID NO: 811528 - DNA, 25 bp, Mus musculus
tccagatcccgctcgaggtcaaggt

SEQ ID NO: 811529 - DNA, 25 bp, Mus musculus
tccagatcccttcagccaggaaaag

SEQ ID NO: 811530 - DNA, 25 bp, Mus musculus
tccagatcccttgagccaggaaaag

SEQ ID NO: 811531 - DNA, 25 bp, Mus musculus
tccagatccgctacattcagaacat

SEQ ID NO: 811532 - DNA, 25 bp, Mus musculus
tccagatccgcttcattcagaacat

SEQ ID NO: 811533 - DNA, 25 bp, Mus musculus
tccagatcctacacgaacaggaagg

SEQ ID NO: 811534 - DNA, 25 bp, Mus musculus
tccagatcctactcgaacaggaagg

SEQ ID NO: 811535 - DNA, 25 bp, Mus musculus
tccagatccttacagcgtgggagac

SEQ ID NO: 811536 - DNA, 25 bp, Mus musculus
tccagatccttagagcgtgggagac

SEQ ID NO: 811537 - DNA, 25 bp, Mus musculus
tccagatcgcttccctgagcgaaaa

SEQ ID NO: 811538 - DNA, 25 bp, Mus musculus
tccagatcgcttgcctgagcgaaaa

SEQ ID NO: 811539 - DNA, 25 bp, Mus musculus
tccagatctcttatcctgtacagaa

SEQ ID NO: 811540 - DNA, 25 bp, Mus musculus
tccagatctcttttcctgtacagaa

SEQ ID NO: 811541 - DNA, 25 bp, Mus musculus
tccagatctgatagacattcctccg

SEQ ID NO: 811542 - DNA, 25 bp, Mus musculus
tccagatctgattgacattcctccg

SEQ ID NO: 811543 - DNA, 25 bp, Mus musculus
tccagatgagcaaattgagcctcag

SEQ ID NO: 811544 - DNA, 25 bp, Mus musculus
tccagatgagcatattgagcctcag

SEQ ID NO: 811545 - DNA, 25 bp, Mus musculus
tccagatggaccacggtaccaggga

SEQ ID NO: 811546 - DNA, 25 bp, Mus musculus
tccagatggacctcggtaccaggga

SEQ ID NO: 811547 - DNA, 25 bp, Mus musculus
tccagatggacgacctatactctag

SEQ ID NO: 811548 - DNA, 25 bp, Mus musculus
tccagatggacgtcctatactctag

SEQ ID NO: 811549 - DNA, 25 bp, Mus musculus
tccagatggcgtccagtgcttagcg

SEQ ID NO: 811550 - DNA, 25 bp, Mus musculus
tccagatggcgtgcagtgcttagcg

SEQ ID NO: 811551 - DNA, 25 bp, Mus musculus
tccagatgggctaggactgagcaga

SEQ ID NO: 811552 - DNA, 25 bp, Mus musculus
tccagatgggcttggactgagcaga

SEQ ID NO: 811553 - DNA, 25 bp, Mus musculus
tccagatgtctgctcatatcatact

SEQ ID NO: 811554 - DNA, 25 bp, Mus musculus
tccagatgtctggtcatatcatact

SEQ ID NO: 811555 - DNA, 25 bp, Mus musculus
tccagatgttcaaggcccttgtgat

SEQ ID NO: 811556 - DNA, 25 bp, Mus musculus
tccagatgttcatggcccttgtgat

SEQ ID NO: 811557 - DNA, 25 bp, Mus musculus
tccagatgttctcagagccaggaca

SEQ ID NO: 811558 - DNA, 25 bp, Mus musculus
tccagatgttctgagagccaggaca

SEQ ID NO: 811559 - DNA, 25 bp, Mus musculus
tccagatgttgaatgagcctcccgg

SEQ ID NO: 811560 - DNA, 25 bp, Mus musculus
tccagatgttgattgagcctcccgg

SEQ ID NO: 811561 - DNA, 25 bp, Mus musculus
tccagattaaagctgaacgaggctc

SEQ ID NO: 811562 - DNA, 25 bp, Mus musculus
tccagattaaaggtgaacgaggctc

SEQ ID NO: 811563 - DNA, 25 bp, Mus musculus
tccagattataaagccactgccttc

SEQ ID NO: 811564 - DNA, 25 bp, Mus musculus
tccagattataaagctactatcttc

SEQ ID NO: 811565 - DNA, 25 bp, Mus musculus
tccagattataatgccactgccttc

SEQ ID NO: 811566 - DNA, 25 bp, Mus musculus
tccagattataatgctactatcttc

SEQ ID NO: 811567 - DNA, 25 bp, Mus musculus
tccagattatcaatagtgtcggcaa

SEQ ID NO: 811568 - DNA, 25 bp, Mus musculus
tccagattatcattagtgtcggcaa

SEQ ID NO: 811569 - DNA, 25 bp, Mus musculus
tccagattcaaaaccatgcccaatg

SEQ ID NO: 811570 - DNA, 25 bp, Mus musculus
tccagattcaaatccatgcccaatg

SEQ ID NO: 811571 - DNA, 25 bp, Mus musculus
tccagattcaggaacaagtgtcatt

SEQ ID NO: 811572 - DNA, 25 bp, Mus musculus
tccagattcaggtacaagtgtcatt

SEQ ID NO: 811573 - DNA, 25 bp, Mus musculus
tccagattgacgattccaagaagaa

SEQ ID NO: 811574 - DNA, 25 bp, Mus musculus
tccagattgacgtttccaagaagaa

SEQ ID NO: 811575 - DNA, 25 bp, Mus musculus
tccagattgcacagtgcccttagga

SEQ ID NO: 811576 - DNA, 25 bp, Mus musculus
tccagattgcactgtgcccttagga

SEQ ID NO: 811577 - DNA, 25 bp, Mus musculus
tccagatttaggcagcagagcagct

SEQ ID NO: 811578 - DNA, 25 bp, Mus musculus
tccagatttagggagcagagcagct

SEQ ID NO: 811579 - DNA, 25 bp, Mus musculus
tccagattttccctaacaccttatc

SEQ ID NO: 811580 - DNA, 25 bp, Mus musculus
tccagattttccgtaacaccttatc

SEQ ID NO: 811581 - DNA, 25 bp, Mus musculus
tccagcaaccccaagacctgagttt

SEQ ID NO: 811582 - DNA, 25 bp, Mus musculus
tccagcaacccctagacctgagttt

SEQ ID NO: 811583 - DNA, 25 bp, Mus musculus
tccagcaacgcacattacatgacat

SEQ ID NO: 811584 - DNA, 25 bp, Mus musculus
tccagcaacgcagattacatgacat

SEQ ID NO: 811585 - DNA, 25 bp, Mus musculus
tccagcaagatcagtgacgtgactg

SEQ ID NO: 811586 - DNA, 25 bp, Mus musculus
tccagcaagatctgtgacgtgactg

SEQ ID NO: 811587 - DNA, 25 bp, Mus musculus
tccagcaaggagacagcatgccctc

SEQ ID NO: 811588 - DNA, 25 bp, Mus musculus
tccagcaaggagtcagcatgccctc

SEQ ID NO: 811589 - DNA, 25 bp, Mus musculus
tccagcaatgagcacacagctaatg

SEQ ID NO: 811590 - DNA, 25 bp, Mus musculus
tccagcaatgaggacacagctaatg

SEQ ID NO: 811591 - DNA, 25 bp, Mus musculus
tccagcacagatcctttgtctagaa

SEQ ID NO: 811592 - DNA, 25 bp, Mus musculus
tccagcacagatgctttgtctagaa

SEQ ID NO: 811593 - DNA, 25 bp, Mus musculus
tccagcacaggacacgtttgtccgt

SEQ ID NO: 811594 - DNA, 25 bp, Mus musculus
tccagcacaggagacgtttgtccgt

SEQ ID NO: 811595 - DNA, 25 bp, Mus musculus
tccagcacataacgaccagctcaga

SEQ ID NO: 811596 - DNA, 25 bp, Mus musculus
tccagcacataaggaccagctcaga

SEQ ID NO: 811597 - DNA, 25 bp, Mus musculus
tccagcacataccatgctagaataa

SEQ ID NO: 811598 - DNA, 25 bp, Mus musculus
tccagcacatacgatgctagaataa

SEQ ID NO: 811599 - DNA, 25 bp, Mus musculus
tccagcacatttacccatccctgcc

SEQ ID NO: 811600 - DNA, 25 bp, Mus musculus
tccagcacattttcccatccctgcc

SEQ ID NO: 811601 - DNA, 25 bp, Mus musculus
tccagcaccaccacactgttgagat

SEQ ID NO: 811602 - DNA, 25 bp, Mus musculus
tccagcaccacctcactgttgagat

SEQ ID NO: 811603 - DNA, 25 bp, Mus musculus
tccagcaccatcattttcaattctt

SEQ ID NO: 811604 - DNA, 25 bp, Mus musculus
tccagcaccatctttttcaattctt

SEQ ID NO: 811605 - DNA, 25 bp, Mus musculus
tccagcacccacaatcttcctcaga

SEQ ID NO: 811606 - DNA, 25 bp, Mus musculus
tccagcacccactatcttcctcaga

SEQ ID NO: 811607 - DNA, 25 bp, Mus musculus
tccagcaccggtacccaagagccca

SEQ ID NO: 811608 - DNA, 25 bp, Mus musculus
tccagcaccggttcccaagagccca

SEQ ID NO: 811609 - DNA, 25 bp, Mus musculus
tccagcaccgttacctaggaggcat

SEQ ID NO: 811610 - DNA, 25 bp, Mus musculus
tccagcaccgtttcctaggaggcat

SEQ ID NO: 811611 - DNA, 25 bp, Mus musculus
tccagcacgagcagcgggatctcct

SEQ ID NO: 811612 - DNA, 25 bp, Mus musculus
tccagcacgagctgcgggatctcct

SEQ ID NO: 811613 - DNA, 25 bp, Mus musculus
tccagcacgtgactaacctgaacaa

SEQ ID NO: 811614 - DNA, 25 bp, Mus musculus
tccagcacgtgagtaacctgaacaa

SEQ ID NO: 811615 - DNA, 25 bp, Mus musculus
tccagcactcacacgctaaggtaag

SEQ ID NO: 811616 - DNA, 25 bp, Mus musculus
tccagcactcactcgctaaggtaag

SEQ ID NO: 811617 - DNA, 25 bp, Mus musculus
tccagcactcatactggtgtactaa

SEQ ID NO: 811618 - DNA, 25 bp, Mus musculus
tccagcactcattctggtgtactaa

SEQ ID NO: 811619 - DNA, 25 bp, Mus musculus
tccagcactccacatatgttagaca

SEQ ID NO: 811620 - DNA, 25 bp, Mus musculus
tccagcactccagatatgttagaca

SEQ ID NO: 811621 - DNA, 25 bp, Mus musculus
tccagcactgaacaataaaccattt

SEQ ID NO: 811622 - DNA, 25 bp, Mus musculus
tccagcactgaagaataaaccattt

SEQ ID NO: 811623 - DNA, 25 bp, Mus musculus
tccagcactggaagtagaggtaaat

SEQ ID NO: 811624 - DNA, 25 bp, Mus musculus
tccagcactggatgtagaggtaaat

SEQ ID NO: 811625 - DNA, 25 bp, Mus musculus
tccagcactgtaatagctaggtgta

SEQ ID NO: 811626 - DNA, 25 bp, Mus musculus
tccagcactgtattagctaggtgta

SEQ ID NO: 811627 - DNA, 25 bp, Mus musculus
tccagcacttggattcctgagacag

SEQ ID NO: 811628 - DNA, 25 bp, Mus musculus
tccagcacttggtttcctgagacag

SEQ ID NO: 811629 - DNA, 25 bp, Mus musculus
tccagcagcatgattagtgcctgaa

SEQ ID NO: 811630 - DNA, 25 bp, Mus musculus
tccagcagcatgtttagtgcctgaa

SEQ ID NO: 811631 - DNA, 25 bp, Mus musculus
tccagcagccgtcagcgttgtttct

SEQ ID NO: 811632 - DNA, 25 bp, Mus musculus
tccagcagccgtgagcgttgtttct

SEQ ID NO: 811633 - DNA, 25 bp, Mus musculus
tccagcaggaacaacctttctgaac

SEQ ID NO: 811634 - DNA, 25 bp, Mus musculus
tccagcaggaactacctttctgaac

SEQ ID NO: 811635 - DNA, 25 bp, Mus musculus
tccagcagggccagaagttcagact

SEQ ID NO: 811636 - DNA, 25 bp, Mus musculus
tccagcagggcctgaagttcagact

SEQ ID NO: 811637 - DNA, 25 bp, Mus musculus
tccagcagggcgcaaatcctacaaa

SEQ ID NO: 811638 - DNA, 25 bp, Mus musculus
tccagcagggcggaaatcctacaaa

SEQ ID NO: 811639 - DNA, 25 bp, Mus musculus
tccagcagggttctgggaaccacat

SEQ ID NO: 811640 - DNA, 25 bp, Mus musculus
tccagcagggttgtgggaaccacat

SEQ ID NO: 811641 - DNA, 25 bp, Mus musculus
tccagcagtgggacctgcccgtgaa

SEQ ID NO: 811642 - DNA, 25 bp, Mus musculus
tccagcagtgggtcctgcccgtgaa

SEQ ID NO: 811643 - DNA, 25 bp, Mus musculus
tccagcagtgttcctacagagatgt

SEQ ID NO: 811644 - DNA, 25 bp, Mus musculus
tccagcagtgttgctacagagatgt

SEQ ID NO: 811645 - DNA, 25 bp, Mus musculus
tccagcatcaagattgtctccagca

SEQ ID NO: 811646 - DNA, 25 bp, Mus musculus
tccagcatcaagtttgtctccagca

SEQ ID NO: 811647 - DNA, 25 bp, Mus musculus
tccagcatcaggatacaaacacgct

SEQ ID NO: 811648 - DNA, 25 bp, Mus musculus
tccagcatcaggttacaaacacgct

SEQ ID NO: 811649 - DNA, 25 bp, Mus musculus
tccagcatggatcgtttagcttttc

SEQ ID NO: 811650 - DNA, 25 bp, Mus musculus
tccagcatggatggtttagcttttc

SEQ ID NO: 811651 - DNA, 25 bp, Mus musculus
tccagcatgtgtaactctgtcaaca

SEQ ID NO: 811652 - DNA, 25 bp, Mus musculus
tccagcatgtgttactctgtcaaca

SEQ ID NO: 811653 - DNA, 25 bp, Mus musculus
tccagcattgcacggactctcttaa

SEQ ID NO: 811654 - DNA, 25 bp, Mus musculus
tccagcattgcagggactctcttaa

SEQ ID NO: 811655 - DNA, 25 bp, Mus musculus
tccagccaaggcatctgtggtacaa

SEQ ID NO: 811656 - DNA, 25 bp, Mus musculus
tccagccaaggcttctgtggtacaa

SEQ ID NO: 811657 - DNA, 25 bp, Mus musculus
tccagccacgtgaccttggtcataa

SEQ ID NO: 811658 - DNA, 25 bp, Mus musculus
tccagccacgtgtccttggtcataa

SEQ ID NO: 811659 - DNA, 25 bp, Mus musculus
tccagccagcctctctgtcaggaag

SEQ ID NO: 811660 - DNA, 25 bp, Mus musculus
tccagccagcctgtctgtcaggaag

SEQ ID NO: 811661 - DNA, 25 bp, Mus musculus
tccagccaggacattcatcattgtg

SEQ ID NO: 811662 - DNA, 25 bp, Mus musculus
tccagccaggactttcatcattgtg

SEQ ID NO: 811663 - DNA, 25 bp, Mus musculus
tccagccaggataagcatacagttg

SEQ ID NO: 811664 - DNA, 25 bp, Mus musculus
tccagccaggattagcatacagttg

SEQ ID NO: 811665 - DNA, 25 bp, Mus musculus
tccagccaggccacatatgttgact

SEQ ID NO: 811666 - DNA, 25 bp, Mus musculus
tccagccaggcctcatatgttgact

SEQ ID NO: 811667 - DNA, 25 bp, Mus musculus
tccagccaggcgcagaggttatgaa

SEQ ID NO: 811668 - DNA, 25 bp, Mus musculus
tccagccaggcggagaggttatgaa

SEQ ID NO: 811669 - DNA, 25 bp, Mus musculus
tccagccagggaccacttcagtgca

SEQ ID NO: 811670 - DNA, 25 bp, Mus musculus
tccagccagggagcacttcagtgca

SEQ ID NO: 811671 - DNA, 25 bp, Mus musculus
tccagccaggttctccaagcaggtg

SEQ ID NO: 811672 - DNA, 25 bp, Mus musculus
tccagccaggttgtccaagcaggtg

SEQ ID NO: 811673 - DNA, 25 bp, Mus musculus
tccagccagtgacatctatacagtg

SEQ ID NO: 811674 - DNA, 25 bp, Mus musculus
tccagccagtgagatctatacagtg

SEQ ID NO: 811675 - DNA, 25 bp, Mus musculus
tccagccatacccagttgagatact

SEQ ID NO: 811676 - DNA, 25 bp, Mus musculus
tccagccataccgagttgagatact

SEQ ID NO: 811677 - DNA, 25 bp, Mus musculus
tccagccatagcagtctccttgggt

SEQ ID NO: 811678 - DNA, 25 bp, Mus musculus
tccagccatagctgtctccttgggt

SEQ ID NO: 811679 - DNA, 25 bp, Mus musculus
tccagcccaaaaagcagttctttca

SEQ ID NO: 811680 - DNA, 25 bp, Mus musculus
tccagcccaaaatgcagttctttca

SEQ ID NO: 811681 - DNA, 25 bp, Mus musculus
tccagcccaaccaaagactatgtac

SEQ ID NO: 811682 - DNA, 25 bp, Mus musculus
tccagcccaacctaagactatgtac

SEQ ID NO: 811683 - DNA, 25 bp, Mus musculus
tccagcccacaccagagtgaggatg

SEQ ID NO: 811684 - DNA, 25 bp, Mus musculus
tccagcccacacgagagtgaggatg

SEQ ID NO: 811685 - DNA, 25 bp, Mus musculus
tccagcccacagcatgtggttttaa

SEQ ID NO: 811686 - DNA, 25 bp, Mus musculus
tccagcccacaggatgtggttttaa

SEQ ID NO: 811687 - DNA, 25 bp, Mus musculus
tccagcccagaactctgatcgacag

SEQ ID NO: 811688 - DNA, 25 bp, Mus musculus
tccagcccagaagtctgatcgacag

SEQ ID NO: 811689 - DNA, 25 bp, Mus musculus
tccagcccagcaagacttccatata

SEQ ID NO: 811690 - DNA, 25 bp, Mus musculus
tccagcccagcatgacttccatata

SEQ ID NO: 811691 - DNA, 25 bp, Mus musculus
tccagcccatcaaggagatctgcat

SEQ ID NO: 811692 - DNA, 25 bp, Mus musculus
tccagcccatcatggagatctgcat

SEQ ID NO: 811693 - DNA, 25 bp, Mus musculus
tccagcccatgaatcttcccttgaa

SEQ ID NO: 811694 - DNA, 25 bp, Mus musculus
tccagcccatgacagattatttaaa

SEQ ID NO: 811695 - DNA, 25 bp, Mus musculus
tccagcccatgagagattatttaaa

SEQ ID NO: 811696 - DNA, 25 bp, Mus musculus
tccagcccatgattcttcccttgaa

SEQ ID NO: 811697 - DNA, 25 bp, Mus musculus
tccagccccaacagggttaaccatt

SEQ ID NO: 811698 - DNA, 25 bp, Mus musculus
tccagccccaactgggttaaccatt

SEQ ID NO: 811699 - DNA, 25 bp, Mus musculus
tccagccccagtattaagcctgtta

SEQ ID NO: 811700 - DNA, 25 bp, Mus musculus
tccagccccagttttaagcctgtta

SEQ ID NO: 811701 - DNA, 25 bp, Mus musculus
tccagccccatcaatgaggatgcag

SEQ ID NO: 811702 - DNA, 25 bp, Mus musculus
tccagccccatctatgaggatgcag

SEQ ID NO: 811703 - DNA, 25 bp, Mus musculus
tccagcccctatcagaaactctaga

SEQ ID NO: 811704 - DNA, 25 bp, Mus musculus
tccagcccctatgagaaactctaga

SEQ ID NO: 811705 - DNA, 25 bp, Mus musculus
tccagcccctggctctttattaagt

SEQ ID NO: 811706 - DNA, 25 bp, Mus musculus
tccagcccctgggtctttattaagt

SEQ ID NO: 811707 - DNA, 25 bp, Mus musculus
tccagcccctgtaacctagggacca

SEQ ID NO: 811708 - DNA, 25 bp, Mus musculus
tccagcccctgttacctagggacca

SEQ ID NO: 811709 - DNA, 25 bp, Mus musculus
tccagccccttcatatctttgaaac

SEQ ID NO: 811710 - DNA, 25 bp, Mus musculus
tccagccccttcttatctttgaaac

SEQ ID NO: 811711 - DNA, 25 bp, Mus musculus
tccagcccgagtcaggacttcttaa

SEQ ID NO: 811712 - DNA, 25 bp, Mus musculus
tccagcccgagtgaggacttcttaa

SEQ ID NO: 811713 - DNA, 25 bp, Mus musculus
tccagcccgcaacaagcatgataca

SEQ ID NO: 811714 - DNA, 25 bp, Mus musculus
tccagcccgcaagaagcatgataca

SEQ ID NO: 811715 - DNA, 25 bp, Mus musculus
tccagcccgtatctgagtcattttt

SEQ ID NO: 811716 - DNA, 25 bp, Mus musculus
tccagcccgtatgtgagtcattttt

SEQ ID NO: 811717 - DNA, 25 bp, Mus musculus
tccagcccgtgtacatgtttataca

SEQ ID NO: 811718 - DNA, 25 bp, Mus musculus
tccagcccgtgttcatgtttataca

SEQ ID NO: 811719 - DNA, 25 bp, Mus musculus
tccagccctaaacaaccaccaggcg

SEQ ID NO: 811720 - DNA, 25 bp, Mus musculus
tccagccctaaagaaccaccaggcg

SEQ ID NO: 811721 - DNA, 25 bp, Mus musculus
tccagccctagaaaatatttgtatt

SEQ ID NO: 811722 - DNA, 25 bp, Mus musculus
tccagccctagaaagccgagaacag

SEQ ID NO: 811723 - DNA, 25 bp, Mus musculus
tccagccctagataatatttgtatt

SEQ ID NO: 811724 - DNA, 25 bp, Mus musculus
tccagccctagatagccgagaacag

SEQ ID NO: 811725 - DNA, 25 bp, Mus musculus
tccagccctcatatttaactcctga

SEQ ID NO: 811726 - DNA, 25 bp, Mus musculus
tccagccctcatttttaactcctga

SEQ ID NO: 811727 - DNA, 25 bp, Mus musculus
tccagccctgggaaaatgtcctttg

SEQ ID NO: 811728 - DNA, 25 bp, Mus musculus
tccagccctgggtaaatgtcctttg

SEQ ID NO: 811729 - DNA, 25 bp, Mus musculus
tccagccctgtcaattttatgtgag

SEQ ID NO: 811730 - DNA, 25 bp, Mus musculus
tccagccctgtctattttatgtgag

SEQ ID NO: 811731 - DNA, 25 bp, Mus musculus
tccagcccttctataagttcttgct

SEQ ID NO: 811732 - DNA, 25 bp, Mus musculus
tccagcccttctttaagttcttgct

SEQ ID NO: 811733 - DNA, 25 bp, Mus musculus
tccagcccttggacagggccataaa

SEQ ID NO: 811734 - DNA, 25 bp, Mus musculus
tccagcccttggagtctaatgtcct

SEQ ID NO: 811735 - DNA, 25 bp, Mus musculus
tccagcccttggtcagggccataaa

SEQ ID NO: 811736 - DNA, 25 bp, Mus musculus
tccagcccttggtgtctaatgtcct

SEQ ID NO: 811737 - DNA, 25 bp, Mus musculus
tccagccggtgccaacctgtgaatt

SEQ ID NO: 811738 - DNA, 25 bp, Mus musculus
tccagccggtgcgaacctgtgaatt

SEQ ID NO: 811739 - DNA, 25 bp, Mus musculus
tccagccgtgttatcgtgccgatcg

SEQ ID NO: 811740 - DNA, 25 bp, Mus musculus
tccagccgtgttttcgtgccgatcg

SEQ ID NO: 811741 - DNA, 25 bp, Mus musculus
tccagcctaaaaccttgtcccggaa

SEQ ID NO: 811742 - DNA, 25 bp, Mus musculus
tccagcctaaaagcttgtcccggaa

SEQ ID NO: 811743 - DNA, 25 bp, Mus musculus
tccagcctaaggagtgcagcaggtg

SEQ ID NO: 811744 - DNA, 25 bp, Mus musculus
tccagcctaaggtgtgcagcaggtg

SEQ ID NO: 811745 - DNA, 25 bp, Mus musculus
tccagcctacagcatggtgactgca

SEQ ID NO: 811746 - DNA, 25 bp, Mus musculus
tccagcctacaggatggtgactgca

SEQ ID NO: 811747 - DNA, 25 bp, Mus musculus
tccagcctactaaggcctggctttg

SEQ ID NO: 811748 - DNA, 25 bp, Mus musculus
tccagcctactatggcctggctttg

SEQ ID NO: 811749 - DNA, 25 bp, Mus musculus
tccagcctagctagtagtcccagca

SEQ ID NO: 811750 - DNA, 25 bp, Mus musculus
tccagcctagcttgtagtcccagca

SEQ ID NO: 811751 - DNA, 25 bp, Mus musculus
tccagcctcaatactccaggttgag

SEQ ID NO: 811752 - DNA, 25 bp, Mus musculus
tccagcctcaattctccaggttgag

SEQ ID NO: 811753 - DNA, 25 bp, Mus musculus
tccagcctcaccaaacataagcgtg

SEQ ID NO: 811754 - DNA, 25 bp, Mus musculus
tccagcctcacctaacataagcgtg

SEQ ID NO: 811755 - DNA, 25 bp, Mus musculus
tccagcctcaggaggttgatgcagg

SEQ ID NO: 811756 - DNA, 25 bp, Mus musculus
tccagcctcaggtggttgatgcagg

SEQ ID NO: 811757 - DNA, 25 bp, Mus musculus
tccagcctcagtctgtatggtccca

SEQ ID NO: 811758 - DNA, 25 bp, Mus musculus
tccagcctcagtgtgtatggtccca

SEQ ID NO: 811759 - DNA, 25 bp, Mus musculus
tccagcctcattcctttggttttag

SEQ ID NO: 811760 - DNA, 25 bp, Mus musculus
tccagcctcattgctttggttttag

SEQ ID NO: 811761 - DNA, 25 bp, Mus musculus
tccagcctcgaccacaaatttaact

SEQ ID NO: 811762 - DNA, 25 bp, Mus musculus
tccagcctcgacgacaaatttaact

SEQ ID NO: 811763 - DNA, 25 bp, Mus musculus
tccagcctctgcacagtgtttttgt

SEQ ID NO: 811764 - DNA, 25 bp, Mus musculus
tccagcctctgctcagtgtttttgt

SEQ ID NO: 811765 - DNA, 25 bp, Mus musculus
tccagcctctggatctcaggcaagg

SEQ ID NO: 811766 - DNA, 25 bp, Mus musculus
tccagcctctggttctcaggcaagg

SEQ ID NO: 811767 - DNA, 25 bp, Mus musculus
tccagcctctgtaatcattttgata

SEQ ID NO: 811768 - DNA, 25 bp, Mus musculus
tccagcctctgttatcattttgata

SEQ ID NO: 811769 - DNA, 25 bp, Mus musculus
tccagcctgattatgccatggcagc

SEQ ID NO: 811770 - DNA, 25 bp, Mus musculus
tccagcctgattttgccatggcagc

SEQ ID NO: 811771 - DNA, 25 bp, Mus musculus
tccagcctgcagagttgttctggtt

SEQ ID NO: 811772 - DNA, 25 bp, Mus musculus
tccagcctgcagtgttgttctggtt

SEQ ID NO: 811773 - DNA, 25 bp, Mus musculus
tccagcctggaacatcccttttaat

SEQ ID NO: 811774 - DNA, 25 bp, Mus musculus
tccagcctggaagatcccttttaat

SEQ ID NO: 811775 - DNA, 25 bp, Mus musculus
tccagcctggagagccattataaaa

SEQ ID NO: 811776 - DNA, 25 bp, Mus musculus
tccagcctggagtgccattataaaa

SEQ ID NO: 811777 - DNA, 25 bp, Mus musculus
tccagcctggatacgtgaaggcctt

SEQ ID NO: 811778 - DNA, 25 bp, Mus musculus
tccagcctggattcgtgaaggcctt

SEQ ID NO: 811779 - DNA, 25 bp, Mus musculus
tccagcctgggaaattcttttgaac

SEQ ID NO: 811780 - DNA, 25 bp, Mus musculus
tccagcctgggatattcttttgaac

SEQ ID NO: 811781 - DNA, 25 bp, Mus musculus
tccagcctgggcaagttgtcagaag

SEQ ID NO: 811782 - DNA, 25 bp, Mus musculus
tccagcctgggctagttgtcagaag

SEQ ID NO: 811783 - DNA, 25 bp, Mus musculus
tccagcctgttaaacctccaataaa

SEQ ID NO: 811784 - DNA, 25 bp, Mus musculus
tccagcctgttatacctccaataaa

SEQ ID NO: 811785 - DNA, 25 bp, Mus musculus
tccagccttccacttgaaccggatt

SEQ ID NO: 811786 - DNA, 25 bp, Mus musculus
tccagccttccagttgaaccggatt

SEQ ID NO: 811787 - DNA, 25 bp, Mus musculus
tccagccttcttctcttatatcttg

SEQ ID NO: 811788 - DNA, 25 bp, Mus musculus
tccagccttcttgtcttatatcttg

SEQ ID NO: 811789 - DNA, 25 bp, Mus musculus
tccagccttgaaatgacggtttgtg

SEQ ID NO: 811790 - DNA, 25 bp, Mus musculus
tccagccttgaattgacggtttgtg

SEQ ID NO: 811791 - DNA, 25 bp, Mus musculus
tccagccttgggaccgaaacacaaa

SEQ ID NO: 811792 - DNA, 25 bp, Mus musculus
tccagccttgggtccgaaacacaaa

SEQ ID NO: 811793 - DNA, 25 bp, Mus musculus
tccagccttggtcgcctaatacaga

SEQ ID NO: 811794 - DNA, 25 bp, Mus musculus
tccagccttggtggcctaatacaga

SEQ ID NO: 811795 - DNA, 25 bp, Mus musculus
tccagccttgtgcagatgatcttct

SEQ ID NO: 811796 - DNA, 25 bp, Mus musculus
tccagccttgtggagatgatcttct

SEQ ID NO: 811797 - DNA, 25 bp, Mus musculus
tccagccttgttccctctgtatatt

SEQ ID NO: 811798 - DNA, 25 bp, Mus musculus
tccagccttgttgcctctgtatatt

SEQ ID NO: 811799 - DNA, 25 bp, Mus musculus
tccagcgaaagccaagaaactactt

SEQ ID NO: 811800 - DNA, 25 bp, Mus musculus
tccagcgaaagcgaagaaactactt

SEQ ID NO: 811801 - DNA, 25 bp, Mus musculus
tccagcgacagtcagtgcgacatct

SEQ ID NO: 811802 - DNA, 25 bp, Mus musculus
tccagcgacagtgagtgcgacatct

SEQ ID NO: 811803 - DNA, 25 bp, Mus musculus
tccagcgagagaaggctaatggcac

SEQ ID NO: 811804 - DNA, 25 bp, Mus musculus
tccagcgagagatggctaatggcac

SEQ ID NO: 811805 - DNA, 25 bp, Mus musculus
tccagcgaggcacaagtacagtgag

SEQ ID NO: 811806 - DNA, 25 bp, Mus musculus
tccagcgaggcagaagtacagtgag

SEQ ID NO: 811807 - DNA, 25 bp, Mus musculus
tccagcgccacgaagggactactga

SEQ ID NO: 811808 - DNA, 25 bp, Mus musculus
tccagcgccacgtagggactactga

SEQ ID NO: 811809 - DNA, 25 bp, Mus musculus
tccagcgccagcaacttaaaatcta

SEQ ID NO: 811810 - DNA, 25 bp, Mus musculus
tccagcgccagctacttaaaatcta

SEQ ID NO: 811811 - DNA, 25 bp, Mus musculus
tccagcgcccagaatctgtgaagga

SEQ ID NO: 811812 - DNA, 25 bp, Mus musculus
tccagcgcccagtatctgtgaagga

SEQ ID NO: 811813 - DNA, 25 bp, Mus musculus
tccagcggaaatcctgtacccgtgt

SEQ ID NO: 811814 - DNA, 25 bp, Mus musculus
tccagcggaaatgctgtacccgtgt

SEQ ID NO: 811815 - DNA, 25 bp, Mus musculus
tccagcggatggatgcttttccttc

SEQ ID NO: 811816 - DNA, 25 bp, Mus musculus
tccagcggatggttgcttttccttc

SEQ ID NO: 811817 - DNA, 25 bp, Mus musculus
tccagcggctccagatgatgggtga

SEQ ID NO: 811818 - DNA, 25 bp, Mus musculus
tccagcggctcctgatgatgggtga

SEQ ID NO: 811819 - DNA, 25 bp, Mus musculus
tccagcggttgcctattggttatat

SEQ ID NO: 811820 - DNA, 25 bp, Mus musculus
tccagcggttgcgtattggttatat

SEQ ID NO: 811821 - DNA, 25 bp, Mus musculus
tccagcgtgcatctcccgtttctgt

SEQ ID NO: 811822 - DNA, 25 bp, Mus musculus
tccagcgtgcatgtcccgtttctgt

SEQ ID NO: 811823 - DNA, 25 bp, Mus musculus
tccagcgtgtgcatccccgagaata

SEQ ID NO: 811824 - DNA, 25 bp, Mus musculus
tccagcgtgtgcttccccgagaata

SEQ ID NO: 811825 - DNA, 25 bp, Mus musculus
tccagcgtgttccacagtcaggtga

SEQ ID NO: 811826 - DNA, 25 bp, Mus musculus
tccagcgtgttcgacagtcaggtga

SEQ ID NO: 811827 - DNA, 25 bp, Mus musculus
tccagcgttcaaatcttataataca

SEQ ID NO: 811828 - DNA, 25 bp, Mus musculus
tccagcgttcaattcttataataca

SEQ ID NO: 811829 - DNA, 25 bp, Mus musculus
tccagctactacaaggttggtcctt

SEQ ID NO: 811830 - DNA, 25 bp, Mus musculus
tccagctactactaggttggtcctt

SEQ ID NO: 811831 - DNA, 25 bp, Mus musculus
tccagctactggacatctaagcgag

SEQ ID NO: 811832 - DNA, 25 bp, Mus musculus
tccagctactggtcatctaagcgag

SEQ ID NO: 811833 - DNA, 25 bp, Mus musculus
tccagctaggtcagagctcttttga

SEQ ID NO: 811834 - DNA, 25 bp, Mus musculus
tccagctaggtctgagctcttttga

SEQ ID NO: 811835 - DNA, 25 bp, Mus musculus
tccagctagtacaccaggtctctgt

SEQ ID NO: 811836 - DNA, 25 bp, Mus musculus
tccagctagtactccaggtctctgt

SEQ ID NO: 811837 - DNA, 25 bp, Mus musculus
tccagctataatctctgcctccggg

SEQ ID NO: 811838 - DNA, 25 bp, Mus musculus
tccagctataatgtctgcctccggg

SEQ ID NO: 811839 - DNA, 25 bp, Mus musculus
tccagctatgtacatgccgtcagtc

SEQ ID NO: 811840 - DNA, 25 bp, Mus musculus
tccagctatgtagatgccgtcagtc

SEQ ID NO: 811841 - DNA, 25 bp, Mus musculus
tccagctcaccacagcagatggaag

SEQ ID NO: 811842 - DNA, 25 bp, Mus musculus
tccagctcaccagagcagatggaag

SEQ ID NO: 811843 - DNA, 25 bp, Mus musculus
tccagctcagctaaatcagtgtcgt

SEQ ID NO: 811844 - DNA, 25 bp, Mus musculus
tccagctcagcttaatcagtgtcgt

SEQ ID NO: 811845 - DNA, 25 bp, Mus musculus
tccagctcaggactaaactcatttt

SEQ ID NO: 811846 - DNA, 25 bp, Mus musculus
tccagctcaggagtaaactcatttt

SEQ ID NO: 811847 - DNA, 25 bp, Mus musculus
tccagctccaagaacaatgcatttt

SEQ ID NO: 811848 - DNA, 25 bp, Mus musculus
tccagctccaagtacaatgcatttt

SEQ ID NO: 811849 - DNA, 25 bp, Mus musculus
tccagctccacaagtttctagttaa

SEQ ID NO: 811850 - DNA, 25 bp, Mus musculus
tccagctccacatgtttctagttaa

SEQ ID NO: 811851 - DNA, 25 bp, Mus musculus
tccagctccaggaggtctgatgacc

SEQ ID NO: 811852 - DNA, 25 bp, Mus musculus
tccagctccaggtggtctgatgacc

SEQ ID NO: 811853 - DNA, 25 bp, Mus musculus
tccagctccagtagagacctagtgc

SEQ ID NO: 811854 - DNA, 25 bp, Mus musculus
tccagctccagttgagacctagtgc

SEQ ID NO: 811855 - DNA, 25 bp, Mus musculus
tccagctcccagatttttaaatttt

SEQ ID NO: 811856 - DNA, 25 bp, Mus musculus
tccagctcccagttttttaaatttt

SEQ ID NO: 811857 - DNA, 25 bp, Mus musculus
tccagctcctacaaggtcaaaacct

SEQ ID NO: 811858 - DNA, 25 bp, Mus musculus
tccagctcctactaggtcaaaacct

SEQ ID NO: 811859 - DNA, 25 bp, Mus musculus
tccagctccttacccacagagtggg

SEQ ID NO: 811860 - DNA, 25 bp, Mus musculus
tccagctccttagccacagagtggg

SEQ ID NO: 811861 - DNA, 25 bp, Mus musculus
tccagctccttgacaccgagagata

SEQ ID NO: 811862 - DNA, 25 bp, Mus musculus
tccagctccttgtcaccgagagata

SEQ ID NO: 811863 - DNA, 25 bp, Mus musculus
tccagctcgtcaccatgaactccct

SEQ ID NO: 811864 - DNA, 25 bp, Mus musculus
tccagctcgtcagcatgaactccct

SEQ ID NO: 811865 - DNA, 25 bp, Mus musculus
tccagctcgtggatgcaggaatcaa

SEQ ID NO: 811866 - DNA, 25 bp, Mus musculus
tccagctcgtggttgcaggaatcaa

SEQ ID NO: 811867 - DNA, 25 bp, Mus musculus
tccagctctcttattccatttgaaa

SEQ ID NO: 811868 - DNA, 25 bp, Mus musculus
tccagctctcttcatgtactgggag

SEQ ID NO: 811869 - DNA, 25 bp, Mus musculus
tccagctctcttgatgtactgggag

SEQ ID NO: 811870 - DNA, 25 bp, Mus musculus
tccagctctctttttccatttgaaa

SEQ ID NO: 811871 - DNA, 25 bp, Mus musculus
tccagctctgccacatatcagtata

SEQ ID NO: 811872 - DNA, 25 bp, Mus musculus
tccagctctgcctcatatcagtata

SEQ ID NO: 811873 - DNA, 25 bp, Mus musculus
tccagctctggaatctgcaatgtct

SEQ ID NO: 811874 - DNA, 25 bp, Mus musculus
tccagctctggattctgcaatgtct

SEQ ID NO: 811875 - DNA, 25 bp, Mus musculus
tccagctctggccattggtatccag

SEQ ID NO: 811876 - DNA, 25 bp, Mus musculus
tccagctctggcgattggtatccag

SEQ ID NO: 811877 - DNA, 25 bp, Mus musculus
tccagctctgggagttatgtagaag

SEQ ID NO: 811878 - DNA, 25 bp, Mus musculus
tccagctctgggtgttatgtagaag

SEQ ID NO: 811879 - DNA, 25 bp, Mus musculus
tccagctctggtctctgtattttca

SEQ ID NO: 811880 - DNA, 25 bp, Mus musculus
tccagctctggtgtctgtattttca

SEQ ID NO: 811881 - DNA, 25 bp, Mus musculus
tccagctctgttctctccgttgcaa

SEQ ID NO: 811882 - DNA, 25 bp, Mus musculus
tccagctctgttgtctccgttgcaa

SEQ ID NO: 811883 - DNA, 25 bp, Mus musculus
tccagctcttttctcctcgaaggtg

SEQ ID NO: 811884 - DNA, 25 bp, Mus musculus
tccagctcttttgtcctcgaaggtg

SEQ ID NO: 811885 - DNA, 25 bp, Mus musculus
tccagctgaagacctccatgtacag

SEQ ID NO: 811886 - DNA, 25 bp, Mus musculus
tccagctgaagacgcgcagtgcccg

SEQ ID NO: 811887 - DNA, 25 bp, Mus musculus
tccagctgaagagctccatgtacag

SEQ ID NO: 811888 - DNA, 25 bp, Mus musculus
tccagctgaagaggcgcagtgcccg

SEQ ID NO: 811889 - DNA, 25 bp, Mus musculus
tccagctgaagcaggcctctgggaa

SEQ ID NO: 811890 - DNA, 25 bp, Mus musculus
tccagctgaagccttttcctaagat

SEQ ID NO: 811891 - DNA, 25 bp, Mus musculus
tccagctgaagcgttttcctaagat

SEQ ID NO: 811892 - DNA, 25 bp, Mus musculus
tccagctgaagctggcctctgggaa

SEQ ID NO: 811893 - DNA, 25 bp, Mus musculus
tccagctgacacatggcattgctca

SEQ ID NO: 811894 - DNA, 25 bp, Mus musculus
tccagctgacacttggcattgctca

SEQ ID NO: 811895 - DNA, 25 bp, Mus musculus
tccagctgaccacagtttattggat

SEQ ID NO: 811896 - DNA, 25 bp, Mus musculus
tccagctgaccacattcatatgaat

SEQ ID NO: 811897 - DNA, 25 bp, Mus musculus
tccagctgaccagagtttattggat

SEQ ID NO: 811898 - DNA, 25 bp, Mus musculus
tccagctgaccagattcatatgaat

SEQ ID NO: 811899 - DNA, 25 bp, Mus musculus
tccagctgaggtagcattggtcact

SEQ ID NO: 811900 - DNA, 25 bp, Mus musculus
tccagctgaggttgcattggtcact

SEQ ID NO: 811901 - DNA, 25 bp, Mus musculus
tccagctgatgaccgcctctcggag

SEQ ID NO: 811902 - DNA, 25 bp, Mus musculus
tccagctgatgagcgcctctcggag

SEQ ID NO: 811903 - DNA, 25 bp, Mus musculus
tccagctgatggcatactgattcaa

SEQ ID NO: 811904 - DNA, 25 bp, Mus musculus
tccagctgatgggatactgattcaa

SEQ ID NO: 811905 - DNA, 25 bp, Mus musculus
tccagctgccttcacttgttggctt

SEQ ID NO: 811906 - DNA, 25 bp, Mus musculus
tccagctgccttgacttgttggctt

SEQ ID NO: 811907 - DNA, 25 bp, Mus musculus
tccagctgcggacactcaagacact

SEQ ID NO: 811908 - DNA, 25 bp, Mus musculus
tccagctgcggagactcaagacact

SEQ ID NO: 811909 - DNA, 25 bp, Mus musculus
tccagctgctccatcctaagatggg

SEQ ID NO: 811910 - DNA, 25 bp, Mus musculus
tccagctgctccttcctaagatggg

SEQ ID NO: 811911 - DNA, 25 bp, Mus musculus
tccagctgctggaaccatgtgacaa

SEQ ID NO: 811912 - DNA, 25 bp, Mus musculus
tccagctgctggtaccatgtgacaa

SEQ ID NO: 811913 - DNA, 25 bp, Mus musculus
tccagctggaaaactgaagtatttc

SEQ ID NO: 811914 - DNA, 25 bp, Mus musculus
tccagctggaaatctgaagtatttc

SEQ ID NO: 811915 - DNA, 25 bp, Mus musculus
tccagctggacaagaaaggagacgt

SEQ ID NO: 811916 - DNA, 25 bp, Mus musculus
tccagctggacatgaaaggagacgt

SEQ ID NO: 811917 - DNA, 25 bp, Mus musculus
tccagctggcttaatggctagaata

SEQ ID NO: 811918 - DNA, 25 bp, Mus musculus
tccagctggctttatggctagaata

SEQ ID NO: 811919 - DNA, 25 bp, Mus musculus
tccagctgggagatcaaattcatgc

SEQ ID NO: 811920 - DNA, 25 bp, Mus musculus
tccagctgggagttcaaattcatgc

SEQ ID NO: 811921 - DNA, 25 bp, Mus musculus
tccagctgtgggagtgcacaatgag

SEQ ID NO: 811922 - DNA, 25 bp, Mus musculus
tccagctgtgggtgtgcacaatgag

SEQ ID NO: 811923 - DNA, 25 bp, Mus musculus
tccagctgtgtgatcgctgacttag

SEQ ID NO: 811924 - DNA, 25 bp, Mus musculus
tccagctgtgtgttcgctgacttag

SEQ ID NO: 811925 - DNA, 25 bp, Mus musculus
tccagctgttgcatgatagcccaag

SEQ ID NO: 811926 - DNA, 25 bp, Mus musculus
tccagctgttgcttgatagcccaag

SEQ ID NO: 811927 - DNA, 25 bp, Mus musculus
tccagctgttggagatctaaaacat

SEQ ID NO: 811928 - DNA, 25 bp, Mus musculus
tccagctgttggtgatctaaaacat

SEQ ID NO: 811929 - DNA, 25 bp, Mus musculus
tccagctgtttcagtgggaaagcct

SEQ ID NO: 811930 - DNA, 25 bp, Mus musculus
tccagctgtttctgtgggaaagcct

SEQ ID NO: 811931 - DNA, 25 bp, Mus musculus
tccagcttcaatacctccttttaaa

SEQ ID NO: 811932 - DNA, 25 bp, Mus musculus
tccagcttcaattcctccttttaaa

SEQ ID NO: 811933 - DNA, 25 bp, Mus musculus
tccagcttccataacattcgagaaa

SEQ ID NO: 811934 - DNA, 25 bp, Mus musculus
tccagcttccattacattcgagaaa

SEQ ID NO: 811935 - DNA, 25 bp, Mus musculus
tccagcttcccgctaaaggatgatt

SEQ ID NO: 811936 - DNA, 25 bp, Mus musculus
tccagcttcccggtaaaggatgatt

SEQ ID NO: 811937 - DNA, 25 bp, Mus musculus
tccagcttctacagccacagtgagg

SEQ ID NO: 811938 - DNA, 25 bp, Mus musculus
tccagcttctactgccacagtgagg

SEQ ID NO: 811939 - DNA, 25 bp, Mus musculus
tccagcttctcgacagcgcagaaat

SEQ ID NO: 811940 - DNA, 25 bp, Mus musculus
tccagcttctcgtcagcgcagaaat

SEQ ID NO: 811941 - DNA, 25 bp, Mus musculus
tccagctttcttcagtgtcctccat

SEQ ID NO: 811942 - DNA, 25 bp, Mus musculus
tccagctttcttgagtgtcctccat

SEQ ID NO: 811943 - DNA, 25 bp, Mus musculus
tccagctttgtaccggtcagtggct

SEQ ID NO: 811944 - DNA, 25 bp, Mus musculus
tccagctttgtagcggtcagtggct

SEQ ID NO: 811945 - DNA, 25 bp, Mus musculus
tccagcttttggattcatcatctat

SEQ ID NO: 811946 - DNA, 25 bp, Mus musculus
tccagcttttggtttcatcatctat

SEQ ID NO: 811947 - DNA, 25 bp, Mus musculus
tccaggaaagcccaaccctaggcgg

SEQ ID NO: 811948 - DNA, 25 bp, Mus musculus
tccaggaaagccgaaccctaggcgg

SEQ ID NO: 811949 - DNA, 25 bp, Mus musculus
tccaggaacactaccttcgctgtta

SEQ ID NO: 811950 - DNA, 25 bp, Mus musculus
tccaggaacacttccttcgctgtta

SEQ ID NO: 811951 - DNA, 25 bp, Mus musculus
tccaggaaccagagctttggccggg

SEQ ID NO: 811952 - DNA, 25 bp, Mus musculus
tccaggaaccagtgctttggccggg

SEQ ID NO: 811953 - DNA, 25 bp, Mus musculus
tccaggaactctaccagggtcaaga

SEQ ID NO: 811954 - DNA, 25 bp, Mus musculus
tccaggaactcttccagggtcaaga

SEQ ID NO: 811955 - DNA, 25 bp, Mus musculus
tccaggaacttcacgggagaacctc

SEQ ID NO: 811956 - DNA, 25 bp, Mus musculus
tccaggaacttctcgggagaacctc

SEQ ID NO: 811957 - DNA, 25 bp, Mus musculus
tccaggaagtctaggccgccagtgg

SEQ ID NO: 811958 - DNA, 25 bp, Mus musculus
tccaggaagtcttggccgccagtgg

SEQ ID NO: 811959 - DNA, 25 bp, Mus musculus
tccaggaagtgaattacagtttcaa

SEQ ID NO: 811960 - DNA, 25 bp, Mus musculus
tccaggaagtgatttacagtttcaa

SEQ ID NO: 811961 - DNA, 25 bp, Mus musculus
tccaggaatcacagaggtccttctt

SEQ ID NO: 811962 - DNA, 25 bp, Mus musculus
tccaggaatcactgaggtccttctt

SEQ ID NO: 811963 - DNA, 25 bp, Mus musculus
tccaggacaaacacgggtgtggcac

SEQ ID NO: 811964 - DNA, 25 bp, Mus musculus
tccaggacaaactcgggtgtggcac

SEQ ID NO: 811965 - DNA, 25 bp, Mus musculus
tccaggacaactagcgccacacagg

SEQ ID NO: 811966 - DNA, 25 bp, Mus musculus
tccaggacaacttgcgccacacagg

SEQ ID NO: 811967 - DNA, 25 bp, Mus musculus
tccaggacaccaagcactacctgtg

SEQ ID NO: 811968 - DNA, 25 bp, Mus musculus
tccaggacaccatgcactacctgtg

SEQ ID NO: 811969 - DNA, 25 bp, Mus musculus
tccaggacacctaagttaacccaga

SEQ ID NO: 811970 - DNA, 25 bp, Mus musculus
tccaggacaccttagttaacccaga

SEQ ID NO: 811971 - DNA, 25 bp, Mus musculus
tccaggacagaaaacagccatgcaa

SEQ ID NO: 811972 - DNA, 25 bp, Mus musculus
tccaggacagaatacagccatgcaa

SEQ ID NO: 811973 - DNA, 25 bp, Mus musculus
tccaggacatgaaaccctttggtgt

SEQ ID NO: 811974 - DNA, 25 bp, Mus musculus
tccaggacatgataccctttggtgt

SEQ ID NO: 811975 - DNA, 25 bp, Mus musculus
tccaggaccaaaccagcctttgtat

SEQ ID NO: 811976 - DNA, 25 bp, Mus musculus
tccaggaccaaagcagcctttgtat

SEQ ID NO: 811977 - DNA, 25 bp, Mus musculus
tccaggaccattcggtttatgtagt

SEQ ID NO: 811978 - DNA, 25 bp, Mus musculus
tccaggaccattgggtttatgtagt

SEQ ID NO: 811979 - DNA, 25 bp, Mus musculus
tccaggaccgataccacttcaatga

SEQ ID NO: 811980 - DNA, 25 bp, Mus musculus
tccaggaccgattccacttcaatga

SEQ ID NO: 811981 - DNA, 25 bp, Mus musculus
tccaggacctatactcttgctgtca

SEQ ID NO: 811982 - DNA, 25 bp, Mus musculus
tccaggacctattctcttgctgtca

SEQ ID NO: 811983 - DNA, 25 bp, Mus musculus
tccaggacctcacttcaccttagat

SEQ ID NO: 811984 - DNA, 25 bp, Mus musculus
tccaggacctcagttcaccttagat

SEQ ID NO: 811985 - DNA, 25 bp, Mus musculus
tccaggacctggcttggcacaagtg

SEQ ID NO: 811986 - DNA, 25 bp, Mus musculus
tccaggacctgggttggcacaagtg

SEQ ID NO: 811987 - DNA, 25 bp, Mus musculus
tccaggacctgtctggctcccgaga

SEQ ID NO: 811988 - DNA, 25 bp, Mus musculus
tccaggacctgtgtggctcccgaga

SEQ ID NO: 811989 - DNA, 25 bp, Mus musculus
tccaggaccttaccctgtttgaggt

SEQ ID NO: 811990 - DNA, 25 bp, Mus musculus
tccaggaccttagcctgtttgaggt

SEQ ID NO: 811991 - DNA, 25 bp, Mus musculus
tccaggactagacctaggttagact

SEQ ID NO: 811992 - DNA, 25 bp, Mus musculus
tccaggactagagctaggttagact

SEQ ID NO: 811993 - DNA, 25 bp, Mus musculus
tccaggactcacagctcaagaacag

SEQ ID NO: 811994 - DNA, 25 bp, Mus musculus
tccaggactcactgctcaagaacag

SEQ ID NO: 811995 - DNA, 25 bp, Mus musculus
tccaggagacccagtgctctgactt

SEQ ID NO: 811996 - DNA, 25 bp, Mus musculus
tccaggagaccctgtgctctgactt

SEQ ID NO: 811997 - DNA, 25 bp, Mus musculus
tccaggagattgctgaccgggtcaa

SEQ ID NO: 811998 - DNA, 25 bp, Mus musculus
tccaggagattggtgaccgggtcaa

SEQ ID NO: 811999 - DNA, 25 bp, Mus musculus
tccaggagcacgagtacgaggagat

SEQ ID NO: 812000 - DNA, 25 bp, Mus musculus
tccaggagcacgtgtacgaggagat

SEQ ID NO: 812001 - DNA, 25 bp, Mus musculus
tccaggagcagaccctaggttcttt

SEQ ID NO: 812002 - DNA, 25 bp, Mus musculus
tccaggagcagagcctaggttcttt

SEQ ID NO: 812003 - DNA, 25 bp, Mus musculus
tccaggagcatacactgcgggcttt

SEQ ID NO: 812004 - DNA, 25 bp, Mus musculus
tccaggagcatagactgcgggcttt

SEQ ID NO: 812005 - DNA, 25 bp, Mus musculus
tccaggagccatagtacccacctat

SEQ ID NO: 812006 - DNA, 25 bp, Mus musculus
tccaggagccattgtacccacctat

SEQ ID NO: 812007 - DNA, 25 bp, Mus musculus
tccaggagcgagaccccactaacat

SEQ ID NO: 812008 - DNA, 25 bp, Mus musculus
tccaggagcgagtccccactaacat

SEQ ID NO: 812009 - DNA, 25 bp, Mus musculus
tccaggagctcactctgggcagcag

SEQ ID NO: 812010 - DNA, 25 bp, Mus musculus
tccaggagctcagtctgggcagcag

SEQ ID NO: 812011 - DNA, 25 bp, Mus musculus
tccaggagtgcccagcagaagagcg

SEQ ID NO: 812012 - DNA, 25 bp, Mus musculus
tccaggagtgcccaggcgaccacct

SEQ ID NO: 812013 - DNA, 25 bp, Mus musculus
tccaggagtgccgagcagaagagcg

SEQ ID NO: 812014 - DNA, 25 bp, Mus musculus
tccaggagtgccgaggcgaccacct

SEQ ID NO: 812015 - DNA, 25 bp, Mus musculus
tccaggagtgggaaaagctctatga

SEQ ID NO: 812016 - DNA, 25 bp, Mus musculus
tccaggagtgggtaaagctctatga

SEQ ID NO: 812017 - DNA, 25 bp, Mus musculus
tccaggagttgaactcaccttcaag

SEQ ID NO: 812018 - DNA, 25 bp, Mus musculus
tccaggagttgatctcaccttcaag

SEQ ID NO: 812019 - DNA, 25 bp, Mus musculus
tccaggataccgccccaaatattta

SEQ ID NO: 812020 - DNA, 25 bp, Mus musculus
tccaggataccggcccaaatattta

SEQ ID NO: 812021 - DNA, 25 bp, Mus musculus
tccaggatatccagaagcacagact

SEQ ID NO: 812022 - DNA, 25 bp, Mus musculus
tccaggatatcctgaagcacagact

SEQ ID NO: 812023 - DNA, 25 bp, Mus musculus
tccaggatattccacactgctataa

SEQ ID NO: 812024 - DNA, 25 bp, Mus musculus
tccaggatattcgacactgctataa

SEQ ID NO: 812025 - DNA, 25 bp, Mus musculus
tccaggatcctccatacagcacaga

SEQ ID NO: 812026 - DNA, 25 bp, Mus musculus
tccaggatcctcgatacagcacaga

SEQ ID NO: 812027 - DNA, 25 bp, Mus musculus
tccaggatcctgcaaccaccactcc

SEQ ID NO: 812028 - DNA, 25 bp, Mus musculus
tccaggatcctggaaccaccactcc

SEQ ID NO: 812029 - DNA, 25 bp, Mus musculus
tccaggatctgcagacttgcctata

SEQ ID NO: 812030 - DNA, 25 bp, Mus musculus
tccaggatctgctgacttgcctata

SEQ ID NO: 812031 - DNA, 25 bp, Mus musculus
tccaggatcttcctcccagtggcaa

SEQ ID NO: 812032 - DNA, 25 bp, Mus musculus
tccaggatcttcgtcccagtggcaa

SEQ ID NO: 812033 - DNA, 25 bp, Mus musculus
tccaggatcttgaactttggcctct

SEQ ID NO: 812034 - DNA, 25 bp, Mus musculus
tccaggatcttgacaggcttggcaa

SEQ ID NO: 812035 - DNA, 25 bp, Mus musculus
tccaggatcttgtactttggcctct

SEQ ID NO: 812036 - DNA, 25 bp, Mus musculus
tccaggatcttgtcaggcttggcaa

SEQ ID NO: 812037 - DNA, 25 bp, Mus musculus
tccaggatgcatcgtcatttgaaat

SEQ ID NO: 812038 - DNA, 25 bp, Mus musculus
tccaggatgcatggtcatttgaaat

SEQ ID NO: 812039 - DNA, 25 bp, Mus musculus
tccaggatgctgactgccaggtcac

SEQ ID NO: 812040 - DNA, 25 bp, Mus musculus
tccaggatgctgtctgccaggtcac

SEQ ID NO: 812041 - DNA, 25 bp, Mus musculus
tccaggatggagctcccagggcatc

SEQ ID NO: 812042 - DNA, 25 bp, Mus musculus
tccaggatggaggtcccagggcatc

SEQ ID NO: 812043 - DNA, 25 bp, Mus musculus
tccaggatgtccctggcagagacta

SEQ ID NO: 812044 - DNA, 25 bp, Mus musculus
tccaggatgtccgtggcagagacta

SEQ ID NO: 812045 - DNA, 25 bp, Mus musculus
tccaggattcctaatagccccggag

SEQ ID NO: 812046 - DNA, 25 bp, Mus musculus
tccaggattccttatagccccggag

SEQ ID NO: 812047 - DNA, 25 bp, Mus musculus
tccaggattttcagatccccaaggg

SEQ ID NO: 812048 - DNA, 25 bp, Mus musculus
tccaggattttctgatccccaaggg

SEQ ID NO: 812049 - DNA, 25 bp, Mus musculus
tccaggcaatgaaggtgccccacaa

SEQ ID NO: 812050 - DNA, 25 bp, Mus musculus
tccaggcaatgatggtgccccacaa

SEQ ID NO: 812051 - DNA, 25 bp, Mus musculus
tccaggcactggatggcacttgcaa

SEQ ID NO: 812052 - DNA, 25 bp, Mus musculus
tccaggcactggttggcacttgcaa

SEQ ID NO: 812053 - DNA, 25 bp, Mus musculus
tccaggcactgtcatgagtcggaaa

SEQ ID NO: 812054 - DNA, 25 bp, Mus musculus
tccaggcactgtgatgagtcggaaa

SEQ ID NO: 812055 - DNA, 25 bp, Mus musculus
tccaggcagctcaggatggatatga

SEQ ID NO: 812056 - DNA, 25 bp, Mus musculus
tccaggcagctctggatggatatga

SEQ ID NO: 812057 - DNA, 25 bp, Mus musculus
tccaggcagctgagtacattaagat

SEQ ID NO: 812058 - DNA, 25 bp, Mus musculus
tccaggcagctgtgtacattaagat

SEQ ID NO: 812059 - DNA, 25 bp, Mus musculus
tccaggcagtgcactgggcaggaat

SEQ ID NO: 812060 - DNA, 25 bp, Mus musculus
tccaggcagtgctctgggcaggaat

SEQ ID NO: 812061 - DNA, 25 bp, Mus musculus
tccaggcagtgtatgacccgtcata

SEQ ID NO: 812062 - DNA, 25 bp, Mus musculus
tccaggcagtgtttgacccgtcata

SEQ ID NO: 812063 - DNA, 25 bp, Mus musculus
tccaggcatgagctagtgtgacact

SEQ ID NO: 812064 - DNA, 25 bp, Mus musculus
tccaggcatgaggtagtgtgacact

SEQ ID NO: 812065 - DNA, 25 bp, Mus musculus
tccaggcatgcccttagagcatggt

SEQ ID NO: 812066 - DNA, 25 bp, Mus musculus
tccaggcatgccgttagagcatggt

SEQ ID NO: 812067 - DNA, 25 bp, Mus musculus
tccaggcatgcgaggtctgctttga

SEQ ID NO: 812068 - DNA, 25 bp, Mus musculus
tccaggcatgcgtggtctgctttga

SEQ ID NO: 812069 - DNA, 25 bp, Mus musculus
tccaggcattgcagggagggacatg

SEQ ID NO: 812070 - DNA, 25 bp, Mus musculus
tccaggcattgctgggagggacatg

SEQ ID NO: 812071 - DNA, 25 bp, Mus musculus
tccaggcatttgagtgggagccagc

SEQ ID NO: 812072 - DNA, 25 bp, Mus musculus
tccaggcatttgtgtgggagccagc

SEQ ID NO: 812073 - DNA, 25 bp, Mus musculus
tccaggccaacaactttgctaaagg

SEQ ID NO: 812074 - DNA, 25 bp, Mus musculus
tccaggccaacatctttgctaaagg

SEQ ID NO: 812075 - DNA, 25 bp, Mus musculus
tccaggccaagtacagggtgtccac

SEQ ID NO: 812076 - DNA, 25 bp, Mus musculus
tccaggccaagttcagggtgtccac

SEQ ID NO: 812077 - DNA, 25 bp, Mus musculus
tccaggccaatccagaagccaactg

SEQ ID NO: 812078 - DNA, 25 bp, Mus musculus
tccaggccaatcgagaagccaactg

SEQ ID NO: 812079 - DNA, 25 bp, Mus musculus
tccaggccagccctagctagatgat

SEQ ID NO: 812080 - DNA, 25 bp, Mus musculus
tccaggccagccgtagctagatgat

SEQ ID NO: 812081 - DNA, 25 bp, Mus musculus
tccaggccagttcagagacttcagc

SEQ ID NO: 812082 - DNA, 25 bp, Mus musculus
tccaggccagttcggactgcacact

SEQ ID NO: 812083 - DNA, 25 bp, Mus musculus
tccaggccagttgagagacttcagc

SEQ ID NO: 812084 - DNA, 25 bp, Mus musculus
tccaggccagttgggactgcacact

SEQ ID NO: 812085 - DNA, 25 bp, Mus musculus
tccaggccatgcagtgcaagtttaa

SEQ ID NO: 812086 - DNA, 25 bp, Mus musculus
tccaggccatgctgtgcaagtttaa

SEQ ID NO: 812087 - DNA, 25 bp, Mus musculus
tccaggccatggataagaggctgtg

SEQ ID NO: 812088 - DNA, 25 bp, Mus musculus
tccaggccatggttaagaggctgtg

SEQ ID NO: 812089 - DNA, 25 bp, Mus musculus
tccaggcccatgacagcaagggaga

SEQ ID NO: 812090 - DNA, 25 bp, Mus musculus
tccaggcccatgtcagcaagggaga

SEQ ID NO: 812091 - DNA, 25 bp, Mus musculus
tccaggcccattcaggtagctcttt

SEQ ID NO: 812092 - DNA, 25 bp, Mus musculus
tccaggcccattgaggtagctcttt

SEQ ID NO: 812093 - DNA, 25 bp, Mus musculus
tccaggcccccaatatttcagaaga

SEQ ID NO: 812094 - DNA, 25 bp, Mus musculus
tccaggcccccattatttcagaaga

SEQ ID NO: 812095 - DNA, 25 bp, Mus musculus
tccaggccctgcatgtgcagaggtg

SEQ ID NO: 812096 - DNA, 25 bp, Mus musculus
tccaggccctgcttgtgcagaggtg

SEQ ID NO: 812097 - DNA, 25 bp, Mus musculus
tccaggccctggaataagaatgctt

SEQ ID NO: 812098 - DNA, 25 bp, Mus musculus
tccaggccctggtataagaatgctt

SEQ ID NO: 812099 - DNA, 25 bp, Mus musculus
tccaggccgatgagaagttcccagt

SEQ ID NO: 812100 - DNA, 25 bp, Mus musculus
tccaggccgatgtgaagttcccagt

SEQ ID NO: 812101 - DNA, 25 bp, Mus musculus
tccaggcctgcacggagtgttgata

SEQ ID NO: 812102 - DNA, 25 bp, Mus musculus
tccaggcctgcagggagtgttgata

SEQ ID NO: 812103 - DNA, 25 bp, Mus musculus
tccaggcctgggaacttcactaaag

SEQ ID NO: 812104 - DNA, 25 bp, Mus musculus
tccaggcctgggtacttcactaaag

SEQ ID NO: 812105 - DNA, 25 bp, Mus musculus
tccaggccttatagagaccagaccc

SEQ ID NO: 812106 - DNA, 25 bp, Mus musculus
tccaggccttattgagaccagaccc

SEQ ID NO: 812107 - DNA, 25 bp, Mus musculus
tccaggccttccagttcactgacaa

SEQ ID NO: 812108 - DNA, 25 bp, Mus musculus
tccaggccttcctgttcactgacaa

SEQ ID NO: 812109 - DNA, 25 bp, Mus musculus
tccaggccttgtcgcgcggattcct

SEQ ID NO: 812110 - DNA, 25 bp, Mus musculus
tccaggccttgtggcgcggattcct

SEQ ID NO: 812111 - DNA, 25 bp, Mus musculus
tccaggcgacacaggcgacgcttca

SEQ ID NO: 812112 - DNA, 25 bp, Mus musculus
tccaggcgacactggcgacgcttca

SEQ ID NO: 812113 - DNA, 25 bp, Mus musculus
tccaggcgtcagaggccttcatttt

SEQ ID NO: 812114 - DNA, 25 bp, Mus musculus
tccaggcgtcagtggccttcatttt

SEQ ID NO: 812115 - DNA, 25 bp, Mus musculus
tccaggcgtctgcaaaatgtttccc

SEQ ID NO: 812116 - DNA, 25 bp, Mus musculus
tccaggcgtctggaaaatgtttccc

SEQ ID NO: 812117 - DNA, 25 bp, Mus musculus
tccaggcgtggtccctagtaggtca

SEQ ID NO: 812118 - DNA, 25 bp, Mus musculus
tccaggcgtggtgcctagtaggtca

SEQ ID NO: 812119 - DNA, 25 bp, Mus musculus
tccaggctaatcagagctactctca

SEQ ID NO: 812120 - DNA, 25 bp, Mus musculus
tccaggctaatctgagctactctca

SEQ ID NO: 812121 - DNA, 25 bp, Mus musculus
tccaggctacaccactgcatggaaa

SEQ ID NO: 812122 - DNA, 25 bp, Mus musculus
tccaggctacacgactgcatggaaa

SEQ ID NO: 812123 - DNA, 25 bp, Mus musculus
tccaggctagctcctttttttccta

SEQ ID NO: 812124 - DNA, 25 bp, Mus musculus
tccaggctagctgctttttttccta

SEQ ID NO: 812125 - DNA, 25 bp, Mus musculus
tccaggctagtcagtcttatagagt

SEQ ID NO: 812126 - DNA, 25 bp, Mus musculus
tccaggctagtctgtcttatagagt

SEQ ID NO: 812127 - DNA, 25 bp, Mus musculus
tccaggctccagcacttgttgaagg

SEQ ID NO: 812128 - DNA, 25 bp, Mus musculus
tccaggctccaggacttgttgaagg

SEQ ID NO: 812129 - DNA, 25 bp, Mus musculus
tccaggctcggcaggtgtctatctc

SEQ ID NO: 812130 - DNA, 25 bp, Mus musculus
tccaggctcggctggtgtctatctc

SEQ ID NO: 812131 - DNA, 25 bp, Mus musculus
tccaggctctgtatgttagtgcatg

SEQ ID NO: 812132 - DNA, 25 bp, Mus musculus
tccaggctctgtttgttagtgcatg

SEQ ID NO: 812133 - DNA, 25 bp, Mus musculus
tccaggctgatgacgtccatgttga

SEQ ID NO: 812134 - DNA, 25 bp, Mus musculus
tccaggctgatgtcgtccatgttga

SEQ ID NO: 812135 - DNA, 25 bp, Mus musculus
tccaggctgcgcagaagcacgaata

SEQ ID NO: 812136 - DNA, 25 bp, Mus musculus
tccaggctgcgctgaagcacgaata

SEQ ID NO: 812137 - DNA, 25 bp, Mus musculus
tccaggctgcttatttgaggtcttt

SEQ ID NO: 812138 - DNA, 25 bp, Mus musculus
tccaggctgcttcactaccataaat

SEQ ID NO: 812139 - DNA, 25 bp, Mus musculus
tccaggctgcttgactaccataaat

SEQ ID NO: 812140 - DNA, 25 bp, Mus musculus
tccaggctgcttttttgaggtcttt

SEQ ID NO: 812141 - DNA, 25 bp, Mus musculus
tccaggctgggtccgcgccatgggc

SEQ ID NO: 812142 - DNA, 25 bp, Mus musculus
tccaggctgggtgcgcgccatgggc

SEQ ID NO: 812143 - DNA, 25 bp, Mus musculus
tccaggctggtccatctcatcaaac

SEQ ID NO: 812144 - DNA, 25 bp, Mus musculus
tccaggctggtcgatctcatcaaac

SEQ ID NO: 812145 - DNA, 25 bp, Mus musculus
tccaggctggtgaacgagtgcttag

SEQ ID NO: 812146 - DNA, 25 bp, Mus musculus
tccaggctggtgtacgagtgcttag

SEQ ID NO: 812147 - DNA, 25 bp, Mus musculus
tccaggctgtcgagtttatcagtag

SEQ ID NO: 812148 - DNA, 25 bp, Mus musculus
tccaggctgtcgtgtttatcagtag

SEQ ID NO: 812149 - DNA, 25 bp, Mus musculus
tccaggctgtggaagatcttgaacc

SEQ ID NO: 812150 - DNA, 25 bp, Mus musculus
tccaggctgtggtagatcttgaacc

SEQ ID NO: 812151 - DNA, 25 bp, Mus musculus
tccaggcttatgaggaagctcaagc

SEQ ID NO: 812152 - DNA, 25 bp, Mus musculus
tccaggcttatgtggaagctcaagc

SEQ ID NO: 812153 - DNA, 25 bp, Mus musculus
tccaggcttcaaataacttgagttt

SEQ ID NO: 812154 - DNA, 25 bp, Mus musculus
tccaggcttcaattaacttgagttt

SEQ ID NO: 812155 - DNA, 25 bp, Mus musculus
tccaggcttgccagagccggatgca

SEQ ID NO: 812156 - DNA, 25 bp, Mus musculus
tccaggcttgcctgagccggatgca

SEQ ID NO: 812157 - DNA, 25 bp, Mus musculus
tccagggaaaggctcgagtgacaca

SEQ ID NO: 812158 - DNA, 25 bp, Mus musculus
tccagggaaagggtcgagtgacaca

SEQ ID NO: 812159 - DNA, 25 bp, Mus musculus
tccagggaagcgatgtttctccagg

SEQ ID NO: 812160 - DNA, 25 bp, Mus musculus
tccagggaagcgttgtttctccagg

SEQ ID NO: 812161 - DNA, 25 bp, Mus musculus
tccagggaatgtcaggtatgaacca

SEQ ID NO: 812162 - DNA, 25 bp, Mus musculus
tccagggaatgtgaggtatgaacca

SEQ ID NO: 812163 - DNA, 25 bp, Mus musculus
tccagggaccaactgtgagatcgca

SEQ ID NO: 812164 - DNA, 25 bp, Mus musculus
tccagggaccaagtgtgagatcgca

SEQ ID NO: 812165 - DNA, 25 bp, Mus musculus
tccagggaccacagagcctgagcag

SEQ ID NO: 812166 - DNA, 25 bp, Mus musculus
tccagggaccactgagcctgagcag

SEQ ID NO: 812167 - DNA, 25 bp, Mus musculus
tccagggaccagaatctttctgctt

SEQ ID NO: 812168 - DNA, 25 bp, Mus musculus
tccagggaccagacactaagttcag

SEQ ID NO: 812169 - DNA, 25 bp, Mus musculus
tccagggaccagtatctttctgctt

SEQ ID NO: 812170 - DNA, 25 bp, Mus musculus
tccagggaccagtcactaagttcag

SEQ ID NO: 812171 - DNA, 25 bp, Mus musculus
tccagggaccggagtacaaaataca

SEQ ID NO: 812172 - DNA, 25 bp, Mus musculus
tccagggaccggtgtacaaaataca

SEQ ID NO: 812173 - DNA, 25 bp, Mus musculus
tccagggacctacatctgcgtcttc

SEQ ID NO: 812174 - DNA, 25 bp, Mus musculus
tccagggacctacgcaaggactgca

SEQ ID NO: 812175 - DNA, 25 bp, Mus musculus
tccagggacctagatctgcgtcttc

SEQ ID NO: 812176 - DNA, 25 bp, Mus musculus
tccagggacctaggcaaggactgca

SEQ ID NO: 812177 - DNA, 25 bp, Mus musculus
tccagggacctcaggcttagcagaa

SEQ ID NO: 812178 - DNA, 25 bp, Mus musculus
tccagggacctctggcttagcagaa

SEQ ID NO: 812179 - DNA, 25 bp, Mus musculus
tccagggacgacagtgatgccacca

SEQ ID NO: 812180 - DNA, 25 bp, Mus musculus
tccagggacgactgtgatgccacca

SEQ ID NO: 812181 - DNA, 25 bp, Mus musculus
tccagggacttcacagagggcgata

SEQ ID NO: 812182 - DNA, 25 bp, Mus musculus
tccagggacttctcagagggcgata

SEQ ID NO: 812183 - DNA, 25 bp, Mus musculus
tccagggagaatcgtcgcataacaa

SEQ ID NO: 812184 - DNA, 25 bp, Mus musculus
tccagggagaatggtcgcataacaa

SEQ ID NO: 812185 - DNA, 25 bp, Mus musculus
tccagggagggacagcttgtcttct

SEQ ID NO: 812186 - DNA, 25 bp, Mus musculus
tccagggagggagagcttgtcttct

SEQ ID NO: 812187 - DNA, 25 bp, Mus musculus
tccagggatcacatggtgccagata

SEQ ID NO: 812188 - DNA, 25 bp, Mus musculus
tccagggatcacttggtgccagata

SEQ ID NO: 812189 - DNA, 25 bp, Mus musculus
tccagggatgacacaggttcccggt

SEQ ID NO: 812190 - DNA, 25 bp, Mus musculus
tccagggatgactcaggttcccggt

SEQ ID NO: 812191 - DNA, 25 bp, Mus musculus
tccagggatgagcagctgagaaccc

SEQ ID NO: 812192 - DNA, 25 bp, Mus musculus
tccagggatgaggagctgagaaccc

SEQ ID NO: 812193 - DNA, 25 bp, Mus musculus
tccagggatgatctttgtgttctgc

SEQ ID NO: 812194 - DNA, 25 bp, Mus musculus
tccagggatgatgtttgtgttctgc

SEQ ID NO: 812195 - DNA, 25 bp, Mus musculus
tccagggatgccacggtgcctcgga

SEQ ID NO: 812196 - DNA, 25 bp, Mus musculus
tccagggatgcctcggtgcctcgga

SEQ ID NO: 812197 - DNA, 25 bp, Mus musculus
tccagggatgctacctttgaggact

SEQ ID NO: 812198 - DNA, 25 bp, Mus musculus
tccagggatgcttcctttgaggact

SEQ ID NO: 812199 - DNA, 25 bp, Mus musculus
tccagggcaaagatccgaaccgtga

SEQ ID NO: 812200 - DNA, 25 bp, Mus musculus
tccagggcaaagttccgaaccgtga

SEQ ID NO: 812201 - DNA, 25 bp, Mus musculus
tccagggcaagcacatctgtgcaga

SEQ ID NO: 812202 - DNA, 25 bp, Mus musculus
tccagggcaagctcatctgtgcaga

SEQ ID NO: 812203 - DNA, 25 bp, Mus musculus
tccagggcagaaagacggagaagct

SEQ ID NO: 812204 - DNA, 25 bp, Mus musculus
tccagggcagaatgacggagaagct

SEQ ID NO: 812205 - DNA, 25 bp, Mus musculus
tccagggcagctatgaacttgtagg

SEQ ID NO: 812206 - DNA, 25 bp, Mus musculus
tccagggcagctttgaacttgtagg

SEQ ID NO: 812207 - DNA, 25 bp, Mus musculus
tccagggccaataagaattagtttt

SEQ ID NO: 812208 - DNA, 25 bp, Mus musculus
tccagggccaattagaattagtttt

SEQ ID NO: 812209 - DNA, 25 bp, Mus musculus
tccagggccaccccaagttgtggtg

SEQ ID NO: 812210 - DNA, 25 bp, Mus musculus
tccagggccaccgcaagttgtggtg

SEQ ID NO: 812211 - DNA, 25 bp, Mus musculus
tccagggccccgatgacatcactga

SEQ ID NO: 812212 - DNA, 25 bp, Mus musculus
tccagggccccgttgacatcactga

SEQ ID NO: 812213 - DNA, 25 bp, Mus musculus
tccagggccgggaatgtagcctaca

SEQ ID NO: 812214 - DNA, 25 bp, Mus musculus
tccagggccgggtatgtagcctaca

SEQ ID NO: 812215 - DNA, 25 bp, Mus musculus
tccagggccgtgattacagtaaaat

SEQ ID NO: 812216 - DNA, 25 bp, Mus musculus
tccagggccgtgtttacagtaaaat

SEQ ID NO: 812217 - DNA, 25 bp, Mus musculus
tccagggccttaatttggcgagtaa

SEQ ID NO: 812218 - DNA, 25 bp, Mus musculus
tccagggccttattttggcgagtaa

SEQ ID NO: 812219 - DNA, 25 bp, Mus musculus
tccagggcggagagaactactttac

SEQ ID NO: 812220 - DNA, 25 bp, Mus musculus
tccagggcggagtgaactactttac

SEQ ID NO: 812221 - DNA, 25 bp, Mus musculus
tccagggctgatccaagtctagaac

SEQ ID NO: 812222 - DNA, 25 bp, Mus musculus
tccagggctgatgcaagtctagaac

SEQ ID NO: 812223 - DNA, 25 bp, Mus musculus
tccagggctgtcactctgatgacaa

SEQ ID NO: 812224 - DNA, 25 bp, Mus musculus
tccagggctgtctctctgatgacaa

SEQ ID NO: 812225 - DNA, 25 bp, Mus musculus
tccagggcttcacagttgctgtttg

SEQ ID NO: 812226 - DNA, 25 bp, Mus musculus
tccagggcttcagagttgctgtttg

SEQ ID NO: 812227 - DNA, 25 bp, Mus musculus
tccagggcttccaaaggaccttggg

SEQ ID NO: 812228 - DNA, 25 bp, Mus musculus
tccagggcttcctaaggaccttggg

SEQ ID NO: 812229 - DNA, 25 bp, Mus musculus
tccagggcttgcacatgctaagtac

SEQ ID NO: 812230 - DNA, 25 bp, Mus musculus
tccagggcttgctcatgctaagtac

SEQ ID NO: 812231 - DNA, 25 bp, Mus musculus
tccagggctttcatatcaggtgtcc

SEQ ID NO: 812232 - DNA, 25 bp, Mus musculus
tccagggctttcttatcaggtgtcc

SEQ ID NO: 812233 - DNA, 25 bp, Mus musculus
tccagggtccaccaaaactgttggt

SEQ ID NO: 812234 - DNA, 25 bp, Mus musculus
tccagggtccacgaaaactgttggt

SEQ ID NO: 812235 - DNA, 25 bp, Mus musculus
tccagggtcctgcagcataacagat

SEQ ID NO: 812236 - DNA, 25 bp, Mus musculus
tccagggtcctggagcataacagat

SEQ ID NO: 812237 - DNA, 25 bp, Mus musculus
tccagggtcgctcagctgactgagt

SEQ ID NO: 812238 - DNA, 25 bp, Mus musculus
tccagggtcgctgagctgactgagt

SEQ ID NO: 812239 - DNA, 25 bp, Mus musculus
tccagggtgatgctcttgcctgtca

SEQ ID NO: 812240 - DNA, 25 bp, Mus musculus
tccagggtgatggtcttgcctgtca

SEQ ID NO: 812241 - DNA, 25 bp, Mus musculus
tccagggtgcagaaccatgtcagtc

SEQ ID NO: 812242 - DNA, 25 bp, Mus musculus
tccagggtgcagtaccatgtcagtc

SEQ ID NO: 812243 - DNA, 25 bp, Mus musculus
tccagggtgctgctgttcactgaga

SEQ ID NO: 812244 - DNA, 25 bp, Mus musculus
tccagggtgctggtgttcactgaga

SEQ ID NO: 812245 - DNA, 25 bp, Mus musculus
tccagggtggagatggcctttgcca

SEQ ID NO: 812246 - DNA, 25 bp, Mus musculus
tccagggtggagttggcctttgcca

SEQ ID NO: 812247 - DNA, 25 bp, Mus musculus
tccagggtggctacgatggctatgc

SEQ ID NO: 812248 - DNA, 25 bp, Mus musculus
tccagggtggcttcgatggctatgc

SEQ ID NO: 812249 - DNA, 25 bp, Mus musculus
tccagggtggtcaagctattgatat

SEQ ID NO: 812250 - DNA, 25 bp, Mus musculus
tccagggtggtctagctattgatat

SEQ ID NO: 812251 - DNA, 25 bp, Mus musculus
tccagggtttaaatttattgctact

SEQ ID NO: 812252 - DNA, 25 bp, Mus musculus
tccagggtttaattttattgctact

SEQ ID NO: 812253 - DNA, 25 bp, Mus musculus
tccaggtacatcattcattcccttc

SEQ ID NO: 812254 - DNA, 25 bp, Mus musculus
tccaggtacatctttcattcccttc

SEQ ID NO: 812255 - DNA, 25 bp, Mus musculus
tccaggtacctgaacttgctatgtt

SEQ ID NO: 812256 - DNA, 25 bp, Mus musculus
tccaggtacctgtacttgctatgtt

SEQ ID NO: 812257 - DNA, 25 bp, Mus musculus
tccaggtactcgcacactatttttt

SEQ ID NO: 812258 - DNA, 25 bp, Mus musculus
tccaggtactcggacactatttttt

SEQ ID NO: 812259 - DNA, 25 bp, Mus musculus
tccaggtagctccggctatcctgga

SEQ ID NO: 812260 - DNA, 25 bp, Mus musculus
tccaggtagctcgggctatcctgga

SEQ ID NO: 812261 - DNA, 25 bp, Mus musculus
tccaggtagtccagtgcccaggaaa

SEQ ID NO: 812262 - DNA, 25 bp, Mus musculus
tccaggtagtcctgtgcccaggaaa

SEQ ID NO: 812263 - DNA, 25 bp, Mus musculus
tccaggtataagaatttctctctct

SEQ ID NO: 812264 - DNA, 25 bp, Mus musculus
tccaggtataagtatttctctctct

SEQ ID NO: 812265 - DNA, 25 bp, Mus musculus
tccaggtatactatgggcccagcac

SEQ ID NO: 812266 - DNA, 25 bp, Mus musculus
tccaggtatactttgggcccagcac

SEQ ID NO: 812267 - DNA, 25 bp, Mus musculus
tccaggtatgcgacagccgctctaa

SEQ ID NO: 812268 - DNA, 25 bp, Mus musculus
tccaggtatgcgtcagccgctctaa

SEQ ID NO: 812269 - DNA, 25 bp, Mus musculus
tccaggtcaaccatgggtgcagtac

SEQ ID NO: 812270 - DNA, 25 bp, Mus musculus
tccaggtcaaccttgggtgcagtac

SEQ ID NO: 812271 - DNA, 25 bp, Mus musculus
tccaggtcagagatcagtgaagcca

SEQ ID NO: 812272 - DNA, 25 bp, Mus musculus
tccaggtcagagttcagtgaagcca

SEQ ID NO: 812273 - DNA, 25 bp, Mus musculus
tccaggtcagcacggagactttcca

SEQ ID NO: 812274 - DNA, 25 bp, Mus musculus
tccaggtcagcagggagactttcca

SEQ ID NO: 812275 - DNA, 25 bp, Mus musculus
tccaggtccacaactgtatccagaa

SEQ ID NO: 812276 - DNA, 25 bp, Mus musculus
tccaggtccacatctgtatccagaa

SEQ ID NO: 812277 - DNA, 25 bp, Mus musculus
tccaggtcctgcagtagttcttagt

SEQ ID NO: 812278 - DNA, 25 bp, Mus musculus
tccaggtcctgctgtagttcttagt

SEQ ID NO: 812279 - DNA, 25 bp, Mus musculus
tccaggtcctggcaaatccttaggt

SEQ ID NO: 812280 - DNA, 25 bp, Mus musculus
tccaggtcctgggaaatccttaggt

SEQ ID NO: 812281 - DNA, 25 bp, Mus musculus
tccaggtcgacacgatgctgcaggt

SEQ ID NO: 812282 - DNA, 25 bp, Mus musculus
tccaggtcgacaggatgctgcaggt

SEQ ID NO: 812283 - DNA, 25 bp, Mus musculus
tccaggtcggtgaaagagactgccc

SEQ ID NO: 812284 - DNA, 25 bp, Mus musculus
tccaggtcggtgtaagagactgccc

SEQ ID NO: 812285 - DNA, 25 bp, Mus musculus
tccaggtctaccagcctaggattgt

SEQ ID NO: 812286 - DNA, 25 bp, Mus musculus
tccaggtctacctgcctaggattgt

SEQ ID NO: 812287 - DNA, 25 bp, Mus musculus
tccaggtctgctctactttggactt

SEQ ID NO: 812288 - DNA, 25 bp, Mus musculus
tccaggtctgctgtactttggactt

SEQ ID NO: 812289 - DNA, 25 bp, Mus musculus
tccaggtctgggacggctttttcct

SEQ ID NO: 812290 - DNA, 25 bp, Mus musculus
tccaggtctgggtcggctttttcct

SEQ ID NO: 812291 - DNA, 25 bp, Mus musculus
tccaggtctgttcttcggtcctgat

SEQ ID NO: 812292 - DNA, 25 bp, Mus musculus
tccaggtctgttgttcggtcctgat

SEQ ID NO: 812293 - DNA, 25 bp, Mus musculus
tccaggtcttacagctcctcaaagt

SEQ ID NO: 812294 - DNA, 25 bp, Mus musculus
tccaggtcttactgctcctcaaagt

SEQ ID NO: 812295 - DNA, 25 bp, Mus musculus
tccaggtgacaaagcgcactctgca

SEQ ID NO: 812296 - DNA, 25 bp, Mus musculus
tccaggtgacaatgcgcactctgca

SEQ ID NO: 812297 - DNA, 25 bp, Mus musculus
tccaggtgactgctttgctctttgc

SEQ ID NO: 812298 - DNA, 25 bp, Mus musculus
tccaggtgactggtttgctctttgc

SEQ ID NO: 812299 - DNA, 25 bp, Mus musculus
tccaggtgccctagcgagatgagga

SEQ ID NO: 812300 - DNA, 25 bp, Mus musculus
tccaggtgcccttgcgagatgagga

SEQ ID NO: 812301 - DNA, 25 bp, Mus musculus
tccaggtgcctgacattaaaatggg

SEQ ID NO: 812302 - DNA, 25 bp, Mus musculus
tccaggtgcctgataataagcttat

SEQ ID NO: 812303 - DNA, 25 bp, Mus musculus
tccaggtgcctgtcattaaaatggg

SEQ ID NO: 812304 - DNA, 25 bp, Mus musculus
tccaggtgcctgttaataagcttat

SEQ ID NO: 812305 - DNA, 25 bp, Mus musculus
tccaggtggaaaaacagcagcgggt

SEQ ID NO: 812306 - DNA, 25 bp, Mus musculus
tccaggtggaaatacagcagcgggt

SEQ ID NO: 812307 - DNA, 25 bp, Mus musculus
tccaggtggacccttaggtgaccaa

SEQ ID NO: 812308 - DNA, 25 bp, Mus musculus
tccaggtggaccgttaggtgaccaa

SEQ ID NO: 812309 - DNA, 25 bp, Mus musculus
tccaggtggcaaatcataaatagta

SEQ ID NO: 812310 - DNA, 25 bp, Mus musculus
tccaggtggcaattcataaatagta

SEQ ID NO: 812311 - DNA, 25 bp, Mus musculus
tccaggtggcttaagggtcctaagg

SEQ ID NO: 812312 - DNA, 25 bp, Mus musculus
tccaggtggctttagggtcctaagg

SEQ ID NO: 812313 - DNA, 25 bp, Mus musculus
tccaggtgggcaatatccaaagaga

SEQ ID NO: 812314 - DNA, 25 bp, Mus musculus
tccaggtgggcattatccaaagaga

SEQ ID NO: 812315 - DNA, 25 bp, Mus musculus
tccaggtggtatccccagtggtgta

SEQ ID NO: 812316 - DNA, 25 bp, Mus musculus
tccaggtggtatgcccagtggtgta

SEQ ID NO: 812317 - DNA, 25 bp, Mus musculus
tccaggtggttgaattgagtcatcc

SEQ ID NO: 812318 - DNA, 25 bp, Mus musculus
tccaggtggttgtattgagtcatcc

SEQ ID NO: 812319 - DNA, 25 bp, Mus musculus
tccaggtgtcaaactcatacagtaa

SEQ ID NO: 812320 - DNA, 25 bp, Mus musculus
tccaggtgtcaatctcatacagtaa

SEQ ID NO: 812321 - DNA, 25 bp, Mus musculus
tccaggtgttgaactgtacattggt

SEQ ID NO: 812322 - DNA, 25 bp, Mus musculus
tccaggtgttgatctgtacattggt

SEQ ID NO: 812323 - DNA, 25 bp, Mus musculus
tccaggttaacaaaggtttttccat

SEQ ID NO: 812324 - DNA, 25 bp, Mus musculus
tccaggttaacataggtttttccat

SEQ ID NO: 812325 - DNA, 25 bp, Mus musculus
tccaggttacggaaccccatatggt

SEQ ID NO: 812326 - DNA, 25 bp, Mus musculus
tccaggttacggtaccccatatggt

SEQ ID NO: 812327 - DNA, 25 bp, Mus musculus
tccaggttatacatatgcagaatca

SEQ ID NO: 812328 - DNA, 25 bp, Mus musculus
tccaggttatacttatgcagaatca

SEQ ID NO: 812329 - DNA, 25 bp, Mus musculus
tccaggttccacaggtgacattgtg

SEQ ID NO: 812330 - DNA, 25 bp, Mus musculus
tccaggttccactggtgacattgtg

SEQ ID NO: 812331 - DNA, 25 bp, Mus musculus
tccaggttcgatacctcagactgtc

SEQ ID NO: 812332 - DNA, 25 bp, Mus musculus
tccaggttcgattcctcagactgtc

SEQ ID NO: 812333 - DNA, 25 bp, Mus musculus
tccaggttgataacactgacgccga

SEQ ID NO: 812334 - DNA, 25 bp, Mus musculus
tccaggttgataattcctgccttct

SEQ ID NO: 812335 - DNA, 25 bp, Mus musculus
tccaggttgatatcactgacgccga

SEQ ID NO: 812336 - DNA, 25 bp, Mus musculus
tccaggttgatatttcctgccttct

SEQ ID NO: 812337 - DNA, 25 bp, Mus musculus
tccaggttgattcccttatacccta

SEQ ID NO: 812338 - DNA, 25 bp, Mus musculus
tccaggttgattgccttatacccta

SEQ ID NO: 812339 - DNA, 25 bp, Mus musculus
tccaggtttagtagccagcaccaaa

SEQ ID NO: 812340 - DNA, 25 bp, Mus musculus
tccaggtttagttgccagcaccaaa

SEQ ID NO: 812341 - DNA, 25 bp, Mus musculus
tccaggtttccaagactctaatggt

SEQ ID NO: 812342 - DNA, 25 bp, Mus musculus
tccaggtttccatgactctaatggt

SEQ ID NO: 812343 - DNA, 25 bp, Mus musculus
tccaggtttcttccaagatggctaa

SEQ ID NO: 812344 - DNA, 25 bp, Mus musculus
tccaggtttcttgcaagatggctaa

SEQ ID NO: 812345 - DNA, 25 bp, Mus musculus
tccaggtttgataaagagacccttt

SEQ ID NO: 812346 - DNA, 25 bp, Mus musculus
tccaggtttgattaagagacccttt

SEQ ID NO: 812347 - DNA, 25 bp, Mus musculus
tccaggtttgccataggtcttccta

SEQ ID NO: 812348 - DNA, 25 bp, Mus musculus
tccaggtttgccttaggtcttccta

SEQ ID NO: 812349 - DNA, 25 bp, Mus musculus
tccaggtttggacgcacaggcctta

SEQ ID NO: 812350 - DNA, 25 bp, Mus musculus
tccaggtttggaggcacaggcctta

SEQ ID NO: 812351 - DNA, 25 bp, Mus musculus
tccaggtttgttccagttctctcat

SEQ ID NO: 812352 - DNA, 25 bp, Mus musculus
tccaggtttgttgcagttctctcat

SEQ ID NO: 812353 - DNA, 25 bp, Mus musculus
tccagtacagtcaagctacccagaa

SEQ ID NO: 812354 - DNA, 25 bp, Mus musculus
tccagtacagtcaagtaaagctata

SEQ ID NO: 812355 - DNA, 25 bp, Mus musculus
tccagtacagtctagctacccagaa

SEQ ID NO: 812356 - DNA, 25 bp, Mus musculus
tccagtacagtctagtaaagctata

SEQ ID NO: 812357 - DNA, 25 bp, Mus musculus
tccagtaccagcctcttgagaacta

SEQ ID NO: 812358 - DNA, 25 bp, Mus musculus
tccagtaccagcgtcttgagaacta

SEQ ID NO: 812359 - DNA, 25 bp, Mus musculus
tccagtacccacatttccaagatgg

SEQ ID NO: 812360 - DNA, 25 bp, Mus musculus
tccagtacccacttttccaagatgg

SEQ ID NO: 812361 - DNA, 25 bp, Mus musculus
tccagtacgtctactccttccgaga

SEQ ID NO: 812362 - DNA, 25 bp, Mus musculus
tccagtacgtcttctccttccgaga

SEQ ID NO: 812363 - DNA, 25 bp, Mus musculus
tccagtacgtgtctaggccatgtga

SEQ ID NO: 812364 - DNA, 25 bp, Mus musculus
tccagtacgtgtgtaggccatgtga

SEQ ID NO: 812365 - DNA, 25 bp, Mus musculus
tccagtactactctttagcagaaat

SEQ ID NO: 812366 - DNA, 25 bp, Mus musculus
tccagtactactgtttagcagaaat

SEQ ID NO: 812367 - DNA, 25 bp, Mus musculus
tccagtactcctctaaatctatcat

SEQ ID NO: 812368 - DNA, 25 bp, Mus musculus
tccagtactcctgtaaatctatcat

SEQ ID NO: 812369 - DNA, 25 bp, Mus musculus
tccagtagaaccctgggagcctgct

SEQ ID NO: 812370 - DNA, 25 bp, Mus musculus
tccagtagaaccgtgggagcctgct

SEQ ID NO: 812371 - DNA, 25 bp, Mus musculus
tccagtagagaacgatgctaacagc

SEQ ID NO: 812372 - DNA, 25 bp, Mus musculus
tccagtagagaaggatgctaacagc

SEQ ID NO: 812373 - DNA, 25 bp, Mus musculus
tccagtagagccaacaaggtcacag

SEQ ID NO: 812374 - DNA, 25 bp, Mus musculus
tccagtagagcctacaaggtcacag

SEQ ID NO: 812375 - DNA, 25 bp, Mus musculus
tccagtagcatcacagggtccagaa

SEQ ID NO: 812376 - DNA, 25 bp, Mus musculus
tccagtagcatctcagggtccagaa

SEQ ID NO: 812377 - DNA, 25 bp, Mus musculus
tccagtaggctaaaactcagtcaca

SEQ ID NO: 812378 - DNA, 25 bp, Mus musculus
tccagtaggctataactcagtcaca

SEQ ID NO: 812379 - DNA, 25 bp, Mus musculus
tccagtaggctgagtattcctgacc

SEQ ID NO: 812380 - DNA, 25 bp, Mus musculus
tccagtaggctgtgtattcctgacc

SEQ ID NO: 812381 - DNA, 25 bp, Mus musculus
tccagtagggagacatttcccagat

SEQ ID NO: 812382 - DNA, 25 bp, Mus musculus
tccagtagggagtcatttcccagat

SEQ ID NO: 812383 - DNA, 25 bp, Mus musculus
tccagtaggtctacctttcaaaaag

SEQ ID NO: 812384 - DNA, 25 bp, Mus musculus
tccagtaggtcttcctttcaaaaag

SEQ ID NO: 812385 - DNA, 25 bp, Mus musculus
tccagtagtcatactctactgagaa

SEQ ID NO: 812386 - DNA, 25 bp, Mus musculus
tccagtagtcattctctactgagaa

SEQ ID NO: 812387 - DNA, 25 bp, Mus musculus
tccagtagtgctcccttattctagg

SEQ ID NO: 812388 - DNA, 25 bp, Mus musculus
tccagtagtgctgccttattctagg

SEQ ID NO: 812389 - DNA, 25 bp, Mus musculus
tccagtagttacaagcaagggcaag

SEQ ID NO: 812390 - DNA, 25 bp, Mus musculus
tccagtagttactagcaagggcaag

SEQ ID NO: 812391 - DNA, 25 bp, Mus musculus
tccagtatatagatgccgttccagc

SEQ ID NO: 812392 - DNA, 25 bp, Mus musculus
tccagtatatagttgccgttccagc

SEQ ID NO: 812393 - DNA, 25 bp, Mus musculus
tccagtatatttatcctggaacctg

SEQ ID NO: 812394 - DNA, 25 bp, Mus musculus
tccagtatatttttcctggaacctg

SEQ ID NO: 812395 - DNA, 25 bp, Mus musculus
tccagtatctggagatccaacaccc

SEQ ID NO: 812396 - DNA, 25 bp, Mus musculus
tccagtatctggtgatccaacaccc

SEQ ID NO: 812397 - DNA, 25 bp, Mus musculus
tccagtatgactaatgtacccaaga

SEQ ID NO: 812398 - DNA, 25 bp, Mus musculus
tccagtatgactccactcacggcaa

SEQ ID NO: 812399 - DNA, 25 bp, Mus musculus
tccagtatgactgcactcacggcaa

SEQ ID NO: 812400 - DNA, 25 bp, Mus musculus
tccagtatgacttatgtacccaaga

SEQ ID NO: 812401 - DNA, 25 bp, Mus musculus
tccagtatgcaaattaagtatcccc

SEQ ID NO: 812402 - DNA, 25 bp, Mus musculus
tccagtatgcaatttaagtatcccc

SEQ ID NO: 812403 - DNA, 25 bp, Mus musculus
tccagtattaataagggccccagaa

SEQ ID NO: 812404 - DNA, 25 bp, Mus musculus
tccagtattaattagggccccagaa

SEQ ID NO: 812405 - DNA, 25 bp, Mus musculus
tccagtattagcactagaacgaagg

SEQ ID NO: 812406 - DNA, 25 bp, Mus musculus
tccagtattagctctagaacgaagg

SEQ ID NO: 812407 - DNA, 25 bp, Mus musculus
tccagtattctacgctgaagtactc

SEQ ID NO: 812408 - DNA, 25 bp, Mus musculus
tccagtattctaggctgaagtactc

SEQ ID NO: 812409 - DNA, 25 bp, Mus musculus
tccagtcaaattaccttctttgtgt

SEQ ID NO: 812410 - DNA, 25 bp, Mus musculus
tccagtcaaatttccttctttgtgt

SEQ ID NO: 812411 - DNA, 25 bp, Mus musculus
tccagtcaatccagtggtcttcttc

SEQ ID NO: 812412 - DNA, 25 bp, Mus musculus
tccagtcaatcctgtggtcttcttc

SEQ ID NO: 812413 - DNA, 25 bp, Mus musculus
tccagtcaccagcttcttgctcagg

SEQ ID NO: 812414 - DNA, 25 bp, Mus musculus
tccagtcaccaggttcttgctcagg

SEQ ID NO: 812415 - DNA, 25 bp, Mus musculus
tccagtcaccgacgttgggtttgct

SEQ ID NO: 812416 - DNA, 25 bp, Mus musculus
tccagtcaccgaggttgggtttgct

SEQ ID NO: 812417 - DNA, 25 bp, Mus musculus
tccagtcagcagaggaggccctgag

SEQ ID NO: 812418 - DNA, 25 bp, Mus musculus
tccagtcagcagtggaggccctgag

SEQ ID NO: 812419 - DNA, 25 bp, Mus musculus
tccagtcagcgtcttaaaggccagc

SEQ ID NO: 812420 - DNA, 25 bp, Mus musculus
tccagtcagcgtgttaaaggccagc

SEQ ID NO: 812421 - DNA, 25 bp, Mus musculus
tccagtcatctcacaaccattatta

SEQ ID NO: 812422 - DNA, 25 bp, Mus musculus
tccagtcatctctcaaccattatta

SEQ ID NO: 812423 - DNA, 25 bp, Mus musculus
tccagtcatgcaacacaaatgggat

SEQ ID NO: 812424 - DNA, 25 bp, Mus musculus
tccagtcatgcatcacaaatgggat

SEQ ID NO: 812425 - DNA, 25 bp, Mus musculus
tccagtcatggtctctacgggcagg

SEQ ID NO: 812426 - DNA, 25 bp, Mus musculus
tccagtcatggtgtctacgggcagg

SEQ ID NO: 812427 - DNA, 25 bp, Mus musculus
tccagtcatgtgcagctttgtaact

SEQ ID NO: 812428 - DNA, 25 bp, Mus musculus
tccagtcatgtggagctttgtaact

SEQ ID NO: 812429 - DNA, 25 bp, Mus musculus
tccagtccactgatgaaaaggccaa

SEQ ID NO: 812430 - DNA, 25 bp, Mus musculus
tccagtccactgttgaaaaggccaa

SEQ ID NO: 812431 - DNA, 25 bp, Mus musculus
tccagtccatcgagagcggatgtca

SEQ ID NO: 812432 - DNA, 25 bp, Mus musculus
tccagtccatcgtgagcggatgtca

SEQ ID NO: 812433 - DNA, 25 bp, Mus musculus
tccagtccatggaggagccgcagat

SEQ ID NO: 812434 - DNA, 25 bp, Mus musculus
tccagtccatggtggagccgcagat

SEQ ID NO: 812435 - DNA, 25 bp, Mus musculus
tccagtccattccagtattcaacga

SEQ ID NO: 812436 - DNA, 25 bp, Mus musculus
tccagtccattcgagtattcaacga

SEQ ID NO: 812437 - DNA, 25 bp, Mus musculus
tccagtcccatgagcttgaaaagca

SEQ ID NO: 812438 - DNA, 25 bp, Mus musculus
tccagtcccatgtgcttgaaaagca

SEQ ID NO: 812439 - DNA, 25 bp, Mus musculus
tccagtccccttcatatctagaatt

SEQ ID NO: 812440 - DNA, 25 bp, Mus musculus
tccagtccccttgatatctagaatt

SEQ ID NO: 812441 - DNA, 25 bp, Mus musculus
tccagtcccttcaccggagaggaag

SEQ ID NO: 812442 - DNA, 25 bp, Mus musculus
tccagtcccttctccggagaggaag

SEQ ID NO: 812443 - DNA, 25 bp, Mus musculus
tccagtccgcccattaagaagtact

SEQ ID NO: 812444 - DNA, 25 bp, Mus musculus
tccagtccgccctttaagaagtact

SEQ ID NO: 812445 - DNA, 25 bp, Mus musculus
tccagtcctagcactgccatataaa

SEQ ID NO: 812446 - DNA, 25 bp, Mus musculus
tccagtcctagctctgccatataaa

SEQ ID NO: 812447 - DNA, 25 bp, Mus musculus
tccagtcctcacacttgaattcaga

SEQ ID NO: 812448 - DNA, 25 bp, Mus musculus
tccagtcctcactcttgaattcaga

SEQ ID NO: 812449 - DNA, 25 bp, Mus musculus
tccagtcctggtagttgtagcttta

SEQ ID NO: 812450 - DNA, 25 bp, Mus musculus
tccagtcctggtcggatcgaaactt

SEQ ID NO: 812451 - DNA, 25 bp, Mus musculus
tccagtcctggtgggatcgaaactt

SEQ ID NO: 812452 - DNA, 25 bp, Mus musculus
tccagtcctggttgttgtagcttta

SEQ ID NO: 812453 - DNA, 25 bp, Mus musculus
tccagtcctgtcagtccacatatgt

SEQ ID NO: 812454 - DNA, 25 bp, Mus musculus
tccagtcctgtctgtccacatatgt

SEQ ID NO: 812455 - DNA, 25 bp, Mus musculus
tccagtccttgtactagcatggtta

SEQ ID NO: 812456 - DNA, 25 bp, Mus musculus
tccagtccttgttctagcatggtta

SEQ ID NO: 812457 - DNA, 25 bp, Mus musculus
tccagtcgcggccaagtagggtacc

SEQ ID NO: 812458 - DNA, 25 bp, Mus musculus
tccagtcgcggcgaagtagggtacc

SEQ ID NO: 812459 - DNA, 25 bp, Mus musculus
tccagtcgggatcctcctgcagtga

SEQ ID NO: 812460 - DNA, 25 bp, Mus musculus
tccagtcgggatgctcctgcagtga

SEQ ID NO: 812461 - DNA, 25 bp, Mus musculus
tccagtctccagcacctatctaaaa

SEQ ID NO: 812462 - DNA, 25 bp, Mus musculus
tccagtctccaggacctatctaaaa

SEQ ID NO: 812463 - DNA, 25 bp, Mus musculus
tccagtctccatattatacccagat

SEQ ID NO: 812464 - DNA, 25 bp, Mus musculus
tccagtctccattttatacccagat

SEQ ID NO: 812465 - DNA, 25 bp, Mus musculus
tccagtctcctgaaacacacttgca

SEQ ID NO: 812466 - DNA, 25 bp, Mus musculus
tccagtctcctgtaacacacttgca

SEQ ID NO: 812467 - DNA, 25 bp, Mus musculus
tccagtctctcacgagtttctgttg

SEQ ID NO: 812468 - DNA, 25 bp, Mus musculus
tccagtctctcaggagtttctgttg

SEQ ID NO: 812469 - DNA, 25 bp, Mus musculus
tccagtctctggatttgctttgatg

SEQ ID NO: 812470 - DNA, 25 bp, Mus musculus
tccagtctctggttttgctttgatg

SEQ ID NO: 812471 - DNA, 25 bp, Mus musculus
tccagtctctgtctgaggacaacag

SEQ ID NO: 812472 - DNA, 25 bp, Mus musculus
tccagtctctgtgtgaggacaacag

SEQ ID NO: 812473 - DNA, 25 bp, Mus musculus
tccagtctgtgcacagtggtctgca

SEQ ID NO: 812474 - DNA, 25 bp, Mus musculus
tccagtctgtgctcagtggtctgca

SEQ ID NO: 812475 - DNA, 25 bp, Mus musculus
tccagtctgttgcttactggaggga

SEQ ID NO: 812476 - DNA, 25 bp, Mus musculus
tccagtctgttggttactggaggga

SEQ ID NO: 812477 - DNA, 25 bp, Mus musculus
tccagtcttcgtcgttacaagcaac

SEQ ID NO: 812478 - DNA, 25 bp, Mus musculus
tccagtcttcgtggttacaagcaac

SEQ ID NO: 812479 - DNA, 25 bp, Mus musculus
tccagtcttgttcttataaatagca

SEQ ID NO: 812480 - DNA, 25 bp, Mus musculus
tccagtcttgttgttataaatagca

SEQ ID NO: 812481 - DNA, 25 bp, Mus musculus
tccagtgaacctaccaggtacagga

SEQ ID NO: 812482 - DNA, 25 bp, Mus musculus
tccagtgaaccttccaggtacagga

SEQ ID NO: 812483 - DNA, 25 bp, Mus musculus
tccagtgacagtcaagacatttttt

SEQ ID NO: 812484 - DNA, 25 bp, Mus musculus
tccagtgacagtgaagacatttttt

SEQ ID NO: 812485 - DNA, 25 bp, Mus musculus
tccagtgacatcaaagggctccagt

SEQ ID NO: 812486 - DNA, 25 bp, Mus musculus
tccagtgacatcaattcttccaaag

SEQ ID NO: 812487 - DNA, 25 bp, Mus musculus
tccagtgacatctaagggctccagt

SEQ ID NO: 812488 - DNA, 25 bp, Mus musculus
tccagtgacatctattcttccaaag

SEQ ID NO: 812489 - DNA, 25 bp, Mus musculus
tccagtgaccctacttttagtgggt

SEQ ID NO: 812490 - DNA, 25 bp, Mus musculus
tccagtgacccttcttttagtgggt

SEQ ID NO: 812491 - DNA, 25 bp, Mus musculus
tccagtgacctcagtggtcatttga

SEQ ID NO: 812492 - DNA, 25 bp, Mus musculus
tccagtgacctctgtggtcatttga

SEQ ID NO: 812493 - DNA, 25 bp, Mus musculus
tccagtgactggagtgtgctgtcca

SEQ ID NO: 812494 - DNA, 25 bp, Mus musculus
tccagtgactggtgtgtgctgtcca

SEQ ID NO: 812495 - DNA, 25 bp, Mus musculus
tccagtgaggagcacccgcgctggg

SEQ ID NO: 812496 - DNA, 25 bp, Mus musculus
tccagtgaggaggacccgcgctggg

SEQ ID NO: 812497 - DNA, 25 bp, Mus musculus
tccagtgagtcaatagccaagccaa

SEQ ID NO: 812498 - DNA, 25 bp, Mus musculus
tccagtgagtcattagccaagccaa

SEQ ID NO: 812499 - DNA, 25 bp, Mus musculus
tccagtgatccactccacattgttc

SEQ ID NO: 812500 - DNA, 25 bp, Mus musculus
tccagtgatccagtccacattgttc

SEQ ID NO: 812501 - DNA, 25 bp, Mus musculus
tccagtgatcctactgtaagaatgt

SEQ ID NO: 812502 - DNA, 25 bp, Mus musculus
tccagtgatccttctgtaagaatgt

SEQ ID NO: 812503 - DNA, 25 bp, Mus musculus
tccagtgatgttctccttatttaat

SEQ ID NO: 812504 - DNA, 25 bp, Mus musculus
tccagtgatgttgtccttatttaat

SEQ ID NO: 812505 - DNA, 25 bp, Mus musculus
tccagtgattgtactttagagagtt

SEQ ID NO: 812506 - DNA, 25 bp, Mus musculus
tccagtgattgttctttagagagtt

SEQ ID NO: 812507 - DNA, 25 bp, Mus musculus
tccagtgcagtgcagcgtaccaaat

SEQ ID NO: 812508 - DNA, 25 bp, Mus musculus
tccagtgcagtggagcgtaccaaat

SEQ ID NO: 812509 - DNA, 25 bp, Mus musculus
tccagtgccagcatttctaagtcga

SEQ ID NO: 812510 - DNA, 25 bp, Mus musculus
tccagtgccagcttttctaagtcga

SEQ ID NO: 812511 - DNA, 25 bp, Mus musculus
tccagtgcccaacagctgccggtgg

SEQ ID NO: 812512 - DNA, 25 bp, Mus musculus
tccagtgcccaagagctgccggtgg

SEQ ID NO: 812513 - DNA, 25 bp, Mus musculus
tccagtgcctaccacatggcaaatt

SEQ ID NO: 812514 - DNA, 25 bp, Mus musculus
tccagtgcctacgacatggcaaatt

SEQ ID NO: 812515 - DNA, 25 bp, Mus musculus
tccagtgccttcaatgaggctgact

SEQ ID NO: 812516 - DNA, 25 bp, Mus musculus
tccagtgccttctatgaggctgact

SEQ ID NO: 812517 - DNA, 25 bp, Mus musculus
tccagtgcgctcatttcagtgggac

SEQ ID NO: 812518 - DNA, 25 bp, Mus musculus
tccagtgcgctcttttcagtgggac

SEQ ID NO: 812519 - DNA, 25 bp, Mus musculus
tccagtgctatcatctgacctcttc

SEQ ID NO: 812520 - DNA, 25 bp, Mus musculus
tccagtgctatcttctgacctcttc

SEQ ID NO: 812521 - DNA, 25 bp, Mus musculus
tccagtgctggaacatttctcctgt

SEQ ID NO: 812522 - DNA, 25 bp, Mus musculus
tccagtgctggatcatttctcctgt

SEQ ID NO: 812523 - DNA, 25 bp, Mus musculus
tccagtgctgttaacagactgccaa

SEQ ID NO: 812524 - DNA, 25 bp, Mus musculus
tccagtgctgttcatgcttttcatg

SEQ ID NO: 812525 - DNA, 25 bp, Mus musculus
tccagtgctgttgatgcttttcatg

SEQ ID NO: 812526 - DNA, 25 bp, Mus musculus
tccagtgctgtttacagactgccaa

SEQ ID NO: 812527 - DNA, 25 bp, Mus musculus
tccagtgcttgacgaagacgctctt

SEQ ID NO: 812528 - DNA, 25 bp, Mus musculus
tccagtgcttgaggaagacgctctt

SEQ ID NO: 812529 - DNA, 25 bp, Mus musculus
tccagtgctttgctagtggctgtct

SEQ ID NO: 812530 - DNA, 25 bp, Mus musculus
tccagtgctttggtagtggctgtct

SEQ ID NO: 812531 - DNA, 25 bp, Mus musculus
tccagtggacaaaagatagcagttt

SEQ ID NO: 812532 - DNA, 25 bp, Mus musculus
tccagtggacaatagatagcagttt

SEQ ID NO: 812533 - DNA, 25 bp, Mus musculus
tccagtggacgacctttttgcacag

SEQ ID NO: 812534 - DNA, 25 bp, Mus musculus
tccagtggacgagctttttgcacag

SEQ ID NO: 812535 - DNA, 25 bp, Mus musculus
tccagtggacttacccttttgtttg

SEQ ID NO: 812536 - DNA, 25 bp, Mus musculus
tccagtggactttcccttttgtttg

SEQ ID NO: 812537 - DNA, 25 bp, Mus musculus
tccagtggagacaaccggggatccg

SEQ ID NO: 812538 - DNA, 25 bp, Mus musculus
tccagtggagactaccggggatccg

SEQ ID NO: 812539 - DNA, 25 bp, Mus musculus
tccagtggcaggacatctccaagga

SEQ ID NO: 812540 - DNA, 25 bp, Mus musculus
tccagtggcaggtcatctccaagga

SEQ ID NO: 812541 - DNA, 25 bp, Mus musculus
tccagtggccaaatgcagagcattg

SEQ ID NO: 812542 - DNA, 25 bp, Mus musculus
tccagtggccaattgcagagcattg

SEQ ID NO: 812543 - DNA, 25 bp, Mus musculus
tccagtggccacatacagcctgttt

SEQ ID NO: 812544 - DNA, 25 bp, Mus musculus
tccagtggccacttacagcctgttt

SEQ ID NO: 812545 - DNA, 25 bp, Mus musculus
tccagtggccagagcttttttgtga

SEQ ID NO: 812546 - DNA, 25 bp, Mus musculus
tccagtggccagtgcttttttgtga

SEQ ID NO: 812547 - DNA, 25 bp, Mus musculus
tccagtggccgaaggcaaacccagt

SEQ ID NO: 812548 - DNA, 25 bp, Mus musculus
tccagtggccgatggcaaacccagt

SEQ ID NO: 812549 - DNA, 25 bp, Mus musculus
tccagtggccgtatgggaaccggca

SEQ ID NO: 812550 - DNA, 25 bp, Mus musculus
tccagtggccgtttgggaaccggca

SEQ ID NO: 812551 - DNA, 25 bp, Mus musculus
tccagtggcgtcattgactttcaga

SEQ ID NO: 812552 - DNA, 25 bp, Mus musculus
tccagtggcgtctttgactttcaga

SEQ ID NO: 812553 - DNA, 25 bp, Mus musculus
tccagtggctggataaggttctgac

SEQ ID NO: 812554 - DNA, 25 bp, Mus musculus
tccagtggctggttaaggttctgac

SEQ ID NO: 812555 - DNA, 25 bp, Mus musculus
tccagtgggttgctgtgtcctgaaa

SEQ ID NO: 812556 - DNA, 25 bp, Mus musculus
tccagtgggttggtgtgtcctgaaa

SEQ ID NO: 812557 - DNA, 25 bp, Mus musculus
tccagtgtaccccatggagagggcc

SEQ ID NO: 812558 - DNA, 25 bp, Mus musculus
tccagtgtacccgatggagagggcc

SEQ ID NO: 812559 - DNA, 25 bp, Mus musculus
tccagtgtcagtatgcatgtgttct

SEQ ID NO: 812560 - DNA, 25 bp, Mus musculus
tccagtgtcagtttgcatgtgttct

SEQ ID NO: 812561 - DNA, 25 bp, Mus musculus
tccagtgtcctgattctgctagaaa

SEQ ID NO: 812562 - DNA, 25 bp, Mus musculus
tccagtgtcctgtttctgctagaaa

SEQ ID NO: 812563 - DNA, 25 bp, Mus musculus
tccagtgtctgcacggatgtagcat

SEQ ID NO: 812564 - DNA, 25 bp, Mus musculus
tccagtgtctgctcggatgtagcat

SEQ ID NO: 812565 - DNA, 25 bp, Mus musculus
tccagtgtgactcaacgaccttgcc

SEQ ID NO: 812566 - DNA, 25 bp, Mus musculus
tccagtgtgactgaacgaccttgcc

SEQ ID NO: 812567 - DNA, 25 bp, Mus musculus
tccagtgtgctcctttgtggtgaca

SEQ ID NO: 812568 - DNA, 25 bp, Mus musculus
tccagtgtgctcgtttgtggtgaca

SEQ ID NO: 812569 - DNA, 25 bp, Mus musculus
tccagtgtgggacgtttctgcctct

SEQ ID NO: 812570 - DNA, 25 bp, Mus musculus
tccagtgtgggaggtttctgcctct

SEQ ID NO: 812571 - DNA, 25 bp, Mus musculus
tccagtgtgggtacatcaagcccct

SEQ ID NO: 812572 - DNA, 25 bp, Mus musculus
tccagtgtgggttcatcaagcccct

SEQ ID NO: 812573 - DNA, 25 bp, Mus musculus
tccagtgtgtaacaccctccgatgg

SEQ ID NO: 812574 - DNA, 25 bp, Mus musculus
tccagtgtgtaagaccctccgatgg

SEQ ID NO: 812575 - DNA, 25 bp, Mus musculus
tccagtgtttcaagttcccattctc

SEQ ID NO: 812576 - DNA, 25 bp, Mus musculus
tccagtgtttcatgttcccattctc

SEQ ID NO: 812577 - DNA, 25 bp, Mus musculus
tccagttacgatctcatttgttcat

SEQ ID NO: 812578 - DNA, 25 bp, Mus musculus
tccagttacgatgtcatttgttcat

SEQ ID NO: 812579 - DNA, 25 bp, Mus musculus
tccagttagatgagactgaggcgca

SEQ ID NO: 812580 - DNA, 25 bp, Mus musculus
tccagttagatgtgactgaggcgca

SEQ ID NO: 812581 - DNA, 25 bp, Mus musculus
tccagttagccaactcaaggagaaa

SEQ ID NO: 812582 - DNA, 25 bp, Mus musculus
tccagttagccatctcaaggagaaa

SEQ ID NO: 812583 - DNA, 25 bp, Mus musculus
tccagttagggtactgtctgtcctt

SEQ ID NO: 812584 - DNA, 25 bp, Mus musculus
tccagttagggttctgtctgtcctt

SEQ ID NO: 812585 - DNA, 25 bp, Mus musculus
tccagttatctacccatgtgtcatc

SEQ ID NO: 812586 - DNA, 25 bp, Mus musculus
tccagttatctagccatgtgtcatc

SEQ ID NO: 812587 - DNA, 25 bp, Mus musculus
tccagttatggtactccagggcaaa

SEQ ID NO: 812588 - DNA, 25 bp, Mus musculus
tccagttatggttctccagggcaaa

SEQ ID NO: 812589 - DNA, 25 bp, Mus musculus
tccagttattcgagccttcccagta

SEQ ID NO: 812590 - DNA, 25 bp, Mus musculus
tccagttattcgtgccttcccagta

SEQ ID NO: 812591 - DNA, 25 bp, Mus musculus
tccagttcagctattattaccacaa

SEQ ID NO: 812592 - DNA, 25 bp, Mus musculus
tccagttcagcttttattaccacaa

SEQ ID NO: 812593 - DNA, 25 bp, Mus musculus
tccagttcagtactgacagggtacc

SEQ ID NO: 812594 - DNA, 25 bp, Mus musculus
tccagttcagtagtgacagggtacc

SEQ ID NO: 812595 - DNA, 25 bp, Mus musculus
tccagttccagtctcctcaggaaat

SEQ ID NO: 812596 - DNA, 25 bp, Mus musculus
tccagttccagtgtcctcaggaaat

SEQ ID NO: 812597 - DNA, 25 bp, Mus musculus
tccagttccccacttgtatgagggt

SEQ ID NO: 812598 - DNA, 25 bp, Mus musculus
tccagttccccagttgtatgagggt

SEQ ID NO: 812599 - DNA, 25 bp, Mus musculus
tccagttccctaagttccagaacat

SEQ ID NO: 812600 - DNA, 25 bp, Mus musculus
tccagttccctatgttccagaacat

SEQ ID NO: 812601 - DNA, 25 bp, Mus musculus
tccagttcctgaagtcaacaagaaa

SEQ ID NO: 812602 - DNA, 25 bp, Mus musculus
tccagttcctgacaaggcttctatg

SEQ ID NO: 812603 - DNA, 25 bp, Mus musculus
tccagttcctgactctgcagttgct

SEQ ID NO: 812604 - DNA, 25 bp, Mus musculus
tccagttcctgagaaggcttctatg

SEQ ID NO: 812605 - DNA, 25 bp, Mus musculus
tccagttcctgagtctgcagttgct

SEQ ID NO: 812606 - DNA, 25 bp, Mus musculus
tccagttcctgatgtcaacaagaaa

SEQ ID NO: 812607 - DNA, 25 bp, Mus musculus
tccagttcctgccgagatgtcctgc

SEQ ID NO: 812608 - DNA, 25 bp, Mus musculus
tccagttcctgcggagatgtcctgc

SEQ ID NO: 812609 - DNA, 25 bp, Mus musculus
tccagttcctgtccttcgttccgtt

SEQ ID NO: 812610 - DNA, 25 bp, Mus musculus
tccagttcctgtgcttcgttccgtt

SEQ ID NO: 812611 - DNA, 25 bp, Mus musculus
tccagttcctttccaaatcattcct

SEQ ID NO: 812612 - DNA, 25 bp, Mus musculus
tccagttcctttgcaaatcattcct

SEQ ID NO: 812613 - DNA, 25 bp, Mus musculus
tccagttctcagctgccatgtcaga

SEQ ID NO: 812614 - DNA, 25 bp, Mus musculus
tccagttctcaggtgccatgtcaga

SEQ ID NO: 812615 - DNA, 25 bp, Mus musculus
tccagttctctgagtcttaaagttg

SEQ ID NO: 812616 - DNA, 25 bp, Mus musculus
tccagttctctgtgtcttaaagttg

SEQ ID NO: 812617 - DNA, 25 bp, Mus musculus
tccagttctggacataccggtgctc

SEQ ID NO: 812618 - DNA, 25 bp, Mus musculus
tccagttctggagataccggtgctc

SEQ ID NO: 812619 - DNA, 25 bp, Mus musculus
tccagttctgtgctattgtccaaga

SEQ ID NO: 812620 - DNA, 25 bp, Mus musculus
tccagttctgtggtattgtccaaga

SEQ ID NO: 812621 - DNA, 25 bp, Mus musculus
tccagttcttgtcgtcgtgcaacaa

SEQ ID NO: 812622 - DNA, 25 bp, Mus musculus
tccagttcttgtggtcgtgcaacaa

SEQ ID NO: 812623 - DNA, 25 bp, Mus musculus
tccagttgcaatagggctggcggaa

SEQ ID NO: 812624 - DNA, 25 bp, Mus musculus
tccagttgcaattgggctggcggaa

SEQ ID NO: 812625 - DNA, 25 bp, Mus musculus
tccagttgcagtcgtcctgctggaa

SEQ ID NO: 812626 - DNA, 25 bp, Mus musculus
tccagttgcagtggtcctgctggaa

SEQ ID NO: 812627 - DNA, 25 bp, Mus musculus
tccagttgcattactcagacaatga

SEQ ID NO: 812628 - DNA, 25 bp, Mus musculus
tccagttgcatttctcagacaatga

SEQ ID NO: 812629 - DNA, 25 bp, Mus musculus
tccagttgccatatctcgacaagaa

SEQ ID NO: 812630 - DNA, 25 bp, Mus musculus
tccagttgccatcctgagacttgag

SEQ ID NO: 812631 - DNA, 25 bp, Mus musculus
tccagttgccatgctgagacttgag

SEQ ID NO: 812632 - DNA, 25 bp, Mus musculus
tccagttgccatttctcgacaagaa

SEQ ID NO: 812633 - DNA, 25 bp, Mus musculus
tccagttgccccagagcttgtgcaa

SEQ ID NO: 812634 - DNA, 25 bp, Mus musculus
tccagttgcccctgagcttgtgcaa

SEQ ID NO: 812635 - DNA, 25 bp, Mus musculus
tccagttgcttcatagggagagccc

SEQ ID NO: 812636 - DNA, 25 bp, Mus musculus
tccagttgcttcttagggagagccc

SEQ ID NO: 812637 - DNA, 25 bp, Mus musculus
tccagttggcatatgtttgaaattg

SEQ ID NO: 812638 - DNA, 25 bp, Mus musculus
tccagttggcatttgtttgaaattg

SEQ ID NO: 812639 - DNA, 25 bp, Mus musculus
tccagttggcgcagtgcatggcact

SEQ ID NO: 812640 - DNA, 25 bp, Mus musculus
tccagttggcgctgtgcatggcact

SEQ ID NO: 812641 - DNA, 25 bp, Mus musculus
tccagttgtagaataagcaccatgt

SEQ ID NO: 812642 - DNA, 25 bp, Mus musculus
tccagttgtagattaagcaccatgt

SEQ ID NO: 812643 - DNA, 25 bp, Mus musculus
tccagttgtgccaagtgaaaaccgg

SEQ ID NO: 812644 - DNA, 25 bp, Mus musculus
tccagttgtgcctagtgaaaaccgg

SEQ ID NO: 812645 - DNA, 25 bp, Mus musculus
tccagttgtgttcagaccccgatag

SEQ ID NO: 812646 - DNA, 25 bp, Mus musculus
tccagttgtgttgagaccccgatag

SEQ ID NO: 812647 - DNA, 25 bp, Mus musculus
tccagttgttgacacaggttaccag

SEQ ID NO: 812648 - DNA, 25 bp, Mus musculus
tccagttgttgagacaggttaccag

SEQ ID NO: 812649 - DNA, 25 bp, Mus musculus
tccagtttaagtatgtcctttacat

SEQ ID NO: 812650 - DNA, 25 bp, Mus musculus
tccagtttaagtttgtcctttacat

SEQ ID NO: 812651 - DNA, 25 bp, Mus musculus
tccagtttaggactcttctctctgt

SEQ ID NO: 812652 - DNA, 25 bp, Mus musculus
tccagtttaggagtcttctctctgt

SEQ ID NO: 812653 - DNA, 25 bp, Mus musculus
tccagtttcacccttaggaccaaga

SEQ ID NO: 812654 - DNA, 25 bp, Mus musculus
tccagtttcaccgttaggaccaaga

SEQ ID NO: 812655 - DNA, 25 bp, Mus musculus
tccagtttcaggaaccagccacatt

SEQ ID NO: 812656 - DNA, 25 bp, Mus musculus
tccagtttcaggtaccagccacatt

SEQ ID NO: 812657 - DNA, 25 bp, Mus musculus
tccagtttcataatgcacatgcagg

SEQ ID NO: 812658 - DNA, 25 bp, Mus musculus
tccagtttcatattgcacatgcagg

SEQ ID NO: 812659 - DNA, 25 bp, Mus musculus
tccagtttccacctagaagggcaga

SEQ ID NO: 812660 - DNA, 25 bp, Mus musculus
tccagtttccacgtagaagggcaga

SEQ ID NO: 812661 - DNA, 25 bp, Mus musculus
tccagtttcccacggcacagggtga

SEQ ID NO: 812662 - DNA, 25 bp, Mus musculus
tccagtttcccagggcacagggtga

SEQ ID NO: 812663 - DNA, 25 bp, Mus musculus
tccagtttccttcagggctctttat

SEQ ID NO: 812664 - DNA, 25 bp, Mus musculus
tccagtttccttgagggctctttat

SEQ ID NO: 812665 - DNA, 25 bp, Mus musculus
tccagtttctgtattcgtgtgttac

SEQ ID NO: 812666 - DNA, 25 bp, Mus musculus
tccagtttctgttttcgtgtgttac

SEQ ID NO: 812667 - DNA, 25 bp, Mus musculus
tccagtttgaacattccatccttgt

SEQ ID NO: 812668 - DNA, 25 bp, Mus musculus
tccagtttgaactttccatccttgt

SEQ ID NO: 812669 - DNA, 25 bp, Mus musculus
tccagttttcctaaatgagtcgcga

SEQ ID NO: 812670 - DNA, 25 bp, Mus musculus
tccagttttccttaatgagtcgcga

SEQ ID NO: 812671 - DNA, 25 bp, Mus musculus
tccagttttgttcgtgcacagccaa

SEQ ID NO: 812672 - DNA, 25 bp, Mus musculus
tccagttttgttggtgcacagccaa

SEQ ID NO: 812673 - DNA, 25 bp, Mus musculus
tccataaaagtactggccctgccct

SEQ ID NO: 812674 - DNA, 25 bp, Mus musculus
tccataaaagtagtggccctgccct

SEQ ID NO: 812675 - DNA, 25 bp, Mus musculus
tccataaaattaactacctttgctc

SEQ ID NO: 812676 - DNA, 25 bp, Mus musculus
tccataaaattatctacctttgctc

SEQ ID NO: 812677 - DNA, 25 bp, Mus musculus
tccataaccaccacacacagaagaa

SEQ ID NO: 812678 - DNA, 25 bp, Mus musculus
tccataaccacctcacacagaagaa

SEQ ID NO: 812679 - DNA, 25 bp, Mus musculus
tccataaccaggaccccaaagactg

SEQ ID NO: 812680 - DNA, 25 bp, Mus musculus
tccataaccaggtccccaaagactg

SEQ ID NO: 812681 - DNA, 25 bp, Mus musculus
tccataaccatgagcttgcctattt

SEQ ID NO: 812682 - DNA, 25 bp, Mus musculus
tccataaccatgtgcttgcctattt

SEQ ID NO: 812683 - DNA, 25 bp, Mus musculus
tccataacctccctaatcaattttt

SEQ ID NO: 812684 - DNA, 25 bp, Mus musculus
tccataacctccgtaatcaattttt

SEQ ID NO: 812685 - DNA, 25 bp, Mus musculus
tccataactaacataaatcccagct

SEQ ID NO: 812686 - DNA, 25 bp, Mus musculus
tccataactaacttaaatcccagct

SEQ ID NO: 812687 - DNA, 25 bp, Mus musculus
tccataatcgaccaggttagtccac

SEQ ID NO: 812688 - DNA, 25 bp, Mus musculus
tccataatcgacgaggttagtccac

SEQ ID NO: 812689 - DNA, 25 bp, Mus musculus
tccataatgggccagtagtatctga

SEQ ID NO: 812690 - DNA, 25 bp, Mus musculus
tccataatgggcgagtagtatctga

SEQ ID NO: 812691 - DNA, 25 bp, Mus musculus
tccatacagaggcactgacttcaat

SEQ ID NO: 812692 - DNA, 25 bp, Mus musculus
tccatacagagggactgacttcaat

SEQ ID NO: 812693 - DNA, 25 bp, Mus musculus
tccatacatagcacgcgttagactg

SEQ ID NO: 812694 - DNA, 25 bp, Mus musculus
tccatacatagctcgcgttagactg

SEQ ID NO: 812695 - DNA, 25 bp, Mus musculus
tccatacattacagtggtgcccaga

SEQ ID NO: 812696 - DNA, 25 bp, Mus musculus
tccatacattactgtggtgcccaga

SEQ ID NO: 812697 - DNA, 25 bp, Mus musculus
tccatacccaagagaatgtgatggg

SEQ ID NO: 812698 - DNA, 25 bp, Mus musculus
tccatacccaagtgaatgtgatggg

SEQ ID NO: 812699 - DNA, 25 bp, Mus musculus
tccataccctgtccagtggagcttc

SEQ ID NO: 812700 - DNA, 25 bp, Mus musculus
tccataccctgtgcagtggagcttc

SEQ ID NO: 812701 - DNA, 25 bp, Mus musculus
tccatacctctcctgagtgacttca

SEQ ID NO: 812702 - DNA, 25 bp, Mus musculus
tccatacctctcgtgagtgacttca

SEQ ID NO: 812703 - DNA, 25 bp, Mus musculus
tccatacctcttcccatagggcagg

SEQ ID NO: 812704 - DNA, 25 bp, Mus musculus
tccatacctcttgccatagggcagg

SEQ ID NO: 812705 - DNA, 25 bp, Mus musculus
tccatacctgtacttgtgctgtgac

SEQ ID NO: 812706 - DNA, 25 bp, Mus musculus
tccatacctgtagttgtgctgtgac

SEQ ID NO: 812707 - DNA, 25 bp, Mus musculus
tccatactctccaaatttcttaaga

SEQ ID NO: 812708 - DNA, 25 bp, Mus musculus
tccatactctcctaatttcttaaga

SEQ ID NO: 812709 - DNA, 25 bp, Mus musculus
tccatactcttgctttagattttca

SEQ ID NO: 812710 - DNA, 25 bp, Mus musculus
tccatactcttggtttagattttca

SEQ ID NO: 812711 - DNA, 25 bp, Mus musculus
tccatactgaacacactgcctttta

SEQ ID NO: 812712 - DNA, 25 bp, Mus musculus
tccatactgaactcactgcctttta

SEQ ID NO: 812713 - DNA, 25 bp, Mus musculus
tccatacttcagagttcatgatgct

SEQ ID NO: 812714 - DNA, 25 bp, Mus musculus
tccatacttcagtgttcatgatgct

SEQ ID NO: 812715 - DNA, 25 bp, Mus musculus
tccatacttcgtaactcctttcatg

SEQ ID NO: 812716 - DNA, 25 bp, Mus musculus
tccatacttcgttactcctttcatg

SEQ ID NO: 812717 - DNA, 25 bp, Mus musculus
tccatacttctgaacccccattttt

SEQ ID NO: 812718 - DNA, 25 bp, Mus musculus
tccatacttctgtacccccattttt

SEQ ID NO: 812719 - DNA, 25 bp, Mus musculus
tccatagacaccacactcatatgtg

SEQ ID NO: 812720 - DNA, 25 bp, Mus musculus
tccatagacacctcactcatatgtg

SEQ ID NO: 812721 - DNA, 25 bp, Mus musculus
tccatagactcgctgcgtgactctc

SEQ ID NO: 812722 - DNA, 25 bp, Mus musculus
tccatagactcggtgcgtgactctc

SEQ ID NO: 812723 - DNA, 25 bp, Mus musculus
tccatagagaatacacagacaaact

SEQ ID NO: 812724 - DNA, 25 bp, Mus musculus
tccatagagaattcacagacaaact

SEQ ID NO: 812725 - DNA, 25 bp, Mus musculus
tccatagcacagagcgccacagagc

SEQ ID NO: 812726 - DNA, 25 bp, Mus musculus
tccatagcacagtgcgccacagagc

SEQ ID NO: 812727 - DNA, 25 bp, Mus musculus
tccatagcacatagttgcgtgcctt

SEQ ID NO: 812728 - DNA, 25 bp, Mus musculus
tccatagcacattgttgcgtgcctt

SEQ ID NO: 812729 - DNA, 25 bp, Mus musculus
tccatagcctctctattagccactg

SEQ ID NO: 812730 - DNA, 25 bp, Mus musculus
tccatagcctctgtattagccactg

SEQ ID NO: 812731 - DNA, 25 bp, Mus musculus
tccatagcctgtccagggtacagag

SEQ ID NO: 812732 - DNA, 25 bp, Mus musculus
tccatagcctgtgcagggtacagag

SEQ ID NO: 812733 - DNA, 25 bp, Mus musculus
tccatagccttcctaccacagagag

SEQ ID NO: 812734 - DNA, 25 bp, Mus musculus
tccatagccttcgtaccacagagag

SEQ ID NO: 812735 - DNA, 25 bp, Mus musculus
tccatagcggagactgagccctctc

SEQ ID NO: 812736 - DNA, 25 bp, Mus musculus
tccatagcggagtctgagccctctc

SEQ ID NO: 812737 - DNA, 25 bp, Mus musculus
tccatagcttcactgtcactgtgga

SEQ ID NO: 812738 - DNA, 25 bp, Mus musculus
tccatagcttcagtgtcactgtgga

SEQ ID NO: 812739 - DNA, 25 bp, Mus musculus
tccataggaccaagtccccatcatt

SEQ ID NO: 812740 - DNA, 25 bp, Mus musculus
tccataggaccatgtccccatcatt

SEQ ID NO: 812741 - DNA, 25 bp, Mus musculus
tccataggagctctgaattcgacgt

SEQ ID NO: 812742 - DNA, 25 bp, Mus musculus
tccataggagctgtgaattcgacgt

SEQ ID NO: 812743 - DNA, 25 bp, Mus musculus
tccataggctggacttatctttgtt

SEQ ID NO: 812744 - DNA, 25 bp, Mus musculus
tccataggctggtcttatctttgtt

SEQ ID NO: 812745 - DNA, 25 bp, Mus musculus
tccatagtaaccatctaccgggaag

SEQ ID NO: 812746 - DNA, 25 bp, Mus musculus
tccatagtaaccttctaccgggaag

SEQ ID NO: 812747 - DNA, 25 bp, Mus musculus
tccatagtggccatgtgtgtgcaca

SEQ ID NO: 812748 - DNA, 25 bp, Mus musculus
tccatagtggccttgtgtgtgcaca

SEQ ID NO: 812749 - DNA, 25 bp, Mus musculus
tccatagtgtctcggaagggccttc

SEQ ID NO: 812750 - DNA, 25 bp, Mus musculus
tccatagtgtctgggaagggccttc

SEQ ID NO: 812751 - DNA, 25 bp, Mus musculus
tccatataccctcctactgtgattg

SEQ ID NO: 812752 - DNA, 25 bp, Mus musculus
tccatataccctgctactgtgattg

SEQ ID NO: 812753 - DNA, 25 bp, Mus musculus
tccatatagcctcgttgaccgcaat

SEQ ID NO: 812754 - DNA, 25 bp, Mus musculus
tccatatagcctggttgaccgcaat

SEQ ID NO: 812755 - DNA, 25 bp, Mus musculus
tccatatatctgactgtggttgtat

SEQ ID NO: 812756 - DNA, 25 bp, Mus musculus
tccatatatctgtctgtggttgtat

SEQ ID NO: 812757 - DNA, 25 bp, Mus musculus
tccatatattttataagacttccta

SEQ ID NO: 812758 - DNA, 25 bp, Mus musculus
tccatatattttttaagacttccta

SEQ ID NO: 812759 - DNA, 25 bp, Mus musculus
tccatatctataaaccttctgccat

SEQ ID NO: 812760 - DNA, 25 bp, Mus musculus
tccatatctatataccttctgccat

SEQ ID NO: 812761 - DNA, 25 bp, Mus musculus
tccatatctccccaggaagtcatat

SEQ ID NO: 812762 - DNA, 25 bp, Mus musculus
tccatatctcccgaggaagtcatat

SEQ ID NO: 812763 - DNA, 25 bp, Mus musculus
tccatatctgtcattagtccttttg

SEQ ID NO: 812764 - DNA, 25 bp, Mus musculus
tccatatctgtctttagtccttttg

SEQ ID NO: 812765 - DNA, 25 bp, Mus musculus
tccatatcttcgagaggaacccctc

SEQ ID NO: 812766 - DNA, 25 bp, Mus musculus
tccatatcttcgtgaggaacccctc

SEQ ID NO: 812767 - DNA, 25 bp, Mus musculus
tccatatcttggacgggccagacca

SEQ ID NO: 812768 - DNA, 25 bp, Mus musculus
tccatatcttggtcgggccagacca

SEQ ID NO: 812769 - DNA, 25 bp, Mus musculus
tccatatgattgagaacagctaaac

SEQ ID NO: 812770 - DNA, 25 bp, Mus musculus
tccatatgattgtgaacagctaaac

SEQ ID NO: 812771 - DNA, 25 bp, Mus musculus
tccatatgatttagggctcctccac

SEQ ID NO: 812772 - DNA, 25 bp, Mus musculus
tccatatgattttgggctcctccac

SEQ ID NO: 812773 - DNA, 25 bp, Mus musculus
tccatatgccatacattcaggacat

SEQ ID NO: 812774 - DNA, 25 bp, Mus musculus
tccatatgccattcattcaggacat

SEQ ID NO: 812775 - DNA, 25 bp, Mus musculus
tccatatgctaaagacatgtctgta

SEQ ID NO: 812776 - DNA, 25 bp, Mus musculus
tccatatgctaatgacatgtctgta

SEQ ID NO: 812777 - DNA, 25 bp, Mus musculus
tccatatgctacactctccctatct

SEQ ID NO: 812778 - DNA, 25 bp, Mus musculus
tccatatgctactctctccctatct

SEQ ID NO: 812779 - DNA, 25 bp, Mus musculus
tccatatgctagcaacttggtcccc

SEQ ID NO: 812780 - DNA, 25 bp, Mus musculus
tccatatgctaggaacttggtcccc

SEQ ID NO: 812781 - DNA, 25 bp, Mus musculus
tccatattagtcagtgtcaagtgtg

SEQ ID NO: 812782 - DNA, 25 bp, Mus musculus
tccatattagtctgtgtcaagtgtg

SEQ ID NO: 812783 - DNA, 25 bp, Mus musculus
tccatattccctcttggttcctgtt

SEQ ID NO: 812784 - DNA, 25 bp, Mus musculus
tccatattccctgttggttcctgtt

SEQ ID NO: 812785 - DNA, 25 bp, Mus musculus
tccatattgtgacgcagtgctttat

SEQ ID NO: 812786 - DNA, 25 bp, Mus musculus
tccatattgtgaggcagtgctttat

SEQ ID NO: 812787 - DNA, 25 bp, Mus musculus
tccatattgtgtcaattgaaccatc

SEQ ID NO: 812788 - DNA, 25 bp, Mus musculus
tccatattgtgtgaattgaaccatc

SEQ ID NO: 812789 - DNA, 25 bp, Mus musculus
tccatatttgtgagcgcatccttag

SEQ ID NO: 812790 - DNA, 25 bp, Mus musculus
tccatatttgtgtgcgcatccttag

SEQ ID NO: 812791 - DNA, 25 bp, Mus musculus
tccatcaaccaacccagggctagga

SEQ ID NO: 812792 - DNA, 25 bp, Mus musculus
tccatcaaccaagccagggctagga

SEQ ID NO: 812793 - DNA, 25 bp, Mus musculus
tccatcaactttactcccaaggatt

SEQ ID NO: 812794 - DNA, 25 bp, Mus musculus
tccatcaacttttctcccaaggatt

SEQ ID NO: 812795 - DNA, 25 bp, Mus musculus
tccatcaagaaccaagttcaccttc

SEQ ID NO: 812796 - DNA, 25 bp, Mus musculus
tccatcaagaacgaagttcaccttc

SEQ ID NO: 812797 - DNA, 25 bp, Mus musculus
tccatcaagagaattctgaacccca

SEQ ID NO: 812798 - DNA, 25 bp, Mus musculus
tccatcaagagatttctgaacccca

SEQ ID NO: 812799 - DNA, 25 bp, Mus musculus
tccatcaagatgagaagccttccga

SEQ ID NO: 812800 - DNA, 25 bp, Mus musculus
tccatcaagatgtgaagccttccga

SEQ ID NO: 812801 - DNA, 25 bp, Mus musculus
tccatcaagctgagtaaaggttggt

SEQ ID NO: 812802 - DNA, 25 bp, Mus musculus
tccatcaagctgtgtaaaggttggt

SEQ ID NO: 812803 - DNA, 25 bp, Mus musculus
tccatcaaggatctgcaaccatgca

SEQ ID NO: 812804 - DNA, 25 bp, Mus musculus
tccatcaaggatgtgcaaccatgca

SEQ ID NO: 812805 - DNA, 25 bp, Mus musculus
tccatcaaggcaagtttcctcaagc

SEQ ID NO: 812806 - DNA, 25 bp, Mus musculus
tccatcaaggcatgtttcctcaagc

SEQ ID NO: 812807 - DNA, 25 bp, Mus musculus
tccatcaatttcattatcttctcct

SEQ ID NO: 812808 - DNA, 25 bp, Mus musculus
tccatcaatttctttatcttctcct

SEQ ID NO: 812809 - DNA, 25 bp, Mus musculus
tccatcacagagcactcactaattg

SEQ ID NO: 812810 - DNA, 25 bp, Mus musculus
tccatcacagaggactcactaattg

SEQ ID NO: 812811 - DNA, 25 bp, Mus musculus
tccatcacccctctaatggtggaaa

SEQ ID NO: 812812 - DNA, 25 bp, Mus musculus
tccatcacccctgtaatggtggaaa

SEQ ID NO: 812813 - DNA, 25 bp, Mus musculus
tccatcaccgttattcatcatcaaa

SEQ ID NO: 812814 - DNA, 25 bp, Mus musculus
tccatcaccgtttttcatcatcaaa

SEQ ID NO: 812815 - DNA, 25 bp, Mus musculus
tccatcacctggcaccatagtggac

SEQ ID NO: 812816 - DNA, 25 bp, Mus musculus
tccatcacctgggaccatagtggac

SEQ ID NO: 812817 - DNA, 25 bp, Mus musculus
tccatcaccttaattccatgtattt

SEQ ID NO: 812818 - DNA, 25 bp, Mus musculus
tccatcaccttatttccatgtattt

SEQ ID NO: 812819 - DNA, 25 bp, Mus musculus
tccatcacgattaccagctggctga

SEQ ID NO: 812820 - DNA, 25 bp, Mus musculus
tccatcacgatttccagctggctga

SEQ ID NO: 812821 - DNA, 25 bp, Mus musculus
tccatcactgccactttgaaaggga

SEQ ID NO: 812822 - DNA, 25 bp, Mus musculus
tccatcactgcctctttgaaaggga

SEQ ID NO: 812823 - DNA, 25 bp, Mus musculus
tccatcacttggagggctctgtcga

SEQ ID NO: 812824 - DNA, 25 bp, Mus musculus
tccatcacttggtgggctctgtcga

SEQ ID NO: 812825 - DNA, 25 bp, Mus musculus
tccatcagacttccacgacagtgtt

SEQ ID NO: 812826 - DNA, 25 bp, Mus musculus
tccatcagacttgcacgacagtgtt

SEQ ID NO: 812827 - DNA, 25 bp, Mus musculus
tccatcagctggagttcatcctcag

SEQ ID NO: 812828 - DNA, 25 bp, Mus musculus
tccatcagctggtgttcatcctcag

SEQ ID NO: 812829 - DNA, 25 bp, Mus musculus
tccatcagggaaagccccagggttg

SEQ ID NO: 812830 - DNA, 25 bp, Mus musculus
tccatcagggaatgccccagggttg

SEQ ID NO: 812831 - DNA, 25 bp, Mus musculus
tccatcaggtggataggcttcctca

SEQ ID NO: 812832 - DNA, 25 bp, Mus musculus
tccatcaggtggcacatgcacacac

SEQ ID NO: 812833 - DNA, 25 bp, Mus musculus
tccatcaggtggcagtacttcttag

SEQ ID NO: 812834 - DNA, 25 bp, Mus musculus
tccatcaggtgggacatgcacacac

SEQ ID NO: 812835 - DNA, 25 bp, Mus musculus
tccatcaggtgggagtacttcttag

SEQ ID NO: 812836 - DNA, 25 bp, Mus musculus
tccatcaggtggttaggcttcctca

SEQ ID NO: 812837 - DNA, 25 bp, Mus musculus
tccatcagtgccacccaggatagaa

SEQ ID NO: 812838 - DNA, 25 bp, Mus musculus
tccatcagtgcctcccaggatagaa

SEQ ID NO: 812839 - DNA, 25 bp, Mus musculus
tccatcagtgtcattaccaaagctg

SEQ ID NO: 812840 - DNA, 25 bp, Mus musculus
tccatcagtgtctttaccaaagctg

SEQ ID NO: 812841 - DNA, 25 bp, Mus musculus
tccatcatccctccaaggacttgga

SEQ ID NO: 812842 - DNA, 25 bp, Mus musculus
tccatcatccctgcaaggacttgga

SEQ ID NO: 812843 - DNA, 25 bp, Mus musculus
tccatcatcctaatgttggtaggct

SEQ ID NO: 812844 - DNA, 25 bp, Mus musculus
tccatcatcctattgttggtaggct

SEQ ID NO: 812845 - DNA, 25 bp, Mus musculus
tccatcatggccactctttcatgaa

SEQ ID NO: 812846 - DNA, 25 bp, Mus musculus
tccatcatggcctctctttcatgaa

SEQ ID NO: 812847 - DNA, 25 bp, Mus musculus
tccatcatgtctcacagacaggtcc

SEQ ID NO: 812848 - DNA, 25 bp, Mus musculus
tccatcatgtctgacagacaggtcc

SEQ ID NO: 812849 - DNA, 25 bp, Mus musculus
tccatccaaagtctagggttatata

SEQ ID NO: 812850 - DNA, 25 bp, Mus musculus
tccatccaaagtgtagggttatata

SEQ ID NO: 812851 - DNA, 25 bp, Mus musculus
tccatccaagcaccaagtgatctct

SEQ ID NO: 812852 - DNA, 25 bp, Mus musculus
tccatccaagcactaacccaaagta

SEQ ID NO: 812853 - DNA, 25 bp, Mus musculus
tccatccaagcagcaagtgatctct

SEQ ID NO: 812854 - DNA, 25 bp, Mus musculus
tccatccaagcagtaacccaaagta

SEQ ID NO: 812855 - DNA, 25 bp, Mus musculus
tccatccaagttccatctcatcatt

SEQ ID NO: 812856 - DNA, 25 bp, Mus musculus
tccatccaagttgcatctcatcatt

SEQ ID NO: 812857 - DNA, 25 bp, Mus musculus
tccatccacattcctgggcacccag

SEQ ID NO: 812858 - DNA, 25 bp, Mus musculus
tccatccacattgctgggcacccag

SEQ ID NO: 812859 - DNA, 25 bp, Mus musculus
tccatccagactacatccatgaacg

SEQ ID NO: 812860 - DNA, 25 bp, Mus musculus
tccatccagacttcatccatgaacg

SEQ ID NO: 812861 - DNA, 25 bp, Mus musculus
tccatccagatcaaaatcccttacg

SEQ ID NO: 812862 - DNA, 25 bp, Mus musculus
tccatccagatctaaatcccttacg

SEQ ID NO: 812863 - DNA, 25 bp, Mus musculus
tccatccaggacagcttcatggtat

SEQ ID NO: 812864 - DNA, 25 bp, Mus musculus
tccatccaggactgcttcatggtat

SEQ ID NO: 812865 - DNA, 25 bp, Mus musculus
tccatccagttccacacaggaggag

SEQ ID NO: 812866 - DNA, 25 bp, Mus musculus
tccatccagttcgacacaggaggag

SEQ ID NO: 812867 - DNA, 25 bp, Mus musculus
tccatccatgtcagagttgctgcga

SEQ ID NO: 812868 - DNA, 25 bp, Mus musculus
tccatccatgtctgagttgctgcga

SEQ ID NO: 812869 - DNA, 25 bp, Mus musculus
tccatccatgttcaagcctaattga

SEQ ID NO: 812870 - DNA, 25 bp, Mus musculus
tccatccatgttgaagcctaattga

SEQ ID NO: 812871 - DNA, 25 bp, Mus musculus
tccatccattaaagatcctcatttg

SEQ ID NO: 812872 - DNA, 25 bp, Mus musculus
tccatccattaatgatcctcatttg

SEQ ID NO: 812873 - DNA, 25 bp, Mus musculus
tccatccattcactatacttttcta

SEQ ID NO: 812874 - DNA, 25 bp, Mus musculus
tccatccattcagtatacttttcta

SEQ ID NO: 812875 - DNA, 25 bp, Mus musculus
tccatcccaacaccttgtgtatgaa

SEQ ID NO: 812876 - DNA, 25 bp, Mus musculus
tccatcccaacagcttgtgtatgaa

SEQ ID NO: 812877 - DNA, 25 bp, Mus musculus
tccatcccaagccagttcaattaga

SEQ ID NO: 812878 - DNA, 25 bp, Mus musculus
tccatcccaagcgagttcaattaga

SEQ ID NO: 812879 - DNA, 25 bp, Mus musculus
tccatcccacacataaggctgttga

SEQ ID NO: 812880 - DNA, 25 bp, Mus musculus
tccatcccacacttaaggctgttga

SEQ ID NO: 812881 - DNA, 25 bp, Mus musculus
tccatcccaggaagacaggctgatt

SEQ ID NO: 812882 - DNA, 25 bp, Mus musculus
tccatcccaggatgacaggctgatt

SEQ ID NO: 812883 - DNA, 25 bp, Mus musculus
tccatcccagtacccatgtaaagat

SEQ ID NO: 812884 - DNA, 25 bp, Mus musculus
tccatcccagtagccatgtaaagat

SEQ ID NO: 812885 - DNA, 25 bp, Mus musculus
tccatcccattaatagctccaaacg

SEQ ID NO: 812886 - DNA, 25 bp, Mus musculus
tccatcccattattagctccaaacg

SEQ ID NO: 812887 - DNA, 25 bp, Mus musculus
tccatcccattgacctttaattatc

SEQ ID NO: 812888 - DNA, 25 bp, Mus musculus
tccatcccattgagtcactgtaatt

SEQ ID NO: 812889 - DNA, 25 bp, Mus musculus
tccatcccattgtcctttaattatc

SEQ ID NO: 812890 - DNA, 25 bp, Mus musculus
tccatcccattgtgtcactgtaatt

SEQ ID NO: 812891 - DNA, 25 bp, Mus musculus
tccatccccaaaagtactttgggat

SEQ ID NO: 812892 - DNA, 25 bp, Mus musculus
tccatccccaaatgtactttgggat

SEQ ID NO: 812893 - DNA, 25 bp, Mus musculus
tccatcccggtcacaaatttgttat

SEQ ID NO: 812894 - DNA, 25 bp, Mus musculus
tccatcccggtctcaaatttgttat

SEQ ID NO: 812895 - DNA, 25 bp, Mus musculus
tccatcccgtccattcgagaggagg

SEQ ID NO: 812896 - DNA, 25 bp, Mus musculus
tccatcccgtcctttcgagaggagg

SEQ ID NO: 812897 - DNA, 25 bp, Mus musculus
tccatccctcttaggaagagtaaaa

SEQ ID NO: 812898 - DNA, 25 bp, Mus musculus
tccatccctctttggaagagtaaaa

SEQ ID NO: 812899 - DNA, 25 bp, Mus musculus
tccatccctggtcagggacctcgaa

SEQ ID NO: 812900 - DNA, 25 bp, Mus musculus
tccatccctggtgagggacctcgaa

SEQ ID NO: 812901 - DNA, 25 bp, Mus musculus
tccatcccttctacatgagcttagg

SEQ ID NO: 812902 - DNA, 25 bp, Mus musculus
tccatcccttcttcatgagcttagg

SEQ ID NO: 812903 - DNA, 25 bp, Mus musculus
tccatcccttttcactttaatcagt

SEQ ID NO: 812904 - DNA, 25 bp, Mus musculus
tccatcccttttgactttaatcagt

SEQ ID NO: 812905 - DNA, 25 bp, Mus musculus
tccatccgaggacgtcaagacacag

SEQ ID NO: 812906 - DNA, 25 bp, Mus musculus
tccatccgaggaggtcaagacacag

SEQ ID NO: 812907 - DNA, 25 bp, Mus musculus
tccatccgagtgaccttaaacctaa

SEQ ID NO: 812908 - DNA, 25 bp, Mus musculus
tccatccgagtgtccttaaacctaa

SEQ ID NO: 812909 - DNA, 25 bp, Mus musculus
tccatccgtccaccagggcgagggt

SEQ ID NO: 812910 - DNA, 25 bp, Mus musculus
tccatccgtccagcagggcgagggt

SEQ ID NO: 812911 - DNA, 25 bp, Mus musculus
tccatcctaaggacttgttagatct

SEQ ID NO: 812912 - DNA, 25 bp, Mus musculus
tccatcctaaggtcttgttagatct

SEQ ID NO: 812913 - DNA, 25 bp, Mus musculus
tccatcctaataacgtgtctcttcc

SEQ ID NO: 812914 - DNA, 25 bp, Mus musculus
tccatcctaatatcgtgtctcttcc

SEQ ID NO: 812915 - DNA, 25 bp, Mus musculus
tccatcctagtgacacttctcagga

SEQ ID NO: 812916 - DNA, 25 bp, Mus musculus
tccatcctagtgtcacttctcagga

SEQ ID NO: 812917 - DNA, 25 bp, Mus musculus
tccatcctatgtacccattatctgg

SEQ ID NO: 812918 - DNA, 25 bp, Mus musculus
tccatcctatgttcccattatctgg

SEQ ID NO: 812919 - DNA, 25 bp, Mus musculus
tccatcctccatcatgtatagagga

SEQ ID NO: 812920 - DNA, 25 bp, Mus musculus
tccatcctccatgatgtatagagga

SEQ ID NO: 812921 - DNA, 25 bp, Mus musculus
tccatcctcgctccgatggcatggg

SEQ ID NO: 812922 - DNA, 25 bp, Mus musculus
tccatcctcgctgcgatggcatggg

SEQ ID NO: 812923 - DNA, 25 bp, Mus musculus
tccatcctcgttccggatgtgtgtt

SEQ ID NO: 812924 - DNA, 25 bp, Mus musculus
tccatcctcgttgcggatgtgtgtt

SEQ ID NO: 812925 - DNA, 25 bp, Mus musculus
tccatcctgacccttgtttcaaggg

SEQ ID NO: 812926 - DNA, 25 bp, Mus musculus
tccatcctgaccgttgtttcaaggg

SEQ ID NO: 812927 - DNA, 25 bp, Mus musculus
tccatcctgtagctcctagggtttg

SEQ ID NO: 812928 - DNA, 25 bp, Mus musculus
tccatcctgtaggtcctagggtttg

SEQ ID NO: 812929 - DNA, 25 bp, Mus musculus
tccatccttcaaatgagctcaaagt

SEQ ID NO: 812930 - DNA, 25 bp, Mus musculus
tccatccttcaattgagctcaaagt

SEQ ID NO: 812931 - DNA, 25 bp, Mus musculus
tccatccttcccagagttgagatta

SEQ ID NO: 812932 - DNA, 25 bp, Mus musculus
tccatccttccctgagttgagatta

SEQ ID NO: 812933 - DNA, 25 bp, Mus musculus
tccatccttggtcgtatttccgaaa

SEQ ID NO: 812934 - DNA, 25 bp, Mus musculus
tccatccttggtggtatttccgaaa

SEQ ID NO: 812935 - DNA, 25 bp, Mus musculus
tccatcctttcaattgactgtgtct

SEQ ID NO: 812936 - DNA, 25 bp, Mus musculus
tccatcctttcatttgactgtgtct

SEQ ID NO: 812937 - DNA, 25 bp, Mus musculus
tccatcgagatgacaattccacaat

SEQ ID NO: 812938 - DNA, 25 bp, Mus musculus
tccatcgagatgtcaattccacaat

SEQ ID NO: 812939 - DNA, 25 bp, Mus musculus
tccatcgaggacctttggttcttca

SEQ ID NO: 812940 - DNA, 25 bp, Mus musculus
tccatcgaggacgtttggttcttca

SEQ ID NO: 812941 - DNA, 25 bp, Mus musculus
tccatcgccaaaccagtgggatcac

SEQ ID NO: 812942 - DNA, 25 bp, Mus musculus
tccatcgccaaagcagtgggatcac

SEQ ID NO: 812943 - DNA, 25 bp, Mus musculus
tccatcgccagcatcctttggaagg

SEQ ID NO: 812944 - DNA, 25 bp, Mus musculus
tccatcgccagcttcctttggaagg

SEQ ID NO: 812945 - DNA, 25 bp, Mus musculus
tccatcgggctgcaagctgtggctt

SEQ ID NO: 812946 - DNA, 25 bp, Mus musculus
tccatcgggctggaagctgtggctt

SEQ ID NO: 812947 - DNA, 25 bp, Mus musculus
tccatcggtaaacggcctggcgccg

SEQ ID NO: 812948 - DNA, 25 bp, Mus musculus
tccatcggtaaagggcctggcgccg

SEQ ID NO: 812949 - DNA, 25 bp, Mus musculus
tccatcggttcacgtgggatacaat

SEQ ID NO: 812950 - DNA, 25 bp, Mus musculus
tccatcggttcaggtgggatacaat

SEQ ID NO: 812951 - DNA, 25 bp, Mus musculus
tccatcgtagttatctgagcccctc

SEQ ID NO: 812952 - DNA, 25 bp, Mus musculus
tccatcgtagttttctgagcccctc

SEQ ID NO: 812953 - DNA, 25 bp, Mus musculus
tccatcgtccatctgcaggcaggat

SEQ ID NO: 812954 - DNA, 25 bp, Mus musculus
tccatcgtccatgtgcaggcaggat

SEQ ID NO: 812955 - DNA, 25 bp, Mus musculus
tccatcgtcctcatcaaggagtggt

SEQ ID NO: 812956 - DNA, 25 bp, Mus musculus
tccatcgtcctcttcaaggagtggt

SEQ ID NO: 812957 - DNA, 25 bp, Mus musculus
tccatcgtcttgactatccgtctgt

SEQ ID NO: 812958 - DNA, 25 bp, Mus musculus
tccatcgtcttgtctatccgtctgt

SEQ ID NO: 812959 - DNA, 25 bp, Mus musculus
tccatcgtggacagtatttcttcag

SEQ ID NO: 812960 - DNA, 25 bp, Mus musculus
tccatcgtggactgtatttcttcag

SEQ ID NO: 812961 - DNA, 25 bp, Mus musculus
tccatcgtgtaacccaagcctttct

SEQ ID NO: 812962 - DNA, 25 bp, Mus musculus
tccatcgtgtaagccaagcctttct

SEQ ID NO: 812963 - DNA, 25 bp, Mus musculus
tccatcgtgtgcctgatgatcacgc

SEQ ID NO: 812964 - DNA, 25 bp, Mus musculus
tccatcgtgtgcgtgatgatcacgc

SEQ ID NO: 812965 - DNA, 25 bp, Mus musculus
tccatctaactgagttgttgcctct

SEQ ID NO: 812966 - DNA, 25 bp, Mus musculus
tccatctaactgtgttgttgcctct

SEQ ID NO: 812967 - DNA, 25 bp, Mus musculus
tccatctaagcaaccccatagtgat

SEQ ID NO: 812968 - DNA, 25 bp, Mus musculus
tccatctaagcatccccatagtgat

SEQ ID NO: 812969 - DNA, 25 bp, Mus musculus
tccatctacctaacatatgctgtct

SEQ ID NO: 812970 - DNA, 25 bp, Mus musculus
tccatctacctatcatatgctgtct

SEQ ID NO: 812971 - DNA, 25 bp, Mus musculus
tccatctaccttacttcaggctgaa

SEQ ID NO: 812972 - DNA, 25 bp, Mus musculus
tccatctacctttcttcaggctgaa

SEQ ID NO: 812973 - DNA, 25 bp, Mus musculus
tccatctagcatcagcgggcacatt

SEQ ID NO: 812974 - DNA, 25 bp, Mus musculus
tccatctagcatgagcgggcacatt

SEQ ID NO: 812975 - DNA, 25 bp, Mus musculus
tccatctagccaactgtcagtcaat

SEQ ID NO: 812976 - DNA, 25 bp, Mus musculus
tccatctagccatctgtcagtcaat

SEQ ID NO: 812977 - DNA, 25 bp, Mus musculus
tccatctatactcccctttgttgat

SEQ ID NO: 812978 - DNA, 25 bp, Mus musculus
tccatctatactgccctttgttgat

SEQ ID NO: 812979 - DNA, 25 bp, Mus musculus
tccatctattcccagctcaacaaga

SEQ ID NO: 812980 - DNA, 25 bp, Mus musculus
tccatctattccgagctcaacaaga

SEQ ID NO: 812981 - DNA, 25 bp, Mus musculus
tccatctcacccataggatgtgaaa

SEQ ID NO: 812982 - DNA, 25 bp, Mus musculus
tccatctcacccttaggatgtgaaa

SEQ ID NO: 812983 - DNA, 25 bp, Mus musculus
tccatctcagacactcatccagcct

SEQ ID NO: 812984 - DNA, 25 bp, Mus musculus
tccatctcagactctcatccagcct

SEQ ID NO: 812985 - DNA, 25 bp, Mus musculus
tccatctcaggtcgctaggctgaac

SEQ ID NO: 812986 - DNA, 25 bp, Mus musculus
tccatctcaggtggctaggctgaac

SEQ ID NO: 812987 - DNA, 25 bp, Mus musculus
tccatctcatcaacgcagctctaaa

SEQ ID NO: 812988 - DNA, 25 bp, Mus musculus
tccatctcatcatcgcagctctaaa

SEQ ID NO: 812989 - DNA, 25 bp, Mus musculus
tccatctccaatccggaaaagacag

SEQ ID NO: 812990 - DNA, 25 bp, Mus musculus
tccatctccaatgcggaaaagacag

SEQ ID NO: 812991 - DNA, 25 bp, Mus musculus
tccatctccaggagtggtcccagga

SEQ ID NO: 812992 - DNA, 25 bp, Mus musculus
tccatctccaggtgtggtcccagga

SEQ ID NO: 812993 - DNA, 25 bp, Mus musculus
tccatctccctcagggtctctgagt

SEQ ID NO: 812994 - DNA, 25 bp, Mus musculus
tccatctccctctgggtctctgagt

SEQ ID NO: 812995 - DNA, 25 bp, Mus musculus
tccatctcctataagctgtttgctg

SEQ ID NO: 812996 - DNA, 25 bp, Mus musculus
tccatctcctattagctgtttgctg

SEQ ID NO: 812997 - DNA, 25 bp, Mus musculus
tccatctccttaaccaacattaaac

SEQ ID NO: 812998 - DNA, 25 bp, Mus musculus
tccatctccttatccaacattaaac

SEQ ID NO: 812999 - DNA, 25 bp, Mus musculus
tccatctctctgactgtgaattgca

SEQ ID NO: 813000 - DNA, 25 bp, Mus musculus
tccatctctctgtctgtgaattgca

SEQ ID NO: 813001 - DNA, 25 bp, Mus musculus
tccatctctggacctgtagctggtt

SEQ ID NO: 813002 - DNA, 25 bp, Mus musculus
tccatctctggagctgtagctggtt

SEQ ID NO: 813003 - DNA, 25 bp, Mus musculus
tccatctctttactttatcctttgt

SEQ ID NO: 813004 - DNA, 25 bp, Mus musculus
tccatctctttagtttatcctttgt

SEQ ID NO: 813005 - DNA, 25 bp, Mus musculus
tccatctgacccacagtacatctgt

SEQ ID NO: 813006 - DNA, 25 bp, Mus musculus
tccatctgaccctcagtacatctgt

SEQ ID NO: 813007 - DNA, 25 bp, Mus musculus
tccatctgcagcactctgtgtgtgt

SEQ ID NO: 813008 - DNA, 25 bp, Mus musculus
tccatctgcagctctctgtgtgtgt

SEQ ID NO: 813009 - DNA, 25 bp, Mus musculus
tccatctgccagagcggacctgtgg

SEQ ID NO: 813010 - DNA, 25 bp, Mus musculus
tccatctgccagtgcggacctgtgg

SEQ ID NO: 813011 - DNA, 25 bp, Mus musculus
tccatctgccttatactactatttt

SEQ ID NO: 813012 - DNA, 25 bp, Mus musculus
tccatctgccttttactactatttt

SEQ ID NO: 813013 - DNA, 25 bp, Mus musculus
tccatctgtattatgttgcctcgat

SEQ ID NO: 813014 - DNA, 25 bp, Mus musculus
tccatctgtattttgttgcctcgat

SEQ ID NO: 813015 - DNA, 25 bp, Mus musculus
tccatctgtctgaggtagatccata

SEQ ID NO: 813016 - DNA, 25 bp, Mus musculus
tccatctgtctgtggtagatccata

SEQ ID NO: 813017 - DNA, 25 bp, Mus musculus
tccatcttccatcagttgcttttgt

SEQ ID NO: 813018 - DNA, 25 bp, Mus musculus
tccatcttccatgagttgcttttgt

SEQ ID NO: 813019 - DNA, 25 bp, Mus musculus
tccatcttctgactcatgctttaag

SEQ ID NO: 813020 - DNA, 25 bp, Mus musculus
tccatcttctgagtcatgctttaag

SEQ ID NO: 813021 - DNA, 25 bp, Mus musculus
tccatcttcttccagtggtgactga

SEQ ID NO: 813022 - DNA, 25 bp, Mus musculus
tccatcttcttcgagtggtgactga

SEQ ID NO: 813023 - DNA, 25 bp, Mus musculus
tccatcttgagacccgagcagttac

SEQ ID NO: 813024 - DNA, 25 bp, Mus musculus
tccatcttgagagccgagcagttac

SEQ ID NO: 813025 - DNA, 25 bp, Mus musculus
tccatcttgaggctagcagtgctga

SEQ ID NO: 813026 - DNA, 25 bp, Mus musculus
tccatcttgagggtagcagtgctga

SEQ ID NO: 813027 - DNA, 25 bp, Mus musculus
tccatcttggctaacagtgggcaga

SEQ ID NO: 813028 - DNA, 25 bp, Mus musculus
tccatcttggcttacagtgggcaga

SEQ ID NO: 813029 - DNA, 25 bp, Mus musculus
tccatcttgggccaacccatttata

SEQ ID NO: 813030 - DNA, 25 bp, Mus musculus
tccatcttgggcgaacccatttata

SEQ ID NO: 813031 - DNA, 25 bp, Mus musculus
tccatcttgggtacacgcaccgctg

SEQ ID NO: 813032 - DNA, 25 bp, Mus musculus
tccatcttgggtacattgcctgcgg

SEQ ID NO: 813033 - DNA, 25 bp, Mus musculus
tccatcttgggttcacgcaccgctg

SEQ ID NO: 813034 - DNA, 25 bp, Mus musculus
tccatcttgggttcattgcctgcgg

SEQ ID NO: 813035 - DNA, 25 bp, Mus musculus
tccatcttgtgacgctgttatgcaa

SEQ ID NO: 813036 - DNA, 25 bp, Mus musculus
tccatcttgtgaggctgttatgcaa

SEQ ID NO: 813037 - DNA, 25 bp, Mus musculus
tccatctttaatacagggaccctgg

SEQ ID NO: 813038 - DNA, 25 bp, Mus musculus
tccatctttaattcagggaccctgg

SEQ ID NO: 813039 - DNA, 25 bp, Mus musculus
tccatctttccaatattccctgctt

SEQ ID NO: 813040 - DNA, 25 bp, Mus musculus
tccatctttccattattccctgctt

SEQ ID NO: 813041 - DNA, 25 bp, Mus musculus
tccatctttgacatggccaggaagc

SEQ ID NO: 813042 - DNA, 25 bp, Mus musculus
tccatctttgacttggccaggaagc

SEQ ID NO: 813043 - DNA, 25 bp, Mus musculus
tccatctttgctctgtgaggccaaa

SEQ ID NO: 813044 - DNA, 25 bp, Mus musculus
tccatctttgctgtgtgaggccaaa

SEQ ID NO: 813045 - DNA, 25 bp, Mus musculus
tccatctttggcacgggcttctcgg

SEQ ID NO: 813046 - DNA, 25 bp, Mus musculus
tccatctttggctcgggcttctcgg

SEQ ID NO: 813047 - DNA, 25 bp, Mus musculus
tccatctttgtccttgaggtggtcc

SEQ ID NO: 813048 - DNA, 25 bp, Mus musculus
tccatctttgtcgttgaggtggtcc

SEQ ID NO: 813049 - DNA, 25 bp, Mus musculus
tccatgaaagatatcgaagagatga

SEQ ID NO: 813050 - DNA, 25 bp, Mus musculus
tccatgaaagatttcgaagagatga

SEQ ID NO: 813051 - DNA, 25 bp, Mus musculus
tccatgaacaatctgcagagtgatt

SEQ ID NO: 813052 - DNA, 25 bp, Mus musculus
tccatgaacaatgtgcagagtgatt

SEQ ID NO: 813053 - DNA, 25 bp, Mus musculus
tccatgaagatcactcttggtgctt

SEQ ID NO: 813054 - DNA, 25 bp, Mus musculus
tccatgaagatctctcttggtgctt

SEQ ID NO: 813055 - DNA, 25 bp, Mus musculus
tccatgaagcctctcccaagagtaa

SEQ ID NO: 813056 - DNA, 25 bp, Mus musculus
tccatgaagcctgtcccaagagtaa

SEQ ID NO: 813057 - DNA, 25 bp, Mus musculus
tccatgaataccaggtacacacaca

SEQ ID NO: 813058 - DNA, 25 bp, Mus musculus
tccatgaatacctggtacacacaca

SEQ ID NO: 813059 - DNA, 25 bp, Mus musculus
tccatgactcccatgatgggacttt

SEQ ID NO: 813060 - DNA, 25 bp, Mus musculus
tccatgactcccttgatgggacttt

SEQ ID NO: 813061 - DNA, 25 bp, Mus musculus
tccatgagaagccagggccttttcc

SEQ ID NO: 813062 - DNA, 25 bp, Mus musculus
tccatgagaagcgagggccttttcc

SEQ ID NO: 813063 - DNA, 25 bp, Mus musculus
tccatgagcagtcgctcagttggaa

SEQ ID NO: 813064 - DNA, 25 bp, Mus musculus
tccatgagcagtggctcagttggaa

SEQ ID NO: 813065 - DNA, 25 bp, Mus musculus
tccatgagcgtcagccaactgttgc

SEQ ID NO: 813066 - DNA, 25 bp, Mus musculus
tccatgagcgtctgccaactgttgc

SEQ ID NO: 813067 - DNA, 25 bp, Mus musculus
tccatgagctcacgtggtccagaaa

SEQ ID NO: 813068 - DNA, 25 bp, Mus musculus
tccatgagctcaggtggtccagaaa

SEQ ID NO: 813069 - DNA, 25 bp, Mus musculus
tccatgaggctcaaagttcaatccc

SEQ ID NO: 813070 - DNA, 25 bp, Mus musculus
tccatgaggctctaagttcaatccc

SEQ ID NO: 813071 - DNA, 25 bp, Mus musculus
tccatgatcctcatcagtgcattga

SEQ ID NO: 813072 - DNA, 25 bp, Mus musculus
tccatgatcctcttcagtgcattga

SEQ ID NO: 813073 - DNA, 25 bp, Mus musculus
tccatgatggccatacagtactgta

SEQ ID NO: 813074 - DNA, 25 bp, Mus musculus
tccatgatggccttacagtactgta

SEQ ID NO: 813075 - DNA, 25 bp, Mus musculus
tccatgcaagcaaacctacacatac

SEQ ID NO: 813076 - DNA, 25 bp, Mus musculus
tccatgcaagcatacctacacatac

SEQ ID NO: 813077 - DNA, 25 bp, Mus musculus
tccatgcacatgctgagttttcaga

SEQ ID NO: 813078 - DNA, 25 bp, Mus musculus
tccatgcacatggtgagttttcaga

SEQ ID NO: 813079 - DNA, 25 bp, Mus musculus
tccatgcagaagaaaagctcaggct

SEQ ID NO: 813080 - DNA, 25 bp, Mus musculus
tccatgcagaagtaaagctcaggct

SEQ ID NO: 813081 - DNA, 25 bp, Mus musculus
tccatgcagctcaagtgcacagctg

SEQ ID NO: 813082 - DNA, 25 bp, Mus musculus
tccatgcagctctagtgcacagctg

SEQ ID NO: 813083 - DNA, 25 bp, Mus musculus
tccatgcatggacataacttaatag

SEQ ID NO: 813084 - DNA, 25 bp, Mus musculus
tccatgcatggagataacttaatag

SEQ ID NO: 813085 - DNA, 25 bp, Mus musculus
tccatgcatgtgatgatggacgtgt

SEQ ID NO: 813086 - DNA, 25 bp, Mus musculus
tccatgcatgtgttgatggacgtgt

SEQ ID NO: 813087 - DNA, 25 bp, Mus musculus
tccatgccagatattgacaccggtc

SEQ ID NO: 813088 - DNA, 25 bp, Mus musculus
tccatgccagatcggtcggtcggtc

SEQ ID NO: 813089 - DNA, 25 bp, Mus musculus
tccatgccagatgggtcggtcggtc

SEQ ID NO: 813090 - DNA, 25 bp, Mus musculus
tccatgccagattttgacaccggtc

SEQ ID NO: 813091 - DNA, 25 bp, Mus musculus
tccatgccaggtcctgaaacaggta

SEQ ID NO: 813092 - DNA, 25 bp, Mus musculus
tccatgccaggtgctgaaacaggta

SEQ ID NO: 813093 - DNA, 25 bp, Mus musculus
tccatgccagtcacttatcttaaag

SEQ ID NO: 813094 - DNA, 25 bp, Mus musculus
tccatgccagtctcttatcttaaag

SEQ ID NO: 813095 - DNA, 25 bp, Mus musculus
tccatgcccagtcctggtgacaggg

SEQ ID NO: 813096 - DNA, 25 bp, Mus musculus
tccatgcccagtgctggtgacaggg

SEQ ID NO: 813097 - DNA, 25 bp, Mus musculus
tccatgcccattccaagttttactt

SEQ ID NO: 813098 - DNA, 25 bp, Mus musculus
tccatgcccattgcaagttttactt

SEQ ID NO: 813099 - DNA, 25 bp, Mus musculus
tccatgcctatgaggaacctttgaa

SEQ ID NO: 813100 - DNA, 25 bp, Mus musculus
tccatgcctatgtggaacctttgaa

SEQ ID NO: 813101 - DNA, 25 bp, Mus musculus
tccatgcgaaaacgatgcccacctg

SEQ ID NO: 813102 - DNA, 25 bp, Mus musculus
tccatgcgaaaaggatgcccacctg

SEQ ID NO: 813103 - DNA, 25 bp, Mus musculus
tccatgctagatagcgagttcagag

SEQ ID NO: 813104 - DNA, 25 bp, Mus musculus
tccatgctagattgcgagttcagag

SEQ ID NO: 813105 - DNA, 25 bp, Mus musculus
tccatgctcagtactggttgctttt

SEQ ID NO: 813106 - DNA, 25 bp, Mus musculus
tccatgctcagttctggttgctttt

SEQ ID NO: 813107 - DNA, 25 bp, Mus musculus
tccatgctgagtatgaacctgacca

SEQ ID NO: 813108 - DNA, 25 bp, Mus musculus
tccatgctgagtttgaacctgacca

SEQ ID NO: 813109 - DNA, 25 bp, Mus musculus
tccatgctggccaccttgcaactgg

SEQ ID NO: 813110 - DNA, 25 bp, Mus musculus
tccatgctggcctccttgcaactgg

SEQ ID NO: 813111 - DNA, 25 bp, Mus musculus
tccatgctttggaacaaaatctggt

SEQ ID NO: 813112 - DNA, 25 bp, Mus musculus
tccatgctttggtacaaaatctggt

SEQ ID NO: 813113 - DNA, 25 bp, Mus musculus
tccatggacattccctggcagcaaa

SEQ ID NO: 813114 - DNA, 25 bp, Mus musculus
tccatggacattgcctggcagcaaa

SEQ ID NO: 813115 - DNA, 25 bp, Mus musculus
tccatggaccatatctactgacatt

SEQ ID NO: 813116 - DNA, 25 bp, Mus musculus
tccatggaccatttctactgacatt

SEQ ID NO: 813117 - DNA, 25 bp, Mus musculus
tccatggactccagataagggccag

SEQ ID NO: 813118 - DNA, 25 bp, Mus musculus
tccatggactcctgataagggccag

SEQ ID NO: 813119 - DNA, 25 bp, Mus musculus
tccatggactgtctgtgcaattgca

SEQ ID NO: 813120 - DNA, 25 bp, Mus musculus
tccatggactgtgtgtgcaattgca

SEQ ID NO: 813121 - DNA, 25 bp, Mus musculus
tccatggagggtatgatgaacatgg

SEQ ID NO: 813122 - DNA, 25 bp, Mus musculus
tccatggagggtttgatgaacatgg

SEQ ID NO: 813123 - DNA, 25 bp, Mus musculus
tccatggatgttagcctatttgaaa

SEQ ID NO: 813124 - DNA, 25 bp, Mus musculus
tccatggatgtttgcctatttgaaa

SEQ ID NO: 813125 - DNA, 25 bp, Mus musculus
tccatggcacacaactgcttttcaa

SEQ ID NO: 813126 - DNA, 25 bp, Mus musculus
tccatggcacactactgcttttcaa

SEQ ID NO: 813127 - DNA, 25 bp, Mus musculus
tccatggcatgaattctcaccttga

SEQ ID NO: 813128 - DNA, 25 bp, Mus musculus
tccatggcatgatttctcaccttga

SEQ ID NO: 813129 - DNA, 25 bp, Mus musculus
tccatggccaatagcaccaccgtgg

SEQ ID NO: 813130 - DNA, 25 bp, Mus musculus
tccatggccaattgcaccaccgtgg

SEQ ID NO: 813131 - DNA, 25 bp, Mus musculus
tccatggcccagatatatactcact

SEQ ID NO: 813132 - DNA, 25 bp, Mus musculus
tccatggcccagttatatactcact

SEQ ID NO: 813133 - DNA, 25 bp, Mus musculus
tccatggcctatctaccgccgccat

SEQ ID NO: 813134 - DNA, 25 bp, Mus musculus
tccatggcctatgtaccgccgccat

SEQ ID NO: 813135 - DNA, 25 bp, Mus musculus
tccatggcctcgatctgcaataaag

SEQ ID NO: 813136 - DNA, 25 bp, Mus musculus
tccatggcctcgttctgcaataaag

SEQ ID NO: 813137 - DNA, 25 bp, Mus musculus
tccatggcctgcagtggttttgacc

SEQ ID NO: 813138 - DNA, 25 bp, Mus musculus
tccatggcctgctgtggttttgacc

SEQ ID NO: 813139 - DNA, 25 bp, Mus musculus
tccatggctcgtatttcccagtggt

SEQ ID NO: 813140 - DNA, 25 bp, Mus musculus
tccatggctcgtttttcccagtggt

SEQ ID NO: 813141 - DNA, 25 bp, Mus musculus
tccatggctctgctactctgggaaa

SEQ ID NO: 813142 - DNA, 25 bp, Mus musculus
tccatggctctggtactctgggaaa

SEQ ID NO: 813143 - DNA, 25 bp, Mus musculus
tccatggcttctcgaggtggtgtcc

SEQ ID NO: 813144 - DNA, 25 bp, Mus musculus
tccatggcttctggaggtggtgtcc

SEQ ID NO: 813145 - DNA, 25 bp, Mus musculus
tccatggctttgaggtttttcttcc

SEQ ID NO: 813146 - DNA, 25 bp, Mus musculus
tccatggctttgtggtttttcttcc

SEQ ID NO: 813147 - DNA, 25 bp, Mus musculus
tccatgggcacccaggtatgcacaa

SEQ ID NO: 813148 - DNA, 25 bp, Mus musculus
tccatgggcaccgaggtatgcacaa

SEQ ID NO: 813149 - DNA, 25 bp, Mus musculus
tccatgggcagcatgatctgtggct

SEQ ID NO: 813150 - DNA, 25 bp, Mus musculus
tccatgggcagcttgatctgtggct

SEQ ID NO: 813151 - DNA, 25 bp, Mus musculus
tccatgggtaccagtcaagcaaatg

SEQ ID NO: 813152 - DNA, 25 bp, Mus musculus
tccatgggtacctgtcaagcaaatg

SEQ ID NO: 813153 - DNA, 25 bp, Mus musculus
tccatgggtgcaaccaagtatcgct

SEQ ID NO: 813154 - DNA, 25 bp, Mus musculus
tccatgggtgcatccaagtatcgct

SEQ ID NO: 813155 - DNA, 25 bp, Mus musculus
tccatgggtttaattccttatcagt

SEQ ID NO: 813156 - DNA, 25 bp, Mus musculus
tccatgggtttatttccttatcagt

SEQ ID NO: 813157 - DNA, 25 bp, Mus musculus
tccatggtacagattattggcagag

SEQ ID NO: 813158 - DNA, 25 bp, Mus musculus
tccatggtacagtttattggcagag

SEQ ID NO: 813159 - DNA, 25 bp, Mus musculus
tccatggtccagaagtgcaagctat

SEQ ID NO: 813160 - DNA, 25 bp, Mus musculus
tccatggtccagtagtgcaagctat

SEQ ID NO: 813161 - DNA, 25 bp, Mus musculus
tccatggtccatataagtgcagcta

SEQ ID NO: 813162 - DNA, 25 bp, Mus musculus
tccatggtccatttaagtgcagcta

SEQ ID NO: 813163 - DNA, 25 bp, Mus musculus
tccatggtctgaattggtgaggcat

SEQ ID NO: 813164 - DNA, 25 bp, Mus musculus
tccatggtctgatttggtgaggcat

SEQ ID NO: 813165 - DNA, 25 bp, Mus musculus
tccatggtgcatcagctcaaccggt

SEQ ID NO: 813166 - DNA, 25 bp, Mus musculus
tccatggtgcatgagctcaaccggt

SEQ ID NO: 813167 - DNA, 25 bp, Mus musculus
tccatggtgcccaatgtgcccgagg

SEQ ID NO: 813168 - DNA, 25 bp, Mus musculus
tccatggtgccctatgtgcccgagg

SEQ ID NO: 813169 - DNA, 25 bp, Mus musculus
tccatggtggcccatcattttgtac

SEQ ID NO: 813170 - DNA, 25 bp, Mus musculus
tccatggtggccgatcattttgtac

SEQ ID NO: 813171 - DNA, 25 bp, Mus musculus
tccatggtggctcatgtgcatcgca

SEQ ID NO: 813172 - DNA, 25 bp, Mus musculus
tccatggtggctgatgtgcatcgca

SEQ ID NO: 813173 - DNA, 25 bp, Mus musculus
tccatggtgttgcaaggtccttcct

SEQ ID NO: 813174 - DNA, 25 bp, Mus musculus
tccatggtgttggaaggtccttcct

SEQ ID NO: 813175 - DNA, 25 bp, Mus musculus
tccatggttgagagcacgtgatgca

SEQ ID NO: 813176 - DNA, 25 bp, Mus musculus
tccatggttgagtgcacgtgatgca

SEQ ID NO: 813177 - DNA, 25 bp, Mus musculus
tccatggtttcccagtggtttcaga

SEQ ID NO: 813178 - DNA, 25 bp, Mus musculus
tccatggtttccgagtggtttcaga

SEQ ID NO: 813179 - DNA, 25 bp, Mus musculus
tccatggtttctcagtgtctgttct

SEQ ID NO: 813180 - DNA, 25 bp, Mus musculus
tccatggtttctgagtgtctgttct

SEQ ID NO: 813181 - DNA, 25 bp, Mus musculus
tccatgtaagcacccaattctaaag

SEQ ID NO: 813182 - DNA, 25 bp, Mus musculus
tccatgtaagcagccaattctaaag

SEQ ID NO: 813183 - DNA, 25 bp, Mus musculus
tccatgtaaggacggtatggtatag

SEQ ID NO: 813184 - DNA, 25 bp, Mus musculus
tccatgtaaggagggtatggtatag

SEQ ID NO: 813185 - DNA, 25 bp, Mus musculus
tccatgtaattgcacagggttaaat

SEQ ID NO: 813186 - DNA, 25 bp, Mus musculus
tccatgtaattggacagggttaaat

SEQ ID NO: 813187 - DNA, 25 bp, Mus musculus
tccatgtaccccagctcaaactgat

SEQ ID NO: 813188 - DNA, 25 bp, Mus musculus
tccatgtacccctgctcaaactgat

SEQ ID NO: 813189 - DNA, 25 bp, Mus musculus
tccatgtacctaccaacctattggt

SEQ ID NO: 813190 - DNA, 25 bp, Mus musculus
tccatgtacctagcaacctattggt

SEQ ID NO: 813191 - DNA, 25 bp, Mus musculus
tccatgtatatcatcctaagggtta

SEQ ID NO: 813192 - DNA, 25 bp, Mus musculus
tccatgtatatcttcctaagggtta

SEQ ID NO: 813193 - DNA, 25 bp, Mus musculus
tccatgtatccaagtcaccataagc

SEQ ID NO: 813194 - DNA, 25 bp, Mus musculus
tccatgtatccacctagctctggta

SEQ ID NO: 813195 - DNA, 25 bp, Mus musculus
tccatgtatccagctagctctggta

SEQ ID NO: 813196 - DNA, 25 bp, Mus musculus
tccatgtatccatgtcaccataagc

SEQ ID NO: 813197 - DNA, 25 bp, Mus musculus
tccatgtatggcagattgcccatcg

SEQ ID NO: 813198 - DNA, 25 bp, Mus musculus
tccatgtatggctgattgcccatcg

SEQ ID NO: 813199 - DNA, 25 bp, Mus musculus
tccatgtatgttccatctttgaggc

SEQ ID NO: 813200 - DNA, 25 bp, Mus musculus
tccatgtatgttgcatctttgaggc

SEQ ID NO: 813201 - DNA, 25 bp, Mus musculus
tccatgtattttataggttcccata

SEQ ID NO: 813202 - DNA, 25 bp, Mus musculus
tccatgtattttttaggttcccata

SEQ ID NO: 813203 - DNA, 25 bp, Mus musculus
tccatgtcacctcaagtagctactg

SEQ ID NO: 813204 - DNA, 25 bp, Mus musculus
tccatgtcacctcgctttgggtaaa

SEQ ID NO: 813205 - DNA, 25 bp, Mus musculus
tccatgtcacctgaagtagctactg

SEQ ID NO: 813206 - DNA, 25 bp, Mus musculus
tccatgtcacctggctttgggtaaa

SEQ ID NO: 813207 - DNA, 25 bp, Mus musculus
tccatgtcagatagtccagtgtcat

SEQ ID NO: 813208 - DNA, 25 bp, Mus musculus
tccatgtcagattgtccagtgtcat

SEQ ID NO: 813209 - DNA, 25 bp, Mus musculus
tccatgtccctgcacccttaggata

SEQ ID NO: 813210 - DNA, 25 bp, Mus musculus
tccatgtccctggacccttaggata

SEQ ID NO: 813211 - DNA, 25 bp, Mus musculus
tccatgtcctcgagctgagagcaga

SEQ ID NO: 813212 - DNA, 25 bp, Mus musculus
tccatgtcctcgtgctgagagcaga

SEQ ID NO: 813213 - DNA, 25 bp, Mus musculus
tccatgtcctgcctgtatatcctac

SEQ ID NO: 813214 - DNA, 25 bp, Mus musculus
tccatgtcctgcgtgtatatcctac

SEQ ID NO: 813215 - DNA, 25 bp, Mus musculus
tccatgtcctgtcattcctgaatga

SEQ ID NO: 813216 - DNA, 25 bp, Mus musculus
tccatgtcctgtgattcctgaatga

SEQ ID NO: 813217 - DNA, 25 bp, Mus musculus
tccatgtcgtgacgccttgatccat

SEQ ID NO: 813218 - DNA, 25 bp, Mus musculus
tccatgtcgtgaggccttgatccat

SEQ ID NO: 813219 - DNA, 25 bp, Mus musculus
tccatgtctagtactcgtttttgca

SEQ ID NO: 813220 - DNA, 25 bp, Mus musculus
tccatgtctagttctcgtttttgca

SEQ ID NO: 813221 - DNA, 25 bp, Mus musculus
tccatgtctggcaggcgaatctctc

SEQ ID NO: 813222 - DNA, 25 bp, Mus musculus
tccatgtctggctggcgaatctctc

SEQ ID NO: 813223 - DNA, 25 bp, Mus musculus
tccatgtctgtgatgttgctgtgat

SEQ ID NO: 813224 - DNA, 25 bp, Mus musculus
tccatgtctgtgttgttgctgtgat

SEQ ID NO: 813225 - DNA, 25 bp, Mus musculus
tccatgtcttggctactgtgagcag

SEQ ID NO: 813226 - DNA, 25 bp, Mus musculus
tccatgtcttgggtactgtgagcag

SEQ ID NO: 813227 - DNA, 25 bp, Mus musculus
tccatgtctttgaaccgtgtcacag

SEQ ID NO: 813228 - DNA, 25 bp, Mus musculus
tccatgtctttgtaccgtgtcacag

SEQ ID NO: 813229 - DNA, 25 bp, Mus musculus
tccatgtgaggtcatttcttctatt

SEQ ID NO: 813230 - DNA, 25 bp, Mus musculus
tccatgtgaggtgatttcttctatt

SEQ ID NO: 813231 - DNA, 25 bp, Mus musculus
tccatgtgagtaccagacccagttc

SEQ ID NO: 813232 - DNA, 25 bp, Mus musculus
tccatgtgagtagcagacccagttc

SEQ ID NO: 813233 - DNA, 25 bp, Mus musculus
tccatgtgccgactgaatgtacatt

SEQ ID NO: 813234 - DNA, 25 bp, Mus musculus
tccatgtgccgagtgaatgtacatt

SEQ ID NO: 813235 - DNA, 25 bp, Mus musculus
tccatgtggcttcattccaagatga

SEQ ID NO: 813236 - DNA, 25 bp, Mus musculus
tccatgtggcttgattccaagatga

SEQ ID NO: 813237 - DNA, 25 bp, Mus musculus
tccatgtggtccctgtttgtagcaa

SEQ ID NO: 813238 - DNA, 25 bp, Mus musculus
tccatgtggtccgtgtttgtagcaa

SEQ ID NO: 813239 - DNA, 25 bp, Mus musculus
tccatgtgtatcacctccatcagta

SEQ ID NO: 813240 - DNA, 25 bp, Mus musculus
tccatgtgtatctcctccatcagta

SEQ ID NO: 813241 - DNA, 25 bp, Mus musculus
tccatgtgtcggagctccagcaaac

SEQ ID NO: 813242 - DNA, 25 bp, Mus musculus
tccatgtgtcggtgctccagcaaac

SEQ ID NO: 813243 - DNA, 25 bp, Mus musculus
tccatgtgtgcaccatggctcacac

SEQ ID NO: 813244 - DNA, 25 bp, Mus musculus
tccatgtgtgcagcatggctcacac

SEQ ID NO: 813245 - DNA, 25 bp, Mus musculus
tccatgtgtttcatagagcgggaca

SEQ ID NO: 813246 - DNA, 25 bp, Mus musculus
tccatgtgtttcttagagcgggaca

SEQ ID NO: 813247 - DNA, 25 bp, Mus musculus
tccatgttaggacctaggtctgatg

SEQ ID NO: 813248 - DNA, 25 bp, Mus musculus
tccatgttaggagctaggtctgatg

SEQ ID NO: 813249 - DNA, 25 bp, Mus musculus
tccatgttccataccgggaaggaga

SEQ ID NO: 813250 - DNA, 25 bp, Mus musculus
tccatgttccattccgggaaggaga

SEQ ID NO: 813251 - DNA, 25 bp, Mus musculus
tccatgttcccactttaaattttct

SEQ ID NO: 813252 - DNA, 25 bp, Mus musculus
tccatgttcccagtttaaattttct

SEQ ID NO: 813253 - DNA, 25 bp, Mus musculus
tccatgttcctgagatgtcccctaa

SEQ ID NO: 813254 - DNA, 25 bp, Mus musculus
tccatgttcctgtgatgtcccctaa

SEQ ID NO: 813255 - DNA, 25 bp, Mus musculus
tccatgttcttccaaggacccaaag

SEQ ID NO: 813256 - DNA, 25 bp, Mus musculus
tccatgttcttcgaaggacccaaag

SEQ ID NO: 813257 - DNA, 25 bp, Mus musculus
tccatgttctttactccagattgtg

SEQ ID NO: 813258 - DNA, 25 bp, Mus musculus
tccatgttcttttctccagattgtg

SEQ ID NO: 813259 - DNA, 25 bp, Mus musculus
tccatgttgcctacttcagatttta

SEQ ID NO: 813260 - DNA, 25 bp, Mus musculus
tccatgttgccttcttcagatttta

SEQ ID NO: 813261 - DNA, 25 bp, Mus musculus
tccatgttgttcctgctgggagaga

SEQ ID NO: 813262 - DNA, 25 bp, Mus musculus
tccatgttgttcgtgctgggagaga

SEQ ID NO: 813263 - DNA, 25 bp, Mus musculus
tccatgttttctctattcgctttag

SEQ ID NO: 813264 - DNA, 25 bp, Mus musculus
tccatgttttctgtattcgctttag

SEQ ID NO: 813265 - DNA, 25 bp, Mus musculus
tccatgttttgtcatcgagtagctc

SEQ ID NO: 813266 - DNA, 25 bp, Mus musculus
tccatgttttgtgatcgagtagctc

SEQ ID NO: 813267 - DNA, 25 bp, Mus musculus
tccattaaagagaggcttgcgtttt

SEQ ID NO: 813268 - DNA, 25 bp, Mus musculus
tccattaaagagtggcttgcgtttt

SEQ ID NO: 813269 - DNA, 25 bp, Mus musculus
tccattaagcatcgactttcccatg

SEQ ID NO: 813270 - DNA, 25 bp, Mus musculus
tccattaagcatggactttcccatg

SEQ ID NO: 813271 - DNA, 25 bp, Mus musculus
tccattaccaccctgttaggcaggt

SEQ ID NO: 813272 - DNA, 25 bp, Mus musculus
tccattaccaccgtgttaggcaggt

SEQ ID NO: 813273 - DNA, 25 bp, Mus musculus
tccattacccatactccacagaatg

SEQ ID NO: 813274 - DNA, 25 bp, Mus musculus
tccattacccattctccacagaatg

SEQ ID NO: 813275 - DNA, 25 bp, Mus musculus
tccattaccgacctgttccatataa

SEQ ID NO: 813276 - DNA, 25 bp, Mus musculus
tccattaccgacgtgttccatataa

SEQ ID NO: 813277 - DNA, 25 bp, Mus musculus
tccattacctatctattctgtgctc

SEQ ID NO: 813278 - DNA, 25 bp, Mus musculus
tccattacctatgtattctgtgctc

SEQ ID NO: 813279 - DNA, 25 bp, Mus musculus
tccattacgttcactgcgctctcag

SEQ ID NO: 813280 - DNA, 25 bp, Mus musculus
tccattacgttctctgcgctctcag

SEQ ID NO: 813281 - DNA, 25 bp, Mus musculus
tccattactaatcccaagaagaggg

SEQ ID NO: 813282 - DNA, 25 bp, Mus musculus
tccattactaatgccaagaagaggg

SEQ ID NO: 813283 - DNA, 25 bp, Mus musculus
tccattacttcccttactattcaaa

SEQ ID NO: 813284 - DNA, 25 bp, Mus musculus
tccattacttccgttactattcaaa

SEQ ID NO: 813285 - DNA, 25 bp, Mus musculus
tccattacttgcaatccatttcaca

SEQ ID NO: 813286 - DNA, 25 bp, Mus musculus
tccattacttgctatccatttcaca

SEQ ID NO: 813287 - DNA, 25 bp, Mus musculus
tccattatgaaactgctattgaaat

SEQ ID NO: 813288 - DNA, 25 bp, Mus musculus
tccattatgaaagtgctattgaaat

SEQ ID NO: 813289 - DNA, 25 bp, Mus musculus
tccattatttccctgatttcattga

SEQ ID NO: 813290 - DNA, 25 bp, Mus musculus
tccattatttccgtgatttcattga

SEQ ID NO: 813291 - DNA, 25 bp, Mus musculus
tccattatttctctcgccgtttgct

SEQ ID NO: 813292 - DNA, 25 bp, Mus musculus
tccattatttctgtcgccgtttgct

SEQ ID NO: 813293 - DNA, 25 bp, Mus musculus
tccattcacctaaatgccagggtgt

SEQ ID NO: 813294 - DNA, 25 bp, Mus musculus
tccattcacctatatgccagggtgt

SEQ ID NO: 813295 - DNA, 25 bp, Mus musculus
tccattcagatgctaaatttgctaa

SEQ ID NO: 813296 - DNA, 25 bp, Mus musculus
tccattcagatggtaaatttgctaa

SEQ ID NO: 813297 - DNA, 25 bp, Mus musculus
tccattcagggactggaaccaactc

SEQ ID NO: 813298 - DNA, 25 bp, Mus musculus
tccattcagggagtggaaccaactc

SEQ ID NO: 813299 - DNA, 25 bp, Mus musculus
tccattcatccgatgctggtaggac

SEQ ID NO: 813300 - DNA, 25 bp, Mus musculus
tccattcatccgttgctggtaggac

SEQ ID NO: 813301 - DNA, 25 bp, Mus musculus
tccattcattctctgtgcgatgttt

SEQ ID NO: 813302 - DNA, 25 bp, Mus musculus
tccattcattctgtgtgcgatgttt

SEQ ID NO: 813303 - DNA, 25 bp, Mus musculus
tccattcattgaccagcagggcagt

SEQ ID NO: 813304 - DNA, 25 bp, Mus musculus
tccattcattgagcagcagggcagt

SEQ ID NO: 813305 - DNA, 25 bp, Mus musculus
tccattccacgcagctatgttacaa

SEQ ID NO: 813306 - DNA, 25 bp, Mus musculus
tccattccacgctgctatgttacaa

SEQ ID NO: 813307 - DNA, 25 bp, Mus musculus
tccattccagacacctgaagttcca

SEQ ID NO: 813308 - DNA, 25 bp, Mus musculus
tccattccagactcctgaagttcca

SEQ ID NO: 813309 - DNA, 25 bp, Mus musculus
tccattcccaaaatcaactgcagct

SEQ ID NO: 813310 - DNA, 25 bp, Mus musculus
tccattcccaaattcaactgcagct

SEQ ID NO: 813311 - DNA, 25 bp, Mus musculus
tccattcccacaatttagagaacct

SEQ ID NO: 813312 - DNA, 25 bp, Mus musculus
tccattcccacattttagagaacct

SEQ ID NO: 813313 - DNA, 25 bp, Mus musculus
tccattcccggaagttactttgtat

SEQ ID NO: 813314 - DNA, 25 bp, Mus musculus
tccattcccggatgttactttgtat

SEQ ID NO: 813315 - DNA, 25 bp, Mus musculus
tccattcccttcaaaattccaaatc

SEQ ID NO: 813316 - DNA, 25 bp, Mus musculus
tccattcccttctaaattccaaatc

SEQ ID NO: 813317 - DNA, 25 bp, Mus musculus
tccattccggacagcattcagtcag

SEQ ID NO: 813318 - DNA, 25 bp, Mus musculus
tccattccggactgcattcagtcag

SEQ ID NO: 813319 - DNA, 25 bp, Mus musculus
tccattccgtggcatgtctgaggag

SEQ ID NO: 813320 - DNA, 25 bp, Mus musculus
tccattccgtgggatgtctgaggag

SEQ ID NO: 813321 - DNA, 25 bp, Mus musculus
tccattcctagtaagcgccacataa

SEQ ID NO: 813322 - DNA, 25 bp, Mus musculus
tccattcctagttagcgccacataa

SEQ ID NO: 813323 - DNA, 25 bp, Mus musculus
tccattcctctgcatcattaacttg

SEQ ID NO: 813324 - DNA, 25 bp, Mus musculus
tccattcctctggatcattaacttg

SEQ ID NO: 813325 - DNA, 25 bp, Mus musculus
tccattcgctatacctttgggcttt

SEQ ID NO: 813326 - DNA, 25 bp, Mus musculus
tccattcgctattcctttgggcttt

SEQ ID NO: 813327 - DNA, 25 bp, Mus musculus
tccattcgtacgagaaacggctttt

SEQ ID NO: 813328 - DNA, 25 bp, Mus musculus
tccattcgtacgtgaaacggctttt

SEQ ID NO: 813329 - DNA, 25 bp, Mus musculus
tccattcgtgtgatgcctttatgtt

SEQ ID NO: 813330 - DNA, 25 bp, Mus musculus
tccattcgtgtgttgcctttatgtt

SEQ ID NO: 813331 - DNA, 25 bp, Mus musculus
tccattctccgtcggctggcaagca

SEQ ID NO: 813332 - DNA, 25 bp, Mus musculus
tccattctccgtgggctggcaagca

SEQ ID NO: 813333 - DNA, 25 bp, Mus musculus
tccattctcttccaggacaacggag

SEQ ID NO: 813334 - DNA, 25 bp, Mus musculus
tccattctcttcgaggacaacggag

SEQ ID NO: 813335 - DNA, 25 bp, Mus musculus
tccattctgctgatctcgagattta

SEQ ID NO: 813336 - DNA, 25 bp, Mus musculus
tccattctgctgttctcgagattta

SEQ ID NO: 813337 - DNA, 25 bp, Mus musculus
tccattctggtcaggtgacaactga

SEQ ID NO: 813338 - DNA, 25 bp, Mus musculus
tccattctggtctggtgacaactga

SEQ ID NO: 813339 - DNA, 25 bp, Mus musculus
tccattcttaggaagggagagcccc

SEQ ID NO: 813340 - DNA, 25 bp, Mus musculus
tccattcttaggtagggagagcccc

SEQ ID NO: 813341 - DNA, 25 bp, Mus musculus
tccattcttcctctactgactgtga

SEQ ID NO: 813342 - DNA, 25 bp, Mus musculus
tccattcttcctgtactgactgtga

SEQ ID NO: 813343 - DNA, 25 bp, Mus musculus
tccattcttctacctatttcacatg

SEQ ID NO: 813344 - DNA, 25 bp, Mus musculus
tccattcttctagctatttcacatg

SEQ ID NO: 813345 - DNA, 25 bp, Mus musculus
tccattcttctcactcgagttttgt

SEQ ID NO: 813346 - DNA, 25 bp, Mus musculus
tccattcttctctctcgagttttgt

SEQ ID NO: 813347 - DNA, 25 bp, Mus musculus
tccattcttgggagacagggactgt

SEQ ID NO: 813348 - DNA, 25 bp, Mus musculus
tccattcttgggtgacagggactgt

SEQ ID NO: 813349 - DNA, 25 bp, Mus musculus
tccattctttttctctgccctctgg

SEQ ID NO: 813350 - DNA, 25 bp, Mus musculus
tccattctttttgtctgccctctgg

SEQ ID NO: 813351 - DNA, 25 bp, Mus musculus
tccattgacggtcgcccagaaaaaa

SEQ ID NO: 813352 - DNA, 25 bp, Mus musculus
tccattgacggtggcccagaaaaaa

SEQ ID NO: 813353 - DNA, 25 bp, Mus musculus
tccattgagagaagagcagcgtgtt

SEQ ID NO: 813354 - DNA, 25 bp, Mus musculus
tccattgagagatgagcagcgtgtt

SEQ ID NO: 813355 - DNA, 25 bp, Mus musculus
tccattgaggttagagtgggcacag

SEQ ID NO: 813356 - DNA, 25 bp, Mus musculus
tccattgaggtttgagtgggcacag

SEQ ID NO: 813357 - DNA, 25 bp, Mus musculus
tccattgataaactttttctcccca

SEQ ID NO: 813358 - DNA, 25 bp, Mus musculus
tccattgataaagtttttctcccca

SEQ ID NO: 813359 - DNA, 25 bp, Mus musculus
tccattgattccaggcctcaggcat

SEQ ID NO: 813360 - DNA, 25 bp, Mus musculus
tccattgattcctggcctcaggcat

SEQ ID NO: 813361 - DNA, 25 bp, Mus musculus
tccattgcagctcagggcttcacaa

SEQ ID NO: 813362 - DNA, 25 bp, Mus musculus
tccattgcagctgagggcttcacaa

SEQ ID NO: 813363 - DNA, 25 bp, Mus musculus
tccattgcatgtcaaacgctttggg

SEQ ID NO: 813364 - DNA, 25 bp, Mus musculus
tccattgcatgtgaaacgctttggg

SEQ ID NO: 813365 - DNA, 25 bp, Mus musculus
tccattgcattgatataggtgacat

SEQ ID NO: 813366 - DNA, 25 bp, Mus musculus
tccattgcattgttataggtgacat

SEQ ID NO: 813367 - DNA, 25 bp, Mus musculus
tccattgccataacggctcgcaaat

SEQ ID NO: 813368 - DNA, 25 bp, Mus musculus
tccattgccatatcggctcgcaaat

SEQ ID NO: 813369 - DNA, 25 bp, Mus musculus
tccattgcctatcttggtctctaaa

SEQ ID NO: 813370 - DNA, 25 bp, Mus musculus
tccattgcctatgttggtctctaaa

SEQ ID NO: 813371 - DNA, 25 bp, Mus musculus
tccattgctcgtagtaaatgtgcgc

SEQ ID NO: 813372 - DNA, 25 bp, Mus musculus
tccattgctcgttgtaaatgtgcgc

SEQ ID NO: 813373 - DNA, 25 bp, Mus musculus
tccattggaggaccccgggcaaaca

SEQ ID NO: 813374 - DNA, 25 bp, Mus musculus
tccattggaggagcccgggcaaaca

SEQ ID NO: 813375 - DNA, 25 bp, Mus musculus
tccattgggaatcttaggttttcgt

SEQ ID NO: 813376 - DNA, 25 bp, Mus musculus
tccattgggaatgttaggttttcgt

SEQ ID NO: 813377 - DNA, 25 bp, Mus musculus
tccattggtagtctgatgctcttaa

SEQ ID NO: 813378 - DNA, 25 bp, Mus musculus
tccattggtagtgtgatgctcttaa

SEQ ID NO: 813379 - DNA, 25 bp, Mus musculus
tccattggtgctactgcagatccaa

SEQ ID NO: 813380 - DNA, 25 bp, Mus musculus
tccattggtgcttctgcagatccaa

SEQ ID NO: 813381 - DNA, 25 bp, Mus musculus
tccattgtaaagcagcttcccgctt

SEQ ID NO: 813382 - DNA, 25 bp, Mus musculus
tccattgtaaaggagcttcccgctt

SEQ ID NO: 813383 - DNA, 25 bp, Mus musculus
tccattgtcacgatcaatcttgaaa

SEQ ID NO: 813384 - DNA, 25 bp, Mus musculus
tccattgtcacgttcaatcttgaaa

SEQ ID NO: 813385 - DNA, 25 bp, Mus musculus
tccattgtccaaactgagagcagca

SEQ ID NO: 813386 - DNA, 25 bp, Mus musculus
tccattgtccaatctgagagcagca

SEQ ID NO: 813387 - DNA, 25 bp, Mus musculus
tccattgtgcatcaacttcatcctt

SEQ ID NO: 813388 - DNA, 25 bp, Mus musculus
tccattgtgcatgaacttcatcctt

SEQ ID NO: 813389 - DNA, 25 bp, Mus musculus
tccattgtgctccatgtcttccaga

SEQ ID NO: 813390 - DNA, 25 bp, Mus musculus
tccattgtgctcgatgtcttccaga

SEQ ID NO: 813391 - DNA, 25 bp, Mus musculus
tccattgtgggaattctttgaacta

SEQ ID NO: 813392 - DNA, 25 bp, Mus musculus
tccattgtgggatttctttgaacta

SEQ ID NO: 813393 - DNA, 25 bp, Mus musculus
tccattgtgtatatgcaccggtttc

SEQ ID NO: 813394 - DNA, 25 bp, Mus musculus
tccattgtgtatttgcaccggtttc

SEQ ID NO: 813395 - DNA, 25 bp, Mus musculus
tccattgttttgctttctaactggg

SEQ ID NO: 813396 - DNA, 25 bp, Mus musculus
tccattgttttggtttctaactggg

SEQ ID NO: 813397 - DNA, 25 bp, Mus musculus
tccatttagagcagcttttccaccc

SEQ ID NO: 813398 - DNA, 25 bp, Mus musculus
tccatttagagctgcttttccaccc

SEQ ID NO: 813399 - DNA, 25 bp, Mus musculus
tccatttatgcactgtgacattctc

SEQ ID NO: 813400 - DNA, 25 bp, Mus musculus
tccatttatgcagtgtgacattctc

SEQ ID NO: 813401 - DNA, 25 bp, Mus musculus
tccatttcaaaaccggaatccaaag

SEQ ID NO: 813402 - DNA, 25 bp, Mus musculus
tccatttcaaaagcggaatccaaag

SEQ ID NO: 813403 - DNA, 25 bp, Mus musculus
tccatttcaaggctcaacaggttat

SEQ ID NO: 813404 - DNA, 25 bp, Mus musculus
tccatttcaagggtcaacaggttat

SEQ ID NO: 813405 - DNA, 25 bp, Mus musculus
tccatttcatgtatcagttagtcat

SEQ ID NO: 813406 - DNA, 25 bp, Mus musculus
tccatttcatgtttcagttagtcat

SEQ ID NO: 813407 - DNA, 25 bp, Mus musculus
tccatttccactcctgacatttgat

SEQ ID NO: 813408 - DNA, 25 bp, Mus musculus
tccatttccactgctgacatttgat

SEQ ID NO: 813409 - DNA, 25 bp, Mus musculus
tccatttcctaacgacaagggcaca

SEQ ID NO: 813410 - DNA, 25 bp, Mus musculus
tccatttcctaaggacaagggcaca

SEQ ID NO: 813411 - DNA, 25 bp, Mus musculus
tccatttcctgaacattgctcctaa

SEQ ID NO: 813412 - DNA, 25 bp, Mus musculus
tccatttcctgatcattgctcctaa

SEQ ID NO: 813413 - DNA, 25 bp, Mus musculus
tccatttccttcctgtgacttggaa

SEQ ID NO: 813414 - DNA, 25 bp, Mus musculus
tccatttccttcgtgtgacttggaa

SEQ ID NO: 813415 - DNA, 25 bp, Mus musculus
tccatttcttcaagctcctagtgag

SEQ ID NO: 813416 - DNA, 25 bp, Mus musculus
tccatttcttcatgctcctagtgag

SEQ ID NO: 813417 - DNA, 25 bp, Mus musculus
tccatttgacataagggcctttcca

SEQ ID NO: 813418 - DNA, 25 bp, Mus musculus
tccatttgacattagggcctttcca

SEQ ID NO: 813419 - DNA, 25 bp, Mus musculus
tccatttgaggcatatccataacta

SEQ ID NO: 813420 - DNA, 25 bp, Mus musculus
tccatttgaggcttatccataacta

SEQ ID NO: 813421 - DNA, 25 bp, Mus musculus
tccatttgcagtcgagaaagccttt

SEQ ID NO: 813422 - DNA, 25 bp, Mus musculus
tccatttgcagtggagaaagccttt

SEQ ID NO: 813423 - DNA, 25 bp, Mus musculus
tccatttgccatattatttcccttt

SEQ ID NO: 813424 - DNA, 25 bp, Mus musculus
tccatttgccattttatttcccttt

SEQ ID NO: 813425 - DNA, 25 bp, Mus musculus
tccatttgccctacatagaagatcc

SEQ ID NO: 813426 - DNA, 25 bp, Mus musculus
tccatttgcccttcatagaagatcc

SEQ ID NO: 813427 - DNA, 25 bp, Mus musculus
tccatttgctacatgctgtcataaa

SEQ ID NO: 813428 - DNA, 25 bp, Mus musculus
tccatttgctacttgctgtcataaa

SEQ ID NO: 813429 - DNA, 25 bp, Mus musculus
tccatttgctctcctggaggttgta

SEQ ID NO: 813430 - DNA, 25 bp, Mus musculus
tccatttgctctgctggaggttgta

SEQ ID NO: 813431 - DNA, 25 bp, Mus musculus
tccatttgctggatcttaaatcggg

SEQ ID NO: 813432 - DNA, 25 bp, Mus musculus
tccatttgctggttcttaaatcggg

SEQ ID NO: 813433 - DNA, 25 bp, Mus musculus
tccatttgctttagtgagtgctctt

SEQ ID NO: 813434 - DNA, 25 bp, Mus musculus
tccatttgcttttgtgagtgctctt

SEQ ID NO: 813435 - DNA, 25 bp, Mus musculus
tccatttggaacattgcccagctct

SEQ ID NO: 813436 - DNA, 25 bp, Mus musculus
tccatttggaactttgcccagctct

SEQ ID NO: 813437 - DNA, 25 bp, Mus musculus
tccatttggatcacttacagcattg

SEQ ID NO: 813438 - DNA, 25 bp, Mus musculus
tccatttggatctcttacagcattg

SEQ ID NO: 813439 - DNA, 25 bp, Mus musculus
tccatttggatgagagcaggcgcag

SEQ ID NO: 813440 - DNA, 25 bp, Mus musculus
tccatttggatgtgagcaggcgcag

SEQ ID NO: 813441 - DNA, 25 bp, Mus musculus
tccatttgggagcagcggctacctt

SEQ ID NO: 813442 - DNA, 25 bp, Mus musculus
tccatttgggaggagcggctacctt

SEQ ID NO: 813443 - DNA, 25 bp, Mus musculus
tccatttgggcaagagccggcataa

SEQ ID NO: 813444 - DNA, 25 bp, Mus musculus
tccatttgggcatgagccggcataa

SEQ ID NO: 813445 - DNA, 25 bp, Mus musculus
tccatttgggtcatgcgcgccctga

SEQ ID NO: 813446 - DNA, 25 bp, Mus musculus
tccatttgggtcttgcgcgccctga

SEQ ID NO: 813447 - DNA, 25 bp, Mus musculus
tccatttgggtgacccgagggtttg

SEQ ID NO: 813448 - DNA, 25 bp, Mus musculus
tccatttgggtgtcccgagggtttg

SEQ ID NO: 813449 - DNA, 25 bp, Mus musculus
tccattttaaatcctgccgctttca

SEQ ID NO: 813450 - DNA, 25 bp, Mus musculus
tccattttaaatgctgccgctttca

SEQ ID NO: 813451 - DNA, 25 bp, Mus musculus
tccattttagaacaggcagccatgt

SEQ ID NO: 813452 - DNA, 25 bp, Mus musculus
tccattttagaagaggcagccatgt

SEQ ID NO: 813453 - DNA, 25 bp, Mus musculus
tccattttagccaccttgtaagaaa

SEQ ID NO: 813454 - DNA, 25 bp, Mus musculus
tccattttagcctccttgtaagaaa

SEQ ID NO: 813455 - DNA, 25 bp, Mus musculus
tccattttcacaccagcatggtagt

SEQ ID NO: 813456 - DNA, 25 bp, Mus musculus
tccattttcacagcagcatggtagt

SEQ ID NO: 813457 - DNA, 25 bp, Mus musculus
tccattttcactattctccctgaaa

SEQ ID NO: 813458 - DNA, 25 bp, Mus musculus
tccattttcacttttctccctgaaa

SEQ ID NO: 813459 - DNA, 25 bp, Mus musculus
tccattttcattcattagccagtgt

SEQ ID NO: 813460 - DNA, 25 bp, Mus musculus
tccattttcattgattagccagtgt

SEQ ID NO: 813461 - DNA, 25 bp, Mus musculus
tccattttcctaaagacatcaccat

SEQ ID NO: 813462 - DNA, 25 bp, Mus musculus
tccattttcctaatgtggcggtaat

SEQ ID NO: 813463 - DNA, 25 bp, Mus musculus
tccattttcctatagacatcaccat

SEQ ID NO: 813464 - DNA, 25 bp, Mus musculus
tccattttcctattgtggcggtaat

SEQ ID NO: 813465 - DNA, 25 bp, Mus musculus
tccattttctggaactccctctcat

SEQ ID NO: 813466 - DNA, 25 bp, Mus musculus
tccattttctggtactccctctcat

SEQ ID NO: 813467 - DNA, 25 bp, Mus musculus
tccattttgtacattaacctcctca

SEQ ID NO: 813468 - DNA, 25 bp, Mus musculus
tccattttgtactttaacctcctca

SEQ ID NO: 813469 - DNA, 25 bp, Mus musculus
tccatttttcacatcccacaaagat

SEQ ID NO: 813470 - DNA, 25 bp, Mus musculus
tccatttttcacttcccacaaagat

SEQ ID NO: 813471 - DNA, 25 bp, Mus musculus
tccattttttatagacttcagtgaa

SEQ ID NO: 813472 - DNA, 25 bp, Mus musculus
tccattttttattgacttcagtgaa

SEQ ID NO: 813473 - DNA, 25 bp, Mus musculus
tcccaaaaaagcagctgtggccaaa

SEQ ID NO: 813474 - DNA, 25 bp, Mus musculus
tcccaaaaaagctgctgtggccaaa

SEQ ID NO: 813475 - DNA, 25 bp, Mus musculus
tcccaaaagcaccgagacttcgtgg

SEQ ID NO: 813476 - DNA, 25 bp, Mus musculus
tcccaaaagcacggagacttcgtgg

SEQ ID NO: 813477 - DNA, 25 bp, Mus musculus
tcccaaaagccaactgcagctgatg

SEQ ID NO: 813478 - DNA, 25 bp, Mus musculus
tcccaaaagccatctgcagctgatg

SEQ ID NO: 813479 - DNA, 25 bp, Mus musculus
tcccaaaagggtccatacaaatcaa

SEQ ID NO: 813480 - DNA, 25 bp, Mus musculus
tcccaaaagggtgcatacaaatcaa

SEQ ID NO: 813481 - DNA, 25 bp, Mus musculus
tcccaaaatccgacatttcattacg

SEQ ID NO: 813482 - DNA, 25 bp, Mus musculus
tcccaaaatccgtcatttcattacg

SEQ ID NO: 813483 - DNA, 25 bp, Mus musculus
tcccaaaccaacacttctggcgaat

SEQ ID NO: 813484 - DNA, 25 bp, Mus musculus
tcccaaaccaactcttctggcgaat

SEQ ID NO: 813485 - DNA, 25 bp, Mus musculus
tcccaaacccagctggtgctaagtg

SEQ ID NO: 813486 - DNA, 25 bp, Mus musculus
tcccaaacccaggtggtgctaagtg

SEQ ID NO: 813487 - DNA, 25 bp, Mus musculus
tcccaaactagcattaaacttgctt

SEQ ID NO: 813488 - DNA, 25 bp, Mus musculus
tcccaaactagctttaaacttgctt

SEQ ID NO: 813489 - DNA, 25 bp, Mus musculus
tcccaaactatgcatctcactgaag

SEQ ID NO: 813490 - DNA, 25 bp, Mus musculus
tcccaaactatggatctcactgaag

SEQ ID NO: 813491 - DNA, 25 bp, Mus musculus
tcccaaagacatcatatggcaagca

SEQ ID NO: 813492 - DNA, 25 bp, Mus musculus
tcccaaagacatgatatggcaagca

SEQ ID NO: 813493 - DNA, 25 bp, Mus musculus
tcccaaagatgtcaacgcggctatt

SEQ ID NO: 813494 - DNA, 25 bp, Mus musculus
tcccaaagatgtgaacgcggctatt

SEQ ID NO: 813495 - DNA, 25 bp, Mus musculus
tcccaaagcattctggcatcagttt

SEQ ID NO: 813496 - DNA, 25 bp, Mus musculus
tcccaaagcattgtggcatcagttt

SEQ ID NO: 813497 - DNA, 25 bp, Mus musculus
tcccaaagctggcaagtgagtcctc

SEQ ID NO: 813498 - DNA, 25 bp, Mus musculus
tcccaaagctgggaagtgagtcctc

SEQ ID NO: 813499 - DNA, 25 bp, Mus musculus
tcccaaagggaacccaggagtctct

SEQ ID NO: 813500 - DNA, 25 bp, Mus musculus
tcccaaagggaagccaggagtctct

SEQ ID NO: 813501 - DNA, 25 bp, Mus musculus
tcccaaagtttgatgcctctatatg

SEQ ID NO: 813502 - DNA, 25 bp, Mus musculus
tcccaaagtttgttgcctctatatg

SEQ ID NO: 813503 - DNA, 25 bp, Mus musculus
tcccaaataaggcatcagcaggctt

SEQ ID NO: 813504 - DNA, 25 bp, Mus musculus
tcccaaataagggatcagcaggctt

SEQ ID NO: 813505 - DNA, 25 bp, Mus musculus
tcccaaatattcacattccaggcag

SEQ ID NO: 813506 - DNA, 25 bp, Mus musculus
tcccaaatattctcattccaggcag

SEQ ID NO: 813507 - DNA, 25 bp, Mus musculus
tcccaaatccacaaagcctacttta

SEQ ID NO: 813508 - DNA, 25 bp, Mus musculus
tcccaaatccactaagcctacttta

SEQ ID NO: 813509 - DNA, 25 bp, Mus musculus
tcccaaatctggactgcagctgtgg

SEQ ID NO: 813510 - DNA, 25 bp, Mus musculus
tcccaaatctggtctgcagctgtgg

SEQ ID NO: 813511 - DNA, 25 bp, Mus musculus
tcccaaatctgtcgtgtgcgcattc

SEQ ID NO: 813512 - DNA, 25 bp, Mus musculus
tcccaaatctgtggtgtgcgcattc

SEQ ID NO: 813513 - DNA, 25 bp, Mus musculus
tcccaacacgctagatgtttgccct

SEQ ID NO: 813514 - DNA, 25 bp, Mus musculus
tcccaacacgcttgatgtttgccct

SEQ ID NO: 813515 - DNA, 25 bp, Mus musculus
tcccaacactggctgaagcagcagc

SEQ ID NO: 813516 - DNA, 25 bp, Mus musculus
tcccaacactgggtgaagcagcagc

SEQ ID NO: 813517 - DNA, 25 bp, Mus musculus
tcccaacacttcacttaggtagaag

SEQ ID NO: 813518 - DNA, 25 bp, Mus musculus
tcccaacacttctcttaggtagaag

SEQ ID NO: 813519 - DNA, 25 bp, Mus musculus
tcccaacagcctataactacagcaa

SEQ ID NO: 813520 - DNA, 25 bp, Mus musculus
tcccaacagcctttaactacagcaa

SEQ ID NO: 813521 - DNA, 25 bp, Mus musculus
tcccaacaggttctatttctcagca

SEQ ID NO: 813522 - DNA, 25 bp, Mus musculus
tcccaacaggttgtatttctcagca

SEQ ID NO: 813523 - DNA, 25 bp, Mus musculus
tcccaacagtggaatgtaagggcac

SEQ ID NO: 813524 - DNA, 25 bp, Mus musculus
tcccaacagtggtatgtaagggcac

SEQ ID NO: 813525 - DNA, 25 bp, Mus musculus
tcccaacatgtaagagtctgacgtt

SEQ ID NO: 813526 - DNA, 25 bp, Mus musculus
tcccaacatgtatgagtctgacgtt

SEQ ID NO: 813527 - DNA, 25 bp, Mus musculus
tcccaaccacttagaaatgcaaaaa

SEQ ID NO: 813528 - DNA, 25 bp, Mus musculus
tcccaaccactttgaaatgcaaaaa

SEQ ID NO: 813529 - DNA, 25 bp, Mus musculus
tcccaaccatctaatgacaccaaaa

SEQ ID NO: 813530 - DNA, 25 bp, Mus musculus
tcccaaccatcttatgacaccaaaa

SEQ ID NO: 813531 - DNA, 25 bp, Mus musculus
tcccaaccatgaagctgacaccatg

SEQ ID NO: 813532 - DNA, 25 bp, Mus musculus
tcccaaccatgatgctgacaccatg

SEQ ID NO: 813533 - DNA, 25 bp, Mus musculus
tcccaacccacaactgtagttgatt

SEQ ID NO: 813534 - DNA, 25 bp, Mus musculus
tcccaacccacatctgtagttgatt

SEQ ID NO: 813535 - DNA, 25 bp, Mus musculus
tcccaaccctacattagacaacagg

SEQ ID NO: 813536 - DNA, 25 bp, Mus musculus
tcccaaccctactttagacaacagg

SEQ ID NO: 813537 - DNA, 25 bp, Mus musculus
tcccaaccctgaagtcgtttacata

SEQ ID NO: 813538 - DNA, 25 bp, Mus musculus
tcccaaccctgatgtcgtttacata

SEQ ID NO: 813539 - DNA, 25 bp, Mus musculus
tcccaacctcaacctcagaattata

SEQ ID NO: 813540 - DNA, 25 bp, Mus musculus
tcccaacctcaagctcagaattata

SEQ ID NO: 813541 - DNA, 25 bp, Mus musculus
tcccaacctgatatctgcatcctga

SEQ ID NO: 813542 - DNA, 25 bp, Mus musculus
tcccaacctgatttctgcatcctga

SEQ ID NO: 813543 - DNA, 25 bp, Mus musculus
tcccaacctgggaagagatgaaagg

SEQ ID NO: 813544 - DNA, 25 bp, Mus musculus
tcccaacctgggtagagatgaaagg

SEQ ID NO: 813545 - DNA, 25 bp, Mus musculus
tcccaacgctgaagcggtcagactg

SEQ ID NO: 813546 - DNA, 25 bp, Mus musculus
tcccaacgctgatgcggtcagactg

SEQ ID NO: 813547 - DNA, 25 bp, Mus musculus
tcccaactacagctggctgttgaca

SEQ ID NO: 813548 - DNA, 25 bp, Mus musculus
tcccaactacaggtggctgttgaca

SEQ ID NO: 813549 - DNA, 25 bp, Mus musculus
tcccaactagcacttgaaacagtgt

SEQ ID NO: 813550 - DNA, 25 bp, Mus musculus
tcccaactagcagttgaaacagtgt

SEQ ID NO: 813551 - DNA, 25 bp, Mus musculus
tcccaactcagtctgcaaaccagta

SEQ ID NO: 813552 - DNA, 25 bp, Mus musculus
tcccaactcagtgtgcaaaccagta

SEQ ID NO: 813553 - DNA, 25 bp, Mus musculus
tcccaactcatgcacaagctgttag

SEQ ID NO: 813554 - DNA, 25 bp, Mus musculus
tcccaactcatggacaagctgttag

SEQ ID NO: 813555 - DNA, 25 bp, Mus musculus
tcccaactctagactattatcccat

SEQ ID NO: 813556 - DNA, 25 bp, Mus musculus
tcccaactctagtctattatcccat

SEQ ID NO: 813557 - DNA, 25 bp, Mus musculus
tcccaactctggcttgtcaagtgtt

SEQ ID NO: 813558 - DNA, 25 bp, Mus musculus
tcccaactctgggttgtcaagtgtt

SEQ ID NO: 813559 - DNA, 25 bp, Mus musculus
tcccaactgctgctaattcctgatg

SEQ ID NO: 813560 - DNA, 25 bp, Mus musculus
tcccaactgctggtaattcctgatg

SEQ ID NO: 813561 - DNA, 25 bp, Mus musculus
tcccaactggctccactgttttaaa

SEQ ID NO: 813562 - DNA, 25 bp, Mus musculus
tcccaactggctgcactgttttaaa

SEQ ID NO: 813563 - DNA, 25 bp, Mus musculus
tcccaactgtagcacctttcatcta

SEQ ID NO: 813564 - DNA, 25 bp, Mus musculus
tcccaactgtaggacctttcatcta

SEQ ID NO: 813565 - DNA, 25 bp, Mus musculus
tcccaacttgaaagtctagaatgtg

SEQ ID NO: 813566 - DNA, 25 bp, Mus musculus
tcccaacttgaatgtctagaatgtg

SEQ ID NO: 813567 - DNA, 25 bp, Mus musculus
tcccaagaacacacctacaagctta

SEQ ID NO: 813568 - DNA, 25 bp, Mus musculus
tcccaagaacactcctacaagctta

SEQ ID NO: 813569 - DNA, 25 bp, Mus musculus
tcccaagaacctatccgttggagtg

SEQ ID NO: 813570 - DNA, 25 bp, Mus musculus
tcccaagaacctttccgttggagtg

SEQ ID NO: 813571 - DNA, 25 bp, Mus musculus
tcccaagaaggactcctcgtgctga

SEQ ID NO: 813572 - DNA, 25 bp, Mus musculus
tcccaagaaggagtcctcgtgctga

SEQ ID NO: 813573 - DNA, 25 bp, Mus musculus
tcccaagaagttatcccttagccgg

SEQ ID NO: 813574 - DNA, 25 bp, Mus musculus
tcccaagaagttttcccttagccgg

SEQ ID NO: 813575 - DNA, 25 bp, Mus musculus
tcccaagacgggattatacacgtag

SEQ ID NO: 813576 - DNA, 25 bp, Mus musculus
tcccaagacgggtttatacacgtag

SEQ ID NO: 813577 - DNA, 25 bp, Mus musculus
tcccaagaggcccacatggcattca

SEQ ID NO: 813578 - DNA, 25 bp, Mus musculus
tcccaagaggccgacatggcattca

SEQ ID NO: 813579 - DNA, 25 bp, Mus musculus
tcccaagagtacaccatactgaata

SEQ ID NO: 813580 - DNA, 25 bp, Mus musculus
tcccaagagtactccatactgaata

SEQ ID NO: 813581 - DNA, 25 bp, Mus musculus
tcccaagcaacaatcgtgctgggcg

SEQ ID NO: 813582 - DNA, 25 bp, Mus musculus
tcccaagcaacattcgtgctgggcg

SEQ ID NO: 813583 - DNA, 25 bp, Mus musculus
tcccaagccatgctattcgtggtta

SEQ ID NO: 813584 - DNA, 25 bp, Mus musculus
tcccaagccatggtattcgtggtta

SEQ ID NO: 813585 - DNA, 25 bp, Mus musculus
tcccaagcccaaaacaacctgagtt

SEQ ID NO: 813586 - DNA, 25 bp, Mus musculus
tcccaagcccaatacaacctgagtt

SEQ ID NO: 813587 - DNA, 25 bp, Mus musculus
tcccaagctaccagcgaggacagtg

SEQ ID NO: 813588 - DNA, 25 bp, Mus musculus
tcccaagctacctgcgaggacagtg

SEQ ID NO: 813589 - DNA, 25 bp, Mus musculus
tcccaagctagtatcccacaataat

SEQ ID NO: 813590 - DNA, 25 bp, Mus musculus
tcccaagctagtttcccacaataat

SEQ ID NO: 813591 - DNA, 25 bp, Mus musculus
tcccaagctattacagcaaaggcat

SEQ ID NO: 813592 - DNA, 25 bp, Mus musculus
tcccaagctatttcagcaaaggcat

SEQ ID NO: 813593 - DNA, 25 bp, Mus musculus
tcccaagctcttcagagcaagcaca

SEQ ID NO: 813594 - DNA, 25 bp, Mus musculus
tcccaagctcttgagagcaagcaca

SEQ ID NO: 813595 - DNA, 25 bp, Mus musculus
tcccaaggagcgctgtatctacata

SEQ ID NO: 813596 - DNA, 25 bp, Mus musculus
tcccaaggagcggtgtatctacata

SEQ ID NO: 813597 - DNA, 25 bp, Mus musculus
tcccaaggatgaactggactatttg

SEQ ID NO: 813598 - DNA, 25 bp, Mus musculus
tcccaaggatgatctggactatttg

SEQ ID NO: 813599 - DNA, 25 bp, Mus musculus
tcccaaggcgacatctgcagagagg

SEQ ID NO: 813600 - DNA, 25 bp, Mus musculus
tcccaaggcgacttctgcagagagg

SEQ ID NO: 813601 - DNA, 25 bp, Mus musculus
tcccaagggaagagggtagcttctc

SEQ ID NO: 813602 - DNA, 25 bp, Mus musculus
tcccaagggaagtgggtagcttctc

SEQ ID NO: 813603 - DNA, 25 bp, Mus musculus
tcccaagggatgatgtcgccgtggc

SEQ ID NO: 813604 - DNA, 25 bp, Mus musculus
tcccaagggatgttgtcgccgtggc

SEQ ID NO: 813605 - DNA, 25 bp, Mus musculus
tcccaagggccacacggagagttta

SEQ ID NO: 813606 - DNA, 25 bp, Mus musculus
tcccaagggccagacggagagttta

SEQ ID NO: 813607 - DNA, 25 bp, Mus musculus
tcccaagggccccttctgttctgaa

SEQ ID NO: 813608 - DNA, 25 bp, Mus musculus
tcccaagggcccgttctgttctgaa

SEQ ID NO: 813609 - DNA, 25 bp, Mus musculus
tcccaagggcctaaaagccagtaag

SEQ ID NO: 813610 - DNA, 25 bp, Mus musculus
tcccaagggccttaaagccagtaag

SEQ ID NO: 813611 - DNA, 25 bp, Mus musculus
tcccaagtacccagaacaatattta

SEQ ID NO: 813612 - DNA, 25 bp, Mus musculus
tcccaagtaccctgaacaatattta

SEQ ID NO: 813613 - DNA, 25 bp, Mus musculus
tcccaagtcctcagcggagagaact

SEQ ID NO: 813614 - DNA, 25 bp, Mus musculus
tcccaagtcctctgcggagagaact

SEQ ID NO: 813615 - DNA, 25 bp, Mus musculus
tcccaagtcggtattttagctatct

SEQ ID NO: 813616 - DNA, 25 bp, Mus musculus
tcccaagtcggttttttagctatct

SEQ ID NO: 813617 - DNA, 25 bp, Mus musculus
tcccaagtctcccatggaaagttgg

SEQ ID NO: 813618 - DNA, 25 bp, Mus musculus
tcccaagtctccgatggaaagttgg

SEQ ID NO: 813619 - DNA, 25 bp, Mus musculus
tcccaagtctgtcctcttgaataat

SEQ ID NO: 813620 - DNA, 25 bp, Mus musculus
tcccaagtctgtgctcttgaataat

SEQ ID NO: 813621 - DNA, 25 bp, Mus musculus
tcccaagtgaatcacagccacgcgt

SEQ ID NO: 813622 - DNA, 25 bp, Mus musculus
tcccaagtgaatgacagccacgcgt

SEQ ID NO: 813623 - DNA, 25 bp, Mus musculus
tcccaagtggagatgtaatggctat

SEQ ID NO: 813624 - DNA, 25 bp, Mus musculus
tcccaagtggagttgtaatggctat

SEQ ID NO: 813625 - DNA, 25 bp, Mus musculus
tcccaagtgtctcaactgttttcaa

SEQ ID NO: 813626 - DNA, 25 bp, Mus musculus
tcccaagtgtctgaactgttttcaa

SEQ ID NO: 813627 - DNA, 25 bp, Mus musculus
tcccaagttaccaggaaacacgaat

SEQ ID NO: 813628 - DNA, 25 bp, Mus musculus
tcccaagttacctggaaacacgaat

SEQ ID NO: 813629 - DNA, 25 bp, Mus musculus
tcccaagtttggattctgacctgaa

SEQ ID NO: 813630 - DNA, 25 bp, Mus musculus
tcccaagtttggtttctgacctgaa

SEQ ID NO: 813631 - DNA, 25 bp, Mus musculus
tcccaagtttgtcccattcgagacc

SEQ ID NO: 813632 - DNA, 25 bp, Mus musculus
tcccaagtttgtgccattcgagacc

SEQ ID NO: 813633 - DNA, 25 bp, Mus musculus
tcccaagttttgctgatttttgtaa

SEQ ID NO: 813634 - DNA, 25 bp, Mus musculus
tcccaagttttggtgatttttgtaa

SEQ ID NO: 813635 - DNA, 25 bp, Mus musculus
tcccaataaattcaggtcctcgctt

SEQ ID NO: 813636 - DNA, 25 bp, Mus musculus
tcccaataaattgaggtcctcgctt

SEQ ID NO: 813637 - DNA, 25 bp, Mus musculus
tcccaataggcgcaactggttttct

SEQ ID NO: 813638 - DNA, 25 bp, Mus musculus
tcccaataggcggaactggttttct

SEQ ID NO: 813639 - DNA, 25 bp, Mus musculus
tcccaatattggaattgtacccctc

SEQ ID NO: 813640 - DNA, 25 bp, Mus musculus
tcccaatattggtattgtacccctc

SEQ ID NO: 813641 - DNA, 25 bp, Mus musculus
tcccaatccattccttaagctttta

SEQ ID NO: 813642 - DNA, 25 bp, Mus musculus
tcccaatccattgcttaagctttta

SEQ ID NO: 813643 - DNA, 25 bp, Mus musculus
tcccaatctgtaattgtccaaaatt

SEQ ID NO: 813644 - DNA, 25 bp, Mus musculus
tcccaatctgtatttgtccaaaatt

SEQ ID NO: 813645 - DNA, 25 bp, Mus musculus
tcccaatgactgaagctgctcggtg

SEQ ID NO: 813646 - DNA, 25 bp, Mus musculus
tcccaatgactgtagctgctcggtg

SEQ ID NO: 813647 - DNA, 25 bp, Mus musculus
tcccaatgccagatttgtacggtgt

SEQ ID NO: 813648 - DNA, 25 bp, Mus musculus
tcccaatgccagttttgtacggtgt

SEQ ID NO: 813649 - DNA, 25 bp, Mus musculus
tcccaatgcttgcatgtttgattcc

SEQ ID NO: 813650 - DNA, 25 bp, Mus musculus
tcccaatgcttggatgtttgattcc

SEQ ID NO: 813651 - DNA, 25 bp, Mus musculus
tcccaatgtaatcgtccaggaggct

SEQ ID NO: 813652 - DNA, 25 bp, Mus musculus
tcccaatgtaatggtccaggaggct

SEQ ID NO: 813653 - DNA, 25 bp, Mus musculus
tcccaatgtgtgagcattaggctgc

SEQ ID NO: 813654 - DNA, 25 bp, Mus musculus
tcccaatgtgtgtgcattaggctgc

SEQ ID NO: 813655 - DNA, 25 bp, Mus musculus
tcccaattaggaagtgcaacagctg

SEQ ID NO: 813656 - DNA, 25 bp, Mus musculus
tcccaattaggatgtgcaacagctg

SEQ ID NO: 813657 - DNA, 25 bp, Mus musculus
tcccaattcggacaacagcggcaat

SEQ ID NO: 813658 - DNA, 25 bp, Mus musculus
tcccaattcggagaacagcggcaat

SEQ ID NO: 813659 - DNA, 25 bp, Mus musculus
tcccaatttgtgagtgtcctcctgt

SEQ ID NO: 813660 - DNA, 25 bp, Mus musculus
tcccaatttgtgtgtgtcctcctgt

SEQ ID NO: 813661 - DNA, 25 bp, Mus musculus
tcccacaaacagcacaggttctgca

SEQ ID NO: 813662 - DNA, 25 bp, Mus musculus
tcccacaaacaggacaggttctgca

SEQ ID NO: 813663 - DNA, 25 bp, Mus musculus
tcccacaacaggaggaattctgaaa

SEQ ID NO: 813664 - DNA, 25 bp, Mus musculus
tcccacaacaggtggaattctgaaa

SEQ ID NO: 813665 - DNA, 25 bp, Mus musculus
tcccacaacatccttatatactcaa

SEQ ID NO: 813666 - DNA, 25 bp, Mus musculus
tcccacaacatcgttatatactcaa

SEQ ID NO: 813667 - DNA, 25 bp, Mus musculus
tcccacaaggtgcatccctggcaaa

SEQ ID NO: 813668 - DNA, 25 bp, Mus musculus
tcccacaaggtggatccctggcaaa

SEQ ID NO: 813669 - DNA, 25 bp, Mus musculus
tcccacaagtaccattaaactccat

SEQ ID NO: 813670 - DNA, 25 bp, Mus musculus
tcccacaagtacgattaaactccat

SEQ ID NO: 813671 - DNA, 25 bp, Mus musculus
tcccacaatattacacttacagaaa

SEQ ID NO: 813672 - DNA, 25 bp, Mus musculus
tcccacaatatttcacttacagaaa

SEQ ID NO: 813673 - DNA, 25 bp, Mus musculus
tcccacaatcctagtgtccagaatc

SEQ ID NO: 813674 - DNA, 25 bp, Mus musculus
tcccacaatccttgtgtccagaatc

SEQ ID NO: 813675 - DNA, 25 bp, Mus musculus
tcccacaattatcacaatgtagtca

SEQ ID NO: 813676 - DNA, 25 bp, Mus musculus
tcccacaattatgacaatgtagtca

SEQ ID NO: 813677 - DNA, 25 bp, Mus musculus
tcccacacaaccactgtaaggcata

SEQ ID NO: 813678 - DNA, 25 bp, Mus musculus
tcccacacaacctctgtaaggcata

SEQ ID NO: 813679 - DNA, 25 bp, Mus musculus
tcccacacaaggagctgcggttcat

SEQ ID NO: 813680 - DNA, 25 bp, Mus musculus
tcccacacaaggtgctgcggttcat

SEQ ID NO: 813681 - DNA, 25 bp, Mus musculus
tcccacacaggtctcacgactaatg

SEQ ID NO: 813682 - DNA, 25 bp, Mus musculus
tcccacacaggtgtcacgactaatg

SEQ ID NO: 813683 - DNA, 25 bp, Mus musculus
tcccacaccattaacctacaataat

SEQ ID NO: 813684 - DNA, 25 bp, Mus musculus
tcccacaccatttacctacaataat

SEQ ID NO: 813685 - DNA, 25 bp, Mus musculus
tcccacaccgtcacatactaatgaa

SEQ ID NO: 813686 - DNA, 25 bp, Mus musculus
tcccacaccgtctcatactaatgaa

SEQ ID NO: 813687 - DNA, 25 bp, Mus musculus
tcccacactagtcctgaaagcattg

SEQ ID NO: 813688 - DNA, 25 bp, Mus musculus
tcccacactagtgctgaaagcattg

SEQ ID NO: 813689 - DNA, 25 bp, Mus musculus
tcccacactctgctgactcttgacc

SEQ ID NO: 813690 - DNA, 25 bp, Mus musculus
tcccacactctggtgactcttgacc

SEQ ID NO: 813691 - DNA, 25 bp, Mus musculus
tcccacacttctctggacatgtagg

SEQ ID NO: 813692 - DNA, 25 bp, Mus musculus
tcccacacttctgtggacatgtagg

SEQ ID NO: 813693 - DNA, 25 bp, Mus musculus
tcccacacttgtaaggctgaatcag

SEQ ID NO: 813694 - DNA, 25 bp, Mus musculus
tcccacacttgttaggctgaatcag

SEQ ID NO: 813695 - DNA, 25 bp, Mus musculus
tcccacagacctctcagtgatgatt

SEQ ID NO: 813696 - DNA, 25 bp, Mus musculus
tcccacagacctgtcagtgatgatt

SEQ ID NO: 813697 - DNA, 25 bp, Mus musculus
tcccacagatcacgtggagactgga

SEQ ID NO: 813698 - DNA, 25 bp, Mus musculus
tcccacagatcaggtggagactgga

SEQ ID NO: 813699 - DNA, 25 bp, Mus musculus
tcccacagcatgacttctgactata

SEQ ID NO: 813700 - DNA, 25 bp, Mus musculus
tcccacagcatgtcttctgactata

SEQ ID NO: 813701 - DNA, 25 bp, Mus musculus
tcccacagcggcaacgtttgaaacg

SEQ ID NO: 813702 - DNA, 25 bp, Mus musculus
tcccacagcggctacgtttgaaacg

SEQ ID NO: 813703 - DNA, 25 bp, Mus musculus
tcccacagctcaagtggccattaat

SEQ ID NO: 813704 - DNA, 25 bp, Mus musculus
tcccacagctcatgtggccattaat

SEQ ID NO: 813705 - DNA, 25 bp, Mus musculus
tcccacagtccaagattggtgagct

SEQ ID NO: 813706 - DNA, 25 bp, Mus musculus
tcccacagtccatgattggtgagct

SEQ ID NO: 813707 - DNA, 25 bp, Mus musculus
tcccacagtgcgagcagatcaacat

SEQ ID NO: 813708 - DNA, 25 bp, Mus musculus
tcccacagtgcgtgcagatcaacat

SEQ ID NO: 813709 - DNA, 25 bp, Mus musculus
tcccacataaatagatgtgcagcat

SEQ ID NO: 813710 - DNA, 25 bp, Mus musculus
tcccacataaattgatgtgcagcat

SEQ ID NO: 813711 - DNA, 25 bp, Mus musculus
tcccacatcaaccattagtggagaa

SEQ ID NO: 813712 - DNA, 25 bp, Mus musculus
tcccacatcaacgattagtggagaa

SEQ ID NO: 813713 - DNA, 25 bp, Mus musculus
tcccacatgctaagattaatggcaa

SEQ ID NO: 813714 - DNA, 25 bp, Mus musculus
tcccacatgctatgattaatggcaa

SEQ ID NO: 813715 - DNA, 25 bp, Mus musculus
tcccacatgtagatagcctgctcag

SEQ ID NO: 813716 - DNA, 25 bp, Mus musculus
tcccacatgtagttagcctgctcag

SEQ ID NO: 813717 - DNA, 25 bp, Mus musculus
tcccacatttgcagccagaatcaac

SEQ ID NO: 813718 - DNA, 25 bp, Mus musculus
tcccacatttgctgccagaatcaac

SEQ ID NO: 813719 - DNA, 25 bp, Mus musculus
tcccaccaacttaaaacctggattg

SEQ ID NO: 813720 - DNA, 25 bp, Mus musculus
tcccaccaactttaaacctggattg

SEQ ID NO: 813721 - DNA, 25 bp, Mus musculus
tcccaccaagaacatgacagacatt

SEQ ID NO: 813722 - DNA, 25 bp, Mus musculus
tcccaccaagaagatgacagacatt

SEQ ID NO: 813723 - DNA, 25 bp, Mus musculus
tcccaccacagactgagttcctgtg

SEQ ID NO: 813724 - DNA, 25 bp, Mus musculus
tcccaccacagagtgagttcctgtg

SEQ ID NO: 813725 - DNA, 25 bp, Mus musculus
tcccaccacatcaagccagataaaa

SEQ ID NO: 813726 - DNA, 25 bp, Mus musculus
tcccaccacatcattcttatattta

SEQ ID NO: 813727 - DNA, 25 bp, Mus musculus
tcccaccacatctagccagataaaa

SEQ ID NO: 813728 - DNA, 25 bp, Mus musculus
tcccaccacatctttcttatattta

SEQ ID NO: 813729 - DNA, 25 bp, Mus musculus
tcccaccagaacagggaccaggttt

SEQ ID NO: 813730 - DNA, 25 bp, Mus musculus
tcccaccagaactgggaccaggttt

SEQ ID NO: 813731 - DNA, 25 bp, Mus musculus
tcccaccagacactctagaaacatg

SEQ ID NO: 813732 - DNA, 25 bp, Mus musculus
tcccaccagacagtctagaaacatg

SEQ ID NO: 813733 - DNA, 25 bp, Mus musculus
tcccaccaggaccataggaccaagg

SEQ ID NO: 813734 - DNA, 25 bp, Mus musculus
tcccaccaggacgataggaccaagg

SEQ ID NO: 813735 - DNA, 25 bp, Mus musculus
tcccaccagggaagagtaaaatcgt

SEQ ID NO: 813736 - DNA, 25 bp, Mus musculus
tcccaccagggatgagtaaaatcgt

SEQ ID NO: 813737 - DNA, 25 bp, Mus musculus
tcccaccagggcagtactacattaa

SEQ ID NO: 813738 - DNA, 25 bp, Mus musculus
tcccaccagggctgtactacattaa

SEQ ID NO: 813739 - DNA, 25 bp, Mus musculus
tcccaccagttcctttgtaggcaaa

SEQ ID NO: 813740 - DNA, 25 bp, Mus musculus
tcccaccagttcgtttgtaggcaaa

SEQ ID NO: 813741 - DNA, 25 bp, Mus musculus
tcccaccataagagaactggtctcc

SEQ ID NO: 813742 - DNA, 25 bp, Mus musculus
tcccaccataagtgaactggtctcc

SEQ ID NO: 813743 - DNA, 25 bp, Mus musculus
tcccaccatatcattctgttttgtc

SEQ ID NO: 813744 - DNA, 25 bp, Mus musculus
tcccaccatatctttctgttttgtc

SEQ ID NO: 813745 - DNA, 25 bp, Mus musculus
tcccaccatcctcttatatgtatag

SEQ ID NO: 813746 - DNA, 25 bp, Mus musculus
tcccaccatcctgttatatgtatag

SEQ ID NO: 813747 - DNA, 25 bp, Mus musculus
tcccaccattccaaagacaggctgt

SEQ ID NO: 813748 - DNA, 25 bp, Mus musculus
tcccaccattcctaagacaggctgt

SEQ ID NO: 813749 - DNA, 25 bp, Mus musculus
tcccaccattctcattttcttgttt

SEQ ID NO: 813750 - DNA, 25 bp, Mus musculus
tcccaccattctgattttcttgttt

SEQ ID NO: 813751 - DNA, 25 bp, Mus musculus
tcccacccaatgcacagttcttagt

SEQ ID NO: 813752 - DNA, 25 bp, Mus musculus
tcccacccaatggacagttcttagt

SEQ ID NO: 813753 - DNA, 25 bp, Mus musculus
tcccacccacagaatttggacatag

SEQ ID NO: 813754 - DNA, 25 bp, Mus musculus
tcccacccacagtatttggacatag

SEQ ID NO: 813755 - DNA, 25 bp, Mus musculus
tcccacccagctcaatctggtttag

SEQ ID NO: 813756 - DNA, 25 bp, Mus musculus
tcccacccagctgaatctggtttag

SEQ ID NO: 813757 - DNA, 25 bp, Mus musculus
tcccacccatggacatgacatacat

SEQ ID NO: 813758 - DNA, 25 bp, Mus musculus
tcccacccatggtcatgacatacat

SEQ ID NO: 813759 - DNA, 25 bp, Mus musculus
tcccacccgagccaccgagtgaggg

SEQ ID NO: 813760 - DNA, 25 bp, Mus musculus
tcccacccgagcgaccgagtgaggg

SEQ ID NO: 813761 - DNA, 25 bp, Mus musculus
tcccacccggatcgcggtatataga

SEQ ID NO: 813762 - DNA, 25 bp, Mus musculus
tcccacccggatggcggtatataga

SEQ ID NO: 813763 - DNA, 25 bp, Mus musculus
tcccacccgtgactgtaagaatgct

SEQ ID NO: 813764 - DNA, 25 bp, Mus musculus
tcccacccgtgagtgtaagaatgct

SEQ ID NO: 813765 - DNA, 25 bp, Mus musculus
tcccaccctatgagtcctatgagaa

SEQ ID NO: 813766 - DNA, 25 bp, Mus musculus
tcccaccctatgtgtcctatgagaa

SEQ ID NO: 813767 - DNA, 25 bp, Mus musculus
tcccaccctgtgagctgagaacaat

SEQ ID NO: 813768 - DNA, 25 bp, Mus musculus
tcccaccctgtgtgctgagaacaat

SEQ ID NO: 813769 - DNA, 25 bp, Mus musculus
tcccacccttgtaagaagccacatg

SEQ ID NO: 813770 - DNA, 25 bp, Mus musculus
tcccacccttgttagaagccacatg

SEQ ID NO: 813771 - DNA, 25 bp, Mus musculus
tcccaccgaatactactaaggggca

SEQ ID NO: 813772 - DNA, 25 bp, Mus musculus
tcccaccgaatagtactaaggggca

SEQ ID NO: 813773 - DNA, 25 bp, Mus musculus
tcccaccgaatgagctttacctatg

SEQ ID NO: 813774 - DNA, 25 bp, Mus musculus
tcccaccgaatgtgctttacctatg

SEQ ID NO: 813775 - DNA, 25 bp, Mus musculus
tcccaccgacaccttttaatgtaag

SEQ ID NO: 813776 - DNA, 25 bp, Mus musculus
tcccaccgacacgttttaatgtaag

SEQ ID NO: 813777 - DNA, 25 bp, Mus musculus
tcccaccgaccacttagtgttgaga

SEQ ID NO: 813778 - DNA, 25 bp, Mus musculus
tcccaccgaccagttagtgttgaga

SEQ ID NO: 813779 - DNA, 25 bp, Mus musculus
tcccaccgatatcggttgggcgttg

SEQ ID NO: 813780 - DNA, 25 bp, Mus musculus
tcccaccgatatgggttgggcgttg

SEQ ID NO: 813781 - DNA, 25 bp, Mus musculus
tcccaccggacgcattcggagcgga

SEQ ID NO: 813782 - DNA, 25 bp, Mus musculus
tcccaccggacggattcggagcgga

SEQ ID NO: 813783 - DNA, 25 bp, Mus musculus
tcccaccggttcaaaggctaagagt

SEQ ID NO: 813784 - DNA, 25 bp, Mus musculus
tcccaccggttctaaggctaagagt

SEQ ID NO: 813785 - DNA, 25 bp, Mus musculus
tcccacctacctataacttgtaaca

SEQ ID NO: 813786 - DNA, 25 bp, Mus musculus
tcccacctacctttaacttgtaaca

SEQ ID NO: 813787 - DNA, 25 bp, Mus musculus
tcccacctagagcttcctgttaaag

SEQ ID NO: 813788 - DNA, 25 bp, Mus musculus
tcccacctagaggttcctgttaaag

SEQ ID NO: 813789 - DNA, 25 bp, Mus musculus
tcccacctcggtcccaataaagaaa

SEQ ID NO: 813790 - DNA, 25 bp, Mus musculus
tcccacctcggtgccaataaagaaa

SEQ ID NO: 813791 - DNA, 25 bp, Mus musculus
tcccacctcttcagtccataaaaat

SEQ ID NO: 813792 - DNA, 25 bp, Mus musculus
tcccacctcttctgtccataaaaat

SEQ ID NO: 813793 - DNA, 25 bp, Mus musculus
tcccacctggagatctatgaagcct

SEQ ID NO: 813794 - DNA, 25 bp, Mus musculus
tcccacctggagttctatgaagcct

SEQ ID NO: 813795 - DNA, 25 bp, Mus musculus
tcccacctggtaccttctaaaggca

SEQ ID NO: 813796 - DNA, 25 bp, Mus musculus
tcccacctggtagcttctaaaggca

SEQ ID NO: 813797 - DNA, 25 bp, Mus musculus
tcccacctgtacctgtgtctgtgtc

SEQ ID NO: 813798 - DNA, 25 bp, Mus musculus
tcccacctgtacgtgtgtctgtgtc

SEQ ID NO: 813799 - DNA, 25 bp, Mus musculus
tcccacctgtagctgaagagtttcc

SEQ ID NO: 813800 - DNA, 25 bp, Mus musculus
tcccacctgtaggtgaagagtttcc

SEQ ID NO: 813801 - DNA, 25 bp, Mus musculus
tcccacctgtctccatagaacggaa

SEQ ID NO: 813802 - DNA, 25 bp, Mus musculus
tcccacctgtctgcatagaacggaa

SEQ ID NO: 813803 - DNA, 25 bp, Mus musculus
tcccaccttccactctgtttttaag

SEQ ID NO: 813804 - DNA, 25 bp, Mus musculus
tcccaccttccagtctgtttttaag

SEQ ID NO: 813805 - DNA, 25 bp, Mus musculus
tcccaccttgagcaaagtccaaaag

SEQ ID NO: 813806 - DNA, 25 bp, Mus musculus
tcccaccttgaggaaagtccaaaag

SEQ ID NO: 813807 - DNA, 25 bp, Mus musculus
tcccaccttgatagcaggttagcca

SEQ ID NO: 813808 - DNA, 25 bp, Mus musculus
tcccaccttgattgcaggttagcca

SEQ ID NO: 813809 - DNA, 25 bp, Mus musculus
tcccaccttggaccatttatgtaga

SEQ ID NO: 813810 - DNA, 25 bp, Mus musculus
tcccaccttggagcatttatgtaga

SEQ ID NO: 813811 - DNA, 25 bp, Mus musculus
tcccaccttgtacggtttgcctttg

SEQ ID NO: 813812 - DNA, 25 bp, Mus musculus
tcccaccttgtagggtttgcctttg

SEQ ID NO: 813813 - DNA, 25 bp, Mus musculus
tcccacctttcaaggttacaccatg

SEQ ID NO: 813814 - DNA, 25 bp, Mus musculus
tcccacctttcatggttacaccatg

SEQ ID NO: 813815 - DNA, 25 bp, Mus musculus
tcccacgagaacctttgaagagctt

SEQ ID NO: 813816 - DNA, 25 bp, Mus musculus
tcccacgagaacgtttgaagagctt

SEQ ID NO: 813817 - DNA, 25 bp, Mus musculus
tcccacgagttcctgaggctcaagc

SEQ ID NO: 813818 - DNA, 25 bp, Mus musculus
tcccacgagttcgtgaggctcaagc

SEQ ID NO: 813819 - DNA, 25 bp, Mus musculus
tcccacgccatcattacaattacta

SEQ ID NO: 813820 - DNA, 25 bp, Mus musculus
tcccacgccatctttacaattacta

SEQ ID NO: 813821 - DNA, 25 bp, Mus musculus
tcccacgctagaagaccatgagaga

SEQ ID NO: 813822 - DNA, 25 bp, Mus musculus
tcccacgctagatgaccatgagaga

SEQ ID NO: 813823 - DNA, 25 bp, Mus musculus
tcccacgctcctcaactgaaggaaa

SEQ ID NO: 813824 - DNA, 25 bp, Mus musculus
tcccacgctcctgaactgaaggaaa

SEQ ID NO: 813825 - DNA, 25 bp, Mus musculus
tcccacgcttggagtttctcaaata

SEQ ID NO: 813826 - DNA, 25 bp, Mus musculus
tcccacgcttggtgtttctcaaata

SEQ ID NO: 813827 - DNA, 25 bp, Mus musculus
tcccacgctttgcaaaaatcccatg

SEQ ID NO: 813828 - DNA, 25 bp, Mus musculus
tcccacgctttggaaaaatcccatg

SEQ ID NO: 813829 - DNA, 25 bp, Mus musculus
tcccacggacggagttttcaaacat

SEQ ID NO: 813830 - DNA, 25 bp, Mus musculus
tcccacggacggtgttttcaaacat

SEQ ID NO: 813831 - DNA, 25 bp, Mus musculus
tcccacggactgctcgggctaggaa

SEQ ID NO: 813832 - DNA, 25 bp, Mus musculus
tcccacggactggtcgggctaggaa

SEQ ID NO: 813833 - DNA, 25 bp, Mus musculus
tcccacggtgacatgtttacagctg

SEQ ID NO: 813834 - DNA, 25 bp, Mus musculus
tcccacggtgacttgtttacagctg

SEQ ID NO: 813835 - DNA, 25 bp, Mus musculus
tcccacgtacccattgaaattgctt

SEQ ID NO: 813836 - DNA, 25 bp, Mus musculus
tcccacgtaccctttgaaattgctt

SEQ ID NO: 813837 - DNA, 25 bp, Mus musculus
tcccacgtacctaagaagttctgtt

SEQ ID NO: 813838 - DNA, 25 bp, Mus musculus
tcccacgtaccttagaagttctgtt

SEQ ID NO: 813839 - DNA, 25 bp, Mus musculus
tcccacgtcacccagaagtttagaa

SEQ ID NO: 813840 - DNA, 25 bp, Mus musculus
tcccacgtcaccgagaagtttagaa

SEQ ID NO: 813841 - DNA, 25 bp, Mus musculus
tcccacgtcagcacggtagacggaa

SEQ ID NO: 813842 - DNA, 25 bp, Mus musculus
tcccacgtcagctcggtagacggaa

SEQ ID NO: 813843 - DNA, 25 bp, Mus musculus
tcccacgtgctacagagaattgact

SEQ ID NO: 813844 - DNA, 25 bp, Mus musculus
tcccacgtgctagagagaattgact

SEQ ID NO: 813845 - DNA, 25 bp, Mus musculus
tcccactaaccaccattaaactgag

SEQ ID NO: 813846 - DNA, 25 bp, Mus musculus
tcccactaaccagcattaaactgag

SEQ ID NO: 813847 - DNA, 25 bp, Mus musculus
tcccactacttaccagatctgcaga

SEQ ID NO: 813848 - DNA, 25 bp, Mus musculus
tcccactacttagcagatctgcaga

SEQ ID NO: 813849 - DNA, 25 bp, Mus musculus
tcccactcagttattcctactgtga

SEQ ID NO: 813850 - DNA, 25 bp, Mus musculus
tcccactcagtttttcctactgtga

SEQ ID NO: 813851 - DNA, 25 bp, Mus musculus
tcccactcctccagtgttaataaca

SEQ ID NO: 813852 - DNA, 25 bp, Mus musculus
tcccactcctcctgtgttaataaca

SEQ ID NO: 813853 - DNA, 25 bp, Mus musculus
tcccactcgtagacaaccagataaa

SEQ ID NO: 813854 - DNA, 25 bp, Mus musculus
tcccactcgtagtcaaccagataaa

SEQ ID NO: 813855 - DNA, 25 bp, Mus musculus
tcccactgacctacttgtaggtagg

SEQ ID NO: 813856 - DNA, 25 bp, Mus musculus
tcccactgacctcagcttactaagg

SEQ ID NO: 813857 - DNA, 25 bp, Mus musculus
tcccactgacctgagcttactaagg

SEQ ID NO: 813858 - DNA, 25 bp, Mus musculus
tcccactgaccttcttgtaggtagg

SEQ ID NO: 813859 - DNA, 25 bp, Mus musculus
tcccactgagaacctggcatccgtg

SEQ ID NO: 813860 - DNA, 25 bp, Mus musculus
tcccactgagaagctggcatccgtg

SEQ ID NO: 813861 - DNA, 25 bp, Mus musculus
tcccactgaggcaaccggtgcttag

SEQ ID NO: 813862 - DNA, 25 bp, Mus musculus
tcccactgaggctaccggtgcttag

SEQ ID NO: 813863 - DNA, 25 bp, Mus musculus
tcccactggcttaatataaaaaact

SEQ ID NO: 813864 - DNA, 25 bp, Mus musculus
tcccactggctttatataaaaaact

SEQ ID NO: 813865 - DNA, 25 bp, Mus musculus
tcccactgggtgatgcttttgctgc

SEQ ID NO: 813866 - DNA, 25 bp, Mus musculus
tcccactgggtgttgcttttgctgc

SEQ ID NO: 813867 - DNA, 25 bp, Mus musculus
tcccactggtgaattgttgttgttc

SEQ ID NO: 813868 - DNA, 25 bp, Mus musculus
tcccactggtgatttgttgttgttc

SEQ ID NO: 813869 - DNA, 25 bp, Mus musculus
tcccactgtagtcaaagccctgttt

SEQ ID NO: 813870 - DNA, 25 bp, Mus musculus
tcccactgtagtgaaagccctgttt

SEQ ID NO: 813871 - DNA, 25 bp, Mus musculus
tcccactgtgataggcatgttgaca

SEQ ID NO: 813872 - DNA, 25 bp, Mus musculus
tcccactgtgattggcatgttgaca

SEQ ID NO: 813873 - DNA, 25 bp, Mus musculus
tcccactgtgcaattcgctttcctg

SEQ ID NO: 813874 - DNA, 25 bp, Mus musculus
tcccactgtgcatttcgctttcctg

SEQ ID NO: 813875 - DNA, 25 bp, Mus musculus
tcccactgtgtccacatgaggtgtg

SEQ ID NO: 813876 - DNA, 25 bp, Mus musculus
tcccactgtgtcgacatgaggtgtg

SEQ ID NO: 813877 - DNA, 25 bp, Mus musculus
tcccactgtgtgaatccagctttaa

SEQ ID NO: 813878 - DNA, 25 bp, Mus musculus
tcccactgtgtgtatccagctttaa

SEQ ID NO: 813879 - DNA, 25 bp, Mus musculus
tcccactgttacaaaagcagaaagt

SEQ ID NO: 813880 - DNA, 25 bp, Mus musculus
tcccactgttactaaagcagaaagt

SEQ ID NO: 813881 - DNA, 25 bp, Mus musculus
tcccactgtttgatgggtaataaat

SEQ ID NO: 813882 - DNA, 25 bp, Mus musculus
tcccactgtttgttgggtaataaat

SEQ ID NO: 813883 - DNA, 25 bp, Mus musculus
tcccacttacccaaaaggctttctg

SEQ ID NO: 813884 - DNA, 25 bp, Mus musculus
tcccacttaccctaaaggctttctg

SEQ ID NO: 813885 - DNA, 25 bp, Mus musculus
tcccacttacgacaccatgttgctg

SEQ ID NO: 813886 - DNA, 25 bp, Mus musculus
tcccacttacgagaccatgttgctg

SEQ ID NO: 813887 - DNA, 25 bp, Mus musculus
tcccacttaggaaaccattgctttg

SEQ ID NO: 813888 - DNA, 25 bp, Mus musculus
tcccacttaggaacccagttagtgt

SEQ ID NO: 813889 - DNA, 25 bp, Mus musculus
tcccacttaggataccattgctttg

SEQ ID NO: 813890 - DNA, 25 bp, Mus musculus
tcccacttaggatcccagttagtgt

SEQ ID NO: 813891 - DNA, 25 bp, Mus musculus
tcccacttcatccaggagcagcagg

SEQ ID NO: 813892 - DNA, 25 bp, Mus musculus
tcccacttcatcgaggagcagcagg

SEQ ID NO: 813893 - DNA, 25 bp, Mus musculus
tcccacttctgtcatggcagggcag

SEQ ID NO: 813894 - DNA, 25 bp, Mus musculus
tcccacttctgtgatggcagggcag

SEQ ID NO: 813895 - DNA, 25 bp, Mus musculus
tcccacttcttgcagacagtcagta

SEQ ID NO: 813896 - DNA, 25 bp, Mus musculus
tcccacttcttggagacagtcagta

SEQ ID NO: 813897 - DNA, 25 bp, Mus musculus
tcccacttgtggaaccctcacaggt

SEQ ID NO: 813898 - DNA, 25 bp, Mus musculus
tcccacttgtggtaccctcacaggt

SEQ ID NO: 813899 - DNA, 25 bp, Mus musculus
tcccacttgtgtatccttgacaaag

SEQ ID NO: 813900 - DNA, 25 bp, Mus musculus
tcccacttgtgtttccttgacaaag

SEQ ID NO: 813901 - DNA, 25 bp, Mus musculus
tcccactttccaacaaacttatcag

SEQ ID NO: 813902 - DNA, 25 bp, Mus musculus
tcccactttccacctgtttggtggt

SEQ ID NO: 813903 - DNA, 25 bp, Mus musculus
tcccactttccagctgtttggtggt

SEQ ID NO: 813904 - DNA, 25 bp, Mus musculus
tcccactttccatcaaacttatcag

SEQ ID NO: 813905 - DNA, 25 bp, Mus musculus
tcccagaaaccaatgacgagatgca

SEQ ID NO: 813906 - DNA, 25 bp, Mus musculus
tcccagaaaccattgacgagatgca

SEQ ID NO: 813907 - DNA, 25 bp, Mus musculus
tcccagaaagggatgaagtccttct

SEQ ID NO: 813908 - DNA, 25 bp, Mus musculus
tcccagaaagggttgaagtccttct

SEQ ID NO: 813909 - DNA, 25 bp, Mus musculus
tcccagaaatgaactcttgtagagg

SEQ ID NO: 813910 - DNA, 25 bp, Mus musculus
tcccagaaatgatctcttgtagagg

SEQ ID NO: 813911 - DNA, 25 bp, Mus musculus
tcccagaaccccatgataacagaag

SEQ ID NO: 813912 - DNA, 25 bp, Mus musculus
tcccagaaccccttgataacagaag

SEQ ID NO: 813913 - DNA, 25 bp, Mus musculus
tcccagaagctcagtagctactttg

SEQ ID NO: 813914 - DNA, 25 bp, Mus musculus
tcccagaagctctgtagctactttg

SEQ ID NO: 813915 - DNA, 25 bp, Mus musculus
tcccagaatgccacttgtcttgtga

SEQ ID NO: 813916 - DNA, 25 bp, Mus musculus
tcccagaatgcctcttgtcttgtga

SEQ ID NO: 813917 - DNA, 25 bp, Mus musculus
tcccagaattcccaaatgagaagtg

SEQ ID NO: 813918 - DNA, 25 bp, Mus musculus
tcccagaattccgaaatgagaagtg

SEQ ID NO: 813919 - DNA, 25 bp, Mus musculus
tcccagaattttacagagccgccag

SEQ ID NO: 813920 - DNA, 25 bp, Mus musculus
tcccagaatttttcagagccgccag

SEQ ID NO: 813921 - DNA, 25 bp, Mus musculus
tcccagacaaagaaccagtaacaga

SEQ ID NO: 813922 - DNA, 25 bp, Mus musculus
tcccagacaaagtaccagtaacaga

SEQ ID NO: 813923 - DNA, 25 bp, Mus musculus
tcccagacactaatctgacttacgt

SEQ ID NO: 813924 - DNA, 25 bp, Mus musculus
tcccagacactattctgacttacgt

SEQ ID NO: 813925 - DNA, 25 bp, Mus musculus
tcccagacaggaatgctacatgtaa

SEQ ID NO: 813926 - DNA, 25 bp, Mus musculus
tcccagacaggattgctacatgtaa

SEQ ID NO: 813927 - DNA, 25 bp, Mus musculus
tcccagacatgaagcctacttggta

SEQ ID NO: 813928 - DNA, 25 bp, Mus musculus
tcccagacatgatgcctacttggta

SEQ ID NO: 813929 - DNA, 25 bp, Mus musculus
tcccagacatgtcccaggaggagaa

SEQ ID NO: 813930 - DNA, 25 bp, Mus musculus
tcccagacatgtgccaggaggagaa

SEQ ID NO: 813931 - DNA, 25 bp, Mus musculus
tcccagacctaaagttgctatgcta

SEQ ID NO: 813932 - DNA, 25 bp, Mus musculus
tcccagacctaatgttgctatgcta

SEQ ID NO: 813933 - DNA, 25 bp, Mus musculus
tcccagacctggattaagagccttt

SEQ ID NO: 813934 - DNA, 25 bp, Mus musculus
tcccagacctggtttaagagccttt

SEQ ID NO: 813935 - DNA, 25 bp, Mus musculus
tcccagacctttcttcagttgtaaa

SEQ ID NO: 813936 - DNA, 25 bp, Mus musculus
tcccagacctttgttcagttgtaaa

SEQ ID NO: 813937 - DNA, 25 bp, Mus musculus
tcccagacggtgaaggtcagctcaa

SEQ ID NO: 813938 - DNA, 25 bp, Mus musculus
tcccagacggtgtaggtcagctcaa

SEQ ID NO: 813939 - DNA, 25 bp, Mus musculus
tcccagactaacctaggtaccttat

SEQ ID NO: 813940 - DNA, 25 bp, Mus musculus
tcccagactaacgtaggtaccttat

SEQ ID NO: 813941 - DNA, 25 bp, Mus musculus
tcccagactaagacactgtgacagt

SEQ ID NO: 813942 - DNA, 25 bp, Mus musculus
tcccagactaagtcactgtgacagt

SEQ ID NO: 813943 - DNA, 25 bp, Mus musculus
tcccagactgtgatggctgtcctga

SEQ ID NO: 813944 - DNA, 25 bp, Mus musculus
tcccagactgtgttggctgtcctga

SEQ ID NO: 813945 - DNA, 25 bp, Mus musculus
tcccagacttttcattcatccaata

SEQ ID NO: 813946 - DNA, 25 bp, Mus musculus
tcccagacttttgattcatccaata

SEQ ID NO: 813947 - DNA, 25 bp, Mus musculus
tcccagagaagacaccctactagaa

SEQ ID NO: 813948 - DNA, 25 bp, Mus musculus
tcccagagaagagaccctactagaa

SEQ ID NO: 813949 - DNA, 25 bp, Mus musculus
tcccagagagccagtataggtgcag

SEQ ID NO: 813950 - DNA, 25 bp, Mus musculus
tcccagagagcctgtataggtgcag

SEQ ID NO: 813951 - DNA, 25 bp, Mus musculus
tcccagagaggtcagcttcctctta

SEQ ID NO: 813952 - DNA, 25 bp, Mus musculus
tcccagagaggtgagcttcctctta

SEQ ID NO: 813953 - DNA, 25 bp, Mus musculus
tcccagagatggaacacgatgttgt

SEQ ID NO: 813954 - DNA, 25 bp, Mus musculus
tcccagagatggtacacgatgttgt

SEQ ID NO: 813955 - DNA, 25 bp, Mus musculus
tcccagagcccgagtagttccagtg

SEQ ID NO: 813956 - DNA, 25 bp, Mus musculus
tcccagagcccgtgtagttccagtg

SEQ ID NO: 813957 - DNA, 25 bp, Mus musculus
tcccagagccgtcatctcaaggtga

SEQ ID NO: 813958 - DNA, 25 bp, Mus musculus
tcccagagccgtgatctcaaggtga

SEQ ID NO: 813959 - DNA, 25 bp, Mus musculus
tcccagagcctgattggtagacatg

SEQ ID NO: 813960 - DNA, 25 bp, Mus musculus
tcccagagcctgtttggtagacatg

SEQ ID NO: 813961 - DNA, 25 bp, Mus musculus
tcccagaggacgatcaggtagcact

SEQ ID NO: 813962 - DNA, 25 bp, Mus musculus
tcccagaggacgttcaggtagcact

SEQ ID NO: 813963 - DNA, 25 bp, Mus musculus
tcccagaggcataccgtggagtgca

SEQ ID NO: 813964 - DNA, 25 bp, Mus musculus
tcccagaggcattccgtggagtgca

SEQ ID NO: 813965 - DNA, 25 bp, Mus musculus
tcccagagggccatgcagtgcagat

SEQ ID NO: 813966 - DNA, 25 bp, Mus musculus
tcccagagggccttgcagtgcagat

SEQ ID NO: 813967 - DNA, 25 bp, Mus musculus
tcccagaggtacaactgtgtcctgt

SEQ ID NO: 813968 - DNA, 25 bp, Mus musculus
tcccagaggtactactgtgtcctgt

SEQ ID NO: 813969 - DNA, 25 bp, Mus musculus
tcccagagtagacggctggtgttca

SEQ ID NO: 813970 - DNA, 25 bp, Mus musculus
tcccagagtagagggctggtgttca

SEQ ID NO: 813971 - DNA, 25 bp, Mus musculus
tcccagagtcacaagattccacatt

SEQ ID NO: 813972 - DNA, 25 bp, Mus musculus
tcccagagtcacagtccctgaacaa

SEQ ID NO: 813973 - DNA, 25 bp, Mus musculus
tcccagagtcactagattccacatt

SEQ ID NO: 813974 - DNA, 25 bp, Mus musculus
tcccagagtcactgtccctgaacaa

SEQ ID NO: 813975 - DNA, 25 bp, Mus musculus
tcccagagtcatctcttctctggtg

SEQ ID NO: 813976 - DNA, 25 bp, Mus musculus
tcccagagtcatgtcttctctggtg

SEQ ID NO: 813977 - DNA, 25 bp, Mus musculus
tcccagagtcgactcttggcttaat

SEQ ID NO: 813978 - DNA, 25 bp, Mus musculus
tcccagagtcgagtcttggcttaat

SEQ ID NO: 813979 - DNA, 25 bp, Mus musculus
tcccagagttatatcccaatccagg

SEQ ID NO: 813980 - DNA, 25 bp, Mus musculus
tcccagagttatttcccaatccagg

SEQ ID NO: 813981 - DNA, 25 bp, Mus musculus
tcccagagttccaaatgacatgcaa

SEQ ID NO: 813982 - DNA, 25 bp, Mus musculus
tcccagagttcctaatgacatgcaa

SEQ ID NO: 813983 - DNA, 25 bp, Mus musculus
tcccagagttttctccggagagcag

SEQ ID NO: 813984 - DNA, 25 bp, Mus musculus
tcccagagttttgtccggagagcag

SEQ ID NO: 813985 - DNA, 25 bp, Mus musculus
tcccagataggaagtaggcacttag

SEQ ID NO: 813986 - DNA, 25 bp, Mus musculus
tcccagataggatgtaggcacttag

SEQ ID NO: 813987 - DNA, 25 bp, Mus musculus
tcccagatcatacggacgccggagt

SEQ ID NO: 813988 - DNA, 25 bp, Mus musculus
tcccagatcatagggacgccggagt

SEQ ID NO: 813989 - DNA, 25 bp, Mus musculus
tcccagatctgtcagctcactgcag

SEQ ID NO: 813990 - DNA, 25 bp, Mus musculus
tcccagatctgtgagctcactgcag

SEQ ID NO: 813991 - DNA, 25 bp, Mus musculus
tcccagatgagacttcctccaagaa

SEQ ID NO: 813992 - DNA, 25 bp, Mus musculus
tcccagatgagagttcctccaagaa

SEQ ID NO: 813993 - DNA, 25 bp, Mus musculus
tcccagatggcaacggctctgagat

SEQ ID NO: 813994 - DNA, 25 bp, Mus musculus
tcccagatggcatcggctctgagat

SEQ ID NO: 813995 - DNA, 25 bp, Mus musculus
tcccagatggccattacagctagtt

SEQ ID NO: 813996 - DNA, 25 bp, Mus musculus
tcccagatggcctttacagctagtt

SEQ ID NO: 813997 - DNA, 25 bp, Mus musculus
tcccagattaccctggcctgtgtca

SEQ ID NO: 813998 - DNA, 25 bp, Mus musculus
tcccagattaccgtggcctgtgtca

SEQ ID NO: 813999 - DNA, 25 bp, Mus musculus
tcccagattcacagagacttttcat

SEQ ID NO: 814000 - DNA, 25 bp, Mus musculus
tcccagattcactgagacttttcat

SEQ ID NO: 814001 - DNA, 25 bp, Mus musculus
tcccagattgccagcgtcggttaga

SEQ ID NO: 814002 - DNA, 25 bp, Mus musculus
tcccagattgcctgcgtcggttaga

SEQ ID NO: 814003 - DNA, 25 bp, Mus musculus
tcccagattgctctaatgaggagat

SEQ ID NO: 814004 - DNA, 25 bp, Mus musculus
tcccagattgctgtaatgaggagat

SEQ ID NO: 814005 - DNA, 25 bp, Mus musculus
tcccagattgtaaagcgtgaagaca

SEQ ID NO: 814006 - DNA, 25 bp, Mus musculus
tcccagattgtatagcgtgaagaca

SEQ ID NO: 814007 - DNA, 25 bp, Mus musculus
tcccagatttgtcaggaaggttgct

SEQ ID NO: 814008 - DNA, 25 bp, Mus musculus
tcccagatttgtgaggaaggttgct

SEQ ID NO: 814009 - DNA, 25 bp, Mus musculus
tcccagcaaattacttcataaccat

SEQ ID NO: 814010 - DNA, 25 bp, Mus musculus
tcccagcaaatttcttcataaccat

SEQ ID NO: 814011 - DNA, 25 bp, Mus musculus
tcccagcaaccaatttaaccataat

SEQ ID NO: 814012 - DNA, 25 bp, Mus musculus
tcccagcaaccattttaaccataat

SEQ ID NO: 814013 - DNA, 25 bp, Mus musculus
tcccagcaagatccagttaccagaa

SEQ ID NO: 814014 - DNA, 25 bp, Mus musculus
tcccagcaagatgcagttaccagaa

SEQ ID NO: 814015 - DNA, 25 bp, Mus musculus
tcccagcacctgagttagatgacag

SEQ ID NO: 814016 - DNA, 25 bp, Mus musculus
tcccagcacctgtgttagatgacag

SEQ ID NO: 814017 - DNA, 25 bp, Mus musculus
tcccagcactgcaggaaccaaattc

SEQ ID NO: 814018 - DNA, 25 bp, Mus musculus
tcccagcactgctggaaccaaattc

SEQ ID NO: 814019 - DNA, 25 bp, Mus musculus
tcccagcacttaagatgtggcggca

SEQ ID NO: 814020 - DNA, 25 bp, Mus musculus
tcccagcacttatgatgtggcggca

SEQ ID NO: 814021 - DNA, 25 bp, Mus musculus
tcccagcaggaaagactctgagact

SEQ ID NO: 814022 - DNA, 25 bp, Mus musculus
tcccagcaggaatgactctgagact

SEQ ID NO: 814023 - DNA, 25 bp, Mus musculus
tcccagcagggtaactgtggcagct

SEQ ID NO: 814024 - DNA, 25 bp, Mus musculus
tcccagcagggtaagcataaaagaa

SEQ ID NO: 814025 - DNA, 25 bp, Mus musculus
tcccagcagggtataacctatattt

SEQ ID NO: 814026 - DNA, 25 bp, Mus musculus
tcccagcagggttactgtggcagct

SEQ ID NO: 814027 - DNA, 25 bp, Mus musculus
tcccagcagggttagcataaaagaa

SEQ ID NO: 814028 - DNA, 25 bp, Mus musculus
tcccagcagggtttaacctatattt

SEQ ID NO: 814029 - DNA, 25 bp, Mus musculus
tcccagcagtgtcggcttatggtac

SEQ ID NO: 814030 - DNA, 25 bp, Mus musculus
tcccagcagtgtgggcttatggtac

SEQ ID NO: 814031 - DNA, 25 bp, Mus musculus
tcccagcatacaaggaaaagcatgc

SEQ ID NO: 814032 - DNA, 25 bp, Mus musculus
tcccagcatacatggaaaagcatgc

SEQ ID NO: 814033 - DNA, 25 bp, Mus musculus
tcccagcataccacttactagtgtg

SEQ ID NO: 814034 - DNA, 25 bp, Mus musculus
tcccagcatacctcttactagtgtg

SEQ ID NO: 814035 - DNA, 25 bp, Mus musculus
tcccagcatctcagtagactgtttc

SEQ ID NO: 814036 - DNA, 25 bp, Mus musculus
tcccagcatctctgtagactgtttc

SEQ ID NO: 814037 - DNA, 25 bp, Mus musculus
tcccagcatgagattgtttattcat

SEQ ID NO: 814038 - DNA, 25 bp, Mus musculus
tcccagcatgagtttgtttattcat

SEQ ID NO: 814039 - DNA, 25 bp, Mus musculus
tcccagcatgggataaccacgcaat

SEQ ID NO: 814040 - DNA, 25 bp, Mus musculus
tcccagcatgggttaaccacgcaat

SEQ ID NO: 814041 - DNA, 25 bp, Mus musculus
tcccagcatggtcttgaggttctca

SEQ ID NO: 814042 - DNA, 25 bp, Mus musculus
tcccagcatggtgttgaggttctca

SEQ ID NO: 814043 - DNA, 25 bp, Mus musculus
tcccagccacagagcattgtgtgtg

SEQ ID NO: 814044 - DNA, 25 bp, Mus musculus
tcccagccacagtgcattgtgtgtg

SEQ ID NO: 814045 - DNA, 25 bp, Mus musculus
tcccagccaccgaagactactttta

SEQ ID NO: 814046 - DNA, 25 bp, Mus musculus
tcccagccaccgtagactactttta

SEQ ID NO: 814047 - DNA, 25 bp, Mus musculus
tcccagccagagaccaacaaagttt

SEQ ID NO: 814048 - DNA, 25 bp, Mus musculus
tcccagccagagtccaacaaagttt

SEQ ID NO: 814049 - DNA, 25 bp, Mus musculus
tcccagccagcaacaggaaggaaaa

SEQ ID NO: 814050 - DNA, 25 bp, Mus musculus
tcccagccagcatcaggaaggaaaa

SEQ ID NO: 814051 - DNA, 25 bp, Mus musculus
tcccagccagctcttgagagtgctt

SEQ ID NO: 814052 - DNA, 25 bp, Mus musculus
tcccagccagctgttgagagtgctt

SEQ ID NO: 814053 - DNA, 25 bp, Mus musculus
tcccagccaggactgtggaagccta

SEQ ID NO: 814054 - DNA, 25 bp, Mus musculus
tcccagccaggagtgtggaagccta

SEQ ID NO: 814055 - DNA, 25 bp, Mus musculus
tcccagccatggaaaccaggcagga

SEQ ID NO: 814056 - DNA, 25 bp, Mus musculus
tcccagccatggtaaccaggcagga

SEQ ID NO: 814057 - DNA, 25 bp, Mus musculus
tcccagcccagcacatgtgacatga

SEQ ID NO: 814058 - DNA, 25 bp, Mus musculus
tcccagcccagctcatgtgacatga

SEQ ID NO: 814059 - DNA, 25 bp, Mus musculus
tcccagcccatgagaggtagagcca

SEQ ID NO: 814060 - DNA, 25 bp, Mus musculus
tcccagcccatgtgaggtagagcca

SEQ ID NO: 814061 - DNA, 25 bp, Mus musculus
tcccagccccatagacatttcaggg

SEQ ID NO: 814062 - DNA, 25 bp, Mus musculus
tcccagccccattgacatttcaggg

SEQ ID NO: 814063 - DNA, 25 bp, Mus musculus
tcccagccctctaattgcaatttta

SEQ ID NO: 814064 - DNA, 25 bp, Mus musculus
tcccagccctcttattgcaatttta

SEQ ID NO: 814065 - DNA, 25 bp, Mus musculus
tcccagccgcagatgttgattgtat

SEQ ID NO: 814066 - DNA, 25 bp, Mus musculus
tcccagccgcagttgttgattgtat

SEQ ID NO: 814067 - DNA, 25 bp, Mus musculus
tcccagcctagcaaggctgactcag

SEQ ID NO: 814068 - DNA, 25 bp, Mus musculus
tcccagcctagctaggctgactcag

SEQ ID NO: 814069 - DNA, 25 bp, Mus musculus
tcccagcctcatagctagaggagct

SEQ ID NO: 814070 - DNA, 25 bp, Mus musculus
tcccagcctcattgctagaggagct

SEQ ID NO: 814071 - DNA, 25 bp, Mus musculus
tcccagcctcctcgtgaataaaatg

SEQ ID NO: 814072 - DNA, 25 bp, Mus musculus
tcccagcctcctggtgaataaaatg

SEQ ID NO: 814073 - DNA, 25 bp, Mus musculus
tcccagctaaccatgtccttgtgaa

SEQ ID NO: 814074 - DNA, 25 bp, Mus musculus
tcccagctaaccttgtccttgtgaa

SEQ ID NO: 814075 - DNA, 25 bp, Mus musculus
tcccagctactgctgaaggtcacag

SEQ ID NO: 814076 - DNA, 25 bp, Mus musculus
tcccagctactggtgaaggtcacag

SEQ ID NO: 814077 - DNA, 25 bp, Mus musculus
tcccagctcctgcagtgggtaggtt

SEQ ID NO: 814078 - DNA, 25 bp, Mus musculus
tcccagctcctggagtgggtaggtt

SEQ ID NO: 814079 - DNA, 25 bp, Mus musculus
tcccagctctagcttcagaggacag

SEQ ID NO: 814080 - DNA, 25 bp, Mus musculus
tcccagctctaggttcagaggacag

SEQ ID NO: 814081 - DNA, 25 bp, Mus musculus
tcccagctgcagcactctggcaata

SEQ ID NO: 814082 - DNA, 25 bp, Mus musculus
tcccagctgcaggactctggcaata

SEQ ID NO: 814083 - DNA, 25 bp, Mus musculus
tcccagctgcttatagcaaggcttt

SEQ ID NO: 814084 - DNA, 25 bp, Mus musculus
tcccagctgcttttagcaaggcttt

SEQ ID NO: 814085 - DNA, 25 bp, Mus musculus
tcccagctggctatgaagaaatatt

SEQ ID NO: 814086 - DNA, 25 bp, Mus musculus
tcccagctggctttgaagaaatatt

SEQ ID NO: 814087 - DNA, 25 bp, Mus musculus
tcccagctgggcatcagagtctaaa

SEQ ID NO: 814088 - DNA, 25 bp, Mus musculus
tcccagctgggcttcagagtctaaa

SEQ ID NO: 814089 - DNA, 25 bp, Mus musculus
tcccagctgtacagttagaggccaa

SEQ ID NO: 814090 - DNA, 25 bp, Mus musculus
tcccagctgtactgttagaggccaa

SEQ ID NO: 814091 - DNA, 25 bp, Mus musculus
tcccagcttaaaaacagtccctaaa

SEQ ID NO: 814092 - DNA, 25 bp, Mus musculus
tcccagcttaaatacagtccctaaa

SEQ ID NO: 814093 - DNA, 25 bp, Mus musculus
tcccagcttagaatcacttgacaga

SEQ ID NO: 814094 - DNA, 25 bp, Mus musculus
tcccagcttagattcacttgacaga

SEQ ID NO: 814095 - DNA, 25 bp, Mus musculus
tcccagcttcatacgtgtaacaatt

SEQ ID NO: 814096 - DNA, 25 bp, Mus musculus
tcccagcttcattcgtgtaacaatt

SEQ ID NO: 814097 - DNA, 25 bp, Mus musculus
tcccagcttgctacgcttgtttaaa

SEQ ID NO: 814098 - DNA, 25 bp, Mus musculus
tcccagcttgcttcgcttgtttaaa

SEQ ID NO: 814099 - DNA, 25 bp, Mus musculus
tcccagctttagctggaggcaagag

SEQ ID NO: 814100 - DNA, 25 bp, Mus musculus
tcccagctttaggtggaggcaagag

SEQ ID NO: 814101 - DNA, 25 bp, Mus musculus
tcccaggaaggaccatcagcagctt

SEQ ID NO: 814102 - DNA, 25 bp, Mus musculus
tcccaggaaggagcatcagcagctt

SEQ ID NO: 814103 - DNA, 25 bp, Mus musculus
tcccaggaatttctactttctgaga

SEQ ID NO: 814104 - DNA, 25 bp, Mus musculus
tcccaggaatttgtactttctgaga

SEQ ID NO: 814105 - DNA, 25 bp, Mus musculus
tcccaggaccctctgacaatggtgc

SEQ ID NO: 814106 - DNA, 25 bp, Mus musculus
tcccaggaccctgtgacaatggtgc

SEQ ID NO: 814107 - DNA, 25 bp, Mus musculus
tcccaggactgcattagttgctgtt

SEQ ID NO: 814108 - DNA, 25 bp, Mus musculus
tcccaggactgctttagttgctgtt

SEQ ID NO: 814109 - DNA, 25 bp, Mus musculus
tcccaggaggacacatagctttccc

SEQ ID NO: 814110 - DNA, 25 bp, Mus musculus
tcccaggaggactcatagctttccc

SEQ ID NO: 814111 - DNA, 25 bp, Mus musculus
tcccaggagggtaaggcaattccca

SEQ ID NO: 814112 - DNA, 25 bp, Mus musculus
tcccaggagggttaggcaattccca

SEQ ID NO: 814113 - DNA, 25 bp, Mus musculus
tcccaggagtagaaatgcgtgatca

SEQ ID NO: 814114 - DNA, 25 bp, Mus musculus
tcccaggagtagtaatgcgtgatca

SEQ ID NO: 814115 - DNA, 25 bp, Mus musculus
tcccaggagtcacaggtcagcaagt

SEQ ID NO: 814116 - DNA, 25 bp, Mus musculus
tcccaggagtcagaggtcagcaagt

SEQ ID NO: 814117 - DNA, 25 bp, Mus musculus
tcccaggcaccaagtcagtattgta

SEQ ID NO: 814118 - DNA, 25 bp, Mus musculus
tcccaggcaccatgtcagtattgta

SEQ ID NO: 814119 - DNA, 25 bp, Mus musculus
tcccaggcagcaactgtcagtatgt

SEQ ID NO: 814120 - DNA, 25 bp, Mus musculus
tcccaggcagcatctgtcagtatgt

SEQ ID NO: 814121 - DNA, 25 bp, Mus musculus
tcccaggcagccataggcaaggtgt

SEQ ID NO: 814122 - DNA, 25 bp, Mus musculus
tcccaggcagccttaggcaaggtgt

SEQ ID NO: 814123 - DNA, 25 bp, Mus musculus
tcccaggcagggaagaaacatacag

SEQ ID NO: 814124 - DNA, 25 bp, Mus musculus
tcccaggcagggtagaaacatacag

SEQ ID NO: 814125 - DNA, 25 bp, Mus musculus
tcccaggcatgcagtgtagtgcaac

SEQ ID NO: 814126 - DNA, 25 bp, Mus musculus
tcccaggcatgctgtgtagtgcaac

SEQ ID NO: 814127 - DNA, 25 bp, Mus musculus
tcccaggcatgtaagcttcctctcc

SEQ ID NO: 814128 - DNA, 25 bp, Mus musculus
tcccaggcatgttagcttcctctcc

SEQ ID NO: 814129 - DNA, 25 bp, Mus musculus
tcccaggcccagacttagaaagaca

SEQ ID NO: 814130 - DNA, 25 bp, Mus musculus
tcccaggcccagtcttagaaagaca

SEQ ID NO: 814131 - DNA, 25 bp, Mus musculus
tcccaggccctaactaataacacta

SEQ ID NO: 814132 - DNA, 25 bp, Mus musculus
tcccaggccctatctaataacacta

SEQ ID NO: 814133 - DNA, 25 bp, Mus musculus
tcccaggccctcaacatttctaatt

SEQ ID NO: 814134 - DNA, 25 bp, Mus musculus
tcccaggccctctacatttctaatt

SEQ ID NO: 814135 - DNA, 25 bp, Mus musculus
tcccaggccctgaggaggtgagact

SEQ ID NO: 814136 - DNA, 25 bp, Mus musculus
tcccaggccctgtggaggtgagact

SEQ ID NO: 814137 - DNA, 25 bp, Mus musculus
tcccaggcctggacctcttgggtga

SEQ ID NO: 814138 - DNA, 25 bp, Mus musculus
tcccaggcctggtcctcttgggtga

SEQ ID NO: 814139 - DNA, 25 bp, Mus musculus
tcccaggcgccaaattgggactact

SEQ ID NO: 814140 - DNA, 25 bp, Mus musculus
tcccaggcgccatattgggactact

SEQ ID NO: 814141 - DNA, 25 bp, Mus musculus
tcccaggcggttcctagaagtcagt

SEQ ID NO: 814142 - DNA, 25 bp, Mus musculus
tcccaggcggttgctagaagtcagt

SEQ ID NO: 814143 - DNA, 25 bp, Mus musculus
tcccaggctactaagggagatggga

SEQ ID NO: 814144 - DNA, 25 bp, Mus musculus
tcccaggctacttagggagatggga

SEQ ID NO: 814145 - DNA, 25 bp, Mus musculus
tcccaggctcagacagccaaggttc

SEQ ID NO: 814146 - DNA, 25 bp, Mus musculus
tcccaggctcagtcagccaaggttc

SEQ ID NO: 814147 - DNA, 25 bp, Mus musculus
tcccaggctcatcggccaactagag

SEQ ID NO: 814148 - DNA, 25 bp, Mus musculus
tcccaggctcatgggccaactagag

SEQ ID NO: 814149 - DNA, 25 bp, Mus musculus
tcccaggctcctcgttgtaggagaa

SEQ ID NO: 814150 - DNA, 25 bp, Mus musculus
tcccaggctcctggttgtaggagaa

SEQ ID NO: 814151 - DNA, 25 bp, Mus musculus
tcccaggctcgaagggcagacggtc

SEQ ID NO: 814152 - DNA, 25 bp, Mus musculus
tcccaggctcgatgggcagacggtc

SEQ ID NO: 814153 - DNA, 25 bp, Mus musculus
tcccaggctcggaatgatccatgta

SEQ ID NO: 814154 - DNA, 25 bp, Mus musculus
tcccaggctcggtatgatccatgta

SEQ ID NO: 814155 - DNA, 25 bp, Mus musculus
tcccaggctctacctacagaggctt

SEQ ID NO: 814156 - DNA, 25 bp, Mus musculus
tcccaggctctagctacagaggctt

SEQ ID NO: 814157 - DNA, 25 bp, Mus musculus
tcccaggctgggacttacgtctaag

SEQ ID NO: 814158 - DNA, 25 bp, Mus musculus
tcccaggctgggtcttacgtctaag

SEQ ID NO: 814159 - DNA, 25 bp, Mus musculus
tcccagggaactaaggctgaggttt

SEQ ID NO: 814160 - DNA, 25 bp, Mus musculus
tcccagggaacttaggctgaggttt

SEQ ID NO: 814161 - DNA, 25 bp, Mus musculus
tcccagggactcaatgtaccaatca

SEQ ID NO: 814162 - DNA, 25 bp, Mus musculus
tcccagggactctatgtaccaatca

SEQ ID NO: 814163 - DNA, 25 bp, Mus musculus
tcccagggatccacgcggtaagaga

SEQ ID NO: 814164 - DNA, 25 bp, Mus musculus
tcccagggatcctcgcggtaagaga

SEQ ID NO: 814165 - DNA, 25 bp, Mus musculus
tcccagggattcactgcatgcattc

SEQ ID NO: 814166 - DNA, 25 bp, Mus musculus
tcccagggattctctgcatgcattc

SEQ ID NO: 814167 - DNA, 25 bp, Mus musculus
tcccagggatttcgctgcacagcaa

SEQ ID NO: 814168 - DNA, 25 bp, Mus musculus
tcccagggatttggctgcacagcaa

SEQ ID NO: 814169 - DNA, 25 bp, Mus musculus
tcccagggcaaaagatgcctgcaat

SEQ ID NO: 814170 - DNA, 25 bp, Mus musculus
tcccagggcaaatgatgcctgcaat

SEQ ID NO: 814171 - DNA, 25 bp, Mus musculus
tcccagggccagatccaagcaataa

SEQ ID NO: 814172 - DNA, 25 bp, Mus musculus
tcccagggccagttccaagcaataa

SEQ ID NO: 814173 - DNA, 25 bp, Mus musculus
tcccagggcccaattgcagagaaaa

SEQ ID NO: 814174 - DNA, 25 bp, Mus musculus
tcccagggcccatttgcagagaaaa

SEQ ID NO: 814175 - DNA, 25 bp, Mus musculus
tcccaggggcagcttggatgagaaa

SEQ ID NO: 814176 - DNA, 25 bp, Mus musculus
tcccaggggcaggttggatgagaaa

SEQ ID NO: 814177 - DNA, 25 bp, Mus musculus
tcccagggtcgtcgaactaccgaag

SEQ ID NO: 814178 - DNA, 25 bp, Mus musculus
tcccagggtcgtggaactaccgaag

SEQ ID NO: 814179 - DNA, 25 bp, Mus musculus
tcccagggttacaagacatttgatg

SEQ ID NO: 814180 - DNA, 25 bp, Mus musculus
tcccagggttactagacatttgatg

SEQ ID NO: 814181 - DNA, 25 bp, Mus musculus
tcccagggttcaaataagttcttgg

SEQ ID NO: 814182 - DNA, 25 bp, Mus musculus
tcccagggttcacatcagaaatgtt

SEQ ID NO: 814183 - DNA, 25 bp, Mus musculus
tcccagggttcagatcagaaatgtt

SEQ ID NO: 814184 - DNA, 25 bp, Mus musculus
tcccagggttcatataagttcttgg

SEQ ID NO: 814185 - DNA, 25 bp, Mus musculus
tcccagggttctacagaaatctgaa

SEQ ID NO: 814186 - DNA, 25 bp, Mus musculus
tcccagggttcttcagaaatctgaa

SEQ ID NO: 814187 - DNA, 25 bp, Mus musculus
tcccaggtaaccattaagacttgtt

SEQ ID NO: 814188 - DNA, 25 bp, Mus musculus
tcccaggtaacctttaagacttgtt

SEQ ID NO: 814189 - DNA, 25 bp, Mus musculus
tcccaggtactgagttgcttccgtt

SEQ ID NO: 814190 - DNA, 25 bp, Mus musculus
tcccaggtactgtgttgcttccgtt

SEQ ID NO: 814191 - DNA, 25 bp, Mus musculus
tcccaggtatgtatgtcactccctg

SEQ ID NO: 814192 - DNA, 25 bp, Mus musculus
tcccaggtatgtttgtcactccctg

SEQ ID NO: 814193 - DNA, 25 bp, Mus musculus
tcccaggtcatgcagcatcttgaaa

SEQ ID NO: 814194 - DNA, 25 bp, Mus musculus
tcccaggtcatggagcatcttgaaa

SEQ ID NO: 814195 - DNA, 25 bp, Mus musculus
tcccaggtcccacgtttctcaatga

SEQ ID NO: 814196 - DNA, 25 bp, Mus musculus
tcccaggtcccaggtttctcaatga

SEQ ID NO: 814197 - DNA, 25 bp, Mus musculus
tcccaggtcctcctagaaatctggt

SEQ ID NO: 814198 - DNA, 25 bp, Mus musculus
tcccaggtcctcgtagaaatctggt

SEQ ID NO: 814199 - DNA, 25 bp, Mus musculus
tcccaggtccttatacatctaacaa

SEQ ID NO: 814200 - DNA, 25 bp, Mus musculus
tcccaggtccttttacatctaacaa

SEQ ID NO: 814201 - DNA, 25 bp, Mus musculus
tcccaggtgcccagagtgttgatat

SEQ ID NO: 814202 - DNA, 25 bp, Mus musculus
tcccaggtgccctgagtgttgatat

SEQ ID NO: 814203 - DNA, 25 bp, Mus musculus
tcccaggtgcctatgctgcagaaac

SEQ ID NO: 814204 - DNA, 25 bp, Mus musculus
tcccaggtgcctttgctgcagaaac

SEQ ID NO: 814205 - DNA, 25 bp, Mus musculus
tcccaggtgggcaagcatctgtgag

SEQ ID NO: 814206 - DNA, 25 bp, Mus musculus
tcccaggtgggctagcatctgtgag

SEQ ID NO: 814207 - DNA, 25 bp, Mus musculus
tcccaggtgtccatcccagcagtgt

SEQ ID NO: 814208 - DNA, 25 bp, Mus musculus
tcccaggtgtccttcccagcagtgt

SEQ ID NO: 814209 - DNA, 25 bp, Mus musculus
tcccaggtgtgtccaatcgcagaca

SEQ ID NO: 814210 - DNA, 25 bp, Mus musculus
tcccaggtgtgtgcaatcgcagaca

SEQ ID NO: 814211 - DNA, 25 bp, Mus musculus
tcccaggttaaactccttcagtatt

SEQ ID NO: 814212 - DNA, 25 bp, Mus musculus
tcccaggttaaagtccttcagtatt

SEQ ID NO: 814213 - DNA, 25 bp, Mus musculus
tcccaggttacgatcccaggaatgc

SEQ ID NO: 814214 - DNA, 25 bp, Mus musculus
tcccaggttacgttcccaggaatgc

SEQ ID NO: 814215 - DNA, 25 bp, Mus musculus
tcccaggttcatcaaaggcatttca

SEQ ID NO: 814216 - DNA, 25 bp, Mus musculus
tcccaggttcatgaaaggcatttca

SEQ ID NO: 814217 - DNA, 25 bp, Mus musculus
tcccaggttccacacgacacggtaa

SEQ ID NO: 814218 - DNA, 25 bp, Mus musculus
tcccaggttccactctttaatttca

SEQ ID NO: 814219 - DNA, 25 bp, Mus musculus
tcccaggttccagacgacacggtaa

SEQ ID NO: 814220 - DNA, 25 bp, Mus musculus
tcccaggttccagtctttaatttca

SEQ ID NO: 814221 - DNA, 25 bp, Mus musculus
tcccaggttctcaaaatttgtaaat

SEQ ID NO: 814222 - DNA, 25 bp, Mus musculus
tcccaggttctctaaatttgtaaat

SEQ ID NO: 814223 - DNA, 25 bp, Mus musculus
tcccaggttctgctgggttttgtct

SEQ ID NO: 814224 - DNA, 25 bp, Mus musculus
tcccaggttctggtgggttttgtct

SEQ ID NO: 814225 - DNA, 25 bp, Mus musculus
tcccaggttgagctagtgagctttc

SEQ ID NO: 814226 - DNA, 25 bp, Mus musculus
tcccaggttgaggtagtgagctttc

SEQ ID NO: 814227 - DNA, 25 bp, Mus musculus
tcccaggtttaaattctagcaacca

SEQ ID NO: 814228 - DNA, 25 bp, Mus musculus
tcccaggtttaatttctagcaacca

SEQ ID NO: 814229 - DNA, 25 bp, Mus musculus
tcccaggtttctccaaggtaacgaa

SEQ ID NO: 814230 - DNA, 25 bp, Mus musculus
tcccaggtttctgcaaggtaacgaa

SEQ ID NO: 814231 - DNA, 25 bp, Mus musculus
tcccaggttttgcatccgtgaacag

SEQ ID NO: 814232 - DNA, 25 bp, Mus musculus
tcccaggttttggatccgtgaacag

SEQ ID NO: 814233 - DNA, 25 bp, Mus musculus
tcccagtacattcgacctacacagt

SEQ ID NO: 814234 - DNA, 25 bp, Mus musculus
tcccagtacattctcccatctattt

SEQ ID NO: 814235 - DNA, 25 bp, Mus musculus
tcccagtacattggacctacacagt

SEQ ID NO: 814236 - DNA, 25 bp, Mus musculus
tcccagtacattgtcccatctattt

SEQ ID NO: 814237 - DNA, 25 bp, Mus musculus
tcccagtaccaacatggcaactcat

SEQ ID NO: 814238 - DNA, 25 bp, Mus musculus
tcccagtaccaagatggcaactcat

SEQ ID NO: 814239 - DNA, 25 bp, Mus musculus
tcccagtattgaagcagtttatgaa

SEQ ID NO: 814240 - DNA, 25 bp, Mus musculus
tcccagtattgatgcagtttatgaa

SEQ ID NO: 814241 - DNA, 25 bp, Mus musculus
tcccagtcccaaactctaaatctaa

SEQ ID NO: 814242 - DNA, 25 bp, Mus musculus
tcccagtcccaatctctaaatctaa

SEQ ID NO: 814243 - DNA, 25 bp, Mus musculus
tcccagtcccataaagagtggaaag

SEQ ID NO: 814244 - DNA, 25 bp, Mus musculus
tcccagtcccattaagagtggaaag

SEQ ID NO: 814245 - DNA, 25 bp, Mus musculus
tcccagtccctgctagctcagatgt

SEQ ID NO: 814246 - DNA, 25 bp, Mus musculus
tcccagtccctggtagctcagatgt

SEQ ID NO: 814247 - DNA, 25 bp, Mus musculus
tcccagtcctctactgatttgtgaa

SEQ ID NO: 814248 - DNA, 25 bp, Mus musculus
tcccagtcctcttctgatttgtgaa

SEQ ID NO: 814249 - DNA, 25 bp, Mus musculus
tcccagtcctggagtcatctttagg

SEQ ID NO: 814250 - DNA, 25 bp, Mus musculus
tcccagtcctggtgtcatctttagg

SEQ ID NO: 814251 - DNA, 25 bp, Mus musculus
tcccagtccttgcttggaatgtcat

SEQ ID NO: 814252 - DNA, 25 bp, Mus musculus
tcccagtccttggttggaatgtcat

SEQ ID NO: 814253 - DNA, 25 bp, Mus musculus
tcccagtctaggattgcgtttgttt

SEQ ID NO: 814254 - DNA, 25 bp, Mus musculus
tcccagtctaggtttgcgtttgttt

SEQ ID NO: 814255 - DNA, 25 bp, Mus musculus
tcccagtctgcaatatcacacccaa

SEQ ID NO: 814256 - DNA, 25 bp, Mus musculus
tcccagtctgcattatcacacccaa

SEQ ID NO: 814257 - DNA, 25 bp, Mus musculus
tcccagtgcatgctgagactacaga

SEQ ID NO: 814258 - DNA, 25 bp, Mus musculus
tcccagtgcatggtgagactacaga

SEQ ID NO: 814259 - DNA, 25 bp, Mus musculus
tcccagtgcgggaagctaactctgt

SEQ ID NO: 814260 - DNA, 25 bp, Mus musculus
tcccagtgcgggtagctaactctgt

SEQ ID NO: 814261 - DNA, 25 bp, Mus musculus
tcccagtggctgcaagtcagacatc

SEQ ID NO: 814262 - DNA, 25 bp, Mus musculus
tcccagtggctggaagtcagacatc

SEQ ID NO: 814263 - DNA, 25 bp, Mus musculus
tcccagtgggacagcgcctgcagtt

SEQ ID NO: 814264 - DNA, 25 bp, Mus musculus
tcccagtgggactgcgcctgcagtt

SEQ ID NO: 814265 - DNA, 25 bp, Mus musculus
tcccagtgtgtgcaagcatccattg

SEQ ID NO: 814266 - DNA, 25 bp, Mus musculus
tcccagtgtgtggaagcatccattg

SEQ ID NO: 814267 - DNA, 25 bp, Mus musculus
tcccagttagtcatattttttctct

SEQ ID NO: 814268 - DNA, 25 bp, Mus musculus
tcccagttagtcttattttttctct

SEQ ID NO: 814269 - DNA, 25 bp, Mus musculus
tcccagttcagtcttctgatgcgac

SEQ ID NO: 814270 - DNA, 25 bp, Mus musculus
tcccagttcagtgttctgatgcgac

SEQ ID NO: 814271 - DNA, 25 bp, Mus musculus
tcccagttcctgaagatttcctact

SEQ ID NO: 814272 - DNA, 25 bp, Mus musculus
tcccagttcctgtagatttcctact

SEQ ID NO: 814273 - DNA, 25 bp, Mus musculus
tcccagttcttcaaattgtaagcca

SEQ ID NO: 814274 - DNA, 25 bp, Mus musculus
tcccagttcttctaattgtaagcca

SEQ ID NO: 814275 - DNA, 25 bp, Mus musculus
tcccagttgagccatttcgttttta

SEQ ID NO: 814276 - DNA, 25 bp, Mus musculus
tcccagttgagcgatttcgttttta

SEQ ID NO: 814277 - DNA, 25 bp, Mus musculus
tcccagttgcttcgcagtgcattta

SEQ ID NO: 814278 - DNA, 25 bp, Mus musculus
tcccagttgcttggcagtgcattta

SEQ ID NO: 814279 - DNA, 25 bp, Mus musculus
tcccagttggtcacactgtttggtg

SEQ ID NO: 814280 - DNA, 25 bp, Mus musculus
tcccagttggtctcactgtttggtg

SEQ ID NO: 814281 - DNA, 25 bp, Mus musculus
tcccagttgtggaccctgtttagag

SEQ ID NO: 814282 - DNA, 25 bp, Mus musculus
tcccagttgtggtccctgtttagag

SEQ ID NO: 814283 - DNA, 25 bp, Mus musculus
tcccagtttacacgcctcagcagag

SEQ ID NO: 814284 - DNA, 25 bp, Mus musculus
tcccagtttacacgtctttattaag

SEQ ID NO: 814285 - DNA, 25 bp, Mus musculus
tcccagtttacaggcctcagcagag

SEQ ID NO: 814286 - DNA, 25 bp, Mus musculus
tcccagtttacaggtctttattaag

SEQ ID NO: 814287 - DNA, 25 bp, Mus musculus
tcccagtttactcaggcttccagac

SEQ ID NO: 814288 - DNA, 25 bp, Mus musculus
tcccagtttactgaggcttccagac

SEQ ID NO: 814289 - DNA, 25 bp, Mus musculus
tcccagtttctgaatagaatcgcac

SEQ ID NO: 814290 - DNA, 25 bp, Mus musculus
tcccagtttctgtatagaatcgcac

SEQ ID NO: 814291 - DNA, 25 bp, Mus musculus
tcccagtttgagagatagcatatgt

SEQ ID NO: 814292 - DNA, 25 bp, Mus musculus
tcccagtttgagtgatagcatatgt

SEQ ID NO: 814293 - DNA, 25 bp, Mus musculus
tcccagtttggaatcagcatttttc

SEQ ID NO: 814294 - DNA, 25 bp, Mus musculus
tcccagtttggacatgccttcgaaa

SEQ ID NO: 814295 - DNA, 25 bp, Mus musculus
tcccagtttggagatgccttcgaaa

SEQ ID NO: 814296 - DNA, 25 bp, Mus musculus
tcccagtttggattcagcatttttc

SEQ ID NO: 814297 - DNA, 25 bp, Mus musculus
tcccagtttgggagatggcctacaa

SEQ ID NO: 814298 - DNA, 25 bp, Mus musculus
tcccagtttgggtgatggcctacaa

SEQ ID NO: 814299 - DNA, 25 bp, Mus musculus
tcccagtttgttagtgtactaataa

SEQ ID NO: 814300 - DNA, 25 bp, Mus musculus
tcccagtttgtttgtgtactaataa

SEQ ID NO: 814301 - DNA, 25 bp, Mus musculus
tcccataaaaaacatccgaagacct

SEQ ID NO: 814302 - DNA, 25 bp, Mus musculus
tcccataaaaaagatccgaagacct

SEQ ID NO: 814303 - DNA, 25 bp, Mus musculus
tcccataaatcaattgttttccaat

SEQ ID NO: 814304 - DNA, 25 bp, Mus musculus
tcccataaatcatttgttttccaat

SEQ ID NO: 814305 - DNA, 25 bp, Mus musculus
tcccataactgccttgtctgctgtc

SEQ ID NO: 814306 - DNA, 25 bp, Mus musculus
tcccataactgcgttgtctgctgtc

SEQ ID NO: 814307 - DNA, 25 bp, Mus musculus
tcccatacccagagaatgcctaaaa

SEQ ID NO: 814308 - DNA, 25 bp, Mus musculus
tcccatacccagtgaatgcctaaaa

SEQ ID NO: 814309 - DNA, 25 bp, Mus musculus
tcccatacctatcacgttcagatgt

SEQ ID NO: 814310 - DNA, 25 bp, Mus musculus
tcccatacctatgacgttcagatgt

SEQ ID NO: 814311 - DNA, 25 bp, Mus musculus
tcccatacctgtattaatcttctag

SEQ ID NO: 814312 - DNA, 25 bp, Mus musculus
tcccatacctgttttaatcttctag

SEQ ID NO: 814313 - DNA, 25 bp, Mus musculus
tcccatacggtaaaagccaatctaa

SEQ ID NO: 814314 - DNA, 25 bp, Mus musculus
tcccatacggtataagccaatctaa

SEQ ID NO: 814315 - DNA, 25 bp, Mus musculus
tcccatacgtggaattccaggactg

SEQ ID NO: 814316 - DNA, 25 bp, Mus musculus
tcccatacgtggtattccaggactg

SEQ ID NO: 814317 - DNA, 25 bp, Mus musculus
tcccatactcagacagtgctgcaga

SEQ ID NO: 814318 - DNA, 25 bp, Mus musculus
tcccatactcagtcagtgctgcaga

SEQ ID NO: 814319 - DNA, 25 bp, Mus musculus
tcccatagggtcagaccagtgctct

SEQ ID NO: 814320 - DNA, 25 bp, Mus musculus
tcccatagggtctgaccagtgctct

SEQ ID NO: 814321 - DNA, 25 bp, Mus musculus
tcccatagtcacacacaatgatatt

SEQ ID NO: 814322 - DNA, 25 bp, Mus musculus
tcccatagtcactcacaatgatatt

SEQ ID NO: 814323 - DNA, 25 bp, Mus musculus
tcccatatacctagttgattctatt

SEQ ID NO: 814324 - DNA, 25 bp, Mus musculus
tcccatataccttgttgattctatt

SEQ ID NO: 814325 - DNA, 25 bp, Mus musculus
tcccatatctacacctcttgtaaat

SEQ ID NO: 814326 - DNA, 25 bp, Mus musculus
tcccatatctactcctcttgtaaat

SEQ ID NO: 814327 - DNA, 25 bp, Mus musculus
tcccatcaaaacagcacttcatatg

SEQ ID NO: 814328 - DNA, 25 bp, Mus musculus
tcccatcaaaactgcacttcatatg

SEQ ID NO: 814329 - DNA, 25 bp, Mus musculus
tcccatcaaagccttttaagcggaa

SEQ ID NO: 814330 - DNA, 25 bp, Mus musculus
tcccatcaaagcgttttaagcggaa

SEQ ID NO: 814331 - DNA, 25 bp, Mus musculus
tcccatcaacaaatctgtcattcct

SEQ ID NO: 814332 - DNA, 25 bp, Mus musculus
tcccatcaacaattctgtcattcct

SEQ ID NO: 814333 - DNA, 25 bp, Mus musculus
tcccatcaccagattctcatagatt

SEQ ID NO: 814334 - DNA, 25 bp, Mus musculus
tcccatcaccagtttctcatagatt

SEQ ID NO: 814335 - DNA, 25 bp, Mus musculus
tcccatcagccaaggattccagcat

SEQ ID NO: 814336 - DNA, 25 bp, Mus musculus
tcccatcagccaattcagcctaaag

SEQ ID NO: 814337 - DNA, 25 bp, Mus musculus
tcccatcagccatggattccagcat

SEQ ID NO: 814338 - DNA, 25 bp, Mus musculus
tcccatcagccatttcagcctaaag

SEQ ID NO: 814339 - DNA, 25 bp, Mus musculus
tcccatcagctcatctgattctgtc

SEQ ID NO: 814340 - DNA, 25 bp, Mus musculus
tcccatcagctcttctgattctgtc

SEQ ID NO: 814341 - DNA, 25 bp, Mus musculus
tcccatcaggcgctcataaagactc

SEQ ID NO: 814342 - DNA, 25 bp, Mus musculus
tcccatcaggcggtcataaagactc

SEQ ID NO: 814343 - DNA, 25 bp, Mus musculus
tcccatcagttgcaattagtacctt

SEQ ID NO: 814344 - DNA, 25 bp, Mus musculus
tcccatcagttggaattagtacctt

SEQ ID NO: 814345 - DNA, 25 bp, Mus musculus
tcccatccaaacaacattgcacagt

SEQ ID NO: 814346 - DNA, 25 bp, Mus musculus
tcccatccaaactacattgcacagt

SEQ ID NO: 814347 - DNA, 25 bp, Mus musculus
tcccatcccatgctctatttaaaat

SEQ ID NO: 814348 - DNA, 25 bp, Mus musculus
tcccatcccatggtctatttaaaat

SEQ ID NO: 814349 - DNA, 25 bp, Mus musculus
tcccatccgcagatcaacaagatag

SEQ ID NO: 814350 - DNA, 25 bp, Mus musculus
tcccatccgcagttcaacaagatag

SEQ ID NO: 814351 - DNA, 25 bp, Mus musculus
tcccatccgctcatgtgaatgttta

SEQ ID NO: 814352 - DNA, 25 bp, Mus musculus
tcccatccgctcttgtgaatgttta

SEQ ID NO: 814353 - DNA, 25 bp, Mus musculus
tcccatcctcttacacttggaagaa

SEQ ID NO: 814354 - DNA, 25 bp, Mus musculus
tcccatcctctttcacttggaagaa

SEQ ID NO: 814355 - DNA, 25 bp, Mus musculus
tcccatcctgatatcctttctattt

SEQ ID NO: 814356 - DNA, 25 bp, Mus musculus
tcccatcctgatttcctttctattt

SEQ ID NO: 814357 - DNA, 25 bp, Mus musculus
tcccatcctggtatacttgttttta

SEQ ID NO: 814358 - DNA, 25 bp, Mus musculus
tcccatcctggtttacttgttttta

SEQ ID NO: 814359 - DNA, 25 bp, Mus musculus
tcccatccttcccttgtgtataaat

SEQ ID NO: 814360 - DNA, 25 bp, Mus musculus
tcccatccttccgttgtgtataaat

SEQ ID NO: 814361 - DNA, 25 bp, Mus musculus
tcccatcctttgcagagcaggacta

SEQ ID NO: 814362 - DNA, 25 bp, Mus musculus
tcccatcctttggagagcaggacta

SEQ ID NO: 814363 - DNA, 25 bp, Mus musculus
tcccatcgacagatttataacttgt

SEQ ID NO: 814364 - DNA, 25 bp, Mus musculus
tcccatcgacagttttataacttgt

SEQ ID NO: 814365 - DNA, 25 bp, Mus musculus
tcccatctcacaacttaactgtttc

SEQ ID NO: 814366 - DNA, 25 bp, Mus musculus
tcccatctcacatcttaactgtttc

SEQ ID NO: 814367 - DNA, 25 bp, Mus musculus
tcccatctcagtatgcaaaaagcac

SEQ ID NO: 814368 - DNA, 25 bp, Mus musculus
tcccatctcagtttgcaaaaagcac

SEQ ID NO: 814369 - DNA, 25 bp, Mus musculus
tcccatctccgtcgactctgtgaaa

SEQ ID NO: 814370 - DNA, 25 bp, Mus musculus
tcccatctccgtggactctgtgaaa

SEQ ID NO: 814371 - DNA, 25 bp, Mus musculus
tcccatctcttcagctgttccagag

SEQ ID NO: 814372 - DNA, 25 bp, Mus musculus
tcccatctcttctgctgttccagag

SEQ ID NO: 814373 - DNA, 25 bp, Mus musculus
tcccatctgcatatgtttgtgcttt

SEQ ID NO: 814374 - DNA, 25 bp, Mus musculus
tcccatctgcatttgtttgtgcttt

SEQ ID NO: 814375 - DNA, 25 bp, Mus musculus
tcccatctgctcaggaaggaagctt

SEQ ID NO: 814376 - DNA, 25 bp, Mus musculus
tcccatctgctctggaaggaagctt

SEQ ID NO: 814377 - DNA, 25 bp, Mus musculus
tcccatctggacattcaaggttctt

SEQ ID NO: 814378 - DNA, 25 bp, Mus musculus
tcccatctggactttcaaggttctt

SEQ ID NO: 814379 - DNA, 25 bp, Mus musculus
tcccatctgggtctaagccgagctc

SEQ ID NO: 814380 - DNA, 25 bp, Mus musculus
tcccatctgggtgtaagccgagctc

SEQ ID NO: 814381 - DNA, 25 bp, Mus musculus
tcccatctgtctaccaggagttagc

SEQ ID NO: 814382 - DNA, 25 bp, Mus musculus
tcccatctgtcttccaggagttagc

SEQ ID NO: 814383 - DNA, 25 bp, Mus musculus
tcccatctgttaaccttgttttgtg

SEQ ID NO: 814384 - DNA, 25 bp, Mus musculus
tcccatctgttatccttgttttgtg

SEQ ID NO: 814385 - DNA, 25 bp, Mus musculus
tcccatcttagcagagccctgactg

SEQ ID NO: 814386 - DNA, 25 bp, Mus musculus
tcccatcttagctgagccctgactg

SEQ ID NO: 814387 - DNA, 25 bp, Mus musculus
tcccatcttatactgtttgcttttg

SEQ ID NO: 814388 - DNA, 25 bp, Mus musculus
tcccatcttatagtgtttgcttttg

SEQ ID NO: 814389 - DNA, 25 bp, Mus musculus
tcccatcttcaaatccagaatcaaa

SEQ ID NO: 814390 - DNA, 25 bp, Mus musculus
tcccatcttcaattccagaatcaaa

SEQ ID NO: 814391 - DNA, 25 bp, Mus musculus
tcccatcttggcataaggaagcttt

SEQ ID NO: 814392 - DNA, 25 bp, Mus musculus
tcccatcttggcttaaggaagcttt

SEQ ID NO: 814393 - DNA, 25 bp, Mus musculus
tcccatcttttcacgcacaagtgct

SEQ ID NO: 814394 - DNA, 25 bp, Mus musculus
tcccatcttttctcgcacaagtgct

SEQ ID NO: 814395 - DNA, 25 bp, Mus musculus
tcccatgaaatgaccaaatcctgaa

SEQ ID NO: 814396 - DNA, 25 bp, Mus musculus
tcccatgaaatgtccaaatcctgaa

SEQ ID NO: 814397 - DNA, 25 bp, Mus musculus
tcccatgaatttcccctgcaggaga

SEQ ID NO: 814398 - DNA, 25 bp, Mus musculus
tcccatgaatttgccctgcaggaga

SEQ ID NO: 814399 - DNA, 25 bp, Mus musculus
tcccatgacaccctaagcaattatg

SEQ ID NO: 814400 - DNA, 25 bp, Mus musculus
tcccatgacaccgtaagcaattatg

SEQ ID NO: 814401 - DNA, 25 bp, Mus musculus
tcccatgaccagagtgtccatctta

SEQ ID NO: 814402 - DNA, 25 bp, Mus musculus
tcccatgaccagtgtgtccatctta

SEQ ID NO: 814403 - DNA, 25 bp, Mus musculus
tcccatgactggagactgtttaaca

SEQ ID NO: 814404 - DNA, 25 bp, Mus musculus
tcccatgactggtgactgtttaaca

SEQ ID NO: 814405 - DNA, 25 bp, Mus musculus
tcccatgactttaactcagtgggtt

SEQ ID NO: 814406 - DNA, 25 bp, Mus musculus
tcccatgacttttactcagtgggtt

SEQ ID NO: 814407 - DNA, 25 bp, Mus musculus
tcccatgagcccacggaggcaagaa

SEQ ID NO: 814408 - DNA, 25 bp, Mus musculus
tcccatgagccctcggaggcaagaa

SEQ ID NO: 814409 - DNA, 25 bp, Mus musculus
tcccatgaggccctcctttgaggat

SEQ ID NO: 814410 - DNA, 25 bp, Mus musculus
tcccatgaggccgtcctttgaggat

SEQ ID NO: 814411 - DNA, 25 bp, Mus musculus
tcccatgatggacacttgggctttg

SEQ ID NO: 814412 - DNA, 25 bp, Mus musculus
tcccatgatggagacttgggctttg

SEQ ID NO: 814413 - DNA, 25 bp, Mus musculus
tcccatgcaatccatctctgaaagg

SEQ ID NO: 814414 - DNA, 25 bp, Mus musculus
tcccatgcaatcgatctctgaaagg

SEQ ID NO: 814415 - DNA, 25 bp, Mus musculus
tcccatgcaggacaagagacttgag

SEQ ID NO: 814416 - DNA, 25 bp, Mus musculus
tcccatgcaggagaagagacttgag

SEQ ID NO: 814417 - DNA, 25 bp, Mus musculus
tcccatgcctttcgtactgccaagg

SEQ ID NO: 814418 - DNA, 25 bp, Mus musculus
tcccatgcctttggtactgccaagg

SEQ ID NO: 814419 - DNA, 25 bp, Mus musculus
tcccatgctattctttttcatcaca

SEQ ID NO: 814420 - DNA, 25 bp, Mus musculus
tcccatgctattgtttttcatcaca

SEQ ID NO: 814421 - DNA, 25 bp, Mus musculus
tcccatgctgcacttttttattctg

SEQ ID NO: 814422 - DNA, 25 bp, Mus musculus
tcccatgctgcagttttttattctg

SEQ ID NO: 814423 - DNA, 25 bp, Mus musculus
tcccatgctgggaagtgatgcccaa

SEQ ID NO: 814424 - DNA, 25 bp, Mus musculus
tcccatgctgggtagtgatgcccaa

SEQ ID NO: 814425 - DNA, 25 bp, Mus musculus
tcccatgcttaacttgctctctatg

SEQ ID NO: 814426 - DNA, 25 bp, Mus musculus
tcccatgcttaagttgctctctatg

SEQ ID NO: 814427 - DNA, 25 bp, Mus musculus
tcccatggacacagtgcatcatgtg

SEQ ID NO: 814428 - DNA, 25 bp, Mus musculus
tcccatggacactgtgcatcatgtg

SEQ ID NO: 814429 - DNA, 25 bp, Mus musculus
tcccatggagtaagtcggcatacca

SEQ ID NO: 814430 - DNA, 25 bp, Mus musculus
tcccatggagtatgtcggcatacca

SEQ ID NO: 814431 - DNA, 25 bp, Mus musculus
tcccatggagtcacctaagccagca

SEQ ID NO: 814432 - DNA, 25 bp, Mus musculus
tcccatggagtctcctaagccagca

SEQ ID NO: 814433 - DNA, 25 bp, Mus musculus
tcccatggctccctactaaggaaat

SEQ ID NO: 814434 - DNA, 25 bp, Mus musculus
tcccatggctccgtactaaggaaat

SEQ ID NO: 814435 - DNA, 25 bp, Mus musculus
tcccatggcttcacttggtatacac

SEQ ID NO: 814436 - DNA, 25 bp, Mus musculus
tcccatggcttctcttggtatacac

SEQ ID NO: 814437 - DNA, 25 bp, Mus musculus
tcccatgggacaccacacacactac

SEQ ID NO: 814438 - DNA, 25 bp, Mus musculus
tcccatgggacagcacacacactac

SEQ ID NO: 814439 - DNA, 25 bp, Mus musculus
tcccatgggcaaagcttgatcttat

SEQ ID NO: 814440 - DNA, 25 bp, Mus musculus
tcccatgggcaatgcttgatcttat

SEQ ID NO: 814441 - DNA, 25 bp, Mus musculus
tcccatgggcagaggaccaggctgt

SEQ ID NO: 814442 - DNA, 25 bp, Mus musculus
tcccatgggcagtggaccaggctgt

SEQ ID NO: 814443 - DNA, 25 bp, Mus musculus
tcccatgggtggcaggacacatgta

SEQ ID NO: 814444 - DNA, 25 bp, Mus musculus
tcccatgggtgggaggacacatgta

SEQ ID NO: 814445 - DNA, 25 bp, Mus musculus
tcccatggtggaatagactctgtaa

SEQ ID NO: 814446 - DNA, 25 bp, Mus musculus
tcccatggtggattagactctgtaa

SEQ ID NO: 814447 - DNA, 25 bp, Mus musculus
tcccatggtttccagtcagtaggat

SEQ ID NO: 814448 - DNA, 25 bp, Mus musculus
tcccatggtttcgagtcagtaggat

SEQ ID NO: 814449 - DNA, 25 bp, Mus musculus
tcccatgtacctcacgaatgttcaa

SEQ ID NO: 814450 - DNA, 25 bp, Mus musculus
tcccatgtacctgacgaatgttcaa

SEQ ID NO: 814451 - DNA, 25 bp, Mus musculus
tcccatgtataaattgtgtgtccaa

SEQ ID NO: 814452 - DNA, 25 bp, Mus musculus
tcccatgtataatttgtgtgtccaa

SEQ ID NO: 814453 - DNA, 25 bp, Mus musculus
tcccatgtgtggaatacctactatg

SEQ ID NO: 814454 - DNA, 25 bp, Mus musculus
tcccatgtgtggctgttacatacag

SEQ ID NO: 814455 - DNA, 25 bp, Mus musculus
tcccatgtgtgggtgttacatacag

SEQ ID NO: 814456 - DNA, 25 bp, Mus musculus
tcccatgtgtggtatacctactatg

SEQ ID NO: 814457 - DNA, 25 bp, Mus musculus
tcccatgttaaaatttgtgttgtgt

SEQ ID NO: 814458 - DNA, 25 bp, Mus musculus
tcccatgttaaattttgtgttgtgt

SEQ ID NO: 814459 - DNA, 25 bp, Mus musculus
tcccatgttagtaaagtgtagagtg

SEQ ID NO: 814460 - DNA, 25 bp, Mus musculus
tcccatgttagttaagtgtagagtg

SEQ ID NO: 814461 - DNA, 25 bp, Mus musculus
tcccatgttctacttgctgttagca

SEQ ID NO: 814462 - DNA, 25 bp, Mus musculus
tcccatgttctagttgctgttagca

SEQ ID NO: 814463 - DNA, 25 bp, Mus musculus
tcccatgttcttatgcagggctgga

SEQ ID NO: 814464 - DNA, 25 bp, Mus musculus
tcccatgttcttttgcagggctgga

SEQ ID NO: 814465 - DNA, 25 bp, Mus musculus
tcccatgttgatcaaagtactgcac

SEQ ID NO: 814466 - DNA, 25 bp, Mus musculus
tcccatgttgatgaaagtactgcac

SEQ ID NO: 814467 - DNA, 25 bp, Mus musculus
tcccatgttgggagacttagattaa

SEQ ID NO: 814468 - DNA, 25 bp, Mus musculus
tcccatgttgggtgacttagattaa

SEQ ID NO: 814469 - DNA, 25 bp, Mus musculus
tcccattagggaccccttgagggat

SEQ ID NO: 814470 - DNA, 25 bp, Mus musculus
tcccattagggagcccttgagggat

SEQ ID NO: 814471 - DNA, 25 bp, Mus musculus
tcccattatccaaccgtggaccttg

SEQ ID NO: 814472 - DNA, 25 bp, Mus musculus
tcccattatccatccgtggaccttg

SEQ ID NO: 814473 - DNA, 25 bp, Mus musculus
tcccattcagggaggcttagacact

SEQ ID NO: 814474 - DNA, 25 bp, Mus musculus
tcccattcagggtggcttagacact

SEQ ID NO: 814475 - DNA, 25 bp, Mus musculus
tcccattcagttccatcagcagaga

SEQ ID NO: 814476 - DNA, 25 bp, Mus musculus
tcccattcagttgcatcagcagaga

SEQ ID NO: 814477 - DNA, 25 bp, Mus musculus
tcccattcccttatgctgttgaatt

SEQ ID NO: 814478 - DNA, 25 bp, Mus musculus
tcccattcccttttgctgttgaatt

SEQ ID NO: 814479 - DNA, 25 bp, Mus musculus
tcccattccgggagacgggctgctg

SEQ ID NO: 814480 - DNA, 25 bp, Mus musculus
tcccattccgggtgacgggctgctg

SEQ ID NO: 814481 - DNA, 25 bp, Mus musculus
tcccattccggtacctaagtaacat

SEQ ID NO: 814482 - DNA, 25 bp, Mus musculus
tcccattccggttcctaagtaacat

SEQ ID NO: 814483 - DNA, 25 bp, Mus musculus
tcccattcctaacgtttctataaca

SEQ ID NO: 814484 - DNA, 25 bp, Mus musculus
tcccattcctaaggtttctataaca

SEQ ID NO: 814485 - DNA, 25 bp, Mus musculus
tcccattcctagaaatccatgacct

SEQ ID NO: 814486 - DNA, 25 bp, Mus musculus
tcccattcctagtaatccatgacct

SEQ ID NO: 814487 - DNA, 25 bp, Mus musculus
tcccattcgaggctacagtcatttc

SEQ ID NO: 814488 - DNA, 25 bp, Mus musculus
tcccattcgagggtacagtcatttc

SEQ ID NO: 814489 - DNA, 25 bp, Mus musculus
tcccattctcaaacctggcatagaa

SEQ ID NO: 814490 - DNA, 25 bp, Mus musculus
tcccattctcaatcctggcatagaa

SEQ ID NO: 814491 - DNA, 25 bp, Mus musculus
tcccattctctgatggccatatatg

SEQ ID NO: 814492 - DNA, 25 bp, Mus musculus
tcccattctctgttggccatatatg

SEQ ID NO: 814493 - DNA, 25 bp, Mus musculus
tcccattctgataatttgatcttct

SEQ ID NO: 814494 - DNA, 25 bp, Mus musculus
tcccattctgattatttgatcttct

SEQ ID NO: 814495 - DNA, 25 bp, Mus musculus
tcccattcttagaggttggaagcaa

SEQ ID NO: 814496 - DNA, 25 bp, Mus musculus
tcccattcttagtggttggaagcaa

SEQ ID NO: 814497 - DNA, 25 bp, Mus musculus
tcccattgacgcacactcgaatgaa

SEQ ID NO: 814498 - DNA, 25 bp, Mus musculus
tcccattgacgctcactcgaatgaa

SEQ ID NO: 814499 - DNA, 25 bp, Mus musculus
tcccattgatgccacaaatttatat

SEQ ID NO: 814500 - DNA, 25 bp, Mus musculus
tcccattgatgcgacaaatttatat

SEQ ID NO: 814501 - DNA, 25 bp, Mus musculus
tcccattgccttcagatgaccagca

SEQ ID NO: 814502 - DNA, 25 bp, Mus musculus
tcccattgccttgagatgaccagca

SEQ ID NO: 814503 - DNA, 25 bp, Mus musculus
tcccattgctttatacattttcact

SEQ ID NO: 814504 - DNA, 25 bp, Mus musculus
tcccattgctttttacattttcact

SEQ ID NO: 814505 - DNA, 25 bp, Mus musculus
tcccattggccaagaatattcaaag

SEQ ID NO: 814506 - DNA, 25 bp, Mus musculus
tcccattggccatgaatattcaaag

SEQ ID NO: 814507 - DNA, 25 bp, Mus musculus
tcccattgggtcagaaatcttgcat

SEQ ID NO: 814508 - DNA, 25 bp, Mus musculus
tcccattgggtctgaaatcttgcat

SEQ ID NO: 814509 - DNA, 25 bp, Mus musculus
tcccattggtagatcttatgttaaa

SEQ ID NO: 814510 - DNA, 25 bp, Mus musculus
tcccattggtagatgtcttctcttt

SEQ ID NO: 814511 - DNA, 25 bp, Mus musculus
tcccattggtagttcttatgttaaa

SEQ ID NO: 814512 - DNA, 25 bp, Mus musculus
tcccattggtagttgtcttctcttt

SEQ ID NO: 814513 - DNA, 25 bp, Mus musculus
tcccattgtccaagatggcatgctg

SEQ ID NO: 814514 - DNA, 25 bp, Mus musculus
tcccattgtccatgatggcatgctg

SEQ ID NO: 814515 - DNA, 25 bp, Mus musculus
tcccattgtctcatctggaactttt

SEQ ID NO: 814516 - DNA, 25 bp, Mus musculus
tcccattgtctcttctggaactttt

SEQ ID NO: 814517 - DNA, 25 bp, Mus musculus
tcccattgtgccctggaccaagatg

SEQ ID NO: 814518 - DNA, 25 bp, Mus musculus
tcccattgtgccgtggaccaagatg

SEQ ID NO: 814519 - DNA, 25 bp, Mus musculus
tcccattgtggaaaacagcctgtgt

SEQ ID NO: 814520 - DNA, 25 bp, Mus musculus
tcccattgtggataacagcctgtgt

SEQ ID NO: 814521 - DNA, 25 bp, Mus musculus
tcccatttacacactccagtagaaa

SEQ ID NO: 814522 - DNA, 25 bp, Mus musculus
tcccatttacactctccagtagaaa

SEQ ID NO: 814523 - DNA, 25 bp, Mus musculus
tcccatttactaatagcttatcatt

SEQ ID NO: 814524 - DNA, 25 bp, Mus musculus
tcccatttactattagcttatcatt

SEQ ID NO: 814525 - DNA, 25 bp, Mus musculus
tcccatttatccaggtggtggtgct

SEQ ID NO: 814526 - DNA, 25 bp, Mus musculus
tcccatttatcctggtggtggtgct

SEQ ID NO: 814527 - DNA, 25 bp, Mus musculus
tcccatttatgacacctctgtaatt

SEQ ID NO: 814528 - DNA, 25 bp, Mus musculus
tcccatttatgagacctctgtaatt

SEQ ID NO: 814529 - DNA, 25 bp, Mus musculus
tcccatttatgtcttctcttctttt

SEQ ID NO: 814530 - DNA, 25 bp, Mus musculus
tcccatttatgtgttctcttctttt

SEQ ID NO: 814531 - DNA, 25 bp, Mus musculus
tcccatttccaacacattatctctg

SEQ ID NO: 814532 - DNA, 25 bp, Mus musculus
tcccatttccaagacattatctctg

SEQ ID NO: 814533 - DNA, 25 bp, Mus musculus
tcccatttccatcactaaccatgtt

SEQ ID NO: 814534 - DNA, 25 bp, Mus musculus
tcccatttccatgactaaccatgtt

SEQ ID NO: 814535 - DNA, 25 bp, Mus musculus
tcccatttccccagaccagaaggaa

SEQ ID NO: 814536 - DNA, 25 bp, Mus musculus
tcccatttcccctgaccagaaggaa

SEQ ID NO: 814537 - DNA, 25 bp, Mus musculus
tcccatttgatgctgtgtgccccaa

SEQ ID NO: 814538 - DNA, 25 bp, Mus musculus
tcccatttgatggtgtgtgccccaa

SEQ ID NO: 814539 - DNA, 25 bp, Mus musculus
tcccatttgccgaccactaaaaaag

SEQ ID NO: 814540 - DNA, 25 bp, Mus musculus
tcccatttgccgtccactaaaaaag

SEQ ID NO: 814541 - DNA, 25 bp, Mus musculus
tcccatttggctccctttaacagtt

SEQ ID NO: 814542 - DNA, 25 bp, Mus musculus
tcccatttggctgcctttaacagtt

SEQ ID NO: 814543 - DNA, 25 bp, Mus musculus
tcccatttgtaccaaaacagtgttc

SEQ ID NO: 814544 - DNA, 25 bp, Mus musculus
tcccatttgtacgaaaacagtgttc

SEQ ID NO: 814545 - DNA, 25 bp, Mus musculus
tcccatttgtcgcagggcagtctta

SEQ ID NO: 814546 - DNA, 25 bp, Mus musculus
tcccatttgtcggagggcagtctta

SEQ ID NO: 814547 - DNA, 25 bp, Mus musculus
tcccattttaagactgcttgaataa

SEQ ID NO: 814548 - DNA, 25 bp, Mus musculus
tcccattttaagtctgcttgaataa

SEQ ID NO: 814549 - DNA, 25 bp, Mus musculus
tcccattttgggaggattaccttca

SEQ ID NO: 814550 - DNA, 25 bp, Mus musculus
tcccattttgggtggattaccttca

SEQ ID NO: 814551 - DNA, 25 bp, Mus musculus
tcccatttttaacacattcactagg

SEQ ID NO: 814552 - DNA, 25 bp, Mus musculus
tcccatttttaagacattcactagg

SEQ ID NO: 814553 - DNA, 25 bp, Mus musculus
tcccatttttggcttatgtatttgg

SEQ ID NO: 814554 - DNA, 25 bp, Mus musculus
tcccatttttgggttatgtatttgg

SEQ ID NO: 814555 - DNA, 25 bp, Mus musculus
tcccattttttgcaattgacctgct

SEQ ID NO: 814556 - DNA, 25 bp, Mus musculus
tcccattttttggaattgacctgct

SEQ ID NO: 814557 - DNA, 25 bp, Mus musculus
tccccaaaaggcaacttaggcttct

SEQ ID NO: 814558 - DNA, 25 bp, Mus musculus
tccccaaaaggctacttaggcttct

SEQ ID NO: 814559 - DNA, 25 bp, Mus musculus
tccccaaaattgagagcagtagtta

SEQ ID NO: 814560 - DNA, 25 bp, Mus musculus
tccccaaaattgtgagcagtagtta

SEQ ID NO: 814561 - DNA, 25 bp, Mus musculus
tccccaaacatgcactagtacacat

SEQ ID NO: 814562 - DNA, 25 bp, Mus musculus
tccccaaacatggactagtacacat

SEQ ID NO: 814563 - DNA, 25 bp, Mus musculus
tccccaaacgttacaattgacagag

SEQ ID NO: 814564 - DNA, 25 bp, Mus musculus
tccccaaacgtttcaattgacagag

SEQ ID NO: 814565 - DNA, 25 bp, Mus musculus
tccccaaagagcagtggttcctatg

SEQ ID NO: 814566 - DNA, 25 bp, Mus musculus
tccccaaagagctgtggttcctatg

SEQ ID NO: 814567 - DNA, 25 bp, Mus musculus
tccccaaaggcgcatgcttcataaa

SEQ ID NO: 814568 - DNA, 25 bp, Mus musculus
tccccaaaggcggatgcttcataaa

SEQ ID NO: 814569 - DNA, 25 bp, Mus musculus
tccccaaagggcagcggacataaat

SEQ ID NO: 814570 - DNA, 25 bp, Mus musculus
tccccaaagggctgcggacataaat

SEQ ID NO: 814571 - DNA, 25 bp, Mus musculus
tccccaaagggtactgacgtctgtc

SEQ ID NO: 814572 - DNA, 25 bp, Mus musculus
tccccaaagggttctgacgtctgtc

SEQ ID NO: 814573 - DNA, 25 bp, Mus musculus
tccccaaaggtaacaacctggccag

SEQ ID NO: 814574 - DNA, 25 bp, Mus musculus
tccccaaaggtatcaacctggccag

SEQ ID NO: 814575 - DNA, 25 bp, Mus musculus
tccccaaatctcatctttcaggtga

SEQ ID NO: 814576 - DNA, 25 bp, Mus musculus
tccccaaatctcttctttcaggtga

SEQ ID NO: 814577 - DNA, 25 bp, Mus musculus
tccccaaatcttcctcttaagaact

SEQ ID NO: 814578 - DNA, 25 bp, Mus musculus
tccccaaatcttgctcttaagaact

SEQ ID NO: 814579 - DNA, 25 bp, Mus musculus
tccccaaattccacattacatctag

SEQ ID NO: 814580 - DNA, 25 bp, Mus musculus
tccccaaattcctcattacatctag

SEQ ID NO: 814581 - DNA, 25 bp, Mus musculus
tccccaaatttgaaacggagcctgg

SEQ ID NO: 814582 - DNA, 25 bp, Mus musculus
tccccaaatttgtaacggagcctgg

SEQ ID NO: 814583 - DNA, 25 bp, Mus musculus
tccccaacacggatgaccagatcat

SEQ ID NO: 814584 - DNA, 25 bp, Mus musculus
tccccaacacggttgaccagatcat

SEQ ID NO: 814585 - DNA, 25 bp, Mus musculus
tccccaacagctccctaattttagg

SEQ ID NO: 814586 - DNA, 25 bp, Mus musculus
tccccaacagctgcctaattttagg

SEQ ID NO: 814587 - DNA, 25 bp, Mus musculus
tccccaacatccagctgttttatag

SEQ ID NO: 814588 - DNA, 25 bp, Mus musculus
tccccaacatcctgctgttttatag

SEQ ID NO: 814589 - DNA, 25 bp, Mus musculus
tccccaacatctcaataacattttg

SEQ ID NO: 814590 - DNA, 25 bp, Mus musculus
tccccaacatctgaataacattttg

SEQ ID NO: 814591 - DNA, 25 bp, Mus musculus
tccccaaccctgataactgggcata

SEQ ID NO: 814592 - DNA, 25 bp, Mus musculus
tccccaaccctgttaactgggcata

SEQ ID NO: 814593 - DNA, 25 bp, Mus musculus
tccccaacctaactcttggaacttg

SEQ ID NO: 814594 - DNA, 25 bp, Mus musculus
tccccaacctaagtcttggaacttg

SEQ ID NO: 814595 - DNA, 25 bp, Mus musculus
tccccaacgatcctagcagttgtgg

SEQ ID NO: 814596 - DNA, 25 bp, Mus musculus
tccccaacgatcgtagcagttgtgg

SEQ ID NO: 814597 - DNA, 25 bp, Mus musculus
tccccaacgtgaaggacaatatttc

SEQ ID NO: 814598 - DNA, 25 bp, Mus musculus
tccccaacgtgatggacaatatttc

SEQ ID NO: 814599 - DNA, 25 bp, Mus musculus
tccccaactataattcttcctgagg

SEQ ID NO: 814600 - DNA, 25 bp, Mus musculus
tccccaactatatttcttcctgagg

SEQ ID NO: 814601 - DNA, 25 bp, Mus musculus
tccccaagctctctgcacatgatag

SEQ ID NO: 814602 - DNA, 25 bp, Mus musculus
tccccaagctctgtgcacatgatag

SEQ ID NO: 814603 - DNA, 25 bp, Mus musculus
tccccaagcttcactccatggagaa

SEQ ID NO: 814604 - DNA, 25 bp, Mus musculus
tccccaagcttctctccatggagaa

SEQ ID NO: 814605 - DNA, 25 bp, Mus musculus
tccccaaggagcctgcacagtggga

SEQ ID NO: 814606 - DNA, 25 bp, Mus musculus
tccccaaggagcgtgcacagtggga

SEQ ID NO: 814607 - DNA, 25 bp, Mus musculus
tccccaagggaacacaggtaatgac

SEQ ID NO: 814608 - DNA, 25 bp, Mus musculus
tccccaagggaagacaggtaatgac

SEQ ID NO: 814609 - DNA, 25 bp, Mus musculus
tccccaaggtgccattgttgtttag

SEQ ID NO: 814610 - DNA, 25 bp, Mus musculus
tccccaaggtgcgattgttgtttag

SEQ ID NO: 814611 - DNA, 25 bp, Mus musculus
tccccaaggttaactcggcaatact

SEQ ID NO: 814612 - DNA, 25 bp, Mus musculus
tccccaaggttatctcggcaatact

SEQ ID NO: 814613 - DNA, 25 bp, Mus musculus
tccccaagtggaacgcgtgctgcga

SEQ ID NO: 814614 - DNA, 25 bp, Mus musculus
tccccaagtggatcgcgtgctgcga

SEQ ID NO: 814615 - DNA, 25 bp, Mus musculus
tccccaagtggcactggattactgg

SEQ ID NO: 814616 - DNA, 25 bp, Mus musculus
tccccaagtggctctggattactgg

SEQ ID NO: 814617 - DNA, 25 bp, Mus musculus
tccccaagttcaaatcatagccagc

SEQ ID NO: 814618 - DNA, 25 bp, Mus musculus
tccccaagttcatatcatagccagc

SEQ ID NO: 814619 - DNA, 25 bp, Mus musculus
tccccaagttggaattggtagctgt

SEQ ID NO: 814620 - DNA, 25 bp, Mus musculus
tccccaagttggtattggtagctgt

SEQ ID NO: 814621 - DNA, 25 bp, Mus musculus
tccccaagttgtcctgtaactataa

SEQ ID NO: 814622 - DNA, 25 bp, Mus musculus
tccccaagttgtgctgtaactataa

SEQ ID NO: 814623 - DNA, 25 bp, Mus musculus
tccccaatattcagtaccttctgat

SEQ ID NO: 814624 - DNA, 25 bp, Mus musculus
tccccaatattctgtaccttctgat

SEQ ID NO: 814625 - DNA, 25 bp, Mus musculus
tccccaatcccactgattcagaaaa

SEQ ID NO: 814626 - DNA, 25 bp, Mus musculus
tccccaatcccagtgattcagaaaa

SEQ ID NO: 814627 - DNA, 25 bp, Mus musculus
tccccaatcgatcgagcagtgatga

SEQ ID NO: 814628 - DNA, 25 bp, Mus musculus
tccccaatcgatggagcagtgatga

SEQ ID NO: 814629 - DNA, 25 bp, Mus musculus
tccccaatgtgaaatctgtccagag

SEQ ID NO: 814630 - DNA, 25 bp, Mus musculus
tccccaatgtgatatctgtccagag

SEQ ID NO: 814631 - DNA, 25 bp, Mus musculus
tccccaattctcagcttaatcataa

SEQ ID NO: 814632 - DNA, 25 bp, Mus musculus
tccccaattctccagcctggtgtta

SEQ ID NO: 814633 - DNA, 25 bp, Mus musculus
tccccaattctcgagcctggtgtta

SEQ ID NO: 814634 - DNA, 25 bp, Mus musculus
tccccaattctctgcttaatcataa

SEQ ID NO: 814635 - DNA, 25 bp, Mus musculus
tccccaattgccatatttttcatag

SEQ ID NO: 814636 - DNA, 25 bp, Mus musculus
tccccaattgccttatttttcatag

SEQ ID NO: 814637 - DNA, 25 bp, Mus musculus
tccccacaaaagaacattccatcat

SEQ ID NO: 814638 - DNA, 25 bp, Mus musculus
tccccacaaaagtacattccatcat

SEQ ID NO: 814639 - DNA, 25 bp, Mus musculus
tccccacaacgccaacatttcactt

SEQ ID NO: 814640 - DNA, 25 bp, Mus musculus
tccccacaacgcgaacatttcactt

SEQ ID NO: 814641 - DNA, 25 bp, Mus musculus
tccccacaactcctagggtgaaatt

SEQ ID NO: 814642 - DNA, 25 bp, Mus musculus
tccccacaactcgtagggtgaaatt

SEQ ID NO: 814643 - DNA, 25 bp, Mus musculus
tccccacaagtaagagggtcgctgt

SEQ ID NO: 814644 - DNA, 25 bp, Mus musculus
tccccacaagtatgagggtcgctgt

SEQ ID NO: 814645 - DNA, 25 bp, Mus musculus
tccccacaatcactgtccagtttta

SEQ ID NO: 814646 - DNA, 25 bp, Mus musculus
tccccacaatcagtgtccagtttta

SEQ ID NO: 814647 - DNA, 25 bp, Mus musculus
tccccacacagacgaaggtagccag

SEQ ID NO: 814648 - DNA, 25 bp, Mus musculus
tccccacacagaggaaggtagccag

SEQ ID NO: 814649 - DNA, 25 bp, Mus musculus
tccccacacccgcattgttgaaaat

SEQ ID NO: 814650 - DNA, 25 bp, Mus musculus
tccccacacccggattgttgaaaat

SEQ ID NO: 814651 - DNA, 25 bp, Mus musculus
tccccacacggtactgtttcttttg

SEQ ID NO: 814652 - DNA, 25 bp, Mus musculus
tccccacacggttctgtttcttttg

SEQ ID NO: 814653 - DNA, 25 bp, Mus musculus
tccccacactttccatgttgaagaa

SEQ ID NO: 814654 - DNA, 25 bp, Mus musculus
tccccacactttgcatgttgaagaa

SEQ ID NO: 814655 - DNA, 25 bp, Mus musculus
tccccacagaaacgaatgctgtact

SEQ ID NO: 814656 - DNA, 25 bp, Mus musculus
tccccacagaaaggaatgctgtact

SEQ ID NO: 814657 - DNA, 25 bp, Mus musculus
tccccacagagaatgagcaggagca

SEQ ID NO: 814658 - DNA, 25 bp, Mus musculus
tccccacagagattgagcaggagca

SEQ ID NO: 814659 - DNA, 25 bp, Mus musculus
tccccacagaggacacgagagcact

SEQ ID NO: 814660 - DNA, 25 bp, Mus musculus
tccccacagaggtcacgagagcact

SEQ ID NO: 814661 - DNA, 25 bp, Mus musculus
tccccacagtacattgccttatctt

SEQ ID NO: 814662 - DNA, 25 bp, Mus musculus
tccccacagtactttgccttatctt

SEQ ID NO: 814663 - DNA, 25 bp, Mus musculus
tccccacataagctacaaaatgagt

SEQ ID NO: 814664 - DNA, 25 bp, Mus musculus
tccccacataaggtacaaaatgagt

SEQ ID NO: 814665 - DNA, 25 bp, Mus musculus
tccccacatgatattaatgctccag

SEQ ID NO: 814666 - DNA, 25 bp, Mus musculus
tccccacatgattttaatgctccag

SEQ ID NO: 814667 - DNA, 25 bp, Mus musculus
tccccacattcacgccttagaggta

SEQ ID NO: 814668 - DNA, 25 bp, Mus musculus
tccccacattcaggccttagaggta

SEQ ID NO: 814669 - DNA, 25 bp, Mus musculus
tccccaccacccacacattattgaa

SEQ ID NO: 814670 - DNA, 25 bp, Mus musculus
tccccaccaccctcacattattgaa

SEQ ID NO: 814671 - DNA, 25 bp, Mus musculus
tccccaccactcagtattcaattag

SEQ ID NO: 814672 - DNA, 25 bp, Mus musculus
tccccaccactctgtattcaattag

SEQ ID NO: 814673 - DNA, 25 bp, Mus musculus
tccccaccagatcctttaatgtatt

SEQ ID NO: 814674 - DNA, 25 bp, Mus musculus
tccccaccagatgctttaatgtatt

SEQ ID NO: 814675 - DNA, 25 bp, Mus musculus
tccccaccataccttatactgaaag

SEQ ID NO: 814676 - DNA, 25 bp, Mus musculus
tccccaccatacgttatactgaaag

SEQ ID NO: 814677 - DNA, 25 bp, Mus musculus
tccccaccattccagagcgaaaaga

SEQ ID NO: 814678 - DNA, 25 bp, Mus musculus
tccccaccattcgagagcgaaaaga

SEQ ID NO: 814679 - DNA, 25 bp, Mus musculus
tccccacccaatatagttgatgaga

SEQ ID NO: 814680 - DNA, 25 bp, Mus musculus
tccccacccaatttagttgatgaga

SEQ ID NO: 814681 - DNA, 25 bp, Mus musculus
tccccacccagcatatgatgataag

SEQ ID NO: 814682 - DNA, 25 bp, Mus musculus
tccccacccagcttatgatgataag

SEQ ID NO: 814683 - DNA, 25 bp, Mus musculus
tccccaccctatatctaaaattgca

SEQ ID NO: 814684 - DNA, 25 bp, Mus musculus
tccccaccctatttctaaaattgca

SEQ ID NO: 814685 - DNA, 25 bp, Mus musculus
tccccaccctgtctgtgagaaaggg

SEQ ID NO: 814686 - DNA, 25 bp, Mus musculus
tccccaccctgtgtgtgagaaaggg

SEQ ID NO: 814687 - DNA, 25 bp, Mus musculus
tccccacctgagcagaatcttgaat

SEQ ID NO: 814688 - DNA, 25 bp, Mus musculus
tccccacctgaggagaatcttgaat

SEQ ID NO: 814689 - DNA, 25 bp, Mus musculus
tccccacctgtaattgatctgtcgt

SEQ ID NO: 814690 - DNA, 25 bp, Mus musculus
tccccacctgtatttgatctgtcgt

SEQ ID NO: 814691 - DNA, 25 bp, Mus musculus
tccccacctgtgctataatggtcac

SEQ ID NO: 814692 - DNA, 25 bp, Mus musculus
tccccacctgtggtataatggtcac

SEQ ID NO: 814693 - DNA, 25 bp, Mus musculus
tccccaccttttagcagctgatgaa

SEQ ID NO: 814694 - DNA, 25 bp, Mus musculus
tccccacctttttgcagctgatgaa

SEQ ID NO: 814695 - DNA, 25 bp, Mus musculus
tccccacgagaaattggtaacccag

SEQ ID NO: 814696 - DNA, 25 bp, Mus musculus
tccccacgagaatttggtaacccag

SEQ ID NO: 814697 - DNA, 25 bp, Mus musculus
tccccacgagagcacccagagatgt

SEQ ID NO: 814698 - DNA, 25 bp, Mus musculus
tccccacgagaggacccagagatgt

SEQ ID NO: 814699 - DNA, 25 bp, Mus musculus
tccccacgatgcctctggagagatg

SEQ ID NO: 814700 - DNA, 25 bp, Mus musculus
tccccacgatgcgtctggagagatg

SEQ ID NO: 814701 - DNA, 25 bp, Mus musculus
tccccacgctacagtcgagagtaca

SEQ ID NO: 814702 - DNA, 25 bp, Mus musculus
tccccacgctactgtcgagagtaca

SEQ ID NO: 814703 - DNA, 25 bp, Mus musculus
tccccacggctcatggcggtttttt

SEQ ID NO: 814704 - DNA, 25 bp, Mus musculus
tccccacggctcttggcggtttttt

SEQ ID NO: 814705 - DNA, 25 bp, Mus musculus
tccccacgggatagatggatctgaa

SEQ ID NO: 814706 - DNA, 25 bp, Mus musculus
tccccacgggattgatggatctgaa

SEQ ID NO: 814707 - DNA, 25 bp, Mus musculus
tccccacggtccagtgataatgttt

SEQ ID NO: 814708 - DNA, 25 bp, Mus musculus
tccccacggtcctgtgataatgttt

SEQ ID NO: 814709 - DNA, 25 bp, Mus musculus
tccccactaaacacattcctggaaa

SEQ ID NO: 814710 - DNA, 25 bp, Mus musculus
tccccactaaactcattcctggaaa

SEQ ID NO: 814711 - DNA, 25 bp, Mus musculus
tccccactaaggatcttttgctttt

SEQ ID NO: 814712 - DNA, 25 bp, Mus musculus
tccccactaaggttcttttgctttt

SEQ ID NO: 814713 - DNA, 25 bp, Mus musculus
tccccactaattcatttttggctgg

SEQ ID NO: 814714 - DNA, 25 bp, Mus musculus
tccccactaattgatttttggctgg

SEQ ID NO: 814715 - DNA, 25 bp, Mus musculus
tccccactactcagtcatagaacta

SEQ ID NO: 814716 - DNA, 25 bp, Mus musculus
tccccactactctgtcatagaacta

SEQ ID NO: 814717 - DNA, 25 bp, Mus musculus
tccccactatatctggtctaggtgt

SEQ ID NO: 814718 - DNA, 25 bp, Mus musculus
tccccactatatgtggtctaggtgt

SEQ ID NO: 814719 - DNA, 25 bp, Mus musculus
tccccactcaagagggtgttggtcc

SEQ ID NO: 814720 - DNA, 25 bp, Mus musculus
tccccactcaagtgggtgttggtcc

SEQ ID NO: 814721 - DNA, 25 bp, Mus musculus
tccccactcatcagtcagttttaag

SEQ ID NO: 814722 - DNA, 25 bp, Mus musculus
tccccactcatctgtcagttttaag

SEQ ID NO: 814723 - DNA, 25 bp, Mus musculus
tccccactggagcaaaggttgactg

SEQ ID NO: 814724 - DNA, 25 bp, Mus musculus
tccccactggaggaaaggttgactg

SEQ ID NO: 814725 - DNA, 25 bp, Mus musculus
tccccactggatatctaagtttctc

SEQ ID NO: 814726 - DNA, 25 bp, Mus musculus
tccccactggatttctaagtttctc

SEQ ID NO: 814727 - DNA, 25 bp, Mus musculus
tccccactgtaaatgatgaggctag

SEQ ID NO: 814728 - DNA, 25 bp, Mus musculus
tccccactgtaattgatgaggctag

SEQ ID NO: 814729 - DNA, 25 bp, Mus musculus
tccccactgtttagctgaggaaaat

SEQ ID NO: 814730 - DNA, 25 bp, Mus musculus
tccccactgtttccatgggcattaa

SEQ ID NO: 814731 - DNA, 25 bp, Mus musculus
tccccactgtttgcatgggcattaa

SEQ ID NO: 814732 - DNA, 25 bp, Mus musculus
tccccactgttttgctgaggaaaat

SEQ ID NO: 814733 - DNA, 25 bp, Mus musculus
tccccacttctaatttgccagcaag

SEQ ID NO: 814734 - DNA, 25 bp, Mus musculus
tccccacttctattttgccagcaag

SEQ ID NO: 814735 - DNA, 25 bp, Mus musculus
tccccacttgagacctaaattttga

SEQ ID NO: 814736 - DNA, 25 bp, Mus musculus
tccccacttgagtcctaaattttga

SEQ ID NO: 814737 - DNA, 25 bp, Mus musculus
tccccacttttccattttgtcatag

SEQ ID NO: 814738 - DNA, 25 bp, Mus musculus
tccccacttttcgattttgtcatag

SEQ ID NO: 814739 - DNA, 25 bp, Mus musculus
tccccagaagcaaccgtcaaagagg

SEQ ID NO: 814740 - DNA, 25 bp, Mus musculus
tccccagaagcatccgtcaaagagg

SEQ ID NO: 814741 - DNA, 25 bp, Mus musculus
tccccagaaggtactttgatcattt

SEQ ID NO: 814742 - DNA, 25 bp, Mus musculus
tccccagaaggtctcactgttgaag

SEQ ID NO: 814743 - DNA, 25 bp, Mus musculus
tccccagaaggtgtcactgttgaag

SEQ ID NO: 814744 - DNA, 25 bp, Mus musculus
tccccagaaggttctttgatcattt

SEQ ID NO: 814745 - DNA, 25 bp, Mus musculus
tccccagaagttattgagcctccgg

SEQ ID NO: 814746 - DNA, 25 bp, Mus musculus
tccccagaagtttttgagcctccgg

SEQ ID NO: 814747 - DNA, 25 bp, Mus musculus
tccccagaatggcaatttcttttat

SEQ ID NO: 814748 - DNA, 25 bp, Mus musculus
tccccagaatgggaatttcttttat

SEQ ID NO: 814749 - DNA, 25 bp, Mus musculus
tccccagagactatgtgacctgtga

SEQ ID NO: 814750 - DNA, 25 bp, Mus musculus
tccccagagactttgtgacctgtga

SEQ ID NO: 814751 - DNA, 25 bp, Mus musculus
tccccagaggaacttagggtgctca

SEQ ID NO: 814752 - DNA, 25 bp, Mus musculus
tccccagaggaagttagggtgctca

SEQ ID NO: 814753 - DNA, 25 bp, Mus musculus
tccccagagggacatgactttcttt

SEQ ID NO: 814754 - DNA, 25 bp, Mus musculus
tccccagagggagatgactttcttt

SEQ ID NO: 814755 - DNA, 25 bp, Mus musculus
tccccagagggtcccatggaggtcc

SEQ ID NO: 814756 - DNA, 25 bp, Mus musculus
tccccagagggtgccatggaggtcc

SEQ ID NO: 814757 - DNA, 25 bp, Mus musculus
tccccagagttcaattgcttcactt

SEQ ID NO: 814758 - DNA, 25 bp, Mus musculus
tccccagagttctattgcttcactt

SEQ ID NO: 814759 - DNA, 25 bp, Mus musculus
tccccagagttgatcgggaggccgt

SEQ ID NO: 814760 - DNA, 25 bp, Mus musculus
tccccagagttgttcgggaggccgt

SEQ ID NO: 814761 - DNA, 25 bp, Mus musculus
tccccagagtttacagagttttctg

SEQ ID NO: 814762 - DNA, 25 bp, Mus musculus
tccccagagttttcagagttttctg

SEQ ID NO: 814763 - DNA, 25 bp, Mus musculus
tccccagataaacccacaatgtaag

SEQ ID NO: 814764 - DNA, 25 bp, Mus musculus
tccccagataaagccacaatgtaag

SEQ ID NO: 814765 - DNA, 25 bp, Mus musculus
tccccagattaaaagagcacacaaa

SEQ ID NO: 814766 - DNA, 25 bp, Mus musculus
tccccagattaatagagcacacaaa

SEQ ID NO: 814767 - DNA, 25 bp, Mus musculus
tccccagattttagcaggcagaaga

SEQ ID NO: 814768 - DNA, 25 bp, Mus musculus
tccccagatttttgcaggcagaaga

SEQ ID NO: 814769 - DNA, 25 bp, Mus musculus
tccccagcaacaagcaggtctagat

SEQ ID NO: 814770 - DNA, 25 bp, Mus musculus
tccccagcaacatgcaggtctagat

SEQ ID NO: 814771 - DNA, 25 bp, Mus musculus
tccccagcagctctttaggcaaagg

SEQ ID NO: 814772 - DNA, 25 bp, Mus musculus
tccccagcagctgtttaggcaaagg

SEQ ID NO: 814773 - DNA, 25 bp, Mus musculus
tccccagcagtgaggcttgacttgc

SEQ ID NO: 814774 - DNA, 25 bp, Mus musculus
tccccagcagtgtggcttgacttgc

SEQ ID NO: 814775 - DNA, 25 bp, Mus musculus
tccccagcatcaatggtggcagtaa

SEQ ID NO: 814776 - DNA, 25 bp, Mus musculus
tccccagcatcattggtggcagtaa

SEQ ID NO: 814777 - DNA, 25 bp, Mus musculus
tccccagccagaccgacgtggtgga

SEQ ID NO: 814778 - DNA, 25 bp, Mus musculus
tccccagccagagcgacgtggtgga

SEQ ID NO: 814779 - DNA, 25 bp, Mus musculus
tccccagccctacttagtttatgga

SEQ ID NO: 814780 - DNA, 25 bp, Mus musculus
tccccagccctagttagtttatgga

SEQ ID NO: 814781 - DNA, 25 bp, Mus musculus
tccccagcctctacttactagtttt

SEQ ID NO: 814782 - DNA, 25 bp, Mus musculus
tccccagcctcttcttactagtttt

SEQ ID NO: 814783 - DNA, 25 bp, Mus musculus
tccccagcggatccaacagacaaat

SEQ ID NO: 814784 - DNA, 25 bp, Mus musculus
tccccagcggatgcaacagacaaat

SEQ ID NO: 814785 - DNA, 25 bp, Mus musculus
tccccagctacacataaacctttat

SEQ ID NO: 814786 - DNA, 25 bp, Mus musculus
tccccagctacagataaacctttat

SEQ ID NO: 814787 - DNA, 25 bp, Mus musculus
tccccagctatgaggtgggcctttt

SEQ ID NO: 814788 - DNA, 25 bp, Mus musculus
tccccagctatgtggtgggcctttt

SEQ ID NO: 814789 - DNA, 25 bp, Mus musculus
tccccagctctgagggaggctgctg

SEQ ID NO: 814790 - DNA, 25 bp, Mus musculus
tccccagctctgtgggaggctgctg

SEQ ID NO: 814791 - DNA, 25 bp, Mus musculus
tccccagctgctaagaggagagaca

SEQ ID NO: 814792 - DNA, 25 bp, Mus musculus
tccccagctgcttagaggagagaca

SEQ ID NO: 814793 - DNA, 25 bp, Mus musculus
tccccagcttacagttattaccttg

SEQ ID NO: 814794 - DNA, 25 bp, Mus musculus
tccccagcttactgttattaccttg

SEQ ID NO: 814795 - DNA, 25 bp, Mus musculus
tccccagcttgcattttggtgtttt

SEQ ID NO: 814796 - DNA, 25 bp, Mus musculus
tccccagcttgctttttggtgtttt

SEQ ID NO: 814797 - DNA, 25 bp, Mus musculus
tccccagcttgtcattcctgcctca

SEQ ID NO: 814798 - DNA, 25 bp, Mus musculus
tccccagcttgtgattcctgcctca

SEQ ID NO: 814799 - DNA, 25 bp, Mus musculus
tccccaggacaacacatagcagatg

SEQ ID NO: 814800 - DNA, 25 bp, Mus musculus
tccccaggacaactaggcatctatt

SEQ ID NO: 814801 - DNA, 25 bp, Mus musculus
tccccaggacaagacatagcagatg

SEQ ID NO: 814802 - DNA, 25 bp, Mus musculus
tccccaggacaagtaggcatctatt

SEQ ID NO: 814803 - DNA, 25 bp, Mus musculus
tccccaggagagacttatcgccgaa

SEQ ID NO: 814804 - DNA, 25 bp, Mus musculus
tccccaggagagcagggcacgtttc

SEQ ID NO: 814805 - DNA, 25 bp, Mus musculus
tccccaggagaggagggcacgtttc

SEQ ID NO: 814806 - DNA, 25 bp, Mus musculus
tccccaggagagtcttatcgccgaa

SEQ ID NO: 814807 - DNA, 25 bp, Mus musculus
tccccaggatgtcctcaccaaggat

SEQ ID NO: 814808 - DNA, 25 bp, Mus musculus
tccccaggatgtgctcaccaaggat

SEQ ID NO: 814809 - DNA, 25 bp, Mus musculus
tccccaggcaaacgtggatgcccag

SEQ ID NO: 814810 - DNA, 25 bp, Mus musculus
tccccaggcaaaggtggatgcccag

SEQ ID NO: 814811 - DNA, 25 bp, Mus musculus
tccccaggcacccatgagtggtgta

SEQ ID NO: 814812 - DNA, 25 bp, Mus musculus
tccccaggcaccgatgagtggtgta

SEQ ID NO: 814813 - DNA, 25 bp, Mus musculus
tccccaggcgggagtctaggaaact

SEQ ID NO: 814814 - DNA, 25 bp, Mus musculus
tccccaggcgggtgtctaggaaact

SEQ ID NO: 814815 - DNA, 25 bp, Mus musculus
tccccagggcagagcttattatgct

SEQ ID NO: 814816 - DNA, 25 bp, Mus musculus
tccccagggcagtgcttattatgct

SEQ ID NO: 814817 - DNA, 25 bp, Mus musculus
tccccagggctaatggacagttttt

SEQ ID NO: 814818 - DNA, 25 bp, Mus musculus
tccccagggctattggacagttttt

SEQ ID NO: 814819 - DNA, 25 bp, Mus musculus
tccccagggctgaagtctgcgggtt

SEQ ID NO: 814820 - DNA, 25 bp, Mus musculus
tccccagggctgtagtctgcgggtt

SEQ ID NO: 814821 - DNA, 25 bp, Mus musculus
tccccagggtatactgagtgctcta

SEQ ID NO: 814822 - DNA, 25 bp, Mus musculus
tccccagggtattctgagtgctcta

SEQ ID NO: 814823 - DNA, 25 bp, Mus musculus
tccccagggtgcacaatctacatta

SEQ ID NO: 814824 - DNA, 25 bp, Mus musculus
tccccagggtgctcaatctacatta

SEQ ID NO: 814825 - DNA, 25 bp, Mus musculus
tccccaggtgccaaaattccaggag

SEQ ID NO: 814826 - DNA, 25 bp, Mus musculus
tccccaggtgcctaaattccaggag

SEQ ID NO: 814827 - DNA, 25 bp, Mus musculus
tccccaggtgctaaccaggtaacaa

SEQ ID NO: 814828 - DNA, 25 bp, Mus musculus
tccccaggtgcttaccaggtaacaa

SEQ ID NO: 814829 - DNA, 25 bp, Mus musculus
tccccaggtgggattcgattgtcta

SEQ ID NO: 814830 - DNA, 25 bp, Mus musculus
tccccaggtgggtttcgattgtcta

SEQ ID NO: 814831 - DNA, 25 bp, Mus musculus
tccccagtaaccattgggcaagact

SEQ ID NO: 814832 - DNA, 25 bp, Mus musculus
tccccagtaacctttgggcaagact

SEQ ID NO: 814833 - DNA, 25 bp, Mus musculus
tccccagtacacagacacctttaat

SEQ ID NO: 814834 - DNA, 25 bp, Mus musculus
tccccagtacactgacacctttaat

SEQ ID NO: 814835 - DNA, 25 bp, Mus musculus
tccccagtagttacacagcgtggat

SEQ ID NO: 814836 - DNA, 25 bp, Mus musculus
tccccagtagtttcacagcgtggat

SEQ ID NO: 814837 - DNA, 25 bp, Mus musculus
tccccagtatgtaatggctgaatta

SEQ ID NO: 814838 - DNA, 25 bp, Mus musculus
tccccagtatgttatggctgaatta

SEQ ID NO: 814839 - DNA, 25 bp, Mus musculus
tccccagtcaggacccaggcagagg

SEQ ID NO: 814840 - DNA, 25 bp, Mus musculus
tccccagtcaggacctaaggctaag

SEQ ID NO: 814841 - DNA, 25 bp, Mus musculus
tccccagtcaggtcccaggcagagg

SEQ ID NO: 814842 - DNA, 25 bp, Mus musculus
tccccagtcaggtcctaaggctaag

SEQ ID NO: 814843 - DNA, 25 bp, Mus musculus
tccccagtccagatacaggaaccag

SEQ ID NO: 814844 - DNA, 25 bp, Mus musculus
tccccagtccagttacaggaaccag

SEQ ID NO: 814845 - DNA, 25 bp, Mus musculus
tccccagtcgttcaataccgcgttg

SEQ ID NO: 814846 - DNA, 25 bp, Mus musculus
tccccagtcgttgaataccgcgttg

SEQ ID NO: 814847 - DNA, 25 bp, Mus musculus
tccccagtgaccattgattcgatac

SEQ ID NO: 814848 - DNA, 25 bp, Mus musculus
tccccagtgacctttgattcgatac

SEQ ID NO: 814849 - DNA, 25 bp, Mus musculus
tccccagtgaggcacattttttggt

SEQ ID NO: 814850 - DNA, 25 bp, Mus musculus
tccccagtgagggacattttttggt

SEQ ID NO: 814851 - DNA, 25 bp, Mus musculus
tccccagtgcggacccaaaactgaa

SEQ ID NO: 814852 - DNA, 25 bp, Mus musculus
tccccagtgcggtcccaaaactgaa

SEQ ID NO: 814853 - DNA, 25 bp, Mus musculus
tccccagtgctcaatgagaataaat

SEQ ID NO: 814854 - DNA, 25 bp, Mus musculus
tccccagtgctctatgagaataaat

SEQ ID NO: 814855 - DNA, 25 bp, Mus musculus
tccccagtgtgacaggaaccagcaa

SEQ ID NO: 814856 - DNA, 25 bp, Mus musculus
tccccagtgtgagaggaaccagcaa

SEQ ID NO: 814857 - DNA, 25 bp, Mus musculus
tccccagttaacacttctcaaagac

SEQ ID NO: 814858 - DNA, 25 bp, Mus musculus
tccccagttaacctgtgctgactat

SEQ ID NO: 814859 - DNA, 25 bp, Mus musculus
tccccagttaacgtgtgctgactat

SEQ ID NO: 814860 - DNA, 25 bp, Mus musculus
tccccagttaactcttctcaaagac

SEQ ID NO: 814861 - DNA, 25 bp, Mus musculus
tccccagttcaaacagcctttcgaa

SEQ ID NO: 814862 - DNA, 25 bp, Mus musculus
tccccagttcaatcagcctttcgaa

SEQ ID NO: 814863 - DNA, 25 bp, Mus musculus
tccccagttgccctctcagtaagat

SEQ ID NO: 814864 - DNA, 25 bp, Mus musculus
tccccagttgccgtctcagtaagat

SEQ ID NO: 814865 - DNA, 25 bp, Mus musculus
tccccagttgctacttttttcacgt

SEQ ID NO: 814866 - DNA, 25 bp, Mus musculus
tccccagttgctcagtgttacaagt

SEQ ID NO: 814867 - DNA, 25 bp, Mus musculus
tccccagttgctgagtgttacaagt

SEQ ID NO: 814868 - DNA, 25 bp, Mus musculus
tccccagttgcttcttttttcacgt

SEQ ID NO: 814869 - DNA, 25 bp, Mus musculus
tccccagttggcatttcttctacaa

SEQ ID NO: 814870 - DNA, 25 bp, Mus musculus
tccccagttggcttttcttctacaa

SEQ ID NO: 814871 - DNA, 25 bp, Mus musculus
tccccataaaatcccaccttgaata

SEQ ID NO: 814872 - DNA, 25 bp, Mus musculus
tccccataaaatgccaccttgaata

SEQ ID NO: 814873 - DNA, 25 bp, Mus musculus
tccccataaaccatcctgttgatgt

SEQ ID NO: 814874 - DNA, 25 bp, Mus musculus
tccccataaaccttcctgttgatgt

SEQ ID NO: 814875 - DNA, 25 bp, Mus musculus
tccccataacctaggcaactgctgt

SEQ ID NO: 814876 - DNA, 25 bp, Mus musculus
tccccataaccttggcaactgctgt

SEQ ID NO: 814877 - DNA, 25 bp, Mus musculus
tccccatactggatcctgaagaact

SEQ ID NO: 814878 - DNA, 25 bp, Mus musculus
tccccatactggttcctgaagaact

SEQ ID NO: 814879 - DNA, 25 bp, Mus musculus
tccccatagggaccatccagcgagt

SEQ ID NO: 814880 - DNA, 25 bp, Mus musculus
tccccatagggaccattacacatat

SEQ ID NO: 814881 - DNA, 25 bp, Mus musculus
tccccatagggagcatccagcgagt

SEQ ID NO: 814882 - DNA, 25 bp, Mus musculus
tccccatagggagcattacacatat

SEQ ID NO: 814883 - DNA, 25 bp, Mus musculus
tccccatagggcatggtagtaagta

SEQ ID NO: 814884 - DNA, 25 bp, Mus musculus
tccccatagggcttggtagtaagta

SEQ ID NO: 814885 - DNA, 25 bp, Mus musculus
tccccatagtaccttgttgctaaaa

SEQ ID NO: 814886 - DNA, 25 bp, Mus musculus
tccccatagtacgttgttgctaaaa

SEQ ID NO: 814887 - DNA, 25 bp, Mus musculus
tccccatatgagagtgcaagacaat

SEQ ID NO: 814888 - DNA, 25 bp, Mus musculus
tccccatatgagtgtgcaagacaat

SEQ ID NO: 814889 - DNA, 25 bp, Mus musculus
tccccatattctctaatgtgatctg

SEQ ID NO: 814890 - DNA, 25 bp, Mus musculus
tccccatattctgtaatgtgatctg

SEQ ID NO: 814891 - DNA, 25 bp, Mus musculus
tccccatcaactactgaactacttt

SEQ ID NO: 814892 - DNA, 25 bp, Mus musculus
tccccatcaacttctgaactacttt

SEQ ID NO: 814893 - DNA, 25 bp, Mus musculus
tccccatcacatctgtcatatttgc

SEQ ID NO: 814894 - DNA, 25 bp, Mus musculus
tccccatcacatgtgtcatatttgc

SEQ ID NO: 814895 - DNA, 25 bp, Mus musculus
tccccatcagaccttcaatacgatg

SEQ ID NO: 814896 - DNA, 25 bp, Mus musculus
tccccatcagacgttcaatacgatg

SEQ ID NO: 814897 - DNA, 25 bp, Mus musculus
tccccatcaggaagtccacacagaa

SEQ ID NO: 814898 - DNA, 25 bp, Mus musculus
tccccatcaggatgtccacacagaa

SEQ ID NO: 814899 - DNA, 25 bp, Mus musculus
tccccatccagactataatcctgat

SEQ ID NO: 814900 - DNA, 25 bp, Mus musculus
tccccatccagagtataatcctgat

SEQ ID NO: 814901 - DNA, 25 bp, Mus musculus
tccccatccaggagttggatctaca

SEQ ID NO: 814902 - DNA, 25 bp, Mus musculus
tccccatccaggtgttggatctaca

SEQ ID NO: 814903 - DNA, 25 bp, Mus musculus
tccccatccccaaagagaacagtta

SEQ ID NO: 814904 - DNA, 25 bp, Mus musculus
tccccatccccatagagaacagtta

SEQ ID NO: 814905 - DNA, 25 bp, Mus musculus
tccccatcccgaatcatctaaagag

SEQ ID NO: 814906 - DNA, 25 bp, Mus musculus
tccccatcccgattcatctaaagag

SEQ ID NO: 814907 - DNA, 25 bp, Mus musculus
tccccatccctcaaatctgatttta

SEQ ID NO: 814908 - DNA, 25 bp, Mus musculus
tccccatccctctaatctgatttta

SEQ ID NO: 814909 - DNA, 25 bp, Mus musculus
tccccatcctaaagggtttgtatgc

SEQ ID NO: 814910 - DNA, 25 bp, Mus musculus
tccccatcctaatgggtttgtatgc

SEQ ID NO: 814911 - DNA, 25 bp, Mus musculus
tccccatcctcactaatagacgtta

SEQ ID NO: 814912 - DNA, 25 bp, Mus musculus
tccccatcctcagtaatagacgtta

SEQ ID NO: 814913 - DNA, 25 bp, Mus musculus
tccccatcgatgagacctttaaaag

SEQ ID NO: 814914 - DNA, 25 bp, Mus musculus
tccccatcgatgtgacctttaaaag

SEQ ID NO: 814915 - DNA, 25 bp, Mus musculus
tccccatctactaatcttttaattg

SEQ ID NO: 814916 - DNA, 25 bp, Mus musculus
tccccatctacttatcttttaattg

SEQ ID NO: 814917 - DNA, 25 bp, Mus musculus
tccccatctcctagtcataacataa

SEQ ID NO: 814918 - DNA, 25 bp, Mus musculus
tccccatctccttgtcataacataa

SEQ ID NO: 814919 - DNA, 25 bp, Mus musculus
tccccatctgatcttggcatgtgag

SEQ ID NO: 814920 - DNA, 25 bp, Mus musculus
tccccatctgatgttggcatgtgag

SEQ ID NO: 814921 - DNA, 25 bp, Mus musculus
tccccatctgtaaactgtagatatg

SEQ ID NO: 814922 - DNA, 25 bp, Mus musculus
tccccatctgtatactgtagatatg

SEQ ID NO: 814923 - DNA, 25 bp, Mus musculus
tccccatcttggctggatatatgca

SEQ ID NO: 814924 - DNA, 25 bp, Mus musculus
tccccatcttgggtggatatatgca

SEQ ID NO: 814925 - DNA, 25 bp, Mus musculus
tccccatgaataagtttacccagcc

SEQ ID NO: 814926 - DNA, 25 bp, Mus musculus
tccccatgaatatgtttacccagcc

SEQ ID NO: 814927 - DNA, 25 bp, Mus musculus
tccccatgacataaaaatccactaa

SEQ ID NO: 814928 - DNA, 25 bp, Mus musculus
tccccatgacattaaaatccactaa

SEQ ID NO: 814929 - DNA, 25 bp, Mus musculus
tccccatgaccaacttaaagacgac

SEQ ID NO: 814930 - DNA, 25 bp, Mus musculus
tccccatgaccaataacacctgtta

SEQ ID NO: 814931 - DNA, 25 bp, Mus musculus
tccccatgaccatcttaaagacgac

SEQ ID NO: 814932 - DNA, 25 bp, Mus musculus
tccccatgaccattaacacctgtta

SEQ ID NO: 814933 - DNA, 25 bp, Mus musculus
tccccatgatggatgagtcagtgac

SEQ ID NO: 814934 - DNA, 25 bp, Mus musculus
tccccatgatggttgagtcagtgac

SEQ ID NO: 814935 - DNA, 25 bp, Mus musculus
tccccatgctccaatacaatgatgc

SEQ ID NO: 814936 - DNA, 25 bp, Mus musculus
tccccatgctcctatacaatgatgc

SEQ ID NO: 814937 - DNA, 25 bp, Mus musculus
tccccatgcttgactggagaccaga

SEQ ID NO: 814938 - DNA, 25 bp, Mus musculus
tccccatgcttgcaaaggaacgact

SEQ ID NO: 814939 - DNA, 25 bp, Mus musculus
tccccatgcttggaaaggaacgact

SEQ ID NO: 814940 - DNA, 25 bp, Mus musculus
tccccatgcttgtctggagaccaga

SEQ ID NO: 814941 - DNA, 25 bp, Mus musculus
tccccatggaagcaccagtccagtt

SEQ ID NO: 814942 - DNA, 25 bp, Mus musculus
tccccatggaaggaccagtccagtt

SEQ ID NO: 814943 - DNA, 25 bp, Mus musculus
tccccatggcccattcagaaaatag

SEQ ID NO: 814944 - DNA, 25 bp, Mus musculus
tccccatggccctttcagaaaatag

SEQ ID NO: 814945 - DNA, 25 bp, Mus musculus
tccccatgggacatattgttacaat

SEQ ID NO: 814946 - DNA, 25 bp, Mus musculus
tccccatgggacttattgttacaat

SEQ ID NO: 814947 - DNA, 25 bp, Mus musculus
tccccatgggagagacggtcagaga

SEQ ID NO: 814948 - DNA, 25 bp, Mus musculus
tccccatgggagtgacggtcagaga

SEQ ID NO: 814949 - DNA, 25 bp, Mus musculus
tccccatgtcatagtgcgcatcaaa

SEQ ID NO: 814950 - DNA, 25 bp, Mus musculus
tccccatgtcattgtgcgcatcaaa

SEQ ID NO: 814951 - DNA, 25 bp, Mus musculus
tccccatgtgaaaggtgcgcttagt

SEQ ID NO: 814952 - DNA, 25 bp, Mus musculus
tccccatgtgaacttaactgtgttg

SEQ ID NO: 814953 - DNA, 25 bp, Mus musculus
tccccatgtgaagttaactgtgttg

SEQ ID NO: 814954 - DNA, 25 bp, Mus musculus
tccccatgtgaatggtgcgcttagt

SEQ ID NO: 814955 - DNA, 25 bp, Mus musculus
tccccatgtgttctgtttgcattgc

SEQ ID NO: 814956 - DNA, 25 bp, Mus musculus
tccccatgtgttgtgtttgcattgc

SEQ ID NO: 814957 - DNA, 25 bp, Mus musculus
tccccatgtttacctgacacacttg

SEQ ID NO: 814958 - DNA, 25 bp, Mus musculus
tccccatgtttagctgacacacttg

SEQ ID NO: 814959 - DNA, 25 bp, Mus musculus
tccccatgtttgatatagcttgccc

SEQ ID NO: 814960 - DNA, 25 bp, Mus musculus
tccccatgtttgttatagcttgccc

SEQ ID NO: 814961 - DNA, 25 bp, Mus musculus
tccccattagctaccaattctgtag

SEQ ID NO: 814962 - DNA, 25 bp, Mus musculus
tccccattagcttccaattctgtag

SEQ ID NO: 814963 - DNA, 25 bp, Mus musculus
tccccattagtcacttagtgttggt

SEQ ID NO: 814964 - DNA, 25 bp, Mus musculus
tccccattagtctcttagtgttggt

SEQ ID NO: 814965 - DNA, 25 bp, Mus musculus
tccccattatttcccagtagcctga

SEQ ID NO: 814966 - DNA, 25 bp, Mus musculus
tccccattatttgccagtagcctga

SEQ ID NO: 814967 - DNA, 25 bp, Mus musculus
tccccattcccaagtcctgagaata

SEQ ID NO: 814968 - DNA, 25 bp, Mus musculus
tccccattcccatgtcctgagaata

SEQ ID NO: 814969 - DNA, 25 bp, Mus musculus
tccccattgggcaactgtgaacagt

SEQ ID NO: 814970 - DNA, 25 bp, Mus musculus
tccccattgggctactgtgaacagt

SEQ ID NO: 814971 - DNA, 25 bp, Mus musculus
tccccattggtccaccagagagaaa

SEQ ID NO: 814972 - DNA, 25 bp, Mus musculus
tccccattggtcgaccagagagaaa

SEQ ID NO: 814973 - DNA, 25 bp, Mus musculus
tccccattgtgtatccttcttgaat

SEQ ID NO: 814974 - DNA, 25 bp, Mus musculus
tccccattgtgtttccttcttgaat

SEQ ID NO: 814975 - DNA, 25 bp, Mus musculus
tccccatttatacactccaacaaaa

SEQ ID NO: 814976 - DNA, 25 bp, Mus musculus
tccccatttatagactccaacaaaa

SEQ ID NO: 814977 - DNA, 25 bp, Mus musculus
tccccatttcagagagtgtatcaga

SEQ ID NO: 814978 - DNA, 25 bp, Mus musculus
tccccatttcagtgagtgtatcaga

SEQ ID NO: 814979 - DNA, 25 bp, Mus musculus
tccccatttggcacactgggaaatt

SEQ ID NO: 814980 - DNA, 25 bp, Mus musculus
tccccatttggctcactgggaaatt

SEQ ID NO: 814981 - DNA, 25 bp, Mus musculus
tccccatttgttctgggagtccagt

SEQ ID NO: 814982 - DNA, 25 bp, Mus musculus
tccccatttgttgtgggagtccagt

SEQ ID NO: 814983 - DNA, 25 bp, Mus musculus
tcccccagaatccttgtgatcatgt

SEQ ID NO: 814984 - DNA, 25 bp, Mus musculus
tcccccagaatcgttgtgatcatgt

SEQ ID NO: 814985 - DNA, 25 bp, Mus musculus
tcccccataagaccgaaccaaaaag

SEQ ID NO: 814986 - DNA, 25 bp, Mus musculus
tcccccataagagcgaaccaaaaag

SEQ ID NO: 814987 - DNA, 25 bp, Mus musculus
tccccccagggcacagagatatata

SEQ ID NO: 814988 - DNA, 25 bp, Mus musculus
tccccccagggctcagagatatata

SEQ ID NO: 814989 - DNA, 25 bp, Mus musculus
tcccccccagggacattagcttttg

SEQ ID NO: 814990 - DNA, 25 bp, Mus musculus
tcccccccagggtcattagcttttg

SEQ ID NO: 814991 - DNA, 25 bp, Mus musculus
tcccccctttctcagatttaactga

SEQ ID NO: 814992 - DNA, 25 bp, Mus musculus
tcccccctttctgagatttaactga

SEQ ID NO: 814993 - DNA, 25 bp, Mus musculus
tcccccgggcttcgagaaacctatg

SEQ ID NO: 814994 - DNA, 25 bp, Mus musculus
tcccccgggcttggagaaacctatg

SEQ ID NO: 814995 - DNA, 25 bp, Mus musculus
tccccctctctgaggcagtttcata

SEQ ID NO: 814996 - DNA, 25 bp, Mus musculus
tccccctctctgtggcagtttcata

SEQ ID NO: 814997 - DNA, 25 bp, Mus musculus
tccccctcttagactgctgagcttt

SEQ ID NO: 814998 - DNA, 25 bp, Mus musculus
tccccctcttagtctgctgagcttt

SEQ ID NO: 814999 - DNA, 25 bp, Mus musculus
tcccccttcaggaaccctgaacagt

SEQ ID NO: 815000 - DNA, 25 bp, Mus musculus
tcccccttcaggtaccctgaacagt

SEQ ID NO: 815001 - DNA, 25 bp, Mus musculus
tcccccttcttaccactatgttttg

SEQ ID NO: 815002 - DNA, 25 bp, Mus musculus
tcccccttcttagcactatgttttg

SEQ ID NO: 815003 - DNA, 25 bp, Mus musculus
tccccgaaagctatggccatggcag

SEQ ID NO: 815004 - DNA, 25 bp, Mus musculus
tccccgaaagctttggccatggcag

SEQ ID NO: 815005 - DNA, 25 bp, Mus musculus
tccccgaagtccaacactcagtagg

SEQ ID NO: 815006 - DNA, 25 bp, Mus musculus
tccccgaagtcctacactcagtagg

SEQ ID NO: 815007 - DNA, 25 bp, Mus musculus
tccccgacatttacaatagcatttg

SEQ ID NO: 815008 - DNA, 25 bp, Mus musculus
tccccgacattttcaatagcatttg

SEQ ID NO: 815009 - DNA, 25 bp, Mus musculus
tccccgacttgtaatttgccttgaa

SEQ ID NO: 815010 - DNA, 25 bp, Mus musculus
tccccgacttgttatttgccttgaa

SEQ ID NO: 815011 - DNA, 25 bp, Mus musculus
tccccgagaaagaacacctaggctt

SEQ ID NO: 815012 - DNA, 25 bp, Mus musculus
tccccgagaaagtacacctaggctt

SEQ ID NO: 815013 - DNA, 25 bp, Mus musculus
tccccgagaaggcagggagccactt

SEQ ID NO: 815014 - DNA, 25 bp, Mus musculus
tccccgagaagggagggagccactt

SEQ ID NO: 815015 - DNA, 25 bp, Mus musculus
tccccgagaatcactaacttttgat

SEQ ID NO: 815016 - DNA, 25 bp, Mus musculus
tccccgagaatctctaacttttgat

SEQ ID NO: 815017 - DNA, 25 bp, Mus musculus
tccccgagcccgcaagagaaaagag

SEQ ID NO: 815018 - DNA, 25 bp, Mus musculus
tccccgagcccggaagagaaaagag

SEQ ID NO: 815019 - DNA, 25 bp, Mus musculus
tccccgagcgttaccagagggagtt

SEQ ID NO: 815020 - DNA, 25 bp, Mus musculus
tccccgagcgtttccagagggagtt

SEQ ID NO: 815021 - DNA, 25 bp, Mus musculus
tccccgaggaggctgaaagcagtaa

SEQ ID NO: 815022 - DNA, 25 bp, Mus musculus
tccccgaggagggtgaaagcagtaa

SEQ ID NO: 815023 - DNA, 25 bp, Mus musculus
tccccgagtaagacctaagaccatt

SEQ ID NO: 815024 - DNA, 25 bp, Mus musculus
tccccgagtaagtcctaagaccatt

SEQ ID NO: 815025 - DNA, 25 bp, Mus musculus
tccccgagttaaatcccatttgtat

SEQ ID NO: 815026 - DNA, 25 bp, Mus musculus
tccccgagttaattcccatttgtat

SEQ ID NO: 815027 - DNA, 25 bp, Mus musculus
tccccgagttagagatcagccttgt

SEQ ID NO: 815028 - DNA, 25 bp, Mus musculus
tccccgagttagtgatcagccttgt

SEQ ID NO: 815029 - DNA, 25 bp, Mus musculus
tccccgatgggacatttgtgacagt

SEQ ID NO: 815030 - DNA, 25 bp, Mus musculus
tccccgatgggagatttgtgacagt

SEQ ID NO: 815031 - DNA, 25 bp, Mus musculus
tccccgattggaactgtggtttttc

SEQ ID NO: 815032 - DNA, 25 bp, Mus musculus
tccccgattggatctgtggtttttc

SEQ ID NO: 815033 - DNA, 25 bp, Mus musculus
tccccgattggtaggctgtgttgca

SEQ ID NO: 815034 - DNA, 25 bp, Mus musculus
tccccgattggttggctgtgttgca

SEQ ID NO: 815035 - DNA, 25 bp, Mus musculus
tccccgcacctgctgtagaagtata

SEQ ID NO: 815036 - DNA, 25 bp, Mus musculus
tccccgcacctggtgtagaagtata

SEQ ID NO: 815037 - DNA, 25 bp, Mus musculus
tccccgcagaagcttatccgtaagg

SEQ ID NO: 815038 - DNA, 25 bp, Mus musculus
tccccgcagaaggttatccgtaagg

SEQ ID NO: 815039 - DNA, 25 bp, Mus musculus
tccccgcagcagcttcagatagtta

SEQ ID NO: 815040 - DNA, 25 bp, Mus musculus
tccccgcagcaggttcagatagtta

SEQ ID NO: 815041 - DNA, 25 bp, Mus musculus
tccccgcatggacaacctggttccc

SEQ ID NO: 815042 - DNA, 25 bp, Mus musculus
tccccgcatggagaacctggttccc

SEQ ID NO: 815043 - DNA, 25 bp, Mus musculus
tccccgccattcataccctctggat

SEQ ID NO: 815044 - DNA, 25 bp, Mus musculus
tccccgccattcttaccctctggat

SEQ ID NO: 815045 - DNA, 25 bp, Mus musculus
tccccgcctccacgtgttagaaaag

SEQ ID NO: 815046 - DNA, 25 bp, Mus musculus
tccccgcctccaggtgttagaaaag

SEQ ID NO: 815047 - DNA, 25 bp, Mus musculus
tccccgcgctgaaaacttgcaatgc

SEQ ID NO: 815048 - DNA, 25 bp, Mus musculus
tccccgcgctgataacttgcaatgc

SEQ ID NO: 815049 - DNA, 25 bp, Mus musculus
tccccgctacatcacatacaattga

SEQ ID NO: 815050 - DNA, 25 bp, Mus musculus
tccccgctacatgacatacaattga

SEQ ID NO: 815051 - DNA, 25 bp, Mus musculus
tccccgctgattctctggagggaaa

SEQ ID NO: 815052 - DNA, 25 bp, Mus musculus
tccccgctgattgtctggagggaaa

SEQ ID NO: 815053 - DNA, 25 bp, Mus musculus
tccccgctgtttattgggcagaagc

SEQ ID NO: 815054 - DNA, 25 bp, Mus musculus
tccccgctgttttttgggcagaagc

SEQ ID NO: 815055 - DNA, 25 bp, Mus musculus
tccccgctttacatctgatagattg

SEQ ID NO: 815056 - DNA, 25 bp, Mus musculus
tccccgctttacttctgatagattg

SEQ ID NO: 815057 - DNA, 25 bp, Mus musculus
tccccggaacctatgattacttgaa

SEQ ID NO: 815058 - DNA, 25 bp, Mus musculus
tccccggaacctttgattacttgaa

SEQ ID NO: 815059 - DNA, 25 bp, Mus musculus
tccccggagcaaaagaggcagtttc

SEQ ID NO: 815060 - DNA, 25 bp, Mus musculus
tccccggagcaatagaggcagtttc

SEQ ID NO: 815061 - DNA, 25 bp, Mus musculus
tccccggatggaattctcaggtcaa

SEQ ID NO: 815062 - DNA, 25 bp, Mus musculus
tccccggatggatttctcaggtcaa

SEQ ID NO: 815063 - DNA, 25 bp, Mus musculus
tccccggatgttaaaggtgacttca

SEQ ID NO: 815064 - DNA, 25 bp, Mus musculus
tccccggatgtttaaggtgacttca

SEQ ID NO: 815065 - DNA, 25 bp, Mus musculus
tccccggatttactgtacaaggcaa

SEQ ID NO: 815066 - DNA, 25 bp, Mus musculus
tccccggatttagtgtacaaggcaa

SEQ ID NO: 815067 - DNA, 25 bp, Mus musculus
tccccggcatgacctctgtaaggag

SEQ ID NO: 815068 - DNA, 25 bp, Mus musculus
tccccggcatgagctctgtaaggag

SEQ ID NO: 815069 - DNA, 25 bp, Mus musculus
tccccgggactaacagccagtgtgg

SEQ ID NO: 815070 - DNA, 25 bp, Mus musculus
tccccgggactatcagccagtgtgg

SEQ ID NO: 815071 - DNA, 25 bp, Mus musculus
tccccggtacacagggctactataa

SEQ ID NO: 815072 - DNA, 25 bp, Mus musculus
tccccggtacactgggctactataa

SEQ ID NO: 815073 - DNA, 25 bp, Mus musculus
tccccggtgagaaaatggttgtggt

SEQ ID NO: 815074 - DNA, 25 bp, Mus musculus
tccccggtgagataatggttgtggt

SEQ ID NO: 815075 - DNA, 25 bp, Mus musculus
tccccggtgtaaagtttgtaactga

SEQ ID NO: 815076 - DNA, 25 bp, Mus musculus
tccccggtgtaatgtttgtaactga

SEQ ID NO: 815077 - DNA, 25 bp, Mus musculus
tccccgtacactactatttcctaag

SEQ ID NO: 815078 - DNA, 25 bp, Mus musculus
tccccgtacacttctatttcctaag

SEQ ID NO: 815079 - DNA, 25 bp, Mus musculus
tccccgtacttgagccaactttaat

SEQ ID NO: 815080 - DNA, 25 bp, Mus musculus
tccccgtacttgtgccaactttaat

SEQ ID NO: 815081 - DNA, 25 bp, Mus musculus
tccccgtcgtaaccgctgaggaatg

SEQ ID NO: 815082 - DNA, 25 bp, Mus musculus
tccccgtcgtaagcgctgaggaatg

SEQ ID NO: 815083 - DNA, 25 bp, Mus musculus
tccccgtctctgcatgtaatcatgg

SEQ ID NO: 815084 - DNA, 25 bp, Mus musculus
tccccgtctctggatgtaatcatgg

SEQ ID NO: 815085 - DNA, 25 bp, Mus musculus
tccccgtgagggaccagtatttata

SEQ ID NO: 815086 - DNA, 25 bp, Mus musculus
tccccgtgagggtccagtatttata

SEQ ID NO: 815087 - DNA, 25 bp, Mus musculus
tccccgtgcacacagatgcttttaa

SEQ ID NO: 815088 - DNA, 25 bp, Mus musculus
tccccgtgcacagagatgcttttaa

SEQ ID NO: 815089 - DNA, 25 bp, Mus musculus
tccccgtgcctgaatctaatatata

SEQ ID NO: 815090 - DNA, 25 bp, Mus musculus
tccccgtgcctgtatctaatatata

SEQ ID NO: 815091 - DNA, 25 bp, Mus musculus
tccccgtgcggccaagtattttgat

SEQ ID NO: 815092 - DNA, 25 bp, Mus musculus
tccccgtgcggcgaagtattttgat

SEQ ID NO: 815093 - DNA, 25 bp, Mus musculus
tccccgtggcaacctttgtgtcttg

SEQ ID NO: 815094 - DNA, 25 bp, Mus musculus
tccccgtggcaagctttgtgtcttg

SEQ ID NO: 815095 - DNA, 25 bp, Mus musculus
tccccgtgtatcataactgtcacaa

SEQ ID NO: 815096 - DNA, 25 bp, Mus musculus
tccccgtgtatcttaactgtcacaa

SEQ ID NO: 815097 - DNA, 25 bp, Mus musculus
tccccgtgtcctcgtggaagctaag

SEQ ID NO: 815098 - DNA, 25 bp, Mus musculus
tccccgtgtcctggtggaagctaag

SEQ ID NO: 815099 - DNA, 25 bp, Mus musculus
tccccgttatctcactcagttagaa

SEQ ID NO: 815100 - DNA, 25 bp, Mus musculus
tccccgttatctgactcagttagaa

SEQ ID NO: 815101 - DNA, 25 bp, Mus musculus
tccccgttgttgaggagaccatgct

SEQ ID NO: 815102 - DNA, 25 bp, Mus musculus
tccccgttgttgtggagaccatgct

SEQ ID NO: 815103 - DNA, 25 bp, Mus musculus
tccccgtttaccacaattgtatcat

SEQ ID NO: 815104 - DNA, 25 bp, Mus musculus
tccccgtttacctcaattgtatcat

SEQ ID NO: 815105 - DNA, 25 bp, Mus musculus
tcccctaaaagcacaggaggcaccc

SEQ ID NO: 815106 - DNA, 25 bp, Mus musculus
tcccctaaaagctcaggaggcaccc

SEQ ID NO: 815107 - DNA, 25 bp, Mus musculus
tcccctaaacacaatctgacatttc

SEQ ID NO: 815108 - DNA, 25 bp, Mus musculus
tcccctaaacactatctgacatttc

SEQ ID NO: 815109 - DNA, 25 bp, Mus musculus
tcccctaaagtgatcattgaacttg

SEQ ID NO: 815110 - DNA, 25 bp, Mus musculus
tcccctaaagtgttcattgaacttg

SEQ ID NO: 815111 - DNA, 25 bp, Mus musculus
tcccctaacccaatggtgtgatttt

SEQ ID NO: 815112 - DNA, 25 bp, Mus musculus
tcccctaacccattggtgtgatttt

SEQ ID NO: 815113 - DNA, 25 bp, Mus musculus
tcccctaagtgcaagcttccaggat

SEQ ID NO: 815114 - DNA, 25 bp, Mus musculus
tcccctaagtgctagcttccaggat

SEQ ID NO: 815115 - DNA, 25 bp, Mus musculus
tcccctaatcagcatgatttggaaa

SEQ ID NO: 815116 - DNA, 25 bp, Mus musculus
tcccctaatcaggatgatttggaaa

SEQ ID NO: 815117 - DNA, 25 bp, Mus musculus
tcccctaatgttaggttctcttact

SEQ ID NO: 815118 - DNA, 25 bp, Mus musculus
tcccctaatgtttggttctcttact

SEQ ID NO: 815119 - DNA, 25 bp, Mus musculus
tcccctacctttcccaatgtgttta

SEQ ID NO: 815120 - DNA, 25 bp, Mus musculus
tcccctacctttgccaatgtgttta

SEQ ID NO: 815121 - DNA, 25 bp, Mus musculus
tcccctactttgaggtgtggtgtaa

SEQ ID NO: 815122 - DNA, 25 bp, Mus musculus
tcccctactttgtggtgtggtgtaa

SEQ ID NO: 815123 - DNA, 25 bp, Mus musculus
tcccctagactgctgtggaggtgaa

SEQ ID NO: 815124 - DNA, 25 bp, Mus musculus
tcccctagactggtgtggaggtgaa

SEQ ID NO: 815125 - DNA, 25 bp, Mus musculus
tcccctagcggacctgatgagttgc

SEQ ID NO: 815126 - DNA, 25 bp, Mus musculus
tcccctagcggagctgatgagttgc

SEQ ID NO: 815127 - DNA, 25 bp, Mus musculus
tcccctagtagtaaaaagagtgcta

SEQ ID NO: 815128 - DNA, 25 bp, Mus musculus
tcccctagtagttaaaagagtgcta

SEQ ID NO: 815129 - DNA, 25 bp, Mus musculus
tcccctataactaagtaggagggag

SEQ ID NO: 815130 - DNA, 25 bp, Mus musculus
tcccctataacttagtaggagggag

SEQ ID NO: 815131 - DNA, 25 bp, Mus musculus
tcccctatccatagccagatgaatg

SEQ ID NO: 815132 - DNA, 25 bp, Mus musculus
tcccctatccattgccagatgaatg

SEQ ID NO: 815133 - DNA, 25 bp, Mus musculus
tcccctatgctgattgtcaagtttg

SEQ ID NO: 815134 - DNA, 25 bp, Mus musculus
tcccctatgctgtttgtcaagtttg

SEQ ID NO: 815135 - DNA, 25 bp, Mus musculus
tcccctatttatcttttcacacagt

SEQ ID NO: 815136 - DNA, 25 bp, Mus musculus
tcccctatttatgttttcacacagt

SEQ ID NO: 815137 - DNA, 25 bp, Mus musculus
tcccctattttgagcttatcgtctt

SEQ ID NO: 815138 - DNA, 25 bp, Mus musculus
tcccctattttgtgcttatcgtctt

SEQ ID NO: 815139 - DNA, 25 bp, Mus musculus
tcccctcaaatgcacccaaaatatt

SEQ ID NO: 815140 - DNA, 25 bp, Mus musculus
tcccctcaaatggacccaaaatatt

SEQ ID NO: 815141 - DNA, 25 bp, Mus musculus
tcccctcaacccactaatgttgtga

SEQ ID NO: 815142 - DNA, 25 bp, Mus musculus
tcccctcaaccctctaatgttgtga

SEQ ID NO: 815143 - DNA, 25 bp, Mus musculus
tcccctcacgttagcagttgatgtg

SEQ ID NO: 815144 - DNA, 25 bp, Mus musculus
tcccctcacgtttgcagttgatgtg

SEQ ID NO: 815145 - DNA, 25 bp, Mus musculus
tcccctcactatcttttgacactaa

SEQ ID NO: 815146 - DNA, 25 bp, Mus musculus
tcccctcactatgttttgacactaa

SEQ ID NO: 815147 - DNA, 25 bp, Mus musculus
tcccctcagcttcattgtgtgagat

SEQ ID NO: 815148 - DNA, 25 bp, Mus musculus
tcccctcagcttgattgtgtgagat

SEQ ID NO: 815149 - DNA, 25 bp, Mus musculus
tcccctcaggacaaatcgtggctta

SEQ ID NO: 815150 - DNA, 25 bp, Mus musculus
tcccctcaggactaatcgtggctta

SEQ ID NO: 815151 - DNA, 25 bp, Mus musculus
tcccctcagggcaggtattggaata

SEQ ID NO: 815152 - DNA, 25 bp, Mus musculus
tcccctcagggctggtattggaata

SEQ ID NO: 815153 - DNA, 25 bp, Mus musculus
tcccctcagtagagcgcagtttgta

SEQ ID NO: 815154 - DNA, 25 bp, Mus musculus
tcccctcagtagtgcgcagtttgta

SEQ ID NO: 815155 - DNA, 25 bp, Mus musculus
tcccctcagttacgtattccttgtt

SEQ ID NO: 815156 - DNA, 25 bp, Mus musculus
tcccctcagttaggtattccttgtt

SEQ ID NO: 815157 - DNA, 25 bp, Mus musculus
tcccctcatcagatcagctaagctg

SEQ ID NO: 815158 - DNA, 25 bp, Mus musculus
tcccctcatcagttcagctaagctg

SEQ ID NO: 815159 - DNA, 25 bp, Mus musculus
tcccctcatcgaaggctggctgtga

SEQ ID NO: 815160 - DNA, 25 bp, Mus musculus
tcccctcatcgatggctggctgtga

SEQ ID NO: 815161 - DNA, 25 bp, Mus musculus
tcccctccaaggagatactacatat

SEQ ID NO: 815162 - DNA, 25 bp, Mus musculus
tcccctccaaggtgatactacatat

SEQ ID NO: 815163 - DNA, 25 bp, Mus musculus
tcccctccagtgatgtaatgtatgt

SEQ ID NO: 815164 - DNA, 25 bp, Mus musculus
tcccctccagtgttgtaatgtatgt

SEQ ID NO: 815165 - DNA, 25 bp, Mus musculus
tcccctccatacattacagtggtgc

SEQ ID NO: 815166 - DNA, 25 bp, Mus musculus
tcccctccatactttacagtggtgc

SEQ ID NO: 815167 - DNA, 25 bp, Mus musculus
tcccctccctcacgacatgaagaaa

SEQ ID NO: 815168 - DNA, 25 bp, Mus musculus
tcccctccctcaggacatgaagaaa

SEQ ID NO: 815169 - DNA, 25 bp, Mus musculus
tcccctccggttcaaaggcgcataa

SEQ ID NO: 815170 - DNA, 25 bp, Mus musculus
tcccctccggttgaaaggcgcataa

SEQ ID NO: 815171 - DNA, 25 bp, Mus musculus
tcccctcctcagatatgtagagcta

SEQ ID NO: 815172 - DNA, 25 bp, Mus musculus
tcccctcctcagttatgtagagcta

SEQ ID NO: 815173 - DNA, 25 bp, Mus musculus
tcccctcctggcaatgttgtttctt

SEQ ID NO: 815174 - DNA, 25 bp, Mus musculus
tcccctcctggctatgttgtttctt

SEQ ID NO: 815175 - DNA, 25 bp, Mus musculus
tcccctcctgtgagacaatgacctt

SEQ ID NO: 815176 - DNA, 25 bp, Mus musculus
tcccctcctgtgtgacaatgacctt

SEQ ID NO: 815177 - DNA, 25 bp, Mus musculus
tcccctccttatacttaactcatgg

SEQ ID NO: 815178 - DNA, 25 bp, Mus musculus
tcccctccttattcttaactcatgg

SEQ ID NO: 815179 - DNA, 25 bp, Mus musculus
tcccctcgaggaactgataaccagc

SEQ ID NO: 815180 - DNA, 25 bp, Mus musculus
tcccctcgaggatctgataaccagc

SEQ ID NO: 815181 - DNA, 25 bp, Mus musculus
tcccctcgcagcatatctattgaga

SEQ ID NO: 815182 - DNA, 25 bp, Mus musculus
tcccctcgcagcttatctattgaga

SEQ ID NO: 815183 - DNA, 25 bp, Mus musculus
tcccctcggtacacgggaggacaga

SEQ ID NO: 815184 - DNA, 25 bp, Mus musculus
tcccctcggtactcgggaggacaga

SEQ ID NO: 815185 - DNA, 25 bp, Mus musculus
tcccctcgttgcagaatacattgta

SEQ ID NO: 815186 - DNA, 25 bp, Mus musculus
tcccctcgttgctgaatacattgta

SEQ ID NO: 815187 - DNA, 25 bp, Mus musculus
tcccctctaagacggacttgggtgc

SEQ ID NO: 815188 - DNA, 25 bp, Mus musculus
tcccctctaagagggacttgggtgc

SEQ ID NO: 815189 - DNA, 25 bp, Mus musculus
tcccctctagttatggtggtttctt

SEQ ID NO: 815190 - DNA, 25 bp, Mus musculus
tcccctctagttttggtggtttctt

SEQ ID NO: 815191 - DNA, 25 bp, Mus musculus
tcccctctccatatataccaaagaa

SEQ ID NO: 815192 - DNA, 25 bp, Mus musculus
tcccctctccatccaattatagtta

SEQ ID NO: 815193 - DNA, 25 bp, Mus musculus
tcccctctccatgcaattatagtta

SEQ ID NO: 815194 - DNA, 25 bp, Mus musculus
tcccctctccatttataccaaagaa

SEQ ID NO: 815195 - DNA, 25 bp, Mus musculus
tcccctctcccgcatttaaatggat

SEQ ID NO: 815196 - DNA, 25 bp, Mus musculus
tcccctctcccggatttaaatggat

SEQ ID NO: 815197 - DNA, 25 bp, Mus musculus
tcccctctgcttacaatgtgcattt

SEQ ID NO: 815198 - DNA, 25 bp, Mus musculus
tcccctctgctttcaatgtgcattt

SEQ ID NO: 815199 - DNA, 25 bp, Mus musculus
tcccctctgtcgagtgtgtttgaaa

SEQ ID NO: 815200 - DNA, 25 bp, Mus musculus
tcccctctgtcgtgtgtgtttgaaa

SEQ ID NO: 815201 - DNA, 25 bp, Mus musculus
tcccctcttcaacgacattggtact

SEQ ID NO: 815202 - DNA, 25 bp, Mus musculus
tcccctcttcaaggacattggtact

SEQ ID NO: 815203 - DNA, 25 bp, Mus musculus
tcccctcttgctcaccaggtgagag

SEQ ID NO: 815204 - DNA, 25 bp, Mus musculus
tcccctcttgctgaccaggtgagag

SEQ ID NO: 815205 - DNA, 25 bp, Mus musculus
tcccctctttgtagaaatcccttgg

SEQ ID NO: 815206 - DNA, 25 bp, Mus musculus
tcccctctttgttgaaatcccttgg

SEQ ID NO: 815207 - DNA, 25 bp, Mus musculus
tcccctcttttcctttgataggtag

SEQ ID NO: 815208 - DNA, 25 bp, Mus musculus
tcccctcttttcgtttgataggtag

SEQ ID NO: 815209 - DNA, 25 bp, Mus musculus
tcccctgaaatgctggcgctccgag

SEQ ID NO: 815210 - DNA, 25 bp, Mus musculus
tcccctgaaatggtggcgctccgag

SEQ ID NO: 815211 - DNA, 25 bp, Mus musculus
tcccctgaactaaccacactaagaa

SEQ ID NO: 815212 - DNA, 25 bp, Mus musculus
tcccctgaactatccacactaagaa

SEQ ID NO: 815213 - DNA, 25 bp, Mus musculus
tcccctgaagaaagattcatataga

SEQ ID NO: 815214 - DNA, 25 bp, Mus musculus
tcccctgaagaatgattcatataga

SEQ ID NO: 815215 - DNA, 25 bp, Mus musculus
tcccctgaagcacctattgctggta

SEQ ID NO: 815216 - DNA, 25 bp, Mus musculus
tcccctgaagcagctattgctggta

SEQ ID NO: 815217 - DNA, 25 bp, Mus musculus
tcccctgaaggaatgcattataaat

SEQ ID NO: 815218 - DNA, 25 bp, Mus musculus
tcccctgaaggattgcattataaat

SEQ ID NO: 815219 - DNA, 25 bp, Mus musculus
tcccctgaatttaaccaagcttgag

SEQ ID NO: 815220 - DNA, 25 bp, Mus musculus
tcccctgaattttaccaagcttgag

SEQ ID NO: 815221 - DNA, 25 bp, Mus musculus
tcccctgactccaaataaatctctt

SEQ ID NO: 815222 - DNA, 25 bp, Mus musculus
tcccctgactcctaataaatctctt

SEQ ID NO: 815223 - DNA, 25 bp, Mus musculus
tcccctgagaacatggaccaacatc

SEQ ID NO: 815224 - DNA, 25 bp, Mus musculus
tcccctgagaacttggaccaacatc

SEQ ID NO: 815225 - DNA, 25 bp, Mus musculus
tcccctgagactcctcgaggaggcc

SEQ ID NO: 815226 - DNA, 25 bp, Mus musculus
tcccctgagactgctcgaggaggcc

SEQ ID NO: 815227 - DNA, 25 bp, Mus musculus
tcccctgagcagacctttgccaaga

SEQ ID NO: 815228 - DNA, 25 bp, Mus musculus
tcccctgagcagcagatctgtaata

SEQ ID NO: 815229 - DNA, 25 bp, Mus musculus
tcccctgagcaggagatctgtaata

SEQ ID NO: 815230 - DNA, 25 bp, Mus musculus
tcccctgagcagtcctttgccaaga

SEQ ID NO: 815231 - DNA, 25 bp, Mus musculus
tcccctgaggagatgcacatggtgt

SEQ ID NO: 815232 - DNA, 25 bp, Mus musculus
tcccctgaggagttgcacatggtgt

SEQ ID NO: 815233 - DNA, 25 bp, Mus musculus
tcccctgaggcgcaattctaatctg

SEQ ID NO: 815234 - DNA, 25 bp, Mus musculus
tcccctgaggcggaattctaatctg

SEQ ID NO: 815235 - DNA, 25 bp, Mus musculus
tcccctgagggacagggtcttcttt

SEQ ID NO: 815236 - DNA, 25 bp, Mus musculus
tcccctgagggagagggtcttcttt

SEQ ID NO: 815237 - DNA, 25 bp, Mus musculus
tcccctgagggcatgtttaagtaga

SEQ ID NO: 815238 - DNA, 25 bp, Mus musculus
tcccctgagggcttgtttaagtaga

SEQ ID NO: 815239 - DNA, 25 bp, Mus musculus
tcccctgagtcacaagctgtggaaa

SEQ ID NO: 815240 - DNA, 25 bp, Mus musculus
tcccctgagtcagaagctgtggaaa

SEQ ID NO: 815241 - DNA, 25 bp, Mus musculus
tcccctgatggcacaccttcaaatt

SEQ ID NO: 815242 - DNA, 25 bp, Mus musculus
tcccctgatggctcaccttcaaatt

SEQ ID NO: 815243 - DNA, 25 bp, Mus musculus
tcccctgcaagaatatcaagcgctc

SEQ ID NO: 815244 - DNA, 25 bp, Mus musculus
tcccctgcaagattatcaagcgctc

SEQ ID NO: 815245 - DNA, 25 bp, Mus musculus
tcccctgcaccaaggagaatcaaag

SEQ ID NO: 815246 - DNA, 25 bp, Mus musculus
tcccctgcaccatggagaatcaaag

SEQ ID NO: 815247 - DNA, 25 bp, Mus musculus
tcccctgcactcacgagatgttatt

SEQ ID NO: 815248 - DNA, 25 bp, Mus musculus
tcccctgcactctcgagatgttatt

SEQ ID NO: 815249 - DNA, 25 bp, Mus musculus
tcccctgcataccttgactgatgtg

SEQ ID NO: 815250 - DNA, 25 bp, Mus musculus
tcccctgcatacgttgactgatgtg

SEQ ID NO: 815251 - DNA, 25 bp, Mus musculus
tcccctgcatggcatatgagtcatc

SEQ ID NO: 815252 - DNA, 25 bp, Mus musculus
tcccctgcatgggatatgagtcatc

SEQ ID NO: 815253 - DNA, 25 bp, Mus musculus
tcccctgcctgtaggtagtgaatac

SEQ ID NO: 815254 - DNA, 25 bp, Mus musculus
tcccctgcctgttggtagtgaatac

SEQ ID NO: 815255 - DNA, 25 bp, Mus musculus
tcccctgcgaccagaaaggcattgg

SEQ ID NO: 815256 - DNA, 25 bp, Mus musculus
tcccctgcgacctgaaaggcattgg

SEQ ID NO: 815257 - DNA, 25 bp, Mus musculus
tcccctgcgtctcgtgagtgacaca

SEQ ID NO: 815258 - DNA, 25 bp, Mus musculus
tcccctgcgtctggtgagtgacaca

SEQ ID NO: 815259 - DNA, 25 bp, Mus musculus
tcccctgctcagcagtttatgtgac

SEQ ID NO: 815260 - DNA, 25 bp, Mus musculus
tcccctgctcaggagtttatgtgac

SEQ ID NO: 815261 - DNA, 25 bp, Mus musculus
tcccctgctgtgagcatttgcggag

SEQ ID NO: 815262 - DNA, 25 bp, Mus musculus
tcccctgctgtgtgcatttgcggag

SEQ ID NO: 815263 - DNA, 25 bp, Mus musculus
tcccctgctttgagagttaggcgtg

SEQ ID NO: 815264 - DNA, 25 bp, Mus musculus
tcccctgctttgtgagttaggcgtg

SEQ ID NO: 815265 - DNA, 25 bp, Mus musculus
tcccctggacagacattttaaccct

SEQ ID NO: 815266 - DNA, 25 bp, Mus musculus
tcccctggacagtcattttaaccct

SEQ ID NO: 815267 - DNA, 25 bp, Mus musculus
tcccctggaccaaaggctgctgctg

SEQ ID NO: 815268 - DNA, 25 bp, Mus musculus
tcccctggaccataggctgctgctg

SEQ ID NO: 815269 - DNA, 25 bp, Mus musculus
tcccctggacttagcattgtgagat

SEQ ID NO: 815270 - DNA, 25 bp, Mus musculus
tcccctggactttgcattgtgagat

SEQ ID NO: 815271 - DNA, 25 bp, Mus musculus
tcccctggagacacttgtgctggaa

SEQ ID NO: 815272 - DNA, 25 bp, Mus musculus
tcccctggagactcttgtgctggaa

SEQ ID NO: 815273 - DNA, 25 bp, Mus musculus
tcccctggagccatgacctgaagag

SEQ ID NO: 815274 - DNA, 25 bp, Mus musculus
tcccctggagccttgacctgaagag

SEQ ID NO: 815275 - DNA, 25 bp, Mus musculus
tcccctggatcaccattcttgagct

SEQ ID NO: 815276 - DNA, 25 bp, Mus musculus
tcccctggatcagcattcttgagct

SEQ ID NO: 815277 - DNA, 25 bp, Mus musculus
tcccctggcaggcatgtaggtacct

SEQ ID NO: 815278 - DNA, 25 bp, Mus musculus
tcccctggcagggatgtaggtacct

SEQ ID NO: 815279 - DNA, 25 bp, Mus musculus
tcccctggcatcagtgtataagaga

SEQ ID NO: 815280 - DNA, 25 bp, Mus musculus
tcccctggcatctgtgtataagaga

SEQ ID NO: 815281 - DNA, 25 bp, Mus musculus
tcccctggcccaaagtgttctattt

SEQ ID NO: 815282 - DNA, 25 bp, Mus musculus
tcccctggcccatagtgttctattt

SEQ ID NO: 815283 - DNA, 25 bp, Mus musculus
tcccctggcgtgcactcgacagagt

SEQ ID NO: 815284 - DNA, 25 bp, Mus musculus
tcccctggcgtggactcgacagagt

SEQ ID NO: 815285 - DNA, 25 bp, Mus musculus
tcccctggctgacactgaatatttg

SEQ ID NO: 815286 - DNA, 25 bp, Mus musculus
tcccctggctgagactgaatatttg

SEQ ID NO: 815287 - DNA, 25 bp, Mus musculus
tcccctgggaggagacatatacatc

SEQ ID NO: 815288 - DNA, 25 bp, Mus musculus
tcccctgggaggtgacatatacatc

SEQ ID NO: 815289 - DNA, 25 bp, Mus musculus
tcccctgggatcagctactaaagca

SEQ ID NO: 815290 - DNA, 25 bp, Mus musculus
tcccctgggatctgctactaaagca

SEQ ID NO: 815291 - DNA, 25 bp, Mus musculus
tcccctgggtgaccggcatgtcatg

SEQ ID NO: 815292 - DNA, 25 bp, Mus musculus
tcccctgggtgagcggcatgtcatg

SEQ ID NO: 815293 - DNA, 25 bp, Mus musculus
tcccctggtgacaaagaaagctgac

SEQ ID NO: 815294 - DNA, 25 bp, Mus musculus
tcccctggtgactaagaaagctgac

SEQ ID NO: 815295 - DNA, 25 bp, Mus musculus
tcccctggtgctctatctgcaatga

SEQ ID NO: 815296 - DNA, 25 bp, Mus musculus
tcccctggtgctgtatctgcaatga

SEQ ID NO: 815297 - DNA, 25 bp, Mus musculus
tcccctggtgtccatgactactaat

SEQ ID NO: 815298 - DNA, 25 bp, Mus musculus
tcccctggtgtcgatgactactaat

SEQ ID NO: 815299 - DNA, 25 bp, Mus musculus
tcccctggtttgctggcctaaacag

SEQ ID NO: 815300 - DNA, 25 bp, Mus musculus
tcccctggtttggtggcctaaacag

SEQ ID NO: 815301 - DNA, 25 bp, Mus musculus
tcccctgtaatactcctcagtgtat

SEQ ID NO: 815302 - DNA, 25 bp, Mus musculus
tcccctgtaatagtcctcagtgtat

SEQ ID NO: 815303 - DNA, 25 bp, Mus musculus
tcccctgtcatcactggctgaagtg

SEQ ID NO: 815304 - DNA, 25 bp, Mus musculus
tcccctgtcatctctggctgaagtg

SEQ ID NO: 815305 - DNA, 25 bp, Mus musculus
tcccctgtcttgatttggcatagtg

SEQ ID NO: 815306 - DNA, 25 bp, Mus musculus
tcccctgtcttgttttggcatagtg

SEQ ID NO: 815307 - DNA, 25 bp, Mus musculus
tcccctgtgaaacttgctgtccaaa

SEQ ID NO: 815308 - DNA, 25 bp, Mus musculus
tcccctgtgaaagttgctgtccaaa

SEQ ID NO: 815309 - DNA, 25 bp, Mus musculus
tcccctgtgaatactgtggcaaacg

SEQ ID NO: 815310 - DNA, 25 bp, Mus musculus
tcccctgtgaattctgtggcaaacg

SEQ ID NO: 815311 - DNA, 25 bp, Mus musculus
tcccctgtggatctgctcctgagaa

SEQ ID NO: 815312 - DNA, 25 bp, Mus musculus
tcccctgtggatgtgctcctgagaa

SEQ ID NO: 815313 - DNA, 25 bp, Mus musculus
tcccctgtggctagaaaggattaat

SEQ ID NO: 815314 - DNA, 25 bp, Mus musculus
tcccctgtggcttgaaaggattaat

SEQ ID NO: 815315 - DNA, 25 bp, Mus musculus
tcccctgtgtgcctccttgctggga

SEQ ID NO: 815316 - DNA, 25 bp, Mus musculus
tcccctgtgtgcgtccttgctggga

SEQ ID NO: 815317 - DNA, 25 bp, Mus musculus
tcccctgtgttcatttgaaatcttt

SEQ ID NO: 815318 - DNA, 25 bp, Mus musculus
tcccctgtgttcttttgaaatcttt

SEQ ID NO: 815319 - DNA, 25 bp, Mus musculus
tcccctgttaacatttctaccgtga

SEQ ID NO: 815320 - DNA, 25 bp, Mus musculus
tcccctgttaacttttctaccgtga

SEQ ID NO: 815321 - DNA, 25 bp, Mus musculus
tcccctgttcatctgatccaatcag

SEQ ID NO: 815322 - DNA, 25 bp, Mus musculus
tcccctgttcatgtgatccaatcag

SEQ ID NO: 815323 - DNA, 25 bp, Mus musculus
tcccctgttgaaatcttagtctctt

SEQ ID NO: 815324 - DNA, 25 bp, Mus musculus
tcccctgttgaattcttagtctctt

SEQ ID NO: 815325 - DNA, 25 bp, Mus musculus
tcccctgttgctatctgatgtgttc

SEQ ID NO: 815326 - DNA, 25 bp, Mus musculus
tcccctgttgctttctgatgtgttc

SEQ ID NO: 815327 - DNA, 25 bp, Mus musculus
tcccctgtttgaacagctgcttcta

SEQ ID NO: 815328 - DNA, 25 bp, Mus musculus
tcccctgtttgacctgaaattctgg

SEQ ID NO: 815329 - DNA, 25 bp, Mus musculus
tcccctgtttgagctgaaattctgg

SEQ ID NO: 815330 - DNA, 25 bp, Mus musculus
tcccctgtttgatcagctgcttcta

SEQ ID NO: 815331 - DNA, 25 bp, Mus musculus
tccccttaaagcccagaagatgagt

SEQ ID NO: 815332 - DNA, 25 bp, Mus musculus
tccccttaaagcgcagaagatgagt

SEQ ID NO: 815333 - DNA, 25 bp, Mus musculus
tccccttagacaatctgatgtgcac

SEQ ID NO: 815334 - DNA, 25 bp, Mus musculus
tccccttagacattctgatgtgcac

SEQ ID NO: 815335 - DNA, 25 bp, Mus musculus
tccccttagatgcaacaaatgtggc

SEQ ID NO: 815336 - DNA, 25 bp, Mus musculus
tccccttagatggaacaaatgtggc

SEQ ID NO: 815337 - DNA, 25 bp, Mus musculus
tccccttagcagctatatattcact

SEQ ID NO: 815338 - DNA, 25 bp, Mus musculus
tccccttagcaggtatatattcact

SEQ ID NO: 815339 - DNA, 25 bp, Mus musculus
tccccttagggcacaaccagaagtt

SEQ ID NO: 815340 - DNA, 25 bp, Mus musculus
tccccttagggctcaaccagaagtt

SEQ ID NO: 815341 - DNA, 25 bp, Mus musculus
tccccttatacaagactctgcagac

SEQ ID NO: 815342 - DNA, 25 bp, Mus musculus
tccccttatacatgactctgcagac

SEQ ID NO: 815343 - DNA, 25 bp, Mus musculus
tccccttattccaatgaatcccaag

SEQ ID NO: 815344 - DNA, 25 bp, Mus musculus
tccccttattcctatgaatcccaag

SEQ ID NO: 815345 - DNA, 25 bp, Mus musculus
tccccttattggctctgaagtacaa

SEQ ID NO: 815346 - DNA, 25 bp, Mus musculus
tccccttattgggtctgaagtacaa

SEQ ID NO: 815347 - DNA, 25 bp, Mus musculus
tccccttcaatcacagaggtctgtt

SEQ ID NO: 815348 - DNA, 25 bp, Mus musculus
tccccttcaatctcagaggtctgtt

SEQ ID NO: 815349 - DNA, 25 bp, Mus musculus
tccccttcacctagtttctggcttg

SEQ ID NO: 815350 - DNA, 25 bp, Mus musculus
tccccttcaccttgtttctggcttg

SEQ ID NO: 815351 - DNA, 25 bp, Mus musculus
tccccttcatctagttaacctggac

SEQ ID NO: 815352 - DNA, 25 bp, Mus musculus
tccccttcatcttgttaacctggac

SEQ ID NO: 815353 - DNA, 25 bp, Mus musculus
tccccttcatgaagccctgccttac

SEQ ID NO: 815354 - DNA, 25 bp, Mus musculus
tccccttcatgatgccctgccttac

SEQ ID NO: 815355 - DNA, 25 bp, Mus musculus
tccccttcatgcatttactcaaata

SEQ ID NO: 815356 - DNA, 25 bp, Mus musculus
tccccttcatgcttttactcaaata

SEQ ID NO: 815357 - DNA, 25 bp, Mus musculus
tccccttcattaattgacctctttt

SEQ ID NO: 815358 - DNA, 25 bp, Mus musculus
tccccttcattatttgacctctttt

SEQ ID NO: 815359 - DNA, 25 bp, Mus musculus
tccccttctcgcattatgtgtgtag

SEQ ID NO: 815360 - DNA, 25 bp, Mus musculus
tccccttctcgctttatgtgtgtag

SEQ ID NO: 815361 - DNA, 25 bp, Mus musculus
tccccttctgtcatgtggatctcaa

SEQ ID NO: 815362 - DNA, 25 bp, Mus musculus
tccccttctgtcttgtggatctcaa

SEQ ID NO: 815363 - DNA, 25 bp, Mus musculus
tccccttgactgagcatcaaaagag

SEQ ID NO: 815364 - DNA, 25 bp, Mus musculus
tccccttgactgtgcatcaaaagag

SEQ ID NO: 815365 - DNA, 25 bp, Mus musculus
tccccttgccaacatttattatact

SEQ ID NO: 815366 - DNA, 25 bp, Mus musculus
tccccttgccaagatttattatact

SEQ ID NO: 815367 - DNA, 25 bp, Mus musculus
tccccttgcctacctgatgaattgt

SEQ ID NO: 815368 - DNA, 25 bp, Mus musculus
tccccttgcctagctgatgaattgt

SEQ ID NO: 815369 - DNA, 25 bp, Mus musculus
tccccttgctccagcaactatggaa

SEQ ID NO: 815370 - DNA, 25 bp, Mus musculus
tccccttgctcctgcaactatggaa

SEQ ID NO: 815371 - DNA, 25 bp, Mus musculus
tccccttggaagcaccacctctgtc

SEQ ID NO: 815372 - DNA, 25 bp, Mus musculus
tccccttggaaggaccacctctgtc

SEQ ID NO: 815373 - DNA, 25 bp, Mus musculus
tccccttggagtccagtagagcggc

SEQ ID NO: 815374 - DNA, 25 bp, Mus musculus
tccccttggagtgcagtagagcggc

SEQ ID NO: 815375 - DNA, 25 bp, Mus musculus
tccccttggtgaattatttttcctg

SEQ ID NO: 815376 - DNA, 25 bp, Mus musculus
tccccttggtgatttatttttcctg

SEQ ID NO: 815377 - DNA, 25 bp, Mus musculus
tccccttggtttaatagtgctacat

SEQ ID NO: 815378 - DNA, 25 bp, Mus musculus
tccccttggtttatgtgtttgtctc

SEQ ID NO: 815379 - DNA, 25 bp, Mus musculus
tccccttggtttcctcttttaacag

SEQ ID NO: 815380 - DNA, 25 bp, Mus musculus
tccccttggtttgctcttttaacag

SEQ ID NO: 815381 - DNA, 25 bp, Mus musculus
tccccttggttttatagtgctacat

SEQ ID NO: 815382 - DNA, 25 bp, Mus musculus
tccccttggtttttgtgtttgtctc

SEQ ID NO: 815383 - DNA, 25 bp, Mus musculus
tccccttgtagtcactttgctttat

SEQ ID NO: 815384 - DNA, 25 bp, Mus musculus
tccccttgtagtgactttgctttat

SEQ ID NO: 815385 - DNA, 25 bp, Mus musculus
tccccttgtgtgcagcttggaatga

SEQ ID NO: 815386 - DNA, 25 bp, Mus musculus
tccccttgtgtggagcttggaatga

SEQ ID NO: 815387 - DNA, 25 bp, Mus musculus
tccccttgtttgattacagcatgag

SEQ ID NO: 815388 - DNA, 25 bp, Mus musculus
tccccttgtttgtttacagcatgag

SEQ ID NO: 815389 - DNA, 25 bp, Mus musculus
tcccctttagacaaagagcaactta

SEQ ID NO: 815390 - DNA, 25 bp, Mus musculus
tcccctttagactaagagcaactta

SEQ ID NO: 815391 - DNA, 25 bp, Mus musculus
tcccctttagatcgttatgttgaca

SEQ ID NO: 815392 - DNA, 25 bp, Mus musculus
tcccctttagatggttatgttgaca

SEQ ID NO: 815393 - DNA, 25 bp, Mus musculus
tcccctttagcactaggttcttagt

SEQ ID NO: 815394 - DNA, 25 bp, Mus musculus
tcccctttagcagtaggttcttagt

SEQ ID NO: 815395 - DNA, 25 bp, Mus musculus
tcccctttatcaccagcagttggtc

SEQ ID NO: 815396 - DNA, 25 bp, Mus musculus
tcccctttatcagcagcagttggtc

SEQ ID NO: 815397 - DNA, 25 bp, Mus musculus
tcccctttattcacagttcactgtt

SEQ ID NO: 815398 - DNA, 25 bp, Mus musculus
tcccctttattctcagttcactgtt

SEQ ID NO: 815399 - DNA, 25 bp, Mus musculus
tcccctttcctaaccaaactttgat

SEQ ID NO: 815400 - DNA, 25 bp, Mus musculus
tcccctttcctatccaaactttgat

SEQ ID NO: 815401 - DNA, 25 bp, Mus musculus
tcccctttcctgactaatgtatgag

SEQ ID NO: 815402 - DNA, 25 bp, Mus musculus
tcccctttcctgatacaaaaccgag

SEQ ID NO: 815403 - DNA, 25 bp, Mus musculus
tcccctttcctgtctaatgtatgag

SEQ ID NO: 815404 - DNA, 25 bp, Mus musculus
tcccctttcctgttacaaaaccgag

SEQ ID NO: 815405 - DNA, 25 bp, Mus musculus
tcccctttctacacttatgttctga

SEQ ID NO: 815406 - DNA, 25 bp, Mus musculus
tcccctttctactcttatgttctga

SEQ ID NO: 815407 - DNA, 25 bp, Mus musculus
tcccctttctgcacgaaggatgagg

SEQ ID NO: 815408 - DNA, 25 bp, Mus musculus
tcccctttctgctcgaaggatgagg

SEQ ID NO: 815409 - DNA, 25 bp, Mus musculus
tcccctttctggaatgctctgaaga

SEQ ID NO: 815410 - DNA, 25 bp, Mus musculus
tcccctttctggcacaagacagaaa

SEQ ID NO: 815411 - DNA, 25 bp, Mus musculus
tcccctttctgggacaagacagaaa

SEQ ID NO: 815412 - DNA, 25 bp, Mus musculus
tcccctttctggtatgctctgaaga

SEQ ID NO: 815413 - DNA, 25 bp, Mus musculus
tcccctttgcacagtaatgaggaaa

SEQ ID NO: 815414 - DNA, 25 bp, Mus musculus
tcccctttgcactgtaatgaggaaa

SEQ ID NO: 815415 - DNA, 25 bp, Mus musculus
tcccctttgtaaaaagacactgtag

SEQ ID NO: 815416 - DNA, 25 bp, Mus musculus
tcccctttgtaataagacactgtag

SEQ ID NO: 815417 - DNA, 25 bp, Mus musculus
tcccctttgtctataagcatgtttt

SEQ ID NO: 815418 - DNA, 25 bp, Mus musculus
tcccctttgtctttaagcatgtttt

SEQ ID NO: 815419 - DNA, 25 bp, Mus musculus
tccccttttcctcactcggtgtatg

SEQ ID NO: 815420 - DNA, 25 bp, Mus musculus
tccccttttcctgactcggtgtatg

SEQ ID NO: 815421 - DNA, 25 bp, Mus musculus
tccccttttctgaaatatgtgttca

SEQ ID NO: 815422 - DNA, 25 bp, Mus musculus
tccccttttctgtaatatgtgttca

SEQ ID NO: 815423 - DNA, 25 bp, Mus musculus
tccccttttgccatatgtttttcat

SEQ ID NO: 815424 - DNA, 25 bp, Mus musculus
tccccttttgccttatgtttttcat

SEQ ID NO: 815425 - DNA, 25 bp, Mus musculus
tccccttttggaaatctagatgttt

SEQ ID NO: 815426 - DNA, 25 bp, Mus musculus
tccccttttggacgccagcatgcat

SEQ ID NO: 815427 - DNA, 25 bp, Mus musculus
tccccttttggaggccagcatgcat

SEQ ID NO: 815428 - DNA, 25 bp, Mus musculus
tccccttttggatatctagatgttt

SEQ ID NO: 815429 - DNA, 25 bp, Mus musculus
tccccttttgtccaggaaatggaga

SEQ ID NO: 815430 - DNA, 25 bp, Mus musculus
tccccttttgtcgaggaaatggaga

SEQ ID NO: 815431 - DNA, 25 bp, Mus musculus
tcccgaaagtgaatgtctgacctcc

SEQ ID NO: 815432 - DNA, 25 bp, Mus musculus
tcccgaaagtgattgtctgacctcc

SEQ ID NO: 815433 - DNA, 25 bp, Mus musculus
tcccgaactctgaacgaaacaccta

SEQ ID NO: 815434 - DNA, 25 bp, Mus musculus
tcccgaactctgtacgaaacaccta

SEQ ID NO: 815435 - DNA, 25 bp, Mus musculus
tcccgaacttttcctatctctagat

SEQ ID NO: 815436 - DNA, 25 bp, Mus musculus
tcccgaacttttgctatctctagat

SEQ ID NO: 815437 - DNA, 25 bp, Mus musculus
tcccgaagaattcgcatgtgacagt

SEQ ID NO: 815438 - DNA, 25 bp, Mus musculus
tcccgaagaattggcatgtgacagt

SEQ ID NO: 815439 - DNA, 25 bp, Mus musculus
tcccgaaggatgctagactaatact

SEQ ID NO: 815440 - DNA, 25 bp, Mus musculus
tcccgaaggatggtagactaatact

SEQ ID NO: 815441 - DNA, 25 bp, Mus musculus
tcccgaatggcaagtggtggcctgc

SEQ ID NO: 815442 - DNA, 25 bp, Mus musculus
tcccgaatggcatgtggtggcctgc

SEQ ID NO: 815443 - DNA, 25 bp, Mus musculus
tcccgaatttcaccttcagctctgg

SEQ ID NO: 815444 - DNA, 25 bp, Mus musculus
tcccgaatttcagcttcagctctgg

SEQ ID NO: 815445 - DNA, 25 bp, Mus musculus
tcccgacagcctctgagtatgcttt

SEQ ID NO: 815446 - DNA, 25 bp, Mus musculus
tcccgacagcctgtgagtatgcttt

SEQ ID NO: 815447 - DNA, 25 bp, Mus musculus
tcccgacatgggactagaggacgaa

SEQ ID NO: 815448 - DNA, 25 bp, Mus musculus
tcccgacatgggtctagaggacgaa

SEQ ID NO: 815449 - DNA, 25 bp, Mus musculus
tcccgaccctgaatttgattgtccc

SEQ ID NO: 815450 - DNA, 25 bp, Mus musculus
tcccgaccctgattttgattgtccc

SEQ ID NO: 815451 - DNA, 25 bp, Mus musculus
tcccgactccctcttatgttaaggt

SEQ ID NO: 815452 - DNA, 25 bp, Mus musculus
tcccgactccctgttatgttaaggt

SEQ ID NO: 815453 - DNA, 25 bp, Mus musculus
tcccgactcgcaactggtattgtag

SEQ ID NO: 815454 - DNA, 25 bp, Mus musculus
tcccgactcgcatctggtattgtag

SEQ ID NO: 815455 - DNA, 25 bp, Mus musculus
tcccgactcggtattgatcttgtgt

SEQ ID NO: 815456 - DNA, 25 bp, Mus musculus
tcccgactcggttttgatcttgtgt

SEQ ID NO: 815457 - DNA, 25 bp, Mus musculus
tcccgactggtccacagactgaaaa

SEQ ID NO: 815458 - DNA, 25 bp, Mus musculus
tcccgactggtcgacagactgaaaa

SEQ ID NO: 815459 - DNA, 25 bp, Mus musculus
tcccgagaccatccacatgtattag

SEQ ID NO: 815460 - DNA, 25 bp, Mus musculus
tcccgagaccatgcacatgtattag

SEQ ID NO: 815461 - DNA, 25 bp, Mus musculus
tcccgagactacacagctgagagcg

SEQ ID NO: 815462 - DNA, 25 bp, Mus musculus
tcccgagactactcagctgagagcg

SEQ ID NO: 815463 - DNA, 25 bp, Mus musculus
tcccgagcagagaggttgaggcccc

SEQ ID NO: 815464 - DNA, 25 bp, Mus musculus
tcccgagcagagtggttgaggcccc

SEQ ID NO: 815465 - DNA, 25 bp, Mus musculus
tcccgagcatttctctaccttaccg

SEQ ID NO: 815466 - DNA, 25 bp, Mus musculus
tcccgagcatttgtctaccttaccg

SEQ ID NO: 815467 - DNA, 25 bp, Mus musculus
tcccgaggaagaacgccactttgaa

SEQ ID NO: 815468 - DNA, 25 bp, Mus musculus
tcccgaggaagatcgccactttgaa

SEQ ID NO: 815469 - DNA, 25 bp, Mus musculus
tcccgaggacgtcttcagtgttctt

SEQ ID NO: 815470 - DNA, 25 bp, Mus musculus
tcccgaggacgtgttcagtgttctt

SEQ ID NO: 815471 - DNA, 25 bp, Mus musculus
tcccgaggaggccaagaaactgttc

SEQ ID NO: 815472 - DNA, 25 bp, Mus musculus
tcccgaggaggcgaagaaactgttc

SEQ ID NO: 815473 - DNA, 25 bp, Mus musculus
tcccgaggccacctgactgttgcgt

SEQ ID NO: 815474 - DNA, 25 bp, Mus musculus
tcccgaggccacgtgactgttgcgt

SEQ ID NO: 815475 - DNA, 25 bp, Mus musculus
tcccgagggctgctttgaagctgtt

SEQ ID NO: 815476 - DNA, 25 bp, Mus musculus
tcccgagggctggtttgaagctgtt

SEQ ID NO: 815477 - DNA, 25 bp, Mus musculus
tcccgaggtggcctttatgccgaga

SEQ ID NO: 815478 - DNA, 25 bp, Mus musculus
tcccgaggtggcgtttatgccgaga

SEQ ID NO: 815479 - DNA, 25 bp, Mus musculus
tcccgagtccctagtgcatggaata

SEQ ID NO: 815480 - DNA, 25 bp, Mus musculus
tcccgagtcccttgtgcatggaata

SEQ ID NO: 815481 - DNA, 25 bp, Mus musculus
tcccgagtgtgcattttgcagattt

SEQ ID NO: 815482 - DNA, 25 bp, Mus musculus
tcccgagtgtgctttttgcagattt

SEQ ID NO: 815483 - DNA, 25 bp, Mus musculus
tcccgatatgtgatagacaccccat

SEQ ID NO: 815484 - DNA, 25 bp, Mus musculus
tcccgatatgtgttagacaccccat

SEQ ID NO: 815485 - DNA, 25 bp, Mus musculus
tcccgatcactgaaagagcctggta

SEQ ID NO: 815486 - DNA, 25 bp, Mus musculus
tcccgatcactgtaagagcctggta

SEQ ID NO: 815487 - DNA, 25 bp, Mus musculus
tcccgatcctgtactgactgtaatg

SEQ ID NO: 815488 - DNA, 25 bp, Mus musculus
tcccgatcctgttctgactgtaatg

SEQ ID NO: 815489 - DNA, 25 bp, Mus musculus
tcccgatcctttaagttggagtgga

SEQ ID NO: 815490 - DNA, 25 bp, Mus musculus
tcccgatccttttagttggagtgga

SEQ ID NO: 815491 - DNA, 25 bp, Mus musculus
tcccgatgataacaggcgcctttgt

SEQ ID NO: 815492 - DNA, 25 bp, Mus musculus
tcccgatgataagaggcgcctttgt

SEQ ID NO: 815493 - DNA, 25 bp, Mus musculus
tcccgatgattgactcttctcagca

SEQ ID NO: 815494 - DNA, 25 bp, Mus musculus
tcccgatgattgtctcttctcagca

SEQ ID NO: 815495 - DNA, 25 bp, Mus musculus
tcccgatggaacaattcatgactgg

SEQ ID NO: 815496 - DNA, 25 bp, Mus musculus
tcccgatggaactattcatgactgg

SEQ ID NO: 815497 - DNA, 25 bp, Mus musculus
tcccgatgtggaagggcttgcagcc

SEQ ID NO: 815498 - DNA, 25 bp, Mus musculus
tcccgatgtggatgggcttgcagcc

SEQ ID NO: 815499 - DNA, 25 bp, Mus musculus
tcccgattggtgaagatagtgtctt

SEQ ID NO: 815500 - DNA, 25 bp, Mus musculus
tcccgattggtgtagatagtgtctt

SEQ ID NO: 815501 - DNA, 25 bp, Mus musculus
tcccgcagacttcattcgactgatt

SEQ ID NO: 815502 - DNA, 25 bp, Mus musculus
tcccgcagacttgattcgactgatt

SEQ ID NO: 815503 - DNA, 25 bp, Mus musculus
tcccgcagcagtaccagtttttaaa

SEQ ID NO: 815504 - DNA, 25 bp, Mus musculus
tcccgcagcagttccagtttttaaa

SEQ ID NO: 815505 - DNA, 25 bp, Mus musculus
tcccgcaggactactcaaggtttaa

SEQ ID NO: 815506 - DNA, 25 bp, Mus musculus
tcccgcaggacttctcaaggtttaa

SEQ ID NO: 815507 - DNA, 25 bp, Mus musculus
tcccgcaggcagaacagccttggag

SEQ ID NO: 815508 - DNA, 25 bp, Mus musculus
tcccgcaggcagtacagccttggag

SEQ ID NO: 815509 - DNA, 25 bp, Mus musculus
tcccgcagggcactaaggagctagc

SEQ ID NO: 815510 - DNA, 25 bp, Mus musculus
tcccgcagggcagtaaggagctagc

SEQ ID NO: 815511 - DNA, 25 bp, Mus musculus
tcccgcagtgctatttacaccacag

SEQ ID NO: 815512 - DNA, 25 bp, Mus musculus
tcccgcagtgctttttacaccacag

SEQ ID NO: 815513 - DNA, 25 bp, Mus musculus
tcccgcatatttcaaccgtatagca

SEQ ID NO: 815514 - DNA, 25 bp, Mus musculus
tcccgcatatttgaaccgtatagca

SEQ ID NO: 815515 - DNA, 25 bp, Mus musculus
tcccgcattcccatagtaacaagag

SEQ ID NO: 815516 - DNA, 25 bp, Mus musculus
tcccgcattcccttagtaacaagag

SEQ ID NO: 815517 - DNA, 25 bp, Mus musculus
tcccgccaagaaagtgcactttcta

SEQ ID NO: 815518 - DNA, 25 bp, Mus musculus
tcccgccaagaatgtgcactttcta

SEQ ID NO: 815519 - DNA, 25 bp, Mus musculus
tcccgccaccttaatgtaggttcta

SEQ ID NO: 815520 - DNA, 25 bp, Mus musculus
tcccgccacctttatgtaggttcta

SEQ ID NO: 815521 - DNA, 25 bp, Mus musculus
tcccgccagattactgttggttcaa

SEQ ID NO: 815522 - DNA, 25 bp, Mus musculus
tcccgccagatttctgttggttcaa

SEQ ID NO: 815523 - DNA, 25 bp, Mus musculus
tcccgccatcaaaaggtacttaatt

SEQ ID NO: 815524 - DNA, 25 bp, Mus musculus
tcccgccatcaataggtacttaatt

SEQ ID NO: 815525 - DNA, 25 bp, Mus musculus
tcccgcccatagaaggttcctgaac

SEQ ID NO: 815526 - DNA, 25 bp, Mus musculus
tcccgcccatagtaggttcctgaac

SEQ ID NO: 815527 - DNA, 25 bp, Mus musculus
tcccgcctccaaaagtatactgcta

SEQ ID NO: 815528 - DNA, 25 bp, Mus musculus
tcccgcctccaatagtatactgcta

SEQ ID NO: 815529 - DNA, 25 bp, Mus musculus
tcccgcctctttaagagctttaggt

SEQ ID NO: 815530 - DNA, 25 bp, Mus musculus
tcccgcctcttttagagctttaggt

SEQ ID NO: 815531 - DNA, 25 bp, Mus musculus
tcccgcctttgtataggttttgcag

SEQ ID NO: 815532 - DNA, 25 bp, Mus musculus
tcccgcctttgtttaggttttgcag

SEQ ID NO: 815533 - DNA, 25 bp, Mus musculus
tcccgcgtagaaccgccagagttga

SEQ ID NO: 815534 - DNA, 25 bp, Mus musculus
tcccgcgtagaagcgccagagttga

SEQ ID NO: 815535 - DNA, 25 bp, Mus musculus
tcccgcgtgcttagactggaacgat

SEQ ID NO: 815536 - DNA, 25 bp, Mus musculus
tcccgcgtgctttgactggaacgat

SEQ ID NO: 815537 - DNA, 25 bp, Mus musculus
tcccgctcacgaagttctgttggta

SEQ ID NO: 815538 - DNA, 25 bp, Mus musculus
tcccgctcacgatgttctgttggta

SEQ ID NO: 815539 - DNA, 25 bp, Mus musculus
tcccgctcctggcatcagaatgaaa

SEQ ID NO: 815540 - DNA, 25 bp, Mus musculus
tcccgctcctgggatcagaatgaaa

SEQ ID NO: 815541 - DNA, 25 bp, Mus musculus
tcccgctcggcaaacagtattttga

SEQ ID NO: 815542 - DNA, 25 bp, Mus musculus
tcccgctcggcatacagtattttga

SEQ ID NO: 815543 - DNA, 25 bp, Mus musculus
tcccgctctgtacatactttactaa

SEQ ID NO: 815544 - DNA, 25 bp, Mus musculus
tcccgctctgtagatactttactaa

SEQ ID NO: 815545 - DNA, 25 bp, Mus musculus
tcccgctgcctgatggactgtggtg

SEQ ID NO: 815546 - DNA, 25 bp, Mus musculus
tcccgctgcctgttggactgtggtg

SEQ ID NO: 815547 - DNA, 25 bp, Mus musculus
tcccgctgtcatcccataagagtta

SEQ ID NO: 815548 - DNA, 25 bp, Mus musculus
tcccgctgtcatgccataagagtta

SEQ ID NO: 815549 - DNA, 25 bp, Mus musculus
tcccgctgtcctcgtggaagtcaca

SEQ ID NO: 815550 - DNA, 25 bp, Mus musculus
tcccgctgtcctggtggaagtcaca

SEQ ID NO: 815551 - DNA, 25 bp, Mus musculus
tcccgcttagagaacagaaaaaaca

SEQ ID NO: 815552 - DNA, 25 bp, Mus musculus
tcccgcttagagtacagaaaaaaca

SEQ ID NO: 815553 - DNA, 25 bp, Mus musculus
tcccgcttctctacttgtcaagata

SEQ ID NO: 815554 - DNA, 25 bp, Mus musculus
tcccgcttctcttcttgtcaagata

SEQ ID NO: 815555 - DNA, 25 bp, Mus musculus
tcccgctttaaccaacttgtttgag

SEQ ID NO: 815556 - DNA, 25 bp, Mus musculus
tcccgctttaacgaacttgtttgag

SEQ ID NO: 815557 - DNA, 25 bp, Mus musculus
tcccgctttccaagagtctgtcaac

SEQ ID NO: 815558 - DNA, 25 bp, Mus musculus
tcccgctttccatgagtctgtcaac

SEQ ID NO: 815559 - DNA, 25 bp, Mus musculus
tcccgctttcgcataagatttacag

SEQ ID NO: 815560 - DNA, 25 bp, Mus musculus
tcccgctttcgcttaagatttacag

SEQ ID NO: 815561 - DNA, 25 bp, Mus musculus
tcccgctttctgagcaggcacggta

SEQ ID NO: 815562 - DNA, 25 bp, Mus musculus
tcccgctttctgtgcaggcacggta

SEQ ID NO: 815563 - DNA, 25 bp, Mus musculus
tcccggaaactccatactggtgcag

SEQ ID NO: 815564 - DNA, 25 bp, Mus musculus
tcccggaaactcgatactggtgcag

SEQ ID NO: 815565 - DNA, 25 bp, Mus musculus
tcccggacaccgcagagtctggtag

SEQ ID NO: 815566 - DNA, 25 bp, Mus musculus
tcccggacaccggagagtctggtag

SEQ ID NO: 815567 - DNA, 25 bp, Mus musculus
tcccggactcttaggtggtgatgtg

SEQ ID NO: 815568 - DNA, 25 bp, Mus musculus
tcccggactctttggtggtgatgtg

SEQ ID NO: 815569 - DNA, 25 bp, Mus musculus
tcccggactggtcgatgtacccggt

SEQ ID NO: 815570 - DNA, 25 bp, Mus musculus
tcccggactggtggatgtacccggt

SEQ ID NO: 815571 - DNA, 25 bp, Mus musculus
tcccggagcccgagagttcgctgcg

SEQ ID NO: 815572 - DNA, 25 bp, Mus musculus
tcccggagcccgtgagttcgctgcg

SEQ ID NO: 815573 - DNA, 25 bp, Mus musculus
tcccggatcggacctcctaaaggta

SEQ ID NO: 815574 - DNA, 25 bp, Mus musculus
tcccggatcggagctcctaaaggta

SEQ ID NO: 815575 - DNA, 25 bp, Mus musculus
tcccggatgctccaggacacacata

SEQ ID NO: 815576 - DNA, 25 bp, Mus musculus
tcccggatgctcgaggacacacata

SEQ ID NO: 815577 - DNA, 25 bp, Mus musculus
tcccggattctgatcctcactggag

SEQ ID NO: 815578 - DNA, 25 bp, Mus musculus
tcccggattctgttcctcactggag

SEQ ID NO: 815579 - DNA, 25 bp, Mus musculus
tcccggatttgcacctgttaatgaa

SEQ ID NO: 815580 - DNA, 25 bp, Mus musculus
tcccggatttgctcctgttaatgaa

SEQ ID NO: 815581 - DNA, 25 bp, Mus musculus
tcccggcaagccaggactcaaacat

SEQ ID NO: 815582 - DNA, 25 bp, Mus musculus
tcccggcaagcctggactcaaacat

SEQ ID NO: 815583 - DNA, 25 bp, Mus musculus
tcccggcacaggctcaggacatgga

SEQ ID NO: 815584 - DNA, 25 bp, Mus musculus
tcccggcacagggtcaggacatgga

SEQ ID NO: 815585 - DNA, 25 bp, Mus musculus
tcccggcaggagatggcctatggca

SEQ ID NO: 815586 - DNA, 25 bp, Mus musculus
tcccggcaggagttggcctatggca

SEQ ID NO: 815587 - DNA, 25 bp, Mus musculus
tcccggccacggcagttgcggagag

SEQ ID NO: 815588 - DNA, 25 bp, Mus musculus
tcccggccacgggagttgcggagag

SEQ ID NO: 815589 - DNA, 25 bp, Mus musculus
tcccggccctgacttatctttaact

SEQ ID NO: 815590 - DNA, 25 bp, Mus musculus
tcccggccctgagttatctttaact

SEQ ID NO: 815591 - DNA, 25 bp, Mus musculus
tcccggcgctatcttgcagatcgaa

SEQ ID NO: 815592 - DNA, 25 bp, Mus musculus
tcccggcgctatgttgcagatcgaa

SEQ ID NO: 815593 - DNA, 25 bp, Mus musculus
tcccggctactgagtgaaggtgctg

SEQ ID NO: 815594 - DNA, 25 bp, Mus musculus
tcccggctactgtgtgaaggtgctg

SEQ ID NO: 815595 - DNA, 25 bp, Mus musculus
tcccggctcagtcgtaccaggatga

SEQ ID NO: 815596 - DNA, 25 bp, Mus musculus
tcccggctcagtggtaccaggatga

SEQ ID NO: 815597 - DNA, 25 bp, Mus musculus
tcccggctgtctagtttgtatgtta

SEQ ID NO: 815598 - DNA, 25 bp, Mus musculus
tcccggctgtcttgtttgtatgtta

SEQ ID NO: 815599 - DNA, 25 bp, Mus musculus
tcccgggacggcaactttctgaaca

SEQ ID NO: 815600 - DNA, 25 bp, Mus musculus
tcccgggacggctactttctgaaca

SEQ ID NO: 815601 - DNA, 25 bp, Mus musculus
tcccgggacgtgctaatgaggctct

SEQ ID NO: 815602 - DNA, 25 bp, Mus musculus
tcccgggacgtggtaatgaggctct

SEQ ID NO: 815603 - DNA, 25 bp, Mus musculus
tcccgggagcacaggtgttctcaga

SEQ ID NO: 815604 - DNA, 25 bp, Mus musculus
tcccgggagcactggtgttctcaga

SEQ ID NO: 815605 - DNA, 25 bp, Mus musculus
tcccgggagggcaaatttctctgga

SEQ ID NO: 815606 - DNA, 25 bp, Mus musculus
tcccgggagggctaatttctctgga

SEQ ID NO: 815607 - DNA, 25 bp, Mus musculus
tcccgggcaagcctgacaccaaaaa

SEQ ID NO: 815608 - DNA, 25 bp, Mus musculus
tcccgggcaagcgtgacaccaaaaa

SEQ ID NO: 815609 - DNA, 25 bp, Mus musculus
tcccgggcaataattccattcttcc

SEQ ID NO: 815610 - DNA, 25 bp, Mus musculus
tcccgggcaatatttccattcttcc

SEQ ID NO: 815611 - DNA, 25 bp, Mus musculus
tcccgggcagggaacgtcaatgctc

SEQ ID NO: 815612 - DNA, 25 bp, Mus musculus
tcccgggcagggtacgtcaatgctc

SEQ ID NO: 815613 - DNA, 25 bp, Mus musculus
tcccgggcatctacaactacatagg

SEQ ID NO: 815614 - DNA, 25 bp, Mus musculus
tcccgggcatcttcaactacatagg

SEQ ID NO: 815615 - DNA, 25 bp, Mus musculus
tcccgggcgaaaacggagacaattt

SEQ ID NO: 815616 - DNA, 25 bp, Mus musculus
tcccgggcgaaatcggagacaattt

SEQ ID NO: 815617 - DNA, 25 bp, Mus musculus
tcccgggcgatcaaagtggaaggtt

SEQ ID NO: 815618 - DNA, 25 bp, Mus musculus
tcccgggcgatctaagtggaaggtt

SEQ ID NO: 815619 - DNA, 25 bp, Mus musculus
tcccgggcgcagacaacaaatcaga

SEQ ID NO: 815620 - DNA, 25 bp, Mus musculus
tcccgggcgcagtcaacaaatcaga

SEQ ID NO: 815621 - DNA, 25 bp, Mus musculus
tcccgggctcctagggctttcagga

SEQ ID NO: 815622 - DNA, 25 bp, Mus musculus
tcccgggctccttgggctttcagga

SEQ ID NO: 815623 - DNA, 25 bp, Mus musculus
tcccgggctgtacaatggcaagtgt

SEQ ID NO: 815624 - DNA, 25 bp, Mus musculus
tcccgggctgtagaatggcaagtgt

SEQ ID NO: 815625 - DNA, 25 bp, Mus musculus
tcccgggtcagcacagttgtggcaa

SEQ ID NO: 815626 - DNA, 25 bp, Mus musculus
tcccgggtcagctcagttgtggcaa

SEQ ID NO: 815627 - DNA, 25 bp, Mus musculus
tcccgggtccagatgccaaagtgca

SEQ ID NO: 815628 - DNA, 25 bp, Mus musculus
tcccgggtccagttgccaaagtgca

SEQ ID NO: 815629 - DNA, 25 bp, Mus musculus
tcccgggtgctacgctccaggtaga

SEQ ID NO: 815630 - DNA, 25 bp, Mus musculus
tcccgggtgctaggctccaggtaga

SEQ ID NO: 815631 - DNA, 25 bp, Mus musculus
tcccgggttgagatgttgactatag

SEQ ID NO: 815632 - DNA, 25 bp, Mus musculus
tcccgggttgagttgttgactatag

SEQ ID NO: 815633 - DNA, 25 bp, Mus musculus
tcccgggtttgacatcatccatggc

SEQ ID NO: 815634 - DNA, 25 bp, Mus musculus
tcccgggtttgagatcatccatggc

SEQ ID NO: 815635 - DNA, 25 bp, Mus musculus
tcccggtaactgatacacttcctgg

SEQ ID NO: 815636 - DNA, 25 bp, Mus musculus
tcccggtaactgttacacttcctgg

SEQ ID NO: 815637 - DNA, 25 bp, Mus musculus
tcccggtagcatactgagactttga

SEQ ID NO: 815638 - DNA, 25 bp, Mus musculus
tcccggtagcattctgagactttga

SEQ ID NO: 815639 - DNA, 25 bp, Mus musculus
tcccggtaggccatgggcggctcct

SEQ ID NO: 815640 - DNA, 25 bp, Mus musculus
tcccggtaggccttgggcggctcct

SEQ ID NO: 815641 - DNA, 25 bp, Mus musculus
tcccggtcgatgactcgttgattaa

SEQ ID NO: 815642 - DNA, 25 bp, Mus musculus
tcccggtcgatgtctcgttgattaa

SEQ ID NO: 815643 - DNA, 25 bp, Mus musculus
tcccggtctctgcaagagcgatcta

SEQ ID NO: 815644 - DNA, 25 bp, Mus musculus
tcccggtctctggaagagcgatcta

SEQ ID NO: 815645 - DNA, 25 bp, Mus musculus
tcccggtgatctcccaggtggagca

SEQ ID NO: 815646 - DNA, 25 bp, Mus musculus
tcccggtgatctgccaggtggagca

SEQ ID NO: 815647 - DNA, 25 bp, Mus musculus
tcccggtgctgaccttgtatcacag

SEQ ID NO: 815648 - DNA, 25 bp, Mus musculus
tcccggtgctgagcttgtatcacag

SEQ ID NO: 815649 - DNA, 25 bp, Mus musculus
tcccggtggagaccgtccctggcat

SEQ ID NO: 815650 - DNA, 25 bp, Mus musculus
tcccggtggagagcgtccctggcat

SEQ ID NO: 815651 - DNA, 25 bp, Mus musculus
tcccggtgtacacccaatgacctta

SEQ ID NO: 815652 - DNA, 25 bp, Mus musculus
tcccggtgtacagccaatgacctta

SEQ ID NO: 815653 - DNA, 25 bp, Mus musculus
tcccggtgtctgatcttacaagcaa

SEQ ID NO: 815654 - DNA, 25 bp, Mus musculus
tcccggtgtctgttcttacaagcaa

SEQ ID NO: 815655 - DNA, 25 bp, Mus musculus
tcccggtgttaacgttgccaaccag

SEQ ID NO: 815656 - DNA, 25 bp, Mus musculus
tcccggtgttaaggttgccaaccag

SEQ ID NO: 815657 - DNA, 25 bp, Mus musculus
tcccggttccacagaacacttagtg

SEQ ID NO: 815658 - DNA, 25 bp, Mus musculus
tcccggttccactgaacacttagtg

SEQ ID NO: 815659 - DNA, 25 bp, Mus musculus
tcccggttttttctaagtgtcagcg

SEQ ID NO: 815660 - DNA, 25 bp, Mus musculus
tcccggttttttgtaagtgtcagcg

SEQ ID NO: 815661 - DNA, 25 bp, Mus musculus
tcccgtagatccctgatgtctttaa

SEQ ID NO: 815662 - DNA, 25 bp, Mus musculus
tcccgtagatccgtgatgtctttaa

SEQ ID NO: 815663 - DNA, 25 bp, Mus musculus
tcccgtagtttgagagacctgggtt

SEQ ID NO: 815664 - DNA, 25 bp, Mus musculus
tcccgtagtttgtgagacctgggtt

SEQ ID NO: 815665 - DNA, 25 bp, Mus musculus
tcccgtcacagtaattcatggctag

SEQ ID NO: 815666 - DNA, 25 bp, Mus musculus
tcccgtcacagttattcatggctag

SEQ ID NO: 815667 - DNA, 25 bp, Mus musculus
tcccgtcagtcactggtggccatga

SEQ ID NO: 815668 - DNA, 25 bp, Mus musculus
tcccgtcagtcagtggtggccatga

SEQ ID NO: 815669 - DNA, 25 bp, Mus musculus
tcccgtcatatacattgtgcttact

SEQ ID NO: 815670 - DNA, 25 bp, Mus musculus
tcccgtcatatagattgtgcttact

SEQ ID NO: 815671 - DNA, 25 bp, Mus musculus
tcccgtccaatgatggctgcttata

SEQ ID NO: 815672 - DNA, 25 bp, Mus musculus
tcccgtccaatgttggctgcttata

SEQ ID NO: 815673 - DNA, 25 bp, Mus musculus
tcccgtcccaacatggactgcaaat

SEQ ID NO: 815674 - DNA, 25 bp, Mus musculus
tcccgtcccaacttggactgcaaat

SEQ ID NO: 815675 - DNA, 25 bp, Mus musculus
tcccgtccttccatgaagaaaactg

SEQ ID NO: 815676 - DNA, 25 bp, Mus musculus
tcccgtccttccttgaagaaaactg

SEQ ID NO: 815677 - DNA, 25 bp, Mus musculus
tcccgtccttgtatgctgaggtaca

SEQ ID NO: 815678 - DNA, 25 bp, Mus musculus
tcccgtccttgtttgctgaggtaca

SEQ ID NO: 815679 - DNA, 25 bp, Mus musculus
tcccgtcgtgcacacagtttagcag

SEQ ID NO: 815680 - DNA, 25 bp, Mus musculus
tcccgtcgtgcagacagtttagcag

SEQ ID NO: 815681 - DNA, 25 bp, Mus musculus
tcccgtctcaagatggccattcgag

SEQ ID NO: 815682 - DNA, 25 bp, Mus musculus
tcccgtctcaagttggccattcgag

SEQ ID NO: 815683 - DNA, 25 bp, Mus musculus
tcccgtctgtctatgacaaactcag

SEQ ID NO: 815684 - DNA, 25 bp, Mus musculus
tcccgtctgtctttgacaaactcag

SEQ ID NO: 815685 - DNA, 25 bp, Mus musculus
tcccgtgacctcagcaaatggacag

SEQ ID NO: 815686 - DNA, 25 bp, Mus musculus
tcccgtgacctcagggtttggcccg

SEQ ID NO: 815687 - DNA, 25 bp, Mus musculus
tcccgtgacctctgcaaatggacag

SEQ ID NO: 815688 - DNA, 25 bp, Mus musculus
tcccgtgacctctgggtttggcccg

SEQ ID NO: 815689 - DNA, 25 bp, Mus musculus
tcccgtgctagcaaagatggttcct

SEQ ID NO: 815690 - DNA, 25 bp, Mus musculus
tcccgtgctagctaagatggttcct

SEQ ID NO: 815691 - DNA, 25 bp, Mus musculus
tcccgtgctgttaacatgtttctgt

SEQ ID NO: 815692 - DNA, 25 bp, Mus musculus
tcccgtgctgtttacatgtttctgt

SEQ ID NO: 815693 - DNA, 25 bp, Mus musculus
tcccgtggacagagagcagttgcgc

SEQ ID NO: 815694 - DNA, 25 bp, Mus musculus
tcccgtggacagtgagcagttgcgc

SEQ ID NO: 815695 - DNA, 25 bp, Mus musculus
tcccgtggagatagctgagatgcca

SEQ ID NO: 815696 - DNA, 25 bp, Mus musculus
tcccgtggagattgctgagatgcca

SEQ ID NO: 815697 - DNA, 25 bp, Mus musculus
tcccgtggagctaagcagtatgtct

SEQ ID NO: 815698 - DNA, 25 bp, Mus musculus
tcccgtggagcttagcagtatgtct

SEQ ID NO: 815699 - DNA, 25 bp, Mus musculus
tcccgtggaggaactttttaagctg

SEQ ID NO: 815700 - DNA, 25 bp, Mus musculus
tcccgtggaggatctttttaagctg

SEQ ID NO: 815701 - DNA, 25 bp, Mus musculus
tcccgtggattgcaactttgcacag

SEQ ID NO: 815702 - DNA, 25 bp, Mus musculus
tcccgtggattggaactttgcacag

SEQ ID NO: 815703 - DNA, 25 bp, Mus musculus
tcccgtggccagagttttgtgtgtt

SEQ ID NO: 815704 - DNA, 25 bp, Mus musculus
tcccgtggccagtgttttgtgtgtt

SEQ ID NO: 815705 - DNA, 25 bp, Mus musculus
tcccgtggccgacgctggaagtcca

SEQ ID NO: 815706 - DNA, 25 bp, Mus musculus
tcccgtggccgaggctggaagtcca

SEQ ID NO: 815707 - DNA, 25 bp, Mus musculus
tcccgtggctcacttttgttttatt

SEQ ID NO: 815708 - DNA, 25 bp, Mus musculus
tcccgtggctcagttttgttttatt

SEQ ID NO: 815709 - DNA, 25 bp, Mus musculus
tcccgtgggacgagaactaaatact

SEQ ID NO: 815710 - DNA, 25 bp, Mus musculus
tcccgtgggacgtgaactaaatact

SEQ ID NO: 815711 - DNA, 25 bp, Mus musculus
tcccgtggtgcgacaccgtgcaaaa

SEQ ID NO: 815712 - DNA, 25 bp, Mus musculus
tcccgtggtgcgtcaccgtgcaaaa

SEQ ID NO: 815713 - DNA, 25 bp, Mus musculus
tcccgtggtgttcctagatcaaggc

SEQ ID NO: 815714 - DNA, 25 bp, Mus musculus
tcccgtggtgttgctagatcaaggc

SEQ ID NO: 815715 - DNA, 25 bp, Mus musculus
tcccgtgtacttacttgctgaaggt

SEQ ID NO: 815716 - DNA, 25 bp, Mus musculus
tcccgtgtactttcttgctgaaggt

SEQ ID NO: 815717 - DNA, 25 bp, Mus musculus
tcccgtgtcactcaggtggtggtga

SEQ ID NO: 815718 - DNA, 25 bp, Mus musculus
tcccgtgtcactgaggtggtggtga

SEQ ID NO: 815719 - DNA, 25 bp, Mus musculus
tcccgtgtctgtctttgtcagtctg

SEQ ID NO: 815720 - DNA, 25 bp, Mus musculus
tcccgtgtctgtgtttgtcagtctg

SEQ ID NO: 815721 - DNA, 25 bp, Mus musculus
tcccgtgtcttacttcctacacaaa

SEQ ID NO: 815722 - DNA, 25 bp, Mus musculus
tcccgtgtcttagttcctacacaaa

SEQ ID NO: 815723 - DNA, 25 bp, Mus musculus
tcccgtgtgtctccttcggcaaaag

SEQ ID NO: 815724 - DNA, 25 bp, Mus musculus
tcccgtgtgtctgcttcggcaaaag

SEQ ID NO: 815725 - DNA, 25 bp, Mus musculus
tcccgtgttcacatgtggaagccga

SEQ ID NO: 815726 - DNA, 25 bp, Mus musculus
tcccgtgttcacttgtggaagccga

SEQ ID NO: 815727 - DNA, 25 bp, Mus musculus
tcccgtgttctaatgctcttctaag

SEQ ID NO: 815728 - DNA, 25 bp, Mus musculus
tcccgtgttctattgctcttctaag

SEQ ID NO: 815729 - DNA, 25 bp, Mus musculus
tcccgtgtttgaattataaggccag

SEQ ID NO: 815730 - DNA, 25 bp, Mus musculus
tcccgtgtttgatttataaggccag

SEQ ID NO: 815731 - DNA, 25 bp, Mus musculus
tcccgttaagatcaaggctagcctg

SEQ ID NO: 815732 - DNA, 25 bp, Mus musculus
tcccgttaagatgaaggctagcctg

SEQ ID NO: 815733 - DNA, 25 bp, Mus musculus
tcccgttcggacactttaggcaaca

SEQ ID NO: 815734 - DNA, 25 bp, Mus musculus
tcccgttcggactctttaggcaaca

SEQ ID NO: 815735 - DNA, 25 bp, Mus musculus
tcccgttggcagcactggtttcaaa

SEQ ID NO: 815736 - DNA, 25 bp, Mus musculus
tcccgttggcaggactggtttcaaa

SEQ ID NO: 815737 - DNA, 25 bp, Mus musculus
tcccgttgtatgacccagactacaa

SEQ ID NO: 815738 - DNA, 25 bp, Mus musculus
tcccgttgtatgtcccagactacaa

SEQ ID NO: 815739 - DNA, 25 bp, Mus musculus
tcccgttgttatcagggtggtttca

SEQ ID NO: 815740 - DNA, 25 bp, Mus musculus
tcccgttgttatgagggtggtttca

SEQ ID NO: 815741 - DNA, 25 bp, Mus musculus
tcccgtttacctcctggaagctgaa

SEQ ID NO: 815742 - DNA, 25 bp, Mus musculus
tcccgtttacctgctggaagctgaa

SEQ ID NO: 815743 - DNA, 25 bp, Mus musculus
tcccgtttagagactgcagcacgtg

SEQ ID NO: 815744 - DNA, 25 bp, Mus musculus
tcccgtttagagtctgcagcacgtg

SEQ ID NO: 815745 - DNA, 25 bp, Mus musculus
tcccgtttccatatggtctcttata

SEQ ID NO: 815746 - DNA, 25 bp, Mus musculus
tcccgtttccatttggtctcttata

SEQ ID NO: 815747 - DNA, 25 bp, Mus musculus
tcccgtttgaataaactttgcaaag

SEQ ID NO: 815748 - DNA, 25 bp, Mus musculus
tcccgtttgaattaactttgcaaag

SEQ ID NO: 815749 - DNA, 25 bp, Mus musculus
tcccgtttgcacatctggtcattga

SEQ ID NO: 815750 - DNA, 25 bp, Mus musculus
tcccgtttgcacttctggtcattga

SEQ ID NO: 815751 - DNA, 25 bp, Mus musculus
tccctaaaccccagtaatcacaagt

SEQ ID NO: 815752 - DNA, 25 bp, Mus musculus
tccctaaacccctgtaatcacaagt

SEQ ID NO: 815753 - DNA, 25 bp, Mus musculus
tccctaaacctgagcataatgtaaa

SEQ ID NO: 815754 - DNA, 25 bp, Mus musculus
tccctaaacctgtgcataatgtaaa

SEQ ID NO: 815755 - DNA, 25 bp, Mus musculus
tccctaaactccatgtaaccttctg

SEQ ID NO: 815756 - DNA, 25 bp, Mus musculus
tccctaaactccttgtaaccttctg

SEQ ID NO: 815757 - DNA, 25 bp, Mus musculus
tccctaaagattccatcagattctg

SEQ ID NO: 815758 - DNA, 25 bp, Mus musculus
tccctaaagattgcatcagattctg

SEQ ID NO: 815759 - DNA, 25 bp, Mus musculus
tccctaaagcatctgtgccgattaa

SEQ ID NO: 815760 - DNA, 25 bp, Mus musculus
tccctaaagcatgtgtgccgattaa

SEQ ID NO: 815761 - DNA, 25 bp, Mus musculus
tccctaaatcacaccgtatcgtacg

SEQ ID NO: 815762 - DNA, 25 bp, Mus musculus
tccctaaatcactccgtatcgtacg

SEQ ID NO: 815763 - DNA, 25 bp, Mus musculus
tccctaacacctaatctaacaaaat

SEQ ID NO: 815764 - DNA, 25 bp, Mus musculus
tccctaacaccttatctaacaaaat

SEQ ID NO: 815765 - DNA, 25 bp, Mus musculus
tccctaacagccctaaaggtcatct

SEQ ID NO: 815766 - DNA, 25 bp, Mus musculus
tccctaacagccgtaaaggtcatct

SEQ ID NO: 815767 - DNA, 25 bp, Mus musculus
tccctaaccagaaccagacgcgtaa

SEQ ID NO: 815768 - DNA, 25 bp, Mus musculus
tccctaaccagatccagacgcgtaa

SEQ ID NO: 815769 - DNA, 25 bp, Mus musculus
tccctaaccagtagtcatagcctaa

SEQ ID NO: 815770 - DNA, 25 bp, Mus musculus
tccctaaccagttgtcatagcctaa

SEQ ID NO: 815771 - DNA, 25 bp, Mus musculus
tccctaaccatccattgtgcagact

SEQ ID NO: 815772 - DNA, 25 bp, Mus musculus
tccctaaccatcgattgtgcagact

SEQ ID NO: 815773 - DNA, 25 bp, Mus musculus
tccctaaccctcagttgtagtattt

SEQ ID NO: 815774 - DNA, 25 bp, Mus musculus
tccctaaccctctgttgtagtattt

SEQ ID NO: 815775 - DNA, 25 bp, Mus musculus
tccctaacctcactccatgtgttgt

SEQ ID NO: 815776 - DNA, 25 bp, Mus musculus
tccctaacctcagtccatgtgttgt

SEQ ID NO: 815777 - DNA, 25 bp, Mus musculus
tccctaacctgaacctcggcattta

SEQ ID NO: 815778 - DNA, 25 bp, Mus musculus
tccctaacctgatcctcggcattta

SEQ ID NO: 815779 - DNA, 25 bp, Mus musculus
tccctaagcaacctgtcatcgtgaa

SEQ ID NO: 815780 - DNA, 25 bp, Mus musculus
tccctaagcaacgtgtcatcgtgaa

SEQ ID NO: 815781 - DNA, 25 bp, Mus musculus
tccctaagcctgagtacaccctgaa

SEQ ID NO: 815782 - DNA, 25 bp, Mus musculus
tccctaagcctgtgtacaccctgaa

SEQ ID NO: 815783 - DNA, 25 bp, Mus musculus
tccctaaggttgaacagactcctgt

SEQ ID NO: 815784 - DNA, 25 bp, Mus musculus
tccctaaggttgtacagactcctgt

SEQ ID NO: 815785 - DNA, 25 bp, Mus musculus
tccctaagtatcactttgaagtcta

SEQ ID NO: 815786 - DNA, 25 bp, Mus musculus
tccctaagtatctctttgaagtcta

SEQ ID NO: 815787 - DNA, 25 bp, Mus musculus
tccctaagtcctcggatcacaggca

SEQ ID NO: 815788 - DNA, 25 bp, Mus musculus
tccctaagtcctgggatcacaggca

SEQ ID NO: 815789 - DNA, 25 bp, Mus musculus
tccctaatacttcacaggactcctg

SEQ ID NO: 815790 - DNA, 25 bp, Mus musculus
tccctaatacttgacaggactcctg

SEQ ID NO: 815791 - DNA, 25 bp, Mus musculus
tccctaatccaaacaaacggtaact

SEQ ID NO: 815792 - DNA, 25 bp, Mus musculus
tccctaatccaatcaaacggtaact

SEQ ID NO: 815793 - DNA, 25 bp, Mus musculus
tccctaatccttagtacaggatgga

SEQ ID NO: 815794 - DNA, 25 bp, Mus musculus
tccctaatcctttgtacaggatgga

SEQ ID NO: 815795 - DNA, 25 bp, Mus musculus
tccctaatgcagaatcccatgctat

SEQ ID NO: 815796 - DNA, 25 bp, Mus musculus
tccctaatgcagtatcccatgctat

SEQ ID NO: 815797 - DNA, 25 bp, Mus musculus
tccctaatggctaactttagaaagg

SEQ ID NO: 815798 - DNA, 25 bp, Mus musculus
tccctaatggcttactttagaaagg

SEQ ID NO: 815799 - DNA, 25 bp, Mus musculus
tccctaattttaccttcgagatgca

SEQ ID NO: 815800 - DNA, 25 bp, Mus musculus
tccctaattttagcttcgagatgca

SEQ ID NO: 815801 - DNA, 25 bp, Mus musculus
tccctacacactctcaaatcataaa

SEQ ID NO: 815802 - DNA, 25 bp, Mus musculus
tccctacacactgtcaaatcataaa

SEQ ID NO: 815803 - DNA, 25 bp, Mus musculus
tccctacacgcgaccaggcagagat

SEQ ID NO: 815804 - DNA, 25 bp, Mus musculus
tccctacacgcgtccaggcagagat

SEQ ID NO: 815805 - DNA, 25 bp, Mus musculus
tccctacactatctctgttgatgct

SEQ ID NO: 815806 - DNA, 25 bp, Mus musculus
tccctacactatgtctgttgatgct

SEQ ID NO: 815807 - DNA, 25 bp, Mus musculus
tccctacagtttacctagtgctgag

SEQ ID NO: 815808 - DNA, 25 bp, Mus musculus
tccctacagttttcctagtgctgag

SEQ ID NO: 815809 - DNA, 25 bp, Mus musculus
tccctacatggaacattttgagttt

SEQ ID NO: 815810 - DNA, 25 bp, Mus musculus
tccctacatggatcattttgagttt

SEQ ID NO: 815811 - DNA, 25 bp, Mus musculus
tccctaccacctagttccaaatgga

SEQ ID NO: 815812 - DNA, 25 bp, Mus musculus
tccctaccaccttgttccaaatgga

SEQ ID NO: 815813 - DNA, 25 bp, Mus musculus
tccctaccactcataaagatctatt

SEQ ID NO: 815814 - DNA, 25 bp, Mus musculus
tccctaccactcttaaagatctatt

SEQ ID NO: 815815 - DNA, 25 bp, Mus musculus
tccctaccagtcataatgtatcctc

SEQ ID NO: 815816 - DNA, 25 bp, Mus musculus
tccctaccagtcttaatgtatcctc

SEQ ID NO: 815817 - DNA, 25 bp, Mus musculus
tccctaccatgtattttatgtgaat

SEQ ID NO: 815818 - DNA, 25 bp, Mus musculus
tccctaccatgttttttatgtgaat

SEQ ID NO: 815819 - DNA, 25 bp, Mus musculus
tccctaccgcccatgaaagagaaga

SEQ ID NO: 815820 - DNA, 25 bp, Mus musculus
tccctaccgcccttgaaagagaaga

SEQ ID NO: 815821 - DNA, 25 bp, Mus musculus
tccctacctatgaggccgaggagat

SEQ ID NO: 815822 - DNA, 25 bp, Mus musculus
tccctacctatgtggccgaggagat

SEQ ID NO: 815823 - DNA, 25 bp, Mus musculus
tccctacctcctaccatataaatta

SEQ ID NO: 815824 - DNA, 25 bp, Mus musculus
tccctacctccttccatataaatta

SEQ ID NO: 815825 - DNA, 25 bp, Mus musculus
tccctaccttttcaacattacgaag

SEQ ID NO: 815826 - DNA, 25 bp, Mus musculus
tccctaccttttgaacattacgaag

SEQ ID NO: 815827 - DNA, 25 bp, Mus musculus
tccctacgctttaccctgtggctgg

SEQ ID NO: 815828 - DNA, 25 bp, Mus musculus
tccctacgcttttccctgtggctgg

SEQ ID NO: 815829 - DNA, 25 bp, Mus musculus
tccctactaataattgcgatcatgg

SEQ ID NO: 815830 - DNA, 25 bp, Mus musculus
tccctactaatatttgcgatcatgg

SEQ ID NO: 815831 - DNA, 25 bp, Mus musculus
tccctactcactcacagagtgcttg

SEQ ID NO: 815832 - DNA, 25 bp, Mus musculus
tccctactcactgacagagtgcttg

SEQ ID NO: 815833 - DNA, 25 bp, Mus musculus
tccctactccagaatgggttacttg

SEQ ID NO: 815834 - DNA, 25 bp, Mus musculus
tccctactccagtatgggttacttg

SEQ ID NO: 815835 - DNA, 25 bp, Mus musculus
tccctactctctaattatccttgtt

SEQ ID NO: 815836 - DNA, 25 bp, Mus musculus
tccctactctcttattatccttgtt

SEQ ID NO: 815837 - DNA, 25 bp, Mus musculus
tccctactctggctcgcggagctga

SEQ ID NO: 815838 - DNA, 25 bp, Mus musculus
tccctactctgggtcgcggagctga

SEQ ID NO: 815839 - DNA, 25 bp, Mus musculus
tccctactgagacgactggactgta

SEQ ID NO: 815840 - DNA, 25 bp, Mus musculus
tccctactgagaggactggactgta

SEQ ID NO: 815841 - DNA, 25 bp, Mus musculus
tccctacttacaatccttagtcgga

SEQ ID NO: 815842 - DNA, 25 bp, Mus musculus
tccctacttacattccttagtcgga

SEQ ID NO: 815843 - DNA, 25 bp, Mus musculus
tccctagacagaacatgctccacgt

SEQ ID NO: 815844 - DNA, 25 bp, Mus musculus
tccctagacagatcatgctccacgt

SEQ ID NO: 815845 - DNA, 25 bp, Mus musculus
tccctagacagtaattataagatgg

SEQ ID NO: 815846 - DNA, 25 bp, Mus musculus
tccctagacagttattataagatgg

SEQ ID NO: 815847 - DNA, 25 bp, Mus musculus
tccctagaccctcacaacttttata

SEQ ID NO: 815848 - DNA, 25 bp, Mus musculus
tccctagaccctgacaacttttata

SEQ ID NO: 815849 - DNA, 25 bp, Mus musculus
tccctagagagcaggtatcttgcaa

SEQ ID NO: 815850 - DNA, 25 bp, Mus musculus
tccctagagagctggtatcttgcaa

SEQ ID NO: 815851 - DNA, 25 bp, Mus musculus
tccctagagattcgttttataaagt

SEQ ID NO: 815852 - DNA, 25 bp, Mus musculus
tccctagagattggttttataaagt

SEQ ID NO: 815853 - DNA, 25 bp, Mus musculus
tccctagcaagtcggtggctattcc

SEQ ID NO: 815854 - DNA, 25 bp, Mus musculus
tccctagcaagtgggtggctattcc

SEQ ID NO: 815855 - DNA, 25 bp, Mus musculus
tccctagcacagagattgaactatc

SEQ ID NO: 815856 - DNA, 25 bp, Mus musculus
tccctagcacagtgattgaactatc

SEQ ID NO: 815857 - DNA, 25 bp, Mus musculus
tccctagcaccactattggacaact

SEQ ID NO: 815858 - DNA, 25 bp, Mus musculus
tccctagcaccagtattggacaact

SEQ ID NO: 815859 - DNA, 25 bp, Mus musculus
tccctagcctagaggacagccagat

SEQ ID NO: 815860 - DNA, 25 bp, Mus musculus
tccctagcctagtggacagccagat

SEQ ID NO: 815861 - DNA, 25 bp, Mus musculus
tccctagctctgacactgaatacaa

SEQ ID NO: 815862 - DNA, 25 bp, Mus musculus
tccctagctctgtcactgaatacaa

SEQ ID NO: 815863 - DNA, 25 bp, Mus musculus
tccctaggaaatcaaccactatttt

SEQ ID NO: 815864 - DNA, 25 bp, Mus musculus
tccctaggaaatgaaccactatttt

SEQ ID NO: 815865 - DNA, 25 bp, Mus musculus
tccctaggagtgaggtccggttcta

SEQ ID NO: 815866 - DNA, 25 bp, Mus musculus
tccctaggagtgtggtccggttcta

SEQ ID NO: 815867 - DNA, 25 bp, Mus musculus
tccctagggcctagtttatcagaaa

SEQ ID NO: 815868 - DNA, 25 bp, Mus musculus
tccctagggccttgtttatcagaaa

SEQ ID NO: 815869 - DNA, 25 bp, Mus musculus
tccctagggcggcaagctgtgtaca

SEQ ID NO: 815870 - DNA, 25 bp, Mus musculus
tccctagggcgggaagctgtgtaca

SEQ ID NO: 815871 - DNA, 25 bp, Mus musculus
tccctagggcttcctaggccatcta

SEQ ID NO: 815872 - DNA, 25 bp, Mus musculus
tccctagggcttgctaggccatcta

SEQ ID NO: 815873 - DNA, 25 bp, Mus musculus
tccctagggggcaggaaacctcact

SEQ ID NO: 815874 - DNA, 25 bp, Mus musculus
tccctagggggctggaaacctcact

SEQ ID NO: 815875 - DNA, 25 bp, Mus musculus
tccctagggtgcatgagatttgtgg

SEQ ID NO: 815876 - DNA, 25 bp, Mus musculus
tccctagggtgcttgagatttgtgg

SEQ ID NO: 815877 - DNA, 25 bp, Mus musculus
tccctaggtaggcttggtcatttgt

SEQ ID NO: 815878 - DNA, 25 bp, Mus musculus
tccctaggtagggttggtcatttgt

SEQ ID NO: 815879 - DNA, 25 bp, Mus musculus
tccctagtcaggctttcaggaccca

SEQ ID NO: 815880 - DNA, 25 bp, Mus musculus
tccctagtcagggtttcaggaccca

SEQ ID NO: 815881 - DNA, 25 bp, Mus musculus
tccctagtcctaaaccatttatttc

SEQ ID NO: 815882 - DNA, 25 bp, Mus musculus
tccctagtcctataccatttatttc

SEQ ID NO: 815883 - DNA, 25 bp, Mus musculus
tccctagtgaggagccggaggccat

SEQ ID NO: 815884 - DNA, 25 bp, Mus musculus
tccctagtgaggtgccggaggccat

SEQ ID NO: 815885 - DNA, 25 bp, Mus musculus
tccctagtgcatcgtatgattatgt

SEQ ID NO: 815886 - DNA, 25 bp, Mus musculus
tccctagtgcatggtatgattatgt

SEQ ID NO: 815887 - DNA, 25 bp, Mus musculus
tccctatactgcctttgagacctgt

SEQ ID NO: 815888 - DNA, 25 bp, Mus musculus
tccctatactgcgtttgagacctgt

SEQ ID NO: 815889 - DNA, 25 bp, Mus musculus
tccctatagtctcttcctctgattc

SEQ ID NO: 815890 - DNA, 25 bp, Mus musculus
tccctatagtctgttcctctgattc

SEQ ID NO: 815891 - DNA, 25 bp, Mus musculus
tccctatatcccattgactagatat

SEQ ID NO: 815892 - DNA, 25 bp, Mus musculus
tccctatatccctttgactagatat

SEQ ID NO: 815893 - DNA, 25 bp, Mus musculus
tccctatatggaaaagttgtgcaat

SEQ ID NO: 815894 - DNA, 25 bp, Mus musculus
tccctatatggataagttgtgcaat

SEQ ID NO: 815895 - DNA, 25 bp, Mus musculus
tccctatctctgcttctattgcaga

SEQ ID NO: 815896 - DNA, 25 bp, Mus musculus
tccctatctctggttctattgcaga

SEQ ID NO: 815897 - DNA, 25 bp, Mus musculus
tccctatctgaaagtccttttgacg

SEQ ID NO: 815898 - DNA, 25 bp, Mus musculus
tccctatctgaatgtccttttgacg

SEQ ID NO: 815899 - DNA, 25 bp, Mus musculus
tccctatcttctatctgacaacaaa

SEQ ID NO: 815900 - DNA, 25 bp, Mus musculus
tccctatcttctttctgacaacaaa

SEQ ID NO: 815901 - DNA, 25 bp, Mus musculus
tccctatcttgcctcctgatttttt

SEQ ID NO: 815902 - DNA, 25 bp, Mus musculus
tccctatcttgcgtcctgatttttt

SEQ ID NO: 815903 - DNA, 25 bp, Mus musculus
tccctatggaacaatggagcttata

SEQ ID NO: 815904 - DNA, 25 bp, Mus musculus
tccctatggaactatggagcttata

SEQ ID NO: 815905 - DNA, 25 bp, Mus musculus
tccctatggactaggtaaccttttg

SEQ ID NO: 815906 - DNA, 25 bp, Mus musculus
tccctatggacttggtaaccttttg

SEQ ID NO: 815907 - DNA, 25 bp, Mus musculus
tccctatgttctactagcacagtgt

SEQ ID NO: 815908 - DNA, 25 bp, Mus musculus
tccctatgttcttctagcacagtgt

SEQ ID NO: 815909 - DNA, 25 bp, Mus musculus
tccctattctctagtactcgtatcc

SEQ ID NO: 815910 - DNA, 25 bp, Mus musculus
tccctattctcttgtactcgtatcc

SEQ ID NO: 815911 - DNA, 25 bp, Mus musculus
tccctattcttgaatactgaactat

SEQ ID NO: 815912 - DNA, 25 bp, Mus musculus
tccctattcttgtatactgaactat

SEQ ID NO: 815913 - DNA, 25 bp, Mus musculus
tccctattgcttccttccagttaga

SEQ ID NO: 815914 - DNA, 25 bp, Mus musculus
tccctattgcttgcttccagttaga

SEQ ID NO: 815915 - DNA, 25 bp, Mus musculus
tccctattgtcaccctctatttcta

SEQ ID NO: 815916 - DNA, 25 bp, Mus musculus
tccctattgtcagcctctatttcta

SEQ ID NO: 815917 - DNA, 25 bp, Mus musculus
tccctatttctcaagggccacaaat

SEQ ID NO: 815918 - DNA, 25 bp, Mus musculus
tccctatttctctagggccacaaat

SEQ ID NO: 815919 - DNA, 25 bp, Mus musculus
tccctattttgcaacctcgacagta

SEQ ID NO: 815920 - DNA, 25 bp, Mus musculus
tccctattttgctacctcgacagta

SEQ ID NO: 815921 - DNA, 25 bp, Mus musculus
tccctattttttcgcaaagcccaca

SEQ ID NO: 815922 - DNA, 25 bp, Mus musculus
tccctattttttggcaaagcccaca

SEQ ID NO: 815923 - DNA, 25 bp, Mus musculus
tccctcaaatttccaggttttccat

SEQ ID NO: 815924 - DNA, 25 bp, Mus musculus
tccctcaaatttgcaggttttccat

SEQ ID NO: 815925 - DNA, 25 bp, Mus musculus
tccctcaagcatctagaagtttcta

SEQ ID NO: 815926 - DNA, 25 bp, Mus musculus
tccctcaagcatgtagaagtttcta

SEQ ID NO: 815927 - DNA, 25 bp, Mus musculus
tccctcaagggccacatgaagagca

SEQ ID NO: 815928 - DNA, 25 bp, Mus musculus
tccctcaagggcgacatgaagagca

SEQ ID NO: 815929 - DNA, 25 bp, Mus musculus
tccctcacaattaccatcccagacc

SEQ ID NO: 815930 - DNA, 25 bp, Mus musculus
tccctcacaatttccatcccagacc

SEQ ID NO: 815931 - DNA, 25 bp, Mus musculus
tccctcacagacatcctggtgtggt

SEQ ID NO: 815932 - DNA, 25 bp, Mus musculus
tccctcacagacttcctggtgtggt

SEQ ID NO: 815933 - DNA, 25 bp, Mus musculus
tccctcacatggcatggtccctagg

SEQ ID NO: 815934 - DNA, 25 bp, Mus musculus
tccctcacatgggatggtccctagg

SEQ ID NO: 815935 - DNA, 25 bp, Mus musculus
tccctcaccaggatttcattttcta

SEQ ID NO: 815936 - DNA, 25 bp, Mus musculus
tccctcaccaggttttcattttcta

SEQ ID NO: 815937 - DNA, 25 bp, Mus musculus
tccctcaccattatctatcaaacaa

SEQ ID NO: 815938 - DNA, 25 bp, Mus musculus
tccctcaccattttctatcaaacaa

SEQ ID NO: 815939 - DNA, 25 bp, Mus musculus
tccctcaccgccactattaaaaaag

SEQ ID NO: 815940 - DNA, 25 bp, Mus musculus
tccctcaccgcctctattaaaaaag

SEQ ID NO: 815941 - DNA, 25 bp, Mus musculus
tccctcacctccattgtctaaggta

SEQ ID NO: 815942 - DNA, 25 bp, Mus musculus
tccctcacctcctttgtctaaggta

SEQ ID NO: 815943 - DNA, 25 bp, Mus musculus
tccctcacctggcactagagaatgt

SEQ ID NO: 815944 - DNA, 25 bp, Mus musculus
tccctcacctgggactagagaatgt

SEQ ID NO: 815945 - DNA, 25 bp, Mus musculus
tccctcacgactatccaagcataag

SEQ ID NO: 815946 - DNA, 25 bp, Mus musculus
tccctcacgactttccaagcataag

SEQ ID NO: 815947 - DNA, 25 bp, Mus musculus
tccctcacggtgatgttgcagaaca

SEQ ID NO: 815948 - DNA, 25 bp, Mus musculus
tccctcacggtgttgttgcagaaca

SEQ ID NO: 815949 - DNA, 25 bp, Mus musculus
tccctcactcttatttgtagctcta

SEQ ID NO: 815950 - DNA, 25 bp, Mus musculus
tccctcactcttttttgtagctcta

SEQ ID NO: 815951 - DNA, 25 bp, Mus musculus
tccctcactttgatgtaagccacgg

SEQ ID NO: 815952 - DNA, 25 bp, Mus musculus
tccctcactttgttgtaagccacgg

SEQ ID NO: 815953 - DNA, 25 bp, Mus musculus
tccctcagaaagagttgttagtgca

SEQ ID NO: 815954 - DNA, 25 bp, Mus musculus
tccctcagaaagtgttgttagtgca

SEQ ID NO: 815955 - DNA, 25 bp, Mus musculus
tccctcagaattcgagccactgaga

SEQ ID NO: 815956 - DNA, 25 bp, Mus musculus
tccctcagaattggagccactgaga

SEQ ID NO: 815957 - DNA, 25 bp, Mus musculus
tccctcagacagcagtatcacattc

SEQ ID NO: 815958 - DNA, 25 bp, Mus musculus
tccctcagacaggagtatcacattc

SEQ ID NO: 815959 - DNA, 25 bp, Mus musculus
tccctcagagacctgcaggttgtgt

SEQ ID NO: 815960 - DNA, 25 bp, Mus musculus
tccctcagagacgtgcaggttgtgt

SEQ ID NO: 815961 - DNA, 25 bp, Mus musculus
tccctcagaggcctgagtttgtgtt

SEQ ID NO: 815962 - DNA, 25 bp, Mus musculus
tccctcagaggcgtgagtttgtgtt

SEQ ID NO: 815963 - DNA, 25 bp, Mus musculus
tccctcagatggcacgttttacctt

SEQ ID NO: 815964 - DNA, 25 bp, Mus musculus
tccctcagatgggacgttttacctt

SEQ ID NO: 815965 - DNA, 25 bp, Mus musculus
tccctcagcacacgatcgaaacgta

SEQ ID NO: 815966 - DNA, 25 bp, Mus musculus
tccctcagcacaggatcgaaacgta

SEQ ID NO: 815967 - DNA, 25 bp, Mus musculus
tccctcagcagtctgagacacattt

SEQ ID NO: 815968 - DNA, 25 bp, Mus musculus
tccctcagcagtgtgagacacattt

SEQ ID NO: 815969 - DNA, 25 bp, Mus musculus
tccctcagcataacattggccattc

SEQ ID NO: 815970 - DNA, 25 bp, Mus musculus
tccctcagcatatcattggccattc

SEQ ID NO: 815971 - DNA, 25 bp, Mus musculus
tccctcagcgtgcttccattgaaag

SEQ ID NO: 815972 - DNA, 25 bp, Mus musculus
tccctcagcgtggttccattgaaag

SEQ ID NO: 815973 - DNA, 25 bp, Mus musculus
tccctcagctgtacttttctattat

SEQ ID NO: 815974 - DNA, 25 bp, Mus musculus
tccctcagctgttcttttctattat

SEQ ID NO: 815975 - DNA, 25 bp, Mus musculus
tccctcagcttcatttgcctgaaga

SEQ ID NO: 815976 - DNA, 25 bp, Mus musculus
tccctcagcttcttttgcctgaaga

SEQ ID NO: 815977 - DNA, 25 bp, Mus musculus
tccctcagcttgactatcaggaaca

SEQ ID NO: 815978 - DNA, 25 bp, Mus musculus
tccctcagcttgtctatcaggaaca

SEQ ID NO: 815979 - DNA, 25 bp, Mus musculus
tccctcaggcagagaagctttcaag

SEQ ID NO: 815980 - DNA, 25 bp, Mus musculus
tccctcaggcagtgaagctttcaag

SEQ ID NO: 815981 - DNA, 25 bp, Mus musculus
tccctcaggtcccaaagggttgaca

SEQ ID NO: 815982 - DNA, 25 bp, Mus musculus
tccctcaggtccgaaagggttgaca

SEQ ID NO: 815983 - DNA, 25 bp, Mus musculus
tccctcagtaatcgagtgtgaccta

SEQ ID NO: 815984 - DNA, 25 bp, Mus musculus
tccctcagtaatggagtgtgaccta

SEQ ID NO: 815985 - DNA, 25 bp, Mus musculus
tccctcagtctgctgcttaattgca

SEQ ID NO: 815986 - DNA, 25 bp, Mus musculus
tccctcagtctggtgcttaattgca

SEQ ID NO: 815987 - DNA, 25 bp, Mus musculus
tccctcagtcttctaatgtgacctg

SEQ ID NO: 815988 - DNA, 25 bp, Mus musculus
tccctcagtcttgtaatgtgacctg

SEQ ID NO: 815989 - DNA, 25 bp, Mus musculus
tccctcatcattactgacccagaaa

SEQ ID NO: 815990 - DNA, 25 bp, Mus musculus
tccctcatcatttctgacccagaaa

SEQ ID NO: 815991 - DNA, 25 bp, Mus musculus
tccctcatgcgaaggcaccggaaga

SEQ ID NO: 815992 - DNA, 25 bp, Mus musculus
tccctcatgcgatggcaccggaaga

SEQ ID NO: 815993 - DNA, 25 bp, Mus musculus
tccctcattgacacgctagtgaatg

SEQ ID NO: 815994 - DNA, 25 bp, Mus musculus
tccctcattgactcgctagtgaatg

SEQ ID NO: 815995 - DNA, 25 bp, Mus musculus
tccctccacgaaaccatgatattgt

SEQ ID NO: 815996 - DNA, 25 bp, Mus musculus
tccctccacgaatccatgatattgt

SEQ ID NO: 815997 - DNA, 25 bp, Mus musculus
tccctccactatattcctaaagcaa

SEQ ID NO: 815998 - DNA, 25 bp, Mus musculus
tccctccactattttcctaaagcaa

SEQ ID NO: 815999 - DNA, 25 bp, Mus musculus
tccctccagactagactactcatga

SEQ ID NO: 816000 - DNA, 25 bp, Mus musculus
tccctccagacttgactactcatga

SEQ ID NO: 816001 - DNA, 25 bp, Mus musculus
tccctccaggtcctttcttagagtt

SEQ ID NO: 816002 - DNA, 25 bp, Mus musculus
tccctccaggtcgtttcttagagtt

SEQ ID NO: 816003 - DNA, 25 bp, Mus musculus
tccctccaggtgaagaggaagcagc

SEQ ID NO: 816004 - DNA, 25 bp, Mus musculus
tccctccaggtgtagaggaagcagc

SEQ ID NO: 816005 - DNA, 25 bp, Mus musculus
tccctccatgatcgctgtgccttga

SEQ ID NO: 816006 - DNA, 25 bp, Mus musculus
tccctccatgatggctgtgccttga

SEQ ID NO: 816007 - DNA, 25 bp, Mus musculus
tccctccattgcaattttgattctt

SEQ ID NO: 816008 - DNA, 25 bp, Mus musculus
tccctccattgctattttgattctt

SEQ ID NO: 816009 - DNA, 25 bp, Mus musculus
tccctcccaccaacaagaaggttgg

SEQ ID NO: 816010 - DNA, 25 bp, Mus musculus
tccctcccaccaatgtacaaaggaa

SEQ ID NO: 816011 - DNA, 25 bp, Mus musculus
tccctcccaccatcaagaaggttgg

SEQ ID NO: 816012 - DNA, 25 bp, Mus musculus
tccctcccaccattgtacaaaggaa

SEQ ID NO: 816013 - DNA, 25 bp, Mus musculus
tccctcccaggtcaatcagtaacaa

SEQ ID NO: 816014 - DNA, 25 bp, Mus musculus
tccctcccaggtgaatcagtaacaa

SEQ ID NO: 816015 - DNA, 25 bp, Mus musculus
tccctccccttaacatttgaagaaa

SEQ ID NO: 816016 - DNA, 25 bp, Mus musculus
tccctccccttatcatttgaagaaa

SEQ ID NO: 816017 - DNA, 25 bp, Mus musculus
tccctccccttgcattggaaactga

SEQ ID NO: 816018 - DNA, 25 bp, Mus musculus
tccctccccttggattggaaactga

SEQ ID NO: 816019 - DNA, 25 bp, Mus musculus
tccctcccggagaggcatgcaagag

SEQ ID NO: 816020 - DNA, 25 bp, Mus musculus
tccctcccggagtggcatgcaagag

SEQ ID NO: 816021 - DNA, 25 bp, Mus musculus
tccctccctaagagacatttggtga

SEQ ID NO: 816022 - DNA, 25 bp, Mus musculus
tccctccctaagtgacatttggtga

SEQ ID NO: 816023 - DNA, 25 bp, Mus musculus
tccctccctctgaatactttgtaaa

SEQ ID NO: 816024 - DNA, 25 bp, Mus musculus
tccctccctctgtatactttgtaaa

SEQ ID NO: 816025 - DNA, 25 bp, Mus musculus
tccctccctgagaagctaatgacta

SEQ ID NO: 816026 - DNA, 25 bp, Mus musculus
tccctccctgagtagctaatgacta

SEQ ID NO: 816027 - DNA, 25 bp, Mus musculus
tccctccctgttaggatctggaaag

SEQ ID NO: 816028 - DNA, 25 bp, Mus musculus
tccctccctgtttggatctggaaag

SEQ ID NO: 816029 - DNA, 25 bp, Mus musculus
tccctcccttggcaggatattattc

SEQ ID NO: 816030 - DNA, 25 bp, Mus musculus
tccctcccttgggaggatattattc

SEQ ID NO: 816031 - DNA, 25 bp, Mus musculus
tccctccctttcatttagctgaaag

SEQ ID NO: 816032 - DNA, 25 bp, Mus musculus
tccctccctttcttttagctgaaag

SEQ ID NO: 816033 - DNA, 25 bp, Mus musculus
tccctcccttttccagtagcaataa

SEQ ID NO: 816034 - DNA, 25 bp, Mus musculus
tccctcccttttgcagtagcaataa

SEQ ID NO: 816035 - DNA, 25 bp, Mus musculus
tccctccgaatgattctcaagtgtg

SEQ ID NO: 816036 - DNA, 25 bp, Mus musculus
tccctccgaatgtttctcaagtgtg

SEQ ID NO: 816037 - DNA, 25 bp, Mus musculus
tccctccgacataccctgagaataa

SEQ ID NO: 816038 - DNA, 25 bp, Mus musculus
tccctccgacattccctgagaataa

SEQ ID NO: 816039 - DNA, 25 bp, Mus musculus
tccctccgagaactctcctttagaa

SEQ ID NO: 816040 - DNA, 25 bp, Mus musculus
tccctccgagaagtctcctttagaa

SEQ ID NO: 816041 - DNA, 25 bp, Mus musculus
tccctccgaggaagacacagattgt

SEQ ID NO: 816042 - DNA, 25 bp, Mus musculus
tccctccgaggatgacacagattgt

SEQ ID NO: 816043 - DNA, 25 bp, Mus musculus
tccctccgcagtacaggccaataat

SEQ ID NO: 816044 - DNA, 25 bp, Mus musculus
tccctccgcagttcaggccaataat

SEQ ID NO: 816045 - DNA, 25 bp, Mus musculus
tccctccgcgctagaaagttaacat

SEQ ID NO: 816046 - DNA, 25 bp, Mus musculus
tccctccgcgcttgaaagttaacat

SEQ ID NO: 816047 - DNA, 25 bp, Mus musculus
tccctccgcttactggctttaaaga

SEQ ID NO: 816048 - DNA, 25 bp, Mus musculus
tccctccgcttagtggctttaaaga

SEQ ID NO: 816049 - DNA, 25 bp, Mus musculus
tccctccgtaaaatcatggatgcag

SEQ ID NO: 816050 - DNA, 25 bp, Mus musculus
tccctccgtaaattcatggatgcag

SEQ ID NO: 816051 - DNA, 25 bp, Mus musculus
tccctcctaacactgcttcatttgg

SEQ ID NO: 816052 - DNA, 25 bp, Mus musculus
tccctcctaacagtgcttcatttgg

SEQ ID NO: 816053 - DNA, 25 bp, Mus musculus
tccctcctacagaaggtgccagctt

SEQ ID NO: 816054 - DNA, 25 bp, Mus musculus
tccctcctacagtaggtgccagctt

SEQ ID NO: 816055 - DNA, 25 bp, Mus musculus
tccctcctacccatccttagaaatg

SEQ ID NO: 816056 - DNA, 25 bp, Mus musculus
tccctcctacccttccttagaaatg

SEQ ID NO: 816057 - DNA, 25 bp, Mus musculus
tccctcctacctcatggtattaaga

SEQ ID NO: 816058 - DNA, 25 bp, Mus musculus
tccctcctacctgatggtattaaga

SEQ ID NO: 816059 - DNA, 25 bp, Mus musculus
tccctcctacttatgctaacttata

SEQ ID NO: 816060 - DNA, 25 bp, Mus musculus
tccctcctacttttgctaacttata

SEQ ID NO: 816061 - DNA, 25 bp, Mus musculus
tccctcctagttaacagacatcggc

SEQ ID NO: 816062 - DNA, 25 bp, Mus musculus
tccctcctagtttacagacatcggc

SEQ ID NO: 816063 - DNA, 25 bp, Mus musculus
tccctcctcaaaagccaacttggtg

SEQ ID NO: 816064 - DNA, 25 bp, Mus musculus
tccctcctcaaatgccaacttggtg

SEQ ID NO: 816065 - DNA, 25 bp, Mus musculus
tccctcctcagcaaatattctcaag

SEQ ID NO: 816066 - DNA, 25 bp, Mus musculus
tccctcctcagctaatattctcaag

SEQ ID NO: 816067 - DNA, 25 bp, Mus musculus
tccctcctcctaagacagaagctat

SEQ ID NO: 816068 - DNA, 25 bp, Mus musculus
tccctcctcctatgacagaagctat

SEQ ID NO: 816069 - DNA, 25 bp, Mus musculus
tccctcctcggtctatgtacaagta

SEQ ID NO: 816070 - DNA, 25 bp, Mus musculus
tccctcctcggtgtatgtacaagta

SEQ ID NO: 816071 - DNA, 25 bp, Mus musculus
tccctcctgacactggcaataaact

SEQ ID NO: 816072 - DNA, 25 bp, Mus musculus
tccctcctgacagtggcaataaact

SEQ ID NO: 816073 - DNA, 25 bp, Mus musculus
tccctcctgagcataccaagtgtgg

SEQ ID NO: 816074 - DNA, 25 bp, Mus musculus
tccctcctgagcttaccaagtgtgg

SEQ ID NO: 816075 - DNA, 25 bp, Mus musculus
tccctcctgaggattttcagatgct

SEQ ID NO: 816076 - DNA, 25 bp, Mus musculus
tccctcctgaggtttttcagatgct

SEQ ID NO: 816077 - DNA, 25 bp, Mus musculus
tccctcctgcctatttacaaagtat

SEQ ID NO: 816078 - DNA, 25 bp, Mus musculus
tccctcctgcctttttacaaagtat

SEQ ID NO: 816079 - DNA, 25 bp, Mus musculus
tccctcctgctccatatacatatag

SEQ ID NO: 816080 - DNA, 25 bp, Mus musculus
tccctcctgctcgatatacatatag

SEQ ID NO: 816081 - DNA, 25 bp, Mus musculus
tccctcctgggaaatgctggtgcag

SEQ ID NO: 816082 - DNA, 25 bp, Mus musculus
tccctcctgggaatgtgaaaaaact

SEQ ID NO: 816083 - DNA, 25 bp, Mus musculus
tccctcctgggatatgctggtgcag

SEQ ID NO: 816084 - DNA, 25 bp, Mus musculus
tccctcctgggattgtgaaaaaact

SEQ ID NO: 816085 - DNA, 25 bp, Mus musculus
tccctcctgggtaggatacatctga

SEQ ID NO: 816086 - DNA, 25 bp, Mus musculus
tccctcctgggtcctatgattgaaa

SEQ ID NO: 816087 - DNA, 25 bp, Mus musculus
tccctcctgggtgctatgattgaaa

SEQ ID NO: 816088 - DNA, 25 bp, Mus musculus
tccctcctgggttggatacatctga

SEQ ID NO: 816089 - DNA, 25 bp, Mus musculus
tccctcctgtggaatctagccaaaa

SEQ ID NO: 816090 - DNA, 25 bp, Mus musculus
tccctcctgtggtatctagccaaaa

SEQ ID NO: 816091 - DNA, 25 bp, Mus musculus
tccctcctgtttatgcatactgtat

SEQ ID NO: 816092 - DNA, 25 bp, Mus musculus
tccctcctgtttttgcatactgtat

SEQ ID NO: 816093 - DNA, 25 bp, Mus musculus
tccctccttaggatctgtttcataa

SEQ ID NO: 816094 - DNA, 25 bp, Mus musculus
tccctccttaggttctgtttcataa

SEQ ID NO: 816095 - DNA, 25 bp, Mus musculus
tccctccttcaactgctaagcaaga

SEQ ID NO: 816096 - DNA, 25 bp, Mus musculus
tccctccttcaagtgctaagcaaga

SEQ ID NO: 816097 - DNA, 25 bp, Mus musculus
tccctccttcgacttgcagaaatta

SEQ ID NO: 816098 - DNA, 25 bp, Mus musculus
tccctccttcgagttgcagaaatta

SEQ ID NO: 816099 - DNA, 25 bp, Mus musculus
tccctccttgcaacgcggtgaatgg

SEQ ID NO: 816100 - DNA, 25 bp, Mus musculus
tccctccttgcatcgcggtgaatgg

SEQ ID NO: 816101 - DNA, 25 bp, Mus musculus
tccctccttggaacactgaacatat

SEQ ID NO: 816102 - DNA, 25 bp, Mus musculus
tccctccttggatcactgaacatat

SEQ ID NO: 816103 - DNA, 25 bp, Mus musculus
tccctccttgggacttttgctggtt

SEQ ID NO: 816104 - DNA, 25 bp, Mus musculus
tccctccttgggatatctgttagat

SEQ ID NO: 816105 - DNA, 25 bp, Mus musculus
tccctccttgggtcttttgctggtt

SEQ ID NO: 816106 - DNA, 25 bp, Mus musculus
tccctccttgggttatctgttagat

SEQ ID NO: 816107 - DNA, 25 bp, Mus musculus
tccctccttgtaaaaccattgcatg

SEQ ID NO: 816108 - DNA, 25 bp, Mus musculus
tccctccttgtataaccattgcatg

SEQ ID NO: 816109 - DNA, 25 bp, Mus musculus
tccctccttgtgagttcctgaggat

SEQ ID NO: 816110 - DNA, 25 bp, Mus musculus
tccctccttgtgtgttcctgaggat

SEQ ID NO: 816111 - DNA, 25 bp, Mus musculus
tccctccttgttctgccctctgagt

SEQ ID NO: 816112 - DNA, 25 bp, Mus musculus
tccctccttgttgtgccctctgagt

SEQ ID NO: 816113 - DNA, 25 bp, Mus musculus
tccctcctttcacagtaagtcttca

SEQ ID NO: 816114 - DNA, 25 bp, Mus musculus
tccctcctttcagagtaagtcttca

SEQ ID NO: 816115 - DNA, 25 bp, Mus musculus
tccctcctttggattcatacatggc

SEQ ID NO: 816116 - DNA, 25 bp, Mus musculus
tccctcctttggtttcatacatggc

SEQ ID NO: 816117 - DNA, 25 bp, Mus musculus
tccctcctttgtacctgtggtagaa

SEQ ID NO: 816118 - DNA, 25 bp, Mus musculus
tccctcctttgttcctgtggtagaa

SEQ ID NO: 816119 - DNA, 25 bp, Mus musculus
tccctccttttgatgatctgaatgt

SEQ ID NO: 816120 - DNA, 25 bp, Mus musculus
tccctccttttgttgatctgaatgt

SEQ ID NO: 816121 - DNA, 25 bp, Mus musculus
tccctcgaacccaactcgtaagatt

SEQ ID NO: 816122 - DNA, 25 bp, Mus musculus
tccctcgaaccctactcgtaagatt

SEQ ID NO: 816123 - DNA, 25 bp, Mus musculus
tccctcgaatagctacttttggaag

SEQ ID NO: 816124 - DNA, 25 bp, Mus musculus
tccctcgaataggtacttttggaag

SEQ ID NO: 816125 - DNA, 25 bp, Mus musculus
tccctcgacagtcactgtgagtgta

SEQ ID NO: 816126 - DNA, 25 bp, Mus musculus
tccctcgacagtgactgtgagtgta

SEQ ID NO: 816127 - DNA, 25 bp, Mus musculus
tccctcgatggtccaataaacctga

SEQ ID NO: 816128 - DNA, 25 bp, Mus musculus
tccctcgatggtgcaataaacctga

SEQ ID NO: 816129 - DNA, 25 bp, Mus musculus
tccctcgatttaattaactcccatc

SEQ ID NO: 816130 - DNA, 25 bp, Mus musculus
tccctcgatttatttaactcccatc

SEQ ID NO: 816131 - DNA, 25 bp, Mus musculus
tccctcgccattagacctctaaaga

SEQ ID NO: 816132 - DNA, 25 bp, Mus musculus
tccctcgccatttgacctctaaaga

SEQ ID NO: 816133 - DNA, 25 bp, Mus musculus
tccctcgcctaacgattcttttttg

SEQ ID NO: 816134 - DNA, 25 bp, Mus musculus
tccctcgcctaaggattcttttttg

SEQ ID NO: 816135 - DNA, 25 bp, Mus musculus
tccctcgctgctatgaaattatgta

SEQ ID NO: 816136 - DNA, 25 bp, Mus musculus
tccctcgctgctttgaaattatgta

SEQ ID NO: 816137 - DNA, 25 bp, Mus musculus
tccctcggaactcactcgactaatg

SEQ ID NO: 816138 - DNA, 25 bp, Mus musculus
tccctcggaactgactcgactaatg

SEQ ID NO: 816139 - DNA, 25 bp, Mus musculus
tccctcggagacaagctgaagtatg

SEQ ID NO: 816140 - DNA, 25 bp, Mus musculus
tccctcggagactagctgaagtatg

SEQ ID NO: 816141 - DNA, 25 bp, Mus musculus
tccctcggcccaaacaaaagctaag

SEQ ID NO: 816142 - DNA, 25 bp, Mus musculus
tccctcggcccatacaaaagctaag

SEQ ID NO: 816143 - DNA, 25 bp, Mus musculus
tccctcgtcaaaaatattccccttg

SEQ ID NO: 816144 - DNA, 25 bp, Mus musculus
tccctcgtcaaatatattccccttg

SEQ ID NO: 816145 - DNA, 25 bp, Mus musculus
tccctcgtggaaagtggctgcccgg

SEQ ID NO: 816146 - DNA, 25 bp, Mus musculus
tccctcgtggaatgtggctgcccgg

SEQ ID NO: 816147 - DNA, 25 bp, Mus musculus
tccctcgtgggaaatactgggagga

SEQ ID NO: 816148 - DNA, 25 bp, Mus musculus
tccctcgtgggatatactgggagga

SEQ ID NO: 816149 - DNA, 25 bp, Mus musculus
tccctcgtgtatccgagagacgctg

SEQ ID NO: 816150 - DNA, 25 bp, Mus musculus
tccctcgtgtatgcgagagacgctg

SEQ ID NO: 816151 - DNA, 25 bp, Mus musculus
tccctctaaaacacctttctgttct

SEQ ID NO: 816152 - DNA, 25 bp, Mus musculus
tccctctaaaactcctttctgttct

SEQ ID NO: 816153 - DNA, 25 bp, Mus musculus
tccctctaacgacgagtctccagaa

SEQ ID NO: 816154 - DNA, 25 bp, Mus musculus
tccctctaacgaggagtctccagaa

SEQ ID NO: 816155 - DNA, 25 bp, Mus musculus
tccctctaattaatcatttgttctt

SEQ ID NO: 816156 - DNA, 25 bp, Mus musculus
tccctctaattattcatttgttctt

SEQ ID NO: 816157 - DNA, 25 bp, Mus musculus
tccctctaccttaatcctagcaaaa

SEQ ID NO: 816158 - DNA, 25 bp, Mus musculus
tccctctacctttatcctagcaaaa

SEQ ID NO: 816159 - DNA, 25 bp, Mus musculus
tccctctagcttctagtctaacggt

SEQ ID NO: 816160 - DNA, 25 bp, Mus musculus
tccctctagcttgtagtctaacggt

SEQ ID NO: 816161 - DNA, 25 bp, Mus musculus
tccctctatggacagctggatacaa

SEQ ID NO: 816162 - DNA, 25 bp, Mus musculus
tccctctatggagagctggatacaa

SEQ ID NO: 816163 - DNA, 25 bp, Mus musculus
tccctctcatctaggcctgaaagca

SEQ ID NO: 816164 - DNA, 25 bp, Mus musculus
tccctctcatcttggcctgaaagca

SEQ ID NO: 816165 - DNA, 25 bp, Mus musculus
tccctctccaatcctagtaagtgaa

SEQ ID NO: 816166 - DNA, 25 bp, Mus musculus
tccctctccaatgctagtaagtgaa

SEQ ID NO: 816167 - DNA, 25 bp, Mus musculus
tccctctcgagactttccagatttg

SEQ ID NO: 816168 - DNA, 25 bp, Mus musculus
tccctctcgagagtttccagatttg

SEQ ID NO: 816169 - DNA, 25 bp, Mus musculus
tccctctcgaggagacaagttctct

SEQ ID NO: 816170 - DNA, 25 bp, Mus musculus
tccctctcgaggtgacaagttctct

SEQ ID NO: 816171 - DNA, 25 bp, Mus musculus
tccctctctagactggtacttgact

SEQ ID NO: 816172 - DNA, 25 bp, Mus musculus
tccctctctagagtggtacttgact

SEQ ID NO: 816173 - DNA, 25 bp, Mus musculus
tccctctctcccagaaatgtgaata

SEQ ID NO: 816174 - DNA, 25 bp, Mus musculus
tccctctctccctgaaatgtgaata

SEQ ID NO: 816175 - DNA, 25 bp, Mus musculus
tccctctctttaaagaactgtccat

SEQ ID NO: 816176 - DNA, 25 bp, Mus musculus
tccctctctttatagaactgtccat

SEQ ID NO: 816177 - DNA, 25 bp, Mus musculus
tccctctcttttccaagcatcagaa

SEQ ID NO: 816178 - DNA, 25 bp, Mus musculus
tccctctcttttgcaagcatcagaa

SEQ ID NO: 816179 - DNA, 25 bp, Mus musculus
tccctctgaagcacttaggagctac

SEQ ID NO: 816180 - DNA, 25 bp, Mus musculus
tccctctgaagctcttaggagctac

SEQ ID NO: 816181 - DNA, 25 bp, Mus musculus
tccctctgactgcatacaacctagt

SEQ ID NO: 816182 - DNA, 25 bp, Mus musculus
tccctctgactggatacaacctagt

SEQ ID NO: 816183 - DNA, 25 bp, Mus musculus
tccctctgagggaatggcagtagtg

SEQ ID NO: 816184 - DNA, 25 bp, Mus musculus
tccctctgagggtatggcagtagtg

SEQ ID NO: 816185 - DNA, 25 bp, Mus musculus
tccctctgcactcgatagatttgta

SEQ ID NO: 816186 - DNA, 25 bp, Mus musculus
tccctctgcactggatagatttgta

SEQ ID NO: 816187 - DNA, 25 bp, Mus musculus
tccctctgccaaagactttgggcaa

SEQ ID NO: 816188 - DNA, 25 bp, Mus musculus
tccctctgccaatgactttgggcaa

SEQ ID NO: 816189 - DNA, 25 bp, Mus musculus
tccctctgccctagtatgaaacttg

SEQ ID NO: 816190 - DNA, 25 bp, Mus musculus
tccctctgcccttgtatgaaacttg

SEQ ID NO: 816191 - DNA, 25 bp, Mus musculus
tccctctgccggatggaggacagtg

SEQ ID NO: 816192 - DNA, 25 bp, Mus musculus
tccctctgccggttggaggacagtg

SEQ ID NO: 816193 - DNA, 25 bp, Mus musculus
tccctctgctggaaggtcttcaaga

SEQ ID NO: 816194 - DNA, 25 bp, Mus musculus
tccctctgctggtaggtcttcaaga

SEQ ID NO: 816195 - DNA, 25 bp, Mus musculus
tccctctgctttacctagaatgggc

SEQ ID NO: 816196 - DNA, 25 bp, Mus musculus
tccctctgcttttcctagaatgggc

SEQ ID NO: 816197 - DNA, 25 bp, Mus musculus
tccctctggagcaggtctgggccaa

SEQ ID NO: 816198 - DNA, 25 bp, Mus musculus
tccctctggagctggtctgggccaa

SEQ ID NO: 816199 - DNA, 25 bp, Mus musculus
tccctctggcctattgtattttatt

SEQ ID NO: 816200 - DNA, 25 bp, Mus musculus
tccctctggccttttgtattttatt

SEQ ID NO: 816201 - DNA, 25 bp, Mus musculus
tccctctgggaaatacctgagcctg

SEQ ID NO: 816202 - DNA, 25 bp, Mus musculus
tccctctgggaattacctgagcctg

SEQ ID NO: 816203 - DNA, 25 bp, Mus musculus
tccctctgggcgcgctgcatggaat

SEQ ID NO: 816204 - DNA, 25 bp, Mus musculus
tccctctgggcgggctgcatggaat

SEQ ID NO: 816205 - DNA, 25 bp, Mus musculus
tccctctgggctcttgctatgagca

SEQ ID NO: 816206 - DNA, 25 bp, Mus musculus
tccctctgggctgttgctatgagca

SEQ ID NO: 816207 - DNA, 25 bp, Mus musculus
tccctctgggtgatatgcgactgct

SEQ ID NO: 816208 - DNA, 25 bp, Mus musculus
tccctctgggtgttatgcgactgct

SEQ ID NO: 816209 - DNA, 25 bp, Mus musculus
tccctctgtaccagccaatgatgag

SEQ ID NO: 816210 - DNA, 25 bp, Mus musculus
tccctctgtacctgccaatgatgag

SEQ ID NO: 816211 - DNA, 25 bp, Mus musculus
tccctctgtacgcttgtcgccatgt

SEQ ID NO: 816212 - DNA, 25 bp, Mus musculus
tccctctgtacggttgtcgccatgt

SEQ ID NO: 816213 - DNA, 25 bp, Mus musculus
tccctctgtagtatttacctacaat

SEQ ID NO: 816214 - DNA, 25 bp, Mus musculus
tccctctgtagtttttacctacaat

SEQ ID NO: 816215 - DNA, 25 bp, Mus musculus
tccctctgtgtaccttctaaggaac

SEQ ID NO: 816216 - DNA, 25 bp, Mus musculus
tccctctgtgtagcttctaaggaac

SEQ ID NO: 816217 - DNA, 25 bp, Mus musculus
tccctctgtgtgcagatgaacattc

SEQ ID NO: 816218 - DNA, 25 bp, Mus musculus
tccctctgtgtggagatgaacattc

SEQ ID NO: 816219 - DNA, 25 bp, Mus musculus
tccctctgttcaagaggcagagtca

SEQ ID NO: 816220 - DNA, 25 bp, Mus musculus
tccctctgttcatgaggcagagtca

SEQ ID NO: 816221 - DNA, 25 bp, Mus musculus
tccctctgttgcatcctttaggaac

SEQ ID NO: 816222 - DNA, 25 bp, Mus musculus
tccctctgttgcttcctttaggaac

SEQ ID NO: 816223 - DNA, 25 bp, Mus musculus
tccctctgtttcacttgaatcttct

SEQ ID NO: 816224 - DNA, 25 bp, Mus musculus
tccctctgtttctcttgaatcttct

SEQ ID NO: 816225 - DNA, 25 bp, Mus musculus
tccctctgttttccagggaacccaa

SEQ ID NO: 816226 - DNA, 25 bp, Mus musculus
tccctctgttttgcagggaacccaa

SEQ ID NO: 816227 - DNA, 25 bp, Mus musculus
tccctcttacacacaaaatcttcta

SEQ ID NO: 816228 - DNA, 25 bp, Mus musculus
tccctcttacactcaaaatcttcta

SEQ ID NO: 816229 - DNA, 25 bp, Mus musculus
tccctcttagttacggcagtctgtg

SEQ ID NO: 816230 - DNA, 25 bp, Mus musculus
tccctcttagtttcggcagtctgtg

SEQ ID NO: 816231 - DNA, 25 bp, Mus musculus
tccctcttcacgcaacctaatgaaa

SEQ ID NO: 816232 - DNA, 25 bp, Mus musculus
tccctcttcacggaacctaatgaaa

SEQ ID NO: 816233 - DNA, 25 bp, Mus musculus
tccctcttcctccttgtaagagctt

SEQ ID NO: 816234 - DNA, 25 bp, Mus musculus
tccctcttcctcgttgtaagagctt

SEQ ID NO: 816235 - DNA, 25 bp, Mus musculus
tccctcttccttcgagcaaacgtat

SEQ ID NO: 816236 - DNA, 25 bp, Mus musculus
tccctcttccttggagcaaacgtat

SEQ ID NO: 816237 - DNA, 25 bp, Mus musculus
tccctcttctacatttatggtcctg

SEQ ID NO: 816238 - DNA, 25 bp, Mus musculus
tccctcttctacttttatggtcctg

SEQ ID NO: 816239 - DNA, 25 bp, Mus musculus
tccctcttctcacagctggaagcaa

SEQ ID NO: 816240 - DNA, 25 bp, Mus musculus
tccctcttctcagagctggaagcaa

SEQ ID NO: 816241 - DNA, 25 bp, Mus musculus
tccctcttctgacatgtagacagaa

SEQ ID NO: 816242 - DNA, 25 bp, Mus musculus
tccctcttctgagatgtagacagaa

SEQ ID NO: 816243 - DNA, 25 bp, Mus musculus
tccctcttgacactaccttctttta

SEQ ID NO: 816244 - DNA, 25 bp, Mus musculus
tccctcttgacagtaccttctttta

SEQ ID NO: 816245 - DNA, 25 bp, Mus musculus
tccctcttgaccaatgcatctttag

SEQ ID NO: 816246 - DNA, 25 bp, Mus musculus
tccctcttgacctatgcatctttag

SEQ ID NO: 816247 - DNA, 25 bp, Mus musculus
tccctcttgagccataaaggacagt

SEQ ID NO: 816248 - DNA, 25 bp, Mus musculus
tccctcttgagcgataaaggacagt

SEQ ID NO: 816249 - DNA, 25 bp, Mus musculus
tccctcttgaggatgactggacgga

SEQ ID NO: 816250 - DNA, 25 bp, Mus musculus
tccctcttgaggttgactggacgga

SEQ ID NO: 816251 - DNA, 25 bp, Mus musculus
tccctcttgctcaattttgactact

SEQ ID NO: 816252 - DNA, 25 bp, Mus musculus
tccctcttgctctattttgactact

SEQ ID NO: 816253 - DNA, 25 bp, Mus musculus
tccctcttgggaatcatgtgtgtca

SEQ ID NO: 816254 - DNA, 25 bp, Mus musculus
tccctcttgggattcatgtgtgtca

SEQ ID NO: 816255 - DNA, 25 bp, Mus musculus
tccctcttgggcaggttcgagttcg

SEQ ID NO: 816256 - DNA, 25 bp, Mus musculus
tccctcttgggctggttcgagttcg

SEQ ID NO: 816257 - DNA, 25 bp, Mus musculus
tccctcttgtagagctctaagcttg

SEQ ID NO: 816258 - DNA, 25 bp, Mus musculus
tccctcttgtagtgctctaagcttg

SEQ ID NO: 816259 - DNA, 25 bp, Mus musculus
tccctctttcctcagctatatataa

SEQ ID NO: 816260 - DNA, 25 bp, Mus musculus
tccctctttcctgagctatatataa

SEQ ID NO: 816261 - DNA, 25 bp, Mus musculus
tccctctttctgaaccttgtaacta

SEQ ID NO: 816262 - DNA, 25 bp, Mus musculus
tccctctttctgtaccttgtaacta

SEQ ID NO: 816263 - DNA, 25 bp, Mus musculus
tccctcttttctacggagaacgttg

SEQ ID NO: 816264 - DNA, 25 bp, Mus musculus
tccctcttttcttcggagaacgttg

SEQ ID NO: 816265 - DNA, 25 bp, Mus musculus
tccctgaaaaccctcctgaattaag

SEQ ID NO: 816266 - DNA, 25 bp, Mus musculus
tccctgaaaaccgtcctgaattaag

SEQ ID NO: 816267 - DNA, 25 bp, Mus musculus
tccctgaacaccagagaatatctct

SEQ ID NO: 816268 - DNA, 25 bp, Mus musculus
tccctgaacacctgagaatatctct

SEQ ID NO: 816269 - DNA, 25 bp, Mus musculus
tccctgaacaggatttccctgacat

SEQ ID NO: 816270 - DNA, 25 bp, Mus musculus
tccctgaacaggttttccctgacat

SEQ ID NO: 816271 - DNA, 25 bp, Mus musculus
tccctgaacctgagcacttactgct

SEQ ID NO: 816272 - DNA, 25 bp, Mus musculus
tccctgaacctgtgcacttactgct

SEQ ID NO: 816273 - DNA, 25 bp, Mus musculus
tccctgaactggagtccgtttagac

SEQ ID NO: 816274 - DNA, 25 bp, Mus musculus
tccctgaactggtgtccgtttagac

SEQ ID NO: 816275 - DNA, 25 bp, Mus musculus
tccctgaagaaactcgacagatact

SEQ ID NO: 816276 - DNA, 25 bp, Mus musculus
tccctgaagaaagtcgacagatact

SEQ ID NO: 816277 - DNA, 25 bp, Mus musculus
tccctgaagattaagcgcacgaaaa

SEQ ID NO: 816278 - DNA, 25 bp, Mus musculus
tccctgaagatttagcgcacgaaaa

SEQ ID NO: 816279 - DNA, 25 bp, Mus musculus
tccctgaagctgaccttgaaactga

SEQ ID NO: 816280 - DNA, 25 bp, Mus musculus
tccctgaagctgtccttgaaactga

SEQ ID NO: 816281 - DNA, 25 bp, Mus musculus
tccctgaaggacatcctccagcaag

SEQ ID NO: 816282 - DNA, 25 bp, Mus musculus
tccctgaaggacttcctccagcaag

SEQ ID NO: 816283 - DNA, 25 bp, Mus musculus
tccctgaaggtcatctctgtaactg

SEQ ID NO: 816284 - DNA, 25 bp, Mus musculus
tccctgaaggtcttctctgtaactg

SEQ ID NO: 816285 - DNA, 25 bp, Mus musculus
tccctgaaggtgactcatctacata

SEQ ID NO: 816286 - DNA, 25 bp, Mus musculus
tccctgaaggtgtctcatctacata

SEQ ID NO: 816287 - DNA, 25 bp, Mus musculus
tccctgaaggttccatcaacaccat

SEQ ID NO: 816288 - DNA, 25 bp, Mus musculus
tccctgaaggttgcatcaacaccat

SEQ ID NO: 816289 - DNA, 25 bp, Mus musculus
tccctgaatcttcccttgggataca

SEQ ID NO: 816290 - DNA, 25 bp, Mus musculus
tccctgaatcttgccttgggataca

SEQ ID NO: 816291 - DNA, 25 bp, Mus musculus
tccctgaatgccatcgaaccatgtg

SEQ ID NO: 816292 - DNA, 25 bp, Mus musculus
tccctgaatgccttcgaaccatgtg

SEQ ID NO: 816293 - DNA, 25 bp, Mus musculus
tccctgaatggacattgatgctgct

SEQ ID NO: 816294 - DNA, 25 bp, Mus musculus
tccctgaatggagattgatgctgct

SEQ ID NO: 816295 - DNA, 25 bp, Mus musculus
tccctgacaggaaataaaagccaca

SEQ ID NO: 816296 - DNA, 25 bp, Mus musculus
tccctgacaggatataaaagccaca

SEQ ID NO: 816297 - DNA, 25 bp, Mus musculus
tccctgacagttaggtactcttgat

SEQ ID NO: 816298 - DNA, 25 bp, Mus musculus
tccctgacagtttggtactcttgat

SEQ ID NO: 816299 - DNA, 25 bp, Mus musculus
tccctgactataccacatgttaaaa

SEQ ID NO: 816300 - DNA, 25 bp, Mus musculus
tccctgactatagcacatgttaaaa

SEQ ID NO: 816301 - DNA, 25 bp, Mus musculus
tccctgactgtgctgaaactcatgg

SEQ ID NO: 816302 - DNA, 25 bp, Mus musculus
tccctgactgtggtgaaactcatgg

SEQ ID NO: 816303 - DNA, 25 bp, Mus musculus
tccctgagattcctgtttagaatgt

SEQ ID NO: 816304 - DNA, 25 bp, Mus musculus
tccctgagattcgtgtttagaatgt

SEQ ID NO: 816305 - DNA, 25 bp, Mus musculus
tccctgagcacgaggtcatgacaaa

SEQ ID NO: 816306 - DNA, 25 bp, Mus musculus
tccctgagcacgtggtcatgacaaa

SEQ ID NO: 816307 - DNA, 25 bp, Mus musculus
tccctgagcagtcaggactgtccag

SEQ ID NO: 816308 - DNA, 25 bp, Mus musculus
tccctgagcagtgaggactgtccag

SEQ ID NO: 816309 - DNA, 25 bp, Mus musculus
tccctgagccccaagaaagaaaaag

SEQ ID NO: 816310 - DNA, 25 bp, Mus musculus
tccctgagcccctagaaagaaaaag

SEQ ID NO: 816311 - DNA, 25 bp, Mus musculus
tccctgagcctgaacaccaagatag

SEQ ID NO: 816312 - DNA, 25 bp, Mus musculus
tccctgagcctgtacaccaagatag

SEQ ID NO: 816313 - DNA, 25 bp, Mus musculus
tccctgagcgataatggctgccgat

SEQ ID NO: 816314 - DNA, 25 bp, Mus musculus
tccctgagcgattatggctgccgat

SEQ ID NO: 816315 - DNA, 25 bp, Mus musculus
tccctgagctcgctggaatccgtga

SEQ ID NO: 816316 - DNA, 25 bp, Mus musculus
tccctgagctcggtggaatccgtga

SEQ ID NO: 816317 - DNA, 25 bp, Mus musculus
tccctgaggacacccagtggatgag

SEQ ID NO: 816318 - DNA, 25 bp, Mus musculus
tccctgaggacagccagtggatgag

SEQ ID NO: 816319 - DNA, 25 bp, Mus musculus
tccctgaggaccatttacacattca

SEQ ID NO: 816320 - DNA, 25 bp, Mus musculus
tccctgaggaccttttacacattca

SEQ ID NO: 816321 - DNA, 25 bp, Mus musculus
tccctgagggcgctgagacagactt

SEQ ID NO: 816322 - DNA, 25 bp, Mus musculus
tccctgagggcggtgagacagactt

SEQ ID NO: 816323 - DNA, 25 bp, Mus musculus
tccctgaggttgaacaaacttgaca

SEQ ID NO: 816324 - DNA, 25 bp, Mus musculus
tccctgaggttgtacaaacttgaca

SEQ ID NO: 816325 - DNA, 25 bp, Mus musculus
tccctgagtagtcttgctgcctgtg

SEQ ID NO: 816326 - DNA, 25 bp, Mus musculus
tccctgagtagtgttgctgcctgtg

SEQ ID NO: 816327 - DNA, 25 bp, Mus musculus
tccctgagtcctctgaatctgagtc

SEQ ID NO: 816328 - DNA, 25 bp, Mus musculus
tccctgagtcctgtgaatctgagtc

SEQ ID NO: 816329 - DNA, 25 bp, Mus musculus
tccctgagtgttcgttgagttagac

SEQ ID NO: 816330 - DNA, 25 bp, Mus musculus
tccctgagtgttggttgagttagac

SEQ ID NO: 816331 - DNA, 25 bp, Mus musculus
tccctgataattaatggcaaagagc

SEQ ID NO: 816332 - DNA, 25 bp, Mus musculus
tccctgataatttatggcaaagagc

SEQ ID NO: 816333 - DNA, 25 bp, Mus musculus
tccctgatagggaccttatgtgtcc

SEQ ID NO: 816334 - DNA, 25 bp, Mus musculus
tccctgatagggtccttatgtgtcc

SEQ ID NO: 816335 - DNA, 25 bp, Mus musculus
tccctgatatctctggctttgtcaa

SEQ ID NO: 816336 - DNA, 25 bp, Mus musculus
tccctgatatctgtggctttgtcaa

SEQ ID NO: 816337 - DNA, 25 bp, Mus musculus
tccctgatctgtccactgaagacat

SEQ ID NO: 816338 - DNA, 25 bp, Mus musculus
tccctgatctgtgcactgaagacat

SEQ ID NO: 816339 - DNA, 25 bp, Mus musculus
tccctgatgcccaattgtttctaca

SEQ ID NO: 816340 - DNA, 25 bp, Mus musculus
tccctgatgccctattgtttctaca

SEQ ID NO: 816341 - DNA, 25 bp, Mus musculus
tccctgattggacctggtgggcaat

SEQ ID NO: 816342 - DNA, 25 bp, Mus musculus
tccctgattggagctggtgggcaat

SEQ ID NO: 816343 - DNA, 25 bp, Mus musculus
tccctgcaaatcagtgttgactgta

SEQ ID NO: 816344 - DNA, 25 bp, Mus musculus
tccctgcaaatctgtgttgactgta

SEQ ID NO: 816345 - DNA, 25 bp, Mus musculus
tccctgcaacgtactgtacatatga

SEQ ID NO: 816346 - DNA, 25 bp, Mus musculus
tccctgcaacgttctgtacatatga

SEQ ID NO: 816347 - DNA, 25 bp, Mus musculus
tccctgcacgggagactgaacctag

SEQ ID NO: 816348 - DNA, 25 bp, Mus musculus
tccctgcacgggtgactgaacctag

SEQ ID NO: 816349 - DNA, 25 bp, Mus musculus
tccctgcactgactcctatgtttga

SEQ ID NO: 816350 - DNA, 25 bp, Mus musculus
tccctgcactgagtcctatgtttga

SEQ ID NO: 816351 - DNA, 25 bp, Mus musculus
tccctgcactgcaggatattttata

SEQ ID NO: 816352 - DNA, 25 bp, Mus musculus
tccctgcactgctggatattttata

SEQ ID NO: 816353 - DNA, 25 bp, Mus musculus
tccctgcagagtctcaggtagcctt

SEQ ID NO: 816354 - DNA, 25 bp, Mus musculus
tccctgcagagtgtcaggtagcctt

SEQ ID NO: 816355 - DNA, 25 bp, Mus musculus
tccctgcagccacagttatagacag

SEQ ID NO: 816356 - DNA, 25 bp, Mus musculus
tccctgcagccagagttatagacag

SEQ ID NO: 816357 - DNA, 25 bp, Mus musculus
tccctgcatggaaagttctgggcca

SEQ ID NO: 816358 - DNA, 25 bp, Mus musculus
tccctgcatggatagttctgggcca

SEQ ID NO: 816359 - DNA, 25 bp, Mus musculus
tccctgccacaaaatcatttgccaa

SEQ ID NO: 816360 - DNA, 25 bp, Mus musculus
tccctgccacaatatcatttgccaa

SEQ ID NO: 816361 - DNA, 25 bp, Mus musculus
tccctgccacacaaggaactgtagg

SEQ ID NO: 816362 - DNA, 25 bp, Mus musculus
tccctgccacactaggaactgtagg

SEQ ID NO: 816363 - DNA, 25 bp, Mus musculus
tccctgccacttctcagtagatgtg

SEQ ID NO: 816364 - DNA, 25 bp, Mus musculus
tccctgccacttgtcagtagatgtg

SEQ ID NO: 816365 - DNA, 25 bp, Mus musculus
tccctgccagatctaaagcgaagct

SEQ ID NO: 816366 - DNA, 25 bp, Mus musculus
tccctgccagatctctgcagaagaa

SEQ ID NO: 816367 - DNA, 25 bp, Mus musculus
tccctgccagatgtaaagcgaagct

SEQ ID NO: 816368 - DNA, 25 bp, Mus musculus
tccctgccagatgtctgcagaagaa

SEQ ID NO: 816369 - DNA, 25 bp, Mus musculus
tccctgccaggacaatatactaaaa

SEQ ID NO: 816370 - DNA, 25 bp, Mus musculus
tccctgccaggacagacccatgtaa

SEQ ID NO: 816371 - DNA, 25 bp, Mus musculus
tccctgccaggagaatatactaaaa

SEQ ID NO: 816372 - DNA, 25 bp, Mus musculus
tccctgccaggagagacccatgtaa

SEQ ID NO: 816373 - DNA, 25 bp, Mus musculus
tccctgccaggcacagacatattat

SEQ ID NO: 816374 - DNA, 25 bp, Mus musculus
tccctgccaggcatcctgctttgtg

SEQ ID NO: 816375 - DNA, 25 bp, Mus musculus
tccctgccaggctcagacatattat

SEQ ID NO: 816376 - DNA, 25 bp, Mus musculus
tccctgccaggcttcctgctttgtg

SEQ ID NO: 816377 - DNA, 25 bp, Mus musculus
tccctgcccaagcaagaagggtcta

SEQ ID NO: 816378 - DNA, 25 bp, Mus musculus
tccctgcccaaggaagaagggtcta

SEQ ID NO: 816379 - DNA, 25 bp, Mus musculus
tccctgcccacacagaaactagtgt

SEQ ID NO: 816380 - DNA, 25 bp, Mus musculus
tccctgcccacagagaaactagtgt

SEQ ID NO: 816381 - DNA, 25 bp, Mus musculus
tccctgcccatactttccataagga

SEQ ID NO: 816382 - DNA, 25 bp, Mus musculus
tccctgcccatagtttccataagga

SEQ ID NO: 816383 - DNA, 25 bp, Mus musculus
tccctgcccatgattgtcagcgtga

SEQ ID NO: 816384 - DNA, 25 bp, Mus musculus
tccctgcccatgtttgtcagcgtga

SEQ ID NO: 816385 - DNA, 25 bp, Mus musculus
tccctgccccgtagacatgaggtga

SEQ ID NO: 816386 - DNA, 25 bp, Mus musculus
tccctgccccgttgacatgaggtga

SEQ ID NO: 816387 - DNA, 25 bp, Mus musculus
tccctgcccctgcaaagaagagaac

SEQ ID NO: 816388 - DNA, 25 bp, Mus musculus
tccctgcccctggaaagaagagaac

SEQ ID NO: 816389 - DNA, 25 bp, Mus musculus
tccctgccctttcattgcttgatga

SEQ ID NO: 816390 - DNA, 25 bp, Mus musculus
tccctgccctttgattgcttgatga

SEQ ID NO: 816391 - DNA, 25 bp, Mus musculus
tccctgccgcagactgtagtgcaaa

SEQ ID NO: 816392 - DNA, 25 bp, Mus musculus
tccctgccgcagtctgtagtgcaaa

SEQ ID NO: 816393 - DNA, 25 bp, Mus musculus
tccctgccgctcatgaagaatcata

SEQ ID NO: 816394 - DNA, 25 bp, Mus musculus
tccctgccgctcttgaagaatcata

SEQ ID NO: 816395 - DNA, 25 bp, Mus musculus
tccctgcctatgaaggcttcttttt

SEQ ID NO: 816396 - DNA, 25 bp, Mus musculus
tccctgcctatgtaggcttcttttt

SEQ ID NO: 816397 - DNA, 25 bp, Mus musculus
tccctgcctattccctgcagatcaa

SEQ ID NO: 816398 - DNA, 25 bp, Mus musculus
tccctgcctattgcctgcagatcaa

SEQ ID NO: 816399 - DNA, 25 bp, Mus musculus
tccctgcgatctcgctggcttggat

SEQ ID NO: 816400 - DNA, 25 bp, Mus musculus
tccctgcgatctggctggcttggat

SEQ ID NO: 816401 - DNA, 25 bp, Mus musculus
tccctgcgttgaagccgagccctga

SEQ ID NO: 816402 - DNA, 25 bp, Mus musculus
tccctgcgttgatgccgagccctga

SEQ ID NO: 816403 - DNA, 25 bp, Mus musculus
tccctgctctggcaaaagggctaac

SEQ ID NO: 816404 - DNA, 25 bp, Mus musculus
tccctgctctgggaaaagggctaac

SEQ ID NO: 816405 - DNA, 25 bp, Mus musculus
tccctgctgaccatatcatttgttt

SEQ ID NO: 816406 - DNA, 25 bp, Mus musculus
tccctgctgaccttatcatttgttt

SEQ ID NO: 816407 - DNA, 25 bp, Mus musculus
tccctgctgctgcacaatgatgtgt

SEQ ID NO: 816408 - DNA, 25 bp, Mus musculus
tccctgctgctggacaatgatgtgt

SEQ ID NO: 816409 - DNA, 25 bp, Mus musculus
tccctgctggatacaaagaatttat

SEQ ID NO: 816410 - DNA, 25 bp, Mus musculus
tccctgctggattcaaagaatttat

SEQ ID NO: 816411 - DNA, 25 bp, Mus musculus
tccctgctggtgaggctaactgaat

SEQ ID NO: 816412 - DNA, 25 bp, Mus musculus
tccctgctggtgtggctaactgaat

SEQ ID NO: 816413 - DNA, 25 bp, Mus musculus
tccctgctgtaccttgtactaatga

SEQ ID NO: 816414 - DNA, 25 bp, Mus musculus
tccctgctgtacgttgtactaatga

SEQ ID NO: 816415 - DNA, 25 bp, Mus musculus
tccctgcttagccaaaatgatgccc

SEQ ID NO: 816416 - DNA, 25 bp, Mus musculus
tccctgcttagcgaaaatgatgccc

SEQ ID NO: 816417 - DNA, 25 bp, Mus musculus
tccctgcttcaacttaccaaggaag

SEQ ID NO: 816418 - DNA, 25 bp, Mus musculus
tccctgcttcaagttaccaaggaag

SEQ ID NO: 816419 - DNA, 25 bp, Mus musculus
tccctgcttctcagagtgggatggt

SEQ ID NO: 816420 - DNA, 25 bp, Mus musculus
tccctgcttctctgagtgggatggt

SEQ ID NO: 816421 - DNA, 25 bp, Mus musculus
tccctggaaaagatgctgcttcata

SEQ ID NO: 816422 - DNA, 25 bp, Mus musculus
tccctggaaaagttgctgcttcata

SEQ ID NO: 816423 - DNA, 25 bp, Mus musculus
tccctggaacagcaatggctcccat

SEQ ID NO: 816424 - DNA, 25 bp, Mus musculus
tccctggaacaggaatggctcccat

SEQ ID NO: 816425 - DNA, 25 bp, Mus musculus
tccctggaataacattcagaatcta

SEQ ID NO: 816426 - DNA, 25 bp, Mus musculus
tccctggaataagattcagaatcta

SEQ ID NO: 816427 - DNA, 25 bp, Mus musculus
tccctggaattgcacaagagcttgg

SEQ ID NO: 816428 - DNA, 25 bp, Mus musculus
tccctggaattggacaagagcttgg

SEQ ID NO: 816429 - DNA, 25 bp, Mus musculus
tccctggacctacgagacaccggag

SEQ ID NO: 816430 - DNA, 25 bp, Mus musculus
tccctggacctaggagacaccggag

SEQ ID NO: 816431 - DNA, 25 bp, Mus musculus
tccctggactcacagcggaaggaaa

SEQ ID NO: 816432 - DNA, 25 bp, Mus musculus
tccctggactcagagcggaaggaaa

SEQ ID NO: 816433 - DNA, 25 bp, Mus musculus
tccctggactgcatcgtagttttga

SEQ ID NO: 816434 - DNA, 25 bp, Mus musculus
tccctggactgcttcgtagttttga

SEQ ID NO: 816435 - DNA, 25 bp, Mus musculus
tccctggagaaaattgcttcatcat

SEQ ID NO: 816436 - DNA, 25 bp, Mus musculus
tccctggagaaatttgcttcatcat

SEQ ID NO: 816437 - DNA, 25 bp, Mus musculus
tccctggagaagcttcctgtgctca

SEQ ID NO: 816438 - DNA, 25 bp, Mus musculus
tccctggagaaggttcctgtgctca

SEQ ID NO: 816439 - DNA, 25 bp, Mus musculus
tccctggagagcagctgatcgtggt

SEQ ID NO: 816440 - DNA, 25 bp, Mus musculus
tccctggagagcatgcacgggtttg

SEQ ID NO: 816441 - DNA, 25 bp, Mus musculus
tccctggagagctgctgatcgtggt

SEQ ID NO: 816442 - DNA, 25 bp, Mus musculus
tccctggagagcttgcacgggtttg

SEQ ID NO: 816443 - DNA, 25 bp, Mus musculus
tccctggagctacagtcatagatgg

SEQ ID NO: 816444 - DNA, 25 bp, Mus musculus
tccctggagctagagtcatagatgg

SEQ ID NO: 816445 - DNA, 25 bp, Mus musculus
tccctggagctcagtggtcagtaag

SEQ ID NO: 816446 - DNA, 25 bp, Mus musculus
tccctggagctctgtggtcagtaag

SEQ ID NO: 816447 - DNA, 25 bp, Mus musculus
tccctggaggcgcaaatgtttatta

SEQ ID NO: 816448 - DNA, 25 bp, Mus musculus
tccctggaggcggaaatgtttatta

SEQ ID NO: 816449 - DNA, 25 bp, Mus musculus
tccctggagtgaccaggatcttccc

SEQ ID NO: 816450 - DNA, 25 bp, Mus musculus
tccctggagtgagcaggatcttccc

SEQ ID NO: 816451 - DNA, 25 bp, Mus musculus
tccctggatccacatgtgtagcatg

SEQ ID NO: 816452 - DNA, 25 bp, Mus musculus
tccctggatccagatgtgtagcatg

SEQ ID NO: 816453 - DNA, 25 bp, Mus musculus
tccctggatcccagtggattttgaa

SEQ ID NO: 816454 - DNA, 25 bp, Mus musculus
tccctggatccctgtggattttgaa

SEQ ID NO: 816455 - DNA, 25 bp, Mus musculus
tccctggattcccttctaatcattg

SEQ ID NO: 816456 - DNA, 25 bp, Mus musculus
tccctggattccgttctaatcattg

SEQ ID NO: 816457 - DNA, 25 bp, Mus musculus
tccctggattgtatgtgtatctgct

SEQ ID NO: 816458 - DNA, 25 bp, Mus musculus
tccctggattgtttgtgtatctgct

SEQ ID NO: 816459 - DNA, 25 bp, Mus musculus
tccctggcaccacagaaggtcattt

SEQ ID NO: 816460 - DNA, 25 bp, Mus musculus
tccctggcaccagagaaggtcattt

SEQ ID NO: 816461 - DNA, 25 bp, Mus musculus
tccctggcacggctacggtgtagtt

SEQ ID NO: 816462 - DNA, 25 bp, Mus musculus
tccctggcacgggtacggtgtagtt

SEQ ID NO: 816463 - DNA, 25 bp, Mus musculus
tccctggcactactagagtatagaa

SEQ ID NO: 816464 - DNA, 25 bp, Mus musculus
tccctggcactagtagagtatagaa

SEQ ID NO: 816465 - DNA, 25 bp, Mus musculus
tccctggcactccattgattcaatg

SEQ ID NO: 816466 - DNA, 25 bp, Mus musculus
tccctggcactcgattgattcaatg

SEQ ID NO: 816467 - DNA, 25 bp, Mus musculus
tccctggcagatcagtttaaagaac

SEQ ID NO: 816468 - DNA, 25 bp, Mus musculus
tccctggcagatgagtttaaagaac

SEQ ID NO: 816469 - DNA, 25 bp, Mus musculus
tccctggcagtgatcatcaagcttt

SEQ ID NO: 816470 - DNA, 25 bp, Mus musculus
tccctggcagtgttcatcaagcttt

SEQ ID NO: 816471 - DNA, 25 bp, Mus musculus
tccctggcagttaatatgacctcct

SEQ ID NO: 816472 - DNA, 25 bp, Mus musculus
tccctggcagtttatatgacctcct

SEQ ID NO: 816473 - DNA, 25 bp, Mus musculus
tccctggccaccatgtagcaataaa

SEQ ID NO: 816474 - DNA, 25 bp, Mus musculus
tccctggccaccttgtagcaataaa

SEQ ID NO: 816475 - DNA, 25 bp, Mus musculus
tccctggccatcatgttgtgtttgt

SEQ ID NO: 816476 - DNA, 25 bp, Mus musculus
tccctggccatcttgttgtgtttgt

SEQ ID NO: 816477 - DNA, 25 bp, Mus musculus
tccctggcccagatgtagtgttaaa

SEQ ID NO: 816478 - DNA, 25 bp, Mus musculus
tccctggcccagttgtagtgttaaa

SEQ ID NO: 816479 - DNA, 25 bp, Mus musculus
tccctggccctcacacagtggaaga

SEQ ID NO: 816480 - DNA, 25 bp, Mus musculus
tccctggccctctcacagtggaaga

SEQ ID NO: 816481 - DNA, 25 bp, Mus musculus
tccctggccgcaatgctgcaataag

SEQ ID NO: 816482 - DNA, 25 bp, Mus musculus
tccctggccgcattgctgcaataag

SEQ ID NO: 816483 - DNA, 25 bp, Mus musculus
tccctggcggacaagatggctatgc

SEQ ID NO: 816484 - DNA, 25 bp, Mus musculus
tccctggcggactagatggctatgc

SEQ ID NO: 816485 - DNA, 25 bp, Mus musculus
tccctggctacacctgaagacaagg

SEQ ID NO: 816486 - DNA, 25 bp, Mus musculus
tccctggctacagctgaagacaagg

SEQ ID NO: 816487 - DNA, 25 bp, Mus musculus
tccctggctagaaatgtagtttctt

SEQ ID NO: 816488 - DNA, 25 bp, Mus musculus
tccctggctagatatgtagtttctt

SEQ ID NO: 816489 - DNA, 25 bp, Mus musculus
tccctggctctgaggacgatgaggt

SEQ ID NO: 816490 - DNA, 25 bp, Mus musculus
tccctggctctgtggacgatgaggt

SEQ ID NO: 816491 - DNA, 25 bp, Mus musculus
tccctggctgctaaggtcagtggac

SEQ ID NO: 816492 - DNA, 25 bp, Mus musculus
tccctggctgcttaggtcagtggac

SEQ ID NO: 816493 - DNA, 25 bp, Mus musculus
tccctggcttatcttgcaaactgtt

SEQ ID NO: 816494 - DNA, 25 bp, Mus musculus
tccctggcttatgttgcaaactgtt

SEQ ID NO: 816495 - DNA, 25 bp, Mus musculus
tccctggcttgtcttctaacgtttt

SEQ ID NO: 816496 - DNA, 25 bp, Mus musculus
tccctggcttgtgttctaacgtttt

SEQ ID NO: 816497 - DNA, 25 bp, Mus musculus
tccctgggaaatctgccctccaagg

SEQ ID NO: 816498 - DNA, 25 bp, Mus musculus
tccctgggaaatgtgccctccaagg

SEQ ID NO: 816499 - DNA, 25 bp, Mus musculus
tccctgggaacaacgtgaaagcctt

SEQ ID NO: 816500 - DNA, 25 bp, Mus musculus
tccctgggaacatcgtgaaagcctt

SEQ ID NO: 816501 - DNA, 25 bp, Mus musculus
tccctgggaattactatccatttta

SEQ ID NO: 816502 - DNA, 25 bp, Mus musculus
tccctgggaatttctatccatttta

SEQ ID NO: 816503 - DNA, 25 bp, Mus musculus
tccctgggaccgatgttcataattg

SEQ ID NO: 816504 - DNA, 25 bp, Mus musculus
tccctgggaccgttgttcataattg

SEQ ID NO: 816505 - DNA, 25 bp, Mus musculus
tccctgggacctaatcacccattaa

SEQ ID NO: 816506 - DNA, 25 bp, Mus musculus
tccctgggaccttatcacccattaa

SEQ ID NO: 816507 - DNA, 25 bp, Mus musculus
tccctgggactcaagacctgtggta

SEQ ID NO: 816508 - DNA, 25 bp, Mus musculus
tccctgggactctagacctgtggta

SEQ ID NO: 816509 - DNA, 25 bp, Mus musculus
tccctgggagccatctgtaaggttt

SEQ ID NO: 816510 - DNA, 25 bp, Mus musculus
tccctgggagccttctgtaaggttt

SEQ ID NO: 816511 - DNA, 25 bp, Mus musculus
tccctgggaggtagcttggaccagt

SEQ ID NO: 816512 - DNA, 25 bp, Mus musculus
tccctgggaggttgcttggaccagt

SEQ ID NO: 816513 - DNA, 25 bp, Mus musculus
tccctgggctcactttcccagtgag

SEQ ID NO: 816514 - DNA, 25 bp, Mus musculus
tccctgggctcagtttcccagtgag

SEQ ID NO: 816515 - DNA, 25 bp, Mus musculus
tccctgggctccaggagaaccacat

SEQ ID NO: 816516 - DNA, 25 bp, Mus musculus
tccctgggctcctggagaaccacat

SEQ ID NO: 816517 - DNA, 25 bp, Mus musculus
tccctgggctgacgatgacggctcc

SEQ ID NO: 816518 - DNA, 25 bp, Mus musculus
tccctgggctgaggatgacggctcc

SEQ ID NO: 816519 - DNA, 25 bp, Mus musculus
tccctgggttggcagagacttgaaa

SEQ ID NO: 816520 - DNA, 25 bp, Mus musculus
tccctgggttgggagagacttgaaa

SEQ ID NO: 816521 - DNA, 25 bp, Mus musculus
tccctggtatccatgcaggttggtt

SEQ ID NO: 816522 - DNA, 25 bp, Mus musculus
tccctggtatccttgcaggttggtt

SEQ ID NO: 816523 - DNA, 25 bp, Mus musculus
tccctggtctagcacagccagtggg

SEQ ID NO: 816524 - DNA, 25 bp, Mus musculus
tccctggtctaggacagccagtggg

SEQ ID NO: 816525 - DNA, 25 bp, Mus musculus
tccctggtcttgatttcattgtgaa

SEQ ID NO: 816526 - DNA, 25 bp, Mus musculus
tccctggtcttgttttcattgtgaa

SEQ ID NO: 816527 - DNA, 25 bp, Mus musculus
tccctggtgaaacggctgtaaggtt

SEQ ID NO: 816528 - DNA, 25 bp, Mus musculus
tccctggtgaaagggctgtaaggtt

SEQ ID NO: 816529 - DNA, 25 bp, Mus musculus
tccctggtgattccagcctgatgac

SEQ ID NO: 816530 - DNA, 25 bp, Mus musculus
tccctggtgattgcagcctgatgac

SEQ ID NO: 816531 - DNA, 25 bp, Mus musculus
tccctggtgcaaatgtcgtggcagt

SEQ ID NO: 816532 - DNA, 25 bp, Mus musculus
tccctggtgcaattgtcgtggcagt

SEQ ID NO: 816533 - DNA, 25 bp, Mus musculus
tccctggtgctacaggccaatcgcg

SEQ ID NO: 816534 - DNA, 25 bp, Mus musculus
tccctggtgctagaggccaatcgcg

SEQ ID NO: 816535 - DNA, 25 bp, Mus musculus
tccctggtgctcactgaaaattcta

SEQ ID NO: 816536 - DNA, 25 bp, Mus musculus
tccctggtgctctctgaaaattcta

SEQ ID NO: 816537 - DNA, 25 bp, Mus musculus
tccctggtggagcgagatgacccat

SEQ ID NO: 816538 - DNA, 25 bp, Mus musculus
tccctggtggagggagatgacccat

SEQ ID NO: 816539 - DNA, 25 bp, Mus musculus
tccctggtggctatctgaagaatcg

SEQ ID NO: 816540 - DNA, 25 bp, Mus musculus
tccctggtggctttctgaagaatcg

SEQ ID NO: 816541 - DNA, 25 bp, Mus musculus
tccctggtggtaactgttcttatta

SEQ ID NO: 816542 - DNA, 25 bp, Mus musculus
tccctggtggtatctgttcttatta

SEQ ID NO: 816543 - DNA, 25 bp, Mus musculus
tccctggtggttcccattggagaga

SEQ ID NO: 816544 - DNA, 25 bp, Mus musculus
tccctggtggttgccattggagaga

SEQ ID NO: 816545 - DNA, 25 bp, Mus musculus
tccctggttcatccctagggaggga

SEQ ID NO: 816546 - DNA, 25 bp, Mus musculus
tccctggttcatgcctagggaggga

SEQ ID NO: 816547 - DNA, 25 bp, Mus musculus
tccctggttctgcacaactgcatta

SEQ ID NO: 816548 - DNA, 25 bp, Mus musculus
tccctggttctggacaactgcatta

SEQ ID NO: 816549 - DNA, 25 bp, Mus musculus
tccctggttggtctgctgagtcaca

SEQ ID NO: 816550 - DNA, 25 bp, Mus musculus
tccctggttggtgtgctgagtcaca

SEQ ID NO: 816551 - DNA, 25 bp, Mus musculus
tccctgtaagaaccaagcccatgtg

SEQ ID NO: 816552 - DNA, 25 bp, Mus musculus
tccctgtaagaagcaagcccatgtg

SEQ ID NO: 816553 - DNA, 25 bp, Mus musculus
tccctgtaccatccaatgatctcgg

SEQ ID NO: 816554 - DNA, 25 bp, Mus musculus
tccctgtaccatgcaatgatctcgg

SEQ ID NO: 816555 - DNA, 25 bp, Mus musculus
tccctgtacttcaccaagacttttt

SEQ ID NO: 816556 - DNA, 25 bp, Mus musculus
tccctgtacttctccaagacttttt

SEQ ID NO: 816557 - DNA, 25 bp, Mus musculus
tccctgtagccacccctgaggagca

SEQ ID NO: 816558 - DNA, 25 bp, Mus musculus
tccctgtagccagccctgaggagca

SEQ ID NO: 816559 - DNA, 25 bp, Mus musculus
tccctgtaggtgcaacaacattatg

SEQ ID NO: 816560 - DNA, 25 bp, Mus musculus
tccctgtaggtggaacaacattatg

SEQ ID NO: 816561 - DNA, 25 bp, Mus musculus
tccctgtagttcctaggcatctgac

SEQ ID NO: 816562 - DNA, 25 bp, Mus musculus
tccctgtagttcgtaggcatctgac

SEQ ID NO: 816563 - DNA, 25 bp, Mus musculus
tccctgtatgaacccgaacagctgg

SEQ ID NO: 816564 - DNA, 25 bp, Mus musculus
tccctgtatgaagccgaacagctgg

SEQ ID NO: 816565 - DNA, 25 bp, Mus musculus
tccctgtatgtgcctttctttcagc

SEQ ID NO: 816566 - DNA, 25 bp, Mus musculus
tccctgtatgtggctttctttcagc

SEQ ID NO: 816567 - DNA, 25 bp, Mus musculus
tccctgtcaatcattcacctaaagt

SEQ ID NO: 816568 - DNA, 25 bp, Mus musculus
tccctgtcaatctttcacctaaagt

SEQ ID NO: 816569 - DNA, 25 bp, Mus musculus
tccctgtcacagattctccatgaat

SEQ ID NO: 816570 - DNA, 25 bp, Mus musculus
tccctgtcacagcaaaagatttacc

SEQ ID NO: 816571 - DNA, 25 bp, Mus musculus
tccctgtcacaggaaaagatttacc

SEQ ID NO: 816572 - DNA, 25 bp, Mus musculus
tccctgtcacagtttctccatgaat

SEQ ID NO: 816573 - DNA, 25 bp, Mus musculus
tccctgtcacttctactgttcctag

SEQ ID NO: 816574 - DNA, 25 bp, Mus musculus
tccctgtcacttgtactgttcctag

SEQ ID NO: 816575 - DNA, 25 bp, Mus musculus
tccctgtcatctagaattctcttca

SEQ ID NO: 816576 - DNA, 25 bp, Mus musculus
tccctgtcatcttgaattctcttca

SEQ ID NO: 816577 - DNA, 25 bp, Mus musculus
tccctgtccatacctcaaattgatt

SEQ ID NO: 816578 - DNA, 25 bp, Mus musculus
tccctgtccatagctcaaattgatt

SEQ ID NO: 816579 - DNA, 25 bp, Mus musculus
tccctgtccccaattctttattgta

SEQ ID NO: 816580 - DNA, 25 bp, Mus musculus
tccctgtccccatttctttattgta

SEQ ID NO: 816581 - DNA, 25 bp, Mus musculus
tccctgtcccggctggtggcagaga

SEQ ID NO: 816582 - DNA, 25 bp, Mus musculus
tccctgtcccgggtggtggcagaga

SEQ ID NO: 816583 - DNA, 25 bp, Mus musculus
tccctgtccgacattcacaaaatat

SEQ ID NO: 816584 - DNA, 25 bp, Mus musculus
tccctgtccgactttcacaaaatat

SEQ ID NO: 816585 - DNA, 25 bp, Mus musculus
tccctgtcctcaagcttggttggaa

SEQ ID NO: 816586 - DNA, 25 bp, Mus musculus
tccctgtcctcatgcttggttggaa

SEQ ID NO: 816587 - DNA, 25 bp, Mus musculus
tccctgtcctgtaaagtacccagag

SEQ ID NO: 816588 - DNA, 25 bp, Mus musculus
tccctgtcctgttaagtacccagag

SEQ ID NO: 816589 - DNA, 25 bp, Mus musculus
tccctgtccttgatctgataatgta

SEQ ID NO: 816590 - DNA, 25 bp, Mus musculus
tccctgtccttgttctgataatgta

SEQ ID NO: 816591 - DNA, 25 bp, Mus musculus
tccctgtctatcacaaggattcttg

SEQ ID NO: 816592 - DNA, 25 bp, Mus musculus
tccctgtctatctcaaggattcttg

SEQ ID NO: 816593 - DNA, 25 bp, Mus musculus
tccctgtctcagagtagaagtgcct

SEQ ID NO: 816594 - DNA, 25 bp, Mus musculus
tccctgtctcagtgtagaagtgcct

SEQ ID NO: 816595 - DNA, 25 bp, Mus musculus
tccctgtctctgatgacaggtcagc

SEQ ID NO: 816596 - DNA, 25 bp, Mus musculus
tccctgtctctgttgacaggtcagc

SEQ ID NO: 816597 - DNA, 25 bp, Mus musculus
tccctgtctcttaattttgtgacca

SEQ ID NO: 816598 - DNA, 25 bp, Mus musculus
tccctgtctctttattttgtgacca

SEQ ID NO: 816599 - DNA, 25 bp, Mus musculus
tccctgtctgtccttaggttatttg

SEQ ID NO: 816600 - DNA, 25 bp, Mus musculus
tccctgtctgtcgttaggttatttg

SEQ ID NO: 816601 - DNA, 25 bp, Mus musculus
tccctgtctgttcgatgtggagcct

SEQ ID NO: 816602 - DNA, 25 bp, Mus musculus
tccctgtctgttggatgtggagcct

SEQ ID NO: 816603 - DNA, 25 bp, Mus musculus
tccctgtctttgagattccagctca

SEQ ID NO: 816604 - DNA, 25 bp, Mus musculus
tccctgtctttgtgattccagctca

SEQ ID NO: 816605 - DNA, 25 bp, Mus musculus
tccctgtgaaccctatcatccagag

SEQ ID NO: 816606 - DNA, 25 bp, Mus musculus
tccctgtgaaccgtatcatccagag

SEQ ID NO: 816607 - DNA, 25 bp, Mus musculus
tccctgtgaagacagcgttgtgtat

SEQ ID NO: 816608 - DNA, 25 bp, Mus musculus
tccctgtgaagagagcgttgtgtat

SEQ ID NO: 816609 - DNA, 25 bp, Mus musculus
tccctgtgagctatgggttcagtgt

SEQ ID NO: 816610 - DNA, 25 bp, Mus musculus
tccctgtgagctctgtggctacagg

SEQ ID NO: 816611 - DNA, 25 bp, Mus musculus
tccctgtgagctgtgtggctacagg

SEQ ID NO: 816612 - DNA, 25 bp, Mus musculus
tccctgtgagctttgggttcagtgt

SEQ ID NO: 816613 - DNA, 25 bp, Mus musculus
tccctgtgaggcatttacttatttt

SEQ ID NO: 816614 - DNA, 25 bp, Mus musculus
tccctgtgaggcttttacttatttt

SEQ ID NO: 816615 - DNA, 25 bp, Mus musculus
tccctgtgagtcagcgggctcaaag

SEQ ID NO: 816616 - DNA, 25 bp, Mus musculus
tccctgtgagtctgcgggctcaaag

SEQ ID NO: 816617 - DNA, 25 bp, Mus musculus
tccctgtgatgtaattagctgtgac

SEQ ID NO: 816618 - DNA, 25 bp, Mus musculus
tccctgtgatgtctgatggctttga

SEQ ID NO: 816619 - DNA, 25 bp, Mus musculus
tccctgtgatgtgtgatggctttga

SEQ ID NO: 816620 - DNA, 25 bp, Mus musculus
tccctgtgatgttattagctgtgac

SEQ ID NO: 816621 - DNA, 25 bp, Mus musculus
tccctgtgcagcatctgagaggaga

SEQ ID NO: 816622 - DNA, 25 bp, Mus musculus
tccctgtgcagcttctgagaggaga

SEQ ID NO: 816623 - DNA, 25 bp, Mus musculus
tccctgtgccaactgacaagcactg

SEQ ID NO: 816624 - DNA, 25 bp, Mus musculus
tccctgtgccaagtgacaagcactg

SEQ ID NO: 816625 - DNA, 25 bp, Mus musculus
tccctgtgcctacaagggttcagaa

SEQ ID NO: 816626 - DNA, 25 bp, Mus musculus
tccctgtgcctagaagggttcagaa

SEQ ID NO: 816627 - DNA, 25 bp, Mus musculus
tccctgtgctgtccccatttataag

SEQ ID NO: 816628 - DNA, 25 bp, Mus musculus
tccctgtgctgtgcccatttataag

SEQ ID NO: 816629 - DNA, 25 bp, Mus musculus
tccctgtggcagcatcagcgacaat

SEQ ID NO: 816630 - DNA, 25 bp, Mus musculus
tccctgtggcaggatcagcgacaat

SEQ ID NO: 816631 - DNA, 25 bp, Mus musculus
tccctgtgggatctctgttacacac

SEQ ID NO: 816632 - DNA, 25 bp, Mus musculus
tccctgtgggatgtctgttacacac

SEQ ID NO: 816633 - DNA, 25 bp, Mus musculus
tccctgtgggtcagtagcaacttgt

SEQ ID NO: 816634 - DNA, 25 bp, Mus musculus
tccctgtgggtctgtagcaacttgt

SEQ ID NO: 816635 - DNA, 25 bp, Mus musculus
tccctgtggtagaccagattcaaca

SEQ ID NO: 816636 - DNA, 25 bp, Mus musculus
tccctgtggtagtccagattcaaca

SEQ ID NO: 816637 - DNA, 25 bp, Mus musculus
tccctgtgtagcagccaaaagaaaa

SEQ ID NO: 816638 - DNA, 25 bp, Mus musculus
tccctgtgtagctgccaaaagaaaa

SEQ ID NO: 816639 - DNA, 25 bp, Mus musculus
tccctgtgtccactgctgataagca

SEQ ID NO: 816640 - DNA, 25 bp, Mus musculus
tccctgtgtccagtgctgataagca

SEQ ID NO: 816641 - DNA, 25 bp, Mus musculus
tccctgtgtctgaactttccattgt

SEQ ID NO: 816642 - DNA, 25 bp, Mus musculus
tccctgtgtctgtactttccattgt

SEQ ID NO: 816643 - DNA, 25 bp, Mus musculus
tccctgtgtggtctgagtctcagac

SEQ ID NO: 816644 - DNA, 25 bp, Mus musculus
tccctgtgtggtgtgagtctcagac

SEQ ID NO: 816645 - DNA, 25 bp, Mus musculus
tccctgtgtgtgcaccataatgctg

SEQ ID NO: 816646 - DNA, 25 bp, Mus musculus
tccctgtgtgtggaccataatgctg

SEQ ID NO: 816647 - DNA, 25 bp, Mus musculus
tccctgtgtgttagtgggcgccaca

SEQ ID NO: 816648 - DNA, 25 bp, Mus musculus
tccctgtgtgtttgtgggcgccaca

SEQ ID NO: 816649 - DNA, 25 bp, Mus musculus
tccctgtgttgtcttggatgcacag

SEQ ID NO: 816650 - DNA, 25 bp, Mus musculus
tccctgtgttgtgttggatgcacag

SEQ ID NO: 816651 - DNA, 25 bp, Mus musculus
tccctgttacagctcagaccgcaga

SEQ ID NO: 816652 - DNA, 25 bp, Mus musculus
tccctgttacaggtcagaccgcaga

SEQ ID NO: 816653 - DNA, 25 bp, Mus musculus
tccctgttatacagagtcaaatcca

SEQ ID NO: 816654 - DNA, 25 bp, Mus musculus
tccctgttatactgagtcaaatcca

SEQ ID NO: 816655 - DNA, 25 bp, Mus musculus
tccctgttccaacttgaggagcatg

SEQ ID NO: 816656 - DNA, 25 bp, Mus musculus
tccctgttccaagttgaggagcatg

SEQ ID NO: 816657 - DNA, 25 bp, Mus musculus
tccctgttcccacttgagctgcttt

SEQ ID NO: 816658 - DNA, 25 bp, Mus musculus
tccctgttcccagttgagctgcttt

SEQ ID NO: 816659 - DNA, 25 bp, Mus musculus
tccctgttgagccattttgttggtc

SEQ ID NO: 816660 - DNA, 25 bp, Mus musculus
tccctgttgagcgattttgttggtc

SEQ ID NO: 816661 - DNA, 25 bp, Mus musculus
tccctgttggcgatctagcggtgtc

SEQ ID NO: 816662 - DNA, 25 bp, Mus musculus
tccctgttggcgttctagcggtgtc

SEQ ID NO: 816663 - DNA, 25 bp, Mus musculus
tccctgttgggaatgtatcatttga

SEQ ID NO: 816664 - DNA, 25 bp, Mus musculus
tccctgttgggattgtatcatttga

SEQ ID NO: 816665 - DNA, 25 bp, Mus musculus
tccctgttggtcctgctaagtggct

SEQ ID NO: 816666 - DNA, 25 bp, Mus musculus
tccctgttggtcgtgctaagtggct

SEQ ID NO: 816667 - DNA, 25 bp, Mus musculus
tccctgttggttcctgtttcactgg

SEQ ID NO: 816668 - DNA, 25 bp, Mus musculus
tccctgttggttgctgtttcactgg

SEQ ID NO: 816669 - DNA, 25 bp, Mus musculus
tccctgttgtttactaaggagagac

SEQ ID NO: 816670 - DNA, 25 bp, Mus musculus
tccctgttgttttctaaggagagac

SEQ ID NO: 816671 - DNA, 25 bp, Mus musculus
tccctgtttctgcatgcatgttctt

SEQ ID NO: 816672 - DNA, 25 bp, Mus musculus
tccctgtttctggatgcatgttctt

SEQ ID NO: 816673 - DNA, 25 bp, Mus musculus
tccctgtttgagaggtgacccgaca

SEQ ID NO: 816674 - DNA, 25 bp, Mus musculus
tccctgtttgagtggtgacccgaca

SEQ ID NO: 816675 - DNA, 25 bp, Mus musculus
tcccttaaaaaccagagacctgttg

SEQ ID NO: 816676 - DNA, 25 bp, Mus musculus
tcccttaaaaacgagagacctgttg

SEQ ID NO: 816677 - DNA, 25 bp, Mus musculus
tcccttaaaaatctcacatgcacac

SEQ ID NO: 816678 - DNA, 25 bp, Mus musculus
tcccttaaaaatgtcacatgcacac

SEQ ID NO: 816679 - DNA, 25 bp, Mus musculus
tcccttaaatccatactatgatatc

SEQ ID NO: 816680 - DNA, 25 bp, Mus musculus
tcccttaaatccttactatgatatc

SEQ ID NO: 816681 - DNA, 25 bp, Mus musculus
tcccttaaccgaagtgtatccaagc

SEQ ID NO: 816682 - DNA, 25 bp, Mus musculus
tcccttaaccgatgtgtatccaagc

SEQ ID NO: 816683 - DNA, 25 bp, Mus musculus
tcccttaactggacctgagggctga

SEQ ID NO: 816684 - DNA, 25 bp, Mus musculus
tcccttaactggtcctgagggctga

SEQ ID NO: 816685 - DNA, 25 bp, Mus musculus
tcccttaatggtctctccaagcctg

SEQ ID NO: 816686 - DNA, 25 bp, Mus musculus
tcccttaatggtgtctccaagcctg

SEQ ID NO: 816687 - DNA, 25 bp, Mus musculus
tcccttaatttccttgtcagtgagc

SEQ ID NO: 816688 - DNA, 25 bp, Mus musculus
tcccttaatttcgttgtcagtgagc

SEQ ID NO: 816689 - DNA, 25 bp, Mus musculus
tcccttacacgacaggaccagacac

SEQ ID NO: 816690 - DNA, 25 bp, Mus musculus
tcccttacacgagaggaccagacac

SEQ ID NO: 816691 - DNA, 25 bp, Mus musculus
tcccttaccagtattctgcctaatg

SEQ ID NO: 816692 - DNA, 25 bp, Mus musculus
tcccttaccagttttctgcctaatg

SEQ ID NO: 816693 - DNA, 25 bp, Mus musculus
tcccttaccatgaggccgatgagtc

SEQ ID NO: 816694 - DNA, 25 bp, Mus musculus
tcccttaccatgtggccgatgagtc

SEQ ID NO: 816695 - DNA, 25 bp, Mus musculus
tcccttacccctacagcttgtcttt

SEQ ID NO: 816696 - DNA, 25 bp, Mus musculus
tcccttaccccttcagcttgtcttt

SEQ ID NO: 816697 - DNA, 25 bp, Mus musculus
tcccttaccctgcaaaagagcctat

SEQ ID NO: 816698 - DNA, 25 bp, Mus musculus
tcccttaccctggaaaagagcctat

SEQ ID NO: 816699 - DNA, 25 bp, Mus musculus
tcccttaccgagctgggttgaaaca

SEQ ID NO: 816700 - DNA, 25 bp, Mus musculus
tcccttaccgaggtgggttgaaaca

SEQ ID NO: 816701 - DNA, 25 bp, Mus musculus
tcccttacctacactgagttccctt

SEQ ID NO: 816702 - DNA, 25 bp, Mus musculus
tcccttacctactctgagttccctt

SEQ ID NO: 816703 - DNA, 25 bp, Mus musculus
tcccttacctctattgagtcttcag

SEQ ID NO: 816704 - DNA, 25 bp, Mus musculus
tcccttacctcttttgagtcttcag

SEQ ID NO: 816705 - DNA, 25 bp, Mus musculus
tcccttacctggatggaagtggaag

SEQ ID NO: 816706 - DNA, 25 bp, Mus musculus
tcccttacctggttggaagtggaag

SEQ ID NO: 816707 - DNA, 25 bp, Mus musculus
tcccttacgatacatacatagccat

SEQ ID NO: 816708 - DNA, 25 bp, Mus musculus
tcccttacgatagatacatagccat

SEQ ID NO: 816709 - DNA, 25 bp, Mus musculus
tcccttacgggcatgaatatgcata

SEQ ID NO: 816710 - DNA, 25 bp, Mus musculus
tcccttacgggcttgaatatgcata

SEQ ID NO: 816711 - DNA, 25 bp, Mus musculus
tcccttactaacactggcagacatg

SEQ ID NO: 816712 - DNA, 25 bp, Mus musculus
tcccttactaactctggcagacatg

SEQ ID NO: 816713 - DNA, 25 bp, Mus musculus
tcccttactgcccagaatgttagca

SEQ ID NO: 816714 - DNA, 25 bp, Mus musculus
tcccttactgccgagaatgttagca

SEQ ID NO: 816715 - DNA, 25 bp, Mus musculus
tcccttactgtacatagcactccaa

SEQ ID NO: 816716 - DNA, 25 bp, Mus musculus
tcccttactgtagatagcactccaa

SEQ ID NO: 816717 - DNA, 25 bp, Mus musculus
tcccttagaagcctccgtgaagtgt

SEQ ID NO: 816718 - DNA, 25 bp, Mus musculus
tcccttagaagcgtccgtgaagtgt

SEQ ID NO: 816719 - DNA, 25 bp, Mus musculus
tcccttagatcgacgctgaataaat

SEQ ID NO: 816720 - DNA, 25 bp, Mus musculus
tcccttagatcgtcgctgaataaat

SEQ ID NO: 816721 - DNA, 25 bp, Mus musculus
tcccttagcctaagttgtctgacta

SEQ ID NO: 816722 - DNA, 25 bp, Mus musculus
tcccttagcctatgttgtctgacta

SEQ ID NO: 816723 - DNA, 25 bp, Mus musculus
tcccttagcctcctgtgtataaact

SEQ ID NO: 816724 - DNA, 25 bp, Mus musculus
tcccttagcctcgtgtgtataaact

SEQ ID NO: 816725 - DNA, 25 bp, Mus musculus
tcccttagctccattaagtgggtgc

SEQ ID NO: 816726 - DNA, 25 bp, Mus musculus
tcccttagctcctttaagtgggtgc

SEQ ID NO: 816727 - DNA, 25 bp, Mus musculus
tcccttagggctctgggttccagaa

SEQ ID NO: 816728 - DNA, 25 bp, Mus musculus
tcccttagggctgtgggttccagaa

SEQ ID NO: 816729 - DNA, 25 bp, Mus musculus
tcccttagtccccttgagacaagtg

SEQ ID NO: 816730 - DNA, 25 bp, Mus musculus
tcccttagtcccgttgagacaagtg

SEQ ID NO: 816731 - DNA, 25 bp, Mus musculus
tcccttagtgttcttatgtccctct

SEQ ID NO: 816732 - DNA, 25 bp, Mus musculus
tcccttagtgttgttatgtccctct

SEQ ID NO: 816733 - DNA, 25 bp, Mus musculus
tcccttatagaaaatggcatattgt

SEQ ID NO: 816734 - DNA, 25 bp, Mus musculus
tcccttatagaatatggcatattgt

SEQ ID NO: 816735 - DNA, 25 bp, Mus musculus
tcccttatagtgcaccagaggatac

SEQ ID NO: 816736 - DNA, 25 bp, Mus musculus
tcccttatagtggaccagaggatac

SEQ ID NO: 816737 - DNA, 25 bp, Mus musculus
tcccttatatgacgcacccttcagt

SEQ ID NO: 816738 - DNA, 25 bp, Mus musculus
tcccttatatgaggcacccttcagt

SEQ ID NO: 816739 - DNA, 25 bp, Mus musculus
tcccttatcgccacagcgttctaga

SEQ ID NO: 816740 - DNA, 25 bp, Mus musculus
tcccttatcgcctcagcgttctaga

SEQ ID NO: 816741 - DNA, 25 bp, Mus musculus
tcccttatggatagctgtgatccca

SEQ ID NO: 816742 - DNA, 25 bp, Mus musculus
tcccttatggattgctgtgatccca

SEQ ID NO: 816743 - DNA, 25 bp, Mus musculus
tcccttatttctcaatggttccctt

SEQ ID NO: 816744 - DNA, 25 bp, Mus musculus
tcccttatttctgaatggttccctt

SEQ ID NO: 816745 - DNA, 25 bp, Mus musculus
tcccttcaatacacccaaaactaag

SEQ ID NO: 816746 - DNA, 25 bp, Mus musculus
tcccttcaatactcccaaaactaag

SEQ ID NO: 816747 - DNA, 25 bp, Mus musculus
tcccttcaccccaggaggtgagata

SEQ ID NO: 816748 - DNA, 25 bp, Mus musculus
tcccttcacccctggaggtgagata

SEQ ID NO: 816749 - DNA, 25 bp, Mus musculus
tcccttcagatactttgcctgtgaa

SEQ ID NO: 816750 - DNA, 25 bp, Mus musculus
tcccttcagatagtttgcctgtgaa

SEQ ID NO: 816751 - DNA, 25 bp, Mus musculus
tcccttcagctaagacagctggtgt

SEQ ID NO: 816752 - DNA, 25 bp, Mus musculus
tcccttcagctatgacagctggtgt

SEQ ID NO: 816753 - DNA, 25 bp, Mus musculus
tcccttcaggacctcgatacaatgg

SEQ ID NO: 816754 - DNA, 25 bp, Mus musculus
tcccttcaggacgtcgatacaatgg

SEQ ID NO: 816755 - DNA, 25 bp, Mus musculus
tcccttcaggatcctaagtttttgc

SEQ ID NO: 816756 - DNA, 25 bp, Mus musculus
tcccttcaggatgctaagtttttgc

SEQ ID NO: 816757 - DNA, 25 bp, Mus musculus
tcccttcagttgactcccagactga

SEQ ID NO: 816758 - DNA, 25 bp, Mus musculus
tcccttcagttgtctcccagactga

SEQ ID NO: 816759 - DNA, 25 bp, Mus musculus
tcccttcatatcctctattatcaac

SEQ ID NO: 816760 - DNA, 25 bp, Mus musculus
tcccttcatatcgtctattatcaac

SEQ ID NO: 816761 - DNA, 25 bp, Mus musculus
tcccttcattgcctgcatgtaggaa

SEQ ID NO: 816762 - DNA, 25 bp, Mus musculus
tcccttcattgcgtgcatgtaggaa

SEQ ID NO: 816763 - DNA, 25 bp, Mus musculus
tcccttccaagtcagatccctattg

SEQ ID NO: 816764 - DNA, 25 bp, Mus musculus
tcccttccaagtctccgtgtaaata

SEQ ID NO: 816765 - DNA, 25 bp, Mus musculus
tcccttccaagtgagatccctattg

SEQ ID NO: 816766 - DNA, 25 bp, Mus musculus
tcccttccaagtgtccgtgtaaata

SEQ ID NO: 816767 - DNA, 25 bp, Mus musculus
tcccttccaggaaagttccagcaga

SEQ ID NO: 816768 - DNA, 25 bp, Mus musculus
tcccttccaggatagttccagcaga

SEQ ID NO: 816769 - DNA, 25 bp, Mus musculus
tcccttccagtgacagtcaagacat

SEQ ID NO: 816770 - DNA, 25 bp, Mus musculus
tcccttccagtgtcagtcaagacat

SEQ ID NO: 816771 - DNA, 25 bp, Mus musculus
tcccttccatagattagttgtattt

SEQ ID NO: 816772 - DNA, 25 bp, Mus musculus
tcccttccatagtttagttgtattt

SEQ ID NO: 816773 - DNA, 25 bp, Mus musculus
tcccttccatggcaaaggctggctt

SEQ ID NO: 816774 - DNA, 25 bp, Mus musculus
tcccttccatgggaaaggctggctt

SEQ ID NO: 816775 - DNA, 25 bp, Mus musculus
tcccttcccaacacaattatcttgg

SEQ ID NO: 816776 - DNA, 25 bp, Mus musculus
tcccttcccaactcaattatcttgg

SEQ ID NO: 816777 - DNA, 25 bp, Mus musculus
tcccttcccaccatataagtgtgct

SEQ ID NO: 816778 - DNA, 25 bp, Mus musculus
tcccttcccaccttataagtgtgct

SEQ ID NO: 816779 - DNA, 25 bp, Mus musculus
tcccttcccatcagttgagtttgat

SEQ ID NO: 816780 - DNA, 25 bp, Mus musculus
tcccttcccatctgttgagtttgat

SEQ ID NO: 816781 - DNA, 25 bp, Mus musculus
tcccttccccagcagtgataggcaa

SEQ ID NO: 816782 - DNA, 25 bp, Mus musculus
tcccttccccaggagtgataggcaa

SEQ ID NO: 816783 - DNA, 25 bp, Mus musculus
tcccttccctgaagaactttgatgt

SEQ ID NO: 816784 - DNA, 25 bp, Mus musculus
tcccttccctgatgaactttgatgt

SEQ ID NO: 816785 - DNA, 25 bp, Mus musculus
tcccttccctggaactgacagtgta

SEQ ID NO: 816786 - DNA, 25 bp, Mus musculus
tcccttccctggtactgacagtgta

SEQ ID NO: 816787 - DNA, 25 bp, Mus musculus
tcccttcccttgcagattgtgagat

SEQ ID NO: 816788 - DNA, 25 bp, Mus musculus
tcccttcccttggagattgtgagat

SEQ ID NO: 816789 - DNA, 25 bp, Mus musculus
tcccttccgtgccattattttaagt

SEQ ID NO: 816790 - DNA, 25 bp, Mus musculus
tcccttccgtgcgattattttaagt

SEQ ID NO: 816791 - DNA, 25 bp, Mus musculus
tcccttccgttgaatgcactgcgtg

SEQ ID NO: 816792 - DNA, 25 bp, Mus musculus
tcccttccgttgtatgcactgcgtg

SEQ ID NO: 816793 - DNA, 25 bp, Mus musculus
tcccttcctaccaatttttgtgtga

SEQ ID NO: 816794 - DNA, 25 bp, Mus musculus
tcccttcctacctatttttgtgtga

SEQ ID NO: 816795 - DNA, 25 bp, Mus musculus
tcccttcctgtgacatggcacatgt

SEQ ID NO: 816796 - DNA, 25 bp, Mus musculus
tcccttcctgtgtcatggcacatgt

SEQ ID NO: 816797 - DNA, 25 bp, Mus musculus
tcccttccttgtaggcttattccaa

SEQ ID NO: 816798 - DNA, 25 bp, Mus musculus
tcccttccttgttggcttattccaa

SEQ ID NO: 816799 - DNA, 25 bp, Mus musculus
tcccttcctttcatgtagtactgga

SEQ ID NO: 816800 - DNA, 25 bp, Mus musculus
tcccttcctttcttgtagtactgga

SEQ ID NO: 816801 - DNA, 25 bp, Mus musculus
tcccttcgagtgcaattgacggcct

SEQ ID NO: 816802 - DNA, 25 bp, Mus musculus
tcccttcgagtggaattgacggcct

SEQ ID NO: 816803 - DNA, 25 bp, Mus musculus
tcccttcgctgtagtgcagcagaaa

SEQ ID NO: 816804 - DNA, 25 bp, Mus musculus
tcccttcgctgttgtgcagcagaaa

SEQ ID NO: 816805 - DNA, 25 bp, Mus musculus
tcccttcggccgctacatattagaa

SEQ ID NO: 816806 - DNA, 25 bp, Mus musculus
tcccttcggccggtacatattagaa

SEQ ID NO: 816807 - DNA, 25 bp, Mus musculus
tcccttctaatcattgaattgctca

SEQ ID NO: 816808 - DNA, 25 bp, Mus musculus
tcccttctaatctttgaattgctca

SEQ ID NO: 816809 - DNA, 25 bp, Mus musculus
tcccttctaatgctgacctggaaac

SEQ ID NO: 816810 - DNA, 25 bp, Mus musculus
tcccttctaatggtgacctggaaac

SEQ ID NO: 816811 - DNA, 25 bp, Mus musculus
tcccttctacacatatcttcaactg

SEQ ID NO: 816812 - DNA, 25 bp, Mus musculus
tcccttctacacttatcttcaactg

SEQ ID NO: 816813 - DNA, 25 bp, Mus musculus
tcccttctatctacacaccaataaa

SEQ ID NO: 816814 - DNA, 25 bp, Mus musculus
tcccttctatcttcacaccaataaa

SEQ ID NO: 816815 - DNA, 25 bp, Mus musculus
tcccttctcaagaggaacacaagaa

SEQ ID NO: 816816 - DNA, 25 bp, Mus musculus
tcccttctcaagtggaacacaagaa

SEQ ID NO: 816817 - DNA, 25 bp, Mus musculus
tcccttctcagtactacacttgagt

SEQ ID NO: 816818 - DNA, 25 bp, Mus musculus
tcccttctcagttctacacttgagt

SEQ ID NO: 816819 - DNA, 25 bp, Mus musculus
tcccttctcatcattgtgtatgacg

SEQ ID NO: 816820 - DNA, 25 bp, Mus musculus
tcccttctcatctttgtgtatgacg

SEQ ID NO: 816821 - DNA, 25 bp, Mus musculus
tcccttctccatcattctaattttt

SEQ ID NO: 816822 - DNA, 25 bp, Mus musculus
tcccttctccatgattctaattttt

SEQ ID NO: 816823 - DNA, 25 bp, Mus musculus
tcccttctctggaggcaatgatttc

SEQ ID NO: 816824 - DNA, 25 bp, Mus musculus
tcccttctctggtggcaatgatttc

SEQ ID NO: 816825 - DNA, 25 bp, Mus musculus
tcccttctcttcatagcagtaaatc

SEQ ID NO: 816826 - DNA, 25 bp, Mus musculus
tcccttctcttcttagcagtaaatc

SEQ ID NO: 816827 - DNA, 25 bp, Mus musculus
tcccttctctttacttgaagctggg

SEQ ID NO: 816828 - DNA, 25 bp, Mus musculus
tcccttctcttttcttgaagctggg

SEQ ID NO: 816829 - DNA, 25 bp, Mus musculus
tcccttctgcaaactgctgatgtca

SEQ ID NO: 816830 - DNA, 25 bp, Mus musculus
tcccttctgcaatctgctgatgtca

SEQ ID NO: 816831 - DNA, 25 bp, Mus musculus
tcccttctgccgatgtgagatcaaa

SEQ ID NO: 816832 - DNA, 25 bp, Mus musculus
tcccttctgccgttgtgagatcaaa

SEQ ID NO: 816833 - DNA, 25 bp, Mus musculus
tcccttctgcttacctagagttgaa

SEQ ID NO: 816834 - DNA, 25 bp, Mus musculus
tcccttctgctttcctagagttgaa

SEQ ID NO: 816835 - DNA, 25 bp, Mus musculus
tcccttctggagacaccaagtacag

SEQ ID NO: 816836 - DNA, 25 bp, Mus musculus
tcccttctggagtcaccaagtacag

SEQ ID NO: 816837 - DNA, 25 bp, Mus musculus
tcccttctgtaaattgcttggcacc

SEQ ID NO: 816838 - DNA, 25 bp, Mus musculus
tcccttctgtaatttgcttggcacc

SEQ ID NO: 816839 - DNA, 25 bp, Mus musculus
tcccttctgtatatgcttaacacaa

SEQ ID NO: 816840 - DNA, 25 bp, Mus musculus
tcccttctgtatttgcttaacacaa

SEQ ID NO: 816841 - DNA, 25 bp, Mus musculus
tcccttctgtggattcatatagata

SEQ ID NO: 816842 - DNA, 25 bp, Mus musculus
tcccttctgtggtttcatatagata

SEQ ID NO: 816843 - DNA, 25 bp, Mus musculus
tcccttcttaataccgtaaacacag

SEQ ID NO: 816844 - DNA, 25 bp, Mus musculus
tcccttcttaattccgtaaacacag

SEQ ID NO: 816845 - DNA, 25 bp, Mus musculus
tcccttcttagaaaatttcccattg

SEQ ID NO: 816846 - DNA, 25 bp, Mus musculus
tcccttcttagataatttcccattg

SEQ ID NO: 816847 - DNA, 25 bp, Mus musculus
tcccttcttatgatgaataggttgg

SEQ ID NO: 816848 - DNA, 25 bp, Mus musculus
tcccttcttatgttgaataggttgg

SEQ ID NO: 816849 - DNA, 25 bp, Mus musculus
tcccttcttattatcaactgttcct

SEQ ID NO: 816850 - DNA, 25 bp, Mus musculus
tcccttcttattttcaactgttcct

SEQ ID NO: 816851 - DNA, 25 bp, Mus musculus
tcccttcttcgtatcttgttttgta

SEQ ID NO: 816852 - DNA, 25 bp, Mus musculus
tcccttcttcgtttcttgttttgta

SEQ ID NO: 816853 - DNA, 25 bp, Mus musculus
tcccttcttctaatcaaagtcttgg

SEQ ID NO: 816854 - DNA, 25 bp, Mus musculus
tcccttcttctattcaaagtcttgg

SEQ ID NO: 816855 - DNA, 25 bp, Mus musculus
tcccttcttggtaccacaagcagta

SEQ ID NO: 816856 - DNA, 25 bp, Mus musculus
tcccttcttggttccacaagcagta

SEQ ID NO: 816857 - DNA, 25 bp, Mus musculus
tcccttcttgtcacctttcttagaa

SEQ ID NO: 816858 - DNA, 25 bp, Mus musculus
tcccttcttgtctcctttcttagaa

SEQ ID NO: 816859 - DNA, 25 bp, Mus musculus
tcccttctttacaacactgacaaac

SEQ ID NO: 816860 - DNA, 25 bp, Mus musculus
tcccttctttactacactgacaaac

SEQ ID NO: 816861 - DNA, 25 bp, Mus musculus
tcccttcttttacagcttaccatca

SEQ ID NO: 816862 - DNA, 25 bp, Mus musculus
tcccttcttttagagcttaccatca

SEQ ID NO: 816863 - DNA, 25 bp, Mus musculus
tcccttcttttgctgctggaactga

SEQ ID NO: 816864 - DNA, 25 bp, Mus musculus
tcccttcttttggtgctggaactga

SEQ ID NO: 816865 - DNA, 25 bp, Mus musculus
tcccttctttttaatctcattcatt

SEQ ID NO: 816866 - DNA, 25 bp, Mus musculus
tcccttcttttttatctcattcatt

SEQ ID NO: 816867 - DNA, 25 bp, Mus musculus
tcccttgaactgataactgccaatg

SEQ ID NO: 816868 - DNA, 25 bp, Mus musculus
tcccttgaactgttaactgccaatg

SEQ ID NO: 816869 - DNA, 25 bp, Mus musculus
tcccttgacacacttgggtttctca

SEQ ID NO: 816870 - DNA, 25 bp, Mus musculus
tcccttgacacagttgggtttctca

SEQ ID NO: 816871 - DNA, 25 bp, Mus musculus
tcccttgagcaaatggaacaaataa

SEQ ID NO: 816872 - DNA, 25 bp, Mus musculus
tcccttgagcaattggaacaaataa

SEQ ID NO: 816873 - DNA, 25 bp, Mus musculus
tcccttgagggcagagcagaagacg

SEQ ID NO: 816874 - DNA, 25 bp, Mus musculus
tcccttgagggctgagcagaagacg

SEQ ID NO: 816875 - DNA, 25 bp, Mus musculus
tcccttgagttcattaccattaaag

SEQ ID NO: 816876 - DNA, 25 bp, Mus musculus
tcccttgagttctttaccattaaag

SEQ ID NO: 816877 - DNA, 25 bp, Mus musculus
tcccttgatgacctccctaaagtgt

SEQ ID NO: 816878 - DNA, 25 bp, Mus musculus
tcccttgatgacgtccctaaagtgt

SEQ ID NO: 816879 - DNA, 25 bp, Mus musculus
tcccttgatgggactttagagtttt

SEQ ID NO: 816880 - DNA, 25 bp, Mus musculus
tcccttgatgggtctttagagtttt

SEQ ID NO: 816881 - DNA, 25 bp, Mus musculus
tcccttgcaagcctgggccggtcag

SEQ ID NO: 816882 - DNA, 25 bp, Mus musculus
tcccttgcaagcgtgggccggtcag

SEQ ID NO: 816883 - DNA, 25 bp, Mus musculus
tcccttgcagatagtgagatgtaat

SEQ ID NO: 816884 - DNA, 25 bp, Mus musculus
tcccttgcagattgtgagatgtaat

SEQ ID NO: 816885 - DNA, 25 bp, Mus musculus
tcccttgcgttcacactacatttat

SEQ ID NO: 816886 - DNA, 25 bp, Mus musculus
tcccttgcgttctcactacatttat

SEQ ID NO: 816887 - DNA, 25 bp, Mus musculus
tcccttgctcatatgccatatttag

SEQ ID NO: 816888 - DNA, 25 bp, Mus musculus
tcccttgctcatttgccatatttag

SEQ ID NO: 816889 - DNA, 25 bp, Mus musculus
tcccttgctgttaggactaggcagg

SEQ ID NO: 816890 - DNA, 25 bp, Mus musculus
tcccttgctgtttggactaggcagg

SEQ ID NO: 816891 - DNA, 25 bp, Mus musculus
tcccttgcttaaaggagcatggata

SEQ ID NO: 816892 - DNA, 25 bp, Mus musculus
tcccttgcttaatggagcatggata

SEQ ID NO: 816893 - DNA, 25 bp, Mus musculus
tcccttgcttgcacatgcatatgtg

SEQ ID NO: 816894 - DNA, 25 bp, Mus musculus
tcccttgcttgctcatgcatatgtg

SEQ ID NO: 816895 - DNA, 25 bp, Mus musculus
tcccttgcttttatcttcactgcgt

SEQ ID NO: 816896 - DNA, 25 bp, Mus musculus
tcccttgcttttttcttcactgcgt

SEQ ID NO: 816897 - DNA, 25 bp, Mus musculus
tcccttggacttactacttctgagt

SEQ ID NO: 816898 - DNA, 25 bp, Mus musculus
tcccttggactttctacttctgagt

SEQ ID NO: 816899 - DNA, 25 bp, Mus musculus
tcccttggcgagaccagtggatgaa

SEQ ID NO: 816900 - DNA, 25 bp, Mus musculus
tcccttggcgagtccagtggatgaa

SEQ ID NO: 816901 - DNA, 25 bp, Mus musculus
tcccttggctgtctacctgggagta

SEQ ID NO: 816902 - DNA, 25 bp, Mus musculus
tcccttggctgtgtacctgggagta

SEQ ID NO: 816903 - DNA, 25 bp, Mus musculus
tcccttgggaaaacagttccacgtg

SEQ ID NO: 816904 - DNA, 25 bp, Mus musculus
tcccttgggaaatcagttccacgtg

SEQ ID NO: 816905 - DNA, 25 bp, Mus musculus
tcccttgggccacgttatattcagc

SEQ ID NO: 816906 - DNA, 25 bp, Mus musculus
tcccttgggccaggttatattcagc

SEQ ID NO: 816907 - DNA, 25 bp, Mus musculus
tcccttgggtcgctttgtggctcgt

SEQ ID NO: 816908 - DNA, 25 bp, Mus musculus
tcccttgggtcggtttgtggctcgt

SEQ ID NO: 816909 - DNA, 25 bp, Mus musculus
tcccttggtcatcttttctttctaa

SEQ ID NO: 816910 - DNA, 25 bp, Mus musculus
tcccttggtcatgttttctttctaa

SEQ ID NO: 816911 - DNA, 25 bp, Mus musculus
tcccttggtcttatatcacgtgtgg

SEQ ID NO: 816912 - DNA, 25 bp, Mus musculus
tcccttggtcttttatcacgtgtgg

SEQ ID NO: 816913 - DNA, 25 bp, Mus musculus
tcccttggtggacaccagagagtct

SEQ ID NO: 816914 - DNA, 25 bp, Mus musculus
tcccttggtggagaccagagagtct

SEQ ID NO: 816915 - DNA, 25 bp, Mus musculus
tcccttggttggactgcttagtttt

SEQ ID NO: 816916 - DNA, 25 bp, Mus musculus
tcccttggttggtctgcttagtttt

SEQ ID NO: 816917 - DNA, 25 bp, Mus musculus
tcccttggtttgatcatggaagcta

SEQ ID NO: 816918 - DNA, 25 bp, Mus musculus
tcccttggtttgttcatggaagcta

SEQ ID NO: 816919 - DNA, 25 bp, Mus musculus
tcccttgtaataactgcagcccaga

SEQ ID NO: 816920 - DNA, 25 bp, Mus musculus
tcccttgtaatatctgcagcccaga

SEQ ID NO: 816921 - DNA, 25 bp, Mus musculus
tcccttgtagagagtttgcgtagtg

SEQ ID NO: 816922 - DNA, 25 bp, Mus musculus
tcccttgtagagtgtttgcgtagtg

SEQ ID NO: 816923 - DNA, 25 bp, Mus musculus
tcccttgtcacaatgtagcctctaa

SEQ ID NO: 816924 - DNA, 25 bp, Mus musculus
tcccttgtcacattgtagcctctaa

SEQ ID NO: 816925 - DNA, 25 bp, Mus musculus
tcccttgtccatataccaagattga

SEQ ID NO: 816926 - DNA, 25 bp, Mus musculus
tcccttgtccatttaccaagattga

SEQ ID NO: 816927 - DNA, 25 bp, Mus musculus
tcccttgtctaccttgtgtatgtga

SEQ ID NO: 816928 - DNA, 25 bp, Mus musculus
tcccttgtctacgttgtgtatgtga

SEQ ID NO: 816929 - DNA, 25 bp, Mus musculus
tcccttgtgaggcagtttgttgact

SEQ ID NO: 816930 - DNA, 25 bp, Mus musculus
tcccttgtgagggagtttgttgact

SEQ ID NO: 816931 - DNA, 25 bp, Mus musculus
tcccttgtgtcactacctaaatgtt

SEQ ID NO: 816932 - DNA, 25 bp, Mus musculus
tcccttgtgtcagtacctaaatgtt

SEQ ID NO: 816933 - DNA, 25 bp, Mus musculus
tcccttgtgtgtacacccctattat

SEQ ID NO: 816934 - DNA, 25 bp, Mus musculus
tcccttgtgtgttcacccctattat

SEQ ID NO: 816935 - DNA, 25 bp, Mus musculus
tcccttgtgttacaacctagaccaa

SEQ ID NO: 816936 - DNA, 25 bp, Mus musculus
tcccttgtgttagaacctagaccaa

SEQ ID NO: 816937 - DNA, 25 bp, Mus musculus
tcccttgtgttgatattactaatag

SEQ ID NO: 816938 - DNA, 25 bp, Mus musculus
tcccttgtgttgttattactaatag

SEQ ID NO: 816939 - DNA, 25 bp, Mus musculus
tcccttgttgccatagagtagttaa

SEQ ID NO: 816940 - DNA, 25 bp, Mus musculus
tcccttgttgccttagagtagttaa

SEQ ID NO: 816941 - DNA, 25 bp, Mus musculus
tcccttgttgctcaccactgtggta

SEQ ID NO: 816942 - DNA, 25 bp, Mus musculus
tcccttgttgctgaccactgtggta

SEQ ID NO: 816943 - DNA, 25 bp, Mus musculus
tcccttgttggacatttactgactg

SEQ ID NO: 816944 - DNA, 25 bp, Mus musculus
tcccttgttggagatttactgactg

SEQ ID NO: 816945 - DNA, 25 bp, Mus musculus
tcccttgtttcaaactctggtacca

SEQ ID NO: 816946 - DNA, 25 bp, Mus musculus
tcccttgtttcatactctggtacca

SEQ ID NO: 816947 - DNA, 25 bp, Mus musculus
tccctttaaaacactggaagcgcta

SEQ ID NO: 816948 - DNA, 25 bp, Mus musculus
tccctttaaaactctggaagcgcta

SEQ ID NO: 816949 - DNA, 25 bp, Mus musculus
tccctttaaccaacttgcaatgctg

SEQ ID NO: 816950 - DNA, 25 bp, Mus musculus
tccctttaaccatcttgcaatgctg

SEQ ID NO: 816951 - DNA, 25 bp, Mus musculus
tccctttaatgacccatactgagac

SEQ ID NO: 816952 - DNA, 25 bp, Mus musculus
tccctttaatgagccatactgagac

SEQ ID NO: 816953 - DNA, 25 bp, Mus musculus
tccctttaccacatacagtgggtag

SEQ ID NO: 816954 - DNA, 25 bp, Mus musculus
tccctttaccacttacagtgggtag

SEQ ID NO: 816955 - DNA, 25 bp, Mus musculus
tccctttaccctcttggaaggaatg

SEQ ID NO: 816956 - DNA, 25 bp, Mus musculus
tccctttaccctgttggaaggaatg

SEQ ID NO: 816957 - DNA, 25 bp, Mus musculus
tccctttagcaacctgagtaagact

SEQ ID NO: 816958 - DNA, 25 bp, Mus musculus
tccctttagcaagctgagtaagact

SEQ ID NO: 816959 - DNA, 25 bp, Mus musculus
tccctttatcatagggttttggttg

SEQ ID NO: 816960 - DNA, 25 bp, Mus musculus
tccctttatcattgggttttggttg

SEQ ID NO: 816961 - DNA, 25 bp, Mus musculus
tccctttatgtgcatgcaggaccca

SEQ ID NO: 816962 - DNA, 25 bp, Mus musculus
tccctttatgtggatgcaggaccca

SEQ ID NO: 816963 - DNA, 25 bp, Mus musculus
tccctttcaaggagactgtgctgat

SEQ ID NO: 816964 - DNA, 25 bp, Mus musculus
tccctttcaaggtgactgtgctgat

SEQ ID NO: 816965 - DNA, 25 bp, Mus musculus
tccctttcagtacataggtaagctt

SEQ ID NO: 816966 - DNA, 25 bp, Mus musculus
tccctttcagtagataggtaagctt

SEQ ID NO: 816967 - DNA, 25 bp, Mus musculus
tccctttcagtcaccctgtgaaaaa

SEQ ID NO: 816968 - DNA, 25 bp, Mus musculus
tccctttcagtctccctgtgaaaaa

SEQ ID NO: 816969 - DNA, 25 bp, Mus musculus
tccctttccactattcatggattga

SEQ ID NO: 816970 - DNA, 25 bp, Mus musculus
tccctttccacttttcatggattga

SEQ ID NO: 816971 - DNA, 25 bp, Mus musculus
tccctttcccagcatgagattgttt

SEQ ID NO: 816972 - DNA, 25 bp, Mus musculus
tccctttcccaggatgagattgttt

SEQ ID NO: 816973 - DNA, 25 bp, Mus musculus
tccctttcctgtacaagatcttttg

SEQ ID NO: 816974 - DNA, 25 bp, Mus musculus
tccctttcctgttcaagatcttttg

SEQ ID NO: 816975 - DNA, 25 bp, Mus musculus
tccctttccttcatataatccctta

SEQ ID NO: 816976 - DNA, 25 bp, Mus musculus
tccctttccttcttataatccctta

SEQ ID NO: 816977 - DNA, 25 bp, Mus musculus
tccctttctccccaatgtggaaatt

SEQ ID NO: 816978 - DNA, 25 bp, Mus musculus
tccctttctcccgaatgtggaaatt

SEQ ID NO: 816979 - DNA, 25 bp, Mus musculus
tccctttctgtaatctggattctag

SEQ ID NO: 816980 - DNA, 25 bp, Mus musculus
tccctttctgtattctggattctag

SEQ ID NO: 816981 - DNA, 25 bp, Mus musculus
tccctttctgtgctgttcttggtca

SEQ ID NO: 816982 - DNA, 25 bp, Mus musculus
tccctttctgtggtgttcttggtca

SEQ ID NO: 816983 - DNA, 25 bp, Mus musculus
tccctttctgttctgccaaaatttt

SEQ ID NO: 816984 - DNA, 25 bp, Mus musculus
tccctttctgttgtgccaaaatttt

SEQ ID NO: 816985 - DNA, 25 bp, Mus musculus
tccctttcttaaccccatgaggata

SEQ ID NO: 816986 - DNA, 25 bp, Mus musculus
tccctttcttaagcccatgaggata

SEQ ID NO: 816987 - DNA, 25 bp, Mus musculus
tccctttgaaagacccagtgattat

SEQ ID NO: 816988 - DNA, 25 bp, Mus musculus
tccctttgaaagtcccagtgattat

SEQ ID NO: 816989 - DNA, 25 bp, Mus musculus
tccctttgaagaactgtccatattc

SEQ ID NO: 816990 - DNA, 25 bp, Mus musculus
tccctttgaagatctgtccatattc

SEQ ID NO: 816991 - DNA, 25 bp, Mus musculus
tccctttgacgtaccagaacttcat

SEQ ID NO: 816992 - DNA, 25 bp, Mus musculus
tccctttgacgttccagaacttcat

SEQ ID NO: 816993 - DNA, 25 bp, Mus musculus
tccctttgcctcaatatggatgaag

SEQ ID NO: 816994 - DNA, 25 bp, Mus musculus
tccctttgcctcacagcataaatag

SEQ ID NO: 816995 - DNA, 25 bp, Mus musculus
tccctttgcctctatatggatgaag

SEQ ID NO: 816996 - DNA, 25 bp, Mus musculus
tccctttgcctctcagcataaatag

SEQ ID NO: 816997 - DNA, 25 bp, Mus musculus
tccctttgccttaaccatactaaca

SEQ ID NO: 816998 - DNA, 25 bp, Mus musculus
tccctttgccttacgtgatcacaaa

SEQ ID NO: 816999 - DNA, 25 bp, Mus musculus
tccctttgcctttaccatactaaca

SEQ ID NO: 817000 - DNA, 25 bp, Mus musculus
tccctttgcctttcgtgatcacaaa

SEQ ID NO: 817001 - DNA, 25 bp, Mus musculus
tccctttgcgttccctttgttcatg

SEQ ID NO: 817002 - DNA, 25 bp, Mus musculus
tccctttgcgttgcctttgttcatg

SEQ ID NO: 817003 - DNA, 25 bp, Mus musculus
tccctttgctacattttaactgaat

SEQ ID NO: 817004 - DNA, 25 bp, Mus musculus
tccctttgctactttttaactgaat

SEQ ID NO: 817005 - DNA, 25 bp, Mus musculus
tccctttgctttagctacatcgaaa

SEQ ID NO: 817006 - DNA, 25 bp, Mus musculus
tccctttgcttttgctacatcgaaa

SEQ ID NO: 817007 - DNA, 25 bp, Mus musculus
tccctttggctgcttttgttccctg

SEQ ID NO: 817008 - DNA, 25 bp, Mus musculus
tccctttggctggttttgttccctg

SEQ ID NO: 817009 - DNA, 25 bp, Mus musculus
tccctttgggccctgacaagtgaaa

SEQ ID NO: 817010 - DNA, 25 bp, Mus musculus
tccctttgggccgtgacaagtgaaa

SEQ ID NO: 817011 - DNA, 25 bp, Mus musculus
tccctttgggctccttggagtgaga

SEQ ID NO: 817012 - DNA, 25 bp, Mus musculus
tccctttgggctgcttggagtgaga

SEQ ID NO: 817013 - DNA, 25 bp, Mus musculus
tccctttggtttcctgtggtacttt

SEQ ID NO: 817014 - DNA, 25 bp, Mus musculus
tccctttggtttgctgtggtacttt

SEQ ID NO: 817015 - DNA, 25 bp, Mus musculus
tccctttgtagtaagacagatttgg

SEQ ID NO: 817016 - DNA, 25 bp, Mus musculus
tccctttgtagttagacagatttgg

SEQ ID NO: 817017 - DNA, 25 bp, Mus musculus
tccctttgtgttatccggtatctac

SEQ ID NO: 817018 - DNA, 25 bp, Mus musculus
tccctttgtgttttccggtatctac

SEQ ID NO: 817019 - DNA, 25 bp, Mus musculus
tcccttttaaatcgtggcactagtt

SEQ ID NO: 817020 - DNA, 25 bp, Mus musculus
tcccttttaaatggtggcactagtt

SEQ ID NO: 817021 - DNA, 25 bp, Mus musculus
tcccttttacagagcccaatagaca

SEQ ID NO: 817022 - DNA, 25 bp, Mus musculus
tcccttttacagtgcccaatagaca

SEQ ID NO: 817023 - DNA, 25 bp, Mus musculus
tcccttttacttattaagcatggtg

SEQ ID NO: 817024 - DNA, 25 bp, Mus musculus
tcccttttactttttaagcatggtg

SEQ ID NO: 817025 - DNA, 25 bp, Mus musculus
tcccttttagctacacgactgtgat

SEQ ID NO: 817026 - DNA, 25 bp, Mus musculus
tcccttttagcttcacgactgtgat

SEQ ID NO: 817027 - DNA, 25 bp, Mus musculus
tcccttttatttatgcctccgccag

SEQ ID NO: 817028 - DNA, 25 bp, Mus musculus
tcccttttatttttgcctccgccag

SEQ ID NO: 817029 - DNA, 25 bp, Mus musculus
tcccttttcaggctgtccccaaaat

SEQ ID NO: 817030 - DNA, 25 bp, Mus musculus
tcccttttcagggtgtccccaaaat

SEQ ID NO: 817031 - DNA, 25 bp, Mus musculus
tcccttttccagaagcaataaagct

SEQ ID NO: 817032 - DNA, 25 bp, Mus musculus
tcccttttccagtagcaataaagct

SEQ ID NO: 817033 - DNA, 25 bp, Mus musculus
tcccttttctagactggcagcagat

SEQ ID NO: 817034 - DNA, 25 bp, Mus musculus
tcccttttctagtctggcagcagat

SEQ ID NO: 817035 - DNA, 25 bp, Mus musculus
tcccttttgaaacctgccagtgtca

SEQ ID NO: 817036 - DNA, 25 bp, Mus musculus
tcccttttgaaagctgccagtgtca

SEQ ID NO: 817037 - DNA, 25 bp, Mus musculus
tcccttttgcacagtatctgtctta

SEQ ID NO: 817038 - DNA, 25 bp, Mus musculus
tcccttttgcactgtatctgtctta

SEQ ID NO: 817039 - DNA, 25 bp, Mus musculus
tcccttttgggaatgttgacggcct

SEQ ID NO: 817040 - DNA, 25 bp, Mus musculus
tcccttttgggattgttgacggcct

SEQ ID NO: 817041 - DNA, 25 bp, Mus musculus
tcccttttgtggagacaggtggagt

SEQ ID NO: 817042 - DNA, 25 bp, Mus musculus
tcccttttgtggtgacaggtggagt

SEQ ID NO: 817043 - DNA, 25 bp, Mus musculus
tccctttttctacctatgattcaac

SEQ ID NO: 817044 - DNA, 25 bp, Mus musculus
tccctttttctagctatgattcaac

SEQ ID NO: 817045 - DNA, 25 bp, Mus musculus
tccctttttgcaagtcccaggaaat

SEQ ID NO: 817046 - DNA, 25 bp, Mus musculus
tccctttttgcatgtcccaggaaat

SEQ ID NO: 817047 - DNA, 25 bp, Mus musculus
tccctttttggcctgtaagacactt

SEQ ID NO: 817048 - DNA, 25 bp, Mus musculus
tccctttttggcgtgtaagacactt

SEQ ID NO: 817049 - DNA, 25 bp, Mus musculus
tccctttttgtcagtgaagcaccag

SEQ ID NO: 817050 - DNA, 25 bp, Mus musculus
tccctttttgtctgtgaagcaccag

SEQ ID NO: 817051 - DNA, 25 bp, Mus musculus
tcccttttttgccagcttgagtgag

SEQ ID NO: 817052 - DNA, 25 bp, Mus musculus
tcccttttttgcgagcttgagtgag

SEQ ID NO: 817053 - DNA, 25 bp, Mus musculus
tccgaaaaaccaatggccgcctaca

SEQ ID NO: 817054 - DNA, 25 bp, Mus musculus
tccgaaaaaccattggccgcctaca

SEQ ID NO: 817055 - DNA, 25 bp, Mus musculus
tccgaaaagcagatacagacctgtt

SEQ ID NO: 817056 - DNA, 25 bp, Mus musculus
tccgaaaagcagttacagacctgtt

SEQ ID NO: 817057 - DNA, 25 bp, Mus musculus
tccgaaactgtgctcaacttggctt

SEQ ID NO: 817058 - DNA, 25 bp, Mus musculus
tccgaaactgtggtcaacttggctt

SEQ ID NO: 817059 - DNA, 25 bp, Mus musculus
tccgaaagcagtcctacacagcctt

SEQ ID NO: 817060 - DNA, 25 bp, Mus musculus
tccgaaagcagtgctacacagcctt

SEQ ID NO: 817061 - DNA, 25 bp, Mus musculus
tccgaaagccaaccttttgtgtcct

SEQ ID NO: 817062 - DNA, 25 bp, Mus musculus
tccgaaagccaagcttttgtgtcct

SEQ ID NO: 817063 - DNA, 25 bp, Mus musculus
tccgaaagcccaagttttctgaaag

SEQ ID NO: 817064 - DNA, 25 bp, Mus musculus
tccgaaagcccatgttttctgaaag

SEQ ID NO: 817065 - DNA, 25 bp, Mus musculus
tccgaaattacaaaggttacagagc

SEQ ID NO: 817066 - DNA, 25 bp, Mus musculus
tccgaaattacataggttacagagc

SEQ ID NO: 817067 - DNA, 25 bp, Mus musculus
tccgaaattgtgaagttcttttgcc

SEQ ID NO: 817068 - DNA, 25 bp, Mus musculus
tccgaaattgtgtagttcttttgcc

SEQ ID NO: 817069 - DNA, 25 bp, Mus musculus
tccgaacactcccttgaagacattg

SEQ ID NO: 817070 - DNA, 25 bp, Mus musculus
tccgaacactccgttgaagacattg

SEQ ID NO: 817071 - DNA, 25 bp, Mus musculus
tccgaaccagtaagtgctcaataaa

SEQ ID NO: 817072 - DNA, 25 bp, Mus musculus
tccgaaccagtatgtgctcaataaa

SEQ ID NO: 817073 - DNA, 25 bp, Mus musculus
tccgaaccataacatttacctgtag

SEQ ID NO: 817074 - DNA, 25 bp, Mus musculus
tccgaaccataagatttacctgtag

SEQ ID NO: 817075 - DNA, 25 bp, Mus musculus
tccgaagaaagtaggcgatgacatt

SEQ ID NO: 817076 - DNA, 25 bp, Mus musculus
tccgaagaaagttggcgatgacatt

SEQ ID NO: 817077 - DNA, 25 bp, Mus musculus
tccgaagacctgattttagttcctg

SEQ ID NO: 817078 - DNA, 25 bp, Mus musculus
tccgaagacctgtttttagttcctg

SEQ ID NO: 817079 - DNA, 25 bp, Mus musculus
tccgaagagccaattggacagagaa

SEQ ID NO: 817080 - DNA, 25 bp, Mus musculus
tccgaagagccatttggacagagaa

SEQ ID NO: 817081 - DNA, 25 bp, Mus musculus
tccgaagagtacacgggctccagcc

SEQ ID NO: 817082 - DNA, 25 bp, Mus musculus
tccgaagagtactcgggctccagcc

SEQ ID NO: 817083 - DNA, 25 bp, Mus musculus
tccgaagccatcagcagcaaaggca

SEQ ID NO: 817084 - DNA, 25 bp, Mus musculus
tccgaagccatctgcagcaaaggca

SEQ ID NO: 817085 - DNA, 25 bp, Mus musculus
tccgaagcccacctgtaatctagtt

SEQ ID NO: 817086 - DNA, 25 bp, Mus musculus
tccgaagcccacgtgtaatctagtt

SEQ ID NO: 817087 - DNA, 25 bp, Mus musculus
tccgaagcctacacaagtttccttt

SEQ ID NO: 817088 - DNA, 25 bp, Mus musculus
tccgaagcctactcaagtttccttt

SEQ ID NO: 817089 - DNA, 25 bp, Mus musculus
tccgaagctcatcggacatgcacat

SEQ ID NO: 817090 - DNA, 25 bp, Mus musculus
tccgaagctcatgggacatgcacat

SEQ ID NO: 817091 - DNA, 25 bp, Mus musculus
tccgaagggtccagggtctcaggtc

SEQ ID NO: 817092 - DNA, 25 bp, Mus musculus
tccgaagggtcctgggtctcaggtc

SEQ ID NO: 817093 - DNA, 25 bp, Mus musculus
tccgaaggtccccagatcataggaa

SEQ ID NO: 817094 - DNA, 25 bp, Mus musculus
tccgaaggtcccgagatcataggaa

SEQ ID NO: 817095 - DNA, 25 bp, Mus musculus
tccgaaggtgccaacgggaccatgg

SEQ ID NO: 817096 - DNA, 25 bp, Mus musculus
tccgaaggtgcctacgggaccatgg

SEQ ID NO: 817097 - DNA, 25 bp, Mus musculus
tccgaatcacacatctctgagcatt

SEQ ID NO: 817098 - DNA, 25 bp, Mus musculus
tccgaatcacacttctctgagcatt

SEQ ID NO: 817099 - DNA, 25 bp, Mus musculus
tccgaattcggtcgcctgaagggaa

SEQ ID NO: 817100 - DNA, 25 bp, Mus musculus
tccgaattcggtggcctgaagggaa

SEQ ID NO: 817101 - DNA, 25 bp, Mus musculus
tccgaattgcagaggatcctatatg

SEQ ID NO: 817102 - DNA, 25 bp, Mus musculus
tccgaattgcagtggatcctatatg

SEQ ID NO: 817103 - DNA, 25 bp, Mus musculus
tccgaattgtagctctctctgcctc

SEQ ID NO: 817104 - DNA, 25 bp, Mus musculus
tccgaattgtaggtctctctgcctc

SEQ ID NO: 817105 - DNA, 25 bp, Mus musculus
tccgaatttacactaatcaagacag

SEQ ID NO: 817106 - DNA, 25 bp, Mus musculus
tccgaatttacagtaatcaagacag

SEQ ID NO: 817107 - DNA, 25 bp, Mus musculus
tccgacaaatatatattcatctcta

SEQ ID NO: 817108 - DNA, 25 bp, Mus musculus
tccgacaaatatttattcatctcta

SEQ ID NO: 817109 - DNA, 25 bp, Mus musculus
tccgacaagttgctttttaaccaag

SEQ ID NO: 817110 - DNA, 25 bp, Mus musculus
tccgacaagttggtttttaaccaag

SEQ ID NO: 817111 - DNA, 25 bp, Mus musculus
tccgacacaagacaggattctcatg

SEQ ID NO: 817112 - DNA, 25 bp, Mus musculus
tccgacacaagagaggattctcatg

SEQ ID NO: 817113 - DNA, 25 bp, Mus musculus
tccgacacagagagcattgccagat

SEQ ID NO: 817114 - DNA, 25 bp, Mus musculus
tccgacacagagtgcattgccagat

SEQ ID NO: 817115 - DNA, 25 bp, Mus musculus
tccgacagagttaccgagccaaagg

SEQ ID NO: 817116 - DNA, 25 bp, Mus musculus
tccgacagagtttccgagccaaagg

SEQ ID NO: 817117 - DNA, 25 bp, Mus musculus
tccgacagtggtactcagtgtaact

SEQ ID NO: 817118 - DNA, 25 bp, Mus musculus
tccgacagtggttctcagtgtaact

SEQ ID NO: 817119 - DNA, 25 bp, Mus musculus
tccgacatttcacgccagagcttga

SEQ ID NO: 817120 - DNA, 25 bp, Mus musculus
tccgacatttcaggccagagcttga

SEQ ID NO: 817121 - DNA, 25 bp, Mus musculus
tccgaccaccacagggagcgagcag

SEQ ID NO: 817122 - DNA, 25 bp, Mus musculus
tccgaccaccactgggagcgagcag

SEQ ID NO: 817123 - DNA, 25 bp, Mus musculus
tccgacccaaacatcaagccattaa

SEQ ID NO: 817124 - DNA, 25 bp, Mus musculus
tccgacccaaacttcaagccattaa

SEQ ID NO: 817125 - DNA, 25 bp, Mus musculus
tccgaccgaccgaccggagaaagag

SEQ ID NO: 817126 - DNA, 25 bp, Mus musculus
tccgaccgaccgtccggagaaagag

SEQ ID NO: 817127 - DNA, 25 bp, Mus musculus
tccgaccgtacgcatgtgacatttt

SEQ ID NO: 817128 - DNA, 25 bp, Mus musculus
tccgaccgtacggatgtgacatttt

SEQ ID NO: 817129 - DNA, 25 bp, Mus musculus
tccgacctccgaagttttctggaag

SEQ ID NO: 817130 - DNA, 25 bp, Mus musculus
tccgacctccgatgttttctggaag

SEQ ID NO: 817131 - DNA, 25 bp, Mus musculus
tccgaccttcgccatatgaatagtg

SEQ ID NO: 817132 - DNA, 25 bp, Mus musculus
tccgaccttcgcgatatgaatagtg

SEQ ID NO: 817133 - DNA, 25 bp, Mus musculus
tccgacgcaatgcagccacgtggaa

SEQ ID NO: 817134 - DNA, 25 bp, Mus musculus
tccgacgcaatggagccacgtggaa

SEQ ID NO: 817135 - DNA, 25 bp, Mus musculus
tccgacggacgaaggaaaggagcca

SEQ ID NO: 817136 - DNA, 25 bp, Mus musculus
tccgacggacgatggaaaggagcca

SEQ ID NO: 817137 - DNA, 25 bp, Mus musculus
tccgacggcaggagcgtgagaacca

SEQ ID NO: 817138 - DNA, 25 bp, Mus musculus
tccgacggcaggtgcgtgagaacca

SEQ ID NO: 817139 - DNA, 25 bp, Mus musculus
tccgacgtgtgccagcagcaagcag

SEQ ID NO: 817140 - DNA, 25 bp, Mus musculus
tccgacgtgtgcgagcagcaagcag

SEQ ID NO: 817141 - DNA, 25 bp, Mus musculus
tccgactagtagaacctggaatagg

SEQ ID NO: 817142 - DNA, 25 bp, Mus musculus
tccgactagtagtacctggaatagg

SEQ ID NO: 817143 - DNA, 25 bp, Mus musculus
tccgactcacgtatgtccagtgtta

SEQ ID NO: 817144 - DNA, 25 bp, Mus musculus
tccgactcacgtttgtccagtgtta

SEQ ID NO: 817145 - DNA, 25 bp, Mus musculus
tccgactggaacagcagagtgtacc

SEQ ID NO: 817146 - DNA, 25 bp, Mus musculus
tccgactggaactgcagagtgtacc

SEQ ID NO: 817147 - DNA, 25 bp, Mus musculus
tccgacttcaaaaggcagggtctga

SEQ ID NO: 817148 - DNA, 25 bp, Mus musculus
tccgacttcaaatggcagggtctga

SEQ ID NO: 817149 - DNA, 25 bp, Mus musculus
tccgacttcactcctttgttaagta

SEQ ID NO: 817150 - DNA, 25 bp, Mus musculus
tccgacttcactgctttgttaagta

SEQ ID NO: 817151 - DNA, 25 bp, Mus musculus
tccgacttcccaagggttctaatga

SEQ ID NO: 817152 - DNA, 25 bp, Mus musculus
tccgacttcccatgggttctaatga

SEQ ID NO: 817153 - DNA, 25 bp, Mus musculus
tccgacttctttactacttacacga

SEQ ID NO: 817154 - DNA, 25 bp, Mus musculus
tccgacttcttttctacttacacga

SEQ ID NO: 817155 - DNA, 25 bp, Mus musculus
tccgactttgccagccaatagagtt

SEQ ID NO: 817156 - DNA, 25 bp, Mus musculus
tccgactttgcctgccaatagagtt

SEQ ID NO: 817157 - DNA, 25 bp, Mus musculus
tccgacttttctccttgtaactatt

SEQ ID NO: 817158 - DNA, 25 bp, Mus musculus
tccgacttttctgcttgtaactatt

SEQ ID NO: 817159 - DNA, 25 bp, Mus musculus
tccgagaacaagagtttgcttccag

SEQ ID NO: 817160 - DNA, 25 bp, Mus musculus
tccgagaacaagtgtttgcttccag

SEQ ID NO: 817161 - DNA, 25 bp, Mus musculus
tccgagaatctcaagctggctctaa

SEQ ID NO: 817162 - DNA, 25 bp, Mus musculus
tccgagaatctctagctggctctaa

SEQ ID NO: 817163 - DNA, 25 bp, Mus musculus
tccgagacagttatacagaccatgg

SEQ ID NO: 817164 - DNA, 25 bp, Mus musculus
tccgagacagttttacagaccatgg

SEQ ID NO: 817165 - DNA, 25 bp, Mus musculus
tccgagacctgcactggacggatag

SEQ ID NO: 817166 - DNA, 25 bp, Mus musculus
tccgagacctgctctggacggatag

SEQ ID NO: 817167 - DNA, 25 bp, Mus musculus
tccgagacctttaccatgactttga

SEQ ID NO: 817168 - DNA, 25 bp, Mus musculus
tccgagaccttttccatgactttga

SEQ ID NO: 817169 - DNA, 25 bp, Mus musculus
tccgagagagtgaggtttcatgtgt

SEQ ID NO: 817170 - DNA, 25 bp, Mus musculus
tccgagagagtgtggtttcatgtgt

SEQ ID NO: 817171 - DNA, 25 bp, Mus musculus
tccgagagcggcacagtaccactgg

SEQ ID NO: 817172 - DNA, 25 bp, Mus musculus
tccgagagcggcatcttgccctatt

SEQ ID NO: 817173 - DNA, 25 bp, Mus musculus
tccgagagcggctcagtaccactgg

SEQ ID NO: 817174 - DNA, 25 bp, Mus musculus
tccgagagcggcttcttgccctatt

SEQ ID NO: 817175 - DNA, 25 bp, Mus musculus
tccgagagtgggaggccttcgtcaa

SEQ ID NO: 817176 - DNA, 25 bp, Mus musculus
tccgagagtgggtggccttcgtcaa

SEQ ID NO: 817177 - DNA, 25 bp, Mus musculus
tccgagagtttaactccccacaaga

SEQ ID NO: 817178 - DNA, 25 bp, Mus musculus
tccgagagtttatctccccacaaga

SEQ ID NO: 817179 - DNA, 25 bp, Mus musculus
tccgagatagcaaaccaggcttcca

SEQ ID NO: 817180 - DNA, 25 bp, Mus musculus
tccgagatagcataccaggcttcca

SEQ ID NO: 817181 - DNA, 25 bp, Mus musculus
tccgagatataccaggcgacatctt

SEQ ID NO: 817182 - DNA, 25 bp, Mus musculus
tccgagatatacgaggcgacatctt

SEQ ID NO: 817183 - DNA, 25 bp, Mus musculus
tccgagatgatcagctctgaagcta

SEQ ID NO: 817184 - DNA, 25 bp, Mus musculus
tccgagatgatctgctctgaagcta

SEQ ID NO: 817185 - DNA, 25 bp, Mus musculus
tccgagatggtgacccttggaattt

SEQ ID NO: 817186 - DNA, 25 bp, Mus musculus
tccgagatggtgtcccttggaattt

SEQ ID NO: 817187 - DNA, 25 bp, Mus musculus
tccgagcactcgagcgtgtccagca

SEQ ID NO: 817188 - DNA, 25 bp, Mus musculus
tccgagcactcgtgcgtgtccagca

SEQ ID NO: 817189 - DNA, 25 bp, Mus musculus
tccgagcagcatcagcagcgaaagc

SEQ ID NO: 817190 - DNA, 25 bp, Mus musculus
tccgagcagcatgagcagcgaaagc

SEQ ID NO: 817191 - DNA, 25 bp, Mus musculus
tccgagcagggcctcactggagcac

SEQ ID NO: 817192 - DNA, 25 bp, Mus musculus
tccgagcagggcgtcactggagcac

SEQ ID NO: 817193 - DNA, 25 bp, Mus musculus
tccgagcatccaccactatgagata

SEQ ID NO: 817194 - DNA, 25 bp, Mus musculus
tccgagcatccagcactatgagata

SEQ ID NO: 817195 - DNA, 25 bp, Mus musculus
tccgagccaccacaatcgtgatagt

SEQ ID NO: 817196 - DNA, 25 bp, Mus musculus
tccgagccaccagaatcgtgatagt

SEQ ID NO: 817197 - DNA, 25 bp, Mus musculus
tccgagccactcaccatagagatga

SEQ ID NO: 817198 - DNA, 25 bp, Mus musculus
tccgagccactctccatagagatga

SEQ ID NO: 817199 - DNA, 25 bp, Mus musculus
tccgagccatcacagacatgcatgt

SEQ ID NO: 817200 - DNA, 25 bp, Mus musculus
tccgagccatcagagacatgcatgt

SEQ ID NO: 817201 - DNA, 25 bp, Mus musculus
tccgagccccgcacctagaggtggg

SEQ ID NO: 817202 - DNA, 25 bp, Mus musculus
tccgagccccgctcctagaggtggg

SEQ ID NO: 817203 - DNA, 25 bp, Mus musculus
tccgagccctgactggagagccaga

SEQ ID NO: 817204 - DNA, 25 bp, Mus musculus
tccgagccctgagtggagagccaga

SEQ ID NO: 817205 - DNA, 25 bp, Mus musculus
tccgagcccttgaaagagcaccaag

SEQ ID NO: 817206 - DNA, 25 bp, Mus musculus
tccgagcccttgtaagagcaccaag

SEQ ID NO: 817207 - DNA, 25 bp, Mus musculus
tccgagccttagcacccagtttcag

SEQ ID NO: 817208 - DNA, 25 bp, Mus musculus
tccgagccttaggacccagtttcag

SEQ ID NO: 817209 - DNA, 25 bp, Mus musculus
tccgagcgccctactttgagccaga

SEQ ID NO: 817210 - DNA, 25 bp, Mus musculus
tccgagcgcccttctttgagccaga

SEQ ID NO: 817211 - DNA, 25 bp, Mus musculus
tccgagctcttgcaccgagaaagca

SEQ ID NO: 817212 - DNA, 25 bp, Mus musculus
tccgagctcttggaccgagaaagca

SEQ ID NO: 817213 - DNA, 25 bp, Mus musculus
tccgaggagatgacgattcctttct

SEQ ID NO: 817214 - DNA, 25 bp, Mus musculus
tccgaggagatgctttcaaaggcta

SEQ ID NO: 817215 - DNA, 25 bp, Mus musculus
tccgaggagatggtttcaaaggcta

SEQ ID NO: 817216 - DNA, 25 bp, Mus musculus
tccgaggagatgtcgattcctttct

SEQ ID NO: 817217 - DNA, 25 bp, Mus musculus
tccgaggattccaagatcttatgtt

SEQ ID NO: 817218 - DNA, 25 bp, Mus musculus
tccgaggattcctagatcttatgtt

SEQ ID NO: 817219 - DNA, 25 bp, Mus musculus
tccgaggcacaaaggctggagacct

SEQ ID NO: 817220 - DNA, 25 bp, Mus musculus
tccgaggcacaatggctggagacct

SEQ ID NO: 817221 - DNA, 25 bp, Mus musculus
tccgaggcacgaatattgctaatta

SEQ ID NO: 817222 - DNA, 25 bp, Mus musculus
tccgaggcacgattattgctaatta

SEQ ID NO: 817223 - DNA, 25 bp, Mus musculus
tccgaggccgctacagaagtcccta

SEQ ID NO: 817224 - DNA, 25 bp, Mus musculus
tccgaggccgcttcagaagtcccta

SEQ ID NO: 817225 - DNA, 25 bp, Mus musculus
tccgaggcggagcacaatcctccat

SEQ ID NO: 817226 - DNA, 25 bp, Mus musculus
tccgaggcggaggacaatcctccat

SEQ ID NO: 817227 - DNA, 25 bp, Mus musculus
tccgaggctgaccacactgagggca

SEQ ID NO: 817228 - DNA, 25 bp, Mus musculus
tccgaggctgaccttagctttcgac

SEQ ID NO: 817229 - DNA, 25 bp, Mus musculus
tccgaggctgacgacactgagggca

SEQ ID NO: 817230 - DNA, 25 bp, Mus musculus
tccgaggctgacgttagctttcgac

SEQ ID NO: 817231 - DNA, 25 bp, Mus musculus
tccgagggatagaattgccagtatg

SEQ ID NO: 817232 - DNA, 25 bp, Mus musculus
tccgagggatagtattgccagtatg

SEQ ID NO: 817233 - DNA, 25 bp, Mus musculus
tccgagggctgcagacccagaacag

SEQ ID NO: 817234 - DNA, 25 bp, Mus musculus
tccgagggctgctgacccagaacag

SEQ ID NO: 817235 - DNA, 25 bp, Mus musculus
tccgaggtccggctcagcttggcat

SEQ ID NO: 817236 - DNA, 25 bp, Mus musculus
tccgaggtccgggtcagcttggcat

SEQ ID NO: 817237 - DNA, 25 bp, Mus musculus
tccgaggttggaaatgtcactgatt

SEQ ID NO: 817238 - DNA, 25 bp, Mus musculus
tccgaggttggatatgtcactgatt

SEQ ID NO: 817239 - DNA, 25 bp, Mus musculus
tccgagtacgctagtccagaaaacg

SEQ ID NO: 817240 - DNA, 25 bp, Mus musculus
tccgagtacgcttgtccagaaaacg

SEQ ID NO: 817241 - DNA, 25 bp, Mus musculus
tccgagtaggtgctagaagatgcca

SEQ ID NO: 817242 - DNA, 25 bp, Mus musculus
tccgagtaggtggtagaagatgcca

SEQ ID NO: 817243 - DNA, 25 bp, Mus musculus
tccgagtcccttctggtggcagcaa

SEQ ID NO: 817244 - DNA, 25 bp, Mus musculus
tccgagtcccttgtggtggcagcaa

SEQ ID NO: 817245 - DNA, 25 bp, Mus musculus
tccgagtccttccagttctcttagg

SEQ ID NO: 817246 - DNA, 25 bp, Mus musculus
tccgagtccttcgagttctcttagg

SEQ ID NO: 817247 - DNA, 25 bp, Mus musculus
tccgagtgtcctagtactgtgcaca

SEQ ID NO: 817248 - DNA, 25 bp, Mus musculus
tccgagtgtccttgtactgtgcaca

SEQ ID NO: 817249 - DNA, 25 bp, Mus musculus
tccgataaaccactcactgggctac

SEQ ID NO: 817250 - DNA, 25 bp, Mus musculus
tccgataaaccagtcactgggctac

SEQ ID NO: 817251 - DNA, 25 bp, Mus musculus
tccgataagagtctggacttctcag

SEQ ID NO: 817252 - DNA, 25 bp, Mus musculus
tccgataagagtgtggacttctcag

SEQ ID NO: 817253 - DNA, 25 bp, Mus musculus
tccgatactttgacctgggtaccgt

SEQ ID NO: 817254 - DNA, 25 bp, Mus musculus
tccgatactttgtcctgggtaccgt

SEQ ID NO: 817255 - DNA, 25 bp, Mus musculus
tccgatatgggcagaccaagaagat

SEQ ID NO: 817256 - DNA, 25 bp, Mus musculus
tccgatatgggctgaccaagaagat

SEQ ID NO: 817257 - DNA, 25 bp, Mus musculus
tccgatattcttaactggccttcag

SEQ ID NO: 817258 - DNA, 25 bp, Mus musculus
tccgatattctttactggccttcag

SEQ ID NO: 817259 - DNA, 25 bp, Mus musculus
tccgatcagtgtctgcctgtttaca

SEQ ID NO: 817260 - DNA, 25 bp, Mus musculus
tccgatcagtgtgtgcctgtttaca

SEQ ID NO: 817261 - DNA, 25 bp, Mus musculus
tccgatccctgcatcaatggaggac

SEQ ID NO: 817262 - DNA, 25 bp, Mus musculus
tccgatccctgcttcaatggaggac

SEQ ID NO: 817263 - DNA, 25 bp, Mus musculus
tccgatcctgggactgataggtcag

SEQ ID NO: 817264 - DNA, 25 bp, Mus musculus
tccgatcctgggtctgataggtcag

SEQ ID NO: 817265 - DNA, 25 bp, Mus musculus
tccgatcgaagcattaatggagcgt

SEQ ID NO: 817266 - DNA, 25 bp, Mus musculus
tccgatcgaagctttaatggagcgt

SEQ ID NO: 817267 - DNA, 25 bp, Mus musculus
tccgatcgatacagcattgggtgac

SEQ ID NO: 817268 - DNA, 25 bp, Mus musculus
tccgatcgatactgcattgggtgac

SEQ ID NO: 817269 - DNA, 25 bp, Mus musculus
tccgatctcctaagttcctttaaca

SEQ ID NO: 817270 - DNA, 25 bp, Mus musculus
tccgatctcctatgttcctttaaca

SEQ ID NO: 817271 - DNA, 25 bp, Mus musculus
tccgatgcaaaactcgggtccggtt

SEQ ID NO: 817272 - DNA, 25 bp, Mus musculus
tccgatgcaaaagtcgggtccggtt

SEQ ID NO: 817273 - DNA, 25 bp, Mus musculus
tccgatgccaccataccagaaagag

SEQ ID NO: 817274 - DNA, 25 bp, Mus musculus
tccgatgccaccttaccagaaagag

SEQ ID NO: 817275 - DNA, 25 bp, Mus musculus
tccgatggaagaagacatcctgcag

SEQ ID NO: 817276 - DNA, 25 bp, Mus musculus
tccgatggaagatgacatcctgcag

SEQ ID NO: 817277 - DNA, 25 bp, Mus musculus
tccgatgtagttcatcctcgtcttt

SEQ ID NO: 817278 - DNA, 25 bp, Mus musculus
tccgatgtagttgatcctcgtcttt

SEQ ID NO: 817279 - DNA, 25 bp, Mus musculus
tccgatgtcatgacacggagacact

SEQ ID NO: 817280 - DNA, 25 bp, Mus musculus
tccgatgtcatgtcacggagacact

SEQ ID NO: 817281 - DNA, 25 bp, Mus musculus
tccgatgttgtcaacgcctttgttt

SEQ ID NO: 817282 - DNA, 25 bp, Mus musculus
tccgatgttgtctacgcctttgttt

SEQ ID NO: 817283 - DNA, 25 bp, Mus musculus
tccgattatgctctgaagattgtca

SEQ ID NO: 817284 - DNA, 25 bp, Mus musculus
tccgattatgctgtgaagattgtca

SEQ ID NO: 817285 - DNA, 25 bp, Mus musculus
tccgattccaggcttttgaacacta

SEQ ID NO: 817286 - DNA, 25 bp, Mus musculus
tccgattccagggttttgaacacta

SEQ ID NO: 817287 - DNA, 25 bp, Mus musculus
tccgattcccacaggacccagggag

SEQ ID NO: 817288 - DNA, 25 bp, Mus musculus
tccgattcccactggacccagggag

SEQ ID NO: 817289 - DNA, 25 bp, Mus musculus
tccgattcgattccctagttggtag

SEQ ID NO: 817290 - DNA, 25 bp, Mus musculus
tccgattcgattgcctagttggtag

SEQ ID NO: 817291 - DNA, 25 bp, Mus musculus
tccgattcttccctgggcgagaaac

SEQ ID NO: 817292 - DNA, 25 bp, Mus musculus
tccgattcttccgtgggcgagaaac

SEQ ID NO: 817293 - DNA, 25 bp, Mus musculus
tccgattggctaaggctgatggaat

SEQ ID NO: 817294 - DNA, 25 bp, Mus musculus
tccgattggctatggctgatggaat

SEQ ID NO: 817295 - DNA, 25 bp, Mus musculus
tccgcaaaaattcacgcgagctgcc

SEQ ID NO: 817296 - DNA, 25 bp, Mus musculus
tccgcaaaaattgacgcgagctgcc

SEQ ID NO: 817297 - DNA, 25 bp, Mus musculus
tccgcaaacctgcaagctgagcttt

SEQ ID NO: 817298 - DNA, 25 bp, Mus musculus
tccgcaaacctggaagctgagcttt

SEQ ID NO: 817299 - DNA, 25 bp, Mus musculus
tccgcaacccgaaacaagctattgt

SEQ ID NO: 817300 - DNA, 25 bp, Mus musculus
tccgcaacccgatacaagctattgt

SEQ ID NO: 817301 - DNA, 25 bp, Mus musculus
tccgcaagcgcgaggtgtacgaccg

SEQ ID NO: 817302 - DNA, 25 bp, Mus musculus
tccgcaagcgcgtggtgtacgaccg

SEQ ID NO: 817303 - DNA, 25 bp, Mus musculus
tccgcaatcccaacagcctgaagag

SEQ ID NO: 817304 - DNA, 25 bp, Mus musculus
tccgcaatcccatcagcctgaagag

SEQ ID NO: 817305 - DNA, 25 bp, Mus musculus
tccgcaatcggcatttcaacatttt

SEQ ID NO: 817306 - DNA, 25 bp, Mus musculus
tccgcaatcggcttttcaacatttt

SEQ ID NO: 817307 - DNA, 25 bp, Mus musculus
tccgcacaagacagaggctacaggt

SEQ ID NO: 817308 - DNA, 25 bp, Mus musculus
tccgcacaagactgaggctacaggt

SEQ ID NO: 817309 - DNA, 25 bp, Mus musculus
tccgcaccggaaacattttgtcagt

SEQ ID NO: 817310 - DNA, 25 bp, Mus musculus
tccgcaccggaatcattttgtcagt

SEQ ID NO: 817311 - DNA, 25 bp, Mus musculus
tccgcaccgtggaagtagaaaccca

SEQ ID NO: 817312 - DNA, 25 bp, Mus musculus
tccgcaccgtggtagtagaaaccca

SEQ ID NO: 817313 - DNA, 25 bp, Mus musculus
tccgcacgactgatgtctgtgttgt

SEQ ID NO: 817314 - DNA, 25 bp, Mus musculus
tccgcacgactgttgtctgtgttgt

SEQ ID NO: 817315 - DNA, 25 bp, Mus musculus
tccgcactacaaagggctgtgacac

SEQ ID NO: 817316 - DNA, 25 bp, Mus musculus
tccgcactacaatgggctgtgacac

SEQ ID NO: 817317 - DNA, 25 bp, Mus musculus
tccgcactgtgacatgcttatcctg

SEQ ID NO: 817318 - DNA, 25 bp, Mus musculus
tccgcactgtgagatgcttatcctg

SEQ ID NO: 817319 - DNA, 25 bp, Mus musculus
tccgcacttgtaactgctttgcata

SEQ ID NO: 817320 - DNA, 25 bp, Mus musculus
tccgcacttgtatctgctttgcata

SEQ ID NO: 817321 - DNA, 25 bp, Mus musculus
tccgcagatcaacaagatagccttc

SEQ ID NO: 817322 - DNA, 25 bp, Mus musculus
tccgcagatcaagaagatagccttc

SEQ ID NO: 817323 - DNA, 25 bp, Mus musculus
tccgcagccaacaccagtagagaga

SEQ ID NO: 817324 - DNA, 25 bp, Mus musculus
tccgcagccaactccagtagagaga

SEQ ID NO: 817325 - DNA, 25 bp, Mus musculus
tccgcagccgacatttagattttta

SEQ ID NO: 817326 - DNA, 25 bp, Mus musculus
tccgcagccgacttttagattttta

SEQ ID NO: 817327 - DNA, 25 bp, Mus musculus
tccgcagcctccaagccatggtggg

SEQ ID NO: 817328 - DNA, 25 bp, Mus musculus
tccgcagcctcctagccatggtggg

SEQ ID NO: 817329 - DNA, 25 bp, Mus musculus
tccgcagcctctcattagcagtcaa

SEQ ID NO: 817330 - DNA, 25 bp, Mus musculus
tccgcagcctctgattagcagtcaa

SEQ ID NO: 817331 - DNA, 25 bp, Mus musculus
tccgcagcgatgagctgtggttctc

SEQ ID NO: 817332 - DNA, 25 bp, Mus musculus
tccgcagcgatgtgctgtggttctc

SEQ ID NO: 817333 - DNA, 25 bp, Mus musculus
tccgcaggaatgagcgagccatgct

SEQ ID NO: 817334 - DNA, 25 bp, Mus musculus
tccgcaggaatgtgcgagccatgct

SEQ ID NO: 817335 - DNA, 25 bp, Mus musculus
tccgcaggaccgagatcacaactgt

SEQ ID NO: 817336 - DNA, 25 bp, Mus musculus
tccgcaggaccgtgatcacaactgt

SEQ ID NO: 817337 - DNA, 25 bp, Mus musculus
tccgcaggagcgagagtatctattg

SEQ ID NO: 817338 - DNA, 25 bp, Mus musculus
tccgcaggagcgtgagtatctattg

SEQ ID NO: 817339 - DNA, 25 bp, Mus musculus
tccgcagggagtatgcaagccatct

SEQ ID NO: 817340 - DNA, 25 bp, Mus musculus
tccgcagggagtttgcaagccatct

SEQ ID NO: 817341 - DNA, 25 bp, Mus musculus
tccgcaggtactagaagctccttgg

SEQ ID NO: 817342 - DNA, 25 bp, Mus musculus
tccgcaggtacttgaagctccttgg

SEQ ID NO: 817343 - DNA, 25 bp, Mus musculus
tccgcagtccgtctaagcatgttta

SEQ ID NO: 817344 - DNA, 25 bp, Mus musculus
tccgcagtccgtgtaagcatgttta

SEQ ID NO: 817345 - DNA, 25 bp, Mus musculus
tccgcagtgtctagtggttcacaga

SEQ ID NO: 817346 - DNA, 25 bp, Mus musculus
tccgcagtgtcttgtggttcacaga

SEQ ID NO: 817347 - DNA, 25 bp, Mus musculus
tccgcatccaatcttgttctatcaa

SEQ ID NO: 817348 - DNA, 25 bp, Mus musculus
tccgcatccaatgttgttctatcaa

SEQ ID NO: 817349 - DNA, 25 bp, Mus musculus
tccgcatccttaaccatgcatgtgt

SEQ ID NO: 817350 - DNA, 25 bp, Mus musculus
tccgcatccttatccatgcatgtgt

SEQ ID NO: 817351 - DNA, 25 bp, Mus musculus
tccgcatctttgacaggaacgcaga

SEQ ID NO: 817352 - DNA, 25 bp, Mus musculus
tccgcatctttgtcaggaacgcaga

SEQ ID NO: 817353 - DNA, 25 bp, Mus musculus
tccgcatgagttaccctgaaggctt

SEQ ID NO: 817354 - DNA, 25 bp, Mus musculus
tccgcatgagtttccctgaaggctt

SEQ ID NO: 817355 - DNA, 25 bp, Mus musculus
tccgcatggaacctgacgagacggt

SEQ ID NO: 817356 - DNA, 25 bp, Mus musculus
tccgcatggaacgtgacgagacggt

SEQ ID NO: 817357 - DNA, 25 bp, Mus musculus
tccgcatggccgacaacgaagtcat

SEQ ID NO: 817358 - DNA, 25 bp, Mus musculus
tccgcatggccgtcaacgaagtcat

SEQ ID NO: 817359 - DNA, 25 bp, Mus musculus
tccgcatgttacaaccctgtaaata

SEQ ID NO: 817360 - DNA, 25 bp, Mus musculus
tccgcatgttactaccctgtaaata

SEQ ID NO: 817361 - DNA, 25 bp, Mus musculus
tccgccacccgactgctgagatgaa

SEQ ID NO: 817362 - DNA, 25 bp, Mus musculus
tccgccacccgagtgctgagatgaa

SEQ ID NO: 817363 - DNA, 25 bp, Mus musculus
tccgccacttctagacatacattgg

SEQ ID NO: 817364 - DNA, 25 bp, Mus musculus
tccgccacttcttgacatacattgg

SEQ ID NO: 817365 - DNA, 25 bp, Mus musculus
tccgccagatccaacagctgaggaa

SEQ ID NO: 817366 - DNA, 25 bp, Mus musculus
tccgccagatcctacagctgaggaa

SEQ ID NO: 817367 - DNA, 25 bp, Mus musculus
tccgccagatggagagctatcgcta

SEQ ID NO: 817368 - DNA, 25 bp, Mus musculus
tccgccagatggtgagctatcgcta

SEQ ID NO: 817369 - DNA, 25 bp, Mus musculus
tccgccagtttcctgatcctgagta

SEQ ID NO: 817370 - DNA, 25 bp, Mus musculus
tccgccagtttcgtgatcctgagta

SEQ ID NO: 817371 - DNA, 25 bp, Mus musculus
tccgccatccgccaggtgtatgaac

SEQ ID NO: 817372 - DNA, 25 bp, Mus musculus
tccgccatccgcgaggtgtatgaac

SEQ ID NO: 817373 - DNA, 25 bp, Mus musculus
tccgccatggctacggttcagatgt

SEQ ID NO: 817374 - DNA, 25 bp, Mus musculus
tccgccatggcttcggttcagatgt

SEQ ID NO: 817375 - DNA, 25 bp, Mus musculus
tccgcccaaggtcgatgttcgcatg

SEQ ID NO: 817376 - DNA, 25 bp, Mus musculus
tccgcccaaggtggatgttcgcatg

SEQ ID NO: 817377 - DNA, 25 bp, Mus musculus
tccgcccaccctcagtggaatggag

SEQ ID NO: 817378 - DNA, 25 bp, Mus musculus
tccgcccaccctgagtggaatggag

SEQ ID NO: 817379 - DNA, 25 bp, Mus musculus
tccgcccagtggagagttttaaggt

SEQ ID NO: 817380 - DNA, 25 bp, Mus musculus
tccgcccagtggtgagttttaaggt

SEQ ID NO: 817381 - DNA, 25 bp, Mus musculus
tccgcccagtgtagaggaggccagt

SEQ ID NO: 817382 - DNA, 25 bp, Mus musculus
tccgcccagtgttgaggaggccagt

SEQ ID NO: 817383 - DNA, 25 bp, Mus musculus
tccgcccctgttatgtgtatatgta

SEQ ID NO: 817384 - DNA, 25 bp, Mus musculus
tccgcccctgttttgtgtatatgta

SEQ ID NO: 817385 - DNA, 25 bp, Mus musculus
tccgcccttcagaactgtgaatgta

SEQ ID NO: 817386 - DNA, 25 bp, Mus musculus
tccgcccttcagtactgtgaatgta

SEQ ID NO: 817387 - DNA, 25 bp, Mus musculus
tccgccgagtatagctgcctcaagg

SEQ ID NO: 817388 - DNA, 25 bp, Mus musculus
tccgccgagtattgctgcctcaagg

SEQ ID NO: 817389 - DNA, 25 bp, Mus musculus
tccgccgagtgtatgtggtcaacaa

SEQ ID NO: 817390 - DNA, 25 bp, Mus musculus
tccgccgagtgtttgtggtcaacaa

SEQ ID NO: 817391 - DNA, 25 bp, Mus musculus
tccgccgatctcaacattgggaaaa

SEQ ID NO: 817392 - DNA, 25 bp, Mus musculus
tccgccgatctctacattgggaaaa

SEQ ID NO: 817393 - DNA, 25 bp, Mus musculus
tccgccgatctgaggaccaggattt

SEQ ID NO: 817394 - DNA, 25 bp, Mus musculus
tccgccgatctgtggaccaggattt

SEQ ID NO: 817395 - DNA, 25 bp, Mus musculus
tccgcctaagtgagtctctcattaa

SEQ ID NO: 817396 - DNA, 25 bp, Mus musculus
tccgcctaagtgtgtctctcattaa

SEQ ID NO: 817397 - DNA, 25 bp, Mus musculus
tccgcctagccacacagggctgctc

SEQ ID NO: 817398 - DNA, 25 bp, Mus musculus
tccgcctagccagacagggctgctc

SEQ ID NO: 817399 - DNA, 25 bp, Mus musculus
tccgcctccagaaaacttcagttga

SEQ ID NO: 817400 - DNA, 25 bp, Mus musculus
tccgcctccagataacttcagttga

SEQ ID NO: 817401 - DNA, 25 bp, Mus musculus
tccgcctccggaatgtttatcaaaa

SEQ ID NO: 817402 - DNA, 25 bp, Mus musculus
tccgcctccggattgtttatcaaaa

SEQ ID NO: 817403 - DNA, 25 bp, Mus musculus
tccgcctcctgaagcagataaaccc

SEQ ID NO: 817404 - DNA, 25 bp, Mus musculus
tccgcctcctgatgcagataaaccc

SEQ ID NO: 817405 - DNA, 25 bp, Mus musculus
tccgcctctcttcattttgttcagt

SEQ ID NO: 817406 - DNA, 25 bp, Mus musculus
tccgcctctcttgattttgttcagt

SEQ ID NO: 817407 - DNA, 25 bp, Mus musculus
tccgcctgaattcttgctgcatata

SEQ ID NO: 817408 - DNA, 25 bp, Mus musculus
tccgcctgaattgttgctgcatata

SEQ ID NO: 817409 - DNA, 25 bp, Mus musculus
tccgcctgcgcaatagtcatggtta

SEQ ID NO: 817410 - DNA, 25 bp, Mus musculus
tccgcctgcgcattagtcatggtta

SEQ ID NO: 817411 - DNA, 25 bp, Mus musculus
tccgcctgctggcatcagacagggt

SEQ ID NO: 817412 - DNA, 25 bp, Mus musculus
tccgcctgctgggatcagacagggt

SEQ ID NO: 817413 - DNA, 25 bp, Mus musculus
tccgcctggtttccttgaaagcatc

SEQ ID NO: 817414 - DNA, 25 bp, Mus musculus
tccgcctggtttgcttgaaagcatc

SEQ ID NO: 817415 - DNA, 25 bp, Mus musculus
tccgcctgtgccaagagaagctaaa

SEQ ID NO: 817416 - DNA, 25 bp, Mus musculus
tccgcctgtgcctagagaagctaaa

SEQ ID NO: 817417 - DNA, 25 bp, Mus musculus
tccgcctgtgtgcctggagccagtc

SEQ ID NO: 817418 - DNA, 25 bp, Mus musculus
tccgcctgtgtggctggagccagtc

SEQ ID NO: 817419 - DNA, 25 bp, Mus musculus
tccgccttgcacctaggtcatgtga

SEQ ID NO: 817420 - DNA, 25 bp, Mus musculus
tccgccttgcacgtaggtcatgtga

SEQ ID NO: 817421 - DNA, 25 bp, Mus musculus
tccgcgaatgcgacggcagcgctca

SEQ ID NO: 817422 - DNA, 25 bp, Mus musculus
tccgcgaatgcgtcggcagcgctca

SEQ ID NO: 817423 - DNA, 25 bp, Mus musculus
tccgcgaggcgcacttggcagcgct

SEQ ID NO: 817424 - DNA, 25 bp, Mus musculus
tccgcgaggcgctcttggcagcgct

SEQ ID NO: 817425 - DNA, 25 bp, Mus musculus
tccgcgatgactccgtgcggttaat

SEQ ID NO: 817426 - DNA, 25 bp, Mus musculus
tccgcgatgactgcgtgcggttaat

SEQ ID NO: 817427 - DNA, 25 bp, Mus musculus
tccgcgccagtcactgcaggaacag

SEQ ID NO: 817428 - DNA, 25 bp, Mus musculus
tccgcgccagtctctgcaggaacag

SEQ ID NO: 817429 - DNA, 25 bp, Mus musculus
tccgcgccgcggaagatgaacacgc

SEQ ID NO: 817430 - DNA, 25 bp, Mus musculus
tccgcgccgcggtagatgaacacgc

SEQ ID NO: 817431 - DNA, 25 bp, Mus musculus
tccgcgcggagactctcactttggg

SEQ ID NO: 817432 - DNA, 25 bp, Mus musculus
tccgcgcggagagtctcactttggg

SEQ ID NO: 817433 - DNA, 25 bp, Mus musculus
tccgcgctgttcactgaagattgca

SEQ ID NO: 817434 - DNA, 25 bp, Mus musculus
tccgcgctgttctctgaagattgca

SEQ ID NO: 817435 - DNA, 25 bp, Mus musculus
tccgcgcttgaaagttaacatgtat

SEQ ID NO: 817436 - DNA, 25 bp, Mus musculus
tccgcgcttgaatgttaacatgtat

SEQ ID NO: 817437 - DNA, 25 bp, Mus musculus
tccgcggaggctctgggccattcct

SEQ ID NO: 817438 - DNA, 25 bp, Mus musculus
tccgcggaggctgtgggccattcct

SEQ ID NO: 817439 - DNA, 25 bp, Mus musculus
tccgcggatgacatttatcgaccag

SEQ ID NO: 817440 - DNA, 25 bp, Mus musculus
tccgcggatgacttttatcgaccag

SEQ ID NO: 817441 - DNA, 25 bp, Mus musculus
tccgcggccacacgtctagaaatca

SEQ ID NO: 817442 - DNA, 25 bp, Mus musculus
tccgcggccacaggtctagaaatca

SEQ ID NO: 817443 - DNA, 25 bp, Mus musculus
tccgcgggagcactcagcatcaatg

SEQ ID NO: 817444 - DNA, 25 bp, Mus musculus
tccgcgggagcagtcagcatcaatg

SEQ ID NO: 817445 - DNA, 25 bp, Mus musculus
tccgcggtagagaacattcgtgcgc

SEQ ID NO: 817446 - DNA, 25 bp, Mus musculus
tccgcggtagagtacattcgtgcgc

SEQ ID NO: 817447 - DNA, 25 bp, Mus musculus
tccgcggtcagcacaccaagaccac

SEQ ID NO: 817448 - DNA, 25 bp, Mus musculus
tccgcggtcagctcaccaagaccac

SEQ ID NO: 817449 - DNA, 25 bp, Mus musculus
tccgcggtcccaaaagttggcattt

SEQ ID NO: 817450 - DNA, 25 bp, Mus musculus
tccgcggtcccataagttggcattt

SEQ ID NO: 817451 - DNA, 25 bp, Mus musculus
tccgcgtcacgtcgtttaaatcttc

SEQ ID NO: 817452 - DNA, 25 bp, Mus musculus
tccgcgtcacgtggtttaaatcttc

SEQ ID NO: 817453 - DNA, 25 bp, Mus musculus
tccgcgtcgctgagtaaggctgcac

SEQ ID NO: 817454 - DNA, 25 bp, Mus musculus
tccgcgtcgctgtgtaaggctgcac

SEQ ID NO: 817455 - DNA, 25 bp, Mus musculus
tccgcgtgaactcaactccaataag

SEQ ID NO: 817456 - DNA, 25 bp, Mus musculus
tccgcgtgaactgaactccaataag

SEQ ID NO: 817457 - DNA, 25 bp, Mus musculus
tccgcgttgcatctatgaggcctga

SEQ ID NO: 817458 - DNA, 25 bp, Mus musculus
tccgcgttgcatgtatgaggcctga

SEQ ID NO: 817459 - DNA, 25 bp, Mus musculus
tccgctaacaccattgcaattactg

SEQ ID NO: 817460 - DNA, 25 bp, Mus musculus
tccgctaacacctttgcaattactg

SEQ ID NO: 817461 - DNA, 25 bp, Mus musculus
tccgctcaaagtcacaggagtgcat

SEQ ID NO: 817462 - DNA, 25 bp, Mus musculus
tccgctcaaagtgacaggagtgcat

SEQ ID NO: 817463 - DNA, 25 bp, Mus musculus
tccgctcagccacgagaggctaaaa

SEQ ID NO: 817464 - DNA, 25 bp, Mus musculus
tccgctcagccaggagaggctaaaa

SEQ ID NO: 817465 - DNA, 25 bp, Mus musculus
tccgctcccctaagtgagaaagctt

SEQ ID NO: 817466 - DNA, 25 bp, Mus musculus
tccgctcccctatgtgagaaagctt

SEQ ID NO: 817467 - DNA, 25 bp, Mus musculus
tccgctcggtctcgcttggctgctt

SEQ ID NO: 817468 - DNA, 25 bp, Mus musculus
tccgctcggtctggcttggctgctt

SEQ ID NO: 817469 - DNA, 25 bp, Mus musculus
tccgctctatctaattgggtagctc

SEQ ID NO: 817470 - DNA, 25 bp, Mus musculus
tccgctctatcttattgggtagctc

SEQ ID NO: 817471 - DNA, 25 bp, Mus musculus
tccgctctgggacagtggacccttc

SEQ ID NO: 817472 - DNA, 25 bp, Mus musculus
tccgctctgggagagtggacccttc

SEQ ID NO: 817473 - DNA, 25 bp, Mus musculus
tccgctctttctcaggcctaaggaa

SEQ ID NO: 817474 - DNA, 25 bp, Mus musculus
tccgctctttctgaggcctaaggaa

SEQ ID NO: 817475 - DNA, 25 bp, Mus musculus
tccgctgaacgcctggtaagactta

SEQ ID NO: 817476 - DNA, 25 bp, Mus musculus
tccgctgaacgcgtggtaagactta

SEQ ID NO: 817477 - DNA, 25 bp, Mus musculus
tccgctgcaagcactcatgttgctg

SEQ ID NO: 817478 - DNA, 25 bp, Mus musculus
tccgctgcaagctctcatgttgctg

SEQ ID NO: 817479 - DNA, 25 bp, Mus musculus
tccgctgccaggagaatgggctttg

SEQ ID NO: 817480 - DNA, 25 bp, Mus musculus
tccgctgccaggtgaatgggctttg

SEQ ID NO: 817481 - DNA, 25 bp, Mus musculus
tccgctgccagtacgccaatggaat

SEQ ID NO: 817482 - DNA, 25 bp, Mus musculus
tccgctgccagttcgccaatggaat

SEQ ID NO: 817483 - DNA, 25 bp, Mus musculus
tccgctgccctgaacagtaaaacca

SEQ ID NO: 817484 - DNA, 25 bp, Mus musculus
tccgctgccctgtacagtaaaacca

SEQ ID NO: 817485 - DNA, 25 bp, Mus musculus
tccgctgctttacacagagcctgaa

SEQ ID NO: 817486 - DNA, 25 bp, Mus musculus
tccgctgctttagacagagcctgaa

SEQ ID NO: 817487 - DNA, 25 bp, Mus musculus
tccgctggagaaagggcctcactta

SEQ ID NO: 817488 - DNA, 25 bp, Mus musculus
tccgctggagaatgggcctcactta

SEQ ID NO: 817489 - DNA, 25 bp, Mus musculus
tccgctgtaccccaattgcaggatg

SEQ ID NO: 817490 - DNA, 25 bp, Mus musculus
tccgctgtacccgaattgcaggatg

SEQ ID NO: 817491 - DNA, 25 bp, Mus musculus
tccgctgtcctcatgagagaacgct

SEQ ID NO: 817492 - DNA, 25 bp, Mus musculus
tccgctgtcctcttgagagaacgct

SEQ ID NO: 817493 - DNA, 25 bp, Mus musculus
tccgctgtctgtcaagggaacacgg

SEQ ID NO: 817494 - DNA, 25 bp, Mus musculus
tccgctgtctgtgaagggaacacgg

SEQ ID NO: 817495 - DNA, 25 bp, Mus musculus
tccgctgtgggaccttggatcaatg

SEQ ID NO: 817496 - DNA, 25 bp, Mus musculus
tccgctgtgggagcttggatcaatg

SEQ ID NO: 817497 - DNA, 25 bp, Mus musculus
tccgctgtttctcagtgggacccca

SEQ ID NO: 817498 - DNA, 25 bp, Mus musculus
tccgctgtttctgagtgggacccca

SEQ ID NO: 817499 - DNA, 25 bp, Mus musculus
tccgcttacactctcaacgatgtga

SEQ ID NO: 817500 - DNA, 25 bp, Mus musculus
tccgcttacactgtcaacgatgtga

SEQ ID NO: 817501 - DNA, 25 bp, Mus musculus
tccgcttacctgagctaggcaagga

SEQ ID NO: 817502 - DNA, 25 bp, Mus musculus
tccgcttacctgtgctaggcaagga

SEQ ID NO: 817503 - DNA, 25 bp, Mus musculus
tccgcttagcccaccaaatatttcc

SEQ ID NO: 817504 - DNA, 25 bp, Mus musculus
tccgcttagccctccaaatatttcc

SEQ ID NO: 817505 - DNA, 25 bp, Mus musculus
tccgcttatcttacgaggctctttc

SEQ ID NO: 817506 - DNA, 25 bp, Mus musculus
tccgcttatctttcgaggctctttc

SEQ ID NO: 817507 - DNA, 25 bp, Mus musculus
tccgcttgtgagcagtctggacttc

SEQ ID NO: 817508 - DNA, 25 bp, Mus musculus
tccgcttgtgaggagtctggacttc

SEQ ID NO: 817509 - DNA, 25 bp, Mus musculus
tccgcttgttctacgtaatcactgg

SEQ ID NO: 817510 - DNA, 25 bp, Mus musculus
tccgcttgttcttcgtaatcactgg

SEQ ID NO: 817511 - DNA, 25 bp, Mus musculus
tccgcttgtttcaggaaagtgctat

SEQ ID NO: 817512 - DNA, 25 bp, Mus musculus
tccgcttgtttcctgagcctgctgg

SEQ ID NO: 817513 - DNA, 25 bp, Mus musculus
tccgcttgtttcgtgagcctgctgg

SEQ ID NO: 817514 - DNA, 25 bp, Mus musculus
tccgcttgtttctggaaagtgctat

SEQ ID NO: 817515 - DNA, 25 bp, Mus musculus
tccgctttattacccgagcagcaat

SEQ ID NO: 817516 - DNA, 25 bp, Mus musculus
tccgctttattagccgagcagcaat

SEQ ID NO: 817517 - DNA, 25 bp, Mus musculus
tccgctttttggaggtggatgtgat

SEQ ID NO: 817518 - DNA, 25 bp, Mus musculus
tccgctttttggtggtggatgtgat

SEQ ID NO: 817519 - DNA, 25 bp, Mus musculus
tccggaaacctaaccagttctatac

SEQ ID NO: 817520 - DNA, 25 bp, Mus musculus
tccggaaacctatccagttctatac

SEQ ID NO: 817521 - DNA, 25 bp, Mus musculus
tccggaaagtccagggcgacatcca

SEQ ID NO: 817522 - DNA, 25 bp, Mus musculus
tccggaaagtcctgggcgacatcca

SEQ ID NO: 817523 - DNA, 25 bp, Mus musculus
tccggaaattatagtggtaggaaat

SEQ ID NO: 817524 - DNA, 25 bp, Mus musculus
tccggaaattattgtggtaggaaat

SEQ ID NO: 817525 - DNA, 25 bp, Mus musculus
tccggaaccttaccttgatactgag

SEQ ID NO: 817526 - DNA, 25 bp, Mus musculus
tccggaaccttagcttgatactgag

SEQ ID NO: 817527 - DNA, 25 bp, Mus musculus
tccggaactatgacccagaggatga

SEQ ID NO: 817528 - DNA, 25 bp, Mus musculus
tccggaactatgtcccagaggatga

SEQ ID NO: 817529 - DNA, 25 bp, Mus musculus
tccggaactttcaaaccttgcttcg

SEQ ID NO: 817530 - DNA, 25 bp, Mus musculus
tccggaactttctaaccttgcttcg

SEQ ID NO: 817531 - DNA, 25 bp, Mus musculus
tccggaagctctctggtttgccaga

SEQ ID NO: 817532 - DNA, 25 bp, Mus musculus
tccggaagctctgtggtttgccaga

SEQ ID NO: 817533 - DNA, 25 bp, Mus musculus
tccggaaggcccagagcagtgactc

SEQ ID NO: 817534 - DNA, 25 bp, Mus musculus
tccggaaggccctgagcagtgactc

SEQ ID NO: 817535 - DNA, 25 bp, Mus musculus
tccggaagtcttagggttaattctg

SEQ ID NO: 817536 - DNA, 25 bp, Mus musculus
tccggaagtctttgggttaattctg

SEQ ID NO: 817537 - DNA, 25 bp, Mus musculus
tccggaagttttaagtgatgcttga

SEQ ID NO: 817538 - DNA, 25 bp, Mus musculus
tccggaagtttttagtgatgcttga

SEQ ID NO: 817539 - DNA, 25 bp, Mus musculus
tccggaatatcaccttgtagaaagt

SEQ ID NO: 817540 - DNA, 25 bp, Mus musculus
tccggaatatcagcttgtagaaagt

SEQ ID NO: 817541 - DNA, 25 bp, Mus musculus
tccggacactttctagcttagctga

SEQ ID NO: 817542 - DNA, 25 bp, Mus musculus
tccggacactttgtagcttagctga

SEQ ID NO: 817543 - DNA, 25 bp, Mus musculus
tccggacctcagcaaaatcttcagt

SEQ ID NO: 817544 - DNA, 25 bp, Mus musculus
tccggacctcaggaaaatcttcagt

SEQ ID NO: 817545 - DNA, 25 bp, Mus musculus
tccggactctgtctactgagtacac

SEQ ID NO: 817546 - DNA, 25 bp, Mus musculus
tccggactctgtgtactgagtacac

SEQ ID NO: 817547 - DNA, 25 bp, Mus musculus
tccggactgcgtcgaagctgagcca

SEQ ID NO: 817548 - DNA, 25 bp, Mus musculus
tccggactgcgtggaagctgagcca

SEQ ID NO: 817549 - DNA, 25 bp, Mus musculus
tccggactggcacagcttggactcg

SEQ ID NO: 817550 - DNA, 25 bp, Mus musculus
tccggactggcagagcttggactcg

SEQ ID NO: 817551 - DNA, 25 bp, Mus musculus
tccggacttgaccagcgaagagttt

SEQ ID NO: 817552 - DNA, 25 bp, Mus musculus
tccggacttgacgagcgaagagttt

SEQ ID NO: 817553 - DNA, 25 bp, Mus musculus
tccggagaactgcactcatctgtta

SEQ ID NO: 817554 - DNA, 25 bp, Mus musculus
tccggagaactggactcatctgtta

SEQ ID NO: 817555 - DNA, 25 bp, Mus musculus
tccggagaacttcgaggagcctagc

SEQ ID NO: 817556 - DNA, 25 bp, Mus musculus
tccggagaacttggaggagcctagc

SEQ ID NO: 817557 - DNA, 25 bp, Mus musculus
tccggagactacaggaaggttttgt

SEQ ID NO: 817558 - DNA, 25 bp, Mus musculus
tccggagactactggaaggttttgt

SEQ ID NO: 817559 - DNA, 25 bp, Mus musculus
tccggagattgcactgcagcgtagt

SEQ ID NO: 817560 - DNA, 25 bp, Mus musculus
tccggagattgctctgcagcgtagt

SEQ ID NO: 817561 - DNA, 25 bp, Mus musculus
tccggagcaaccctgtgtagaaagt

SEQ ID NO: 817562 - DNA, 25 bp, Mus musculus
tccggagcaaccgtgtgtagaaagt

SEQ ID NO: 817563 - DNA, 25 bp, Mus musculus
tccggagcccacccagtgaattttt

SEQ ID NO: 817564 - DNA, 25 bp, Mus musculus
tccggagcccacgcagtgaattttt

SEQ ID NO: 817565 - DNA, 25 bp, Mus musculus
tccggagcggtcagtgcatcgagtt

SEQ ID NO: 817566 - DNA, 25 bp, Mus musculus
tccggagcggtctgtgcatcgagtt

SEQ ID NO: 817567 - DNA, 25 bp, Mus musculus
tccggagcttatcctggaccatgac

SEQ ID NO: 817568 - DNA, 25 bp, Mus musculus
tccggagcttatgctggaccatgac

SEQ ID NO: 817569 - DNA, 25 bp, Mus musculus
tccggaggaaggctctaggcttctt

SEQ ID NO: 817570 - DNA, 25 bp, Mus musculus
tccggaggaagggtctaggcttctt

SEQ ID NO: 817571 - DNA, 25 bp, Mus musculus
tccggaggccttacagttctgagat

SEQ ID NO: 817572 - DNA, 25 bp, Mus musculus
tccggaggcctttcagttctgagat

SEQ ID NO: 817573 - DNA, 25 bp, Mus musculus
tccggaggttgtagcagctgacagt

SEQ ID NO: 817574 - DNA, 25 bp, Mus musculus
tccggaggttgttgcagctgacagt

SEQ ID NO: 817575 - DNA, 25 bp, Mus musculus
tccggatacctgctgcgctgagcag

SEQ ID NO: 817576 - DNA, 25 bp, Mus musculus
tccggatacctggtgcgctgagcag

SEQ ID NO: 817577 - DNA, 25 bp, Mus musculus
tccggatcacggcaatgcggctgca

SEQ ID NO: 817578 - DNA, 25 bp, Mus musculus
tccggatcacgggaatgcggctgca

SEQ ID NO: 817579 - DNA, 25 bp, Mus musculus
tccggatcactgagaagatggccaa

SEQ ID NO: 817580 - DNA, 25 bp, Mus musculus
tccggatcactgtgaagatggccaa

SEQ ID NO: 817581 - DNA, 25 bp, Mus musculus
tccggatcccaactacgcaggtgaa

SEQ ID NO: 817582 - DNA, 25 bp, Mus musculus
tccggatcccaagtacgcaggtgaa

SEQ ID NO: 817583 - DNA, 25 bp, Mus musculus
tccggatcctaaccacccatgtaaa

SEQ ID NO: 817584 - DNA, 25 bp, Mus musculus
tccggatcctaagcacccatgtaaa

SEQ ID NO: 817585 - DNA, 25 bp, Mus musculus
tccggatctcacacacatttaaagt

SEQ ID NO: 817586 - DNA, 25 bp, Mus musculus
tccggatctcactcacatttaaagt

SEQ ID NO: 817587 - DNA, 25 bp, Mus musculus
tccggatgactgaccaggaggctat

SEQ ID NO: 817588 - DNA, 25 bp, Mus musculus
tccggatgactgtccaggaggctat

SEQ ID NO: 817589 - DNA, 25 bp, Mus musculus
tccggattacagagaagtcaccttt

SEQ ID NO: 817590 - DNA, 25 bp, Mus musculus
tccggattacagtgaagtcaccttt

SEQ ID NO: 817591 - DNA, 25 bp, Mus musculus
tccggattccaaacactggcgtgag

SEQ ID NO: 817592 - DNA, 25 bp, Mus musculus
tccggattccaatcactggcgtgag

SEQ ID NO: 817593 - DNA, 25 bp, Mus musculus
tccggattccagctgtgcgcacagt

SEQ ID NO: 817594 - DNA, 25 bp, Mus musculus
tccggattccaggtgtgcgcacagt

SEQ ID NO: 817595 - DNA, 25 bp, Mus musculus
tccggcaaagctctggagttgcact

SEQ ID NO: 817596 - DNA, 25 bp, Mus musculus
tccggcaaagctgtggagttgcact

SEQ ID NO: 817597 - DNA, 25 bp, Mus musculus
tccggcaactgcagtcaatggcttt

SEQ ID NO: 817598 - DNA, 25 bp, Mus musculus
tccggcaactgctgtcaatggcttt

SEQ ID NO: 817599 - DNA, 25 bp, Mus musculus
tccggcaagacactgcactcgtgga

SEQ ID NO: 817600 - DNA, 25 bp, Mus musculus
tccggcaagacagtgcactcgtgga

SEQ ID NO: 817601 - DNA, 25 bp, Mus musculus
tccggcaccccaattataattcatg

SEQ ID NO: 817602 - DNA, 25 bp, Mus musculus
tccggcaccccatttataattcatg

SEQ ID NO: 817603 - DNA, 25 bp, Mus musculus
tccggcactcggctggtagagagag

SEQ ID NO: 817604 - DNA, 25 bp, Mus musculus
tccggcactcgggtggtagagagag

SEQ ID NO: 817605 - DNA, 25 bp, Mus musculus
tccggcagctttacctgactaatgg

SEQ ID NO: 817606 - DNA, 25 bp, Mus musculus
tccggcagcttttcctgactaatgg

SEQ ID NO: 817607 - DNA, 25 bp, Mus musculus
tccggcaggagcattacagaggtct

SEQ ID NO: 817608 - DNA, 25 bp, Mus musculus
tccggcaggagctttacagaggtct

SEQ ID NO: 817609 - DNA, 25 bp, Mus musculus
tccggcattataataccctgagcta

SEQ ID NO: 817610 - DNA, 25 bp, Mus musculus
tccggcattatattaccctgagcta

SEQ ID NO: 817611 - DNA, 25 bp, Mus musculus
tccggccaaggccagatggtaagta

SEQ ID NO: 817612 - DNA, 25 bp, Mus musculus
tccggccaaggcgagatggtaagta

SEQ ID NO: 817613 - DNA, 25 bp, Mus musculus
tccggccagcttcgaaaggcgctaa

SEQ ID NO: 817614 - DNA, 25 bp, Mus musculus
tccggccagcttggaaaggcgctaa

SEQ ID NO: 817615 - DNA, 25 bp, Mus musculus
tccggccagtagcattgatttccta

SEQ ID NO: 817616 - DNA, 25 bp, Mus musculus
tccggccagtaggattgatttccta

SEQ ID NO: 817617 - DNA, 25 bp, Mus musculus
tccggccagtgtctgttcaggccca

SEQ ID NO: 817618 - DNA, 25 bp, Mus musculus
tccggccagtgtgtgttcaggccca

SEQ ID NO: 817619 - DNA, 25 bp, Mus musculus
tccggccatctcaggtcagtgtagg

SEQ ID NO: 817620 - DNA, 25 bp, Mus musculus
tccggccatctctggtcagtgtagg

SEQ ID NO: 817621 - DNA, 25 bp, Mus musculus
tccggcccctgaagagcagatggta

SEQ ID NO: 817622 - DNA, 25 bp, Mus musculus
tccggcccctgatgagcagatggta

SEQ ID NO: 817623 - DNA, 25 bp, Mus musculus
tccggcccttgcctagcaatagaga

SEQ ID NO: 817624 - DNA, 25 bp, Mus musculus
tccggcccttgcgtagcaatagaga

SEQ ID NO: 817625 - DNA, 25 bp, Mus musculus
tccggcccttttaaatccagaatcg

SEQ ID NO: 817626 - DNA, 25 bp, Mus musculus
tccggccctttttaatccagaatcg

SEQ ID NO: 817627 - DNA, 25 bp, Mus musculus
tccggcctcggaatggatggatgca

SEQ ID NO: 817628 - DNA, 25 bp, Mus musculus
tccggcctcggattggatggatgca

SEQ ID NO: 817629 - DNA, 25 bp, Mus musculus
tccggcctcgggatcaccatagcgg

SEQ ID NO: 817630 - DNA, 25 bp, Mus musculus
tccggcctcgggttcaccatagcgg

SEQ ID NO: 817631 - DNA, 25 bp, Mus musculus
tccggcctctggagaagcccaagat

SEQ ID NO: 817632 - DNA, 25 bp, Mus musculus
tccggcctctggagatcaagacagg

SEQ ID NO: 817633 - DNA, 25 bp, Mus musculus
tccggcctctggtgaagcccaagat

SEQ ID NO: 817634 - DNA, 25 bp, Mus musculus
tccggcctctggtgatcaagacagg

SEQ ID NO: 817635 - DNA, 25 bp, Mus musculus
tccggcctgagcaaagtcagctgga

SEQ ID NO: 817636 - DNA, 25 bp, Mus musculus
tccggcctgagctaagtcagctgga

SEQ ID NO: 817637 - DNA, 25 bp, Mus musculus
tccggcctgggaacacaaatgcagt

SEQ ID NO: 817638 - DNA, 25 bp, Mus musculus
tccggcctgggatcacaaatgcagt

SEQ ID NO: 817639 - DNA, 25 bp, Mus musculus
tccggcctggtgaagagttggtttt

SEQ ID NO: 817640 - DNA, 25 bp, Mus musculus
tccggcctggtgtagagttggtttt

SEQ ID NO: 817641 - DNA, 25 bp, Mus musculus
tccggcctttacacgtttgaattga

SEQ ID NO: 817642 - DNA, 25 bp, Mus musculus
tccggcctttactcgtttgaattga

SEQ ID NO: 817643 - DNA, 25 bp, Mus musculus
tccggcgcaccaagcagaacctgga

SEQ ID NO: 817644 - DNA, 25 bp, Mus musculus
tccggcgcaccatgcagaacctgga

SEQ ID NO: 817645 - DNA, 25 bp, Mus musculus
tccggcgctatcctatcaagtgaca

SEQ ID NO: 817646 - DNA, 25 bp, Mus musculus
tccggcgctatcgtatcaagtgaca

SEQ ID NO: 817647 - DNA, 25 bp, Mus musculus
tccggcgctgacaatgggtaatact

SEQ ID NO: 817648 - DNA, 25 bp, Mus musculus
tccggcgctgactatgggtaatact

SEQ ID NO: 817649 - DNA, 25 bp, Mus musculus
tccggcgcttccctaaaggcagtaa

SEQ ID NO: 817650 - DNA, 25 bp, Mus musculus
tccggcgcttccgtaaaggcagtaa

SEQ ID NO: 817651 - DNA, 25 bp, Mus musculus
tccggcggccatattggtctcaaaa

SEQ ID NO: 817652 - DNA, 25 bp, Mus musculus
tccggcggccattttggtctcaaaa

SEQ ID NO: 817653 - DNA, 25 bp, Mus musculus
tccggcgggccaatcctcaaaaact

SEQ ID NO: 817654 - DNA, 25 bp, Mus musculus
tccggcgggccattcctcaaaaact

SEQ ID NO: 817655 - DNA, 25 bp, Mus musculus
tccggcgtgagaagtagacacacct

SEQ ID NO: 817656 - DNA, 25 bp, Mus musculus
tccggcgtgagatgtagacacacct

SEQ ID NO: 817657 - DNA, 25 bp, Mus musculus
tccggctaagtgatgtgacgtcact

SEQ ID NO: 817658 - DNA, 25 bp, Mus musculus
tccggctaagtgttgtgacgtcact

SEQ ID NO: 817659 - DNA, 25 bp, Mus musculus
tccggctacgttccaggatcagtct

SEQ ID NO: 817660 - DNA, 25 bp, Mus musculus
tccggctacgttgcaggatcagtct

SEQ ID NO: 817661 - DNA, 25 bp, Mus musculus
tccggctatgacatccctaaggata

SEQ ID NO: 817662 - DNA, 25 bp, Mus musculus
tccggctatgacttccctaaggata

SEQ ID NO: 817663 - DNA, 25 bp, Mus musculus
tccggctccacaaaggcagacagat

SEQ ID NO: 817664 - DNA, 25 bp, Mus musculus
tccggctccacataggcagacagat

SEQ ID NO: 817665 - DNA, 25 bp, Mus musculus
tccggctccatgaactggtaactta

SEQ ID NO: 817666 - DNA, 25 bp, Mus musculus
tccggctccatgtactggtaactta

SEQ ID NO: 817667 - DNA, 25 bp, Mus musculus
tccggctcctgtatgaatgcaatcc

SEQ ID NO: 817668 - DNA, 25 bp, Mus musculus
tccggctcctgtttgaatgcaatcc

SEQ ID NO: 817669 - DNA, 25 bp, Mus musculus
tccggctctacacacttgattcgaa

SEQ ID NO: 817670 - DNA, 25 bp, Mus musculus
tccggctctacagacttgattcgaa

SEQ ID NO: 817671 - DNA, 25 bp, Mus musculus
tccggctctagtcacactcaggtaa

SEQ ID NO: 817672 - DNA, 25 bp, Mus musculus
tccggctctagtgacactcaggtaa

SEQ ID NO: 817673 - DNA, 25 bp, Mus musculus
tccggctgaagcaccaaagttggag

SEQ ID NO: 817674 - DNA, 25 bp, Mus musculus
tccggctgaagctccaaagttggag

SEQ ID NO: 817675 - DNA, 25 bp, Mus musculus
tccggctgcaggctagatcctcgca

SEQ ID NO: 817676 - DNA, 25 bp, Mus musculus
tccggctgcagggtagatcctcgca

SEQ ID NO: 817677 - DNA, 25 bp, Mus musculus
tccggctgcattcggtggaattcca

SEQ ID NO: 817678 - DNA, 25 bp, Mus musculus
tccggctgcattgggtggaattcca

SEQ ID NO: 817679 - DNA, 25 bp, Mus musculus
tccggctgctggcaggagtactatt

SEQ ID NO: 817680 - DNA, 25 bp, Mus musculus
tccggctgctgggaggagtactatt

SEQ ID NO: 817681 - DNA, 25 bp, Mus musculus
tccggctggagcctaacagcaccgg

SEQ ID NO: 817682 - DNA, 25 bp, Mus musculus
tccggctggagcgtaacagcaccgg

SEQ ID NO: 817683 - DNA, 25 bp, Mus musculus
tccggctgtaccagcaccttgtgta

SEQ ID NO: 817684 - DNA, 25 bp, Mus musculus
tccggctgtacctgcaccttgtgta

SEQ ID NO: 817685 - DNA, 25 bp, Mus musculus
tccggcttagacacacagtgccttt

SEQ ID NO: 817686 - DNA, 25 bp, Mus musculus
tccggcttagactcacagtgccttt

SEQ ID NO: 817687 - DNA, 25 bp, Mus musculus
tccggcttgagcctaaggtcaggtt

SEQ ID NO: 817688 - DNA, 25 bp, Mus musculus
tccggcttgagcgtaaggtcaggtt

SEQ ID NO: 817689 - DNA, 25 bp, Mus musculus
tccggcttgccgaggcagttaggaa

SEQ ID NO: 817690 - DNA, 25 bp, Mus musculus
tccggcttgccgtggcagttaggaa

SEQ ID NO: 817691 - DNA, 25 bp, Mus musculus
tccgggaacaggaagaggaccaaat

SEQ ID NO: 817692 - DNA, 25 bp, Mus musculus
tccgggaacaggtagaggaccaaat

SEQ ID NO: 817693 - DNA, 25 bp, Mus musculus
tccgggaagctgaaagtccccgaat

SEQ ID NO: 817694 - DNA, 25 bp, Mus musculus
tccgggaagctgtaagtccccgaat

SEQ ID NO: 817695 - DNA, 25 bp, Mus musculus
tccgggaagtcaatcatgtcttagg

SEQ ID NO: 817696 - DNA, 25 bp, Mus musculus
tccgggaagtcattcatgtcttagg

SEQ ID NO: 817697 - DNA, 25 bp, Mus musculus
tccgggaattcgaaatgtgacgtgc

SEQ ID NO: 817698 - DNA, 25 bp, Mus musculus
tccgggaattcgtaatgtgacgtgc

SEQ ID NO: 817699 - DNA, 25 bp, Mus musculus
tccgggaatttgacagttactgaac

SEQ ID NO: 817700 - DNA, 25 bp, Mus musculus
tccgggaatttgtcagttactgaac

SEQ ID NO: 817701 - DNA, 25 bp, Mus musculus
tccgggacacctcaagccatttgaa

SEQ ID NO: 817702 - DNA, 25 bp, Mus musculus
tccgggacacctgaagccatttgaa

SEQ ID NO: 817703 - DNA, 25 bp, Mus musculus
tccgggacactgacatgagggacat

SEQ ID NO: 817704 - DNA, 25 bp, Mus musculus
tccgggacactgtcatgagggacat

SEQ ID NO: 817705 - DNA, 25 bp, Mus musculus
tccgggacagccaagtctatatcaa

SEQ ID NO: 817706 - DNA, 25 bp, Mus musculus
tccgggacagcctagtctatatcaa

SEQ ID NO: 817707 - DNA, 25 bp, Mus musculus
tccgggacagtgcatgggccttaca

SEQ ID NO: 817708 - DNA, 25 bp, Mus musculus
tccgggacagtggatgggccttaca

SEQ ID NO: 817709 - DNA, 25 bp, Mus musculus
tccgggacatccctgccagcgttgg

SEQ ID NO: 817710 - DNA, 25 bp, Mus musculus
tccgggacatccgtgccagcgttgg

SEQ ID NO: 817711 - DNA, 25 bp, Mus musculus
tccgggaccgccaggtattgggcaa

SEQ ID NO: 817712 - DNA, 25 bp, Mus musculus
tccgggaccgcctggtattgggcaa

SEQ ID NO: 817713 - DNA, 25 bp, Mus musculus
tccgggaccggcaggacttgaagat

SEQ ID NO: 817714 - DNA, 25 bp, Mus musculus
tccgggaccggctggacttgaagat

SEQ ID NO: 817715 - DNA, 25 bp, Mus musculus
tccgggactccgcttacataggatc

SEQ ID NO: 817716 - DNA, 25 bp, Mus musculus
tccgggactccggttacataggatc

SEQ ID NO: 817717 - DNA, 25 bp, Mus musculus
tccgggactttcaccgggtccagag

SEQ ID NO: 817718 - DNA, 25 bp, Mus musculus
tccgggactttctccgggtccagag

SEQ ID NO: 817719 - DNA, 25 bp, Mus musculus
tccgggagaagcatgatcagttgag

SEQ ID NO: 817720 - DNA, 25 bp, Mus musculus
tccgggagaagcttgatcagttgag

SEQ ID NO: 817721 - DNA, 25 bp, Mus musculus
tccgggagacctagaggacacagtc

SEQ ID NO: 817722 - DNA, 25 bp, Mus musculus
tccgggagaccttgaggacacagtc

SEQ ID NO: 817723 - DNA, 25 bp, Mus musculus
tccgggagacttagagtaaggacac

SEQ ID NO: 817724 - DNA, 25 bp, Mus musculus
tccgggagacttccactactcaggc

SEQ ID NO: 817725 - DNA, 25 bp, Mus musculus
tccgggagacttgcactactcaggc

SEQ ID NO: 817726 - DNA, 25 bp, Mus musculus
tccgggagactttgagtaaggacac

SEQ ID NO: 817727 - DNA, 25 bp, Mus musculus
tccgggagagaactcttttaagtat

SEQ ID NO: 817728 - DNA, 25 bp, Mus musculus
tccgggagagaagtcttttaagtat

SEQ ID NO: 817729 - DNA, 25 bp, Mus musculus
tccgggagccacagagagtgacaga

SEQ ID NO: 817730 - DNA, 25 bp, Mus musculus
tccgggagccactgagagtgacaga

SEQ ID NO: 817731 - DNA, 25 bp, Mus musculus
tccgggaggcaaaagagtttgacca

SEQ ID NO: 817732 - DNA, 25 bp, Mus musculus
tccgggaggcaatagagtttgacca

SEQ ID NO: 817733 - DNA, 25 bp, Mus musculus
tccgggataaggacatttttctaca

SEQ ID NO: 817734 - DNA, 25 bp, Mus musculus
tccgggataaggtcatttttctaca

SEQ ID NO: 817735 - DNA, 25 bp, Mus musculus
tccgggatttggatgttgcactacc

SEQ ID NO: 817736 - DNA, 25 bp, Mus musculus
tccgggatttggttgttgcactacc

SEQ ID NO: 817737 - DNA, 25 bp, Mus musculus
tccgggcacttgcaggactgctcaa

SEQ ID NO: 817738 - DNA, 25 bp, Mus musculus
tccgggcacttggaggactgctcaa

SEQ ID NO: 817739 - DNA, 25 bp, Mus musculus
tccgggccagcgctttaacagcagg

SEQ ID NO: 817740 - DNA, 25 bp, Mus musculus
tccgggccagcggtttaacagcagg

SEQ ID NO: 817741 - DNA, 25 bp, Mus musculus
tccgggccgggaactcaaggactag

SEQ ID NO: 817742 - DNA, 25 bp, Mus musculus
tccgggccgggatctcaaggactag

SEQ ID NO: 817743 - DNA, 25 bp, Mus musculus
tccgggcctaaaattctgaaactca

SEQ ID NO: 817744 - DNA, 25 bp, Mus musculus
tccgggcctaaatttctgaaactca

SEQ ID NO: 817745 - DNA, 25 bp, Mus musculus
tccgggcctcagaacccagtggcag

SEQ ID NO: 817746 - DNA, 25 bp, Mus musculus
tccgggcctcagtacccagtggcag

SEQ ID NO: 817747 - DNA, 25 bp, Mus musculus
tccgggctagccaaggccacatagc

SEQ ID NO: 817748 - DNA, 25 bp, Mus musculus
tccgggctagcctaggccacatagc

SEQ ID NO: 817749 - DNA, 25 bp, Mus musculus
tccgggctcaagcagacaacaaatt

SEQ ID NO: 817750 - DNA, 25 bp, Mus musculus
tccgggctcaaggagacaacaaatt

SEQ ID NO: 817751 - DNA, 25 bp, Mus musculus
tccgggctggttaatagtagtgtag

SEQ ID NO: 817752 - DNA, 25 bp, Mus musculus
tccgggctggtttatagtagtgtag

SEQ ID NO: 817753 - DNA, 25 bp, Mus musculus
tccgggctgtgcatgtttaaagaaa

SEQ ID NO: 817754 - DNA, 25 bp, Mus musculus
tccgggctgtgcttgtttaaagaaa

SEQ ID NO: 817755 - DNA, 25 bp, Mus musculus
tccgggctgtggaaaccagaacttc

SEQ ID NO: 817756 - DNA, 25 bp, Mus musculus
tccgggctgtggtaaccagaacttc

SEQ ID NO: 817757 - DNA, 25 bp, Mus musculus
tccgggcttcggatggcaaccagtt

SEQ ID NO: 817758 - DNA, 25 bp, Mus musculus
tccgggcttcggttggcaaccagtt

SEQ ID NO: 817759 - DNA, 25 bp, Mus musculus
tccggggcgctgcatagagtgctgt

SEQ ID NO: 817760 - DNA, 25 bp, Mus musculus
tccggggcgctggatagagtgctgt

SEQ ID NO: 817761 - DNA, 25 bp, Mus musculus
tccgggtaagtgcaatcatcgttta

SEQ ID NO: 817762 - DNA, 25 bp, Mus musculus
tccgggtaagtggaatcatcgttta

SEQ ID NO: 817763 - DNA, 25 bp, Mus musculus
tccgggtagtgccaagactctgtag

SEQ ID NO: 817764 - DNA, 25 bp, Mus musculus
tccgggtagtgcgaagactctgtag

SEQ ID NO: 817765 - DNA, 25 bp, Mus musculus
tccgggtcaacacatactacatagt

SEQ ID NO: 817766 - DNA, 25 bp, Mus musculus
tccgggtcaacagatactacatagt

SEQ ID NO: 817767 - DNA, 25 bp, Mus musculus
tccgggtcacctccagaactgatta

SEQ ID NO: 817768 - DNA, 25 bp, Mus musculus
tccgggtcacctgcagaactgatta

SEQ ID NO: 817769 - DNA, 25 bp, Mus musculus
tccgggtccgagaggaactgtgaat

SEQ ID NO: 817770 - DNA, 25 bp, Mus musculus
tccgggtccgagtggaactgtgaat

SEQ ID NO: 817771 - DNA, 25 bp, Mus musculus
tccgggtccttaccatgcatgggaa

SEQ ID NO: 817772 - DNA, 25 bp, Mus musculus
tccgggtccttagcatgcatgggaa

SEQ ID NO: 817773 - DNA, 25 bp, Mus musculus
tccgggtcgagcaaggaggccctca

SEQ ID NO: 817774 - DNA, 25 bp, Mus musculus
tccgggtcgagctaggaggccctca

SEQ ID NO: 817775 - DNA, 25 bp, Mus musculus
tccgggtctaggcagccctgtgtca

SEQ ID NO: 817776 - DNA, 25 bp, Mus musculus
tccgggtctagggagccctgtgtca

SEQ ID NO: 817777 - DNA, 25 bp, Mus musculus
tccgggtgcatcagtgtttatccaa

SEQ ID NO: 817778 - DNA, 25 bp, Mus musculus
tccgggtgcatctgtgtttatccaa

SEQ ID NO: 817779 - DNA, 25 bp, Mus musculus
tccgggttcccacaacaaatgatga

SEQ ID NO: 817780 - DNA, 25 bp, Mus musculus
tccgggttcccagaacaaatgatga

SEQ ID NO: 817781 - DNA, 25 bp, Mus musculus
tccgggttgctcagaccttaattaa

SEQ ID NO: 817782 - DNA, 25 bp, Mus musculus
tccgggttgctctgaccttaattaa

SEQ ID NO: 817783 - DNA, 25 bp, Mus musculus
tccggtaccgaacataacagccaag

SEQ ID NO: 817784 - DNA, 25 bp, Mus musculus
tccggtaccgaagataacagccaag

SEQ ID NO: 817785 - DNA, 25 bp, Mus musculus
tccggtactttgaagctgagctggc

SEQ ID NO: 817786 - DNA, 25 bp, Mus musculus
tccggtactttgtagctgagctggc

SEQ ID NO: 817787 - DNA, 25 bp, Mus musculus
tccggtatttgtacataatgattca

SEQ ID NO: 817788 - DNA, 25 bp, Mus musculus
tccggtatttgttcataatgattca

SEQ ID NO: 817789 - DNA, 25 bp, Mus musculus
tccggtcacaggaccaagacactaa

SEQ ID NO: 817790 - DNA, 25 bp, Mus musculus
tccggtcacaggtccaagacactaa

SEQ ID NO: 817791 - DNA, 25 bp, Mus musculus
tccggtcgagctacccagagagaga

SEQ ID NO: 817792 - DNA, 25 bp, Mus musculus
tccggtcgagcttcccagagagaga

SEQ ID NO: 817793 - DNA, 25 bp, Mus musculus
tccggtcgctggaatcgggaacctc

SEQ ID NO: 817794 - DNA, 25 bp, Mus musculus
tccggtcgctggtatcgggaacctc

SEQ ID NO: 817795 - DNA, 25 bp, Mus musculus
tccggtcgtgcacacccgtgggtct

SEQ ID NO: 817796 - DNA, 25 bp, Mus musculus
tccggtcgtgcagacccgtgggtct

SEQ ID NO: 817797 - DNA, 25 bp, Mus musculus
tccggtctcttcaaactgctgaaag

SEQ ID NO: 817798 - DNA, 25 bp, Mus musculus
tccggtctcttctaactgctgaaag

SEQ ID NO: 817799 - DNA, 25 bp, Mus musculus
tccggtcttatccctgaatgtctag

SEQ ID NO: 817800 - DNA, 25 bp, Mus musculus
tccggtcttatcgctgaatgtctag

SEQ ID NO: 817801 - DNA, 25 bp, Mus musculus
tccggtcttcgtacaatctgtcaaa

SEQ ID NO: 817802 - DNA, 25 bp, Mus musculus
tccggtcttcgtattagtgcgttca

SEQ ID NO: 817803 - DNA, 25 bp, Mus musculus
tccggtcttcgttcaatctgtcaaa

SEQ ID NO: 817804 - DNA, 25 bp, Mus musculus
tccggtcttcgttttagtgcgttca

SEQ ID NO: 817805 - DNA, 25 bp, Mus musculus
tccggtgaaccacaacaacttagca

SEQ ID NO: 817806 - DNA, 25 bp, Mus musculus
tccggtgaaccagaacaacttagca

SEQ ID NO: 817807 - DNA, 25 bp, Mus musculus
tccggtgactggaagaggcccacac

SEQ ID NO: 817808 - DNA, 25 bp, Mus musculus
tccggtgactggtagaggcccacac

SEQ ID NO: 817809 - DNA, 25 bp, Mus musculus
tccggtgagatgactgacagtgtaa

SEQ ID NO: 817810 - DNA, 25 bp, Mus musculus
tccggtgagatgtctgacagtgtaa

SEQ ID NO: 817811 - DNA, 25 bp, Mus musculus
tccggtgatgtcagctggaccaaaa

SEQ ID NO: 817812 - DNA, 25 bp, Mus musculus
tccggtgatgtctgctggaccaaaa

SEQ ID NO: 817813 - DNA, 25 bp, Mus musculus
tccggtgccttaacagaactactat

SEQ ID NO: 817814 - DNA, 25 bp, Mus musculus
tccggtgccttatcagaactactat

SEQ ID NO: 817815 - DNA, 25 bp, Mus musculus
tccggtgccttgaaccatctttaat

SEQ ID NO: 817816 - DNA, 25 bp, Mus musculus
tccggtgccttgtaccatctttaat

SEQ ID NO: 817817 - DNA, 25 bp, Mus musculus
tccggtgctgttatttgtactccaa

SEQ ID NO: 817818 - DNA, 25 bp, Mus musculus
tccggtgctgttttttgtactccaa

SEQ ID NO: 817819 - DNA, 25 bp, Mus musculus
tccggtggaaatatgagacgacagc

SEQ ID NO: 817820 - DNA, 25 bp, Mus musculus
tccggtggaaatttgagacgacagc

SEQ ID NO: 817821 - DNA, 25 bp, Mus musculus
tccggtggatggatttgattcccgt

SEQ ID NO: 817822 - DNA, 25 bp, Mus musculus
tccggtggatggttttgattcccgt

SEQ ID NO: 817823 - DNA, 25 bp, Mus musculus
tccggtggcgtgctaacctagtatg

SEQ ID NO: 817824 - DNA, 25 bp, Mus musculus
tccggtggcgtggtaacctagtatg

SEQ ID NO: 817825 - DNA, 25 bp, Mus musculus
tccggtgggacacctgctgtagccc

SEQ ID NO: 817826 - DNA, 25 bp, Mus musculus
tccggtgggacagctgctgtagccc

SEQ ID NO: 817827 - DNA, 25 bp, Mus musculus
tccggtgtcatacctgggtacctaa

SEQ ID NO: 817828 - DNA, 25 bp, Mus musculus
tccggtgtcatagctgggtacctaa

SEQ ID NO: 817829 - DNA, 25 bp, Mus musculus
tccggtgtgcatctactttgaggtg

SEQ ID NO: 817830 - DNA, 25 bp, Mus musculus
tccggtgtgcatgtactttgaggtg

SEQ ID NO: 817831 - DNA, 25 bp, Mus musculus
tccggtgtgcttattaacttccttg

SEQ ID NO: 817832 - DNA, 25 bp, Mus musculus
tccggtgtgctttttaacttccttg

SEQ ID NO: 817833 - DNA, 25 bp, Mus musculus
tccggttacatacgatccaacacct

SEQ ID NO: 817834 - DNA, 25 bp, Mus musculus
tccggttacataggatccaacacct

SEQ ID NO: 817835 - DNA, 25 bp, Mus musculus
tccggttaccagacatgaaattcat

SEQ ID NO: 817836 - DNA, 25 bp, Mus musculus
tccggttaccagtcatgaaattcat

SEQ ID NO: 817837 - DNA, 25 bp, Mus musculus
tccggttccacaattgactgatttg

SEQ ID NO: 817838 - DNA, 25 bp, Mus musculus
tccggttccacatttgactgatttg

SEQ ID NO: 817839 - DNA, 25 bp, Mus musculus
tccggttccagcctgaaagcattgc

SEQ ID NO: 817840 - DNA, 25 bp, Mus musculus
tccggttccagcgtgaaagcattgc

SEQ ID NO: 817841 - DNA, 25 bp, Mus musculus
tccggttcgagtaatgccatcaagc

SEQ ID NO: 817842 - DNA, 25 bp, Mus musculus
tccggttcgagttatgccatcaagc

SEQ ID NO: 817843 - DNA, 25 bp, Mus musculus
tccggttcgtgtcgtcgctgccaga

SEQ ID NO: 817844 - DNA, 25 bp, Mus musculus
tccggttcgtgtggtcgctgccaga

SEQ ID NO: 817845 - DNA, 25 bp, Mus musculus
tccggttctgctccacgtttaagaa

SEQ ID NO: 817846 - DNA, 25 bp, Mus musculus
tccggttctgctgcacgtttaagaa

SEQ ID NO: 817847 - DNA, 25 bp, Mus musculus
tccggttctttcaatcccaaggaga

SEQ ID NO: 817848 - DNA, 25 bp, Mus musculus
tccggttctttctatcccaaggaga

SEQ ID NO: 817849 - DNA, 25 bp, Mus musculus
tccggtttcctgcagtttatttttg

SEQ ID NO: 817850 - DNA, 25 bp, Mus musculus
tccggtttcctggagtttatttttg

SEQ ID NO: 817851 - DNA, 25 bp, Mus musculus
tccggtttgtccagtgattgttctt

SEQ ID NO: 817852 - DNA, 25 bp, Mus musculus
tccggtttgtcctgtgattgttctt

SEQ ID NO: 817853 - DNA, 25 bp, Mus musculus
tccgtaaacctgaggtgttttacat

SEQ ID NO: 817854 - DNA, 25 bp, Mus musculus
tccgtaaacctgtggtgttttacat

SEQ ID NO: 817855 - DNA, 25 bp, Mus musculus
tccgtaaaggataatccaccacaaa

SEQ ID NO: 817856 - DNA, 25 bp, Mus musculus
tccgtaaaggattatccaccacaaa

SEQ ID NO: 817857 - DNA, 25 bp, Mus musculus
tccgtaaccggacctggattgttgt

SEQ ID NO: 817858 - DNA, 25 bp, Mus musculus
tccgtaaccggagctggattgttgt

SEQ ID NO: 817859 - DNA, 25 bp, Mus musculus
tccgtaaccggcatagagagcgcgc

SEQ ID NO: 817860 - DNA, 25 bp, Mus musculus
tccgtaaccggcttagagagcgcgc

SEQ ID NO: 817861 - DNA, 25 bp, Mus musculus
tccgtaaggctgaagccttcctggg

SEQ ID NO: 817862 - DNA, 25 bp, Mus musculus
tccgtaaggctgtagccttcctggg

SEQ ID NO: 817863 - DNA, 25 bp, Mus musculus
tccgtacatgccagactattataaa

SEQ ID NO: 817864 - DNA, 25 bp, Mus musculus
tccgtacatgcctgactattataaa

SEQ ID NO: 817865 - DNA, 25 bp, Mus musculus
tccgtactaatcagaaagttctctt

SEQ ID NO: 817866 - DNA, 25 bp, Mus musculus
tccgtactaatctgaaagttctctt

SEQ ID NO: 817867 - DNA, 25 bp, Mus musculus
tccgtactgctgattcatctctcca

SEQ ID NO: 817868 - DNA, 25 bp, Mus musculus
tccgtactgctgtttcatctctcca

SEQ ID NO: 817869 - DNA, 25 bp, Mus musculus
tccgtagcgacgacattgttttcag

SEQ ID NO: 817870 - DNA, 25 bp, Mus musculus
tccgtagcgacgtcattgttttcag

SEQ ID NO: 817871 - DNA, 25 bp, Mus musculus
tccgtagctcacaggtatagtgctt

SEQ ID NO: 817872 - DNA, 25 bp, Mus musculus
tccgtagctcactggtatagtgctt

SEQ ID NO: 817873 - DNA, 25 bp, Mus musculus
tccgtagtaacaaagctgtgggctt

SEQ ID NO: 817874 - DNA, 25 bp, Mus musculus
tccgtagtaacatagctgtgggctt

SEQ ID NO: 817875 - DNA, 25 bp, Mus musculus
tccgtagtacttacgttaagtctca

SEQ ID NO: 817876 - DNA, 25 bp, Mus musculus
tccgtagtactttcgttaagtctca

SEQ ID NO: 817877 - DNA, 25 bp, Mus musculus
tccgtagtcacccagtgcgaagtta

SEQ ID NO: 817878 - DNA, 25 bp, Mus musculus
tccgtagtcaccgagtgcgaagtta

SEQ ID NO: 817879 - DNA, 25 bp, Mus musculus
tccgtagtgtccaaaggccaagggt

SEQ ID NO: 817880 - DNA, 25 bp, Mus musculus
tccgtagtgtcctaaggccaagggt

SEQ ID NO: 817881 - DNA, 25 bp, Mus musculus
tccgtatataaacggatccgatgcc

SEQ ID NO: 817882 - DNA, 25 bp, Mus musculus
tccgtatataaagggatccgatgcc

SEQ ID NO: 817883 - DNA, 25 bp, Mus musculus
tccgtatcagccacaattagaccag

SEQ ID NO: 817884 - DNA, 25 bp, Mus musculus
tccgtatcagcctcaattagaccag

SEQ ID NO: 817885 - DNA, 25 bp, Mus musculus
tccgtatcatgccagagtccagtgc

SEQ ID NO: 817886 - DNA, 25 bp, Mus musculus
tccgtatcatgcgagagtccagtgc

SEQ ID NO: 817887 - DNA, 25 bp, Mus musculus
tccgtattaagccacattcctacga

SEQ ID NO: 817888 - DNA, 25 bp, Mus musculus
tccgtattaagcgacattcctacga

SEQ ID NO: 817889 - DNA, 25 bp, Mus musculus
tccgtattttctatctctgctgtga

SEQ ID NO: 817890 - DNA, 25 bp, Mus musculus
tccgtattttctttctctgctgtga

SEQ ID NO: 817891 - DNA, 25 bp, Mus musculus
tccgtcacataaagttgggtatttt

SEQ ID NO: 817892 - DNA, 25 bp, Mus musculus
tccgtcacataatgttgggtatttt

SEQ ID NO: 817893 - DNA, 25 bp, Mus musculus
tccgtcagcctcaagggactaatga

SEQ ID NO: 817894 - DNA, 25 bp, Mus musculus
tccgtcagcctctagggactaatga

SEQ ID NO: 817895 - DNA, 25 bp, Mus musculus
tccgtcatcgtgcagcctgggaaga

SEQ ID NO: 817896 - DNA, 25 bp, Mus musculus
tccgtcatcgtggagcctgggaaga

SEQ ID NO: 817897 - DNA, 25 bp, Mus musculus
tccgtcatgaacaaacgatgcctgc

SEQ ID NO: 817898 - DNA, 25 bp, Mus musculus
tccgtcatgaactaacgatgcctgc

SEQ ID NO: 817899 - DNA, 25 bp, Mus musculus
tccgtccacccacatctaatgaaga

SEQ ID NO: 817900 - DNA, 25 bp, Mus musculus
tccgtccacccagatctaatgaaga

SEQ ID NO: 817901 - DNA, 25 bp, Mus musculus
tccgtccactttaagcctaagaact

SEQ ID NO: 817902 - DNA, 25 bp, Mus musculus
tccgtccacttttagcctaagaact

SEQ ID NO: 817903 - DNA, 25 bp, Mus musculus
tccgtccagactaccaaagagggag

SEQ ID NO: 817904 - DNA, 25 bp, Mus musculus
tccgtccagacttccaaagagggag

SEQ ID NO: 817905 - DNA, 25 bp, Mus musculus
tccgtcctaaccatggtatgcaata

SEQ ID NO: 817906 - DNA, 25 bp, Mus musculus
tccgtcctaaccttggtatgcaata

SEQ ID NO: 817907 - DNA, 25 bp, Mus musculus
tccgtcctcagtactggctggaaaa

SEQ ID NO: 817908 - DNA, 25 bp, Mus musculus
tccgtcctcagttctggctggaaaa

SEQ ID NO: 817909 - DNA, 25 bp, Mus musculus
tccgtcctccatcaagtaaactcgt

SEQ ID NO: 817910 - DNA, 25 bp, Mus musculus
tccgtcctccatgaagtaaactcgt

SEQ ID NO: 817911 - DNA, 25 bp, Mus musculus
tccgtcctggctcgctagtcacagt

SEQ ID NO: 817912 - DNA, 25 bp, Mus musculus
tccgtcctggctggctagtcacagt

SEQ ID NO: 817913 - DNA, 25 bp, Mus musculus
tccgtccttcctattgctgagtcac

SEQ ID NO: 817914 - DNA, 25 bp, Mus musculus
tccgtccttccttttgctgagtcac

SEQ ID NO: 817915 - DNA, 25 bp, Mus musculus
tccgtccttggacttgcacagctgg

SEQ ID NO: 817916 - DNA, 25 bp, Mus musculus
tccgtccttggagttgcacagctgg

SEQ ID NO: 817917 - DNA, 25 bp, Mus musculus
tccgtcgcatgcagaagggccgcaa

SEQ ID NO: 817918 - DNA, 25 bp, Mus musculus
tccgtcgcatgctgaagggccgcaa

SEQ ID NO: 817919 - DNA, 25 bp, Mus musculus
tccgtcgcctgtaaccgagtgaggt

SEQ ID NO: 817920 - DNA, 25 bp, Mus musculus
tccgtcgcctgttaccgagtgaggt

SEQ ID NO: 817921 - DNA, 25 bp, Mus musculus
tccgtcgtcgccatggtgaagctga

SEQ ID NO: 817922 - DNA, 25 bp, Mus musculus
tccgtcgtcgccttggtgaagctga

SEQ ID NO: 817923 - DNA, 25 bp, Mus musculus
tccgtcgtgtttaactatcatgatg

SEQ ID NO: 817924 - DNA, 25 bp, Mus musculus
tccgtcgtgttttactatcatgatg

SEQ ID NO: 817925 - DNA, 25 bp, Mus musculus
tccgtctactgtccaaacacagtag

SEQ ID NO: 817926 - DNA, 25 bp, Mus musculus
tccgtctactgtgcaaacacagtag

SEQ ID NO: 817927 - DNA, 25 bp, Mus musculus
tccgtctcagacaaagttcagaagt

SEQ ID NO: 817928 - DNA, 25 bp, Mus musculus
tccgtctcagactaagttcagaagt

SEQ ID NO: 817929 - DNA, 25 bp, Mus musculus
tccgtctcgtttctcttttagaaag

SEQ ID NO: 817930 - DNA, 25 bp, Mus musculus
tccgtctcgtttgtcttttagaaag

SEQ ID NO: 817931 - DNA, 25 bp, Mus musculus
tccgtctctgtgcttgctaatagtt

SEQ ID NO: 817932 - DNA, 25 bp, Mus musculus
tccgtctctgtggttgctaatagtt

SEQ ID NO: 817933 - DNA, 25 bp, Mus musculus
tccgtctggatgctggtgatcacac

SEQ ID NO: 817934 - DNA, 25 bp, Mus musculus
tccgtctggatggtggtgatcacac

SEQ ID NO: 817935 - DNA, 25 bp, Mus musculus
tccgtctggccgctgtcttcttttt

SEQ ID NO: 817936 - DNA, 25 bp, Mus musculus
tccgtctggccggtgtcttcttttt

SEQ ID NO: 817937 - DNA, 25 bp, Mus musculus
tccgtctgttcaacacgtcaggaga

SEQ ID NO: 817938 - DNA, 25 bp, Mus musculus
tccgtctgttcatcacgtcaggaga

SEQ ID NO: 817939 - DNA, 25 bp, Mus musculus
tccgtcttcgtgacagaatccttga

SEQ ID NO: 817940 - DNA, 25 bp, Mus musculus
tccgtcttcgtgtcagaatccttga

SEQ ID NO: 817941 - DNA, 25 bp, Mus musculus
tccgtgaaaactaatgtgggtggcc

SEQ ID NO: 817942 - DNA, 25 bp, Mus musculus
tccgtgaaaacttatgtgggtggcc

SEQ ID NO: 817943 - DNA, 25 bp, Mus musculus
tccgtgaagactactcccgaggagg

SEQ ID NO: 817944 - DNA, 25 bp, Mus musculus
tccgtgaagacttctcccgaggagg

SEQ ID NO: 817945 - DNA, 25 bp, Mus musculus
tccgtgaatttcagagctgtgcttt

SEQ ID NO: 817946 - DNA, 25 bp, Mus musculus
tccgtgaatttctgagctgtgcttt

SEQ ID NO: 817947 - DNA, 25 bp, Mus musculus
tccgtgacaggaacaagcgggcttt

SEQ ID NO: 817948 - DNA, 25 bp, Mus musculus
tccgtgacaggatcaagcgggcttt

SEQ ID NO: 817949 - DNA, 25 bp, Mus musculus
tccgtgacagtcaaaatgccccagt

SEQ ID NO: 817950 - DNA, 25 bp, Mus musculus
tccgtgacagtctaaatgccccagt

SEQ ID NO: 817951 - DNA, 25 bp, Mus musculus
tccgtgaccgagaccctgcaggcgt

SEQ ID NO: 817952 - DNA, 25 bp, Mus musculus
tccgtgaccgagtccctgcaggcgt

SEQ ID NO: 817953 - DNA, 25 bp, Mus musculus
tccgtgacctgaaatggacctgttg

SEQ ID NO: 817954 - DNA, 25 bp, Mus musculus
tccgtgacctgatatggacctgttg

SEQ ID NO: 817955 - DNA, 25 bp, Mus musculus
tccgtgactcccaggttgcagctta

SEQ ID NO: 817956 - DNA, 25 bp, Mus musculus
tccgtgactccctggttgcagctta

SEQ ID NO: 817957 - DNA, 25 bp, Mus musculus
tccgtgactgacacgtctgtgacga

SEQ ID NO: 817958 - DNA, 25 bp, Mus musculus
tccgtgactgactcgtctgtgacga

SEQ ID NO: 817959 - DNA, 25 bp, Mus musculus
tccgtgagctgacgaccatcattga

SEQ ID NO: 817960 - DNA, 25 bp, Mus musculus
tccgtgagctgaggaccatcattga

SEQ ID NO: 817961 - DNA, 25 bp, Mus musculus
tccgtgaggcctcatcagggcttta

SEQ ID NO: 817962 - DNA, 25 bp, Mus musculus
tccgtgaggcctgatcagggcttta

SEQ ID NO: 817963 - DNA, 25 bp, Mus musculus
tccgtgagggcacggaccatgtctt

SEQ ID NO: 817964 - DNA, 25 bp, Mus musculus
tccgtgagggcagggaccatgtctt

SEQ ID NO: 817965 - DNA, 25 bp, Mus musculus
tccgtgatgaggcagccggaacttt

SEQ ID NO: 817966 - DNA, 25 bp, Mus musculus
tccgtgatgagggagccggaacttt

SEQ ID NO: 817967 - DNA, 25 bp, Mus musculus
tccgtgattcccagtcaaattgcta

SEQ ID NO: 817968 - DNA, 25 bp, Mus musculus
tccgtgattccctgtcaaattgcta

SEQ ID NO: 817969 - DNA, 25 bp, Mus musculus
tccgtgatttccaacagccttgagc

SEQ ID NO: 817970 - DNA, 25 bp, Mus musculus
tccgtgatttccattgtaatcgctt

SEQ ID NO: 817971 - DNA, 25 bp, Mus musculus
tccgtgatttcctacagccttgagc

SEQ ID NO: 817972 - DNA, 25 bp, Mus musculus
tccgtgatttcctttgtaatcgctt

SEQ ID NO: 817973 - DNA, 25 bp, Mus musculus
tccgtgcagagccaaagtgctgact

SEQ ID NO: 817974 - DNA, 25 bp, Mus musculus
tccgtgcagagcgaaagtgctgact

SEQ ID NO: 817975 - DNA, 25 bp, Mus musculus
tccgtgcagatacgattggcaagcc

SEQ ID NO: 817976 - DNA, 25 bp, Mus musculus
tccgtgcagataggattggcaagcc

SEQ ID NO: 817977 - DNA, 25 bp, Mus musculus
tccgtgcagtttaatccaggccaaa

SEQ ID NO: 817978 - DNA, 25 bp, Mus musculus
tccgtgcagttttatccaggccaaa

SEQ ID NO: 817979 - DNA, 25 bp, Mus musculus
tccgtgcatccgagtacacgtgcaa

SEQ ID NO: 817980 - DNA, 25 bp, Mus musculus
tccgtgcatccgtgtacacgtgcaa

SEQ ID NO: 817981 - DNA, 25 bp, Mus musculus
tccgtgccatgcacatggaagggct

SEQ ID NO: 817982 - DNA, 25 bp, Mus musculus
tccgtgccatgctcatggaagggct

SEQ ID NO: 817983 - DNA, 25 bp, Mus musculus
tccgtgcccagcaaggaagaggtat

SEQ ID NO: 817984 - DNA, 25 bp, Mus musculus
tccgtgcccagctaggaagaggtat

SEQ ID NO: 817985 - DNA, 25 bp, Mus musculus
tccgtgccccacaattgtatgagca

SEQ ID NO: 817986 - DNA, 25 bp, Mus musculus
tccgtgccccactattgtatgagca

SEQ ID NO: 817987 - DNA, 25 bp, Mus musculus
tccgtgcgtgtgcgacacgttccga

SEQ ID NO: 817988 - DNA, 25 bp, Mus musculus
tccgtgcgtgtgggacacgttccga

SEQ ID NO: 817989 - DNA, 25 bp, Mus musculus
tccgtgctaagtatgcagcattgtg

SEQ ID NO: 817990 - DNA, 25 bp, Mus musculus
tccgtgctaagtttgcagcattgtg

SEQ ID NO: 817991 - DNA, 25 bp, Mus musculus
tccgtgctcacaaatgtaccacagt

SEQ ID NO: 817992 - DNA, 25 bp, Mus musculus
tccgtgctcacatatgtaccacagt

SEQ ID NO: 817993 - DNA, 25 bp, Mus musculus
tccgtgctccttaaataattgttgt

SEQ ID NO: 817994 - DNA, 25 bp, Mus musculus
tccgtgctcctttaataattgttgt

SEQ ID NO: 817995 - DNA, 25 bp, Mus musculus
tccgtgctgaagatgccttgttttt

SEQ ID NO: 817996 - DNA, 25 bp, Mus musculus
tccgtgctgaagttgccttgttttt

SEQ ID NO: 817997 - DNA, 25 bp, Mus musculus
tccgtgcttcatcggaataaacatt

SEQ ID NO: 817998 - DNA, 25 bp, Mus musculus
tccgtgcttcatgggaataaacatt

SEQ ID NO: 817999 - DNA, 25 bp, Mus musculus
tccgtggacaggaacacccatttca

SEQ ID NO: 818000 - DNA, 25 bp, Mus musculus
tccgtggacaggtacacccatttca

SEQ ID NO: 818001 - DNA, 25 bp, Mus musculus
tccgtggacatgacctgtgagggct

SEQ ID NO: 818002 - DNA, 25 bp, Mus musculus
tccgtggacatgtcctgtgagggct

SEQ ID NO: 818003 - DNA, 25 bp, Mus musculus
tccgtggcggtcattttggagcatt

SEQ ID NO: 818004 - DNA, 25 bp, Mus musculus
tccgtggcggtctttttggagcatt

SEQ ID NO: 818005 - DNA, 25 bp, Mus musculus
tccgtggctgctcattttagtcacc

SEQ ID NO: 818006 - DNA, 25 bp, Mus musculus
tccgtggctgctgattttagtcacc

SEQ ID NO: 818007 - DNA, 25 bp, Mus musculus
tccgtgggagatcgaaggctttttt

SEQ ID NO: 818008 - DNA, 25 bp, Mus musculus
tccgtgggagatggaaggctttttt

SEQ ID NO: 818009 - DNA, 25 bp, Mus musculus
tccgtgggcaccaagcatatatgtg

SEQ ID NO: 818010 - DNA, 25 bp, Mus musculus
tccgtgggcacctagcatatatgtg

SEQ ID NO: 818011 - DNA, 25 bp, Mus musculus
tccgtggtgcacatgggttgcagat

SEQ ID NO: 818012 - DNA, 25 bp, Mus musculus
tccgtggtgcacttgggttgcagat

SEQ ID NO: 818013 - DNA, 25 bp, Mus musculus
tccgtggttccgatgtgttgactga

SEQ ID NO: 818014 - DNA, 25 bp, Mus musculus
tccgtggttccgttgtgttgactga

SEQ ID NO: 818015 - DNA, 25 bp, Mus musculus
tccgtgtacctcaagacctatgtta

SEQ ID NO: 818016 - DNA, 25 bp, Mus musculus
tccgtgtacctctagacctatgtta

SEQ ID NO: 818017 - DNA, 25 bp, Mus musculus
tccgtgtagataaccagcgccagtg

SEQ ID NO: 818018 - DNA, 25 bp, Mus musculus
tccgtgtagatatccagcgccagtg

SEQ ID NO: 818019 - DNA, 25 bp, Mus musculus
tccgtgtagatgaaacccatgtcta

SEQ ID NO: 818020 - DNA, 25 bp, Mus musculus
tccgtgtagatgtaacccatgtcta

SEQ ID NO: 818021 - DNA, 25 bp, Mus musculus
tccgtgtcaccactgatgaactcat

SEQ ID NO: 818022 - DNA, 25 bp, Mus musculus
tccgtgtcaccagtgatgaactcat

SEQ ID NO: 818023 - DNA, 25 bp, Mus musculus
tccgtgtcacgtcttgtcatggtaa

SEQ ID NO: 818024 - DNA, 25 bp, Mus musculus
tccgtgtcacgtgttgtcatggtaa

SEQ ID NO: 818025 - DNA, 25 bp, Mus musculus
tccgtgtcctatcgagcagggcagc

SEQ ID NO: 818026 - DNA, 25 bp, Mus musculus
tccgtgtcctatggagcagggcagc

SEQ ID NO: 818027 - DNA, 25 bp, Mus musculus
tccgtgtcgaatcctgtactttaat

SEQ ID NO: 818028 - DNA, 25 bp, Mus musculus
tccgtgtcgaatgctgtactttaat

SEQ ID NO: 818029 - DNA, 25 bp, Mus musculus
tccgtgtcggtgacgtcacggccac

SEQ ID NO: 818030 - DNA, 25 bp, Mus musculus
tccgtgtcggtgtcgtcacggccac

SEQ ID NO: 818031 - DNA, 25 bp, Mus musculus
tccgtgtctcgcatcatcattgaag

SEQ ID NO: 818032 - DNA, 25 bp, Mus musculus
tccgtgtctcgcttcatcattgaag

SEQ ID NO: 818033 - DNA, 25 bp, Mus musculus
tccgtgtctctcaaagcgtcaggga

SEQ ID NO: 818034 - DNA, 25 bp, Mus musculus
tccgtgtctctctaagcgtcaggga

SEQ ID NO: 818035 - DNA, 25 bp, Mus musculus
tccgtgtgacctcagttctgggagt

SEQ ID NO: 818036 - DNA, 25 bp, Mus musculus
tccgtgtgacctgagttctgggagt

SEQ ID NO: 818037 - DNA, 25 bp, Mus musculus
tccgtgtgactcatgctaatgggta

SEQ ID NO: 818038 - DNA, 25 bp, Mus musculus
tccgtgtgactcttgctaatgggta

SEQ ID NO: 818039 - DNA, 25 bp, Mus musculus
tccgtgtgccagattaccctggaga

SEQ ID NO: 818040 - DNA, 25 bp, Mus musculus
tccgtgtgccagtttaccctggaga

SEQ ID NO: 818041 - DNA, 25 bp, Mus musculus
tccgtgtgccgcattcagaaaattg

SEQ ID NO: 818042 - DNA, 25 bp, Mus musculus
tccgtgtgccgctttcagaaaattg

SEQ ID NO: 818043 - DNA, 25 bp, Mus musculus
tccgtgtggttcaggtgtggttcca

SEQ ID NO: 818044 - DNA, 25 bp, Mus musculus
tccgtgtggttctggtgtggttcca

SEQ ID NO: 818045 - DNA, 25 bp, Mus musculus
tccgtgtgtgttcctgacagtgtga

SEQ ID NO: 818046 - DNA, 25 bp, Mus musculus
tccgtgtgtgttgctgacagtgtga

SEQ ID NO: 818047 - DNA, 25 bp, Mus musculus
tccgtgtgttcaccctgttatgtga

SEQ ID NO: 818048 - DNA, 25 bp, Mus musculus
tccgtgtgttcagcctgttatgtga

SEQ ID NO: 818049 - DNA, 25 bp, Mus musculus
tccgtgttagccactgatttgacaa

SEQ ID NO: 818050 - DNA, 25 bp, Mus musculus
tccgtgttagcctctgatttgacaa

SEQ ID NO: 818051 - DNA, 25 bp, Mus musculus
tccgtgttcttccaattctcaaatc

SEQ ID NO: 818052 - DNA, 25 bp, Mus musculus
tccgtgttcttcgaattctcaaatc

SEQ ID NO: 818053 - DNA, 25 bp, Mus musculus
tccgtgttgaagaccatcccgcttt

SEQ ID NO: 818054 - DNA, 25 bp, Mus musculus
tccgtgttgaagtccatcccgcttt

SEQ ID NO: 818055 - DNA, 25 bp, Mus musculus
tccgtgtttaccactctgtttgtga

SEQ ID NO: 818056 - DNA, 25 bp, Mus musculus
tccgtgtttacctctctgtttgtga

SEQ ID NO: 818057 - DNA, 25 bp, Mus musculus
tccgttacctccatgcgcataaaaa

SEQ ID NO: 818058 - DNA, 25 bp, Mus musculus
tccgttacctccttgcgcataaaaa

SEQ ID NO: 818059 - DNA, 25 bp, Mus musculus
tccgttagcactccttactgcttca

SEQ ID NO: 818060 - DNA, 25 bp, Mus musculus
tccgttagcactgcttactgcttca

SEQ ID NO: 818061 - DNA, 25 bp, Mus musculus
tccgttagttgaacttcaagaccac

SEQ ID NO: 818062 - DNA, 25 bp, Mus musculus
tccgttagttgatcttcaagaccac

SEQ ID NO: 818063 - DNA, 25 bp, Mus musculus
tccgttatcagtattgtgacccacc

SEQ ID NO: 818064 - DNA, 25 bp, Mus musculus
tccgttatcagttttgtgacccacc

SEQ ID NO: 818065 - DNA, 25 bp, Mus musculus
tccgttcactacagtacacatgctt

SEQ ID NO: 818066 - DNA, 25 bp, Mus musculus
tccgttcactactgtacacatgctt

SEQ ID NO: 818067 - DNA, 25 bp, Mus musculus
tccgttccaactcggcagttcagtg

SEQ ID NO: 818068 - DNA, 25 bp, Mus musculus
tccgttccaactgggcagttcagtg

SEQ ID NO: 818069 - DNA, 25 bp, Mus musculus
tccgttccagtgctgcatgacccaa

SEQ ID NO: 818070 - DNA, 25 bp, Mus musculus
tccgttccagtggtgcatgacccaa

SEQ ID NO: 818071 - DNA, 25 bp, Mus musculus
tccgttccagttcagattgacaccc

SEQ ID NO: 818072 - DNA, 25 bp, Mus musculus
tccgttccagttgagattgacaccc

SEQ ID NO: 818073 - DNA, 25 bp, Mus musculus
tccgttccgaggatacaatatggga

SEQ ID NO: 818074 - DNA, 25 bp, Mus musculus
tccgttccgaggttacaatatggga

SEQ ID NO: 818075 - DNA, 25 bp, Mus musculus
tccgttccgtgtagggctctagcgc

SEQ ID NO: 818076 - DNA, 25 bp, Mus musculus
tccgttccgtgttgggctctagcgc

SEQ ID NO: 818077 - DNA, 25 bp, Mus musculus
tccgttcctgcaatagctgtctgaa

SEQ ID NO: 818078 - DNA, 25 bp, Mus musculus
tccgttcctgcattagctgtctgaa

SEQ ID NO: 818079 - DNA, 25 bp, Mus musculus
tccgttcgttctccagaaggcagga

SEQ ID NO: 818080 - DNA, 25 bp, Mus musculus
tccgttcgttctgcagaaggcagga

SEQ ID NO: 818081 - DNA, 25 bp, Mus musculus
tccgttctagtcacacagccaatga

SEQ ID NO: 818082 - DNA, 25 bp, Mus musculus
tccgttctagtctcacagccaatga

SEQ ID NO: 818083 - DNA, 25 bp, Mus musculus
tccgttctagtgaatatgcagagcc

SEQ ID NO: 818084 - DNA, 25 bp, Mus musculus
tccgttctagtgtatatgcagagcc

SEQ ID NO: 818085 - DNA, 25 bp, Mus musculus
tccgttctatccatcggactttcct

SEQ ID NO: 818086 - DNA, 25 bp, Mus musculus
tccgttctatccttcggactttcct

SEQ ID NO: 818087 - DNA, 25 bp, Mus musculus
tccgttctccagagccatggagatt

SEQ ID NO: 818088 - DNA, 25 bp, Mus musculus
tccgttctccagtgccatggagatt

SEQ ID NO: 818089 - DNA, 25 bp, Mus musculus
tccgttctcggtagttttgatgttt

SEQ ID NO: 818090 - DNA, 25 bp, Mus musculus
tccgttctcggttgttttgatgttt

SEQ ID NO: 818091 - DNA, 25 bp, Mus musculus
tccgttctctcaaggtttctgtgca

SEQ ID NO: 818092 - DNA, 25 bp, Mus musculus
tccgttctctcatggtttctgtgca

SEQ ID NO: 818093 - DNA, 25 bp, Mus musculus
tccgttctgtccactgttgtttaat

SEQ ID NO: 818094 - DNA, 25 bp, Mus musculus
tccgttctgtcctctgttgtttaat

SEQ ID NO: 818095 - DNA, 25 bp, Mus musculus
tccgttgatcgtacgcaacttgcga

SEQ ID NO: 818096 - DNA, 25 bp, Mus musculus
tccgttgatcgttcgcaacttgcga

SEQ ID NO: 818097 - DNA, 25 bp, Mus musculus
tccgttgccatgaaatcctgcctgt

SEQ ID NO: 818098 - DNA, 25 bp, Mus musculus
tccgttgccatgtaatcctgcctgt

SEQ ID NO: 818099 - DNA, 25 bp, Mus musculus
tccgttgcgtttcgtccttaacgag

SEQ ID NO: 818100 - DNA, 25 bp, Mus musculus
tccgttgcgtttggtccttaacgag

SEQ ID NO: 818101 - DNA, 25 bp, Mus musculus
tccgttgctttgctttctaattaac

SEQ ID NO: 818102 - DNA, 25 bp, Mus musculus
tccgttgctttggtttctaattaac

SEQ ID NO: 818103 - DNA, 25 bp, Mus musculus
tccgttggcttgagtttctaggtga

SEQ ID NO: 818104 - DNA, 25 bp, Mus musculus
tccgttggcttgtgtttctaggtga

SEQ ID NO: 818105 - DNA, 25 bp, Mus musculus
tccgttgggtttctatggccctcca

SEQ ID NO: 818106 - DNA, 25 bp, Mus musculus
tccgttgggtttgtatggccctcca

SEQ ID NO: 818107 - DNA, 25 bp, Mus musculus
tccgttggtatgatgaacacttgct

SEQ ID NO: 818108 - DNA, 25 bp, Mus musculus
tccgttggtatgttgaacacttgct

SEQ ID NO: 818109 - DNA, 25 bp, Mus musculus
tccgttggtccaacatctaagaaaa

SEQ ID NO: 818110 - DNA, 25 bp, Mus musculus
tccgttggtccatcatctaagaaaa

SEQ ID NO: 818111 - DNA, 25 bp, Mus musculus
tccgttggtggaaacttgggttatg

SEQ ID NO: 818112 - DNA, 25 bp, Mus musculus
tccgttggtggatacttgggttatg

SEQ ID NO: 818113 - DNA, 25 bp, Mus musculus
tccgttgtaaagagcattgaccact

SEQ ID NO: 818114 - DNA, 25 bp, Mus musculus
tccgttgtaaagtgcattgaccact

SEQ ID NO: 818115 - DNA, 25 bp, Mus musculus
tccgttgtacatattagtctccgtt

SEQ ID NO: 818116 - DNA, 25 bp, Mus musculus
tccgttgtacattttagtctccgtt

SEQ ID NO: 818117 - DNA, 25 bp, Mus musculus
tccgttgtgcaaactgagagtgaat

SEQ ID NO: 818118 - DNA, 25 bp, Mus musculus
tccgttgtgcaatctgagagtgaat

SEQ ID NO: 818119 - DNA, 25 bp, Mus musculus
tccgttgtggatatgatgtgccacc

SEQ ID NO: 818120 - DNA, 25 bp, Mus musculus
tccgttgtggatttgatgtgccacc

SEQ ID NO: 818121 - DNA, 25 bp, Mus musculus
tccgtttaagggaggtcagacatca

SEQ ID NO: 818122 - DNA, 25 bp, Mus musculus
tccgtttaagggtggtcagacatca

SEQ ID NO: 818123 - DNA, 25 bp, Mus musculus
tccgtttaagtcaagcgtgtcccat

SEQ ID NO: 818124 - DNA, 25 bp, Mus musculus
tccgtttaagtctagcgtgtcccat

SEQ ID NO: 818125 - DNA, 25 bp, Mus musculus
tccgtttactgtcatgtgctactgt

SEQ ID NO: 818126 - DNA, 25 bp, Mus musculus
tccgtttactgtgatgtgctactgt

SEQ ID NO: 818127 - DNA, 25 bp, Mus musculus
tccgtttcagtaatgcagcaggaga

SEQ ID NO: 818128 - DNA, 25 bp, Mus musculus
tccgtttcagtattgcagcaggaga

SEQ ID NO: 818129 - DNA, 25 bp, Mus musculus
tccgtttctctaagtcaggttggct

SEQ ID NO: 818130 - DNA, 25 bp, Mus musculus
tccgtttctctatgtcaggttggct

SEQ ID NO: 818131 - DNA, 25 bp, Mus musculus
tccgtttcttcccagcagaagggat

SEQ ID NO: 818132 - DNA, 25 bp, Mus musculus
tccgtttcttccgagcagaagggat

SEQ ID NO: 818133 - DNA, 25 bp, Mus musculus
tccgtttgataaaggcggacccaag

SEQ ID NO: 818134 - DNA, 25 bp, Mus musculus
tccgtttgataatggcggacccaag

SEQ ID NO: 818135 - DNA, 25 bp, Mus musculus
tccgtttgggcgattttctgacttg

SEQ ID NO: 818136 - DNA, 25 bp, Mus musculus
tccgtttgggcgtttttctgacttg

SEQ ID NO: 818137 - DNA, 25 bp, Mus musculus
tccgtttgttccaaaactccaacag

SEQ ID NO: 818138 - DNA, 25 bp, Mus musculus
tccgtttgttcctaaactccaacag

SEQ ID NO: 818139 - DNA, 25 bp, Mus musculus
tccgttttgtacaggcctcaacaag

SEQ ID NO: 818140 - DNA, 25 bp, Mus musculus
tccgttttgtactggcctcaacaag

SEQ ID NO: 818141 - DNA, 25 bp, Mus musculus
tccgtttttcctatcagactacatt

SEQ ID NO: 818142 - DNA, 25 bp, Mus musculus
tccgtttttcctttcagactacatt

SEQ ID NO: 818143 - DNA, 25 bp, Mus musculus
tccgtttttgttactggttactgtg

SEQ ID NO: 818144 - DNA, 25 bp, Mus musculus
tccgtttttgtttctggttactgtg

SEQ ID NO: 818145 - DNA, 25 bp, Mus musculus
tcctaaaacctccttaataaacatg

SEQ ID NO: 818146 - DNA, 25 bp, Mus musculus
tcctaaaacctcgttaataaacatg

SEQ ID NO: 818147 - DNA, 25 bp, Mus musculus
tcctaaaatcagatgctgccgcaga

SEQ ID NO: 818148 - DNA, 25 bp, Mus musculus
tcctaaaatcagttgctgccgcaga

SEQ ID NO: 818149 - DNA, 25 bp, Mus musculus
tcctaaaatgccctctgccagataa

SEQ ID NO: 818150 - DNA, 25 bp, Mus musculus
tcctaaaatgccgtctgccagataa

SEQ ID NO: 818151 - DNA, 25 bp, Mus musculus
tcctaaaatttgaccccagctcttt

SEQ ID NO: 818152 - DNA, 25 bp, Mus musculus
tcctaaaatttgtccccagctcttt

SEQ ID NO: 818153 - DNA, 25 bp, Mus musculus
tcctaaacagtacttttccttccag

SEQ ID NO: 818154 - DNA, 25 bp, Mus musculus
tcctaaacagtagttttccttccag

SEQ ID NO: 818155 - DNA, 25 bp, Mus musculus
tcctaaacatagacttctgagcccc

SEQ ID NO: 818156 - DNA, 25 bp, Mus musculus
tcctaaacatagtcttctgagcccc

SEQ ID NO: 818157 - DNA, 25 bp, Mus musculus
tcctaaacggagctgtgactgagat

SEQ ID NO: 818158 - DNA, 25 bp, Mus musculus
tcctaaacggaggtgtgactgagat

SEQ ID NO: 818159 - DNA, 25 bp, Mus musculus
tcctaaagaacgagtattttctgta

SEQ ID NO: 818160 - DNA, 25 bp, Mus musculus
tcctaaagaacgtgtattttctgta

SEQ ID NO: 818161 - DNA, 25 bp, Mus musculus
tcctaaagagtactgacggcatgca

SEQ ID NO: 818162 - DNA, 25 bp, Mus musculus
tcctaaagagtagtgacggcatgca

SEQ ID NO: 818163 - DNA, 25 bp, Mus musculus
tcctaaagatttccctctgatgtcc

SEQ ID NO: 818164 - DNA, 25 bp, Mus musculus
tcctaaagatttgcctctgatgtcc

SEQ ID NO: 818165 - DNA, 25 bp, Mus musculus
tcctaaagggtgcacaagcttcatt

SEQ ID NO: 818166 - DNA, 25 bp, Mus musculus
tcctaaagggtggacaagcttcatt

SEQ ID NO: 818167 - DNA, 25 bp, Mus musculus
tcctaaagtgagatcgatacccaag

SEQ ID NO: 818168 - DNA, 25 bp, Mus musculus
tcctaaagtgagttcgatacccaag

SEQ ID NO: 818169 - DNA, 25 bp, Mus musculus
tcctaaagtgcaactagtttcccta

SEQ ID NO: 818170 - DNA, 25 bp, Mus musculus
tcctaaagtgcatctagtttcccta

SEQ ID NO: 818171 - DNA, 25 bp, Mus musculus
tcctaaatagcaccaacgtgaaatg

SEQ ID NO: 818172 - DNA, 25 bp, Mus musculus
tcctaaatagcagcaacgtgaaatg

SEQ ID NO: 818173 - DNA, 25 bp, Mus musculus
tcctaaatgcggagctgtctccagc

SEQ ID NO: 818174 - DNA, 25 bp, Mus musculus
tcctaaatgcggtgctgtctccagc

SEQ ID NO: 818175 - DNA, 25 bp, Mus musculus
tcctaacaagcacatgaaggctcat

SEQ ID NO: 818176 - DNA, 25 bp, Mus musculus
tcctaacaagcagatgaaggctcat

SEQ ID NO: 818177 - DNA, 25 bp, Mus musculus
tcctaaccgtggcagcgcctcattg

SEQ ID NO: 818178 - DNA, 25 bp, Mus musculus
tcctaaccgtgggagcgcctcattg

SEQ ID NO: 818179 - DNA, 25 bp, Mus musculus
tcctaacctttgacgactctgtatt

SEQ ID NO: 818180 - DNA, 25 bp, Mus musculus
tcctaacctttgatgactctgtatt

SEQ ID NO: 818181 - DNA, 25 bp, Mus musculus
tcctaacctttgtcgactctgtatt

SEQ ID NO: 818182 - DNA, 25 bp, Mus musculus
tcctaacctttgttgactctgtatt

SEQ ID NO: 818183 - DNA, 25 bp, Mus musculus
tcctaactacgaacagaccaaattt

SEQ ID NO: 818184 - DNA, 25 bp, Mus musculus
tcctaactacgatcagaccaaattt

SEQ ID NO: 818185 - DNA, 25 bp, Mus musculus
tcctaactgaagacacttgggccca

SEQ ID NO: 818186 - DNA, 25 bp, Mus musculus
tcctaactgaagtcacttgggccca

SEQ ID NO: 818187 - DNA, 25 bp, Mus musculus
tcctaactgaatatagcctgtataa

SEQ ID NO: 818188 - DNA, 25 bp, Mus musculus
tcctaactgaatttagcctgtataa

SEQ ID NO: 818189 - DNA, 25 bp, Mus musculus
tcctaacttagcctctgacagtgac

SEQ ID NO: 818190 - DNA, 25 bp, Mus musculus
tcctaacttagcgtctgacagtgac

SEQ ID NO: 818191 - DNA, 25 bp, Mus musculus
tcctaacttattcatgtggtggctt

SEQ ID NO: 818192 - DNA, 25 bp, Mus musculus
tcctaacttattgatgtggtggctt

SEQ ID NO: 818193 - DNA, 25 bp, Mus musculus
tcctaacttggtctgttgtgttttt

SEQ ID NO: 818194 - DNA, 25 bp, Mus musculus
tcctaacttggtgtgttgtgttttt

SEQ ID NO: 818195 - DNA, 25 bp, Mus musculus
tcctaacttgtccattttgttgcat

SEQ ID NO: 818196 - DNA, 25 bp, Mus musculus
tcctaacttgtcgattttgttgcat

SEQ ID NO: 818197 - DNA, 25 bp, Mus musculus
tcctaagaatttcccacgctagaag

SEQ ID NO: 818198 - DNA, 25 bp, Mus musculus
tcctaagaatttgccacgctagaag

SEQ ID NO: 818199 - DNA, 25 bp, Mus musculus
tcctaagactttcctgagagacgta

SEQ ID NO: 818200 - DNA, 25 bp, Mus musculus
tcctaagactttgctgagagacgta

SEQ ID NO: 818201 - DNA, 25 bp, Mus musculus
tcctaagaggatcctgtaccccagg

SEQ ID NO: 818202 - DNA, 25 bp, Mus musculus
tcctaagaggatgctgtaccccagg

SEQ ID NO: 818203 - DNA, 25 bp, Mus musculus
tcctaagcctgaactcaccgaagat

SEQ ID NO: 818204 - DNA, 25 bp, Mus musculus
tcctaagcctgatctcaccgaagat

SEQ ID NO: 818205 - DNA, 25 bp, Mus musculus
tcctaagcgcagaacagccctataa

SEQ ID NO: 818206 - DNA, 25 bp, Mus musculus
tcctaagcgcagtacagccctataa

SEQ ID NO: 818207 - DNA, 25 bp, Mus musculus
tcctaagctgtccactggagacatt

SEQ ID NO: 818208 - DNA, 25 bp, Mus musculus
tcctaagctgtcgactggagacatt

SEQ ID NO: 818209 - DNA, 25 bp, Mus musculus
tcctaagcttaaaggcacctccacc

SEQ ID NO: 818210 - DNA, 25 bp, Mus musculus
tcctaagcttaatggcacctccacc

SEQ ID NO: 818211 - DNA, 25 bp, Mus musculus
tcctaaggacttaactgctattgct

SEQ ID NO: 818212 - DNA, 25 bp, Mus musculus
tcctaaggactttactgctattgct

SEQ ID NO: 818213 - DNA, 25 bp, Mus musculus
tcctaaggaggcagtcatttccact

SEQ ID NO: 818214 - DNA, 25 bp, Mus musculus
tcctaaggaggctgtcatttccact

SEQ ID NO: 818215 - DNA, 25 bp, Mus musculus
tcctaaggctccagaagctggcttc

SEQ ID NO: 818216 - DNA, 25 bp, Mus musculus
tcctaaggctcctgaagctggcttc

SEQ ID NO: 818217 - DNA, 25 bp, Mus musculus
tcctaagggaccacctcagaaaggg

SEQ ID NO: 818218 - DNA, 25 bp, Mus musculus
tcctaagggacctcctcagaaaggg

SEQ ID NO: 818219 - DNA, 25 bp, Mus musculus
tcctaagggagcatttttggactgt

SEQ ID NO: 818220 - DNA, 25 bp, Mus musculus
tcctaagggagcttttttggactgt

SEQ ID NO: 818221 - DNA, 25 bp, Mus musculus
tcctaagggcaaccatttgtatctt

SEQ ID NO: 818222 - DNA, 25 bp, Mus musculus
tcctaagggcaagcatttgtatctt

SEQ ID NO: 818223 - DNA, 25 bp, Mus musculus
tcctaagggttaattgtggcatcaa

SEQ ID NO: 818224 - DNA, 25 bp, Mus musculus
tcctaagggttatttgtggcatcaa

SEQ ID NO: 818225 - DNA, 25 bp, Mus musculus
tcctaaggtcagacctctggcaagg

SEQ ID NO: 818226 - DNA, 25 bp, Mus musculus
tcctaaggtcagtcctctggcaagg

SEQ ID NO: 818227 - DNA, 25 bp, Mus musculus
tcctaaggtcctcatgtcctccaag

SEQ ID NO: 818228 - DNA, 25 bp, Mus musculus
tcctaaggtcctgatgtcctccaag

SEQ ID NO: 818229 - DNA, 25 bp, Mus musculus
tcctaagtcctcagtgttctgtaag

SEQ ID NO: 818230 - DNA, 25 bp, Mus musculus
tcctaagtcctctgtgttctgtaag

SEQ ID NO: 818231 - DNA, 25 bp, Mus musculus
tcctaagtctggagcaggtctgtgt

SEQ ID NO: 818232 - DNA, 25 bp, Mus musculus
tcctaagtctggtgcaggtctgtgt

SEQ ID NO: 818233 - DNA, 25 bp, Mus musculus
tcctaagtgacacaggctcaatctg

SEQ ID NO: 818234 - DNA, 25 bp, Mus musculus
tcctaagtgacagaggctcaatctg

SEQ ID NO: 818235 - DNA, 25 bp, Mus musculus
tcctaagtgataacaaacccttgga

SEQ ID NO: 818236 - DNA, 25 bp, Mus musculus
tcctaagtgatatcaaacccttgga

SEQ ID NO: 818237 - DNA, 25 bp, Mus musculus
tcctaataaagccatgcagtgcctt

SEQ ID NO: 818238 - DNA, 25 bp, Mus musculus
tcctaataaagcgatgcagtgcctt

SEQ ID NO: 818239 - DNA, 25 bp, Mus musculus
tcctaatacacacccatgtttactt

SEQ ID NO: 818240 - DNA, 25 bp, Mus musculus
tcctaatacacagccatgtttactt

SEQ ID NO: 818241 - DNA, 25 bp, Mus musculus
tcctaatatcaacctttttgggtga

SEQ ID NO: 818242 - DNA, 25 bp, Mus musculus
tcctaatatcaagctttttgggtga

SEQ ID NO: 818243 - DNA, 25 bp, Mus musculus
tcctaatatgaacaacggatgggac

SEQ ID NO: 818244 - DNA, 25 bp, Mus musculus
tcctaatatgaagaacggatgggac

SEQ ID NO: 818245 - DNA, 25 bp, Mus musculus
tcctaatattggactgtttttcctg

SEQ ID NO: 818246 - DNA, 25 bp, Mus musculus
tcctaatattggtctgtttttcctg

SEQ ID NO: 818247 - DNA, 25 bp, Mus musculus
tcctaatcctgcaactctttaagat

SEQ ID NO: 818248 - DNA, 25 bp, Mus musculus
tcctaatcctgctactctttaagat

SEQ ID NO: 818249 - DNA, 25 bp, Mus musculus
tcctaatccttgaaatcttcctcaa

SEQ ID NO: 818250 - DNA, 25 bp, Mus musculus
tcctaatccttgtaatcttcctcaa

SEQ ID NO: 818251 - DNA, 25 bp, Mus musculus
tcctaatctgttcgtcttgaaacaa

SEQ ID NO: 818252 - DNA, 25 bp, Mus musculus
tcctaatctgttggtcttgaaacaa

SEQ ID NO: 818253 - DNA, 25 bp, Mus musculus
tcctaatcttgaccacataattttt

SEQ ID NO: 818254 - DNA, 25 bp, Mus musculus
tcctaatcttgagcacataattttt

SEQ ID NO: 818255 - DNA, 25 bp, Mus musculus
tcctaatgaccccagtgtttctttg

SEQ ID NO: 818256 - DNA, 25 bp, Mus musculus
tcctaatgacccgagtgtttctttg

SEQ ID NO: 818257 - DNA, 25 bp, Mus musculus
tcctaatgcgtaaggccaggcctta

SEQ ID NO: 818258 - DNA, 25 bp, Mus musculus
tcctaatgcgtatggccaggcctta

SEQ ID NO: 818259 - DNA, 25 bp, Mus musculus
tcctaatgcgttacatgggctgaaa

SEQ ID NO: 818260 - DNA, 25 bp, Mus musculus
tcctaatgcgtttcatgggctgaaa

SEQ ID NO: 818261 - DNA, 25 bp, Mus musculus
tcctaatggttcatgttttcatcta

SEQ ID NO: 818262 - DNA, 25 bp, Mus musculus
tcctaatggttcttgttttcatcta

SEQ ID NO: 818263 - DNA, 25 bp, Mus musculus
tcctaatgtgaaaatgcgctgccaa

SEQ ID NO: 818264 - DNA, 25 bp, Mus musculus
tcctaatgtgaatatgcgctgccaa

SEQ ID NO: 818265 - DNA, 25 bp, Mus musculus
tcctaattctcaatgtgttcaaaat

SEQ ID NO: 818266 - DNA, 25 bp, Mus musculus
tcctaattctcattgtgttcaaaat

SEQ ID NO: 818267 - DNA, 25 bp, Mus musculus
tcctaattggccctcatagctaagc

SEQ ID NO: 818268 - DNA, 25 bp, Mus musculus
tcctaattggccgtcatagctaagc

SEQ ID NO: 818269 - DNA, 25 bp, Mus musculus
tcctaatttacccagctttcaaaag

SEQ ID NO: 818270 - DNA, 25 bp, Mus musculus
tcctaatttaccgagctttcaaaag

SEQ ID NO: 818271 - DNA, 25 bp, Mus musculus
tcctaatttatcatgacatgttttc

SEQ ID NO: 818272 - DNA, 25 bp, Mus musculus
tcctaatttatcttgacatgttttc

SEQ ID NO: 818273 - DNA, 25 bp, Mus musculus
tcctaatttctaagggttgttttat

SEQ ID NO: 818274 - DNA, 25 bp, Mus musculus
tcctaatttctatgggttgttttat

SEQ ID NO: 818275 - DNA, 25 bp, Mus musculus
tcctaatttcttaacacatgtatag

SEQ ID NO: 818276 - DNA, 25 bp, Mus musculus
tcctaatttctttacacatgtatag

SEQ ID NO: 818277 - DNA, 25 bp, Mus musculus
tcctacaaggatcagactatacccc

SEQ ID NO: 818278 - DNA, 25 bp, Mus musculus
tcctacaaggatgagactatacccc

SEQ ID NO: 818279 - DNA, 25 bp, Mus musculus
tcctacaagtggcaggaagatctac

SEQ ID NO: 818280 - DNA, 25 bp, Mus musculus
tcctacaagtgggaggaagatctac

SEQ ID NO: 818281 - DNA, 25 bp, Mus musculus
tcctacaatgtaaaaactgcttata

SEQ ID NO: 818282 - DNA, 25 bp, Mus musculus
tcctacaatgtataaactgcttata

SEQ ID NO: 818283 - DNA, 25 bp, Mus musculus
tcctacacccttagtaattgctggg

SEQ ID NO: 818284 - DNA, 25 bp, Mus musculus
tcctacaccctttgtaattgctggg

SEQ ID NO: 818285 - DNA, 25 bp, Mus musculus
tcctacactaacacactgagactct

SEQ ID NO: 818286 - DNA, 25 bp, Mus musculus
tcctacactaactcactgagactct

SEQ ID NO: 818287 - DNA, 25 bp, Mus musculus
tcctacactatgactgcattcatat

SEQ ID NO: 818288 - DNA, 25 bp, Mus musculus
tcctacactatgtctgcattcatat

SEQ ID NO: 818289 - DNA, 25 bp, Mus musculus
tcctacactcccattgtgttgttaa

SEQ ID NO: 818290 - DNA, 25 bp, Mus musculus
tcctacactccctttgtgttgttaa

SEQ ID NO: 818291 - DNA, 25 bp, Mus musculus
tcctacactttgcactggcccagat

SEQ ID NO: 818292 - DNA, 25 bp, Mus musculus
tcctacactttggactggcccagat

SEQ ID NO: 818293 - DNA, 25 bp, Mus musculus
tcctacagacttacacatgtgcatg

SEQ ID NO: 818294 - DNA, 25 bp, Mus musculus
tcctacagactttcacatgtgcatg

SEQ ID NO: 818295 - DNA, 25 bp, Mus musculus
tcctacagcacccagaaaatagcta

SEQ ID NO: 818296 - DNA, 25 bp, Mus musculus
tcctacagcaccgagaaaatagcta

SEQ ID NO: 818297 - DNA, 25 bp, Mus musculus
tcctacagcctcatggaagccagtg

SEQ ID NO: 818298 - DNA, 25 bp, Mus musculus
tcctacagcctcttggaagccagtg

SEQ ID NO: 818299 - DNA, 25 bp, Mus musculus
tcctacagcctgagtacctgaaatc

SEQ ID NO: 818300 - DNA, 25 bp, Mus musculus
tcctacagcctgtgtacctgaaatc

SEQ ID NO: 818301 - DNA, 25 bp, Mus musculus
tcctacagggccaacagaggatgac

SEQ ID NO: 818302 - DNA, 25 bp, Mus musculus
tcctacagggcctacagaggatgac

SEQ ID NO: 818303 - DNA, 25 bp, Mus musculus
tcctacagggtactgttgagattct

SEQ ID NO: 818304 - DNA, 25 bp, Mus musculus
tcctacagggtagtgttgagattct

SEQ ID NO: 818305 - DNA, 25 bp, Mus musculus
tcctacagttccactttgttggtgg

SEQ ID NO: 818306 - DNA, 25 bp, Mus musculus
tcctacagttcctctttgttggtgg

SEQ ID NO: 818307 - DNA, 25 bp, Mus musculus
tcctacatagctccttcattgtgct

SEQ ID NO: 818308 - DNA, 25 bp, Mus musculus
tcctacatagctgcttcattgtgct

SEQ ID NO: 818309 - DNA, 25 bp, Mus musculus
tcctacatcaagcaacagcctctgt

SEQ ID NO: 818310 - DNA, 25 bp, Mus musculus
tcctacatcaaggaacagcctctgt

SEQ ID NO: 818311 - DNA, 25 bp, Mus musculus
tcctacatctttcaatcccatttat

SEQ ID NO: 818312 - DNA, 25 bp, Mus musculus
tcctacatctttgaatcccatttat

SEQ ID NO: 818313 - DNA, 25 bp, Mus musculus
tcctacatggttacttctccactgg

SEQ ID NO: 818314 - DNA, 25 bp, Mus musculus
tcctacatggtttcttctccactgg

SEQ ID NO: 818315 - DNA, 25 bp, Mus musculus
tcctacattcaccttatttattggt

SEQ ID NO: 818316 - DNA, 25 bp, Mus musculus
tcctacattcacgttatttattggt

SEQ ID NO: 818317 - DNA, 25 bp, Mus musculus
tcctaccaagctctatcagttatat

SEQ ID NO: 818318 - DNA, 25 bp, Mus musculus
tcctaccaagctgtatcagttatat

SEQ ID NO: 818319 - DNA, 25 bp, Mus musculus
tcctaccaattccagggctgatcaa

SEQ ID NO: 818320 - DNA, 25 bp, Mus musculus
tcctaccaattcgagggctgatcaa

SEQ ID NO: 818321 - DNA, 25 bp, Mus musculus
tcctaccaccttagtatacttgggt

SEQ ID NO: 818322 - DNA, 25 bp, Mus musculus
tcctaccacctttgtatacttgggt

SEQ ID NO: 818323 - DNA, 25 bp, Mus musculus
tcctaccagggtcaacgtgacagaa

SEQ ID NO: 818324 - DNA, 25 bp, Mus musculus
tcctaccagggtgaacgtgacagaa

SEQ ID NO: 818325 - DNA, 25 bp, Mus musculus
tcctacccaaacctgaaaatccctg

SEQ ID NO: 818326 - DNA, 25 bp, Mus musculus
tcctacccaaacgtgaaaatccctg

SEQ ID NO: 818327 - DNA, 25 bp, Mus musculus
tcctacccaacacggaacatctgtg

SEQ ID NO: 818328 - DNA, 25 bp, Mus musculus
tcctacccaacagggaacatctgtg

SEQ ID NO: 818329 - DNA, 25 bp, Mus musculus
tcctacccaattctagtgcacatta

SEQ ID NO: 818330 - DNA, 25 bp, Mus musculus
tcctacccaattgtagtgcacatta

SEQ ID NO: 818331 - DNA, 25 bp, Mus musculus
tcctacccacatatccttgagaagt

SEQ ID NO: 818332 - DNA, 25 bp, Mus musculus
tcctacccacatttccttgagaagt

SEQ ID NO: 818333 - DNA, 25 bp, Mus musculus
tcctacccactcagtaagggaccaa

SEQ ID NO: 818334 - DNA, 25 bp, Mus musculus
tcctacccactctgtaagggaccaa

SEQ ID NO: 818335 - DNA, 25 bp, Mus musculus
tcctacccagagattaattttagtt

SEQ ID NO: 818336 - DNA, 25 bp, Mus musculus
tcctacccagagtttaattttagtt

SEQ ID NO: 818337 - DNA, 25 bp, Mus musculus
tcctacccaggtcaagttccaatag

SEQ ID NO: 818338 - DNA, 25 bp, Mus musculus
tcctacccaggtgaagttccaatag

SEQ ID NO: 818339 - DNA, 25 bp, Mus musculus
tcctaccccaagcatagactgaatg

SEQ ID NO: 818340 - DNA, 25 bp, Mus musculus
tcctaccccaaggatagactgaatg

SEQ ID NO: 818341 - DNA, 25 bp, Mus musculus
tcctaccccatgagtttgtaaatac

SEQ ID NO: 818342 - DNA, 25 bp, Mus musculus
tcctaccccatgtgtttgtaaatac

SEQ ID NO: 818343 - DNA, 25 bp, Mus musculus
tcctacccctatacttcagcatgta

SEQ ID NO: 818344 - DNA, 25 bp, Mus musculus
tcctacccctattcttcagcatgta

SEQ ID NO: 818345 - DNA, 25 bp, Mus musculus
tcctaccctcagcaactgacagaag

SEQ ID NO: 818346 - DNA, 25 bp, Mus musculus
tcctaccctcagcttataaaccagg

SEQ ID NO: 818347 - DNA, 25 bp, Mus musculus
tcctaccctcaggaactgacagaag

SEQ ID NO: 818348 - DNA, 25 bp, Mus musculus
tcctaccctcaggttataaaccagg

SEQ ID NO: 818349 - DNA, 25 bp, Mus musculus
tcctacctacttcagtttttatgtt

SEQ ID NO: 818350 - DNA, 25 bp, Mus musculus
tcctacctacttgagtttttatgtt

SEQ ID NO: 818351 - DNA, 25 bp, Mus musculus
tcctacctagctcacgagattctat

SEQ ID NO: 818352 - DNA, 25 bp, Mus musculus
tcctacctagctgacgagattctat

SEQ ID NO: 818353 - DNA, 25 bp, Mus musculus
tcctacctatcacatttttcttttc

SEQ ID NO: 818354 - DNA, 25 bp, Mus musculus
tcctacctatcagatttttcttttc

SEQ ID NO: 818355 - DNA, 25 bp, Mus musculus
tcctacctatctcctatcaagaagt

SEQ ID NO: 818356 - DNA, 25 bp, Mus musculus
tcctacctatctgctatcaagaagt

SEQ ID NO: 818357 - DNA, 25 bp, Mus musculus
tcctacctcaagacgtgcatttata

SEQ ID NO: 818358 - DNA, 25 bp, Mus musculus
tcctacctcaagtcgtgcatttata

SEQ ID NO: 818359 - DNA, 25 bp, Mus musculus
tcctacctcataaacccagggttgt

SEQ ID NO: 818360 - DNA, 25 bp, Mus musculus
tcctacctcatatacccagggttgt

SEQ ID NO: 818361 - DNA, 25 bp, Mus musculus
tcctacctccatatctgggatctga

SEQ ID NO: 818362 - DNA, 25 bp, Mus musculus
tcctacctccatttctgggatctga

SEQ ID NO: 818363 - DNA, 25 bp, Mus musculus
tcctacctccttctattgttggaat

SEQ ID NO: 818364 - DNA, 25 bp, Mus musculus
tcctacctccttgtattgttggaat

SEQ ID NO: 818365 - DNA, 25 bp, Mus musculus
tcctacctcttccaagcagcatggt

SEQ ID NO: 818366 - DNA, 25 bp, Mus musculus
tcctacctcttcgaagcagcatggt

SEQ ID NO: 818367 - DNA, 25 bp, Mus musculus
tcctacctggagaagtcagacactg

SEQ ID NO: 818368 - DNA, 25 bp, Mus musculus
tcctacctggagtagtcagacactg

SEQ ID NO: 818369 - DNA, 25 bp, Mus musculus
tcctacctgtagactgaaaataaaa

SEQ ID NO: 818370 - DNA, 25 bp, Mus musculus
tcctacctgtagtctgaaaataaaa

SEQ ID NO: 818371 - DNA, 25 bp, Mus musculus
tcctacctgtctctgcacaaaagag

SEQ ID NO: 818372 - DNA, 25 bp, Mus musculus
tcctacctgtctgtgcacaaaagag

SEQ ID NO: 818373 - DNA, 25 bp, Mus musculus
tcctaccttagacaacttaatttgt

SEQ ID NO: 818374 - DNA, 25 bp, Mus musculus
tcctaccttagagaacttaatttgt

SEQ ID NO: 818375 - DNA, 25 bp, Mus musculus
tcctaccttagcctttcaaatactg

SEQ ID NO: 818376 - DNA, 25 bp, Mus musculus
tcctaccttagcgtttcaaatactg

SEQ ID NO: 818377 - DNA, 25 bp, Mus musculus
tcctaccttattcccagaagtgctg

SEQ ID NO: 818378 - DNA, 25 bp, Mus musculus
tcctaccttattgccagaagtgctg

SEQ ID NO: 818379 - DNA, 25 bp, Mus musculus
tcctacctttccattgctaccagaa

SEQ ID NO: 818380 - DNA, 25 bp, Mus musculus
tcctacctttcctttgctaccagaa

SEQ ID NO: 818381 - DNA, 25 bp, Mus musculus
tcctacctttttcaagttgttggct

SEQ ID NO: 818382 - DNA, 25 bp, Mus musculus
tcctacctttttgaagttgttggct

SEQ ID NO: 818383 - DNA, 25 bp, Mus musculus
tcctacgagaggcaaactattctag

SEQ ID NO: 818384 - DNA, 25 bp, Mus musculus
tcctacgagagggaaactattctag

SEQ ID NO: 818385 - DNA, 25 bp, Mus musculus
tcctacgaggaacacttcccatgta

SEQ ID NO: 818386 - DNA, 25 bp, Mus musculus
tcctacgaggaagacttcccatgta

SEQ ID NO: 818387 - DNA, 25 bp, Mus musculus
tcctacgcaggtaggcagtgactga

SEQ ID NO: 818388 - DNA, 25 bp, Mus musculus
tcctacgcaggttggcagtgactga

SEQ ID NO: 818389 - DNA, 25 bp, Mus musculus
tcctacgcgcgtccgagtacaaggg

SEQ ID NO: 818390 - DNA, 25 bp, Mus musculus
tcctacgcgcgtgcgagtacaaggg

SEQ ID NO: 818391 - DNA, 25 bp, Mus musculus
tcctacgggaacaatatgaagaaag

SEQ ID NO: 818392 - DNA, 25 bp, Mus musculus
tcctacgggaaccactggccagaag

SEQ ID NO: 818393 - DNA, 25 bp, Mus musculus
tcctacgggaacgactggccagaag

SEQ ID NO: 818394 - DNA, 25 bp, Mus musculus
tcctacgggaactatatgaagaaag

SEQ ID NO: 818395 - DNA, 25 bp, Mus musculus
tcctacgggcaaactgatggatcag

SEQ ID NO: 818396 - DNA, 25 bp, Mus musculus
tcctacgggcaatctgatggatcag

SEQ ID NO: 818397 - DNA, 25 bp, Mus musculus
tcctacggtgtgactcttttttatc

SEQ ID NO: 818398 - DNA, 25 bp, Mus musculus
tcctacggtgtgtctcttttttatc

SEQ ID NO: 818399 - DNA, 25 bp, Mus musculus
tcctacgtgaaacctgagcaacatt

SEQ ID NO: 818400 - DNA, 25 bp, Mus musculus
tcctacgtgaaagctgagcaacatt

SEQ ID NO: 818401 - DNA, 25 bp, Mus musculus
tcctacgttcaaagggctgacccga

SEQ ID NO: 818402 - DNA, 25 bp, Mus musculus
tcctacgttcaatgggctgacccga

SEQ ID NO: 818403 - DNA, 25 bp, Mus musculus
tcctacgttggaattaccttgttct

SEQ ID NO: 818404 - DNA, 25 bp, Mus musculus
tcctacgttggatttaccttgttct

SEQ ID NO: 818405 - DNA, 25 bp, Mus musculus
tcctactaagtgcttggagagcttc

SEQ ID NO: 818406 - DNA, 25 bp, Mus musculus
tcctactaagtggttggagagcttc

SEQ ID NO: 818407 - DNA, 25 bp, Mus musculus
tcctactaccagctgtccaatttgc

SEQ ID NO: 818408 - DNA, 25 bp, Mus musculus
tcctactaccaggtgtccaatttgc

SEQ ID NO: 818409 - DNA, 25 bp, Mus musculus
tcctactacgcccatcatgttagaa

SEQ ID NO: 818410 - DNA, 25 bp, Mus musculus
tcctactacgccgatcatgttagaa

SEQ ID NO: 818411 - DNA, 25 bp, Mus musculus
tcctactatatcagaagacttcaac

SEQ ID NO: 818412 - DNA, 25 bp, Mus musculus
tcctactatatctgaagacttcaac

SEQ ID NO: 818413 - DNA, 25 bp, Mus musculus
tcctactatcttaaatttctcccca

SEQ ID NO: 818414 - DNA, 25 bp, Mus musculus
tcctactatctttaatttctcccca

SEQ ID NO: 818415 - DNA, 25 bp, Mus musculus
tcctactatgctatccctggcttga

SEQ ID NO: 818416 - DNA, 25 bp, Mus musculus
tcctactatgctttccctggcttga

SEQ ID NO: 818417 - DNA, 25 bp, Mus musculus
tcctactccatacctgcagttaaag

SEQ ID NO: 818418 - DNA, 25 bp, Mus musculus
tcctactccatagctgcagttaaag

SEQ ID NO: 818419 - DNA, 25 bp, Mus musculus
tcctactcctaccatgcttagaaga

SEQ ID NO: 818420 - DNA, 25 bp, Mus musculus
tcctactcctacgatgcttagaaga

SEQ ID NO: 818421 - DNA, 25 bp, Mus musculus
tcctactctaccatacagcagattt

SEQ ID NO: 818422 - DNA, 25 bp, Mus musculus
tcctactctaccttacagcagattt

SEQ ID NO: 818423 - DNA, 25 bp, Mus musculus
tcctactctgctaattttgcttctt

SEQ ID NO: 818424 - DNA, 25 bp, Mus musculus
tcctactctgcttattttgcttctt

SEQ ID NO: 818425 - DNA, 25 bp, Mus musculus
tcctactcttgccttgatcattgat

SEQ ID NO: 818426 - DNA, 25 bp, Mus musculus
tcctactcttgcgttgatcattgat

SEQ ID NO: 818427 - DNA, 25 bp, Mus musculus
tcctactgaaacaagttgtcctttt

SEQ ID NO: 818428 - DNA, 25 bp, Mus musculus
tcctactgaaactagttgtcctttt

SEQ ID NO: 818429 - DNA, 25 bp, Mus musculus
tcctactgcatacatcatgattcaa

SEQ ID NO: 818430 - DNA, 25 bp, Mus musculus
tcctactgcatagatcatgattcaa

SEQ ID NO: 818431 - DNA, 25 bp, Mus musculus
tcctactgctagaatcggctcttca

SEQ ID NO: 818432 - DNA, 25 bp, Mus musculus
tcctactgctagagattccactgat

SEQ ID NO: 818433 - DNA, 25 bp, Mus musculus
tcctactgctagtatcggctcttca

SEQ ID NO: 818434 - DNA, 25 bp, Mus musculus
tcctactgctagtgattccactgat

SEQ ID NO: 818435 - DNA, 25 bp, Mus musculus
tcctactgctgactaaataaaaact

SEQ ID NO: 818436 - DNA, 25 bp, Mus musculus
tcctactgctgagtaaataaaaact

SEQ ID NO: 818437 - DNA, 25 bp, Mus musculus
tcctactgtacacagaccaagaaca

SEQ ID NO: 818438 - DNA, 25 bp, Mus musculus
tcctactgtacagagaccaagaaca

SEQ ID NO: 818439 - DNA, 25 bp, Mus musculus
tcctactgtactaggttaaattcgt

SEQ ID NO: 818440 - DNA, 25 bp, Mus musculus
tcctactgtacttggttaaattcgt

SEQ ID NO: 818441 - DNA, 25 bp, Mus musculus
tcctactgtatacctgtgggcgatg

SEQ ID NO: 818442 - DNA, 25 bp, Mus musculus
tcctactgtatagctgtgggcgatg

SEQ ID NO: 818443 - DNA, 25 bp, Mus musculus
tcctacttaaacaagttgtcgtttg

SEQ ID NO: 818444 - DNA, 25 bp, Mus musculus
tcctacttaaactagttgtcgtttg

SEQ ID NO: 818445 - DNA, 25 bp, Mus musculus
tcctacttgctaaaatgctgtagaa

SEQ ID NO: 818446 - DNA, 25 bp, Mus musculus
tcctacttgctataatgctgtagaa

SEQ ID NO: 818447 - DNA, 25 bp, Mus musculus
tcctacttggagagcctgagagaat

SEQ ID NO: 818448 - DNA, 25 bp, Mus musculus
tcctacttggagtgcctgagagaat

SEQ ID NO: 818449 - DNA, 25 bp, Mus musculus
tcctactttgctcctctgttaaaat

SEQ ID NO: 818450 - DNA, 25 bp, Mus musculus
tcctactttgctgctctgttaaaat

SEQ ID NO: 818451 - DNA, 25 bp, Mus musculus
tcctactttgtgcagaaacatttca

SEQ ID NO: 818452 - DNA, 25 bp, Mus musculus
tcctactttgtggagaaacatttca

SEQ ID NO: 818453 - DNA, 25 bp, Mus musculus
tcctagaaaggacgccagtgctctt

SEQ ID NO: 818454 - DNA, 25 bp, Mus musculus
tcctagaaaggaggccagtgctctt

SEQ ID NO: 818455 - DNA, 25 bp, Mus musculus
tcctagaaatttagccccgggagct

SEQ ID NO: 818456 - DNA, 25 bp, Mus musculus
tcctagaaattttgccccgggagct

SEQ ID NO: 818457 - DNA, 25 bp, Mus musculus
tcctagaactaaatcagtgctaact

SEQ ID NO: 818458 - DNA, 25 bp, Mus musculus
tcctagaactaattcagtgctaact

SEQ ID NO: 818459 - DNA, 25 bp, Mus musculus
tcctagaagccgagtgtgcgtgcgc

SEQ ID NO: 818460 - DNA, 25 bp, Mus musculus
tcctagaagccgtgtgtgcgtgcgc

SEQ ID NO: 818461 - DNA, 25 bp, Mus musculus
tcctagaagggtaacagaaatgtca

SEQ ID NO: 818462 - DNA, 25 bp, Mus musculus
tcctagaagggttacagaaatgtca

SEQ ID NO: 818463 - DNA, 25 bp, Mus musculus
tcctagaagtcaatgcctctccttc

SEQ ID NO: 818464 - DNA, 25 bp, Mus musculus
tcctagaagtcattgcctctccttc

SEQ ID NO: 818465 - DNA, 25 bp, Mus musculus
tcctagactctgactgctgctgttt

SEQ ID NO: 818466 - DNA, 25 bp, Mus musculus
tcctagactctgtctgctgctgttt

SEQ ID NO: 818467 - DNA, 25 bp, Mus musculus
tcctagagagcacactgaggtccag

SEQ ID NO: 818468 - DNA, 25 bp, Mus musculus
tcctagagagcagactgaggtccag

SEQ ID NO: 818469 - DNA, 25 bp, Mus musculus
tcctagagcccactagttttgactt

SEQ ID NO: 818470 - DNA, 25 bp, Mus musculus
tcctagagcccagtagttttgactt

SEQ ID NO: 818471 - DNA, 25 bp, Mus musculus
tcctagaggcagcaaaacccttcct

SEQ ID NO: 818472 - DNA, 25 bp, Mus musculus
tcctagaggcaggaaaacccttcct

SEQ ID NO: 818473 - DNA, 25 bp, Mus musculus
tcctagagggccaggatatggaaga

SEQ ID NO: 818474 - DNA, 25 bp, Mus musculus
tcctagagggcctggatatggaaga

SEQ ID NO: 818475 - DNA, 25 bp, Mus musculus
tcctagagtctcatagtgggcatct

SEQ ID NO: 818476 - DNA, 25 bp, Mus musculus
tcctagagtctcttagtgggcatct

SEQ ID NO: 818477 - DNA, 25 bp, Mus musculus
tcctagagtgtacatgcttttcatt

SEQ ID NO: 818478 - DNA, 25 bp, Mus musculus
tcctagagtgtagatgcttttcatt

SEQ ID NO: 818479 - DNA, 25 bp, Mus musculus
tcctagagttatatgccactggcag

SEQ ID NO: 818480 - DNA, 25 bp, Mus musculus
tcctagagttatttgccactggcag

SEQ ID NO: 818481 - DNA, 25 bp, Mus musculus
tcctagatagttatcccttcaagtc

SEQ ID NO: 818482 - DNA, 25 bp, Mus musculus
tcctagatagttttcccttcaagtc

SEQ ID NO: 818483 - DNA, 25 bp, Mus musculus
tcctagatgccccaaggacagagcc

SEQ ID NO: 818484 - DNA, 25 bp, Mus musculus
tcctagatgcccgaaggacagagcc

SEQ ID NO: 818485 - DNA, 25 bp, Mus musculus
tcctagattactcccaagacagttg

SEQ ID NO: 818486 - DNA, 25 bp, Mus musculus
tcctagattactgccaagacagttg

SEQ ID NO: 818487 - DNA, 25 bp, Mus musculus
tcctagattcagaccctgaagtgct

SEQ ID NO: 818488 - DNA, 25 bp, Mus musculus
tcctagattcagtccctgaagtgct

SEQ ID NO: 818489 - DNA, 25 bp, Mus musculus
tcctagattgacatacacacatagc

SEQ ID NO: 818490 - DNA, 25 bp, Mus musculus
tcctagattgacttacacacatagc

SEQ ID NO: 818491 - DNA, 25 bp, Mus musculus
tcctagattggaaaacggcggcagc

SEQ ID NO: 818492 - DNA, 25 bp, Mus musculus
tcctagattggataacggcggcagc

SEQ ID NO: 818493 - DNA, 25 bp, Mus musculus
tcctagcaacagatgtgtcagtctg

SEQ ID NO: 818494 - DNA, 25 bp, Mus musculus
tcctagcaacagttgtgtcagtctg

SEQ ID NO: 818495 - DNA, 25 bp, Mus musculus
tcctagcaccatcaagatcaagatc

SEQ ID NO: 818496 - DNA, 25 bp, Mus musculus
tcctagcaccatgaagatcaagatc

SEQ ID NO: 818497 - DNA, 25 bp, Mus musculus
tcctagcacctaatactctgaacat

SEQ ID NO: 818498 - DNA, 25 bp, Mus musculus
tcctagcacctacattgagtgactt

SEQ ID NO: 818499 - DNA, 25 bp, Mus musculus
tcctagcacctagattgagtgactt

SEQ ID NO: 818500 - DNA, 25 bp, Mus musculus
tcctagcacctattactctgaacat

SEQ ID NO: 818501 - DNA, 25 bp, Mus musculus
tcctagcagaacatgttagaggtaa

SEQ ID NO: 818502 - DNA, 25 bp, Mus musculus
tcctagcagaacttgttagaggtaa

SEQ ID NO: 818503 - DNA, 25 bp, Mus musculus
tcctagcagctcatcccaagggata

SEQ ID NO: 818504 - DNA, 25 bp, Mus musculus
tcctagcagctcttcccaagggata

SEQ ID NO: 818505 - DNA, 25 bp, Mus musculus
tcctagcatgcacagtcctagcatg

SEQ ID NO: 818506 - DNA, 25 bp, Mus musculus
tcctagcatgcagagtcctagcatg

SEQ ID NO: 818507 - DNA, 25 bp, Mus musculus
tcctagccacagaacccaagagaat

SEQ ID NO: 818508 - DNA, 25 bp, Mus musculus
tcctagccacagtacccaagagaat

SEQ ID NO: 818509 - DNA, 25 bp, Mus musculus
tcctagccactaatctttactcaaa

SEQ ID NO: 818510 - DNA, 25 bp, Mus musculus
tcctagccactacaaccagagatga

SEQ ID NO: 818511 - DNA, 25 bp, Mus musculus
tcctagccactagaaccagagatga

SEQ ID NO: 818512 - DNA, 25 bp, Mus musculus
tcctagccactattctttactcaaa

SEQ ID NO: 818513 - DNA, 25 bp, Mus musculus
tcctagccagagattcagtgtcaca

SEQ ID NO: 818514 - DNA, 25 bp, Mus musculus
tcctagccagagtttcagtgtcaca

SEQ ID NO: 818515 - DNA, 25 bp, Mus musculus
tcctagccagctctcaacacgtgat

SEQ ID NO: 818516 - DNA, 25 bp, Mus musculus
tcctagccagctgtcaacacgtgat

SEQ ID NO: 818517 - DNA, 25 bp, Mus musculus
tcctagccccagatcaagtggtgaa

SEQ ID NO: 818518 - DNA, 25 bp, Mus musculus
tcctagccccagttcaagtggtgaa

SEQ ID NO: 818519 - DNA, 25 bp, Mus musculus
tcctagccccgaaacgagttaacat

SEQ ID NO: 818520 - DNA, 25 bp, Mus musculus
tcctagccccgatacgagttaacat

SEQ ID NO: 818521 - DNA, 25 bp, Mus musculus
tcctagccctggagaattggcatca

SEQ ID NO: 818522 - DNA, 25 bp, Mus musculus
tcctagccctggtgaattggcatca

SEQ ID NO: 818523 - DNA, 25 bp, Mus musculus
tcctagcccttgcagaactgaggta

SEQ ID NO: 818524 - DNA, 25 bp, Mus musculus
tcctagcccttggagaactgaggta

SEQ ID NO: 818525 - DNA, 25 bp, Mus musculus
tcctagccgggacgtgttgcgacat

SEQ ID NO: 818526 - DNA, 25 bp, Mus musculus
tcctagccgggaggtgttgcgacat

SEQ ID NO: 818527 - DNA, 25 bp, Mus musculus
tcctagcctggccatgggcacagtg

SEQ ID NO: 818528 - DNA, 25 bp, Mus musculus
tcctagcctggcgatgggcacagtg

SEQ ID NO: 818529 - DNA, 25 bp, Mus musculus
tcctagcctgtgagcccaccaggaa

SEQ ID NO: 818530 - DNA, 25 bp, Mus musculus
tcctagcctgtgtgcccaccaggaa

SEQ ID NO: 818531 - DNA, 25 bp, Mus musculus
tcctagctactaactggctgtagca

SEQ ID NO: 818532 - DNA, 25 bp, Mus musculus
tcctagctactatctggctgtagca

SEQ ID NO: 818533 - DNA, 25 bp, Mus musculus
tcctagctagctacagctgttgaca

SEQ ID NO: 818534 - DNA, 25 bp, Mus musculus
tcctagctagcttcagctgttgaca

SEQ ID NO: 818535 - DNA, 25 bp, Mus musculus
tcctagctctggaagaaaacattaa

SEQ ID NO: 818536 - DNA, 25 bp, Mus musculus
tcctagctctggtagaaaacattaa

SEQ ID NO: 818537 - DNA, 25 bp, Mus musculus
tcctagctgctgatctaacatcaca

SEQ ID NO: 818538 - DNA, 25 bp, Mus musculus
tcctagctgctgttctaacatcaca

SEQ ID NO: 818539 - DNA, 25 bp, Mus musculus
tcctagcttagcagagcctgagact

SEQ ID NO: 818540 - DNA, 25 bp, Mus musculus
tcctagcttagctgagcctgagact

SEQ ID NO: 818541 - DNA, 25 bp, Mus musculus
tcctagcttccacacacagatgtaa

SEQ ID NO: 818542 - DNA, 25 bp, Mus musculus
tcctagcttccagacacagatgtaa

SEQ ID NO: 818543 - DNA, 25 bp, Mus musculus
tcctagcttgtgagaatatgcagtg

SEQ ID NO: 818544 - DNA, 25 bp, Mus musculus
tcctagcttgtgtgaatatgcagtg

SEQ ID NO: 818545 - DNA, 25 bp, Mus musculus
tcctagctttagctggcaggacagc

SEQ ID NO: 818546 - DNA, 25 bp, Mus musculus
tcctagctttaggtggcaggacagc

SEQ ID NO: 818547 - DNA, 25 bp, Mus musculus
tcctaggaacttccatcaggaagag

SEQ ID NO: 818548 - DNA, 25 bp, Mus musculus
tcctaggaacttgcatcaggaagag

SEQ ID NO: 818549 - DNA, 25 bp, Mus musculus
tcctaggaattcatagctggtgaca

SEQ ID NO: 818550 - DNA, 25 bp, Mus musculus
tcctaggaattcttagctggtgaca

SEQ ID NO: 818551 - DNA, 25 bp, Mus musculus
tcctaggactccaggtttgtagttc

SEQ ID NO: 818552 - DNA, 25 bp, Mus musculus
tcctaggactcctggtttgtagttc

SEQ ID NO: 818553 - DNA, 25 bp, Mus musculus
tcctaggagctgaggactgacgctt

SEQ ID NO: 818554 - DNA, 25 bp, Mus musculus
tcctaggagctgtggactgacgctt

SEQ ID NO: 818555 - DNA, 25 bp, Mus musculus
tcctaggatccgcatttgggtggac

SEQ ID NO: 818556 - DNA, 25 bp, Mus musculus
tcctaggatccggatttgggtggac

SEQ ID NO: 818557 - DNA, 25 bp, Mus musculus
tcctaggattgacctcattttcata

SEQ ID NO: 818558 - DNA, 25 bp, Mus musculus
tcctaggattgagctcattttcata

SEQ ID NO: 818559 - DNA, 25 bp, Mus musculus
tcctaggcaagacaccaggtatctg

SEQ ID NO: 818560 - DNA, 25 bp, Mus musculus
tcctaggcaagagaccaggtatctg

SEQ ID NO: 818561 - DNA, 25 bp, Mus musculus
tcctaggcaggtaataataaaagtt

SEQ ID NO: 818562 - DNA, 25 bp, Mus musculus
tcctaggcaggttataataaaagtt

SEQ ID NO: 818563 - DNA, 25 bp, Mus musculus
tcctaggccacgacccagactggaa

SEQ ID NO: 818564 - DNA, 25 bp, Mus musculus
tcctaggccacgtcccagactggaa

SEQ ID NO: 818565 - DNA, 25 bp, Mus musculus
tcctaggctgtgataaccaaagcaa

SEQ ID NO: 818566 - DNA, 25 bp, Mus musculus
tcctaggctgtgttaaccaaagcaa

SEQ ID NO: 818567 - DNA, 25 bp, Mus musculus
tcctaggcttcaagggacctcggaa

SEQ ID NO: 818568 - DNA, 25 bp, Mus musculus
tcctaggcttcatgggacctcggaa

SEQ ID NO: 818569 - DNA, 25 bp, Mus musculus
tcctagggattaattggcattctgt

SEQ ID NO: 818570 - DNA, 25 bp, Mus musculus
tcctagggattatttggcattctgt

SEQ ID NO: 818571 - DNA, 25 bp, Mus musculus
tcctagggtaaacgctctctgtaat

SEQ ID NO: 818572 - DNA, 25 bp, Mus musculus
tcctagggtaaaggctctctgtaat

SEQ ID NO: 818573 - DNA, 25 bp, Mus musculus
tcctagggtgtccttaagccccaag

SEQ ID NO: 818574 - DNA, 25 bp, Mus musculus
tcctagggtgtcgttaagccccaag

SEQ ID NO: 818575 - DNA, 25 bp, Mus musculus
tcctagggtttgaactcaggctgcc

SEQ ID NO: 818576 - DNA, 25 bp, Mus musculus
tcctagggtttgtactcaggctgcc

SEQ ID NO: 818577 - DNA, 25 bp, Mus musculus
tcctaggtaggaacagctctcaatt

SEQ ID NO: 818578 - DNA, 25 bp, Mus musculus
tcctaggtaggatcagctctcaatt

SEQ ID NO: 818579 - DNA, 25 bp, Mus musculus
tcctaggtcactcgcttttgctgct

SEQ ID NO: 818580 - DNA, 25 bp, Mus musculus
tcctaggtcactggcttttgctgct

SEQ ID NO: 818581 - DNA, 25 bp, Mus musculus
tcctaggtcctgataaagtgttcaa

SEQ ID NO: 818582 - DNA, 25 bp, Mus musculus
tcctaggtcctgttaaagtgttcaa

SEQ ID NO: 818583 - DNA, 25 bp, Mus musculus
tcctaggtggccagagttgtgactc

SEQ ID NO: 818584 - DNA, 25 bp, Mus musculus
tcctaggtggcctgagttgtgactc

SEQ ID NO: 818585 - DNA, 25 bp, Mus musculus
tcctaggttattatggaattccaat

SEQ ID NO: 818586 - DNA, 25 bp, Mus musculus
tcctaggttattttggaattccaat

SEQ ID NO: 818587 - DNA, 25 bp, Mus musculus
tcctaggttgggacattccactggg

SEQ ID NO: 818588 - DNA, 25 bp, Mus musculus
tcctaggttgggtcattccactggg

SEQ ID NO: 818589 - DNA, 25 bp, Mus musculus
tcctagtacattctgaaaattgtcc

SEQ ID NO: 818590 - DNA, 25 bp, Mus musculus
tcctagtacattgtgaaaattgtcc

SEQ ID NO: 818591 - DNA, 25 bp, Mus musculus
tcctagtacccgcatggaggtttat

SEQ ID NO: 818592 - DNA, 25 bp, Mus musculus
tcctagtacccggatggaggtttat

SEQ ID NO: 818593 - DNA, 25 bp, Mus musculus
tcctagtacctgcattaggcagctc

SEQ ID NO: 818594 - DNA, 25 bp, Mus musculus
tcctagtacctggattaggcagctc

SEQ ID NO: 818595 - DNA, 25 bp, Mus musculus
tcctagtacttccatcacccaagga

SEQ ID NO: 818596 - DNA, 25 bp, Mus musculus
tcctagtacttcgatcacccaagga

SEQ ID NO: 818597 - DNA, 25 bp, Mus musculus
tcctagtctccgctgggtttgatgc

SEQ ID NO: 818598 - DNA, 25 bp, Mus musculus
tcctagtctccggtgggtttgatgc

SEQ ID NO: 818599 - DNA, 25 bp, Mus musculus
tcctagtctcctatagaggctctgt

SEQ ID NO: 818600 - DNA, 25 bp, Mus musculus
tcctagtctcctttagaggctctgt

SEQ ID NO: 818601 - DNA, 25 bp, Mus musculus
tcctagtgatgcaggaccatttcta

SEQ ID NO: 818602 - DNA, 25 bp, Mus musculus
tcctagtgatgctggaccatttcta

SEQ ID NO: 818603 - DNA, 25 bp, Mus musculus
tcctagtgcttgaggtcgaggctac

SEQ ID NO: 818604 - DNA, 25 bp, Mus musculus
tcctagtgcttgtggtcgaggctac

SEQ ID NO: 818605 - DNA, 25 bp, Mus musculus
tcctagtggtcactaacaagagtgt

SEQ ID NO: 818606 - DNA, 25 bp, Mus musculus
tcctagtggtcagtaacaagagtgt

SEQ ID NO: 818607 - DNA, 25 bp, Mus musculus
tcctagtgtcccatttcttttaatg

SEQ ID NO: 818608 - DNA, 25 bp, Mus musculus
tcctagtgtcccttttcttttaatg

SEQ ID NO: 818609 - DNA, 25 bp, Mus musculus
tcctagtgtggcaaagcagggatgt

SEQ ID NO: 818610 - DNA, 25 bp, Mus musculus
tcctagtgtggctaagcagggatgt

SEQ ID NO: 818611 - DNA, 25 bp, Mus musculus
tcctagttagagacccagttccaag

SEQ ID NO: 818612 - DNA, 25 bp, Mus musculus
tcctagttagagtcccagttccaag

SEQ ID NO: 818613 - DNA, 25 bp, Mus musculus
tcctagttccttagtttctcatctt

SEQ ID NO: 818614 - DNA, 25 bp, Mus musculus
tcctagttcctttgtttctcatctt

SEQ ID NO: 818615 - DNA, 25 bp, Mus musculus
tcctagttctaactccctgggaagt

SEQ ID NO: 818616 - DNA, 25 bp, Mus musculus
tcctagttctaagtccctgggaagt

SEQ ID NO: 818617 - DNA, 25 bp, Mus musculus
tcctagttgattattactgtacccg

SEQ ID NO: 818618 - DNA, 25 bp, Mus musculus
tcctagttgatttttactgtacccg

SEQ ID NO: 818619 - DNA, 25 bp, Mus musculus
tcctagtttagacacgtcaccaaaa

SEQ ID NO: 818620 - DNA, 25 bp, Mus musculus
tcctagtttagagacgtcaccaaaa

SEQ ID NO: 818621 - DNA, 25 bp, Mus musculus
tcctagtttcaaaccaggttcaaag

SEQ ID NO: 818622 - DNA, 25 bp, Mus musculus
tcctagtttcaatccaggttcaaag

SEQ ID NO: 818623 - DNA, 25 bp, Mus musculus
tcctagtttgtgagaagttgacctt

SEQ ID NO: 818624 - DNA, 25 bp, Mus musculus
tcctagtttgtgtgaagttgacctt

SEQ ID NO: 818625 - DNA, 25 bp, Mus musculus
tcctagtttttactggacaaagaga

SEQ ID NO: 818626 - DNA, 25 bp, Mus musculus
tcctagtttttagtggacaaagaga

SEQ ID NO: 818627 - DNA, 25 bp, Mus musculus
tcctataaaggaaatcttgagcaat

SEQ ID NO: 818628 - DNA, 25 bp, Mus musculus
tcctataaaggatatcttgagcaat

SEQ ID NO: 818629 - DNA, 25 bp, Mus musculus
tcctataagttcatctccagcctta

SEQ ID NO: 818630 - DNA, 25 bp, Mus musculus
tcctataagttcttctccagcctta

SEQ ID NO: 818631 - DNA, 25 bp, Mus musculus
tcctatacatgtctcaatagtaatt

SEQ ID NO: 818632 - DNA, 25 bp, Mus musculus
tcctatacatgtgtcaatagtaatt

SEQ ID NO: 818633 - DNA, 25 bp, Mus musculus
tcctataccaccagccttaggtgag

SEQ ID NO: 818634 - DNA, 25 bp, Mus musculus
tcctataccacctgccttaggtgag

SEQ ID NO: 818635 - DNA, 25 bp, Mus musculus
tcctatagaggcactgttcccagca

SEQ ID NO: 818636 - DNA, 25 bp, Mus musculus
tcctatagaggctctgttcccagca

SEQ ID NO: 818637 - DNA, 25 bp, Mus musculus
tcctataggcctaggattcctcaat

SEQ ID NO: 818638 - DNA, 25 bp, Mus musculus
tcctataggccttggattcctcaat

SEQ ID NO: 818639 - DNA, 25 bp, Mus musculus
tcctatatatagagtctgacctgca

SEQ ID NO: 818640 - DNA, 25 bp, Mus musculus
tcctatatatagtgtctgacctgca

SEQ ID NO: 818641 - DNA, 25 bp, Mus musculus
tcctatatccctatctgactttctc

SEQ ID NO: 818642 - DNA, 25 bp, Mus musculus
tcctatatccctttctgactttctc

SEQ ID NO: 818643 - DNA, 25 bp, Mus musculus
tcctatatctagcagcatgggatac

SEQ ID NO: 818644 - DNA, 25 bp, Mus musculus
tcctatatctaggagcatgggatac

SEQ ID NO: 818645 - DNA, 25 bp, Mus musculus
tcctatatgaccctgaccctttggt

SEQ ID NO: 818646 - DNA, 25 bp, Mus musculus
tcctatatgaccgtgaccctttggt

SEQ ID NO: 818647 - DNA, 25 bp, Mus musculus
tcctatatgtggatactgccttttg

SEQ ID NO: 818648 - DNA, 25 bp, Mus musculus
tcctatatgtggttactgccttttg

SEQ ID NO: 818649 - DNA, 25 bp, Mus musculus
tcctatattggaacacagtgctctc

SEQ ID NO: 818650 - DNA, 25 bp, Mus musculus
tcctatattggatcacagtgctctc

SEQ ID NO: 818651 - DNA, 25 bp, Mus musculus
tcctatcacgtactgcgttgcagac

SEQ ID NO: 818652 - DNA, 25 bp, Mus musculus
tcctatcacgtagtgcgttgcagac

SEQ ID NO: 818653 - DNA, 25 bp, Mus musculus
tcctatcattgacagccttgggttt

SEQ ID NO: 818654 - DNA, 25 bp, Mus musculus
tcctatcattgagagccttgggttt

SEQ ID NO: 818655 - DNA, 25 bp, Mus musculus
tcctatccaaggctacctaactagt

SEQ ID NO: 818656 - DNA, 25 bp, Mus musculus
tcctatccaagggtacctaactagt

SEQ ID NO: 818657 - DNA, 25 bp, Mus musculus
tcctatccagcgctgtgttgggtgc

SEQ ID NO: 818658 - DNA, 25 bp, Mus musculus
tcctatccagcggtgtgttgggtgc

SEQ ID NO: 818659 - DNA, 25 bp, Mus musculus
tcctatccatttaaaggcccgcagc

SEQ ID NO: 818660 - DNA, 25 bp, Mus musculus
tcctatccattttaaggcccgcagc

SEQ ID NO: 818661 - DNA, 25 bp, Mus musculus
tcctatcccagtattgaaagcccct

SEQ ID NO: 818662 - DNA, 25 bp, Mus musculus
tcctatcccagttttgaaagcccct

SEQ ID NO: 818663 - DNA, 25 bp, Mus musculus
tcctatccctatctctgtatatact

SEQ ID NO: 818664 - DNA, 25 bp, Mus musculus
tcctatccctatgtctgtatatact

SEQ ID NO: 818665 - DNA, 25 bp, Mus musculus
tcctatcctctgacccagtttgtgg

SEQ ID NO: 818666 - DNA, 25 bp, Mus musculus
tcctatcctctgtcccagtttgtgg

SEQ ID NO: 818667 - DNA, 25 bp, Mus musculus
tcctatcctggaagagccatactct

SEQ ID NO: 818668 - DNA, 25 bp, Mus musculus
tcctatcctggatgagccatactct

SEQ ID NO: 818669 - DNA, 25 bp, Mus musculus
tcctatcctttcaggattccgtttt

SEQ ID NO: 818670 - DNA, 25 bp, Mus musculus
tcctatcctttcctgtgagatgaaa

SEQ ID NO: 818671 - DNA, 25 bp, Mus musculus
tcctatcctttcgtgtgagatgaaa

SEQ ID NO: 818672 - DNA, 25 bp, Mus musculus
tcctatcctttctggattccgtttt

SEQ ID NO: 818673 - DNA, 25 bp, Mus musculus
tcctatctaaacaggtttgtttgta

SEQ ID NO: 818674 - DNA, 25 bp, Mus musculus
tcctatctaaactggtttgtttgta

SEQ ID NO: 818675 - DNA, 25 bp, Mus musculus
tcctatctacccagttacctaagat

SEQ ID NO: 818676 - DNA, 25 bp, Mus musculus
tcctatctaccctgttacctaagat

SEQ ID NO: 818677 - DNA, 25 bp, Mus musculus
tcctatctccaccaggagggtgtgt

SEQ ID NO: 818678 - DNA, 25 bp, Mus musculus
tcctatctccacgaggagggtgtgt

SEQ ID NO: 818679 - DNA, 25 bp, Mus musculus
tcctatctgaacaatgggtcccaag

SEQ ID NO: 818680 - DNA, 25 bp, Mus musculus
tcctatctgaactatgggtcccaag

SEQ ID NO: 818681 - DNA, 25 bp, Mus musculus
tcctatctgcacatagaagaagctt

SEQ ID NO: 818682 - DNA, 25 bp, Mus musculus
tcctatctgcacttagaagaagctt

SEQ ID NO: 818683 - DNA, 25 bp, Mus musculus
tcctatcttactatgtagcgctggg

SEQ ID NO: 818684 - DNA, 25 bp, Mus musculus
tcctatcttactttgtagcgctggg

SEQ ID NO: 818685 - DNA, 25 bp, Mus musculus
tcctatgagatcaagcagttcctgg

SEQ ID NO: 818686 - DNA, 25 bp, Mus musculus
tcctatgagatctagcagttcctgg

SEQ ID NO: 818687 - DNA, 25 bp, Mus musculus
tcctatgagcctcaagtgagatctt

SEQ ID NO: 818688 - DNA, 25 bp, Mus musculus
tcctatgagcctgaagtgagatctt

SEQ ID NO: 818689 - DNA, 25 bp, Mus musculus
tcctatgattcccttgacagtcttt

SEQ ID NO: 818690 - DNA, 25 bp, Mus musculus
tcctatgattccgttgacagtcttt

SEQ ID NO: 818691 - DNA, 25 bp, Mus musculus
tcctatgattgtaaagtgttcgtgc

SEQ ID NO: 818692 - DNA, 25 bp, Mus musculus
tcctatgattgttaagtgttcgtgc

SEQ ID NO: 818693 - DNA, 25 bp, Mus musculus
tcctatgcatgcactctggttggtg

SEQ ID NO: 818694 - DNA, 25 bp, Mus musculus
tcctatgcatgctctctggttggtg

SEQ ID NO: 818695 - DNA, 25 bp, Mus musculus
tcctatgccaggaacttaacttatg

SEQ ID NO: 818696 - DNA, 25 bp, Mus musculus
tcctatgccaggtacttaacttatg

SEQ ID NO: 818697 - DNA, 25 bp, Mus musculus
tcctatgccatacgactcctaattt

SEQ ID NO: 818698 - DNA, 25 bp, Mus musculus
tcctatgccataggactcctaattt

SEQ ID NO: 818699 - DNA, 25 bp, Mus musculus
tcctatgccctgatgtcttagctgg

SEQ ID NO: 818700 - DNA, 25 bp, Mus musculus
tcctatgccctgttgtcttagctgg

SEQ ID NO: 818701 - DNA, 25 bp, Mus musculus
tcctatgccgggaacacaacgtgtg

SEQ ID NO: 818702 - DNA, 25 bp, Mus musculus
tcctatgccgggtacacaacgtgtg

SEQ ID NO: 818703 - DNA, 25 bp, Mus musculus
tcctatgccggtcagcaggcttctg

SEQ ID NO: 818704 - DNA, 25 bp, Mus musculus
tcctatgccggtgagcaggcttctg

SEQ ID NO: 818705 - DNA, 25 bp, Mus musculus
tcctatgcctgtccgtcttgctaca

SEQ ID NO: 818706 - DNA, 25 bp, Mus musculus
tcctatgcctgtgcgtcttgctaca

SEQ ID NO: 818707 - DNA, 25 bp, Mus musculus
tcctatgctgggactccaaacagtg

SEQ ID NO: 818708 - DNA, 25 bp, Mus musculus
tcctatgctgggtctccaaacagtg

SEQ ID NO: 818709 - DNA, 25 bp, Mus musculus
tcctatgcttacattcccatttcat

SEQ ID NO: 818710 - DNA, 25 bp, Mus musculus
tcctatgcttactttcccatttcat

SEQ ID NO: 818711 - DNA, 25 bp, Mus musculus
tcctatggaggaagtaccagcggct

SEQ ID NO: 818712 - DNA, 25 bp, Mus musculus
tcctatggaggatgtaccagcggct

SEQ ID NO: 818713 - DNA, 25 bp, Mus musculus
tcctatggcccaatctcgatttttc

SEQ ID NO: 818714 - DNA, 25 bp, Mus musculus
tcctatggcccattctcgatttttc

SEQ ID NO: 818715 - DNA, 25 bp, Mus musculus
tcctatggtcctagtggtgacacag

SEQ ID NO: 818716 - DNA, 25 bp, Mus musculus
tcctatggtccttgtggtgacacag

SEQ ID NO: 818717 - DNA, 25 bp, Mus musculus
tcctatggttccaaatctgaagaaa

SEQ ID NO: 818718 - DNA, 25 bp, Mus musculus
tcctatggttcctaatctgaagaaa

SEQ ID NO: 818719 - DNA, 25 bp, Mus musculus
tcctatggttgtcactgggttgtcc

SEQ ID NO: 818720 - DNA, 25 bp, Mus musculus
tcctatggttgtgactgggttgtcc

SEQ ID NO: 818721 - DNA, 25 bp, Mus musculus
tcctatgtacgacatcattcgcgag

SEQ ID NO: 818722 - DNA, 25 bp, Mus musculus
tcctatgtacgagatcattcgcgag

SEQ ID NO: 818723 - DNA, 25 bp, Mus musculus
tcctatgtatacatgactatggtat

SEQ ID NO: 818724 - DNA, 25 bp, Mus musculus
tcctatgtatacttgactatggtat

SEQ ID NO: 818725 - DNA, 25 bp, Mus musculus
tcctatgtatgtaggccctttgaag

SEQ ID NO: 818726 - DNA, 25 bp, Mus musculus
tcctatgtatgttggccctttgaag

SEQ ID NO: 818727 - DNA, 25 bp, Mus musculus
tcctatgtcattcgttttagaaaag

SEQ ID NO: 818728 - DNA, 25 bp, Mus musculus
tcctatgtcattggttttagaaaag

SEQ ID NO: 818729 - DNA, 25 bp, Mus musculus
tcctatgtgagcctgggattcgctt

SEQ ID NO: 818730 - DNA, 25 bp, Mus musculus
tcctatgtgagcgtgggattcgctt

SEQ ID NO: 818731 - DNA, 25 bp, Mus musculus
tcctatgtgcttccagaggtttcta

SEQ ID NO: 818732 - DNA, 25 bp, Mus musculus
tcctatgtgcttgcagaggtttcta

SEQ ID NO: 818733 - DNA, 25 bp, Mus musculus
tcctatgtgttacctctaccttttc

SEQ ID NO: 818734 - DNA, 25 bp, Mus musculus
tcctatgtgttagctctaccttttc

SEQ ID NO: 818735 - DNA, 25 bp, Mus musculus
tcctatgttgctccctaaccaaagg

SEQ ID NO: 818736 - DNA, 25 bp, Mus musculus
tcctatgttgctgcctaaccaaagg

SEQ ID NO: 818737 - DNA, 25 bp, Mus musculus
tcctatgttggcctcactcggtgag

SEQ ID NO: 818738 - DNA, 25 bp, Mus musculus
tcctatgttggcgtcactcggtgag

SEQ ID NO: 818739 - DNA, 25 bp, Mus musculus
tcctattagaggacacaggattcca

SEQ ID NO: 818740 - DNA, 25 bp, Mus musculus
tcctattagaggtcacaggattcca

SEQ ID NO: 818741 - DNA, 25 bp, Mus musculus
tcctattaggaaatacgtccatctt

SEQ ID NO: 818742 - DNA, 25 bp, Mus musculus
tcctattaggaattacgtccatctt

SEQ ID NO: 818743 - DNA, 25 bp, Mus musculus
tcctattagttcagttcctttgcta

SEQ ID NO: 818744 - DNA, 25 bp, Mus musculus
tcctattagttctgttcctttgcta

SEQ ID NO: 818745 - DNA, 25 bp, Mus musculus
tcctattcacccagaacctggaggc

SEQ ID NO: 818746 - DNA, 25 bp, Mus musculus
tcctattcaccctgaacctggaggc

SEQ ID NO: 818747 - DNA, 25 bp, Mus musculus
tcctattctaggcatgtgacttttg

SEQ ID NO: 818748 - DNA, 25 bp, Mus musculus
tcctattctagggatgtgacttttg

SEQ ID NO: 818749 - DNA, 25 bp, Mus musculus
tcctattctcgacctccaggacaaa

SEQ ID NO: 818750 - DNA, 25 bp, Mus musculus
tcctattctcgagctccaggacaaa

SEQ ID NO: 818751 - DNA, 25 bp, Mus musculus
tcctattctctgcagtatgggaagg

SEQ ID NO: 818752 - DNA, 25 bp, Mus musculus
tcctattctctggagtatgggaagg

SEQ ID NO: 818753 - DNA, 25 bp, Mus musculus
tcctattgaagacccattaactgaa

SEQ ID NO: 818754 - DNA, 25 bp, Mus musculus
tcctattgaagagccattaactgaa

SEQ ID NO: 818755 - DNA, 25 bp, Mus musculus
tcctattgcaggagtgacagtgttt

SEQ ID NO: 818756 - DNA, 25 bp, Mus musculus
tcctattgcaggtgtgacagtgttt

SEQ ID NO: 818757 - DNA, 25 bp, Mus musculus
tcctattgcatgaataccatccctc

SEQ ID NO: 818758 - DNA, 25 bp, Mus musculus
tcctattgcatgtataccatccctc

SEQ ID NO: 818759 - DNA, 25 bp, Mus musculus
tcctattgcctaattgttgacacag

SEQ ID NO: 818760 - DNA, 25 bp, Mus musculus
tcctattgcctatttgttgacacag

SEQ ID NO: 818761 - DNA, 25 bp, Mus musculus
tcctattgtataatccttcccttta

SEQ ID NO: 818762 - DNA, 25 bp, Mus musculus
tcctattgtatattccttcccttta

SEQ ID NO: 818763 - DNA, 25 bp, Mus musculus
tcctattgtgatatgtatgtggctc

SEQ ID NO: 818764 - DNA, 25 bp, Mus musculus
tcctattgtgatttgtatgtggctc

SEQ ID NO: 818765 - DNA, 25 bp, Mus musculus
tcctattgtgtaagttactgacatt

SEQ ID NO: 818766 - DNA, 25 bp, Mus musculus
tcctattgtgtatgttactgacatt

SEQ ID NO: 818767 - DNA, 25 bp, Mus musculus
tcctattgtgtgctgctggcctcca

SEQ ID NO: 818768 - DNA, 25 bp, Mus musculus
tcctattgtgtggtgctggcctcca

SEQ ID NO: 818769 - DNA, 25 bp, Mus musculus
tcctattgttggcatactttattaa

SEQ ID NO: 818770 - DNA, 25 bp, Mus musculus
tcctattgttgggatactttattaa

SEQ ID NO: 818771 - DNA, 25 bp, Mus musculus
tcctatttaggcatagtgtcacatg

SEQ ID NO: 818772 - DNA, 25 bp, Mus musculus
tcctatttaggcttagtgtcacatg

SEQ ID NO: 818773 - DNA, 25 bp, Mus musculus
tcctatttagtgatcttacatgtta

SEQ ID NO: 818774 - DNA, 25 bp, Mus musculus
tcctatttagtgttcttacatgtta

SEQ ID NO: 818775 - DNA, 25 bp, Mus musculus
tcctatttcaatcactgtgcaccag

SEQ ID NO: 818776 - DNA, 25 bp, Mus musculus
tcctatttcaatgactgtgcaccag

SEQ ID NO: 818777 - DNA, 25 bp, Mus musculus
tcctatttcacaagttttttaactt

SEQ ID NO: 818778 - DNA, 25 bp, Mus musculus
tcctatttcacatgttttttaactt

SEQ ID NO: 818779 - DNA, 25 bp, Mus musculus
tcctatttcaggaccactatccaca

SEQ ID NO: 818780 - DNA, 25 bp, Mus musculus
tcctatttcaggtccactatccaca

SEQ ID NO: 818781 - DNA, 25 bp, Mus musculus
tcctatttccacacatctattcaga

SEQ ID NO: 818782 - DNA, 25 bp, Mus musculus
tcctatttccactcatctattcaga

SEQ ID NO: 818783 - DNA, 25 bp, Mus musculus
tcctatttccttccagtgttgtata

SEQ ID NO: 818784 - DNA, 25 bp, Mus musculus
tcctatttccttgcagtgttgtata

SEQ ID NO: 818785 - DNA, 25 bp, Mus musculus
tcctatttctcacagggaggctccc

SEQ ID NO: 818786 - DNA, 25 bp, Mus musculus
tcctatttctcactttctcttttaa

SEQ ID NO: 818787 - DNA, 25 bp, Mus musculus
tcctatttctcagagggaggctccc

SEQ ID NO: 818788 - DNA, 25 bp, Mus musculus
tcctatttctcagtttctcttttaa

SEQ ID NO: 818789 - DNA, 25 bp, Mus musculus
tcctatttgcacaggcgaacagcta

SEQ ID NO: 818790 - DNA, 25 bp, Mus musculus
tcctatttgcactggcgaacagcta

SEQ ID NO: 818791 - DNA, 25 bp, Mus musculus
tcctatttgcatatattctgacccc

SEQ ID NO: 818792 - DNA, 25 bp, Mus musculus
tcctatttgcatttattctgacccc

SEQ ID NO: 818793 - DNA, 25 bp, Mus musculus
tcctatttggttaattacttctttg

SEQ ID NO: 818794 - DNA, 25 bp, Mus musculus
tcctatttggtttattacttctttg

SEQ ID NO: 818795 - DNA, 25 bp, Mus musculus
tcctatttgtagacaaggcattgct

SEQ ID NO: 818796 - DNA, 25 bp, Mus musculus
tcctatttgtagtcaaggcattgct

SEQ ID NO: 818797 - DNA, 25 bp, Mus musculus
tcctatttgtgaagtgtacctgtct

SEQ ID NO: 818798 - DNA, 25 bp, Mus musculus
tcctatttgtgatgtgtacctgtct

SEQ ID NO: 818799 - DNA, 25 bp, Mus musculus
tcctattttcaaccgggagtcaaag

SEQ ID NO: 818800 - DNA, 25 bp, Mus musculus
tcctattttcaagcgggagtcaaag

SEQ ID NO: 818801 - DNA, 25 bp, Mus musculus
tcctattttcccactaattattcat

SEQ ID NO: 818802 - DNA, 25 bp, Mus musculus
tcctattttccctctaattattcat

SEQ ID NO: 818803 - DNA, 25 bp, Mus musculus
tcctattttctcatcttttactatg

SEQ ID NO: 818804 - DNA, 25 bp, Mus musculus
tcctattttctcttcttttactatg

SEQ ID NO: 818805 - DNA, 25 bp, Mus musculus
tcctattttgaccatggagccctta

SEQ ID NO: 818806 - DNA, 25 bp, Mus musculus
tcctattttgacgatggagccctta

SEQ ID NO: 818807 - DNA, 25 bp, Mus musculus
tcctattttggactggtcagacatt

SEQ ID NO: 818808 - DNA, 25 bp, Mus musculus
tcctattttggagtggtcagacatt

SEQ ID NO: 818809 - DNA, 25 bp, Mus musculus
tcctcaaaaagtagggaggtcggag

SEQ ID NO: 818810 - DNA, 25 bp, Mus musculus
tcctcaaaaagttgggaggtcggag

SEQ ID NO: 818811 - DNA, 25 bp, Mus musculus
tcctcaaacctcaccagcataaaga

SEQ ID NO: 818812 - DNA, 25 bp, Mus musculus
tcctcaaacctctccagcataaaga

SEQ ID NO: 818813 - DNA, 25 bp, Mus musculus
tcctcaaacgttcctgcagttttga

SEQ ID NO: 818814 - DNA, 25 bp, Mus musculus
tcctcaaacgttgctgcagttttga

SEQ ID NO: 818815 - DNA, 25 bp, Mus musculus
tcctcaaactcactgatgttgttct

SEQ ID NO: 818816 - DNA, 25 bp, Mus musculus
tcctcaaactcagtgatgttgttct

SEQ ID NO: 818817 - DNA, 25 bp, Mus musculus
tcctcaaattatcgaaatctcacag

SEQ ID NO: 818818 - DNA, 25 bp, Mus musculus
tcctcaaattatggaaatctcacag

SEQ ID NO: 818819 - DNA, 25 bp, Mus musculus
tcctcaacctagacgtatccataaa

SEQ ID NO: 818820 - DNA, 25 bp, Mus musculus
tcctcaacctagtcgtatccataaa

SEQ ID NO: 818821 - DNA, 25 bp, Mus musculus
tcctcaacgaccaaatgctctttaa

SEQ ID NO: 818822 - DNA, 25 bp, Mus musculus
tcctcaacgacctaatgctctttaa

SEQ ID NO: 818823 - DNA, 25 bp, Mus musculus
tcctcaacgagcattcagattccat

SEQ ID NO: 818824 - DNA, 25 bp, Mus musculus
tcctcaacgagctttcagattccat

SEQ ID NO: 818825 - DNA, 25 bp, Mus musculus
tcctcaagaggcctggcaagcggtc

SEQ ID NO: 818826 - DNA, 25 bp, Mus musculus
tcctcaagaggcgtggcaagcggtc

SEQ ID NO: 818827 - DNA, 25 bp, Mus musculus
tcctcaagataacctacaatgatct

SEQ ID NO: 818828 - DNA, 25 bp, Mus musculus
tcctcaagataagctacaatgatct

SEQ ID NO: 818829 - DNA, 25 bp, Mus musculus
tcctcaagcttcacactgtttattt

SEQ ID NO: 818830 - DNA, 25 bp, Mus musculus
tcctcaagcttctcactgtttattt

SEQ ID NO: 818831 - DNA, 25 bp, Mus musculus
tcctcaaggacgctgtatgaagttg

SEQ ID NO: 818832 - DNA, 25 bp, Mus musculus
tcctcaaggacggtgtatgaagttg

SEQ ID NO: 818833 - DNA, 25 bp, Mus musculus
tcctcaaggccaatccagcagataa

SEQ ID NO: 818834 - DNA, 25 bp, Mus musculus
tcctcaaggccattccagcagataa

SEQ ID NO: 818835 - DNA, 25 bp, Mus musculus
tcctcaaggctgctctcaaaatttg

SEQ ID NO: 818836 - DNA, 25 bp, Mus musculus
tcctcaaggctggtctcaaaatttg

SEQ ID NO: 818837 - DNA, 25 bp, Mus musculus
tcctcaagggctagcgtccggatgc

SEQ ID NO: 818838 - DNA, 25 bp, Mus musculus
tcctcaagggcttgcgtccggatgc

SEQ ID NO: 818839 - DNA, 25 bp, Mus musculus
tcctcaagtatgatgatgtctctat

SEQ ID NO: 818840 - DNA, 25 bp, Mus musculus
tcctcaagtatgttgatgtctctat

SEQ ID NO: 818841 - DNA, 25 bp, Mus musculus
tcctcaagtgtgccatcatgcttct

SEQ ID NO: 818842 - DNA, 25 bp, Mus musculus
tcctcaagtgtggcatcatgcttct

SEQ ID NO: 818843 - DNA, 25 bp, Mus musculus
tcctcaatcgatacccagtgacagc

SEQ ID NO: 818844 - DNA, 25 bp, Mus musculus
tcctcaatcgattcccagtgacagc

SEQ ID NO: 818845 - DNA, 25 bp, Mus musculus
tcctcaatgcgtcccgtctgaaaaa

SEQ ID NO: 818846 - DNA, 25 bp, Mus musculus
tcctcaatgcgtgccgtctgaaaaa

SEQ ID NO: 818847 - DNA, 25 bp, Mus musculus
tcctcaatggcaccggcatctgaag

SEQ ID NO: 818848 - DNA, 25 bp, Mus musculus
tcctcaatggcagcggcatctgaag

SEQ ID NO: 818849 - DNA, 25 bp, Mus musculus
tcctcaatggtgcagtcaggcgtga

SEQ ID NO: 818850 - DNA, 25 bp, Mus musculus
tcctcaatggtggagtcaggcgtga

SEQ ID NO: 818851 - DNA, 25 bp, Mus musculus
tcctcacaaattcttacattccagc

SEQ ID NO: 818852 - DNA, 25 bp, Mus musculus
tcctcacaaattgttacattccagc

SEQ ID NO: 818853 - DNA, 25 bp, Mus musculus
tcctcacaagcaacaacactggcat

SEQ ID NO: 818854 - DNA, 25 bp, Mus musculus
tcctcacaagcatcaacactggcat

SEQ ID NO: 818855 - DNA, 25 bp, Mus musculus
tcctcacaaggaactattcccaact

SEQ ID NO: 818856 - DNA, 25 bp, Mus musculus
tcctcacaaggatctattcccaact

SEQ ID NO: 818857 - DNA, 25 bp, Mus musculus
tcctcacacccaaacacttggagaa

SEQ ID NO: 818858 - DNA, 25 bp, Mus musculus
tcctcacacccatacacttggagaa

SEQ ID NO: 818859 - DNA, 25 bp, Mus musculus
tcctcacacttgaatacctgcattt

SEQ ID NO: 818860 - DNA, 25 bp, Mus musculus
tcctcacacttgtatacctgcattt

SEQ ID NO: 818861 - DNA, 25 bp, Mus musculus
tcctcacagctaatcacttgtagac

SEQ ID NO: 818862 - DNA, 25 bp, Mus musculus
tcctcacagctattcacttgtagac

SEQ ID NO: 818863 - DNA, 25 bp, Mus musculus
tcctcacagggcagcgactacctga

SEQ ID NO: 818864 - DNA, 25 bp, Mus musculus
tcctcacagggctgcgactacctga

SEQ ID NO: 818865 - DNA, 25 bp, Mus musculus
tcctcacatggtcaaacggaacacg

SEQ ID NO: 818866 - DNA, 25 bp, Mus musculus
tcctcacatggtgaaacggaacacg

SEQ ID NO: 818867 - DNA, 25 bp, Mus musculus
tcctcacattgtcttctgggccaca

SEQ ID NO: 818868 - DNA, 25 bp, Mus musculus
tcctcacattgtgttctgggccaca

SEQ ID NO: 818869 - DNA, 25 bp, Mus musculus
tcctcaccaaggactgtcatgtcat

SEQ ID NO: 818870 - DNA, 25 bp, Mus musculus
tcctcaccaaggtctgtcatgtcat

SEQ ID NO: 818871 - DNA, 25 bp, Mus musculus
tcctcaccaattacgttcctctggg

SEQ ID NO: 818872 - DNA, 25 bp, Mus musculus
tcctcaccaatttcgttcctctggg

SEQ ID NO: 818873 - DNA, 25 bp, Mus musculus
tcctcaccacatcagcagagactgg

SEQ ID NO: 818874 - DNA, 25 bp, Mus musculus
tcctcaccacatgagcagagactgg

SEQ ID NO: 818875 - DNA, 25 bp, Mus musculus
tcctcaccaccaatttaatatccaa

SEQ ID NO: 818876 - DNA, 25 bp, Mus musculus
tcctcaccaccattttaatatccaa

SEQ ID NO: 818877 - DNA, 25 bp, Mus musculus
tcctcaccagcgcaggatctggatg

SEQ ID NO: 818878 - DNA, 25 bp, Mus musculus
tcctcaccagcggaggatctggatg

SEQ ID NO: 818879 - DNA, 25 bp, Mus musculus
tcctcaccatggctagttaagacaa

SEQ ID NO: 818880 - DNA, 25 bp, Mus musculus
tcctcaccatgggtagttaagacaa

SEQ ID NO: 818881 - DNA, 25 bp, Mus musculus
tcctcaccctagagttcgaaccctc

SEQ ID NO: 818882 - DNA, 25 bp, Mus musculus
tcctcaccctagtgttcgaaccctc

SEQ ID NO: 818883 - DNA, 25 bp, Mus musculus
tcctcaccctgaaatacgctactga

SEQ ID NO: 818884 - DNA, 25 bp, Mus musculus
tcctcaccctgatatacgctactga

SEQ ID NO: 818885 - DNA, 25 bp, Mus musculus
tcctcaccgggtatggaacagagca

SEQ ID NO: 818886 - DNA, 25 bp, Mus musculus
tcctcaccgggtttggaacagagca

SEQ ID NO: 818887 - DNA, 25 bp, Mus musculus
tcctcacctccacataaatcaatgt

SEQ ID NO: 818888 - DNA, 25 bp, Mus musculus
tcctcacctccagataaatcaatgt

SEQ ID NO: 818889 - DNA, 25 bp, Mus musculus
tcctcaccttgaagttgcataagga

SEQ ID NO: 818890 - DNA, 25 bp, Mus musculus
tcctcaccttgatgttgcataagga

SEQ ID NO: 818891 - DNA, 25 bp, Mus musculus
tcctcacgaagaccgggtgtccagt

SEQ ID NO: 818892 - DNA, 25 bp, Mus musculus
tcctcacgaagagcgggtgtccagt

SEQ ID NO: 818893 - DNA, 25 bp, Mus musculus
tcctcacgaagtctggtggctgcta

SEQ ID NO: 818894 - DNA, 25 bp, Mus musculus
tcctcacgaagtgtggtggctgcta

SEQ ID NO: 818895 - DNA, 25 bp, Mus musculus
tcctcacgccataactgcaagtttg

SEQ ID NO: 818896 - DNA, 25 bp, Mus musculus
tcctcacgccattactgcaagtttg

SEQ ID NO: 818897 - DNA, 25 bp, Mus musculus
tcctcacggagcagcaaacttgtgt

SEQ ID NO: 818898 - DNA, 25 bp, Mus musculus
tcctcacggagctgcaaacttgtgt

SEQ ID NO: 818899 - DNA, 25 bp, Mus musculus
tcctcactacctcatttggagtcag

SEQ ID NO: 818900 - DNA, 25 bp, Mus musculus
tcctcactacctgatttggagtcag

SEQ ID NO: 818901 - DNA, 25 bp, Mus musculus
tcctcactacttactggtgcatgtt

SEQ ID NO: 818902 - DNA, 25 bp, Mus musculus
tcctcactactttctggtgcatgtt

SEQ ID NO: 818903 - DNA, 25 bp, Mus musculus
tcctcactgagcaactggaccgggt

SEQ ID NO: 818904 - DNA, 25 bp, Mus musculus
tcctcactgagctactggaccgggt

SEQ ID NO: 818905 - DNA, 25 bp, Mus musculus
tcctcactgccacatcaagatttat

SEQ ID NO: 818906 - DNA, 25 bp, Mus musculus
tcctcactgccagatcaagatttat

SEQ ID NO: 818907 - DNA, 25 bp, Mus musculus
tcctcactgcctcgtaaaatcaatc

SEQ ID NO: 818908 - DNA, 25 bp, Mus musculus
tcctcactgcctggtaaaatcaatc

SEQ ID NO: 818909 - DNA, 25 bp, Mus musculus
tcctcactgggtacactaaatgcat

SEQ ID NO: 818910 - DNA, 25 bp, Mus musculus
tcctcactgggttcactaaatgcat

SEQ ID NO: 818911 - DNA, 25 bp, Mus musculus
tcctcactggtaagtatggcatggg

SEQ ID NO: 818912 - DNA, 25 bp, Mus musculus
tcctcactggtatgtatggcatggg

SEQ ID NO: 818913 - DNA, 25 bp, Mus musculus
tcctcactgtcccagatgctggaag

SEQ ID NO: 818914 - DNA, 25 bp, Mus musculus
tcctcactgtccgagatgctggaag

SEQ ID NO: 818915 - DNA, 25 bp, Mus musculus
tcctcacttgtaccattgaatgcct

SEQ ID NO: 818916 - DNA, 25 bp, Mus musculus
tcctcacttgtagcattgaatgcct

SEQ ID NO: 818917 - DNA, 25 bp, Mus musculus
tcctcactttgacaacgcttgaact

SEQ ID NO: 818918 - DNA, 25 bp, Mus musculus
tcctcactttgagaacgcttgaact

SEQ ID NO: 818919 - DNA, 25 bp, Mus musculus
tcctcagaaccacaactgccggaga

SEQ ID NO: 818920 - DNA, 25 bp, Mus musculus
tcctcagaaccagaactgccggaga

SEQ ID NO: 818921 - DNA, 25 bp, Mus musculus
tcctcagaacccctgtagcaatgca

SEQ ID NO: 818922 - DNA, 25 bp, Mus musculus
tcctcagaacccgtgtagcaatgca

SEQ ID NO: 818923 - DNA, 25 bp, Mus musculus
tcctcagaagagctgcatgacccac

SEQ ID NO: 818924 - DNA, 25 bp, Mus musculus
tcctcagaagaggtgcatgacccac

SEQ ID NO: 818925 - DNA, 25 bp, Mus musculus
tcctcagaaggtagggcatttttcc

SEQ ID NO: 818926 - DNA, 25 bp, Mus musculus
tcctcagaaggttgggcatttttcc

SEQ ID NO: 818927 - DNA, 25 bp, Mus musculus
tcctcagaattcattggctggttct

SEQ ID NO: 818928 - DNA, 25 bp, Mus musculus
tcctcagaattctttggctggttct

SEQ ID NO: 818929 - DNA, 25 bp, Mus musculus
tcctcagaccacattcctattggaa

SEQ ID NO: 818930 - DNA, 25 bp, Mus musculus
tcctcagaccactttcctattggaa

SEQ ID NO: 818931 - DNA, 25 bp, Mus musculus
tcctcagagacaagcaggtggccat

SEQ ID NO: 818932 - DNA, 25 bp, Mus musculus
tcctcagagacatgcaggtggccat

SEQ ID NO: 818933 - DNA, 25 bp, Mus musculus
tcctcagagattataggtccctaaa

SEQ ID NO: 818934 - DNA, 25 bp, Mus musculus
tcctcagagattttaggtccctaaa

SEQ ID NO: 818935 - DNA, 25 bp, Mus musculus
tcctcagatcacaggctcacatgtt

SEQ ID NO: 818936 - DNA, 25 bp, Mus musculus
tcctcagatcactggctcacatgtt

SEQ ID NO: 818937 - DNA, 25 bp, Mus musculus
tcctcagatctgcttggcaactgtg

SEQ ID NO: 818938 - DNA, 25 bp, Mus musculus
tcctcagatctggttggcaactgtg

SEQ ID NO: 818939 - DNA, 25 bp, Mus musculus
tcctcagcatcgaatacttctattc

SEQ ID NO: 818940 - DNA, 25 bp, Mus musculus
tcctcagcatcgtatacttctattc

SEQ ID NO: 818941 - DNA, 25 bp, Mus musculus
tcctcagccatgccagcggaaatgc

SEQ ID NO: 818942 - DNA, 25 bp, Mus musculus
tcctcagccatggcagcggaaatgc

SEQ ID NO: 818943 - DNA, 25 bp, Mus musculus
tcctcagcccacattcacaataaag

SEQ ID NO: 818944 - DNA, 25 bp, Mus musculus
tcctcagcccactttcacaataaag

SEQ ID NO: 818945 - DNA, 25 bp, Mus musculus
tcctcagccgatcctttttcaatag

SEQ ID NO: 818946 - DNA, 25 bp, Mus musculus
tcctcagccgatgctttttcaatag

SEQ ID NO: 818947 - DNA, 25 bp, Mus musculus
tcctcagccggcagcagagagtgaa

SEQ ID NO: 818948 - DNA, 25 bp, Mus musculus
tcctcagccggctgcagagagtgaa

SEQ ID NO: 818949 - DNA, 25 bp, Mus musculus
tcctcagctaagcttgacacttcac

SEQ ID NO: 818950 - DNA, 25 bp, Mus musculus
tcctcagctaaggttgacacttcac

SEQ ID NO: 818951 - DNA, 25 bp, Mus musculus
tcctcagctacaatatctaccttac

SEQ ID NO: 818952 - DNA, 25 bp, Mus musculus
tcctcagctacattatctaccttac

SEQ ID NO: 818953 - DNA, 25 bp, Mus musculus
tcctcagctataagtatccccaaaa

SEQ ID NO: 818954 - DNA, 25 bp, Mus musculus
tcctcagctatatgtatccccaaaa

SEQ ID NO: 818955 - DNA, 25 bp, Mus musculus
tcctcagctatcatcttgtcatagg

SEQ ID NO: 818956 - DNA, 25 bp, Mus musculus
tcctcagctatcttcttgtcatagg

SEQ ID NO: 818957 - DNA, 25 bp, Mus musculus
tcctcagctcgaagcctaaagtgca

SEQ ID NO: 818958 - DNA, 25 bp, Mus musculus
tcctcagctcgatgcctaaagtgca

SEQ ID NO: 818959 - DNA, 25 bp, Mus musculus
tcctcagctgctagtcctaagttga

SEQ ID NO: 818960 - DNA, 25 bp, Mus musculus
tcctcagctgcttgtcctaagttga

SEQ ID NO: 818961 - DNA, 25 bp, Mus musculus
tcctcaggaggcatgaatgctgcca

SEQ ID NO: 818962 - DNA, 25 bp, Mus musculus
tcctcaggaggcttgaatgctgcca

SEQ ID NO: 818963 - DNA, 25 bp, Mus musculus
tcctcaggccacaggaattgtaaag

SEQ ID NO: 818964 - DNA, 25 bp, Mus musculus
tcctcaggccactggaattgtaaag

SEQ ID NO: 818965 - DNA, 25 bp, Mus musculus
tcctcaggcgcacctatgcatggag

SEQ ID NO: 818966 - DNA, 25 bp, Mus musculus
tcctcaggcgcagctatgcatggag

SEQ ID NO: 818967 - DNA, 25 bp, Mus musculus
tcctcaggctctctgagaggtgcgt

SEQ ID NO: 818968 - DNA, 25 bp, Mus musculus
tcctcaggctctgtgagaggtgcgt

SEQ ID NO: 818969 - DNA, 25 bp, Mus musculus
tcctcaggctttcagctcaggcgaa

SEQ ID NO: 818970 - DNA, 25 bp, Mus musculus
tcctcaggctttgagctcaggcgaa

SEQ ID NO: 818971 - DNA, 25 bp, Mus musculus
tcctcagggaccctctaggcctgga

SEQ ID NO: 818972 - DNA, 25 bp, Mus musculus
tcctcagggaccgtctaggcctgga

SEQ ID NO: 818973 - DNA, 25 bp, Mus musculus
tcctcagggactagctttgttggtg

SEQ ID NO: 818974 - DNA, 25 bp, Mus musculus
tcctcagggacttgctttgttggtg

SEQ ID NO: 818975 - DNA, 25 bp, Mus musculus
tcctcagggtcaccacacaaaagta

SEQ ID NO: 818976 - DNA, 25 bp, Mus musculus
tcctcagggtcagcacacaaaagta

SEQ ID NO: 818977 - DNA, 25 bp, Mus musculus
tcctcagggtttaaatttaggctag

SEQ ID NO: 818978 - DNA, 25 bp, Mus musculus
tcctcagggttttaatttaggctag

SEQ ID NO: 818979 - DNA, 25 bp, Mus musculus
tcctcaggtaggctgtgccccttac

SEQ ID NO: 818980 - DNA, 25 bp, Mus musculus
tcctcaggtagggtgtgccccttac

SEQ ID NO: 818981 - DNA, 25 bp, Mus musculus
tcctcaggtttacccctaggattga

SEQ ID NO: 818982 - DNA, 25 bp, Mus musculus
tcctcaggtttagccctaggattga

SEQ ID NO: 818983 - DNA, 25 bp, Mus musculus
tcctcagtaaaccaagtcatagctt

SEQ ID NO: 818984 - DNA, 25 bp, Mus musculus
tcctcagtaaacgaagtcatagctt

SEQ ID NO: 818985 - DNA, 25 bp, Mus musculus
tcctcagtaacactgaccggtttca

SEQ ID NO: 818986 - DNA, 25 bp, Mus musculus
tcctcagtaacagtgaccggtttca

SEQ ID NO: 818987 - DNA, 25 bp, Mus musculus
tcctcagtaaggctgtgcatctcac

SEQ ID NO: 818988 - DNA, 25 bp, Mus musculus
tcctcagtaagggtgtgcatctcac

SEQ ID NO: 818989 - DNA, 25 bp, Mus musculus
tcctcagtacctatgtggctggatt

SEQ ID NO: 818990 - DNA, 25 bp, Mus musculus
tcctcagtacctttgtggctggatt

SEQ ID NO: 818991 - DNA, 25 bp, Mus musculus
tcctcagtacgcatcatgcagttta

SEQ ID NO: 818992 - DNA, 25 bp, Mus musculus
tcctcagtacgcttcatgcagttta

SEQ ID NO: 818993 - DNA, 25 bp, Mus musculus
tcctcagtatcaactaagtcagtgc

SEQ ID NO: 818994 - DNA, 25 bp, Mus musculus
tcctcagtatcatctaagtcagtgc

SEQ ID NO: 818995 - DNA, 25 bp, Mus musculus
tcctcagtcaggaggtgccatcaca

SEQ ID NO: 818996 - DNA, 25 bp, Mus musculus
tcctcagtcaggtggtgccatcaca

SEQ ID NO: 818997 - DNA, 25 bp, Mus musculus
tcctcagtctggcaacctcggaatc

SEQ ID NO: 818998 - DNA, 25 bp, Mus musculus
tcctcagtctgggaacctcggaatc

SEQ ID NO: 818999 - DNA, 25 bp, Mus musculus
tcctcagtcttgacggaaggttgcc

SEQ ID NO: 819000 - DNA, 25 bp, Mus musculus
tcctcagtcttgatataacgaacga

SEQ ID NO: 819001 - DNA, 25 bp, Mus musculus
tcctcagtcttgtcggaaggttgcc

SEQ ID NO: 819002 - DNA, 25 bp, Mus musculus
tcctcagtcttgttataacgaacga

SEQ ID NO: 819003 - DNA, 25 bp, Mus musculus
tcctcagtgccaatcagctgtgaga

SEQ ID NO: 819004 - DNA, 25 bp, Mus musculus
tcctcagtgccattcagctgtgaga

SEQ ID NO: 819005 - DNA, 25 bp, Mus musculus
tcctcagtggtactcaaagccttgg

SEQ ID NO: 819006 - DNA, 25 bp, Mus musculus
tcctcagtggtagtcaaagccttgg

SEQ ID NO: 819007 - DNA, 25 bp, Mus musculus
tcctcagtggtcactatttcaaagg

SEQ ID NO: 819008 - DNA, 25 bp, Mus musculus
tcctcagtggtctctatttcaaagg

SEQ ID NO: 819009 - DNA, 25 bp, Mus musculus
tcctcagtgtcaaccgcgcttcaat

SEQ ID NO: 819010 - DNA, 25 bp, Mus musculus
tcctcagtgtcatccgcgcttcaat

SEQ ID NO: 819011 - DNA, 25 bp, Mus musculus
tcctcagttatgaagagctataatg

SEQ ID NO: 819012 - DNA, 25 bp, Mus musculus
tcctcagttatgtagagctataatg

SEQ ID NO: 819013 - DNA, 25 bp, Mus musculus
tcctcagttattcggtgggcctttt

SEQ ID NO: 819014 - DNA, 25 bp, Mus musculus
tcctcagttattgggtgggcctttt

SEQ ID NO: 819015 - DNA, 25 bp, Mus musculus
tcctcagttcccatgttcttagtta

SEQ ID NO: 819016 - DNA, 25 bp, Mus musculus
tcctcagttcccttgttcttagtta

SEQ ID NO: 819017 - DNA, 25 bp, Mus musculus
tcctcagttctaacttctgttacta

SEQ ID NO: 819018 - DNA, 25 bp, Mus musculus
tcctcagttctatcttctgttacta

SEQ ID NO: 819019 - DNA, 25 bp, Mus musculus
tcctcagttctgatttcttttggca

SEQ ID NO: 819020 - DNA, 25 bp, Mus musculus
tcctcagttctgttttcttttggca

SEQ ID NO: 819021 - DNA, 25 bp, Mus musculus
tcctcagttgacatttccttcataa

SEQ ID NO: 819022 - DNA, 25 bp, Mus musculus
tcctcagttgacttttccttcataa

SEQ ID NO: 819023 - DNA, 25 bp, Mus musculus
tcctcagttgagatacccttatagt

SEQ ID NO: 819024 - DNA, 25 bp, Mus musculus
tcctcagttgagttacccttatagt

SEQ ID NO: 819025 - DNA, 25 bp, Mus musculus
tcctcagttgctatagttcttcttt

SEQ ID NO: 819026 - DNA, 25 bp, Mus musculus
tcctcagttgctttagttcttcttt

SEQ ID NO: 819027 - DNA, 25 bp, Mus musculus
tcctcagttgtacctcagcactaga

SEQ ID NO: 819028 - DNA, 25 bp, Mus musculus
tcctcagttgtagctcagcactaga

SEQ ID NO: 819029 - DNA, 25 bp, Mus musculus
tcctcagttttacgaatgactggaa

SEQ ID NO: 819030 - DNA, 25 bp, Mus musculus
tcctcagttttaggaatgactggaa

SEQ ID NO: 819031 - DNA, 25 bp, Mus musculus
tcctcataaaatatctatccctctc

SEQ ID NO: 819032 - DNA, 25 bp, Mus musculus
tcctcataaaatttctatccctctc

SEQ ID NO: 819033 - DNA, 25 bp, Mus musculus
tcctcatacaccctgattaagtcac

SEQ ID NO: 819034 - DNA, 25 bp, Mus musculus
tcctcatacaccgtgattaagtcac

SEQ ID NO: 819035 - DNA, 25 bp, Mus musculus
tcctcataggcacaactcgtctgac

SEQ ID NO: 819036 - DNA, 25 bp, Mus musculus
tcctcataggcagaactcgtctgac

SEQ ID NO: 819037 - DNA, 25 bp, Mus musculus
tcctcatcaggccatgttctaaagt

SEQ ID NO: 819038 - DNA, 25 bp, Mus musculus
tcctcatcaggcgatgttctaaagt

SEQ ID NO: 819039 - DNA, 25 bp, Mus musculus
tcctcatccgcaatgggcattattg

SEQ ID NO: 819040 - DNA, 25 bp, Mus musculus
tcctcatccgcattgggcattattg

SEQ ID NO: 819041 - DNA, 25 bp, Mus musculus
tcctcatcctcacaaacttttaaac

SEQ ID NO: 819042 - DNA, 25 bp, Mus musculus
tcctcatcctcagaaacttttaaac

SEQ ID NO: 819043 - DNA, 25 bp, Mus musculus
tcctcatcctttcgaagtcagcatg

SEQ ID NO: 819044 - DNA, 25 bp, Mus musculus
tcctcatcctttggaagtcagcatg

SEQ ID NO: 819045 - DNA, 25 bp, Mus musculus
tcctcatcgcctaaatagacaaatg

SEQ ID NO: 819046 - DNA, 25 bp, Mus musculus
tcctcatcgccttaatagacaaatg

SEQ ID NO: 819047 - DNA, 25 bp, Mus musculus
tcctcatctatactgcatccaagca

SEQ ID NO: 819048 - DNA, 25 bp, Mus musculus
tcctcatctatagtgcatccaagca

SEQ ID NO: 819049 - DNA, 25 bp, Mus musculus
tcctcatctatccagacagaccgtt

SEQ ID NO: 819050 - DNA, 25 bp, Mus musculus
tcctcatctatcgagacagaccgtt

SEQ ID NO: 819051 - DNA, 25 bp, Mus musculus
tcctcatcttctactagtagctcta

SEQ ID NO: 819052 - DNA, 25 bp, Mus musculus
tcctcatcttcttctagtagctcta

SEQ ID NO: 819053 - DNA, 25 bp, Mus musculus
tcctcatgaactcacataaccctga

SEQ ID NO: 819054 - DNA, 25 bp, Mus musculus
tcctcatgaactgacataaccctga

SEQ ID NO: 819055 - DNA, 25 bp, Mus musculus
tcctcatgcactatcacacatatgg

SEQ ID NO: 819056 - DNA, 25 bp, Mus musculus
tcctcatgcactttcacacatatgg

SEQ ID NO: 819057 - DNA, 25 bp, Mus musculus
tcctcatgccacctaataagccata

SEQ ID NO: 819058 - DNA, 25 bp, Mus musculus
tcctcatgccacgtaataagccata

SEQ ID NO: 819059 - DNA, 25 bp, Mus musculus
tcctcatgcggcctttggaagtgaa

SEQ ID NO: 819060 - DNA, 25 bp, Mus musculus
tcctcatgcggcgtttggaagtgaa

SEQ ID NO: 819061 - DNA, 25 bp, Mus musculus
tcctcatgctatccaccttacataa

SEQ ID NO: 819062 - DNA, 25 bp, Mus musculus
tcctcatgctatgcaccttacataa

SEQ ID NO: 819063 - DNA, 25 bp, Mus musculus
tcctcatgcttgcacagtgggcact

SEQ ID NO: 819064 - DNA, 25 bp, Mus musculus
tcctcatgcttggacagtgggcact

SEQ ID NO: 819065 - DNA, 25 bp, Mus musculus
tcctcatggcatcctcactgaaata

SEQ ID NO: 819066 - DNA, 25 bp, Mus musculus
tcctcatggcatgctcactgaaata

SEQ ID NO: 819067 - DNA, 25 bp, Mus musculus
tcctcatggcctcgtgctggatttg

SEQ ID NO: 819068 - DNA, 25 bp, Mus musculus
tcctcatggcctggtgctggatttg

SEQ ID NO: 819069 - DNA, 25 bp, Mus musculus
tcctcatggtggctcatatcggtat

SEQ ID NO: 819070 - DNA, 25 bp, Mus musculus
tcctcatggtgggtcatatcggtat

SEQ ID NO: 819071 - DNA, 25 bp, Mus musculus
tcctcatggttcagacaggtcagga

SEQ ID NO: 819072 - DNA, 25 bp, Mus musculus
tcctcatggttctgacaggtcagga

SEQ ID NO: 819073 - DNA, 25 bp, Mus musculus
tcctcatggtttcacagactatcac

SEQ ID NO: 819074 - DNA, 25 bp, Mus musculus
tcctcatggtttgacagactatcac

SEQ ID NO: 819075 - DNA, 25 bp, Mus musculus
tcctcatgtctgagtttgttgggtc

SEQ ID NO: 819076 - DNA, 25 bp, Mus musculus
tcctcatgtctgtgtttgttgggtc

SEQ ID NO: 819077 - DNA, 25 bp, Mus musculus
tcctcatgtgacaccctaaaagaag

SEQ ID NO: 819078 - DNA, 25 bp, Mus musculus
tcctcatgtgactccctaaaagaag

SEQ ID NO: 819079 - DNA, 25 bp, Mus musculus
tcctcatgtgccagtgaccagaaca

SEQ ID NO: 819080 - DNA, 25 bp, Mus musculus
tcctcatgtgcctgtgaccagaaca

SEQ ID NO: 819081 - DNA, 25 bp, Mus musculus
tcctcatgtgtaattcctctttttt

SEQ ID NO: 819082 - DNA, 25 bp, Mus musculus
tcctcatgtgtatttcctctttttt

SEQ ID NO: 819083 - DNA, 25 bp, Mus musculus
tcctcatgttgtagtcactttcgac

SEQ ID NO: 819084 - DNA, 25 bp, Mus musculus
tcctcatgttgttgtcactttcgac

SEQ ID NO: 819085 - DNA, 25 bp, Mus musculus
tcctcatgtttgctgtgtatctgct

SEQ ID NO: 819086 - DNA, 25 bp, Mus musculus
tcctcatgtttggtgtgtatctgct

SEQ ID NO: 819087 - DNA, 25 bp, Mus musculus
tcctcattagccatctgtgcccatg

SEQ ID NO: 819088 - DNA, 25 bp, Mus musculus
tcctcattagccttctgtgcccatg

SEQ ID NO: 819089 - DNA, 25 bp, Mus musculus
tcctcattatcacctgtgtgctgat

SEQ ID NO: 819090 - DNA, 25 bp, Mus musculus
tcctcattatcagctgtgtgctgat

SEQ ID NO: 819091 - DNA, 25 bp, Mus musculus
tcctcattcccaactataatccaaa

SEQ ID NO: 819092 - DNA, 25 bp, Mus musculus
tcctcattcccatctataatccaaa

SEQ ID NO: 819093 - DNA, 25 bp, Mus musculus
tcctcattccctctggtactgatgg

SEQ ID NO: 819094 - DNA, 25 bp, Mus musculus
tcctcattccctgtggtactgatgg

SEQ ID NO: 819095 - DNA, 25 bp, Mus musculus
tcctcattccgtcggtgatggatga

SEQ ID NO: 819096 - DNA, 25 bp, Mus musculus
tcctcattccgtgggtgatggatga

SEQ ID NO: 819097 - DNA, 25 bp, Mus musculus
tcctcattctctatgcgagagccaa

SEQ ID NO: 819098 - DNA, 25 bp, Mus musculus
tcctcattctctttgcgagagccaa

SEQ ID NO: 819099 - DNA, 25 bp, Mus musculus
tcctcattcttgacctagaagatgg

SEQ ID NO: 819100 - DNA, 25 bp, Mus musculus
tcctcattcttgtcctagaagatgg

SEQ ID NO: 819101 - DNA, 25 bp, Mus musculus
tcctcattgctgaactctctggaag

SEQ ID NO: 819102 - DNA, 25 bp, Mus musculus
tcctcattgctgcgatcatgtccaa

SEQ ID NO: 819103 - DNA, 25 bp, Mus musculus
tcctcattgctgggatcatgtccaa

SEQ ID NO: 819104 - DNA, 25 bp, Mus musculus
tcctcattgctgtactctctggaag

SEQ ID NO: 819105 - DNA, 25 bp, Mus musculus
tcctcattgtgaacataaccgtgta

SEQ ID NO: 819106 - DNA, 25 bp, Mus musculus
tcctcattgtgatcataaccgtgta

SEQ ID NO: 819107 - DNA, 25 bp, Mus musculus
tcctcattgttgaggcttctctctc

SEQ ID NO: 819108 - DNA, 25 bp, Mus musculus
tcctcattgttgtggcttctctctc

SEQ ID NO: 819109 - DNA, 25 bp, Mus musculus
tcctcatttcatctggtttcccaaa

SEQ ID NO: 819110 - DNA, 25 bp, Mus musculus
tcctcatttcatgtggtttcccaaa

SEQ ID NO: 819111 - DNA, 25 bp, Mus musculus
tcctcatttcctccagggcagaaga

SEQ ID NO: 819112 - DNA, 25 bp, Mus musculus
tcctcatttcctgcagggcagaaga

SEQ ID NO: 819113 - DNA, 25 bp, Mus musculus
tcctcatttggaataccattgtatt

SEQ ID NO: 819114 - DNA, 25 bp, Mus musculus
tcctcatttggattaccattgtatt

SEQ ID NO: 819115 - DNA, 25 bp, Mus musculus
tcctcattttaaacagtgtgccttc

SEQ ID NO: 819116 - DNA, 25 bp, Mus musculus
tcctcattttaatcagtgtgccttc

SEQ ID NO: 819117 - DNA, 25 bp, Mus musculus
tcctcatttttccttcctagatgga

SEQ ID NO: 819118 - DNA, 25 bp, Mus musculus
tcctcatttttcgttcctagatgga

SEQ ID NO: 819119 - DNA, 25 bp, Mus musculus
tcctccaaacatcataggcttttca

SEQ ID NO: 819120 - DNA, 25 bp, Mus musculus
tcctccaaacatgataggcttttca

SEQ ID NO: 819121 - DNA, 25 bp, Mus musculus
tcctccaaaccaagctgggtatgga

SEQ ID NO: 819122 - DNA, 25 bp, Mus musculus
tcctccaaaccatgctgggtatgga

SEQ ID NO: 819123 - DNA, 25 bp, Mus musculus
tcctccaaatacatggtcggtgttt

SEQ ID NO: 819124 - DNA, 25 bp, Mus musculus
tcctccaaatacttggtcggtgttt

SEQ ID NO: 819125 - DNA, 25 bp, Mus musculus
tcctccaacatcagctgggattgaa

SEQ ID NO: 819126 - DNA, 25 bp, Mus musculus
tcctccaacatctgctgggattgaa

SEQ ID NO: 819127 - DNA, 25 bp, Mus musculus
tcctccaacccaagacgattttaat

SEQ ID NO: 819128 - DNA, 25 bp, Mus musculus
tcctccaacccatgacgattttaat

SEQ ID NO: 819129 - DNA, 25 bp, Mus musculus
tcctccaactagatctcatatccaa

SEQ ID NO: 819130 - DNA, 25 bp, Mus musculus
tcctccaactagttctcatatccaa

SEQ ID NO: 819131 - DNA, 25 bp, Mus musculus
tcctccaactctccacatgttaatg

SEQ ID NO: 819132 - DNA, 25 bp, Mus musculus
tcctccaactctgcacatgttaatg

SEQ ID NO: 819133 - DNA, 25 bp, Mus musculus
tcctccaactgacaaggtctttgcc

SEQ ID NO: 819134 - DNA, 25 bp, Mus musculus
tcctccaactgagaaggtctttgcc

SEQ ID NO: 819135 - DNA, 25 bp, Mus musculus
tcctccaaggctcacacagtttaaa

SEQ ID NO: 819136 - DNA, 25 bp, Mus musculus
tcctccaaggctgacacagtttaaa

SEQ ID NO: 819137 - DNA, 25 bp, Mus musculus
tcctccaaggtgaattcatcaatca

SEQ ID NO: 819138 - DNA, 25 bp, Mus musculus
tcctccaaggtgtattcatcaatca

SEQ ID NO: 819139 - DNA, 25 bp, Mus musculus
tcctccaaggttactgcatcaggtt

SEQ ID NO: 819140 - DNA, 25 bp, Mus musculus
tcctccaaggtttctgcatcaggtt

SEQ ID NO: 819141 - DNA, 25 bp, Mus musculus
tcctccaagtccataactcgaaagc

SEQ ID NO: 819142 - DNA, 25 bp, Mus musculus
tcctccaagtccttaactcgaaagc

SEQ ID NO: 819143 - DNA, 25 bp, Mus musculus
tcctccaagtggctaaatgcaattt

SEQ ID NO: 819144 - DNA, 25 bp, Mus musculus
tcctccaagtgggtaaatgcaattt

SEQ ID NO: 819145 - DNA, 25 bp, Mus musculus
tcctccaatctccatatgctgtatg

SEQ ID NO: 819146 - DNA, 25 bp, Mus musculus
tcctccaatctcgatatgctgtatg

SEQ ID NO: 819147 - DNA, 25 bp, Mus musculus
tcctccaatgctctcaagctcagta

SEQ ID NO: 819148 - DNA, 25 bp, Mus musculus
tcctccaatgctgtcaagctcagta

SEQ ID NO: 819149 - DNA, 25 bp, Mus musculus
tcctccacagcaacatgagagacca

SEQ ID NO: 819150 - DNA, 25 bp, Mus musculus
tcctccacagcatcatgagagacca

SEQ ID NO: 819151 - DNA, 25 bp, Mus musculus
tcctccacagtgaacccagggcaga

SEQ ID NO: 819152 - DNA, 25 bp, Mus musculus
tcctccacagtgacttctagtgtaa

SEQ ID NO: 819153 - DNA, 25 bp, Mus musculus
tcctccacagtgatgcgcgtgcgtg

SEQ ID NO: 819154 - DNA, 25 bp, Mus musculus
tcctccacagtgtacccagggcaga

SEQ ID NO: 819155 - DNA, 25 bp, Mus musculus
tcctccacagtgtcttctagtgtaa

SEQ ID NO: 819156 - DNA, 25 bp, Mus musculus
tcctccacagtgttgcgcgtgcgtg

SEQ ID NO: 819157 - DNA, 25 bp, Mus musculus
tcctccacattcaattgtcctaatt

SEQ ID NO: 819158 - DNA, 25 bp, Mus musculus
tcctccacattctattgtcctaatt

SEQ ID NO: 819159 - DNA, 25 bp, Mus musculus
tcctccacgcagaagccgaaggtga

SEQ ID NO: 819160 - DNA, 25 bp, Mus musculus
tcctccacgcagtagccgaaggtga

SEQ ID NO: 819161 - DNA, 25 bp, Mus musculus
tcctccactcctcgatatgtgaata

SEQ ID NO: 819162 - DNA, 25 bp, Mus musculus
tcctccactcctggatatgtgaata

SEQ ID NO: 819163 - DNA, 25 bp, Mus musculus
tcctccactctgaatgggttcagta

SEQ ID NO: 819164 - DNA, 25 bp, Mus musculus
tcctccactctgtatgggttcagta

SEQ ID NO: 819165 - DNA, 25 bp, Mus musculus
tcctccactgaaattgtttgtaacg

SEQ ID NO: 819166 - DNA, 25 bp, Mus musculus
tcctccactgaatttgtttgtaacg

SEQ ID NO: 819167 - DNA, 25 bp, Mus musculus
tcctccactttgagttagcagtctg

SEQ ID NO: 819168 - DNA, 25 bp, Mus musculus
tcctccactttgtgttagcagtctg

SEQ ID NO: 819169 - DNA, 25 bp, Mus musculus
tcctccagaactctcagttgcttgg

SEQ ID NO: 819170 - DNA, 25 bp, Mus musculus
tcctccagaactgtcagttgcttgg

SEQ ID NO: 819171 - DNA, 25 bp, Mus musculus
tcctccagaaggaagagcattgctg

SEQ ID NO: 819172 - DNA, 25 bp, Mus musculus
tcctccagaaggtagagcattgctg

SEQ ID NO: 819173 - DNA, 25 bp, Mus musculus
tcctccagacagagcaggccgtgaa

SEQ ID NO: 819174 - DNA, 25 bp, Mus musculus
tcctccagacagtgcaggccgtgaa

SEQ ID NO: 819175 - DNA, 25 bp, Mus musculus
tcctccagactcaaagggctcaagt

SEQ ID NO: 819176 - DNA, 25 bp, Mus musculus
tcctccagactctaagggctcaagt

SEQ ID NO: 819177 - DNA, 25 bp, Mus musculus
tcctccagagttcacaccctggaag

SEQ ID NO: 819178 - DNA, 25 bp, Mus musculus
tcctccagagttgacaccctggaag

SEQ ID NO: 819179 - DNA, 25 bp, Mus musculus
tcctccagatgcaccaaatatcata

SEQ ID NO: 819180 - DNA, 25 bp, Mus musculus
tcctccagatgctccaaatatcata

SEQ ID NO: 819181 - DNA, 25 bp, Mus musculus
tcctccagcaacactgtatcttaaa

SEQ ID NO: 819182 - DNA, 25 bp, Mus musculus
tcctccagcaactctgtatcttaaa

SEQ ID NO: 819183 - DNA, 25 bp, Mus musculus
tcctccagcaggaaggactttcatg

SEQ ID NO: 819184 - DNA, 25 bp, Mus musculus
tcctccagcaggtaggactttcatg

SEQ ID NO: 819185 - DNA, 25 bp, Mus musculus
tcctccaggattctgaacacacaaa

SEQ ID NO: 819186 - DNA, 25 bp, Mus musculus
tcctccaggattgtgaacacacaaa

SEQ ID NO: 819187 - DNA, 25 bp, Mus musculus
tcctccaggcaactccagttcagtt

SEQ ID NO: 819188 - DNA, 25 bp, Mus musculus
tcctccaggcaagtccagttcagtt

SEQ ID NO: 819189 - DNA, 25 bp, Mus musculus
tcctccaggctcactgacattgaga

SEQ ID NO: 819190 - DNA, 25 bp, Mus musculus
tcctccaggctctctgacattgaga

SEQ ID NO: 819191 - DNA, 25 bp, Mus musculus
tcctccagggccaggactttggcag

SEQ ID NO: 819192 - DNA, 25 bp, Mus musculus
tcctccagggcctggactttggcag

SEQ ID NO: 819193 - DNA, 25 bp, Mus musculus
tcctccagggtcaccaggtggagat

SEQ ID NO: 819194 - DNA, 25 bp, Mus musculus
tcctccagggtctccaggtggagat

SEQ ID NO: 819195 - DNA, 25 bp, Mus musculus
tcctccaggtatcatgggcccacct

SEQ ID NO: 819196 - DNA, 25 bp, Mus musculus
tcctccaggtatgatgggcccacct

SEQ ID NO: 819197 - DNA, 25 bp, Mus musculus
tcctccaggtctccataatctggat

SEQ ID NO: 819198 - DNA, 25 bp, Mus musculus
tcctccaggtctgcataatctggat

SEQ ID NO: 819199 - DNA, 25 bp, Mus musculus
tcctccaggtggaaggttacagcaa

SEQ ID NO: 819200 - DNA, 25 bp, Mus musculus
tcctccaggtggtaggttacagcaa

SEQ ID NO: 819201 - DNA, 25 bp, Mus musculus
tcctccagtaggctgcagcttggta

SEQ ID NO: 819202 - DNA, 25 bp, Mus musculus
tcctccagtagggtgcagcttggta

SEQ ID NO: 819203 - DNA, 25 bp, Mus musculus
tcctccagtggaagtgagatggttc

SEQ ID NO: 819204 - DNA, 25 bp, Mus musculus
tcctccagtggatgtgagatggttc

SEQ ID NO: 819205 - DNA, 25 bp, Mus musculus
tcctccataaacacctacaaactga

SEQ ID NO: 819206 - DNA, 25 bp, Mus musculus
tcctccataaactcctacaaactga

SEQ ID NO: 819207 - DNA, 25 bp, Mus musculus
tcctccatagagaccacacagtaag

SEQ ID NO: 819208 - DNA, 25 bp, Mus musculus
tcctccatagagtccacacagtaag

SEQ ID NO: 819209 - DNA, 25 bp, Mus musculus
tcctccatctgaactgcactgaaga

SEQ ID NO: 819210 - DNA, 25 bp, Mus musculus
tcctccatctgatctgcactgaaga

SEQ ID NO: 819211 - DNA, 25 bp, Mus musculus
tcctccatgcaccatgatttcaaag

SEQ ID NO: 819212 - DNA, 25 bp, Mus musculus
tcctccatgcacgatgatttcaaag

SEQ ID NO: 819213 - DNA, 25 bp, Mus musculus
tcctccatgctgcaattgcagctac

SEQ ID NO: 819214 - DNA, 25 bp, Mus musculus
tcctccatgctggaattgcagctac

SEQ ID NO: 819215 - DNA, 25 bp, Mus musculus
tcctccatggaacattattgatccc

SEQ ID NO: 819216 - DNA, 25 bp, Mus musculus
tcctccatggaagattattgatccc

SEQ ID NO: 819217 - DNA, 25 bp, Mus musculus
tcctccattcccaagcattgtatat

SEQ ID NO: 819218 - DNA, 25 bp, Mus musculus
tcctccattccctagcattgtatat

SEQ ID NO: 819219 - DNA, 25 bp, Mus musculus
tcctccattcgcaaaaatttgttta

SEQ ID NO: 819220 - DNA, 25 bp, Mus musculus
tcctccattcgctaaaatttgttta

SEQ ID NO: 819221 - DNA, 25 bp, Mus musculus
tcctccattttcacagactactatg

SEQ ID NO: 819222 - DNA, 25 bp, Mus musculus
tcctccattttctcagactactatg

SEQ ID NO: 819223 - DNA, 25 bp, Mus musculus
tcctccatttttcccttatctaagt

SEQ ID NO: 819224 - DNA, 25 bp, Mus musculus
tcctccatttttgccttatctaagt

SEQ ID NO: 819225 - DNA, 25 bp, Mus musculus
tcctcccaaaaacccagctgtgaag

SEQ ID NO: 819226 - DNA, 25 bp, Mus musculus
tcctcccaaaaagccagctgtgaag

SEQ ID NO: 819227 - DNA, 25 bp, Mus musculus
tcctcccaaaagagttgatggcccc

SEQ ID NO: 819228 - DNA, 25 bp, Mus musculus
tcctcccaaaagtgttgatggcccc

SEQ ID NO: 819229 - DNA, 25 bp, Mus musculus
tcctcccaagatccttttggtcata

SEQ ID NO: 819230 - DNA, 25 bp, Mus musculus
tcctcccaagatgcttttggtcata

SEQ ID NO: 819231 - DNA, 25 bp, Mus musculus
tcctcccaaggaccagggatcagtt

SEQ ID NO: 819232 - DNA, 25 bp, Mus musculus
tcctcccaaggagcagggatcagtt

SEQ ID NO: 819233 - DNA, 25 bp, Mus musculus
tcctcccacactctggtgactcttg

SEQ ID NO: 819234 - DNA, 25 bp, Mus musculus
tcctcccacactgtggtgactcttg

SEQ ID NO: 819235 - DNA, 25 bp, Mus musculus
tcctcccaccaccattaagtaggag

SEQ ID NO: 819236 - DNA, 25 bp, Mus musculus
tcctcccaccacgattaagtaggag

SEQ ID NO: 819237 - DNA, 25 bp, Mus musculus
tcctcccactggcaagagtctcttt

SEQ ID NO: 819238 - DNA, 25 bp, Mus musculus
tcctcccactgggaagagtctcttt

SEQ ID NO: 819239 - DNA, 25 bp, Mus musculus
tcctcccagataattacagcctcag

SEQ ID NO: 819240 - DNA, 25 bp, Mus musculus
tcctcccagatatttacagcctcag

SEQ ID NO: 819241 - DNA, 25 bp, Mus musculus
tcctcccagggaatgaatgccaaca

SEQ ID NO: 819242 - DNA, 25 bp, Mus musculus
tcctcccagggattgaatgccaaca

SEQ ID NO: 819243 - DNA, 25 bp, Mus musculus
tcctcccagggcaaattgtacaggt

SEQ ID NO: 819244 - DNA, 25 bp, Mus musculus
tcctcccagggctaattgtacaggt

SEQ ID NO: 819245 - DNA, 25 bp, Mus musculus
tcctcccagtttcgtaggacctttg

SEQ ID NO: 819246 - DNA, 25 bp, Mus musculus
tcctcccagtttggtaggacctttg

SEQ ID NO: 819247 - DNA, 25 bp, Mus musculus
tcctcccatggaattgttagtttcg

SEQ ID NO: 819248 - DNA, 25 bp, Mus musculus
tcctcccatggatttgttagtttcg

SEQ ID NO: 819249 - DNA, 25 bp, Mus musculus
tcctcccatgggatcggatggagct

SEQ ID NO: 819250 - DNA, 25 bp, Mus musculus
tcctcccatgggttcggatggagct

SEQ ID NO: 819251 - DNA, 25 bp, Mus musculus
tcctccccaaatctgttatgctatg

SEQ ID NO: 819252 - DNA, 25 bp, Mus musculus
tcctccccaaatgtgttatgctatg

SEQ ID NO: 819253 - DNA, 25 bp, Mus musculus
tcctccccaaggaatgtggtgctgt

SEQ ID NO: 819254 - DNA, 25 bp, Mus musculus
tcctccccaaggtatgtggtgctgt

SEQ ID NO: 819255 - DNA, 25 bp, Mus musculus
tcctccccagagacaagagacttca

SEQ ID NO: 819256 - DNA, 25 bp, Mus musculus
tcctccccagagtcaagagacttca

SEQ ID NO: 819257 - DNA, 25 bp, Mus musculus
tcctccccatatatgtgctgcaatt

SEQ ID NO: 819258 - DNA, 25 bp, Mus musculus
tcctccccatatttgtgctgcaatt

SEQ ID NO: 819259 - DNA, 25 bp, Mus musculus
tcctccccgagtcacagtgtttgaa

SEQ ID NO: 819260 - DNA, 25 bp, Mus musculus
tcctccccgagtgacagtgtttgaa

SEQ ID NO: 819261 - DNA, 25 bp, Mus musculus
tcctccccgattctagctgtaaatg

SEQ ID NO: 819262 - DNA, 25 bp, Mus musculus
tcctccccgattgtagctgtaaatg

SEQ ID NO: 819263 - DNA, 25 bp, Mus musculus
tcctcccctatacattcttgagatt

SEQ ID NO: 819264 - DNA, 25 bp, Mus musculus
tcctcccctatagattcttgagatt

SEQ ID NO: 819265 - DNA, 25 bp, Mus musculus
tcctcccctcttaagggtatattca

SEQ ID NO: 819266 - DNA, 25 bp, Mus musculus
tcctcccctctttagggtatattca

SEQ ID NO: 819267 - DNA, 25 bp, Mus musculus
tcctcccctgagctagtggtgagaa

SEQ ID NO: 819268 - DNA, 25 bp, Mus musculus
tcctcccctgaggtagtggtgagaa

SEQ ID NO: 819269 - DNA, 25 bp, Mus musculus
tcctcccctggacagacattttaac

SEQ ID NO: 819270 - DNA, 25 bp, Mus musculus
tcctcccctggagagacattttaac

SEQ ID NO: 819271 - DNA, 25 bp, Mus musculus
tcctcccctgtacagtattatttat

SEQ ID NO: 819272 - DNA, 25 bp, Mus musculus
tcctcccctgtagagtattatttat

SEQ ID NO: 819273 - DNA, 25 bp, Mus musculus
tcctccccttcaaatgctgtaatta

SEQ ID NO: 819274 - DNA, 25 bp, Mus musculus
tcctccccttcatatgctgtaatta

SEQ ID NO: 819275 - DNA, 25 bp, Mus musculus
tcctcccgaggaaggcagcaatcag

SEQ ID NO: 819276 - DNA, 25 bp, Mus musculus
tcctcccgaggatggcagcaatcag

SEQ ID NO: 819277 - DNA, 25 bp, Mus musculus
tcctcccggtgcaatttttcacttc

SEQ ID NO: 819278 - DNA, 25 bp, Mus musculus
tcctcccggtgctatttttcacttc

SEQ ID NO: 819279 - DNA, 25 bp, Mus musculus
tcctcccgtatcacttgtgcagaat

SEQ ID NO: 819280 - DNA, 25 bp, Mus musculus
tcctcccgtatctcttgtgcagaat

SEQ ID NO: 819281 - DNA, 25 bp, Mus musculus
tcctccctaagacgtttctagcaaa

SEQ ID NO: 819282 - DNA, 25 bp, Mus musculus
tcctccctaagaggtttctagcaaa

SEQ ID NO: 819283 - DNA, 25 bp, Mus musculus
tcctccctagccattgttgttaatt

SEQ ID NO: 819284 - DNA, 25 bp, Mus musculus
tcctccctagcctttgttgttaatt

SEQ ID NO: 819285 - DNA, 25 bp, Mus musculus
tcctccctagctccgtgttgaaaat

SEQ ID NO: 819286 - DNA, 25 bp, Mus musculus
tcctccctagctgcgtgttgaaaat

SEQ ID NO: 819287 - DNA, 25 bp, Mus musculus
tcctccctagtcagcctttgtatat

SEQ ID NO: 819288 - DNA, 25 bp, Mus musculus
tcctccctagtctgcctttgtatat

SEQ ID NO: 819289 - DNA, 25 bp, Mus musculus
tcctccctcaatactggacttttta

SEQ ID NO: 819290 - DNA, 25 bp, Mus musculus
tcctccctcaattctggacttttta

SEQ ID NO: 819291 - DNA, 25 bp, Mus musculus
tcctccctcagtcttatgactttaa

SEQ ID NO: 819292 - DNA, 25 bp, Mus musculus
tcctccctcagtgttatgactttaa

SEQ ID NO: 819293 - DNA, 25 bp, Mus musculus
tcctccctcctgatttctgtaaata

SEQ ID NO: 819294 - DNA, 25 bp, Mus musculus
tcctccctcctgttttctgtaaata

SEQ ID NO: 819295 - DNA, 25 bp, Mus musculus
tcctccctcgtgaagatgccaaata

SEQ ID NO: 819296 - DNA, 25 bp, Mus musculus
tcctccctcgtgtagatgccaaata

SEQ ID NO: 819297 - DNA, 25 bp, Mus musculus
tcctccctcttaaattctctatata

SEQ ID NO: 819298 - DNA, 25 bp, Mus musculus
tcctccctcttatattctctatata

SEQ ID NO: 819299 - DNA, 25 bp, Mus musculus
tcctccctgccaaagtgtaattcca

SEQ ID NO: 819300 - DNA, 25 bp, Mus musculus
tcctccctgccatagtgtaattcca

SEQ ID NO: 819301 - DNA, 25 bp, Mus musculus
tcctccctgctgatttgttcccaat

SEQ ID NO: 819302 - DNA, 25 bp, Mus musculus
tcctccctgctgttttgttcccaat

SEQ ID NO: 819303 - DNA, 25 bp, Mus musculus
tcctccctggacaatagagcaattg

SEQ ID NO: 819304 - DNA, 25 bp, Mus musculus
tcctccctggacaatttgctttttc

SEQ ID NO: 819305 - DNA, 25 bp, Mus musculus
tcctccctggactatagagcaattg

SEQ ID NO: 819306 - DNA, 25 bp, Mus musculus
tcctccctggactatttgctttttc

SEQ ID NO: 819307 - DNA, 25 bp, Mus musculus
tcctccctggagattccataagcac

SEQ ID NO: 819308 - DNA, 25 bp, Mus musculus
tcctccctggagtttccataagcac

SEQ ID NO: 819309 - DNA, 25 bp, Mus musculus
tcctccctggctatgctattgattt

SEQ ID NO: 819310 - DNA, 25 bp, Mus musculus
tcctccctggctttgctattgattt

SEQ ID NO: 819311 - DNA, 25 bp, Mus musculus
tcctccctgggaaataaacaagtgc

SEQ ID NO: 819312 - DNA, 25 bp, Mus musculus
tcctccctgggatataaacaagtgc

SEQ ID NO: 819313 - DNA, 25 bp, Mus musculus
tcctccctgggcaggcattttagaa

SEQ ID NO: 819314 - DNA, 25 bp, Mus musculus
tcctccctgggctggcattttagaa

SEQ ID NO: 819315 - DNA, 25 bp, Mus musculus
tcctccctgtgtattgagatgaaca

SEQ ID NO: 819316 - DNA, 25 bp, Mus musculus
tcctccctgtgtcatatggtttcgg

SEQ ID NO: 819317 - DNA, 25 bp, Mus musculus
tcctccctgtgtgatatggtttcgg

SEQ ID NO: 819318 - DNA, 25 bp, Mus musculus
tcctccctgtgttttgagatgaaca

SEQ ID NO: 819319 - DNA, 25 bp, Mus musculus
tcctcccttctcacgtggagagcat

SEQ ID NO: 819320 - DNA, 25 bp, Mus musculus
tcctcccttctctcgtggagagcat

SEQ ID NO: 819321 - DNA, 25 bp, Mus musculus
tcctcccttggcagcgcagagaaga

SEQ ID NO: 819322 - DNA, 25 bp, Mus musculus
tcctcccttggctgcgcagagaaga

SEQ ID NO: 819323 - DNA, 25 bp, Mus musculus
tcctccctttcaatcaaacagagta

SEQ ID NO: 819324 - DNA, 25 bp, Mus musculus
tcctccctttcattcaaacagagta

SEQ ID NO: 819325 - DNA, 25 bp, Mus musculus
tcctccctttctcttggaagaagca

SEQ ID NO: 819326 - DNA, 25 bp, Mus musculus
tcctccctttctgttggaagaagca

SEQ ID NO: 819327 - DNA, 25 bp, Mus musculus
tcctccctttgaagatctgtccata

SEQ ID NO: 819328 - DNA, 25 bp, Mus musculus
tcctccctttgatgatctgtccata

SEQ ID NO: 819329 - DNA, 25 bp, Mus musculus
tcctcccttttacttcacaagctta

SEQ ID NO: 819330 - DNA, 25 bp, Mus musculus
tcctcccttttagttcacaagctta

SEQ ID NO: 819331 - DNA, 25 bp, Mus musculus
tcctccgaaagcaaaagtgccacag

SEQ ID NO: 819332 - DNA, 25 bp, Mus musculus
tcctccgaaagctaaagtgccacag

SEQ ID NO: 819333 - DNA, 25 bp, Mus musculus
tcctccgaaagtaactgcgattcca

SEQ ID NO: 819334 - DNA, 25 bp, Mus musculus
tcctccgaaagttactgcgattcca

SEQ ID NO: 819335 - DNA, 25 bp, Mus musculus
tcctccgagtggaaagtacagcagc

SEQ ID NO: 819336 - DNA, 25 bp, Mus musculus
tcctccgagtggtaagtacagcagc

SEQ ID NO: 819337 - DNA, 25 bp, Mus musculus
tcctccgatcgaatttaacctgttg

SEQ ID NO: 819338 - DNA, 25 bp, Mus musculus
tcctccgatcgattttaacctgttg

SEQ ID NO: 819339 - DNA, 25 bp, Mus musculus
tcctccgcataaacagctttactta

SEQ ID NO: 819340 - DNA, 25 bp, Mus musculus
tcctccgcataatcagctttactta

SEQ ID NO: 819341 - DNA, 25 bp, Mus musculus
tcctccgcggacagagaactggaca

SEQ ID NO: 819342 - DNA, 25 bp, Mus musculus
tcctccgcggactgagaactggaca

SEQ ID NO: 819343 - DNA, 25 bp, Mus musculus
tcctccgcttccagggcaaagacga

SEQ ID NO: 819344 - DNA, 25 bp, Mus musculus
tcctccgcttcctgggcaaagacga

SEQ ID NO: 819345 - DNA, 25 bp, Mus musculus
tcctccggagcgaagtggttgacgt

SEQ ID NO: 819346 - DNA, 25 bp, Mus musculus
tcctccggagcgtagtggttgacgt

SEQ ID NO: 819347 - DNA, 25 bp, Mus musculus
tcctccggcaccacagaagaagctg

SEQ ID NO: 819348 - DNA, 25 bp, Mus musculus
tcctccggcacctcagaagaagctg

SEQ ID NO: 819349 - DNA, 25 bp, Mus musculus
tcctccggctggaaccaggatggga

SEQ ID NO: 819350 - DNA, 25 bp, Mus musculus
tcctccggctggtaccaggatggga

SEQ ID NO: 819351 - DNA, 25 bp, Mus musculus
tcctccggctttctggaagaattca

SEQ ID NO: 819352 - DNA, 25 bp, Mus musculus
tcctccggctttgtggaagaattca

SEQ ID NO: 819353 - DNA, 25 bp, Mus musculus
tcctccgggcttagactttgttgat

SEQ ID NO: 819354 - DNA, 25 bp, Mus musculus
tcctccgggctttgactttgttgat

SEQ ID NO: 819355 - DNA, 25 bp, Mus musculus
tcctccgtacgtatatagggacaca

SEQ ID NO: 819356 - DNA, 25 bp, Mus musculus
tcctccgtacgtttatagggacaca

SEQ ID NO: 819357 - DNA, 25 bp, Mus musculus
tcctccgtcagaccaactatgatgt

SEQ ID NO: 819358 - DNA, 25 bp, Mus musculus
tcctccgtcagagcaactatgatgt

SEQ ID NO: 819359 - DNA, 25 bp, Mus musculus
tcctccgtccaacatttaatcagtg

SEQ ID NO: 819360 - DNA, 25 bp, Mus musculus
tcctccgtccaagatttaatcagtg

SEQ ID NO: 819361 - DNA, 25 bp, Mus musculus
tcctccgtccttattattgacaggg

SEQ ID NO: 819362 - DNA, 25 bp, Mus musculus
tcctccgtcctttttattgacaggg

SEQ ID NO: 819363 - DNA, 25 bp, Mus musculus
tcctccgtgtataacaccagtgtta

SEQ ID NO: 819364 - DNA, 25 bp, Mus musculus
tcctccgtgtattacaccagtgtta

SEQ ID NO: 819365 - DNA, 25 bp, Mus musculus
tcctccgtgtggactaacacttatt

SEQ ID NO: 819366 - DNA, 25 bp, Mus musculus
tcctccgtgtggtctaacacttatt

SEQ ID NO: 819367 - DNA, 25 bp, Mus musculus
tcctccgtttttctgtcagatattt

SEQ ID NO: 819368 - DNA, 25 bp, Mus musculus
tcctccgtttttgtgtcagatattt

SEQ ID NO: 819369 - DNA, 25 bp, Mus musculus
tcctcctaaatcctgtgcctgagaa

SEQ ID NO: 819370 - DNA, 25 bp, Mus musculus
tcctcctaaatcgtgtgcctgagaa

SEQ ID NO: 819371 - DNA, 25 bp, Mus musculus
tcctcctaaattagcttcctggttg

SEQ ID NO: 819372 - DNA, 25 bp, Mus musculus
tcctcctaaatttgcttcctggttg

SEQ ID NO: 819373 - DNA, 25 bp, Mus musculus
tcctcctaactccaacatcaagatg

SEQ ID NO: 819374 - DNA, 25 bp, Mus musculus
tcctcctaactcgaacatcaagatg

SEQ ID NO: 819375 - DNA, 25 bp, Mus musculus
tcctcctacattatttactctgcaa

SEQ ID NO: 819376 - DNA, 25 bp, Mus musculus
tcctcctacattcagcagacacggt

SEQ ID NO: 819377 - DNA, 25 bp, Mus musculus
tcctcctacattgagcagacacggt

SEQ ID NO: 819378 - DNA, 25 bp, Mus musculus
tcctcctacattttttactctgcaa

SEQ ID NO: 819379 - DNA, 25 bp, Mus musculus
tcctcctaccaacttatttaataga

SEQ ID NO: 819380 - DNA, 25 bp, Mus musculus
tcctcctaccaagttatttaataga

SEQ ID NO: 819381 - DNA, 25 bp, Mus musculus
tcctcctacccaatcagggaaagga

SEQ ID NO: 819382 - DNA, 25 bp, Mus musculus
tcctcctacccattcagggaaagga

SEQ ID NO: 819383 - DNA, 25 bp, Mus musculus
tcctcctagccacctttatttggaa

SEQ ID NO: 819384 - DNA, 25 bp, Mus musculus
tcctcctagccagctttatttggaa

SEQ ID NO: 819385 - DNA, 25 bp, Mus musculus
tcctcctaggtcacggctctgagca

SEQ ID NO: 819386 - DNA, 25 bp, Mus musculus
tcctcctaggtctcggctctgagca

SEQ ID NO: 819387 - DNA, 25 bp, Mus musculus
tcctcctatgagaaaccatgtgtgt

SEQ ID NO: 819388 - DNA, 25 bp, Mus musculus
tcctcctatgagtaaccatgtgtgt

SEQ ID NO: 819389 - DNA, 25 bp, Mus musculus
tcctcctattcaactactctgaccc

SEQ ID NO: 819390 - DNA, 25 bp, Mus musculus
tcctcctattcatctactctgaccc

SEQ ID NO: 819391 - DNA, 25 bp, Mus musculus
tcctcctattttccagaagtgaaca

SEQ ID NO: 819392 - DNA, 25 bp, Mus musculus
tcctcctattttgcagaagtgaaca

SEQ ID NO: 819393 - DNA, 25 bp, Mus musculus
tcctcctcaagacctatgttcttgg

SEQ ID NO: 819394 - DNA, 25 bp, Mus musculus
tcctcctcaagagctatgttcttgg

SEQ ID NO: 819395 - DNA, 25 bp, Mus musculus
tcctcctcagcgaaatatctcaaac

SEQ ID NO: 819396 - DNA, 25 bp, Mus musculus
tcctcctcagcgtaatatctcaaac

SEQ ID NO: 819397 - DNA, 25 bp, Mus musculus
tcctcctcaggaatatggctcaaca

SEQ ID NO: 819398 - DNA, 25 bp, Mus musculus
tcctcctcaggattatggctcaaca

SEQ ID NO: 819399 - DNA, 25 bp, Mus musculus
tcctcctccaaacccggattgggat

SEQ ID NO: 819400 - DNA, 25 bp, Mus musculus
tcctcctccaaagccggattgggat

SEQ ID NO: 819401 - DNA, 25 bp, Mus musculus
tcctcctccaggcatgcgaggtctg

SEQ ID NO: 819402 - DNA, 25 bp, Mus musculus
tcctcctccagggatgcgaggtctg

SEQ ID NO: 819403 - DNA, 25 bp, Mus musculus
tcctcctcccaaaagattcaacatt

SEQ ID NO: 819404 - DNA, 25 bp, Mus musculus
tcctcctcccaatagattcaacatt

SEQ ID NO: 819405 - DNA, 25 bp, Mus musculus
tcctcctcctaaagcttttgtttgg

SEQ ID NO: 819406 - DNA, 25 bp, Mus musculus
tcctcctcctaatgcttttgtttgg

SEQ ID NO: 819407 - DNA, 25 bp, Mus musculus
tcctcctcctatcggctcgaatata

SEQ ID NO: 819408 - DNA, 25 bp, Mus musculus
tcctcctcctatgggctcgaatata

SEQ ID NO: 819409 - DNA, 25 bp, Mus musculus
tcctcctcctgactttgggaaactg

SEQ ID NO: 819410 - DNA, 25 bp, Mus musculus
tcctcctcctgagtttgggaaactg

SEQ ID NO: 819411 - DNA, 25 bp, Mus musculus
tcctcctccttaattgttggaagtg

SEQ ID NO: 819412 - DNA, 25 bp, Mus musculus
tcctcctccttatttgttggaagtg

SEQ ID NO: 819413 - DNA, 25 bp, Mus musculus
tcctcctcggccaaatttgatgtgg

SEQ ID NO: 819414 - DNA, 25 bp, Mus musculus
tcctcctcggcctaatttgatgtgg

SEQ ID NO: 819415 - DNA, 25 bp, Mus musculus
tcctcctctagaatctgtgtgcttt

SEQ ID NO: 819416 - DNA, 25 bp, Mus musculus
tcctcctctagattctgtgtgcttt

SEQ ID NO: 819417 - DNA, 25 bp, Mus musculus
tcctcctctaggaacaagattctgt

SEQ ID NO: 819418 - DNA, 25 bp, Mus musculus
tcctcctctaggtacaagattctgt

SEQ ID NO: 819419 - DNA, 25 bp, Mus musculus
tcctcctctctgagtgttggaggga

SEQ ID NO: 819420 - DNA, 25 bp, Mus musculus
tcctcctctctgtgtgttggaggga

SEQ ID NO: 819421 - DNA, 25 bp, Mus musculus
tcctcctcttaactgctggctacat

SEQ ID NO: 819422 - DNA, 25 bp, Mus musculus
tcctcctcttaagtgctggctacat

SEQ ID NO: 819423 - DNA, 25 bp, Mus musculus
tcctcctcttacagtactttctgaa

SEQ ID NO: 819424 - DNA, 25 bp, Mus musculus
tcctcctcttactgtactttctgaa

SEQ ID NO: 819425 - DNA, 25 bp, Mus musculus
tcctcctcttcactaacaaaactta

SEQ ID NO: 819426 - DNA, 25 bp, Mus musculus
tcctcctcttcagtaacaaaactta

SEQ ID NO: 819427 - DNA, 25 bp, Mus musculus
tcctcctgaaagctcagttccagaa

SEQ ID NO: 819428 - DNA, 25 bp, Mus musculus
tcctcctgaaaggtcagttccagaa

SEQ ID NO: 819429 - DNA, 25 bp, Mus musculus
tcctcctgaagaagccacggatgac

SEQ ID NO: 819430 - DNA, 25 bp, Mus musculus
tcctcctgaagatgccacggatgac

SEQ ID NO: 819431 - DNA, 25 bp, Mus musculus
tcctcctgaaggaagtcgagccgtg

SEQ ID NO: 819432 - DNA, 25 bp, Mus musculus
tcctcctgaaggtagtcgagccgtg

SEQ ID NO: 819433 - DNA, 25 bp, Mus musculus
tcctcctgacatacatatgtttggg

SEQ ID NO: 819434 - DNA, 25 bp, Mus musculus
tcctcctgacattcatatgtttggg

SEQ ID NO: 819435 - DNA, 25 bp, Mus musculus
tcctcctgactgaactgcgggcaag

SEQ ID NO: 819436 - DNA, 25 bp, Mus musculus
tcctcctgactgtactgcgggcaag

SEQ ID NO: 819437 - DNA, 25 bp, Mus musculus
tcctcctgagtgattggcactaacc

SEQ ID NO: 819438 - DNA, 25 bp, Mus musculus
tcctcctgagtgtttggcactaacc

SEQ ID NO: 819439 - DNA, 25 bp, Mus musculus
tcctcctgcagtcgatttctaacta

SEQ ID NO: 819440 - DNA, 25 bp, Mus musculus
tcctcctgcagtggatttctaacta

SEQ ID NO: 819441 - DNA, 25 bp, Mus musculus
tcctcctgcattattcgtgaaagtc

SEQ ID NO: 819442 - DNA, 25 bp, Mus musculus
tcctcctgcatttttcgtgaaagtc

SEQ ID NO: 819443 - DNA, 25 bp, Mus musculus
tcctcctgccacagactggttagga

SEQ ID NO: 819444 - DNA, 25 bp, Mus musculus
tcctcctgccactgactggttagga

SEQ ID NO: 819445 - DNA, 25 bp, Mus musculus
tcctcctgccagaggctgaccataa

SEQ ID NO: 819446 - DNA, 25 bp, Mus musculus
tcctcctgccagtggctgaccataa

SEQ ID NO: 819447 - DNA, 25 bp, Mus musculus
tcctcctgccccattagaaataaca

SEQ ID NO: 819448 - DNA, 25 bp, Mus musculus
tcctcctgcccctttagaaataaca

SEQ ID NO: 819449 - DNA, 25 bp, Mus musculus
tcctcctgccgtagatgagtcagaa

SEQ ID NO: 819450 - DNA, 25 bp, Mus musculus
tcctcctgccgttgatgagtcagaa

SEQ ID NO: 819451 - DNA, 25 bp, Mus musculus
tcctcctgcctgatgctttcattgg

SEQ ID NO: 819452 - DNA, 25 bp, Mus musculus
tcctcctgcctgttgctttcattgg

SEQ ID NO: 819453 - DNA, 25 bp, Mus musculus
tcctcctgcttcatcactttggtgg

SEQ ID NO: 819454 - DNA, 25 bp, Mus musculus
tcctcctgcttcttcactttggtgg

SEQ ID NO: 819455 - DNA, 25 bp, Mus musculus
tcctcctgctttaagggtccatgta

SEQ ID NO: 819456 - DNA, 25 bp, Mus musculus
tcctcctgcttttagggtccatgta

SEQ ID NO: 819457 - DNA, 25 bp, Mus musculus
tcctcctggaatccattgtgaccga

SEQ ID NO: 819458 - DNA, 25 bp, Mus musculus
tcctcctggaatgcattgtgaccga

SEQ ID NO: 819459 - DNA, 25 bp, Mus musculus
tcctcctggcagaagcgtggaacta

SEQ ID NO: 819460 - DNA, 25 bp, Mus musculus
tcctcctggcagctctttaaactaa

SEQ ID NO: 819461 - DNA, 25 bp, Mus musculus
tcctcctggcaggtctttaaactaa

SEQ ID NO: 819462 - DNA, 25 bp, Mus musculus
tcctcctggcagtagcgtggaacta

SEQ ID NO: 819463 - DNA, 25 bp, Mus musculus
tcctcctggcctatctaataaagtc

SEQ ID NO: 819464 - DNA, 25 bp, Mus musculus
tcctcctggcctttctaataaagtc

SEQ ID NO: 819465 - DNA, 25 bp, Mus musculus
tcctcctgggagattgcctgcacaa

SEQ ID NO: 819466 - DNA, 25 bp, Mus musculus
tcctcctgggagtttgcctgcacaa

SEQ ID NO: 819467 - DNA, 25 bp, Mus musculus
tcctcctgtaggacgctagagggcg

SEQ ID NO: 819468 - DNA, 25 bp, Mus musculus
tcctcctgtaggtcgctagagggcg

SEQ ID NO: 819469 - DNA, 25 bp, Mus musculus
tcctcctgtagtatacgttatctct

SEQ ID NO: 819470 - DNA, 25 bp, Mus musculus
tcctcctgtagtttacgttatctct

SEQ ID NO: 819471 - DNA, 25 bp, Mus musculus
tcctcctgtggcacaatttatgcaa

SEQ ID NO: 819472 - DNA, 25 bp, Mus musculus
tcctcctgtggctcaatttatgcaa

SEQ ID NO: 819473 - DNA, 25 bp, Mus musculus
tcctcctgtgttaaatgttactttc

SEQ ID NO: 819474 - DNA, 25 bp, Mus musculus
tcctcctgtgttcttctacatggtg

SEQ ID NO: 819475 - DNA, 25 bp, Mus musculus
tcctcctgtgttgttctacatggtg

SEQ ID NO: 819476 - DNA, 25 bp, Mus musculus
tcctcctgtgtttaatgttactttc

SEQ ID NO: 819477 - DNA, 25 bp, Mus musculus
tcctcctgttagaatgtccctttta

SEQ ID NO: 819478 - DNA, 25 bp, Mus musculus
tcctcctgttagaggcctaatcctc

SEQ ID NO: 819479 - DNA, 25 bp, Mus musculus
tcctcctgttagtatgtccctttta

SEQ ID NO: 819480 - DNA, 25 bp, Mus musculus
tcctcctgttagtggcctaatcctc

SEQ ID NO: 819481 - DNA, 25 bp, Mus musculus
tcctcctgtttcaactttccaaata

SEQ ID NO: 819482 - DNA, 25 bp, Mus musculus
tcctcctgtttctactttccaaata

SEQ ID NO: 819483 - DNA, 25 bp, Mus musculus
tcctcctgtttgaatgggacttctt

SEQ ID NO: 819484 - DNA, 25 bp, Mus musculus
tcctcctgtttgtatgggacttctt

SEQ ID NO: 819485 - DNA, 25 bp, Mus musculus
tcctccttacaaatatgatattctt

SEQ ID NO: 819486 - DNA, 25 bp, Mus musculus
tcctccttacaattatgatattctt

SEQ ID NO: 819487 - DNA, 25 bp, Mus musculus
tcctccttacttatgacggaaacat

SEQ ID NO: 819488 - DNA, 25 bp, Mus musculus
tcctccttacttttgacggaaacat

SEQ ID NO: 819489 - DNA, 25 bp, Mus musculus
tcctccttagagctgagacttggct

SEQ ID NO: 819490 - DNA, 25 bp, Mus musculus
tcctccttagaggtgagacttggct

SEQ ID NO: 819491 - DNA, 25 bp, Mus musculus
tcctccttagctcctgctaaattga

SEQ ID NO: 819492 - DNA, 25 bp, Mus musculus
tcctccttagctgctgctaaattga

SEQ ID NO: 819493 - DNA, 25 bp, Mus musculus
tcctccttaggcaccaagaactcag

SEQ ID NO: 819494 - DNA, 25 bp, Mus musculus
tcctccttaggctccaagaactcag

SEQ ID NO: 819495 - DNA, 25 bp, Mus musculus
tcctccttcagaatgggcttgcatt

SEQ ID NO: 819496 - DNA, 25 bp, Mus musculus
tcctccttcagattgggcttgcatt

SEQ ID NO: 819497 - DNA, 25 bp, Mus musculus
tcctccttcatgacacgagagcgtg

SEQ ID NO: 819498 - DNA, 25 bp, Mus musculus
tcctccttcatgtcacgagagcgtg

SEQ ID NO: 819499 - DNA, 25 bp, Mus musculus
tcctccttccccataaaattcaatg

SEQ ID NO: 819500 - DNA, 25 bp, Mus musculus
tcctccttccccttaaaattcaatg

SEQ ID NO: 819501 - DNA, 25 bp, Mus musculus
tcctccttccctagatcagagggat

SEQ ID NO: 819502 - DNA, 25 bp, Mus musculus
tcctccttcccttgatcagagggat

SEQ ID NO: 819503 - DNA, 25 bp, Mus musculus
tcctccttcctaaactgcagtgaaa

SEQ ID NO: 819504 - DNA, 25 bp, Mus musculus
tcctccttcctatactgcagtgaaa

SEQ ID NO: 819505 - DNA, 25 bp, Mus musculus
tcctccttcctgagttggctgggaa

SEQ ID NO: 819506 - DNA, 25 bp, Mus musculus
tcctccttcctgtgttggctgggaa

SEQ ID NO: 819507 - DNA, 25 bp, Mus musculus
tcctccttctgaagattacacttct

SEQ ID NO: 819508 - DNA, 25 bp, Mus musculus
tcctccttctgatgattacacttct

SEQ ID NO: 819509 - DNA, 25 bp, Mus musculus
tcctccttctgcatgatatgggaaa

SEQ ID NO: 819510 - DNA, 25 bp, Mus musculus
tcctccttctgcttgatatgggaaa

SEQ ID NO: 819511 - DNA, 25 bp, Mus musculus
tcctccttctggaactcttgattta

SEQ ID NO: 819512 - DNA, 25 bp, Mus musculus
tcctccttctggtactcttgattta

SEQ ID NO: 819513 - DNA, 25 bp, Mus musculus
tcctccttctgtatgctggttgaca

SEQ ID NO: 819514 - DNA, 25 bp, Mus musculus
tcctccttctgtttgctggttgaca

SEQ ID NO: 819515 - DNA, 25 bp, Mus musculus
tcctccttcttccttaattcatgga

SEQ ID NO: 819516 - DNA, 25 bp, Mus musculus
tcctccttcttcgttaattcatgga

SEQ ID NO: 819517 - DNA, 25 bp, Mus musculus
tcctccttgataacatggtatgcat

SEQ ID NO: 819518 - DNA, 25 bp, Mus musculus
tcctccttgatatcatggtatgcat

SEQ ID NO: 819519 - DNA, 25 bp, Mus musculus
tcctccttggtcattgccatataag

SEQ ID NO: 819520 - DNA, 25 bp, Mus musculus
tcctccttggtctttgccatataag

SEQ ID NO: 819521 - DNA, 25 bp, Mus musculus
tcctccttgtcaacactgtgtgtgt

SEQ ID NO: 819522 - DNA, 25 bp, Mus musculus
tcctccttgtcatcactgtgtgtgt

SEQ ID NO: 819523 - DNA, 25 bp, Mus musculus
tcctccttgtccactgatcagaaca

SEQ ID NO: 819524 - DNA, 25 bp, Mus musculus
tcctccttgtcctctgatcagaaca

SEQ ID NO: 819525 - DNA, 25 bp, Mus musculus
tcctcctttcttacctgttaaagct

SEQ ID NO: 819526 - DNA, 25 bp, Mus musculus
tcctcctttctttcctgttaaagct

SEQ ID NO: 819527 - DNA, 25 bp, Mus musculus
tcctcctttggtagtgtctggtaga

SEQ ID NO: 819528 - DNA, 25 bp, Mus musculus
tcctcctttggttgtgtctggtaga

SEQ ID NO: 819529 - DNA, 25 bp, Mus musculus
tcctcctttgtccaacattttatcc

SEQ ID NO: 819530 - DNA, 25 bp, Mus musculus
tcctcctttgtcgaacattttatcc

SEQ ID NO: 819531 - DNA, 25 bp, Mus musculus
tcctccttttcaatcttactgtcat

SEQ ID NO: 819532 - DNA, 25 bp, Mus musculus
tcctccttttcattcttactgtcat

SEQ ID NO: 819533 - DNA, 25 bp, Mus musculus
tcctccttttctctggctaagtaga

SEQ ID NO: 819534 - DNA, 25 bp, Mus musculus
tcctccttttctgtggctaagtaga

SEQ ID NO: 819535 - DNA, 25 bp, Mus musculus
tcctcctttttaacattgatgagtt

SEQ ID NO: 819536 - DNA, 25 bp, Mus musculus
tcctcctttttatcattgatgagtt

SEQ ID NO: 819537 - DNA, 25 bp, Mus musculus
tcctcgaaaccccttgagtttgtat

SEQ ID NO: 819538 - DNA, 25 bp, Mus musculus
tcctcgaaacccgttgagtttgtat

SEQ ID NO: 819539 - DNA, 25 bp, Mus musculus
tcctcgaactgtacccaaggttaca

SEQ ID NO: 819540 - DNA, 25 bp, Mus musculus
tcctcgaactgttcccaaggttaca

SEQ ID NO: 819541 - DNA, 25 bp, Mus musculus
tcctcgaacttcagtgggacacttt

SEQ ID NO: 819542 - DNA, 25 bp, Mus musculus
tcctcgaacttctgtgggacacttt

SEQ ID NO: 819543 - DNA, 25 bp, Mus musculus
tcctcgagcgccagggacagctgcg

SEQ ID NO: 819544 - DNA, 25 bp, Mus musculus
tcctcgagcgcctgggacagctgcg

SEQ ID NO: 819545 - DNA, 25 bp, Mus musculus
tcctcgagctgtaactgcctgtacg

SEQ ID NO: 819546 - DNA, 25 bp, Mus musculus
tcctcgagctgttactgcctgtacg

SEQ ID NO: 819547 - DNA, 25 bp, Mus musculus
tcctcgagtgggagagcttgaagct

SEQ ID NO: 819548 - DNA, 25 bp, Mus musculus
tcctcgagtgggtgagcttgaagct

SEQ ID NO: 819549 - DNA, 25 bp, Mus musculus
tcctcgagtttcagaacgatcgcgg

SEQ ID NO: 819550 - DNA, 25 bp, Mus musculus
tcctcgagtttctgaacgatcgcgg

SEQ ID NO: 819551 - DNA, 25 bp, Mus musculus
tcctcgatgcagcttgcgcctgttt

SEQ ID NO: 819552 - DNA, 25 bp, Mus musculus
tcctcgatgcaggttgcgcctgttt

SEQ ID NO: 819553 - DNA, 25 bp, Mus musculus
tcctcgcagtttacagcagttcaaa

SEQ ID NO: 819554 - DNA, 25 bp, Mus musculus
tcctcgcagttttcagcagttcaaa

SEQ ID NO: 819555 - DNA, 25 bp, Mus musculus
tcctcgccaaagacagcctagagag

SEQ ID NO: 819556 - DNA, 25 bp, Mus musculus
tcctcgccaaagtcagcctagagag

SEQ ID NO: 819557 - DNA, 25 bp, Mus musculus
tcctcgcccggcatataactcatta

SEQ ID NO: 819558 - DNA, 25 bp, Mus musculus
tcctcgcccggcttataactcatta

SEQ ID NO: 819559 - DNA, 25 bp, Mus musculus
tcctcgccctagaggacatgacaat

SEQ ID NO: 819560 - DNA, 25 bp, Mus musculus
tcctcgccctagtggacatgacaat

SEQ ID NO: 819561 - DNA, 25 bp, Mus musculus
tcctcgccctttagtcaaactgtta

SEQ ID NO: 819562 - DNA, 25 bp, Mus musculus
tcctcgcccttttgtcaaactgtta

SEQ ID NO: 819563 - DNA, 25 bp, Mus musculus
tcctcgccggagatgtgaaagtgaa

SEQ ID NO: 819564 - DNA, 25 bp, Mus musculus
tcctcgccggagttgtgaaagtgaa

SEQ ID NO: 819565 - DNA, 25 bp, Mus musculus
tcctcgcctttccaggcatggagaa

SEQ ID NO: 819566 - DNA, 25 bp, Mus musculus
tcctcgcctttcgaggcatggagaa

SEQ ID NO: 819567 - DNA, 25 bp, Mus musculus
tcctcgctgcaacgtgccaattgaa

SEQ ID NO: 819568 - DNA, 25 bp, Mus musculus
tcctcgctgcaaggtgccaattgaa

SEQ ID NO: 819569 - DNA, 25 bp, Mus musculus
tcctcgcttccaacagctcgggagg

SEQ ID NO: 819570 - DNA, 25 bp, Mus musculus
tcctcgcttccatcagctcgggagg

SEQ ID NO: 819571 - DNA, 25 bp, Mus musculus
tcctcgcttgttcgaaggcttttgc

SEQ ID NO: 819572 - DNA, 25 bp, Mus musculus
tcctcgcttgttggaaggcttttgc

SEQ ID NO: 819573 - DNA, 25 bp, Mus musculus
tcctcgctttggcaagtgtctgttt

SEQ ID NO: 819574 - DNA, 25 bp, Mus musculus
tcctcgctttgggaagtgtctgttt

SEQ ID NO: 819575 - DNA, 25 bp, Mus musculus
tcctcgctttttcaaagttcctgcc

SEQ ID NO: 819576 - DNA, 25 bp, Mus musculus
tcctcgctttttgaaagttcctgcc

SEQ ID NO: 819577 - DNA, 25 bp, Mus musculus
tcctcggaaaacatggacacctaga

SEQ ID NO: 819578 - DNA, 25 bp, Mus musculus
tcctcggaaaacttggacacctaga

SEQ ID NO: 819579 - DNA, 25 bp, Mus musculus
tcctcggaggcaagacgcacttggg

SEQ ID NO: 819580 - DNA, 25 bp, Mus musculus
tcctcggaggcatgacgcacttggg

SEQ ID NO: 819581 - DNA, 25 bp, Mus musculus
tcctcggatcatacggccggtgaag

SEQ ID NO: 819582 - DNA, 25 bp, Mus musculus
tcctcggatcattcggccggtgaag

SEQ ID NO: 819583 - DNA, 25 bp, Mus musculus
tcctcggattctccacacaggttgg

SEQ ID NO: 819584 - DNA, 25 bp, Mus musculus
tcctcggattctgcacacaggttgg

SEQ ID NO: 819585 - DNA, 25 bp, Mus musculus
tcctcggctacaatttaaccctgaa

SEQ ID NO: 819586 - DNA, 25 bp, Mus musculus
tcctcggctacattttaaccctgaa

SEQ ID NO: 819587 - DNA, 25 bp, Mus musculus
tcctcggcttctccagatcttgact

SEQ ID NO: 819588 - DNA, 25 bp, Mus musculus
tcctcggcttctgcagatcttgact

SEQ ID NO: 819589 - DNA, 25 bp, Mus musculus
tcctcggcttgtatcccaaaagaca

SEQ ID NO: 819590 - DNA, 25 bp, Mus musculus
tcctcggcttgtttcccaaaagaca

SEQ ID NO: 819591 - DNA, 25 bp, Mus musculus
tcctcggctttccagaagaggctgg

SEQ ID NO: 819592 - DNA, 25 bp, Mus musculus
tcctcggctttcgagaagaggctgg

SEQ ID NO: 819593 - DNA, 25 bp, Mus musculus
tcctcgggaaaaccatccacggtgt

SEQ ID NO: 819594 - DNA, 25 bp, Mus musculus
tcctcgggaaaagcatccacggtgt

SEQ ID NO: 819595 - DNA, 25 bp, Mus musculus
tcctcgggccaaaaaactgatgtta

SEQ ID NO: 819596 - DNA, 25 bp, Mus musculus
tcctcgggccaataaactgatgtta

SEQ ID NO: 819597 - DNA, 25 bp, Mus musculus
tcctcgggctgtatggtttccatca

SEQ ID NO: 819598 - DNA, 25 bp, Mus musculus
tcctcgggctgtttggtttccatca

SEQ ID NO: 819599 - DNA, 25 bp, Mus musculus
tcctcgggttgaaacaactaacctt

SEQ ID NO: 819600 - DNA, 25 bp, Mus musculus
tcctcgggttgatacaactaacctt

SEQ ID NO: 819601 - DNA, 25 bp, Mus musculus
tcctcggtatccagactggctgagg

SEQ ID NO: 819602 - DNA, 25 bp, Mus musculus
tcctcggtatcctgactggctgagg

SEQ ID NO: 819603 - DNA, 25 bp, Mus musculus
tcctcggtcagaatgcagatgccac

SEQ ID NO: 819604 - DNA, 25 bp, Mus musculus
tcctcggtcagattgcagatgccac

SEQ ID NO: 819605 - DNA, 25 bp, Mus musculus
tcctcggtcgagatgagagtctcat

SEQ ID NO: 819606 - DNA, 25 bp, Mus musculus
tcctcggtcgagttgagagtctcat

SEQ ID NO: 819607 - DNA, 25 bp, Mus musculus
tcctcggtgctgaagctcagggacg

SEQ ID NO: 819608 - DNA, 25 bp, Mus musculus
tcctcggtgctgtagctcagggacg

SEQ ID NO: 819609 - DNA, 25 bp, Mus musculus
tcctcggttcatacgtgtccgtaaa

SEQ ID NO: 819610 - DNA, 25 bp, Mus musculus
tcctcggttcattcgtgtccgtaaa

SEQ ID NO: 819611 - DNA, 25 bp, Mus musculus
tcctcgtaagttcatgatagtttga

SEQ ID NO: 819612 - DNA, 25 bp, Mus musculus
tcctcgtaagttgatgatagtttga

SEQ ID NO: 819613 - DNA, 25 bp, Mus musculus
tcctcgtatggtattatgatccttt

SEQ ID NO: 819614 - DNA, 25 bp, Mus musculus
tcctcgtatggttttatgatccttt

SEQ ID NO: 819615 - DNA, 25 bp, Mus musculus
tcctcgtattctcttgcagggacta

SEQ ID NO: 819616 - DNA, 25 bp, Mus musculus
tcctcgtattctgttgcagggacta

SEQ ID NO: 819617 - DNA, 25 bp, Mus musculus
tcctcgtcactaacatgggctaact

SEQ ID NO: 819618 - DNA, 25 bp, Mus musculus
tcctcgtcactatcatgggctaact

SEQ ID NO: 819619 - DNA, 25 bp, Mus musculus
tcctcgtcaggaccacaagagtttg

SEQ ID NO: 819620 - DNA, 25 bp, Mus musculus
tcctcgtcaggagcacaagagtttg

SEQ ID NO: 819621 - DNA, 25 bp, Mus musculus
tcctcgtcattcagcattttatcca

SEQ ID NO: 819622 - DNA, 25 bp, Mus musculus
tcctcgtcattctgcattttatcca

SEQ ID NO: 819623 - DNA, 25 bp, Mus musculus
tcctcgtccttaataccagaatttc

SEQ ID NO: 819624 - DNA, 25 bp, Mus musculus
tcctcgtccttattaccagaatttc

SEQ ID NO: 819625 - DNA, 25 bp, Mus musculus
tcctcgtctgcaacgggctgggcat

SEQ ID NO: 819626 - DNA, 25 bp, Mus musculus
tcctcgtctgcatcgggctgggcat

SEQ ID NO: 819627 - DNA, 25 bp, Mus musculus
tcctcgtcttaacttttcaaccatt

SEQ ID NO: 819628 - DNA, 25 bp, Mus musculus
tcctcgtcttaagttttcaaccatt

SEQ ID NO: 819629 - DNA, 25 bp, Mus musculus
tcctcgtcttccatgatgactgtaa

SEQ ID NO: 819630 - DNA, 25 bp, Mus musculus
tcctcgtcttccttgatgactgtaa

SEQ ID NO: 819631 - DNA, 25 bp, Mus musculus
tcctcgtgtgtacctggtcttgaag

SEQ ID NO: 819632 - DNA, 25 bp, Mus musculus
tcctcgtgtgtagctggtcttgaag

SEQ ID NO: 819633 - DNA, 25 bp, Mus musculus
tcctcgtgttccatggctgtaataa

SEQ ID NO: 819634 - DNA, 25 bp, Mus musculus
tcctcgtgttccttggctgtaataa

SEQ ID NO: 819635 - DNA, 25 bp, Mus musculus
tcctcgttccttattgggctgataa

SEQ ID NO: 819636 - DNA, 25 bp, Mus musculus
tcctcgttcctttttgggctgataa

SEQ ID NO: 819637 - DNA, 25 bp, Mus musculus
tcctcgttgattatggttcatgcat

SEQ ID NO: 819638 - DNA, 25 bp, Mus musculus
tcctcgttgattttggttcatgcat

SEQ ID NO: 819639 - DNA, 25 bp, Mus musculus
tcctcgttgcttaaaaggctgctct

SEQ ID NO: 819640 - DNA, 25 bp, Mus musculus
tcctcgttgctttaaaggctgctct

SEQ ID NO: 819641 - DNA, 25 bp, Mus musculus
tcctcgttggacactgcatctgcag

SEQ ID NO: 819642 - DNA, 25 bp, Mus musculus
tcctcgttggactctgcatctgcag

SEQ ID NO: 819643 - DNA, 25 bp, Mus musculus
tcctcgttggctcgctgagcattct

SEQ ID NO: 819644 - DNA, 25 bp, Mus musculus
tcctcgttggctggctgagcattct

SEQ ID NO: 819645 - DNA, 25 bp, Mus musculus
tcctctaaaagaatagctcttgctt

SEQ ID NO: 819646 - DNA, 25 bp, Mus musculus
tcctctaaaagattagctcttgctt

SEQ ID NO: 819647 - DNA, 25 bp, Mus musculus
tcctctaaaggaagcgccatggact

SEQ ID NO: 819648 - DNA, 25 bp, Mus musculus
tcctctaaaggatgcgccatggact

SEQ ID NO: 819649 - DNA, 25 bp, Mus musculus
tcctctaacacccatggcgatgaag

SEQ ID NO: 819650 - DNA, 25 bp, Mus musculus
tcctctaacaccgatggcgatgaag

SEQ ID NO: 819651 - DNA, 25 bp, Mus musculus
tcctctaagacactgcctttagcca

SEQ ID NO: 819652 - DNA, 25 bp, Mus musculus
tcctctaagacagtgcctttagcca

SEQ ID NO: 819653 - DNA, 25 bp, Mus musculus
tcctctaatccccttaacagtggtt

SEQ ID NO: 819654 - DNA, 25 bp, Mus musculus
tcctctaatcccgttaacagtggtt

SEQ ID NO: 819655 - DNA, 25 bp, Mus musculus
tcctctaattttcggttttcgtctg

SEQ ID NO: 819656 - DNA, 25 bp, Mus musculus
tcctctaattttgggttttcgtctg

SEQ ID NO: 819657 - DNA, 25 bp, Mus musculus
tcctctacaccaacgagaatccaga

SEQ ID NO: 819658 - DNA, 25 bp, Mus musculus
tcctctacaccatcgagaatccaga

SEQ ID NO: 819659 - DNA, 25 bp, Mus musculus
tcctctaccaggcagttccgggaga

SEQ ID NO: 819660 - DNA, 25 bp, Mus musculus
tcctctaccagggagttccgggaga

SEQ ID NO: 819661 - DNA, 25 bp, Mus musculus
tcctctacctgcaagctgtcaggag

SEQ ID NO: 819662 - DNA, 25 bp, Mus musculus
tcctctacctgctagctgtcaggag

SEQ ID NO: 819663 - DNA, 25 bp, Mus musculus
tcctctacctggatgggtggagcaa

SEQ ID NO: 819664 - DNA, 25 bp, Mus musculus
tcctctacctggttgggtggagcaa

SEQ ID NO: 819665 - DNA, 25 bp, Mus musculus
tcctctacgttcaggctttacatga

SEQ ID NO: 819666 - DNA, 25 bp, Mus musculus
tcctctacgttctggctttacatga

SEQ ID NO: 819667 - DNA, 25 bp, Mus musculus
tcctctactagcaaggactccaggg

SEQ ID NO: 819668 - DNA, 25 bp, Mus musculus
tcctctactagctaggactccaggg

SEQ ID NO: 819669 - DNA, 25 bp, Mus musculus
tcctctactgcccatgtgaaaaaat

SEQ ID NO: 819670 - DNA, 25 bp, Mus musculus
tcctctactgccgatgtgaaaaaat

SEQ ID NO: 819671 - DNA, 25 bp, Mus musculus
tcctctagaaatccccagaagctcg

SEQ ID NO: 819672 - DNA, 25 bp, Mus musculus
tcctctagaaatgcccagaagctcg

SEQ ID NO: 819673 - DNA, 25 bp, Mus musculus
tcctctagaagaccgctaactgcaa

SEQ ID NO: 819674 - DNA, 25 bp, Mus musculus
tcctctagaagagcgctaactgcaa

SEQ ID NO: 819675 - DNA, 25 bp, Mus musculus
tcctctagacatctgggtccatgaa

SEQ ID NO: 819676 - DNA, 25 bp, Mus musculus
tcctctagacatgtgggtccatgaa

SEQ ID NO: 819677 - DNA, 25 bp, Mus musculus
tcctctagtactctaaactcctgaa

SEQ ID NO: 819678 - DNA, 25 bp, Mus musculus
tcctctagtactgtaaactcctgaa

SEQ ID NO: 819679 - DNA, 25 bp, Mus musculus
tcctctagtagtcaatttatcacca

SEQ ID NO: 819680 - DNA, 25 bp, Mus musculus
tcctctagtagtgaatttatcacca

SEQ ID NO: 819681 - DNA, 25 bp, Mus musculus
tcctctatcccgatggtcaagttta

SEQ ID NO: 819682 - DNA, 25 bp, Mus musculus
tcctctatcccgttggtcaagttta

SEQ ID NO: 819683 - DNA, 25 bp, Mus musculus
tcctctatgaatcacgagaccagta

SEQ ID NO: 819684 - DNA, 25 bp, Mus musculus
tcctctatgaatgacgagaccagta

SEQ ID NO: 819685 - DNA, 25 bp, Mus musculus
tcctctatggatcaagcaaacactg

SEQ ID NO: 819686 - DNA, 25 bp, Mus musculus
tcctctatggatgaagcaaacactg

SEQ ID NO: 819687 - DNA, 25 bp, Mus musculus
tcctctatggccatactgtcactgt

SEQ ID NO: 819688 - DNA, 25 bp, Mus musculus
tcctctatggccttactgtcactgt

SEQ ID NO: 819689 - DNA, 25 bp, Mus musculus
tcctctatgggtatagtgtgtttct

SEQ ID NO: 819690 - DNA, 25 bp, Mus musculus
tcctctatgggtttagtgtgtttct

SEQ ID NO: 819691 - DNA, 25 bp, Mus musculus
tcctctatggttatgcatgtgcact

SEQ ID NO: 819692 - DNA, 25 bp, Mus musculus
tcctctatggttttgcatgtgcact

SEQ ID NO: 819693 - DNA, 25 bp, Mus musculus
tcctctattccacgaagtctggcgg

SEQ ID NO: 819694 - DNA, 25 bp, Mus musculus
tcctctattccaggaagtctggcgg

SEQ ID NO: 819695 - DNA, 25 bp, Mus musculus
tcctctatttctcccattaaagctg

SEQ ID NO: 819696 - DNA, 25 bp, Mus musculus
tcctctatttctgccattaaagctg

SEQ ID NO: 819697 - DNA, 25 bp, Mus musculus
tcctctcaaaggactaaaagctgta

SEQ ID NO: 819698 - DNA, 25 bp, Mus musculus
tcctctcaaaggtctaaaagctgta

SEQ ID NO: 819699 - DNA, 25 bp, Mus musculus
tcctctcaaataatcagccttctac

SEQ ID NO: 819700 - DNA, 25 bp, Mus musculus
tcctctcaaatattcagccttctac

SEQ ID NO: 819701 - DNA, 25 bp, Mus musculus
tcctctcaacagaggcgtctagaag

SEQ ID NO: 819702 - DNA, 25 bp, Mus musculus
tcctctcaacagtggcgtctagaag

SEQ ID NO: 819703 - DNA, 25 bp, Mus musculus
tcctctcaacgccatttatgccaag

SEQ ID NO: 819704 - DNA, 25 bp, Mus musculus
tcctctcaacgcgatttatgccaag

SEQ ID NO: 819705 - DNA, 25 bp, Mus musculus
tcctctcaatggctgtgtacacacc

SEQ ID NO: 819706 - DNA, 25 bp, Mus musculus
tcctctcaatgggtgtgtacacacc

SEQ ID NO: 819707 - DNA, 25 bp, Mus musculus
tcctctcaattcacacatactctag

SEQ ID NO: 819708 - DNA, 25 bp, Mus musculus
tcctctcaattctcacatactctag

SEQ ID NO: 819709 - DNA, 25 bp, Mus musculus
tcctctcacagaatgttgctgctgc

SEQ ID NO: 819710 - DNA, 25 bp, Mus musculus
tcctctcacagattgttgctgctgc

SEQ ID NO: 819711 - DNA, 25 bp, Mus musculus
tcctctcacgctatcgtgttatgaa

SEQ ID NO: 819712 - DNA, 25 bp, Mus musculus
tcctctcacgctttcgtgttatgaa

SEQ ID NO: 819713 - DNA, 25 bp, Mus musculus
tcctctcactctcactagaatcttt

SEQ ID NO: 819714 - DNA, 25 bp, Mus musculus
tcctctcactctgactagaatcttt

SEQ ID NO: 819715 - DNA, 25 bp, Mus musculus
tcctctcagaatacaccggttctaa

SEQ ID NO: 819716 - DNA, 25 bp, Mus musculus
tcctctcagaattcaccggttctaa

SEQ ID NO: 819717 - DNA, 25 bp, Mus musculus
tcctctcagtctagcttctgagcag

SEQ ID NO: 819718 - DNA, 25 bp, Mus musculus
tcctctcagtcttgcttctgagcag

SEQ ID NO: 819719 - DNA, 25 bp, Mus musculus
tcctctcagtggctttagtggacaa

SEQ ID NO: 819720 - DNA, 25 bp, Mus musculus
tcctctcagtgggtttagtggacaa

SEQ ID NO: 819721 - DNA, 25 bp, Mus musculus
tcctctcataagaacccaatgtatt

SEQ ID NO: 819722 - DNA, 25 bp, Mus musculus
tcctctcataagtacccaatgtatt

SEQ ID NO: 819723 - DNA, 25 bp, Mus musculus
tcctctcatgagaagacagacctga

SEQ ID NO: 819724 - DNA, 25 bp, Mus musculus
tcctctcatgagtagacagacctga

SEQ ID NO: 819725 - DNA, 25 bp, Mus musculus
tcctctcattttcaaggtatgtgtc

SEQ ID NO: 819726 - DNA, 25 bp, Mus musculus
tcctctcattttgaaggtatgtgtc

SEQ ID NO: 819727 - DNA, 25 bp, Mus musculus
tcctctccaagccaatctttgcaaa

SEQ ID NO: 819728 - DNA, 25 bp, Mus musculus
tcctctccaagcgaatctttgcaaa

SEQ ID NO: 819729 - DNA, 25 bp, Mus musculus
tcctctccaagtctctctggatggg

SEQ ID NO: 819730 - DNA, 25 bp, Mus musculus
tcctctccaagtgtctctggatggg

SEQ ID NO: 819731 - DNA, 25 bp, Mus musculus
tcctctccactcagtactgatggtt

SEQ ID NO: 819732 - DNA, 25 bp, Mus musculus
tcctctccactctgtactgatggtt

SEQ ID NO: 819733 - DNA, 25 bp, Mus musculus
tcctctccataacgtactctgttga

SEQ ID NO: 819734 - DNA, 25 bp, Mus musculus
tcctctccataaggtactctgttga

SEQ ID NO: 819735 - DNA, 25 bp, Mus musculus
tcctctccatcaagtacaattctac

SEQ ID NO: 819736 - DNA, 25 bp, Mus musculus
tcctctccatcatgtacaattctac

SEQ ID NO: 819737 - DNA, 25 bp, Mus musculus
tcctctcccctaattcaggaattta

SEQ ID NO: 819738 - DNA, 25 bp, Mus musculus
tcctctcccctatttcaggaattta

SEQ ID NO: 819739 - DNA, 25 bp, Mus musculus
tcctctcccgaaataacctggtaga

SEQ ID NO: 819740 - DNA, 25 bp, Mus musculus
tcctctcccgaattaacctggtaga

SEQ ID NO: 819741 - DNA, 25 bp, Mus musculus
tcctctccctgtcaggttttcgcaa

SEQ ID NO: 819742 - DNA, 25 bp, Mus musculus
tcctctccctgtgaggttttcgcaa

SEQ ID NO: 819743 - DNA, 25 bp, Mus musculus
tcctctccgtgtatttaactctccg

SEQ ID NO: 819744 - DNA, 25 bp, Mus musculus
tcctctccgtgtttttaactctccg

SEQ ID NO: 819745 - DNA, 25 bp, Mus musculus
tcctctcctcacatgcagtggttaa

SEQ ID NO: 819746 - DNA, 25 bp, Mus musculus
tcctctcctcacttgcagtggttaa

SEQ ID NO: 819747 - DNA, 25 bp, Mus musculus
tcctctcctcataggaacttagtgt

SEQ ID NO: 819748 - DNA, 25 bp, Mus musculus
tcctctcctcattggaacttagtgt

SEQ ID NO: 819749 - DNA, 25 bp, Mus musculus
tcctctcctccaaagatgactaaac

SEQ ID NO: 819750 - DNA, 25 bp, Mus musculus
tcctctcctccatagatgactaaac

SEQ ID NO: 819751 - DNA, 25 bp, Mus musculus
tcctctcctcgtagccaagatattg

SEQ ID NO: 819752 - DNA, 25 bp, Mus musculus
tcctctcctcgttgccaagatattg

SEQ ID NO: 819753 - DNA, 25 bp, Mus musculus
tcctctcctggtctagttcaaatgc

SEQ ID NO: 819754 - DNA, 25 bp, Mus musculus
tcctctcctggtgtagttcaaatgc

SEQ ID NO: 819755 - DNA, 25 bp, Mus musculus
tcctctcgaaccatgtgtagaattc

SEQ ID NO: 819756 - DNA, 25 bp, Mus musculus
tcctctcgaaccttgtgtagaattc

SEQ ID NO: 819757 - DNA, 25 bp, Mus musculus
tcctctcgacctatcttgacagaac

SEQ ID NO: 819758 - DNA, 25 bp, Mus musculus
tcctctcgacctttcttgacagaac

SEQ ID NO: 819759 - DNA, 25 bp, Mus musculus
tcctctcgcacaaggaaggtatcag

SEQ ID NO: 819760 - DNA, 25 bp, Mus musculus
tcctctcgcacatggaaggtatcag

SEQ ID NO: 819761 - DNA, 25 bp, Mus musculus
tcctctcgggatcactaaactactt

SEQ ID NO: 819762 - DNA, 25 bp, Mus musculus
tcctctcgggatgactaaactactt

SEQ ID NO: 819763 - DNA, 25 bp, Mus musculus
tcctctcgggcaatttggtgctcat

SEQ ID NO: 819764 - DNA, 25 bp, Mus musculus
tcctctcgggcattttggtgctcat

SEQ ID NO: 819765 - DNA, 25 bp, Mus musculus
tcctctcgtaataacaactccttgc

SEQ ID NO: 819766 - DNA, 25 bp, Mus musculus
tcctctcgtaattacaactccttgc

SEQ ID NO: 819767 - DNA, 25 bp, Mus musculus
tcctctctaaatcgacatcctcgtt

SEQ ID NO: 819768 - DNA, 25 bp, Mus musculus
tcctctctaaatggacatcctcgtt

SEQ ID NO: 819769 - DNA, 25 bp, Mus musculus
tcctctctacacagtcgtagattgc

SEQ ID NO: 819770 - DNA, 25 bp, Mus musculus
tcctctctacactgtcgtagattgc

SEQ ID NO: 819771 - DNA, 25 bp, Mus musculus
tcctctctaccactatttcttcttt

SEQ ID NO: 819772 - DNA, 25 bp, Mus musculus
tcctctctaccagtatttcttcttt

SEQ ID NO: 819773 - DNA, 25 bp, Mus musculus
tcctctctagcaaaagactttggct

SEQ ID NO: 819774 - DNA, 25 bp, Mus musculus
tcctctctagcataagactttggct

SEQ ID NO: 819775 - DNA, 25 bp, Mus musculus
tcctctctcaggcaatcagatggca

SEQ ID NO: 819776 - DNA, 25 bp, Mus musculus
tcctctctcagggaatcagatggca

SEQ ID NO: 819777 - DNA, 25 bp, Mus musculus
tcctctctccagacagacaatacat

SEQ ID NO: 819778 - DNA, 25 bp, Mus musculus
tcctctctccagtcagacaatacat

SEQ ID NO: 819779 - DNA, 25 bp, Mus musculus
tcctctctccctatgaaatctactt

SEQ ID NO: 819780 - DNA, 25 bp, Mus musculus
tcctctctccctttgaaatctactt

SEQ ID NO: 819781 - DNA, 25 bp, Mus musculus
tcctctctctctccatttgtgtatt

SEQ ID NO: 819782 - DNA, 25 bp, Mus musculus
tcctctctctctgcatttgtgtatt

SEQ ID NO: 819783 - DNA, 25 bp, Mus musculus
tcctctctcttcactatgtggatag

SEQ ID NO: 819784 - DNA, 25 bp, Mus musculus
tcctctctcttctctatgtggatag

SEQ ID NO: 819785 - DNA, 25 bp, Mus musculus
tcctctctgcagaaaaggtgcctct

SEQ ID NO: 819786 - DNA, 25 bp, Mus musculus
tcctctctgcagtaaaggtgcctct

SEQ ID NO: 819787 - DNA, 25 bp, Mus musculus
tcctctctgcatatccctggttctg

SEQ ID NO: 819788 - DNA, 25 bp, Mus musculus
tcctctctgcatcgaagtgccgggc

SEQ ID NO: 819789 - DNA, 25 bp, Mus musculus
tcctctctgcatggaagtgccgggc

SEQ ID NO: 819790 - DNA, 25 bp, Mus musculus
tcctctctgcatttccctggttctg

SEQ ID NO: 819791 - DNA, 25 bp, Mus musculus
tcctctctgcttatactaaacttgc

SEQ ID NO: 819792 - DNA, 25 bp, Mus musculus
tcctctctgcttttactaaacttgc

SEQ ID NO: 819793 - DNA, 25 bp, Mus musculus
tcctctctggacaaggtctctgtat

SEQ ID NO: 819794 - DNA, 25 bp, Mus musculus
tcctctctggactaggtctctgtat

SEQ ID NO: 819795 - DNA, 25 bp, Mus musculus
tcctctctggagcaaagcagaccat

SEQ ID NO: 819796 - DNA, 25 bp, Mus musculus
tcctctctggaggaaagcagaccat

SEQ ID NO: 819797 - DNA, 25 bp, Mus musculus
tcctctctgggaagtcatctgcagg

SEQ ID NO: 819798 - DNA, 25 bp, Mus musculus
tcctctctgggatgtcatctgcagg

SEQ ID NO: 819799 - DNA, 25 bp, Mus musculus
tcctctcttaacctactgatcacag

SEQ ID NO: 819800 - DNA, 25 bp, Mus musculus
tcctctcttaacgtactgatcacag

SEQ ID NO: 819801 - DNA, 25 bp, Mus musculus
tcctctcttatcatccgagcaataa

SEQ ID NO: 819802 - DNA, 25 bp, Mus musculus
tcctctcttatcttccgagcaataa

SEQ ID NO: 819803 - DNA, 25 bp, Mus musculus
tcctctcttcacatatactggtgtg

SEQ ID NO: 819804 - DNA, 25 bp, Mus musculus
tcctctcttcacttatactggtgtg

SEQ ID NO: 819805 - DNA, 25 bp, Mus musculus
tcctctcttcttaactcctattatt

SEQ ID NO: 819806 - DNA, 25 bp, Mus musculus
tcctctcttcttcggagacttggaa

SEQ ID NO: 819807 - DNA, 25 bp, Mus musculus
tcctctcttcttgggagacttggaa

SEQ ID NO: 819808 - DNA, 25 bp, Mus musculus
tcctctcttctttactcctattatt

SEQ ID NO: 819809 - DNA, 25 bp, Mus musculus
tcctctctttacaaatgatcaaggt

SEQ ID NO: 819810 - DNA, 25 bp, Mus musculus
tcctctctttactaatgatcaaggt

SEQ ID NO: 819811 - DNA, 25 bp, Mus musculus
tcctctctttttaggtgatcgtttc

SEQ ID NO: 819812 - DNA, 25 bp, Mus musculus
tcctctcttttttggtgatcgtttc

SEQ ID NO: 819813 - DNA, 25 bp, Mus musculus
tcctctgaaatacggattctgtggt

SEQ ID NO: 819814 - DNA, 25 bp, Mus musculus
tcctctgaaatagggattctgtggt

SEQ ID NO: 819815 - DNA, 25 bp, Mus musculus
tcctctgaacggcagggctgagaac

SEQ ID NO: 819816 - DNA, 25 bp, Mus musculus
tcctctgaacgggagggctgagaac

SEQ ID NO: 819817 - DNA, 25 bp, Mus musculus
tcctctgaagatccagccagagctc

SEQ ID NO: 819818 - DNA, 25 bp, Mus musculus
tcctctgaagatgcagccagagctc

SEQ ID NO: 819819 - DNA, 25 bp, Mus musculus
tcctctgaagcacccactctgtccc

SEQ ID NO: 819820 - DNA, 25 bp, Mus musculus
tcctctgaagcagccactctgtccc

SEQ ID NO: 819821 - DNA, 25 bp, Mus musculus
tcctctgaattgatctttgcactga

SEQ ID NO: 819822 - DNA, 25 bp, Mus musculus
tcctctgaattgttctttgcactga

SEQ ID NO: 819823 - DNA, 25 bp, Mus musculus
tcctctgacagtcactatgacctgc

SEQ ID NO: 819824 - DNA, 25 bp, Mus musculus
tcctctgacagtgactatgacctgc

SEQ ID NO: 819825 - DNA, 25 bp, Mus musculus
tcctctgacccaccatagatgactg

SEQ ID NO: 819826 - DNA, 25 bp, Mus musculus
tcctctgacccagcatagatgactg

SEQ ID NO: 819827 - DNA, 25 bp, Mus musculus
tcctctgaccgaagcttgtgaattg

SEQ ID NO: 819828 - DNA, 25 bp, Mus musculus
tcctctgaccgatgcttgtgaattg

SEQ ID NO: 819829 - DNA, 25 bp, Mus musculus
tcctctgacgttctccctaagggaa

SEQ ID NO: 819830 - DNA, 25 bp, Mus musculus
tcctctgacgttgtccctaagggaa

SEQ ID NO: 819831 - DNA, 25 bp, Mus musculus
tcctctgactctcaggcggtgattc

SEQ ID NO: 819832 - DNA, 25 bp, Mus musculus
tcctctgactctgaggcggtgattc

SEQ ID NO: 819833 - DNA, 25 bp, Mus musculus
tcctctgagcaccacgagtatactg

SEQ ID NO: 819834 - DNA, 25 bp, Mus musculus
tcctctgagcacgacgagtatactg

SEQ ID NO: 819835 - DNA, 25 bp, Mus musculus
tcctctgagggaaataagctatttt

SEQ ID NO: 819836 - DNA, 25 bp, Mus musculus
tcctctgagggatataagctatttt

SEQ ID NO: 819837 - DNA, 25 bp, Mus musculus
tcctctgatacaagcggctggagcc

SEQ ID NO: 819838 - DNA, 25 bp, Mus musculus
tcctctgatacatgcggctggagcc

SEQ ID NO: 819839 - DNA, 25 bp, Mus musculus
tcctctgcaagtctgagcgtgcaag

SEQ ID NO: 819840 - DNA, 25 bp, Mus musculus
tcctctgcaagtgtgagcgtgcaag

SEQ ID NO: 819841 - DNA, 25 bp, Mus musculus
tcctctgcaggcataagttattatg

SEQ ID NO: 819842 - DNA, 25 bp, Mus musculus
tcctctgcaggcttaagttattatg

SEQ ID NO: 819843 - DNA, 25 bp, Mus musculus
tcctctgcagggacagtggttcaga

SEQ ID NO: 819844 - DNA, 25 bp, Mus musculus
tcctctgcagggtcagtggttcaga

SEQ ID NO: 819845 - DNA, 25 bp, Mus musculus
tcctctgcaggtcgtggtacttgat

SEQ ID NO: 819846 - DNA, 25 bp, Mus musculus
tcctctgcaggtggtggtacttgat

SEQ ID NO: 819847 - DNA, 25 bp, Mus musculus
tcctctgccaatctgctgggaagac

SEQ ID NO: 819848 - DNA, 25 bp, Mus musculus
tcctctgccaatgtgctgggaagac

SEQ ID NO: 819849 - DNA, 25 bp, Mus musculus
tcctctgccataaaactggagtgct

SEQ ID NO: 819850 - DNA, 25 bp, Mus musculus
tcctctgccatataactggagtgct

SEQ ID NO: 819851 - DNA, 25 bp, Mus musculus
tcctctgccatcactgtcaaagata

SEQ ID NO: 819852 - DNA, 25 bp, Mus musculus
tcctctgccatctctgtcaaagata

SEQ ID NO: 819853 - DNA, 25 bp, Mus musculus
tcctctgcccctaagaaggacggga

SEQ ID NO: 819854 - DNA, 25 bp, Mus musculus
tcctctgccccttagaaggacggga

SEQ ID NO: 819855 - DNA, 25 bp, Mus musculus
tcctctgccggtagagtggtagcaa

SEQ ID NO: 819856 - DNA, 25 bp, Mus musculus
tcctctgccggttgagtggtagcaa

SEQ ID NO: 819857 - DNA, 25 bp, Mus musculus
tcctctgcctatattaaaacccaca

SEQ ID NO: 819858 - DNA, 25 bp, Mus musculus
tcctctgcctattttaaaacccaca

SEQ ID NO: 819859 - DNA, 25 bp, Mus musculus
tcctctgccttacatcatggtgcta

SEQ ID NO: 819860 - DNA, 25 bp, Mus musculus
tcctctgccttagatcatggtgcta

SEQ ID NO: 819861 - DNA, 25 bp, Mus musculus
tcctctgctaggcaaagctgcccaa

SEQ ID NO: 819862 - DNA, 25 bp, Mus musculus
tcctctgctagggaaagctgcccaa

SEQ ID NO: 819863 - DNA, 25 bp, Mus musculus
tcctctgctataataaaatccccaa

SEQ ID NO: 819864 - DNA, 25 bp, Mus musculus
tcctctgctatattaaaatccccaa

SEQ ID NO: 819865 - DNA, 25 bp, Mus musculus
tcctctgctcaaaaacctacaacgg

SEQ ID NO: 819866 - DNA, 25 bp, Mus musculus
tcctctgctcaaaactgttcgtcct

SEQ ID NO: 819867 - DNA, 25 bp, Mus musculus
tcctctgctcaacatcagcattttt

SEQ ID NO: 819868 - DNA, 25 bp, Mus musculus
tcctctgctcaaccaagtgcctgat

SEQ ID NO: 819869 - DNA, 25 bp, Mus musculus
tcctctgctcaagatcagcattttt

SEQ ID NO: 819870 - DNA, 25 bp, Mus musculus
tcctctgctcaagcaagtgcctgat

SEQ ID NO: 819871 - DNA, 25 bp, Mus musculus
tcctctgctcaataacctacaacgg

SEQ ID NO: 819872 - DNA, 25 bp, Mus musculus
tcctctgctcaatactgttcgtcct

SEQ ID NO: 819873 - DNA, 25 bp, Mus musculus
tcctctgctgagcataagtaccatg

SEQ ID NO: 819874 - DNA, 25 bp, Mus musculus
tcctctgctgaggataagtaccatg

SEQ ID NO: 819875 - DNA, 25 bp, Mus musculus
tcctctgctggcaaagagtcaccta

SEQ ID NO: 819876 - DNA, 25 bp, Mus musculus
tcctctgctggctaagagtcaccta

SEQ ID NO: 819877 - DNA, 25 bp, Mus musculus
tcctctgctgttcagtgctgtctag

SEQ ID NO: 819878 - DNA, 25 bp, Mus musculus
tcctctgctgttgagtgctgtctag

SEQ ID NO: 819879 - DNA, 25 bp, Mus musculus
tcctctggagaaccgtgaagtatac

SEQ ID NO: 819880 - DNA, 25 bp, Mus musculus
tcctctggagaagcgtgaagtatac

SEQ ID NO: 819881 - DNA, 25 bp, Mus musculus
tcctctggagatatcgctacatttc

SEQ ID NO: 819882 - DNA, 25 bp, Mus musculus
tcctctggagatttcgctacatttc

SEQ ID NO: 819883 - DNA, 25 bp, Mus musculus
tcctctggagctcatagtgactctt

SEQ ID NO: 819884 - DNA, 25 bp, Mus musculus
tcctctggagctcgtgtaagacagg

SEQ ID NO: 819885 - DNA, 25 bp, Mus musculus
tcctctggagctgatagtgactctt

SEQ ID NO: 819886 - DNA, 25 bp, Mus musculus
tcctctggagctggtgtaagacagg

SEQ ID NO: 819887 - DNA, 25 bp, Mus musculus
tcctctggatcgacatctccaatag

SEQ ID NO: 819888 - DNA, 25 bp, Mus musculus
tcctctggatcgtcatctccaatag

SEQ ID NO: 819889 - DNA, 25 bp, Mus musculus
tcctctggcacaacttctgatgaag

SEQ ID NO: 819890 - DNA, 25 bp, Mus musculus
tcctctggcacatcttctgatgaag

SEQ ID NO: 819891 - DNA, 25 bp, Mus musculus
tcctctggcaccaaccgatgtgtgg

SEQ ID NO: 819892 - DNA, 25 bp, Mus musculus
tcctctggcacctaccgatgtgtgg

SEQ ID NO: 819893 - DNA, 25 bp, Mus musculus
tcctctggcattatcttaggtaaaa

SEQ ID NO: 819894 - DNA, 25 bp, Mus musculus
tcctctggcattttcttaggtaaaa

SEQ ID NO: 819895 - DNA, 25 bp, Mus musculus
tcctctggccaaccttaggaggaat

SEQ ID NO: 819896 - DNA, 25 bp, Mus musculus
tcctctggccaagcttaggaggaat

SEQ ID NO: 819897 - DNA, 25 bp, Mus musculus
tcctctggccttaagtaatttacat

SEQ ID NO: 819898 - DNA, 25 bp, Mus musculus
tcctctggcctttagtaatttacat

SEQ ID NO: 819899 - DNA, 25 bp, Mus musculus
tcctctggcggcagtactatgacta

SEQ ID NO: 819900 - DNA, 25 bp, Mus musculus
tcctctggcggctgtactatgacta

SEQ ID NO: 819901 - DNA, 25 bp, Mus musculus
tcctctggctggcagtgctgatgta

SEQ ID NO: 819902 - DNA, 25 bp, Mus musculus
tcctctggctgggagtgctgatgta

SEQ ID NO: 819903 - DNA, 25 bp, Mus musculus
tcctctggcttgaagttctccagaa

SEQ ID NO: 819904 - DNA, 25 bp, Mus musculus
tcctctggcttgaggctcccatggg

SEQ ID NO: 819905 - DNA, 25 bp, Mus musculus
tcctctggcttgtagttctccagaa

SEQ ID NO: 819906 - DNA, 25 bp, Mus musculus
tcctctggcttgtggctcccatggg

SEQ ID NO: 819907 - DNA, 25 bp, Mus musculus
tcctctggctttatcaggcattcag

SEQ ID NO: 819908 - DNA, 25 bp, Mus musculus
tcctctggctttttcaggcattcag

SEQ ID NO: 819909 - DNA, 25 bp, Mus musculus
tcctctgggaaaagcctcttaactg

SEQ ID NO: 819910 - DNA, 25 bp, Mus musculus
tcctctgggaaatgcctcttaactg

SEQ ID NO: 819911 - DNA, 25 bp, Mus musculus
tcctctgggagaccggccaatgctg

SEQ ID NO: 819912 - DNA, 25 bp, Mus musculus
tcctctgggagagcggccaatgctg

SEQ ID NO: 819913 - DNA, 25 bp, Mus musculus
tcctctgggcacacacggagcgcgg

SEQ ID NO: 819914 - DNA, 25 bp, Mus musculus
tcctctgggcactcacggagcgcgg

SEQ ID NO: 819915 - DNA, 25 bp, Mus musculus
tcctctgggcagaattatcctcagc

SEQ ID NO: 819916 - DNA, 25 bp, Mus musculus
tcctctgggcagcactatctagata

SEQ ID NO: 819917 - DNA, 25 bp, Mus musculus
tcctctgggcaggactatctagata

SEQ ID NO: 819918 - DNA, 25 bp, Mus musculus
tcctctgggcagtattatcctcagc

SEQ ID NO: 819919 - DNA, 25 bp, Mus musculus
tcctctgggtctctctccgaagaaa

SEQ ID NO: 819920 - DNA, 25 bp, Mus musculus
tcctctgggtctgtctccgaagaaa

SEQ ID NO: 819921 - DNA, 25 bp, Mus musculus
tcctctgggttcatataggatgttt

SEQ ID NO: 819922 - DNA, 25 bp, Mus musculus
tcctctgggttcttataggatgttt

SEQ ID NO: 819923 - DNA, 25 bp, Mus musculus
tcctctggtcaactcgtcggtagaa

SEQ ID NO: 819924 - DNA, 25 bp, Mus musculus
tcctctggtcaagtcgtcggtagaa

SEQ ID NO: 819925 - DNA, 25 bp, Mus musculus
tcctctggtgccacttttactagaa

SEQ ID NO: 819926 - DNA, 25 bp, Mus musculus
tcctctggtgcctcttttactagaa

SEQ ID NO: 819927 - DNA, 25 bp, Mus musculus
tcctctggtggtcacttgtgttagt

SEQ ID NO: 819928 - DNA, 25 bp, Mus musculus
tcctctggtggtgacttgtgttagt

SEQ ID NO: 819929 - DNA, 25 bp, Mus musculus
tcctctggtgtaactgtgagactaa

SEQ ID NO: 819930 - DNA, 25 bp, Mus musculus
tcctctggtgtaacttccttattag

SEQ ID NO: 819931 - DNA, 25 bp, Mus musculus
tcctctggtgtatctgtgagactaa

SEQ ID NO: 819932 - DNA, 25 bp, Mus musculus
tcctctggtgtatcttccttattag

SEQ ID NO: 819933 - DNA, 25 bp, Mus musculus
tcctctggttcaattagctgtttgg

SEQ ID NO: 819934 - DNA, 25 bp, Mus musculus
tcctctggttcatttagctgtttgg

SEQ ID NO: 819935 - DNA, 25 bp, Mus musculus
tcctctgtactgctgatccgaatga

SEQ ID NO: 819936 - DNA, 25 bp, Mus musculus
tcctctgtactggtgatccgaatga

SEQ ID NO: 819937 - DNA, 25 bp, Mus musculus
tcctctgtagcaccagttgattcta

SEQ ID NO: 819938 - DNA, 25 bp, Mus musculus
tcctctgtagcagcagttgattcta

SEQ ID NO: 819939 - DNA, 25 bp, Mus musculus
tcctctgtagctctgaatgcagcag

SEQ ID NO: 819940 - DNA, 25 bp, Mus musculus
tcctctgtagctgtgaatgcagcag

SEQ ID NO: 819941 - DNA, 25 bp, Mus musculus
tcctctgtaggcagttcactgttag

SEQ ID NO: 819942 - DNA, 25 bp, Mus musculus
tcctctgtaggctgttcactgttag

SEQ ID NO: 819943 - DNA, 25 bp, Mus musculus
tcctctgtagtaactccacatgatg

SEQ ID NO: 819944 - DNA, 25 bp, Mus musculus
tcctctgtagtatctccacatgatg

SEQ ID NO: 819945 - DNA, 25 bp, Mus musculus
tcctctgtctctatatgatttgatt

SEQ ID NO: 819946 - DNA, 25 bp, Mus musculus
tcctctgtctctttatgatttgatt

SEQ ID NO: 819947 - DNA, 25 bp, Mus musculus
tcctctgtctgcctttcttagtaaa

SEQ ID NO: 819948 - DNA, 25 bp, Mus musculus
tcctctgtctgcgtttcttagtaaa

SEQ ID NO: 819949 - DNA, 25 bp, Mus musculus
tcctctgtgagtcggtgtttagcta

SEQ ID NO: 819950 - DNA, 25 bp, Mus musculus
tcctctgtgagtgggtgtttagcta

SEQ ID NO: 819951 - DNA, 25 bp, Mus musculus
tcctctgtgctaacattgtcttggt

SEQ ID NO: 819952 - DNA, 25 bp, Mus musculus
tcctctgtgctatcattgtcttggt

SEQ ID NO: 819953 - DNA, 25 bp, Mus musculus
tcctctgtgctcagtgcatttgcct

SEQ ID NO: 819954 - DNA, 25 bp, Mus musculus
tcctctgtgctctgtgcatttgcct

SEQ ID NO: 819955 - DNA, 25 bp, Mus musculus
tcctctgtggagactgggccatata

SEQ ID NO: 819956 - DNA, 25 bp, Mus musculus
tcctctgtggagtctgggccatata

SEQ ID NO: 819957 - DNA, 25 bp, Mus musculus
tcctctgtgtagacactgttgttgg

SEQ ID NO: 819958 - DNA, 25 bp, Mus musculus
tcctctgtgtagcttctgggctaga

SEQ ID NO: 819959 - DNA, 25 bp, Mus musculus
tcctctgtgtaggttctgggctaga

SEQ ID NO: 819960 - DNA, 25 bp, Mus musculus
tcctctgtgtagtcactgttgttgg

SEQ ID NO: 819961 - DNA, 25 bp, Mus musculus
tcctctgtgttgactgggcttttac

SEQ ID NO: 819962 - DNA, 25 bp, Mus musculus
tcctctgtgttgtctgggcttttac

SEQ ID NO: 819963 - DNA, 25 bp, Mus musculus
tcctctgttacacgctaggctcaca

SEQ ID NO: 819964 - DNA, 25 bp, Mus musculus
tcctctgttacaggctaggctcaca

SEQ ID NO: 819965 - DNA, 25 bp, Mus musculus
tcctctgttatgaattctctgttta

SEQ ID NO: 819966 - DNA, 25 bp, Mus musculus
tcctctgttatgacctattccaaag

SEQ ID NO: 819967 - DNA, 25 bp, Mus musculus
tcctctgttatgtattctctgttta

SEQ ID NO: 819968 - DNA, 25 bp, Mus musculus
tcctctgttatgtcctattccaaag

SEQ ID NO: 819969 - DNA, 25 bp, Mus musculus
tcctctgttcccagatgacctgcat

SEQ ID NO: 819970 - DNA, 25 bp, Mus musculus
tcctctgttccctgatgacctgcat

SEQ ID NO: 819971 - DNA, 25 bp, Mus musculus
tcctctgttgcaaatagtgtgcttg

SEQ ID NO: 819972 - DNA, 25 bp, Mus musculus
tcctctgttgcatatagtgtgcttg

SEQ ID NO: 819973 - DNA, 25 bp, Mus musculus
tcctctgttgtcctgtgtttgttac

SEQ ID NO: 819974 - DNA, 25 bp, Mus musculus
tcctctgttgtcgtgtgtttgttac

SEQ ID NO: 819975 - DNA, 25 bp, Mus musculus
tcctctgttgtgatatcttacctgg

SEQ ID NO: 819976 - DNA, 25 bp, Mus musculus
tcctctgttgtgttatcttacctgg

SEQ ID NO: 819977 - DNA, 25 bp, Mus musculus
tcctctgttgttaaactcaatggtc

SEQ ID NO: 819978 - DNA, 25 bp, Mus musculus
tcctctgttgtttaactcaatggtc

SEQ ID NO: 819979 - DNA, 25 bp, Mus musculus
tcctcttaccttcgcttttcttatc

SEQ ID NO: 819980 - DNA, 25 bp, Mus musculus
tcctcttaccttggcttttcttatc

SEQ ID NO: 819981 - DNA, 25 bp, Mus musculus
tcctcttagcccaccagaaagatgt

SEQ ID NO: 819982 - DNA, 25 bp, Mus musculus
tcctcttagccctccagaaagatgt

SEQ ID NO: 819983 - DNA, 25 bp, Mus musculus
tcctcttagtgcattggccaattga

SEQ ID NO: 819984 - DNA, 25 bp, Mus musculus
tcctcttagtgctttggccaattga

SEQ ID NO: 819985 - DNA, 25 bp, Mus musculus
tcctcttatggcaccgataatctgt

SEQ ID NO: 819986 - DNA, 25 bp, Mus musculus
tcctcttatggctccgataatctgt

SEQ ID NO: 819987 - DNA, 25 bp, Mus musculus
tcctcttcaaaaatagtttcagctg

SEQ ID NO: 819988 - DNA, 25 bp, Mus musculus
tcctcttcaaaattagtttcagctg

SEQ ID NO: 819989 - DNA, 25 bp, Mus musculus
tcctcttcaacccagatgtgccagg

SEQ ID NO: 819990 - DNA, 25 bp, Mus musculus
tcctcttcaaccgagatgtgccagg

SEQ ID NO: 819991 - DNA, 25 bp, Mus musculus
tcctcttcaagtcctcctgttgtct

SEQ ID NO: 819992 - DNA, 25 bp, Mus musculus
tcctcttcaagtgctcctgttgtct

SEQ ID NO: 819993 - DNA, 25 bp, Mus musculus
tcctcttcaataaggctgatccctg

SEQ ID NO: 819994 - DNA, 25 bp, Mus musculus
tcctcttcaatatggctgatccctg

SEQ ID NO: 819995 - DNA, 25 bp, Mus musculus
tcctcttcacatcccttattctgaa

SEQ ID NO: 819996 - DNA, 25 bp, Mus musculus
tcctcttcacatgccttattctgaa

SEQ ID NO: 819997 - DNA, 25 bp, Mus musculus
tcctcttcactgacatcacgtatgg

SEQ ID NO: 819998 - DNA, 25 bp, Mus musculus
tcctcttcactgtcatcacgtatgg

SEQ ID NO: 819999 - DNA, 25 bp, Mus musculus
tcctcttcagccagatttttgttta

SEQ ID NO: 820000 - DNA, 25 bp, Mus musculus
tcctcttcagcctgatttttgttta

SEQ ID NO: 820001 - DNA, 25 bp, Mus musculus
tcctcttcagggaccagaactggat

SEQ ID NO: 820002 - DNA, 25 bp, Mus musculus
tcctcttcagggtccagaactggat

SEQ ID NO: 820003 - DNA, 25 bp, Mus musculus
tcctcttcagtcagtacttctagct

SEQ ID NO: 820004 - DNA, 25 bp, Mus musculus
tcctcttcagtctgtacttctagct

SEQ ID NO: 820005 - DNA, 25 bp, Mus musculus
tcctcttccacaaatgcgctggtga

SEQ ID NO: 820006 - DNA, 25 bp, Mus musculus
tcctcttccacaacacgaaagcgaa

SEQ ID NO: 820007 - DNA, 25 bp, Mus musculus
tcctcttccacatatgcgctggtga

SEQ ID NO: 820008 - DNA, 25 bp, Mus musculus
tcctcttccacatcacgaaagcgaa

SEQ ID NO: 820009 - DNA, 25 bp, Mus musculus
tcctcttccagtatgtcagtattgt

SEQ ID NO: 820010 - DNA, 25 bp, Mus musculus
tcctcttccagtttgtcagtattgt

SEQ ID NO: 820011 - DNA, 25 bp, Mus musculus
tcctcttccatgacgtatacttttg

SEQ ID NO: 820012 - DNA, 25 bp, Mus musculus
tcctcttccatgctagcgctcaaag

SEQ ID NO: 820013 - DNA, 25 bp, Mus musculus
tcctcttccatggtagcgctcaaag

SEQ ID NO: 820014 - DNA, 25 bp, Mus musculus
tcctcttccatgtcgtatacttttg

SEQ ID NO: 820015 - DNA, 25 bp, Mus musculus
tcctcttcccttataatcctcaaag

SEQ ID NO: 820016 - DNA, 25 bp, Mus musculus
tcctcttcccttttaatcctcaaag

SEQ ID NO: 820017 - DNA, 25 bp, Mus musculus
tcctcttccgagcagctgttagtct

SEQ ID NO: 820018 - DNA, 25 bp, Mus musculus
tcctcttccgaggagctgttagtct

SEQ ID NO: 820019 - DNA, 25 bp, Mus musculus
tcctcttccgctaaatcgggttgag

SEQ ID NO: 820020 - DNA, 25 bp, Mus musculus
tcctcttccgcttaatcgggttgag

SEQ ID NO: 820021 - DNA, 25 bp, Mus musculus
tcctcttcggagaacttttcaaaat

SEQ ID NO: 820022 - DNA, 25 bp, Mus musculus
tcctcttcggagtacttttcaaaat

SEQ ID NO: 820023 - DNA, 25 bp, Mus musculus
tcctcttctacgaggtcttcatgct

SEQ ID NO: 820024 - DNA, 25 bp, Mus musculus
tcctcttctacgtggtcttcatgct

SEQ ID NO: 820025 - DNA, 25 bp, Mus musculus
tcctcttctactcgaacgcaaaggc

SEQ ID NO: 820026 - DNA, 25 bp, Mus musculus
tcctcttctactggaacgcaaaggc

SEQ ID NO: 820027 - DNA, 25 bp, Mus musculus
tcctcttctcatagttaagtctcag

SEQ ID NO: 820028 - DNA, 25 bp, Mus musculus
tcctcttctcattgttaagtctcag

SEQ ID NO: 820029 - DNA, 25 bp, Mus musculus
tcctcttctgaaccctatactgacg

SEQ ID NO: 820030 - DNA, 25 bp, Mus musculus
tcctcttctgaagcctatactgacg

SEQ ID NO: 820031 - DNA, 25 bp, Mus musculus
tcctcttctgacaggcagcacacag

SEQ ID NO: 820032 - DNA, 25 bp, Mus musculus
tcctcttctgactggcagcacacag

SEQ ID NO: 820033 - DNA, 25 bp, Mus musculus
tcctcttctgtgactcgtggaggag

SEQ ID NO: 820034 - DNA, 25 bp, Mus musculus
tcctcttctgtgtctcgtggaggag

SEQ ID NO: 820035 - DNA, 25 bp, Mus musculus
tcctcttctgttaaaagctgcctac

SEQ ID NO: 820036 - DNA, 25 bp, Mus musculus
tcctcttctgtttaaagctgcctac

SEQ ID NO: 820037 - DNA, 25 bp, Mus musculus
tcctcttcttgccaatgctgctatg

SEQ ID NO: 820038 - DNA, 25 bp, Mus musculus
tcctcttcttgcgaatgctgctatg

SEQ ID NO: 820039 - DNA, 25 bp, Mus musculus
tcctcttgaaagatcctagccagca

SEQ ID NO: 820040 - DNA, 25 bp, Mus musculus
tcctcttgaaagttcctagccagca

SEQ ID NO: 820041 - DNA, 25 bp, Mus musculus
tcctcttgaaggctgtgcattttga

SEQ ID NO: 820042 - DNA, 25 bp, Mus musculus
tcctcttgaagggtgtgcattttga

SEQ ID NO: 820043 - DNA, 25 bp, Mus musculus
tcctcttgaatgaacagccctgtgt

SEQ ID NO: 820044 - DNA, 25 bp, Mus musculus
tcctcttgaatgtacagccctgtgt

SEQ ID NO: 820045 - DNA, 25 bp, Mus musculus
tcctcttgacagagaactgaggcga

SEQ ID NO: 820046 - DNA, 25 bp, Mus musculus
tcctcttgacagtgaactgaggcga

SEQ ID NO: 820047 - DNA, 25 bp, Mus musculus
tcctcttgacgcctttctggtggtt

SEQ ID NO: 820048 - DNA, 25 bp, Mus musculus
tcctcttgacgcgtttctggtggtt

SEQ ID NO: 820049 - DNA, 25 bp, Mus musculus
tcctcttgaggcagtttctgacaaa

SEQ ID NO: 820050 - DNA, 25 bp, Mus musculus
tcctcttgaggctgtttctgacaaa

SEQ ID NO: 820051 - DNA, 25 bp, Mus musculus
tcctcttgatcaagcattaggtcaa

SEQ ID NO: 820052 - DNA, 25 bp, Mus musculus
tcctcttgatcatgcattaggtcaa

SEQ ID NO: 820053 - DNA, 25 bp, Mus musculus
tcctcttgccctaggaggctttacc

SEQ ID NO: 820054 - DNA, 25 bp, Mus musculus
tcctcttgcccttggaggctttacc

SEQ ID NO: 820055 - DNA, 25 bp, Mus musculus
tcctcttgctaaagccaaatttgat

SEQ ID NO: 820056 - DNA, 25 bp, Mus musculus
tcctcttgctaatgccaaatttgat

SEQ ID NO: 820057 - DNA, 25 bp, Mus musculus
tcctcttgctgccagttacgtttgg

SEQ ID NO: 820058 - DNA, 25 bp, Mus musculus
tcctcttgctgcgagttacgtttgg

SEQ ID NO: 820059 - DNA, 25 bp, Mus musculus
tcctcttgctgtaagcggagcgctt

SEQ ID NO: 820060 - DNA, 25 bp, Mus musculus
tcctcttgctgttagcggagcgctt

SEQ ID NO: 820061 - DNA, 25 bp, Mus musculus
tcctcttggaatccccatcagtgat

SEQ ID NO: 820062 - DNA, 25 bp, Mus musculus
tcctcttggaatgcccatcagtgat

SEQ ID NO: 820063 - DNA, 25 bp, Mus musculus
tcctcttggctgaagcagcgttttt

SEQ ID NO: 820064 - DNA, 25 bp, Mus musculus
tcctcttggctgtagcagcgttttt

SEQ ID NO: 820065 - DNA, 25 bp, Mus musculus
tcctcttgtacccagcatttgtgag

SEQ ID NO: 820066 - DNA, 25 bp, Mus musculus
tcctcttgtaccgagcatttgtgag

SEQ ID NO: 820067 - DNA, 25 bp, Mus musculus
tcctcttgttgactgagccttaagt

SEQ ID NO: 820068 - DNA, 25 bp, Mus musculus
tcctcttgttgagtgagccttaagt

SEQ ID NO: 820069 - DNA, 25 bp, Mus musculus
tcctctttaaagatcatccgttata

SEQ ID NO: 820070 - DNA, 25 bp, Mus musculus
tcctctttaaagttcatccgttata

SEQ ID NO: 820071 - DNA, 25 bp, Mus musculus
tcctctttaaggaactccgtcatct

SEQ ID NO: 820072 - DNA, 25 bp, Mus musculus
tcctctttaaggtactccgtcatct

SEQ ID NO: 820073 - DNA, 25 bp, Mus musculus
tcctctttaagtcgtaatgcttcat

SEQ ID NO: 820074 - DNA, 25 bp, Mus musculus
tcctctttaagtggtaatgcttcat

SEQ ID NO: 820075 - DNA, 25 bp, Mus musculus
tcctctttagagctcatgctgacaa

SEQ ID NO: 820076 - DNA, 25 bp, Mus musculus
tcctctttagaggtcatgctgacaa

SEQ ID NO: 820077 - DNA, 25 bp, Mus musculus
tcctctttaggcagctgaaaacaga

SEQ ID NO: 820078 - DNA, 25 bp, Mus musculus
tcctctttaggctgctgaaaacaga

SEQ ID NO: 820079 - DNA, 25 bp, Mus musculus
tcctctttatcaactctgccaaatt

SEQ ID NO: 820080 - DNA, 25 bp, Mus musculus
tcctctttatcatctctgccaaatt

SEQ ID NO: 820081 - DNA, 25 bp, Mus musculus
tcctctttcaacacttacaattcca

SEQ ID NO: 820082 - DNA, 25 bp, Mus musculus
tcctctttcaactcttacaattcca

SEQ ID NO: 820083 - DNA, 25 bp, Mus musculus
tcctctttccgtaagaatctcattg

SEQ ID NO: 820084 - DNA, 25 bp, Mus musculus
tcctctttccgttagaatctcattg

SEQ ID NO: 820085 - DNA, 25 bp, Mus musculus
tcctctttctaaacagtgttctaat

SEQ ID NO: 820086 - DNA, 25 bp, Mus musculus
tcctctttctaatcagtgttctaat

SEQ ID NO: 820087 - DNA, 25 bp, Mus musculus
tcctctttgacactgcttttggcac

SEQ ID NO: 820088 - DNA, 25 bp, Mus musculus
tcctctttgacagtgcttttggcac

SEQ ID NO: 820089 - DNA, 25 bp, Mus musculus
tcctctttgaggagtcttctctaag

SEQ ID NO: 820090 - DNA, 25 bp, Mus musculus
tcctctttgaggtgtcttctctaag

SEQ ID NO: 820091 - DNA, 25 bp, Mus musculus
tcctctttgcagacttgattcacat

SEQ ID NO: 820092 - DNA, 25 bp, Mus musculus
tcctctttgcagtcttgattcacat

SEQ ID NO: 820093 - DNA, 25 bp, Mus musculus
tcctctttgcctcagggcatttgta

SEQ ID NO: 820094 - DNA, 25 bp, Mus musculus
tcctctttgcctgagggcatttgta

SEQ ID NO: 820095 - DNA, 25 bp, Mus musculus
tcctctttgtgtccagttcctataa

SEQ ID NO: 820096 - DNA, 25 bp, Mus musculus
tcctctttgtgtgcagttcctataa

SEQ ID NO: 820097 - DNA, 25 bp, Mus musculus
tcctcttttaggcactctgttccat

SEQ ID NO: 820098 - DNA, 25 bp, Mus musculus
tcctcttttagggactctgttccat

SEQ ID NO: 820099 - DNA, 25 bp, Mus musculus
tcctcttttataaggagaatccctt

SEQ ID NO: 820100 - DNA, 25 bp, Mus musculus
tcctcttttatatggagaatccctt

SEQ ID NO: 820101 - DNA, 25 bp, Mus musculus
tcctcttttgatcctcaagcctggt

SEQ ID NO: 820102 - DNA, 25 bp, Mus musculus
tcctcttttgatgctcaagcctggt

SEQ ID NO: 820103 - DNA, 25 bp, Mus musculus
tcctgaaacaaaaccatggatatca

SEQ ID NO: 820104 - DNA, 25 bp, Mus musculus
tcctgaaacaaatccatggatatca

SEQ ID NO: 820105 - DNA, 25 bp, Mus musculus
tcctgaaacaggaactacttgtcct

SEQ ID NO: 820106 - DNA, 25 bp, Mus musculus
tcctgaaacaggtactacttgtcct

SEQ ID NO: 820107 - DNA, 25 bp, Mus musculus
tcctgaaacccaactttctgtgact

SEQ ID NO: 820108 - DNA, 25 bp, Mus musculus
tcctgaaacccatctttctgtgact

SEQ ID NO: 820109 - DNA, 25 bp, Mus musculus
tcctgaaactatcccagctctggaa

SEQ ID NO: 820110 - DNA, 25 bp, Mus musculus
tcctgaaactatgccagctctggaa

SEQ ID NO: 820111 - DNA, 25 bp, Mus musculus
tcctgaaactgtcctggtgccgggc

SEQ ID NO: 820112 - DNA, 25 bp, Mus musculus
tcctgaaactgtgctggtgccgggc

SEQ ID NO: 820113 - DNA, 25 bp, Mus musculus
tcctgaaagcttaccttccttttga

SEQ ID NO: 820114 - DNA, 25 bp, Mus musculus
tcctgaaagctttccttccttttga

SEQ ID NO: 820115 - DNA, 25 bp, Mus musculus
tcctgaaaggtgctacttatgtgcc

SEQ ID NO: 820116 - DNA, 25 bp, Mus musculus
tcctgaaaggtggtacttatgtgcc

SEQ ID NO: 820117 - DNA, 25 bp, Mus musculus
tcctgaaagtagaagtgagctcccc

SEQ ID NO: 820118 - DNA, 25 bp, Mus musculus
tcctgaaagtagtagtgagctcccc

SEQ ID NO: 820119 - DNA, 25 bp, Mus musculus
tcctgaaattgcactgtactggtgc

SEQ ID NO: 820120 - DNA, 25 bp, Mus musculus
tcctgaaattgctctgtactggtgc

SEQ ID NO: 820121 - DNA, 25 bp, Mus musculus
tcctgaaatttactatgtagaccag

SEQ ID NO: 820122 - DNA, 25 bp, Mus musculus
tcctgaaatttagtatgtagaccag

SEQ ID NO: 820123 - DNA, 25 bp, Mus musculus
tcctgaacacagaaagcttacctat

SEQ ID NO: 820124 - DNA, 25 bp, Mus musculus
tcctgaacacagtaagcttacctat

SEQ ID NO: 820125 - DNA, 25 bp, Mus musculus
tcctgaacctctcggttgctgtggt

SEQ ID NO: 820126 - DNA, 25 bp, Mus musculus
tcctgaacctctgggttgctgtggt

SEQ ID NO: 820127 - DNA, 25 bp, Mus musculus
tcctgaacctgacgttacttccatt

SEQ ID NO: 820128 - DNA, 25 bp, Mus musculus
tcctgaacctgaggttacttccatt

SEQ ID NO: 820129 - DNA, 25 bp, Mus musculus
tcctgaacggtagcatcttgacgac

SEQ ID NO: 820130 - DNA, 25 bp, Mus musculus
tcctgaactatgaaacatgaatatg

SEQ ID NO: 820131 - DNA, 25 bp, Mus musculus
tcctgaactatgtaacatgaatatg

SEQ ID NO: 820132 - DNA, 25 bp, Mus musculus
tcctgaactcacaacgtagtctagg

SEQ ID NO: 820133 - DNA, 25 bp, Mus musculus
tcctgaactcacacaacctgtaaga

SEQ ID NO: 820134 - DNA, 25 bp, Mus musculus
tcctgaactcactacgtagtctagg

SEQ ID NO: 820135 - DNA, 25 bp, Mus musculus
tcctgaactcactcaacctgtaaga

SEQ ID NO: 820136 - DNA, 25 bp, Mus musculus
tcctgaactgccatctactaaatca

SEQ ID NO: 820137 - DNA, 25 bp, Mus musculus
tcctgaactgccttctactaaatca

SEQ ID NO: 820138 - DNA, 25 bp, Mus musculus
tcctgaacttgaccgggaaggtgct

SEQ ID NO: 820139 - DNA, 25 bp, Mus musculus
tcctgaacttgagcgggaaggtgct

SEQ ID NO: 820140 - DNA, 25 bp, Mus musculus
tcctgaagagataacccacactaag

SEQ ID NO: 820141 - DNA, 25 bp, Mus musculus
tcctgaagagattacccacactaag

SEQ ID NO: 820142 - DNA, 25 bp, Mus musculus
tcctgaagaggccaacctggatggc

SEQ ID NO: 820143 - DNA, 25 bp, Mus musculus
tcctgaagaggcgaacctggatggc

SEQ ID NO: 820144 - DNA, 25 bp, Mus musculus
tcctgaagatgcagaccactctcta

SEQ ID NO: 820145 - DNA, 25 bp, Mus musculus
tcctgaagatgctgaccactctcta

SEQ ID NO: 820146 - DNA, 25 bp, Mus musculus
tcctgaagcattatccatgctgtca

SEQ ID NO: 820147 - DNA, 25 bp, Mus musculus
tcctgaagcattccttgtctgctat

SEQ ID NO: 820148 - DNA, 25 bp, Mus musculus
tcctgaagcattgcttgtctgctat

SEQ ID NO: 820149 - DNA, 25 bp, Mus musculus
tcctgaagcattttccatgctgtca

SEQ ID NO: 820150 - DNA, 25 bp, Mus musculus
tcctgaagcctgatgtacattgtaa

SEQ ID NO: 820151 - DNA, 25 bp, Mus musculus
tcctgaagcctgttgtacattgtaa

SEQ ID NO: 820152 - DNA, 25 bp, Mus musculus
tcctgaagcggtagccaaggtgaca

SEQ ID NO: 820153 - DNA, 25 bp, Mus musculus
tcctgaagcggttgccaaggtgaca

SEQ ID NO: 820154 - DNA, 25 bp, Mus musculus
tcctgaagctcactacgtagacctc

SEQ ID NO: 820155 - DNA, 25 bp, Mus musculus
tcctgaagctcagtacgtagacctc

SEQ ID NO: 820156 - DNA, 25 bp, Mus musculus
tcctgaagctctctaccttgaaaaa

SEQ ID NO: 820157 - DNA, 25 bp, Mus musculus
tcctgaagctctgtaccttgaaaaa

SEQ ID NO: 820158 - DNA, 25 bp, Mus musculus
tcctgaagcttcacctggccctggg

SEQ ID NO: 820159 - DNA, 25 bp, Mus musculus
tcctgaagcttctcctggccctggg

SEQ ID NO: 820160 - DNA, 25 bp, Mus musculus
tcctgaaggactccatgggacgtga

SEQ ID NO: 820161 - DNA, 25 bp, Mus musculus
tcctgaaggactgcatgggacgtga

SEQ ID NO: 820162 - DNA, 25 bp, Mus musculus
tcctgaagtaccctgaaacccgagg

SEQ ID NO: 820163 - DNA, 25 bp, Mus musculus
tcctgaagtaccgtgaaacccgagg

SEQ ID NO: 820164 - DNA, 25 bp, Mus musculus
tcctgaagtctacccacacttggca

SEQ ID NO: 820165 - DNA, 25 bp, Mus musculus
tcctgaagtctagccacacttggca

SEQ ID NO: 820166 - DNA, 25 bp, Mus musculus
tcctgaagttctagttcatctactg

SEQ ID NO: 820167 - DNA, 25 bp, Mus musculus
tcctgaagttcttgttcatctactg

SEQ ID NO: 820168 - DNA, 25 bp, Mus musculus
tcctgaataaagaaccgtcttgttg

SEQ ID NO: 820169 - DNA, 25 bp, Mus musculus
tcctgaataaagtaccgtcttgttg

SEQ ID NO: 820170 - DNA, 25 bp, Mus musculus
tcctgaatcaccagcgccatcgatg

SEQ ID NO: 820171 - DNA, 25 bp, Mus musculus
tcctgaatcacctgcgccatcgatg

SEQ ID NO: 820172 - DNA, 25 bp, Mus musculus
tcctgaatccccagcattgcataaa

SEQ ID NO: 820173 - DNA, 25 bp, Mus musculus
tcctgaatcccctgcattgcataaa

SEQ ID NO: 820174 - DNA, 25 bp, Mus musculus
tcctgaatctgaacaggcttcacaa

SEQ ID NO: 820175 - DNA, 25 bp, Mus musculus
tcctgaatctgatcaggcttcacaa

SEQ ID NO: 820176 - DNA, 25 bp, Mus musculus
tcctgaatgggccaaaagaggtttc

SEQ ID NO: 820177 - DNA, 25 bp, Mus musculus
tcctgaatgggcgaaaagaggtttc

SEQ ID NO: 820178 - DNA, 25 bp, Mus musculus
tcctgaattatgcacccacagctgt

SEQ ID NO: 820179 - DNA, 25 bp, Mus musculus
tcctgaattatggacccacagctgt

SEQ ID NO: 820180 - DNA, 25 bp, Mus musculus
tcctgaatttgcctgtattctctcc

SEQ ID NO: 820181 - DNA, 25 bp, Mus musculus
tcctgaatttgcgtgtattctctcc

SEQ ID NO: 820182 - DNA, 25 bp, Mus musculus
tcctgacaacccaccatatgataag

SEQ ID NO: 820183 - DNA, 25 bp, Mus musculus
tcctgacaaccctccatatgataag

SEQ ID NO: 820184 - DNA, 25 bp, Mus musculus
tcctgacaactgcagagttcctcaa

SEQ ID NO: 820185 - DNA, 25 bp, Mus musculus
tcctgacaactggagagttcctcaa

SEQ ID NO: 820186 - DNA, 25 bp, Mus musculus
tcctgacacagaagttgtaatgcat

SEQ ID NO: 820187 - DNA, 25 bp, Mus musculus
tcctgacacagatgttgtaatgcat

SEQ ID NO: 820188 - DNA, 25 bp, Mus musculus
tcctgacaccggaatgtgctgactg

SEQ ID NO: 820189 - DNA, 25 bp, Mus musculus
tcctgacaccggtatgtgctgactg

SEQ ID NO: 820190 - DNA, 25 bp, Mus musculus
tcctgacacgtgatcacactcgggt

SEQ ID NO: 820191 - DNA, 25 bp, Mus musculus
tcctgacacgtgttcacactcgggt

SEQ ID NO: 820192 - DNA, 25 bp, Mus musculus
tcctgacactttctgatccttagta

SEQ ID NO: 820193 - DNA, 25 bp, Mus musculus
tcctgacactttgtgatccttagta

SEQ ID NO: 820194 - DNA, 25 bp, Mus musculus
tcctgacagtggctcatggcacagg

SEQ ID NO: 820195 - DNA, 25 bp, Mus musculus
tcctgacagtgggtcatggcacagg

SEQ ID NO: 820196 - DNA, 25 bp, Mus musculus
tcctgacatacccagcttcgacatt

SEQ ID NO: 820197 - DNA, 25 bp, Mus musculus
tcctgacataccgagcttcgacatt

SEQ ID NO: 820198 - DNA, 25 bp, Mus musculus
tcctgacattacagaactaaactga

SEQ ID NO: 820199 - DNA, 25 bp, Mus musculus
tcctgacattactgaactaaactga

SEQ ID NO: 820200 - DNA, 25 bp, Mus musculus
tcctgacattttccctttcacaaat

SEQ ID NO: 820201 - DNA, 25 bp, Mus musculus
tcctgacattttgcctttcacaaat

SEQ ID NO: 820202 - DNA, 25 bp, Mus musculus
tcctgaccaagaactatttcctggt

SEQ ID NO: 820203 - DNA, 25 bp, Mus musculus
tcctgaccaagatctatttcctggt

SEQ ID NO: 820204 - DNA, 25 bp, Mus musculus
tcctgaccaggtatgtgctatcatg

SEQ ID NO: 820205 - DNA, 25 bp, Mus musculus
tcctgaccaggtttgtgctatcatg

SEQ ID NO: 820206 - DNA, 25 bp, Mus musculus
tcctgaccagtgaaactcattttta

SEQ ID NO: 820207 - DNA, 25 bp, Mus musculus
tcctgaccagtgtaactcattttta

SEQ ID NO: 820208 - DNA, 25 bp, Mus musculus
tcctgaccatagagaccaacaaatg

SEQ ID NO: 820209 - DNA, 25 bp, Mus musculus
tcctgaccatagtgaccaacaaatg

SEQ ID NO: 820210 - DNA, 25 bp, Mus musculus
tcctgacccagtaggactgactggc

SEQ ID NO: 820211 - DNA, 25 bp, Mus musculus
tcctgacccagttggactgactggc

SEQ ID NO: 820212 - DNA, 25 bp, Mus musculus
tcctgaccccgcaaagaaagagata

SEQ ID NO: 820213 - DNA, 25 bp, Mus musculus
tcctgaccccgctaagaaagagata

SEQ ID NO: 820214 - DNA, 25 bp, Mus musculus
tcctgaccctgacgttgtgatacac

SEQ ID NO: 820215 - DNA, 25 bp, Mus musculus
tcctgaccctgaggttgtgatacac

SEQ ID NO: 820216 - DNA, 25 bp, Mus musculus
tcctgaccgagcctggctacagctt

SEQ ID NO: 820217 - DNA, 25 bp, Mus musculus
tcctgaccgagcgtggctacagctt

SEQ ID NO: 820218 - DNA, 25 bp, Mus musculus
tcctgaccgtgtactggacaaatca

SEQ ID NO: 820219 - DNA, 25 bp, Mus musculus
tcctgaccgtgttctggacaaatca

SEQ ID NO: 820220 - DNA, 25 bp, Mus musculus
tcctgacgccagattttaccccgtt

SEQ ID NO: 820221 - DNA, 25 bp, Mus musculus
tcctgacgccagtttttaccccgtt

SEQ ID NO: 820222 - DNA, 25 bp, Mus musculus
tcctgacgggtcacaaggcttcaaa

SEQ ID NO: 820223 - DNA, 25 bp, Mus musculus
tcctgacgggtctcaaggcttcaaa

SEQ ID NO: 820224 - DNA, 25 bp, Mus musculus
tcctgacggtcacgccagttaattc

SEQ ID NO: 820225 - DNA, 25 bp, Mus musculus
tcctgacggtcaggccagttaattc

SEQ ID NO: 820226 - DNA, 25 bp, Mus musculus
tcctgacgtggtcttcagagctctt

SEQ ID NO: 820227 - DNA, 25 bp, Mus musculus
tcctgacgtggtgttcagagctctt

SEQ ID NO: 820228 - DNA, 25 bp, Mus musculus
tcctgactaacaacaccttcttgaa

SEQ ID NO: 820229 - DNA, 25 bp, Mus musculus
tcctgactaacatcaccttcttgaa

SEQ ID NO: 820230 - DNA, 25 bp, Mus musculus
tcctgactacaaatgagtttaggcc

SEQ ID NO: 820231 - DNA, 25 bp, Mus musculus
tcctgactacaattgagtttaggcc

SEQ ID NO: 820232 - DNA, 25 bp, Mus musculus
tcctgactcacaatcacttggaggc

SEQ ID NO: 820233 - DNA, 25 bp, Mus musculus
tcctgactcacattcacttggaggc

SEQ ID NO: 820234 - DNA, 25 bp, Mus musculus
tcctgactcagcacgggtgtgtgca

SEQ ID NO: 820235 - DNA, 25 bp, Mus musculus
tcctgactcagctcgggtgtgtgca

SEQ ID NO: 820236 - DNA, 25 bp, Mus musculus
tcctgactgcccactataggtggcg

SEQ ID NO: 820237 - DNA, 25 bp, Mus musculus
tcctgactgccctctataggtggcg

SEQ ID NO: 820238 - DNA, 25 bp, Mus musculus
tcctgactgctgagcacatttgcat

SEQ ID NO: 820239 - DNA, 25 bp, Mus musculus
tcctgactgctgctaggtaggcact

SEQ ID NO: 820240 - DNA, 25 bp, Mus musculus
tcctgactgctggtaggtaggcact

SEQ ID NO: 820241 - DNA, 25 bp, Mus musculus
tcctgactgctgtgcacatttgcat

SEQ ID NO: 820242 - DNA, 25 bp, Mus musculus
tcctgactgggcagaagtactctac

SEQ ID NO: 820243 - DNA, 25 bp, Mus musculus
tcctgactgggctgaagtactctac

SEQ ID NO: 820244 - DNA, 25 bp, Mus musculus
tcctgactggttatgtacccttggg

SEQ ID NO: 820245 - DNA, 25 bp, Mus musculus
tcctgactggttttgtacccttggg

SEQ ID NO: 820246 - DNA, 25 bp, Mus musculus
tcctgactgtggacgggaattccgt

SEQ ID NO: 820247 - DNA, 25 bp, Mus musculus
tcctgactgtggtcgggaattccgt

SEQ ID NO: 820248 - DNA, 25 bp, Mus musculus
tcctgacttcagatccacacagacg

SEQ ID NO: 820249 - DNA, 25 bp, Mus musculus
tcctgacttcagttccacacagacg

SEQ ID NO: 820250 - DNA, 25 bp, Mus musculus
tcctgacttggccttgcatgcatga

SEQ ID NO: 820251 - DNA, 25 bp, Mus musculus
tcctgacttggcgttgcatgcatga

SEQ ID NO: 820252 - DNA, 25 bp, Mus musculus
tcctgacttgggagcccgagaggtc

SEQ ID NO: 820253 - DNA, 25 bp, Mus musculus
tcctgacttgggtgcccgagaggtc

SEQ ID NO: 820254 - DNA, 25 bp, Mus musculus
tcctgacttgttcgaatacctctta

SEQ ID NO: 820255 - DNA, 25 bp, Mus musculus
tcctgacttgttggaatacctctta

SEQ ID NO: 820256 - DNA, 25 bp, Mus musculus
tcctgactttccataaagcttcaca

SEQ ID NO: 820257 - DNA, 25 bp, Mus musculus
tcctgactttccttaaagcttcaca

SEQ ID NO: 820258 - DNA, 25 bp, Mus musculus
tcctgagaaacaacagagccagctt

SEQ ID NO: 820259 - DNA, 25 bp, Mus musculus
tcctgagaaacatcagagccagctt

SEQ ID NO: 820260 - DNA, 25 bp, Mus musculus
tcctgagaacagatgcccctaatat

SEQ ID NO: 820261 - DNA, 25 bp, Mus musculus
tcctgagaacagttgcccctaatat

SEQ ID NO: 820262 - DNA, 25 bp, Mus musculus
tcctgagaagtgcactaacagtaga

SEQ ID NO: 820263 - DNA, 25 bp, Mus musculus
tcctgagaagtggactaacagtaga

SEQ ID NO: 820264 - DNA, 25 bp, Mus musculus
tcctgagaccagagagtgcgcacat

SEQ ID NO: 820265 - DNA, 25 bp, Mus musculus
tcctgagaccagtgagtgcgcacat

SEQ ID NO: 820266 - DNA, 25 bp, Mus musculus
tcctgagagcttaggctgtggtaac

SEQ ID NO: 820267 - DNA, 25 bp, Mus musculus
tcctgagagctttggctgtggtaac

SEQ ID NO: 820268 - DNA, 25 bp, Mus musculus
tcctgagagtctactcccatgcaga

SEQ ID NO: 820269 - DNA, 25 bp, Mus musculus
tcctgagagtcttctcccatgcaga

SEQ ID NO: 820270 - DNA, 25 bp, Mus musculus
tcctgagagtgactggtgggttgct

SEQ ID NO: 820271 - DNA, 25 bp, Mus musculus
tcctgagagtgagtggtgggttgct

SEQ ID NO: 820272 - DNA, 25 bp, Mus musculus
tcctgagagtggctgtgagaccctc

SEQ ID NO: 820273 - DNA, 25 bp, Mus musculus
tcctgagagtgggtgtgagaccctc

SEQ ID NO: 820274 - DNA, 25 bp, Mus musculus
tcctgagatggacccctacataaaa

SEQ ID NO: 820275 - DNA, 25 bp, Mus musculus
tcctgagatggagccctacataaaa

SEQ ID NO: 820276 - DNA, 25 bp, Mus musculus
tcctgagatttcagcttcccatcaa

SEQ ID NO: 820277 - DNA, 25 bp, Mus musculus
tcctgagatttctgcttcccatcaa

SEQ ID NO: 820278 - DNA, 25 bp, Mus musculus
tcctgagcagacattcagaagggag

SEQ ID NO: 820279 - DNA, 25 bp, Mus musculus
tcctgagcagactttcagaagggag

SEQ ID NO: 820280 - DNA, 25 bp, Mus musculus
tcctgagcagctatgggtgacaaca

SEQ ID NO: 820281 - DNA, 25 bp, Mus musculus
tcctgagcagctttgggtgacaaca

SEQ ID NO: 820282 - DNA, 25 bp, Mus musculus
tcctgagcatggctgaccacttgaa

SEQ ID NO: 820283 - DNA, 25 bp, Mus musculus
tcctgagcatgggtgaccacttgaa

SEQ ID NO: 820284 - DNA, 25 bp, Mus musculus
tcctgagccactaagccaatgtttg

SEQ ID NO: 820285 - DNA, 25 bp, Mus musculus
tcctgagccacttagccaatgtttg

SEQ ID NO: 820286 - DNA, 25 bp, Mus musculus
tcctgagccatcaacagcagcgtgg

SEQ ID NO: 820287 - DNA, 25 bp, Mus musculus
tcctgagccatctacagcagcgtgg

SEQ ID NO: 820288 - DNA, 25 bp, Mus musculus
tcctgagcccctagcaacaaagtta

SEQ ID NO: 820289 - DNA, 25 bp, Mus musculus
tcctgagccccttgcaacaaagtta

SEQ ID NO: 820290 - DNA, 25 bp, Mus musculus
tcctgagccctgctgagtggtctta

SEQ ID NO: 820291 - DNA, 25 bp, Mus musculus
tcctgagccctggtgagtggtctta

SEQ ID NO: 820292 - DNA, 25 bp, Mus musculus
tcctgagcccttcggaaactcaaca

SEQ ID NO: 820293 - DNA, 25 bp, Mus musculus
tcctgagcccttgggaaactcaaca

SEQ ID NO: 820294 - DNA, 25 bp, Mus musculus
tcctgagcctacatgcacttggaag

SEQ ID NO: 820295 - DNA, 25 bp, Mus musculus
tcctgagcctacttgcacttggaag

SEQ ID NO: 820296 - DNA, 25 bp, Mus musculus
tcctgagcctctagttaccttgtta

SEQ ID NO: 820297 - DNA, 25 bp, Mus musculus
tcctgagcctcttgttaccttgtta

SEQ ID NO: 820298 - DNA, 25 bp, Mus musculus
tcctgagcctgaaatttgtcttgtc

SEQ ID NO: 820299 - DNA, 25 bp, Mus musculus
tcctgagcctgatatttgtcttgtc

SEQ ID NO: 820300 - DNA, 25 bp, Mus musculus
tcctgagcctgcaacttaagagggt

SEQ ID NO: 820301 - DNA, 25 bp, Mus musculus
tcctgagcctgctacttaagagggt

SEQ ID NO: 820302 - DNA, 25 bp, Mus musculus
tcctgagcgagtctgcttgcatccg

SEQ ID NO: 820303 - DNA, 25 bp, Mus musculus
tcctgagcgagtgtgcttgcatccg

SEQ ID NO: 820304 - DNA, 25 bp, Mus musculus
tcctgagcgctgcattaaaggtgtg

SEQ ID NO: 820305 - DNA, 25 bp, Mus musculus
tcctgagcgctggattaaaggtgtg

SEQ ID NO: 820306 - DNA, 25 bp, Mus musculus
tcctgagcggagactgtagaacttg

SEQ ID NO: 820307 - DNA, 25 bp, Mus musculus
tcctgagcggagtctgtagaacttg

SEQ ID NO: 820308 - DNA, 25 bp, Mus musculus
tcctgagcggctagttttcaaacct

SEQ ID NO: 820309 - DNA, 25 bp, Mus musculus
tcctgagcggcttgttttcaaacct

SEQ ID NO: 820310 - DNA, 25 bp, Mus musculus
tcctgagctgagaagatcctgtgca

SEQ ID NO: 820311 - DNA, 25 bp, Mus musculus
tcctgagctgagtagatcctgtgca

SEQ ID NO: 820312 - DNA, 25 bp, Mus musculus
tcctgagctgccaaatcgaagccag

SEQ ID NO: 820313 - DNA, 25 bp, Mus musculus
tcctgagctgcctaatcgaagccag

SEQ ID NO: 820314 - DNA, 25 bp, Mus musculus
tcctgagcttgaaaggattcctgtt

SEQ ID NO: 820315 - DNA, 25 bp, Mus musculus
tcctgagcttgataggattcctgtt

SEQ ID NO: 820316 - DNA, 25 bp, Mus musculus
tcctgaggaaatccacttgacgagt

SEQ ID NO: 820317 - DNA, 25 bp, Mus musculus
tcctgaggaaatgcacttgacgagt

SEQ ID NO: 820318 - DNA, 25 bp, Mus musculus
tcctgaggaattaaagcattttaag

SEQ ID NO: 820319 - DNA, 25 bp, Mus musculus
tcctgaggaatttaagcattttaag

SEQ ID NO: 820320 - DNA, 25 bp, Mus musculus
tcctgaggagctctttctgttattg

SEQ ID NO: 820321 - DNA, 25 bp, Mus musculus
tcctgaggagctgtttctgttattg

SEQ ID NO: 820322 - DNA, 25 bp, Mus musculus
tcctgaggatctagtgatggtttcc

SEQ ID NO: 820323 - DNA, 25 bp, Mus musculus
tcctgaggatcttgtgatggtttcc

SEQ ID NO: 820324 - DNA, 25 bp, Mus musculus
tcctgaggattacgagaaacttggt

SEQ ID NO: 820325 - DNA, 25 bp, Mus musculus
tcctgaggattaggagaaacttggt

SEQ ID NO: 820326 - DNA, 25 bp, Mus musculus
tcctgaggccctagagaccaaagaa

SEQ ID NO: 820327 - DNA, 25 bp, Mus musculus
tcctgaggcccttgagaccaaagaa

SEQ ID NO: 820328 - DNA, 25 bp, Mus musculus
tcctgaggccgcagcctgactttga

SEQ ID NO: 820329 - DNA, 25 bp, Mus musculus
tcctgaggccgctgcctgactttga

SEQ ID NO: 820330 - DNA, 25 bp, Mus musculus
tcctgaggctcaccgggccattgaa

SEQ ID NO: 820331 - DNA, 25 bp, Mus musculus
tcctgaggctcagcgggccattgaa

SEQ ID NO: 820332 - DNA, 25 bp, Mus musculus
tcctgaggctggacctgtgaacctt

SEQ ID NO: 820333 - DNA, 25 bp, Mus musculus
tcctgaggctggtcctgtgaacctt

SEQ ID NO: 820334 - DNA, 25 bp, Mus musculus
tcctgagggctcagaggcactgcag

SEQ ID NO: 820335 - DNA, 25 bp, Mus musculus
tcctgagggctctgaggcactgcag

SEQ ID NO: 820336 - DNA, 25 bp, Mus musculus
tcctgagggctgctatcaaagttgt

SEQ ID NO: 820337 - DNA, 25 bp, Mus musculus
tcctgagggctggtatcaaagttgt

SEQ ID NO: 820338 - DNA, 25 bp, Mus musculus
tcctgaggtcagattgccctttgtg

SEQ ID NO: 820339 - DNA, 25 bp, Mus musculus
tcctgaggtcagtttgccctttgtg

SEQ ID NO: 820340 - DNA, 25 bp, Mus musculus
tcctgaggtccccacagagcttgtc

SEQ ID NO: 820341 - DNA, 25 bp, Mus musculus
tcctgaggtcccgacagagcttgtc

SEQ ID NO: 820342 - DNA, 25 bp, Mus musculus
tcctgaggtgtcactggtagcggta

SEQ ID NO: 820343 - DNA, 25 bp, Mus musculus
tcctgaggtgtctctggtagcggta

SEQ ID NO: 820344 - DNA, 25 bp, Mus musculus
tcctgaggtgtgctactgagacaac

SEQ ID NO: 820345 - DNA, 25 bp, Mus musculus
tcctgaggtgtggtactgagacaac

SEQ ID NO: 820346 - DNA, 25 bp, Mus musculus
tcctgaggttacagccttaccctag

SEQ ID NO: 820347 - DNA, 25 bp, Mus musculus
tcctgaggttactgccttaccctag

SEQ ID NO: 820348 - DNA, 25 bp, Mus musculus
tcctgaggtttacgctgttgtgacc

SEQ ID NO: 820349 - DNA, 25 bp, Mus musculus
tcctgaggtttaggctgttgtgacc

SEQ ID NO: 820350 - DNA, 25 bp, Mus musculus
tcctgagtaactagggtttgcaacc

SEQ ID NO: 820351 - DNA, 25 bp, Mus musculus
tcctgagtaacttgggtttgcaacc

SEQ ID NO: 820352 - DNA, 25 bp, Mus musculus
tcctgagtccaactatatagtcctg

SEQ ID NO: 820353 - DNA, 25 bp, Mus musculus
tcctgagtccaagtatatagtcctg

SEQ ID NO: 820354 - DNA, 25 bp, Mus musculus
tcctgagtcgtgctctgttggtata

SEQ ID NO: 820355 - DNA, 25 bp, Mus musculus
tcctgagtcgtggtctgttggtata

SEQ ID NO: 820356 - DNA, 25 bp, Mus musculus
tcctgagtctatctcctgaggcaaa

SEQ ID NO: 820357 - DNA, 25 bp, Mus musculus
tcctgagtctatgtcctgaggcaaa

SEQ ID NO: 820358 - DNA, 25 bp, Mus musculus
tcctgagtctctctcgggtgttttt

SEQ ID NO: 820359 - DNA, 25 bp, Mus musculus
tcctgagtctctgtcgggtgttttt

SEQ ID NO: 820360 - DNA, 25 bp, Mus musculus
tcctgagtctttagacgaatccagt

SEQ ID NO: 820361 - DNA, 25 bp, Mus musculus
tcctgagtcttttgacgaatccagt

SEQ ID NO: 820362 - DNA, 25 bp, Mus musculus
tcctgagtgactaccaacctgggat

SEQ ID NO: 820363 - DNA, 25 bp, Mus musculus
tcctgagtgacttccaacctgggat

SEQ ID NO: 820364 - DNA, 25 bp, Mus musculus
tcctgagtgcctcttgagagccaca

SEQ ID NO: 820365 - DNA, 25 bp, Mus musculus
tcctgagtgcctgttgagagccaca

SEQ ID NO: 820366 - DNA, 25 bp, Mus musculus
tcctgagtggacaggaggagtcttc

SEQ ID NO: 820367 - DNA, 25 bp, Mus musculus
tcctgagtggactggaggagtcttc

SEQ ID NO: 820368 - DNA, 25 bp, Mus musculus
tcctgagtgtaaccccaggcatggg

SEQ ID NO: 820369 - DNA, 25 bp, Mus musculus
tcctgagtgtaagcccaggcatggg

SEQ ID NO: 820370 - DNA, 25 bp, Mus musculus
tcctgagtgtgtcttctggtgcata

SEQ ID NO: 820371 - DNA, 25 bp, Mus musculus
tcctgagtgtgtgttctggtgcata

SEQ ID NO: 820372 - DNA, 25 bp, Mus musculus
tcctgagttcagaggcagccggagc

SEQ ID NO: 820373 - DNA, 25 bp, Mus musculus
tcctgagttcagctgtttccaacgc

SEQ ID NO: 820374 - DNA, 25 bp, Mus musculus
tcctgagttcaggtgtttccaacgc

SEQ ID NO: 820375 - DNA, 25 bp, Mus musculus
tcctgagttcagtggcagccggagc

SEQ ID NO: 820376 - DNA, 25 bp, Mus musculus
tcctgagttccaagacctgaattga

SEQ ID NO: 820377 - DNA, 25 bp, Mus musculus
tcctgagttccatgacctgaattga

SEQ ID NO: 820378 - DNA, 25 bp, Mus musculus
tcctgagttcggaattcctgaagac

SEQ ID NO: 820379 - DNA, 25 bp, Mus musculus
tcctgagttcggtattcctgaagac

SEQ ID NO: 820380 - DNA, 25 bp, Mus musculus
tcctgagttgggagcctgtgcacag

SEQ ID NO: 820381 - DNA, 25 bp, Mus musculus
tcctgagttgggtgcctgtgcacag

SEQ ID NO: 820382 - DNA, 25 bp, Mus musculus
tcctgagtttctacatggccagagt

SEQ ID NO: 820383 - DNA, 25 bp, Mus musculus
tcctgagtttcttcatggccagagt

SEQ ID NO: 820384 - DNA, 25 bp, Mus musculus
tcctgataaattaggctcctgtgtg

SEQ ID NO: 820385 - DNA, 25 bp, Mus musculus
tcctgataaatttggctcctgtgtg

SEQ ID NO: 820386 - DNA, 25 bp, Mus musculus
tcctgataccatcatgttttgcaca

SEQ ID NO: 820387 - DNA, 25 bp, Mus musculus
tcctgataccatgatgttttgcaca

SEQ ID NO: 820388 - DNA, 25 bp, Mus musculus
tcctgatacttgcttgtatttccta

SEQ ID NO: 820389 - DNA, 25 bp, Mus musculus
tcctgatacttggttgtatttccta

SEQ ID NO: 820390 - DNA, 25 bp, Mus musculus
tcctgatataccaaagggcctccgt

SEQ ID NO: 820391 - DNA, 25 bp, Mus musculus
tcctgatatacctaagggcctccgt

SEQ ID NO: 820392 - DNA, 25 bp, Mus musculus
tcctgatattctacttgggttgtaa

SEQ ID NO: 820393 - DNA, 25 bp, Mus musculus
tcctgatattcttcttgggttgtaa

SEQ ID NO: 820394 - DNA, 25 bp, Mus musculus
tcctgatcatcacttagagttctgt

SEQ ID NO: 820395 - DNA, 25 bp, Mus musculus
tcctgatcatcagttagagttctgt

SEQ ID NO: 820396 - DNA, 25 bp, Mus musculus
tcctgatcatgacgacagtgagctc

SEQ ID NO: 820397 - DNA, 25 bp, Mus musculus
tcctgatcatgaggacagtgagctc

SEQ ID NO: 820398 - DNA, 25 bp, Mus musculus
tcctgatccaagaatgtcccttatt

SEQ ID NO: 820399 - DNA, 25 bp, Mus musculus
tcctgatccaagtatgtcccttatt

SEQ ID NO: 820400 - DNA, 25 bp, Mus musculus
tcctgatccaccaggcagggtttcc

SEQ ID NO: 820401 - DNA, 25 bp, Mus musculus
tcctgatccacctggcagggtttcc

SEQ ID NO: 820402 - DNA, 25 bp, Mus musculus
tcctgatcccctctaggactaaaag

SEQ ID NO: 820403 - DNA, 25 bp, Mus musculus
tcctgatcccctgtaggactaaaag

SEQ ID NO: 820404 - DNA, 25 bp, Mus musculus
tcctgatcccttacagcggttaaaa

SEQ ID NO: 820405 - DNA, 25 bp, Mus musculus
tcctgatcccttcctacccaggatt

SEQ ID NO: 820406 - DNA, 25 bp, Mus musculus
tcctgatcccttgctacccaggatt

SEQ ID NO: 820407 - DNA, 25 bp, Mus musculus
tcctgatccctttcagcggttaaaa

SEQ ID NO: 820408 - DNA, 25 bp, Mus musculus
tcctgatcctctatcccaagtgtta

SEQ ID NO: 820409 - DNA, 25 bp, Mus musculus
tcctgatcctctttcccaagtgtta

SEQ ID NO: 820410 - DNA, 25 bp, Mus musculus
tcctgatcctgtctgcaactagctt

SEQ ID NO: 820411 - DNA, 25 bp, Mus musculus
tcctgatcctgtgtgcaactagctt

SEQ ID NO: 820412 - DNA, 25 bp, Mus musculus
tcctgatctcagaatggtgccgttc

SEQ ID NO: 820413 - DNA, 25 bp, Mus musculus
tcctgatctcagtatggtgccgttc

SEQ ID NO: 820414 - DNA, 25 bp, Mus musculus
tcctgatctgagaggcatgctacaa

SEQ ID NO: 820415 - DNA, 25 bp, Mus musculus
tcctgatctgagtggcatgctacaa

SEQ ID NO: 820416 - DNA, 25 bp, Mus musculus
tcctgatgcaaaaccttcgtctctt

SEQ ID NO: 820417 - DNA, 25 bp, Mus musculus
tcctgatgcaaatccttcgtctctt

SEQ ID NO: 820418 - DNA, 25 bp, Mus musculus
tcctgatgctacagccggaggagtg

SEQ ID NO: 820419 - DNA, 25 bp, Mus musculus
tcctgatgctactgccggaggagtg

SEQ ID NO: 820420 - DNA, 25 bp, Mus musculus
tcctgatgctagataggacagcatg

SEQ ID NO: 820421 - DNA, 25 bp, Mus musculus
tcctgatgctagttaggacagcatg

SEQ ID NO: 820422 - DNA, 25 bp, Mus musculus
tcctgatgctgcactggtacacaca

SEQ ID NO: 820423 - DNA, 25 bp, Mus musculus
tcctgatgctgctctggtacacaca

SEQ ID NO: 820424 - DNA, 25 bp, Mus musculus
tcctgatgcttaaatcctgaagata

SEQ ID NO: 820425 - DNA, 25 bp, Mus musculus
tcctgatgcttatatcctgaagata

SEQ ID NO: 820426 - DNA, 25 bp, Mus musculus
tcctgatgggcaattcttagagaga

SEQ ID NO: 820427 - DNA, 25 bp, Mus musculus
tcctgatgggcactcgacggactga

SEQ ID NO: 820428 - DNA, 25 bp, Mus musculus
tcctgatgggcagtcgacggactga

SEQ ID NO: 820429 - DNA, 25 bp, Mus musculus
tcctgatgggcatttcttagagaga

SEQ ID NO: 820430 - DNA, 25 bp, Mus musculus
tcctgatgggctaatgctgtcgcag

SEQ ID NO: 820431 - DNA, 25 bp, Mus musculus
tcctgatgggcttatgctgtcgcag

SEQ ID NO: 820432 - DNA, 25 bp, Mus musculus
tcctgatggtggatttaatgatcta

SEQ ID NO: 820433 - DNA, 25 bp, Mus musculus
tcctgatggtggttttaatgatcta

SEQ ID NO: 820434 - DNA, 25 bp, Mus musculus
tcctgatgtattattgttcactatt

SEQ ID NO: 820435 - DNA, 25 bp, Mus musculus
tcctgatgtatttttgttcactatt

SEQ ID NO: 820436 - DNA, 25 bp, Mus musculus
tcctgattatgaagccctagatgtt

SEQ ID NO: 820437 - DNA, 25 bp, Mus musculus
tcctgattatgatgccctagatgtt

SEQ ID NO: 820438 - DNA, 25 bp, Mus musculus
tcctgattatttatggaattccatt

SEQ ID NO: 820439 - DNA, 25 bp, Mus musculus
tcctgattatttttggaattccatt

SEQ ID NO: 820440 - DNA, 25 bp, Mus musculus
tcctgattcagaccctccaaaagag

SEQ ID NO: 820441 - DNA, 25 bp, Mus musculus
tcctgattcagagcctccaaaagag

SEQ ID NO: 820442 - DNA, 25 bp, Mus musculus
tcctgattccagacggtgccaacgt

SEQ ID NO: 820443 - DNA, 25 bp, Mus musculus
tcctgattccagtcggtgccaacgt

SEQ ID NO: 820444 - DNA, 25 bp, Mus musculus
tcctgattcgtcctggacccaaatt

SEQ ID NO: 820445 - DNA, 25 bp, Mus musculus
tcctgattcgtcgtggacccaaatt

SEQ ID NO: 820446 - DNA, 25 bp, Mus musculus
tcctgattctcaccctattctgttg

SEQ ID NO: 820447 - DNA, 25 bp, Mus musculus
tcctgattctcagcctattctgttg

SEQ ID NO: 820448 - DNA, 25 bp, Mus musculus
tcctgattctgcagctgttgggcac

SEQ ID NO: 820449 - DNA, 25 bp, Mus musculus
tcctgattctgctgctgttgggcac

SEQ ID NO: 820450 - DNA, 25 bp, Mus musculus
tcctgattctgtccttaattctgga

SEQ ID NO: 820451 - DNA, 25 bp, Mus musculus
tcctgattctgtgcttaattctgga

SEQ ID NO: 820452 - DNA, 25 bp, Mus musculus
tcctgattggccaccaagacttgtt

SEQ ID NO: 820453 - DNA, 25 bp, Mus musculus
tcctgattggcctccaagacttgtt

SEQ ID NO: 820454 - DNA, 25 bp, Mus musculus
tcctgattgtggacgtagccatgac

SEQ ID NO: 820455 - DNA, 25 bp, Mus musculus
tcctgattgtggtcgtagccatgac

SEQ ID NO: 820456 - DNA, 25 bp, Mus musculus
tcctgattgttcactggttgctaca

SEQ ID NO: 820457 - DNA, 25 bp, Mus musculus
tcctgattgttctctggttgctaca

SEQ ID NO: 820458 - DNA, 25 bp, Mus musculus
tcctgattgtttacattccctcgtg

SEQ ID NO: 820459 - DNA, 25 bp, Mus musculus
tcctgattgttttcattccctcgtg

SEQ ID NO: 820460 - DNA, 25 bp, Mus musculus
tcctgatttataacctttagtaagt

SEQ ID NO: 820461 - DNA, 25 bp, Mus musculus
tcctgatttatatcctttagtaagt

SEQ ID NO: 820462 - DNA, 25 bp, Mus musculus
tcctgatttcttagtatcagtatag

SEQ ID NO: 820463 - DNA, 25 bp, Mus musculus
tcctgatttctttgtatcagtatag

SEQ ID NO: 820464 - DNA, 25 bp, Mus musculus
tcctgatttgatagtcgcctggaga

SEQ ID NO: 820465 - DNA, 25 bp, Mus musculus
tcctgatttgattgtcgcctggaga

SEQ ID NO: 820466 - DNA, 25 bp, Mus musculus
tcctgatttgtgactcttccttttg

SEQ ID NO: 820467 - DNA, 25 bp, Mus musculus
tcctgatttgtgtctcttccttttg

SEQ ID NO: 820468 - DNA, 25 bp, Mus musculus
tcctgcaaaaagagtgaacaggcct

SEQ ID NO: 820469 - DNA, 25 bp, Mus musculus
tcctgcaaaaagtgtgaacaggcct

SEQ ID NO: 820470 - DNA, 25 bp, Mus musculus
tcctgcaaaactacctatgtccatt

SEQ ID NO: 820471 - DNA, 25 bp, Mus musculus
tcctgcaaaacttcctatgtccatt

SEQ ID NO: 820472 - DNA, 25 bp, Mus musculus
tcctgcaaacttccctgggtgagtg

SEQ ID NO: 820473 - DNA, 25 bp, Mus musculus
tcctgcaaacttgcctgggtgagtg

SEQ ID NO: 820474 - DNA, 25 bp, Mus musculus
tcctgcaaaggtcaagctacttgta

SEQ ID NO: 820475 - DNA, 25 bp, Mus musculus
tcctgcaaaggtgaagctacttgta

SEQ ID NO: 820476 - DNA, 25 bp, Mus musculus
tcctgcaaattgacaactgaccaat

SEQ ID NO: 820477 - DNA, 25 bp, Mus musculus
tcctgcaaattgtcaactgaccaat

SEQ ID NO: 820478 - DNA, 25 bp, Mus musculus
tcctgcaacctaccttatttgaatc

SEQ ID NO: 820479 - DNA, 25 bp, Mus musculus
tcctgcaacctagcttatttgaatc

SEQ ID NO: 820480 - DNA, 25 bp, Mus musculus
tcctgcaacgccaaaaacctgagat

SEQ ID NO: 820481 - DNA, 25 bp, Mus musculus
tcctgcaacgcctaaaacctgagat

SEQ ID NO: 820482 - DNA, 25 bp, Mus musculus
tcctgcaagcagacagtgatcactt

SEQ ID NO: 820483 - DNA, 25 bp, Mus musculus
tcctgcaagcagtcagtgatcactt

SEQ ID NO: 820484 - DNA, 25 bp, Mus musculus
tcctgcaaggacactgagcctccgg

SEQ ID NO: 820485 - DNA, 25 bp, Mus musculus
tcctgcaaggactctgagcctccgg

SEQ ID NO: 820486 - DNA, 25 bp, Mus musculus
tcctgcaatcaactcctagacttag

SEQ ID NO: 820487 - DNA, 25 bp, Mus musculus
tcctgcaatcaagtcctagacttag

SEQ ID NO: 820488 - DNA, 25 bp, Mus musculus
tcctgcaatcctaaaacccgagagt

SEQ ID NO: 820489 - DNA, 25 bp, Mus musculus
tcctgcaatccttaaacccgagagt

SEQ ID NO: 820490 - DNA, 25 bp, Mus musculus
tcctgcacaagtcgtgtaatgacat

SEQ ID NO: 820491 - DNA, 25 bp, Mus musculus
tcctgcacaagtggtgtaatgacat

SEQ ID NO: 820492 - DNA, 25 bp, Mus musculus
tcctgcacaatgagtttctgcctca

SEQ ID NO: 820493 - DNA, 25 bp, Mus musculus
tcctgcacaatgtgtttctgcctca

SEQ ID NO: 820494 - DNA, 25 bp, Mus musculus
tcctgcacagctacacaatgtacag

SEQ ID NO: 820495 - DNA, 25 bp, Mus musculus
tcctgcacagcttcacaatgtacag

SEQ ID NO: 820496 - DNA, 25 bp, Mus musculus
tcctgcacaggactgttgtattttt

SEQ ID NO: 820497 - DNA, 25 bp, Mus musculus
tcctgcacaggagtgttgtattttt

SEQ ID NO: 820498 - DNA, 25 bp, Mus musculus
tcctgcacctgacggccatgttcat

SEQ ID NO: 820499 - DNA, 25 bp, Mus musculus
tcctgcacctgagggccatgttcat

SEQ ID NO: 820500 - DNA, 25 bp, Mus musculus
tcctgcacctggctagggccatagg

SEQ ID NO: 820501 - DNA, 25 bp, Mus musculus
tcctgcacctgggtagggccatagg

SEQ ID NO: 820502 - DNA, 25 bp, Mus musculus
tcctgcactcaactcccttaaatat

SEQ ID NO: 820503 - DNA, 25 bp, Mus musculus
tcctgcactcaagtcccttaaatat

SEQ ID NO: 820504 - DNA, 25 bp, Mus musculus
tcctgcactgccagtatgcaactga

SEQ ID NO: 820505 - DNA, 25 bp, Mus musculus
tcctgcactgcctgtatgcaactga

SEQ ID NO: 820506 - DNA, 25 bp, Mus musculus
tcctgcagacacaggcatcatctac

SEQ ID NO: 820507 - DNA, 25 bp, Mus musculus
tcctgcagacacagttatacctgcc

SEQ ID NO: 820508 - DNA, 25 bp, Mus musculus
tcctgcagacactggcatcatctac

SEQ ID NO: 820509 - DNA, 25 bp, Mus musculus
tcctgcagacactgttatacctgcc

SEQ ID NO: 820510 - DNA, 25 bp, Mus musculus
tcctgcagacctcctagattgcaaa

SEQ ID NO: 820511 - DNA, 25 bp, Mus musculus
tcctgcagacctgctagattgcaaa

SEQ ID NO: 820512 - DNA, 25 bp, Mus musculus
tcctgcagcaggaaagcctaatttt

SEQ ID NO: 820513 - DNA, 25 bp, Mus musculus
tcctgcagcaggtaagcctaatttt

SEQ ID NO: 820514 - DNA, 25 bp, Mus musculus
tcctgcagcatcatgtcataattaa

SEQ ID NO: 820515 - DNA, 25 bp, Mus musculus
tcctgcagcatcttgtcataattaa

SEQ ID NO: 820516 - DNA, 25 bp, Mus musculus
tcctgcagcatgaggtactggcggc

SEQ ID NO: 820517 - DNA, 25 bp, Mus musculus
tcctgcagcatgtggtactggcggc

SEQ ID NO: 820518 - DNA, 25 bp, Mus musculus
tcctgcagctagactttgactttga

SEQ ID NO: 820519 - DNA, 25 bp, Mus musculus
tcctgcagctagtctttgactttga

SEQ ID NO: 820520 - DNA, 25 bp, Mus musculus
tcctgcagctgtcagctcctgacag

SEQ ID NO: 820521 - DNA, 25 bp, Mus musculus
tcctgcagctgtgagctcctgacag

SEQ ID NO: 820522 - DNA, 25 bp, Mus musculus
tcctgcagcttgcagtactgcactg

SEQ ID NO: 820523 - DNA, 25 bp, Mus musculus
tcctgcagcttggagtactgcactg

SEQ ID NO: 820524 - DNA, 25 bp, Mus musculus
tcctgcaggcacagtgggactcgag

SEQ ID NO: 820525 - DNA, 25 bp, Mus musculus
tcctgcaggcactgtgggactcgag

SEQ ID NO: 820526 - DNA, 25 bp, Mus musculus
tcctgcagggagagtcttacccagc

SEQ ID NO: 820527 - DNA, 25 bp, Mus musculus
tcctgcagggagtgtcttacccagc

SEQ ID NO: 820528 - DNA, 25 bp, Mus musculus
tcctgcaggtaaatgctattggtga

SEQ ID NO: 820529 - DNA, 25 bp, Mus musculus
tcctgcaggtaattgctattggtga

SEQ ID NO: 820530 - DNA, 25 bp, Mus musculus
tcctgcaggtctatgacgcttctaa

SEQ ID NO: 820531 - DNA, 25 bp, Mus musculus
tcctgcaggtctttgacgcttctaa

SEQ ID NO: 820532 - DNA, 25 bp, Mus musculus
tcctgcagtcggagctggtgaacta

SEQ ID NO: 820533 - DNA, 25 bp, Mus musculus
tcctgcagtcggtgctggtgaacta

SEQ ID NO: 820534 - DNA, 25 bp, Mus musculus
tcctgcagtctaactacacctatgt

SEQ ID NO: 820535 - DNA, 25 bp, Mus musculus
tcctgcagtctatctacacctatgt

SEQ ID NO: 820536 - DNA, 25 bp, Mus musculus
tcctgcagtgccagctgactcattt

SEQ ID NO: 820537 - DNA, 25 bp, Mus musculus
tcctgcagtgcctgctgactcattt

SEQ ID NO: 820538 - DNA, 25 bp, Mus musculus
tcctgcagtgctcagggaaaaggct

SEQ ID NO: 820539 - DNA, 25 bp, Mus musculus
tcctgcagtgctgagggaaaaggct

SEQ ID NO: 820540 - DNA, 25 bp, Mus musculus
tcctgcagtgtgagctctagtgcca

SEQ ID NO: 820541 - DNA, 25 bp, Mus musculus
tcctgcagtgtgtgctctagtgcca

SEQ ID NO: 820542 - DNA, 25 bp, Mus musculus
tcctgcagttggaccagtgtccagg

SEQ ID NO: 820543 - DNA, 25 bp, Mus musculus
tcctgcagttggtccagtgtccagg

SEQ ID NO: 820544 - DNA, 25 bp, Mus musculus
tcctgcagtttccaggacagagtgg

SEQ ID NO: 820545 - DNA, 25 bp, Mus musculus
tcctgcagtttcgaggacagagtgg

SEQ ID NO: 820546 - DNA, 25 bp, Mus musculus
tcctgcatcagtactcttgagagag

SEQ ID NO: 820547 - DNA, 25 bp, Mus musculus
tcctgcatcagttctcttgagagag

SEQ ID NO: 820548 - DNA, 25 bp, Mus musculus
tcctgcatcgatcatttttaccctc

SEQ ID NO: 820549 - DNA, 25 bp, Mus musculus
tcctgcatcgatgatttttaccctc

SEQ ID NO: 820550 - DNA, 25 bp, Mus musculus
tcctgcatctggcaagctgtggcag

SEQ ID NO: 820551 - DNA, 25 bp, Mus musculus
tcctgcatctgggaagctgtggcag

SEQ ID NO: 820552 - DNA, 25 bp, Mus musculus
tcctgcatcttgatccagttaacat

SEQ ID NO: 820553 - DNA, 25 bp, Mus musculus
tcctgcatcttgttccagttaacat

SEQ ID NO: 820554 - DNA, 25 bp, Mus musculus
tcctgcatgaaaacagtggccggtg

SEQ ID NO: 820555 - DNA, 25 bp, Mus musculus
tcctgcatgaaatcagtggccggtg

SEQ ID NO: 820556 - DNA, 25 bp, Mus musculus
tcctgcatgcttcagccacttaaaa

SEQ ID NO: 820557 - DNA, 25 bp, Mus musculus
tcctgcatgcttgagccacttaaaa

SEQ ID NO: 820558 - DNA, 25 bp, Mus musculus
tcctgcattagaataagcctgtttc

SEQ ID NO: 820559 - DNA, 25 bp, Mus musculus
tcctgcattagattaagcctgtttc

SEQ ID NO: 820560 - DNA, 25 bp, Mus musculus
tcctgcattgaactttttaatttta

SEQ ID NO: 820561 - DNA, 25 bp, Mus musculus
tcctgcattgaagtttttaatttta

SEQ ID NO: 820562 - DNA, 25 bp, Mus musculus
tcctgcattgacacttagaacctta

SEQ ID NO: 820563 - DNA, 25 bp, Mus musculus
tcctgcattgactcttagaacctta

SEQ ID NO: 820564 - DNA, 25 bp, Mus musculus
tcctgcattggacaactgactgagc

SEQ ID NO: 820565 - DNA, 25 bp, Mus musculus
tcctgcattggagaactgactgagc

SEQ ID NO: 820566 - DNA, 25 bp, Mus musculus
tcctgcattgtgagaggctggtcct

SEQ ID NO: 820567 - DNA, 25 bp, Mus musculus
tcctgcattgtgtgaggctggtcct

SEQ ID NO: 820568 - DNA, 25 bp, Mus musculus
tcctgccaagaaatccttccttaga

SEQ ID NO: 820569 - DNA, 25 bp, Mus musculus
tcctgccaagaattccttccttaga

SEQ ID NO: 820570 - DNA, 25 bp, Mus musculus
tcctgccaattccactaagtctaag

SEQ ID NO: 820571 - DNA, 25 bp, Mus musculus
tcctgccaattcgactaagtctaag

SEQ ID NO: 820572 - DNA, 25 bp, Mus musculus
tcctgccacacccttaagttcagta

SEQ ID NO: 820573 - DNA, 25 bp, Mus musculus
tcctgccacaccgttaagttcagta

SEQ ID NO: 820574 - DNA, 25 bp, Mus musculus
tcctgccacatcagtgtgtctatta

SEQ ID NO: 820575 - DNA, 25 bp, Mus musculus
tcctgccacatctgtgtgtctatta

SEQ ID NO: 820576 - DNA, 25 bp, Mus musculus
tcctgccacccactcctcgagatgg

SEQ ID NO: 820577 - DNA, 25 bp, Mus musculus
tcctgccacccagtcctcgagatgg

SEQ ID NO: 820578 - DNA, 25 bp, Mus musculus
tcctgccacctgaagtctaaactta

SEQ ID NO: 820579 - DNA, 25 bp, Mus musculus
tcctgccacctgtagtctaaactta

SEQ ID NO: 820580 - DNA, 25 bp, Mus musculus
tcctgccacgacatgtttgattttc

SEQ ID NO: 820581 - DNA, 25 bp, Mus musculus
tcctgccacgacttgtttgattttc

SEQ ID NO: 820582 - DNA, 25 bp, Mus musculus
tcctgccagggaatctgagacgcaa

SEQ ID NO: 820583 - DNA, 25 bp, Mus musculus
tcctgccagggattctgagacgcaa

SEQ ID NO: 820584 - DNA, 25 bp, Mus musculus
tcctgccatgataagacctgctttt

SEQ ID NO: 820585 - DNA, 25 bp, Mus musculus
tcctgccatgattagacctgctttt

SEQ ID NO: 820586 - DNA, 25 bp, Mus musculus
tcctgccatgggactgccccatgta

SEQ ID NO: 820587 - DNA, 25 bp, Mus musculus
tcctgccatgggtctgccccatgta

SEQ ID NO: 820588 - DNA, 25 bp, Mus musculus
tcctgccattcactgtaaacattca

SEQ ID NO: 820589 - DNA, 25 bp, Mus musculus
tcctgccattcagtgtaaacattca

SEQ ID NO: 820590 - DNA, 25 bp, Mus musculus
tcctgccattttctaagtgattacg

SEQ ID NO: 820591 - DNA, 25 bp, Mus musculus
tcctgccattttgtaagtgattacg

SEQ ID NO: 820592 - DNA, 25 bp, Mus musculus
tcctgcccaacactctcaaaagatt

SEQ ID NO: 820593 - DNA, 25 bp, Mus musculus
tcctgcccaacagtctcaaaagatt

SEQ ID NO: 820594 - DNA, 25 bp, Mus musculus
tcctgcccacctacatgtgatttat

SEQ ID NO: 820595 - DNA, 25 bp, Mus musculus
tcctgcccaccttcatgtgatttat

SEQ ID NO: 820596 - DNA, 25 bp, Mus musculus
tcctgcccagaaaccggtggaagtc

SEQ ID NO: 820597 - DNA, 25 bp, Mus musculus
tcctgcccagaatccggtggaagtc

SEQ ID NO: 820598 - DNA, 25 bp, Mus musculus
tcctgcccagttctatacgctgaag

SEQ ID NO: 820599 - DNA, 25 bp, Mus musculus
tcctgcccagttgtatacgctgaag

SEQ ID NO: 820600 - DNA, 25 bp, Mus musculus
tcctgccccgagacaaagatccaat

SEQ ID NO: 820601 - DNA, 25 bp, Mus musculus
tcctgccccgagtcaaagatccaat

SEQ ID NO: 820602 - DNA, 25 bp, Mus musculus
tcctgcccgactcaggttatgacat

SEQ ID NO: 820603 - DNA, 25 bp, Mus musculus
tcctgcccgactgaggttatgacat

SEQ ID NO: 820604 - DNA, 25 bp, Mus musculus
tcctgcccggatctaaaactttgta

SEQ ID NO: 820605 - DNA, 25 bp, Mus musculus
tcctgcccggatgtaaaactttgta

SEQ ID NO: 820606 - DNA, 25 bp, Mus musculus
tcctgcccgggaatcgttcctttgt

SEQ ID NO: 820607 - DNA, 25 bp, Mus musculus
tcctgcccgggattcgttcctttgt

SEQ ID NO: 820608 - DNA, 25 bp, Mus musculus
tcctgccctaagcagaggctttgtt

SEQ ID NO: 820609 - DNA, 25 bp, Mus musculus
tcctgccctaaggagaggctttgtt

SEQ ID NO: 820610 - DNA, 25 bp, Mus musculus
tcctgccctacaacaggctctaagg

SEQ ID NO: 820611 - DNA, 25 bp, Mus musculus
tcctgccctacatcaggctctaagg

SEQ ID NO: 820612 - DNA, 25 bp, Mus musculus
tcctgccctatgcttgtttatgcga

SEQ ID NO: 820613 - DNA, 25 bp, Mus musculus
tcctgccctatggttgtttatgcga

SEQ ID NO: 820614 - DNA, 25 bp, Mus musculus
tcctgccctgaaaatgccatcatac

SEQ ID NO: 820615 - DNA, 25 bp, Mus musculus
tcctgccctgaatatgccatcatac

SEQ ID NO: 820616 - DNA, 25 bp, Mus musculus
tcctgccctgcgacgttctagtcag

SEQ ID NO: 820617 - DNA, 25 bp, Mus musculus
tcctgccctgcgtcgttctagtcag

SEQ ID NO: 820618 - DNA, 25 bp, Mus musculus
tcctgcccttctccatagggtagct

SEQ ID NO: 820619 - DNA, 25 bp, Mus musculus
tcctgcccttctcttgtgatttata

SEQ ID NO: 820620 - DNA, 25 bp, Mus musculus
tcctgcccttctgcatagggtagct

SEQ ID NO: 820621 - DNA, 25 bp, Mus musculus
tcctgcccttctgttgtgatttata

SEQ ID NO: 820622 - DNA, 25 bp, Mus musculus
tcctgccctttaccagtgcaacatg

SEQ ID NO: 820623 - DNA, 25 bp, Mus musculus
tcctgccctttagcagtgcaacatg

SEQ ID NO: 820624 - DNA, 25 bp, Mus musculus
tcctgccggcaaaacagttcagttt

SEQ ID NO: 820625 - DNA, 25 bp, Mus musculus
tcctgccggcaatacagttcagttt

SEQ ID NO: 820626 - DNA, 25 bp, Mus musculus
tcctgccgggtcagagtattgtaaa

SEQ ID NO: 820627 - DNA, 25 bp, Mus musculus
tcctgccgggtctgagtattgtaaa

SEQ ID NO: 820628 - DNA, 25 bp, Mus musculus
tcctgccggtgactaaagtctgttt

SEQ ID NO: 820629 - DNA, 25 bp, Mus musculus
tcctgccggtgagtaaagtctgttt

SEQ ID NO: 820630 - DNA, 25 bp, Mus musculus
tcctgcctacagctgcagactgttt

SEQ ID NO: 820631 - DNA, 25 bp, Mus musculus
tcctgcctacaggtgcagactgttt

SEQ ID NO: 820632 - DNA, 25 bp, Mus musculus
tcctgcctagcactcaagcatgcat

SEQ ID NO: 820633 - DNA, 25 bp, Mus musculus
tcctgcctagcagtcaagcatgcat

SEQ ID NO: 820634 - DNA, 25 bp, Mus musculus
tcctgcctattccataccatttgaa

SEQ ID NO: 820635 - DNA, 25 bp, Mus musculus
tcctgcctattcgataccatttgaa

SEQ ID NO: 820636 - DNA, 25 bp, Mus musculus
tcctgcctcaacaaagcctcatgat

SEQ ID NO: 820637 - DNA, 25 bp, Mus musculus
tcctgcctcaacaagaacaccgagg

SEQ ID NO: 820638 - DNA, 25 bp, Mus musculus
tcctgcctcaactaagcctcatgat

SEQ ID NO: 820639 - DNA, 25 bp, Mus musculus
tcctgcctcaactagaacaccgagg

SEQ ID NO: 820640 - DNA, 25 bp, Mus musculus
tcctgcctcacaaattggggttatt

SEQ ID NO: 820641 - DNA, 25 bp, Mus musculus
tcctgcctcacatattggggttatt

SEQ ID NO: 820642 - DNA, 25 bp, Mus musculus
tcctgcctccagcataaagggctta

SEQ ID NO: 820643 - DNA, 25 bp, Mus musculus
tcctgcctccaggataaagggctta

SEQ ID NO: 820644 - DNA, 25 bp, Mus musculus
tcctgcctcctgattctggaatgaa

SEQ ID NO: 820645 - DNA, 25 bp, Mus musculus
tcctgcctcctgtttctggaatgaa

SEQ ID NO: 820646 - DNA, 25 bp, Mus musculus
tcctgcctgaaaacacctgtatttt

SEQ ID NO: 820647 - DNA, 25 bp, Mus musculus
tcctgcctgaaatcacctgtatttt

SEQ ID NO: 820648 - DNA, 25 bp, Mus musculus
tcctgcctgactcgaagctgcacat

SEQ ID NO: 820649 - DNA, 25 bp, Mus musculus
tcctgcctgactggaagctgcacat

SEQ ID NO: 820650 - DNA, 25 bp, Mus musculus
tcctgcctgcatagaaacagagcct

SEQ ID NO: 820651 - DNA, 25 bp, Mus musculus
tcctgcctgcatctgttttgtgaaa

SEQ ID NO: 820652 - DNA, 25 bp, Mus musculus
tcctgcctgcatgtgttttgtgaaa

SEQ ID NO: 820653 - DNA, 25 bp, Mus musculus
tcctgcctgcattgaaacagagcct

SEQ ID NO: 820654 - DNA, 25 bp, Mus musculus
tcctgcctggcaattgataccatta

SEQ ID NO: 820655 - DNA, 25 bp, Mus musculus
tcctgcctggcatttgataccatta

SEQ ID NO: 820656 - DNA, 25 bp, Mus musculus
tcctgcctgggaattgcttttagac

SEQ ID NO: 820657 - DNA, 25 bp, Mus musculus
tcctgcctgggatttgcttttagac

SEQ ID NO: 820658 - DNA, 25 bp, Mus musculus
tcctgcctggtcctttattacatgg

SEQ ID NO: 820659 - DNA, 25 bp, Mus musculus
tcctgcctggtcgtttattacatgg

SEQ ID NO: 820660 - DNA, 25 bp, Mus musculus
tcctgcctgtgaaacctcagtgtgc

SEQ ID NO: 820661 - DNA, 25 bp, Mus musculus
tcctgcctgtgatacctcagtgtgc

SEQ ID NO: 820662 - DNA, 25 bp, Mus musculus
tcctgcctgttcatcaagagtatgt

SEQ ID NO: 820663 - DNA, 25 bp, Mus musculus
tcctgcctgttcttcaagagtatgt

SEQ ID NO: 820664 - DNA, 25 bp, Mus musculus
tcctgccttacccttaaatatcaat

SEQ ID NO: 820665 - DNA, 25 bp, Mus musculus
tcctgccttaccgttaaatatcaat

SEQ ID NO: 820666 - DNA, 25 bp, Mus musculus
tcctgccttactaaactttccttga

SEQ ID NO: 820667 - DNA, 25 bp, Mus musculus
tcctgccttacttaactttccttga

SEQ ID NO: 820668 - DNA, 25 bp, Mus musculus
tcctgccttagcatcaatagggcta

SEQ ID NO: 820669 - DNA, 25 bp, Mus musculus
tcctgccttagcttcaatagggcta

SEQ ID NO: 820670 - DNA, 25 bp, Mus musculus
tcctgccttataatctcatgggaag

SEQ ID NO: 820671 - DNA, 25 bp, Mus musculus
tcctgccttatattctcatgggaag

SEQ ID NO: 820672 - DNA, 25 bp, Mus musculus
tcctgccttattctcgtctttaaga

SEQ ID NO: 820673 - DNA, 25 bp, Mus musculus
tcctgccttattgtcgtctttaaga

SEQ ID NO: 820674 - DNA, 25 bp, Mus musculus
tcctgccttggaactgtgtgtggaa

SEQ ID NO: 820675 - DNA, 25 bp, Mus musculus
tcctgccttggatctgtgtgtggaa

SEQ ID NO: 820676 - DNA, 25 bp, Mus musculus
tcctgcctttctatctatcaatttt

SEQ ID NO: 820677 - DNA, 25 bp, Mus musculus
tcctgcctttctttctatcaatttt

SEQ ID NO: 820678 - DNA, 25 bp, Mus musculus
tcctgcctttggaatcgtcagacta

SEQ ID NO: 820679 - DNA, 25 bp, Mus musculus
tcctgcctttggtatcgtcagacta

SEQ ID NO: 820680 - DNA, 25 bp, Mus musculus
tcctgccttttacctactgtgacta

SEQ ID NO: 820681 - DNA, 25 bp, Mus musculus
tcctgccttttagctactgtgacta

SEQ ID NO: 820682 - DNA, 25 bp, Mus musculus
tcctgcgcattcacacaagagtttc

SEQ ID NO: 820683 - DNA, 25 bp, Mus musculus
tcctgcgcattctcacaagagtttc

SEQ ID NO: 820684 - DNA, 25 bp, Mus musculus
tcctgcgcctgaacgctgttgggta

SEQ ID NO: 820685 - DNA, 25 bp, Mus musculus
tcctgcgcctgatcgctgttgggta

SEQ ID NO: 820686 - DNA, 25 bp, Mus musculus
tcctgcgcctgtcatggacaagtat

SEQ ID NO: 820687 - DNA, 25 bp, Mus musculus
tcctgcgcctgtgatggacaagtat

SEQ ID NO: 820688 - DNA, 25 bp, Mus musculus
tcctgcgcgtcaactccacgtgtgg

SEQ ID NO: 820689 - DNA, 25 bp, Mus musculus
tcctgcgcgtcatctccacgtgtgg

SEQ ID NO: 820690 - DNA, 25 bp, Mus musculus
tcctgcgcttcaaactgaagatcat

SEQ ID NO: 820691 - DNA, 25 bp, Mus musculus
tcctgcgcttcatactgaagatcat

SEQ ID NO: 820692 - DNA, 25 bp, Mus musculus
tcctgcggcagcacaaagggcggct

SEQ ID NO: 820693 - DNA, 25 bp, Mus musculus
tcctgcggcagctcaaagggcggct

SEQ ID NO: 820694 - DNA, 25 bp, Mus musculus
tcctgcggccaaactgagggagagt

SEQ ID NO: 820695 - DNA, 25 bp, Mus musculus
tcctgcggccaatctgagggagagt

SEQ ID NO: 820696 - DNA, 25 bp, Mus musculus
tcctgcgggacaacaccatgaggta

SEQ ID NO: 820697 - DNA, 25 bp, Mus musculus
tcctgcgggacatcaccatgaggta

SEQ ID NO: 820698 - DNA, 25 bp, Mus musculus
tcctgcggttggaggtaactgtgac

SEQ ID NO: 820699 - DNA, 25 bp, Mus musculus
tcctgcggttggtggtaactgtgac

SEQ ID NO: 820700 - DNA, 25 bp, Mus musculus
tcctgcggtttactgatgcctcaga

SEQ ID NO: 820701 - DNA, 25 bp, Mus musculus
tcctgcggtttagtgatgcctcaga

SEQ ID NO: 820702 - DNA, 25 bp, Mus musculus
tcctgcgtgactcgatgggctgcaa

SEQ ID NO: 820703 - DNA, 25 bp, Mus musculus
tcctgcgtgactggatgggctgcaa

SEQ ID NO: 820704 - DNA, 25 bp, Mus musculus
tcctgcgtgctgacatgacaagtgt

SEQ ID NO: 820705 - DNA, 25 bp, Mus musculus
tcctgcgtgctgtcatgacaagtgt

SEQ ID NO: 820706 - DNA, 25 bp, Mus musculus
tcctgcgttcatcactagctgagtc

SEQ ID NO: 820707 - DNA, 25 bp, Mus musculus
tcctgcgttcatgactagctgagtc

SEQ ID NO: 820708 - DNA, 25 bp, Mus musculus
tcctgctaagttcatgctcccctga

SEQ ID NO: 820709 - DNA, 25 bp, Mus musculus
tcctgctaagttgatgctcccctga

SEQ ID NO: 820710 - DNA, 25 bp, Mus musculus
tcctgctaattccttcctgagattt

SEQ ID NO: 820711 - DNA, 25 bp, Mus musculus
tcctgctaattcgttcctgagattt

SEQ ID NO: 820712 - DNA, 25 bp, Mus musculus
tcctgctacaagctgagtctaccag

SEQ ID NO: 820713 - DNA, 25 bp, Mus musculus
tcctgctacaaggtgagtctaccag

SEQ ID NO: 820714 - DNA, 25 bp, Mus musculus
tcctgctacagaattgaaccctcat

SEQ ID NO: 820715 - DNA, 25 bp, Mus musculus
tcctgctacagacatgcgctggttg

SEQ ID NO: 820716 - DNA, 25 bp, Mus musculus
tcctgctacagagatgcgctggttg

SEQ ID NO: 820717 - DNA, 25 bp, Mus musculus
tcctgctacagatttgaaccctcat

SEQ ID NO: 820718 - DNA, 25 bp, Mus musculus
tcctgctaccaacggttcttctttt

SEQ ID NO: 820719 - DNA, 25 bp, Mus musculus
tcctgctaccaagggttcttctttt

SEQ ID NO: 820720 - DNA, 25 bp, Mus musculus
tcctgctacctactgtcaatgacta

SEQ ID NO: 820721 - DNA, 25 bp, Mus musculus
tcctgctacctagtgtcaatgacta

SEQ ID NO: 820722 - DNA, 25 bp, Mus musculus
tcctgctacctcaaatgtatatgct

SEQ ID NO: 820723 - DNA, 25 bp, Mus musculus
tcctgctacctctaatgtatatgct

SEQ ID NO: 820724 - DNA, 25 bp, Mus musculus
tcctgctacctgagctaacagtgtg

SEQ ID NO: 820725 - DNA, 25 bp, Mus musculus
tcctgctacctgtgctaacagtgtg

SEQ ID NO: 820726 - DNA, 25 bp, Mus musculus
tcctgctacgtgcagctcaagacat

SEQ ID NO: 820727 - DNA, 25 bp, Mus musculus
tcctgctacgtggagctcaagacat

SEQ ID NO: 820728 - DNA, 25 bp, Mus musculus
tcctgctactacagccactgagaca

SEQ ID NO: 820729 - DNA, 25 bp, Mus musculus
tcctgctactactgccactgagaca

SEQ ID NO: 820730 - DNA, 25 bp, Mus musculus
tcctgctagcacagcgattacaaat

SEQ ID NO: 820731 - DNA, 25 bp, Mus musculus
tcctgctagcactgcgattacaaat

SEQ ID NO: 820732 - DNA, 25 bp, Mus musculus
tcctgctatcttcacaggcaaggaa

SEQ ID NO: 820733 - DNA, 25 bp, Mus musculus
tcctgctatcttgacaggcaaggaa

SEQ ID NO: 820734 - DNA, 25 bp, Mus musculus
tcctgctatgtaacaggtgctcaat

SEQ ID NO: 820735 - DNA, 25 bp, Mus musculus
tcctgctatgtatcaggtgctcaat

SEQ ID NO: 820736 - DNA, 25 bp, Mus musculus
tcctgctcaagaccggcacgtgcat

SEQ ID NO: 820737 - DNA, 25 bp, Mus musculus
tcctgctcaagagcggcacgtgcat

SEQ ID NO: 820738 - DNA, 25 bp, Mus musculus
tcctgctcaagcaggaatgggctgc

SEQ ID NO: 820739 - DNA, 25 bp, Mus musculus
tcctgctcaagctggaatgggctgc

SEQ ID NO: 820740 - DNA, 25 bp, Mus musculus
tcctgctcactcaggttaattgtat

SEQ ID NO: 820741 - DNA, 25 bp, Mus musculus
tcctgctcactctggttaattgtat

SEQ ID NO: 820742 - DNA, 25 bp, Mus musculus
tcctgctcaggaacttggtatttag

SEQ ID NO: 820743 - DNA, 25 bp, Mus musculus
tcctgctcaggatcttggtatttag

SEQ ID NO: 820744 - DNA, 25 bp, Mus musculus
tcctgctcagtgattgatagctgtt

SEQ ID NO: 820745 - DNA, 25 bp, Mus musculus
tcctgctcagtgtttgatagctgtt

SEQ ID NO: 820746 - DNA, 25 bp, Mus musculus
tcctgctccactactgcgaggtttt

SEQ ID NO: 820747 - DNA, 25 bp, Mus musculus
tcctgctccacttctgcgaggtttt

SEQ ID NO: 820748 - DNA, 25 bp, Mus musculus
tcctgctccagtactggcactggtg

SEQ ID NO: 820749 - DNA, 25 bp, Mus musculus
tcctgctccagttctggcactggtg

SEQ ID NO: 820750 - DNA, 25 bp, Mus musculus
tcctgctcctcactctgaaaagata

SEQ ID NO: 820751 - DNA, 25 bp, Mus musculus
tcctgctcctcagtctgaaaagata

SEQ ID NO: 820752 - DNA, 25 bp, Mus musculus
tcctgctcctgcctttcaagtaaca

SEQ ID NO: 820753 - DNA, 25 bp, Mus musculus
tcctgctcctgcgtttcaagtaaca

SEQ ID NO: 820754 - DNA, 25 bp, Mus musculus
tcctgctcggttactctttgtaaac

SEQ ID NO: 820755 - DNA, 25 bp, Mus musculus
tcctgctcggtttctctttgtaaac

SEQ ID NO: 820756 - DNA, 25 bp, Mus musculus
tcctgctctaatcaccaccttgtaa

SEQ ID NO: 820757 - DNA, 25 bp, Mus musculus
tcctgctctaatgaccaccttgtaa

SEQ ID NO: 820758 - DNA, 25 bp, Mus musculus
tcctgctctgtcacaaagggttttg

SEQ ID NO: 820759 - DNA, 25 bp, Mus musculus
tcctgctctgtctcaaagggttttg

SEQ ID NO: 820760 - DNA, 25 bp, Mus musculus
tcctgctcttaaagactaccagatt

SEQ ID NO: 820761 - DNA, 25 bp, Mus musculus
tcctgctcttaatgactaccagatt

SEQ ID NO: 820762 - DNA, 25 bp, Mus musculus
tcctgctcttccagttcacaaagcg

SEQ ID NO: 820763 - DNA, 25 bp, Mus musculus
tcctgctcttcctgttcacaaagcg

SEQ ID NO: 820764 - DNA, 25 bp, Mus musculus
tcctgctctttcacgggcgctgtac

SEQ ID NO: 820765 - DNA, 25 bp, Mus musculus
tcctgctctttctcgggcgctgtac

SEQ ID NO: 820766 - DNA, 25 bp, Mus musculus
tcctgctcttttccatgtctactaa

SEQ ID NO: 820767 - DNA, 25 bp, Mus musculus
tcctgctcttttgcatgtctactaa

SEQ ID NO: 820768 - DNA, 25 bp, Mus musculus
tcctgctgaagtaggccagagactt

SEQ ID NO: 820769 - DNA, 25 bp, Mus musculus
tcctgctgaagttggccagagactt

SEQ ID NO: 820770 - DNA, 25 bp, Mus musculus
tcctgctgacctctagataattatt

SEQ ID NO: 820771 - DNA, 25 bp, Mus musculus
tcctgctgacctctatctaactaat

SEQ ID NO: 820772 - DNA, 25 bp, Mus musculus
tcctgctgacctgtagataattatt

SEQ ID NO: 820773 - DNA, 25 bp, Mus musculus
tcctgctgacctgtatctaactaat

SEQ ID NO: 820774 - DNA, 25 bp, Mus musculus
tcctgctgcccaagtttctgtgcaa

SEQ ID NO: 820775 - DNA, 25 bp, Mus musculus
tcctgctgcccacaagtattactac

SEQ ID NO: 820776 - DNA, 25 bp, Mus musculus
tcctgctgcccagaagtattactac

SEQ ID NO: 820777 - DNA, 25 bp, Mus musculus
tcctgctgcccatgtttctgtgcaa

SEQ ID NO: 820778 - DNA, 25 bp, Mus musculus
tcctgctgcctcactgggatgacat

SEQ ID NO: 820779 - DNA, 25 bp, Mus musculus
tcctgctgcctctctgggatgacat

SEQ ID NO: 820780 - DNA, 25 bp, Mus musculus
tcctgctgctcccagaagtgggaat

SEQ ID NO: 820781 - DNA, 25 bp, Mus musculus
tcctgctgctccgagaagtgggaat

SEQ ID NO: 820782 - DNA, 25 bp, Mus musculus
tcctgctgctctcatctgatagatg

SEQ ID NO: 820783 - DNA, 25 bp, Mus musculus
tcctgctgctctgatctgatagatg

SEQ ID NO: 820784 - DNA, 25 bp, Mus musculus
tcctgctgctgactgtgaattctga

SEQ ID NO: 820785 - DNA, 25 bp, Mus musculus
tcctgctgctgagtgtgaattctga

SEQ ID NO: 820786 - DNA, 25 bp, Mus musculus
tcctgctgcttacgtccttttggga

SEQ ID NO: 820787 - DNA, 25 bp, Mus musculus
tcctgctgcttaggtccttttggga

SEQ ID NO: 820788 - DNA, 25 bp, Mus musculus
tcctgctgcttcaagtgctggcatt

SEQ ID NO: 820789 - DNA, 25 bp, Mus musculus
tcctgctgcttctagtgctggcatt

SEQ ID NO: 820790 - DNA, 25 bp, Mus musculus
tcctgctgcttgcaggactacaggg

SEQ ID NO: 820791 - DNA, 25 bp, Mus musculus
tcctgctgcttggaggactacaggg

SEQ ID NO: 820792 - DNA, 25 bp, Mus musculus
tcctgctgggacagtttgtggaact

SEQ ID NO: 820793 - DNA, 25 bp, Mus musculus
tcctgctgggactgtttgtggaact

SEQ ID NO: 820794 - DNA, 25 bp, Mus musculus
tcctgctgtcccatgttctcagaga

SEQ ID NO: 820795 - DNA, 25 bp, Mus musculus
tcctgctgtcccttgttctcagaga

SEQ ID NO: 820796 - DNA, 25 bp, Mus musculus
tcctgctgtgcgaggacaaactgat

SEQ ID NO: 820797 - DNA, 25 bp, Mus musculus
tcctgctgtgcgtggacaaactgat

SEQ ID NO: 820798 - DNA, 25 bp, Mus musculus
tcctgctgtggcacagttatccggt

SEQ ID NO: 820799 - DNA, 25 bp, Mus musculus
tcctgctgtggctcagttatccggt

SEQ ID NO: 820800 - DNA, 25 bp, Mus musculus
tcctgctgtgtaatggttcctccca

SEQ ID NO: 820801 - DNA, 25 bp, Mus musculus
tcctgctgtgtattggttcctccca

SEQ ID NO: 820802 - DNA, 25 bp, Mus musculus
tcctgctgttagagtgctgaaatgc

SEQ ID NO: 820803 - DNA, 25 bp, Mus musculus
tcctgctgttagtgtgctgaaatgc

SEQ ID NO: 820804 - DNA, 25 bp, Mus musculus
tcctgcttaacgcacggacggagag

SEQ ID NO: 820805 - DNA, 25 bp, Mus musculus
tcctgcttaacggacggacggagag

SEQ ID NO: 820806 - DNA, 25 bp, Mus musculus
tcctgcttaactccttgctttcttc

SEQ ID NO: 820807 - DNA, 25 bp, Mus musculus
tcctgcttaactgcttgctttcttc

SEQ ID NO: 820808 - DNA, 25 bp, Mus musculus
tcctgcttaagtcaatgtatcatta

SEQ ID NO: 820809 - DNA, 25 bp, Mus musculus
tcctgcttaagtgaatgtatcatta

SEQ ID NO: 820810 - DNA, 25 bp, Mus musculus
tcctgcttaatgacagccattggct

SEQ ID NO: 820811 - DNA, 25 bp, Mus musculus
tcctgcttaatgtcagccattggct

SEQ ID NO: 820812 - DNA, 25 bp, Mus musculus
tcctgcttcaagaaggacctgcaca

SEQ ID NO: 820813 - DNA, 25 bp, Mus musculus
tcctgcttcaagctactgtgtttag

SEQ ID NO: 820814 - DNA, 25 bp, Mus musculus
tcctgcttcaaggtactgtgtttag

SEQ ID NO: 820815 - DNA, 25 bp, Mus musculus
tcctgcttcaagtaggacctgcaca

SEQ ID NO: 820816 - DNA, 25 bp, Mus musculus
tcctgcttcagcaaacagtggagcg

SEQ ID NO: 820817 - DNA, 25 bp, Mus musculus
tcctgcttcagctaacagtggagcg

SEQ ID NO: 820818 - DNA, 25 bp, Mus musculus
tcctgcttcatgagtaacctgggct

SEQ ID NO: 820819 - DNA, 25 bp, Mus musculus
tcctgcttcatgtgtaacctgggct

SEQ ID NO: 820820 - DNA, 25 bp, Mus musculus
tcctgcttccatatatgcagtgtga

SEQ ID NO: 820821 - DNA, 25 bp, Mus musculus
tcctgcttccatttatgcagtgtga

SEQ ID NO: 820822 - DNA, 25 bp, Mus musculus
tcctgcttcctcactgtggaagaaa

SEQ ID NO: 820823 - DNA, 25 bp, Mus musculus
tcctgcttcctctctgtggaagaaa

SEQ ID NO: 820824 - DNA, 25 bp, Mus musculus
tcctgcttctacaacctctggagga

SEQ ID NO: 820825 - DNA, 25 bp, Mus musculus
tcctgcttctactacctctggagga

SEQ ID NO: 820826 - DNA, 25 bp, Mus musculus
tcctgcttctatcaactgtacgtaa

SEQ ID NO: 820827 - DNA, 25 bp, Mus musculus
tcctgcttctatccccatttaaagg

SEQ ID NO: 820828 - DNA, 25 bp, Mus musculus
tcctgcttctatgaactgtacgtaa

SEQ ID NO: 820829 - DNA, 25 bp, Mus musculus
tcctgcttctatgcccatttaaagg

SEQ ID NO: 820830 - DNA, 25 bp, Mus musculus
tcctgcttctctcactgtaagctct

SEQ ID NO: 820831 - DNA, 25 bp, Mus musculus
tcctgcttctctgactgtaagctct

SEQ ID NO: 820832 - DNA, 25 bp, Mus musculus
tcctgcttctgacataaactgttaa

SEQ ID NO: 820833 - DNA, 25 bp, Mus musculus
tcctgcttctgagataaactgttaa

SEQ ID NO: 820834 - DNA, 25 bp, Mus musculus
tcctgcttctgcagacaatacggaa

SEQ ID NO: 820835 - DNA, 25 bp, Mus musculus
tcctgcttctgctgacaatacggaa

SEQ ID NO: 820836 - DNA, 25 bp, Mus musculus
tcctgcttgaagaaccagtagtctt

SEQ ID NO: 820837 - DNA, 25 bp, Mus musculus
tcctgcttgaagtaccagtagtctt

SEQ ID NO: 820838 - DNA, 25 bp, Mus musculus
tcctgcttgagaccctgtgtaccag

SEQ ID NO: 820839 - DNA, 25 bp, Mus musculus
tcctgcttgagagcctgtgtaccag

SEQ ID NO: 820840 - DNA, 25 bp, Mus musculus
tcctgcttgatcatccttagcacaa

SEQ ID NO: 820841 - DNA, 25 bp, Mus musculus
tcctgcttgatcttccttagcacaa

SEQ ID NO: 820842 - DNA, 25 bp, Mus musculus
tcctgcttggaaacctatgataaaa

SEQ ID NO: 820843 - DNA, 25 bp, Mus musculus
tcctgcttggaatcctatgataaaa

SEQ ID NO: 820844 - DNA, 25 bp, Mus musculus
tcctgcttggaccaaatacaacaat

SEQ ID NO: 820845 - DNA, 25 bp, Mus musculus
tcctgcttggacgaaatacaacaat

SEQ ID NO: 820846 - DNA, 25 bp, Mus musculus
tcctgcttggtccttgctcaatgtg

SEQ ID NO: 820847 - DNA, 25 bp, Mus musculus
tcctgcttggtcgttgctcaatgtg

SEQ ID NO: 820848 - DNA, 25 bp, Mus musculus
tcctgcttgtgtagtggccctttag

SEQ ID NO: 820849 - DNA, 25 bp, Mus musculus
tcctgcttgtgttgtggccctttag

SEQ ID NO: 820850 - DNA, 25 bp, Mus musculus
tcctgctttaccatgttggttggtt

SEQ ID NO: 820851 - DNA, 25 bp, Mus musculus
tcctgctttaccttgttggttggtt

SEQ ID NO: 820852 - DNA, 25 bp, Mus musculus
tcctgctttcccagaggatccaagt

SEQ ID NO: 820853 - DNA, 25 bp, Mus musculus
tcctgctttccctgaggatccaagt

SEQ ID NO: 820854 - DNA, 25 bp, Mus musculus
tcctgctttcgcctcagatttacag

SEQ ID NO: 820855 - DNA, 25 bp, Mus musculus
tcctgctttcgcgtcagatttacag

SEQ ID NO: 820856 - DNA, 25 bp, Mus musculus
tcctgctttctaatgtgctaactgt

SEQ ID NO: 820857 - DNA, 25 bp, Mus musculus
tcctgctttctactgctttgtatac

SEQ ID NO: 820858 - DNA, 25 bp, Mus musculus
tcctgctttctagtgctttgtatac

SEQ ID NO: 820859 - DNA, 25 bp, Mus musculus
tcctgctttctattgtgctaactgt

SEQ ID NO: 820860 - DNA, 25 bp, Mus musculus
tcctgctttgagcttgttcacgaaa

SEQ ID NO: 820861 - DNA, 25 bp, Mus musculus
tcctgctttgaggttgttcacgaaa

SEQ ID NO: 820862 - DNA, 25 bp, Mus musculus
tcctgctttgctcccaaagggtttt

SEQ ID NO: 820863 - DNA, 25 bp, Mus musculus
tcctgctttgctgccaaagggtttt

SEQ ID NO: 820864 - DNA, 25 bp, Mus musculus
tcctggaaatcaaccactgcaaaaa

SEQ ID NO: 820865 - DNA, 25 bp, Mus musculus
tcctggaaatcatccactgcaaaaa

SEQ ID NO: 820866 - DNA, 25 bp, Mus musculus
tcctggaaatcgacaacctgctcaa

SEQ ID NO: 820867 - DNA, 25 bp, Mus musculus
tcctggaaatcgtcaacctgctcaa

SEQ ID NO: 820868 - DNA, 25 bp, Mus musculus
tcctggaaatgtctccagctggaga

SEQ ID NO: 820869 - DNA, 25 bp, Mus musculus
tcctggaaatgtgtccagctggaga

SEQ ID NO: 820870 - DNA, 25 bp, Mus musculus
tcctggaacaatcgtgatttttccc

SEQ ID NO: 820871 - DNA, 25 bp, Mus musculus
tcctggaacaatggtgatttttccc

SEQ ID NO: 820872 - DNA, 25 bp, Mus musculus
tcctggaaccatagtctgcggacta

SEQ ID NO: 820873 - DNA, 25 bp, Mus musculus
tcctggaaccattgtctgcggacta

SEQ ID NO: 820874 - DNA, 25 bp, Mus musculus
tcctggaacccgcagtacagtgact

SEQ ID NO: 820875 - DNA, 25 bp, Mus musculus
tcctggaacccggagtacagtgact

SEQ ID NO: 820876 - DNA, 25 bp, Mus musculus
tcctggaactgactccaagtcctct

SEQ ID NO: 820877 - DNA, 25 bp, Mus musculus
tcctggaactgagtccaagtcctct

SEQ ID NO: 820878 - DNA, 25 bp, Mus musculus
tcctggaagaatatctgggaccact

SEQ ID NO: 820879 - DNA, 25 bp, Mus musculus
tcctggaagaatttctgggaccact

SEQ ID NO: 820880 - DNA, 25 bp, Mus musculus
tcctggaaggaaagggcagctgcct

SEQ ID NO: 820881 - DNA, 25 bp, Mus musculus
tcctggaaggaatgggcagctgcct

SEQ ID NO: 820882 - DNA, 25 bp, Mus musculus
tcctggaaggcaacgccattcttaa

SEQ ID NO: 820883 - DNA, 25 bp, Mus musculus
tcctggaaggcatcgccattcttaa

SEQ ID NO: 820884 - DNA, 25 bp, Mus musculus
tcctggaagtgtcccaggctgtgtc

SEQ ID NO: 820885 - DNA, 25 bp, Mus musculus
tcctggaagtgtgccaggctgtgtc

SEQ ID NO: 820886 - DNA, 25 bp, Mus musculus
tcctggaatactcacacccgggatt

SEQ ID NO: 820887 - DNA, 25 bp, Mus musculus
tcctggaatactgacacccgggatt

SEQ ID NO: 820888 - DNA, 25 bp, Mus musculus
tcctggaatagcctctgggactatg

SEQ ID NO: 820889 - DNA, 25 bp, Mus musculus
tcctggaatagcgtctgggactatg

SEQ ID NO: 820890 - DNA, 25 bp, Mus musculus
tcctggaatcaccagcgagcactgc

SEQ ID NO: 820891 - DNA, 25 bp, Mus musculus
tcctggaatcacgagcgagcactgc

SEQ ID NO: 820892 - DNA, 25 bp, Mus musculus
tcctggaatccacatgatgcaagaa

SEQ ID NO: 820893 - DNA, 25 bp, Mus musculus
tcctggaatccagatgatgcaagaa

SEQ ID NO: 820894 - DNA, 25 bp, Mus musculus
tcctggacacatacctacatacaga

SEQ ID NO: 820895 - DNA, 25 bp, Mus musculus
tcctggacacattcctacatacaga

SEQ ID NO: 820896 - DNA, 25 bp, Mus musculus
tcctggacaccgctgcgtgatgcta

SEQ ID NO: 820897 - DNA, 25 bp, Mus musculus
tcctggacaccggtgcgtgatgcta

SEQ ID NO: 820898 - DNA, 25 bp, Mus musculus
tcctggacacctaacctttctaaga

SEQ ID NO: 820899 - DNA, 25 bp, Mus musculus
tcctggacaccttacctttctaaga

SEQ ID NO: 820900 - DNA, 25 bp, Mus musculus
tcctggacatgacttcggccttcag

SEQ ID NO: 820901 - DNA, 25 bp, Mus musculus
tcctggacatgagttcggccttcag

SEQ ID NO: 820902 - DNA, 25 bp, Mus musculus
tcctggacatggatcgctgcagcag

SEQ ID NO: 820903 - DNA, 25 bp, Mus musculus
tcctggacatggttcgctgcagcag

SEQ ID NO: 820904 - DNA, 25 bp, Mus musculus
tcctggaccactagatcactgtcat

SEQ ID NO: 820905 - DNA, 25 bp, Mus musculus
tcctggaccacttgatcactgtcat

SEQ ID NO: 820906 - DNA, 25 bp, Mus musculus
tcctggaccaggaagtttgcactct

SEQ ID NO: 820907 - DNA, 25 bp, Mus musculus
tcctggaccaggtagtttgcactct

SEQ ID NO: 820908 - DNA, 25 bp, Mus musculus
tcctggaccattccactactaaacg

SEQ ID NO: 820909 - DNA, 25 bp, Mus musculus
tcctggaccattgcactactaaacg

SEQ ID NO: 820910 - DNA, 25 bp, Mus musculus
tcctggaccgaaatgtgtgcttatc

SEQ ID NO: 820911 - DNA, 25 bp, Mus musculus
tcctggaccgaattgtgtgcttatc

SEQ ID NO: 820912 - DNA, 25 bp, Mus musculus
tcctggacctgcagttttgtttctt

SEQ ID NO: 820913 - DNA, 25 bp, Mus musculus
tcctggacctgctgttttgtttctt

SEQ ID NO: 820914 - DNA, 25 bp, Mus musculus
tcctggacgaacaggccggcaaact

SEQ ID NO: 820915 - DNA, 25 bp, Mus musculus
tcctggacgaactggccggcaaact

SEQ ID NO: 820916 - DNA, 25 bp, Mus musculus
tcctggacgagaactctgaatgctt

SEQ ID NO: 820917 - DNA, 25 bp, Mus musculus
tcctggacgagatctctgaatgctt

SEQ ID NO: 820918 - DNA, 25 bp, Mus musculus
tcctggacgctacacagaaggttcc

SEQ ID NO: 820919 - DNA, 25 bp, Mus musculus
tcctggacgctagacagaaggttcc

SEQ ID NO: 820920 - DNA, 25 bp, Mus musculus
tcctggacggcactgagctcagcta

SEQ ID NO: 820921 - DNA, 25 bp, Mus musculus
tcctggacggcagtgagctcagcta

SEQ ID NO: 820922 - DNA, 25 bp, Mus musculus
tcctggacgtggcttggaacatata

SEQ ID NO: 820923 - DNA, 25 bp, Mus musculus
tcctggacgtgggttggaacatata

SEQ ID NO: 820924 - DNA, 25 bp, Mus musculus
tcctggactcatcctgtttctaacc

SEQ ID NO: 820925 - DNA, 25 bp, Mus musculus
tcctggactcatgctgtttctaacc

SEQ ID NO: 820926 - DNA, 25 bp, Mus musculus
tcctggactccaatagacaagcaat

SEQ ID NO: 820927 - DNA, 25 bp, Mus musculus
tcctggactccattagacaagcaat

SEQ ID NO: 820928 - DNA, 25 bp, Mus musculus
tcctggacttctaaatatctgaaac

SEQ ID NO: 820929 - DNA, 25 bp, Mus musculus
tcctggacttcttaatatctgaaac

SEQ ID NO: 820930 - DNA, 25 bp, Mus musculus
tcctggacttgcaatggcctggctt

SEQ ID NO: 820931 - DNA, 25 bp, Mus musculus
tcctggacttgctatggcctggctt

SEQ ID NO: 820932 - DNA, 25 bp, Mus musculus
tcctggagaaatagggacagcattg

SEQ ID NO: 820933 - DNA, 25 bp, Mus musculus
tcctggagaaattgggacagcattg

SEQ ID NO: 820934 - DNA, 25 bp, Mus musculus
tcctggagagcgcatctagcatttt

SEQ ID NO: 820935 - DNA, 25 bp, Mus musculus
tcctggagagcggatctagcatttt

SEQ ID NO: 820936 - DNA, 25 bp, Mus musculus
tcctggagcatgaagcctctgacca

SEQ ID NO: 820937 - DNA, 25 bp, Mus musculus
tcctggagcatgtagcctctgacca

SEQ ID NO: 820938 - DNA, 25 bp, Mus musculus
tcctggagccatagtatgaagctgg

SEQ ID NO: 820939 - DNA, 25 bp, Mus musculus
tcctggagccattgtatgaagctgg

SEQ ID NO: 820940 - DNA, 25 bp, Mus musculus
tcctggagcccaacatgagcctaag

SEQ ID NO: 820941 - DNA, 25 bp, Mus musculus
tcctggagcccatcatgagcctaag

SEQ ID NO: 820942 - DNA, 25 bp, Mus musculus
tcctggagcggtcgacctcagatga

SEQ ID NO: 820943 - DNA, 25 bp, Mus musculus
tcctggagcggtggacctcagatga

SEQ ID NO: 820944 - DNA, 25 bp, Mus musculus
tcctggaggaacatccccacaaaag

SEQ ID NO: 820945 - DNA, 25 bp, Mus musculus
tcctggaggaacttccccacaaaag

SEQ ID NO: 820946 - DNA, 25 bp, Mus musculus
tcctggaggccacacgggttaatcg

SEQ ID NO: 820947 - DNA, 25 bp, Mus musculus
tcctggaggccagacgggttaatcg

SEQ ID NO: 820948 - DNA, 25 bp, Mus musculus
tcctggaggccgcatgctctggctt

SEQ ID NO: 820949 - DNA, 25 bp, Mus musculus
tcctggaggccggatgctctggctt

SEQ ID NO: 820950 - DNA, 25 bp, Mus musculus
tcctggaggcttagtacccaaaact

SEQ ID NO: 820951 - DNA, 25 bp, Mus musculus
tcctggaggctttgtacccaaaact

SEQ ID NO: 820952 - DNA, 25 bp, Mus musculus
tcctggaggtagaaatgcctgggac

SEQ ID NO: 820953 - DNA, 25 bp, Mus musculus
tcctggaggtagtaatgcctgggac

SEQ ID NO: 820954 - DNA, 25 bp, Mus musculus
tcctggagtacactaaggtcagtat

SEQ ID NO: 820955 - DNA, 25 bp, Mus musculus
tcctggagtacagtaaggtcagtat

SEQ ID NO: 820956 - DNA, 25 bp, Mus musculus
tcctggagtcacactccaagggaga

SEQ ID NO: 820957 - DNA, 25 bp, Mus musculus
tcctggagtcactctccaagggaga

SEQ ID NO: 820958 - DNA, 25 bp, Mus musculus
tcctggagtcagctgcaatcctaca

SEQ ID NO: 820959 - DNA, 25 bp, Mus musculus
tcctggagtcaggtgcaatcctaca

SEQ ID NO: 820960 - DNA, 25 bp, Mus musculus
tcctggagtcgcataaactgtgctt

SEQ ID NO: 820961 - DNA, 25 bp, Mus musculus
tcctggagtcgcttaaactgtgctt

SEQ ID NO: 820962 - DNA, 25 bp, Mus musculus
tcctggagtctccatgagccttaga

SEQ ID NO: 820963 - DNA, 25 bp, Mus musculus
tcctggagtctcgatgagccttaga

SEQ ID NO: 820964 - DNA, 25 bp, Mus musculus
tcctggatagctacctatggctgga

SEQ ID NO: 820965 - DNA, 25 bp, Mus musculus
tcctggatagcttcctatggctgga

SEQ ID NO: 820966 - DNA, 25 bp, Mus musculus
tcctggatatatagactttcaaaag

SEQ ID NO: 820967 - DNA, 25 bp, Mus musculus
tcctggatatattgactttcaaaag

SEQ ID NO: 820968 - DNA, 25 bp, Mus musculus
tcctggatatcaccattgggctcac

SEQ ID NO: 820969 - DNA, 25 bp, Mus musculus
tcctggatatcagcattgggctcac

SEQ ID NO: 820970 - DNA, 25 bp, Mus musculus
tcctggatcagtcccgtctaaatta

SEQ ID NO: 820971 - DNA, 25 bp, Mus musculus
tcctggatcagtgccgtctaaatta

SEQ ID NO: 820972 - DNA, 25 bp, Mus musculus
tcctggatcatcattttgttggtat

SEQ ID NO: 820973 - DNA, 25 bp, Mus musculus
tcctggatcatctttttgttggtat

SEQ ID NO: 820974 - DNA, 25 bp, Mus musculus
tcctggatcatgaattacctatttt

SEQ ID NO: 820975 - DNA, 25 bp, Mus musculus
tcctggatcatgtattacctatttt

SEQ ID NO: 820976 - DNA, 25 bp, Mus musculus
tcctggatccagagctttcggagaa

SEQ ID NO: 820977 - DNA, 25 bp, Mus musculus
tcctggatccagtgctttcggagaa

SEQ ID NO: 820978 - DNA, 25 bp, Mus musculus
tcctggatccgcatgtggcgtatcc

SEQ ID NO: 820979 - DNA, 25 bp, Mus musculus
tcctggatccgcttgtggcgtatcc

SEQ ID NO: 820980 - DNA, 25 bp, Mus musculus
tcctggatcctcagcttagcgaaat

SEQ ID NO: 820981 - DNA, 25 bp, Mus musculus
tcctggatcctctgcttagcgaaat

SEQ ID NO: 820982 - DNA, 25 bp, Mus musculus
tcctggatctgaacccatcagagga

SEQ ID NO: 820983 - DNA, 25 bp, Mus musculus
tcctggatctgatcccatcagagga

SEQ ID NO: 820984 - DNA, 25 bp, Mus musculus
tcctggatgacgagtccctgacaca

SEQ ID NO: 820985 - DNA, 25 bp, Mus musculus
tcctggatgacgtgtccctgacaca

SEQ ID NO: 820986 - DNA, 25 bp, Mus musculus
tcctggatgctcacccaaaggcaaa

SEQ ID NO: 820987 - DNA, 25 bp, Mus musculus
tcctggatgctctcccaaaggcaaa

SEQ ID NO: 820988 - DNA, 25 bp, Mus musculus
tcctggatggaaatgacgtagactc

SEQ ID NO: 820989 - DNA, 25 bp, Mus musculus
tcctggatggaattgacgtagactc

SEQ ID NO: 820990 - DNA, 25 bp, Mus musculus
tcctggatggtaattggcgctgttc

SEQ ID NO: 820991 - DNA, 25 bp, Mus musculus
tcctggatggtatttggcgctgttc

SEQ ID NO: 820992 - DNA, 25 bp, Mus musculus
tcctggatggttctgtagagcgcct

SEQ ID NO: 820993 - DNA, 25 bp, Mus musculus
tcctggatggttgtgtagagcgcct

SEQ ID NO: 820994 - DNA, 25 bp, Mus musculus
tcctggatgtatatttatgtgcata

SEQ ID NO: 820995 - DNA, 25 bp, Mus musculus
tcctggatgtatttttatgtgcata

SEQ ID NO: 820996 - DNA, 25 bp, Mus musculus
tcctggatgttgcacggcagcttaa

SEQ ID NO: 820997 - DNA, 25 bp, Mus musculus
tcctggatgttggacggcagcttaa

SEQ ID NO: 820998 - DNA, 25 bp, Mus musculus
tcctggattcctcgcatttcatgta

SEQ ID NO: 820999 - DNA, 25 bp, Mus musculus
tcctggattcctggcatttcatgta

SEQ ID NO: 821000 - DNA, 25 bp, Mus musculus
tcctggattctgcttctcctaaaaa

SEQ ID NO: 821001 - DNA, 25 bp, Mus musculus
tcctggattctggttctcctaaaaa

SEQ ID NO: 821002 - DNA, 25 bp, Mus musculus
tcctggattggaattggctatgttt

SEQ ID NO: 821003 - DNA, 25 bp, Mus musculus
tcctggattggatttggctatgttt

SEQ ID NO: 821004 - DNA, 25 bp, Mus musculus
tcctggatttggataggactttcca

SEQ ID NO: 821005 - DNA, 25 bp, Mus musculus
tcctggatttggttaggactttcca

SEQ ID NO: 821006 - DNA, 25 bp, Mus musculus
tcctggatttgtagcctagtttaag

SEQ ID NO: 821007 - DNA, 25 bp, Mus musculus
tcctggatttgttgcctagtttaag

SEQ ID NO: 821008 - DNA, 25 bp, Mus musculus
tcctggcaaggacaacgcgggactc

SEQ ID NO: 821009 - DNA, 25 bp, Mus musculus
tcctggcaaggagaacgcgggactc

SEQ ID NO: 821010 - DNA, 25 bp, Mus musculus
tcctggcaattgaataccatgtcaa

SEQ ID NO: 821011 - DNA, 25 bp, Mus musculus
tcctggcaattgtataccatgtcaa

SEQ ID NO: 821012 - DNA, 25 bp, Mus musculus
tcctggcacatcatactgggtcctt

SEQ ID NO: 821013 - DNA, 25 bp, Mus musculus
tcctggcacatcttactgggtcctt

SEQ ID NO: 821014 - DNA, 25 bp, Mus musculus
tcctggcaccttctactcatgatgg

SEQ ID NO: 821015 - DNA, 25 bp, Mus musculus
tcctggcaccttgtactcatgatgg

SEQ ID NO: 821016 - DNA, 25 bp, Mus musculus
tcctggcagaggctataaatgattc

SEQ ID NO: 821017 - DNA, 25 bp, Mus musculus
tcctggcagagggtataaatgattc

SEQ ID NO: 821018 - DNA, 25 bp, Mus musculus
tcctggcagtcgaagagtcgcgtga

SEQ ID NO: 821019 - DNA, 25 bp, Mus musculus
tcctggcagtcgtagagtcgcgtga

SEQ ID NO: 821020 - DNA, 25 bp, Mus musculus
tcctggcagttaacacaatgtgcaa

SEQ ID NO: 821021 - DNA, 25 bp, Mus musculus
tcctggcagttatcacaatgtgcaa

SEQ ID NO: 821022 - DNA, 25 bp, Mus musculus
tcctggcatagtcacctgttagttt

SEQ ID NO: 821023 - DNA, 25 bp, Mus musculus
tcctggcatagtgacctgttagttt

SEQ ID NO: 821024 - DNA, 25 bp, Mus musculus
tcctggcatgagaataacttgagta

SEQ ID NO: 821025 - DNA, 25 bp, Mus musculus
tcctggcatgagtataacttgagta

SEQ ID NO: 821026 - DNA, 25 bp, Mus musculus
tcctggccaacactgctgttcctga

SEQ ID NO: 821027 - DNA, 25 bp, Mus musculus
tcctggccaacagtgctgttcctga

SEQ ID NO: 821028 - DNA, 25 bp, Mus musculus
tcctggccagcgcaattgtgcgtgc

SEQ ID NO: 821029 - DNA, 25 bp, Mus musculus
tcctggccagcggaattgtgcgtgc

SEQ ID NO: 821030 - DNA, 25 bp, Mus musculus
tcctggccaggaaccagttgagcag

SEQ ID NO: 821031 - DNA, 25 bp, Mus musculus
tcctggccaggatccagttgagcag

SEQ ID NO: 821032 - DNA, 25 bp, Mus musculus
tcctggccaggccaatgactcggaa

SEQ ID NO: 821033 - DNA, 25 bp, Mus musculus
tcctggccaggcgaatgactcggaa

SEQ ID NO: 821034 - DNA, 25 bp, Mus musculus
tcctggcccctgaatacacataaaa

SEQ ID NO: 821035 - DNA, 25 bp, Mus musculus
tcctggcccctgtatacacataaaa

SEQ ID NO: 821036 - DNA, 25 bp, Mus musculus
tcctggcccgctagtttttcggctt

SEQ ID NO: 821037 - DNA, 25 bp, Mus musculus
tcctggcccgcttgtttttcggctt

SEQ ID NO: 821038 - DNA, 25 bp, Mus musculus
tcctggccctggagctgatctgttc

SEQ ID NO: 821039 - DNA, 25 bp, Mus musculus
tcctggccctggtgctgatctgttc

SEQ ID NO: 821040 - DNA, 25 bp, Mus musculus
tcctggcctagcatgctagttttat

SEQ ID NO: 821041 - DNA, 25 bp, Mus musculus
tcctggcctagcttgctagttttat

SEQ ID NO: 821042 - DNA, 25 bp, Mus musculus
tcctggcctcaactcctagaggaag

SEQ ID NO: 821043 - DNA, 25 bp, Mus musculus
tcctggcctcaagtcctagaggaag

SEQ ID NO: 821044 - DNA, 25 bp, Mus musculus
tcctggcctcatcgccctagaggtg

SEQ ID NO: 821045 - DNA, 25 bp, Mus musculus
tcctggcctcatggccctagaggtg

SEQ ID NO: 821046 - DNA, 25 bp, Mus musculus
tcctggcctgctagatctggatagg

SEQ ID NO: 821047 - DNA, 25 bp, Mus musculus
tcctggcctgcttgatctggatagg

SEQ ID NO: 821048 - DNA, 25 bp, Mus musculus
tcctggcctggaacagatgaccaca

SEQ ID NO: 821049 - DNA, 25 bp, Mus musculus
tcctggcctggatcagatgaccaca

SEQ ID NO: 821050 - DNA, 25 bp, Mus musculus
tcctggcctgtcagaaggcctgaat

SEQ ID NO: 821051 - DNA, 25 bp, Mus musculus
tcctggcctgtctgaaggcctgaat

SEQ ID NO: 821052 - DNA, 25 bp, Mus musculus
tcctggccttcgagaagacccaatt

SEQ ID NO: 821053 - DNA, 25 bp, Mus musculus
tcctggccttcgagtgtttttgtaa

SEQ ID NO: 821054 - DNA, 25 bp, Mus musculus
tcctggccttcgtgaagacccaatt

SEQ ID NO: 821055 - DNA, 25 bp, Mus musculus
tcctggccttcgtgtgtttttgtaa

SEQ ID NO: 821056 - DNA, 25 bp, Mus musculus
tcctggccttctaaagaccattgca

SEQ ID NO: 821057 - DNA, 25 bp, Mus musculus
tcctggccttcttaagaccattgca

SEQ ID NO: 821058 - DNA, 25 bp, Mus musculus
tcctggccttgtatttcctttgtgg

SEQ ID NO: 821059 - DNA, 25 bp, Mus musculus
tcctggccttgtttttcctttgtgg

SEQ ID NO: 821060 - DNA, 25 bp, Mus musculus
tcctggcctttgagttctctggcac

SEQ ID NO: 821061 - DNA, 25 bp, Mus musculus
tcctggcctttgtgttctctggcac

SEQ ID NO: 821062 - DNA, 25 bp, Mus musculus
tcctggcgctctatcgaaagtttga

SEQ ID NO: 821063 - DNA, 25 bp, Mus musculus
tcctggcgctctttcgaaagtttga

SEQ ID NO: 821064 - DNA, 25 bp, Mus musculus
tcctggcgtcatcgtcaacgtgcaa

SEQ ID NO: 821065 - DNA, 25 bp, Mus musculus
tcctggcgtcatggtcaacgtgcaa

SEQ ID NO: 821066 - DNA, 25 bp, Mus musculus
tcctggcgttgaatgactacattat

SEQ ID NO: 821067 - DNA, 25 bp, Mus musculus
tcctggcgttgattgactacattat

SEQ ID NO: 821068 - DNA, 25 bp, Mus musculus
tcctggctaaggctgagatctatct

SEQ ID NO: 821069 - DNA, 25 bp, Mus musculus
tcctggctaagggtgagatctatct

SEQ ID NO: 821070 - DNA, 25 bp, Mus musculus
tcctggctagtgcaagcttgtcaca

SEQ ID NO: 821071 - DNA, 25 bp, Mus musculus
tcctggctagtggaagcttgtcaca

SEQ ID NO: 821072 - DNA, 25 bp, Mus musculus
tcctggctatgtcatggtgctaaat

SEQ ID NO: 821073 - DNA, 25 bp, Mus musculus
tcctggctatgtgatggtgctaaat

SEQ ID NO: 821074 - DNA, 25 bp, Mus musculus
tcctggctccacattcttggagaaa

SEQ ID NO: 821075 - DNA, 25 bp, Mus musculus
tcctggctccactttcttggagaaa

SEQ ID NO: 821076 - DNA, 25 bp, Mus musculus
tcctggctctgaacttcgagtgttg

SEQ ID NO: 821077 - DNA, 25 bp, Mus musculus
tcctggctctgaagtgttgacctgc

SEQ ID NO: 821078 - DNA, 25 bp, Mus musculus
tcctggctctgatcttcgagtgttg

SEQ ID NO: 821079 - DNA, 25 bp, Mus musculus
tcctggctctgatgtgttgacctgc

SEQ ID NO: 821080 - DNA, 25 bp, Mus musculus
tcctggctgaggatctccttgtata

SEQ ID NO: 821081 - DNA, 25 bp, Mus musculus
tcctggctgaggttctccttgtata

SEQ ID NO: 821082 - DNA, 25 bp, Mus musculus
tcctggctgccgcaagagagatcct

SEQ ID NO: 821083 - DNA, 25 bp, Mus musculus
tcctggctgccggaagagagatcct

SEQ ID NO: 821084 - DNA, 25 bp, Mus musculus
tcctggctggctatgacgagcatga

SEQ ID NO: 821085 - DNA, 25 bp, Mus musculus
tcctggctggctttgacgagcatga

SEQ ID NO: 821086 - DNA, 25 bp, Mus musculus
tcctggctggtgctcctggtttcta

SEQ ID NO: 821087 - DNA, 25 bp, Mus musculus
tcctggctggtggtcctggtttcta

SEQ ID NO: 821088 - DNA, 25 bp, Mus musculus
tcctggctgtatacataagatccca

SEQ ID NO: 821089 - DNA, 25 bp, Mus musculus
tcctggctgtattcataagatccca

SEQ ID NO: 821090 - DNA, 25 bp, Mus musculus
tcctggctgtgcacagatactggca

SEQ ID NO: 821091 - DNA, 25 bp, Mus musculus
tcctggctgtgctcagatactggca

SEQ ID NO: 821092 - DNA, 25 bp, Mus musculus
tcctggctgtgtcagaactcctatg

SEQ ID NO: 821093 - DNA, 25 bp, Mus musculus
tcctggctgtgtgagaactcctatg

SEQ ID NO: 821094 - DNA, 25 bp, Mus musculus
tcctggctgtttagttcttctgaaa

SEQ ID NO: 821095 - DNA, 25 bp, Mus musculus
tcctggctgttttgttcttctgaaa

SEQ ID NO: 821096 - DNA, 25 bp, Mus musculus
tcctggcttactctgtattgagaca

SEQ ID NO: 821097 - DNA, 25 bp, Mus musculus
tcctggcttactgtgtattgagaca

SEQ ID NO: 821098 - DNA, 25 bp, Mus musculus
tcctggcttatcactacaatctgtt

SEQ ID NO: 821099 - DNA, 25 bp, Mus musculus
tcctggcttatctctacaatctgtt

SEQ ID NO: 821100 - DNA, 25 bp, Mus musculus
tcctggcttcccaattgggtgggca

SEQ ID NO: 821101 - DNA, 25 bp, Mus musculus
tcctggcttccctattgggtgggca

SEQ ID NO: 821102 - DNA, 25 bp, Mus musculus
tcctggctttagataaatgacctgt

SEQ ID NO: 821103 - DNA, 25 bp, Mus musculus
tcctggctttagttaaatgacctgt

SEQ ID NO: 821104 - DNA, 25 bp, Mus musculus
tcctggctttgactgtctgatggca

SEQ ID NO: 821105 - DNA, 25 bp, Mus musculus
tcctggctttgagtgtctgatggca

SEQ ID NO: 821106 - DNA, 25 bp, Mus musculus
tcctgggaaagcacaagggcacgcc

SEQ ID NO: 821107 - DNA, 25 bp, Mus musculus
tcctgggaaagctcaagggcacgcc

SEQ ID NO: 821108 - DNA, 25 bp, Mus musculus
tcctgggaacacacactactagatt

SEQ ID NO: 821109 - DNA, 25 bp, Mus musculus
tcctgggaacactcactactagatt

SEQ ID NO: 821110 - DNA, 25 bp, Mus musculus
tcctgggaacatcctggccctagga

SEQ ID NO: 821111 - DNA, 25 bp, Mus musculus
tcctgggaacatgctggccctagga

SEQ ID NO: 821112 - DNA, 25 bp, Mus musculus
tcctgggaacttagcgagatggtca

SEQ ID NO: 821113 - DNA, 25 bp, Mus musculus
tcctgggaacttcttcttgaatgaa

SEQ ID NO: 821114 - DNA, 25 bp, Mus musculus
tcctgggaacttgttcttgaatgaa

SEQ ID NO: 821115 - DNA, 25 bp, Mus musculus
tcctgggaactttgcgagatggtca

SEQ ID NO: 821116 - DNA, 25 bp, Mus musculus
tcctgggaagatcactggtaacatg

SEQ ID NO: 821117 - DNA, 25 bp, Mus musculus
tcctgggaagatgactggtaacatg

SEQ ID NO: 821118 - DNA, 25 bp, Mus musculus
tcctgggaagtaccaacaacctccg

SEQ ID NO: 821119 - DNA, 25 bp, Mus musculus
tcctgggaagtagcaacaacctccg

SEQ ID NO: 821120 - DNA, 25 bp, Mus musculus
tcctgggaattgagtacgactcggt

SEQ ID NO: 821121 - DNA, 25 bp, Mus musculus
tcctgggaattgtgtacgactcggt

SEQ ID NO: 821122 - DNA, 25 bp, Mus musculus
tcctgggacaagaccggagacccgt

SEQ ID NO: 821123 - DNA, 25 bp, Mus musculus
tcctgggacaagtccggagacccgt

SEQ ID NO: 821124 - DNA, 25 bp, Mus musculus
tcctgggacacaaattattataaca

SEQ ID NO: 821125 - DNA, 25 bp, Mus musculus
tcctgggacacatattattataaca

SEQ ID NO: 821126 - DNA, 25 bp, Mus musculus
tcctgggacagccacgtagactgat

SEQ ID NO: 821127 - DNA, 25 bp, Mus musculus
tcctgggacagcgacgtagactgat

SEQ ID NO: 821128 - DNA, 25 bp, Mus musculus
tcctgggactccctgtcaattattt

SEQ ID NO: 821129 - DNA, 25 bp, Mus musculus
tcctgggactccgtgtcaattattt

SEQ ID NO: 821130 - DNA, 25 bp, Mus musculus
tcctgggacttgctgatgagaatgt

SEQ ID NO: 821131 - DNA, 25 bp, Mus musculus
tcctgggacttggtgatgagaatgt

SEQ ID NO: 821132 - DNA, 25 bp, Mus musculus
tcctgggagaacagactgtggctga

SEQ ID NO: 821133 - DNA, 25 bp, Mus musculus
tcctgggagaactgactgtggctga

SEQ ID NO: 821134 - DNA, 25 bp, Mus musculus
tcctgggagactaaggactacccct

SEQ ID NO: 821135 - DNA, 25 bp, Mus musculus
tcctgggagactatgtggtgaacct

SEQ ID NO: 821136 - DNA, 25 bp, Mus musculus
tcctgggagacttaggactacccct

SEQ ID NO: 821137 - DNA, 25 bp, Mus musculus
tcctgggagactttgtggtgaacct

SEQ ID NO: 821138 - DNA, 25 bp, Mus musculus
tcctgggagagaagggatctctgcc

SEQ ID NO: 821139 - DNA, 25 bp, Mus musculus
tcctgggagagatgggatctctgcc

SEQ ID NO: 821140 - DNA, 25 bp, Mus musculus
tcctgggagcagctggtacctcacg

SEQ ID NO: 821141 - DNA, 25 bp, Mus musculus
tcctgggagcaggtggtacctcacg

SEQ ID NO: 821142 - DNA, 25 bp, Mus musculus
tcctgggagctcagttgagttcttg

SEQ ID NO: 821143 - DNA, 25 bp, Mus musculus
tcctgggagctctgttgagttcttg

SEQ ID NO: 821144 - DNA, 25 bp, Mus musculus
tcctgggaggacaggtggctactat

SEQ ID NO: 821145 - DNA, 25 bp, Mus musculus
tcctgggaggactggtggctactat

SEQ ID NO: 821146 - DNA, 25 bp, Mus musculus
tcctgggagggtcataactgttcat

SEQ ID NO: 821147 - DNA, 25 bp, Mus musculus
tcctgggagggtgataactgttcat

SEQ ID NO: 821148 - DNA, 25 bp, Mus musculus
tcctgggatagcagacaatctgtcg

SEQ ID NO: 821149 - DNA, 25 bp, Mus musculus
tcctgggatagctgacaatctgtcg

SEQ ID NO: 821150 - DNA, 25 bp, Mus musculus
tcctgggatatacccgttcacgcaa

SEQ ID NO: 821151 - DNA, 25 bp, Mus musculus
tcctgggatatagccgttcacgcaa

SEQ ID NO: 821152 - DNA, 25 bp, Mus musculus
tcctgggatcacaggcttagtaaaa

SEQ ID NO: 821153 - DNA, 25 bp, Mus musculus
tcctgggatcactggcttagtaaaa

SEQ ID NO: 821154 - DNA, 25 bp, Mus musculus
tcctgggatctacggcccaaatggg

SEQ ID NO: 821155 - DNA, 25 bp, Mus musculus
tcctgggatctagggcccaaatggg

SEQ ID NO: 821156 - DNA, 25 bp, Mus musculus
tcctgggcacctcggtctgtggttt

SEQ ID NO: 821157 - DNA, 25 bp, Mus musculus
tcctgggcacctgggtctgtggttt

SEQ ID NO: 821158 - DNA, 25 bp, Mus musculus
tcctgggcacttcaatacctttggt

SEQ ID NO: 821159 - DNA, 25 bp, Mus musculus
tcctgggcacttcagtcattgttca

SEQ ID NO: 821160 - DNA, 25 bp, Mus musculus
tcctgggcacttgaatacctttggt

SEQ ID NO: 821161 - DNA, 25 bp, Mus musculus
tcctgggcacttgagtcattgttca

SEQ ID NO: 821162 - DNA, 25 bp, Mus musculus
tcctgggcagagaggacacctctcc

SEQ ID NO: 821163 - DNA, 25 bp, Mus musculus
tcctgggcagagtggacacctctcc

SEQ ID NO: 821164 - DNA, 25 bp, Mus musculus
tcctgggcagccaaatgacttcttc

SEQ ID NO: 821165 - DNA, 25 bp, Mus musculus
tcctgggcagcctaatgacttcttc

SEQ ID NO: 821166 - DNA, 25 bp, Mus musculus
tcctgggcagtccttctgaaaagtc

SEQ ID NO: 821167 - DNA, 25 bp, Mus musculus
tcctgggcagtcgttctgaaaagtc

SEQ ID NO: 821168 - DNA, 25 bp, Mus musculus
tcctgggcatctacaagcagggcct

SEQ ID NO: 821169 - DNA, 25 bp, Mus musculus
tcctgggcatcttcaagcagggcct

SEQ ID NO: 821170 - DNA, 25 bp, Mus musculus
tcctgggcatgcattcatcactgaa

SEQ ID NO: 821171 - DNA, 25 bp, Mus musculus
tcctgggcatgctttcatcactgaa

SEQ ID NO: 821172 - DNA, 25 bp, Mus musculus
tcctgggccatgatgctgtgatcca

SEQ ID NO: 821173 - DNA, 25 bp, Mus musculus
tcctgggccatgttgctgtgatcca

SEQ ID NO: 821174 - DNA, 25 bp, Mus musculus
tcctgggccctacttgtatttattt

SEQ ID NO: 821175 - DNA, 25 bp, Mus musculus
tcctgggccctagttgtatttattt

SEQ ID NO: 821176 - DNA, 25 bp, Mus musculus
tcctgggccctgatatgatcaatgg

SEQ ID NO: 821177 - DNA, 25 bp, Mus musculus
tcctgggccctgttatgatcaatgg

SEQ ID NO: 821178 - DNA, 25 bp, Mus musculus
tcctgggccgtgactcaggcaaaaa

SEQ ID NO: 821179 - DNA, 25 bp, Mus musculus
tcctgggccgtgtctcaggcaaaaa

SEQ ID NO: 821180 - DNA, 25 bp, Mus musculus
tcctgggccttacaaacactatcct

SEQ ID NO: 821181 - DNA, 25 bp, Mus musculus
tcctgggccttagaaacactatcct

SEQ ID NO: 821182 - DNA, 25 bp, Mus musculus
tcctgggcgatgagcttttttcacc

SEQ ID NO: 821183 - DNA, 25 bp, Mus musculus
tcctgggcgatgtgcttttttcacc

SEQ ID NO: 821184 - DNA, 25 bp, Mus musculus
tcctgggctcagatcctcttcaaag

SEQ ID NO: 821185 - DNA, 25 bp, Mus musculus
tcctgggctcagttcctcttcaaag

SEQ ID NO: 821186 - DNA, 25 bp, Mus musculus
tcctgggctccgaagaacacatttt

SEQ ID NO: 821187 - DNA, 25 bp, Mus musculus
tcctgggctccgtagaacacatttt

SEQ ID NO: 821188 - DNA, 25 bp, Mus musculus
tcctgggctcgactcttgacaggtg

SEQ ID NO: 821189 - DNA, 25 bp, Mus musculus
tcctgggctcgagtcttgacaggtg

SEQ ID NO: 821190 - DNA, 25 bp, Mus musculus
tcctgggctctcagtagatcagtgg

SEQ ID NO: 821191 - DNA, 25 bp, Mus musculus
tcctgggctctctgtagatcagtgg

SEQ ID NO: 821192 - DNA, 25 bp, Mus musculus
tcctgggctggcaagcgaatcggct

SEQ ID NO: 821193 - DNA, 25 bp, Mus musculus
tcctgggctggctagcgaatcggct

SEQ ID NO: 821194 - DNA, 25 bp, Mus musculus
tcctgggcttgaagtgttcttccta

SEQ ID NO: 821195 - DNA, 25 bp, Mus musculus
tcctgggcttgatgtgttcttccta

SEQ ID NO: 821196 - DNA, 25 bp, Mus musculus
tcctgggctttcaaggacagtgtct

SEQ ID NO: 821197 - DNA, 25 bp, Mus musculus
tcctgggctttctaggacagtgtct

SEQ ID NO: 821198 - DNA, 25 bp, Mus musculus
tcctgggctttgctttcttaactcc

SEQ ID NO: 821199 - DNA, 25 bp, Mus musculus
tcctgggctttggtttcttaactcc

SEQ ID NO: 821200 - DNA, 25 bp, Mus musculus
tcctgggcttttaaagtgctgcgat

SEQ ID NO: 821201 - DNA, 25 bp, Mus musculus
tcctgggctttttaagtgctgcgat

SEQ ID NO: 821202 - DNA, 25 bp, Mus musculus
tcctgggtaagccagcactgcaaga

SEQ ID NO: 821203 - DNA, 25 bp, Mus musculus
tcctgggtaagcgagcactgcaaga

SEQ ID NO: 821204 - DNA, 25 bp, Mus musculus
tcctgggtacaacctggtcactggt

SEQ ID NO: 821205 - DNA, 25 bp, Mus musculus
tcctgggtacaagctggtcactggt

SEQ ID NO: 821206 - DNA, 25 bp, Mus musculus
tcctgggtacacagaggctgtcctt

SEQ ID NO: 821207 - DNA, 25 bp, Mus musculus
tcctgggtacactgaggctgtcctt

SEQ ID NO: 821208 - DNA, 25 bp, Mus musculus
tcctgggtacccaactgtgttgtta

SEQ ID NO: 821209 - DNA, 25 bp, Mus musculus
tcctgggtaccctactgtgttgtta

SEQ ID NO: 821210 - DNA, 25 bp, Mus musculus
tcctgggtacgcatcagagcactaa

SEQ ID NO: 821211 - DNA, 25 bp, Mus musculus
tcctgggtacgcttcagagcactaa

SEQ ID NO: 821212 - DNA, 25 bp, Mus musculus
tcctgggtactgactggtacatgcc

SEQ ID NO: 821213 - DNA, 25 bp, Mus musculus
tcctgggtactgtctggtacatgcc

SEQ ID NO: 821214 - DNA, 25 bp, Mus musculus
tcctgggtagaaacatcttggagga

SEQ ID NO: 821215 - DNA, 25 bp, Mus musculus
tcctgggtagaatcatcttggagga

SEQ ID NO: 821216 - DNA, 25 bp, Mus musculus
tcctgggtagccagtatcattggct

SEQ ID NO: 821217 - DNA, 25 bp, Mus musculus
tcctgggtagcctgtatcattggct

SEQ ID NO: 821218 - DNA, 25 bp, Mus musculus
tcctgggtatttcgatcttacaact

SEQ ID NO: 821219 - DNA, 25 bp, Mus musculus
tcctgggtatttggatcttacaact

SEQ ID NO: 821220 - DNA, 25 bp, Mus musculus
tcctgggtcaagcttttgtggtgtt

SEQ ID NO: 821221 - DNA, 25 bp, Mus musculus
tcctgggtcaaggttttgtggtgtt

SEQ ID NO: 821222 - DNA, 25 bp, Mus musculus
tcctgggtcctaatggacactggca

SEQ ID NO: 821223 - DNA, 25 bp, Mus musculus
tcctgggtcctattggacactggca

SEQ ID NO: 821224 - DNA, 25 bp, Mus musculus
tcctgggtctgactctacatgctgc

SEQ ID NO: 821225 - DNA, 25 bp, Mus musculus
tcctgggtctgagtctacatgctgc

SEQ ID NO: 821226 - DNA, 25 bp, Mus musculus
tcctgggtgatcacatttctgattt

SEQ ID NO: 821227 - DNA, 25 bp, Mus musculus
tcctgggtgatctcatttctgattt

SEQ ID NO: 821228 - DNA, 25 bp, Mus musculus
tcctgggtgcagagtgcatgttcct

SEQ ID NO: 821229 - DNA, 25 bp, Mus musculus
tcctgggtgcagtgtgcatgttcct

SEQ ID NO: 821230 - DNA, 25 bp, Mus musculus
tcctgggtgcccagttgtgcagtag

SEQ ID NO: 821231 - DNA, 25 bp, Mus musculus
tcctgggtgccctgttgtgcagtag

SEQ ID NO: 821232 - DNA, 25 bp, Mus musculus
tcctgggtgctaacgggtctggaac

SEQ ID NO: 821233 - DNA, 25 bp, Mus musculus
tcctgggtgctatcgggtctggaac

SEQ ID NO: 821234 - DNA, 25 bp, Mus musculus
tcctgggtggttaaatggctccgtt

SEQ ID NO: 821235 - DNA, 25 bp, Mus musculus
tcctgggtggttagaaccctgctgg

SEQ ID NO: 821236 - DNA, 25 bp, Mus musculus
tcctgggtggtttaatggctccgtt

SEQ ID NO: 821237 - DNA, 25 bp, Mus musculus
tcctgggtggtttgaaccctgctgg

SEQ ID NO: 821238 - DNA, 25 bp, Mus musculus
tcctgggtgtctattgtttcttctg

SEQ ID NO: 821239 - DNA, 25 bp, Mus musculus
tcctgggtgtcttttgtttcttctg

SEQ ID NO: 821240 - DNA, 25 bp, Mus musculus
tcctgggttcccatgaactcaggga

SEQ ID NO: 821241 - DNA, 25 bp, Mus musculus
tcctgggttcccttgaactcaggga

SEQ ID NO: 821242 - DNA, 25 bp, Mus musculus
tcctgggttctaacacctgcttatt

SEQ ID NO: 821243 - DNA, 25 bp, Mus musculus
tcctgggttctaaggtgtttctata

SEQ ID NO: 821244 - DNA, 25 bp, Mus musculus
tcctgggttctatcacctgcttatt

SEQ ID NO: 821245 - DNA, 25 bp, Mus musculus
tcctgggttctatggtgtttctata

SEQ ID NO: 821246 - DNA, 25 bp, Mus musculus
tcctgggttggacatgaaggcctaa

SEQ ID NO: 821247 - DNA, 25 bp, Mus musculus
tcctgggttggagatgaaggcctaa

SEQ ID NO: 821248 - DNA, 25 bp, Mus musculus
tcctgggttggcagcctttgtcaaa

SEQ ID NO: 821249 - DNA, 25 bp, Mus musculus
tcctgggttggctgcctttgtcaaa

SEQ ID NO: 821250 - DNA, 25 bp, Mus musculus
tcctgggtttggatctttctctagg

SEQ ID NO: 821251 - DNA, 25 bp, Mus musculus
tcctgggtttggttctttctctagg

SEQ ID NO: 821252 - DNA, 25 bp, Mus musculus
tcctgggtttgtctggtgattgtaa

SEQ ID NO: 821253 - DNA, 25 bp, Mus musculus
tcctgggtttgtgtggtgattgtaa

SEQ ID NO: 821254 - DNA, 25 bp, Mus musculus
tcctggtaaaccctgtgctcctgta

SEQ ID NO: 821255 - DNA, 25 bp, Mus musculus
tcctggtaaaccgtgtgctcctgta

SEQ ID NO: 821256 - DNA, 25 bp, Mus musculus
tcctggtaagccattcaatggtctg

SEQ ID NO: 821257 - DNA, 25 bp, Mus musculus
tcctggtaagcctttcaatggtctg

SEQ ID NO: 821258 - DNA, 25 bp, Mus musculus
tcctggtacatgctatgccgctatt

SEQ ID NO: 821259 - DNA, 25 bp, Mus musculus
tcctggtacatggtatgccgctatt

SEQ ID NO: 821260 - DNA, 25 bp, Mus musculus
tcctggtacgcaagagcttggctca

SEQ ID NO: 821261 - DNA, 25 bp, Mus musculus
tcctggtacgcatgagcttggctca

SEQ ID NO: 821262 - DNA, 25 bp, Mus musculus
tcctggtactcacagcatctcagaa

SEQ ID NO: 821263 - DNA, 25 bp, Mus musculus
tcctggtactcagagcatctcagaa

SEQ ID NO: 821264 - DNA, 25 bp, Mus musculus
tcctggtaggctatctcagcagaga

SEQ ID NO: 821265 - DNA, 25 bp, Mus musculus
tcctggtaggctttctcagcagaga

SEQ ID NO: 821266 - DNA, 25 bp, Mus musculus
tcctggtatcggctccggtaatgac

SEQ ID NO: 821267 - DNA, 25 bp, Mus musculus
tcctggtatcgggtccggtaatgac

SEQ ID NO: 821268 - DNA, 25 bp, Mus musculus
tcctggtatgccaataaagcgtttt

SEQ ID NO: 821269 - DNA, 25 bp, Mus musculus
tcctggtatgcctataaagcgtttt

SEQ ID NO: 821270 - DNA, 25 bp, Mus musculus
tcctggtcacttagttaattttata

SEQ ID NO: 821271 - DNA, 25 bp, Mus musculus
tcctggtcacttatggccatgatgg

SEQ ID NO: 821272 - DNA, 25 bp, Mus musculus
tcctggtcactttgttaattttata

SEQ ID NO: 821273 - DNA, 25 bp, Mus musculus
tcctggtcacttttggccatgatgg

SEQ ID NO: 821274 - DNA, 25 bp, Mus musculus
tcctggtcagagaaaggagactgga

SEQ ID NO: 821275 - DNA, 25 bp, Mus musculus
tcctggtcagagtaaggagactgga

SEQ ID NO: 821276 - DNA, 25 bp, Mus musculus
tcctggtcatatcatttagggtcat

SEQ ID NO: 821277 - DNA, 25 bp, Mus musculus
tcctggtcatatgatttagggtcat

SEQ ID NO: 821278 - DNA, 25 bp, Mus musculus
tcctggtccactatgttgtacactg

SEQ ID NO: 821279 - DNA, 25 bp, Mus musculus
tcctggtccactttgttgtacactg

SEQ ID NO: 821280 - DNA, 25 bp, Mus musculus
tcctggtccaggctggtatgcatgc

SEQ ID NO: 821281 - DNA, 25 bp, Mus musculus
tcctggtccagggtggtatgcatgc

SEQ ID NO: 821282 - DNA, 25 bp, Mus musculus
tcctggtcctctcattgatgtttca

SEQ ID NO: 821283 - DNA, 25 bp, Mus musculus
tcctggtcctctgattgatgtttca

SEQ ID NO: 821284 - DNA, 25 bp, Mus musculus
tcctggtcctttctagaactagtag

SEQ ID NO: 821285 - DNA, 25 bp, Mus musculus
tcctggtcctttgtagaactagtag

SEQ ID NO: 821286 - DNA, 25 bp, Mus musculus
tcctggtctaccatgactgcgtgct

SEQ ID NO: 821287 - DNA, 25 bp, Mus musculus
tcctggtctaccttgactgcgtgct

SEQ ID NO: 821288 - DNA, 25 bp, Mus musculus
tcctggtctcggatactcatgtgta

SEQ ID NO: 821289 - DNA, 25 bp, Mus musculus
tcctggtctcggttactcatgtgta

SEQ ID NO: 821290 - DNA, 25 bp, Mus musculus
tcctggtctcttctcgctcgggaca

SEQ ID NO: 821291 - DNA, 25 bp, Mus musculus
tcctggtctcttgtcgctcgggaca

SEQ ID NO: 821292 - DNA, 25 bp, Mus musculus
tcctggtctgacctcacaactttgg

SEQ ID NO: 821293 - DNA, 25 bp, Mus musculus
tcctggtctgacgtcacaactttgg

SEQ ID NO: 821294 - DNA, 25 bp, Mus musculus
tcctggtctggacttgagcactggc

SEQ ID NO: 821295 - DNA, 25 bp, Mus musculus
tcctggtctggagttgagcactggc

SEQ ID NO: 821296 - DNA, 25 bp, Mus musculus
tcctggtctgggacttgatcagttt

SEQ ID NO: 821297 - DNA, 25 bp, Mus musculus
tcctggtctgggtcttgatcagttt

SEQ ID NO: 821298 - DNA, 25 bp, Mus musculus
tcctggtctgtgaacccatattgac

SEQ ID NO: 821299 - DNA, 25 bp, Mus musculus
tcctggtctgtgtacccatattgac

SEQ ID NO: 821300 - DNA, 25 bp, Mus musculus
tcctggtctgttatcttgaaccagt

SEQ ID NO: 821301 - DNA, 25 bp, Mus musculus
tcctggtctgttttcttgaaccagt

SEQ ID NO: 821302 - DNA, 25 bp, Mus musculus
tcctggtctttcctttcctgagtta

SEQ ID NO: 821303 - DNA, 25 bp, Mus musculus
tcctggtctttcgtttcctgagtta

SEQ ID NO: 821304 - DNA, 25 bp, Mus musculus
tcctggtgaaggctgcgagcccaca

SEQ ID NO: 821305 - DNA, 25 bp, Mus musculus
tcctggtgaagggtgcgagcccaca

SEQ ID NO: 821306 - DNA, 25 bp, Mus musculus
tcctggtgaatgactgttcagctct

SEQ ID NO: 821307 - DNA, 25 bp, Mus musculus
tcctggtgaatgtctgttcagctct

SEQ ID NO: 821308 - DNA, 25 bp, Mus musculus
tcctggtgacagacaggtcgcgagc

SEQ ID NO: 821309 - DNA, 25 bp, Mus musculus
tcctggtgacagtcaggtcgcgagc

SEQ ID NO: 821310 - DNA, 25 bp, Mus musculus
tcctggtgacgcagaagagtgatca

SEQ ID NO: 821311 - DNA, 25 bp, Mus musculus
tcctggtgacgctgaagagtgatca

SEQ ID NO: 821312 - DNA, 25 bp, Mus musculus
tcctggtgactgaagtagctaatgt

SEQ ID NO: 821313 - DNA, 25 bp, Mus musculus
tcctggtgactgctacctatgacaa

SEQ ID NO: 821314 - DNA, 25 bp, Mus musculus
tcctggtgactggtacctatgacaa

SEQ ID NO: 821315 - DNA, 25 bp, Mus musculus
tcctggtgactgtagtagctaatgt

SEQ ID NO: 821316 - DNA, 25 bp, Mus musculus
tcctggtgagcaagccctccaaata

SEQ ID NO: 821317 - DNA, 25 bp, Mus musculus
tcctggtgagcatgccctccaaata

SEQ ID NO: 821318 - DNA, 25 bp, Mus musculus
tcctggtgatcacatggactatata

SEQ ID NO: 821319 - DNA, 25 bp, Mus musculus
tcctggtgatcagatggactatata

SEQ ID NO: 821320 - DNA, 25 bp, Mus musculus
tcctggtgccaacaggtgccaagaa

SEQ ID NO: 821321 - DNA, 25 bp, Mus musculus
tcctggtgccaagaggtgccaagaa

SEQ ID NO: 821322 - DNA, 25 bp, Mus musculus
tcctggtgcccacacgtatgtgcag

SEQ ID NO: 821323 - DNA, 25 bp, Mus musculus
tcctggtgcccagacgtatgtgcag

SEQ ID NO: 821324 - DNA, 25 bp, Mus musculus
tcctggtgcttgcttggcagtgaca

SEQ ID NO: 821325 - DNA, 25 bp, Mus musculus
tcctggtgcttggttggcagtgaca

SEQ ID NO: 821326 - DNA, 25 bp, Mus musculus
tcctggtggatcatgaggttccttt

SEQ ID NO: 821327 - DNA, 25 bp, Mus musculus
tcctggtggatcttgaggttccttt

SEQ ID NO: 821328 - DNA, 25 bp, Mus musculus
tcctggtggctcagtttcttcggct

SEQ ID NO: 821329 - DNA, 25 bp, Mus musculus
tcctggtggctctgtttcttcggct

SEQ ID NO: 821330 - DNA, 25 bp, Mus musculus
tcctggtggtgtagatcatctgctg

SEQ ID NO: 821331 - DNA, 25 bp, Mus musculus
tcctggtggtgttgatcatctgctg

SEQ ID NO: 821332 - DNA, 25 bp, Mus musculus
tcctggtgtgtgaagcagagaagcc

SEQ ID NO: 821333 - DNA, 25 bp, Mus musculus
tcctggtgtgtgtagcagagaagcc

SEQ ID NO: 821334 - DNA, 25 bp, Mus musculus
tcctggtgttagactctttcttttt

SEQ ID NO: 821335 - DNA, 25 bp, Mus musculus
tcctggtgttagtctctttcttttt

SEQ ID NO: 821336 - DNA, 25 bp, Mus musculus
tcctggttaagccaatatacatgtt

SEQ ID NO: 821337 - DNA, 25 bp, Mus musculus
tcctggttaagcgaatatacatgtt

SEQ ID NO: 821338 - DNA, 25 bp, Mus musculus
tcctggttcactcatgagtgggtat

SEQ ID NO: 821339 - DNA, 25 bp, Mus musculus
tcctggttcactgatgagtgggtat

SEQ ID NO: 821340 - DNA, 25 bp, Mus musculus
tcctggttcagtagtgttgagggca

SEQ ID NO: 821341 - DNA, 25 bp, Mus musculus
tcctggttcagttgtgttgagggca

SEQ ID NO: 821342 - DNA, 25 bp, Mus musculus
tcctggttcatcatgtgattgagtc

SEQ ID NO: 821343 - DNA, 25 bp, Mus musculus
tcctggttcatcttgtgattgagtc

SEQ ID NO: 821344 - DNA, 25 bp, Mus musculus
tcctggttcctcagattaagatcaa

SEQ ID NO: 821345 - DNA, 25 bp, Mus musculus
tcctggttcctctgattaagatcaa

SEQ ID NO: 821346 - DNA, 25 bp, Mus musculus
tcctggttccttctcccaggatgaa

SEQ ID NO: 821347 - DNA, 25 bp, Mus musculus
tcctggttccttgtcccaggatgaa

SEQ ID NO: 821348 - DNA, 25 bp, Mus musculus
tcctggttgccaagggcaacaggag

SEQ ID NO: 821349 - DNA, 25 bp, Mus musculus
tcctggttgccatgggcaacaggag

SEQ ID NO: 821350 - DNA, 25 bp, Mus musculus
tcctggttgcctatggtacaagatg

SEQ ID NO: 821351 - DNA, 25 bp, Mus musculus
tcctggttgcctttggtacaagatg

SEQ ID NO: 821352 - DNA, 25 bp, Mus musculus
tcctggttggataatcctggctctt

SEQ ID NO: 821353 - DNA, 25 bp, Mus musculus
tcctggttggattatcctggctctt

SEQ ID NO: 821354 - DNA, 25 bp, Mus musculus
tcctggttggtgcaaagtgcaagaa

SEQ ID NO: 821355 - DNA, 25 bp, Mus musculus
tcctggttggtggaaagtgcaagaa

SEQ ID NO: 821356 - DNA, 25 bp, Mus musculus
tcctggttgtcgcttcctaaacctt

SEQ ID NO: 821357 - DNA, 25 bp, Mus musculus
tcctggttgtcggttcctaaacctt

SEQ ID NO: 821358 - DNA, 25 bp, Mus musculus
tcctggtttaagagactttatacca

SEQ ID NO: 821359 - DNA, 25 bp, Mus musculus
tcctggtttaagtgactttatacca

SEQ ID NO: 821360 - DNA, 25 bp, Mus musculus
tcctggtttaccatgtaacagcagt

SEQ ID NO: 821361 - DNA, 25 bp, Mus musculus
tcctggtttaccttgtaacagcagt

SEQ ID NO: 821362 - DNA, 25 bp, Mus musculus
tcctggtttcaacattttgggagaa

SEQ ID NO: 821363 - DNA, 25 bp, Mus musculus
tcctggtttcaagattttgggagaa

SEQ ID NO: 821364 - DNA, 25 bp, Mus musculus
tcctggtttctgagctgcctagagc

SEQ ID NO: 821365 - DNA, 25 bp, Mus musculus
tcctggtttctgaggttccaatttt

SEQ ID NO: 821366 - DNA, 25 bp, Mus musculus
tcctggtttctgtgctgcctagagc

SEQ ID NO: 821367 - DNA, 25 bp, Mus musculus
tcctggtttctgtggttccaatttt

SEQ ID NO: 821368 - DNA, 25 bp, Mus musculus
tcctggtttgaacctggactttctt

SEQ ID NO: 821369 - DNA, 25 bp, Mus musculus
tcctggtttgaagctggactttctt

SEQ ID NO: 821370 - DNA, 25 bp, Mus musculus
tcctggtttgcacctgtcttcaaat

SEQ ID NO: 821371 - DNA, 25 bp, Mus musculus
tcctggtttgcagctgtcttcaaat

SEQ ID NO: 821372 - DNA, 25 bp, Mus musculus
tcctggtttggaactctcatttcta

SEQ ID NO: 821373 - DNA, 25 bp, Mus musculus
tcctggtttggatctctcatttcta

SEQ ID NO: 821374 - DNA, 25 bp, Mus musculus
tcctggtttgggatctggagatagt

SEQ ID NO: 821375 - DNA, 25 bp, Mus musculus
tcctggtttgggttctggagatagt

SEQ ID NO: 821376 - DNA, 25 bp, Mus musculus
tcctggttttacaacagttacctgt

SEQ ID NO: 821377 - DNA, 25 bp, Mus musculus
tcctggttttactacagttacctgt

SEQ ID NO: 821378 - DNA, 25 bp, Mus musculus
tcctggtttttaacctggattagta

SEQ ID NO: 821379 - DNA, 25 bp, Mus musculus
tcctggtttttatcctggattagta

SEQ ID NO: 821380 - DNA, 25 bp, Mus musculus
tcctgtaaagtaactctgtctccca

SEQ ID NO: 821381 - DNA, 25 bp, Mus musculus
tcctgtaaagtatctctgtctccca

SEQ ID NO: 821382 - DNA, 25 bp, Mus musculus
tcctgtaaatgtcaaagtgcacctt

SEQ ID NO: 821383 - DNA, 25 bp, Mus musculus
tcctgtaaatgtgaaagtgcacctt

SEQ ID NO: 821384 - DNA, 25 bp, Mus musculus
tcctgtaaccatccaagcctgtagt

SEQ ID NO: 821385 - DNA, 25 bp, Mus musculus
tcctgtaaccatgcaagcctgtagt

SEQ ID NO: 821386 - DNA, 25 bp, Mus musculus
tcctgtaacccgaagaacaaactgt

SEQ ID NO: 821387 - DNA, 25 bp, Mus musculus
tcctgtaacccgtagaacaaactgt

SEQ ID NO: 821388 - DNA, 25 bp, Mus musculus
tcctgtaaccctactcttgacagaa

SEQ ID NO: 821389 - DNA, 25 bp, Mus musculus
tcctgtaacccttctcttgacagaa

SEQ ID NO: 821390 - DNA, 25 bp, Mus musculus
tcctgtaactttacctaagcagata

SEQ ID NO: 821391 - DNA, 25 bp, Mus musculus
tcctgtaacttttcctaagcagata

SEQ ID NO: 821392 - DNA, 25 bp, Mus musculus
tcctgtaatgaaagctgtttgtcgt

SEQ ID NO: 821393 - DNA, 25 bp, Mus musculus
tcctgtaatgaatgctgtttgtcgt

SEQ ID NO: 821394 - DNA, 25 bp, Mus musculus
tcctgtaatggaaactgctgtgatg

SEQ ID NO: 821395 - DNA, 25 bp, Mus musculus
tcctgtaatggatactgctgtgatg

SEQ ID NO: 821396 - DNA, 25 bp, Mus musculus
tcctgtaattttactcctttgtcaa

SEQ ID NO: 821397 - DNA, 25 bp, Mus musculus
tcctgtaatttttctcctttgtcaa

SEQ ID NO: 821398 - DNA, 25 bp, Mus musculus
tcctgtacacataattcctcatttt

SEQ ID NO: 821399 - DNA, 25 bp, Mus musculus
tcctgtacacattattcctcatttt

SEQ ID NO: 821400 - DNA, 25 bp, Mus musculus
tcctgtacatggaagacgtctatct

SEQ ID NO: 821401 - DNA, 25 bp, Mus musculus
tcctgtacatggtagacgtctatct

SEQ ID NO: 821402 - DNA, 25 bp, Mus musculus
tcctgtaccatcagagactgctttc

SEQ ID NO: 821403 - DNA, 25 bp, Mus musculus
tcctgtaccatctgagactgctttc

SEQ ID NO: 821404 - DNA, 25 bp, Mus musculus
tcctgtacctagcaccggaggaaag

SEQ ID NO: 821405 - DNA, 25 bp, Mus musculus
tcctgtacctaggaccggaggaaag

SEQ ID NO: 821406 - DNA, 25 bp, Mus musculus
tcctgtacctctagagccttgaact

SEQ ID NO: 821407 - DNA, 25 bp, Mus musculus
tcctgtacctcttgagccttgaact

SEQ ID NO: 821408 - DNA, 25 bp, Mus musculus
tcctgtactatgcttcagctgtgaa

SEQ ID NO: 821409 - DNA, 25 bp, Mus musculus
tcctgtactatggttcagctgtgaa

SEQ ID NO: 821410 - DNA, 25 bp, Mus musculus
tcctgtactcttagggcttcaaaga

SEQ ID NO: 821411 - DNA, 25 bp, Mus musculus
tcctgtactctttgggcttcaaaga

SEQ ID NO: 821412 - DNA, 25 bp, Mus musculus
tcctgtactgtccttactgtatgta

SEQ ID NO: 821413 - DNA, 25 bp, Mus musculus
tcctgtactgtcgttactgtatgta

SEQ ID NO: 821414 - DNA, 25 bp, Mus musculus
tcctgtacttagcatttgacgtgaa

SEQ ID NO: 821415 - DNA, 25 bp, Mus musculus
tcctgtacttaggatttgacgtgaa

SEQ ID NO: 821416 - DNA, 25 bp, Mus musculus
tcctgtacttgaccctgtggaaagt

SEQ ID NO: 821417 - DNA, 25 bp, Mus musculus
tcctgtacttgagcctgtggaaagt

SEQ ID NO: 821418 - DNA, 25 bp, Mus musculus
tcctgtacttggcagatgaaagcag

SEQ ID NO: 821419 - DNA, 25 bp, Mus musculus
tcctgtacttgggagatgaaagcag

SEQ ID NO: 821420 - DNA, 25 bp, Mus musculus
tcctgtagaacacaaagtccagtct

SEQ ID NO: 821421 - DNA, 25 bp, Mus musculus
tcctgtagaacagaaagtccagtct

SEQ ID NO: 821422 - DNA, 25 bp, Mus musculus
tcctgtagccacactgggaagcaat

SEQ ID NO: 821423 - DNA, 25 bp, Mus musculus
tcctgtagccactctgggaagcaat

SEQ ID NO: 821424 - DNA, 25 bp, Mus musculus
tcctgtagcccgacatgactaatgg

SEQ ID NO: 821425 - DNA, 25 bp, Mus musculus
tcctgtagcccgtcatgactaatgg

SEQ ID NO: 821426 - DNA, 25 bp, Mus musculus
tcctgtagccctagcacagagttta

SEQ ID NO: 821427 - DNA, 25 bp, Mus musculus
tcctgtagcccttgcacagagttta

SEQ ID NO: 821428 - DNA, 25 bp, Mus musculus
tcctgtaggaccagagggctccaag

SEQ ID NO: 821429 - DNA, 25 bp, Mus musculus
tcctgtaggacctgagggctccaag

SEQ ID NO: 821430 - DNA, 25 bp, Mus musculus
tcctgtaggcgacactgttcaggtg

SEQ ID NO: 821431 - DNA, 25 bp, Mus musculus
tcctgtaggcgagactgttcaggtg

SEQ ID NO: 821432 - DNA, 25 bp, Mus musculus
tcctgtaggctgcagttgtctactc

SEQ ID NO: 821433 - DNA, 25 bp, Mus musculus
tcctgtaggctggagttgtctactc

SEQ ID NO: 821434 - DNA, 25 bp, Mus musculus
tcctgtagtagacgtggttccatcc

SEQ ID NO: 821435 - DNA, 25 bp, Mus musculus
tcctgtagtagaggtggttccatcc

SEQ ID NO: 821436 - DNA, 25 bp, Mus musculus
tcctgtagtgtgacttcagccttca

SEQ ID NO: 821437 - DNA, 25 bp, Mus musculus
tcctgtagtgtgtcttcagccttca

SEQ ID NO: 821438 - DNA, 25 bp, Mus musculus
tcctgtatagccattgtagggttac

SEQ ID NO: 821439 - DNA, 25 bp, Mus musculus
tcctgtatagcctttgtagggttac

SEQ ID NO: 821440 - DNA, 25 bp, Mus musculus
tcctgtatgcacactcaagaaaata

SEQ ID NO: 821441 - DNA, 25 bp, Mus musculus
tcctgtatgcactctcaagaaaata

SEQ ID NO: 821442 - DNA, 25 bp, Mus musculus
tcctgtatgcagaacgacggcgtca

SEQ ID NO: 821443 - DNA, 25 bp, Mus musculus
tcctgtatgcagtacgacggcgtca

SEQ ID NO: 821444 - DNA, 25 bp, Mus musculus
tcctgtatggacatgagatggcttc

SEQ ID NO: 821445 - DNA, 25 bp, Mus musculus
tcctgtatggacttgagatggcttc

SEQ ID NO: 821446 - DNA, 25 bp, Mus musculus
tcctgtatgtttcctgtaaccccag

SEQ ID NO: 821447 - DNA, 25 bp, Mus musculus
tcctgtatgtttgctgtaaccccag

SEQ ID NO: 821448 - DNA, 25 bp, Mus musculus
tcctgtattctgatctctggtaatg

SEQ ID NO: 821449 - DNA, 25 bp, Mus musculus
tcctgtattctgttctctggtaatg

SEQ ID NO: 821450 - DNA, 25 bp, Mus musculus
tcctgtattgaaagcttatttgatt

SEQ ID NO: 821451 - DNA, 25 bp, Mus musculus
tcctgtattgaatgcttatttgatt

SEQ ID NO: 821452 - DNA, 25 bp, Mus musculus
tcctgtcaacgcaatgaactccttt

SEQ ID NO: 821453 - DNA, 25 bp, Mus musculus
tcctgtcaacgctatgaactccttt

SEQ ID NO: 821454 - DNA, 25 bp, Mus musculus
tcctgtcaagctactccattgtaaa

SEQ ID NO: 821455 - DNA, 25 bp, Mus musculus
tcctgtcaagcttctccattgtaaa

SEQ ID NO: 821456 - DNA, 25 bp, Mus musculus
tcctgtcacattcacacaatttctc

SEQ ID NO: 821457 - DNA, 25 bp, Mus musculus
tcctgtcacattgacacaatttctc

SEQ ID NO: 821458 - DNA, 25 bp, Mus musculus
tcctgtcaccagcatttggaggcag

SEQ ID NO: 821459 - DNA, 25 bp, Mus musculus
tcctgtcaccaggatttggaggcag

SEQ ID NO: 821460 - DNA, 25 bp, Mus musculus
tcctgtcacggcctttacaagtgtg

SEQ ID NO: 821461 - DNA, 25 bp, Mus musculus
tcctgtcacggcgtttacaagtgtg

SEQ ID NO: 821462 - DNA, 25 bp, Mus musculus
tcctgtcacgtcctgcgagaaaagt

SEQ ID NO: 821463 - DNA, 25 bp, Mus musculus
tcctgtcacgtcgtgcgagaaaagt

SEQ ID NO: 821464 - DNA, 25 bp, Mus musculus
tcctgtcactcaagtggacctcata

SEQ ID NO: 821465 - DNA, 25 bp, Mus musculus
tcctgtcactcatgtggacctcata

SEQ ID NO: 821466 - DNA, 25 bp, Mus musculus
tcctgtcacttcctgttgtttgtag

SEQ ID NO: 821467 - DNA, 25 bp, Mus musculus
tcctgtcacttcgtgttgtttgtag

SEQ ID NO: 821468 - DNA, 25 bp, Mus musculus
tcctgtcacttgactgctgagcaca

SEQ ID NO: 821469 - DNA, 25 bp, Mus musculus
tcctgtcacttgtctgctgagcaca

SEQ ID NO: 821470 - DNA, 25 bp, Mus musculus
tcctgtcagccaaatcttgctagta

SEQ ID NO: 821471 - DNA, 25 bp, Mus musculus
tcctgtcagccatatcttgctagta

SEQ ID NO: 821472 - DNA, 25 bp, Mus musculus
tcctgtcaggttctctacagagact

SEQ ID NO: 821473 - DNA, 25 bp, Mus musculus
tcctgtcaggttgtctacagagact

SEQ ID NO: 821474 - DNA, 25 bp, Mus musculus
tcctgtcatcgcacatattatttgt

SEQ ID NO: 821475 - DNA, 25 bp, Mus musculus
tcctgtcatcgctcatattatttgt

SEQ ID NO: 821476 - DNA, 25 bp, Mus musculus
tcctgtcatgttctgatgcagcaag

SEQ ID NO: 821477 - DNA, 25 bp, Mus musculus
tcctgtcatgttgtgatgcagcaag

SEQ ID NO: 821478 - DNA, 25 bp, Mus musculus
tcctgtcattggatttggcacgtga

SEQ ID NO: 821479 - DNA, 25 bp, Mus musculus
tcctgtcattggttttggcacgtga

SEQ ID NO: 821480 - DNA, 25 bp, Mus musculus
tcctgtcattttcatgtgacccaga

SEQ ID NO: 821481 - DNA, 25 bp, Mus musculus
tcctgtcattttgatgtgacccaga

SEQ ID NO: 821482 - DNA, 25 bp, Mus musculus
tcctgtccagctctatataaaccca

SEQ ID NO: 821483 - DNA, 25 bp, Mus musculus
tcctgtccagctgtatataaaccca

SEQ ID NO: 821484 - DNA, 25 bp, Mus musculus
tcctgtccaggtaccaaacaccgat

SEQ ID NO: 821485 - DNA, 25 bp, Mus musculus
tcctgtccaggttccaaacaccgat

SEQ ID NO: 821486 - DNA, 25 bp, Mus musculus
tcctgtccatcgagtgcctgatgat

SEQ ID NO: 821487 - DNA, 25 bp, Mus musculus
tcctgtccatcgtgtgcctgatgat

SEQ ID NO: 821488 - DNA, 25 bp, Mus musculus
tcctgtccatgtactattggatgta

SEQ ID NO: 821489 - DNA, 25 bp, Mus musculus
tcctgtccatgttctattggatgta

SEQ ID NO: 821490 - DNA, 25 bp, Mus musculus
tcctgtcccatgaggtaaacccaat

SEQ ID NO: 821491 - DNA, 25 bp, Mus musculus
tcctgtcccatgtggtaaacccaat

SEQ ID NO: 821492 - DNA, 25 bp, Mus musculus
tcctgtcccgaactaagtgcatgaa

SEQ ID NO: 821493 - DNA, 25 bp, Mus musculus
tcctgtcccgaagtaagtgcatgaa

SEQ ID NO: 821494 - DNA, 25 bp, Mus musculus
tcctgtcccttacgtggagaagtat

SEQ ID NO: 821495 - DNA, 25 bp, Mus musculus
tcctgtcccttacgttgaaaagctt

SEQ ID NO: 821496 - DNA, 25 bp, Mus musculus
tcctgtcccttaggtggagaagtat

SEQ ID NO: 821497 - DNA, 25 bp, Mus musculus
tcctgtcccttaggttgaaaagctt

SEQ ID NO: 821498 - DNA, 25 bp, Mus musculus
tcctgtccgggcaaagattacgtat

SEQ ID NO: 821499 - DNA, 25 bp, Mus musculus
tcctgtccgggctaagattacgtat

SEQ ID NO: 821500 - DNA, 25 bp, Mus musculus
tcctgtcctcccacatgggctgtgg

SEQ ID NO: 821501 - DNA, 25 bp, Mus musculus
tcctgtcctccctcatgggctgtgg

SEQ ID NO: 821502 - DNA, 25 bp, Mus musculus
tcctgtcctgacatgtgatagtgat

SEQ ID NO: 821503 - DNA, 25 bp, Mus musculus
tcctgtcctgacttgtgatagtgat

SEQ ID NO: 821504 - DNA, 25 bp, Mus musculus
tcctgtcctgatcttttcatcaagg

SEQ ID NO: 821505 - DNA, 25 bp, Mus musculus
tcctgtcctgatgttttcatcaagg

SEQ ID NO: 821506 - DNA, 25 bp, Mus musculus
tcctgtcgaaacctggctcctggct

SEQ ID NO: 821507 - DNA, 25 bp, Mus musculus
tcctgtcgaaacgtggctcctggct

SEQ ID NO: 821508 - DNA, 25 bp, Mus musculus
tcctgtcgaggtagcttctggaaca

SEQ ID NO: 821509 - DNA, 25 bp, Mus musculus
tcctgtcgaggttgcttctggaaca

SEQ ID NO: 821510 - DNA, 25 bp, Mus musculus
tcctgtcggtttcgtcagttgcagt

SEQ ID NO: 821511 - DNA, 25 bp, Mus musculus
tcctgtcggtttggtcagttgcagt

SEQ ID NO: 821512 - DNA, 25 bp, Mus musculus
tcctgtctacagatgatggttcaat

SEQ ID NO: 821513 - DNA, 25 bp, Mus musculus
tcctgtctacagttgatggttcaat

SEQ ID NO: 821514 - DNA, 25 bp, Mus musculus
tcctgtctatccaagtgtccatgaa

SEQ ID NO: 821515 - DNA, 25 bp, Mus musculus
tcctgtctatcctagtgtccatgaa

SEQ ID NO: 821516 - DNA, 25 bp, Mus musculus
tcctgtctatctaatgtttgtttcc

SEQ ID NO: 821517 - DNA, 25 bp, Mus musculus
tcctgtctatcttatgtttgtttcc

SEQ ID NO: 821518 - DNA, 25 bp, Mus musculus
tcctgtctatttccagaattcgatg

SEQ ID NO: 821519 - DNA, 25 bp, Mus musculus
tcctgtctatttgcagaattcgatg

SEQ ID NO: 821520 - DNA, 25 bp, Mus musculus
tcctgtctcacccttcaaaggttat

SEQ ID NO: 821521 - DNA, 25 bp, Mus musculus
tcctgtctcaccgttcaaaggttat

SEQ ID NO: 821522 - DNA, 25 bp, Mus musculus
tcctgtctcagtagcagcttcacaa

SEQ ID NO: 821523 - DNA, 25 bp, Mus musculus
tcctgtctcagttgcagcttcacaa

SEQ ID NO: 821524 - DNA, 25 bp, Mus musculus
tcctgtctcatgaggagcagctgct

SEQ ID NO: 821525 - DNA, 25 bp, Mus musculus
tcctgtctcatgtggagcagctgct

SEQ ID NO: 821526 - DNA, 25 bp, Mus musculus
tcctgtctccatattgccacaaagg

SEQ ID NO: 821527 - DNA, 25 bp, Mus musculus
tcctgtctccattttgccacaaagg

SEQ ID NO: 821528 - DNA, 25 bp, Mus musculus
tcctgtctcccaatgtcatttttgt

SEQ ID NO: 821529 - DNA, 25 bp, Mus musculus
tcctgtctcccattgtcatttttgt

SEQ ID NO: 821530 - DNA, 25 bp, Mus musculus
tcctgtctcggccctggcgctgaat

SEQ ID NO: 821531 - DNA, 25 bp, Mus musculus
tcctgtctcggcgctggcgctgaat

SEQ ID NO: 821532 - DNA, 25 bp, Mus musculus
tcctgtctgaccaggtggcatggtg

SEQ ID NO: 821533 - DNA, 25 bp, Mus musculus
tcctgtctgaccctcagtttgacca

SEQ ID NO: 821534 - DNA, 25 bp, Mus musculus
tcctgtctgaccgtcagtttgacca

SEQ ID NO: 821535 - DNA, 25 bp, Mus musculus
tcctgtctgacctggtggcatggtg

SEQ ID NO: 821536 - DNA, 25 bp, Mus musculus
tcctgtctgcatccattcggtctgc

SEQ ID NO: 821537 - DNA, 25 bp, Mus musculus
tcctgtctgcatgcattcggtctgc

SEQ ID NO: 821538 - DNA, 25 bp, Mus musculus
tcctgtctgctcaatcactgtgtag

SEQ ID NO: 821539 - DNA, 25 bp, Mus musculus
tcctgtctgctctatcactgtgtag

SEQ ID NO: 821540 - DNA, 25 bp, Mus musculus
tcctgtctggctcagtatagcctca

SEQ ID NO: 821541 - DNA, 25 bp, Mus musculus
tcctgtctggctgagtatagcctca

SEQ ID NO: 821542 - DNA, 25 bp, Mus musculus
tcctgtctgtccaagaacttttccc

SEQ ID NO: 821543 - DNA, 25 bp, Mus musculus
tcctgtctgtcctagaacttttccc

SEQ ID NO: 821544 - DNA, 25 bp, Mus musculus
tcctgtctgtctatatatgcatgtg

SEQ ID NO: 821545 - DNA, 25 bp, Mus musculus
tcctgtctgtctccagagcgagcag

SEQ ID NO: 821546 - DNA, 25 bp, Mus musculus
tcctgtctgtctgcagagcgagcag

SEQ ID NO: 821547 - DNA, 25 bp, Mus musculus
tcctgtctgtctttatatgcatgtg

SEQ ID NO: 821548 - DNA, 25 bp, Mus musculus
tcctgtcttattatccagaatgttt

SEQ ID NO: 821549 - DNA, 25 bp, Mus musculus
tcctgtcttattttccagaatgttt

SEQ ID NO: 821550 - DNA, 25 bp, Mus musculus
tcctgtcttccaaaattcatgcttt

SEQ ID NO: 821551 - DNA, 25 bp, Mus musculus
tcctgtcttccataattcatgcttt

SEQ ID NO: 821552 - DNA, 25 bp, Mus musculus
tcctgtcttgagcatcttcgtgaac

SEQ ID NO: 821553 - DNA, 25 bp, Mus musculus
tcctgtcttgaggatcttcgtgaac

SEQ ID NO: 821554 - DNA, 25 bp, Mus musculus
tcctgtcttgtacctaagttctcta

SEQ ID NO: 821555 - DNA, 25 bp, Mus musculus
tcctgtcttgtagctaagttctcta

SEQ ID NO: 821556 - DNA, 25 bp, Mus musculus
tcctgtctttctatggcctgttgaa

SEQ ID NO: 821557 - DNA, 25 bp, Mus musculus
tcctgtctttctttggcctgttgaa

SEQ ID NO: 821558 - DNA, 25 bp, Mus musculus
tcctgtcttttgagacacaatcaga

SEQ ID NO: 821559 - DNA, 25 bp, Mus musculus
tcctgtcttttgtgacacaatcaga

SEQ ID NO: 821560 - DNA, 25 bp, Mus musculus
tcctgtctttttagggtcagagccc

SEQ ID NO: 821561 - DNA, 25 bp, Mus musculus
tcctgtcttttttgggtcagagccc

SEQ ID NO: 821562 - DNA, 25 bp, Mus musculus
tcctgtgaaaccagcaagcctcagg

SEQ ID NO: 821563 - DNA, 25 bp, Mus musculus
tcctgtgaaacctgcaagcctcagg

SEQ ID NO: 821564 - DNA, 25 bp, Mus musculus
tcctgtgacaccattgccaagatct

SEQ ID NO: 821565 - DNA, 25 bp, Mus musculus
tcctgtgacacctttgccaagatct

SEQ ID NO: 821566 - DNA, 25 bp, Mus musculus
tcctgtgacccccaggatggagcct

SEQ ID NO: 821567 - DNA, 25 bp, Mus musculus
tcctgtgaccccgaggatggagcct

SEQ ID NO: 821568 - DNA, 25 bp, Mus musculus
tcctgtgactgcaatctcatctgat

SEQ ID NO: 821569 - DNA, 25 bp, Mus musculus
tcctgtgactgctatctcatctgat

SEQ ID NO: 821570 - DNA, 25 bp, Mus musculus
tcctgtgagacaccaaagtgtggct

SEQ ID NO: 821571 - DNA, 25 bp, Mus musculus
tcctgtgagacagcaaagtgtggct

SEQ ID NO: 821572 - DNA, 25 bp, Mus musculus
tcctgtgagaggaactgagctccaa

SEQ ID NO: 821573 - DNA, 25 bp, Mus musculus
tcctgtgagaggtactgagctccaa

SEQ ID NO: 821574 - DNA, 25 bp, Mus musculus
tcctgtgaggtactgaatctttgaa

SEQ ID NO: 821575 - DNA, 25 bp, Mus musculus
tcctgtgaggtagtgaatctttgaa

SEQ ID NO: 821576 - DNA, 25 bp, Mus musculus
tcctgtgagtctatccagtgtagaa

SEQ ID NO: 821577 - DNA, 25 bp, Mus musculus
tcctgtgagtctttccagtgtagaa

SEQ ID NO: 821578 - DNA, 25 bp, Mus musculus
tcctgtgataatccttagtgtgtac

SEQ ID NO: 821579 - DNA, 25 bp, Mus musculus
tcctgtgataatgcttagtgtgtac

SEQ ID NO: 821580 - DNA, 25 bp, Mus musculus
tcctgtgataggacactcccattgt

SEQ ID NO: 821581 - DNA, 25 bp, Mus musculus
tcctgtgataggtcactcccattgt

SEQ ID NO: 821582 - DNA, 25 bp, Mus musculus
tcctgtgatcgtctgtgtatgtgag

SEQ ID NO: 821583 - DNA, 25 bp, Mus musculus
tcctgtgatcgtgtgtgtatgtgag

SEQ ID NO: 821584 - DNA, 25 bp, Mus musculus
tcctgtgcaaaaagcattgcctgtt

SEQ ID NO: 821585 - DNA, 25 bp, Mus musculus
tcctgtgcaaaatgcattgcctgtt

SEQ ID NO: 821586 - DNA, 25 bp, Mus musculus
tcctgtgcacatagcctaaagtcat

SEQ ID NO: 821587 - DNA, 25 bp, Mus musculus
tcctgtgcacattgcctaaagtcat

SEQ ID NO: 821588 - DNA, 25 bp, Mus musculus
tcctgtgcagaacgccgccagcttg

SEQ ID NO: 821589 - DNA, 25 bp, Mus musculus
tcctgtgcagaaggccgccagcttg

SEQ ID NO: 821590 - DNA, 25 bp, Mus musculus
tcctgtgcagagatctgtgggccgc

SEQ ID NO: 821591 - DNA, 25 bp, Mus musculus
tcctgtgcagagttctgtgggccgc

SEQ ID NO: 821592 - DNA, 25 bp, Mus musculus
tcctgtgcaggacgttttacaccct

SEQ ID NO: 821593 - DNA, 25 bp, Mus musculus
tcctgtgcaggaggttttacaccct

SEQ ID NO: 821594 - DNA, 25 bp, Mus musculus
tcctgtgcatctacttgtctaagtt

SEQ ID NO: 821595 - DNA, 25 bp, Mus musculus
tcctgtgcatcttcttgtctaagtt

SEQ ID NO: 821596 - DNA, 25 bp, Mus musculus
tcctgtgcatgtctgccctggacat

SEQ ID NO: 821597 - DNA, 25 bp, Mus musculus
tcctgtgcatgtgtgccctggacat

SEQ ID NO: 821598 - DNA, 25 bp, Mus musculus
tcctgtgcattcacatgagtatctt

SEQ ID NO: 821599 - DNA, 25 bp, Mus musculus
tcctgtgcattctcatgagtatctt

SEQ ID NO: 821600 - DNA, 25 bp, Mus musculus
tcctgtgccatcaagtggagaaagg

SEQ ID NO: 821601 - DNA, 25 bp, Mus musculus
tcctgtgccatctagtggagaaagg

SEQ ID NO: 821602 - DNA, 25 bp, Mus musculus
tcctgtgcccaacattcatgaatgt

SEQ ID NO: 821603 - DNA, 25 bp, Mus musculus
tcctgtgcccaagattcatgaatgt

SEQ ID NO: 821604 - DNA, 25 bp, Mus musculus
tcctgtgcccagaatggtctcagaa

SEQ ID NO: 821605 - DNA, 25 bp, Mus musculus
tcctgtgcccagtatggtctcagaa

SEQ ID NO: 821606 - DNA, 25 bp, Mus musculus
tcctgtgcccatatttatcattaaa

SEQ ID NO: 821607 - DNA, 25 bp, Mus musculus
tcctgtgcccatttttatcattaaa

SEQ ID NO: 821608 - DNA, 25 bp, Mus musculus
tcctgtgccgccacgatttatgggt

SEQ ID NO: 821609 - DNA, 25 bp, Mus musculus
tcctgtgccgcctcgatttatgggt

SEQ ID NO: 821610 - DNA, 25 bp, Mus musculus
tcctgtgcctaaattggtccaagca

SEQ ID NO: 821611 - DNA, 25 bp, Mus musculus
tcctgtgcctaatttggtccaagca

SEQ ID NO: 821612 - DNA, 25 bp, Mus musculus
tcctgtgcctgacaactcgatatga

SEQ ID NO: 821613 - DNA, 25 bp, Mus musculus
tcctgtgcctgagaactcgatatga

SEQ ID NO: 821614 - DNA, 25 bp, Mus musculus
tcctgtgcctggaacgatcccataa

SEQ ID NO: 821615 - DNA, 25 bp, Mus musculus
tcctgtgcctggtacgatcccataa

SEQ ID NO: 821616 - DNA, 25 bp, Mus musculus
tcctgtgcctgtaggagttccagtt

SEQ ID NO: 821617 - DNA, 25 bp, Mus musculus
tcctgtgcctgttggagttccagtt

SEQ ID NO: 821618 - DNA, 25 bp, Mus musculus
tcctgtgccttcattgtatatgggc

SEQ ID NO: 821619 - DNA, 25 bp, Mus musculus
tcctgtgccttctttgtatatgggc

SEQ ID NO: 821620 - DNA, 25 bp, Mus musculus
tcctgtgcgaatagaggtcctcact

SEQ ID NO: 821621 - DNA, 25 bp, Mus musculus
tcctgtgcgaattgaggtcctcact

SEQ ID NO: 821622 - DNA, 25 bp, Mus musculus
tcctgtgctattcgtgatcggcatt

SEQ ID NO: 821623 - DNA, 25 bp, Mus musculus
tcctgtgctattggtgatcggcatt

SEQ ID NO: 821624 - DNA, 25 bp, Mus musculus
tcctgtgctccaaatttattcgtga

SEQ ID NO: 821625 - DNA, 25 bp, Mus musculus
tcctgtgctccatatttattcgtga

SEQ ID NO: 821626 - DNA, 25 bp, Mus musculus
tcctgtgctgagaatctctgtggcc

SEQ ID NO: 821627 - DNA, 25 bp, Mus musculus
tcctgtgctgagtatctctgtggcc

SEQ ID NO: 821628 - DNA, 25 bp, Mus musculus
tcctgtgctgatcataccgggaaca

SEQ ID NO: 821629 - DNA, 25 bp, Mus musculus
tcctgtgctgatgataccgggaaca

SEQ ID NO: 821630 - DNA, 25 bp, Mus musculus
tcctgtgctgccatagtacttatat

SEQ ID NO: 821631 - DNA, 25 bp, Mus musculus
tcctgtgctgccttagtacttatat

SEQ ID NO: 821632 - DNA, 25 bp, Mus musculus
tcctgtgctgttagcattctcgata

SEQ ID NO: 821633 - DNA, 25 bp, Mus musculus
tcctgtgctgtttgcattctcgata

SEQ ID NO: 821634 - DNA, 25 bp, Mus musculus
tcctgtgcttgaattccaacatggc

SEQ ID NO: 821635 - DNA, 25 bp, Mus musculus
tcctgtgcttgatttccaacatggc

SEQ ID NO: 821636 - DNA, 25 bp, Mus musculus
tcctgtgctttcatgtaatggtcac

SEQ ID NO: 821637 - DNA, 25 bp, Mus musculus
tcctgtgctttcttgtaatggtcac

SEQ ID NO: 821638 - DNA, 25 bp, Mus musculus
tcctgtggacaaaaatctccccgtt

SEQ ID NO: 821639 - DNA, 25 bp, Mus musculus
tcctgtggacaataatctccccgtt

SEQ ID NO: 821640 - DNA, 25 bp, Mus musculus
tcctgtggaccactgctgtttgtta

SEQ ID NO: 821641 - DNA, 25 bp, Mus musculus
tcctgtggaccagtgctgtttgtta

SEQ ID NO: 821642 - DNA, 25 bp, Mus musculus
tcctgtggacccaagctgctgtaag

SEQ ID NO: 821643 - DNA, 25 bp, Mus musculus
tcctgtggaccctagctgctgtaag

SEQ ID NO: 821644 - DNA, 25 bp, Mus musculus
tcctgtggacgcaggtttgtgagca

SEQ ID NO: 821645 - DNA, 25 bp, Mus musculus
tcctgtggacgctggtttgtgagca

SEQ ID NO: 821646 - DNA, 25 bp, Mus musculus
tcctgtggagaccagtccgaggaac

SEQ ID NO: 821647 - DNA, 25 bp, Mus musculus
tcctgtggagacgagtccgaggaac

SEQ ID NO: 821648 - DNA, 25 bp, Mus musculus
tcctgtggcacacaaggctttcgca

SEQ ID NO: 821649 - DNA, 25 bp, Mus musculus
tcctgtggcacagaaggctttcgca

SEQ ID NO: 821650 - DNA, 25 bp, Mus musculus
tcctgtggcatccttcatgcaataa

SEQ ID NO: 821651 - DNA, 25 bp, Mus musculus
tcctgtggcatcgttcatgcaataa

SEQ ID NO: 821652 - DNA, 25 bp, Mus musculus
tcctgtggccctatggtgtgatgct

SEQ ID NO: 821653 - DNA, 25 bp, Mus musculus
tcctgtggccctttggtgtgatgct

SEQ ID NO: 821654 - DNA, 25 bp, Mus musculus
tcctgtggcctaccagttatatctc

SEQ ID NO: 821655 - DNA, 25 bp, Mus musculus
tcctgtggcctagcagttatatctc

SEQ ID NO: 821656 - DNA, 25 bp, Mus musculus
tcctgtggcctgcaaggtctagtga

SEQ ID NO: 821657 - DNA, 25 bp, Mus musculus
tcctgtggcctggaaggtctagtga

SEQ ID NO: 821658 - DNA, 25 bp, Mus musculus
tcctgtggctcccttgtcagtggcg

SEQ ID NO: 821659 - DNA, 25 bp, Mus musculus
tcctgtggctccgttgtcagtggcg

SEQ ID NO: 821660 - DNA, 25 bp, Mus musculus
tcctgtggctggagaatcttttcag

SEQ ID NO: 821661 - DNA, 25 bp, Mus musculus
tcctgtggctggtgaatcttttcag

SEQ ID NO: 821662 - DNA, 25 bp, Mus musculus
tcctgtggctttccaagttcctaat

SEQ ID NO: 821663 - DNA, 25 bp, Mus musculus
tcctgtggctttgcaagttcctaat

SEQ ID NO: 821664 - DNA, 25 bp, Mus musculus
tcctgtgggacgagtgcgatggatt

SEQ ID NO: 821665 - DNA, 25 bp, Mus musculus
tcctgtgggacgtgtgcgatggatt

SEQ ID NO: 821666 - DNA, 25 bp, Mus musculus
tcctgtgggactattgccatgtact

SEQ ID NO: 821667 - DNA, 25 bp, Mus musculus
tcctgtgggacttttgccatgtact

SEQ ID NO: 821668 - DNA, 25 bp, Mus musculus
tcctgtggtacaccatgaggcccag

SEQ ID NO: 821669 - DNA, 25 bp, Mus musculus
tcctgtggtacagcatgaggcccag

SEQ ID NO: 821670 - DNA, 25 bp, Mus musculus
tcctgtggtattccagcaagaggaa

SEQ ID NO: 821671 - DNA, 25 bp, Mus musculus
tcctgtggtattgcagcaagaggaa

SEQ ID NO: 821672 - DNA, 25 bp, Mus musculus
tcctgtggtctcagagtcgggaagt

SEQ ID NO: 821673 - DNA, 25 bp, Mus musculus
tcctgtggtctctgagtcgggaagt

SEQ ID NO: 821674 - DNA, 25 bp, Mus musculus
tcctgtggtggacttcgctgctgat

SEQ ID NO: 821675 - DNA, 25 bp, Mus musculus
tcctgtggtggagttcgctgctgat

SEQ ID NO: 821676 - DNA, 25 bp, Mus musculus
tcctgtggtggcacttctgtaaaca

SEQ ID NO: 821677 - DNA, 25 bp, Mus musculus
tcctgtggtggcattggcagctgta

SEQ ID NO: 821678 - DNA, 25 bp, Mus musculus
tcctgtggtggctcttctgtaaaca

SEQ ID NO: 821679 - DNA, 25 bp, Mus musculus
tcctgtggtggctttggcagctgta

SEQ ID NO: 821680 - DNA, 25 bp, Mus musculus
tcctgtggttggacctgatgttgta

SEQ ID NO: 821681 - DNA, 25 bp, Mus musculus
tcctgtggttggtcctgatgttgta

SEQ ID NO: 821682 - DNA, 25 bp, Mus musculus
tcctgtgtaaccagctttaaatgct

SEQ ID NO: 821683 - DNA, 25 bp, Mus musculus
tcctgtgtaacctgctttaaatgct

SEQ ID NO: 821684 - DNA, 25 bp, Mus musculus
tcctgtgtacagatgctctttagag

SEQ ID NO: 821685 - DNA, 25 bp, Mus musculus
tcctgtgtacagttgctctttagag

SEQ ID NO: 821686 - DNA, 25 bp, Mus musculus
tcctgtgtactgatttgcatactgc

SEQ ID NO: 821687 - DNA, 25 bp, Mus musculus
tcctgtgtactgttttgcatactgc

SEQ ID NO: 821688 - DNA, 25 bp, Mus musculus
tcctgtgtagtgagtgaggtcccga

SEQ ID NO: 821689 - DNA, 25 bp, Mus musculus
tcctgtgtagtgtgtgaggtcccga

SEQ ID NO: 821690 - DNA, 25 bp, Mus musculus
tcctgtgtctacagagaagccccat

SEQ ID NO: 821691 - DNA, 25 bp, Mus musculus
tcctgtgtctactgagaagccccat

SEQ ID NO: 821692 - DNA, 25 bp, Mus musculus
tcctgtgtctctcgtgttgcacgaa

SEQ ID NO: 821693 - DNA, 25 bp, Mus musculus
tcctgtgtctctggtgttgcacgaa

SEQ ID NO: 821694 - DNA, 25 bp, Mus musculus
tcctgtgtgaaaaacactctctatg

SEQ ID NO: 821695 - DNA, 25 bp, Mus musculus
tcctgtgtgaaatacactctctatg

SEQ ID NO: 821696 - DNA, 25 bp, Mus musculus
tcctgtgtgagcaccagacttgtat

SEQ ID NO: 821697 - DNA, 25 bp, Mus musculus
tcctgtgtgagccactggatgtcaa

SEQ ID NO: 821698 - DNA, 25 bp, Mus musculus
tcctgtgtgagcgactggatgtcaa

SEQ ID NO: 821699 - DNA, 25 bp, Mus musculus
tcctgtgtgagctccagacttgtat

SEQ ID NO: 821700 - DNA, 25 bp, Mus musculus
tcctgtgtgatcactacccaactgt

SEQ ID NO: 821701 - DNA, 25 bp, Mus musculus
tcctgtgtgatctctacccaactgt

SEQ ID NO: 821702 - DNA, 25 bp, Mus musculus
tcctgtgtgcagagcccaaggtggc

SEQ ID NO: 821703 - DNA, 25 bp, Mus musculus
tcctgtgtgcagtgcccaaggtggc

SEQ ID NO: 821704 - DNA, 25 bp, Mus musculus
tcctgtgtgcatctccattacatct

SEQ ID NO: 821705 - DNA, 25 bp, Mus musculus
tcctgtgtgcatgtccattacatct

SEQ ID NO: 821706 - DNA, 25 bp, Mus musculus
tcctgtgtgctcactgggtaagcag

SEQ ID NO: 821707 - DNA, 25 bp, Mus musculus
tcctgtgtgctctctgggtaagcag

SEQ ID NO: 821708 - DNA, 25 bp, Mus musculus
tcctgtgtggctccgtctgtatgtg

SEQ ID NO: 821709 - DNA, 25 bp, Mus musculus
tcctgtgtggctgcgtctgtatgtg

SEQ ID NO: 821710 - DNA, 25 bp, Mus musculus
tcctgtgtgtccctatgtggaacta

SEQ ID NO: 821711 - DNA, 25 bp, Mus musculus
tcctgtgtgtccgtatgtggaacta

SEQ ID NO: 821712 - DNA, 25 bp, Mus musculus
tcctgtgtgttcatctcaaatgtga

SEQ ID NO: 821713 - DNA, 25 bp, Mus musculus
tcctgtgtgttcttctcaaatgtga

SEQ ID NO: 821714 - DNA, 25 bp, Mus musculus
tcctgtgttactagcgtggcctcaa

SEQ ID NO: 821715 - DNA, 25 bp, Mus musculus
tcctgtgttacttgcgtggcctcaa

SEQ ID NO: 821716 - DNA, 25 bp, Mus musculus
tcctgtgttaggaatctctctagat

SEQ ID NO: 821717 - DNA, 25 bp, Mus musculus
tcctgtgttaggtatctctctagat

SEQ ID NO: 821718 - DNA, 25 bp, Mus musculus
tcctgtgttcacatgtataacaatg

SEQ ID NO: 821719 - DNA, 25 bp, Mus musculus
tcctgtgttcacttgtataacaatg

SEQ ID NO: 821720 - DNA, 25 bp, Mus musculus
tcctgtgttcagaaccctgagttga

SEQ ID NO: 821721 - DNA, 25 bp, Mus musculus
tcctgtgttcagaagcatggttaat

SEQ ID NO: 821722 - DNA, 25 bp, Mus musculus
tcctgtgttcagtaccctgagttga

SEQ ID NO: 821723 - DNA, 25 bp, Mus musculus
tcctgtgttcagtagcatggttaat

SEQ ID NO: 821724 - DNA, 25 bp, Mus musculus
tcctgtgttccaaagctcgagactg

SEQ ID NO: 821725 - DNA, 25 bp, Mus musculus
tcctgtgttccatagctcgagactg

SEQ ID NO: 821726 - DNA, 25 bp, Mus musculus
tcctgtgttctcaggcactccaaag

SEQ ID NO: 821727 - DNA, 25 bp, Mus musculus
tcctgtgttctctggcactccaaag

SEQ ID NO: 821728 - DNA, 25 bp, Mus musculus
tcctgtgttcttctacatggtgcaa

SEQ ID NO: 821729 - DNA, 25 bp, Mus musculus
tcctgtgttcttgtacatggtgcaa

SEQ ID NO: 821730 - DNA, 25 bp, Mus musculus
tcctgtgttgccatctgtaatcccc

SEQ ID NO: 821731 - DNA, 25 bp, Mus musculus
tcctgtgttgccttctgtaatcccc

SEQ ID NO: 821732 - DNA, 25 bp, Mus musculus
tcctgtgttgttccctcagcgttaa

SEQ ID NO: 821733 - DNA, 25 bp, Mus musculus
tcctgtgttgttgcctcagcgttaa

SEQ ID NO: 821734 - DNA, 25 bp, Mus musculus
tcctgtgtttgcacctttgtgtgta

SEQ ID NO: 821735 - DNA, 25 bp, Mus musculus
tcctgtgtttgctcctttgtgtgta

SEQ ID NO: 821736 - DNA, 25 bp, Mus musculus
tcctgtgttttaatgacattgtatt

SEQ ID NO: 821737 - DNA, 25 bp, Mus musculus
tcctgtgttttattgacattgtatt

SEQ ID NO: 821738 - DNA, 25 bp, Mus musculus
tcctgttaaacacgtggaccccaag

SEQ ID NO: 821739 - DNA, 25 bp, Mus musculus
tcctgttaaacaggtggaccccaag

SEQ ID NO: 821740 - DNA, 25 bp, Mus musculus
tcctgttaacacagagtgccctggg

SEQ ID NO: 821741 - DNA, 25 bp, Mus musculus
tcctgttaacactgagtgccctggg

SEQ ID NO: 821742 - DNA, 25 bp, Mus musculus
tcctgttaagtcatgccatcagcca

SEQ ID NO: 821743 - DNA, 25 bp, Mus musculus
tcctgttaagtcttgccatcagcca

SEQ ID NO: 821744 - DNA, 25 bp, Mus musculus
tcctgttacaagaagatgacttcga

SEQ ID NO: 821745 - DNA, 25 bp, Mus musculus
tcctgttacaagtagatgacttcga

SEQ ID NO: 821746 - DNA, 25 bp, Mus musculus
tcctgttactcgcacactgaagcca

SEQ ID NO: 821747 - DNA, 25 bp, Mus musculus
tcctgttactcggacactgaagcca

SEQ ID NO: 821748 - DNA, 25 bp, Mus musculus
tcctgttagaatctcttagtcgtat

SEQ ID NO: 821749 - DNA, 25 bp, Mus musculus
tcctgttagaatgtcttagtcgtat

SEQ ID NO: 821750 - DNA, 25 bp, Mus musculus
tcctgttagctgagtgccaggctct

SEQ ID NO: 821751 - DNA, 25 bp, Mus musculus
tcctgttagctgtgtgccaggctct

SEQ ID NO: 821752 - DNA, 25 bp, Mus musculus
tcctgttcacagatgtatattaaga

SEQ ID NO: 821753 - DNA, 25 bp, Mus musculus
tcctgttcacagttgtatattaaga

SEQ ID NO: 821754 - DNA, 25 bp, Mus musculus
tcctgttcacatcagttcagctaaa

SEQ ID NO: 821755 - DNA, 25 bp, Mus musculus
tcctgttcacatgagttcagctaaa

SEQ ID NO: 821756 - DNA, 25 bp, Mus musculus
tcctgttcagctcgatcgtggatga

SEQ ID NO: 821757 - DNA, 25 bp, Mus musculus
tcctgttcagctggatcgtggatga

SEQ ID NO: 821758 - DNA, 25 bp, Mus musculus
tcctgttcaggtatttgttttgaca

SEQ ID NO: 821759 - DNA, 25 bp, Mus musculus
tcctgttcaggtttttgttttgaca

SEQ ID NO: 821760 - DNA, 25 bp, Mus musculus
tcctgttcatccataggcatttatc

SEQ ID NO: 821761 - DNA, 25 bp, Mus musculus
tcctgttcatccttaggcatttatc

SEQ ID NO: 821762 - DNA, 25 bp, Mus musculus
tcctgttcccacaacaacatgaacc

SEQ ID NO: 821763 - DNA, 25 bp, Mus musculus
tcctgttcccactacaacatgaacc

SEQ ID NO: 821764 - DNA, 25 bp, Mus musculus
tcctgttccccaattagttcttgat

SEQ ID NO: 821765 - DNA, 25 bp, Mus musculus
tcctgttccccatttagttcttgat

SEQ ID NO: 821766 - DNA, 25 bp, Mus musculus
tcctgttccccgagccggatagctg

SEQ ID NO: 821767 - DNA, 25 bp, Mus musculus
tcctgttccccgtgccggatagctg

SEQ ID NO: 821768 - DNA, 25 bp, Mus musculus
tcctgttccctcacggattaaggta

SEQ ID NO: 821769 - DNA, 25 bp, Mus musculus
tcctgttccctctcggattaaggta

SEQ ID NO: 821770 - DNA, 25 bp, Mus musculus
tcctgttcctcaatcatgtaatcaa

SEQ ID NO: 821771 - DNA, 25 bp, Mus musculus
tcctgttcctcattcatgtaatcaa

SEQ ID NO: 821772 - DNA, 25 bp, Mus musculus
tcctgttcctcgaattccagctgaa

SEQ ID NO: 821773 - DNA, 25 bp, Mus musculus
tcctgttcctcgtattccagctgaa

SEQ ID NO: 821774 - DNA, 25 bp, Mus musculus
tcctgttcctgtaagctatccatgt

SEQ ID NO: 821775 - DNA, 25 bp, Mus musculus
tcctgttcctgttagctatccatgt

SEQ ID NO: 821776 - DNA, 25 bp, Mus musculus
tcctgttccttcacacaaggttttg

SEQ ID NO: 821777 - DNA, 25 bp, Mus musculus
tcctgttccttctcacaaggttttg

SEQ ID NO: 821778 - DNA, 25 bp, Mus musculus
tcctgttcctttccctgtcttttta

SEQ ID NO: 821779 - DNA, 25 bp, Mus musculus
tcctgttcctttgcctgtcttttta

SEQ ID NO: 821780 - DNA, 25 bp, Mus musculus
tcctgttcgcatccgtggctgctga

SEQ ID NO: 821781 - DNA, 25 bp, Mus musculus
tcctgttcgcatgcgtggctgctga

SEQ ID NO: 821782 - DNA, 25 bp, Mus musculus
tcctgttctaatattgcagtgcaac

SEQ ID NO: 821783 - DNA, 25 bp, Mus musculus
tcctgttctaattttgcagtgcaac

SEQ ID NO: 821784 - DNA, 25 bp, Mus musculus
tcctgttctctaactattcactggg

SEQ ID NO: 821785 - DNA, 25 bp, Mus musculus
tcctgttctctatctattcactggg

SEQ ID NO: 821786 - DNA, 25 bp, Mus musculus
tcctgttctctcagagctttcataa

SEQ ID NO: 821787 - DNA, 25 bp, Mus musculus
tcctgttctctctgagctttcataa

SEQ ID NO: 821788 - DNA, 25 bp, Mus musculus
tcctgttctctgctcacaaatgcag

SEQ ID NO: 821789 - DNA, 25 bp, Mus musculus
tcctgttctctggtcacaaatgcag

SEQ ID NO: 821790 - DNA, 25 bp, Mus musculus
tcctgttctggtaccggttcgtgtg

SEQ ID NO: 821791 - DNA, 25 bp, Mus musculus
tcctgttctggttccggttcgtgtg

SEQ ID NO: 821792 - DNA, 25 bp, Mus musculus
tcctgttctttcaatatgctcttca

SEQ ID NO: 821793 - DNA, 25 bp, Mus musculus
tcctgttctttctatatgctcttca

SEQ ID NO: 821794 - DNA, 25 bp, Mus musculus
tcctgttgaaaacctgatgtgtcca

SEQ ID NO: 821795 - DNA, 25 bp, Mus musculus
tcctgttgaaaagctgatgtgtcca

SEQ ID NO: 821796 - DNA, 25 bp, Mus musculus
tcctgttgagatcaacagctttctg

SEQ ID NO: 821797 - DNA, 25 bp, Mus musculus
tcctgttgagatgaacagctttctg

SEQ ID NO: 821798 - DNA, 25 bp, Mus musculus
tcctgttgagggaagcggagacctt

SEQ ID NO: 821799 - DNA, 25 bp, Mus musculus
tcctgttgagggtagcggagacctt

SEQ ID NO: 821800 - DNA, 25 bp, Mus musculus
tcctgttgatgtcgtcctgttactt

SEQ ID NO: 821801 - DNA, 25 bp, Mus musculus
tcctgttgatgtggtcctgttactt

SEQ ID NO: 821802 - DNA, 25 bp, Mus musculus
tcctgttgcaccaggctcgggcaga

SEQ ID NO: 821803 - DNA, 25 bp, Mus musculus
tcctgttgcacctggctcgggcaga

SEQ ID NO: 821804 - DNA, 25 bp, Mus musculus
tcctgttggtctacaatcggatgac

SEQ ID NO: 821805 - DNA, 25 bp, Mus musculus
tcctgttggtcttcaatcggatgac

SEQ ID NO: 821806 - DNA, 25 bp, Mus musculus
tcctgttggttcaccttcaccttga

SEQ ID NO: 821807 - DNA, 25 bp, Mus musculus
tcctgttggttctccttcaccttga

SEQ ID NO: 821808 - DNA, 25 bp, Mus musculus
tcctgttgtggcaatcagaactgct

SEQ ID NO: 821809 - DNA, 25 bp, Mus musculus
tcctgttgtggctatcagaactgct

SEQ ID NO: 821810 - DNA, 25 bp, Mus musculus
tcctgttgtgtaccatccagaggct

SEQ ID NO: 821811 - DNA, 25 bp, Mus musculus
tcctgttgtgtagcatccagaggct

SEQ ID NO: 821812 - DNA, 25 bp, Mus musculus
tcctgttgttctcctggtgatcgga

SEQ ID NO: 821813 - DNA, 25 bp, Mus musculus
tcctgttgttctgctggtgatcgga

SEQ ID NO: 821814 - DNA, 25 bp, Mus musculus
tcctgtttagtgcatatctcggtgt

SEQ ID NO: 821815 - DNA, 25 bp, Mus musculus
tcctgtttagtggatatctcggtgt

SEQ ID NO: 821816 - DNA, 25 bp, Mus musculus
tcctgtttatctcggttctaacctt

SEQ ID NO: 821817 - DNA, 25 bp, Mus musculus
tcctgtttatctgggttctaacctt

SEQ ID NO: 821818 - DNA, 25 bp, Mus musculus
tcctgtttattcatggagggcacac

SEQ ID NO: 821819 - DNA, 25 bp, Mus musculus
tcctgtttattcttggagggcacac

SEQ ID NO: 821820 - DNA, 25 bp, Mus musculus
tcctgtttcacacaatgacttctgt

SEQ ID NO: 821821 - DNA, 25 bp, Mus musculus
tcctgtttcacagaatgacttctgt

SEQ ID NO: 821822 - DNA, 25 bp, Mus musculus
tcctgtttcactcccaagtagcttg

SEQ ID NO: 821823 - DNA, 25 bp, Mus musculus
tcctgtttcactgccaagtagcttg

SEQ ID NO: 821824 - DNA, 25 bp, Mus musculus
tcctgtttcaggctcacactttgat

SEQ ID NO: 821825 - DNA, 25 bp, Mus musculus
tcctgtttcagggtcacactttgat

SEQ ID NO: 821826 - DNA, 25 bp, Mus musculus
tcctgtttccgaatcctgtggtgaa

SEQ ID NO: 821827 - DNA, 25 bp, Mus musculus
tcctgtttccgattcctgtggtgaa

SEQ ID NO: 821828 - DNA, 25 bp, Mus musculus
tcctgtttcggaccgaggaccactt

SEQ ID NO: 821829 - DNA, 25 bp, Mus musculus
tcctgtttcggagcgaggaccactt

SEQ ID NO: 821830 - DNA, 25 bp, Mus musculus
tcctgtttctctaggccactatgaa

SEQ ID NO: 821831 - DNA, 25 bp, Mus musculus
tcctgtttctcttggccactatgaa

SEQ ID NO: 821832 - DNA, 25 bp, Mus musculus
tcctgtttctgactggcgctaacca

SEQ ID NO: 821833 - DNA, 25 bp, Mus musculus
tcctgtttctgagtggcgctaacca

SEQ ID NO: 821834 - DNA, 25 bp, Mus musculus
tcctgtttgagtaagaagcagtccc

SEQ ID NO: 821835 - DNA, 25 bp, Mus musculus
tcctgtttgagttagaagcagtccc

SEQ ID NO: 821836 - DNA, 25 bp, Mus musculus
tcctgtttgcccaccttggttgcag

SEQ ID NO: 821837 - DNA, 25 bp, Mus musculus
tcctgtttgccctccttggttgcag

SEQ ID NO: 821838 - DNA, 25 bp, Mus musculus
tcctgtttggtgagccaaggtttta

SEQ ID NO: 821839 - DNA, 25 bp, Mus musculus
tcctgtttggtgtgccaaggtttta

SEQ ID NO: 821840 - DNA, 25 bp, Mus musculus
tcctgtttgtgtaaagcgaatgatt

SEQ ID NO: 821841 - DNA, 25 bp, Mus musculus
tcctgtttgtgttaagcgaatgatt

SEQ ID NO: 821842 - DNA, 25 bp, Mus musculus
tcctgttttactctgcttttttggt

SEQ ID NO: 821843 - DNA, 25 bp, Mus musculus
tcctgttttactgtgcttttttggt

SEQ ID NO: 821844 - DNA, 25 bp, Mus musculus
tcctgttttctgaatacgttcacag

SEQ ID NO: 821845 - DNA, 25 bp, Mus musculus
tcctgttttctgtatacgttcacag

SEQ ID NO: 821846 - DNA, 25 bp, Mus musculus
tcctgttttcttctcacctgaataa

SEQ ID NO: 821847 - DNA, 25 bp, Mus musculus
tcctgttttcttctggccggaagtt

SEQ ID NO: 821848 - DNA, 25 bp, Mus musculus
tcctgttttcttgtcacctgaataa

SEQ ID NO: 821849 - DNA, 25 bp, Mus musculus
tcctgttttcttgtggccggaagtt

SEQ ID NO: 821850 - DNA, 25 bp, Mus musculus
tcctgtttttcaactgtcacggcag

SEQ ID NO: 821851 - DNA, 25 bp, Mus musculus
tcctgtttttcatctgtcacggcag

SEQ ID NO: 821852 - DNA, 25 bp, Mus musculus
tcctgtttttcccaattcttgagat

SEQ ID NO: 821853 - DNA, 25 bp, Mus musculus
tcctgtttttccgaattcttgagat

SEQ ID NO: 821854 - DNA, 25 bp, Mus musculus
tccttaaaatgaaccttgcccagcg

SEQ ID NO: 821855 - DNA, 25 bp, Mus musculus
tccttaaaatgatccttgcccagcg

SEQ ID NO: 821856 - DNA, 25 bp, Mus musculus
tccttaaactggaggcctcggaaca

SEQ ID NO: 821857 - DNA, 25 bp, Mus musculus
tccttaaactggtggcctcggaaca

SEQ ID NO: 821858 - DNA, 25 bp, Mus musculus
tccttaaagccaatttgaactgagt

SEQ ID NO: 821859 - DNA, 25 bp, Mus musculus
tccttaaagccattttgaactgagt

SEQ ID NO: 821860 - DNA, 25 bp, Mus musculus
tccttaaaggctcaagacatgactt

SEQ ID NO: 821861 - DNA, 25 bp, Mus musculus
tccttaaaggctgaagacatgactt

SEQ ID NO: 821862 - DNA, 25 bp, Mus musculus
tccttaaagtggatacaggtgtgaa

SEQ ID NO: 821863 - DNA, 25 bp, Mus musculus
tccttaaagtggttacaggtgtgaa

SEQ ID NO: 821864 - DNA, 25 bp, Mus musculus
tccttaacggcacagtgtcagttaa

SEQ ID NO: 821865 - DNA, 25 bp, Mus musculus
tccttaacggcagagtgtcagttaa

SEQ ID NO: 821866 - DNA, 25 bp, Mus musculus
tccttaactgtactctccattttat

SEQ ID NO: 821867 - DNA, 25 bp, Mus musculus
tccttaactgtagtctccattttat

SEQ ID NO: 821868 - DNA, 25 bp, Mus musculus
tccttaactgtgatgtactctgggc

SEQ ID NO: 821869 - DNA, 25 bp, Mus musculus
tccttaactgtgttgtactctgggc

SEQ ID NO: 821870 - DNA, 25 bp, Mus musculus
tccttaagacccatggaccctgaag

SEQ ID NO: 821871 - DNA, 25 bp, Mus musculus
tccttaagacccttggaccctgaag

SEQ ID NO: 821872 - DNA, 25 bp, Mus musculus
tccttaagtgccagcatgtgctaga

SEQ ID NO: 821873 - DNA, 25 bp, Mus musculus
tccttaagtgcctgcatgtgctaga

SEQ ID NO: 821874 - DNA, 25 bp, Mus musculus
tccttaatatctcttttcagtttcc

SEQ ID NO: 821875 - DNA, 25 bp, Mus musculus
tccttaatatctgttttcagtttcc

SEQ ID NO: 821876 - DNA, 25 bp, Mus musculus
tccttaatctttctctcaagtgtag

SEQ ID NO: 821877 - DNA, 25 bp, Mus musculus
tccttaatctttgtctcaagtgtag

SEQ ID NO: 821878 - DNA, 25 bp, Mus musculus
tccttaattttgacccaagctgcca

SEQ ID NO: 821879 - DNA, 25 bp, Mus musculus
tccttaattttgtcccaagctgcca

SEQ ID NO: 821880 - DNA, 25 bp, Mus musculus
tccttacacagaccctgtttttgtt

SEQ ID NO: 821881 - DNA, 25 bp, Mus musculus
tccttacacagagcctgtttttgtt

SEQ ID NO: 821882 - DNA, 25 bp, Mus musculus
tccttacagaggcttctgtaacttc

SEQ ID NO: 821883 - DNA, 25 bp, Mus musculus
tccttacagagggttctgtaacttc

SEQ ID NO: 821884 - DNA, 25 bp, Mus musculus
tccttacaggagagcgtctgcctct

SEQ ID NO: 821885 - DNA, 25 bp, Mus musculus
tccttacaggagtgcgtctgcctct

SEQ ID NO: 821886 - DNA, 25 bp, Mus musculus
tccttaccacaaagaccttcttctg

SEQ ID NO: 821887 - DNA, 25 bp, Mus musculus
tccttaccacaatgaccttcttctg

SEQ ID NO: 821888 - DNA, 25 bp, Mus musculus
tccttaccagtacagtgcgcagatg

SEQ ID NO: 821889 - DNA, 25 bp, Mus musculus
tccttaccagtagagtgcgcagatg

SEQ ID NO: 821890 - DNA, 25 bp, Mus musculus
tccttacccaacactttccagataa

SEQ ID NO: 821891 - DNA, 25 bp, Mus musculus
tccttacccaactctttccagataa

SEQ ID NO: 821892 - DNA, 25 bp, Mus musculus
tccttacccaatatcttgccattta

SEQ ID NO: 821893 - DNA, 25 bp, Mus musculus
tccttacccaatttcttgccattta

SEQ ID NO: 821894 - DNA, 25 bp, Mus musculus
tccttaccctcaagtttcaaagcta

SEQ ID NO: 821895 - DNA, 25 bp, Mus musculus
tccttaccctcatgtttcaaagcta

SEQ ID NO: 821896 - DNA, 25 bp, Mus musculus
tccttacccttactggtattggaga

SEQ ID NO: 821897 - DNA, 25 bp, Mus musculus
tccttacccttagtggtattggaga

SEQ ID NO: 821898 - DNA, 25 bp, Mus musculus
tccttaccgatgaattttcctactc

SEQ ID NO: 821899 - DNA, 25 bp, Mus musculus
tccttaccgatgtattttcctactc

SEQ ID NO: 821900 - DNA, 25 bp, Mus musculus
tccttaccgtggagttggaggttgg

SEQ ID NO: 821901 - DNA, 25 bp, Mus musculus
tccttaccgtggtgttggaggttgg

SEQ ID NO: 821902 - DNA, 25 bp, Mus musculus
tccttacctatcactgcctaggagg

SEQ ID NO: 821903 - DNA, 25 bp, Mus musculus
tccttacctatctctgcctaggagg

SEQ ID NO: 821904 - DNA, 25 bp, Mus musculus
tccttacctctgaagagggcgttga

SEQ ID NO: 821905 - DNA, 25 bp, Mus musculus
tccttacctctgtagagggcgttga

SEQ ID NO: 821906 - DNA, 25 bp, Mus musculus
tccttaccttatcctgtgtcctata

SEQ ID NO: 821907 - DNA, 25 bp, Mus musculus
tccttaccttatgctgtgtcctata

SEQ ID NO: 821908 - DNA, 25 bp, Mus musculus
tccttactactacttcatgatttaa

SEQ ID NO: 821909 - DNA, 25 bp, Mus musculus
tccttactactagttcatgatttaa

SEQ ID NO: 821910 - DNA, 25 bp, Mus musculus
tccttactcatccaattggtaccca

SEQ ID NO: 821911 - DNA, 25 bp, Mus musculus
tccttactcatcgaattggtaccca

SEQ ID NO: 821912 - DNA, 25 bp, Mus musculus
tccttactccttagccaagtgtgtg

SEQ ID NO: 821913 - DNA, 25 bp, Mus musculus
tccttactcctttgccaagtgtgtg

SEQ ID NO: 821914 - DNA, 25 bp, Mus musculus
tccttactgagcacatccggatgat

SEQ ID NO: 821915 - DNA, 25 bp, Mus musculus
tccttactgagctcatccggatgat

SEQ ID NO: 821916 - DNA, 25 bp, Mus musculus
tccttactgcttcaaccggcttttc

SEQ ID NO: 821917 - DNA, 25 bp, Mus musculus
tccttactgcttgaaccggcttttc

SEQ ID NO: 821918 - DNA, 25 bp, Mus musculus
tccttactggatcctgagggtcatt

SEQ ID NO: 821919 - DNA, 25 bp, Mus musculus
tccttactggatgctgagggtcatt

SEQ ID NO: 821920 - DNA, 25 bp, Mus musculus
tccttacttagccagaacccacaat

SEQ ID NO: 821921 - DNA, 25 bp, Mus musculus
tccttacttagcgagaacccacaat

SEQ ID NO: 821922 - DNA, 25 bp, Mus musculus
tccttacttcagaggagctggctct

SEQ ID NO: 821923 - DNA, 25 bp, Mus musculus
tccttacttcagtggagctggctct

SEQ ID NO: 821924 - DNA, 25 bp, Mus musculus
tccttacttgacagcgctgttgcga

SEQ ID NO: 821925 - DNA, 25 bp, Mus musculus
tccttacttgactgcgctgttgcga

SEQ ID NO: 821926 - DNA, 25 bp, Mus musculus
tccttagactcactcagtactgggt

SEQ ID NO: 821927 - DNA, 25 bp, Mus musculus
tccttagactcagtcagtactgggt

SEQ ID NO: 821928 - DNA, 25 bp, Mus musculus
tccttagagaccaggctgtgcacac

SEQ ID NO: 821929 - DNA, 25 bp, Mus musculus
tccttagagacctggctgtgcacac

SEQ ID NO: 821930 - DNA, 25 bp, Mus musculus
tccttagatgaaatgtttacatagc

SEQ ID NO: 821931 - DNA, 25 bp, Mus musculus
tccttagatgaattgtttacatagc

SEQ ID NO: 821932 - DNA, 25 bp, Mus musculus
tccttagatttgatccttgctttat

SEQ ID NO: 821933 - DNA, 25 bp, Mus musculus
tccttagatttgttccttgctttat

SEQ ID NO: 821934 - DNA, 25 bp, Mus musculus
tccttagcatcgactacttcagaat

SEQ ID NO: 821935 - DNA, 25 bp, Mus musculus
tccttagcatcgtctacttcagaat

SEQ ID NO: 821936 - DNA, 25 bp, Mus musculus
tccttagcgctaatctaggaaccgc

SEQ ID NO: 821937 - DNA, 25 bp, Mus musculus
tccttagcgctattctaggaaccgc

SEQ ID NO: 821938 - DNA, 25 bp, Mus musculus
tccttagctttgacaaacttcagat

SEQ ID NO: 821939 - DNA, 25 bp, Mus musculus
tccttagctttgtcaaacttcagat

SEQ ID NO: 821940 - DNA, 25 bp, Mus musculus
tccttaggagagcaggcctgaagcc

SEQ ID NO: 821941 - DNA, 25 bp, Mus musculus
tccttaggagaggaggcctgaagcc

SEQ ID NO: 821942 - DNA, 25 bp, Mus musculus
tccttaggcaggagatatggtcccc

SEQ ID NO: 821943 - DNA, 25 bp, Mus musculus
tccttaggcaggtgatatggtcccc

SEQ ID NO: 821944 - DNA, 25 bp, Mus musculus
tccttaggcatcaagttcccagttt

SEQ ID NO: 821945 - DNA, 25 bp, Mus musculus
tccttaggcatctagttcccagttt

SEQ ID NO: 821946 - DNA, 25 bp, Mus musculus
tccttaggcattcattctatctttg

SEQ ID NO: 821947 - DNA, 25 bp, Mus musculus
tccttaggcattgattctatctttg

SEQ ID NO: 821948 - DNA, 25 bp, Mus musculus
tccttaggccttccacttaagtcat

SEQ ID NO: 821949 - DNA, 25 bp, Mus musculus
tccttaggccttgcacttaagtcat

SEQ ID NO: 821950 - DNA, 25 bp, Mus musculus
tccttagggagtcttcgtgtctgac

SEQ ID NO: 821951 - DNA, 25 bp, Mus musculus
tccttagggagtgttcgtgtctgac

SEQ ID NO: 821952 - DNA, 25 bp, Mus musculus
tccttagggtgccaacctttgcgat

SEQ ID NO: 821953 - DNA, 25 bp, Mus musculus
tccttagggtgccaactctgatggg

SEQ ID NO: 821954 - DNA, 25 bp, Mus musculus
tccttagggtgcgaacctttgcgat

SEQ ID NO: 821955 - DNA, 25 bp, Mus musculus
tccttagggtgcgaactctgatggg

SEQ ID NO: 821956 - DNA, 25 bp, Mus musculus
tccttaggtcacaaacttccctctt

SEQ ID NO: 821957 - DNA, 25 bp, Mus musculus
tccttaggtcactaacttccctctt

SEQ ID NO: 821958 - DNA, 25 bp, Mus musculus
tccttaggtgctcacttttcttttg

SEQ ID NO: 821959 - DNA, 25 bp, Mus musculus
tccttaggtgctgacttttcttttg

SEQ ID NO: 821960 - DNA, 25 bp, Mus musculus
tccttagtcggcagcagggaacaag

SEQ ID NO: 821961 - DNA, 25 bp, Mus musculus
tccttagtcggctgcagggaacaag

SEQ ID NO: 821962 - DNA, 25 bp, Mus musculus
tccttagtctcaaacttccttcttc

SEQ ID NO: 821963 - DNA, 25 bp, Mus musculus
tccttagtctcatacttccttcttc

SEQ ID NO: 821964 - DNA, 25 bp, Mus musculus
tccttataccatccagatttcttcc

SEQ ID NO: 821965 - DNA, 25 bp, Mus musculus
tccttataccatgcagatttcttcc

SEQ ID NO: 821966 - DNA, 25 bp, Mus musculus
tccttatactatattggttgaccta

SEQ ID NO: 821967 - DNA, 25 bp, Mus musculus
tccttatactattttggttgaccta

SEQ ID NO: 821968 - DNA, 25 bp, Mus musculus
tccttatatcatcattccaactgat

SEQ ID NO: 821969 - DNA, 25 bp, Mus musculus
tccttatatcatgattccaactgat

SEQ ID NO: 821970 - DNA, 25 bp, Mus musculus
tccttatcaaccaccaggctgctgg

SEQ ID NO: 821971 - DNA, 25 bp, Mus musculus
tccttatcaacctccaggctgctgg

SEQ ID NO: 821972 - DNA, 25 bp, Mus musculus
tccttatcataacttctgcttttca

SEQ ID NO: 821973 - DNA, 25 bp, Mus musculus
tccttatcataagttctgcttttca

SEQ ID NO: 821974 - DNA, 25 bp, Mus musculus
tccttatccatcactttcgagtggt

SEQ ID NO: 821975 - DNA, 25 bp, Mus musculus
tccttatccatctctttcgagtggt

SEQ ID NO: 821976 - DNA, 25 bp, Mus musculus
tccttatcccaaccacctttagtgt

SEQ ID NO: 821977 - DNA, 25 bp, Mus musculus
tccttatcccaagcacctttagtgt

SEQ ID NO: 821978 - DNA, 25 bp, Mus musculus
tccttatcccgacgtgaacacattt

SEQ ID NO: 821979 - DNA, 25 bp, Mus musculus
tccttatcccgaggtgaacacattt

SEQ ID NO: 821980 - DNA, 25 bp, Mus musculus
tccttatccctcaaacgtactatgt

SEQ ID NO: 821981 - DNA, 25 bp, Mus musculus
tccttatccctctaacgtactatgt

SEQ ID NO: 821982 - DNA, 25 bp, Mus musculus
tccttatctggcattcttggagaaa

SEQ ID NO: 821983 - DNA, 25 bp, Mus musculus
tccttatctggctttcttggagaaa

SEQ ID NO: 821984 - DNA, 25 bp, Mus musculus
tccttatctgtgctctactgtgatt

SEQ ID NO: 821985 - DNA, 25 bp, Mus musculus
tccttatctgtggtctactgtgatt

SEQ ID NO: 821986 - DNA, 25 bp, Mus musculus
tccttatctttcaaccgcaactaaa

SEQ ID NO: 821987 - DNA, 25 bp, Mus musculus
tccttatctttctaccgcaactaaa

SEQ ID NO: 821988 - DNA, 25 bp, Mus musculus
tccttatgcccaaatgtccatccat

SEQ ID NO: 821989 - DNA, 25 bp, Mus musculus
tccttatgcccatatgtccatccat

SEQ ID NO: 821990 - DNA, 25 bp, Mus musculus
tccttatgctagaaatgctccacag

SEQ ID NO: 821991 - DNA, 25 bp, Mus musculus
tccttatgctagtaatgctccacag

SEQ ID NO: 821992 - DNA, 25 bp, Mus musculus
tccttatggaacacaggcgatcctc

SEQ ID NO: 821993 - DNA, 25 bp, Mus musculus
tccttatggaactcaggcgatcctc

SEQ ID NO: 821994 - DNA, 25 bp, Mus musculus
tccttatgtggaagcagccgtggct

SEQ ID NO: 821995 - DNA, 25 bp, Mus musculus
tccttatgtggatgcagccgtggct

SEQ ID NO: 821996 - DNA, 25 bp, Mus musculus
tccttattagcacatttgtcatatg

SEQ ID NO: 821997 - DNA, 25 bp, Mus musculus
tccttattagcagatttgtcatatg

SEQ ID NO: 821998 - DNA, 25 bp, Mus musculus
tccttattccaccactagaaagaag

SEQ ID NO: 821999 - DNA, 25 bp, Mus musculus
tccttattccacgactagaaagaag

SEQ ID NO: 822000 - DNA, 25 bp, Mus musculus
tccttattcccaatacaaccacaat

SEQ ID NO: 822001 - DNA, 25 bp, Mus musculus
tccttattcccattacaaccacaat

SEQ ID NO: 822002 - DNA, 25 bp, Mus musculus
tccttattctgtcttttcagtgaat

SEQ ID NO: 822003 - DNA, 25 bp, Mus musculus
tccttattctgtgttttcagtgaat

SEQ ID NO: 822004 - DNA, 25 bp, Mus musculus
tccttattcttaactcatgggccgg

SEQ ID NO: 822005 - DNA, 25 bp, Mus musculus
tccttattcttatctcatgggccgg

SEQ ID NO: 822006 - DNA, 25 bp, Mus musculus
tccttattgcaaactggaatttctc

SEQ ID NO: 822007 - DNA, 25 bp, Mus musculus
tccttattgcaatctggaatttctc

SEQ ID NO: 822008 - DNA, 25 bp, Mus musculus
tccttattgtcaacccatatagctc

SEQ ID NO: 822009 - DNA, 25 bp, Mus musculus
tccttattgtcatcccatatagctc

SEQ ID NO: 822010 - DNA, 25 bp, Mus musculus
tccttatttcccctatatcctgagt

SEQ ID NO: 822011 - DNA, 25 bp, Mus musculus
tccttatttcccgtatatcctgagt

SEQ ID NO: 822012 - DNA, 25 bp, Mus musculus
tccttcaaaaggctcattcccattt

SEQ ID NO: 822013 - DNA, 25 bp, Mus musculus
tccttcaaaagggtcattcccattt

SEQ ID NO: 822014 - DNA, 25 bp, Mus musculus
tccttcaacccaaggaaagtattaa

SEQ ID NO: 822015 - DNA, 25 bp, Mus musculus
tccttcaacccatggaaagtattaa

SEQ ID NO: 822016 - DNA, 25 bp, Mus musculus
tccttcaacctaaaccatttccttt

SEQ ID NO: 822017 - DNA, 25 bp, Mus musculus
tccttcaacctataccatttccttt

SEQ ID NO: 822018 - DNA, 25 bp, Mus musculus
tccttcaactacctactctggaaat

SEQ ID NO: 822019 - DNA, 25 bp, Mus musculus
tccttcaactacgtactctggaaat

SEQ ID NO: 822020 - DNA, 25 bp, Mus musculus
tccttcaagagtcatggccggaaag

SEQ ID NO: 822021 - DNA, 25 bp, Mus musculus
tccttcaagagtgatggccggaaag

SEQ ID NO: 822022 - DNA, 25 bp, Mus musculus
tccttcaatactcatgcttgctcac

SEQ ID NO: 822023 - DNA, 25 bp, Mus musculus
tccttcaatactgatgcttgctcac

SEQ ID NO: 822024 - DNA, 25 bp, Mus musculus
tccttcaccctccagcttcattttt

SEQ ID NO: 822025 - DNA, 25 bp, Mus musculus
tccttcaccctcgagcttcattttt

SEQ ID NO: 822026 - DNA, 25 bp, Mus musculus
tccttcacctggcatgtgaacgagg

SEQ ID NO: 822027 - DNA, 25 bp, Mus musculus
tccttcacctgggatgtgaacgagg

SEQ ID NO: 822028 - DNA, 25 bp, Mus musculus
tccttcaccttgcagaacttcagaa

SEQ ID NO: 822029 - DNA, 25 bp, Mus musculus
tccttcaccttggagaacttcagaa

SEQ ID NO: 822030 - DNA, 25 bp, Mus musculus
tccttcacggaaaactaatgtacaa

SEQ ID NO: 822031 - DNA, 25 bp, Mus musculus
tccttcacggaatactaatgtacaa

SEQ ID NO: 822032 - DNA, 25 bp, Mus musculus
tccttcacggaccttgctgagattg

SEQ ID NO: 822033 - DNA, 25 bp, Mus musculus
tccttcacggacgttgctgagattg

SEQ ID NO: 822034 - DNA, 25 bp, Mus musculus
tccttcactgtgacgtgtcttcaga

SEQ ID NO: 822035 - DNA, 25 bp, Mus musculus
tccttcactgtgtcgtgtcttcaga

SEQ ID NO: 822036 - DNA, 25 bp, Mus musculus
tccttcactgttccctcctgtgtgt

SEQ ID NO: 822037 - DNA, 25 bp, Mus musculus
tccttcactgttgcctcctgtgtgt

SEQ ID NO: 822038 - DNA, 25 bp, Mus musculus
tccttcacttcaacagagtcctgtt

SEQ ID NO: 822039 - DNA, 25 bp, Mus musculus
tccttcacttcatcagagtcctgtt

SEQ ID NO: 822040 - DNA, 25 bp, Mus musculus
tccttcacttgccagtagtactgat

SEQ ID NO: 822041 - DNA, 25 bp, Mus musculus
tccttcacttgcgagtagtactgat

SEQ ID NO: 822042 - DNA, 25 bp, Mus musculus
tccttcagaacaatcaggtatttga

SEQ ID NO: 822043 - DNA, 25 bp, Mus musculus
tccttcagaacattcaggtatttga

SEQ ID NO: 822044 - DNA, 25 bp, Mus musculus
tccttcagaagtaccggctgccagg

SEQ ID NO: 822045 - DNA, 25 bp, Mus musculus
tccttcagaagttccggctgccagg

SEQ ID NO: 822046 - DNA, 25 bp, Mus musculus
tccttcagactgcacaagctgcatt

SEQ ID NO: 822047 - DNA, 25 bp, Mus musculus
tccttcagactggacaagctgcatt

SEQ ID NO: 822048 - DNA, 25 bp, Mus musculus
tccttcagagccatgatagtgagaa

SEQ ID NO: 822049 - DNA, 25 bp, Mus musculus
tccttcagagccttgatagtgagaa

SEQ ID NO: 822050 - DNA, 25 bp, Mus musculus
tccttcagatccactgctgagctag

SEQ ID NO: 822051 - DNA, 25 bp, Mus musculus
tccttcagatcctctgctgagctag

SEQ ID NO: 822052 - DNA, 25 bp, Mus musculus
tccttcagcaagcactggtctttct

SEQ ID NO: 822053 - DNA, 25 bp, Mus musculus
tccttcagcaaggactggtctttct

SEQ ID NO: 822054 - DNA, 25 bp, Mus musculus
tccttcagcttgcagagtgctggat

SEQ ID NO: 822055 - DNA, 25 bp, Mus musculus
tccttcagcttggagagtgctggat

SEQ ID NO: 822056 - DNA, 25 bp, Mus musculus
tccttcagctttatagtggcttata

SEQ ID NO: 822057 - DNA, 25 bp, Mus musculus
tccttcagctttttagtggcttata

SEQ ID NO: 822058 - DNA, 25 bp, Mus musculus
tccttcaggaggatctgctacttac

SEQ ID NO: 822059 - DNA, 25 bp, Mus musculus
tccttcaggaggttctgctacttac

SEQ ID NO: 822060 - DNA, 25 bp, Mus musculus
tccttcagggatatgtttgcctttc

SEQ ID NO: 822061 - DNA, 25 bp, Mus musculus
tccttcagggatttgtttgcctttc

SEQ ID NO: 822062 - DNA, 25 bp, Mus musculus
tccttcagggtaattaatgttactc

SEQ ID NO: 822063 - DNA, 25 bp, Mus musculus
tccttcagggtatttaatgttactc

SEQ ID NO: 822064 - DNA, 25 bp, Mus musculus
tccttcagtcagattccccagagaa

SEQ ID NO: 822065 - DNA, 25 bp, Mus musculus
tccttcagtcagtttccccagagaa

SEQ ID NO: 822066 - DNA, 25 bp, Mus musculus
tccttcagtgtacgaccagagtctt

SEQ ID NO: 822067 - DNA, 25 bp, Mus musculus
tccttcagtgtaggaccagagtctt

SEQ ID NO: 822068 - DNA, 25 bp, Mus musculus
tccttcataaaaatgagctttgctc

SEQ ID NO: 822069 - DNA, 25 bp, Mus musculus
tccttcataaaattgagctttgctc

SEQ ID NO: 822070 - DNA, 25 bp, Mus musculus
tccttcataccaattacttcattcc

SEQ ID NO: 822071 - DNA, 25 bp, Mus musculus
tccttcataccatttacttcattcc

SEQ ID NO: 822072 - DNA, 25 bp, Mus musculus
tccttcatataaacccttatatccc

SEQ ID NO: 822073 - DNA, 25 bp, Mus musculus
tccttcatataatcccttatatccc

SEQ ID NO: 822074 - DNA, 25 bp, Mus musculus
tccttcatattgatcactgcactgt

SEQ ID NO: 822075 - DNA, 25 bp, Mus musculus
tccttcatattgttcactgcactgt

SEQ ID NO: 822076 - DNA, 25 bp, Mus musculus
tccttcatcacaagtaattcacttg

SEQ ID NO: 822077 - DNA, 25 bp, Mus musculus
tccttcatcacatgtaattcacttg

SEQ ID NO: 822078 - DNA, 25 bp, Mus musculus
tccttcatcctgactgcagcaaaag

SEQ ID NO: 822079 - DNA, 25 bp, Mus musculus
tccttcatcctgatgttatcaccaa

SEQ ID NO: 822080 - DNA, 25 bp, Mus musculus
tccttcatcctgtctgcagcaaaag

SEQ ID NO: 822081 - DNA, 25 bp, Mus musculus
tccttcatcctgttgttatcaccaa

SEQ ID NO: 822082 - DNA, 25 bp, Mus musculus
tccttcatcgctcccactaagtgag

SEQ ID NO: 822083 - DNA, 25 bp, Mus musculus
tccttcatcgctgccactaagtgag

SEQ ID NO: 822084 - DNA, 25 bp, Mus musculus
tccttcatctctaagcattacactg

SEQ ID NO: 822085 - DNA, 25 bp, Mus musculus
tccttcatctcttagcattacactg

SEQ ID NO: 822086 - DNA, 25 bp, Mus musculus
tccttcatcttaatgtgtgcctttc

SEQ ID NO: 822087 - DNA, 25 bp, Mus musculus
tccttcatcttattgtgtgcctttc

SEQ ID NO: 822088 - DNA, 25 bp, Mus musculus
tccttcatgtctcctggaactctgg

SEQ ID NO: 822089 - DNA, 25 bp, Mus musculus
tccttcatgtctgctggaactctgg

SEQ ID NO: 822090 - DNA, 25 bp, Mus musculus
tccttcatgtttatgccacctctgg

SEQ ID NO: 822091 - DNA, 25 bp, Mus musculus
tccttcatgtttcctttcgttggct

SEQ ID NO: 822092 - DNA, 25 bp, Mus musculus
tccttcatgtttgctttcgttggct

SEQ ID NO: 822093 - DNA, 25 bp, Mus musculus
tccttcatgtttttgccacctctgg

SEQ ID NO: 822094 - DNA, 25 bp, Mus musculus
tccttcattgcaccatggacctgaa

SEQ ID NO: 822095 - DNA, 25 bp, Mus musculus
tccttcattgcagcatggacctgaa

SEQ ID NO: 822096 - DNA, 25 bp, Mus musculus
tccttcattgtgcagaacccagcct

SEQ ID NO: 822097 - DNA, 25 bp, Mus musculus
tccttcattgtggagaacccagcct

SEQ ID NO: 822098 - DNA, 25 bp, Mus musculus
tccttcatttataaacactggtgtg

SEQ ID NO: 822099 - DNA, 25 bp, Mus musculus
tccttcatttattaacactggtgtg

SEQ ID NO: 822100 - DNA, 25 bp, Mus musculus
tccttcattttcacatttcaagcat

SEQ ID NO: 822101 - DNA, 25 bp, Mus musculus
tccttcattttctcatttcaagcat

SEQ ID NO: 822102 - DNA, 25 bp, Mus musculus
tccttcatttttcaatgaacccgag

SEQ ID NO: 822103 - DNA, 25 bp, Mus musculus
tccttcatttttgaatgaacccgag

SEQ ID NO: 822104 - DNA, 25 bp, Mus musculus
tccttccaaacactgcttttgtgaa

SEQ ID NO: 822105 - DNA, 25 bp, Mus musculus
tccttccaaacagtgcttttgtgaa

SEQ ID NO: 822106 - DNA, 25 bp, Mus musculus
tccttccaaagcagtgccccatagt

SEQ ID NO: 822107 - DNA, 25 bp, Mus musculus
tccttccaaagctgtgccccatagt

SEQ ID NO: 822108 - DNA, 25 bp, Mus musculus
tccttccaagatctcatgactgaca

SEQ ID NO: 822109 - DNA, 25 bp, Mus musculus
tccttccaagatgtcatgactgaca

SEQ ID NO: 822110 - DNA, 25 bp, Mus musculus
tccttccaagctcatgacttctcaa

SEQ ID NO: 822111 - DNA, 25 bp, Mus musculus
tccttccaagctgatgacttctcaa

SEQ ID NO: 822112 - DNA, 25 bp, Mus musculus
tccttccaaggaactgcagctctgg

SEQ ID NO: 822113 - DNA, 25 bp, Mus musculus
tccttccaaggatctgcagctctgg

SEQ ID NO: 822114 - DNA, 25 bp, Mus musculus
tccttccacagtaatgttggcttcc

SEQ ID NO: 822115 - DNA, 25 bp, Mus musculus
tccttccacagttatgttggcttcc

SEQ ID NO: 822116 - DNA, 25 bp, Mus musculus
tccttccacccaatttcacaaaatt

SEQ ID NO: 822117 - DNA, 25 bp, Mus musculus
tccttccacccattttcacaaaatt

SEQ ID NO: 822118 - DNA, 25 bp, Mus musculus
tccttccacctccaggtttacatgg

SEQ ID NO: 822119 - DNA, 25 bp, Mus musculus
tccttccacctcgaggtttacatgg

SEQ ID NO: 822120 - DNA, 25 bp, Mus musculus
tccttccacgaacccaatggtgaca

SEQ ID NO: 822121 - DNA, 25 bp, Mus musculus
tccttccacgaagccaatggtgaca

SEQ ID NO: 822122 - DNA, 25 bp, Mus musculus
tccttccacgttcatctggtttttg

SEQ ID NO: 822123 - DNA, 25 bp, Mus musculus
tccttccacgttgatctggtttttg

SEQ ID NO: 822124 - DNA, 25 bp, Mus musculus
tccttccactctcttctatcaagat

SEQ ID NO: 822125 - DNA, 25 bp, Mus musculus
tccttccactctgttctatcaagat

SEQ ID NO: 822126 - DNA, 25 bp, Mus musculus
tccttccactgactctatcatgtca

SEQ ID NO: 822127 - DNA, 25 bp, Mus musculus
tccttccactgagtctatcatgtca

SEQ ID NO: 822128 - DNA, 25 bp, Mus musculus
tccttccagaaccaaagtgcaggct

SEQ ID NO: 822129 - DNA, 25 bp, Mus musculus
tccttccagaacgaaagtgcaggct

SEQ ID NO: 822130 - DNA, 25 bp, Mus musculus
tccttccagaccatgattgatcgga

SEQ ID NO: 822131 - DNA, 25 bp, Mus musculus
tccttccagaccttgattgatcgga

SEQ ID NO: 822132 - DNA, 25 bp, Mus musculus
tccttccagatccagggagaggccg

SEQ ID NO: 822133 - DNA, 25 bp, Mus musculus
tccttccagatcgagggagaggccg

SEQ ID NO: 822134 - DNA, 25 bp, Mus musculus
tccttccagattagagcagtcagct

SEQ ID NO: 822135 - DNA, 25 bp, Mus musculus
tccttccagatttgagcagtcagct

SEQ ID NO: 822136 - DNA, 25 bp, Mus musculus
tccttccagcaccagcaaagtaacg

SEQ ID NO: 822137 - DNA, 25 bp, Mus musculus
tccttccagcacgagcaaagtaacg

SEQ ID NO: 822138 - DNA, 25 bp, Mus musculus
tccttccagccaacattctattaag

SEQ ID NO: 822139 - DNA, 25 bp, Mus musculus
tccttccagccatcattctattaag

SEQ ID NO: 822140 - DNA, 25 bp, Mus musculus
tccttccaggatcaggacttaccgt

SEQ ID NO: 822141 - DNA, 25 bp, Mus musculus
tccttccaggatgaggacttaccgt

SEQ ID NO: 822142 - DNA, 25 bp, Mus musculus
tccttccagggaacacttcaaatgg

SEQ ID NO: 822143 - DNA, 25 bp, Mus musculus
tccttccagggacttccaaggaaag

SEQ ID NO: 822144 - DNA, 25 bp, Mus musculus
tccttccagggagttccaaggaaag

SEQ ID NO: 822145 - DNA, 25 bp, Mus musculus
tccttccagggatcacttcaaatgg

SEQ ID NO: 822146 - DNA, 25 bp, Mus musculus
tccttccagttaaatttccttgtca

SEQ ID NO: 822147 - DNA, 25 bp, Mus musculus
tccttccagttatatttccttgtca

SEQ ID NO: 822148 - DNA, 25 bp, Mus musculus
tccttccagttgatgtgtagcgtat

SEQ ID NO: 822149 - DNA, 25 bp, Mus musculus
tccttccagttgttgtgtagcgtat

SEQ ID NO: 822150 - DNA, 25 bp, Mus musculus
tccttccatcacagctctgaaattt

SEQ ID NO: 822151 - DNA, 25 bp, Mus musculus
tccttccatcactgctctgaaattt

SEQ ID NO: 822152 - DNA, 25 bp, Mus musculus
tccttccatctgcttccacttatta

SEQ ID NO: 822153 - DNA, 25 bp, Mus musculus
tccttccatctggttccacttatta

SEQ ID NO: 822154 - DNA, 25 bp, Mus musculus
tccttccatcttattgacactgttt

SEQ ID NO: 822155 - DNA, 25 bp, Mus musculus
tccttccatctttttgacactgttt

SEQ ID NO: 822156 - DNA, 25 bp, Mus musculus
tccttccatgcacagcttaggctga

SEQ ID NO: 822157 - DNA, 25 bp, Mus musculus
tccttccatgcagagcttaggctga

SEQ ID NO: 822158 - DNA, 25 bp, Mus musculus
tccttccatttaccagttaacacag

SEQ ID NO: 822159 - DNA, 25 bp, Mus musculus
tccttccatttagcagttaacacag

SEQ ID NO: 822160 - DNA, 25 bp, Mus musculus
tccttccattttcttccatttattg

SEQ ID NO: 822161 - DNA, 25 bp, Mus musculus
tccttccattttgttccatttattg

SEQ ID NO: 822162 - DNA, 25 bp, Mus musculus
tccttcccaaccactttgacaggaa

SEQ ID NO: 822163 - DNA, 25 bp, Mus musculus
tccttcccaacctctttgacaggaa

SEQ ID NO: 822164 - DNA, 25 bp, Mus musculus
tccttcccacttcgaagccatgcta

SEQ ID NO: 822165 - DNA, 25 bp, Mus musculus
tccttcccacttggaagccatgcta

SEQ ID NO: 822166 - DNA, 25 bp, Mus musculus
tccttccccacacaaatagagcatg

SEQ ID NO: 822167 - DNA, 25 bp, Mus musculus
tccttccccacagaaatagagcatg

SEQ ID NO: 822168 - DNA, 25 bp, Mus musculus
tccttccccaccatctatttataag

SEQ ID NO: 822169 - DNA, 25 bp, Mus musculus
tccttccccaccttctatttataag

SEQ ID NO: 822170 - DNA, 25 bp, Mus musculus
tccttccccatactcctgtatataa

SEQ ID NO: 822171 - DNA, 25 bp, Mus musculus
tccttccccatagtcctgtatataa

SEQ ID NO: 822172 - DNA, 25 bp, Mus musculus
tccttcccctctctaaatagtattt

SEQ ID NO: 822173 - DNA, 25 bp, Mus musculus
tccttcccctctgtaaatagtattt

SEQ ID NO: 822174 - DNA, 25 bp, Mus musculus
tccttcccgtttcaaacaggtagat

SEQ ID NO: 822175 - DNA, 25 bp, Mus musculus
tccttcccgtttgaaacaggtagat

SEQ ID NO: 822176 - DNA, 25 bp, Mus musculus
tccttccctaacagttcagtttaag

SEQ ID NO: 822177 - DNA, 25 bp, Mus musculus
tccttccctaactgttcagtttaag

SEQ ID NO: 822178 - DNA, 25 bp, Mus musculus
tccttccctaagacgagattctgag

SEQ ID NO: 822179 - DNA, 25 bp, Mus musculus
tccttccctaagtcgagattctgag

SEQ ID NO: 822180 - DNA, 25 bp, Mus musculus
tccttccctaccagtgaaattgcta

SEQ ID NO: 822181 - DNA, 25 bp, Mus musculus
tccttccctacctgtgaaattgcta

SEQ ID NO: 822182 - DNA, 25 bp, Mus musculus
tccttccctcagactatatgaacta

SEQ ID NO: 822183 - DNA, 25 bp, Mus musculus
tccttccctcagtctatatgaacta

SEQ ID NO: 822184 - DNA, 25 bp, Mus musculus
tccttccctcccagaagacagagaa

SEQ ID NO: 822185 - DNA, 25 bp, Mus musculus
tccttccctccctgaagacagagaa

SEQ ID NO: 822186 - DNA, 25 bp, Mus musculus
tccttccctcgtatatacacaatat

SEQ ID NO: 822187 - DNA, 25 bp, Mus musculus
tccttccctcgtttatacacaatat

SEQ ID NO: 822188 - DNA, 25 bp, Mus musculus
tccttccctctaaactgtacttttt

SEQ ID NO: 822189 - DNA, 25 bp, Mus musculus
tccttccctctatactgtacttttt

SEQ ID NO: 822190 - DNA, 25 bp, Mus musculus
tccttccctgttactctaagtaaca

SEQ ID NO: 822191 - DNA, 25 bp, Mus musculus
tccttccctgtttctctaagtaaca

SEQ ID NO: 822192 - DNA, 25 bp, Mus musculus
tccttccgcaggagctatttttagc

SEQ ID NO: 822193 - DNA, 25 bp, Mus musculus
tccttccgcaggtgctatttttagc

SEQ ID NO: 822194 - DNA, 25 bp, Mus musculus
tccttccggaggaatatctgggctt

SEQ ID NO: 822195 - DNA, 25 bp, Mus musculus
tccttccggaggtatatctgggctt

SEQ ID NO: 822196 - DNA, 25 bp, Mus musculus
tccttccgttttactctgagactaa

SEQ ID NO: 822197 - DNA, 25 bp, Mus musculus
tccttccgtttttctctgagactaa

SEQ ID NO: 822198 - DNA, 25 bp, Mus musculus
tccttcctaagaccttcccgaaaga

SEQ ID NO: 822199 - DNA, 25 bp, Mus musculus
tccttcctaagagcttcccgaaaga

SEQ ID NO: 822200 - DNA, 25 bp, Mus musculus
tccttcctacctagggcagttaata

SEQ ID NO: 822201 - DNA, 25 bp, Mus musculus
tccttcctaccttgggcagttaata

SEQ ID NO: 822202 - DNA, 25 bp, Mus musculus
tccttcctagggagaacatggacag

SEQ ID NO: 822203 - DNA, 25 bp, Mus musculus
tccttcctagggtgaacatggacag

SEQ ID NO: 822204 - DNA, 25 bp, Mus musculus
tccttcctatacaccaaggttcatg

SEQ ID NO: 822205 - DNA, 25 bp, Mus musculus
tccttcctataccttggctttgaat

SEQ ID NO: 822206 - DNA, 25 bp, Mus musculus
tccttcctatacgttggctttgaat

SEQ ID NO: 822207 - DNA, 25 bp, Mus musculus
tccttcctatactccaaggttcatg

SEQ ID NO: 822208 - DNA, 25 bp, Mus musculus
tccttcctatatagtctaatttgag

SEQ ID NO: 822209 - DNA, 25 bp, Mus musculus
tccttcctatattgtctaatttgag

SEQ ID NO: 822210 - DNA, 25 bp, Mus musculus
tccttcctcaaaacgagtcgcctgg

SEQ ID NO: 822211 - DNA, 25 bp, Mus musculus
tccttcctcaaatcgagtcgcctgg

SEQ ID NO: 822212 - DNA, 25 bp, Mus musculus
tccttcctcattcccctgtaaataa

SEQ ID NO: 822213 - DNA, 25 bp, Mus musculus
tccttcctcattgccctgtaaataa

SEQ ID NO: 822214 - DNA, 25 bp, Mus musculus
tccttcctcgttactgcaaattgat

SEQ ID NO: 822215 - DNA, 25 bp, Mus musculus
tccttcctcgtttctgcaaattgat

SEQ ID NO: 822216 - DNA, 25 bp, Mus musculus
tccttcctctgactccagattgaca

SEQ ID NO: 822217 - DNA, 25 bp, Mus musculus
tccttcctctgagtccagattgaca

SEQ ID NO: 822218 - DNA, 25 bp, Mus musculus
tccttcctgaagaactggactcaga

SEQ ID NO: 822219 - DNA, 25 bp, Mus musculus
tccttcctgaagtactggactcaga

SEQ ID NO: 822220 - DNA, 25 bp, Mus musculus
tccttcctgaccatggtcaccgaga

SEQ ID NO: 822221 - DNA, 25 bp, Mus musculus
tccttcctgaccttggtcaccgaga

SEQ ID NO: 822222 - DNA, 25 bp, Mus musculus
tccttcctgactactggagggcaac

SEQ ID NO: 822223 - DNA, 25 bp, Mus musculus
tccttcctgacttctggagggcaac

SEQ ID NO: 822224 - DNA, 25 bp, Mus musculus
tccttcctgccaacgataagatggg

SEQ ID NO: 822225 - DNA, 25 bp, Mus musculus
tccttcctgccatcgataagatggg

SEQ ID NO: 822226 - DNA, 25 bp, Mus musculus
tccttcctgcgcaggttaaattaga

SEQ ID NO: 822227 - DNA, 25 bp, Mus musculus
tccttcctgcgctggttaaattaga

SEQ ID NO: 822228 - DNA, 25 bp, Mus musculus
tccttcctgctgagttcatagcgag

SEQ ID NO: 822229 - DNA, 25 bp, Mus musculus
tccttcctgctgtgttcatagcgag

SEQ ID NO: 822230 - DNA, 25 bp, Mus musculus
tccttcctggcaccagagtctgtaa

SEQ ID NO: 822231 - DNA, 25 bp, Mus musculus
tccttcctggcagcagagtctgtaa

SEQ ID NO: 822232 - DNA, 25 bp, Mus musculus
tccttcctggccagaactaatcttt

SEQ ID NO: 822233 - DNA, 25 bp, Mus musculus
tccttcctggcccatgtatgataac

SEQ ID NO: 822234 - DNA, 25 bp, Mus musculus
tccttcctggccgatgtatgataac

SEQ ID NO: 822235 - DNA, 25 bp, Mus musculus
tccttcctggcctgaactaatcttt

SEQ ID NO: 822236 - DNA, 25 bp, Mus musculus
tccttcctggcgcaaacatgggaac

SEQ ID NO: 822237 - DNA, 25 bp, Mus musculus
tccttcctggcggaaacatgggaac

SEQ ID NO: 822238 - DNA, 25 bp, Mus musculus
tccttcctgggccttgtcctattct

SEQ ID NO: 822239 - DNA, 25 bp, Mus musculus
tccttcctgggcgttgtcctattct

SEQ ID NO: 822240 - DNA, 25 bp, Mus musculus
tccttcctgtctcaaattttcagtt

SEQ ID NO: 822241 - DNA, 25 bp, Mus musculus
tccttcctgtctgaaattttcagtt

SEQ ID NO: 822242 - DNA, 25 bp, Mus musculus
tccttcctgtgtaccttcttaggaa

SEQ ID NO: 822243 - DNA, 25 bp, Mus musculus
tccttcctgtgtcgcctaacaagaa

SEQ ID NO: 822244 - DNA, 25 bp, Mus musculus
tccttcctgtgtggcctaacaagaa

SEQ ID NO: 822245 - DNA, 25 bp, Mus musculus
tccttcctgtgttccttcttaggaa

SEQ ID NO: 822246 - DNA, 25 bp, Mus musculus
tccttcctgtttaagagatagtctc

SEQ ID NO: 822247 - DNA, 25 bp, Mus musculus
tccttcctgttttagagatagtctc

SEQ ID NO: 822248 - DNA, 25 bp, Mus musculus
tccttccttctgctggatcccagtg

SEQ ID NO: 822249 - DNA, 25 bp, Mus musculus
tccttccttctggtggatcccagtg

SEQ ID NO: 822250 - DNA, 25 bp, Mus musculus
tccttccttcttaagttgagcacag

SEQ ID NO: 822251 - DNA, 25 bp, Mus musculus
tccttccttcttattgatagcttgt

SEQ ID NO: 822252 - DNA, 25 bp, Mus musculus
tccttccttctttagttgagcacag

SEQ ID NO: 822253 - DNA, 25 bp, Mus musculus
tccttccttctttttgatagcttgt

SEQ ID NO: 822254 - DNA, 25 bp, Mus musculus
tccttccttggcatatatggactgc

SEQ ID NO: 822255 - DNA, 25 bp, Mus musculus
tccttccttggcttatatggactgc

SEQ ID NO: 822256 - DNA, 25 bp, Mus musculus
tccttcctttgtcctttattcatgg

SEQ ID NO: 822257 - DNA, 25 bp, Mus musculus
tccttcctttgtgctttattcatgg

SEQ ID NO: 822258 - DNA, 25 bp, Mus musculus
tccttcctttttcatggagtgatta

SEQ ID NO: 822259 - DNA, 25 bp, Mus musculus
tccttcctttttgatggagtgatta

SEQ ID NO: 822260 - DNA, 25 bp, Mus musculus
tccttcgagaatcctatgaccagag

SEQ ID NO: 822261 - DNA, 25 bp, Mus musculus
tccttcgagaatgctatgaccagag

SEQ ID NO: 822262 - DNA, 25 bp, Mus musculus
tccttcgagcagctggagcatgttc

SEQ ID NO: 822263 - DNA, 25 bp, Mus musculus
tccttcgagcaggtggagcatgttc

SEQ ID NO: 822264 - DNA, 25 bp, Mus musculus
tccttcgcatgtctgatggttagat

SEQ ID NO: 822265 - DNA, 25 bp, Mus musculus
tccttcgcatgtgtgatggttagat

SEQ ID NO: 822266 - DNA, 25 bp, Mus musculus
tccttcgccttccacgtatgacggt

SEQ ID NO: 822267 - DNA, 25 bp, Mus musculus
tccttcgccttcgacgtatgacggt

SEQ ID NO: 822268 - DNA, 25 bp, Mus musculus
tccttcgctggtattgtttaaaggt

SEQ ID NO: 822269 - DNA, 25 bp, Mus musculus
tccttcgctggttttgtttaaaggt

SEQ ID NO: 822270 - DNA, 25 bp, Mus musculus
tccttcgggaagactagatttgcta

SEQ ID NO: 822271 - DNA, 25 bp, Mus musculus
tccttcgggaagtctagatttgcta

SEQ ID NO: 822272 - DNA, 25 bp, Mus musculus
tccttcggtattagtccttgtggga

SEQ ID NO: 822273 - DNA, 25 bp, Mus musculus
tccttcggtatttgtccttgtggga

SEQ ID NO: 822274 - DNA, 25 bp, Mus musculus
tccttctaaggccacggttaccgat

SEQ ID NO: 822275 - DNA, 25 bp, Mus musculus
tccttctaaggcgacggttaccgat

SEQ ID NO: 822276 - DNA, 25 bp, Mus musculus
tccttctaatgcaatgttaattgaa

SEQ ID NO: 822277 - DNA, 25 bp, Mus musculus
tccttctaatgctatgttaattgaa

SEQ ID NO: 822278 - DNA, 25 bp, Mus musculus
tccttctaccgtctggtggttacag

SEQ ID NO: 822279 - DNA, 25 bp, Mus musculus
tccttctaccgtgtggtggttacag

SEQ ID NO: 822280 - DNA, 25 bp, Mus musculus
tccttctagagaaggcaccaaccta

SEQ ID NO: 822281 - DNA, 25 bp, Mus musculus
tccttctagagatggcaccaaccta

SEQ ID NO: 822282 - DNA, 25 bp, Mus musculus
tccttctagcaaccctcagttaaga

SEQ ID NO: 822283 - DNA, 25 bp, Mus musculus
tccttctagcaagcctcagttaaga

SEQ ID NO: 822284 - DNA, 25 bp, Mus musculus
tccttctagggacctgtgactatat

SEQ ID NO: 822285 - DNA, 25 bp, Mus musculus
tccttctagggagctgtgactatat

SEQ ID NO: 822286 - DNA, 25 bp, Mus musculus
tccttctattagcaacttgccatgc

SEQ ID NO: 822287 - DNA, 25 bp, Mus musculus
tccttctattaggaacttgccatgc

SEQ ID NO: 822288 - DNA, 25 bp, Mus musculus
tccttctcaccgatctttaataagt

SEQ ID NO: 822289 - DNA, 25 bp, Mus musculus
tccttctcaccgttctttaataagt

SEQ ID NO: 822290 - DNA, 25 bp, Mus musculus
tccttctcatcaaatctacacattc

SEQ ID NO: 822291 - DNA, 25 bp, Mus musculus
tccttctcatcatatctacacattc

SEQ ID NO: 822292 - DNA, 25 bp, Mus musculus
tccttctccagtacattatacaact

SEQ ID NO: 822293 - DNA, 25 bp, Mus musculus
tccttctccagttcattatacaact

SEQ ID NO: 822294 - DNA, 25 bp, Mus musculus
tccttctccatgagtggcgctgggc

SEQ ID NO: 822295 - DNA, 25 bp, Mus musculus
tccttctccatgcttatttctcaat

SEQ ID NO: 822296 - DNA, 25 bp, Mus musculus
tccttctccatggttatttctcaat

SEQ ID NO: 822297 - DNA, 25 bp, Mus musculus
tccttctccatgtgtggcgctgggc

SEQ ID NO: 822298 - DNA, 25 bp, Mus musculus
tccttctccgaaacaccttggaaag

SEQ ID NO: 822299 - DNA, 25 bp, Mus musculus
tccttctccgaatcaccttggaaag

SEQ ID NO: 822300 - DNA, 25 bp, Mus musculus
tccttctccgctcactgtaacagaa

SEQ ID NO: 822301 - DNA, 25 bp, Mus musculus
tccttctccgctgactgtaacagaa

SEQ ID NO: 822302 - DNA, 25 bp, Mus musculus
tccttctcctatcccggtgagcagg

SEQ ID NO: 822303 - DNA, 25 bp, Mus musculus
tccttctcctatgccggtgagcagg

SEQ ID NO: 822304 - DNA, 25 bp, Mus musculus
tccttctcctggaaactgttgcatt

SEQ ID NO: 822305 - DNA, 25 bp, Mus musculus
tccttctcctggtaactgttgcatt

SEQ ID NO: 822306 - DNA, 25 bp, Mus musculus
tccttctctaaacctgtagctagtt

SEQ ID NO: 822307 - DNA, 25 bp, Mus musculus
tccttctctaaagctgtagctagtt

SEQ ID NO: 822308 - DNA, 25 bp, Mus musculus
tccttctctatgctgattttcaagt

SEQ ID NO: 822309 - DNA, 25 bp, Mus musculus
tccttctctatggtgattttcaagt

SEQ ID NO: 822310 - DNA, 25 bp, Mus musculus
tccttctctctccaaatgtcactga

SEQ ID NO: 822311 - DNA, 25 bp, Mus musculus
tccttctctctcgaaatgtcactga

SEQ ID NO: 822312 - DNA, 25 bp, Mus musculus
tccttctctggccataggcatgagg

SEQ ID NO: 822313 - DNA, 25 bp, Mus musculus
tccttctctggcgataggcatgagg

SEQ ID NO: 822314 - DNA, 25 bp, Mus musculus
tccttctcttgaatatgtgcacaca

SEQ ID NO: 822315 - DNA, 25 bp, Mus musculus
tccttctcttgattatgtgcacaca

SEQ ID NO: 822316 - DNA, 25 bp, Mus musculus
tccttctgacttcgctttgccattt

SEQ ID NO: 822317 - DNA, 25 bp, Mus musculus
tccttctgacttggctttgccattt

SEQ ID NO: 822318 - DNA, 25 bp, Mus musculus
tccttctgatgacacctgtgagaaa

SEQ ID NO: 822319 - DNA, 25 bp, Mus musculus
tccttctgatgagacctgtgagaaa

SEQ ID NO: 822320 - DNA, 25 bp, Mus musculus
tccttctgcccaagactgagtgtga

SEQ ID NO: 822321 - DNA, 25 bp, Mus musculus
tccttctgcccatgactgagtgtga

SEQ ID NO: 822322 - DNA, 25 bp, Mus musculus
tccttctgcgagaagggccagaggg

SEQ ID NO: 822323 - DNA, 25 bp, Mus musculus
tccttctgcgagtagggccagaggg

SEQ ID NO: 822324 - DNA, 25 bp, Mus musculus
tccttctgctgtccctgggtccaga

SEQ ID NO: 822325 - DNA, 25 bp, Mus musculus
tccttctgctgtgcctgggtccaga

SEQ ID NO: 822326 - DNA, 25 bp, Mus musculus
tccttctggtaaaaaggctgcctgg

SEQ ID NO: 822327 - DNA, 25 bp, Mus musculus
tccttctggtaataaggctgcctgg

SEQ ID NO: 822328 - DNA, 25 bp, Mus musculus
tccttctggtggctgccacgctgtt

SEQ ID NO: 822329 - DNA, 25 bp, Mus musculus
tccttctggtgggtgccacgctgtt

SEQ ID NO: 822330 - DNA, 25 bp, Mus musculus
tccttctgtcccattagtacttttc

SEQ ID NO: 822331 - DNA, 25 bp, Mus musculus
tccttctgtccctttagtacttttc

SEQ ID NO: 822332 - DNA, 25 bp, Mus musculus
tccttctgtgataccaaataaaatc

SEQ ID NO: 822333 - DNA, 25 bp, Mus musculus
tccttctgtgattccaaataaaatc

SEQ ID NO: 822334 - DNA, 25 bp, Mus musculus
tccttctgtgccctctgagaggaac

SEQ ID NO: 822335 - DNA, 25 bp, Mus musculus
tccttctgtgccgtctgagaggaac

SEQ ID NO: 822336 - DNA, 25 bp, Mus musculus
tccttctgtgtcagcgaggccaatg

SEQ ID NO: 822337 - DNA, 25 bp, Mus musculus
tccttctgtgtctgcgaggccaatg

SEQ ID NO: 822338 - DNA, 25 bp, Mus musculus
tccttctgtgtgcttccaactgaac

SEQ ID NO: 822339 - DNA, 25 bp, Mus musculus
tccttctgtgtggttccaactgaac

SEQ ID NO: 822340 - DNA, 25 bp, Mus musculus
tccttctgttggagtccctcatcac

SEQ ID NO: 822341 - DNA, 25 bp, Mus musculus
tccttctgttggtgtccctcatcac

SEQ ID NO: 822342 - DNA, 25 bp, Mus musculus
tccttcttccaaagccaagcatatg

SEQ ID NO: 822343 - DNA, 25 bp, Mus musculus
tccttcttccaatgccaagcatatg

SEQ ID NO: 822344 - DNA, 25 bp, Mus musculus
tccttcttgatcagacatggtgcat

SEQ ID NO: 822345 - DNA, 25 bp, Mus musculus
tccttcttgatctgacatggtgcat

SEQ ID NO: 822346 - DNA, 25 bp, Mus musculus
tccttcttgccactctaacagggtg

SEQ ID NO: 822347 - DNA, 25 bp, Mus musculus
tccttcttgccagtctaacagggtg

SEQ ID NO: 822348 - DNA, 25 bp, Mus musculus
tccttcttgtgtcccttctgagctg

SEQ ID NO: 822349 - DNA, 25 bp, Mus musculus
tccttcttgtgtgccttctgagctg

SEQ ID NO: 822350 - DNA, 25 bp, Mus musculus
tccttcttgttcagtgatcacaatt

SEQ ID NO: 822351 - DNA, 25 bp, Mus musculus
tccttcttgttctgtgatcacaatt

SEQ ID NO: 822352 - DNA, 25 bp, Mus musculus
tccttcttgtttcttccggtgaaat

SEQ ID NO: 822353 - DNA, 25 bp, Mus musculus
tccttcttgtttgttccggtgaaat

SEQ ID NO: 822354 - DNA, 25 bp, Mus musculus
tccttctttactcgacattctgatg

SEQ ID NO: 822355 - DNA, 25 bp, Mus musculus
tccttctttactggacattctgatg

SEQ ID NO: 822356 - DNA, 25 bp, Mus musculus
tccttctttcacacatctgtatgca

SEQ ID NO: 822357 - DNA, 25 bp, Mus musculus
tccttctttcactcatctgtatgca

SEQ ID NO: 822358 - DNA, 25 bp, Mus musculus
tccttctttccaacatgctgggtaa

SEQ ID NO: 822359 - DNA, 25 bp, Mus musculus
tccttctttccatcatgctgggtaa

SEQ ID NO: 822360 - DNA, 25 bp, Mus musculus
tccttctttcgccattgcaccagag

SEQ ID NO: 822361 - DNA, 25 bp, Mus musculus
tccttctttcgcgattgcaccagag

SEQ ID NO: 822362 - DNA, 25 bp, Mus musculus
tccttcttttccctgttctacaaag

SEQ ID NO: 822363 - DNA, 25 bp, Mus musculus
tccttcttttccgtgttctacaaag

SEQ ID NO: 822364 - DNA, 25 bp, Mus musculus
tccttcttttctcatctgagtacac

SEQ ID NO: 822365 - DNA, 25 bp, Mus musculus
tccttcttttctgatctgagtacac

SEQ ID NO: 822366 - DNA, 25 bp, Mus musculus
tccttgaaaaatcacgtctagagaa

SEQ ID NO: 822367 - DNA, 25 bp, Mus musculus
tccttgaaaaatgacgtctagagaa

SEQ ID NO: 822368 - DNA, 25 bp, Mus musculus
tccttgaaacatcccactagccttg

SEQ ID NO: 822369 - DNA, 25 bp, Mus musculus
tccttgaaacatgccactagccttg

SEQ ID NO: 822370 - DNA, 25 bp, Mus musculus
tccttgaacgatccccgagatagtc

SEQ ID NO: 822371 - DNA, 25 bp, Mus musculus
tccttgaacgatgcccgagatagtc

SEQ ID NO: 822372 - DNA, 25 bp, Mus musculus
tccttgaagggcaatctggagtccc

SEQ ID NO: 822373 - DNA, 25 bp, Mus musculus
tccttgaagggctatctggagtccc

SEQ ID NO: 822374 - DNA, 25 bp, Mus musculus
tccttgaatcacctttgtgcctggt

SEQ ID NO: 822375 - DNA, 25 bp, Mus musculus
tccttgaatcacgtttgtgcctggt

SEQ ID NO: 822376 - DNA, 25 bp, Mus musculus
tccttgaatgttatacactgcctcc

SEQ ID NO: 822377 - DNA, 25 bp, Mus musculus
tccttgaatgttttacactgcctcc

SEQ ID NO: 822378 - DNA, 25 bp, Mus musculus
tccttgaattttactctgggtaaag

SEQ ID NO: 822379 - DNA, 25 bp, Mus musculus
tccttgaatttttctctgggtaaag

SEQ ID NO: 822380 - DNA, 25 bp, Mus musculus
tccttgaccaagatcaagggtttag

SEQ ID NO: 822381 - DNA, 25 bp, Mus musculus
tccttgaccaagttcaagggtttag

SEQ ID NO: 822382 - DNA, 25 bp, Mus musculus
tccttgactatgagacatttactcc

SEQ ID NO: 822383 - DNA, 25 bp, Mus musculus
tccttgactatgtgacatttactcc

SEQ ID NO: 822384 - DNA, 25 bp, Mus musculus
tccttgactggacgttgaactcaaa

SEQ ID NO: 822385 - DNA, 25 bp, Mus musculus
tccttgactggaggttgaactcaaa

SEQ ID NO: 822386 - DNA, 25 bp, Mus musculus
tccttgagactgcttccacgtgaaa

SEQ ID NO: 822387 - DNA, 25 bp, Mus musculus
tccttgagactggttccacgtgaaa

SEQ ID NO: 822388 - DNA, 25 bp, Mus musculus
tccttgagagataccgcagcttaga

SEQ ID NO: 822389 - DNA, 25 bp, Mus musculus
tccttgagagattccgcagcttaga

SEQ ID NO: 822390 - DNA, 25 bp, Mus musculus
tccttgagcacacatcaatgggaat

SEQ ID NO: 822391 - DNA, 25 bp, Mus musculus
tccttgagcacagatcaatgggaat

SEQ ID NO: 822392 - DNA, 25 bp, Mus musculus
tccttgagctcacaattaaaattgc

SEQ ID NO: 822393 - DNA, 25 bp, Mus musculus
tccttgagctcagaattaaaattgc

SEQ ID NO: 822394 - DNA, 25 bp, Mus musculus
tccttgagcttaattcacccctcca

SEQ ID NO: 822395 - DNA, 25 bp, Mus musculus
tccttgagcttatttcacccctcca

SEQ ID NO: 822396 - DNA, 25 bp, Mus musculus
tccttgataacaacctaagaaagaa

SEQ ID NO: 822397 - DNA, 25 bp, Mus musculus
tccttgataacatcctaagaaagaa

SEQ ID NO: 822398 - DNA, 25 bp, Mus musculus
tccttgatccttacatgagctacag

SEQ ID NO: 822399 - DNA, 25 bp, Mus musculus
tccttgatcctttcatgagctacag

SEQ ID NO: 822400 - DNA, 25 bp, Mus musculus
tccttgatctgacggttgattgaca

SEQ ID NO: 822401 - DNA, 25 bp, Mus musculus
tccttgatctgagggttgattgaca

SEQ ID NO: 822402 - DNA, 25 bp, Mus musculus
tccttgatgagcacctgcacatgca

SEQ ID NO: 822403 - DNA, 25 bp, Mus musculus
tccttgatgagctcctgcacatgca

SEQ ID NO: 822404 - DNA, 25 bp, Mus musculus
tccttgatgttactacagaatctgg

SEQ ID NO: 822405 - DNA, 25 bp, Mus musculus
tccttgatgttagtacagaatctgg

SEQ ID NO: 822406 - DNA, 25 bp, Mus musculus
tccttgattcttatgtcatgtaact

SEQ ID NO: 822407 - DNA, 25 bp, Mus musculus
tccttgattcttttgtcatgtaact

SEQ ID NO: 822408 - DNA, 25 bp, Mus musculus
tccttgatttcccttagttgtctaa

SEQ ID NO: 822409 - DNA, 25 bp, Mus musculus
tccttgatttccgttagttgtctaa

SEQ ID NO: 822410 - DNA, 25 bp, Mus musculus
tccttgatttgcatatgtaaacaag

SEQ ID NO: 822411 - DNA, 25 bp, Mus musculus
tccttgatttgcttatgtaaacaag

SEQ ID NO: 822412 - DNA, 25 bp, Mus musculus
tccttgcaaatcatcaggtggccta

SEQ ID NO: 822413 - DNA, 25 bp, Mus musculus
tccttgcaaatcttcaggtggccta

SEQ ID NO: 822414 - DNA, 25 bp, Mus musculus
tccttgcacactcaaaatctgtgag

SEQ ID NO: 822415 - DNA, 25 bp, Mus musculus
tccttgcacactgaaaatctgtgag

SEQ ID NO: 822416 - DNA, 25 bp, Mus musculus
tccttgcacaggatcaggaacagca

SEQ ID NO: 822417 - DNA, 25 bp, Mus musculus
tccttgcacaggttcaggaacagca

SEQ ID NO: 822418 - DNA, 25 bp, Mus musculus
tccttgcaggctcggccaggccaga

SEQ ID NO: 822419 - DNA, 25 bp, Mus musculus
tccttgcaggctgggccaggccaga

SEQ ID NO: 822420 - DNA, 25 bp, Mus musculus
tccttgcagggacactgacctgata

SEQ ID NO: 822421 - DNA, 25 bp, Mus musculus
tccttgcagggagactgacctgata

SEQ ID NO: 822422 - DNA, 25 bp, Mus musculus
tccttgcagtccatcttgagatctt

SEQ ID NO: 822423 - DNA, 25 bp, Mus musculus
tccttgcagtccctcttgcatcctg

SEQ ID NO: 822424 - DNA, 25 bp, Mus musculus
tccttgcagtccgtcttgcatcctg

SEQ ID NO: 822425 - DNA, 25 bp, Mus musculus
tccttgcagtccttcttgagatctt

SEQ ID NO: 822426 - DNA, 25 bp, Mus musculus
tccttgcatcctactgaggtactga

SEQ ID NO: 822427 - DNA, 25 bp, Mus musculus
tccttgcatccttctgaggtactga

SEQ ID NO: 822428 - DNA, 25 bp, Mus musculus
tccttgcatgctcaggctcttagag

SEQ ID NO: 822429 - DNA, 25 bp, Mus musculus
tccttgcatgctgaggctcttagag

SEQ ID NO: 822430 - DNA, 25 bp, Mus musculus
tccttgccacctctgttggaactaa

SEQ ID NO: 822431 - DNA, 25 bp, Mus musculus
tccttgccacctgtgttggaactaa

SEQ ID NO: 822432 - DNA, 25 bp, Mus musculus
tccttgccagcaagaattcctttta

SEQ ID NO: 822433 - DNA, 25 bp, Mus musculus
tccttgccagcatgaattcctttta

SEQ ID NO: 822434 - DNA, 25 bp, Mus musculus
tccttgcccagtcctgacctagtgt

SEQ ID NO: 822435 - DNA, 25 bp, Mus musculus
tccttgcccagtgctgacctagtgt

SEQ ID NO: 822436 - DNA, 25 bp, Mus musculus
tccttgccgctcctattgtagtgag

SEQ ID NO: 822437 - DNA, 25 bp, Mus musculus
tccttgccgctcgtattgtagtgag

SEQ ID NO: 822438 - DNA, 25 bp, Mus musculus
tccttgccggacagcccttcaagga

SEQ ID NO: 822439 - DNA, 25 bp, Mus musculus
tccttgccggactgcccttcaagga

SEQ ID NO: 822440 - DNA, 25 bp, Mus musculus
tccttgcctagcatcaataggagat

SEQ ID NO: 822441 - DNA, 25 bp, Mus musculus
tccttgcctagcttcaataggagat

SEQ ID NO: 822442 - DNA, 25 bp, Mus musculus
tccttgcctgcaaatggtaccgaac

SEQ ID NO: 822443 - DNA, 25 bp, Mus musculus
tccttgcctgcatatggtaccgaac

SEQ ID NO: 822444 - DNA, 25 bp, Mus musculus
tccttgcctggcaggagtttacaga

SEQ ID NO: 822445 - DNA, 25 bp, Mus musculus
tccttgcctggctggagtttacaga

SEQ ID NO: 822446 - DNA, 25 bp, Mus musculus
tccttgcctgttactttcatcagta

SEQ ID NO: 822447 - DNA, 25 bp, Mus musculus
tccttgcctgtttctttcatcagta

SEQ ID NO: 822448 - DNA, 25 bp, Mus musculus
tccttgccttaccatgtccaagaaa

SEQ ID NO: 822449 - DNA, 25 bp, Mus musculus
tccttgccttacgatgtccaagaaa

SEQ ID NO: 822450 - DNA, 25 bp, Mus musculus
tccttgctaactacagccgaagctg

SEQ ID NO: 822451 - DNA, 25 bp, Mus musculus
tccttgctaacttcagccgaagctg

SEQ ID NO: 822452 - DNA, 25 bp, Mus musculus
tccttgctaattatttcctccacat

SEQ ID NO: 822453 - DNA, 25 bp, Mus musculus
tccttgctaattttttcctccacat

SEQ ID NO: 822454 - DNA, 25 bp, Mus musculus
tccttgctatgaaatctgtgtcctt

SEQ ID NO: 822455 - DNA, 25 bp, Mus musculus
tccttgctatgatatctgtgtcctt

SEQ ID NO: 822456 - DNA, 25 bp, Mus musculus
tccttgctcctgaatcttcagtgaa

SEQ ID NO: 822457 - DNA, 25 bp, Mus musculus
tccttgctcctgctagaaatgcctt

SEQ ID NO: 822458 - DNA, 25 bp, Mus musculus
tccttgctcctggtagaaatgcctt

SEQ ID NO: 822459 - DNA, 25 bp, Mus musculus
tccttgctcctgtatcttcagtgaa

SEQ ID NO: 822460 - DNA, 25 bp, Mus musculus
tccttgctcgaacagtgcggcctga

SEQ ID NO: 822461 - DNA, 25 bp, Mus musculus
tccttgctcgaagagtgcggcctga

SEQ ID NO: 822462 - DNA, 25 bp, Mus musculus
tccttgctctgcagtgatgtgtgta

SEQ ID NO: 822463 - DNA, 25 bp, Mus musculus
tccttgctctgctgtgatgtgtgta

SEQ ID NO: 822464 - DNA, 25 bp, Mus musculus
tccttgctgactccatgattgtact

SEQ ID NO: 822465 - DNA, 25 bp, Mus musculus
tccttgctgactgcatgattgtact

SEQ ID NO: 822466 - DNA, 25 bp, Mus musculus
tccttgctgaggactgtttctaaaa

SEQ ID NO: 822467 - DNA, 25 bp, Mus musculus
tccttgctgaggtctgtttctaaaa

SEQ ID NO: 822468 - DNA, 25 bp, Mus musculus
tccttgctggttacacaactgggac

SEQ ID NO: 822469 - DNA, 25 bp, Mus musculus
tccttgctggtttcacaactgggac

SEQ ID NO: 822470 - DNA, 25 bp, Mus musculus
tccttgctgtgccaccctggaagag

SEQ ID NO: 822471 - DNA, 25 bp, Mus musculus
tccttgctgtgcgaccctggaagag

SEQ ID NO: 822472 - DNA, 25 bp, Mus musculus
tccttgctgtgtcgtgatctcatga

SEQ ID NO: 822473 - DNA, 25 bp, Mus musculus
tccttgctgtgtggtgatctcatga

SEQ ID NO: 822474 - DNA, 25 bp, Mus musculus
tccttgcttaccacattgttaactg

SEQ ID NO: 822475 - DNA, 25 bp, Mus musculus
tccttgcttacctcattgttaactg

SEQ ID NO: 822476 - DNA, 25 bp, Mus musculus
tccttgcttagaataccacatcatt

SEQ ID NO: 822477 - DNA, 25 bp, Mus musculus
tccttgcttagattaccacatcatt

SEQ ID NO: 822478 - DNA, 25 bp, Mus musculus
tccttgcttctcagctaaagtagct

SEQ ID NO: 822479 - DNA, 25 bp, Mus musculus
tccttgcttctctgctaaagtagct

SEQ ID NO: 822480 - DNA, 25 bp, Mus musculus
tccttgcttgcaatgctagcgtatt

SEQ ID NO: 822481 - DNA, 25 bp, Mus musculus
tccttgcttgcattgctagcgtatt

SEQ ID NO: 822482 - DNA, 25 bp, Mus musculus
tccttgcttgtcaccatgtatgagg

SEQ ID NO: 822483 - DNA, 25 bp, Mus musculus
tccttgcttgtctccatgtatgagg

SEQ ID NO: 822484 - DNA, 25 bp, Mus musculus
tccttgcttgttacggctgacggct

SEQ ID NO: 822485 - DNA, 25 bp, Mus musculus
tccttgcttgtttcggctgacggct

SEQ ID NO: 822486 - DNA, 25 bp, Mus musculus
tccttgctttcacaactgttataat

SEQ ID NO: 822487 - DNA, 25 bp, Mus musculus
tccttgctttcagaactgttataat

SEQ ID NO: 822488 - DNA, 25 bp, Mus musculus
tccttgctttggagtcctgactgag

SEQ ID NO: 822489 - DNA, 25 bp, Mus musculus
tccttgctttggtgtcctgactgag

SEQ ID NO: 822490 - DNA, 25 bp, Mus musculus
tccttgctttttacacatgttttat

SEQ ID NO: 822491 - DNA, 25 bp, Mus musculus
tccttgcttttttcacatgttttat

SEQ ID NO: 822492 - DNA, 25 bp, Mus musculus
tccttggacactccacacatatggt

SEQ ID NO: 822493 - DNA, 25 bp, Mus musculus
tccttggacactcgcagaatttgac

SEQ ID NO: 822494 - DNA, 25 bp, Mus musculus
tccttggacactgcacacatatggt

SEQ ID NO: 822495 - DNA, 25 bp, Mus musculus
tccttggacactggcagaatttgac

SEQ ID NO: 822496 - DNA, 25 bp, Mus musculus
tccttggactttctacccgagaaag

SEQ ID NO: 822497 - DNA, 25 bp, Mus musculus
tccttggactttgtacccgagaaag

SEQ ID NO: 822498 - DNA, 25 bp, Mus musculus
tccttggagtctactcattcccttc

SEQ ID NO: 822499 - DNA, 25 bp, Mus musculus
tccttggagtctcaagagtaccaga

SEQ ID NO: 822500 - DNA, 25 bp, Mus musculus
tccttggagtctcgaggctgaaatc

SEQ ID NO: 822501 - DNA, 25 bp, Mus musculus
tccttggagtctgaagagtaccaga

SEQ ID NO: 822502 - DNA, 25 bp, Mus musculus
tccttggagtctggaggctgaaatc

SEQ ID NO: 822503 - DNA, 25 bp, Mus musculus
tccttggagtcttctcattcccttc

SEQ ID NO: 822504 - DNA, 25 bp, Mus musculus
tccttggagtggaggcttctgctga

SEQ ID NO: 822505 - DNA, 25 bp, Mus musculus
tccttggagtggtggcttctgctga

SEQ ID NO: 822506 - DNA, 25 bp, Mus musculus
tccttggatactaacatacctgaaa

SEQ ID NO: 822507 - DNA, 25 bp, Mus musculus
tccttggatacttacatacctgaaa

SEQ ID NO: 822508 - DNA, 25 bp, Mus musculus
tccttggatagtacacaaacacctt

SEQ ID NO: 822509 - DNA, 25 bp, Mus musculus
tccttggatagttcacaaacacctt

SEQ ID NO: 822510 - DNA, 25 bp, Mus musculus
tccttggatcgaaacagaaccgttt

SEQ ID NO: 822511 - DNA, 25 bp, Mus musculus
tccttggatcgatacagaaccgttt

SEQ ID NO: 822512 - DNA, 25 bp, Mus musculus
tccttggattagcttgacttttttc

SEQ ID NO: 822513 - DNA, 25 bp, Mus musculus
tccttggattaggttgacttttttc

SEQ ID NO: 822514 - DNA, 25 bp, Mus musculus
tccttggcagcgagttcagagttgg

SEQ ID NO: 822515 - DNA, 25 bp, Mus musculus
tccttggcagcgtgttcagagttgg

SEQ ID NO: 822516 - DNA, 25 bp, Mus musculus
tccttggcaggcagcgagacacagc

SEQ ID NO: 822517 - DNA, 25 bp, Mus musculus
tccttggcaggctgcgagacacagc

SEQ ID NO: 822518 - DNA, 25 bp, Mus musculus
tccttggcattaatctgggcaccgt

SEQ ID NO: 822519 - DNA, 25 bp, Mus musculus
tccttggcattattctgggcaccgt

SEQ ID NO: 822520 - DNA, 25 bp, Mus musculus
tccttggccagtatctggtgctaaa

SEQ ID NO: 822521 - DNA, 25 bp, Mus musculus
tccttggccagtttctggtgctaaa

SEQ ID NO: 822522 - DNA, 25 bp, Mus musculus
tccttggcctcacggagcggttgaa

SEQ ID NO: 822523 - DNA, 25 bp, Mus musculus
tccttggcctcagggagcggttgaa

SEQ ID NO: 822524 - DNA, 25 bp, Mus musculus
tccttggcgtcgcacattcggtgtt

SEQ ID NO: 822525 - DNA, 25 bp, Mus musculus
tccttggcgtcggacattcggtgtt

SEQ ID NO: 822526 - DNA, 25 bp, Mus musculus
tccttggctatgaagtaaacttgag

SEQ ID NO: 822527 - DNA, 25 bp, Mus musculus
tccttggctatgtagtaaacttgag

SEQ ID NO: 822528 - DNA, 25 bp, Mus musculus
tccttggctcgtcgtgggaacacaa

SEQ ID NO: 822529 - DNA, 25 bp, Mus musculus
tccttggctcgtggtgggaacacaa

SEQ ID NO: 822530 - DNA, 25 bp, Mus musculus
tccttggctgccagtggtttgttat

SEQ ID NO: 822531 - DNA, 25 bp, Mus musculus
tccttggctgcctgtggtttgttat

SEQ ID NO: 822532 - DNA, 25 bp, Mus musculus
tccttggctggtcataaagagacag

SEQ ID NO: 822533 - DNA, 25 bp, Mus musculus
tccttggctggtgataaagagacag

SEQ ID NO: 822534 - DNA, 25 bp, Mus musculus
tccttggctttcaggtgagttatta

SEQ ID NO: 822535 - DNA, 25 bp, Mus musculus
tccttggctttcctatgtcgtcaga

SEQ ID NO: 822536 - DNA, 25 bp, Mus musculus
tccttggctttcgtatgtcgtcaga

SEQ ID NO: 822537 - DNA, 25 bp, Mus musculus
tccttggctttctggtgagttatta

SEQ ID NO: 822538 - DNA, 25 bp, Mus musculus
tccttggcttttatcatgctaatat

SEQ ID NO: 822539 - DNA, 25 bp, Mus musculus
tccttggcttttttcatgctaatat

SEQ ID NO: 822540 - DNA, 25 bp, Mus musculus
tccttgggaccactgtctagcctgt

SEQ ID NO: 822541 - DNA, 25 bp, Mus musculus
tccttgggaccagtgtctagcctgt

SEQ ID NO: 822542 - DNA, 25 bp, Mus musculus
tccttgggactaaaccagcaatcaa

SEQ ID NO: 822543 - DNA, 25 bp, Mus musculus
tccttgggactataccagcaatcaa

SEQ ID NO: 822544 - DNA, 25 bp, Mus musculus
tccttgggaggtatgcatttgtgtg

SEQ ID NO: 822545 - DNA, 25 bp, Mus musculus
tccttgggaggtttgcatttgtgtg

SEQ ID NO: 822546 - DNA, 25 bp, Mus musculus
tccttgggcaccagacacacagagt

SEQ ID NO: 822547 - DNA, 25 bp, Mus musculus
tccttgggcacctgacacacagagt

SEQ ID NO: 822548 - DNA, 25 bp, Mus musculus
tccttgggcgccagcacatatgtgt

SEQ ID NO: 822549 - DNA, 25 bp, Mus musculus
tccttgggcgcctgcacatatgtgt

SEQ ID NO: 822550 - DNA, 25 bp, Mus musculus
tccttgggctggagggtattctcat

SEQ ID NO: 822551 - DNA, 25 bp, Mus musculus
tccttgggctggtgggtattctcat

SEQ ID NO: 822552 - DNA, 25 bp, Mus musculus
tccttgggcttcactaaactagcac

SEQ ID NO: 822553 - DNA, 25 bp, Mus musculus
tccttgggcttctctaaactagcac

SEQ ID NO: 822554 - DNA, 25 bp, Mus musculus
tccttgggttgaatctatcttcaca

SEQ ID NO: 822555 - DNA, 25 bp, Mus musculus
tccttgggttgattctatcttcaca

SEQ ID NO: 822556 - DNA, 25 bp, Mus musculus
tccttgggttggagtgtagctgccc

SEQ ID NO: 822557 - DNA, 25 bp, Mus musculus
tccttgggttggatcttagtgctac

SEQ ID NO: 822558 - DNA, 25 bp, Mus musculus
tccttgggttggtgtgtagctgccc

SEQ ID NO: 822559 - DNA, 25 bp, Mus musculus
tccttgggttggttcttagtgctac

SEQ ID NO: 822560 - DNA, 25 bp, Mus musculus
tccttggtaactcaaacagaaactt

SEQ ID NO: 822561 - DNA, 25 bp, Mus musculus
tccttggtaactgaaacagaaactt

SEQ ID NO: 822562 - DNA, 25 bp, Mus musculus
tccttggtagctactattggtactt

SEQ ID NO: 822563 - DNA, 25 bp, Mus musculus
tccttggtagcttctattggtactt

SEQ ID NO: 822564 - DNA, 25 bp, Mus musculus
tccttggtagttaaggcatcttccc

SEQ ID NO: 822565 - DNA, 25 bp, Mus musculus
tccttggtagtttaggcatcttccc

SEQ ID NO: 822566 - DNA, 25 bp, Mus musculus
tccttggtcacgcacagtactgtga

SEQ ID NO: 822567 - DNA, 25 bp, Mus musculus
tccttggtcacggacagtactgtga

SEQ ID NO: 822568 - DNA, 25 bp, Mus musculus
tccttggtccctaacagagtgggta

SEQ ID NO: 822569 - DNA, 25 bp, Mus musculus
tccttggtcccttacagagtgggta

SEQ ID NO: 822570 - DNA, 25 bp, Mus musculus
tccttggtctgacccaggactgatg

SEQ ID NO: 822571 - DNA, 25 bp, Mus musculus
tccttggtctgagccaggactgatg

SEQ ID NO: 822572 - DNA, 25 bp, Mus musculus
tccttggtgctcattctccctgatg

SEQ ID NO: 822573 - DNA, 25 bp, Mus musculus
tccttggtgctctttctccctgatg

SEQ ID NO: 822574 - DNA, 25 bp, Mus musculus
tccttggtgctgcatattgtgtaca

SEQ ID NO: 822575 - DNA, 25 bp, Mus musculus
tccttggtgctggatattgtgtaca

SEQ ID NO: 822576 - DNA, 25 bp, Mus musculus
tccttggtgtctcccatctaatcaa

SEQ ID NO: 822577 - DNA, 25 bp, Mus musculus
tccttggtgtctgccatctaatcaa

SEQ ID NO: 822578 - DNA, 25 bp, Mus musculus
tccttggtgtgtacattgagtttat

SEQ ID NO: 822579 - DNA, 25 bp, Mus musculus
tccttggtgtgttcattgagtttat

SEQ ID NO: 822580 - DNA, 25 bp, Mus musculus
tccttggttcctactaattgtatca

SEQ ID NO: 822581 - DNA, 25 bp, Mus musculus
tccttggttccttctaattgtatca

SEQ ID NO: 822582 - DNA, 25 bp, Mus musculus
tccttggtttcaactagcctcagca

SEQ ID NO: 822583 - DNA, 25 bp, Mus musculus
tccttggtttcatctagcctcagca

SEQ ID NO: 822584 - DNA, 25 bp, Mus musculus
tccttggtttccaagcaaccagagc

SEQ ID NO: 822585 - DNA, 25 bp, Mus musculus
tccttggtttcctagcaaccagagc

SEQ ID NO: 822586 - DNA, 25 bp, Mus musculus
tccttgtaaagacatgcagccgtca

SEQ ID NO: 822587 - DNA, 25 bp, Mus musculus
tccttgtaaagagatgcagccgtca

SEQ ID NO: 822588 - DNA, 25 bp, Mus musculus
tccttgtaagatatgtttctagcac

SEQ ID NO: 822589 - DNA, 25 bp, Mus musculus
tccttgtaagatttgtttctagcac

SEQ ID NO: 822590 - DNA, 25 bp, Mus musculus
tccttgtacttacctccctaaagtg

SEQ ID NO: 822591 - DNA, 25 bp, Mus musculus
tccttgtacttagctccctaaagtg

SEQ ID NO: 822592 - DNA, 25 bp, Mus musculus
tccttgtagcgaagctgcaggccat

SEQ ID NO: 822593 - DNA, 25 bp, Mus musculus
tccttgtagcgatgctgcaggccat

SEQ ID NO: 822594 - DNA, 25 bp, Mus musculus
tccttgtaggcccagggcggttcct

SEQ ID NO: 822595 - DNA, 25 bp, Mus musculus
tccttgtaggccgagggcggttcct

SEQ ID NO: 822596 - DNA, 25 bp, Mus musculus
tccttgtaggttcctgagctgggaa

SEQ ID NO: 822597 - DNA, 25 bp, Mus musculus
tccttgtaggttgctgagctgggaa

SEQ ID NO: 822598 - DNA, 25 bp, Mus musculus
tccttgtattatactctgtattttg

SEQ ID NO: 822599 - DNA, 25 bp, Mus musculus
tccttgtattattctctgtattttg

SEQ ID NO: 822600 - DNA, 25 bp, Mus musculus
tccttgtcacaaatccagagtttca

SEQ ID NO: 822601 - DNA, 25 bp, Mus musculus
tccttgtcacaattccagagtttca

SEQ ID NO: 822602 - DNA, 25 bp, Mus musculus
tccttgtcaccgagagatagaaaat

SEQ ID NO: 822603 - DNA, 25 bp, Mus musculus
tccttgtcaccgtgagatagaaaat

SEQ ID NO: 822604 - DNA, 25 bp, Mus musculus
tccttgtcccctactaggttaagca

SEQ ID NO: 822605 - DNA, 25 bp, Mus musculus
tccttgtccccttctaggttaagca

SEQ ID NO: 822606 - DNA, 25 bp, Mus musculus
tccttgtcctaactggagctggtaa

SEQ ID NO: 822607 - DNA, 25 bp, Mus musculus
tccttgtcctaagtggagctggtaa

SEQ ID NO: 822608 - DNA, 25 bp, Mus musculus
tccttgtcctccaggtatgagagaa

SEQ ID NO: 822609 - DNA, 25 bp, Mus musculus
tccttgtcctcctggtatgagagaa

SEQ ID NO: 822610 - DNA, 25 bp, Mus musculus
tccttgtcctgtagatgatcttgta

SEQ ID NO: 822611 - DNA, 25 bp, Mus musculus
tccttgtcctgttgatgatcttgta

SEQ ID NO: 822612 - DNA, 25 bp, Mus musculus
tccttgtctactagggcttcagtgt

SEQ ID NO: 822613 - DNA, 25 bp, Mus musculus
tccttgtctacttgggcttcagtgt

SEQ ID NO: 822614 - DNA, 25 bp, Mus musculus
tccttgtctataaacctgtgatact

SEQ ID NO: 822615 - DNA, 25 bp, Mus musculus
tccttgtctatatacctgtgatact

SEQ ID NO: 822616 - DNA, 25 bp, Mus musculus
tccttgtctcacagtttctttgcat

SEQ ID NO: 822617 - DNA, 25 bp, Mus musculus
tccttgtctcactgtttctttgcat

SEQ ID NO: 822618 - DNA, 25 bp, Mus musculus
tccttgtctctgagacttgtagacg

SEQ ID NO: 822619 - DNA, 25 bp, Mus musculus
tccttgtctctgtgacttgtagacg

SEQ ID NO: 822620 - DNA, 25 bp, Mus musculus
tccttgtctgcactcttcttcaaag

SEQ ID NO: 822621 - DNA, 25 bp, Mus musculus
tccttgtctgcagtcttcttcaaag

SEQ ID NO: 822622 - DNA, 25 bp, Mus musculus
tccttgtctttactcttcttacaga

SEQ ID NO: 822623 - DNA, 25 bp, Mus musculus
tccttgtctttagtcttcttacaga

SEQ ID NO: 822624 - DNA, 25 bp, Mus musculus
tccttgtgcagtcaaccttgtttta

SEQ ID NO: 822625 - DNA, 25 bp, Mus musculus
tccttgtgcagtgaaccttgtttta

SEQ ID NO: 822626 - DNA, 25 bp, Mus musculus
tccttgtgcccaccctaggaaaggg

SEQ ID NO: 822627 - DNA, 25 bp, Mus musculus
tccttgtgcccagcctaggaaaggg

SEQ ID NO: 822628 - DNA, 25 bp, Mus musculus
tccttgtgccctcaaatgaaatccc

SEQ ID NO: 822629 - DNA, 25 bp, Mus musculus
tccttgtgccctgaaatgaaatccc

SEQ ID NO: 822630 - DNA, 25 bp, Mus musculus
tccttgtggccactgatgtccagat

SEQ ID NO: 822631 - DNA, 25 bp, Mus musculus
tccttgtggccagtgatgtccagat

SEQ ID NO: 822632 - DNA, 25 bp, Mus musculus
tccttgtggcgcataagacccagat

SEQ ID NO: 822633 - DNA, 25 bp, Mus musculus
tccttgtggcgcttaagacccagat

SEQ ID NO: 822634 - DNA, 25 bp, Mus musculus
tccttgtggctgattgacttgtaaa

SEQ ID NO: 822635 - DNA, 25 bp, Mus musculus
tccttgtggctgtttgacttgtaaa

SEQ ID NO: 822636 - DNA, 25 bp, Mus musculus
tccttgtgggccaagctgaaactgc

SEQ ID NO: 822637 - DNA, 25 bp, Mus musculus
tccttgtgggcctagctgaaactgc

SEQ ID NO: 822638 - DNA, 25 bp, Mus musculus
tccttgtgggctatacctgagatcc

SEQ ID NO: 822639 - DNA, 25 bp, Mus musculus
tccttgtgggctttacctgagatcc

SEQ ID NO: 822640 - DNA, 25 bp, Mus musculus
tccttgtggtgcagagaccgtgtat

SEQ ID NO: 822641 - DNA, 25 bp, Mus musculus
tccttgtggtgctgagaccgtgtat

SEQ ID NO: 822642 - DNA, 25 bp, Mus musculus
tccttgtgtcaccttgctgcaaaag

SEQ ID NO: 822643 - DNA, 25 bp, Mus musculus
tccttgtgtcacgttgctgcaaaag

SEQ ID NO: 822644 - DNA, 25 bp, Mus musculus
tccttgtgtccacaatcccagatgg

SEQ ID NO: 822645 - DNA, 25 bp, Mus musculus
tccttgtgtccagaatcccagatgg

SEQ ID NO: 822646 - DNA, 25 bp, Mus musculus
tccttgtgtgaaagcatgaggcaga

SEQ ID NO: 822647 - DNA, 25 bp, Mus musculus
tccttgtgtgaatgcatgaggcaga

SEQ ID NO: 822648 - DNA, 25 bp, Mus musculus
tccttgtgtttaccattccatcttt

SEQ ID NO: 822649 - DNA, 25 bp, Mus musculus
tccttgtgtttagcattccatcttt

SEQ ID NO: 822650 - DNA, 25 bp, Mus musculus
tccttgttacttatgcatacacgga

SEQ ID NO: 822651 - DNA, 25 bp, Mus musculus
tccttgttacttttgcatacacgga

SEQ ID NO: 822652 - DNA, 25 bp, Mus musculus
tccttgttaggcaacgggaacgaga

SEQ ID NO: 822653 - DNA, 25 bp, Mus musculus
tccttgttaggctacgggaacgaga

SEQ ID NO: 822654 - DNA, 25 bp, Mus musculus
tccttgttagtgacattgggtacca

SEQ ID NO: 822655 - DNA, 25 bp, Mus musculus
tccttgttagtgtcattgggtacca

SEQ ID NO: 822656 - DNA, 25 bp, Mus musculus
tccttgttcaggctgctcggttcat

SEQ ID NO: 822657 - DNA, 25 bp, Mus musculus
tccttgttcagggtgctcggttcat

SEQ ID NO: 822658 - DNA, 25 bp, Mus musculus
tccttgttcgaaagctgcaggtttg

SEQ ID NO: 822659 - DNA, 25 bp, Mus musculus
tccttgttcgaatgctgcaggtttg

SEQ ID NO: 822660 - DNA, 25 bp, Mus musculus
tccttgttctctaatggaagctccc

SEQ ID NO: 822661 - DNA, 25 bp, Mus musculus
tccttgttctcttatggaagctccc

SEQ ID NO: 822662 - DNA, 25 bp, Mus musculus
tccttgttgacactactcctggagc

SEQ ID NO: 822663 - DNA, 25 bp, Mus musculus
tccttgttgacagtactcctggagc

SEQ ID NO: 822664 - DNA, 25 bp, Mus musculus
tccttgttgcagaaagtcctggcgt

SEQ ID NO: 822665 - DNA, 25 bp, Mus musculus
tccttgttgcagtaagtcctggcgt

SEQ ID NO: 822666 - DNA, 25 bp, Mus musculus
tccttgttgctcagcttcctttaaa

SEQ ID NO: 822667 - DNA, 25 bp, Mus musculus
tccttgttgctctgcttcctttaaa

SEQ ID NO: 822668 - DNA, 25 bp, Mus musculus
tccttgtttactaagatctgtgcaa

SEQ ID NO: 822669 - DNA, 25 bp, Mus musculus
tccttgtttacttagatctgtgcaa

SEQ ID NO: 822670 - DNA, 25 bp, Mus musculus
tccttgtttcttacttggttaagat

SEQ ID NO: 822671 - DNA, 25 bp, Mus musculus
tccttgtttctttcttggttaagat

SEQ ID NO: 822672 - DNA, 25 bp, Mus musculus
tccttgtttggtagtctctgcatag

SEQ ID NO: 822673 - DNA, 25 bp, Mus musculus
tccttgtttggttgtctctgcatag

SEQ ID NO: 822674 - DNA, 25 bp, Mus musculus
tccttgtttgtgagggacatctaca

SEQ ID NO: 822675 - DNA, 25 bp, Mus musculus
tccttgtttgtgtgggacatctaca

SEQ ID NO: 822676 - DNA, 25 bp, Mus musculus
tcctttaaaaggctggccactgctt

SEQ ID NO: 822677 - DNA, 25 bp, Mus musculus
tcctttaaaagggtggccactgctt

SEQ ID NO: 822678 - DNA, 25 bp, Mus musculus
tcctttaagattatcgacaccctat

SEQ ID NO: 822679 - DNA, 25 bp, Mus musculus
tcctttaagattttcgacaccctat

SEQ ID NO: 822680 - DNA, 25 bp, Mus musculus
tcctttacagaccttacttggaagc

SEQ ID NO: 822681 - DNA, 25 bp, Mus musculus
tcctttacagacgttacttggaagc

SEQ ID NO: 822682 - DNA, 25 bp, Mus musculus
tcctttacaggaaccgtcagggctg

SEQ ID NO: 822683 - DNA, 25 bp, Mus musculus
tcctttacaggatccgtcagggctg

SEQ ID NO: 822684 - DNA, 25 bp, Mus musculus
tcctttacccaaagtagctgatatt

SEQ ID NO: 822685 - DNA, 25 bp, Mus musculus
tcctttacccaatgtagctgatatt

SEQ ID NO: 822686 - DNA, 25 bp, Mus musculus
tcctttacccgaagggagacatgga

SEQ ID NO: 822687 - DNA, 25 bp, Mus musculus
tcctttacccgatgggagacatgga

SEQ ID NO: 822688 - DNA, 25 bp, Mus musculus
tcctttaccctccagtccaggaaat

SEQ ID NO: 822689 - DNA, 25 bp, Mus musculus
tcctttaccctcgagtccaggaaat

SEQ ID NO: 822690 - DNA, 25 bp, Mus musculus
tcctttaccgaaatcccaggatttg

SEQ ID NO: 822691 - DNA, 25 bp, Mus musculus
tcctttaccgaattcccaggatttg

SEQ ID NO: 822692 - DNA, 25 bp, Mus musculus
tcctttacctaaatgcctgtctcaa

SEQ ID NO: 822693 - DNA, 25 bp, Mus musculus
tcctttacctaattgcctgtctcaa

SEQ ID NO: 822694 - DNA, 25 bp, Mus musculus
tcctttacctgaacgaactcctgag

SEQ ID NO: 822695 - DNA, 25 bp, Mus musculus
tcctttacctgatcgaactcctgag

SEQ ID NO: 822696 - DNA, 25 bp, Mus musculus
tcctttacctgtatgggatttgaca

SEQ ID NO: 822697 - DNA, 25 bp, Mus musculus
tcctttacctgtttgggatttgaca

SEQ ID NO: 822698 - DNA, 25 bp, Mus musculus
tcctttactgatacttaacatgttt

SEQ ID NO: 822699 - DNA, 25 bp, Mus musculus
tcctttactgattcttaacatgttt

SEQ ID NO: 822700 - DNA, 25 bp, Mus musculus
tcctttactggaactttcttctcat

SEQ ID NO: 822701 - DNA, 25 bp, Mus musculus
tcctttactggacttgggcagtgca

SEQ ID NO: 822702 - DNA, 25 bp, Mus musculus
tcctttactggagttgggcagtgca

SEQ ID NO: 822703 - DNA, 25 bp, Mus musculus
tcctttactggatctttcttctcat

SEQ ID NO: 822704 - DNA, 25 bp, Mus musculus
tcctttactgtgatatgatgggcta

SEQ ID NO: 822705 - DNA, 25 bp, Mus musculus
tcctttactgtgttatgatgggcta

SEQ ID NO: 822706 - DNA, 25 bp, Mus musculus
tcctttactttgcaactcaccagca

SEQ ID NO: 822707 - DNA, 25 bp, Mus musculus
tcctttactttggaactcaccagca

SEQ ID NO: 822708 - DNA, 25 bp, Mus musculus
tcctttagaaataattagctgcaat

SEQ ID NO: 822709 - DNA, 25 bp, Mus musculus
tcctttagaaattattagctgcaat

SEQ ID NO: 822710 - DNA, 25 bp, Mus musculus
tcctttagccgccatttttggaaga

SEQ ID NO: 822711 - DNA, 25 bp, Mus musculus
tcctttagccgcgatttttggaaga

SEQ ID NO: 822712 - DNA, 25 bp, Mus musculus
tcctttagcgtccttcagtgtatct

SEQ ID NO: 822713 - DNA, 25 bp, Mus musculus
tcctttagcgtcgttcagtgtatct

SEQ ID NO: 822714 - DNA, 25 bp, Mus musculus
tcctttagtctcctattcgcatgaa

SEQ ID NO: 822715 - DNA, 25 bp, Mus musculus
tcctttagtctcgtattcgcatgaa

SEQ ID NO: 822716 - DNA, 25 bp, Mus musculus
tcctttatactgatcgggaaggctg

SEQ ID NO: 822717 - DNA, 25 bp, Mus musculus
tcctttatactgttcgggaaggctg

SEQ ID NO: 822718 - DNA, 25 bp, Mus musculus
tcctttatatcaacggctgccagca

SEQ ID NO: 822719 - DNA, 25 bp, Mus musculus
tcctttatatcatcggctgccagca

SEQ ID NO: 822720 - DNA, 25 bp, Mus musculus
tcctttatattgatcccactgagac

SEQ ID NO: 822721 - DNA, 25 bp, Mus musculus
tcctttatattgttcccactgagac

SEQ ID NO: 822722 - DNA, 25 bp, Mus musculus
tcctttatcctgactagtttagatt

SEQ ID NO: 822723 - DNA, 25 bp, Mus musculus
tcctttatcctgtctagtttagatt

SEQ ID NO: 822724 - DNA, 25 bp, Mus musculus
tcctttatgccaaagaagtgaacat

SEQ ID NO: 822725 - DNA, 25 bp, Mus musculus
tcctttatgccatagaagtgaacat

SEQ ID NO: 822726 - DNA, 25 bp, Mus musculus
tcctttatgctgatggtttgtttgg

SEQ ID NO: 822727 - DNA, 25 bp, Mus musculus
tcctttatgctgttggtttgtttgg

SEQ ID NO: 822728 - DNA, 25 bp, Mus musculus
tcctttattcttactattgcatctc

SEQ ID NO: 822729 - DNA, 25 bp, Mus musculus
tcctttattctttctattgcatctc

SEQ ID NO: 822730 - DNA, 25 bp, Mus musculus
tcctttattgccatctgcaatcctg

SEQ ID NO: 822731 - DNA, 25 bp, Mus musculus
tcctttattgccttctgcaatcctg

SEQ ID NO: 822732 - DNA, 25 bp, Mus musculus
tcctttatttagctacttcccgaca

SEQ ID NO: 822733 - DNA, 25 bp, Mus musculus
tcctttatttaggtacttcccgaca

SEQ ID NO: 822734 - DNA, 25 bp, Mus musculus
tcctttatttttctgagcctagagt

SEQ ID NO: 822735 - DNA, 25 bp, Mus musculus
tcctttatttttgtgagcctagagt

SEQ ID NO: 822736 - DNA, 25 bp, Mus musculus
tcctttcaaagacacgttggttcca

SEQ ID NO: 822737 - DNA, 25 bp, Mus musculus
tcctttcaaagagacgttggttcca

SEQ ID NO: 822738 - DNA, 25 bp, Mus musculus
tcctttcaacaaaaaaccagctccg

SEQ ID NO: 822739 - DNA, 25 bp, Mus musculus
tcctttcaacaataaaccagctccg

SEQ ID NO: 822740 - DNA, 25 bp, Mus musculus
tcctttcaaccaaagactccagaat

SEQ ID NO: 822741 - DNA, 25 bp, Mus musculus
tcctttcaaccatagactccagaat

SEQ ID NO: 822742 - DNA, 25 bp, Mus musculus
tcctttcaagccagataccgtgagc

SEQ ID NO: 822743 - DNA, 25 bp, Mus musculus
tcctttcaagcctgataccgtgagc

SEQ ID NO: 822744 - DNA, 25 bp, Mus musculus
tcctttcaatggatattgtgcacca

SEQ ID NO: 822745 - DNA, 25 bp, Mus musculus
tcctttcaatggttattgtgcacca

SEQ ID NO: 822746 - DNA, 25 bp, Mus musculus
tcctttcacagaaggagacattctg

SEQ ID NO: 822747 - DNA, 25 bp, Mus musculus
tcctttcacagatggagacattctg

SEQ ID NO: 822748 - DNA, 25 bp, Mus musculus
tcctttcactgacagctagacttat

SEQ ID NO: 822749 - DNA, 25 bp, Mus musculus
tcctttcactgagagctagacttat

SEQ ID NO: 822750 - DNA, 25 bp, Mus musculus
tcctttcactgcagtcaatgaccta

SEQ ID NO: 822751 - DNA, 25 bp, Mus musculus
tcctttcactgctgtcaatgaccta

SEQ ID NO: 822752 - DNA, 25 bp, Mus musculus
tcctttcactgtctccacacgatgg

SEQ ID NO: 822753 - DNA, 25 bp, Mus musculus
tcctttcactgtgtccacacgatgg

SEQ ID NO: 822754 - DNA, 25 bp, Mus musculus
tcctttcagaagcaacttttccatg

SEQ ID NO: 822755 - DNA, 25 bp, Mus musculus
tcctttcagaaggaacttttccatg

SEQ ID NO: 822756 - DNA, 25 bp, Mus musculus
tcctttcagatgactatggcttgtg

SEQ ID NO: 822757 - DNA, 25 bp, Mus musculus
tcctttcagatgtctatggcttgtg

SEQ ID NO: 822758 - DNA, 25 bp, Mus musculus
tcctttcagctaaaattgtattcag

SEQ ID NO: 822759 - DNA, 25 bp, Mus musculus
tcctttcagctataattgtattcag

SEQ ID NO: 822760 - DNA, 25 bp, Mus musculus
tcctttcagctgatcttacccagaa

SEQ ID NO: 822761 - DNA, 25 bp, Mus musculus
tcctttcagctgttcttacccagaa

SEQ ID NO: 822762 - DNA, 25 bp, Mus musculus
tcctttcaggataccgttttagtga

SEQ ID NO: 822763 - DNA, 25 bp, Mus musculus
tcctttcaggatcactgctggccta

SEQ ID NO: 822764 - DNA, 25 bp, Mus musculus
tcctttcaggatgactgctggccta

SEQ ID NO: 822765 - DNA, 25 bp, Mus musculus
tcctttcaggattccgttttagtga

SEQ ID NO: 822766 - DNA, 25 bp, Mus musculus
tcctttcaggccattaattcccaca

SEQ ID NO: 822767 - DNA, 25 bp, Mus musculus
tcctttcaggcctttaattcccaca

SEQ ID NO: 822768 - DNA, 25 bp, Mus musculus
tcctttcagggcatcattgttgctg

SEQ ID NO: 822769 - DNA, 25 bp, Mus musculus
tcctttcagggcttcattgttgctg

SEQ ID NO: 822770 - DNA, 25 bp, Mus musculus
tcctttcagggtcagcagaacccca

SEQ ID NO: 822771 - DNA, 25 bp, Mus musculus
tcctttcagggtgagcagaacccca

SEQ ID NO: 822772 - DNA, 25 bp, Mus musculus
tcctttcagtcaaaatgtcaggttc

SEQ ID NO: 822773 - DNA, 25 bp, Mus musculus
tcctttcagtcataatgtcaggttc

SEQ ID NO: 822774 - DNA, 25 bp, Mus musculus
tcctttcatgaaatgattaacactg

SEQ ID NO: 822775 - DNA, 25 bp, Mus musculus
tcctttcatgaattgattaacactg

SEQ ID NO: 822776 - DNA, 25 bp, Mus musculus
tcctttccaactcaagggcctggtt

SEQ ID NO: 822777 - DNA, 25 bp, Mus musculus
tcctttccaactgaagggcctggtt

SEQ ID NO: 822778 - DNA, 25 bp, Mus musculus
tcctttccaagcacctgtgctttga

SEQ ID NO: 822779 - DNA, 25 bp, Mus musculus
tcctttccaagctcctgtgctttga

SEQ ID NO: 822780 - DNA, 25 bp, Mus musculus
tcctttccagatcctactcgaacag

SEQ ID NO: 822781 - DNA, 25 bp, Mus musculus
tcctttccagatgctactcgaacag

SEQ ID NO: 822782 - DNA, 25 bp, Mus musculus
tcctttccagcactgtttagtgaaa

SEQ ID NO: 822783 - DNA, 25 bp, Mus musculus
tcctttccagcagtgtttagtgaaa

SEQ ID NO: 822784 - DNA, 25 bp, Mus musculus
tcctttcccactcgctttatataaa

SEQ ID NO: 822785 - DNA, 25 bp, Mus musculus
tcctttcccactggctttatataaa

SEQ ID NO: 822786 - DNA, 25 bp, Mus musculus
tcctttcccagcaaagagggtgttc

SEQ ID NO: 822787 - DNA, 25 bp, Mus musculus
tcctttcccagctaagagggtgttc

SEQ ID NO: 822788 - DNA, 25 bp, Mus musculus
tcctttcccagtacctaggaatagg

SEQ ID NO: 822789 - DNA, 25 bp, Mus musculus
tcctttcccagtcaagggaggagtc

SEQ ID NO: 822790 - DNA, 25 bp, Mus musculus
tcctttcccagtgaagggaggagtc

SEQ ID NO: 822791 - DNA, 25 bp, Mus musculus
tcctttcccagttcctaggaatagg

SEQ ID NO: 822792 - DNA, 25 bp, Mus musculus
tcctttccccaaactggatctgtga

SEQ ID NO: 822793 - DNA, 25 bp, Mus musculus
tcctttccccaatctggatctgtga

SEQ ID NO: 822794 - DNA, 25 bp, Mus musculus
tcctttccccatatcagataaggta

SEQ ID NO: 822795 - DNA, 25 bp, Mus musculus
tcctttccccatttcagataaggta

SEQ ID NO: 822796 - DNA, 25 bp, Mus musculus
tcctttccccccacttgaagaagat

SEQ ID NO: 822797 - DNA, 25 bp, Mus musculus
tcctttcccccctcttgaagaagat

SEQ ID NO: 822798 - DNA, 25 bp, Mus musculus
tcctttccctacagtacacggagaa

SEQ ID NO: 822799 - DNA, 25 bp, Mus musculus
tcctttccctactgtacacggagaa

SEQ ID NO: 822800 - DNA, 25 bp, Mus musculus
tcctttccctcgaccagtattggaa

SEQ ID NO: 822801 - DNA, 25 bp, Mus musculus
tcctttccctcgtccagtattggaa

SEQ ID NO: 822802 - DNA, 25 bp, Mus musculus
tcctttccctgtctatttattctct

SEQ ID NO: 822803 - DNA, 25 bp, Mus musculus
tcctttccctgtgtatttattctct

SEQ ID NO: 822804 - DNA, 25 bp, Mus musculus
tcctttccctttcatgatgcaaata

SEQ ID NO: 822805 - DNA, 25 bp, Mus musculus
tcctttccctttgatgatgcaaata

SEQ ID NO: 822806 - DNA, 25 bp, Mus musculus
tcctttccgatgcaggaaggcagat

SEQ ID NO: 822807 - DNA, 25 bp, Mus musculus
tcctttccgatggaggaaggcagat

SEQ ID NO: 822808 - DNA, 25 bp, Mus musculus
tcctttcctaagcaggataagcagc

SEQ ID NO: 822809 - DNA, 25 bp, Mus musculus
tcctttcctaaggaggataagcagc

SEQ ID NO: 822810 - DNA, 25 bp, Mus musculus
tcctttcctattcactgactgctga

SEQ ID NO: 822811 - DNA, 25 bp, Mus musculus
tcctttcctattgactgactgctga

SEQ ID NO: 822812 - DNA, 25 bp, Mus musculus
tcctttcctcagatggcgaccatta

SEQ ID NO: 822813 - DNA, 25 bp, Mus musculus
tcctttcctcagttggcgaccatta

SEQ ID NO: 822814 - DNA, 25 bp, Mus musculus
tcctttcctccgaatttataaccag

SEQ ID NO: 822815 - DNA, 25 bp, Mus musculus
tcctttcctccgtatttataaccag

SEQ ID NO: 822816 - DNA, 25 bp, Mus musculus
tcctttcctctaatgtaacccaaag

SEQ ID NO: 822817 - DNA, 25 bp, Mus musculus
tcctttcctctattgtaacccaaag

SEQ ID NO: 822818 - DNA, 25 bp, Mus musculus
tcctttcctcttcggactgttacat

SEQ ID NO: 822819 - DNA, 25 bp, Mus musculus
tcctttcctcttgggactgttacat

SEQ ID NO: 822820 - DNA, 25 bp, Mus musculus
tcctttcctgagagccctaaaaact

SEQ ID NO: 822821 - DNA, 25 bp, Mus musculus
tcctttcctgagctttaggctgttg

SEQ ID NO: 822822 - DNA, 25 bp, Mus musculus
tcctttcctgaggtttaggctgttg

SEQ ID NO: 822823 - DNA, 25 bp, Mus musculus
tcctttcctgagtgccctaaaaact

SEQ ID NO: 822824 - DNA, 25 bp, Mus musculus
tcctttcctggtcccaaagatcaaa

SEQ ID NO: 822825 - DNA, 25 bp, Mus musculus
tcctttcctggtgccaaagatcaaa

SEQ ID NO: 822826 - DNA, 25 bp, Mus musculus
tcctttccttcgagcaacagagaat

SEQ ID NO: 822827 - DNA, 25 bp, Mus musculus
tcctttccttcgtgcaacagagaat

SEQ ID NO: 822828 - DNA, 25 bp, Mus musculus
tcctttccttctcttgagcaatcag

SEQ ID NO: 822829 - DNA, 25 bp, Mus musculus
tcctttccttctgttgagcaatcag

SEQ ID NO: 822830 - DNA, 25 bp, Mus musculus
tcctttccttgtattgggatcctga

SEQ ID NO: 822831 - DNA, 25 bp, Mus musculus
tcctttccttgttttgggatcctga

SEQ ID NO: 822832 - DNA, 25 bp, Mus musculus
tcctttcgaatgccactaccttagg

SEQ ID NO: 822833 - DNA, 25 bp, Mus musculus
tcctttcgaatggcactaccttagg

SEQ ID NO: 822834 - DNA, 25 bp, Mus musculus
tcctttcgggaaagaggccgctgcc

SEQ ID NO: 822835 - DNA, 25 bp, Mus musculus
tcctttcgggaatgaggccgctgcc

SEQ ID NO: 822836 - DNA, 25 bp, Mus musculus
tcctttctaagcaccattgggtaag

SEQ ID NO: 822837 - DNA, 25 bp, Mus musculus
tcctttctaagctccattgggtaag

SEQ ID NO: 822838 - DNA, 25 bp, Mus musculus
tcctttctactaagcttctccaagc

SEQ ID NO: 822839 - DNA, 25 bp, Mus musculus
tcctttctactatgcttctccaagc

SEQ ID NO: 822840 - DNA, 25 bp, Mus musculus
tcctttctaggtccaactgttcagt

SEQ ID NO: 822841 - DNA, 25 bp, Mus musculus
tcctttctaggtgcaactgttcagt

SEQ ID NO: 822842 - DNA, 25 bp, Mus musculus
tcctttctagttaccttcttgcttt

SEQ ID NO: 822843 - DNA, 25 bp, Mus musculus
tcctttctagtttccttcttgcttt

SEQ ID NO: 822844 - DNA, 25 bp, Mus musculus
tcctttctataactctgatcgttat

SEQ ID NO: 822845 - DNA, 25 bp, Mus musculus
tcctttctataagtctgatcgttat

SEQ ID NO: 822846 - DNA, 25 bp, Mus musculus
tcctttctattccttctctttacta

SEQ ID NO: 822847 - DNA, 25 bp, Mus musculus
tcctttctattcgttctctttacta

SEQ ID NO: 822848 - DNA, 25 bp, Mus musculus
tcctttctccagaattctctgtttg

SEQ ID NO: 822849 - DNA, 25 bp, Mus musculus
tcctttctccagtattctctgtttg

SEQ ID NO: 822850 - DNA, 25 bp, Mus musculus
tcctttctcctaactttttgcctta

SEQ ID NO: 822851 - DNA, 25 bp, Mus musculus
tcctttctcctatctttttgcctta

SEQ ID NO: 822852 - DNA, 25 bp, Mus musculus
tcctttctcgcacccaagaggaagg

SEQ ID NO: 822853 - DNA, 25 bp, Mus musculus
tcctttctcgcagccaagaggaagg

SEQ ID NO: 822854 - DNA, 25 bp, Mus musculus
tcctttctcgttacctggcaaatga

SEQ ID NO: 822855 - DNA, 25 bp, Mus musculus
tcctttctcgtttcctggcaaatga

SEQ ID NO: 822856 - DNA, 25 bp, Mus musculus
tcctttctctacagacaagattgca

SEQ ID NO: 822857 - DNA, 25 bp, Mus musculus
tcctttctctactgacaagattgca

SEQ ID NO: 822858 - DNA, 25 bp, Mus musculus
tcctttctgaagaatctgttgggtt

SEQ ID NO: 822859 - DNA, 25 bp, Mus musculus
tcctttctgaagtatctgttgggtt

SEQ ID NO: 822860 - DNA, 25 bp, Mus musculus
tcctttctgcacatgaatactggac

SEQ ID NO: 822861 - DNA, 25 bp, Mus musculus
tcctttctgcacttgaatactggac

SEQ ID NO: 822862 - DNA, 25 bp, Mus musculus
tcctttctgctgactggaccctctg

SEQ ID NO: 822863 - DNA, 25 bp, Mus musculus
tcctttctgctgtctggaccctctg

SEQ ID NO: 822864 - DNA, 25 bp, Mus musculus
tcctttctgcttccacatgatattt

SEQ ID NO: 822865 - DNA, 25 bp, Mus musculus
tcctttctgcttgcacatgatattt

SEQ ID NO: 822866 - DNA, 25 bp, Mus musculus
tcctttctgtatactcattgctgaa

SEQ ID NO: 822867 - DNA, 25 bp, Mus musculus
tcctttctgtattctcattgctgaa

SEQ ID NO: 822868 - DNA, 25 bp, Mus musculus
tcctttctgtctagctttgaacaaa

SEQ ID NO: 822869 - DNA, 25 bp, Mus musculus
tcctttctgtcttgctttgaacaaa

SEQ ID NO: 822870 - DNA, 25 bp, Mus musculus
tcctttctgtgcattgcttttctga

SEQ ID NO: 822871 - DNA, 25 bp, Mus musculus
tcctttctgtgctttgcttttctga

SEQ ID NO: 822872 - DNA, 25 bp, Mus musculus
tcctttcttcctatgaattttggcg

SEQ ID NO: 822873 - DNA, 25 bp, Mus musculus
tcctttcttcctttgaattttggcg

SEQ ID NO: 822874 - DNA, 25 bp, Mus musculus
tcctttcttcgacggaaatggaacg

SEQ ID NO: 822875 - DNA, 25 bp, Mus musculus
tcctttcttcgagggaaatggaacg

SEQ ID NO: 822876 - DNA, 25 bp, Mus musculus
tcctttcttctcatgttttgattca

SEQ ID NO: 822877 - DNA, 25 bp, Mus musculus
tcctttcttctcttgttttgattca

SEQ ID NO: 822878 - DNA, 25 bp, Mus musculus
tcctttcttgctacgttattcctgt

SEQ ID NO: 822879 - DNA, 25 bp, Mus musculus
tcctttcttgcttcgttattcctgt

SEQ ID NO: 822880 - DNA, 25 bp, Mus musculus
tcctttcttggaaccgaatttttgt

SEQ ID NO: 822881 - DNA, 25 bp, Mus musculus
tcctttcttggatccgaatttttgt

SEQ ID NO: 822882 - DNA, 25 bp, Mus musculus
tcctttctttagaatgatagccttt

SEQ ID NO: 822883 - DNA, 25 bp, Mus musculus
tcctttctttagtatgatagccttt

SEQ ID NO: 822884 - DNA, 25 bp, Mus musculus
tcctttctttgtctgtagtgcagca

SEQ ID NO: 822885 - DNA, 25 bp, Mus musculus
tcctttctttgtgtgtagtgcagca

SEQ ID NO: 822886 - DNA, 25 bp, Mus musculus
tcctttgaactcaaatgtcctgcac

SEQ ID NO: 822887 - DNA, 25 bp, Mus musculus
tcctttgaactctaatgtcctgcac

SEQ ID NO: 822888 - DNA, 25 bp, Mus musculus
tcctttgacaccattcctaaatggc

SEQ ID NO: 822889 - DNA, 25 bp, Mus musculus
tcctttgacacctttcctaaatggc

SEQ ID NO: 822890 - DNA, 25 bp, Mus musculus
tcctttgaccctcgtggctgatgaa

SEQ ID NO: 822891 - DNA, 25 bp, Mus musculus
tcctttgaccctggtggctgatgaa

SEQ ID NO: 822892 - DNA, 25 bp, Mus musculus
tcctttgagaaaccctgtatataaa

SEQ ID NO: 822893 - DNA, 25 bp, Mus musculus
tcctttgagaaagcctgtatataaa

SEQ ID NO: 822894 - DNA, 25 bp, Mus musculus
tcctttgaggcaagtgttccctttg

SEQ ID NO: 822895 - DNA, 25 bp, Mus musculus
tcctttgaggcatgtgttccctttg

SEQ ID NO: 822896 - DNA, 25 bp, Mus musculus
tcctttgaggctacagacacaggcc

SEQ ID NO: 822897 - DNA, 25 bp, Mus musculus
tcctttgaggcttcagacacaggcc

SEQ ID NO: 822898 - DNA, 25 bp, Mus musculus
tcctttgatataagtgtttctccct

SEQ ID NO: 822899 - DNA, 25 bp, Mus musculus
tcctttgatataccccaatattggg

SEQ ID NO: 822900 - DNA, 25 bp, Mus musculus
tcctttgatatagcccaatattggg

SEQ ID NO: 822901 - DNA, 25 bp, Mus musculus
tcctttgatatatgtgtttctccct

SEQ ID NO: 822902 - DNA, 25 bp, Mus musculus
tcctttgatcacctttaccagtgtg

SEQ ID NO: 822903 - DNA, 25 bp, Mus musculus
tcctttgatcacgtttaccagtgtg

SEQ ID NO: 822904 - DNA, 25 bp, Mus musculus
tcctttgatcttcaccactcatgga

SEQ ID NO: 822905 - DNA, 25 bp, Mus musculus
tcctttgatcttgaccactcatgga

SEQ ID NO: 822906 - DNA, 25 bp, Mus musculus
tcctttgatgtgactgtttccttga

SEQ ID NO: 822907 - DNA, 25 bp, Mus musculus
tcctttgatgtgtctgtttccttga

SEQ ID NO: 822908 - DNA, 25 bp, Mus musculus
tcctttgcaagtcatccatgtcatt

SEQ ID NO: 822909 - DNA, 25 bp, Mus musculus
tcctttgcaagtgatccatgtcatt

SEQ ID NO: 822910 - DNA, 25 bp, Mus musculus
tcctttgcagacaggcgatcgggcc

SEQ ID NO: 822911 - DNA, 25 bp, Mus musculus
tcctttgcagactggcgatcgggcc

SEQ ID NO: 822912 - DNA, 25 bp, Mus musculus
tcctttgcagctacaggctttgaaa

SEQ ID NO: 822913 - DNA, 25 bp, Mus musculus
tcctttgcagcttcaggctttgaaa

SEQ ID NO: 822914 - DNA, 25 bp, Mus musculus
tcctttgcagttcctattgcatata

SEQ ID NO: 822915 - DNA, 25 bp, Mus musculus
tcctttgcagttgctattgcatata

SEQ ID NO: 822916 - DNA, 25 bp, Mus musculus
tcctttgcatcccatggtatattag

SEQ ID NO: 822917 - DNA, 25 bp, Mus musculus
tcctttgcatccgatggtatattag

SEQ ID NO: 822918 - DNA, 25 bp, Mus musculus
tcctttgcatctctagcctgtgaac

SEQ ID NO: 822919 - DNA, 25 bp, Mus musculus
tcctttgcatctgtagcctgtgaac

SEQ ID NO: 822920 - DNA, 25 bp, Mus musculus
tcctttgcatgtcatcgtgagtcag

SEQ ID NO: 822921 - DNA, 25 bp, Mus musculus
tcctttgcatgtgatcgtgagtcag

SEQ ID NO: 822922 - DNA, 25 bp, Mus musculus
tcctttgcatttccctggattgttt

SEQ ID NO: 822923 - DNA, 25 bp, Mus musculus
tcctttgcatttgcctggattgttt

SEQ ID NO: 822924 - DNA, 25 bp, Mus musculus
tcctttgccactacatgtcatcata

SEQ ID NO: 822925 - DNA, 25 bp, Mus musculus
tcctttgccacttcatgtcatcata

SEQ ID NO: 822926 - DNA, 25 bp, Mus musculus
tcctttgccagcatctgattctaaa

SEQ ID NO: 822927 - DNA, 25 bp, Mus musculus
tcctttgccagcttctgattctaaa

SEQ ID NO: 822928 - DNA, 25 bp, Mus musculus
tcctttgcccagatgctgagggttg

SEQ ID NO: 822929 - DNA, 25 bp, Mus musculus
tcctttgcccagttgctgagggttg

SEQ ID NO: 822930 - DNA, 25 bp, Mus musculus
tcctttgcccttagctctgcaggga

SEQ ID NO: 822931 - DNA, 25 bp, Mus musculus
tcctttgcccttccagcatataaca

SEQ ID NO: 822932 - DNA, 25 bp, Mus musculus
tcctttgcccttgcagcatataaca

SEQ ID NO: 822933 - DNA, 25 bp, Mus musculus
tcctttgccctttgctctgcaggga

SEQ ID NO: 822934 - DNA, 25 bp, Mus musculus
tcctttgccgagcatgatcccaaga

SEQ ID NO: 822935 - DNA, 25 bp, Mus musculus
tcctttgccgaggatgatcccaaga

SEQ ID NO: 822936 - DNA, 25 bp, Mus musculus
tcctttgccgataacaacttgctgg

SEQ ID NO: 822937 - DNA, 25 bp, Mus musculus
tcctttgccgattacaacttgctgg

SEQ ID NO: 822938 - DNA, 25 bp, Mus musculus
tcctttgccggcatcactggaagat

SEQ ID NO: 822939 - DNA, 25 bp, Mus musculus
tcctttgccggcttcactggaagat

SEQ ID NO: 822940 - DNA, 25 bp, Mus musculus
tcctttgcctaaagaactgtatgaa

SEQ ID NO: 822941 - DNA, 25 bp, Mus musculus
tcctttgcctaatgaactgtatgaa

SEQ ID NO: 822942 - DNA, 25 bp, Mus musculus
tcctttgcctctataataatgtgtt

SEQ ID NO: 822943 - DNA, 25 bp, Mus musculus
tcctttgcctctttaataatgtgtt

SEQ ID NO: 822944 - DNA, 25 bp, Mus musculus
tcctttgcctttcagctcatgcaag

SEQ ID NO: 822945 - DNA, 25 bp, Mus musculus
tcctttgcctttgagctcatgcaag

SEQ ID NO: 822946 - DNA, 25 bp, Mus musculus
tcctttgcggatagccctttggcat

SEQ ID NO: 822947 - DNA, 25 bp, Mus musculus
tcctttgcggattgccctttggcat

SEQ ID NO: 822948 - DNA, 25 bp, Mus musculus
tcctttgcgttcctcgtttaagcaa

SEQ ID NO: 822949 - DNA, 25 bp, Mus musculus
tcctttgcgttcgtcgtttaagcaa

SEQ ID NO: 822950 - DNA, 25 bp, Mus musculus
tcctttgctacgaatatctgccatg

SEQ ID NO: 822951 - DNA, 25 bp, Mus musculus
tcctttgctacgtatatctgccatg

SEQ ID NO: 822952 - DNA, 25 bp, Mus musculus
tcctttgctcatagtaaaatgtgca

SEQ ID NO: 822953 - DNA, 25 bp, Mus musculus
tcctttgctcattgtaaaatgtgca

SEQ ID NO: 822954 - DNA, 25 bp, Mus musculus
tcctttgctccaccttaaggcatta

SEQ ID NO: 822955 - DNA, 25 bp, Mus musculus
tcctttgctccagcttaaggcatta

SEQ ID NO: 822956 - DNA, 25 bp, Mus musculus
tcctttgctcctcaccaaacgagag

SEQ ID NO: 822957 - DNA, 25 bp, Mus musculus
tcctttgctcctgaccaaacgagag

SEQ ID NO: 822958 - DNA, 25 bp, Mus musculus
tcctttgctctgaagtagtctctct

SEQ ID NO: 822959 - DNA, 25 bp, Mus musculus
tcctttgctctgtagtagtctctct

SEQ ID NO: 822960 - DNA, 25 bp, Mus musculus
tcctttgctcttatacagcgagtac

SEQ ID NO: 822961 - DNA, 25 bp, Mus musculus
tcctttgctcttttacagcgagtac

SEQ ID NO: 822962 - DNA, 25 bp, Mus musculus
tcctttgctgtgatgaagcaccata

SEQ ID NO: 822963 - DNA, 25 bp, Mus musculus
tcctttgctgtgttgaagcaccata

SEQ ID NO: 822964 - DNA, 25 bp, Mus musculus
tcctttgctttactcttctacttta

SEQ ID NO: 822965 - DNA, 25 bp, Mus musculus
tcctttgctttagtcttctacttta

SEQ ID NO: 822966 - DNA, 25 bp, Mus musculus
tcctttggaaggcacttggccttgg

SEQ ID NO: 822967 - DNA, 25 bp, Mus musculus
tcctttggaagggacttggccttgg

SEQ ID NO: 822968 - DNA, 25 bp, Mus musculus
tcctttggaatgaattgttagattt

SEQ ID NO: 822969 - DNA, 25 bp, Mus musculus
tcctttggaatgtattgttagattt

SEQ ID NO: 822970 - DNA, 25 bp, Mus musculus
tcctttggagtaagagcctgttctt

SEQ ID NO: 822971 - DNA, 25 bp, Mus musculus
tcctttggagtatgagcctgttctt

SEQ ID NO: 822972 - DNA, 25 bp, Mus musculus
tcctttggatctcccagggttcacc

SEQ ID NO: 822973 - DNA, 25 bp, Mus musculus
tcctttggatctgccagggttcacc

SEQ ID NO: 822974 - DNA, 25 bp, Mus musculus
tcctttggcgctagcagagacttca

SEQ ID NO: 822975 - DNA, 25 bp, Mus musculus
tcctttggcgcttgcagagacttca

SEQ ID NO: 822976 - DNA, 25 bp, Mus musculus
tcctttggctcccagatagcaagca

SEQ ID NO: 822977 - DNA, 25 bp, Mus musculus
tcctttggctccgagatagcaagca

SEQ ID NO: 822978 - DNA, 25 bp, Mus musculus
tcctttggctcgatctcttgaggaa

SEQ ID NO: 822979 - DNA, 25 bp, Mus musculus
tcctttggctcgttctcttgaggaa

SEQ ID NO: 822980 - DNA, 25 bp, Mus musculus
tcctttggcttcatgtgacaccttc

SEQ ID NO: 822981 - DNA, 25 bp, Mus musculus
tcctttggcttcttgtgacaccttc

SEQ ID NO: 822982 - DNA, 25 bp, Mus musculus
tcctttgggtcactctgtcatgttg

SEQ ID NO: 822983 - DNA, 25 bp, Mus musculus
tcctttgggtcagtctgtcatgttg

SEQ ID NO: 822984 - DNA, 25 bp, Mus musculus
tcctttgggtccacagtgctgttga

SEQ ID NO: 822985 - DNA, 25 bp, Mus musculus
tcctttgggtcctcagtgctgttga

SEQ ID NO: 822986 - DNA, 25 bp, Mus musculus
tcctttgggtttcgtggtactaatg

SEQ ID NO: 822987 - DNA, 25 bp, Mus musculus
tcctttgggtttggtggtactaatg

SEQ ID NO: 822988 - DNA, 25 bp, Mus musculus
tcctttggtcagctgatccgccgtg

SEQ ID NO: 822989 - DNA, 25 bp, Mus musculus
tcctttggtcaggtgatccgccgtg

SEQ ID NO: 822990 - DNA, 25 bp, Mus musculus
tcctttggtcctccagtacagtgtg

SEQ ID NO: 822991 - DNA, 25 bp, Mus musculus
tcctttggtcctgcagtacagtgtg

SEQ ID NO: 822992 - DNA, 25 bp, Mus musculus
tcctttggtttcatcgacagccttc

SEQ ID NO: 822993 - DNA, 25 bp, Mus musculus
tcctttggtttcttcgacagccttc

SEQ ID NO: 822994 - DNA, 25 bp, Mus musculus
tcctttgtaacaatcagacctattt

SEQ ID NO: 822995 - DNA, 25 bp, Mus musculus
tcctttgtaacattcagacctattt

SEQ ID NO: 822996 - DNA, 25 bp, Mus musculus
tcctttgtagctccctgtttacagt

SEQ ID NO: 822997 - DNA, 25 bp, Mus musculus
tcctttgtagctgcctgtttacagt

SEQ ID NO: 822998 - DNA, 25 bp, Mus musculus
tcctttgtatttatctctatccacc

SEQ ID NO: 822999 - DNA, 25 bp, Mus musculus
tcctttgtatttttctctatccacc

SEQ ID NO: 823000 - DNA, 25 bp, Mus musculus
tcctttgtcatacatgggtcctgtc

SEQ ID NO: 823001 - DNA, 25 bp, Mus musculus
tcctttgtcatagatgggtcctgtc

SEQ ID NO: 823002 - DNA, 25 bp, Mus musculus
tcctttgtcctcattttcactattg

SEQ ID NO: 823003 - DNA, 25 bp, Mus musculus
tcctttgtcctctttttcactattg

SEQ ID NO: 823004 - DNA, 25 bp, Mus musculus
tcctttgtcggtctctactgaagaa

SEQ ID NO: 823005 - DNA, 25 bp, Mus musculus
tcctttgtcggtgtctactgaagaa

SEQ ID NO: 823006 - DNA, 25 bp, Mus musculus
tcctttgtgaaaaccttgctatgac

SEQ ID NO: 823007 - DNA, 25 bp, Mus musculus
tcctttgtgaaatccttgctatgac

SEQ ID NO: 823008 - DNA, 25 bp, Mus musculus
tcctttgtgagcactctgctttggt

SEQ ID NO: 823009 - DNA, 25 bp, Mus musculus
tcctttgtgagctctctgctttggt

SEQ ID NO: 823010 - DNA, 25 bp, Mus musculus
tcctttgtgtttactgggtgcctgc

SEQ ID NO: 823011 - DNA, 25 bp, Mus musculus
tcctttgtgttttctgggtgcctgc

SEQ ID NO: 823012 - DNA, 25 bp, Mus musculus
tcctttgttaagatgtgtgtgctca

SEQ ID NO: 823013 - DNA, 25 bp, Mus musculus
tcctttgttaagttgtgtgtgctca

SEQ ID NO: 823014 - DNA, 25 bp, Mus musculus
tcctttgttagcaccgattcttcag

SEQ ID NO: 823015 - DNA, 25 bp, Mus musculus
tcctttgttagctccgattcttcag

SEQ ID NO: 823016 - DNA, 25 bp, Mus musculus
tcctttgttattagttcttaacacg

SEQ ID NO: 823017 - DNA, 25 bp, Mus musculus
tcctttgttatttgttcttaacacg

SEQ ID NO: 823018 - DNA, 25 bp, Mus musculus
tcctttgttgcccagataaataaat

SEQ ID NO: 823019 - DNA, 25 bp, Mus musculus
tcctttgttgccgagataaataaat

SEQ ID NO: 823020 - DNA, 25 bp, Mus musculus
tcctttgttgctcatggctggacag

SEQ ID NO: 823021 - DNA, 25 bp, Mus musculus
tcctttgttgctgatggctggacag

SEQ ID NO: 823022 - DNA, 25 bp, Mus musculus
tcctttgtttcgctcttgtcagaga

SEQ ID NO: 823023 - DNA, 25 bp, Mus musculus
tcctttgtttcggtcttgtcagaga

SEQ ID NO: 823024 - DNA, 25 bp, Mus musculus
tcctttgttttgagtcagggaactt

SEQ ID NO: 823025 - DNA, 25 bp, Mus musculus
tcctttgttttgcagccctctgatg

SEQ ID NO: 823026 - DNA, 25 bp, Mus musculus
tcctttgttttggagccctctgatg

SEQ ID NO: 823027 - DNA, 25 bp, Mus musculus
tcctttgttttgtgtcagggaactt

SEQ ID NO: 823028 - DNA, 25 bp, Mus musculus
tccttttaactgacctcactcaaat

SEQ ID NO: 823029 - DNA, 25 bp, Mus musculus
tccttttaactgtcctcactcaaat

SEQ ID NO: 823030 - DNA, 25 bp, Mus musculus
tccttttaatctcaattcatctttt

SEQ ID NO: 823031 - DNA, 25 bp, Mus musculus
tccttttaatctgaattcatctttt

SEQ ID NO: 823032 - DNA, 25 bp, Mus musculus
tccttttacactcgctcttttcttt

SEQ ID NO: 823033 - DNA, 25 bp, Mus musculus
tccttttacactggctcttttcttt

SEQ ID NO: 823034 - DNA, 25 bp, Mus musculus
tccttttacctcagcatgtgtcatg

SEQ ID NO: 823035 - DNA, 25 bp, Mus musculus
tccttttacctctgcatgtgtcatg

SEQ ID NO: 823036 - DNA, 25 bp, Mus musculus
tccttttagaacaaaccttcagcat

SEQ ID NO: 823037 - DNA, 25 bp, Mus musculus
tccttttagaactaaccttcagcat

SEQ ID NO: 823038 - DNA, 25 bp, Mus musculus
tccttttatgcaacactgtttgtgt

SEQ ID NO: 823039 - DNA, 25 bp, Mus musculus
tccttttatgcatcactgtttgtgt

SEQ ID NO: 823040 - DNA, 25 bp, Mus musculus
tccttttattgcctcctactttata

SEQ ID NO: 823041 - DNA, 25 bp, Mus musculus
tccttttattgcgtcctactttata

SEQ ID NO: 823042 - DNA, 25 bp, Mus musculus
tccttttcaaagaagcccttggctc

SEQ ID NO: 823043 - DNA, 25 bp, Mus musculus
tccttttcaaagtagcccttggctc

SEQ ID NO: 823044 - DNA, 25 bp, Mus musculus
tccttttcacatattatacgtattc

SEQ ID NO: 823045 - DNA, 25 bp, Mus musculus
tccttttcacattttatacgtattc

SEQ ID NO: 823046 - DNA, 25 bp, Mus musculus
tccttttcagctcgtcttggcagag

SEQ ID NO: 823047 - DNA, 25 bp, Mus musculus
tccttttcagctggtcttggcagag

SEQ ID NO: 823048 - DNA, 25 bp, Mus musculus
tccttttcaggaaatttattgtttc

SEQ ID NO: 823049 - DNA, 25 bp, Mus musculus
tccttttcaggatatttattgtttc

SEQ ID NO: 823050 - DNA, 25 bp, Mus musculus
tccttttcctcacttaggatctttt

SEQ ID NO: 823051 - DNA, 25 bp, Mus musculus
tccttttcctcagttaggatctttt

SEQ ID NO: 823052 - DNA, 25 bp, Mus musculus
tccttttcctccaatgatggagctg

SEQ ID NO: 823053 - DNA, 25 bp, Mus musculus
tccttttcctccagctggattttga

SEQ ID NO: 823054 - DNA, 25 bp, Mus musculus
tccttttcctcctatgatggagctg

SEQ ID NO: 823055 - DNA, 25 bp, Mus musculus
tccttttcctcctgctggattttga

SEQ ID NO: 823056 - DNA, 25 bp, Mus musculus
tccttttcctggatctctcttagaa

SEQ ID NO: 823057 - DNA, 25 bp, Mus musculus
tccttttcctggttctctcttagaa

SEQ ID NO: 823058 - DNA, 25 bp, Mus musculus
tccttttcctgtagagctccattta

SEQ ID NO: 823059 - DNA, 25 bp, Mus musculus
tccttttcctgttgagctccattta

SEQ ID NO: 823060 - DNA, 25 bp, Mus musculus
tccttttccttaatttgattgcaaa

SEQ ID NO: 823061 - DNA, 25 bp, Mus musculus
tccttttccttattttgattgcaaa

SEQ ID NO: 823062 - DNA, 25 bp, Mus musculus
tccttttctaagctcactgcacaaa

SEQ ID NO: 823063 - DNA, 25 bp, Mus musculus
tccttttctaaggtcactgcacaaa

SEQ ID NO: 823064 - DNA, 25 bp, Mus musculus
tccttttctatgcaacactgattct

SEQ ID NO: 823065 - DNA, 25 bp, Mus musculus
tccttttctatggaacactgattct

SEQ ID NO: 823066 - DNA, 25 bp, Mus musculus
tccttttctattaggagctgaatcc

SEQ ID NO: 823067 - DNA, 25 bp, Mus musculus
tccttttctattcctgatgtacata

SEQ ID NO: 823068 - DNA, 25 bp, Mus musculus
tccttttctattgctgatgtacata

SEQ ID NO: 823069 - DNA, 25 bp, Mus musculus
tccttttctatttggagctgaatcc

SEQ ID NO: 823070 - DNA, 25 bp, Mus musculus
tccttttctcctacaatggctggaa

SEQ ID NO: 823071 - DNA, 25 bp, Mus musculus
tccttttctccttcaatggctggaa

SEQ ID NO: 823072 - DNA, 25 bp, Mus musculus
tccttttcttacactcttacacata

SEQ ID NO: 823073 - DNA, 25 bp, Mus musculus
tccttttcttactctcttacacata

SEQ ID NO: 823074 - DNA, 25 bp, Mus musculus
tccttttctttcatattctggtttc

SEQ ID NO: 823075 - DNA, 25 bp, Mus musculus
tccttttctttcttattctggtttc

SEQ ID NO: 823076 - DNA, 25 bp, Mus musculus
tccttttgaaagaggtctctgtgtg

SEQ ID NO: 823077 - DNA, 25 bp, Mus musculus
tccttttgaaagtggtctctgtgtg

SEQ ID NO: 823078 - DNA, 25 bp, Mus musculus
tccttttgacccaactcgaatttat

SEQ ID NO: 823079 - DNA, 25 bp, Mus musculus
tccttttgaccctactcgaatttat

SEQ ID NO: 823080 - DNA, 25 bp, Mus musculus
tccttttgagcacttcctttcagag

SEQ ID NO: 823081 - DNA, 25 bp, Mus musculus
tccttttgagcagttcctttcagag

SEQ ID NO: 823082 - DNA, 25 bp, Mus musculus
tccttttgataccatcttgttttct

SEQ ID NO: 823083 - DNA, 25 bp, Mus musculus
tccttttgatacgatcttgttttct

SEQ ID NO: 823084 - DNA, 25 bp, Mus musculus
tccttttgccccagctggcaaggga

SEQ ID NO: 823085 - DNA, 25 bp, Mus musculus
tccttttgcccctgctggcaaggga

SEQ ID NO: 823086 - DNA, 25 bp, Mus musculus
tccttttgctgtactagattatgtt

SEQ ID NO: 823087 - DNA, 25 bp, Mus musculus
tccttttgctgttctagattatgtt

SEQ ID NO: 823088 - DNA, 25 bp, Mus musculus
tccttttgcttcagaaatctgaaag

SEQ ID NO: 823089 - DNA, 25 bp, Mus musculus
tccttttgcttctgaaatctgaaag

SEQ ID NO: 823090 - DNA, 25 bp, Mus musculus
tccttttgcttgatacagcccatat

SEQ ID NO: 823091 - DNA, 25 bp, Mus musculus
tccttttgcttgttacagcccatat

SEQ ID NO: 823092 - DNA, 25 bp, Mus musculus
tccttttgctttcacacggaatttc

SEQ ID NO: 823093 - DNA, 25 bp, Mus musculus
tccttttgctttgacacggaatttc

SEQ ID NO: 823094 - DNA, 25 bp, Mus musculus
tccttttgggccctaaggactggag

SEQ ID NO: 823095 - DNA, 25 bp, Mus musculus
tccttttgggccgtaaggactggag

SEQ ID NO: 823096 - DNA, 25 bp, Mus musculus
tccttttgggtgaattttgctaagt

SEQ ID NO: 823097 - DNA, 25 bp, Mus musculus
tccttttgggtgtattttgctaagt

SEQ ID NO: 823098 - DNA, 25 bp, Mus musculus
tccttttgtcggagcctatgttaaa

SEQ ID NO: 823099 - DNA, 25 bp, Mus musculus
tccttttgtcggtgcctatgttaaa

SEQ ID NO: 823100 - DNA, 25 bp, Mus musculus
tccttttgtgaaacctccaagcaat

SEQ ID NO: 823101 - DNA, 25 bp, Mus musculus
tccttttgtgaatcctccaagcaat

SEQ ID NO: 823102 - DNA, 25 bp, Mus musculus
tccttttgtttcatcccatgtgcaa

SEQ ID NO: 823103 - DNA, 25 bp, Mus musculus
tccttttgtttcttcccatgtgcaa

SEQ ID NO: 823104 - DNA, 25 bp, Mus musculus
tcctttttaccaccagggagactat

SEQ ID NO: 823105 - DNA, 25 bp, Mus musculus
tcctttttaccagcagggagactat

SEQ ID NO: 823106 - DNA, 25 bp, Mus musculus
tcctttttatacacttggctgtcct

SEQ ID NO: 823107 - DNA, 25 bp, Mus musculus
tcctttttatactcttggctgtcct

SEQ ID NO: 823108 - DNA, 25 bp, Mus musculus
tcctttttcaatcactatttttctc

SEQ ID NO: 823109 - DNA, 25 bp, Mus musculus
tcctttttcaatgactatttttctc

SEQ ID NO: 823110 - DNA, 25 bp, Mus musculus
tcctttttcccaatgcttgctagta

SEQ ID NO: 823111 - DNA, 25 bp, Mus musculus
tcctttttcccattgcttgctagta

SEQ ID NO: 823112 - DNA, 25 bp, Mus musculus
tcctttttgaaccataagcacgtaa

SEQ ID NO: 823113 - DNA, 25 bp, Mus musculus
tcctttttgaacgataagcacgtaa

SEQ ID NO: 823114 - DNA, 25 bp, Mus musculus
tcctttttgctaaagaattcttgct

SEQ ID NO: 823115 - DNA, 25 bp, Mus musculus
tcctttttgctatagaattcttgct

SEQ ID NO: 823116 - DNA, 25 bp, Mus musculus
tcctttttgcttcttgtgtgtatga

SEQ ID NO: 823117 - DNA, 25 bp, Mus musculus
tcctttttgcttgttgtgtgtatga

SEQ ID NO: 823118 - DNA, 25 bp, Mus musculus
tcctttttggttaggtagtagtgag

SEQ ID NO: 823119 - DNA, 25 bp, Mus musculus
tcctttttggtttggtagtagtgag

SEQ ID NO: 823120 - DNA, 25 bp, Mus musculus
tccttttttacccaagacatgcata

SEQ ID NO: 823121 - DNA, 25 bp, Mus musculus
tccttttttaccgaagacatgcata

SEQ ID NO: 823122 - DNA, 25 bp, Mus musculus
tccttttttccacctcataggtagc

SEQ ID NO: 823123 - DNA, 25 bp, Mus musculus
tccttttttccagctcataggtagc

SEQ ID NO: 823124 - DNA, 25 bp, Mus musculus
tccttttttgacactaagccggtct

SEQ ID NO: 823125 - DNA, 25 bp, Mus musculus
tccttttttgactctaagccggtct

SEQ ID NO: 823126 - DNA, 25 bp, Mus musculus
tccttttttgtgagggtacctggag

SEQ ID NO: 823127 - DNA, 25 bp, Mus musculus
tccttttttgtgtgggtacctggag

SEQ ID NO: 823128 - DNA, 25 bp, Mus musculus
tccttttttgttatcagggagtgat

SEQ ID NO: 823129 - DNA, 25 bp, Mus musculus
tccttttttgttcttcttgggctgg

SEQ ID NO: 823130 - DNA, 25 bp, Mus musculus
tccttttttgttgttcttgggctgg

SEQ ID NO: 823131 - DNA, 25 bp, Mus musculus
tccttttttgttttcagggagtgat

SEQ ID NO: 823132 - DNA, 25 bp, Mus musculus
tcgaaaacttcgaggcgctcaagtc

SEQ ID NO: 823133 - DNA, 25 bp, Mus musculus
tcgaaaacttcgtggcgctcaagtc

SEQ ID NO: 823134 - DNA, 25 bp, Mus musculus
tcgaaacctcggctgggcagtgtct

SEQ ID NO: 823135 - DNA, 25 bp, Mus musculus
tcgaaacctcgggtgggcagtgtct

SEQ ID NO: 823136 - DNA, 25 bp, Mus musculus
tcgaaacctgctacagcgactagct

SEQ ID NO: 823137 - DNA, 25 bp, Mus musculus
tcgaaacctgcttcagcgactagct

SEQ ID NO: 823138 - DNA, 25 bp, Mus musculus
tcgaaactctggcataggctatttg

SEQ ID NO: 823139 - DNA, 25 bp, Mus musculus
tcgaaactctgggataggctatttg

SEQ ID NO: 823140 - DNA, 25 bp, Mus musculus
tcgaaagcgagaataccaccagaag

SEQ ID NO: 823141 - DNA, 25 bp, Mus musculus
tcgaaagcgagattaccaccagaag

SEQ ID NO: 823142 - DNA, 25 bp, Mus musculus
tcgaaagcggaacttatcccctggc

SEQ ID NO: 823143 - DNA, 25 bp, Mus musculus
tcgaaagcggaagttatcccctggc

SEQ ID NO: 823144 - DNA, 25 bp, Mus musculus
tcgaaaggcacaccattgctcctgt

SEQ ID NO: 823145 - DNA, 25 bp, Mus musculus
tcgaaaggcacagcattgctcctgt

SEQ ID NO: 823146 - DNA, 25 bp, Mus musculus
tcgaaagggtgcagcccagcgtgct

SEQ ID NO: 823147 - DNA, 25 bp, Mus musculus
tcgaaagggtgctgcccagcgtgct

SEQ ID NO: 823148 - DNA, 25 bp, Mus musculus
tcgaaatccatgcttgagaactgtt

SEQ ID NO: 823149 - DNA, 25 bp, Mus musculus
tcgaaatccatggttgagaactgtt

SEQ ID NO: 823150 - DNA, 25 bp, Mus musculus
tcgaaattacagcaagctctcgtag

SEQ ID NO: 823151 - DNA, 25 bp, Mus musculus
tcgaaattacaggaagctctcgtag

SEQ ID NO: 823152 - DNA, 25 bp, Mus musculus
tcgaacaaagtcctaatatgcccaa

SEQ ID NO: 823153 - DNA, 25 bp, Mus musculus
tcgaacaaagtcgtaatatgcccaa

SEQ ID NO: 823154 - DNA, 25 bp, Mus musculus
tcgaacagtgccctgtctatcgaga

SEQ ID NO: 823155 - DNA, 25 bp, Mus musculus
tcgaacagtgccgtgtctatcgaga

SEQ ID NO: 823156 - DNA, 25 bp, Mus musculus
tcgaacatccagaccctatctttga

SEQ ID NO: 823157 - DNA, 25 bp, Mus musculus
tcgaacatccagtccctatctttga

SEQ ID NO: 823158 - DNA, 25 bp, Mus musculus
tcgaaccatgtgagatctgccaggg

SEQ ID NO: 823159 - DNA, 25 bp, Mus musculus
tcgaaccatgtgtgatctgccaggg

SEQ ID NO: 823160 - DNA, 25 bp, Mus musculus
tcgaaccgtgacctagaggccaaaa

SEQ ID NO: 823161 - DNA, 25 bp, Mus musculus
tcgaaccgtgacgtagaggccaaaa

SEQ ID NO: 823162 - DNA, 25 bp, Mus musculus
tcgaacctcgctcagaacaattcta

SEQ ID NO: 823163 - DNA, 25 bp, Mus musculus
tcgaacctcgctgagaacaattcta

SEQ ID NO: 823164 - DNA, 25 bp, Mus musculus
tcgaacgctcgaacttgactcagat

SEQ ID NO: 823165 - DNA, 25 bp, Mus musculus
tcgaacgctcgatcttgactcagat

SEQ ID NO: 823166 - DNA, 25 bp, Mus musculus
tcgaacggaaatcccctgacatgat

SEQ ID NO: 823167 - DNA, 25 bp, Mus musculus
tcgaacggaaatgccctgacatgat

SEQ ID NO: 823168 - DNA, 25 bp, Mus musculus
tcgaactcacagaattccgactgcc

SEQ ID NO: 823169 - DNA, 25 bp, Mus musculus
tcgaactcacagtattccgactgcc

SEQ ID NO: 823170 - DNA, 25 bp, Mus musculus
tcgaactcgcttagacccaggatac

SEQ ID NO: 823171 - DNA, 25 bp, Mus musculus
tcgaactcgctttgacccaggatac

SEQ ID NO: 823172 - DNA, 25 bp, Mus musculus
tcgaactgggccctttataatccaa

SEQ ID NO: 823173 - DNA, 25 bp, Mus musculus
tcgaactgggccgtttataatccaa

SEQ ID NO: 823174 - DNA, 25 bp, Mus musculus
tcgaacttgactatctagaggaagt

SEQ ID NO: 823175 - DNA, 25 bp, Mus musculus
tcgaacttgactttctagaggaagt

SEQ ID NO: 823176 - DNA, 25 bp, Mus musculus
tcgaacttttggactttcttcacca

SEQ ID NO: 823177 - DNA, 25 bp, Mus musculus
tcgaacttttggtctttcttcacca

SEQ ID NO: 823178 - DNA, 25 bp, Mus musculus
tcgaagacaaaaagctatccactat

SEQ ID NO: 823179 - DNA, 25 bp, Mus musculus
tcgaagacaaaatgctatccactat

SEQ ID NO: 823180 - DNA, 25 bp, Mus musculus
tcgaagacgaatacccagacttgcc

SEQ ID NO: 823181 - DNA, 25 bp, Mus musculus
tcgaagacgaattcccagacttgcc

SEQ ID NO: 823182 - DNA, 25 bp, Mus musculus
tcgaagagcgatcccctggagacct

SEQ ID NO: 823183 - DNA, 25 bp, Mus musculus
tcgaagagcgatgccctggagacct

SEQ ID NO: 823184 - DNA, 25 bp, Mus musculus
tcgaagatccccacgtgtaaaaact

SEQ ID NO: 823185 - DNA, 25 bp, Mus musculus
tcgaagatcccctcgtgtaaaaact

SEQ ID NO: 823186 - DNA, 25 bp, Mus musculus
tcgaagatggttctttccctccctc

SEQ ID NO: 823187 - DNA, 25 bp, Mus musculus
tcgaagatggttgtttccctccctc

SEQ ID NO: 823188 - DNA, 25 bp, Mus musculus
tcgaagattgttatgggactgccaa

SEQ ID NO: 823189 - DNA, 25 bp, Mus musculus
tcgaagattgttttgggactgccaa

SEQ ID NO: 823190 - DNA, 25 bp, Mus musculus
tcgaagcagaatcgctcctcggcct

SEQ ID NO: 823191 - DNA, 25 bp, Mus musculus
tcgaagcagaatggctcctcggcct

SEQ ID NO: 823192 - DNA, 25 bp, Mus musculus
tcgaagccagtgcttccggctgagc

SEQ ID NO: 823193 - DNA, 25 bp, Mus musculus
tcgaagccagtggttccggctgagc

SEQ ID NO: 823194 - DNA, 25 bp, Mus musculus
tcgaagcccagcctctgaagagcat

SEQ ID NO: 823195 - DNA, 25 bp, Mus musculus
tcgaagcccagcgtctgaagagcat

SEQ ID NO: 823196 - DNA, 25 bp, Mus musculus
tcgaagcggccacttctccaggatg

SEQ ID NO: 823197 - DNA, 25 bp, Mus musculus
tcgaagcggccagttctccaggatg

SEQ ID NO: 823198 - DNA, 25 bp, Mus musculus
tcgaagcttaccaggctcacaagaa

SEQ ID NO: 823199 - DNA, 25 bp, Mus musculus
tcgaagcttacctggctcacaagaa

SEQ ID NO: 823200 - DNA, 25 bp, Mus musculus
tcgaagcttggacaacatggccaat

SEQ ID NO: 823201 - DNA, 25 bp, Mus musculus
tcgaagcttggagaacatggccaat

SEQ ID NO: 823202 - DNA, 25 bp, Mus musculus
tcgaaggattccagatgtgtctaat

SEQ ID NO: 823203 - DNA, 25 bp, Mus musculus
tcgaaggattcctgatgtgtctaat

SEQ ID NO: 823204 - DNA, 25 bp, Mus musculus
tcgaaggcaaggagctggagttcta

SEQ ID NO: 823205 - DNA, 25 bp, Mus musculus
tcgaaggcaaggtgctggagttcta

SEQ ID NO: 823206 - DNA, 25 bp, Mus musculus
tcgaagggacagatatgaaatggct

SEQ ID NO: 823207 - DNA, 25 bp, Mus musculus
tcgaagggacagttatgaaatggct

SEQ ID NO: 823208 - DNA, 25 bp, Mus musculus
tcgaagggtcagcagatcaagtaga

SEQ ID NO: 823209 - DNA, 25 bp, Mus musculus
tcgaagggtcaggagatcaagtaga

SEQ ID NO: 823210 - DNA, 25 bp, Mus musculus
tcgaaggtaaggctgtagtcatctc

SEQ ID NO: 823211 - DNA, 25 bp, Mus musculus
tcgaaggtaagggtgtagtcatctc

SEQ ID NO: 823212 - DNA, 25 bp, Mus musculus
tcgaaggttgcgataatcttgcagc

SEQ ID NO: 823213 - DNA, 25 bp, Mus musculus
tcgaaggttgcgttaatcttgcagc

SEQ ID NO: 823214 - DNA, 25 bp, Mus musculus
tcgaagttccttcttagctgtgctt

SEQ ID NO: 823215 - DNA, 25 bp, Mus musculus
tcgaagttccttgttagctgtgctt

SEQ ID NO: 823216 - DNA, 25 bp, Mus musculus
tcgaagtttcgaacataaagctctc

SEQ ID NO: 823217 - DNA, 25 bp, Mus musculus
tcgaagtttcgatcataaagctctc

SEQ ID NO: 823218 - DNA, 25 bp, Mus musculus
tcgaatagagacagtcccgccagca

SEQ ID NO: 823219 - DNA, 25 bp, Mus musculus
tcgaatagagactgtcccgccagca

SEQ ID NO: 823220 - DNA, 25 bp, Mus musculus
tcgaatatatttcagaccgggtctt

SEQ ID NO: 823221 - DNA, 25 bp, Mus musculus
tcgaatatatttgagaccgggtctt

SEQ ID NO: 823222 - DNA, 25 bp, Mus musculus
tcgaatatgtggaataaagctttat

SEQ ID NO: 823223 - DNA, 25 bp, Mus musculus
tcgaatatgtggtataaagctttat

SEQ ID NO: 823224 - DNA, 25 bp, Mus musculus
tcgaatcagtttcattcaccgacaa

SEQ ID NO: 823225 - DNA, 25 bp, Mus musculus
tcgaatcagtttgattcaccgacaa

SEQ ID NO: 823226 - DNA, 25 bp, Mus musculus
tcgaatccgagaccgaaatcgagac

SEQ ID NO: 823227 - DNA, 25 bp, Mus musculus
tcgaatccgagagcgaaatcgagac

SEQ ID NO: 823228 - DNA, 25 bp, Mus musculus
tcgaatcgtgacagccgtgacagcc

SEQ ID NO: 823229 - DNA, 25 bp, Mus musculus
tcgaatcgtgactgccgtgacagcc

SEQ ID NO: 823230 - DNA, 25 bp, Mus musculus
tcgaatctgttgagcatcccttggt

SEQ ID NO: 823231 - DNA, 25 bp, Mus musculus
tcgaatctgttgtgcatcccttggt

SEQ ID NO: 823232 - DNA, 25 bp, Mus musculus
tcgaatcttgtcctcgctgtgtcta

SEQ ID NO: 823233 - DNA, 25 bp, Mus musculus
tcgaatcttgtcgtcgctgtgtcta

SEQ ID NO: 823234 - DNA, 25 bp, Mus musculus
tcgaatgaacttcggtcgagaccac

SEQ ID NO: 823235 - DNA, 25 bp, Mus musculus
tcgaatgaacttgggtcgagaccac

SEQ ID NO: 823236 - DNA, 25 bp, Mus musculus
tcgaatgcagccataaagggccaag

SEQ ID NO: 823237 - DNA, 25 bp, Mus musculus
tcgaatgcagccttaaagggccaag

SEQ ID NO: 823238 - DNA, 25 bp, Mus musculus
tcgaatggtcagctgttggacagca

SEQ ID NO: 823239 - DNA, 25 bp, Mus musculus
tcgaatggtcaggtgttggacagca

SEQ ID NO: 823240 - DNA, 25 bp, Mus musculus
tcgaatgtgccaatctgatccaaat

SEQ ID NO: 823241 - DNA, 25 bp, Mus musculus
tcgaatgtgccattctgatccaaat

SEQ ID NO: 823242 - DNA, 25 bp, Mus musculus
tcgaatgtgtaacgctgcttgcagc

SEQ ID NO: 823243 - DNA, 25 bp, Mus musculus
tcgaatgtgtaaggctgcttgcagc

SEQ ID NO: 823244 - DNA, 25 bp, Mus musculus
tcgaatgtttaaaccgaagtcccat

SEQ ID NO: 823245 - DNA, 25 bp, Mus musculus
tcgaatgtttaatccgaagtcccat

SEQ ID NO: 823246 - DNA, 25 bp, Mus musculus
tcgaattaccacatttagctctctg

SEQ ID NO: 823247 - DNA, 25 bp, Mus musculus
tcgaattaccacttttagctctctg

SEQ ID NO: 823248 - DNA, 25 bp, Mus musculus
tcgaattggcgacctaatgctagca

SEQ ID NO: 823249 - DNA, 25 bp, Mus musculus
tcgaattggcgagctaatgctagca

SEQ ID NO: 823250 - DNA, 25 bp, Mus musculus
tcgaatttcctgcacagcagttgta

SEQ ID NO: 823251 - DNA, 25 bp, Mus musculus
tcgaatttcctggacagcagttgta

SEQ ID NO: 823252 - DNA, 25 bp, Mus musculus
tcgacaaccaagaagtgagcaccaa

SEQ ID NO: 823253 - DNA, 25 bp, Mus musculus
tcgacaaccaagtagtgagcaccaa

SEQ ID NO: 823254 - DNA, 25 bp, Mus musculus
tcgacaagatcaacctcccggattt

SEQ ID NO: 823255 - DNA, 25 bp, Mus musculus
tcgacaagatcatcctcccggattt

SEQ ID NO: 823256 - DNA, 25 bp, Mus musculus
tcgacaaggcttcacgagcagggca

SEQ ID NO: 823257 - DNA, 25 bp, Mus musculus
tcgacaaggcttgacgagcagggca

SEQ ID NO: 823258 - DNA, 25 bp, Mus musculus
tcgacaagttgccaagatctcatga

SEQ ID NO: 823259 - DNA, 25 bp, Mus musculus
tcgacaagttgcgaagatctcatga

SEQ ID NO: 823260 - DNA, 25 bp, Mus musculus
tcgacaatgaatacatgggacctca

SEQ ID NO: 823261 - DNA, 25 bp, Mus musculus
tcgacaatgaattcatgggacctca

SEQ ID NO: 823262 - DNA, 25 bp, Mus musculus
tcgacaatggaacgactacttggaa

SEQ ID NO: 823263 - DNA, 25 bp, Mus musculus
tcgacaatggaaggactacttggaa

SEQ ID NO: 823264 - DNA, 25 bp, Mus musculus
tcgacacaagcccaagtcatatgat

SEQ ID NO: 823265 - DNA, 25 bp, Mus musculus
tcgacacaagccgaagtcatatgat

SEQ ID NO: 823266 - DNA, 25 bp, Mus musculus
tcgacacaataacgttagacatctt

SEQ ID NO: 823267 - DNA, 25 bp, Mus musculus
tcgacacaataaggttagacatctt

SEQ ID NO: 823268 - DNA, 25 bp, Mus musculus
tcgacacccatccaagcatattact

SEQ ID NO: 823269 - DNA, 25 bp, Mus musculus
tcgacacccatcgaagcatattact

SEQ ID NO: 823270 - DNA, 25 bp, Mus musculus
tcgacactctaaacagcactgacac

SEQ ID NO: 823271 - DNA, 25 bp, Mus musculus
tcgacactctaatcagcactgacac

SEQ ID NO: 823272 - DNA, 25 bp, Mus musculus
tcgacactgaacaccgtctggtcct

SEQ ID NO: 823273 - DNA, 25 bp, Mus musculus
tcgacactgaactccgtctggtcct

SEQ ID NO: 823274 - DNA, 25 bp, Mus musculus
tcgacactgatccagtcactcatta

SEQ ID NO: 823275 - DNA, 25 bp, Mus musculus
tcgacactgatcgagtcactcatta

SEQ ID NO: 823276 - DNA, 25 bp, Mus musculus
tcgacagaattgaaggcgattctag

SEQ ID NO: 823277 - DNA, 25 bp, Mus musculus
tcgacagaattgtaggcgattctag

SEQ ID NO: 823278 - DNA, 25 bp, Mus musculus
tcgacagctagacgagtccctggat

SEQ ID NO: 823279 - DNA, 25 bp, Mus musculus
tcgacagctagaggagtccctggat

SEQ ID NO: 823280 - DNA, 25 bp, Mus musculus
tcgacagcttccacagaaacagttt

SEQ ID NO: 823281 - DNA, 25 bp, Mus musculus
tcgacagcttcctcagaaacagttt

SEQ ID NO: 823282 - DNA, 25 bp, Mus musculus
tcgacaggagtgcttattgacataa

SEQ ID NO: 823283 - DNA, 25 bp, Mus musculus
tcgacaggagtggttattgacataa

SEQ ID NO: 823284 - DNA, 25 bp, Mus musculus
tcgacaggcgagaatgagaaacagt

SEQ ID NO: 823285 - DNA, 25 bp, Mus musculus
tcgacaggcgagtatgagaaacagt

SEQ ID NO: 823286 - DNA, 25 bp, Mus musculus
tcgacaggtgtgcagatttcgtcac

SEQ ID NO: 823287 - DNA, 25 bp, Mus musculus
tcgacaggtgtggagatttcgtcac

SEQ ID NO: 823288 - DNA, 25 bp, Mus musculus
tcgacagtatttcaggccctgagcc

SEQ ID NO: 823289 - DNA, 25 bp, Mus musculus
tcgacagtatttgaggccctgagcc

SEQ ID NO: 823290 - DNA, 25 bp, Mus musculus
tcgacagtcaccctgcctttgtggt

SEQ ID NO: 823291 - DNA, 25 bp, Mus musculus
tcgacagtcaccgtgcctttgtggt

SEQ ID NO: 823292 - DNA, 25 bp, Mus musculus
tcgacatcttttagtagcataataa

SEQ ID NO: 823293 - DNA, 25 bp, Mus musculus
tcgacatctttttgtagcataataa

SEQ ID NO: 823294 - DNA, 25 bp, Mus musculus
tcgacatgagatactctttgactca

SEQ ID NO: 823295 - DNA, 25 bp, Mus musculus
tcgacatgagattctctttgactca

SEQ ID NO: 823296 - DNA, 25 bp, Mus musculus
tcgacatgtcctatgagcaactgat

SEQ ID NO: 823297 - DNA, 25 bp, Mus musculus
tcgacatgtcctttgagcaactgat

SEQ ID NO: 823298 - DNA, 25 bp, Mus musculus
tcgacatgttgcagggcatcatggg

SEQ ID NO: 823299 - DNA, 25 bp, Mus musculus
tcgacatgttgctgggcatcatggg

SEQ ID NO: 823300 - DNA, 25 bp, Mus musculus
tcgacattccatcccttcagagatg

SEQ ID NO: 823301 - DNA, 25 bp, Mus musculus
tcgacattccatgccttcagagatg

SEQ ID NO: 823302 - DNA, 25 bp, Mus musculus
tcgaccaaccttcccaggaatgtgg

SEQ ID NO: 823303 - DNA, 25 bp, Mus musculus
tcgaccaaccttgccaggaatgtgg

SEQ ID NO: 823304 - DNA, 25 bp, Mus musculus
tcgaccaacttgcagcggctgatga

SEQ ID NO: 823305 - DNA, 25 bp, Mus musculus
tcgaccaacttggagcggctgatga

SEQ ID NO: 823306 - DNA, 25 bp, Mus musculus
tcgaccacaaatataacttcatata

SEQ ID NO: 823307 - DNA, 25 bp, Mus musculus
tcgaccacaaatttaacttcatata

SEQ ID NO: 823308 - DNA, 25 bp, Mus musculus
tcgaccacagttcctgcgtttcaaa

SEQ ID NO: 823309 - DNA, 25 bp, Mus musculus
tcgaccacagttgctgcgtttcaaa

SEQ ID NO: 823310 - DNA, 25 bp, Mus musculus
tcgaccacgctaacaactctagcaa

SEQ ID NO: 823311 - DNA, 25 bp, Mus musculus
tcgaccacgctatcaactctagcaa

SEQ ID NO: 823312 - DNA, 25 bp, Mus musculus
tcgaccagagaaatattttacacag

SEQ ID NO: 823313 - DNA, 25 bp, Mus musculus
tcgaccagagaattattttacacag

SEQ ID NO: 823314 - DNA, 25 bp, Mus musculus
tcgacccagtacctagagcgctttt

SEQ ID NO: 823315 - DNA, 25 bp, Mus musculus
tcgacccagtacgtagagcgctttt

SEQ ID NO: 823316 - DNA, 25 bp, Mus musculus
tcgaccccagccctaatgaattaac

SEQ ID NO: 823317 - DNA, 25 bp, Mus musculus
tcgaccccagccgtaatgaattaac

SEQ ID NO: 823318 - DNA, 25 bp, Mus musculus
tcgaccccgggcctattgtaaggat

SEQ ID NO: 823319 - DNA, 25 bp, Mus musculus
tcgaccccgggcgtattgtaaggat

SEQ ID NO: 823320 - DNA, 25 bp, Mus musculus
tcgacccggcctccgaggacatgtt

SEQ ID NO: 823321 - DNA, 25 bp, Mus musculus
tcgacccggcctgcgaggacatgtt

SEQ ID NO: 823322 - DNA, 25 bp, Mus musculus
tcgaccctccaccagtcttgggaat

SEQ ID NO: 823323 - DNA, 25 bp, Mus musculus
tcgaccctccacgagtcttgggaat

SEQ ID NO: 823324 - DNA, 25 bp, Mus musculus
tcgaccctcccaaatatgtgtgtaa

SEQ ID NO: 823325 - DNA, 25 bp, Mus musculus
tcgaccctcccatatatgtgtgtaa

SEQ ID NO: 823326 - DNA, 25 bp, Mus musculus
tcgaccctgccgagtatgacgtgtc

SEQ ID NO: 823327 - DNA, 25 bp, Mus musculus
tcgaccctgccgtgtatgacgtgtc

SEQ ID NO: 823328 - DNA, 25 bp, Mus musculus
tcgaccgccagaagtgtatgaccca

SEQ ID NO: 823329 - DNA, 25 bp, Mus musculus
tcgaccgccagatgtgtatgaccca

SEQ ID NO: 823330 - DNA, 25 bp, Mus musculus
tcgaccgcggtacgcagtgcacagc

SEQ ID NO: 823331 - DNA, 25 bp, Mus musculus
tcgaccgcggtaggcagtgcacagc

SEQ ID NO: 823332 - DNA, 25 bp, Mus musculus
tcgacctcttttacctcagacaaga

SEQ ID NO: 823333 - DNA, 25 bp, Mus musculus
tcgacctctttttcctcagacaaga

SEQ ID NO: 823334 - DNA, 25 bp, Mus musculus
tcgacctgagccaacccataatagt

SEQ ID NO: 823335 - DNA, 25 bp, Mus musculus
tcgacctgagcctacccataatagt

SEQ ID NO: 823336 - DNA, 25 bp, Mus musculus
tcgacctgccagacagatgctggga

SEQ ID NO: 823337 - DNA, 25 bp, Mus musculus
tcgacctgccagtcagatgctggga

SEQ ID NO: 823338 - DNA, 25 bp, Mus musculus
tcgacctggtgcatagtctgtgcaa

SEQ ID NO: 823339 - DNA, 25 bp, Mus musculus
tcgacctggtgcttagtctgtgcaa

SEQ ID NO: 823340 - DNA, 25 bp, Mus musculus
tcgaccttaggacccactggaggag

SEQ ID NO: 823341 - DNA, 25 bp, Mus musculus
tcgaccttaggagccactggaggag

SEQ ID NO: 823342 - DNA, 25 bp, Mus musculus
tcgaccttcacaacagagaagcaaa

SEQ ID NO: 823343 - DNA, 25 bp, Mus musculus
tcgaccttcacatcagagaagcaaa

SEQ ID NO: 823344 - DNA, 25 bp, Mus musculus
tcgacctttcgcagacaaagggctt

SEQ ID NO: 823345 - DNA, 25 bp, Mus musculus
tcgacctttcgctgacaaagggctt

SEQ ID NO: 823346 - DNA, 25 bp, Mus musculus
tcgacgacttctattggcatgggca

SEQ ID NO: 823347 - DNA, 25 bp, Mus musculus
tcgacgacttcttttggcatgggca

SEQ ID NO: 823348 - DNA, 25 bp, Mus musculus
tcgacgaggttgacactcctgaatg

SEQ ID NO: 823349 - DNA, 25 bp, Mus musculus
tcgacgaggttgtcactcctgaatg

SEQ ID NO: 823350 - DNA, 25 bp, Mus musculus
tcgacgagtcctcgccataaagggc

SEQ ID NO: 823351 - DNA, 25 bp, Mus musculus
tcgacgagtcctggccataaagggc

SEQ ID NO: 823352 - DNA, 25 bp, Mus musculus
tcgacgatgccgcacagcagatgtg

SEQ ID NO: 823353 - DNA, 25 bp, Mus musculus
tcgacgatgccggacagcagatgtg

SEQ ID NO: 823354 - DNA, 25 bp, Mus musculus
tcgacgcagcagctcttctatcaga

SEQ ID NO: 823355 - DNA, 25 bp, Mus musculus
tcgacgcagcaggtcttctatcaga

SEQ ID NO: 823356 - DNA, 25 bp, Mus musculus
tcgacgcctgtgaaaaagctgctgg

SEQ ID NO: 823357 - DNA, 25 bp, Mus musculus
tcgacgcctgtgtaaaagctgctgg

SEQ ID NO: 823358 - DNA, 25 bp, Mus musculus
tcgacgcgattgacttcaagcagca

SEQ ID NO: 823359 - DNA, 25 bp, Mus musculus
tcgacgcgattgtcttcaagcagca

SEQ ID NO: 823360 - DNA, 25 bp, Mus musculus
tcgacggaggcgctctaggtctacc

SEQ ID NO: 823361 - DNA, 25 bp, Mus musculus
tcgacggaggcggtctaggtctacc

SEQ ID NO: 823362 - DNA, 25 bp, Mus musculus
tcgacggcaagaaccccaggagatg

SEQ ID NO: 823363 - DNA, 25 bp, Mus musculus
tcgacggcaagatccccaggagatg

SEQ ID NO: 823364 - DNA, 25 bp, Mus musculus
tcgacggcagagactatcactttgt

SEQ ID NO: 823365 - DNA, 25 bp, Mus musculus
tcgacggcagagtctatcactttgt

SEQ ID NO: 823366 - DNA, 25 bp, Mus musculus
tcgacgggatgaaactggtgcagac

SEQ ID NO: 823367 - DNA, 25 bp, Mus musculus
tcgacgggatgatactggtgcagac

SEQ ID NO: 823368 - DNA, 25 bp, Mus musculus
tcgacgggtataagcaattcttcac

SEQ ID NO: 823369 - DNA, 25 bp, Mus musculus
tcgacgggtatatgcaattcttcac

SEQ ID NO: 823370 - DNA, 25 bp, Mus musculus
tcgacgtattacactctcacatgga

SEQ ID NO: 823371 - DNA, 25 bp, Mus musculus
tcgacgtattactctctcacatgga

SEQ ID NO: 823372 - DNA, 25 bp, Mus musculus
tcgacgtcagccagattgcgacaag

SEQ ID NO: 823373 - DNA, 25 bp, Mus musculus
tcgacgtcagcctgattgcgacaag

SEQ ID NO: 823374 - DNA, 25 bp, Mus musculus
tcgactacggtaactgagctgagaa

SEQ ID NO: 823375 - DNA, 25 bp, Mus musculus
tcgactacggtatctgagctgagaa

SEQ ID NO: 823376 - DNA, 25 bp, Mus musculus
tcgactagagagctctccaagccca

SEQ ID NO: 823377 - DNA, 25 bp, Mus musculus
tcgactagagaggtctccaagccca

SEQ ID NO: 823378 - DNA, 25 bp, Mus musculus
tcgactagatcaagagggagcctcc

SEQ ID NO: 823379 - DNA, 25 bp, Mus musculus
tcgactagatcatgagggagcctcc

SEQ ID NO: 823380 - DNA, 25 bp, Mus musculus
tcgactcactcacctctgtagtttc

SEQ ID NO: 823381 - DNA, 25 bp, Mus musculus
tcgactcactcagctctgtagtttc

SEQ ID NO: 823382 - DNA, 25 bp, Mus musculus
tcgactcagttcacagcagcttgat

SEQ ID NO: 823383 - DNA, 25 bp, Mus musculus
tcgactcagttctcagcagcttgat

SEQ ID NO: 823384 - DNA, 25 bp, Mus musculus
tcgactctatgaatcccctatttag

SEQ ID NO: 823385 - DNA, 25 bp, Mus musculus
tcgactctatgattcccctatttag

SEQ ID NO: 823386 - DNA, 25 bp, Mus musculus
tcgactctcagaaggccaagggcat

SEQ ID NO: 823387 - DNA, 25 bp, Mus musculus
tcgactctcagatggccaagggcat

SEQ ID NO: 823388 - DNA, 25 bp, Mus musculus
tcgactctgcctaccatgtatggta

SEQ ID NO: 823389 - DNA, 25 bp, Mus musculus
tcgactctgccttccatgtatggta

SEQ ID NO: 823390 - DNA, 25 bp, Mus musculus
tcgactcttacaacagccctgtgaa

SEQ ID NO: 823391 - DNA, 25 bp, Mus musculus
tcgactcttacatcagccctgtgaa

SEQ ID NO: 823392 - DNA, 25 bp, Mus musculus
tcgactgaggccagggaccgtgcct

SEQ ID NO: 823393 - DNA, 25 bp, Mus musculus
tcgactgaggcctgggaccgtgcct

SEQ ID NO: 823394 - DNA, 25 bp, Mus musculus
tcgactgatactcctttctcttttt

SEQ ID NO: 823395 - DNA, 25 bp, Mus musculus
tcgactgatactgctttctcttttt

SEQ ID NO: 823396 - DNA, 25 bp, Mus musculus
tcgactgcccagatgacactgtctg

SEQ ID NO: 823397 - DNA, 25 bp, Mus musculus
tcgactgcccagttgacactgtctg

SEQ ID NO: 823398 - DNA, 25 bp, Mus musculus
tcgactgcgatcaagttggaggcca

SEQ ID NO: 823399 - DNA, 25 bp, Mus musculus
tcgactgcgatctagttggaggcca

SEQ ID NO: 823400 - DNA, 25 bp, Mus musculus
tcgactggtatgacagctagcccac

SEQ ID NO: 823401 - DNA, 25 bp, Mus musculus
tcgactggtatgtcagctagcccac

SEQ ID NO: 823402 - DNA, 25 bp, Mus musculus
tcgactgtcgtcagctatagcttgt

SEQ ID NO: 823403 - DNA, 25 bp, Mus musculus
tcgactgtcgtctgctatagcttgt

SEQ ID NO: 823404 - DNA, 25 bp, Mus musculus
tcgactgtgaacagcctgttgcata

SEQ ID NO: 823405 - DNA, 25 bp, Mus musculus
tcgactgtgaactgcctgttgcata

SEQ ID NO: 823406 - DNA, 25 bp, Mus musculus
tcgactgtgagtccctgacgtaccc

SEQ ID NO: 823407 - DNA, 25 bp, Mus musculus
tcgactgtgagtgcctgacgtaccc

SEQ ID NO: 823408 - DNA, 25 bp, Mus musculus
tcgacttcactcacgctgtgtccaa

SEQ ID NO: 823409 - DNA, 25 bp, Mus musculus
tcgacttcactctcgctgtgtccaa

SEQ ID NO: 823410 - DNA, 25 bp, Mus musculus
tcgacttcaggtacaggtcccagaa

SEQ ID NO: 823411 - DNA, 25 bp, Mus musculus
tcgacttcaggttcaggtcccagaa

SEQ ID NO: 823412 - DNA, 25 bp, Mus musculus
tcgacttccagaaccgcaaggactt

SEQ ID NO: 823413 - DNA, 25 bp, Mus musculus
tcgacttccagatccgcaaggactt

SEQ ID NO: 823414 - DNA, 25 bp, Mus musculus
tcgacttcccctaacagatatgcat

SEQ ID NO: 823415 - DNA, 25 bp, Mus musculus
tcgacttccccttacagatatgcat

SEQ ID NO: 823416 - DNA, 25 bp, Mus musculus
tcgacttccggaacccggagcagga

SEQ ID NO: 823417 - DNA, 25 bp, Mus musculus
tcgacttccggatcccggagcagga

SEQ ID NO: 823418 - DNA, 25 bp, Mus musculus
tcgacttctaggaacttcttcctct

SEQ ID NO: 823419 - DNA, 25 bp, Mus musculus
tcgacttctaggtacttcttcctct

SEQ ID NO: 823420 - DNA, 25 bp, Mus musculus
tcgacttgcaggaccactttttcaa

SEQ ID NO: 823421 - DNA, 25 bp, Mus musculus
tcgacttgcaggtccactttttcaa

SEQ ID NO: 823422 - DNA, 25 bp, Mus musculus
tcgactttctgtcacttgccacata

SEQ ID NO: 823423 - DNA, 25 bp, Mus musculus
tcgactttctgtgacttgccacata

SEQ ID NO: 823424 - DNA, 25 bp, Mus musculus
tcgactttgaccatttctccttgga

SEQ ID NO: 823425 - DNA, 25 bp, Mus musculus
tcgactttgaccttttctccttgga

SEQ ID NO: 823426 - DNA, 25 bp, Mus musculus
tcgactttggagcttcatgctttgg

SEQ ID NO: 823427 - DNA, 25 bp, Mus musculus
tcgactttggaggttcatgctttgg

SEQ ID NO: 823428 - DNA, 25 bp, Mus musculus
tcgacttttcccacttggtgtttct

SEQ ID NO: 823429 - DNA, 25 bp, Mus musculus
tcgacttttccctcttggtgtttct

SEQ ID NO: 823430 - DNA, 25 bp, Mus musculus
tcgagaaacagtatgtgctactgat

SEQ ID NO: 823431 - DNA, 25 bp, Mus musculus
tcgagaaacagtcgtcacgtggttg

SEQ ID NO: 823432 - DNA, 25 bp, Mus musculus
tcgagaaacagtggtcacgtggttg

SEQ ID NO: 823433 - DNA, 25 bp, Mus musculus
tcgagaaacagtttgtgctactgat

SEQ ID NO: 823434 - DNA, 25 bp, Mus musculus
tcgagaaactttccaaggccagccg

SEQ ID NO: 823435 - DNA, 25 bp, Mus musculus
tcgagaaactttgcaaggccagccg

SEQ ID NO: 823436 - DNA, 25 bp, Mus musculus
tcgagaacacgtacaggctttcctg

SEQ ID NO: 823437 - DNA, 25 bp, Mus musculus
tcgagaacacgttcaggctttcctg

SEQ ID NO: 823438 - DNA, 25 bp, Mus musculus
tcgagaacctgaagtgtgaccccac

SEQ ID NO: 823439 - DNA, 25 bp, Mus musculus
tcgagaacctgatgtgtgaccccac

SEQ ID NO: 823440 - DNA, 25 bp, Mus musculus
tcgagaacctggagtgtgaccccaa

SEQ ID NO: 823441 - DNA, 25 bp, Mus musculus
tcgagaacctggtgtgtgaccccaa

SEQ ID NO: 823442 - DNA, 25 bp, Mus musculus
tcgagaacctgtcaagcagcctggg

SEQ ID NO: 823443 - DNA, 25 bp, Mus musculus
tcgagaacctgtgaagcagcctggg

SEQ ID NO: 823444 - DNA, 25 bp, Mus musculus
tcgagaagggccaccccgaagagca

SEQ ID NO: 823445 - DNA, 25 bp, Mus musculus
tcgagaagggcctccccgaagagca

SEQ ID NO: 823446 - DNA, 25 bp, Mus musculus
tcgagaagtcgcctctcgaccagga

SEQ ID NO: 823447 - DNA, 25 bp, Mus musculus
tcgagaagtcgcgtctcgaccagga

SEQ ID NO: 823448 - DNA, 25 bp, Mus musculus
tcgagacaccaaagaaccgttccat

SEQ ID NO: 823449 - DNA, 25 bp, Mus musculus
tcgagacaccaatgaaccgttccat

SEQ ID NO: 823450 - DNA, 25 bp, Mus musculus
tcgagacagcgacacaatcagaaag

SEQ ID NO: 823451 - DNA, 25 bp, Mus musculus
tcgagacagcgagacaatcagaaag

SEQ ID NO: 823452 - DNA, 25 bp, Mus musculus
tcgagacagtgtatgcttctgccga

SEQ ID NO: 823453 - DNA, 25 bp, Mus musculus
tcgagacagtgtttgcttctgccga

SEQ ID NO: 823454 - DNA, 25 bp, Mus musculus
tcgagacatgatagccgaggccagc

SEQ ID NO: 823455 - DNA, 25 bp, Mus musculus
tcgagacatgattgccgaggccagc

SEQ ID NO: 823456 - DNA, 25 bp, Mus musculus
tcgagaccacctaactttatgataa

SEQ ID NO: 823457 - DNA, 25 bp, Mus musculus
tcgagaccaccttactttatgataa

SEQ ID NO: 823458 - DNA, 25 bp, Mus musculus
tcgagacctagcctggttttccctt

SEQ ID NO: 823459 - DNA, 25 bp, Mus musculus
tcgagacctagcgtggttttccctt

SEQ ID NO: 823460 - DNA, 25 bp, Mus musculus
tcgagacctctgcagcccttcgatt

SEQ ID NO: 823461 - DNA, 25 bp, Mus musculus
tcgagacctctggagcccttcgatt

SEQ ID NO: 823462 - DNA, 25 bp, Mus musculus
tcgagacttgctcagagttcctgct

SEQ ID NO: 823463 - DNA, 25 bp, Mus musculus
tcgagacttgctgagagttcctgct

SEQ ID NO: 823464 - DNA, 25 bp, Mus musculus
tcgagactttgtaaggagccacctg

SEQ ID NO: 823465 - DNA, 25 bp, Mus musculus
tcgagactttgttaggagccacctg

SEQ ID NO: 823466 - DNA, 25 bp, Mus musculus
tcgagagaacccatgcccggagcag

SEQ ID NO: 823467 - DNA, 25 bp, Mus musculus
tcgagagaacccttgcccggagcag

SEQ ID NO: 823468 - DNA, 25 bp, Mus musculus
tcgagagaatgtctcctgctgctaa

SEQ ID NO: 823469 - DNA, 25 bp, Mus musculus
tcgagagaatgtgtcctgctgctaa

SEQ ID NO: 823470 - DNA, 25 bp, Mus musculus
tcgagagattcaccttggaggagat

SEQ ID NO: 823471 - DNA, 25 bp, Mus musculus
tcgagagattcagcttggaggagat

SEQ ID NO: 823472 - DNA, 25 bp, Mus musculus
tcgagagcacagaatccgatttttt

SEQ ID NO: 823473 - DNA, 25 bp, Mus musculus
tcgagagcacagtatccgatttttt

SEQ ID NO: 823474 - DNA, 25 bp, Mus musculus
tcgagagcatcaacagtccaaaacg

SEQ ID NO: 823475 - DNA, 25 bp, Mus musculus
tcgagagcatcatcagtccaaaacg

SEQ ID NO: 823476 - DNA, 25 bp, Mus musculus
tcgagagccagtacccagataccat

SEQ ID NO: 823477 - DNA, 25 bp, Mus musculus
tcgagagccagttcccagataccat

SEQ ID NO: 823478 - DNA, 25 bp, Mus musculus
tcgagagcgtggatgactactgacc

SEQ ID NO: 823479 - DNA, 25 bp, Mus musculus
tcgagagcgtggttgactactgacc

SEQ ID NO: 823480 - DNA, 25 bp, Mus musculus
tcgagagtcaacaaccagggcacct

SEQ ID NO: 823481 - DNA, 25 bp, Mus musculus
tcgagagtcaactaccagggcacct

SEQ ID NO: 823482 - DNA, 25 bp, Mus musculus
tcgagagttaacacctggatgacat

SEQ ID NO: 823483 - DNA, 25 bp, Mus musculus
tcgagagttaactcctggatgacat

SEQ ID NO: 823484 - DNA, 25 bp, Mus musculus
tcgagagttactctccatcagcagt

SEQ ID NO: 823485 - DNA, 25 bp, Mus musculus
tcgagagttactgtccatcagcagt

SEQ ID NO: 823486 - DNA, 25 bp, Mus musculus
tcgagatacacaaatgggtttccac

SEQ ID NO: 823487 - DNA, 25 bp, Mus musculus
tcgagatacacatatgggtttccac

SEQ ID NO: 823488 - DNA, 25 bp, Mus musculus
tcgagatcaccaataattccccaga

SEQ ID NO: 823489 - DNA, 25 bp, Mus musculus
tcgagatcaccattaattccccaga

SEQ ID NO: 823490 - DNA, 25 bp, Mus musculus
tcgagatccagtccatcagccacat

SEQ ID NO: 823491 - DNA, 25 bp, Mus musculus
tcgagatccagtgcatcagccacat

SEQ ID NO: 823492 - DNA, 25 bp, Mus musculus
tcgagatcgattccagcctggctga

SEQ ID NO: 823493 - DNA, 25 bp, Mus musculus
tcgagatcgattgcagcctggctga

SEQ ID NO: 823494 - DNA, 25 bp, Mus musculus
tcgagatgccttacttagccttgtg

SEQ ID NO: 823495 - DNA, 25 bp, Mus musculus
tcgagatgcctttcttagccttgtg

SEQ ID NO: 823496 - DNA, 25 bp, Mus musculus
tcgagatgctccaggcctcctggca

SEQ ID NO: 823497 - DNA, 25 bp, Mus musculus
tcgagatgctcctggcctcctggca

SEQ ID NO: 823498 - DNA, 25 bp, Mus musculus
tcgagatggacacccgctacaccag

SEQ ID NO: 823499 - DNA, 25 bp, Mus musculus
tcgagatggacagccgctacaccag

SEQ ID NO: 823500 - DNA, 25 bp, Mus musculus
tcgagatgggacatgcttgtgtacc

SEQ ID NO: 823501 - DNA, 25 bp, Mus musculus
tcgagatgggacttgcttgtgtacc

SEQ ID NO: 823502 - DNA, 25 bp, Mus musculus
tcgagattgacgatgaaagtgcttt

SEQ ID NO: 823503 - DNA, 25 bp, Mus musculus
tcgagattgacgttgaaagtgcttt

SEQ ID NO: 823504 - DNA, 25 bp, Mus musculus
tcgagattgtcaccaccttaagatg

SEQ ID NO: 823505 - DNA, 25 bp, Mus musculus
tcgagattgtcagcaccttaagatg

SEQ ID NO: 823506 - DNA, 25 bp, Mus musculus
tcgagcacagagaggcccaggccaa

SEQ ID NO: 823507 - DNA, 25 bp, Mus musculus
tcgagcacagagtggcccaggccaa

SEQ ID NO: 823508 - DNA, 25 bp, Mus musculus
tcgagcagagccctttggagcagtc

SEQ ID NO: 823509 - DNA, 25 bp, Mus musculus
tcgagcagagccgtttggagcagtc

SEQ ID NO: 823510 - DNA, 25 bp, Mus musculus
tcgagcagcagtagcgactctgact

SEQ ID NO: 823511 - DNA, 25 bp, Mus musculus
tcgagcagcagttgcgactctgact

SEQ ID NO: 823512 - DNA, 25 bp, Mus musculus
tcgagcagcctactaaccggattgg

SEQ ID NO: 823513 - DNA, 25 bp, Mus musculus
tcgagcagcctagtaaccggattgg

SEQ ID NO: 823514 - DNA, 25 bp, Mus musculus
tcgagcagctatcatacctcccaag

SEQ ID NO: 823515 - DNA, 25 bp, Mus musculus
tcgagcagctatgatacctcccaag

SEQ ID NO: 823516 - DNA, 25 bp, Mus musculus
tcgagcaggagcagtgtaatgaaga

SEQ ID NO: 823517 - DNA, 25 bp, Mus musculus
tcgagcaggagctgtgtaatgaaga

SEQ ID NO: 823518 - DNA, 25 bp, Mus musculus
tcgagccaccaactgtcagagcttc

SEQ ID NO: 823519 - DNA, 25 bp, Mus musculus
tcgagccaccaagtgtcagagcttc

SEQ ID NO: 823520 - DNA, 25 bp, Mus musculus
tcgagccagccaatcagatggtcaa

SEQ ID NO: 823521 - DNA, 25 bp, Mus musculus
tcgagccagccattcagatggtcaa

SEQ ID NO: 823522 - DNA, 25 bp, Mus musculus
tcgagcccacgtcaagaaaaccatt

SEQ ID NO: 823523 - DNA, 25 bp, Mus musculus
tcgagcccacgtgaagaaaaccatt

SEQ ID NO: 823524 - DNA, 25 bp, Mus musculus
tcgagcccagtgataccaccaagaa

SEQ ID NO: 823525 - DNA, 25 bp, Mus musculus
tcgagcccagtgttaccaccaagaa

SEQ ID NO: 823526 - DNA, 25 bp, Mus musculus
tcgagccccagtaaacgtgcattaa

SEQ ID NO: 823527 - DNA, 25 bp, Mus musculus
tcgagccccagttaacgtgcattaa

SEQ ID NO: 823528 - DNA, 25 bp, Mus musculus
tcgagcccgggacttcgcagctaca

SEQ ID NO: 823529 - DNA, 25 bp, Mus musculus
tcgagcccgggagttcgcagctaca

SEQ ID NO: 823530 - DNA, 25 bp, Mus musculus
tcgagcctacggaatgcctttcgtt

SEQ ID NO: 823531 - DNA, 25 bp, Mus musculus
tcgagcctacggtatgcctttcgtt

SEQ ID NO: 823532 - DNA, 25 bp, Mus musculus
tcgagcgatcccagtttccatttca

SEQ ID NO: 823533 - DNA, 25 bp, Mus musculus
tcgagcgatccctgtttccatttca

SEQ ID NO: 823534 - DNA, 25 bp, Mus musculus
tcgagcgatgatccctctgctagaa

SEQ ID NO: 823535 - DNA, 25 bp, Mus musculus
tcgagcgatgatgcctctgctagaa

SEQ ID NO: 823536 - DNA, 25 bp, Mus musculus
tcgagcgccaagatcgtgaagccca

SEQ ID NO: 823537 - DNA, 25 bp, Mus musculus
tcgagcgccaagttcgtgaagccca

SEQ ID NO: 823538 - DNA, 25 bp, Mus musculus
tcgagcgcttcgaggtggcagccgg

SEQ ID NO: 823539 - DNA, 25 bp, Mus musculus
tcgagcgcttcgtggtggcagccgg

SEQ ID NO: 823540 - DNA, 25 bp, Mus musculus
tcgagcggcacgcactgaggtctct

SEQ ID NO: 823541 - DNA, 25 bp, Mus musculus
tcgagcggcacggactgaggtctct

SEQ ID NO: 823542 - DNA, 25 bp, Mus musculus
tcgagcgggtacacaagaagatcaa

SEQ ID NO: 823543 - DNA, 25 bp, Mus musculus
tcgagcgggtactcaagaagatcaa

SEQ ID NO: 823544 - DNA, 25 bp, Mus musculus
tcgagcggtacaaacgcacctttga

SEQ ID NO: 823545 - DNA, 25 bp, Mus musculus
tcgagcggtacatacgcacctttga

SEQ ID NO: 823546 - DNA, 25 bp, Mus musculus
tcgagctacagaacccagtgagaga

SEQ ID NO: 823547 - DNA, 25 bp, Mus musculus
tcgagctacagatcccagtgagaga

SEQ ID NO: 823548 - DNA, 25 bp, Mus musculus
tcgagctcatccagacgcgcggcgg

SEQ ID NO: 823549 - DNA, 25 bp, Mus musculus
tcgagctcatcctgacgcgcggcgg

SEQ ID NO: 823550 - DNA, 25 bp, Mus musculus
tcgagctccattcagggccagcaga

SEQ ID NO: 823551 - DNA, 25 bp, Mus musculus
tcgagctccattgagggccagcaga

SEQ ID NO: 823552 - DNA, 25 bp, Mus musculus
tcgagctgcctccttatagcgtcgg

SEQ ID NO: 823553 - DNA, 25 bp, Mus musculus
tcgagctgcctcgttatagcgtcgg

SEQ ID NO: 823554 - DNA, 25 bp, Mus musculus
tcgagcttccccatgattagaggga

SEQ ID NO: 823555 - DNA, 25 bp, Mus musculus
tcgagcttccccttgattagaggga

SEQ ID NO: 823556 - DNA, 25 bp, Mus musculus
tcgagcttgatcctgttttgaattt

SEQ ID NO: 823557 - DNA, 25 bp, Mus musculus
tcgagcttgatcgtgttttgaattt

SEQ ID NO: 823558 - DNA, 25 bp, Mus musculus
tcgagcttgcagaccttggagcctg

SEQ ID NO: 823559 - DNA, 25 bp, Mus musculus
tcgagcttgcagtccttggagcctg

SEQ ID NO: 823560 - DNA, 25 bp, Mus musculus
tcgaggaaccagactcttcagagaa

SEQ ID NO: 823561 - DNA, 25 bp, Mus musculus
tcgaggaaccagtctcttcagagaa

SEQ ID NO: 823562 - DNA, 25 bp, Mus musculus
tcgaggaatcatccacccggttcta

SEQ ID NO: 823563 - DNA, 25 bp, Mus musculus
tcgaggaatcatgcacccggttcta

SEQ ID NO: 823564 - DNA, 25 bp, Mus musculus
tcgaggaccgtgaactgtacaagca

SEQ ID NO: 823565 - DNA, 25 bp, Mus musculus
tcgaggaccgtgtactgtacaagca

SEQ ID NO: 823566 - DNA, 25 bp, Mus musculus
tcgaggacctgcatgatcgccatga

SEQ ID NO: 823567 - DNA, 25 bp, Mus musculus
tcgaggacctgcttgatcgccatga

SEQ ID NO: 823568 - DNA, 25 bp, Mus musculus
tcgaggaccttgaggcagctttgat

SEQ ID NO: 823569 - DNA, 25 bp, Mus musculus
tcgaggaccttgtggcagctttgat

SEQ ID NO: 823570 - DNA, 25 bp, Mus musculus
tcgaggactcagaccaacacactgg

SEQ ID NO: 823571 - DNA, 25 bp, Mus musculus
tcgaggactcagtccaacacactgg

SEQ ID NO: 823572 - DNA, 25 bp, Mus musculus
tcgaggagcgagacttttctgccta

SEQ ID NO: 823573 - DNA, 25 bp, Mus musculus
tcgaggagcgagtcttttctgccta

SEQ ID NO: 823574 - DNA, 25 bp, Mus musculus
tcgaggagcttgacaactggcaggt

SEQ ID NO: 823575 - DNA, 25 bp, Mus musculus
tcgaggagcttgtcaactggcaggt

SEQ ID NO: 823576 - DNA, 25 bp, Mus musculus
tcgaggaggcgcagcccgacacaga

SEQ ID NO: 823577 - DNA, 25 bp, Mus musculus
tcgaggaggcgctgcccgacacaga

SEQ ID NO: 823578 - DNA, 25 bp, Mus musculus
tcgaggcctgatactcttacaaggt

SEQ ID NO: 823579 - DNA, 25 bp, Mus musculus
tcgaggcctgattctcttacaaggt

SEQ ID NO: 823580 - DNA, 25 bp, Mus musculus
tcgaggccttacaactgagcttcaa

SEQ ID NO: 823581 - DNA, 25 bp, Mus musculus
tcgaggccttactactgagcttcaa

SEQ ID NO: 823582 - DNA, 25 bp, Mus musculus
tcgaggcgcactaccaggaggccga

SEQ ID NO: 823583 - DNA, 25 bp, Mus musculus
tcgaggcgcacttccaggaggccga

SEQ ID NO: 823584 - DNA, 25 bp, Mus musculus
tcgaggcgtccaacacacgcagtga

SEQ ID NO: 823585 - DNA, 25 bp, Mus musculus
tcgaggcgtccatcacacgcagtga

SEQ ID NO: 823586 - DNA, 25 bp, Mus musculus
tcgaggctagcccaggttgtattag

SEQ ID NO: 823587 - DNA, 25 bp, Mus musculus
tcgaggctagccgaggttgtattag

SEQ ID NO: 823588 - DNA, 25 bp, Mus musculus
tcgaggctcaacctttgccaggata

SEQ ID NO: 823589 - DNA, 25 bp, Mus musculus
tcgaggctcaacgtttgccaggata

SEQ ID NO: 823590 - DNA, 25 bp, Mus musculus
tcgaggctctgaattgtcagtcagc

SEQ ID NO: 823591 - DNA, 25 bp, Mus musculus
tcgaggctctgatttgtcagtcagc

SEQ ID NO: 823592 - DNA, 25 bp, Mus musculus
tcgaggctctggataattactatgt

SEQ ID NO: 823593 - DNA, 25 bp, Mus musculus
tcgaggctctggttaattactatgt

SEQ ID NO: 823594 - DNA, 25 bp, Mus musculus
tcgaggctggcgagatccagtgttt

SEQ ID NO: 823595 - DNA, 25 bp, Mus musculus
tcgaggctggcgtgatccagtgttt

SEQ ID NO: 823596 - DNA, 25 bp, Mus musculus
tcgagggaccccaagtgaagatgag

SEQ ID NO: 823597 - DNA, 25 bp, Mus musculus
tcgagggacccctagtgaagatgag

SEQ ID NO: 823598 - DNA, 25 bp, Mus musculus
tcgagggcgagtacatccctttgca

SEQ ID NO: 823599 - DNA, 25 bp, Mus musculus
tcgagggcgagttcatccctttgca

SEQ ID NO: 823600 - DNA, 25 bp, Mus musculus
tcgagggctagtcatgtccaagacg

SEQ ID NO: 823601 - DNA, 25 bp, Mus musculus
tcgagggctagtgatgtccaagacg

SEQ ID NO: 823602 - DNA, 25 bp, Mus musculus
tcgagggtacctatcaactggtgca

SEQ ID NO: 823603 - DNA, 25 bp, Mus musculus
tcgagggtacctttcaactggtgca

SEQ ID NO: 823604 - DNA, 25 bp, Mus musculus
tcgaggtcaaggaccaggtcgcgat

SEQ ID NO: 823605 - DNA, 25 bp, Mus musculus
tcgaggtcaaggtccaggtcgcgat

SEQ ID NO: 823606 - DNA, 25 bp, Mus musculus
tcgaggtcaggacttacaggccaaa

SEQ ID NO: 823607 - DNA, 25 bp, Mus musculus
tcgaggtcaggagttacaggccaaa

SEQ ID NO: 823608 - DNA, 25 bp, Mus musculus
tcgaggtcatctccgagcgcggcta

SEQ ID NO: 823609 - DNA, 25 bp, Mus musculus
tcgaggtcatctgcgagcgcggcta

SEQ ID NO: 823610 - DNA, 25 bp, Mus musculus
tcgaggtctttcacagttcacttgt

SEQ ID NO: 823611 - DNA, 25 bp, Mus musculus
tcgaggtctttctcagttcacttgt

SEQ ID NO: 823612 - DNA, 25 bp, Mus musculus
tcgaggtggctcattatctaggaaa

SEQ ID NO: 823613 - DNA, 25 bp, Mus musculus
tcgaggtggctctttatctaggaaa

SEQ ID NO: 823614 - DNA, 25 bp, Mus musculus
tcgagtaacataacagccgcagctg

SEQ ID NO: 823615 - DNA, 25 bp, Mus musculus
tcgagtaacatatcagccgcagctg

SEQ ID NO: 823616 - DNA, 25 bp, Mus musculus
tcgagtactcaaccccaactgctga

SEQ ID NO: 823617 - DNA, 25 bp, Mus musculus
tcgagtactcaagcccaactgctga

SEQ ID NO: 823618 - DNA, 25 bp, Mus musculus
tcgagtactggaatgtccgaaattc

SEQ ID NO: 823619 - DNA, 25 bp, Mus musculus
tcgagtactggattgtccgaaattc

SEQ ID NO: 823620 - DNA, 25 bp, Mus musculus
tcgagtaggcggctttcctaacttt

SEQ ID NO: 823621 - DNA, 25 bp, Mus musculus
tcgagtaggcgggtttcctaacttt

SEQ ID NO: 823622 - DNA, 25 bp, Mus musculus
tcgagtatccttcagccagtggctg

SEQ ID NO: 823623 - DNA, 25 bp, Mus musculus
tcgagtatccttgagccagtggctg

SEQ ID NO: 823624 - DNA, 25 bp, Mus musculus
tcgagtcaagaaagctgtctactgt

SEQ ID NO: 823625 - DNA, 25 bp, Mus musculus
tcgagtcaagaatgctgtctactgt

SEQ ID NO: 823626 - DNA, 25 bp, Mus musculus
tcgagtcagcgcaacatagtgagac

SEQ ID NO: 823627 - DNA, 25 bp, Mus musculus
tcgagtcagcgctacatagtgagac

SEQ ID NO: 823628 - DNA, 25 bp, Mus musculus
tcgagtcatgtcaactgtaccctgt

SEQ ID NO: 823629 - DNA, 25 bp, Mus musculus
tcgagtcatgtctactgtaccctgt

SEQ ID NO: 823630 - DNA, 25 bp, Mus musculus
tcgagtccctcacaccatcaggaat

SEQ ID NO: 823631 - DNA, 25 bp, Mus musculus
tcgagtccctcagaccatcaggaat

SEQ ID NO: 823632 - DNA, 25 bp, Mus musculus
tcgagtcctcttcggccttgatgta

SEQ ID NO: 823633 - DNA, 25 bp, Mus musculus
tcgagtcctcttgggccttgatgta

SEQ ID NO: 823634 - DNA, 25 bp, Mus musculus
tcgagtcctgttcccttgtggtgct

SEQ ID NO: 823635 - DNA, 25 bp, Mus musculus
tcgagtcctgttgccttgtggtgct

SEQ ID NO: 823636 - DNA, 25 bp, Mus musculus
tcgagtcgtgtaatgtggagcttga

SEQ ID NO: 823637 - DNA, 25 bp, Mus musculus
tcgagtcgtgtattgtggagcttga

SEQ ID NO: 823638 - DNA, 25 bp, Mus musculus
tcgagtctcaggaccagttggtaca

SEQ ID NO: 823639 - DNA, 25 bp, Mus musculus
tcgagtctcaggatggaggcccctt

SEQ ID NO: 823640 - DNA, 25 bp, Mus musculus
tcgagtctcaggtccagttggtaca

SEQ ID NO: 823641 - DNA, 25 bp, Mus musculus
tcgagtctcaggttggaggcccctt

SEQ ID NO: 823642 - DNA, 25 bp, Mus musculus
tcgagtctgcgcctgcatattccta

SEQ ID NO: 823643 - DNA, 25 bp, Mus musculus
tcgagtctgcgcgtgcatattccta

SEQ ID NO: 823644 - DNA, 25 bp, Mus musculus
tcgagtgaatgtcgcagttaaacat

SEQ ID NO: 823645 - DNA, 25 bp, Mus musculus
tcgagtgaatgtggcagttaaacat

SEQ ID NO: 823646 - DNA, 25 bp, Mus musculus
tcgagtgacaggagctgccctcatt

SEQ ID NO: 823647 - DNA, 25 bp, Mus musculus
tcgagtgacaggtgctgccctcatt

SEQ ID NO: 823648 - DNA, 25 bp, Mus musculus
tcgagtgagttcctttattcagagc

SEQ ID NO: 823649 - DNA, 25 bp, Mus musculus
tcgagtgagttcgtttattcagagc

SEQ ID NO: 823650 - DNA, 25 bp, Mus musculus
tcgagtgatactccattgaccagct

SEQ ID NO: 823651 - DNA, 25 bp, Mus musculus
tcgagtgatactgcattgaccagct

SEQ ID NO: 823652 - DNA, 25 bp, Mus musculus
tcgagtgattatatggacctgccat

SEQ ID NO: 823653 - DNA, 25 bp, Mus musculus
tcgagtgattatttggacctgccat

SEQ ID NO: 823654 - DNA, 25 bp, Mus musculus
tcgagtgcacacaggacggcctgag

SEQ ID NO: 823655 - DNA, 25 bp, Mus musculus
tcgagtgcacactggacggcctgag

SEQ ID NO: 823656 - DNA, 25 bp, Mus musculus
tcgagtgcagttacgccaaggccaa

SEQ ID NO: 823657 - DNA, 25 bp, Mus musculus
tcgagtgcagtttcgccaaggccaa

SEQ ID NO: 823658 - DNA, 25 bp, Mus musculus
tcgagtggcatcaacctctgttcac

SEQ ID NO: 823659 - DNA, 25 bp, Mus musculus
tcgagtggcatctacctctgttcac

SEQ ID NO: 823660 - DNA, 25 bp, Mus musculus
tcgagtggtacacatttctatgtgt

SEQ ID NO: 823661 - DNA, 25 bp, Mus musculus
tcgagtggtacagatttctatgtgt

SEQ ID NO: 823662 - DNA, 25 bp, Mus musculus
tcgagtggtgaacgacctcagtgca

SEQ ID NO: 823663 - DNA, 25 bp, Mus musculus
tcgagtggtgaaggacctcagtgca

SEQ ID NO: 823664 - DNA, 25 bp, Mus musculus
tcgagtgtacgacgcttgaagcatt

SEQ ID NO: 823665 - DNA, 25 bp, Mus musculus
tcgagtgtacgaggcttgaagcatt

SEQ ID NO: 823666 - DNA, 25 bp, Mus musculus
tcgagtgtgaacaactactttgaga

SEQ ID NO: 823667 - DNA, 25 bp, Mus musculus
tcgagtgtgaactactactttgaga

SEQ ID NO: 823668 - DNA, 25 bp, Mus musculus
tcgagtgttcctccagtatcttcct

SEQ ID NO: 823669 - DNA, 25 bp, Mus musculus
tcgagtgttcctgcagtatcttcct

SEQ ID NO: 823670 - DNA, 25 bp, Mus musculus
tcgagtgtttatatggacctgtgac

SEQ ID NO: 823671 - DNA, 25 bp, Mus musculus
tcgagtgtttatttggacctgtgac

SEQ ID NO: 823672 - DNA, 25 bp, Mus musculus
tcgagttcccggagggttctttgag

SEQ ID NO: 823673 - DNA, 25 bp, Mus musculus
tcgagttcccggtgggttctttgag

SEQ ID NO: 823674 - DNA, 25 bp, Mus musculus
tcgagttcctggatatggttatcac

SEQ ID NO: 823675 - DNA, 25 bp, Mus musculus
tcgagttcctggttatggttatcac

SEQ ID NO: 823676 - DNA, 25 bp, Mus musculus
tcgagttctgtgagattcctgagca

SEQ ID NO: 823677 - DNA, 25 bp, Mus musculus
tcgagttctgtgtgattcctgagca

SEQ ID NO: 823678 - DNA, 25 bp, Mus musculus
tcgagttcttctatgaggagcaggc

SEQ ID NO: 823679 - DNA, 25 bp, Mus musculus
tcgagttcttctttgaggagcaggc

SEQ ID NO: 823680 - DNA, 25 bp, Mus musculus
tcgagttgattgcattgttcccccc

SEQ ID NO: 823681 - DNA, 25 bp, Mus musculus
tcgagttgattggattgttcccccc

SEQ ID NO: 823682 - DNA, 25 bp, Mus musculus
tcgagttggcttacacccctatatt

SEQ ID NO: 823683 - DNA, 25 bp, Mus musculus
tcgagttggctttcacccctatatt

SEQ ID NO: 823684 - DNA, 25 bp, Mus musculus
tcgagtttagtgattgaaaggccaa

SEQ ID NO: 823685 - DNA, 25 bp, Mus musculus
tcgagtttagtgtttgaaaggccaa

SEQ ID NO: 823686 - DNA, 25 bp, Mus musculus
tcgagttttcctacagagcaagttc

SEQ ID NO: 823687 - DNA, 25 bp, Mus musculus
tcgagttttccttcagagcaagttc

SEQ ID NO: 823688 - DNA, 25 bp, Mus musculus
tcgagttttcgtactccgtataaag

SEQ ID NO: 823689 - DNA, 25 bp, Mus musculus
tcgagttttcgttctccgtataaag

SEQ ID NO: 823690 - DNA, 25 bp, Mus musculus
tcgataaaaactatgtcctattttt

SEQ ID NO: 823691 - DNA, 25 bp, Mus musculus
tcgataaaaactttgtcctattttt

SEQ ID NO: 823692 - DNA, 25 bp, Mus musculus
tcgataaacggaatcacttttagca

SEQ ID NO: 823693 - DNA, 25 bp, Mus musculus
tcgataaacggattcacttttagca

SEQ ID NO: 823694 - DNA, 25 bp, Mus musculus
tcgataagtcctacatgaacccggg

SEQ ID NO: 823695 - DNA, 25 bp, Mus musculus
tcgataagtccttcatgaacccggg

SEQ ID NO: 823696 - DNA, 25 bp, Mus musculus
tcgatacacaataattcctctcaat

SEQ ID NO: 823697 - DNA, 25 bp, Mus musculus
tcgatacacaattattcctctcaat

SEQ ID NO: 823698 - DNA, 25 bp, Mus musculus
tcgatacagtgaccattttgaaaat

SEQ ID NO: 823699 - DNA, 25 bp, Mus musculus
tcgatacagtgagcattttgaaaat

SEQ ID NO: 823700 - DNA, 25 bp, Mus musculus
tcgataccaccaacgggagttccgg

SEQ ID NO: 823701 - DNA, 25 bp, Mus musculus
tcgataccaccatcgggagttccgg

SEQ ID NO: 823702 - DNA, 25 bp, Mus musculus
tcgataccgcccattaaaaccagat

SEQ ID NO: 823703 - DNA, 25 bp, Mus musculus
tcgataccgccctttaaaaccagat

SEQ ID NO: 823704 - DNA, 25 bp, Mus musculus
tcgatacgtgatattggcaactctt

SEQ ID NO: 823705 - DNA, 25 bp, Mus musculus
tcgatacgtgattttggcaactctt

SEQ ID NO: 823706 - DNA, 25 bp, Mus musculus
tcgatactataacactaagcgggtg

SEQ ID NO: 823707 - DNA, 25 bp, Mus musculus
tcgatactataagactaagcgggtg

SEQ ID NO: 823708 - DNA, 25 bp, Mus musculus
tcgatactctgtagctgtgtaagtt

SEQ ID NO: 823709 - DNA, 25 bp, Mus musculus
tcgatactctgttgctgtgtaagtt

SEQ ID NO: 823710 - DNA, 25 bp, Mus musculus
tcgatactgccaactctctaaatta

SEQ ID NO: 823711 - DNA, 25 bp, Mus musculus
tcgatactgccatctctctaaatta

SEQ ID NO: 823712 - DNA, 25 bp, Mus musculus
tcgatagaacttccaactccatctc

SEQ ID NO: 823713 - DNA, 25 bp, Mus musculus
tcgatagaacttgcaactccatctc

SEQ ID NO: 823714 - DNA, 25 bp, Mus musculus
tcgatagagttcagacagctgcctg

SEQ ID NO: 823715 - DNA, 25 bp, Mus musculus
tcgatagagttctgacagctgcctg

SEQ ID NO: 823716 - DNA, 25 bp, Mus musculus
tcgatagctcgcaggcactctggag

SEQ ID NO: 823717 - DNA, 25 bp, Mus musculus
tcgatagctcgctggcactctggag

SEQ ID NO: 823718 - DNA, 25 bp, Mus musculus
tcgatatacagccttttatagaaaa

SEQ ID NO: 823719 - DNA, 25 bp, Mus musculus
tcgatatacagcgttttatagaaaa

SEQ ID NO: 823720 - DNA, 25 bp, Mus musculus
tcgatatgggtaagtgggctcctcc

SEQ ID NO: 823721 - DNA, 25 bp, Mus musculus
tcgatatgggtatgtgggctcctcc

SEQ ID NO: 823722 - DNA, 25 bp, Mus musculus
tcgatattatgtccttgaagcgaat

SEQ ID NO: 823723 - DNA, 25 bp, Mus musculus
tcgatattatgtgcttgaagcgaat

SEQ ID NO: 823724 - DNA, 25 bp, Mus musculus
tcgatattgaacacggagaaaaagt

SEQ ID NO: 823725 - DNA, 25 bp, Mus musculus
tcgatattgaactcggagaaaaagt

SEQ ID NO: 823726 - DNA, 25 bp, Mus musculus
tcgatcactgctattcaattccagt

SEQ ID NO: 823727 - DNA, 25 bp, Mus musculus
tcgatcactgcttttcaattccagt

SEQ ID NO: 823728 - DNA, 25 bp, Mus musculus
tcgatccagcctcttaaaggaccaa

SEQ ID NO: 823729 - DNA, 25 bp, Mus musculus
tcgatccagcctgttaaaggaccaa

SEQ ID NO: 823730 - DNA, 25 bp, Mus musculus
tcgatcccaaatctgaaggtttccc

SEQ ID NO: 823731 - DNA, 25 bp, Mus musculus
tcgatcccaaatgtgaaggtttccc

SEQ ID NO: 823732 - DNA, 25 bp, Mus musculus
tcgatcctcagactttactcacatg

SEQ ID NO: 823733 - DNA, 25 bp, Mus musculus
tcgatcctcagagtttactcacatg

SEQ ID NO: 823734 - DNA, 25 bp, Mus musculus
tcgatcctcgtcaggtgcaggtcag

SEQ ID NO: 823735 - DNA, 25 bp, Mus musculus
tcgatcctcgtctggtgcaggtcag

SEQ ID NO: 823736 - DNA, 25 bp, Mus musculus
tcgatccttcccacagtgagacttt

SEQ ID NO: 823737 - DNA, 25 bp, Mus musculus
tcgatccttccctcagtgagacttt

SEQ ID NO: 823738 - DNA, 25 bp, Mus musculus
tcgatcgaatcacttgttattgttg

SEQ ID NO: 823739 - DNA, 25 bp, Mus musculus
tcgatcgaatcagttgttattgttg

SEQ ID NO: 823740 - DNA, 25 bp, Mus musculus
tcgatctaatgcacagacctacact

SEQ ID NO: 823741 - DNA, 25 bp, Mus musculus
tcgatctaatgctcagacctacact

SEQ ID NO: 823742 - DNA, 25 bp, Mus musculus
tcgatctctagccagagtgtggcag

SEQ ID NO: 823743 - DNA, 25 bp, Mus musculus
tcgatctctagcgagagtgtggcag

SEQ ID NO: 823744 - DNA, 25 bp, Mus musculus
tcgatctgcacgctacatcctaaag

SEQ ID NO: 823745 - DNA, 25 bp, Mus musculus
tcgatctgcacggtacatcctaaag

SEQ ID NO: 823746 - DNA, 25 bp, Mus musculus
tcgatctgctagaccaaaacaggat

SEQ ID NO: 823747 - DNA, 25 bp, Mus musculus
tcgatctgctagtccaaaacaggat

SEQ ID NO: 823748 - DNA, 25 bp, Mus musculus
tcgatctgggatctgttctgggaaa

SEQ ID NO: 823749 - DNA, 25 bp, Mus musculus
tcgatctgggatgtgttctgggaaa

SEQ ID NO: 823750 - DNA, 25 bp, Mus musculus
tcgatctggtccagccttggcgggt

SEQ ID NO: 823751 - DNA, 25 bp, Mus musculus
tcgatctggtcctgccttggcgggt

SEQ ID NO: 823752 - DNA, 25 bp, Mus musculus
tcgatcttcataacggacaaactga

SEQ ID NO: 823753 - DNA, 25 bp, Mus musculus
tcgatcttcatatcggacaaactga

SEQ ID NO: 823754 - DNA, 25 bp, Mus musculus
tcgatctttcttatgtatggacagc

SEQ ID NO: 823755 - DNA, 25 bp, Mus musculus
tcgatctttcttttgtatggacagc

SEQ ID NO: 823756 - DNA, 25 bp, Mus musculus
tcgatgaagaagctggcaaggcccc

SEQ ID NO: 823757 - DNA, 25 bp, Mus musculus
tcgatgaagaaggtggcaaggcccc

SEQ ID NO: 823758 - DNA, 25 bp, Mus musculus
tcgatgaatccaccattgtctgtaa

SEQ ID NO: 823759 - DNA, 25 bp, Mus musculus
tcgatgaatccagcattgtctgtaa

SEQ ID NO: 823760 - DNA, 25 bp, Mus musculus
tcgatgacgctcaactgcagatcta

SEQ ID NO: 823761 - DNA, 25 bp, Mus musculus
tcgatgacgctctactgcagatcta

SEQ ID NO: 823762 - DNA, 25 bp, Mus musculus
tcgatgactcagctcctaatgaaat

SEQ ID NO: 823763 - DNA, 25 bp, Mus musculus
tcgatgactcaggtcctaatgaaat

SEQ ID NO: 823764 - DNA, 25 bp, Mus musculus
tcgatgactgacctacgccaagggc

SEQ ID NO: 823765 - DNA, 25 bp, Mus musculus
tcgatgactgacgtacgccaagggc

SEQ ID NO: 823766 - DNA, 25 bp, Mus musculus
tcgatgagaagcaccaccactctgt

SEQ ID NO: 823767 - DNA, 25 bp, Mus musculus
tcgatgagaagctccaccactctgt

SEQ ID NO: 823768 - DNA, 25 bp, Mus musculus
tcgatgagatccataaccactgctg

SEQ ID NO: 823769 - DNA, 25 bp, Mus musculus
tcgatgagatccttaaccactgctg

SEQ ID NO: 823770 - DNA, 25 bp, Mus musculus
tcgatgagctcgctgtccatgcagc

SEQ ID NO: 823771 - DNA, 25 bp, Mus musculus
tcgatgagctcggtgtccatgcagc

SEQ ID NO: 823772 - DNA, 25 bp, Mus musculus
tcgatgagtactcggacctgctcca

SEQ ID NO: 823773 - DNA, 25 bp, Mus musculus
tcgatgagtactgggacctgctcca

SEQ ID NO: 823774 - DNA, 25 bp, Mus musculus
tcgatgcactgaccgctccggaaaa

SEQ ID NO: 823775 - DNA, 25 bp, Mus musculus
tcgatgcactgagcgctccggaaaa

SEQ ID NO: 823776 - DNA, 25 bp, Mus musculus
tcgatgcagcttccgcctgtttggg

SEQ ID NO: 823777 - DNA, 25 bp, Mus musculus
tcgatgcagcttgcgcctgtttggg

SEQ ID NO: 823778 - DNA, 25 bp, Mus musculus
tcgatgccaattctcggaagcaaga

SEQ ID NO: 823779 - DNA, 25 bp, Mus musculus
tcgatgccaattgtcggaagcaaga

SEQ ID NO: 823780 - DNA, 25 bp, Mus musculus
tcgatgccatccacaaagttaaaag

SEQ ID NO: 823781 - DNA, 25 bp, Mus musculus
tcgatgccatcctcaaagttaaaag

SEQ ID NO: 823782 - DNA, 25 bp, Mus musculus
tcgatgcgcttcaaaaggtgtgctg

SEQ ID NO: 823783 - DNA, 25 bp, Mus musculus
tcgatgcgcttctaaaggtgtgctg

SEQ ID NO: 823784 - DNA, 25 bp, Mus musculus
tcgatgctctggattctggctggaa

SEQ ID NO: 823785 - DNA, 25 bp, Mus musculus
tcgatgctctggtttctggctggaa

SEQ ID NO: 823786 - DNA, 25 bp, Mus musculus
tcgatgctctgtagccagtatcaaa

SEQ ID NO: 823787 - DNA, 25 bp, Mus musculus
tcgatgctctgttgccagtatcaaa

SEQ ID NO: 823788 - DNA, 25 bp, Mus musculus
tcgatgctgctacattcccttgaag

SEQ ID NO: 823789 - DNA, 25 bp, Mus musculus
tcgatgctgctagattcccttgaag

SEQ ID NO: 823790 - DNA, 25 bp, Mus musculus
tcgatgctttccacaaccaggctaa

SEQ ID NO: 823791 - DNA, 25 bp, Mus musculus
tcgatgctttccacttgaagtcttt

SEQ ID NO: 823792 - DNA, 25 bp, Mus musculus
tcgatgctttcctcaaccaggctaa

SEQ ID NO: 823793 - DNA, 25 bp, Mus musculus
tcgatgctttcctcttgaagtcttt

SEQ ID NO: 823794 - DNA, 25 bp, Mus musculus
tcgatggacgacagttcagaggatg

SEQ ID NO: 823795 - DNA, 25 bp, Mus musculus
tcgatggacgactgttcagaggatg

SEQ ID NO: 823796 - DNA, 25 bp, Mus musculus
tcgatggctatgacagggacaacaa

SEQ ID NO: 823797 - DNA, 25 bp, Mus musculus
tcgatggctatgtcagggacaacaa

SEQ ID NO: 823798 - DNA, 25 bp, Mus musculus
tcgatgtacagtcctgctcctgctg

SEQ ID NO: 823799 - DNA, 25 bp, Mus musculus
tcgatgtacagtgctgctcctgctg

SEQ ID NO: 823800 - DNA, 25 bp, Mus musculus
tcgatgtacataccacaaaccgtgt

SEQ ID NO: 823801 - DNA, 25 bp, Mus musculus
tcgatgtacatagcacaaaccgtgt

SEQ ID NO: 823802 - DNA, 25 bp, Mus musculus
tcgatgtcagcaatggcggccagga

SEQ ID NO: 823803 - DNA, 25 bp, Mus musculus
tcgatgtcagcattggcggccagga

SEQ ID NO: 823804 - DNA, 25 bp, Mus musculus
tcgatgtcagggaggcctgcactca

SEQ ID NO: 823805 - DNA, 25 bp, Mus musculus
tcgatgtcagggtggcctgcactca

SEQ ID NO: 823806 - DNA, 25 bp, Mus musculus
tcgatgtctgacattgtggctgatt

SEQ ID NO: 823807 - DNA, 25 bp, Mus musculus
tcgatgtctgactttgtggctgatt

SEQ ID NO: 823808 - DNA, 25 bp, Mus musculus
tcgatgtgcactatgcctcattaat

SEQ ID NO: 823809 - DNA, 25 bp, Mus musculus
tcgatgtgcactttgcctcattaat

SEQ ID NO: 823810 - DNA, 25 bp, Mus musculus
tcgatgtgtactacccgcagatcag

SEQ ID NO: 823811 - DNA, 25 bp, Mus musculus
tcgatgtgtacttcccgcagatcag

SEQ ID NO: 823812 - DNA, 25 bp, Mus musculus
tcgatgttccgacaagtccttccaa

SEQ ID NO: 823813 - DNA, 25 bp, Mus musculus
tcgatgttccgagaagtccttccaa

SEQ ID NO: 823814 - DNA, 25 bp, Mus musculus
tcgattaagattctggcctcggcta

SEQ ID NO: 823815 - DNA, 25 bp, Mus musculus
tcgattaagattgtggcctcggcta

SEQ ID NO: 823816 - DNA, 25 bp, Mus musculus
tcgattacctgacggccaactttga

SEQ ID NO: 823817 - DNA, 25 bp, Mus musculus
tcgattacctgagggccaactttga

SEQ ID NO: 823818 - DNA, 25 bp, Mus musculus
tcgattactaaaaggcctcgcccaa

SEQ ID NO: 823819 - DNA, 25 bp, Mus musculus
tcgattactaaatggcctcgcccaa

SEQ ID NO: 823820 - DNA, 25 bp, Mus musculus
tcgattatgactacccactgctgtg

SEQ ID NO: 823821 - DNA, 25 bp, Mus musculus
tcgattatgacttcccactgctgtg

SEQ ID NO: 823822 - DNA, 25 bp, Mus musculus
tcgattcaacccctgacatgtatat

SEQ ID NO: 823823 - DNA, 25 bp, Mus musculus
tcgattcaacccgtgacatgtatat

SEQ ID NO: 823824 - DNA, 25 bp, Mus musculus
tcgattcagattctgctattttgtg

SEQ ID NO: 823825 - DNA, 25 bp, Mus musculus
tcgattcagattgtgctattttgtg

SEQ ID NO: 823826 - DNA, 25 bp, Mus musculus
tcgattcattgacatccagcagcaa

SEQ ID NO: 823827 - DNA, 25 bp, Mus musculus
tcgattcattgagatccagcagcaa

SEQ ID NO: 823828 - DNA, 25 bp, Mus musculus
tcgattcctctaaagacccaaataa

SEQ ID NO: 823829 - DNA, 25 bp, Mus musculus
tcgattcctctatagacccaaataa

SEQ ID NO: 823830 - DNA, 25 bp, Mus musculus
tcgattgaatctatcgttttcccgg

SEQ ID NO: 823831 - DNA, 25 bp, Mus musculus
tcgattgaatctttcgttttcccgg

SEQ ID NO: 823832 - DNA, 25 bp, Mus musculus
tcgattggctccatgagaagaagaa

SEQ ID NO: 823833 - DNA, 25 bp, Mus musculus
tcgattggctccttgagaagaagaa

SEQ ID NO: 823834 - DNA, 25 bp, Mus musculus
tcgattgtggtgacttggcgactaa

SEQ ID NO: 823835 - DNA, 25 bp, Mus musculus
tcgattgtggtgtcttggcgactaa

SEQ ID NO: 823836 - DNA, 25 bp, Mus musculus
tcgatttcaaggagagtctgccatt

SEQ ID NO: 823837 - DNA, 25 bp, Mus musculus
tcgatttcaaggtgagtctgccatt

SEQ ID NO: 823838 - DNA, 25 bp, Mus musculus
tcgatttcacatcttaccattgcca

SEQ ID NO: 823839 - DNA, 25 bp, Mus musculus
tcgatttcacatgttaccattgcca

SEQ ID NO: 823840 - DNA, 25 bp, Mus musculus
tcgatttctggccagaaggccccgg

SEQ ID NO: 823841 - DNA, 25 bp, Mus musculus
tcgatttctggcgagaaggccccgg

SEQ ID NO: 823842 - DNA, 25 bp, Mus musculus
tcgatttgagcaagccatggccctc

SEQ ID NO: 823843 - DNA, 25 bp, Mus musculus
tcgatttgagcatgccatggccctc

SEQ ID NO: 823844 - DNA, 25 bp, Mus musculus
tcgatttggcccatctaatatgtaa

SEQ ID NO: 823845 - DNA, 25 bp, Mus musculus
tcgatttggcccttctaatatgtaa

SEQ ID NO: 823846 - DNA, 25 bp, Mus musculus
tcgattttctgcagtgaggcctaaa

SEQ ID NO: 823847 - DNA, 25 bp, Mus musculus
tcgattttctgctgtgaggcctaaa

SEQ ID NO: 823848 - DNA, 25 bp, Mus musculus
tcgcaaaaacccatccatcaaaaat

SEQ ID NO: 823849 - DNA, 25 bp, Mus musculus
tcgcaaaaacccttccatcaaaaat

SEQ ID NO: 823850 - DNA, 25 bp, Mus musculus
tcgcaaacactcatggctacaccag

SEQ ID NO: 823851 - DNA, 25 bp, Mus musculus
tcgcaaacactcttggctacaccag

SEQ ID NO: 823852 - DNA, 25 bp, Mus musculus
tcgcaaacctggctgggcattgaag

SEQ ID NO: 823853 - DNA, 25 bp, Mus musculus
tcgcaaacctgggtgggcattgaag

SEQ ID NO: 823854 - DNA, 25 bp, Mus musculus
tcgcaaactcatcctgcgcaggaac

SEQ ID NO: 823855 - DNA, 25 bp, Mus musculus
tcgcaaactcatgctgcgcaggaac

SEQ ID NO: 823856 - DNA, 25 bp, Mus musculus
tcgcaaagctcccaggaagccatga

SEQ ID NO: 823857 - DNA, 25 bp, Mus musculus
tcgcaaagctccgaggaagccatga

SEQ ID NO: 823858 - DNA, 25 bp, Mus musculus
tcgcaacctctccaaggatggcaaa

SEQ ID NO: 823859 - DNA, 25 bp, Mus musculus
tcgcaacctctcgaaggatggcaaa

SEQ ID NO: 823860 - DNA, 25 bp, Mus musculus
tcgcaactctggaattaactccaag

SEQ ID NO: 823861 - DNA, 25 bp, Mus musculus
tcgcaactctggtattaactccaag

SEQ ID NO: 823862 - DNA, 25 bp, Mus musculus
tcgcaagcaaacctatcaagagcaa

SEQ ID NO: 823863 - DNA, 25 bp, Mus musculus
tcgcaagcaaacgtatcaagagcaa

SEQ ID NO: 823864 - DNA, 25 bp, Mus musculus
tcgcaagccagtctgaggcagctta

SEQ ID NO: 823865 - DNA, 25 bp, Mus musculus
tcgcaagccagtgtgaggcagctta

SEQ ID NO: 823866 - DNA, 25 bp, Mus musculus
tcgcaagctgtgagcctttgggcat

SEQ ID NO: 823867 - DNA, 25 bp, Mus musculus
tcgcaagctgtgtgcctttgggcat

SEQ ID NO: 823868 - DNA, 25 bp, Mus musculus
tcgcaaggtctgatctggtctgttc

SEQ ID NO: 823869 - DNA, 25 bp, Mus musculus
tcgcaaggtctgttctggtctgttc

SEQ ID NO: 823870 - DNA, 25 bp, Mus musculus
tcgcaatacttacatgctcactcgt

SEQ ID NO: 823871 - DNA, 25 bp, Mus musculus
tcgcaatacttagatgctcactcgt

SEQ ID NO: 823872 - DNA, 25 bp, Mus musculus
tcgcaatgattcagctcgctgagga

SEQ ID NO: 823873 - DNA, 25 bp, Mus musculus
tcgcaatgattctgctcgctgagga

SEQ ID NO: 823874 - DNA, 25 bp, Mus musculus
tcgcaatgccgcctaaggacgacaa

SEQ ID NO: 823875 - DNA, 25 bp, Mus musculus
tcgcaatgccgcgtaaggacgacaa

SEQ ID NO: 823876 - DNA, 25 bp, Mus musculus
tcgcaatgcttgattatgagagtgt

SEQ ID NO: 823877 - DNA, 25 bp, Mus musculus
tcgcaatgcttgtttatgagagtgt

SEQ ID NO: 823878 - DNA, 25 bp, Mus musculus
tcgcacaccagtcaggggtcccgta

SEQ ID NO: 823879 - DNA, 25 bp, Mus musculus
tcgcacaccagtgaggggtcccgta

SEQ ID NO: 823880 - DNA, 25 bp, Mus musculus
tcgcacagcatgcacagacttccta

SEQ ID NO: 823881 - DNA, 25 bp, Mus musculus
tcgcacagcatggacagacttccta

SEQ ID NO: 823882 - DNA, 25 bp, Mus musculus
tcgcacattgacagagcaaacttca

SEQ ID NO: 823883 - DNA, 25 bp, Mus musculus
tcgcacattgactgagcaaacttca

SEQ ID NO: 823884 - DNA, 25 bp, Mus musculus
tcgcaccctttgacaacctacaggt

SEQ ID NO: 823885 - DNA, 25 bp, Mus musculus
tcgcaccctttgtcaacctacaggt

SEQ ID NO: 823886 - DNA, 25 bp, Mus musculus
tcgcaccgtgccctggagaagagaa

SEQ ID NO: 823887 - DNA, 25 bp, Mus musculus
tcgcaccgtgccgtggagaagagaa

SEQ ID NO: 823888 - DNA, 25 bp, Mus musculus
tcgcaccttcatcacgttcagtgat

SEQ ID NO: 823889 - DNA, 25 bp, Mus musculus
tcgcaccttcatgacgttcagtgat

SEQ ID NO: 823890 - DNA, 25 bp, Mus musculus
tcgcactagcttcggaaactccttg

SEQ ID NO: 823891 - DNA, 25 bp, Mus musculus
tcgcactagcttgggaaactccttg

SEQ ID NO: 823892 - DNA, 25 bp, Mus musculus
tcgcactatcaacctttgaacatat

SEQ ID NO: 823893 - DNA, 25 bp, Mus musculus
tcgcactatcaagctttgaacatat

SEQ ID NO: 823894 - DNA, 25 bp, Mus musculus
tcgcactatgatatttactcatccc

SEQ ID NO: 823895 - DNA, 25 bp, Mus musculus
tcgcactatgatttttactcatccc

SEQ ID NO: 823896 - DNA, 25 bp, Mus musculus
tcgcactgacagcacagattgctct

SEQ ID NO: 823897 - DNA, 25 bp, Mus musculus
tcgcactgacaggacagattgctct

SEQ ID NO: 823898 - DNA, 25 bp, Mus musculus
tcgcactgtgaccttagcgtttagt

SEQ ID NO: 823899 - DNA, 25 bp, Mus musculus
tcgcactgtgacgttagcgtttagt

SEQ ID NO: 823900 - DNA, 25 bp, Mus musculus
tcgcacttcacacattccatttcaa

SEQ ID NO: 823901 - DNA, 25 bp, Mus musculus
tcgcacttcacagattccatttcaa

SEQ ID NO: 823902 - DNA, 25 bp, Mus musculus
tcgcagaaagtgcagagcgttttgc

SEQ ID NO: 823903 - DNA, 25 bp, Mus musculus
tcgcagaaagtggagagcgttttgc

SEQ ID NO: 823904 - DNA, 25 bp, Mus musculus
tcgcagacaacgagcagcccatcag

SEQ ID NO: 823905 - DNA, 25 bp, Mus musculus
tcgcagacaacgtgcagcccatcag

SEQ ID NO: 823906 - DNA, 25 bp, Mus musculus
tcgcagacgtgacggcagccatctt

SEQ ID NO: 823907 - DNA, 25 bp, Mus musculus
tcgcagacgtgagggcagccatctt

SEQ ID NO: 823908 - DNA, 25 bp, Mus musculus
tcgcagagaagaacctacctgtgtt

SEQ ID NO: 823909 - DNA, 25 bp, Mus musculus
tcgcagagaagatcctacctgtgtt

SEQ ID NO: 823910 - DNA, 25 bp, Mus musculus
tcgcagagagatccacacagggcct

SEQ ID NO: 823911 - DNA, 25 bp, Mus musculus
tcgcagagagatgcacacagggcct

SEQ ID NO: 823912 - DNA, 25 bp, Mus musculus
tcgcagaggatacctctctcggcct

SEQ ID NO: 823913 - DNA, 25 bp, Mus musculus
tcgcagaggatagctctctcggcct

SEQ ID NO: 823914 - DNA, 25 bp, Mus musculus
tcgcagataagacacctaacactcg

SEQ ID NO: 823915 - DNA, 25 bp, Mus musculus
tcgcagataagagacctaacactcg

SEQ ID NO: 823916 - DNA, 25 bp, Mus musculus
tcgcagatgaacagtagagtacgtt

SEQ ID NO: 823917 - DNA, 25 bp, Mus musculus
tcgcagatgaactgtagagtacgtt

SEQ ID NO: 823918 - DNA, 25 bp, Mus musculus
tcgcagattcaacgccaggagtagt

SEQ ID NO: 823919 - DNA, 25 bp, Mus musculus
tcgcagattcaaggccaggagtagt

SEQ ID NO: 823920 - DNA, 25 bp, Mus musculus
tcgcagccactaagaggagggtccg

SEQ ID NO: 823921 - DNA, 25 bp, Mus musculus
tcgcagccactatgaggagggtccg

SEQ ID NO: 823922 - DNA, 25 bp, Mus musculus
tcgcagccctggagtgtttgttgca

SEQ ID NO: 823923 - DNA, 25 bp, Mus musculus
tcgcagccctggtgtgtttgttgca

SEQ ID NO: 823924 - DNA, 25 bp, Mus musculus
tcgcagcgtgcgatgggccatgaat

SEQ ID NO: 823925 - DNA, 25 bp, Mus musculus
tcgcagcgtgcgttgggccatgaat

SEQ ID NO: 823926 - DNA, 25 bp, Mus musculus
tcgcagctccatatcagtcatcgag

SEQ ID NO: 823927 - DNA, 25 bp, Mus musculus
tcgcagctccatttcagtcatcgag

SEQ ID NO: 823928 - DNA, 25 bp, Mus musculus
tcgcagctgctcaaccacattggca

SEQ ID NO: 823929 - DNA, 25 bp, Mus musculus
tcgcagctgctctaccacattggca

SEQ ID NO: 823930 - DNA, 25 bp, Mus musculus
tcgcagctgtcaccactacagtaag

SEQ ID NO: 823931 - DNA, 25 bp, Mus musculus
tcgcagctgtcagcactacagtaag

SEQ ID NO: 823932 - DNA, 25 bp, Mus musculus
tcgcagctgtgacaaatcttgagaa

SEQ ID NO: 823933 - DNA, 25 bp, Mus musculus
tcgcagctgtgagaaatcttgagaa

SEQ ID NO: 823934 - DNA, 25 bp, Mus musculus
tcgcagcttagtatattcccaacat

SEQ ID NO: 823935 - DNA, 25 bp, Mus musculus
tcgcagcttagtttattcccaacat

SEQ ID NO: 823936 - DNA, 25 bp, Mus musculus
tcgcaggagattcgcacttactcca

SEQ ID NO: 823937 - DNA, 25 bp, Mus musculus
tcgcaggagattggcacttactcca

SEQ ID NO: 823938 - DNA, 25 bp, Mus musculus
tcgcaggatgctccatatgttcacc

SEQ ID NO: 823939 - DNA, 25 bp, Mus musculus
tcgcaggatgctgcatatgttcacc

SEQ ID NO: 823940 - DNA, 25 bp, Mus musculus
tcgcaggcccaacagctgcatttaa

SEQ ID NO: 823941 - DNA, 25 bp, Mus musculus
tcgcaggcccaagagctgcatttaa

SEQ ID NO: 823942 - DNA, 25 bp, Mus musculus
tcgcagggcatgcagtagcacagct

SEQ ID NO: 823943 - DNA, 25 bp, Mus musculus
tcgcagggcatggagtagcacagct

SEQ ID NO: 823944 - DNA, 25 bp, Mus musculus
tcgcagggccatctagtggagcacc

SEQ ID NO: 823945 - DNA, 25 bp, Mus musculus
tcgcagggccatgtagtggagcacc

SEQ ID NO: 823946 - DNA, 25 bp, Mus musculus
tcgcaggtaccaattgtataacatc

SEQ ID NO: 823947 - DNA, 25 bp, Mus musculus
tcgcaggtaccatttgtataacatc

SEQ ID NO: 823948 - DNA, 25 bp, Mus musculus
tcgcaggtctgacgtctcacttgaa

SEQ ID NO: 823949 - DNA, 25 bp, Mus musculus
tcgcaggtctgaggtctcacttgaa

SEQ ID NO: 823950 - DNA, 25 bp, Mus musculus
tcgcagtattaaagttacaaataca

SEQ ID NO: 823951 - DNA, 25 bp, Mus musculus
tcgcagtattaatgttacaaataca

SEQ ID NO: 823952 - DNA, 25 bp, Mus musculus
tcgcagtgacttcgcagcactgagt

SEQ ID NO: 823953 - DNA, 25 bp, Mus musculus
tcgcagtgacttggcagcactgagt

SEQ ID NO: 823954 - DNA, 25 bp, Mus musculus
tcgcagtggcctctgagggcccaaa

SEQ ID NO: 823955 - DNA, 25 bp, Mus musculus
tcgcagtggcctgtgagggcccaaa

SEQ ID NO: 823956 - DNA, 25 bp, Mus musculus
tcgcataatctcactttcacagagc

SEQ ID NO: 823957 - DNA, 25 bp, Mus musculus
tcgcataatctctctttcacagagc

SEQ ID NO: 823958 - DNA, 25 bp, Mus musculus
tcgcatcaattcacagctggtggca

SEQ ID NO: 823959 - DNA, 25 bp, Mus musculus
tcgcatcaattctcagctggtggca

SEQ ID NO: 823960 - DNA, 25 bp, Mus musculus
tcgcatccttggaagaaagcagtag

SEQ ID NO: 823961 - DNA, 25 bp, Mus musculus
tcgcatccttggtagaaagcagtag

SEQ ID NO: 823962 - DNA, 25 bp, Mus musculus
tcgcatctgacaaggagacttacga

SEQ ID NO: 823963 - DNA, 25 bp, Mus musculus
tcgcatctgacatggagacttacga

SEQ ID NO: 823964 - DNA, 25 bp, Mus musculus
tcgcatctggagaccgtggtacagc

SEQ ID NO: 823965 - DNA, 25 bp, Mus musculus
tcgcatctggagtccgtggtacagc

SEQ ID NO: 823966 - DNA, 25 bp, Mus musculus
tcgcatgacttcacgctgtagagag

SEQ ID NO: 823967 - DNA, 25 bp, Mus musculus
tcgcatgacttctcgctgtagagag

SEQ ID NO: 823968 - DNA, 25 bp, Mus musculus
tcgcatgagcagatttccttcccag

SEQ ID NO: 823969 - DNA, 25 bp, Mus musculus
tcgcatgagcagttttccttcccag

SEQ ID NO: 823970 - DNA, 25 bp, Mus musculus
tcgcatgcacgcacccgggaagggc

SEQ ID NO: 823971 - DNA, 25 bp, Mus musculus
tcgcatgcacgctcccgggaagggc

SEQ ID NO: 823972 - DNA, 25 bp, Mus musculus
tcgcatgctctgcttctctattgaa

SEQ ID NO: 823973 - DNA, 25 bp, Mus musculus
tcgcatgctctggttctctattgaa

SEQ ID NO: 823974 - DNA, 25 bp, Mus musculus
tcgcatgtatggacctctataggca

SEQ ID NO: 823975 - DNA, 25 bp, Mus musculus
tcgcatgtatggtcctctataggca

SEQ ID NO: 823976 - DNA, 25 bp, Mus musculus
tcgcattatggacgacttgtcactt

SEQ ID NO: 823977 - DNA, 25 bp, Mus musculus
tcgcattatggaggacttgtcactt

SEQ ID NO: 823978 - DNA, 25 bp, Mus musculus
tcgcattcacgtcactgctgtgtta

SEQ ID NO: 823979 - DNA, 25 bp, Mus musculus
tcgcattcacgtgactgctgtgtta

SEQ ID NO: 823980 - DNA, 25 bp, Mus musculus
tcgcattccaaaactcgggctctaa

SEQ ID NO: 823981 - DNA, 25 bp, Mus musculus
tcgcattccaaatctcgggctctaa

SEQ ID NO: 823982 - DNA, 25 bp, Mus musculus
tcgcatttccgtagtgagctggtga

SEQ ID NO: 823983 - DNA, 25 bp, Mus musculus
tcgcatttccgttgtgagctggtga

SEQ ID NO: 823984 - DNA, 25 bp, Mus musculus
tcgccaaacaggatgttgtgctcaa

SEQ ID NO: 823985 - DNA, 25 bp, Mus musculus
tcgccaaacaggttgttgtgctcaa

SEQ ID NO: 823986 - DNA, 25 bp, Mus musculus
tcgccaagcactaacctgagggtta

SEQ ID NO: 823987 - DNA, 25 bp, Mus musculus
tcgccaagcacttacctgagggtta

SEQ ID NO: 823988 - DNA, 25 bp, Mus musculus
tcgccaagcgctctgggatgatcat

SEQ ID NO: 823989 - DNA, 25 bp, Mus musculus
tcgccaagcgctgtgggatgatcat

SEQ ID NO: 823990 - DNA, 25 bp, Mus musculus
tcgccaaggagaacgccagggcagt

SEQ ID NO: 823991 - DNA, 25 bp, Mus musculus
tcgccaaggagatcgccagggcagt

SEQ ID NO: 823992 - DNA, 25 bp, Mus musculus
tcgccaaggcaccattagctgctct

SEQ ID NO: 823993 - DNA, 25 bp, Mus musculus
tcgccaaggcacgattagctgctct

SEQ ID NO: 823994 - DNA, 25 bp, Mus musculus
tcgccaattggtactgggtggagtc

SEQ ID NO: 823995 - DNA, 25 bp, Mus musculus
tcgccaattggttctgggtggagtc

SEQ ID NO: 823996 - DNA, 25 bp, Mus musculus
tcgccaccccaaaaaacattacatg

SEQ ID NO: 823997 - DNA, 25 bp, Mus musculus
tcgccaccccaataaacattacatg

SEQ ID NO: 823998 - DNA, 25 bp, Mus musculus
tcgccacctcagagaaaacttctaa

SEQ ID NO: 823999 - DNA, 25 bp, Mus musculus
tcgccacctcagtgaaaacttctaa

SEQ ID NO: 824000 - DNA, 25 bp, Mus musculus
tcgccactacccatgaagctggctt

SEQ ID NO: 824001 - DNA, 25 bp, Mus musculus
tcgccactacccttgaagctggctt

SEQ ID NO: 824002 - DNA, 25 bp, Mus musculus
tcgccactcgcaatttaaccaaaac

SEQ ID NO: 824003 - DNA, 25 bp, Mus musculus
tcgccactcgcattttaaccaaaac

SEQ ID NO: 824004 - DNA, 25 bp, Mus musculus
tcgccactgccaaagactcccagga

SEQ ID NO: 824005 - DNA, 25 bp, Mus musculus
tcgccactgccatagactcccagga

SEQ ID NO: 824006 - DNA, 25 bp, Mus musculus
tcgccactggctacttaggtaagtt

SEQ ID NO: 824007 - DNA, 25 bp, Mus musculus
tcgccactggcttcttaggtaagtt

SEQ ID NO: 824008 - DNA, 25 bp, Mus musculus
tcgccactgtgactgggctgcaagt

SEQ ID NO: 824009 - DNA, 25 bp, Mus musculus
tcgccactgtgagtgggctgcaagt

SEQ ID NO: 824010 - DNA, 25 bp, Mus musculus
tcgccactgtttaccggttactaat

SEQ ID NO: 824011 - DNA, 25 bp, Mus musculus
tcgccactgttttccggttactaat

SEQ ID NO: 824012 - DNA, 25 bp, Mus musculus
tcgccagaaactcgagatacctcaa

SEQ ID NO: 824013 - DNA, 25 bp, Mus musculus
tcgccagaaactggagatacctcaa

SEQ ID NO: 824014 - DNA, 25 bp, Mus musculus
tcgccagacttcacgctatcaggaa

SEQ ID NO: 824015 - DNA, 25 bp, Mus musculus
tcgccagacttctcgctatcaggaa

SEQ ID NO: 824016 - DNA, 25 bp, Mus musculus
tcgccagccccaagagtacattttt

SEQ ID NO: 824017 - DNA, 25 bp, Mus musculus
tcgccagccccatgagtacattttt

SEQ ID NO: 824018 - DNA, 25 bp, Mus musculus
tcgccagcctatctaatgtttggat

SEQ ID NO: 824019 - DNA, 25 bp, Mus musculus
tcgccagcctatgtaatgtttggat

SEQ ID NO: 824020 - DNA, 25 bp, Mus musculus
tcgccagcgaggatcttcaaattag

SEQ ID NO: 824021 - DNA, 25 bp, Mus musculus
tcgccagcgaggttcttcaaattag

SEQ ID NO: 824022 - DNA, 25 bp, Mus musculus
tcgccagctcctagagacatacttt

SEQ ID NO: 824023 - DNA, 25 bp, Mus musculus
tcgccagctccttgagacatacttt

SEQ ID NO: 824024 - DNA, 25 bp, Mus musculus
tcgccagctttaagagatggtcctt

SEQ ID NO: 824025 - DNA, 25 bp, Mus musculus
tcgccagctttatgagatggtcctt

SEQ ID NO: 824026 - DNA, 25 bp, Mus musculus
tcgccaggctctatgcagtcttaac

SEQ ID NO: 824027 - DNA, 25 bp, Mus musculus
tcgccaggctctttgcagtcttaac

SEQ ID NO: 824028 - DNA, 25 bp, Mus musculus
tcgccaggctgccaacatctgtgca

SEQ ID NO: 824029 - DNA, 25 bp, Mus musculus
tcgccaggctgcgaacatctgtgca

SEQ ID NO: 824030 - DNA, 25 bp, Mus musculus
tcgccagggcaacacaggagatact

SEQ ID NO: 824031 - DNA, 25 bp, Mus musculus
tcgccagggcaagacaggagatact

SEQ ID NO: 824032 - DNA, 25 bp, Mus musculus
tcgccagggctaatcctatgggcat

SEQ ID NO: 824033 - DNA, 25 bp, Mus musculus
tcgccagggctattcctatgggcat

SEQ ID NO: 824034 - DNA, 25 bp, Mus musculus
tcgccagtagttcatttcgataaaa

SEQ ID NO: 824035 - DNA, 25 bp, Mus musculus
tcgccagtagttgatttcgataaaa

SEQ ID NO: 824036 - DNA, 25 bp, Mus musculus
tcgccagtcccacagaccagtttga

SEQ ID NO: 824037 - DNA, 25 bp, Mus musculus
tcgccagtcccagagaccagtttga

SEQ ID NO: 824038 - DNA, 25 bp, Mus musculus
tcgccagtgcaaacctacattatgg

SEQ ID NO: 824039 - DNA, 25 bp, Mus musculus
tcgccagtgcaatcctacattatgg

SEQ ID NO: 824040 - DNA, 25 bp, Mus musculus
tcgccagtttatatcctacaccaaa

SEQ ID NO: 824041 - DNA, 25 bp, Mus musculus
tcgccagtttatttcctacaccaaa

SEQ ID NO: 824042 - DNA, 25 bp, Mus musculus
tcgccatcaacaccctggagaagat

SEQ ID NO: 824043 - DNA, 25 bp, Mus musculus
tcgccatcaacagcctggagaagat

SEQ ID NO: 824044 - DNA, 25 bp, Mus musculus
tcgccatcaaccagacatgtccgaa

SEQ ID NO: 824045 - DNA, 25 bp, Mus musculus
tcgccatcaacctgacatgtccgaa

SEQ ID NO: 824046 - DNA, 25 bp, Mus musculus
tcgccatcactcaggatccatttta

SEQ ID NO: 824047 - DNA, 25 bp, Mus musculus
tcgccatcactctggatccatttta

SEQ ID NO: 824048 - DNA, 25 bp, Mus musculus
tcgccatcatctctgctcagcagaa

SEQ ID NO: 824049 - DNA, 25 bp, Mus musculus
tcgccatcatctgtgctcagcagaa

SEQ ID NO: 824050 - DNA, 25 bp, Mus musculus
tcgccatcgtcaagggactcagcaa

SEQ ID NO: 824051 - DNA, 25 bp, Mus musculus
tcgccatcgtcatgggactcagcaa

SEQ ID NO: 824052 - DNA, 25 bp, Mus musculus
tcgccatgtccgagataaggaagaa

SEQ ID NO: 824053 - DNA, 25 bp, Mus musculus
tcgccatgtccgtgataaggaagaa

SEQ ID NO: 824054 - DNA, 25 bp, Mus musculus
tcgccattcttaatattcccagcat

SEQ ID NO: 824055 - DNA, 25 bp, Mus musculus
tcgccattcttattattcccagcat

SEQ ID NO: 824056 - DNA, 25 bp, Mus musculus
tcgccattgaatattatgttctctt

SEQ ID NO: 824057 - DNA, 25 bp, Mus musculus
tcgccattgaattttatgttctctt

SEQ ID NO: 824058 - DNA, 25 bp, Mus musculus
tcgccatttgacctctaaagaacct

SEQ ID NO: 824059 - DNA, 25 bp, Mus musculus
tcgccatttgacgtctaaagaacct

SEQ ID NO: 824060 - DNA, 25 bp, Mus musculus
tcgcccaacaaaagatcagccttgc

SEQ ID NO: 824061 - DNA, 25 bp, Mus musculus
tcgcccaacaaatgatcagccttgc

SEQ ID NO: 824062 - DNA, 25 bp, Mus musculus
tcgcccaacattagcaaccaggagg

SEQ ID NO: 824063 - DNA, 25 bp, Mus musculus
tcgcccaacatttgcaaccaggagg

SEQ ID NO: 824064 - DNA, 25 bp, Mus musculus
tcgcccacagccaggcttttaaaag

SEQ ID NO: 824065 - DNA, 25 bp, Mus musculus
tcgcccacagcctggcttttaaaag

SEQ ID NO: 824066 - DNA, 25 bp, Mus musculus
tcgcccacatctctttctttgaata

SEQ ID NO: 824067 - DNA, 25 bp, Mus musculus
tcgcccacatctgtttctttgaata

SEQ ID NO: 824068 - DNA, 25 bp, Mus musculus
tcgcccagaaccaagggaaatgggt

SEQ ID NO: 824069 - DNA, 25 bp, Mus musculus
tcgcccagaacctagggaaatgggt

SEQ ID NO: 824070 - DNA, 25 bp, Mus musculus
tcgcccagagataacttgtgtgtgt

SEQ ID NO: 824071 - DNA, 25 bp, Mus musculus
tcgcccagagattacttgtgtgtgt

SEQ ID NO: 824072 - DNA, 25 bp, Mus musculus
tcgcccaggattacaaaaccgactt

SEQ ID NO: 824073 - DNA, 25 bp, Mus musculus
tcgcccaggatttcaaaaccgactt

SEQ ID NO: 824074 - DNA, 25 bp, Mus musculus
tcgcccagtattccagaagattgtt

SEQ ID NO: 824075 - DNA, 25 bp, Mus musculus
tcgcccagtattgcagaagattgtt

SEQ ID NO: 824076 - DNA, 25 bp, Mus musculus
tcgcccatgccaatttagaatgaaa

SEQ ID NO: 824077 - DNA, 25 bp, Mus musculus
tcgcccatgccattttagaatgaaa

SEQ ID NO: 824078 - DNA, 25 bp, Mus musculus
tcgcccattgcactccttgagtgga

SEQ ID NO: 824079 - DNA, 25 bp, Mus musculus
tcgcccattgcagtccttgagtgga

SEQ ID NO: 824080 - DNA, 25 bp, Mus musculus
tcgcccattttgattttgtgagagc

SEQ ID NO: 824081 - DNA, 25 bp, Mus musculus
tcgcccattttgtttttgtgagagc

SEQ ID NO: 824082 - DNA, 25 bp, Mus musculus
tcgccccagctgagaatgggacctc

SEQ ID NO: 824083 - DNA, 25 bp, Mus musculus
tcgccccagctgtgaatgggacctc

SEQ ID NO: 824084 - DNA, 25 bp, Mus musculus
tcgcccctaagacgctttattagaa

SEQ ID NO: 824085 - DNA, 25 bp, Mus musculus
tcgcccctaagaggctttattagaa

SEQ ID NO: 824086 - DNA, 25 bp, Mus musculus
tcgcccctgtatatcacgagatact

SEQ ID NO: 824087 - DNA, 25 bp, Mus musculus
tcgcccctgtatttcacgagatact

SEQ ID NO: 824088 - DNA, 25 bp, Mus musculus
tcgcccgagcctactctgagaagac

SEQ ID NO: 824089 - DNA, 25 bp, Mus musculus
tcgcccgagccttctctgagaagac

SEQ ID NO: 824090 - DNA, 25 bp, Mus musculus
tcgcccgagtccacactgttattaa

SEQ ID NO: 824091 - DNA, 25 bp, Mus musculus
tcgcccgagtcctcactgttattaa

SEQ ID NO: 824092 - DNA, 25 bp, Mus musculus
tcgcccggcttaaaactcattatgt

SEQ ID NO: 824093 - DNA, 25 bp, Mus musculus
tcgcccggcttataactcattatgt

SEQ ID NO: 824094 - DNA, 25 bp, Mus musculus
tcgcccgggatacactggagcagct

SEQ ID NO: 824095 - DNA, 25 bp, Mus musculus
tcgcccgggatagactggagcagct

SEQ ID NO: 824096 - DNA, 25 bp, Mus musculus
tcgccctaatttcatctatccaaga

SEQ ID NO: 824097 - DNA, 25 bp, Mus musculus
tcgccctaatttgatctatccaaga

SEQ ID NO: 824098 - DNA, 25 bp, Mus musculus
tcgccctcaaatcgcatgattccta

SEQ ID NO: 824099 - DNA, 25 bp, Mus musculus
tcgccctcaaatggcatgattccta

SEQ ID NO: 824100 - DNA, 25 bp, Mus musculus
tcgccctcccatagacttaagtaag

SEQ ID NO: 824101 - DNA, 25 bp, Mus musculus
tcgccctcccattgacttaagtaag

SEQ ID NO: 824102 - DNA, 25 bp, Mus musculus
tcgccctcctggcaacttgttaata

SEQ ID NO: 824103 - DNA, 25 bp, Mus musculus
tcgccctcctgggaacttgttaata

SEQ ID NO: 824104 - DNA, 25 bp, Mus musculus
tcgccctgtggaatgagattttata

SEQ ID NO: 824105 - DNA, 25 bp, Mus musculus
tcgccctgtggattgagattttata

SEQ ID NO: 824106 - DNA, 25 bp, Mus musculus
tcgcccttacacagacatttttatg

SEQ ID NO: 824107 - DNA, 25 bp, Mus musculus
tcgcccttacactgacatttttatg

SEQ ID NO: 824108 - DNA, 25 bp, Mus musculus
tcgcccttaccgagcatggtcttgt

SEQ ID NO: 824109 - DNA, 25 bp, Mus musculus
tcgcccttaccgtgcatggtcttgt

SEQ ID NO: 824110 - DNA, 25 bp, Mus musculus
tcgcccttctgccaggccaagtgga

SEQ ID NO: 824111 - DNA, 25 bp, Mus musculus
tcgcccttctgcgaggccaagtgga

SEQ ID NO: 824112 - DNA, 25 bp, Mus musculus
tcgcccttggtgacttactctggag

SEQ ID NO: 824113 - DNA, 25 bp, Mus musculus
tcgcccttggtgtcttactctggag

SEQ ID NO: 824114 - DNA, 25 bp, Mus musculus
tcgccgaaattgctggagccaaagt

SEQ ID NO: 824115 - DNA, 25 bp, Mus musculus
tcgccgaaattggtggagccaaagt

SEQ ID NO: 824116 - DNA, 25 bp, Mus musculus
tcgccgagcctgattctctgtgggt

SEQ ID NO: 824117 - DNA, 25 bp, Mus musculus
tcgccgagcctgtttctctgtgggt

SEQ ID NO: 824118 - DNA, 25 bp, Mus musculus
tcgccgaggattacaaagctgcctt

SEQ ID NO: 824119 - DNA, 25 bp, Mus musculus
tcgccgaggatttcaaagctgcctt

SEQ ID NO: 824120 - DNA, 25 bp, Mus musculus
tcgccgattgctataacccaagtta

SEQ ID NO: 824121 - DNA, 25 bp, Mus musculus
tcgccgattgctttaacccaagtta

SEQ ID NO: 824122 - DNA, 25 bp, Mus musculus
tcgccgcgtcgtcaggttcaaggac

SEQ ID NO: 824123 - DNA, 25 bp, Mus musculus
tcgccgcgtcgtgaggttcaaggac

SEQ ID NO: 824124 - DNA, 25 bp, Mus musculus
tcgccggcacccagatggagagtga

SEQ ID NO: 824125 - DNA, 25 bp, Mus musculus
tcgccggcaccctgatggagagtga

SEQ ID NO: 824126 - DNA, 25 bp, Mus musculus
tcgccgggcgtcagcaacttgtgcg

SEQ ID NO: 824127 - DNA, 25 bp, Mus musculus
tcgccgggcgtctgcaacttgtgcg

SEQ ID NO: 824128 - DNA, 25 bp, Mus musculus
tcgccgtgcacccaagagttcacag

SEQ ID NO: 824129 - DNA, 25 bp, Mus musculus
tcgccgtgcaccgaagagttcacag

SEQ ID NO: 824130 - DNA, 25 bp, Mus musculus
tcgccgtgttggcagggttcttata

SEQ ID NO: 824131 - DNA, 25 bp, Mus musculus
tcgccgtgttgggagggttcttata

SEQ ID NO: 824132 - DNA, 25 bp, Mus musculus
tcgccgttgatgacgaagtggccaa

SEQ ID NO: 824133 - DNA, 25 bp, Mus musculus
tcgccgttgatgtcgaagtggccaa

SEQ ID NO: 824134 - DNA, 25 bp, Mus musculus
tcgcctacctgtagtaagtttcatg

SEQ ID NO: 824135 - DNA, 25 bp, Mus musculus
tcgcctacctgttgtaagtttcatg

SEQ ID NO: 824136 - DNA, 25 bp, Mus musculus
tcgcctacgactcaggtaagagact

SEQ ID NO: 824137 - DNA, 25 bp, Mus musculus
tcgcctacgactgaggtaagagact

SEQ ID NO: 824138 - DNA, 25 bp, Mus musculus
tcgcctatgcaaaaaacggaacaat

SEQ ID NO: 824139 - DNA, 25 bp, Mus musculus
tcgcctatgcaataaacggaacaat

SEQ ID NO: 824140 - DNA, 25 bp, Mus musculus
tcgcctccagacaatattagacatt

SEQ ID NO: 824141 - DNA, 25 bp, Mus musculus
tcgcctccagactatattagacatt

SEQ ID NO: 824142 - DNA, 25 bp, Mus musculus
tcgcctcgcacactatgaacgtgta

SEQ ID NO: 824143 - DNA, 25 bp, Mus musculus
tcgcctcgcacagtatgaacgtgta

SEQ ID NO: 824144 - DNA, 25 bp, Mus musculus
tcgcctctacttagtaagcactcag

SEQ ID NO: 824145 - DNA, 25 bp, Mus musculus
tcgcctctactttgtaagcactcag

SEQ ID NO: 824146 - DNA, 25 bp, Mus musculus
tcgcctctgagtcgaaaccggaaat

SEQ ID NO: 824147 - DNA, 25 bp, Mus musculus
tcgcctctgagtggaaaccggaaat

SEQ ID NO: 824148 - DNA, 25 bp, Mus musculus
tcgcctctgattcgacgctagggat

SEQ ID NO: 824149 - DNA, 25 bp, Mus musculus
tcgcctctgattggacgctagggat

SEQ ID NO: 824150 - DNA, 25 bp, Mus musculus
tcgcctcttagcattttcacatggg

SEQ ID NO: 824151 - DNA, 25 bp, Mus musculus
tcgcctcttagctttttcacatggg

SEQ ID NO: 824152 - DNA, 25 bp, Mus musculus
tcgcctgagctcaagcttcaagagt

SEQ ID NO: 824153 - DNA, 25 bp, Mus musculus
tcgcctgagctctagcttcaagagt

SEQ ID NO: 824154 - DNA, 25 bp, Mus musculus
tcgcctgcaaatccgggacctaagt

SEQ ID NO: 824155 - DNA, 25 bp, Mus musculus
tcgcctgcaaatgcgggacctaagt

SEQ ID NO: 824156 - DNA, 25 bp, Mus musculus
tcgcctgcgacacttcaatgacagt

SEQ ID NO: 824157 - DNA, 25 bp, Mus musculus
tcgcctgcgacagttcaatgacagt

SEQ ID NO: 824158 - DNA, 25 bp, Mus musculus
tcgcctgctcgccagctgtgagatt

SEQ ID NO: 824159 - DNA, 25 bp, Mus musculus
tcgcctgctcgcgagctgtgagatt

SEQ ID NO: 824160 - DNA, 25 bp, Mus musculus
tcgcctgctggactttagccttcaa

SEQ ID NO: 824161 - DNA, 25 bp, Mus musculus
tcgcctgctggagtttagccttcaa

SEQ ID NO: 824162 - DNA, 25 bp, Mus musculus
tcgcctgctttcagggacccgggag

SEQ ID NO: 824163 - DNA, 25 bp, Mus musculus
tcgcctgctttctgggacccgggag

SEQ ID NO: 824164 - DNA, 25 bp, Mus musculus
tcgcctggaaaaaagtgcccaagct

SEQ ID NO: 824165 - DNA, 25 bp, Mus musculus
tcgcctggaaaatagtgcccaagct

SEQ ID NO: 824166 - DNA, 25 bp, Mus musculus
tcgcctggaccaattgtttaatccc

SEQ ID NO: 824167 - DNA, 25 bp, Mus musculus
tcgcctggaccatttgtttaatccc

SEQ ID NO: 824168 - DNA, 25 bp, Mus musculus
tcgcctggacctaaggttctttatg

SEQ ID NO: 824169 - DNA, 25 bp, Mus musculus
tcgcctggaccttaggttctttatg

SEQ ID NO: 824170 - DNA, 25 bp, Mus musculus
tcgcctggatgcaatgtttcgagct

SEQ ID NO: 824171 - DNA, 25 bp, Mus musculus
tcgcctggatgctatgtttcgagct

SEQ ID NO: 824172 - DNA, 25 bp, Mus musculus
tcgcctggcctaactaaagtctatt

SEQ ID NO: 824173 - DNA, 25 bp, Mus musculus
tcgcctggcctatctaaagtctatt

SEQ ID NO: 824174 - DNA, 25 bp, Mus musculus
tcgcctgggcccatagatctatcac

SEQ ID NO: 824175 - DNA, 25 bp, Mus musculus
tcgcctgggcccttagatctatcac

SEQ ID NO: 824176 - DNA, 25 bp, Mus musculus
tcgcctggtgtcaggagcatttatg

SEQ ID NO: 824177 - DNA, 25 bp, Mus musculus
tcgcctggtgtctggagcatttatg

SEQ ID NO: 824178 - DNA, 25 bp, Mus musculus
tcgcctggttgcaggtcccagcagg

SEQ ID NO: 824179 - DNA, 25 bp, Mus musculus
tcgcctggttgctggtcccagcagg

SEQ ID NO: 824180 - DNA, 25 bp, Mus musculus
tcgcctggttttctacaagtactgt

SEQ ID NO: 824181 - DNA, 25 bp, Mus musculus
tcgcctggttttgtacaagtactgt

SEQ ID NO: 824182 - DNA, 25 bp, Mus musculus
tcgcctgtacgaaagcactgtataa

SEQ ID NO: 824183 - DNA, 25 bp, Mus musculus
tcgcctgtacgatagcactgtataa

SEQ ID NO: 824184 - DNA, 25 bp, Mus musculus
tcgcctgtcattaccaggacatatc

SEQ ID NO: 824185 - DNA, 25 bp, Mus musculus
tcgcctgtcatttccaggacatatc

SEQ ID NO: 824186 - DNA, 25 bp, Mus musculus
tcgcctgtctgtacttggtagcatg

SEQ ID NO: 824187 - DNA, 25 bp, Mus musculus
tcgcctgtctgttcttggtagcatg

SEQ ID NO: 824188 - DNA, 25 bp, Mus musculus
tcgcctgtgctacgatgaccggtaa

SEQ ID NO: 824189 - DNA, 25 bp, Mus musculus
tcgcctgtgctaggatgaccggtaa

SEQ ID NO: 824190 - DNA, 25 bp, Mus musculus
tcgcctgtgtgactgcatctaaagc

SEQ ID NO: 824191 - DNA, 25 bp, Mus musculus
tcgcctgtgtgagtgcatctaaagc

SEQ ID NO: 824192 - DNA, 25 bp, Mus musculus
tcgccttccctgaagatggcactag

SEQ ID NO: 824193 - DNA, 25 bp, Mus musculus
tcgccttccctgtagatggcactag

SEQ ID NO: 824194 - DNA, 25 bp, Mus musculus
tcgccttccgcaaaactgtgagcaa

SEQ ID NO: 824195 - DNA, 25 bp, Mus musculus
tcgccttccgcataactgtgagcaa

SEQ ID NO: 824196 - DNA, 25 bp, Mus musculus
tcgccttcctacacactgaaattca

SEQ ID NO: 824197 - DNA, 25 bp, Mus musculus
tcgccttcctactcactgaaattca

SEQ ID NO: 824198 - DNA, 25 bp, Mus musculus
tcgccttcctttagaatgccaatga

SEQ ID NO: 824199 - DNA, 25 bp, Mus musculus
tcgccttccttttgaatgccaatga

SEQ ID NO: 824200 - DNA, 25 bp, Mus musculus
tcgccttgatttacctccatatgaa

SEQ ID NO: 824201 - DNA, 25 bp, Mus musculus
tcgccttgattttcctccatatgaa

SEQ ID NO: 824202 - DNA, 25 bp, Mus musculus
tcgccttgcactatctggaaaactt

SEQ ID NO: 824203 - DNA, 25 bp, Mus musculus
tcgccttgcactttctggaaaactt

SEQ ID NO: 824204 - DNA, 25 bp, Mus musculus
tcgccttggatcagttctccataat

SEQ ID NO: 824205 - DNA, 25 bp, Mus musculus
tcgccttggatctgttctccataat

SEQ ID NO: 824206 - DNA, 25 bp, Mus musculus
tcgccttgtgtcaccaaatgtatgg

SEQ ID NO: 824207 - DNA, 25 bp, Mus musculus
tcgccttgtgtctccaaatgtatgg

SEQ ID NO: 824208 - DNA, 25 bp, Mus musculus
tcgcctttcaagcttgtgagctaca

SEQ ID NO: 824209 - DNA, 25 bp, Mus musculus
tcgcctttcaaggttgtgagctaca

SEQ ID NO: 824210 - DNA, 25 bp, Mus musculus
tcgcctttccagacgagttcgtggt

SEQ ID NO: 824211 - DNA, 25 bp, Mus musculus
tcgcctttccagtcgagttcgtggt

SEQ ID NO: 824212 - DNA, 25 bp, Mus musculus
tcgcctttgccaacatgccttaaaa

SEQ ID NO: 824213 - DNA, 25 bp, Mus musculus
tcgcctttgccatcatgccttaaaa

SEQ ID NO: 824214 - DNA, 25 bp, Mus musculus
tcgccttttaatctagccatcggga

SEQ ID NO: 824215 - DNA, 25 bp, Mus musculus
tcgccttttaatgtagccatcggga

SEQ ID NO: 824216 - DNA, 25 bp, Mus musculus
tcgccttttcaactttctagggtgt

SEQ ID NO: 824217 - DNA, 25 bp, Mus musculus
tcgccttttcaagtttctagggtgt

SEQ ID NO: 824218 - DNA, 25 bp, Mus musculus
tcgccttttccgcgttgcgaggttg

SEQ ID NO: 824219 - DNA, 25 bp, Mus musculus
tcgccttttccgggttgcgaggttg

SEQ ID NO: 824220 - DNA, 25 bp, Mus musculus
tcgcgaagagtgagcacccttctca

SEQ ID NO: 824221 - DNA, 25 bp, Mus musculus
tcgcgaagagtgtgcacccttctca

SEQ ID NO: 824222 - DNA, 25 bp, Mus musculus
tcgcgacttgcgaatcaccgagaag

SEQ ID NO: 824223 - DNA, 25 bp, Mus musculus
tcgcgacttgcgtatcaccgagaag

SEQ ID NO: 824224 - DNA, 25 bp, Mus musculus
tcgcgagaaacgagctttataataa

SEQ ID NO: 824225 - DNA, 25 bp, Mus musculus
tcgcgagaaacgtgctttataataa

SEQ ID NO: 824226 - DNA, 25 bp, Mus musculus
tcgcgagcgctcacattatgcatga

SEQ ID NO: 824227 - DNA, 25 bp, Mus musculus
tcgcgagcgctctcattatgcatga

SEQ ID NO: 824228 - DNA, 25 bp, Mus musculus
tcgcgattgcgcacattcgcaggac

SEQ ID NO: 824229 - DNA, 25 bp, Mus musculus
tcgcgattgcgctcattcgcaggac

SEQ ID NO: 824230 - DNA, 25 bp, Mus musculus
tcgcgatttatgaagccggcctggc

SEQ ID NO: 824231 - DNA, 25 bp, Mus musculus
tcgcgatttatgtagccggcctggc

SEQ ID NO: 824232 - DNA, 25 bp, Mus musculus
tcgcgcagacacactggacgagtac

SEQ ID NO: 824233 - DNA, 25 bp, Mus musculus
tcgcgcagacactctggacgagtac

SEQ ID NO: 824234 - DNA, 25 bp, Mus musculus
tcgcgcatggaacaggtggattaaa

SEQ ID NO: 824235 - DNA, 25 bp, Mus musculus
tcgcgcatggaagaggtggattaaa

SEQ ID NO: 824236 - DNA, 25 bp, Mus musculus
tcgcgccatgagacagacctgatat

SEQ ID NO: 824237 - DNA, 25 bp, Mus musculus
tcgcgccatgagtcagacctgatat

SEQ ID NO: 824238 - DNA, 25 bp, Mus musculus
tcgcgctacaaaaccgggctggaag

SEQ ID NO: 824239 - DNA, 25 bp, Mus musculus
tcgcgctacaaatccgggctggaag

SEQ ID NO: 824240 - DNA, 25 bp, Mus musculus
tcgcgctacgtcattgcatccgctc

SEQ ID NO: 824241 - DNA, 25 bp, Mus musculus
tcgcgctacgtctttgcatccgctc

SEQ ID NO: 824242 - DNA, 25 bp, Mus musculus
tcgcgctagtggcatccttctcatg

SEQ ID NO: 824243 - DNA, 25 bp, Mus musculus
tcgcgctagtgggatccttctcatg

SEQ ID NO: 824244 - DNA, 25 bp, Mus musculus
tcgcgctcaagtcttatctcaacaa

SEQ ID NO: 824245 - DNA, 25 bp, Mus musculus
tcgcgctcaagtgttatctcaacaa

SEQ ID NO: 824246 - DNA, 25 bp, Mus musculus
tcgcgctcctatacggagctcaagg

SEQ ID NO: 824247 - DNA, 25 bp, Mus musculus
tcgcgctcctattcggagctcaagg

SEQ ID NO: 824248 - DNA, 25 bp, Mus musculus
tcgcggagctcgcaggacactaagc

SEQ ID NO: 824249 - DNA, 25 bp, Mus musculus
tcgcggagctcggaggacactaagc

SEQ ID NO: 824250 - DNA, 25 bp, Mus musculus
tcgcggagctgaacccgtaagtgcc

SEQ ID NO: 824251 - DNA, 25 bp, Mus musculus
tcgcggagctgatcccgtaagtgcc

SEQ ID NO: 824252 - DNA, 25 bp, Mus musculus
tcgcggcagttaccgttgggacggg

SEQ ID NO: 824253 - DNA, 25 bp, Mus musculus
tcgcggcagttagcgttgggacggg

SEQ ID NO: 824254 - DNA, 25 bp, Mus musculus
tcgcggcctcaaagtcacaccagta

SEQ ID NO: 824255 - DNA, 25 bp, Mus musculus
tcgcggcctcaatgtcacaccagta

SEQ ID NO: 824256 - DNA, 25 bp, Mus musculus
tcgcggctgccaagtacaagctgaa

SEQ ID NO: 824257 - DNA, 25 bp, Mus musculus
tcgcggctgccatgtacaagctgaa

SEQ ID NO: 824258 - DNA, 25 bp, Mus musculus
tcgcgggcctccaaaaaggttcata

SEQ ID NO: 824259 - DNA, 25 bp, Mus musculus
tcgcgggcctcctaaaaggttcata

SEQ ID NO: 824260 - DNA, 25 bp, Mus musculus
tcgcgggtgggcagattgttaaaac

SEQ ID NO: 824261 - DNA, 25 bp, Mus musculus
tcgcgggtgggctgattgttaaaac

SEQ ID NO: 824262 - DNA, 25 bp, Mus musculus
tcgcggtgtcgtctctgcagcagtc

SEQ ID NO: 824263 - DNA, 25 bp, Mus musculus
tcgcggtgtcgtgtctgcagcagtc

SEQ ID NO: 824264 - DNA, 25 bp, Mus musculus
tcgcggttccagacgatgcatttct

SEQ ID NO: 824265 - DNA, 25 bp, Mus musculus
tcgcggttccagtcgatgcatttct

SEQ ID NO: 824266 - DNA, 25 bp, Mus musculus
tcgcgtccacacacatacagcttcc

SEQ ID NO: 824267 - DNA, 25 bp, Mus musculus
tcgcgtccacactcatacagcttcc

SEQ ID NO: 824268 - DNA, 25 bp, Mus musculus
tcgcgtcgctcacttcagcagtgta

SEQ ID NO: 824269 - DNA, 25 bp, Mus musculus
tcgcgtcgctcagttcagcagtgta

SEQ ID NO: 824270 - DNA, 25 bp, Mus musculus
tcgcgtgacaataatcatgtaacat

SEQ ID NO: 824271 - DNA, 25 bp, Mus musculus
tcgcgtgacaattatcatgtaacat

SEQ ID NO: 824272 - DNA, 25 bp, Mus musculus
tcgcgtgcctccacagggtcaggaa

SEQ ID NO: 824273 - DNA, 25 bp, Mus musculus
tcgcgtgcctcctcagggtcaggaa

SEQ ID NO: 824274 - DNA, 25 bp, Mus musculus
tcgcgtgtgattactgagatgcctc

SEQ ID NO: 824275 - DNA, 25 bp, Mus musculus
tcgcgtgtgatttctgagatgcctc

SEQ ID NO: 824276 - DNA, 25 bp, Mus musculus
tcgcgttctctcacaccgaaaaaag

SEQ ID NO: 824277 - DNA, 25 bp, Mus musculus
tcgcgttctctctcaccgaaaaaag

SEQ ID NO: 824278 - DNA, 25 bp, Mus musculus
tcgcgtttacaacttctgtgcccag

SEQ ID NO: 824279 - DNA, 25 bp, Mus musculus
tcgcgtttacaagttctgtgcccag

SEQ ID NO: 824280 - DNA, 25 bp, Mus musculus
tcgcgtttccggattgatgatccct

SEQ ID NO: 824281 - DNA, 25 bp, Mus musculus
tcgcgtttccggtttgatgatccct

SEQ ID NO: 824282 - DNA, 25 bp, Mus musculus
tcgcgtttctcccatatttaaaatt

SEQ ID NO: 824283 - DNA, 25 bp, Mus musculus
tcgcgtttctccgatatttaaaatt

SEQ ID NO: 824284 - DNA, 25 bp, Mus musculus
tcgcgtttgcagcttattcacctac

SEQ ID NO: 824285 - DNA, 25 bp, Mus musculus
tcgcgtttgcaggttattcacctac

SEQ ID NO: 824286 - DNA, 25 bp, Mus musculus
tcgcgttttctgaaccttgtgatga

SEQ ID NO: 824287 - DNA, 25 bp, Mus musculus
tcgcgttttctgtaccttgtgatga

SEQ ID NO: 824288 - DNA, 25 bp, Mus musculus
tcgctaaccatcatcttgattccaa

SEQ ID NO: 824289 - DNA, 25 bp, Mus musculus
tcgctaaccatcttcttgattccaa

SEQ ID NO: 824290 - DNA, 25 bp, Mus musculus
tcgctaagagcacgcatgcacagct

SEQ ID NO: 824291 - DNA, 25 bp, Mus musculus
tcgctaagagcaggcatgcacagct

SEQ ID NO: 824292 - DNA, 25 bp, Mus musculus
tcgctaagcacaagacagactagtt

SEQ ID NO: 824293 - DNA, 25 bp, Mus musculus
tcgctaagcacatgacagactagtt

SEQ ID NO: 824294 - DNA, 25 bp, Mus musculus
tcgctacacttcctacctagaggga

SEQ ID NO: 824295 - DNA, 25 bp, Mus musculus
tcgctacacttcgtacctagaggga

SEQ ID NO: 824296 - DNA, 25 bp, Mus musculus
tcgctaccagttacaaatattgtgt

SEQ ID NO: 824297 - DNA, 25 bp, Mus musculus
tcgctaccagtttcaaatattgtgt

SEQ ID NO: 824298 - DNA, 25 bp, Mus musculus
tcgctactctgtacttcgatgaagt

SEQ ID NO: 824299 - DNA, 25 bp, Mus musculus
tcgctactctgttcttcgatgaagt

SEQ ID NO: 824300 - DNA, 25 bp, Mus musculus
tcgctagctgaaaggttgcttatat

SEQ ID NO: 824301 - DNA, 25 bp, Mus musculus
tcgctagctgaatggttgcttatat

SEQ ID NO: 824302 - DNA, 25 bp, Mus musculus
tcgctaggcgtcaatctacaggagg

SEQ ID NO: 824303 - DNA, 25 bp, Mus musculus
tcgctaggcgtctatctacaggagg

SEQ ID NO: 824304 - DNA, 25 bp, Mus musculus
tcgctataccttagcaccgtgggag

SEQ ID NO: 824305 - DNA, 25 bp, Mus musculus
tcgctatacctttgcaccgtgggag

SEQ ID NO: 824306 - DNA, 25 bp, Mus musculus
tcgctatgaggtcgcggtgccactc

SEQ ID NO: 824307 - DNA, 25 bp, Mus musculus
tcgctatgaggtggcggtgccactc

SEQ ID NO: 824308 - DNA, 25 bp, Mus musculus
tcgctatgatccagctcagccaagg

SEQ ID NO: 824309 - DNA, 25 bp, Mus musculus
tcgctatgatcctgctcagccaagg

SEQ ID NO: 824310 - DNA, 25 bp, Mus musculus
tcgctatgcctacagtacctatcgc

SEQ ID NO: 824311 - DNA, 25 bp, Mus musculus
tcgctatgcctagagtacctatcgc

SEQ ID NO: 824312 - DNA, 25 bp, Mus musculus
tcgctatgtcagaaagcacacttgt

SEQ ID NO: 824313 - DNA, 25 bp, Mus musculus
tcgctatgtcagtaagcacacttgt

SEQ ID NO: 824314 - DNA, 25 bp, Mus musculus
tcgctattgcgaccacgaccagagg

SEQ ID NO: 824315 - DNA, 25 bp, Mus musculus
tcgctattgcgagcacgaccagagg

SEQ ID NO: 824316 - DNA, 25 bp, Mus musculus
tcgctcaatgagatcaatcctatgg

SEQ ID NO: 824317 - DNA, 25 bp, Mus musculus
tcgctcaatgagttcaatcctatgg

SEQ ID NO: 824318 - DNA, 25 bp, Mus musculus
tcgctcacacacacatcgtaaatgg

SEQ ID NO: 824319 - DNA, 25 bp, Mus musculus
tcgctcacacactcatcgtaaatgg

SEQ ID NO: 824320 - DNA, 25 bp, Mus musculus
tcgctcactgccagattaatctaca

SEQ ID NO: 824321 - DNA, 25 bp, Mus musculus
tcgctcactgcctgattaatctaca

SEQ ID NO: 824322 - DNA, 25 bp, Mus musculus
tcgctcactgttctccgctaggtgg

SEQ ID NO: 824323 - DNA, 25 bp, Mus musculus
tcgctcactgttgtccgctaggtgg

SEQ ID NO: 824324 - DNA, 25 bp, Mus musculus
tcgctcagaagcacggctaccgaaa

SEQ ID NO: 824325 - DNA, 25 bp, Mus musculus
tcgctcagaagctcggctaccgaaa

SEQ ID NO: 824326 - DNA, 25 bp, Mus musculus
tcgctcagcagcacctgttaccaag

SEQ ID NO: 824327 - DNA, 25 bp, Mus musculus
tcgctcagcagctcctgttaccaag

SEQ ID NO: 824328 - DNA, 25 bp, Mus musculus
tcgctcagtggaaaagctcacgcct

SEQ ID NO: 824329 - DNA, 25 bp, Mus musculus
tcgctcagtggataagctcacgcct

SEQ ID NO: 824330 - DNA, 25 bp, Mus musculus
tcgctcatagtacgagctgaaatcc

SEQ ID NO: 824331 - DNA, 25 bp, Mus musculus
tcgctcatagtaggagctgaaatcc

SEQ ID NO: 824332 - DNA, 25 bp, Mus musculus
tcgctcatttggaatttattgcaaa

SEQ ID NO: 824333 - DNA, 25 bp, Mus musculus
tcgctcatttggtatttattgcaaa

SEQ ID NO: 824334 - DNA, 25 bp, Mus musculus
tcgctccacatgctagagcgtggct

SEQ ID NO: 824335 - DNA, 25 bp, Mus musculus
tcgctccacatggtagagcgtggct

SEQ ID NO: 824336 - DNA, 25 bp, Mus musculus
tcgctccactaccagttttatgtct

SEQ ID NO: 824337 - DNA, 25 bp, Mus musculus
tcgctccactacgagttttatgtct

SEQ ID NO: 824338 - DNA, 25 bp, Mus musculus
tcgctcccataccatgacaagctgg

SEQ ID NO: 824339 - DNA, 25 bp, Mus musculus
tcgctcccatacgatgacaagctgg

SEQ ID NO: 824340 - DNA, 25 bp, Mus musculus
tcgctccctcctaaaggacataagt

SEQ ID NO: 824341 - DNA, 25 bp, Mus musculus
tcgctccctccttaaggacataagt

SEQ ID NO: 824342 - DNA, 25 bp, Mus musculus
tcgctccggttactttacagcaagt

SEQ ID NO: 824343 - DNA, 25 bp, Mus musculus
tcgctccggttagtttacagcaagt

SEQ ID NO: 824344 - DNA, 25 bp, Mus musculus
tcgctcctactcaagctgtttggaa

SEQ ID NO: 824345 - DNA, 25 bp, Mus musculus
tcgctcctactctagctgtttggaa

SEQ ID NO: 824346 - DNA, 25 bp, Mus musculus
tcgctcctcttgatgtgttttgcct

SEQ ID NO: 824347 - DNA, 25 bp, Mus musculus
tcgctcctcttgttgtgttttgcct

SEQ ID NO: 824348 - DNA, 25 bp, Mus musculus
tcgctcctgactccagttctataaa

SEQ ID NO: 824349 - DNA, 25 bp, Mus musculus
tcgctcctgactgcagttctataaa

SEQ ID NO: 824350 - DNA, 25 bp, Mus musculus
tcgctcctggagcagttaaggcctt

SEQ ID NO: 824351 - DNA, 25 bp, Mus musculus
tcgctcctggaggagttaaggcctt

SEQ ID NO: 824352 - DNA, 25 bp, Mus musculus
tcgctcctttgacaggtcccataaa

SEQ ID NO: 824353 - DNA, 25 bp, Mus musculus
tcgctcctttgagaggtcccataaa

SEQ ID NO: 824354 - DNA, 25 bp, Mus musculus
tcgctcgagctacgagttgtgtcgt

SEQ ID NO: 824355 - DNA, 25 bp, Mus musculus
tcgctcgagctaggagttgtgtcgt

SEQ ID NO: 824356 - DNA, 25 bp, Mus musculus
tcgctcgccctgaattaggagtggt

SEQ ID NO: 824357 - DNA, 25 bp, Mus musculus
tcgctcgccctgtattaggagtggt

SEQ ID NO: 824358 - DNA, 25 bp, Mus musculus
tcgctcgctcagctgcactctatgg

SEQ ID NO: 824359 - DNA, 25 bp, Mus musculus
tcgctcgctcaggtgcactctatgg

SEQ ID NO: 824360 - DNA, 25 bp, Mus musculus
tcgctcggcattactccagaggaag

SEQ ID NO: 824361 - DNA, 25 bp, Mus musculus
tcgctcggcatttctccagaggaag

SEQ ID NO: 824362 - DNA, 25 bp, Mus musculus
tcgctcgtggtgatgctcctgcaga

SEQ ID NO: 824363 - DNA, 25 bp, Mus musculus
tcgctcgtggtgttgctcctgcaga

SEQ ID NO: 824364 - DNA, 25 bp, Mus musculus
tcgctcgtttttaacttcacaaata

SEQ ID NO: 824365 - DNA, 25 bp, Mus musculus
tcgctcgttttttacttcacaaata

SEQ ID NO: 824366 - DNA, 25 bp, Mus musculus
tcgctctcaatcactcttttcacct

SEQ ID NO: 824367 - DNA, 25 bp, Mus musculus
tcgctctcaatctctcttttcacct

SEQ ID NO: 824368 - DNA, 25 bp, Mus musculus
tcgctctcaggtactcatcaggaac

SEQ ID NO: 824369 - DNA, 25 bp, Mus musculus
tcgctctcaggttctcatcaggaac

SEQ ID NO: 824370 - DNA, 25 bp, Mus musculus
tcgctctccagaatccagtcagagt

SEQ ID NO: 824371 - DNA, 25 bp, Mus musculus
tcgctctccagattccagtcagagt

SEQ ID NO: 824372 - DNA, 25 bp, Mus musculus
tcgctctcgtctaaaggactcttaa

SEQ ID NO: 824373 - DNA, 25 bp, Mus musculus
tcgctctcgtcttaaggactcttaa

SEQ ID NO: 824374 - DNA, 25 bp, Mus musculus
tcgctctctctcacagagattgaga

SEQ ID NO: 824375 - DNA, 25 bp, Mus musculus
tcgctctctctctcagagattgaga

SEQ ID NO: 824376 - DNA, 25 bp, Mus musculus
tcgctctctcttatttgtacttgtg

SEQ ID NO: 824377 - DNA, 25 bp, Mus musculus
tcgctctctcttttttgtacttgtg

SEQ ID NO: 824378 - DNA, 25 bp, Mus musculus
tcgctctctgctcagggactgccag

SEQ ID NO: 824379 - DNA, 25 bp, Mus musculus
tcgctctctgctgagggactgccag

SEQ ID NO: 824380 - DNA, 25 bp, Mus musculus
tcgctctgctggacgtagctcttgg

SEQ ID NO: 824381 - DNA, 25 bp, Mus musculus
tcgctctgctggtcgtagctcttgg

SEQ ID NO: 824382 - DNA, 25 bp, Mus musculus
tcgctctgtggacgcctgtaaatta

SEQ ID NO: 824383 - DNA, 25 bp, Mus musculus
tcgctctgtggaggcctgtaaatta

SEQ ID NO: 824384 - DNA, 25 bp, Mus musculus
tcgctcttccaaaaggtctctctgt

SEQ ID NO: 824385 - DNA, 25 bp, Mus musculus
tcgctcttccaataggtctctctgt

SEQ ID NO: 824386 - DNA, 25 bp, Mus musculus
tcgctgaaggctaacctgctggtaa

SEQ ID NO: 824387 - DNA, 25 bp, Mus musculus
tcgctgaaggcttacctgctggtaa

SEQ ID NO: 824388 - DNA, 25 bp, Mus musculus
tcgctgaatcctattatcttttgtg

SEQ ID NO: 824389 - DNA, 25 bp, Mus musculus
tcgctgaatccttttatcttttgtg

SEQ ID NO: 824390 - DNA, 25 bp, Mus musculus
tcgctgacccaacatgctgcaaaga

SEQ ID NO: 824391 - DNA, 25 bp, Mus musculus
tcgctgacccaagatgctgcaaaga

SEQ ID NO: 824392 - DNA, 25 bp, Mus musculus
tcgctgacggacaggtgtttctgcc

SEQ ID NO: 824393 - DNA, 25 bp, Mus musculus
tcgctgacggactggtgtttctgcc

SEQ ID NO: 824394 - DNA, 25 bp, Mus musculus
tcgctgagagacattataaatccat

SEQ ID NO: 824395 - DNA, 25 bp, Mus musculus
tcgctgagagactttataaatccat

SEQ ID NO: 824396 - DNA, 25 bp, Mus musculus
tcgctgagcgaacggcatgacctca

SEQ ID NO: 824397 - DNA, 25 bp, Mus musculus
tcgctgagcgaagggcatgacctca

SEQ ID NO: 824398 - DNA, 25 bp, Mus musculus
tcgctgagtgcgagctctttatcct

SEQ ID NO: 824399 - DNA, 25 bp, Mus musculus
tcgctgagtgcgtgctctttatcct

SEQ ID NO: 824400 - DNA, 25 bp, Mus musculus
tcgctgatccttctgaccagatgag

SEQ ID NO: 824401 - DNA, 25 bp, Mus musculus
tcgctgatccttgtgaccagatgag

SEQ ID NO: 824402 - DNA, 25 bp, Mus musculus
tcgctgatgcgaagaagaacccgga

SEQ ID NO: 824403 - DNA, 25 bp, Mus musculus
tcgctgatgcgatgaagaacccgga

SEQ ID NO: 824404 - DNA, 25 bp, Mus musculus
tcgctgatgctcagtgatacacgct

SEQ ID NO: 824405 - DNA, 25 bp, Mus musculus
tcgctgatgctctgtgatacacgct

SEQ ID NO: 824406 - DNA, 25 bp, Mus musculus
tcgctgatggacactctctttaaaa

SEQ ID NO: 824407 - DNA, 25 bp, Mus musculus
tcgctgatggactctctctttaaaa

SEQ ID NO: 824408 - DNA, 25 bp, Mus musculus
tcgctgatgttgcttattaaagtag

SEQ ID NO: 824409 - DNA, 25 bp, Mus musculus
tcgctgatgttggttattaaagtag

SEQ ID NO: 824410 - DNA, 25 bp, Mus musculus
tcgctgcctagcactaatcaatgaa

SEQ ID NO: 824411 - DNA, 25 bp, Mus musculus
tcgctgcctagctctaatcaatgaa

SEQ ID NO: 824412 - DNA, 25 bp, Mus musculus
tcgctgcgagctcttatttcatttg

SEQ ID NO: 824413 - DNA, 25 bp, Mus musculus
tcgctgcgagctgttatttcatttg

SEQ ID NO: 824414 - DNA, 25 bp, Mus musculus
tcgctgcgcttgaaggcttcgggaa

SEQ ID NO: 824415 - DNA, 25 bp, Mus musculus
tcgctgcgcttgtaggcttcgggaa

SEQ ID NO: 824416 - DNA, 25 bp, Mus musculus
tcgctgctactgaccggatgtgagt

SEQ ID NO: 824417 - DNA, 25 bp, Mus musculus
tcgctgctactgtccggatgtgagt

SEQ ID NO: 824418 - DNA, 25 bp, Mus musculus
tcgctgctcctccaggaaagggtga

SEQ ID NO: 824419 - DNA, 25 bp, Mus musculus
tcgctgctcctcgaggaaagggtga

SEQ ID NO: 824420 - DNA, 25 bp, Mus musculus
tcgctgcttccaacctggcagtggg

SEQ ID NO: 824421 - DNA, 25 bp, Mus musculus
tcgctgcttccatcctggcagtggg

SEQ ID NO: 824422 - DNA, 25 bp, Mus musculus
tcgctgcttgttctgtactgttata

SEQ ID NO: 824423 - DNA, 25 bp, Mus musculus
tcgctgcttgttgtgtactgttata

SEQ ID NO: 824424 - DNA, 25 bp, Mus musculus
tcgctggaccttctatgtgtgcaca

SEQ ID NO: 824425 - DNA, 25 bp, Mus musculus
tcgctggaccttgtatgtgtgcaca

SEQ ID NO: 824426 - DNA, 25 bp, Mus musculus
tcgctggcagaacgctccctaggga

SEQ ID NO: 824427 - DNA, 25 bp, Mus musculus
tcgctggcagaaggctccctaggga

SEQ ID NO: 824428 - DNA, 25 bp, Mus musculus
tcgctggcccgaagatctttgctgc

SEQ ID NO: 824429 - DNA, 25 bp, Mus musculus
tcgctggcccgatgatctttgctgc

SEQ ID NO: 824430 - DNA, 25 bp, Mus musculus
tcgctggctctgcaggctgaattca

SEQ ID NO: 824431 - DNA, 25 bp, Mus musculus
tcgctggctctggaggctgaattca

SEQ ID NO: 824432 - DNA, 25 bp, Mus musculus
tcgctggcttccaactgactatgaa

SEQ ID NO: 824433 - DNA, 25 bp, Mus musculus
tcgctggcttcctactgactatgaa

SEQ ID NO: 824434 - DNA, 25 bp, Mus musculus
tcgctggcttttacaccttcgccaa

SEQ ID NO: 824435 - DNA, 25 bp, Mus musculus
tcgctggctttttcaccttcgccaa

SEQ ID NO: 824436 - DNA, 25 bp, Mus musculus
tcgctggttttgacacattcaacat

SEQ ID NO: 824437 - DNA, 25 bp, Mus musculus
tcgctggttttgtcacattcaacat

SEQ ID NO: 824438 - DNA, 25 bp, Mus musculus
tcgctgtaactcctgttgttggtag

SEQ ID NO: 824439 - DNA, 25 bp, Mus musculus
tcgctgtaactcgtgttgttggtag

SEQ ID NO: 824440 - DNA, 25 bp, Mus musculus
tcgctgtcagttcattgtggctcct

SEQ ID NO: 824441 - DNA, 25 bp, Mus musculus
tcgctgtcagttgattgtggctcct

SEQ ID NO: 824442 - DNA, 25 bp, Mus musculus
tcgctgtccatgctttctgagtgtc

SEQ ID NO: 824443 - DNA, 25 bp, Mus musculus
tcgctgtccatggtttctgagtgtc

SEQ ID NO: 824444 - DNA, 25 bp, Mus musculus
tcgctgtgcactcttctgacatggg

SEQ ID NO: 824445 - DNA, 25 bp, Mus musculus
tcgctgtgcactgttctgacatggg

SEQ ID NO: 824446 - DNA, 25 bp, Mus musculus
tcgctgtgcttactcccagcaggga

SEQ ID NO: 824447 - DNA, 25 bp, Mus musculus
tcgctgtgcttagtcccagcaggga

SEQ ID NO: 824448 - DNA, 25 bp, Mus musculus
tcgctgtggctgagtgtcatgagaa

SEQ ID NO: 824449 - DNA, 25 bp, Mus musculus
tcgctgtggctgtgtgtcatgagaa

SEQ ID NO: 824450 - DNA, 25 bp, Mus musculus
tcgctgtggtccacatgctggcctt

SEQ ID NO: 824451 - DNA, 25 bp, Mus musculus
tcgctgtggtcctcatgctggcctt

SEQ ID NO: 824452 - DNA, 25 bp, Mus musculus
tcgctgttcacccagtagtctaaga

SEQ ID NO: 824453 - DNA, 25 bp, Mus musculus
tcgctgttcaccgagtagtctaaga

SEQ ID NO: 824454 - DNA, 25 bp, Mus musculus
tcgctgttggccacgtgaagatgac

SEQ ID NO: 824455 - DNA, 25 bp, Mus musculus
tcgctgttggcctcgtgaagatgac

SEQ ID NO: 824456 - DNA, 25 bp, Mus musculus
tcgctgttggttataagaatttcct

SEQ ID NO: 824457 - DNA, 25 bp, Mus musculus
tcgctgttggttttaagaatttcct

SEQ ID NO: 824458 - DNA, 25 bp, Mus musculus
tcgctgttttctccatttctttcaa

SEQ ID NO: 824459 - DNA, 25 bp, Mus musculus
tcgctgttttctgcatttctttcaa

SEQ ID NO: 824460 - DNA, 25 bp, Mus musculus
tcgcttactactcccaaccttgtgg

SEQ ID NO: 824461 - DNA, 25 bp, Mus musculus
tcgcttactactgccaaccttgtgg

SEQ ID NO: 824462 - DNA, 25 bp, Mus musculus
tcgcttattgggattaatattgttc

SEQ ID NO: 824463 - DNA, 25 bp, Mus musculus
tcgcttattgggtttaatattgttc

SEQ ID NO: 824464 - DNA, 25 bp, Mus musculus
tcgcttcaagctctggtacacagtg

SEQ ID NO: 824465 - DNA, 25 bp, Mus musculus
tcgcttcaagctgtggtacacagtg

SEQ ID NO: 824466 - DNA, 25 bp, Mus musculus
tcgcttcagggcaggactaataata

SEQ ID NO: 824467 - DNA, 25 bp, Mus musculus
tcgcttcagggctggactaataata

SEQ ID NO: 824468 - DNA, 25 bp, Mus musculus
tcgcttcatctgaaagcagtgtggc

SEQ ID NO: 824469 - DNA, 25 bp, Mus musculus
tcgcttcatctgtaagcagtgtggc

SEQ ID NO: 824470 - DNA, 25 bp, Mus musculus
tcgcttccaacacctcgggagggct

SEQ ID NO: 824471 - DNA, 25 bp, Mus musculus
tcgcttccaacagctcgggagggct

SEQ ID NO: 824472 - DNA, 25 bp, Mus musculus
tcgcttcccatcacagaaaggcctg

SEQ ID NO: 824473 - DNA, 25 bp, Mus musculus
tcgcttcccatctcagaaaggcctg

SEQ ID NO: 824474 - DNA, 25 bp, Mus musculus
tcgcttcccttactaaactgagctg

SEQ ID NO: 824475 - DNA, 25 bp, Mus musculus
tcgcttcccttagtaaactgagctg

SEQ ID NO: 824476 - DNA, 25 bp, Mus musculus
tcgcttccggaaaaacttccaggct

SEQ ID NO: 824477 - DNA, 25 bp, Mus musculus
tcgcttccggaataacttccaggct

SEQ ID NO: 824478 - DNA, 25 bp, Mus musculus
tcgcttctccggctccaaagatacg

SEQ ID NO: 824479 - DNA, 25 bp, Mus musculus
tcgcttctccgggtccaaagatacg

SEQ ID NO: 824480 - DNA, 25 bp, Mus musculus
tcgcttctctacaaactcagttatc

SEQ ID NO: 824481 - DNA, 25 bp, Mus musculus
tcgcttctctactaactcagttatc

SEQ ID NO: 824482 - DNA, 25 bp, Mus musculus
tcgcttctgccgatgtcacagctgt

SEQ ID NO: 824483 - DNA, 25 bp, Mus musculus
tcgcttctgccgttgtcacagctgt

SEQ ID NO: 824484 - DNA, 25 bp, Mus musculus
tcgcttctggatattggattcccac

SEQ ID NO: 824485 - DNA, 25 bp, Mus musculus
tcgcttctggattttggattcccac

SEQ ID NO: 824486 - DNA, 25 bp, Mus musculus
tcgcttgaccaactggcagggaatc

SEQ ID NO: 824487 - DNA, 25 bp, Mus musculus
tcgcttgaccaagtggcagggaatc

SEQ ID NO: 824488 - DNA, 25 bp, Mus musculus
tcgcttgacttcaattttcagctat

SEQ ID NO: 824489 - DNA, 25 bp, Mus musculus
tcgcttgacttctattttcagctat

SEQ ID NO: 824490 - DNA, 25 bp, Mus musculus
tcgcttgagcatcctgttcagacaa

SEQ ID NO: 824491 - DNA, 25 bp, Mus musculus
tcgcttgagcatgctgttcagacaa

SEQ ID NO: 824492 - DNA, 25 bp, Mus musculus
tcgcttgagtttagaatgcttttaa

SEQ ID NO: 824493 - DNA, 25 bp, Mus musculus
tcgcttgagttttgaatgcttttaa

SEQ ID NO: 824494 - DNA, 25 bp, Mus musculus
tcgcttgtcaagaatgtacccctga

SEQ ID NO: 824495 - DNA, 25 bp, Mus musculus
tcgcttgtcaagtatgtacccctga

SEQ ID NO: 824496 - DNA, 25 bp, Mus musculus
tcgctttacattccttcctagttta

SEQ ID NO: 824497 - DNA, 25 bp, Mus musculus
tcgctttacattgcttcctagttta

SEQ ID NO: 824498 - DNA, 25 bp, Mus musculus
tcgctttagttaaccggcatggatg

SEQ ID NO: 824499 - DNA, 25 bp, Mus musculus
tcgctttagttatccggcatggatg

SEQ ID NO: 824500 - DNA, 25 bp, Mus musculus
tcgctttccaacctgctcactaaaa

SEQ ID NO: 824501 - DNA, 25 bp, Mus musculus
tcgctttccaacgtgctcactaaaa

SEQ ID NO: 824502 - DNA, 25 bp, Mus musculus
tcgctttcccgtcatatacattgtg

SEQ ID NO: 824503 - DNA, 25 bp, Mus musculus
tcgctttcccgtgatatacattgtg

SEQ ID NO: 824504 - DNA, 25 bp, Mus musculus
tcgctttccgagacagactaactgc

SEQ ID NO: 824505 - DNA, 25 bp, Mus musculus
tcgctttccgagtcagactaactgc

SEQ ID NO: 824506 - DNA, 25 bp, Mus musculus
tcgctttctgaaaggtttgcctgca

SEQ ID NO: 824507 - DNA, 25 bp, Mus musculus
tcgctttctgaatggtttgcctgca

SEQ ID NO: 824508 - DNA, 25 bp, Mus musculus
tcgctttcttgaaaatttctgccaa

SEQ ID NO: 824509 - DNA, 25 bp, Mus musculus
tcgctttcttgataatttctgccaa

SEQ ID NO: 824510 - DNA, 25 bp, Mus musculus
tcgctttgaggccatgctagatctc

SEQ ID NO: 824511 - DNA, 25 bp, Mus musculus
tcgctttgaggcgatgctagatctc

SEQ ID NO: 824512 - DNA, 25 bp, Mus musculus
tcgctttgggccagaactgaagcct

SEQ ID NO: 824513 - DNA, 25 bp, Mus musculus
tcgctttgggcctgaactgaagcct

SEQ ID NO: 824514 - DNA, 25 bp, Mus musculus
tcggaaaaattccagctcttcactc

SEQ ID NO: 824515 - DNA, 25 bp, Mus musculus
tcggaaaaattcgagctcttcactc

SEQ ID NO: 824516 - DNA, 25 bp, Mus musculus
tcggaaaatcaacttctcggacaat

SEQ ID NO: 824517 - DNA, 25 bp, Mus musculus
tcggaaaatcaagttctcggacaat

SEQ ID NO: 824518 - DNA, 25 bp, Mus musculus
tcggaaaatggtaactgaagatgaa

SEQ ID NO: 824519 - DNA, 25 bp, Mus musculus
tcggaaaatggttactgaagatgaa

SEQ ID NO: 824520 - DNA, 25 bp, Mus musculus
tcggaaactgccctgctgcggagca

SEQ ID NO: 824521 - DNA, 25 bp, Mus musculus
tcggaaactgccgtgctgcggagca

SEQ ID NO: 824522 - DNA, 25 bp, Mus musculus
tcggaaagcctcctctacgttgggt

SEQ ID NO: 824523 - DNA, 25 bp, Mus musculus
tcggaaagcctcgtctacgttgggt

SEQ ID NO: 824524 - DNA, 25 bp, Mus musculus
tcggaaaggcttagcctgctggact

SEQ ID NO: 824525 - DNA, 25 bp, Mus musculus
tcggaaaggctttgcctgctggact

SEQ ID NO: 824526 - DNA, 25 bp, Mus musculus
tcggaaatccctcccgtgagcagga

SEQ ID NO: 824527 - DNA, 25 bp, Mus musculus
tcggaaatccctgccgtgagcagga

SEQ ID NO: 824528 - DNA, 25 bp, Mus musculus
tcggaaattcctctgcactgagctg

SEQ ID NO: 824529 - DNA, 25 bp, Mus musculus
tcggaaattcctgtgcactgagctg

SEQ ID NO: 824530 - DNA, 25 bp, Mus musculus
tcggaacagggaagacaccaccaca

SEQ ID NO: 824531 - DNA, 25 bp, Mus musculus
tcggaacagggatgacaccaccaca

SEQ ID NO: 824532 - DNA, 25 bp, Mus musculus
tcggaaccagcacgaggcgctctga

SEQ ID NO: 824533 - DNA, 25 bp, Mus musculus
tcggaaccagcaggaggcgctctga

SEQ ID NO: 824534 - DNA, 25 bp, Mus musculus
tcggaacctccaccagggactggct

SEQ ID NO: 824535 - DNA, 25 bp, Mus musculus
tcggaacctccagcagggactggct

SEQ ID NO: 824536 - DNA, 25 bp, Mus musculus
tcggaacctcttcctggaacacaga

SEQ ID NO: 824537 - DNA, 25 bp, Mus musculus
tcggaacctcttgctggaacacaga

SEQ ID NO: 824538 - DNA, 25 bp, Mus musculus
tcggaactcgtcccttatttacgaa

SEQ ID NO: 824539 - DNA, 25 bp, Mus musculus
tcggaactcgtcgcttatttacgaa

SEQ ID NO: 824540 - DNA, 25 bp, Mus musculus
tcggaactggaaatgaccatcctcc

SEQ ID NO: 824541 - DNA, 25 bp, Mus musculus
tcggaactggaattgaccatcctcc

SEQ ID NO: 824542 - DNA, 25 bp, Mus musculus
tcggaagattaaatgctacatgtgt

SEQ ID NO: 824543 - DNA, 25 bp, Mus musculus
tcggaagattaattgctacatgtgt

SEQ ID NO: 824544 - DNA, 25 bp, Mus musculus
tcggaagcaattaagtggtgacacg

SEQ ID NO: 824545 - DNA, 25 bp, Mus musculus
tcggaagcaatttagtggtgacacg

SEQ ID NO: 824546 - DNA, 25 bp, Mus musculus
tcggaagcacccaaatgagatctgt

SEQ ID NO: 824547 - DNA, 25 bp, Mus musculus
tcggaagcaccctaatgagatctgt

SEQ ID NO: 824548 - DNA, 25 bp, Mus musculus
tcggaagcgacgctgtcaggacact

SEQ ID NO: 824549 - DNA, 25 bp, Mus musculus
tcggaagcgacggtgtcaggacact

SEQ ID NO: 824550 - DNA, 25 bp, Mus musculus
tcggaaggccatcgaagctgttgct

SEQ ID NO: 824551 - DNA, 25 bp, Mus musculus
tcggaaggccatggaagctgttgct

SEQ ID NO: 824552 - DNA, 25 bp, Mus musculus
tcggaaggtgcgaccactggagcta

SEQ ID NO: 824553 - DNA, 25 bp, Mus musculus
tcggaaggtgcgtccactggagcta

SEQ ID NO: 824554 - DNA, 25 bp, Mus musculus
tcggaaggttgccatgaggatccct

SEQ ID NO: 824555 - DNA, 25 bp, Mus musculus
tcggaaggttgcgatgaggatccct

SEQ ID NO: 824556 - DNA, 25 bp, Mus musculus
tcggaagtctcgaggtggccagttc

SEQ ID NO: 824557 - DNA, 25 bp, Mus musculus
tcggaagtctcgtggtggccagttc

SEQ ID NO: 824558 - DNA, 25 bp, Mus musculus
tcggaatggcgcacagcagatattt

SEQ ID NO: 824559 - DNA, 25 bp, Mus musculus
tcggaatggcgctcagcagatattt

SEQ ID NO: 824560 - DNA, 25 bp, Mus musculus
tcggaattttctcctcttaaagcaa

SEQ ID NO: 824561 - DNA, 25 bp, Mus musculus
tcggaattttctgctcttaaagcaa

SEQ ID NO: 824562 - DNA, 25 bp, Mus musculus
tcggacacagctcatgctcacttgg

SEQ ID NO: 824563 - DNA, 25 bp, Mus musculus
tcggacacagctgatgctcacttgg

SEQ ID NO: 824564 - DNA, 25 bp, Mus musculus
tcggacacccgaagtgcattgcgtg

SEQ ID NO: 824565 - DNA, 25 bp, Mus musculus
tcggacacccgatgtgcattgcgtg

SEQ ID NO: 824566 - DNA, 25 bp, Mus musculus
tcggacacgatgaatggttcctggt

SEQ ID NO: 824567 - DNA, 25 bp, Mus musculus
tcggacacgatgtatggttcctggt

SEQ ID NO: 824568 - DNA, 25 bp, Mus musculus
tcggacacttgacacataccccaga

SEQ ID NO: 824569 - DNA, 25 bp, Mus musculus
tcggacacttgagacataccccaga

SEQ ID NO: 824570 - DNA, 25 bp, Mus musculus
tcggacagagcgaataacatgttat

SEQ ID NO: 824571 - DNA, 25 bp, Mus musculus
tcggacagagcgtataacatgttat

SEQ ID NO: 824572 - DNA, 25 bp, Mus musculus
tcggacaggtttactcactgagatg

SEQ ID NO: 824573 - DNA, 25 bp, Mus musculus
tcggacaggttttctcactgagatg

SEQ ID NO: 824574 - DNA, 25 bp, Mus musculus
tcggacataccacgcggctaagtgt

SEQ ID NO: 824575 - DNA, 25 bp, Mus musculus
tcggacataccaggcggctaagtgt

SEQ ID NO: 824576 - DNA, 25 bp, Mus musculus
tcggacatttgaccccttctctgaa

SEQ ID NO: 824577 - DNA, 25 bp, Mus musculus
tcggacatttgagcccttctctgaa

SEQ ID NO: 824578 - DNA, 25 bp, Mus musculus
tcggaccaacacagcaggactcgtt

SEQ ID NO: 824579 - DNA, 25 bp, Mus musculus
tcggaccaacactgcaggactcgtt

SEQ ID NO: 824580 - DNA, 25 bp, Mus musculus
tcggaccacgaactgctcagttcca

SEQ ID NO: 824581 - DNA, 25 bp, Mus musculus
tcggaccacgaagtgctcagttcca

SEQ ID NO: 824582 - DNA, 25 bp, Mus musculus
tcggaccagggacacgactcaccgt

SEQ ID NO: 824583 - DNA, 25 bp, Mus musculus
tcggaccagggagacgactcaccgt

SEQ ID NO: 824584 - DNA, 25 bp, Mus musculus
tcggaccatttaatccagcctgcag

SEQ ID NO: 824585 - DNA, 25 bp, Mus musculus
tcggaccatttattccagcctgcag

SEQ ID NO: 824586 - DNA, 25 bp, Mus musculus
tcggacccaaagcagggcgacacaa

SEQ ID NO: 824587 - DNA, 25 bp, Mus musculus
tcggacccaaaggagggcgacacaa

SEQ ID NO: 824588 - DNA, 25 bp, Mus musculus
tcggacccagaacaggtgactcaag

SEQ ID NO: 824589 - DNA, 25 bp, Mus musculus
tcggacccagaagaggtgactcaag

SEQ ID NO: 824590 - DNA, 25 bp, Mus musculus
tcggaccctgtaattcctaccagta

SEQ ID NO: 824591 - DNA, 25 bp, Mus musculus
tcggaccctgtatttcctaccagta

SEQ ID NO: 824592 - DNA, 25 bp, Mus musculus
tcggacctatatccacacaagaagt

SEQ ID NO: 824593 - DNA, 25 bp, Mus musculus
tcggacctatatgcacacaagaagt

SEQ ID NO: 824594 - DNA, 25 bp, Mus musculus
tcggacgagagtcgactaaccctct

SEQ ID NO: 824595 - DNA, 25 bp, Mus musculus
tcggacgagagtggactaaccctct

SEQ ID NO: 824596 - DNA, 25 bp, Mus musculus
tcggacgcacggagcatcctaaacc

SEQ ID NO: 824597 - DNA, 25 bp, Mus musculus
tcggacgcacggtgcatcctaaacc

SEQ ID NO: 824598 - DNA, 25 bp, Mus musculus
tcggacgcgggcagaaccacaacgt

SEQ ID NO: 824599 - DNA, 25 bp, Mus musculus
tcggacgcgggctgaaccacaacgt

SEQ ID NO: 824600 - DNA, 25 bp, Mus musculus
tcggactcactgctgtatgacgatg

SEQ ID NO: 824601 - DNA, 25 bp, Mus musculus
tcggactcactggtgtatgacgatg

SEQ ID NO: 824602 - DNA, 25 bp, Mus musculus
tcggactcctgcagtcactctgtgt

SEQ ID NO: 824603 - DNA, 25 bp, Mus musculus
tcggactcctgctgtcactctgtgt

SEQ ID NO: 824604 - DNA, 25 bp, Mus musculus
tcggactcggaccttagcttaccta

SEQ ID NO: 824605 - DNA, 25 bp, Mus musculus
tcggactcggacgttagcttaccta

SEQ ID NO: 824606 - DNA, 25 bp, Mus musculus
tcggactgccaaatttcaccggttt

SEQ ID NO: 824607 - DNA, 25 bp, Mus musculus
tcggactgccaattttcaccggttt

SEQ ID NO: 824608 - DNA, 25 bp, Mus musculus
tcggactgcctgactgtgcattaaa

SEQ ID NO: 824609 - DNA, 25 bp, Mus musculus
tcggactgcctgtctgtgcattaaa

SEQ ID NO: 824610 - DNA, 25 bp, Mus musculus
tcggacttcagaccactttatgtag

SEQ ID NO: 824611 - DNA, 25 bp, Mus musculus
tcggacttcagagcactttatgtag

SEQ ID NO: 824612 - DNA, 25 bp, Mus musculus
tcggacttgataccgctggtctagc

SEQ ID NO: 824613 - DNA, 25 bp, Mus musculus
tcggacttgatagcgctggtctagc

SEQ ID NO: 824614 - DNA, 25 bp, Mus musculus
tcggacttggctagtttgtttattg

SEQ ID NO: 824615 - DNA, 25 bp, Mus musculus
tcggacttggcttgtttgtttattg

SEQ ID NO: 824616 - DNA, 25 bp, Mus musculus
tcggacttttgaagccaacacgggc

SEQ ID NO: 824617 - DNA, 25 bp, Mus musculus
tcggacttttgatgccaacacgggc

SEQ ID NO: 824618 - DNA, 25 bp, Mus musculus
tcggagaagggcacgccatgccact

SEQ ID NO: 824619 - DNA, 25 bp, Mus musculus
tcggagaagggctcgccatgccact

SEQ ID NO: 824620 - DNA, 25 bp, Mus musculus
tcggagaatcccacgtcacaggctt

SEQ ID NO: 824621 - DNA, 25 bp, Mus musculus
tcggagaatccctcgtcacaggctt

SEQ ID NO: 824622 - DNA, 25 bp, Mus musculus
tcggagacaaatcgtcctcttcaag

SEQ ID NO: 824623 - DNA, 25 bp, Mus musculus
tcggagacaaatggtcctcttcaag

SEQ ID NO: 824624 - DNA, 25 bp, Mus musculus
tcggagacatatatctacccttgcc

SEQ ID NO: 824625 - DNA, 25 bp, Mus musculus
tcggagacatatttctacccttgcc

SEQ ID NO: 824626 - DNA, 25 bp, Mus musculus
tcggagactcaaagcccagggactt

SEQ ID NO: 824627 - DNA, 25 bp, Mus musculus
tcggagactcaatgcccagggactt

SEQ ID NO: 824628 - DNA, 25 bp, Mus musculus
tcggagagatgaccatggtgaacgt

SEQ ID NO: 824629 - DNA, 25 bp, Mus musculus
tcggagagatgagcatggtgaacgt

SEQ ID NO: 824630 - DNA, 25 bp, Mus musculus
tcggagagcctcctaaccctgtttc

SEQ ID NO: 824631 - DNA, 25 bp, Mus musculus
tcggagagcctcgtaaccctgtttc

SEQ ID NO: 824632 - DNA, 25 bp, Mus musculus
tcggagagggaaattatttacagcc

SEQ ID NO: 824633 - DNA, 25 bp, Mus musculus
tcggagagggaatttatttacagcc

SEQ ID NO: 824634 - DNA, 25 bp, Mus musculus
tcggagagggacacttcagtatgga

SEQ ID NO: 824635 - DNA, 25 bp, Mus musculus
tcggagagggactcttcagtatgga

SEQ ID NO: 824636 - DNA, 25 bp, Mus musculus
tcggagagttcacaggtgcctaagc

SEQ ID NO: 824637 - DNA, 25 bp, Mus musculus
tcggagagttcagaggtgcctaagc

SEQ ID NO: 824638 - DNA, 25 bp, Mus musculus
tcggagcagtggctccaaccgaagt

SEQ ID NO: 824639 - DNA, 25 bp, Mus musculus
tcggagcagtgggtccaaccgaagt

SEQ ID NO: 824640 - DNA, 25 bp, Mus musculus
tcggagccaggtagcctaatgctaa

SEQ ID NO: 824641 - DNA, 25 bp, Mus musculus
tcggagccaggttgcctaatgctaa

SEQ ID NO: 824642 - DNA, 25 bp, Mus musculus
tcggagcccagtcacgttatcatac

SEQ ID NO: 824643 - DNA, 25 bp, Mus musculus
tcggagcccagtgacgttatcatac

SEQ ID NO: 824644 - DNA, 25 bp, Mus musculus
tcggagcccgtcaggtgctatgagc

SEQ ID NO: 824645 - DNA, 25 bp, Mus musculus
tcggagcccgtctggtgctatgagc

SEQ ID NO: 824646 - DNA, 25 bp, Mus musculus
tcggagcctggacttcaatgcctag

SEQ ID NO: 824647 - DNA, 25 bp, Mus musculus
tcggagcctggagttcaatgcctag

SEQ ID NO: 824648 - DNA, 25 bp, Mus musculus
tcggagctgagcacgttgctttcca

SEQ ID NO: 824649 - DNA, 25 bp, Mus musculus
tcggagctgagctcgttgctttcca

SEQ ID NO: 824650 - DNA, 25 bp, Mus musculus
tcggaggcaagaacacctacgggat

SEQ ID NO: 824651 - DNA, 25 bp, Mus musculus
tcggaggcaagatcacctacgggat

SEQ ID NO: 824652 - DNA, 25 bp, Mus musculus
tcggagggcggcacggctgaccagg

SEQ ID NO: 824653 - DNA, 25 bp, Mus musculus
tcggagggcggctcggctgaccagg

SEQ ID NO: 824654 - DNA, 25 bp, Mus musculus
tcggagtcacagatgagtacccttt

SEQ ID NO: 824655 - DNA, 25 bp, Mus musculus
tcggagtcacagttgagtacccttt

SEQ ID NO: 824656 - DNA, 25 bp, Mus musculus
tcggagtcaccgcagctgatggtta

SEQ ID NO: 824657 - DNA, 25 bp, Mus musculus
tcggagtcaccggagctgatggtta

SEQ ID NO: 824658 - DNA, 25 bp, Mus musculus
tcggagtcagatccgcgcagtcgca

SEQ ID NO: 824659 - DNA, 25 bp, Mus musculus
tcggagtcagatgcgcgcagtcgca

SEQ ID NO: 824660 - DNA, 25 bp, Mus musculus
tcggagtccttgaggttacgcagca

SEQ ID NO: 824661 - DNA, 25 bp, Mus musculus
tcggagtccttgtggttacgcagca

SEQ ID NO: 824662 - DNA, 25 bp, Mus musculus
tcggagtctcttacatgtacacctt

SEQ ID NO: 824663 - DNA, 25 bp, Mus musculus
tcggagtctctttcatgtacacctt

SEQ ID NO: 824664 - DNA, 25 bp, Mus musculus
tcggagtgctccaatggaccaaggt

SEQ ID NO: 824665 - DNA, 25 bp, Mus musculus
tcggagtgctcctatggaccaaggt

SEQ ID NO: 824666 - DNA, 25 bp, Mus musculus
tcggagtgttctctgtaacgcgaca

SEQ ID NO: 824667 - DNA, 25 bp, Mus musculus
tcggagtgttctgtgtaacgcgaca

SEQ ID NO: 824668 - DNA, 25 bp, Mus musculus
tcggagttagaacagcccaccattt

SEQ ID NO: 824669 - DNA, 25 bp, Mus musculus
tcggagttagaagagcccaccattt

SEQ ID NO: 824670 - DNA, 25 bp, Mus musculus
tcggataactttacctgtgcataga

SEQ ID NO: 824671 - DNA, 25 bp, Mus musculus
tcggataacttttcctgtgcataga

SEQ ID NO: 824672 - DNA, 25 bp, Mus musculus
tcggatagttttcagaactcctgct

SEQ ID NO: 824673 - DNA, 25 bp, Mus musculus
tcggatagttttgagaactcctgct

SEQ ID NO: 824674 - DNA, 25 bp, Mus musculus
tcggatattgccagtcatgtggtca

SEQ ID NO: 824675 - DNA, 25 bp, Mus musculus
tcggatattgcctgtcatgtggtca

SEQ ID NO: 824676 - DNA, 25 bp, Mus musculus
tcggatccacctacaacccaagatg

SEQ ID NO: 824677 - DNA, 25 bp, Mus musculus
tcggatccaccttcaacccaagatg

SEQ ID NO: 824678 - DNA, 25 bp, Mus musculus
tcggatcccgggacggcaactttct

SEQ ID NO: 824679 - DNA, 25 bp, Mus musculus
tcggatcccgggtcggcaactttct

SEQ ID NO: 824680 - DNA, 25 bp, Mus musculus
tcggatccctctcttccttgaaagc

SEQ ID NO: 824681 - DNA, 25 bp, Mus musculus
tcggatccctctgttccttgaaagc

SEQ ID NO: 824682 - DNA, 25 bp, Mus musculus
tcggatctctggacaagtcggagcc

SEQ ID NO: 824683 - DNA, 25 bp, Mus musculus
tcggatctctggtcaagtcggagcc

SEQ ID NO: 824684 - DNA, 25 bp, Mus musculus
tcggatctgtccagtgaagagggat

SEQ ID NO: 824685 - DNA, 25 bp, Mus musculus
tcggatctgtcctgtgaagagggat

SEQ ID NO: 824686 - DNA, 25 bp, Mus musculus
tcggatcttttccacacagttgcac

SEQ ID NO: 824687 - DNA, 25 bp, Mus musculus
tcggatcttttcgacacagttgcac

SEQ ID NO: 824688 - DNA, 25 bp, Mus musculus
tcggatgaactcagcggcgttggcc

SEQ ID NO: 824689 - DNA, 25 bp, Mus musculus
tcggatgaactctgcggcgttggcc

SEQ ID NO: 824690 - DNA, 25 bp, Mus musculus
tcggatgacaggaggtcgaccacct

SEQ ID NO: 824691 - DNA, 25 bp, Mus musculus
tcggatgacaggtggtcgaccacct

SEQ ID NO: 824692 - DNA, 25 bp, Mus musculus
tcggatgacgccattcttctggaaa

SEQ ID NO: 824693 - DNA, 25 bp, Mus musculus
tcggatgacgcctttcttctggaaa

SEQ ID NO: 824694 - DNA, 25 bp, Mus musculus
tcggatgatcgtatccagcactgaa

SEQ ID NO: 824695 - DNA, 25 bp, Mus musculus
tcggatgatcgtttccagcactgaa

SEQ ID NO: 824696 - DNA, 25 bp, Mus musculus
tcggatgcaacgatttgcccagcag

SEQ ID NO: 824697 - DNA, 25 bp, Mus musculus
tcggatgcaacgttttgcccagcag

SEQ ID NO: 824698 - DNA, 25 bp, Mus musculus
tcggatgcccacagagagccagagg

SEQ ID NO: 824699 - DNA, 25 bp, Mus musculus
tcggatgcccactgagagccagagg

SEQ ID NO: 824700 - DNA, 25 bp, Mus musculus
tcggatgccgtcaggatgcgctcca

SEQ ID NO: 824701 - DNA, 25 bp, Mus musculus
tcggatgccgtctggatgcgctcca

SEQ ID NO: 824702 - DNA, 25 bp, Mus musculus
tcggatgtggaacgccctcacctac

SEQ ID NO: 824703 - DNA, 25 bp, Mus musculus
tcggatgtggaaggccctcacctac

SEQ ID NO: 824704 - DNA, 25 bp, Mus musculus
tcggattatccgagatctgcgggag

SEQ ID NO: 824705 - DNA, 25 bp, Mus musculus
tcggattatccgtgatctgcgggag

SEQ ID NO: 824706 - DNA, 25 bp, Mus musculus
tcggattcatatagagatacctcca

SEQ ID NO: 824707 - DNA, 25 bp, Mus musculus
tcggattcatattgagatacctcca

SEQ ID NO: 824708 - DNA, 25 bp, Mus musculus
tcggattccgcactagcaagaggca

SEQ ID NO: 824709 - DNA, 25 bp, Mus musculus
tcggattccgcagtagcaagaggca

SEQ ID NO: 824710 - DNA, 25 bp, Mus musculus
tcggattctcacatgcaaacatttt

SEQ ID NO: 824711 - DNA, 25 bp, Mus musculus
tcggattctcacttgcaaacatttt

SEQ ID NO: 824712 - DNA, 25 bp, Mus musculus
tcggattttaaactctccaatttgg

SEQ ID NO: 824713 - DNA, 25 bp, Mus musculus
tcggattttaaagtctccaatttgg

SEQ ID NO: 824714 - DNA, 25 bp, Mus musculus
tcggcaaactttactgaccactcag

SEQ ID NO: 824715 - DNA, 25 bp, Mus musculus
tcggcaaacttttctgaccactcag

SEQ ID NO: 824716 - DNA, 25 bp, Mus musculus
tcggcaaagcttcgcgggctaatca

SEQ ID NO: 824717 - DNA, 25 bp, Mus musculus
tcggcaaagcttggcgggctaatca

SEQ ID NO: 824718 - DNA, 25 bp, Mus musculus
tcggcaacattcaagtctcctttac

SEQ ID NO: 824719 - DNA, 25 bp, Mus musculus
tcggcaacattctagtctcctttac

SEQ ID NO: 824720 - DNA, 25 bp, Mus musculus
tcggcaaccgcaaccacagaatgtt

SEQ ID NO: 824721 - DNA, 25 bp, Mus musculus
tcggcaaccgcatccacagaatgtt

SEQ ID NO: 824722 - DNA, 25 bp, Mus musculus
tcggcaactccaaggagacggtcgt

SEQ ID NO: 824723 - DNA, 25 bp, Mus musculus
tcggcaactccatggagacggtcgt

SEQ ID NO: 824724 - DNA, 25 bp, Mus musculus
tcggcaactcgcagcggcagggtct

SEQ ID NO: 824725 - DNA, 25 bp, Mus musculus
tcggcaactcgctgcggcagggtct

SEQ ID NO: 824726 - DNA, 25 bp, Mus musculus
tcggcaagcattactaccaatcagt

SEQ ID NO: 824727 - DNA, 25 bp, Mus musculus
tcggcaagcatttctaccaatcagt

SEQ ID NO: 824728 - DNA, 25 bp, Mus musculus
tcggcaagcggcataacagaggaca

SEQ ID NO: 824729 - DNA, 25 bp, Mus musculus
tcggcaagcggcttaacagaggaca

SEQ ID NO: 824730 - DNA, 25 bp, Mus musculus
tcggcaagcttacattaccaccatt

SEQ ID NO: 824731 - DNA, 25 bp, Mus musculus
tcggcaagcttagattaccaccatt

SEQ ID NO: 824732 - DNA, 25 bp, Mus musculus
tcggcaagcttcagaattcctactt

SEQ ID NO: 824733 - DNA, 25 bp, Mus musculus
tcggcaagcttctgaattcctactt

SEQ ID NO: 824734 - DNA, 25 bp, Mus musculus
tcggcaagtctgaccgcttcaaaag

SEQ ID NO: 824735 - DNA, 25 bp, Mus musculus
tcggcaagtctgtccgcttcaaaag

SEQ ID NO: 824736 - DNA, 25 bp, Mus musculus
tcggcacttcctcactcacacagat

SEQ ID NO: 824737 - DNA, 25 bp, Mus musculus
tcggcacttcctgactcacacagat

SEQ ID NO: 824738 - DNA, 25 bp, Mus musculus
tcggcagaggatatggctatgtgct

SEQ ID NO: 824739 - DNA, 25 bp, Mus musculus
tcggcagaggatttggctatgtgct

SEQ ID NO: 824740 - DNA, 25 bp, Mus musculus
tcggcagaggctacttaggatatct

SEQ ID NO: 824741 - DNA, 25 bp, Mus musculus
tcggcagaggcttcttaggatatct

SEQ ID NO: 824742 - DNA, 25 bp, Mus musculus
tcggcagatctgaggtgcagcttca

SEQ ID NO: 824743 - DNA, 25 bp, Mus musculus
tcggcagatctgtggtgcagcttca

SEQ ID NO: 824744 - DNA, 25 bp, Mus musculus
tcggcagcagtgactgcagccccag

SEQ ID NO: 824745 - DNA, 25 bp, Mus musculus
tcggcagcagtgtctgcagccccag

SEQ ID NO: 824746 - DNA, 25 bp, Mus musculus
tcggcagcatctactcacacaggag

SEQ ID NO: 824747 - DNA, 25 bp, Mus musculus
tcggcagcatcttctcacacaggag

SEQ ID NO: 824748 - DNA, 25 bp, Mus musculus
tcggcagctacgagagtaccaggag

SEQ ID NO: 824749 - DNA, 25 bp, Mus musculus
tcggcagctacgtgagtaccaggag

SEQ ID NO: 824750 - DNA, 25 bp, Mus musculus
tcggcagctgtaccctcaatggaga

SEQ ID NO: 824751 - DNA, 25 bp, Mus musculus
tcggcagctgtagcctcaatggaga

SEQ ID NO: 824752 - DNA, 25 bp, Mus musculus
tcggcaggatggctactggctcacc

SEQ ID NO: 824753 - DNA, 25 bp, Mus musculus
tcggcaggatgggtactggctcacc

SEQ ID NO: 824754 - DNA, 25 bp, Mus musculus
tcggcaggcatcagactaattcagt

SEQ ID NO: 824755 - DNA, 25 bp, Mus musculus
tcggcaggcatctgactaattcagt

SEQ ID NO: 824756 - DNA, 25 bp, Mus musculus
tcggcaggccaaactgttttcagat

SEQ ID NO: 824757 - DNA, 25 bp, Mus musculus
tcggcaggccaatctgttttcagat

SEQ ID NO: 824758 - DNA, 25 bp, Mus musculus
tcggcaggctggaaaggtaacatgt

SEQ ID NO: 824759 - DNA, 25 bp, Mus musculus
tcggcaggctggtaaggtaacatgt

SEQ ID NO: 824760 - DNA, 25 bp, Mus musculus
tcggcagtatctcttttctctctat

SEQ ID NO: 824761 - DNA, 25 bp, Mus musculus
tcggcagtatctgttttctctctat

SEQ ID NO: 824762 - DNA, 25 bp, Mus musculus
tcggcagtgttcatgagactcttat

SEQ ID NO: 824763 - DNA, 25 bp, Mus musculus
tcggcagtgttcttgagactcttat

SEQ ID NO: 824764 - DNA, 25 bp, Mus musculus
tcggcagttccgacagccaaggcta

SEQ ID NO: 824765 - DNA, 25 bp, Mus musculus
tcggcagttccgtcagccaaggcta

SEQ ID NO: 824766 - DNA, 25 bp, Mus musculus
tcggcagttgtgcttcagaacatga

SEQ ID NO: 824767 - DNA, 25 bp, Mus musculus
tcggcagttgtggttcagaacatga

SEQ ID NO: 824768 - DNA, 25 bp, Mus musculus
tcggcataacaaacgcattggattc

SEQ ID NO: 824769 - DNA, 25 bp, Mus musculus
tcggcataacaatcgcattggattc

SEQ ID NO: 824770 - DNA, 25 bp, Mus musculus
tcggcataccagagtgcatcaaaca

SEQ ID NO: 824771 - DNA, 25 bp, Mus musculus
tcggcataccagtgtgcatcaaaca

SEQ ID NO: 824772 - DNA, 25 bp, Mus musculus
tcggcatacccaatgttgccgtttt

SEQ ID NO: 824773 - DNA, 25 bp, Mus musculus
tcggcatacccattgttgccgtttt

SEQ ID NO: 824774 - DNA, 25 bp, Mus musculus
tcggcatcaattccagatacccacg

SEQ ID NO: 824775 - DNA, 25 bp, Mus musculus
tcggcatcaattgcagatacccacg

SEQ ID NO: 824776 - DNA, 25 bp, Mus musculus
tcggcatcacagcacctaaatctat

SEQ ID NO: 824777 - DNA, 25 bp, Mus musculus
tcggcatcacaggacctaaatctat

SEQ ID NO: 824778 - DNA, 25 bp, Mus musculus
tcggcatcgtccagcagccaggagt

SEQ ID NO: 824779 - DNA, 25 bp, Mus musculus
tcggcatcgtcctgcagccaggagt

SEQ ID NO: 824780 - DNA, 25 bp, Mus musculus
tcggcatgcatgactgtttactact

SEQ ID NO: 824781 - DNA, 25 bp, Mus musculus
tcggcatgcatgtctgtttactact

SEQ ID NO: 824782 - DNA, 25 bp, Mus musculus
tcggcatgcctgctttctggtctgt

SEQ ID NO: 824783 - DNA, 25 bp, Mus musculus
tcggcatgcctggtttctggtctgt

SEQ ID NO: 824784 - DNA, 25 bp, Mus musculus
tcggcattatttctacctccatttt

SEQ ID NO: 824785 - DNA, 25 bp, Mus musculus
tcggcattatttgtacctccatttt

SEQ ID NO: 824786 - DNA, 25 bp, Mus musculus
tcggcatttaaaagttggtcccagc

SEQ ID NO: 824787 - DNA, 25 bp, Mus musculus
tcggcatttaaatgttggtcccagc

SEQ ID NO: 824788 - DNA, 25 bp, Mus musculus
tcggcatttgcaaacaagccagaaa

SEQ ID NO: 824789 - DNA, 25 bp, Mus musculus
tcggcatttgcatacaagccagaaa

SEQ ID NO: 824790 - DNA, 25 bp, Mus musculus
tcggccaaaaagcataaagacccag

SEQ ID NO: 824791 - DNA, 25 bp, Mus musculus
tcggccaaaaaggataaagacccag

SEQ ID NO: 824792 - DNA, 25 bp, Mus musculus
tcggccaacagtcccagctgatgga

SEQ ID NO: 824793 - DNA, 25 bp, Mus musculus
tcggccaacagtgccagctgatgga

SEQ ID NO: 824794 - DNA, 25 bp, Mus musculus
tcggccaacgcaccagttttaccaa

SEQ ID NO: 824795 - DNA, 25 bp, Mus musculus
tcggccaacgcagcagttttaccaa

SEQ ID NO: 824796 - DNA, 25 bp, Mus musculus
tcggccaagccaaggtggtcctgaa

SEQ ID NO: 824797 - DNA, 25 bp, Mus musculus
tcggccaagccatggtggtcctgaa

SEQ ID NO: 824798 - DNA, 25 bp, Mus musculus
tcggccaagcctattagtcagtttg

SEQ ID NO: 824799 - DNA, 25 bp, Mus musculus
tcggccaagccttttagtcagtttg

SEQ ID NO: 824800 - DNA, 25 bp, Mus musculus
tcggccactaggcaacctggatgtg

SEQ ID NO: 824801 - DNA, 25 bp, Mus musculus
tcggccactagggaacctggatgtg

SEQ ID NO: 824802 - DNA, 25 bp, Mus musculus
tcggccagagtactatcccctggaa

SEQ ID NO: 824803 - DNA, 25 bp, Mus musculus
tcggccagagtagtatcccctggaa

SEQ ID NO: 824804 - DNA, 25 bp, Mus musculus
tcggccagatgcacttcgtgagcgg

SEQ ID NO: 824805 - DNA, 25 bp, Mus musculus
tcggccagatgctcttcgtgagcgg

SEQ ID NO: 824806 - DNA, 25 bp, Mus musculus
tcggccagcactcggattcctgaaa

SEQ ID NO: 824807 - DNA, 25 bp, Mus musculus
tcggccagcactgggattcctgaaa

SEQ ID NO: 824808 - DNA, 25 bp, Mus musculus
tcggccagcatcaccattggatatt

SEQ ID NO: 824809 - DNA, 25 bp, Mus musculus
tcggccagcatctccattggatatt

SEQ ID NO: 824810 - DNA, 25 bp, Mus musculus
tcggccagctgtctcgagatgccct

SEQ ID NO: 824811 - DNA, 25 bp, Mus musculus
tcggccagctgtgtcgagatgccct

SEQ ID NO: 824812 - DNA, 25 bp, Mus musculus
tcggccagtgcactcagtggtgcca

SEQ ID NO: 824813 - DNA, 25 bp, Mus musculus
tcggccagtgcagtcagtggtgcca

SEQ ID NO: 824814 - DNA, 25 bp, Mus musculus
tcggccatccaaacagatacttctg

SEQ ID NO: 824815 - DNA, 25 bp, Mus musculus
tcggccatccaatcagatacttctg

SEQ ID NO: 824816 - DNA, 25 bp, Mus musculus
tcggcccaggatctgactttattct

SEQ ID NO: 824817 - DNA, 25 bp, Mus musculus
tcggcccaggatgtgactttattct

SEQ ID NO: 824818 - DNA, 25 bp, Mus musculus
tcggccccattccttagacacagag

SEQ ID NO: 824819 - DNA, 25 bp, Mus musculus
tcggccccattcgttagacacagag

SEQ ID NO: 824820 - DNA, 25 bp, Mus musculus
tcggccccgtgtatatatgctttag

SEQ ID NO: 824821 - DNA, 25 bp, Mus musculus
tcggccccgtgtttatatgctttag

SEQ ID NO: 824822 - DNA, 25 bp, Mus musculus
tcggccctaattctgggttttgact

SEQ ID NO: 824823 - DNA, 25 bp, Mus musculus
tcggccctaattgtgggttttgact

SEQ ID NO: 824824 - DNA, 25 bp, Mus musculus
tcggccctagtgatctgcttctgtt

SEQ ID NO: 824825 - DNA, 25 bp, Mus musculus
tcggccctagtgttctgcttctgtt

SEQ ID NO: 824826 - DNA, 25 bp, Mus musculus
tcggccctcgagatgattggattgt

SEQ ID NO: 824827 - DNA, 25 bp, Mus musculus
tcggccctcgagttgattggattgt

SEQ ID NO: 824828 - DNA, 25 bp, Mus musculus
tcggccctggagacggtttcagaaa

SEQ ID NO: 824829 - DNA, 25 bp, Mus musculus
tcggccctggagtcggtttcagaaa

SEQ ID NO: 824830 - DNA, 25 bp, Mus musculus
tcggccctggtgctctaaagtaata

SEQ ID NO: 824831 - DNA, 25 bp, Mus musculus
tcggccctggtggtctaaagtaata

SEQ ID NO: 824832 - DNA, 25 bp, Mus musculus
tcggcccttcaaagagttctctaag

SEQ ID NO: 824833 - DNA, 25 bp, Mus musculus
tcggcccttcaatgagttctctaag

SEQ ID NO: 824834 - DNA, 25 bp, Mus musculus
tcggccgcgccacctgtcaaaaaga

SEQ ID NO: 824835 - DNA, 25 bp, Mus musculus
tcggccgcgccagctgtcaaaaaga

SEQ ID NO: 824836 - DNA, 25 bp, Mus musculus
tcggccgcgggcagatgagccccaa

SEQ ID NO: 824837 - DNA, 25 bp, Mus musculus
tcggccgcgggctgatgagccccaa

SEQ ID NO: 824838 - DNA, 25 bp, Mus musculus
tcggccgtgagcaccatagagtacc

SEQ ID NO: 824839 - DNA, 25 bp, Mus musculus
tcggccgtgagctccatagagtacc

SEQ ID NO: 824840 - DNA, 25 bp, Mus musculus
tcggccgtttgcagttgaagcgaac

SEQ ID NO: 824841 - DNA, 25 bp, Mus musculus
tcggccgtttgctgttgaagcgaac

SEQ ID NO: 824842 - DNA, 25 bp, Mus musculus
tcggcctaagatagagacctgtttg

SEQ ID NO: 824843 - DNA, 25 bp, Mus musculus
tcggcctaagattgagacctgtttg

SEQ ID NO: 824844 - DNA, 25 bp, Mus musculus
tcggcctaagccatcaggtggagga

SEQ ID NO: 824845 - DNA, 25 bp, Mus musculus
tcggcctaagccttcaggtggagga

SEQ ID NO: 824846 - DNA, 25 bp, Mus musculus
tcggcctacctaatactggcattaa

SEQ ID NO: 824847 - DNA, 25 bp, Mus musculus
tcggcctacctattactggcattaa

SEQ ID NO: 824848 - DNA, 25 bp, Mus musculus
tcggcctataggcacacctgtgaga

SEQ ID NO: 824849 - DNA, 25 bp, Mus musculus
tcggcctatagggacacctgtgaga

SEQ ID NO: 824850 - DNA, 25 bp, Mus musculus
tcggcctcagcgatcacagaagtga

SEQ ID NO: 824851 - DNA, 25 bp, Mus musculus
tcggcctcagcgttcacagaagtga

SEQ ID NO: 824852 - DNA, 25 bp, Mus musculus
tcggcctcatttagaccagctggta

SEQ ID NO: 824853 - DNA, 25 bp, Mus musculus
tcggcctcattttgaccagctggta

SEQ ID NO: 824854 - DNA, 25 bp, Mus musculus
tcggcctctacacagtacctaacta

SEQ ID NO: 824855 - DNA, 25 bp, Mus musculus
tcggcctctacagagtacctaacta

SEQ ID NO: 824856 - DNA, 25 bp, Mus musculus
tcggcctctcagatttcttctgctg

SEQ ID NO: 824857 - DNA, 25 bp, Mus musculus
tcggcctctcagttttcttctgctg

SEQ ID NO: 824858 - DNA, 25 bp, Mus musculus
tcggcctctggtaattgcattgaga

SEQ ID NO: 824859 - DNA, 25 bp, Mus musculus
tcggcctctggttattgcattgaga

SEQ ID NO: 824860 - DNA, 25 bp, Mus musculus
tcggcctgtaccaggacgtcccggg

SEQ ID NO: 824861 - DNA, 25 bp, Mus musculus
tcggcctgtacctggacgtcccggg

SEQ ID NO: 824862 - DNA, 25 bp, Mus musculus
tcggcctgtgcaaaagtcctgtgac

SEQ ID NO: 824863 - DNA, 25 bp, Mus musculus
tcggcctgtgcataagtcctgtgac

SEQ ID NO: 824864 - DNA, 25 bp, Mus musculus
tcggccttaccgagaagcaggaaag

SEQ ID NO: 824865 - DNA, 25 bp, Mus musculus
tcggccttaccgtgaagcaggaaag

SEQ ID NO: 824866 - DNA, 25 bp, Mus musculus
tcggccttcagacacagagccagct

SEQ ID NO: 824867 - DNA, 25 bp, Mus musculus
tcggccttcagagacagagccagct

SEQ ID NO: 824868 - DNA, 25 bp, Mus musculus
tcggccttgcttcgacttttgaaaa

SEQ ID NO: 824869 - DNA, 25 bp, Mus musculus
tcggccttgcttggacttttgaaaa

SEQ ID NO: 824870 - DNA, 25 bp, Mus musculus
tcggccttggaaaacgctgctaaac

SEQ ID NO: 824871 - DNA, 25 bp, Mus musculus
tcggccttggaatacgctgctaaac

SEQ ID NO: 824872 - DNA, 25 bp, Mus musculus
tcggcctttaaaatgaccctgctaa

SEQ ID NO: 824873 - DNA, 25 bp, Mus musculus
tcggcctttaaattgaccctgctaa

SEQ ID NO: 824874 - DNA, 25 bp, Mus musculus
tcggcgactatgaggcgctgcagaa

SEQ ID NO: 824875 - DNA, 25 bp, Mus musculus
tcggcgactatgtggcgctgcagaa

SEQ ID NO: 824876 - DNA, 25 bp, Mus musculus
tcggcgcgagtaaaggagggctgtt

SEQ ID NO: 824877 - DNA, 25 bp, Mus musculus
tcggcgcgagtataggagggctgtt

SEQ ID NO: 824878 - DNA, 25 bp, Mus musculus
tcggcgcttcccatgtgaattttaa

SEQ ID NO: 824879 - DNA, 25 bp, Mus musculus
tcggcgcttcccttgtgaattttaa

SEQ ID NO: 824880 - DNA, 25 bp, Mus musculus
tcggcgcttctgcacgaacaaagga

SEQ ID NO: 824881 - DNA, 25 bp, Mus musculus
tcggcgcttctggacgaacaaagga

SEQ ID NO: 824882 - DNA, 25 bp, Mus musculus
tcggcggaacagctaattgctggct

SEQ ID NO: 824883 - DNA, 25 bp, Mus musculus
tcggcggaacaggtaattgctggct

SEQ ID NO: 824884 - DNA, 25 bp, Mus musculus
tcggcggcctgtcttagaattcgga

SEQ ID NO: 824885 - DNA, 25 bp, Mus musculus
tcggcggcctgtgttagaattcgga

SEQ ID NO: 824886 - DNA, 25 bp, Mus musculus
tcggcgggagcaaaccctgcgtcag

SEQ ID NO: 824887 - DNA, 25 bp, Mus musculus
tcggcgggagcataccctgcgtcag

SEQ ID NO: 824888 - DNA, 25 bp, Mus musculus
tcggcgggtagcatcgttccggctc

SEQ ID NO: 824889 - DNA, 25 bp, Mus musculus
tcggcgggtagcttcgttccggctc

SEQ ID NO: 824890 - DNA, 25 bp, Mus musculus
tcggcggtattgactgtatttcttc

SEQ ID NO: 824891 - DNA, 25 bp, Mus musculus
tcggcggtattgtctgtatttcttc

SEQ ID NO: 824892 - DNA, 25 bp, Mus musculus
tcggcggttaagaccacttccggag

SEQ ID NO: 824893 - DNA, 25 bp, Mus musculus
tcggcggttaagtccacttccggag

SEQ ID NO: 824894 - DNA, 25 bp, Mus musculus
tcggcgtcaaagactacgtcagtgg

SEQ ID NO: 824895 - DNA, 25 bp, Mus musculus
tcggcgtcaaagtctacgtcagtgg

SEQ ID NO: 824896 - DNA, 25 bp, Mus musculus
tcggcgtcctgcaggactacgacaa

SEQ ID NO: 824897 - DNA, 25 bp, Mus musculus
tcggcgtcctgctggactacgacaa

SEQ ID NO: 824898 - DNA, 25 bp, Mus musculus
tcggcgttttctacctgggctgtaa

SEQ ID NO: 824899 - DNA, 25 bp, Mus musculus
tcggcgttttcttcctgggctgtaa

SEQ ID NO: 824900 - DNA, 25 bp, Mus musculus
tcggctataacgactgctctcgcgt

SEQ ID NO: 824901 - DNA, 25 bp, Mus musculus
tcggctataacgtctgctctcgcgt

SEQ ID NO: 824902 - DNA, 25 bp, Mus musculus
tcggctatacatatacctcattcac

SEQ ID NO: 824903 - DNA, 25 bp, Mus musculus
tcggctatacatttacctcattcac

SEQ ID NO: 824904 - DNA, 25 bp, Mus musculus
tcggctatccgaagaaactcattac

SEQ ID NO: 824905 - DNA, 25 bp, Mus musculus
tcggctatccgatgaaactcattac

SEQ ID NO: 824906 - DNA, 25 bp, Mus musculus
tcggctatccttactgctaactctc

SEQ ID NO: 824907 - DNA, 25 bp, Mus musculus
tcggctatcctttctgctaactctc

SEQ ID NO: 824908 - DNA, 25 bp, Mus musculus
tcggctatggagcacctgctctaaa

SEQ ID NO: 824909 - DNA, 25 bp, Mus musculus
tcggctatggaggacctgctctaaa

SEQ ID NO: 824910 - DNA, 25 bp, Mus musculus
tcggctcaaattctccacgtattta

SEQ ID NO: 824911 - DNA, 25 bp, Mus musculus
tcggctcaaattgtccacgtattta

SEQ ID NO: 824912 - DNA, 25 bp, Mus musculus
tcggctcaccgaagacaagatactt

SEQ ID NO: 824913 - DNA, 25 bp, Mus musculus
tcggctcaccgatgacaagatactt

SEQ ID NO: 824914 - DNA, 25 bp, Mus musculus
tcggctcactcaccatcatttattg

SEQ ID NO: 824915 - DNA, 25 bp, Mus musculus
tcggctcactcagcatcatttattg

SEQ ID NO: 824916 - DNA, 25 bp, Mus musculus
tcggctccaattccatttcacaaga

SEQ ID NO: 824917 - DNA, 25 bp, Mus musculus
tcggctccaattgcatttcacaaga

SEQ ID NO: 824918 - DNA, 25 bp, Mus musculus
tcggctccccaaaacaggcataagt

SEQ ID NO: 824919 - DNA, 25 bp, Mus musculus
tcggctccccaatacaggcataagt

SEQ ID NO: 824920 - DNA, 25 bp, Mus musculus
tcggctcctggacactctagatact

SEQ ID NO: 824921 - DNA, 25 bp, Mus musculus
tcggctcctggagactctagatact

SEQ ID NO: 824922 - DNA, 25 bp, Mus musculus
tcggctcctgtgaaggcatgtattc

SEQ ID NO: 824923 - DNA, 25 bp, Mus musculus
tcggctcctgtgtaggcatgtattc

SEQ ID NO: 824924 - DNA, 25 bp, Mus musculus
tcggctctactgcaacaacacttat

SEQ ID NO: 824925 - DNA, 25 bp, Mus musculus
tcggctctactggaacaacacttat

SEQ ID NO: 824926 - DNA, 25 bp, Mus musculus
tcggctctccggagggacgcagaat

SEQ ID NO: 824927 - DNA, 25 bp, Mus musculus
tcggctctccggtgggacgcagaat

SEQ ID NO: 824928 - DNA, 25 bp, Mus musculus
tcggctctcctaatctttgtaggaa

SEQ ID NO: 824929 - DNA, 25 bp, Mus musculus
tcggctctcctattctttgtaggaa

SEQ ID NO: 824930 - DNA, 25 bp, Mus musculus
tcggctctgggtcattgagtaactc

SEQ ID NO: 824931 - DNA, 25 bp, Mus musculus
tcggctctgggtgattgagtaactc

SEQ ID NO: 824932 - DNA, 25 bp, Mus musculus
tcggctctgtaactggctggcagca

SEQ ID NO: 824933 - DNA, 25 bp, Mus musculus
tcggctctgtaagtggctggcagca

SEQ ID NO: 824934 - DNA, 25 bp, Mus musculus
tcggctctgtgcacgatcgatgcaa

SEQ ID NO: 824935 - DNA, 25 bp, Mus musculus
tcggctctgtgctcgatcgatgcaa

SEQ ID NO: 824936 - DNA, 25 bp, Mus musculus
tcggctcttatgagcacggagtgac

SEQ ID NO: 824937 - DNA, 25 bp, Mus musculus
tcggctcttatgtgcacggagtgac

SEQ ID NO: 824938 - DNA, 25 bp, Mus musculus
tcggctgccagtcgtgaccgtgttc

SEQ ID NO: 824939 - DNA, 25 bp, Mus musculus
tcggctgccagtggtgaccgtgttc

SEQ ID NO: 824940 - DNA, 25 bp, Mus musculus
tcggctgccttcagacattttgtca

SEQ ID NO: 824941 - DNA, 25 bp, Mus musculus
tcggctgccttccaggaggcatagc

SEQ ID NO: 824942 - DNA, 25 bp, Mus musculus
tcggctgccttcgaggaggcatagc

SEQ ID NO: 824943 - DNA, 25 bp, Mus musculus
tcggctgccttctgacattttgtca

SEQ ID NO: 824944 - DNA, 25 bp, Mus musculus
tcggctggagctcaactactgcatt

SEQ ID NO: 824945 - DNA, 25 bp, Mus musculus
tcggctggagctgaactactgcatt

SEQ ID NO: 824946 - DNA, 25 bp, Mus musculus
tcggctggccgaattattagagaac

SEQ ID NO: 824947 - DNA, 25 bp, Mus musculus
tcggctggccgatttattagagaac

SEQ ID NO: 824948 - DNA, 25 bp, Mus musculus
tcggctgggtttcaagtttgctcca

SEQ ID NO: 824949 - DNA, 25 bp, Mus musculus
tcggctgggtttgaagtttgctcca

SEQ ID NO: 824950 - DNA, 25 bp, Mus musculus
tcggctggtgttactgtggccattc

SEQ ID NO: 824951 - DNA, 25 bp, Mus musculus
tcggctggtgtttctgtggccattc

SEQ ID NO: 824952 - DNA, 25 bp, Mus musculus
tcggctgtacaacctttccaaatgt

SEQ ID NO: 824953 - DNA, 25 bp, Mus musculus
tcggctgtacaagctttccaaatgt

SEQ ID NO: 824954 - DNA, 25 bp, Mus musculus
tcggctgtgagtctttacggcaacc

SEQ ID NO: 824955 - DNA, 25 bp, Mus musculus
tcggctgtgagtgtttacggcaacc

SEQ ID NO: 824956 - DNA, 25 bp, Mus musculus
tcggctgtgccgaaggacgaaaaca

SEQ ID NO: 824957 - DNA, 25 bp, Mus musculus
tcggctgtgccgtaggacgaaaaca

SEQ ID NO: 824958 - DNA, 25 bp, Mus musculus
tcggctgttggcagtctttacccag

SEQ ID NO: 824959 - DNA, 25 bp, Mus musculus
tcggctgttggctgtctttacccag

SEQ ID NO: 824960 - DNA, 25 bp, Mus musculus
tcggcttacagcactcaggtcccag

SEQ ID NO: 824961 - DNA, 25 bp, Mus musculus
tcggcttacagctctcaggtcccag

SEQ ID NO: 824962 - DNA, 25 bp, Mus musculus
tcggcttcactgacagcggaggttt

SEQ ID NO: 824963 - DNA, 25 bp, Mus musculus
tcggcttcactgtcagcggaggttt

SEQ ID NO: 824964 - DNA, 25 bp, Mus musculus
tcggcttcagcaccaggatttcgga

SEQ ID NO: 824965 - DNA, 25 bp, Mus musculus
tcggcttcagcagcaggatttcgga

SEQ ID NO: 824966 - DNA, 25 bp, Mus musculus
tcggcttcagtgctcttggtgagca

SEQ ID NO: 824967 - DNA, 25 bp, Mus musculus
tcggcttcagtggtcttggtgagca

SEQ ID NO: 824968 - DNA, 25 bp, Mus musculus
tcggcttccagtagtaagcgcctta

SEQ ID NO: 824969 - DNA, 25 bp, Mus musculus
tcggcttccagttgtaagcgcctta

SEQ ID NO: 824970 - DNA, 25 bp, Mus musculus
tcggcttcctggaacccaagcgcag

SEQ ID NO: 824971 - DNA, 25 bp, Mus musculus
tcggcttcctggtacccaagcgcag

SEQ ID NO: 824972 - DNA, 25 bp, Mus musculus
tcggcttctctcacttggattagac

SEQ ID NO: 824973 - DNA, 25 bp, Mus musculus
tcggcttctctctcttggattagac

SEQ ID NO: 824974 - DNA, 25 bp, Mus musculus
tcggcttgaaatccctggaacacct

SEQ ID NO: 824975 - DNA, 25 bp, Mus musculus
tcggcttgaaatgcctggaacacct

SEQ ID NO: 824976 - DNA, 25 bp, Mus musculus
tcggcttgatgtagcgctgccaaag

SEQ ID NO: 824977 - DNA, 25 bp, Mus musculus
tcggcttgatgttgcgctgccaaag

SEQ ID NO: 824978 - DNA, 25 bp, Mus musculus
tcggcttggctcataagctgcagta

SEQ ID NO: 824979 - DNA, 25 bp, Mus musculus
tcggcttggctcttaagctgcagta

SEQ ID NO: 824980 - DNA, 25 bp, Mus musculus
tcggcttgtcttactccatttagga

SEQ ID NO: 824981 - DNA, 25 bp, Mus musculus
tcggcttgtctttctccatttagga

SEQ ID NO: 824982 - DNA, 25 bp, Mus musculus
tcggctttacctcacactgaatgaa

SEQ ID NO: 824983 - DNA, 25 bp, Mus musculus
tcggctttacctgacactgaatgaa

SEQ ID NO: 824984 - DNA, 25 bp, Mus musculus
tcggctttagccacagacagaatca

SEQ ID NO: 824985 - DNA, 25 bp, Mus musculus
tcggctttagcctcagacagaatca

SEQ ID NO: 824986 - DNA, 25 bp, Mus musculus
tcggctttctctattccttttccct

SEQ ID NO: 824987 - DNA, 25 bp, Mus musculus
tcggctttctcttttccttttccct

SEQ ID NO: 824988 - DNA, 25 bp, Mus musculus
tcggctttgatgatacatgctgtct

SEQ ID NO: 824989 - DNA, 25 bp, Mus musculus
tcggctttgatgttacatgctgtct

SEQ ID NO: 824990 - DNA, 25 bp, Mus musculus
tcggctttggttagcacaggatgct

SEQ ID NO: 824991 - DNA, 25 bp, Mus musculus
tcggctttggtttgcacaggatgct

SEQ ID NO: 824992 - DNA, 25 bp, Mus musculus
tcggcttttaccaagcatgatggga

SEQ ID NO: 824993 - DNA, 25 bp, Mus musculus
tcggcttttacctagcatgatggga

SEQ ID NO: 824994 - DNA, 25 bp, Mus musculus
tcgggaaaggacacactcgtctgtg

SEQ ID NO: 824995 - DNA, 25 bp, Mus musculus
tcgggaaaggactcactcgtctgtg

SEQ ID NO: 824996 - DNA, 25 bp, Mus musculus
tcgggaaattcaaaagtctacaagt

SEQ ID NO: 824997 - DNA, 25 bp, Mus musculus
tcgggaaattcataagtctacaagt

SEQ ID NO: 824998 - DNA, 25 bp, Mus musculus
tcgggaacagccagggtatggacca

SEQ ID NO: 824999 - DNA, 25 bp, Mus musculus
tcgggaacagcctgggtatggacca

SEQ ID NO: 825000 - DNA, 25 bp, Mus musculus
tcgggaacccatcctttctttctgg

SEQ ID NO: 825001 - DNA, 25 bp, Mus musculus
tcgggaacccatgctttctttctgg

SEQ ID NO: 825002 - DNA, 25 bp, Mus musculus
tcgggaaccctcagtgcctttaata

SEQ ID NO: 825003 - DNA, 25 bp, Mus musculus
tcgggaaccctctgtgcctttaata

SEQ ID NO: 825004 - DNA, 25 bp, Mus musculus
tcgggaacctcaactgtgcaactga

SEQ ID NO: 825005 - DNA, 25 bp, Mus musculus
tcgggaacctcatctgtgcaactga

SEQ ID NO: 825006 - DNA, 25 bp, Mus musculus
tcgggaacgcgaaccaccaattgaa

SEQ ID NO: 825007 - DNA, 25 bp, Mus musculus
tcgggaacgcgatccaccaattgaa

SEQ ID NO: 825008 - DNA, 25 bp, Mus musculus
tcgggaagagttccccgccagcctt

SEQ ID NO: 825009 - DNA, 25 bp, Mus musculus
tcgggaagagttgcccgccagcctt

SEQ ID NO: 825010 - DNA, 25 bp, Mus musculus
tcgggaagtgttctttattcaataa

SEQ ID NO: 825011 - DNA, 25 bp, Mus musculus
tcgggaagtgttgtttattcaataa

SEQ ID NO: 825012 - DNA, 25 bp, Mus musculus
tcgggaatgcttatgggtacctagc

SEQ ID NO: 825013 - DNA, 25 bp, Mus musculus
tcgggaatgcttttgggtacctagc

SEQ ID NO: 825014 - DNA, 25 bp, Mus musculus
tcgggacacatcacaatccagctgt

SEQ ID NO: 825015 - DNA, 25 bp, Mus musculus
tcgggacacatctcaatccagctgt

SEQ ID NO: 825016 - DNA, 25 bp, Mus musculus
tcgggacaccttagggaagttggct

SEQ ID NO: 825017 - DNA, 25 bp, Mus musculus
tcgggacacctttgggaagttggct

SEQ ID NO: 825018 - DNA, 25 bp, Mus musculus
tcgggacagagacgttcaaaggact

SEQ ID NO: 825019 - DNA, 25 bp, Mus musculus
tcgggacagagaggttcaaaggact

SEQ ID NO: 825020 - DNA, 25 bp, Mus musculus
tcgggacagagtcatttaccttgat

SEQ ID NO: 825021 - DNA, 25 bp, Mus musculus
tcgggacagagtgatttaccttgat

SEQ ID NO: 825022 - DNA, 25 bp, Mus musculus
tcgggacatttcatttatcgctttt

SEQ ID NO: 825023 - DNA, 25 bp, Mus musculus
tcgggacatttcttttatcgctttt

SEQ ID NO: 825024 - DNA, 25 bp, Mus musculus
tcgggaccgcagcacttctcgggct

SEQ ID NO: 825025 - DNA, 25 bp, Mus musculus
tcgggaccgcaggacttctcgggct

SEQ ID NO: 825026 - DNA, 25 bp, Mus musculus
tcgggacgaactaacaaccccacag

SEQ ID NO: 825027 - DNA, 25 bp, Mus musculus
tcgggacgaacttacaaccccacag

SEQ ID NO: 825028 - DNA, 25 bp, Mus musculus
tcgggacgctggagttcactgtgat

SEQ ID NO: 825029 - DNA, 25 bp, Mus musculus
tcgggacgctggtgttcactgtgat

SEQ ID NO: 825030 - DNA, 25 bp, Mus musculus
tcgggactcaaaacaaccggaccgg

SEQ ID NO: 825031 - DNA, 25 bp, Mus musculus
tcgggactcaaatcaaccggaccgg

SEQ ID NO: 825032 - DNA, 25 bp, Mus musculus
tcgggactctctcttcttgggtgga

SEQ ID NO: 825033 - DNA, 25 bp, Mus musculus
tcgggactctctgttcttgggtgga

SEQ ID NO: 825034 - DNA, 25 bp, Mus musculus
tcgggactcttaacggcacagcgca

SEQ ID NO: 825035 - DNA, 25 bp, Mus musculus
tcgggactcttatcggcacagcgca

SEQ ID NO: 825036 - DNA, 25 bp, Mus musculus
tcgggactgaggcacacccacgctg

SEQ ID NO: 825037 - DNA, 25 bp, Mus musculus
tcgggactgagggacacccacgctg

SEQ ID NO: 825038 - DNA, 25 bp, Mus musculus
tcgggactggtgaacttgtgacaat

SEQ ID NO: 825039 - DNA, 25 bp, Mus musculus
tcgggactggtgtacttgtgacaat

SEQ ID NO: 825040 - DNA, 25 bp, Mus musculus
tcgggacttcacattagcttcaact

SEQ ID NO: 825041 - DNA, 25 bp, Mus musculus
tcgggacttcactttagcttcaact

SEQ ID NO: 825042 - DNA, 25 bp, Mus musculus
tcgggacttgatccaatccggatca

SEQ ID NO: 825043 - DNA, 25 bp, Mus musculus
tcgggacttgatgcaatccggatca

SEQ ID NO: 825044 - DNA, 25 bp, Mus musculus
tcgggactttggagtctgaagatct

SEQ ID NO: 825045 - DNA, 25 bp, Mus musculus
tcgggactttggtgtctgaagatct

SEQ ID NO: 825046 - DNA, 25 bp, Mus musculus
tcgggagaccacagggtataatcta

SEQ ID NO: 825047 - DNA, 25 bp, Mus musculus
tcgggagaccactgggtataatcta

SEQ ID NO: 825048 - DNA, 25 bp, Mus musculus
tcgggagagccccaacctgagtttg

SEQ ID NO: 825049 - DNA, 25 bp, Mus musculus
tcgggagagcccgaacctgagtttg

SEQ ID NO: 825050 - DNA, 25 bp, Mus musculus
tcgggagagtctcagctttgtttga

SEQ ID NO: 825051 - DNA, 25 bp, Mus musculus
tcgggagagtctgagctttgtttga

SEQ ID NO: 825052 - DNA, 25 bp, Mus musculus
tcgggagattgccacttccacaact

SEQ ID NO: 825053 - DNA, 25 bp, Mus musculus
tcgggagattgcgacttccacaact

SEQ ID NO: 825054 - DNA, 25 bp, Mus musculus
tcgggagcctaccagtgcttcgcca

SEQ ID NO: 825055 - DNA, 25 bp, Mus musculus
tcgggagcctacgagtgcttcgcca

SEQ ID NO: 825056 - DNA, 25 bp, Mus musculus
tcgggagctgaaatagtctattacc

SEQ ID NO: 825057 - DNA, 25 bp, Mus musculus
tcgggagctgaattagtctattacc

SEQ ID NO: 825058 - DNA, 25 bp, Mus musculus
tcgggagctggaagccgttcatgaa

SEQ ID NO: 825059 - DNA, 25 bp, Mus musculus
tcgggagctggatgccgttcatgaa

SEQ ID NO: 825060 - DNA, 25 bp, Mus musculus
tcgggaggaccgcatgcctctacat

SEQ ID NO: 825061 - DNA, 25 bp, Mus musculus
tcgggaggaccggatgcctctacat

SEQ ID NO: 825062 - DNA, 25 bp, Mus musculus
tcgggaggctgtattgcacaggcat

SEQ ID NO: 825063 - DNA, 25 bp, Mus musculus
tcgggaggctgttttgcacaggcat

SEQ ID NO: 825064 - DNA, 25 bp, Mus musculus
tcgggagtctatagtctcttccttc

SEQ ID NO: 825065 - DNA, 25 bp, Mus musculus
tcgggagtctattgtctcttccttc

SEQ ID NO: 825066 - DNA, 25 bp, Mus musculus
tcgggagtgtgtatccccttatata

SEQ ID NO: 825067 - DNA, 25 bp, Mus musculus
tcgggagtgtgtttccccttatata

SEQ ID NO: 825068 - DNA, 25 bp, Mus musculus
tcgggagtgttcatcagtctagaca

SEQ ID NO: 825069 - DNA, 25 bp, Mus musculus
tcgggagtgttcttcagtctagaca

SEQ ID NO: 825070 - DNA, 25 bp, Mus musculus
tcgggagttctccaccgctgtcgga

SEQ ID NO: 825071 - DNA, 25 bp, Mus musculus
tcgggagttctcgaccgctgtcgga

SEQ ID NO: 825072 - DNA, 25 bp, Mus musculus
tcgggagttgtgacaatgttctcta

SEQ ID NO: 825073 - DNA, 25 bp, Mus musculus
tcgggagttgtgtcaatgttctcta

SEQ ID NO: 825074 - DNA, 25 bp, Mus musculus
tcgggatactcaacaccgtgccttt

SEQ ID NO: 825075 - DNA, 25 bp, Mus musculus
tcgggatactcatcaccgtgccttt

SEQ ID NO: 825076 - DNA, 25 bp, Mus musculus
tcgggatctgtcagccactagccca

SEQ ID NO: 825077 - DNA, 25 bp, Mus musculus
tcgggatctgtctgccactagccca

SEQ ID NO: 825078 - DNA, 25 bp, Mus musculus
tcgggatgacaaaccattagctgtt

SEQ ID NO: 825079 - DNA, 25 bp, Mus musculus
tcgggatgacaatccattagctgtt

SEQ ID NO: 825080 - DNA, 25 bp, Mus musculus
tcgggatgccccatggttcgtccta

SEQ ID NO: 825081 - DNA, 25 bp, Mus musculus
tcgggatgccccttggttcgtccta

SEQ ID NO: 825082 - DNA, 25 bp, Mus musculus
tcgggatgctctaccatcgggataa

SEQ ID NO: 825083 - DNA, 25 bp, Mus musculus
tcgggatgctcttccatcgggataa

SEQ ID NO: 825084 - DNA, 25 bp, Mus musculus
tcgggatggattagagctggctcat

SEQ ID NO: 825085 - DNA, 25 bp, Mus musculus
tcgggatggatttgagctggctcat

SEQ ID NO: 825086 - DNA, 25 bp, Mus musculus
tcgggcaaccggaattttagcagca

SEQ ID NO: 825087 - DNA, 25 bp, Mus musculus
tcgggcaaccggtattttagcagca

SEQ ID NO: 825088 - DNA, 25 bp, Mus musculus
tcgggcaatctcatcatcctaattg

SEQ ID NO: 825089 - DNA, 25 bp, Mus musculus
tcgggcaatctcttcatcctaattg

SEQ ID NO: 825090 - DNA, 25 bp, Mus musculus
tcgggcaatggacatctacgtcaat

SEQ ID NO: 825091 - DNA, 25 bp, Mus musculus
tcgggcaatggagatctacgtcaat

SEQ ID NO: 825092 - DNA, 25 bp, Mus musculus
tcgggcacagttactttccgtcttt

SEQ ID NO: 825093 - DNA, 25 bp, Mus musculus
tcgggcacagtttctttccgtcttt

SEQ ID NO: 825094 - DNA, 25 bp, Mus musculus
tcgggcacatgaatgttgagaacgt

SEQ ID NO: 825095 - DNA, 25 bp, Mus musculus
tcgggcacatgattgttgagaacgt

SEQ ID NO: 825096 - DNA, 25 bp, Mus musculus
tcgggcacgtcaaccacagaagttg

SEQ ID NO: 825097 - DNA, 25 bp, Mus musculus
tcgggcacgtcatccacagaagttg

SEQ ID NO: 825098 - DNA, 25 bp, Mus musculus
tcgggcagattgctcactggtgtct

SEQ ID NO: 825099 - DNA, 25 bp, Mus musculus
tcgggcagattggtcactggtgtct

SEQ ID NO: 825100 - DNA, 25 bp, Mus musculus
tcgggcagcgtgaactggactttac

SEQ ID NO: 825101 - DNA, 25 bp, Mus musculus
tcgggcagcgtgtactggactttac

SEQ ID NO: 825102 - DNA, 25 bp, Mus musculus
tcgggcatccatctgtaacgcgctg

SEQ ID NO: 825103 - DNA, 25 bp, Mus musculus
tcgggcatccatgtgtaacgcgctg

SEQ ID NO: 825104 - DNA, 25 bp, Mus musculus
tcgggcatcccgatagaagcttatg

SEQ ID NO: 825105 - DNA, 25 bp, Mus musculus
tcgggcatcccgttagaagcttatg

SEQ ID NO: 825106 - DNA, 25 bp, Mus musculus
tcgggcatcggcatcggcatgtcag

SEQ ID NO: 825107 - DNA, 25 bp, Mus musculus
tcgggcatcggcttcggcatgtcag

SEQ ID NO: 825108 - DNA, 25 bp, Mus musculus
tcgggccaaagtacagaatgggcag

SEQ ID NO: 825109 - DNA, 25 bp, Mus musculus
tcgggccaaagttcagaatgggcag

SEQ ID NO: 825110 - DNA, 25 bp, Mus musculus
tcgggccaataaactgatgttactg

SEQ ID NO: 825111 - DNA, 25 bp, Mus musculus
tcgggccaataatctgatgttactg

SEQ ID NO: 825112 - DNA, 25 bp, Mus musculus
tcgggccaatggacactcttttgtg

SEQ ID NO: 825113 - DNA, 25 bp, Mus musculus
tcgggccaatggtcactcttttgtg

SEQ ID NO: 825114 - DNA, 25 bp, Mus musculus
tcgggccagcctccagaaagtattc

SEQ ID NO: 825115 - DNA, 25 bp, Mus musculus
tcgggccagcctgcagaaagtattc

SEQ ID NO: 825116 - DNA, 25 bp, Mus musculus
tcgggccaggtaaactgcctaggaa

SEQ ID NO: 825117 - DNA, 25 bp, Mus musculus
tcgggccaggtatactgcctaggaa

SEQ ID NO: 825118 - DNA, 25 bp, Mus musculus
tcgggccatccacaagaaaattgac

SEQ ID NO: 825119 - DNA, 25 bp, Mus musculus
tcgggccatccagaagaaaattgac

SEQ ID NO: 825120 - DNA, 25 bp, Mus musculus
tcgggccattgcagtatgctctttg

SEQ ID NO: 825121 - DNA, 25 bp, Mus musculus
tcgggccattgctgtatgctctttg

SEQ ID NO: 825122 - DNA, 25 bp, Mus musculus
tcgggccccaacagtatcagagtta

SEQ ID NO: 825123 - DNA, 25 bp, Mus musculus
tcgggccccaactgtatcagagtta

SEQ ID NO: 825124 - DNA, 25 bp, Mus musculus
tcgggccctaggagggtaactgcac

SEQ ID NO: 825125 - DNA, 25 bp, Mus musculus
tcgggccctaggtgggtaactgcac

SEQ ID NO: 825126 - DNA, 25 bp, Mus musculus
tcgggccctgcactatgatatatga

SEQ ID NO: 825127 - DNA, 25 bp, Mus musculus
tcgggccctgcagtatgatatatga

SEQ ID NO: 825128 - DNA, 25 bp, Mus musculus
tcgggccgatggaatggacacagtc

SEQ ID NO: 825129 - DNA, 25 bp, Mus musculus
tcgggccgatggtatggacacagtc

SEQ ID NO: 825130 - DNA, 25 bp, Mus musculus
tcgggccgattgacgctcacaaaaa

SEQ ID NO: 825131 - DNA, 25 bp, Mus musculus
tcgggccgattgtcgctcacaaaaa

SEQ ID NO: 825132 - DNA, 25 bp, Mus musculus
tcgggccgcagaaatgaagcacatt

SEQ ID NO: 825133 - DNA, 25 bp, Mus musculus
tcgggccgcagatatgaagcacatt

SEQ ID NO: 825134 - DNA, 25 bp, Mus musculus
tcgggccgttacagtgggattgact

SEQ ID NO: 825135 - DNA, 25 bp, Mus musculus
tcgggccgttactgtgggattgact

SEQ ID NO: 825136 - DNA, 25 bp, Mus musculus
tcgggcctggttaagtggagtacct

SEQ ID NO: 825137 - DNA, 25 bp, Mus musculus
tcgggcctggtttagtggagtacct

SEQ ID NO: 825138 - DNA, 25 bp, Mus musculus
tcgggcgaacacagtgagcacctaa

SEQ ID NO: 825139 - DNA, 25 bp, Mus musculus
tcgggcgaacactgtgagcacctaa

SEQ ID NO: 825140 - DNA, 25 bp, Mus musculus
tcgggcgaaccactgtgagacacat

SEQ ID NO: 825141 - DNA, 25 bp, Mus musculus
tcgggcgaaccagtgtgagacacat

SEQ ID NO: 825142 - DNA, 25 bp, Mus musculus
tcgggcggcccaaaaaaccatcagt

SEQ ID NO: 825143 - DNA, 25 bp, Mus musculus
tcgggcggcccataaaaccatcagt

SEQ ID NO: 825144 - DNA, 25 bp, Mus musculus
tcgggcgtgaaaacagtggctatac

SEQ ID NO: 825145 - DNA, 25 bp, Mus musculus
tcgggcgtgaaatcagtggctatac

SEQ ID NO: 825146 - DNA, 25 bp, Mus musculus
tcgggcgtgttactgaccgcacaaa

SEQ ID NO: 825147 - DNA, 25 bp, Mus musculus
tcgggcgtgttagtgaccgcacaaa

SEQ ID NO: 825148 - DNA, 25 bp, Mus musculus
tcgggctaccacagaggcgtgaact

SEQ ID NO: 825149 - DNA, 25 bp, Mus musculus
tcgggctaccactgaggcgtgaact

SEQ ID NO: 825150 - DNA, 25 bp, Mus musculus
tcgggctactttctcagcatcgacg

SEQ ID NO: 825151 - DNA, 25 bp, Mus musculus
tcgggctactttgtcagcatcgacg

SEQ ID NO: 825152 - DNA, 25 bp, Mus musculus
tcgggctagcacagaactggttttg

SEQ ID NO: 825153 - DNA, 25 bp, Mus musculus
tcgggctagcactgaactggttttg

SEQ ID NO: 825154 - DNA, 25 bp, Mus musculus
tcgggctataggctaaatggaataa

SEQ ID NO: 825155 - DNA, 25 bp, Mus musculus
tcgggctatagggtaaatggaataa

SEQ ID NO: 825156 - DNA, 25 bp, Mus musculus
tcgggctccaagatgcagctgctgg

SEQ ID NO: 825157 - DNA, 25 bp, Mus musculus
tcgggctccaagttgcagctgctgg

SEQ ID NO: 825158 - DNA, 25 bp, Mus musculus
tcgggctgatgacattacacgtcca

SEQ ID NO: 825159 - DNA, 25 bp, Mus musculus
tcgggctgatgagattacacgtcca

SEQ ID NO: 825160 - DNA, 25 bp, Mus musculus
tcgggctgcccaacgtgtttctgcg

SEQ ID NO: 825161 - DNA, 25 bp, Mus musculus
tcgggctgcccaaggactttgtaga

SEQ ID NO: 825162 - DNA, 25 bp, Mus musculus
tcgggctgcccatcgtgtttctgcg

SEQ ID NO: 825163 - DNA, 25 bp, Mus musculus
tcgggctgcccatggactttgtaga

SEQ ID NO: 825164 - DNA, 25 bp, Mus musculus
tcgggctgctttctgtagcctgtca

SEQ ID NO: 825165 - DNA, 25 bp, Mus musculus
tcgggctgctttgtgtagcctgtca

SEQ ID NO: 825166 - DNA, 25 bp, Mus musculus
tcgggctggcagagacgctcagaaa

SEQ ID NO: 825167 - DNA, 25 bp, Mus musculus
tcgggctggcagtgacgctcagaaa

SEQ ID NO: 825168 - DNA, 25 bp, Mus musculus
tcgggctgggcactgcacttctcac

SEQ ID NO: 825169 - DNA, 25 bp, Mus musculus
tcgggctgggcagtgcacttctcac

SEQ ID NO: 825170 - DNA, 25 bp, Mus musculus
tcgggctggtctaacactgcatcgt

SEQ ID NO: 825171 - DNA, 25 bp, Mus musculus
tcgggctggtcttacactgcatcgt

SEQ ID NO: 825172 - DNA, 25 bp, Mus musculus
tcgggcttcagcagcatgttagtgc

SEQ ID NO: 825173 - DNA, 25 bp, Mus musculus
tcgggcttcagctgcatgttagtgc

SEQ ID NO: 825174 - DNA, 25 bp, Mus musculus
tcgggcttcggcaaagctggaatat

SEQ ID NO: 825175 - DNA, 25 bp, Mus musculus
tcgggcttcggctaagctggaatat

SEQ ID NO: 825176 - DNA, 25 bp, Mus musculus
tcgggcttctttactatattaataa

SEQ ID NO: 825177 - DNA, 25 bp, Mus musculus
tcgggcttcttttctatattaataa

SEQ ID NO: 825178 - DNA, 25 bp, Mus musculus
tcgggcttgtttagtgctctcctgt

SEQ ID NO: 825179 - DNA, 25 bp, Mus musculus
tcgggcttgttttgtgctctcctgt

SEQ ID NO: 825180 - DNA, 25 bp, Mus musculus
tcgggctttgacagtctgtacttga

SEQ ID NO: 825181 - DNA, 25 bp, Mus musculus
tcgggctttgactgtctgtacttga

SEQ ID NO: 825182 - DNA, 25 bp, Mus musculus
tcgggctttgatattcctagacttc

SEQ ID NO: 825183 - DNA, 25 bp, Mus musculus
tcgggctttgattttcctagacttc

SEQ ID NO: 825184 - DNA, 25 bp, Mus musculus
tcgggtaacaacactggccgcggtg

SEQ ID NO: 825185 - DNA, 25 bp, Mus musculus
tcgggtaacaactctggccgcggtg

SEQ ID NO: 825186 - DNA, 25 bp, Mus musculus
tcgggtacatatcctgcccctggag

SEQ ID NO: 825187 - DNA, 25 bp, Mus musculus
tcgggtacatatgctgcccctggag

SEQ ID NO: 825188 - DNA, 25 bp, Mus musculus
tcgggtaggttacttctctgagttt

SEQ ID NO: 825189 - DNA, 25 bp, Mus musculus
tcgggtaggttagttctctgagttt

SEQ ID NO: 825190 - DNA, 25 bp, Mus musculus
tcgggtatcatacagcctgttatca

SEQ ID NO: 825191 - DNA, 25 bp, Mus musculus
tcgggtatcatagagcctgttatca

SEQ ID NO: 825192 - DNA, 25 bp, Mus musculus
tcgggtatgatacacgcttgcctgg

SEQ ID NO: 825193 - DNA, 25 bp, Mus musculus
tcgggtatgatagacgcttgcctgg

SEQ ID NO: 825194 - DNA, 25 bp, Mus musculus
tcgggtattaccctatggtctcaat

SEQ ID NO: 825195 - DNA, 25 bp, Mus musculus
tcgggtattaccgtatggtctcaat

SEQ ID NO: 825196 - DNA, 25 bp, Mus musculus
tcgggtattatgatcacgcagactt

SEQ ID NO: 825197 - DNA, 25 bp, Mus musculus
tcgggtattatgttcacgcagactt

SEQ ID NO: 825198 - DNA, 25 bp, Mus musculus
tcgggtattgttacttccacagctt

SEQ ID NO: 825199 - DNA, 25 bp, Mus musculus
tcgggtattgtttcttccacagctt

SEQ ID NO: 825200 - DNA, 25 bp, Mus musculus
tcgggtatttctaactggcacagta

SEQ ID NO: 825201 - DNA, 25 bp, Mus musculus
tcgggtatttcttactggcacagta

SEQ ID NO: 825202 - DNA, 25 bp, Mus musculus
tcgggtcctgtcaggctgcccagag

SEQ ID NO: 825203 - DNA, 25 bp, Mus musculus
tcgggtcctgtctggctgcccagag

SEQ ID NO: 825204 - DNA, 25 bp, Mus musculus
tcgggtcctgttatctaaaacagca

SEQ ID NO: 825205 - DNA, 25 bp, Mus musculus
tcgggtcctgttttctaaaacagca

SEQ ID NO: 825206 - DNA, 25 bp, Mus musculus
tcgggtctcaccaggcagttttgga

SEQ ID NO: 825207 - DNA, 25 bp, Mus musculus
tcgggtctcacctggcagttttgga

SEQ ID NO: 825208 - DNA, 25 bp, Mus musculus
tcgggtctcaggctttacctaatga

SEQ ID NO: 825209 - DNA, 25 bp, Mus musculus
tcgggtctcagggtttacctaatga

SEQ ID NO: 825210 - DNA, 25 bp, Mus musculus
tcgggtctcatgatgcctttgagga

SEQ ID NO: 825211 - DNA, 25 bp, Mus musculus
tcgggtctcatgttgcctttgagga

SEQ ID NO: 825212 - DNA, 25 bp, Mus musculus
tcgggtcttgttactggatgggtct

SEQ ID NO: 825213 - DNA, 25 bp, Mus musculus
tcgggtcttgtttctggatgggtct

SEQ ID NO: 825214 - DNA, 25 bp, Mus musculus
tcgggtgacatgcttctaatcacct

SEQ ID NO: 825215 - DNA, 25 bp, Mus musculus
tcgggtgacatggttctaatcacct

SEQ ID NO: 825216 - DNA, 25 bp, Mus musculus
tcgggtgatcccatcagcgcatact

SEQ ID NO: 825217 - DNA, 25 bp, Mus musculus
tcgggtgatcccttcagcgcatact

SEQ ID NO: 825218 - DNA, 25 bp, Mus musculus
tcgggtgccttaagcagtgactaca

SEQ ID NO: 825219 - DNA, 25 bp, Mus musculus
tcgggtgccttatgcagtgactaca

SEQ ID NO: 825220 - DNA, 25 bp, Mus musculus
tcgggtggaaatacggcagagcaca

SEQ ID NO: 825221 - DNA, 25 bp, Mus musculus
tcgggtggaaattcggcagagcaca

SEQ ID NO: 825222 - DNA, 25 bp, Mus musculus
tcgggtgggcatccaaagtgaacca

SEQ ID NO: 825223 - DNA, 25 bp, Mus musculus
tcgggtgggcatgcaaagtgaacca

SEQ ID NO: 825224 - DNA, 25 bp, Mus musculus
tcgggttcacgcagcgcggagactc

SEQ ID NO: 825225 - DNA, 25 bp, Mus musculus
tcgggttcacgctgcgcggagactc

SEQ ID NO: 825226 - DNA, 25 bp, Mus musculus
tcgggttcagatacagctcggattt

SEQ ID NO: 825227 - DNA, 25 bp, Mus musculus
tcgggttcagattcagctcggattt

SEQ ID NO: 825228 - DNA, 25 bp, Mus musculus
tcgggttcccaaaaaagacactctt

SEQ ID NO: 825229 - DNA, 25 bp, Mus musculus
tcgggttcccaataaagacactctt

SEQ ID NO: 825230 - DNA, 25 bp, Mus musculus
tcgggttccctgcatagacagcacc

SEQ ID NO: 825231 - DNA, 25 bp, Mus musculus
tcgggttccctggatagacagcacc

SEQ ID NO: 825232 - DNA, 25 bp, Mus musculus
tcgggttctattagggagtgactgc

SEQ ID NO: 825233 - DNA, 25 bp, Mus musculus
tcgggttctatttgggagtgactgc

SEQ ID NO: 825234 - DNA, 25 bp, Mus musculus
tcgggttgaacacccagaatgagcg

SEQ ID NO: 825235 - DNA, 25 bp, Mus musculus
tcgggttgaacagccagaatgagcg

SEQ ID NO: 825236 - DNA, 25 bp, Mus musculus
tcgggttgaattcactttccctgac

SEQ ID NO: 825237 - DNA, 25 bp, Mus musculus
tcgggttgaattgactttccctgac

SEQ ID NO: 825238 - DNA, 25 bp, Mus musculus
tcgggttgctgcacggcctggccac

SEQ ID NO: 825239 - DNA, 25 bp, Mus musculus
tcgggttgctgctcggcctggccac

SEQ ID NO: 825240 - DNA, 25 bp, Mus musculus
tcgggtttaagcatagcctccgcag

SEQ ID NO: 825241 - DNA, 25 bp, Mus musculus
tcgggtttaagcttagcctccgcag

SEQ ID NO: 825242 - DNA, 25 bp, Mus musculus
tcgggtttctccatccactaggtag

SEQ ID NO: 825243 - DNA, 25 bp, Mus musculus
tcgggtttctccttccactaggtag

SEQ ID NO: 825244 - DNA, 25 bp, Mus musculus
tcgggtttgtctccttaaaatatag

SEQ ID NO: 825245 - DNA, 25 bp, Mus musculus
tcgggtttgtctgcttaaaatatag

SEQ ID NO: 825246 - DNA, 25 bp, Mus musculus
tcgggttttggcagtaacatatttt

SEQ ID NO: 825247 - DNA, 25 bp, Mus musculus
tcgggttttggcagtttggtaccag

SEQ ID NO: 825248 - DNA, 25 bp, Mus musculus
tcgggttttggctgtaacatatttt

SEQ ID NO: 825249 - DNA, 25 bp, Mus musculus
tcgggttttggctgtttggtaccag

SEQ ID NO: 825250 - DNA, 25 bp, Mus musculus
tcgggtttttgtcgattcagacctg

SEQ ID NO: 825251 - DNA, 25 bp, Mus musculus
tcgggtttttgtggattcagacctg

SEQ ID NO: 825252 - DNA, 25 bp, Mus musculus
tcggtacaatgacggcttctcaaca

SEQ ID NO: 825253 - DNA, 25 bp, Mus musculus
tcggtacaatgagggcttctcaaca

SEQ ID NO: 825254 - DNA, 25 bp, Mus musculus
tcggtaccgctgagttttctttctt

SEQ ID NO: 825255 - DNA, 25 bp, Mus musculus
tcggtaccgctgtgttttctttctt

SEQ ID NO: 825256 - DNA, 25 bp, Mus musculus
tcggtacttccgcagccgcgtggtt

SEQ ID NO: 825257 - DNA, 25 bp, Mus musculus
tcggtacttccggagccgcgtggtt

SEQ ID NO: 825258 - DNA, 25 bp, Mus musculus
tcggtagagtggatctggtgctaga

SEQ ID NO: 825259 - DNA, 25 bp, Mus musculus
tcggtagagtggttctggtgctaga

SEQ ID NO: 825260 - DNA, 25 bp, Mus musculus
tcggtaggcctccatgagaccctcg

SEQ ID NO: 825261 - DNA, 25 bp, Mus musculus
tcggtaggcctcgatgagaccctcg

SEQ ID NO: 825262 - DNA, 25 bp, Mus musculus
tcggtatcctcacccgtgaagtgag

SEQ ID NO: 825263 - DNA, 25 bp, Mus musculus
tcggtatcctcagccgtgaagtgag

SEQ ID NO: 825264 - DNA, 25 bp, Mus musculus
tcggtatgcaccatataataacaaa

SEQ ID NO: 825265 - DNA, 25 bp, Mus musculus
tcggtatgcaccttataataacaaa

SEQ ID NO: 825266 - DNA, 25 bp, Mus musculus
tcggtcaccttcaagtccatgagac

SEQ ID NO: 825267 - DNA, 25 bp, Mus musculus
tcggtcaccttctagtccatgagac

SEQ ID NO: 825268 - DNA, 25 bp, Mus musculus
tcggtcagcgtcatcccgcaagcgg

SEQ ID NO: 825269 - DNA, 25 bp, Mus musculus
tcggtcagcgtcttcccgcaagcgg

SEQ ID NO: 825270 - DNA, 25 bp, Mus musculus
tcggtcagttgacagcacagcagca

SEQ ID NO: 825271 - DNA, 25 bp, Mus musculus
tcggtcagttgagagcacagcagca

SEQ ID NO: 825272 - DNA, 25 bp, Mus musculus
tcggtcatcatcaccaacggcaggt

SEQ ID NO: 825273 - DNA, 25 bp, Mus musculus
tcggtcatcatctccaacggcaggt

SEQ ID NO: 825274 - DNA, 25 bp, Mus musculus
tcggtccacagaccatgggctacaa

SEQ ID NO: 825275 - DNA, 25 bp, Mus musculus
tcggtccacagagcatgggctacaa

SEQ ID NO: 825276 - DNA, 25 bp, Mus musculus
tcggtccctgagctggtattacttt

SEQ ID NO: 825277 - DNA, 25 bp, Mus musculus
tcggtccctgaggtggtattacttt

SEQ ID NO: 825278 - DNA, 25 bp, Mus musculus
tcggtcctgaagcatggcagccatc

SEQ ID NO: 825279 - DNA, 25 bp, Mus musculus
tcggtcctgaaggatggcagccatc

SEQ ID NO: 825280 - DNA, 25 bp, Mus musculus
tcggtcctgcagagcagctcagttg

SEQ ID NO: 825281 - DNA, 25 bp, Mus musculus
tcggtcctgcagtgcagctcagttg

SEQ ID NO: 825282 - DNA, 25 bp, Mus musculus
tcggtcgagcagaacccagaactgt

SEQ ID NO: 825283 - DNA, 25 bp, Mus musculus
tcggtcgagcagtacccagaactgt

SEQ ID NO: 825284 - DNA, 25 bp, Mus musculus
tcggtctcaccgacttcaggaaaag

SEQ ID NO: 825285 - DNA, 25 bp, Mus musculus
tcggtctcaccgtcttcaggaaaag

SEQ ID NO: 825286 - DNA, 25 bp, Mus musculus
tcggtctccttccaagctacttgag

SEQ ID NO: 825287 - DNA, 25 bp, Mus musculus
tcggtctccttcgaagctacttgag

SEQ ID NO: 825288 - DNA, 25 bp, Mus musculus
tcggtctcctttctgatgctgtggg

SEQ ID NO: 825289 - DNA, 25 bp, Mus musculus
tcggtctcctttgtgatgctgtggg

SEQ ID NO: 825290 - DNA, 25 bp, Mus musculus
tcggtctcttagacaccttaaaaag

SEQ ID NO: 825291 - DNA, 25 bp, Mus musculus
tcggtctcttagtcaccttaaaaag

SEQ ID NO: 825292 - DNA, 25 bp, Mus musculus
tcggtctgcacacggagctctaatc

SEQ ID NO: 825293 - DNA, 25 bp, Mus musculus
tcggtctgcacagggagctctaatc

SEQ ID NO: 825294 - DNA, 25 bp, Mus musculus
tcggtctgcattcccagtgggcagt

SEQ ID NO: 825295 - DNA, 25 bp, Mus musculus
tcggtctgcattgccagtgggcagt

SEQ ID NO: 825296 - DNA, 25 bp, Mus musculus
tcggtctgtgtgctctccctgggca

SEQ ID NO: 825297 - DNA, 25 bp, Mus musculus
tcggtctgtgtggtctccctgggca

SEQ ID NO: 825298 - DNA, 25 bp, Mus musculus
tcggtcttccatctcctcatataga

SEQ ID NO: 825299 - DNA, 25 bp, Mus musculus
tcggtcttccatgtcctcatataga

SEQ ID NO: 825300 - DNA, 25 bp, Mus musculus
tcggtcttctgaccaccttgagttc

SEQ ID NO: 825301 - DNA, 25 bp, Mus musculus
tcggtcttctgagcaccttgagttc

SEQ ID NO: 825302 - DNA, 25 bp, Mus musculus
tcggtcttcttgagctcggcttcat

SEQ ID NO: 825303 - DNA, 25 bp, Mus musculus
tcggtcttcttgtgctcggcttcat

SEQ ID NO: 825304 - DNA, 25 bp, Mus musculus
tcggtcttttataacctaaatgtct

SEQ ID NO: 825305 - DNA, 25 bp, Mus musculus
tcggtcttttattacctaaatgtct

SEQ ID NO: 825306 - DNA, 25 bp, Mus musculus
tcggtgacacagaccagacagcgct

SEQ ID NO: 825307 - DNA, 25 bp, Mus musculus
tcggtgacacagtccagacagcgct

SEQ ID NO: 825308 - DNA, 25 bp, Mus musculus
tcggtgaccggtactgaggatccaa

SEQ ID NO: 825309 - DNA, 25 bp, Mus musculus
tcggtgaccggttctgaggatccaa

SEQ ID NO: 825310 - DNA, 25 bp, Mus musculus
tcggtgagcttacacgtgagtcctc

SEQ ID NO: 825311 - DNA, 25 bp, Mus musculus
tcggtgagcttagacgtgagtcctc

SEQ ID NO: 825312 - DNA, 25 bp, Mus musculus
tcggtgatccatccgttcaggcaat

SEQ ID NO: 825313 - DNA, 25 bp, Mus musculus
tcggtgatccatgcgttcaggcaat

SEQ ID NO: 825314 - DNA, 25 bp, Mus musculus
tcggtgcaggagctcgtgactcttt

SEQ ID NO: 825315 - DNA, 25 bp, Mus musculus
tcggtgcaggaggtcgtgactcttt

SEQ ID NO: 825316 - DNA, 25 bp, Mus musculus
tcggtgcatgtgcttttccacggag

SEQ ID NO: 825317 - DNA, 25 bp, Mus musculus
tcggtgcatgtggttttccacggag

SEQ ID NO: 825318 - DNA, 25 bp, Mus musculus
tcggtgccaatcactgggtcaccaa

SEQ ID NO: 825319 - DNA, 25 bp, Mus musculus
tcggtgccaatctctgggtcaccaa

SEQ ID NO: 825320 - DNA, 25 bp, Mus musculus
tcggtgccagctccagagccagaaa

SEQ ID NO: 825321 - DNA, 25 bp, Mus musculus
tcggtgccagctgcagagccagaaa

SEQ ID NO: 825322 - DNA, 25 bp, Mus musculus
tcggtgcccataactctgtctacat

SEQ ID NO: 825323 - DNA, 25 bp, Mus musculus
tcggtgcccatatctctgtctacat

SEQ ID NO: 825324 - DNA, 25 bp, Mus musculus
tcggtgcccatgagagtttcttatc

SEQ ID NO: 825325 - DNA, 25 bp, Mus musculus
tcggtgcccatgtgagtttcttatc

SEQ ID NO: 825326 - DNA, 25 bp, Mus musculus
tcggtgccccggctcagtcacagtg

SEQ ID NO: 825327 - DNA, 25 bp, Mus musculus
tcggtgccccgggtcagtcacagtg

SEQ ID NO: 825328 - DNA, 25 bp, Mus musculus
tcggtgctatgcaaccctgaccatg

SEQ ID NO: 825329 - DNA, 25 bp, Mus musculus
tcggtgctatgctaccctgaccatg

SEQ ID NO: 825330 - DNA, 25 bp, Mus musculus
tcggtgctcaaacaataatacatag

SEQ ID NO: 825331 - DNA, 25 bp, Mus musculus
tcggtgctcaaagaataatacatag

SEQ ID NO: 825332 - DNA, 25 bp, Mus musculus
tcggtgcttcccctaacagtgtttg

SEQ ID NO: 825333 - DNA, 25 bp, Mus musculus
tcggtgcttcccgtaacagtgtttg

SEQ ID NO: 825334 - DNA, 25 bp, Mus musculus
tcggtgcttctgatactagacttgg

SEQ ID NO: 825335 - DNA, 25 bp, Mus musculus
tcggtgcttctgttactagacttgg

SEQ ID NO: 825336 - DNA, 25 bp, Mus musculus
tcggtggaaaggctcttggaaatca

SEQ ID NO: 825337 - DNA, 25 bp, Mus musculus
tcggtggaaagggtcttggaaatca

SEQ ID NO: 825338 - DNA, 25 bp, Mus musculus
tcggtggaacccacagtgaaaggca

SEQ ID NO: 825339 - DNA, 25 bp, Mus musculus
tcggtggaaccctcagtgaaaggca

SEQ ID NO: 825340 - DNA, 25 bp, Mus musculus
tcggtggattggcagcccgcgggcg

SEQ ID NO: 825341 - DNA, 25 bp, Mus musculus
tcggtggattgggagcccgcgggcg

SEQ ID NO: 825342 - DNA, 25 bp, Mus musculus
tcggtggccccgctaacttggtgct

SEQ ID NO: 825343 - DNA, 25 bp, Mus musculus
tcggtggccccggtaacttggtgct

SEQ ID NO: 825344 - DNA, 25 bp, Mus musculus
tcggtggcctgtattggtgcaatcc

SEQ ID NO: 825345 - DNA, 25 bp, Mus musculus
tcggtggcctgttttggtgcaatcc

SEQ ID NO: 825346 - DNA, 25 bp, Mus musculus
tcggtgggaacgaacaagagctttt

SEQ ID NO: 825347 - DNA, 25 bp, Mus musculus
tcggtgggaacgtacaagagctttt

SEQ ID NO: 825348 - DNA, 25 bp, Mus musculus
tcggtgggcacaacgctgcatttaa

SEQ ID NO: 825349 - DNA, 25 bp, Mus musculus
tcggtgggcacatcgctgcatttaa

SEQ ID NO: 825350 - DNA, 25 bp, Mus musculus
tcggtggtctctcgttttaaggaat

SEQ ID NO: 825351 - DNA, 25 bp, Mus musculus
tcggtggtctctggttttaaggaat

SEQ ID NO: 825352 - DNA, 25 bp, Mus musculus
tcggtgtattcacgatgtctttcat

SEQ ID NO: 825353 - DNA, 25 bp, Mus musculus
tcggtgtattcaggatgtctttcat

SEQ ID NO: 825354 - DNA, 25 bp, Mus musculus
tcggtgtcattgactcagctcaaag

SEQ ID NO: 825355 - DNA, 25 bp, Mus musculus
tcggtgtcattgtctcagctcaaag

SEQ ID NO: 825356 - DNA, 25 bp, Mus musculus
tcggtgtgaacgcatttggccgtat

SEQ ID NO: 825357 - DNA, 25 bp, Mus musculus
tcggtgtgaacggatttggccgtat

SEQ ID NO: 825358 - DNA, 25 bp, Mus musculus
tcggtgtgacccagggaactcttgt

SEQ ID NO: 825359 - DNA, 25 bp, Mus musculus
tcggtgtgaccctgggaactcttgt

SEQ ID NO: 825360 - DNA, 25 bp, Mus musculus
tcggtgtgccgccaaagcagacatc

SEQ ID NO: 825361 - DNA, 25 bp, Mus musculus
tcggtgtgccgcgaaagcagacatc

SEQ ID NO: 825362 - DNA, 25 bp, Mus musculus
tcggtgtgctgtaaggtctcatata

SEQ ID NO: 825363 - DNA, 25 bp, Mus musculus
tcggtgtgctgttaggtctcatata

SEQ ID NO: 825364 - DNA, 25 bp, Mus musculus
tcggtgtggacaccagtgcccgcat

SEQ ID NO: 825365 - DNA, 25 bp, Mus musculus
tcggtgtggacagcagtgcccgcat

SEQ ID NO: 825366 - DNA, 25 bp, Mus musculus
tcggtgtgtcttatgtctatgtggc

SEQ ID NO: 825367 - DNA, 25 bp, Mus musculus
tcggtgtgtcttttgtctatgtggc

SEQ ID NO: 825368 - DNA, 25 bp, Mus musculus
tcggtgtttgctacacagccatgaa

SEQ ID NO: 825369 - DNA, 25 bp, Mus musculus
tcggtgtttgcttcacagccatgaa

SEQ ID NO: 825370 - DNA, 25 bp, Mus musculus
tcggttatacacacattagactgaa

SEQ ID NO: 825371 - DNA, 25 bp, Mus musculus
tcggttatacactcattagactgaa

SEQ ID NO: 825372 - DNA, 25 bp, Mus musculus
tcggttatcgatcaaatctctgtag

SEQ ID NO: 825373 - DNA, 25 bp, Mus musculus
tcggttatcgatgaaatctctgtag

SEQ ID NO: 825374 - DNA, 25 bp, Mus musculus
tcggttatttagctccagcagctac

SEQ ID NO: 825375 - DNA, 25 bp, Mus musculus
tcggttatttaggtccagcagctac

SEQ ID NO: 825376 - DNA, 25 bp, Mus musculus
tcggttcatacaaaggaccttccat

SEQ ID NO: 825377 - DNA, 25 bp, Mus musculus
tcggttcatacataggaccttccat

SEQ ID NO: 825378 - DNA, 25 bp, Mus musculus
tcggttcatgctatatcctagtttt

SEQ ID NO: 825379 - DNA, 25 bp, Mus musculus
tcggttcatgctttatcctagtttt

SEQ ID NO: 825380 - DNA, 25 bp, Mus musculus
tcggttccaacaccttcgatgaata

SEQ ID NO: 825381 - DNA, 25 bp, Mus musculus
tcggttccaacagcttcgatgaata

SEQ ID NO: 825382 - DNA, 25 bp, Mus musculus
tcggttccccaaaatcttgaaagaa

SEQ ID NO: 825383 - DNA, 25 bp, Mus musculus
tcggttccccaatatcttgaaagaa

SEQ ID NO: 825384 - DNA, 25 bp, Mus musculus
tcggttcctcatcagctgcacggaa

SEQ ID NO: 825385 - DNA, 25 bp, Mus musculus
tcggttcctcatgagctgcacggaa

SEQ ID NO: 825386 - DNA, 25 bp, Mus musculus
tcggttcctgggactgatgcaatat

SEQ ID NO: 825387 - DNA, 25 bp, Mus musculus
tcggttcctgggtctgatgcaatat

SEQ ID NO: 825388 - DNA, 25 bp, Mus musculus
tcggttctaccacgcttctattgta

SEQ ID NO: 825389 - DNA, 25 bp, Mus musculus
tcggttctaccaggcttctattgta

SEQ ID NO: 825390 - DNA, 25 bp, Mus musculus
tcggttctgtctcctgaaccaggta

SEQ ID NO: 825391 - DNA, 25 bp, Mus musculus
tcggttctgtctgctgaaccaggta

SEQ ID NO: 825392 - DNA, 25 bp, Mus musculus
tcggttcttgctatggtgactgggt

SEQ ID NO: 825393 - DNA, 25 bp, Mus musculus
tcggttcttgctttggtgactgggt

SEQ ID NO: 825394 - DNA, 25 bp, Mus musculus
tcggttgaatttatgtgctcttccc

SEQ ID NO: 825395 - DNA, 25 bp, Mus musculus
tcggttgaatttttgtgctcttccc

SEQ ID NO: 825396 - DNA, 25 bp, Mus musculus
tcggttgacctgattccaccaagga

SEQ ID NO: 825397 - DNA, 25 bp, Mus musculus
tcggttgacctgtttccaccaagga

SEQ ID NO: 825398 - DNA, 25 bp, Mus musculus
tcggttgcactacccacacaaaatg

SEQ ID NO: 825399 - DNA, 25 bp, Mus musculus
tcggttgcactagccacacaaaatg

SEQ ID NO: 825400 - DNA, 25 bp, Mus musculus
tcggttggcgccatccaggactggt

SEQ ID NO: 825401 - DNA, 25 bp, Mus musculus
tcggttggcgccttccaggactggt

SEQ ID NO: 825402 - DNA, 25 bp, Mus musculus
tcggttgtccttagacttgctgaga

SEQ ID NO: 825403 - DNA, 25 bp, Mus musculus
tcggttgtcctttgacttgctgaga

SEQ ID NO: 825404 - DNA, 25 bp, Mus musculus
tcggttgtgtaccaagtcccaagac

SEQ ID NO: 825405 - DNA, 25 bp, Mus musculus
tcggttgtgtacgaagtcccaagac

SEQ ID NO: 825406 - DNA, 25 bp, Mus musculus
tcggtttattccaaggccccatggg

SEQ ID NO: 825407 - DNA, 25 bp, Mus musculus
tcggtttattcctaggccccatggg

SEQ ID NO: 825408 - DNA, 25 bp, Mus musculus
tcggtttcagtaatcaactctccac

SEQ ID NO: 825409 - DNA, 25 bp, Mus musculus
tcggtttcagtattcaactctccac

SEQ ID NO: 825410 - DNA, 25 bp, Mus musculus
tcggtttccatcagtgcttatttac

SEQ ID NO: 825411 - DNA, 25 bp, Mus musculus
tcggtttccatctgtgcttatttac

SEQ ID NO: 825412 - DNA, 25 bp, Mus musculus
tcggtttccgggattgaggctccaa

SEQ ID NO: 825413 - DNA, 25 bp, Mus musculus
tcggtttccgggtttgaggctccaa

SEQ ID NO: 825414 - DNA, 25 bp, Mus musculus
tcggtttctaggcttccgcctcgca

SEQ ID NO: 825415 - DNA, 25 bp, Mus musculus
tcggtttctagggttccgcctcgca

SEQ ID NO: 825416 - DNA, 25 bp, Mus musculus
tcggtttgaattaacccgcgggcag

SEQ ID NO: 825417 - DNA, 25 bp, Mus musculus
tcggtttgaatttacccgcgggcag

SEQ ID NO: 825418 - DNA, 25 bp, Mus musculus
tcggtttgagacacaatacatgttg

SEQ ID NO: 825419 - DNA, 25 bp, Mus musculus
tcggtttgagactcaatacatgttg

SEQ ID NO: 825420 - DNA, 25 bp, Mus musculus
tcggtttgattacgccttcgatgac

SEQ ID NO: 825421 - DNA, 25 bp, Mus musculus
tcggtttgattaggccttcgatgac

SEQ ID NO: 825422 - DNA, 25 bp, Mus musculus
tcggtttgccagagctcgggagccc

SEQ ID NO: 825423 - DNA, 25 bp, Mus musculus
tcggtttgccagtgctcgggagccc

SEQ ID NO: 825424 - DNA, 25 bp, Mus musculus
tcggtttgtgttatcctggccttct

SEQ ID NO: 825425 - DNA, 25 bp, Mus musculus
tcggtttgtgttttcctggccttct

SEQ ID NO: 825426 - DNA, 25 bp, Mus musculus
tcggttttccatatctccagaatgt

SEQ ID NO: 825427 - DNA, 25 bp, Mus musculus
tcggttttccatttctccagaatgt

SEQ ID NO: 825428 - DNA, 25 bp, Mus musculus
tcggttttctgaaacatgatctcat

SEQ ID NO: 825429 - DNA, 25 bp, Mus musculus
tcggttttctgatacatgatctcat

SEQ ID NO: 825430 - DNA, 25 bp, Mus musculus
tcgtaaaaccggctggcctggaaat

SEQ ID NO: 825431 - DNA, 25 bp, Mus musculus
tcgtaaaaccgggtggcctggaaat

SEQ ID NO: 825432 - DNA, 25 bp, Mus musculus
tcgtaaactgaacagtgcaccgcaa

SEQ ID NO: 825433 - DNA, 25 bp, Mus musculus
tcgtaaactgaagagtgcaccgcaa

SEQ ID NO: 825434 - DNA, 25 bp, Mus musculus
tcgtaaattcatctggacaaaccat

SEQ ID NO: 825435 - DNA, 25 bp, Mus musculus
tcgtaaattcatgtggacaaaccat

SEQ ID NO: 825436 - DNA, 25 bp, Mus musculus
tcgtaacagattaccccacctaagg

SEQ ID NO: 825437 - DNA, 25 bp, Mus musculus
tcgtaacagatttccccacctaagg

SEQ ID NO: 825438 - DNA, 25 bp, Mus musculus
tcgtaaccgctcaccactagttgtt

SEQ ID NO: 825439 - DNA, 25 bp, Mus musculus
tcgtaaccgctctccactagttgtt

SEQ ID NO: 825440 - DNA, 25 bp, Mus musculus
tcgtaaccgtccaccttttggtcag

SEQ ID NO: 825441 - DNA, 25 bp, Mus musculus
tcgtaaccgtcctccttttggtcag

SEQ ID NO: 825442 - DNA, 25 bp, Mus musculus
tcgtaagacatccgcgagcgactgt

SEQ ID NO: 825443 - DNA, 25 bp, Mus musculus
tcgtaagacatcggcgagcgactgt

SEQ ID NO: 825444 - DNA, 25 bp, Mus musculus
tcgtaagtcccaactgatgcagcac

SEQ ID NO: 825445 - DNA, 25 bp, Mus musculus
tcgtaagtcccatctgatgcagcac

SEQ ID NO: 825446 - DNA, 25 bp, Mus musculus
tcgtaagtgcacctggagtctctac

SEQ ID NO: 825447 - DNA, 25 bp, Mus musculus
tcgtaagtgcacgtggagtctctac

SEQ ID NO: 825448 - DNA, 25 bp, Mus musculus
tcgtaagtgccaccttgctcacggg

SEQ ID NO: 825449 - DNA, 25 bp, Mus musculus
tcgtaagtgccagcttgctcacggg

SEQ ID NO: 825450 - DNA, 25 bp, Mus musculus
tcgtaagttctgagcggtttggtat

SEQ ID NO: 825451 - DNA, 25 bp, Mus musculus
tcgtaagttctgtgcggtttggtat

SEQ ID NO: 825452 - DNA, 25 bp, Mus musculus
tcgtaagttgcacctattgttaagt

SEQ ID NO: 825453 - DNA, 25 bp, Mus musculus
tcgtaagttgcagctattgttaagt

SEQ ID NO: 825454 - DNA, 25 bp, Mus musculus
tcgtaataaaccctatcctgtccgg

SEQ ID NO: 825455 - DNA, 25 bp, Mus musculus
tcgtaataaaccgtatcctgtccgg

SEQ ID NO: 825456 - DNA, 25 bp, Mus musculus
tcgtaatcctacattcacatctttc

SEQ ID NO: 825457 - DNA, 25 bp, Mus musculus
tcgtaatcctactttcacatctttc

SEQ ID NO: 825458 - DNA, 25 bp, Mus musculus
tcgtaatgacagctttacagcctgc

SEQ ID NO: 825459 - DNA, 25 bp, Mus musculus
tcgtaatgacaggtttacagcctgc

SEQ ID NO: 825460 - DNA, 25 bp, Mus musculus
tcgtaatggcccagtggacttaagt

SEQ ID NO: 825461 - DNA, 25 bp, Mus musculus
tcgtaatggccctgtggacttaagt

SEQ ID NO: 825462 - DNA, 25 bp, Mus musculus
tcgtaatgttccagtcctttgttga

SEQ ID NO: 825463 - DNA, 25 bp, Mus musculus
tcgtaatgttcctgtcctttgttga

SEQ ID NO: 825464 - DNA, 25 bp, Mus musculus
tcgtaattacaacattccagccaag

SEQ ID NO: 825465 - DNA, 25 bp, Mus musculus
tcgtaattacaagattccagccaag

SEQ ID NO: 825466 - DNA, 25 bp, Mus musculus
tcgtacaacctgcacgtggaccatg

SEQ ID NO: 825467 - DNA, 25 bp, Mus musculus
tcgtacaacctggacgtggaccatg

SEQ ID NO: 825468 - DNA, 25 bp, Mus musculus
tcgtacaagcgcagccttcactcgt

SEQ ID NO: 825469 - DNA, 25 bp, Mus musculus
tcgtacaagcgctgccttcactcgt

SEQ ID NO: 825470 - DNA, 25 bp, Mus musculus
tcgtacacccctcgcttgggaagga

SEQ ID NO: 825471 - DNA, 25 bp, Mus musculus
tcgtacacccctggcttgggaagga

SEQ ID NO: 825472 - DNA, 25 bp, Mus musculus
tcgtacactctgatggcttggtagg

SEQ ID NO: 825473 - DNA, 25 bp, Mus musculus
tcgtacactctgttggcttggtagg

SEQ ID NO: 825474 - DNA, 25 bp, Mus musculus
tcgtacatctgtagccctgatgaca

SEQ ID NO: 825475 - DNA, 25 bp, Mus musculus
tcgtacatctgttgccctgatgaca

SEQ ID NO: 825476 - DNA, 25 bp, Mus musculus
tcgtaccaagcaatggatctccctg

SEQ ID NO: 825477 - DNA, 25 bp, Mus musculus
tcgtaccaagcattggatctccctg

SEQ ID NO: 825478 - DNA, 25 bp, Mus musculus
tcgtaccagctccagaaatttgtta

SEQ ID NO: 825479 - DNA, 25 bp, Mus musculus
tcgtaccagctcgagaaatttgtta

SEQ ID NO: 825480 - DNA, 25 bp, Mus musculus
tcgtaccccaagcagagatgttctc

SEQ ID NO: 825481 - DNA, 25 bp, Mus musculus
tcgtaccccaaggagagatgttctc

SEQ ID NO: 825482 - DNA, 25 bp, Mus musculus
tcgtaccttcccagaggttgtacaa

SEQ ID NO: 825483 - DNA, 25 bp, Mus musculus
tcgtaccttccctgaggttgtacaa

SEQ ID NO: 825484 - DNA, 25 bp, Mus musculus
tcgtaccttcctcgtcttgctagat

SEQ ID NO: 825485 - DNA, 25 bp, Mus musculus
tcgtaccttcctggtcttgctagat

SEQ ID NO: 825486 - DNA, 25 bp, Mus musculus
tcgtacctttgacttgaggctgttt

SEQ ID NO: 825487 - DNA, 25 bp, Mus musculus
tcgtacctttgagttgaggctgttt

SEQ ID NO: 825488 - DNA, 25 bp, Mus musculus
tcgtacgcgcgtcgacctctctgat

SEQ ID NO: 825489 - DNA, 25 bp, Mus musculus
tcgtacgcgcgtggacctctctgat

SEQ ID NO: 825490 - DNA, 25 bp, Mus musculus
tcgtacgtgcctcctgtatagtata

SEQ ID NO: 825491 - DNA, 25 bp, Mus musculus
tcgtacgtgcctgctgtatagtata

SEQ ID NO: 825492 - DNA, 25 bp, Mus musculus
tcgtactctaacataaatcgttgaa

SEQ ID NO: 825493 - DNA, 25 bp, Mus musculus
tcgtactctaacttaaatcgttgaa

SEQ ID NO: 825494 - DNA, 25 bp, Mus musculus
tcgtacttagatctggagctgcaag

SEQ ID NO: 825495 - DNA, 25 bp, Mus musculus
tcgtacttagatgtggagctgcaag

SEQ ID NO: 825496 - DNA, 25 bp, Mus musculus
tcgtacttccagcatctgaggatgt

SEQ ID NO: 825497 - DNA, 25 bp, Mus musculus
tcgtacttccaggatctgaggatgt

SEQ ID NO: 825498 - DNA, 25 bp, Mus musculus
tcgtactttttgatacaatgtattc

SEQ ID NO: 825499 - DNA, 25 bp, Mus musculus
tcgtactttttgttacaatgtattc

SEQ ID NO: 825500 - DNA, 25 bp, Mus musculus
tcgtagaaagtcagctgacctctgc

SEQ ID NO: 825501 - DNA, 25 bp, Mus musculus
tcgtagaaagtctgctgacctctgc

SEQ ID NO: 825502 - DNA, 25 bp, Mus musculus
tcgtagacgttgcacaattcccagg

SEQ ID NO: 825503 - DNA, 25 bp, Mus musculus
tcgtagacgttggacaattcccagg

SEQ ID NO: 825504 - DNA, 25 bp, Mus musculus
tcgtagccatgaccttggaaggccc

SEQ ID NO: 825505 - DNA, 25 bp, Mus musculus
tcgtagccatgagcttggaaggccc

SEQ ID NO: 825506 - DNA, 25 bp, Mus musculus
tcgtagcccctactgtggtttccat

SEQ ID NO: 825507 - DNA, 25 bp, Mus musculus
tcgtagcccctagtgtggtttccat

SEQ ID NO: 825508 - DNA, 25 bp, Mus musculus
tcgtagcgacgaatctccaagtaac

SEQ ID NO: 825509 - DNA, 25 bp, Mus musculus
tcgtagcgacgattctccaagtaac

SEQ ID NO: 825510 - DNA, 25 bp, Mus musculus
tcgtagcgttcacgcacacagtatg

SEQ ID NO: 825511 - DNA, 25 bp, Mus musculus
tcgtagcgttcaggcacacagtatg

SEQ ID NO: 825512 - DNA, 25 bp, Mus musculus
tcgtaggaactaagctcgcttaata

SEQ ID NO: 825513 - DNA, 25 bp, Mus musculus
tcgtaggaactatgctcgcttaata

SEQ ID NO: 825514 - DNA, 25 bp, Mus musculus
tcgtaggcgatgaagcctctccgca

SEQ ID NO: 825515 - DNA, 25 bp, Mus musculus
tcgtaggcgatgtagcctctccgca

SEQ ID NO: 825516 - DNA, 25 bp, Mus musculus
tcgtagggcgagactaattgttaga

SEQ ID NO: 825517 - DNA, 25 bp, Mus musculus
tcgtagggcgagtctaattgttaga

SEQ ID NO: 825518 - DNA, 25 bp, Mus musculus
tcgtagtaaatgagcgcaggcgtca

SEQ ID NO: 825519 - DNA, 25 bp, Mus musculus
tcgtagtaaatgtgcgcaggcgtca

SEQ ID NO: 825520 - DNA, 25 bp, Mus musculus
tcgtagtcgaacacggcggtccaca

SEQ ID NO: 825521 - DNA, 25 bp, Mus musculus
tcgtagtcgaactcggcggtccaca

SEQ ID NO: 825522 - DNA, 25 bp, Mus musculus
tcgtagttccctccgagaacatgaa

SEQ ID NO: 825523 - DNA, 25 bp, Mus musculus
tcgtagttccctgcgagaacatgaa

SEQ ID NO: 825524 - DNA, 25 bp, Mus musculus
tcgtagttccgaccataaacgatgc

SEQ ID NO: 825525 - DNA, 25 bp, Mus musculus
tcgtagttccgagcataaacgatgc

SEQ ID NO: 825526 - DNA, 25 bp, Mus musculus
tcgtagttctagacttaggcccttt

SEQ ID NO: 825527 - DNA, 25 bp, Mus musculus
tcgtagttctagtcttaggcccttt

SEQ ID NO: 825528 - DNA, 25 bp, Mus musculus
tcgtagttttcaacccacttcttca

SEQ ID NO: 825529 - DNA, 25 bp, Mus musculus
tcgtagttttcatcccacttcttca

SEQ ID NO: 825530 - DNA, 25 bp, Mus musculus
tcgtatacttatagggctttgctta

SEQ ID NO: 825531 - DNA, 25 bp, Mus musculus
tcgtatacttattgggctttgctta

SEQ ID NO: 825532 - DNA, 25 bp, Mus musculus
tcgtatccaggccatgaaacccatg

SEQ ID NO: 825533 - DNA, 25 bp, Mus musculus
tcgtatccaggcgatgaaacccatg

SEQ ID NO: 825534 - DNA, 25 bp, Mus musculus
tcgtatccctgaactctgaatctta

SEQ ID NO: 825535 - DNA, 25 bp, Mus musculus
tcgtatccctgatctctgaatctta

SEQ ID NO: 825536 - DNA, 25 bp, Mus musculus
tcgtatcggtgtcgctttgagtaaa

SEQ ID NO: 825537 - DNA, 25 bp, Mus musculus
tcgtatcggtgtggctttgagtaaa

SEQ ID NO: 825538 - DNA, 25 bp, Mus musculus
tcgtatgagcttatgttgtttgcct

SEQ ID NO: 825539 - DNA, 25 bp, Mus musculus
tcgtatgagcttttgttgtttgcct

SEQ ID NO: 825540 - DNA, 25 bp, Mus musculus
tcgtatggtattatgatccttttca

SEQ ID NO: 825541 - DNA, 25 bp, Mus musculus
tcgtatggtattttgatccttttca

SEQ ID NO: 825542 - DNA, 25 bp, Mus musculus
tcgtattctctgagtcatggactgg

SEQ ID NO: 825543 - DNA, 25 bp, Mus musculus
tcgtattctctgtgtcatggactgg

SEQ ID NO: 825544 - DNA, 25 bp, Mus musculus
tcgtattgcgcccctagaggtgaaa

SEQ ID NO: 825545 - DNA, 25 bp, Mus musculus
tcgtattgcgccgctagaggtgaaa

SEQ ID NO: 825546 - DNA, 25 bp, Mus musculus
tcgtatttacttcctctttgttgca

SEQ ID NO: 825547 - DNA, 25 bp, Mus musculus
tcgtatttacttgctctttgttgca

SEQ ID NO: 825548 - DNA, 25 bp, Mus musculus
tcgtatttcactattccctttattg

SEQ ID NO: 825549 - DNA, 25 bp, Mus musculus
tcgtatttcacttttccctttattg

SEQ ID NO: 825550 - DNA, 25 bp, Mus musculus
tcgtcaaagacaacacaagcaggga

SEQ ID NO: 825551 - DNA, 25 bp, Mus musculus
tcgtcaaagacatcacaagcaggga

SEQ ID NO: 825552 - DNA, 25 bp, Mus musculus
tcgtcaaccaagatgaactggccat

SEQ ID NO: 825553 - DNA, 25 bp, Mus musculus
tcgtcaaccaagttgaactggccat

SEQ ID NO: 825554 - DNA, 25 bp, Mus musculus
tcgtcaacgaatcctctgctttaaa

SEQ ID NO: 825555 - DNA, 25 bp, Mus musculus
tcgtcaacgaatgctctgctttaaa

SEQ ID NO: 825556 - DNA, 25 bp, Mus musculus
tcgtcaagagtcccataatctcaga

SEQ ID NO: 825557 - DNA, 25 bp, Mus musculus
tcgtcaagagtcgcataatctcaga

SEQ ID NO: 825558 - DNA, 25 bp, Mus musculus
tcgtcaagcacacactccctccttt

SEQ ID NO: 825559 - DNA, 25 bp, Mus musculus
tcgtcaagcacagactccctccttt

SEQ ID NO: 825560 - DNA, 25 bp, Mus musculus
tcgtcacagaggaaacatgtccaaa

SEQ ID NO: 825561 - DNA, 25 bp, Mus musculus
tcgtcacagaggtaacatgtccaaa

SEQ ID NO: 825562 - DNA, 25 bp, Mus musculus
tcgtcaccaaggctcagctcctgtg

SEQ ID NO: 825563 - DNA, 25 bp, Mus musculus
tcgtcaccaagggtcagctcctgtg

SEQ ID NO: 825564 - DNA, 25 bp, Mus musculus
tcgtcacccctgctgtttgtctttt

SEQ ID NO: 825565 - DNA, 25 bp, Mus musculus
tcgtcacccctggtgtttgtctttt

SEQ ID NO: 825566 - DNA, 25 bp, Mus musculus
tcgtcaccctggagactatgtcttg

SEQ ID NO: 825567 - DNA, 25 bp, Mus musculus
tcgtcaccctggtgactatgtcttg

SEQ ID NO: 825568 - DNA, 25 bp, Mus musculus
tcgtcacctttcactccactggagg

SEQ ID NO: 825569 - DNA, 25 bp, Mus musculus
tcgtcacctttctctccactggagg

SEQ ID NO: 825570 - DNA, 25 bp, Mus musculus
tcgtcactagcaaactcaggcctga

SEQ ID NO: 825571 - DNA, 25 bp, Mus musculus
tcgtcactagcatactcaggcctga

SEQ ID NO: 825572 - DNA, 25 bp, Mus musculus
tcgtcactagcgagtgtgtgctcaa

SEQ ID NO: 825573 - DNA, 25 bp, Mus musculus
tcgtcactagcgtgtgtgtgctcaa

SEQ ID NO: 825574 - DNA, 25 bp, Mus musculus
tcgtcactatgtatggctggttcac

SEQ ID NO: 825575 - DNA, 25 bp, Mus musculus
tcgtcactatgtttggctggttcac

SEQ ID NO: 825576 - DNA, 25 bp, Mus musculus
tcgtcactcacgcaacacgagagga

SEQ ID NO: 825577 - DNA, 25 bp, Mus musculus
tcgtcactcacggaacacgagagga

SEQ ID NO: 825578 - DNA, 25 bp, Mus musculus
tcgtcactcagcacataatccttat

SEQ ID NO: 825579 - DNA, 25 bp, Mus musculus
tcgtcactcagctcataatccttat

SEQ ID NO: 825580 - DNA, 25 bp, Mus musculus
tcgtcactgaagattgaccttgtat

SEQ ID NO: 825581 - DNA, 25 bp, Mus musculus
tcgtcactgaagtttgaccttgtat

SEQ ID NO: 825582 - DNA, 25 bp, Mus musculus
tcgtcacttgcaccttgctatacgt

SEQ ID NO: 825583 - DNA, 25 bp, Mus musculus
tcgtcacttgcagcttgctatacgt

SEQ ID NO: 825584 - DNA, 25 bp, Mus musculus
tcgtcagccttaaagccaacaagaa

SEQ ID NO: 825585 - DNA, 25 bp, Mus musculus
tcgtcagccttatagccaacaagaa

SEQ ID NO: 825586 - DNA, 25 bp, Mus musculus
tcgtcagctagcattaagtatttct

SEQ ID NO: 825587 - DNA, 25 bp, Mus musculus
tcgtcagctagctttaagtatttct

SEQ ID NO: 825588 - DNA, 25 bp, Mus musculus
tcgtcagctgctcaggttcctagtg

SEQ ID NO: 825589 - DNA, 25 bp, Mus musculus
tcgtcagctgctgaggttcctagtg

SEQ ID NO: 825590 - DNA, 25 bp, Mus musculus
tcgtcagcttaacatctaatttcct

SEQ ID NO: 825591 - DNA, 25 bp, Mus musculus
tcgtcagcttaagatctaatttcct

SEQ ID NO: 825592 - DNA, 25 bp, Mus musculus
tcgtcagggatgcttttggcccaaa

SEQ ID NO: 825593 - DNA, 25 bp, Mus musculus
tcgtcagggatggttttggcccaaa

SEQ ID NO: 825594 - DNA, 25 bp, Mus musculus
tcgtcaggtgcacgtcagcacgttg

SEQ ID NO: 825595 - DNA, 25 bp, Mus musculus
tcgtcaggtgcaggtcagcacgttg

SEQ ID NO: 825596 - DNA, 25 bp, Mus musculus
tcgtcagtgctcctagtctcggttt

SEQ ID NO: 825597 - DNA, 25 bp, Mus musculus
tcgtcagtgctcgtagtctcggttt

SEQ ID NO: 825598 - DNA, 25 bp, Mus musculus
tcgtcagttccaacatttgtctcat

SEQ ID NO: 825599 - DNA, 25 bp, Mus musculus
tcgtcagttccatcatttgtctcat

SEQ ID NO: 825600 - DNA, 25 bp, Mus musculus
tcgtcagttgaacacagatcctgaa

SEQ ID NO: 825601 - DNA, 25 bp, Mus musculus
tcgtcagttgaagacagatcctgaa

SEQ ID NO: 825602 - DNA, 25 bp, Mus musculus
tcgtcagtttctcccgttgtaatta

SEQ ID NO: 825603 - DNA, 25 bp, Mus musculus
tcgtcagtttctgccgttgtaatta

SEQ ID NO: 825604 - DNA, 25 bp, Mus musculus
tcgtcataacgtcctagcaacctga

SEQ ID NO: 825605 - DNA, 25 bp, Mus musculus
tcgtcataacgtgctagcaacctga

SEQ ID NO: 825606 - DNA, 25 bp, Mus musculus
tcgtcatcgttgactgtgccattag

SEQ ID NO: 825607 - DNA, 25 bp, Mus musculus
tcgtcatcgttgtctgtgccattag

SEQ ID NO: 825608 - DNA, 25 bp, Mus musculus
tcgtcatctcatcctctttgctgat

SEQ ID NO: 825609 - DNA, 25 bp, Mus musculus
tcgtcatctcatgctctttgctgat

SEQ ID NO: 825610 - DNA, 25 bp, Mus musculus
tcgtcatctcttatactgaatcact

SEQ ID NO: 825611 - DNA, 25 bp, Mus musculus
tcgtcatctcttttactgaatcact

SEQ ID NO: 825612 - DNA, 25 bp, Mus musculus
tcgtcattaaaccattgatcgttga

SEQ ID NO: 825613 - DNA, 25 bp, Mus musculus
tcgtcattaaacgattgatcgttga

SEQ ID NO: 825614 - DNA, 25 bp, Mus musculus
tcgtcattcccacatgttctgaagt

SEQ ID NO: 825615 - DNA, 25 bp, Mus musculus
tcgtcattcccagatgttctgaagt

SEQ ID NO: 825616 - DNA, 25 bp, Mus musculus
tcgtcattccgacatagcgttgagg

SEQ ID NO: 825617 - DNA, 25 bp, Mus musculus
tcgtcattccgagatagcgttgagg

SEQ ID NO: 825618 - DNA, 25 bp, Mus musculus
tcgtcattgccgagctggtcaacgt

SEQ ID NO: 825619 - DNA, 25 bp, Mus musculus
tcgtcattgccgtgctggtcaacgt

SEQ ID NO: 825620 - DNA, 25 bp, Mus musculus
tcgtcatttctccaggttaattcct

SEQ ID NO: 825621 - DNA, 25 bp, Mus musculus
tcgtcatttctcgaggttaattcct

SEQ ID NO: 825622 - DNA, 25 bp, Mus musculus
tcgtccaaacatcagaatctcctct

SEQ ID NO: 825623 - DNA, 25 bp, Mus musculus
tcgtccaaacatgagaatctcctct

SEQ ID NO: 825624 - DNA, 25 bp, Mus musculus
tcgtccaagcttattcatcagaatt

SEQ ID NO: 825625 - DNA, 25 bp, Mus musculus
tcgtccaagctttttcatcagaatt

SEQ ID NO: 825626 - DNA, 25 bp, Mus musculus
tcgtccacagtacctttcttacagt

SEQ ID NO: 825627 - DNA, 25 bp, Mus musculus
tcgtccacagtagctttcttacagt

SEQ ID NO: 825628 - DNA, 25 bp, Mus musculus
tcgtccaccaggaccctgtgagcat

SEQ ID NO: 825629 - DNA, 25 bp, Mus musculus
tcgtccaccaggtccctgtgagcat

SEQ ID NO: 825630 - DNA, 25 bp, Mus musculus
tcgtccaccattaatacatgtcctg

SEQ ID NO: 825631 - DNA, 25 bp, Mus musculus
tcgtccaccatttatacatgtcctg

SEQ ID NO: 825632 - DNA, 25 bp, Mus musculus
tcgtccagatgccacctgtgattgt

SEQ ID NO: 825633 - DNA, 25 bp, Mus musculus
tcgtccagatgcgacctgtgattgt

SEQ ID NO: 825634 - DNA, 25 bp, Mus musculus
tcgtccatgttaccgatctttctgg

SEQ ID NO: 825635 - DNA, 25 bp, Mus musculus
tcgtccatgttagcgatctttctgg

SEQ ID NO: 825636 - DNA, 25 bp, Mus musculus
tcgtccattcaaacatacactcaaa

SEQ ID NO: 825637 - DNA, 25 bp, Mus musculus
tcgtccattcaatcatacactcaaa

SEQ ID NO: 825638 - DNA, 25 bp, Mus musculus
tcgtccattcgtctgcttttagaga

SEQ ID NO: 825639 - DNA, 25 bp, Mus musculus
tcgtccattcgtgtgcttttagaga

SEQ ID NO: 825640 - DNA, 25 bp, Mus musculus
tcgtcccaacagattcatagagcac

SEQ ID NO: 825641 - DNA, 25 bp, Mus musculus
tcgtcccaacagtttcatagagcac

SEQ ID NO: 825642 - DNA, 25 bp, Mus musculus
tcgtcccatcagctgaatgagttcc

SEQ ID NO: 825643 - DNA, 25 bp, Mus musculus
tcgtcccatcaggtgaatgagttcc

SEQ ID NO: 825644 - DNA, 25 bp, Mus musculus
tcgtcccatttcaccataggagtgc

SEQ ID NO: 825645 - DNA, 25 bp, Mus musculus
tcgtcccatttctccataggagtgc

SEQ ID NO: 825646 - DNA, 25 bp, Mus musculus
tcgtccccaaggagcttgtgggtaa

SEQ ID NO: 825647 - DNA, 25 bp, Mus musculus
tcgtccccaaggtgcttgtgggtaa

SEQ ID NO: 825648 - DNA, 25 bp, Mus musculus
tcgtccccacagaggtcacgagagc

SEQ ID NO: 825649 - DNA, 25 bp, Mus musculus
tcgtccccacagtggtcacgagagc

SEQ ID NO: 825650 - DNA, 25 bp, Mus musculus
tcgtccccatttcacataagtagct

SEQ ID NO: 825651 - DNA, 25 bp, Mus musculus
tcgtccccatttgacataagtagct

SEQ ID NO: 825652 - DNA, 25 bp, Mus musculus
tcgtccccgctgaaaaggtcccatt

SEQ ID NO: 825653 - DNA, 25 bp, Mus musculus
tcgtccccgctgtaaaggtcccatt

SEQ ID NO: 825654 - DNA, 25 bp, Mus musculus
tcgtccccgggcagtattattaagc

SEQ ID NO: 825655 - DNA, 25 bp, Mus musculus
tcgtccccgggctgtattattaagc

SEQ ID NO: 825656 - DNA, 25 bp, Mus musculus
tcgtcccgattgctgggtttaaagg

SEQ ID NO: 825657 - DNA, 25 bp, Mus musculus
tcgtcccgattggtgggtttaaagg

SEQ ID NO: 825658 - DNA, 25 bp, Mus musculus
tcgtccctagtaccttgcaaagtgt

SEQ ID NO: 825659 - DNA, 25 bp, Mus musculus
tcgtccctagtagcttgcaaagtgt

SEQ ID NO: 825660 - DNA, 25 bp, Mus musculus
tcgtccctcagacgaaccctgtgaa

SEQ ID NO: 825661 - DNA, 25 bp, Mus musculus
tcgtccctcagaggaaccctgtgaa

SEQ ID NO: 825662 - DNA, 25 bp, Mus musculus
tcgtcccttaataatggccctgatg

SEQ ID NO: 825663 - DNA, 25 bp, Mus musculus
tcgtcccttaattatggccctgatg

SEQ ID NO: 825664 - DNA, 25 bp, Mus musculus
tcgtccgagatgaatgtcctggtcc

SEQ ID NO: 825665 - DNA, 25 bp, Mus musculus
tcgtccgagatgtatgtcctggtcc

SEQ ID NO: 825666 - DNA, 25 bp, Mus musculus
tcgtcctacaaaacaaggtccctac

SEQ ID NO: 825667 - DNA, 25 bp, Mus musculus
tcgtcctacaaatcaaggtccctac

SEQ ID NO: 825668 - DNA, 25 bp, Mus musculus
tcgtcctacaataccagtgcttttt

SEQ ID NO: 825669 - DNA, 25 bp, Mus musculus
tcgtcctacaattccagtgcttttt

SEQ ID NO: 825670 - DNA, 25 bp, Mus musculus
tcgtcctagggaccgtgactcatta

SEQ ID NO: 825671 - DNA, 25 bp, Mus musculus
tcgtcctagggagcgtgactcatta

SEQ ID NO: 825672 - DNA, 25 bp, Mus musculus
tcgtcctatggaatggcagcttggt

SEQ ID NO: 825673 - DNA, 25 bp, Mus musculus
tcgtcctatggattggcagcttggt

SEQ ID NO: 825674 - DNA, 25 bp, Mus musculus
tcgtcctcagtgcagaagctaggtg

SEQ ID NO: 825675 - DNA, 25 bp, Mus musculus
tcgtcctcagtggagaagctaggtg

SEQ ID NO: 825676 - DNA, 25 bp, Mus musculus
tcgtcctcctttactttgcaactca

SEQ ID NO: 825677 - DNA, 25 bp, Mus musculus
tcgtcctccttttctttgcaactca

SEQ ID NO: 825678 - DNA, 25 bp, Mus musculus
tcgtcctcgttactgcttagtggaa

SEQ ID NO: 825679 - DNA, 25 bp, Mus musculus
tcgtcctcgttagtgcttagtggaa

SEQ ID NO: 825680 - DNA, 25 bp, Mus musculus
tcgtcctgaaaactaatggctctcg

SEQ ID NO: 825681 - DNA, 25 bp, Mus musculus
tcgtcctgaaaagtaatggctctcg

SEQ ID NO: 825682 - DNA, 25 bp, Mus musculus
tcgtcctgtagtctgctatgagcaa

SEQ ID NO: 825683 - DNA, 25 bp, Mus musculus
tcgtcctgtagtgtgctatgagcaa

SEQ ID NO: 825684 - DNA, 25 bp, Mus musculus
tcgtcctgtctcatctaatctcctt

SEQ ID NO: 825685 - DNA, 25 bp, Mus musculus
tcgtcctgtctcttctaatctcctt

SEQ ID NO: 825686 - DNA, 25 bp, Mus musculus
tcgtccttaaagagcttctcctggc

SEQ ID NO: 825687 - DNA, 25 bp, Mus musculus
tcgtccttaaagtgcttctcctggc

SEQ ID NO: 825688 - DNA, 25 bp, Mus musculus
tcgtcgccatggagaagctgagcaa

SEQ ID NO: 825689 - DNA, 25 bp, Mus musculus
tcgtcgccatggtgaagctgagcaa

SEQ ID NO: 825690 - DNA, 25 bp, Mus musculus
tcgtcgccctttatgtactgttgaa

SEQ ID NO: 825691 - DNA, 25 bp, Mus musculus
tcgtcgccctttttgtactgttgaa

SEQ ID NO: 825692 - DNA, 25 bp, Mus musculus
tcgtcgccgggcctcagcaacttgt

SEQ ID NO: 825693 - DNA, 25 bp, Mus musculus
tcgtcgccgggcgtcagcaacttgt

SEQ ID NO: 825694 - DNA, 25 bp, Mus musculus
tcgtcggcaagtacgggacccgcta

SEQ ID NO: 825695 - DNA, 25 bp, Mus musculus
tcgtcggcaagttcgggacccgcta

SEQ ID NO: 825696 - DNA, 25 bp, Mus musculus
tcgtcgtaggatcatgatgcagtct

SEQ ID NO: 825697 - DNA, 25 bp, Mus musculus
tcgtcgtaggatgatgatgcagtct

SEQ ID NO: 825698 - DNA, 25 bp, Mus musculus
tcgtcgttccacaggactgtctgtc

SEQ ID NO: 825699 - DNA, 25 bp, Mus musculus
tcgtcgttccactggactgtctgtc

SEQ ID NO: 825700 - DNA, 25 bp, Mus musculus
tcgtctacggagagcgctttggtta

SEQ ID NO: 825701 - DNA, 25 bp, Mus musculus
tcgtctacggagtgcgctttggtta

SEQ ID NO: 825702 - DNA, 25 bp, Mus musculus
tcgtctattacgatgttctgggaaa

SEQ ID NO: 825703 - DNA, 25 bp, Mus musculus
tcgtctattacgttgttctgggaaa

SEQ ID NO: 825704 - DNA, 25 bp, Mus musculus
tcgtctcaggaacctctggtttact

SEQ ID NO: 825705 - DNA, 25 bp, Mus musculus
tcgtctcaggaagctctggtttact

SEQ ID NO: 825706 - DNA, 25 bp, Mus musculus
tcgtctcatctcattggctcagtgt

SEQ ID NO: 825707 - DNA, 25 bp, Mus musculus
tcgtctcatctctttggctcagtgt

SEQ ID NO: 825708 - DNA, 25 bp, Mus musculus
tcgtctcctagtcaggactcctcat

SEQ ID NO: 825709 - DNA, 25 bp, Mus musculus
tcgtctcctagtgaggactcctcat

SEQ ID NO: 825710 - DNA, 25 bp, Mus musculus
tcgtctctaaagatcaccctcagga

SEQ ID NO: 825711 - DNA, 25 bp, Mus musculus
tcgtctctaaagttcaccctcagga

SEQ ID NO: 825712 - DNA, 25 bp, Mus musculus
tcgtctctgcggatactgtacagca

SEQ ID NO: 825713 - DNA, 25 bp, Mus musculus
tcgtctctgcggttactgtacagca

SEQ ID NO: 825714 - DNA, 25 bp, Mus musculus
tcgtctcttaccattgggagcagag

SEQ ID NO: 825715 - DNA, 25 bp, Mus musculus
tcgtctcttacctttgggagcagag

SEQ ID NO: 825716 - DNA, 25 bp, Mus musculus
tcgtctcttcagctcaagtgctata

SEQ ID NO: 825717 - DNA, 25 bp, Mus musculus
tcgtctcttcaggtcaagtgctata

SEQ ID NO: 825718 - DNA, 25 bp, Mus musculus
tcgtctcttcttcttatggttgcaa

SEQ ID NO: 825719 - DNA, 25 bp, Mus musculus
tcgtctcttcttgttatggttgcaa

SEQ ID NO: 825720 - DNA, 25 bp, Mus musculus
tcgtctgaacaaagcccacactaat

SEQ ID NO: 825721 - DNA, 25 bp, Mus musculus
tcgtctgaacaatgcccacactaat

SEQ ID NO: 825722 - DNA, 25 bp, Mus musculus
tcgtctgagccactgcttgatgata

SEQ ID NO: 825723 - DNA, 25 bp, Mus musculus
tcgtctgagccagtgcttgatgata

SEQ ID NO: 825724 - DNA, 25 bp, Mus musculus
tcgtctgatgacactttgggaaatt

SEQ ID NO: 825725 - DNA, 25 bp, Mus musculus
tcgtctgatgactctttgggaaatt

SEQ ID NO: 825726 - DNA, 25 bp, Mus musculus
tcgtctgctcccatcagactgagca

SEQ ID NO: 825727 - DNA, 25 bp, Mus musculus
tcgtctgctcccttcagactgagca

SEQ ID NO: 825728 - DNA, 25 bp, Mus musculus
tcgtctgctctgactggttacaaag

SEQ ID NO: 825729 - DNA, 25 bp, Mus musculus
tcgtctgctctgtctggttacaaag

SEQ ID NO: 825730 - DNA, 25 bp, Mus musculus
tcgtctggacagctcattcaagtgg

SEQ ID NO: 825731 - DNA, 25 bp, Mus musculus
tcgtctggacaggtcattcaagtgg

SEQ ID NO: 825732 - DNA, 25 bp, Mus musculus
tcgtctggactcagtgggaacccgc

SEQ ID NO: 825733 - DNA, 25 bp, Mus musculus
tcgtctggactctgtgggaacccgc

SEQ ID NO: 825734 - DNA, 25 bp, Mus musculus
tcgtctgtgactaactgatgtcccg

SEQ ID NO: 825735 - DNA, 25 bp, Mus musculus
tcgtctgtgacttactgatgtcccg

SEQ ID NO: 825736 - DNA, 25 bp, Mus musculus
tcgtctgtgttcacactgttttcat

SEQ ID NO: 825737 - DNA, 25 bp, Mus musculus
tcgtctgtgttctcactgttttcat

SEQ ID NO: 825738 - DNA, 25 bp, Mus musculus
tcgtctgttgctaggaatctatgaa

SEQ ID NO: 825739 - DNA, 25 bp, Mus musculus
tcgtctgttgcttggaatctatgaa

SEQ ID NO: 825740 - DNA, 25 bp, Mus musculus
tcgtcttcagggaagcaagctcaac

SEQ ID NO: 825741 - DNA, 25 bp, Mus musculus
tcgtcttcagggtagcaagctcaac

SEQ ID NO: 825742 - DNA, 25 bp, Mus musculus
tcgtcttccaggctgcagtggagtc

SEQ ID NO: 825743 - DNA, 25 bp, Mus musculus
tcgtcttccagggtgcagtggagtc

SEQ ID NO: 825744 - DNA, 25 bp, Mus musculus
tcgtcttccctgctcttgaaaagga

SEQ ID NO: 825745 - DNA, 25 bp, Mus musculus
tcgtcttccctggtcttgaaaagga

SEQ ID NO: 825746 - DNA, 25 bp, Mus musculus
tcgtcttctggtaacctttctgaga

SEQ ID NO: 825747 - DNA, 25 bp, Mus musculus
tcgtcttctggttacctttctgaga

SEQ ID NO: 825748 - DNA, 25 bp, Mus musculus
tcgtcttgatgacactgcctaaggt

SEQ ID NO: 825749 - DNA, 25 bp, Mus musculus
tcgtcttgatgagactgcctaaggt

SEQ ID NO: 825750 - DNA, 25 bp, Mus musculus
tcgtcttgtgccattagcgtgtgga

SEQ ID NO: 825751 - DNA, 25 bp, Mus musculus
tcgtcttgtgcctttagcgtgtgga

SEQ ID NO: 825752 - DNA, 25 bp, Mus musculus
tcgtctttacctatagcctcggaag

SEQ ID NO: 825753 - DNA, 25 bp, Mus musculus
tcgtctttacctttagcctcggaag

SEQ ID NO: 825754 - DNA, 25 bp, Mus musculus
tcgtctttatgcagtagtggacaaa

SEQ ID NO: 825755 - DNA, 25 bp, Mus musculus
tcgtctttatgctgtagtggacaaa

SEQ ID NO: 825756 - DNA, 25 bp, Mus musculus
tcgtctttcagcagagtcccatata

SEQ ID NO: 825757 - DNA, 25 bp, Mus musculus
tcgtctttcagctgagtcccatata

SEQ ID NO: 825758 - DNA, 25 bp, Mus musculus
tcgtctttgctgcttctgtatttgc

SEQ ID NO: 825759 - DNA, 25 bp, Mus musculus
tcgtctttgctggttctgtatttgc

SEQ ID NO: 825760 - DNA, 25 bp, Mus musculus
tcgtcttttcccaccatttgaagag

SEQ ID NO: 825761 - DNA, 25 bp, Mus musculus
tcgtcttttccctccatttgaagag

SEQ ID NO: 825762 - DNA, 25 bp, Mus musculus
tcgtgaacccctacagataatgttc

SEQ ID NO: 825763 - DNA, 25 bp, Mus musculus
tcgtgaaccccttcagataatgttc

SEQ ID NO: 825764 - DNA, 25 bp, Mus musculus
tcgtgaacgttgacaattgtttaca

SEQ ID NO: 825765 - DNA, 25 bp, Mus musculus
tcgtgaacgttgtcaattgtttaca

SEQ ID NO: 825766 - DNA, 25 bp, Mus musculus
tcgtgaactttgacctccctgtaaa

SEQ ID NO: 825767 - DNA, 25 bp, Mus musculus
tcgtgaactttgtcctccctgtaaa

SEQ ID NO: 825768 - DNA, 25 bp, Mus musculus
tcgtgaaggcacaactcttagaaca

SEQ ID NO: 825769 - DNA, 25 bp, Mus musculus
tcgtgaaggcactactcttagaaca

SEQ ID NO: 825770 - DNA, 25 bp, Mus musculus
tcgtgaatcctgctacctctgcggg

SEQ ID NO: 825771 - DNA, 25 bp, Mus musculus
tcgtgaatcctggtacctctgcggg

SEQ ID NO: 825772 - DNA, 25 bp, Mus musculus
tcgtgacattccagggcatgcatgt

SEQ ID NO: 825773 - DNA, 25 bp, Mus musculus
tcgtgacattcctgggcatgcatgt

SEQ ID NO: 825774 - DNA, 25 bp, Mus musculus
tcgtgaccagcacctacaagggagg

SEQ ID NO: 825775 - DNA, 25 bp, Mus musculus
tcgtgaccagcagctacaagggagg

SEQ ID NO: 825776 - DNA, 25 bp, Mus musculus
tcgtgaccctggagctttggaagcc

SEQ ID NO: 825777 - DNA, 25 bp, Mus musculus
tcgtgaccctggtgctttggaagcc

SEQ ID NO: 825778 - DNA, 25 bp, Mus musculus
tcgtgacctgacatcatccctgagc

SEQ ID NO: 825779 - DNA, 25 bp, Mus musculus
tcgtgacctgacttcatccctgagc

SEQ ID NO: 825780 - DNA, 25 bp, Mus musculus
tcgtgaccttagagcccttgtattt

SEQ ID NO: 825781 - DNA, 25 bp, Mus musculus
tcgtgaccttagtgcccttgtattt

SEQ ID NO: 825782 - DNA, 25 bp, Mus musculus
tcgtgactgctcctaattacagctc

SEQ ID NO: 825783 - DNA, 25 bp, Mus musculus
tcgtgactgctcgtaattacagctc

SEQ ID NO: 825784 - DNA, 25 bp, Mus musculus
tcgtgacttgccctggttgccagaa

SEQ ID NO: 825785 - DNA, 25 bp, Mus musculus
tcgtgacttgccgtggttgccagaa

SEQ ID NO: 825786 - DNA, 25 bp, Mus musculus
tcgtgagagatgacagttctaccat

SEQ ID NO: 825787 - DNA, 25 bp, Mus musculus
tcgtgagagatgtcagttctaccat

SEQ ID NO: 825788 - DNA, 25 bp, Mus musculus
tcgtgagcctttagtctctccctct

SEQ ID NO: 825789 - DNA, 25 bp, Mus musculus
tcgtgagccttttgtctctccctct

SEQ ID NO: 825790 - DNA, 25 bp, Mus musculus
tcgtgagctaacagtggccgcgcct

SEQ ID NO: 825791 - DNA, 25 bp, Mus musculus
tcgtgagctaactgtggccgcgcct

SEQ ID NO: 825792 - DNA, 25 bp, Mus musculus
tcgtgagctatgaaactgtatgtat

SEQ ID NO: 825793 - DNA, 25 bp, Mus musculus
tcgtgagctatgtaactgtatgtat

SEQ ID NO: 825794 - DNA, 25 bp, Mus musculus
tcgtgaggtcctaccaatactgagg

SEQ ID NO: 825795 - DNA, 25 bp, Mus musculus
tcgtgaggtccttccaatactgagg

SEQ ID NO: 825796 - DNA, 25 bp, Mus musculus
tcgtgagtccaacagatgtcgtcgt

SEQ ID NO: 825797 - DNA, 25 bp, Mus musculus
tcgtgagtccaagagatgtcgtcgt

SEQ ID NO: 825798 - DNA, 25 bp, Mus musculus
tcgtgagtctccctcgttgtgccag

SEQ ID NO: 825799 - DNA, 25 bp, Mus musculus
tcgtgagtctccgtcgttgtgccag

SEQ ID NO: 825800 - DNA, 25 bp, Mus musculus
tcgtgatcacaactgagcctacaga

SEQ ID NO: 825801 - DNA, 25 bp, Mus musculus
tcgtgatcacaagtgagcctacaga

SEQ ID NO: 825802 - DNA, 25 bp, Mus musculus
tcgtgatgcccgcacacatggtctt

SEQ ID NO: 825803 - DNA, 25 bp, Mus musculus
tcgtgatgcccggacacatggtctt

SEQ ID NO: 825804 - DNA, 25 bp, Mus musculus
tcgtgatgctgaagcggatccactc

SEQ ID NO: 825805 - DNA, 25 bp, Mus musculus
tcgtgatgctgatgcggatccactc

SEQ ID NO: 825806 - DNA, 25 bp, Mus musculus
tcgtgatgggctctggatctccgca

SEQ ID NO: 825807 - DNA, 25 bp, Mus musculus
tcgtgatgggctgtggatctccgca

SEQ ID NO: 825808 - DNA, 25 bp, Mus musculus
tcgtgatgtgctcaggtgctcccaa

SEQ ID NO: 825809 - DNA, 25 bp, Mus musculus
tcgtgatgtgctgaggtgctcccaa

SEQ ID NO: 825810 - DNA, 25 bp, Mus musculus
tcgtgatgtgttccttttccttgct

SEQ ID NO: 825811 - DNA, 25 bp, Mus musculus
tcgtgatgtgttgcttttccttgct

SEQ ID NO: 825812 - DNA, 25 bp, Mus musculus
tcgtgattctagatacattatttct

SEQ ID NO: 825813 - DNA, 25 bp, Mus musculus
tcgtgattctagttacattatttct

SEQ ID NO: 825814 - DNA, 25 bp, Mus musculus
tcgtgcacccatctatggaccagaa

SEQ ID NO: 825815 - DNA, 25 bp, Mus musculus
tcgtgcacccatgtatggaccagaa

SEQ ID NO: 825816 - DNA, 25 bp, Mus musculus
tcgtgcacctcaatctatggatctg

SEQ ID NO: 825817 - DNA, 25 bp, Mus musculus
tcgtgcacctcattctatggatctg

SEQ ID NO: 825818 - DNA, 25 bp, Mus musculus
tcgtgcactacacatgggacctgat

SEQ ID NO: 825819 - DNA, 25 bp, Mus musculus
tcgtgcactacagatgggacctgat

SEQ ID NO: 825820 - DNA, 25 bp, Mus musculus
tcgtgcactgtcagaaggcagccat

SEQ ID NO: 825821 - DNA, 25 bp, Mus musculus
tcgtgcactgtctgaaggcagccat

SEQ ID NO: 825822 - DNA, 25 bp, Mus musculus
tcgtgcagaaagaattcccgggtcc

SEQ ID NO: 825823 - DNA, 25 bp, Mus musculus
tcgtgcagaaagacaaatggcgtcc

SEQ ID NO: 825824 - DNA, 25 bp, Mus musculus
tcgtgcagaaagtattcccgggtcc

SEQ ID NO: 825825 - DNA, 25 bp, Mus musculus
tcgtgcagaaagtcaaatggcgtcc

SEQ ID NO: 825826 - DNA, 25 bp, Mus musculus
tcgtgcatgtgcagcaggcaccagc

SEQ ID NO: 825827 - DNA, 25 bp, Mus musculus
tcgtgcatgtgctgcaggcaccagc

SEQ ID NO: 825828 - DNA, 25 bp, Mus musculus
tcgtgcattctcatgagcccttggg

SEQ ID NO: 825829 - DNA, 25 bp, Mus musculus
tcgtgcattctcttgagcccttggg

SEQ ID NO: 825830 - DNA, 25 bp, Mus musculus
tcgtgccaaattccgaagcaacctt

SEQ ID NO: 825831 - DNA, 25 bp, Mus musculus
tcgtgccaaattgcgaagcaacctt

SEQ ID NO: 825832 - DNA, 25 bp, Mus musculus
tcgtgccacatgacagctaagtact

SEQ ID NO: 825833 - DNA, 25 bp, Mus musculus
tcgtgccacatgtcagctaagtact

SEQ ID NO: 825834 - DNA, 25 bp, Mus musculus
tcgtgccaggctcacccaaaacagg

SEQ ID NO: 825835 - DNA, 25 bp, Mus musculus
tcgtgccaggctgacccaaaacagg

SEQ ID NO: 825836 - DNA, 25 bp, Mus musculus
tcgtgcccatctcattctgggttga

SEQ ID NO: 825837 - DNA, 25 bp, Mus musculus
tcgtgcccatctgattctgggttga

SEQ ID NO: 825838 - DNA, 25 bp, Mus musculus
tcgtgccctttaagagatgttgcgg

SEQ ID NO: 825839 - DNA, 25 bp, Mus musculus
tcgtgccctttatgagatgttgcgg

SEQ ID NO: 825840 - DNA, 25 bp, Mus musculus
tcgtgccgggatcactctgagtgta

SEQ ID NO: 825841 - DNA, 25 bp, Mus musculus
tcgtgccgggatgactctgagtgta

SEQ ID NO: 825842 - DNA, 25 bp, Mus musculus
tcgtgcctaccgctctatcaatgct

SEQ ID NO: 825843 - DNA, 25 bp, Mus musculus
tcgtgcctaccggtctatcaatgct

SEQ ID NO: 825844 - DNA, 25 bp, Mus musculus
tcgtgccttcacatatggatgggaa

SEQ ID NO: 825845 - DNA, 25 bp, Mus musculus
tcgtgccttcacttatggatgggaa

SEQ ID NO: 825846 - DNA, 25 bp, Mus musculus
tcgtgccttggtaagactcagtgaa

SEQ ID NO: 825847 - DNA, 25 bp, Mus musculus
tcgtgccttggttagactcagtgaa

SEQ ID NO: 825848 - DNA, 25 bp, Mus musculus
tcgtgcctttggctctgaagatgtc

SEQ ID NO: 825849 - DNA, 25 bp, Mus musculus
tcgtgcctttgggtctgaagatgtc

SEQ ID NO: 825850 - DNA, 25 bp, Mus musculus
tcgtgcgcaaggagccaccgggtta

SEQ ID NO: 825851 - DNA, 25 bp, Mus musculus
tcgtgcgcaaggtgccaccgggtta

SEQ ID NO: 825852 - DNA, 25 bp, Mus musculus
tcgtgcgcaggcctcacacctgaat

SEQ ID NO: 825853 - DNA, 25 bp, Mus musculus
tcgtgcgcaggcgtcacacctgaat

SEQ ID NO: 825854 - DNA, 25 bp, Mus musculus
tcgtgcgtcactaccggaacaaata

SEQ ID NO: 825855 - DNA, 25 bp, Mus musculus
tcgtgcgtcacttccggaacaaata

SEQ ID NO: 825856 - DNA, 25 bp, Mus musculus
tcgtgctacagaagaggtctctctc

SEQ ID NO: 825857 - DNA, 25 bp, Mus musculus
tcgtgctacagatgaggtctctctc

SEQ ID NO: 825858 - DNA, 25 bp, Mus musculus
tcgtgctatgttcaaactgagctat

SEQ ID NO: 825859 - DNA, 25 bp, Mus musculus
tcgtgctatgttgaaactgagctat

SEQ ID NO: 825860 - DNA, 25 bp, Mus musculus
tcgtgctcaccaccttgtaatggaa

SEQ ID NO: 825861 - DNA, 25 bp, Mus musculus
tcgtgctcaccagcttgtaatggaa

SEQ ID NO: 825862 - DNA, 25 bp, Mus musculus
tcgtgctcagacacgtctcaacaag

SEQ ID NO: 825863 - DNA, 25 bp, Mus musculus
tcgtgctcagactcgtctcaacaag

SEQ ID NO: 825864 - DNA, 25 bp, Mus musculus
tcgtgctctgcaaacactgtgactt

SEQ ID NO: 825865 - DNA, 25 bp, Mus musculus
tcgtgctctgcatacactgtgactt

SEQ ID NO: 825866 - DNA, 25 bp, Mus musculus
tcgtgctgacatctgtgggcctgcc

SEQ ID NO: 825867 - DNA, 25 bp, Mus musculus
tcgtgctgacatgtgtgggcctgcc

SEQ ID NO: 825868 - DNA, 25 bp, Mus musculus
tcgtgctgccatagttaaaatgcca

SEQ ID NO: 825869 - DNA, 25 bp, Mus musculus
tcgtgctgccattgttaaaatgcca

SEQ ID NO: 825870 - DNA, 25 bp, Mus musculus
tcgtgctgcttcaacgttacaaggt

SEQ ID NO: 825871 - DNA, 25 bp, Mus musculus
tcgtgctgcttctacgttacaaggt

SEQ ID NO: 825872 - DNA, 25 bp, Mus musculus
tcgtgctggcgtcgagacctgggaa

SEQ ID NO: 825873 - DNA, 25 bp, Mus musculus
tcgtgctggcgtggagacctgggaa

SEQ ID NO: 825874 - DNA, 25 bp, Mus musculus
tcgtgctgtcaactgccgtaagagg

SEQ ID NO: 825875 - DNA, 25 bp, Mus musculus
tcgtgctgtcaagtgccgtaagagg

SEQ ID NO: 825876 - DNA, 25 bp, Mus musculus
tcgtgcttcaagctctcggaactgt

SEQ ID NO: 825877 - DNA, 25 bp, Mus musculus
tcgtgcttcaaggtctcggaactgt

SEQ ID NO: 825878 - DNA, 25 bp, Mus musculus
tcgtgcttctggctgcagtgatcag

SEQ ID NO: 825879 - DNA, 25 bp, Mus musculus
tcgtgcttctgggtgcagtgatcag

SEQ ID NO: 825880 - DNA, 25 bp, Mus musculus
tcgtggaagtatacacttctgttgt

SEQ ID NO: 825881 - DNA, 25 bp, Mus musculus
tcgtggaagtattcacttctgttgt

SEQ ID NO: 825882 - DNA, 25 bp, Mus musculus
tcgtggaagtgtagaaccggttcct

SEQ ID NO: 825883 - DNA, 25 bp, Mus musculus
tcgtggaagtgttgaaccggttcct

SEQ ID NO: 825884 - DNA, 25 bp, Mus musculus
tcgtggacaacaacggatacctttc

SEQ ID NO: 825885 - DNA, 25 bp, Mus musculus
tcgtggacaacatcggatacctttc

SEQ ID NO: 825886 - DNA, 25 bp, Mus musculus
tcgtggacacgcattccggtagcgg

SEQ ID NO: 825887 - DNA, 25 bp, Mus musculus
tcgtggacacgctttccggtagcgg

SEQ ID NO: 825888 - DNA, 25 bp, Mus musculus
tcgtggaccccaaggtgatagtgga

SEQ ID NO: 825889 - DNA, 25 bp, Mus musculus
tcgtggaccccatggtgatagtgga

SEQ ID NO: 825890 - DNA, 25 bp, Mus musculus
tcgtggacctgaaccccgacagtga

SEQ ID NO: 825891 - DNA, 25 bp, Mus musculus
tcgtggacctgatccccgacagtga

SEQ ID NO: 825892 - DNA, 25 bp, Mus musculus
tcgtggacctgcactttgtcaaaga

SEQ ID NO: 825893 - DNA, 25 bp, Mus musculus
tcgtggacctgctctttgtcaaaga

SEQ ID NO: 825894 - DNA, 25 bp, Mus musculus
tcgtggacttccaactcacatgaag

SEQ ID NO: 825895 - DNA, 25 bp, Mus musculus
tcgtggacttcctactcacatgaag

SEQ ID NO: 825896 - DNA, 25 bp, Mus musculus
tcgtggagaccaacagacctgatag

SEQ ID NO: 825897 - DNA, 25 bp, Mus musculus
tcgtggagaccatcagacctgatag

SEQ ID NO: 825898 - DNA, 25 bp, Mus musculus
tcgtggatggtgatcatgtgaagtt

SEQ ID NO: 825899 - DNA, 25 bp, Mus musculus
tcgtggatggtgttcatgtgaagtt

SEQ ID NO: 825900 - DNA, 25 bp, Mus musculus
tcgtggcaagacaggaaccgctgca

SEQ ID NO: 825901 - DNA, 25 bp, Mus musculus
tcgtggcaagactggaaccgctgca

SEQ ID NO: 825902 - DNA, 25 bp, Mus musculus
tcgtggcagcgaagacccagtcgaa

SEQ ID NO: 825903 - DNA, 25 bp, Mus musculus
tcgtggcagcgatgacccagtcgaa

SEQ ID NO: 825904 - DNA, 25 bp, Mus musculus
tcgtggcattttattggtttacaag

SEQ ID NO: 825905 - DNA, 25 bp, Mus musculus
tcgtggcatttttttggtttacaag

SEQ ID NO: 825906 - DNA, 25 bp, Mus musculus
tcgtggcccaggagatagcgggtgt

SEQ ID NO: 825907 - DNA, 25 bp, Mus musculus
tcgtggcccaggtgatagcgggtgt

SEQ ID NO: 825908 - DNA, 25 bp, Mus musculus
tcgtggcctatcagcggcggcgcct

SEQ ID NO: 825909 - DNA, 25 bp, Mus musculus
tcgtggcctatctgcggcggcgcct

SEQ ID NO: 825910 - DNA, 25 bp, Mus musculus
tcgtggcctgtaagacggaccggta

SEQ ID NO: 825911 - DNA, 25 bp, Mus musculus
tcgtggcctgtatgacggaccggta

SEQ ID NO: 825912 - DNA, 25 bp, Mus musculus
tcgtggcgccgcacaacgactcggg

SEQ ID NO: 825913 - DNA, 25 bp, Mus musculus
tcgtggcgccgctcaacgactcggg

SEQ ID NO: 825914 - DNA, 25 bp, Mus musculus
tcgtggcggagcaccataggaccga

SEQ ID NO: 825915 - DNA, 25 bp, Mus musculus
tcgtggcggagctccataggaccga

SEQ ID NO: 825916 - DNA, 25 bp, Mus musculus
tcgtggctacagagagagctggcaa

SEQ ID NO: 825917 - DNA, 25 bp, Mus musculus
tcgtggctacagtgagagctggcaa

SEQ ID NO: 825918 - DNA, 25 bp, Mus musculus
tcgtggctagaaagttaaatggata

SEQ ID NO: 825919 - DNA, 25 bp, Mus musculus
tcgtggctagaatgttaaatggata

SEQ ID NO: 825920 - DNA, 25 bp, Mus musculus
tcgtggctctggatgtatggtgcta

SEQ ID NO: 825921 - DNA, 25 bp, Mus musculus
tcgtggctctggttgtatggtgcta

SEQ ID NO: 825922 - DNA, 25 bp, Mus musculus
tcgtggctgccgattctgttaaacg

SEQ ID NO: 825923 - DNA, 25 bp, Mus musculus
tcgtggctgccgtttctgttaaacg

SEQ ID NO: 825924 - DNA, 25 bp, Mus musculus
tcgtggctttgtctgagagtctgtt

SEQ ID NO: 825925 - DNA, 25 bp, Mus musculus
tcgtggctttgtgtgagagtctgtt

SEQ ID NO: 825926 - DNA, 25 bp, Mus musculus
tcgtgggccctcagatcagtgactt

SEQ ID NO: 825927 - DNA, 25 bp, Mus musculus
tcgtgggccctctgatcagtgactt

SEQ ID NO: 825928 - DNA, 25 bp, Mus musculus
tcgtgggccgccctaggcaccaggg

SEQ ID NO: 825929 - DNA, 25 bp, Mus musculus
tcgtgggccgccgtaggcaccaggg

SEQ ID NO: 825930 - DNA, 25 bp, Mus musculus
tcgtgggcgcccagtgtaccaactg

SEQ ID NO: 825931 - DNA, 25 bp, Mus musculus
tcgtgggcgccctgtgtaccaactg

SEQ ID NO: 825932 - DNA, 25 bp, Mus musculus
tcgtgggctcctctgatatcactga

SEQ ID NO: 825933 - DNA, 25 bp, Mus musculus
tcgtgggctcctgtgatatcactga

SEQ ID NO: 825934 - DNA, 25 bp, Mus musculus
tcgtggggctccattgtgaccgtgc

SEQ ID NO: 825935 - DNA, 25 bp, Mus musculus
tcgtggggctcctttgtgaccgtgc

SEQ ID NO: 825936 - DNA, 25 bp, Mus musculus
tcgtgggtaagccaccagtcaggca

SEQ ID NO: 825937 - DNA, 25 bp, Mus musculus
tcgtgggtaagcgaccagtcaggca

SEQ ID NO: 825938 - DNA, 25 bp, Mus musculus
tcgtgggtagctctctgtacacaat

SEQ ID NO: 825939 - DNA, 25 bp, Mus musculus
tcgtgggtagctgtctgtacacaat

SEQ ID NO: 825940 - DNA, 25 bp, Mus musculus
tcgtgggtctcacaaatatctttgt

SEQ ID NO: 825941 - DNA, 25 bp, Mus musculus
tcgtgggtctcagaaatatctttgt

SEQ ID NO: 825942 - DNA, 25 bp, Mus musculus
tcgtgggtcttgattcaatggcaac

SEQ ID NO: 825943 - DNA, 25 bp, Mus musculus
tcgtgggtcttgtttcaatggcaac

SEQ ID NO: 825944 - DNA, 25 bp, Mus musculus
tcgtgggtttcgctggagccatcat

SEQ ID NO: 825945 - DNA, 25 bp, Mus musculus
tcgtgggtttcggtggagccatcat

SEQ ID NO: 825946 - DNA, 25 bp, Mus musculus
tcgtggtcagtaaattccgggaaat

SEQ ID NO: 825947 - DNA, 25 bp, Mus musculus
tcgtggtcagtatattccgggaaat

SEQ ID NO: 825948 - DNA, 25 bp, Mus musculus
tcgtggtccgctaccggccagatga

SEQ ID NO: 825949 - DNA, 25 bp, Mus musculus
tcgtggtccgcttccggccagatga

SEQ ID NO: 825950 - DNA, 25 bp, Mus musculus
tcgtggtcctccatagcagctgatt

SEQ ID NO: 825951 - DNA, 25 bp, Mus musculus
tcgtggtcctccttagcagctgatt

SEQ ID NO: 825952 - DNA, 25 bp, Mus musculus
tcgtggtcgctgctttctattgcat

SEQ ID NO: 825953 - DNA, 25 bp, Mus musculus
tcgtggtcgctggtttctattgcat

SEQ ID NO: 825954 - DNA, 25 bp, Mus musculus
tcgtggtcgtcgactgtgctgctag

SEQ ID NO: 825955 - DNA, 25 bp, Mus musculus
tcgtggtcgtcgtctgtgctgctag

SEQ ID NO: 825956 - DNA, 25 bp, Mus musculus
tcgtggtgctgccattcatgaccat

SEQ ID NO: 825957 - DNA, 25 bp, Mus musculus
tcgtggtgctgcgattcatgaccat

SEQ ID NO: 825958 - DNA, 25 bp, Mus musculus
tcgtggtggccaactacttcatgac

SEQ ID NO: 825959 - DNA, 25 bp, Mus musculus
tcgtggtggccatctacttcatgac

SEQ ID NO: 825960 - DNA, 25 bp, Mus musculus
tcgtggtggccgagttggaacccac

SEQ ID NO: 825961 - DNA, 25 bp, Mus musculus
tcgtggtggccgtgttggaacccac

SEQ ID NO: 825962 - DNA, 25 bp, Mus musculus
tcgtggtggttacctaggcagtttt

SEQ ID NO: 825963 - DNA, 25 bp, Mus musculus
tcgtggtggttagctaggcagtttt

SEQ ID NO: 825964 - DNA, 25 bp, Mus musculus
tcgtggtgtgttcgtttccgttctt

SEQ ID NO: 825965 - DNA, 25 bp, Mus musculus
tcgtggtgtgttggtttccgttctt

SEQ ID NO: 825966 - DNA, 25 bp, Mus musculus
tcgtggttatctatgagccactgaa

SEQ ID NO: 825967 - DNA, 25 bp, Mus musculus
tcgtggttatctttgagccactgaa

SEQ ID NO: 825968 - DNA, 25 bp, Mus musculus
tcgtggttccagatgcatcttaata

SEQ ID NO: 825969 - DNA, 25 bp, Mus musculus
tcgtggttccagttgcatcttaata

SEQ ID NO: 825970 - DNA, 25 bp, Mus musculus
tcgtggtttaatccctaaggattga

SEQ ID NO: 825971 - DNA, 25 bp, Mus musculus
tcgtggtttaatgcctaaggattga

SEQ ID NO: 825972 - DNA, 25 bp, Mus musculus
tcgtggtttagcacctcggtggtga

SEQ ID NO: 825973 - DNA, 25 bp, Mus musculus
tcgtggtttagctcctcggtggtga

SEQ ID NO: 825974 - DNA, 25 bp, Mus musculus
tcgtggtttatcctggcaatgataa

SEQ ID NO: 825975 - DNA, 25 bp, Mus musculus
tcgtggtttatcgtggcaatgataa

SEQ ID NO: 825976 - DNA, 25 bp, Mus musculus
tcgtgtaatgttagtgcacctccct

SEQ ID NO: 825977 - DNA, 25 bp, Mus musculus
tcgtgtaatgtttgtgcacctccct

SEQ ID NO: 825978 - DNA, 25 bp, Mus musculus
tcgtgtaccacgaggtcatcaacgc

SEQ ID NO: 825979 - DNA, 25 bp, Mus musculus
tcgtgtaccacgtggtcatcaacgc

SEQ ID NO: 825980 - DNA, 25 bp, Mus musculus
tcgtgtacctggctcatggatgtat

SEQ ID NO: 825981 - DNA, 25 bp, Mus musculus
tcgtgtacctgggtcatggatgtat

SEQ ID NO: 825982 - DNA, 25 bp, Mus musculus
tcgtgtaggtccagcgcagaccgag

SEQ ID NO: 825983 - DNA, 25 bp, Mus musculus
tcgtgtaggtcctgcgcagaccgag

SEQ ID NO: 825984 - DNA, 25 bp, Mus musculus
tcgtgtatcttcatttttcttcttc

SEQ ID NO: 825985 - DNA, 25 bp, Mus musculus
tcgtgtatcttcttttttcttcttc

SEQ ID NO: 825986 - DNA, 25 bp, Mus musculus
tcgtgtcaacacaagagcaatgctt

SEQ ID NO: 825987 - DNA, 25 bp, Mus musculus
tcgtgtcaacactagagcaatgctt

SEQ ID NO: 825988 - DNA, 25 bp, Mus musculus
tcgtgtcactgtaaactcagcagct

SEQ ID NO: 825989 - DNA, 25 bp, Mus musculus
tcgtgtcactgttaactcagcagct

SEQ ID NO: 825990 - DNA, 25 bp, Mus musculus
tcgtgtccaataattccgaaatgct

SEQ ID NO: 825991 - DNA, 25 bp, Mus musculus
tcgtgtccaatatttccgaaatgct

SEQ ID NO: 825992 - DNA, 25 bp, Mus musculus
tcgtgtcccactaggttgtttagtt

SEQ ID NO: 825993 - DNA, 25 bp, Mus musculus
tcgtgtcccacttggttgtttagtt

SEQ ID NO: 825994 - DNA, 25 bp, Mus musculus
tcgtgtccgcctagttaagaaagag

SEQ ID NO: 825995 - DNA, 25 bp, Mus musculus
tcgtgtccgccttgttaagaaagag

SEQ ID NO: 825996 - DNA, 25 bp, Mus musculus
tcgtgtcctgcaacacaaacgccga

SEQ ID NO: 825997 - DNA, 25 bp, Mus musculus
tcgtgtcctgcatcacaaacgccga

SEQ ID NO: 825998 - DNA, 25 bp, Mus musculus
tcgtgtctccctaccaataaaattt

SEQ ID NO: 825999 - DNA, 25 bp, Mus musculus
tcgtgtctcccttccaataaaattt

SEQ ID NO: 826000 - DNA, 25 bp, Mus musculus
tcgtgtctccttccaatgctgcaga

SEQ ID NO: 826001 - DNA, 25 bp, Mus musculus
tcgtgtctccttgcaatgctgcaga

SEQ ID NO: 826002 - DNA, 25 bp, Mus musculus
tcgtgtctgtacatagcggcctggc

SEQ ID NO: 826003 - DNA, 25 bp, Mus musculus
tcgtgtctgtacttagcggcctggc

SEQ ID NO: 826004 - DNA, 25 bp, Mus musculus
tcgtgtcttgggactgcatgtcagg

SEQ ID NO: 826005 - DNA, 25 bp, Mus musculus
tcgtgtcttgggtctgcatgtcagg

SEQ ID NO: 826006 - DNA, 25 bp, Mus musculus
tcgtgtctttcaaggtactgtacat

SEQ ID NO: 826007 - DNA, 25 bp, Mus musculus
tcgtgtctttcatggtactgtacat

SEQ ID NO: 826008 - DNA, 25 bp, Mus musculus
tcgtgtgaccacaatgtacttccta

SEQ ID NO: 826009 - DNA, 25 bp, Mus musculus
tcgtgtgaccactatgtacttccta

SEQ ID NO: 826010 - DNA, 25 bp, Mus musculus
tcgtgtgatctcactctcaggagag

SEQ ID NO: 826011 - DNA, 25 bp, Mus musculus
tcgtgtgatctctctctcaggagag

SEQ ID NO: 826012 - DNA, 25 bp, Mus musculus
tcgtgtgcccgtccctgtagaagct

SEQ ID NO: 826013 - DNA, 25 bp, Mus musculus
tcgtgtgcccgtgcctgtagaagct

SEQ ID NO: 826014 - DNA, 25 bp, Mus musculus
tcgtgtgccgcccagtgaaaagaca

SEQ ID NO: 826015 - DNA, 25 bp, Mus musculus
tcgtgtgccgccgagtgaaaagaca

SEQ ID NO: 826016 - DNA, 25 bp, Mus musculus
tcgtgtggccttcgatgatgtgcta

SEQ ID NO: 826017 - DNA, 25 bp, Mus musculus
tcgtgtggccttggatgatgtgcta

SEQ ID NO: 826018 - DNA, 25 bp, Mus musculus
tcgtgtgtagtccagatgaagtcat

SEQ ID NO: 826019 - DNA, 25 bp, Mus musculus
tcgtgtgtagtcgagatgaagtcat

SEQ ID NO: 826020 - DNA, 25 bp, Mus musculus
tcgtgtgtggtcataattttatcaa

SEQ ID NO: 826021 - DNA, 25 bp, Mus musculus
tcgtgtgtggtcttaattttatcaa

SEQ ID NO: 826022 - DNA, 25 bp, Mus musculus
tcgtgtgttctcacaatcctgagta

SEQ ID NO: 826023 - DNA, 25 bp, Mus musculus
tcgtgtgttctctcaatcctgagta

SEQ ID NO: 826024 - DNA, 25 bp, Mus musculus
tcgtgttattatctggtgctgagaa

SEQ ID NO: 826025 - DNA, 25 bp, Mus musculus
tcgtgttattatgtggtgctgagaa

SEQ ID NO: 826026 - DNA, 25 bp, Mus musculus
tcgtgttattttatgagctgctaca

SEQ ID NO: 826027 - DNA, 25 bp, Mus musculus
tcgtgttattttttgagctgctaca

SEQ ID NO: 826028 - DNA, 25 bp, Mus musculus
tcgtgttcatatagattccattttg

SEQ ID NO: 826029 - DNA, 25 bp, Mus musculus
tcgtgttcatattgattccattttg

SEQ ID NO: 826030 - DNA, 25 bp, Mus musculus
tcgtgttccatactgacccagtctg

SEQ ID NO: 826031 - DNA, 25 bp, Mus musculus
tcgtgttccatagtgacccagtctg

SEQ ID NO: 826032 - DNA, 25 bp, Mus musculus
tcgtgttcccagcacatgaactaat

SEQ ID NO: 826033 - DNA, 25 bp, Mus musculus
tcgtgttcccaggacatgaactaat

SEQ ID NO: 826034 - DNA, 25 bp, Mus musculus
tcgtgttcccttacttaggcggcga

SEQ ID NO: 826035 - DNA, 25 bp, Mus musculus
tcgtgttccctttcttaggcggcga

SEQ ID NO: 826036 - DNA, 25 bp, Mus musculus
tcgtgttctttcctggatcacagac

SEQ ID NO: 826037 - DNA, 25 bp, Mus musculus
tcgtgttctttcgtggatcacagac

SEQ ID NO: 826038 - DNA, 25 bp, Mus musculus
tcgtgttgcccaacaatggatgctt

SEQ ID NO: 826039 - DNA, 25 bp, Mus musculus
tcgtgttgcccatcaatggatgctt

SEQ ID NO: 826040 - DNA, 25 bp, Mus musculus
tcgtgtttagttcctctgtagtgtc

SEQ ID NO: 826041 - DNA, 25 bp, Mus musculus
tcgtgtttagttgctctgtagtgtc

SEQ ID NO: 826042 - DNA, 25 bp, Mus musculus
tcgtgtttcatcacttaagtgctca

SEQ ID NO: 826043 - DNA, 25 bp, Mus musculus
tcgtgtttcatctcttaagtgctca

SEQ ID NO: 826044 - DNA, 25 bp, Mus musculus
tcgtgtttccccagtgagtattgaa

SEQ ID NO: 826045 - DNA, 25 bp, Mus musculus
tcgtgtttcccctgtgagtattgaa

SEQ ID NO: 826046 - DNA, 25 bp, Mus musculus
tcgtgtttccgaccttttgtccttg

SEQ ID NO: 826047 - DNA, 25 bp, Mus musculus
tcgtgtttccgagcttttgtccttg

SEQ ID NO: 826048 - DNA, 25 bp, Mus musculus
tcgtgtttcgggacagttcgctgct

SEQ ID NO: 826049 - DNA, 25 bp, Mus musculus
tcgtgtttcgggtcagttcgctgct

SEQ ID NO: 826050 - DNA, 25 bp, Mus musculus
tcgtgtttcttcaactgtcactaaa

SEQ ID NO: 826051 - DNA, 25 bp, Mus musculus
tcgtgtttcttctactgtcactaaa

SEQ ID NO: 826052 - DNA, 25 bp, Mus musculus
tcgtgtttgctaactgttggacccc

SEQ ID NO: 826053 - DNA, 25 bp, Mus musculus
tcgtgtttgctatctgttggacccc

SEQ ID NO: 826054 - DNA, 25 bp, Mus musculus
tcgtgtttgtctaagcagcctcaaa

SEQ ID NO: 826055 - DNA, 25 bp, Mus musculus
tcgtgtttgtcttagcagcctcaaa

SEQ ID NO: 826056 - DNA, 25 bp, Mus musculus
tcgttaaatactcagatgcaatcct

SEQ ID NO: 826057 - DNA, 25 bp, Mus musculus
tcgttaaatactgagatgcaatcct

SEQ ID NO: 826058 - DNA, 25 bp, Mus musculus
tcgttaacctgcatctgtcggccga

SEQ ID NO: 826059 - DNA, 25 bp, Mus musculus
tcgttaacctgcttctgtcggccga

SEQ ID NO: 826060 - DNA, 25 bp, Mus musculus
tcgttaactcttaccttcttgggag

SEQ ID NO: 826061 - DNA, 25 bp, Mus musculus
tcgttaactctttccttcttgggag

SEQ ID NO: 826062 - DNA, 25 bp, Mus musculus
tcgttaagagtcaagctgccggtca

SEQ ID NO: 826063 - DNA, 25 bp, Mus musculus
tcgttaagagtctagctgccggtca

SEQ ID NO: 826064 - DNA, 25 bp, Mus musculus
tcgttaagtctgactactgaaacac

SEQ ID NO: 826065 - DNA, 25 bp, Mus musculus
tcgttaagtctgtctactgaaacac

SEQ ID NO: 826066 - DNA, 25 bp, Mus musculus
tcgttaatacaaactgatcctgaag

SEQ ID NO: 826067 - DNA, 25 bp, Mus musculus
tcgttaatacaatctgatcctgaag

SEQ ID NO: 826068 - DNA, 25 bp, Mus musculus
tcgttacatgttaccctttcccagt

SEQ ID NO: 826069 - DNA, 25 bp, Mus musculus
tcgttacatgttatgtccagcagtc

SEQ ID NO: 826070 - DNA, 25 bp, Mus musculus
tcgttacatgtttccctttcccagt

SEQ ID NO: 826071 - DNA, 25 bp, Mus musculus
tcgttacatgttttgtccagcagtc

SEQ ID NO: 826072 - DNA, 25 bp, Mus musculus
tcgttactagagatttacccatggg

SEQ ID NO: 826073 - DNA, 25 bp, Mus musculus
tcgttactagagttttacccatggg

SEQ ID NO: 826074 - DNA, 25 bp, Mus musculus
tcgttactgagaagcgcggctgtta

SEQ ID NO: 826075 - DNA, 25 bp, Mus musculus
tcgttactgagatgcgcggctgtta

SEQ ID NO: 826076 - DNA, 25 bp, Mus musculus
tcgttacttttcagttaggagctta

SEQ ID NO: 826077 - DNA, 25 bp, Mus musculus
tcgttacttttctgttaggagctta

SEQ ID NO: 826078 - DNA, 25 bp, Mus musculus
tcgttagaacacaccctcgatttag

SEQ ID NO: 826079 - DNA, 25 bp, Mus musculus
tcgttagaacactccctcgatttag

SEQ ID NO: 826080 - DNA, 25 bp, Mus musculus
tcgttagactcacagaattcctcct

SEQ ID NO: 826081 - DNA, 25 bp, Mus musculus
tcgttagactcagagaattcctcct

SEQ ID NO: 826082 - DNA, 25 bp, Mus musculus
tcgttagtaattatatcacccatga

SEQ ID NO: 826083 - DNA, 25 bp, Mus musculus
tcgttagtaattttatcacccatga

SEQ ID NO: 826084 - DNA, 25 bp, Mus musculus
tcgttagtgaatacagataccttaa

SEQ ID NO: 826085 - DNA, 25 bp, Mus musculus
tcgttagtgaattcagataccttaa

SEQ ID NO: 826086 - DNA, 25 bp, Mus musculus
tcgttataaaacaagatctttcttc

SEQ ID NO: 826087 - DNA, 25 bp, Mus musculus
tcgttataaaactagatctttcttc

SEQ ID NO: 826088 - DNA, 25 bp, Mus musculus
tcgttatcattcaaagctgaactgt

SEQ ID NO: 826089 - DNA, 25 bp, Mus musculus
tcgttatcattctaagctgaactgt

SEQ ID NO: 826090 - DNA, 25 bp, Mus musculus
tcgttatctataaatggtcagtgct

SEQ ID NO: 826091 - DNA, 25 bp, Mus musculus
tcgttatctatatatggtcagtgct

SEQ ID NO: 826092 - DNA, 25 bp, Mus musculus
tcgttatctgtaaatatccttttta

SEQ ID NO: 826093 - DNA, 25 bp, Mus musculus
tcgttatctgtatatatccttttta

SEQ ID NO: 826094 - DNA, 25 bp, Mus musculus
tcgttatgacccctatttttctggg

SEQ ID NO: 826095 - DNA, 25 bp, Mus musculus
tcgttatgacccgtatttttctggg

SEQ ID NO: 826096 - DNA, 25 bp, Mus musculus
tcgttatgacttaacacccagcttc

SEQ ID NO: 826097 - DNA, 25 bp, Mus musculus
tcgttatgactttacacccagcttc

SEQ ID NO: 826098 - DNA, 25 bp, Mus musculus
tcgttatggcgccttgtacttctac

SEQ ID NO: 826099 - DNA, 25 bp, Mus musculus
tcgttatggcgcgttgtacttctac

SEQ ID NO: 826100 - DNA, 25 bp, Mus musculus
tcgttcaaccggaatgcttttaatg

SEQ ID NO: 826101 - DNA, 25 bp, Mus musculus
tcgttcaaccggtatgcttttaatg

SEQ ID NO: 826102 - DNA, 25 bp, Mus musculus
tcgttcactcatcgaaaatagcgat

SEQ ID NO: 826103 - DNA, 25 bp, Mus musculus
tcgttcactcatggaaaatagcgat

SEQ ID NO: 826104 - DNA, 25 bp, Mus musculus
tcgttcaggaacataaggcatacag

SEQ ID NO: 826105 - DNA, 25 bp, Mus musculus
tcgttcaggaacttaaggcatacag

SEQ ID NO: 826106 - DNA, 25 bp, Mus musculus
tcgttcagggccaggagcgtgccaa

SEQ ID NO: 826107 - DNA, 25 bp, Mus musculus
tcgttcagggcctggagcgtgccaa

SEQ ID NO: 826108 - DNA, 25 bp, Mus musculus
tcgttcattcctccagagttgcttt

SEQ ID NO: 826109 - DNA, 25 bp, Mus musculus
tcgttcattcctgcagagttgcttt

SEQ ID NO: 826110 - DNA, 25 bp, Mus musculus
tcgttcattgtcaggggccagaaaa

SEQ ID NO: 826111 - DNA, 25 bp, Mus musculus
tcgttcattgtctggggccagaaaa

SEQ ID NO: 826112 - DNA, 25 bp, Mus musculus
tcgttccaaagactagtaaccttat

SEQ ID NO: 826113 - DNA, 25 bp, Mus musculus
tcgttccaaagagtagtaaccttat

SEQ ID NO: 826114 - DNA, 25 bp, Mus musculus
tcgttccacctcagctaactataaa

SEQ ID NO: 826115 - DNA, 25 bp, Mus musculus
tcgttccacctctgctaactataaa

SEQ ID NO: 826116 - DNA, 25 bp, Mus musculus
tcgttccactccactagaaccggtt

SEQ ID NO: 826117 - DNA, 25 bp, Mus musculus
tcgttccactccatcttgcaaatgc

SEQ ID NO: 826118 - DNA, 25 bp, Mus musculus
tcgttccactcctctagaaccggtt

SEQ ID NO: 826119 - DNA, 25 bp, Mus musculus
tcgttccactccttcttgcaaatgc

SEQ ID NO: 826120 - DNA, 25 bp, Mus musculus
tcgttcccagctatgagaggtctca

SEQ ID NO: 826121 - DNA, 25 bp, Mus musculus
tcgttcccagctttgagaggtctca

SEQ ID NO: 826122 - DNA, 25 bp, Mus musculus
tcgttcccatttcttttccagtgtt

SEQ ID NO: 826123 - DNA, 25 bp, Mus musculus
tcgttcccatttgttttccagtgtt

SEQ ID NO: 826124 - DNA, 25 bp, Mus musculus
tcgttccctaacctttctgaagatt

SEQ ID NO: 826125 - DNA, 25 bp, Mus musculus
tcgttccctaacgtttctgaagatt

SEQ ID NO: 826126 - DNA, 25 bp, Mus musculus
tcgttccctgctaggcatcatctta

SEQ ID NO: 826127 - DNA, 25 bp, Mus musculus
tcgttccctgcttggcatcatctta

SEQ ID NO: 826128 - DNA, 25 bp, Mus musculus
tcgttccctggcacacacaatgtgt

SEQ ID NO: 826129 - DNA, 25 bp, Mus musculus
tcgttccctggctcacacaatgtgt

SEQ ID NO: 826130 - DNA, 25 bp, Mus musculus
tcgttccgcttgacttggcagttga

SEQ ID NO: 826131 - DNA, 25 bp, Mus musculus
tcgttccgcttgtcttggcagttga

SEQ ID NO: 826132 - DNA, 25 bp, Mus musculus
tcgttcctgaacactactagtaccg

SEQ ID NO: 826133 - DNA, 25 bp, Mus musculus
tcgttcctgaactctactagtaccg

SEQ ID NO: 826134 - DNA, 25 bp, Mus musculus
tcgttcctgttgagtacttggtgtt

SEQ ID NO: 826135 - DNA, 25 bp, Mus musculus
tcgttcctgttgtgtacttggtgtt

SEQ ID NO: 826136 - DNA, 25 bp, Mus musculus
tcgttcgacttaagagtttgccaat

SEQ ID NO: 826137 - DNA, 25 bp, Mus musculus
tcgttcgacttatgagtttgccaat

SEQ ID NO: 826138 - DNA, 25 bp, Mus musculus
tcgttcgcagagatccgctctttgt

SEQ ID NO: 826139 - DNA, 25 bp, Mus musculus
tcgttcgcagagttccgctctttgt

SEQ ID NO: 826140 - DNA, 25 bp, Mus musculus
tcgttcgcaggactggtttacagaa

SEQ ID NO: 826141 - DNA, 25 bp, Mus musculus
tcgttcgcaggagtggtttacagaa

SEQ ID NO: 826142 - DNA, 25 bp, Mus musculus
tcgttcggttgaccaaggctagcca

SEQ ID NO: 826143 - DNA, 25 bp, Mus musculus
tcgttcggttgagcaaggctagcca

SEQ ID NO: 826144 - DNA, 25 bp, Mus musculus
tcgttctagatgaggcctgcaggga

SEQ ID NO: 826145 - DNA, 25 bp, Mus musculus
tcgttctagatgtggcctgcaggga

SEQ ID NO: 826146 - DNA, 25 bp, Mus musculus
tcgttctagctcatagcaggctcat

SEQ ID NO: 826147 - DNA, 25 bp, Mus musculus
tcgttctagctcttagcaggctcat

SEQ ID NO: 826148 - DNA, 25 bp, Mus musculus
tcgttctcatagatgattcgattgt

SEQ ID NO: 826149 - DNA, 25 bp, Mus musculus
tcgttctcatagttgattcgattgt

SEQ ID NO: 826150 - DNA, 25 bp, Mus musculus
tcgttctcccacattcaggacaaaa

SEQ ID NO: 826151 - DNA, 25 bp, Mus musculus
tcgttctcccactttcaggacaaaa

SEQ ID NO: 826152 - DNA, 25 bp, Mus musculus
tcgttctgatccatcactacaagat

SEQ ID NO: 826153 - DNA, 25 bp, Mus musculus
tcgttctgatccttcactacaagat

SEQ ID NO: 826154 - DNA, 25 bp, Mus musculus
tcgttctgccgccaggacaactcgg

SEQ ID NO: 826155 - DNA, 25 bp, Mus musculus
tcgttctgccgcgaggacaactcgg

SEQ ID NO: 826156 - DNA, 25 bp, Mus musculus
tcgttctgccggacgttgagagtga

SEQ ID NO: 826157 - DNA, 25 bp, Mus musculus
tcgttctgccggtcgttgagagtga

SEQ ID NO: 826158 - DNA, 25 bp, Mus musculus
tcgttctgcctcatcttgggttgca

SEQ ID NO: 826159 - DNA, 25 bp, Mus musculus
tcgttctgcctcttcttgggttgca

SEQ ID NO: 826160 - DNA, 25 bp, Mus musculus
tcgttctgctacagatgtttcctaa

SEQ ID NO: 826161 - DNA, 25 bp, Mus musculus
tcgttctgctactgatgtttcctaa

SEQ ID NO: 826162 - DNA, 25 bp, Mus musculus
tcgttctgtccaatagaggtcttaa

SEQ ID NO: 826163 - DNA, 25 bp, Mus musculus
tcgttctgtccattagaggtcttaa

SEQ ID NO: 826164 - DNA, 25 bp, Mus musculus
tcgttctgtgcgatcattctgcaaa

SEQ ID NO: 826165 - DNA, 25 bp, Mus musculus
tcgttctgtgcgttcattctgcaaa

SEQ ID NO: 826166 - DNA, 25 bp, Mus musculus
tcgttctttttgagagttagctttt

SEQ ID NO: 826167 - DNA, 25 bp, Mus musculus
tcgttctttttgtgagttagctttt

SEQ ID NO: 826168 - DNA, 25 bp, Mus musculus
tcgttgaaccatctgtgactgttaa

SEQ ID NO: 826169 - DNA, 25 bp, Mus musculus
tcgttgaaccatgtgtgactgttaa

SEQ ID NO: 826170 - DNA, 25 bp, Mus musculus
tcgttgacgtgtatttccaagggag

SEQ ID NO: 826171 - DNA, 25 bp, Mus musculus
tcgttgacgtgtttttccaagggag

SEQ ID NO: 826172 - DNA, 25 bp, Mus musculus
tcgttgatctgactgccctgagtct

SEQ ID NO: 826173 - DNA, 25 bp, Mus musculus
tcgttgatctgagtgccctgagtct

SEQ ID NO: 826174 - DNA, 25 bp, Mus musculus
tcgttgatcttaatctgctcatcac

SEQ ID NO: 826175 - DNA, 25 bp, Mus musculus
tcgttgatcttattctgctcatcac

SEQ ID NO: 826176 - DNA, 25 bp, Mus musculus
tcgttgcaatttaaagtggttttca

SEQ ID NO: 826177 - DNA, 25 bp, Mus musculus
tcgttgcaattttaagtggttttca

SEQ ID NO: 826178 - DNA, 25 bp, Mus musculus
tcgttgcatgtcagggctccagtgc

SEQ ID NO: 826179 - DNA, 25 bp, Mus musculus
tcgttgcatgtctgggctccagtgc

SEQ ID NO: 826180 - DNA, 25 bp, Mus musculus
tcgttgccagccattggagttggat

SEQ ID NO: 826181 - DNA, 25 bp, Mus musculus
tcgttgccagcctttggagttggat

SEQ ID NO: 826182 - DNA, 25 bp, Mus musculus
tcgttgctacttcattaactgacat

SEQ ID NO: 826183 - DNA, 25 bp, Mus musculus
tcgttgctacttgattaactgacat

SEQ ID NO: 826184 - DNA, 25 bp, Mus musculus
tcgttgctcaagacttatggccagg

SEQ ID NO: 826185 - DNA, 25 bp, Mus musculus
tcgttgctcaagtcttatggccagg

SEQ ID NO: 826186 - DNA, 25 bp, Mus musculus
tcgttgctgtccagtttggaacaca

SEQ ID NO: 826187 - DNA, 25 bp, Mus musculus
tcgttgctgtcctgtttggaacaca

SEQ ID NO: 826188 - DNA, 25 bp, Mus musculus
tcgttgctgtttcatactgtgcttt

SEQ ID NO: 826189 - DNA, 25 bp, Mus musculus
tcgttgctgtttgatactgtgcttt

SEQ ID NO: 826190 - DNA, 25 bp, Mus musculus
tcgttgcttaggagctttttccttt

SEQ ID NO: 826191 - DNA, 25 bp, Mus musculus
tcgttgcttaggtgctttttccttt

SEQ ID NO: 826192 - DNA, 25 bp, Mus musculus
tcgttggaatctatcccaggcccct

SEQ ID NO: 826193 - DNA, 25 bp, Mus musculus
tcgttggaatctttcccaggcccct

SEQ ID NO: 826194 - DNA, 25 bp, Mus musculus
tcgttggcctctctttgctgaagga

SEQ ID NO: 826195 - DNA, 25 bp, Mus musculus
tcgttggcctctgtttgctgaagga

SEQ ID NO: 826196 - DNA, 25 bp, Mus musculus
tcgttggctaatactgtctgtagat

SEQ ID NO: 826197 - DNA, 25 bp, Mus musculus
tcgttggctaattctgtctgtagat

SEQ ID NO: 826198 - DNA, 25 bp, Mus musculus
tcgttggtgcccatgaatgaccttc

SEQ ID NO: 826199 - DNA, 25 bp, Mus musculus
tcgttggtgcccttgaatgaccttc

SEQ ID NO: 826200 - DNA, 25 bp, Mus musculus
tcgttggttaggagtcccatttgac

SEQ ID NO: 826201 - DNA, 25 bp, Mus musculus
tcgttggttaggtgtcccatttgac

SEQ ID NO: 826202 - DNA, 25 bp, Mus musculus
tcgttggttctgacctaggctataa

SEQ ID NO: 826203 - DNA, 25 bp, Mus musculus
tcgttggttctgtcctaggctataa

SEQ ID NO: 826204 - DNA, 25 bp, Mus musculus
tcgttgtaattgatgacattccttt

SEQ ID NO: 826205 - DNA, 25 bp, Mus musculus
tcgttgtaattgttgacattccttt

SEQ ID NO: 826206 - DNA, 25 bp, Mus musculus
tcgttgtcttgcacagcgtcttttg

SEQ ID NO: 826207 - DNA, 25 bp, Mus musculus
tcgttgtcttgctcagcgtcttttg

SEQ ID NO: 826208 - DNA, 25 bp, Mus musculus
tcgttgttccccattataagtgaag

SEQ ID NO: 826209 - DNA, 25 bp, Mus musculus
tcgttgttcccctttataagtgaag

SEQ ID NO: 826210 - DNA, 25 bp, Mus musculus
tcgttgttcctgagctgatggttca

SEQ ID NO: 826211 - DNA, 25 bp, Mus musculus
tcgttgttcctgtgctgatggttca

SEQ ID NO: 826212 - DNA, 25 bp, Mus musculus
tcgttgttttctcagagacctagga

SEQ ID NO: 826213 - DNA, 25 bp, Mus musculus
tcgttgttttctgagagacctagga

SEQ ID NO: 826214 - DNA, 25 bp, Mus musculus
tcgtttaagaatcagggtgcagagc

SEQ ID NO: 826215 - DNA, 25 bp, Mus musculus
tcgtttaagaatgagggtgcagagc

SEQ ID NO: 826216 - DNA, 25 bp, Mus musculus
tcgtttacctccagtttagtgggct

SEQ ID NO: 826217 - DNA, 25 bp, Mus musculus
tcgtttacctcctgtttagtgggct

SEQ ID NO: 826218 - DNA, 25 bp, Mus musculus
tcgtttatgcggcaggactcgctcc

SEQ ID NO: 826219 - DNA, 25 bp, Mus musculus
tcgtttatgcgggaggactcgctcc

SEQ ID NO: 826220 - DNA, 25 bp, Mus musculus
tcgtttatgggcatgtcctcggcac

SEQ ID NO: 826221 - DNA, 25 bp, Mus musculus
tcgtttatgggcttgtcctcggcac

SEQ ID NO: 826222 - DNA, 25 bp, Mus musculus
tcgtttattatgagtgccgtgactt

SEQ ID NO: 826223 - DNA, 25 bp, Mus musculus
tcgtttattatgtgtgccgtgactt

SEQ ID NO: 826224 - DNA, 25 bp, Mus musculus
tcgtttcaagatatcaggcctcagc

SEQ ID NO: 826225 - DNA, 25 bp, Mus musculus
tcgtttcaagatttcaggcctcagc

SEQ ID NO: 826226 - DNA, 25 bp, Mus musculus
tcgtttcacaggctccagagtaaga

SEQ ID NO: 826227 - DNA, 25 bp, Mus musculus
tcgtttcacagggtccagagtaaga

SEQ ID NO: 826228 - DNA, 25 bp, Mus musculus
tcgtttcagtctatgtaatcaatct

SEQ ID NO: 826229 - DNA, 25 bp, Mus musculus
tcgtttcagtctttgtaatcaatct

SEQ ID NO: 826230 - DNA, 25 bp, Mus musculus
tcgtttcatggcaaacccacagctc

SEQ ID NO: 826231 - DNA, 25 bp, Mus musculus
tcgtttcatggctaacccacagctc

SEQ ID NO: 826232 - DNA, 25 bp, Mus musculus
tcgtttccacccagggccaggacag

SEQ ID NO: 826233 - DNA, 25 bp, Mus musculus
tcgtttccaccctgggccaggacag

SEQ ID NO: 826234 - DNA, 25 bp, Mus musculus
tcgtttctacccctggtaatgcgag

SEQ ID NO: 826235 - DNA, 25 bp, Mus musculus
tcgtttctacccgtggtaatgcgag

SEQ ID NO: 826236 - DNA, 25 bp, Mus musculus
tcgtttctttggctgtcttgggtaa

SEQ ID NO: 826237 - DNA, 25 bp, Mus musculus
tcgtttctttgggtgtcttgggtaa

SEQ ID NO: 826238 - DNA, 25 bp, Mus musculus
tcgtttctttttccttataaatgga

SEQ ID NO: 826239 - DNA, 25 bp, Mus musculus
tcgtttctttttgcttataaatgga

SEQ ID NO: 826240 - DNA, 25 bp, Mus musculus
tcgtttgaatgtctcttggtttagt

SEQ ID NO: 826241 - DNA, 25 bp, Mus musculus
tcgtttgaatgtgtcttggtttagt

SEQ ID NO: 826242 - DNA, 25 bp, Mus musculus
tcgtttgcgaataccatcgtctttt

SEQ ID NO: 826243 - DNA, 25 bp, Mus musculus
tcgtttgcgaattccatcgtctttt

SEQ ID NO: 826244 - DNA, 25 bp, Mus musculus
tcgtttgctggaactaatgggctgt

SEQ ID NO: 826245 - DNA, 25 bp, Mus musculus
tcgtttgctggatctaatgggctgt

SEQ ID NO: 826246 - DNA, 25 bp, Mus musculus
tcgttttaatttctcagtgtctgga

SEQ ID NO: 826247 - DNA, 25 bp, Mus musculus
tcgttttaatttgtcagtgtctgga

SEQ ID NO: 826248 - DNA, 25 bp, Mus musculus
tcgttttccaaaaggatagcagact

SEQ ID NO: 826249 - DNA, 25 bp, Mus musculus
tcgttttccaaatggatagcagact

SEQ ID NO: 826250 - DNA, 25 bp, Mus musculus
tcgttttccagccagcattcaaata

SEQ ID NO: 826251 - DNA, 25 bp, Mus musculus
tcgttttccagcgagcattcaaata

SEQ ID NO: 826252 - DNA, 25 bp, Mus musculus
tcgttttcccagagtatttcccaag

SEQ ID NO: 826253 - DNA, 25 bp, Mus musculus
tcgttttcccagtgtatttcccaag

SEQ ID NO: 826254 - DNA, 25 bp, Mus musculus
tcgttttcctaactgacgctccgct

SEQ ID NO: 826255 - DNA, 25 bp, Mus musculus
tcgttttcctaagtgacgctccgct

SEQ ID NO: 826256 - DNA, 25 bp, Mus musculus
tcgttttcctcccttcatagagaaa

SEQ ID NO: 826257 - DNA, 25 bp, Mus musculus
tcgttttcctccgttcatagagaaa

SEQ ID NO: 826258 - DNA, 25 bp, Mus musculus
tcgttttccttcctacaactcagtg

SEQ ID NO: 826259 - DNA, 25 bp, Mus musculus
tcgttttccttcgtacaactcagtg

SEQ ID NO: 826260 - DNA, 25 bp, Mus musculus
tcgttttctagacagagggcatgca

SEQ ID NO: 826261 - DNA, 25 bp, Mus musculus
tcgttttctagagagagggcatgca

SEQ ID NO: 826262 - DNA, 25 bp, Mus musculus
tcgttttctttgcttgccctaactt

SEQ ID NO: 826263 - DNA, 25 bp, Mus musculus
tcgttttctttggttgccctaactt

SEQ ID NO: 826264 - DNA, 25 bp, Mus musculus
tctaaaaacaaaccactcctaatat

SEQ ID NO: 826265 - DNA, 25 bp, Mus musculus
tctaaaaacaaagcactcctaatat

SEQ ID NO: 826266 - DNA, 25 bp, Mus musculus
tctaaaacccagcactgtggaagta

SEQ ID NO: 826267 - DNA, 25 bp, Mus musculus
tctaaaacccaggactgtggaagta

SEQ ID NO: 826268 - DNA, 25 bp, Mus musculus
tctaaaactcatcggtagctgggtg

SEQ ID NO: 826269 - DNA, 25 bp, Mus musculus
tctaaaactcatgggtagctgggtg

SEQ ID NO: 826270 - DNA, 25 bp, Mus musculus
tctaaaactctcatatgctgcacgc

SEQ ID NO: 826271 - DNA, 25 bp, Mus musculus
tctaaaactctcttatgctgcacgc

SEQ ID NO: 826272 - DNA, 25 bp, Mus musculus
tctaaaactcttcgttggctttgga

SEQ ID NO: 826273 - DNA, 25 bp, Mus musculus
tctaaaactcttggttggctttgga

SEQ ID NO: 826274 - DNA, 25 bp, Mus musculus
tctaaaactgctagcactgcccagt

SEQ ID NO: 826275 - DNA, 25 bp, Mus musculus
tctaaaactgcttgcactgcccagt

SEQ ID NO: 826276 - DNA, 25 bp, Mus musculus
tctaaaacttgccatagtgaaatgt

SEQ ID NO: 826277 - DNA, 25 bp, Mus musculus
tctaaaacttgcgatagtgaaatgt

SEQ ID NO: 826278 - DNA, 25 bp, Mus musculus
tctaaaagccctcgcagagctctgc

SEQ ID NO: 826279 - DNA, 25 bp, Mus musculus
tctaaaagccctggcagagctctgc

SEQ ID NO: 826280 - DNA, 25 bp, Mus musculus
tctaaaaggaggacgccgggactgt

SEQ ID NO: 826281 - DNA, 25 bp, Mus musculus
tctaaaaggaggtcgccgggactgt

SEQ ID NO: 826282 - DNA, 25 bp, Mus musculus
tctaaaagtgtcactatctactgtg

SEQ ID NO: 826283 - DNA, 25 bp, Mus musculus
tctaaaagtgtctctatctactgtg

SEQ ID NO: 826284 - DNA, 25 bp, Mus musculus
tctaaaagttttcgctgaaagacct

SEQ ID NO: 826285 - DNA, 25 bp, Mus musculus
tctaaaagttttggctgaaagacct

SEQ ID NO: 826286 - DNA, 25 bp, Mus musculus
tctaaaatagcccttgaaccagagc

SEQ ID NO: 826287 - DNA, 25 bp, Mus musculus
tctaaaatagccgttgaaccagagc

SEQ ID NO: 826288 - DNA, 25 bp, Mus musculus
tctaaaatcagacgccaacaggtaa

SEQ ID NO: 826289 - DNA, 25 bp, Mus musculus
tctaaaatcagaggccaacaggtaa

SEQ ID NO: 826290 - DNA, 25 bp, Mus musculus
tctaaaatgacgacagcccttggct

SEQ ID NO: 826291 - DNA, 25 bp, Mus musculus
tctaaaatgacgtcagcccttggct

SEQ ID NO: 826292 - DNA, 25 bp, Mus musculus
tctaaaatgcctcacggacgccgct

SEQ ID NO: 826293 - DNA, 25 bp, Mus musculus
tctaaaatgcctgacggacgccgct

SEQ ID NO: 826294 - DNA, 25 bp, Mus musculus
tctaaaatgcttagtcgacatcctg

SEQ ID NO: 826295 - DNA, 25 bp, Mus musculus
tctaaaatgctttgtcgacatcctg

SEQ ID NO: 826296 - DNA, 25 bp, Mus musculus
tctaaacaaggaagcccctggctgt

SEQ ID NO: 826297 - DNA, 25 bp, Mus musculus
tctaaacaaggatgcccctggctgt

SEQ ID NO: 826298 - DNA, 25 bp, Mus musculus
tctaaacagaaacaatgggctcttc

SEQ ID NO: 826299 - DNA, 25 bp, Mus musculus
tctaaacagaaagaatgggctcttc

SEQ ID NO: 826300 - DNA, 25 bp, Mus musculus
tctaaacagcccatgtgagtggcct

SEQ ID NO: 826301 - DNA, 25 bp, Mus musculus
tctaaacagcccttgtgagtggcct

SEQ ID NO: 826302 - DNA, 25 bp, Mus musculus
tctaaacccttcagctccataggtc

SEQ ID NO: 826303 - DNA, 25 bp, Mus musculus
tctaaacccttctgctccataggtc

SEQ ID NO: 826304 - DNA, 25 bp, Mus musculus
tctaaactacaactcctcgctaatt

SEQ ID NO: 826305 - DNA, 25 bp, Mus musculus
tctaaactacaagtcctcgctaatt

SEQ ID NO: 826306 - DNA, 25 bp, Mus musculus
tctaaactcatgatcgtacctccat

SEQ ID NO: 826307 - DNA, 25 bp, Mus musculus
tctaaactcatgttcgtacctccat

SEQ ID NO: 826308 - DNA, 25 bp, Mus musculus
tctaaactggtgagtctgctgagct

SEQ ID NO: 826309 - DNA, 25 bp, Mus musculus
tctaaactggtgtgtctgctgagct

SEQ ID NO: 826310 - DNA, 25 bp, Mus musculus
tctaaactgtggctgcatgtcatgc

SEQ ID NO: 826311 - DNA, 25 bp, Mus musculus
tctaaactgtgggtgcatgtcatgc

SEQ ID NO: 826312 - DNA, 25 bp, Mus musculus
tctaaacttccaacttgtttgtaaa

SEQ ID NO: 826313 - DNA, 25 bp, Mus musculus
tctaaacttccatcttgtttgtaaa

SEQ ID NO: 826314 - DNA, 25 bp, Mus musculus
tctaaagaaattagggtgacacatc

SEQ ID NO: 826315 - DNA, 25 bp, Mus musculus
tctaaagaaatttgggtgacacatc

SEQ ID NO: 826316 - DNA, 25 bp, Mus musculus
tctaaagaagtaacctaggccctgt

SEQ ID NO: 826317 - DNA, 25 bp, Mus musculus
tctaaagaagtatcctaggccctgt

SEQ ID NO: 826318 - DNA, 25 bp, Mus musculus
tctaaagaatacagagtctctctgg

SEQ ID NO: 826319 - DNA, 25 bp, Mus musculus
tctaaagaatactgagtctctctgg

SEQ ID NO: 826320 - DNA, 25 bp, Mus musculus
tctaaagacaaccacatgctcacct

SEQ ID NO: 826321 - DNA, 25 bp, Mus musculus
tctaaagacaacgacatgctcacct

SEQ ID NO: 826322 - DNA, 25 bp, Mus musculus
tctaaagacagcctctaccatttgg

SEQ ID NO: 826323 - DNA, 25 bp, Mus musculus
tctaaagacagcgtctaccatttgg

SEQ ID NO: 826324 - DNA, 25 bp, Mus musculus
tctaaagacgggattccacgacaag

SEQ ID NO: 826325 - DNA, 25 bp, Mus musculus
tctaaagacgggtttccacgacaag

SEQ ID NO: 826326 - DNA, 25 bp, Mus musculus
tctaaagcaactcttcccaacctgt

SEQ ID NO: 826327 - DNA, 25 bp, Mus musculus
tctaaagcaactgttcccaacctgt

SEQ ID NO: 826328 - DNA, 25 bp, Mus musculus
tctaaagcagcgaaaggactccacc

SEQ ID NO: 826329 - DNA, 25 bp, Mus musculus
tctaaagcagcgtaaggactccacc

SEQ ID NO: 826330 - DNA, 25 bp, Mus musculus
tctaaagccactaccatgcaaagat

SEQ ID NO: 826331 - DNA, 25 bp, Mus musculus
tctaaagccacttccatgcaaagat

SEQ ID NO: 826332 - DNA, 25 bp, Mus musculus
tctaaagcccgtacgttcctgagtt

SEQ ID NO: 826333 - DNA, 25 bp, Mus musculus
tctaaagcccgttcgttcctgagtt

SEQ ID NO: 826334 - DNA, 25 bp, Mus musculus
tctaaagccttacatcgatcctgaa

SEQ ID NO: 826335 - DNA, 25 bp, Mus musculus
tctaaagccttagatcgatcctgaa

SEQ ID NO: 826336 - DNA, 25 bp, Mus musculus
tctaaagccttcagtggatgttctg

SEQ ID NO: 826337 - DNA, 25 bp, Mus musculus
tctaaagccttctgtggatgttctg

SEQ ID NO: 826338 - DNA, 25 bp, Mus musculus
tctaaaggctcaccactctgcagag

SEQ ID NO: 826339 - DNA, 25 bp, Mus musculus
tctaaaggctcagcactctgcagag

SEQ ID NO: 826340 - DNA, 25 bp, Mus musculus
tctaaaggtcctcagccggagcatg

SEQ ID NO: 826341 - DNA, 25 bp, Mus musculus
tctaaaggtcctgagccggagcatg

SEQ ID NO: 826342 - DNA, 25 bp, Mus musculus
tctaaagtccacaccatctggccgg

SEQ ID NO: 826343 - DNA, 25 bp, Mus musculus
tctaaagtccactccatctggccgg

SEQ ID NO: 826344 - DNA, 25 bp, Mus musculus
tctaaagtttgacggagccatctat

SEQ ID NO: 826345 - DNA, 25 bp, Mus musculus
tctaaagtttgagggagccatctat

SEQ ID NO: 826346 - DNA, 25 bp, Mus musculus
tctaaagtttgcatgcggctcccaa

SEQ ID NO: 826347 - DNA, 25 bp, Mus musculus
tctaaagtttgcttgcggctcccaa

SEQ ID NO: 826348 - DNA, 25 bp, Mus musculus
tctaaataaaatcctaggttctacc

SEQ ID NO: 826349 - DNA, 25 bp, Mus musculus
tctaaataaaatgctaggttctacc

SEQ ID NO: 826350 - DNA, 25 bp, Mus musculus
tctaaatcaagactgtatccacatt

SEQ ID NO: 826351 - DNA, 25 bp, Mus musculus
tctaaatcaagagtgtatccacatt

SEQ ID NO: 826352 - DNA, 25 bp, Mus musculus
tctaaatccttcatcatcacaacaa

SEQ ID NO: 826353 - DNA, 25 bp, Mus musculus
tctaaatccttcttcatcacaacaa

SEQ ID NO: 826354 - DNA, 25 bp, Mus musculus
tctaaatctctgcacttctgaagga

SEQ ID NO: 826355 - DNA, 25 bp, Mus musculus
tctaaatctctggacttctgaagga

SEQ ID NO: 826356 - DNA, 25 bp, Mus musculus
tctaaatcttgcaacttccactcta

SEQ ID NO: 826357 - DNA, 25 bp, Mus musculus
tctaaatcttgctacttccactcta

SEQ ID NO: 826358 - DNA, 25 bp, Mus musculus
tctaaatgaactacctgcaccacag

SEQ ID NO: 826359 - DNA, 25 bp, Mus musculus
tctaaatgaacttcctgcaccacag

SEQ ID NO: 826360 - DNA, 25 bp, Mus musculus
tctaaatgacttcttttcccaggaa

SEQ ID NO: 826361 - DNA, 25 bp, Mus musculus
tctaaatgacttgttttcccaggaa

SEQ ID NO: 826362 - DNA, 25 bp, Mus musculus
tctaaattatggctgttaaagatat

SEQ ID NO: 826363 - DNA, 25 bp, Mus musculus
tctaaattatgggtgttaaagatat

SEQ ID NO: 826364 - DNA, 25 bp, Mus musculus
tctaaatttagccttcacctccttc

SEQ ID NO: 826365 - DNA, 25 bp, Mus musculus
tctaaatttagcgttcacctccttc

SEQ ID NO: 826366 - DNA, 25 bp, Mus musculus
tctaaatttcgaatactcccctgct

SEQ ID NO: 826367 - DNA, 25 bp, Mus musculus
tctaaatttcgattactcccctgct

SEQ ID NO: 826368 - DNA, 25 bp, Mus musculus
tctaaatttcttcctatgctgcctc

SEQ ID NO: 826369 - DNA, 25 bp, Mus musculus
tctaaatttcttgctatgctgcctc

SEQ ID NO: 826370 - DNA, 25 bp, Mus musculus
tctaacaataagactgagccccaga

SEQ ID NO: 826371 - DNA, 25 bp, Mus musculus
tctaacaataagtctgagccccaga

SEQ ID NO: 826372 - DNA, 25 bp, Mus musculus
tctaacacccttagtccatccatgg

SEQ ID NO: 826373 - DNA, 25 bp, Mus musculus
tctaacaccctttgtccatccatgg

SEQ ID NO: 826374 - DNA, 25 bp, Mus musculus
tctaacactgccacatactaactat

SEQ ID NO: 826375 - DNA, 25 bp, Mus musculus
tctaacactgcctcatactaactat

SEQ ID NO: 826376 - DNA, 25 bp, Mus musculus
tctaacatactccagctgaagcagg

SEQ ID NO: 826377 - DNA, 25 bp, Mus musculus
tctaacatactcgagctgaagcagg

SEQ ID NO: 826378 - DNA, 25 bp, Mus musculus
tctaacatacttaccatcaacaacc

SEQ ID NO: 826379 - DNA, 25 bp, Mus musculus
tctaacatactttccatcaacaacc

SEQ ID NO: 826380 - DNA, 25 bp, Mus musculus
tctaacatagcaacagaggcaggag

SEQ ID NO: 826381 - DNA, 25 bp, Mus musculus
tctaacatagcatcagaggcaggag

SEQ ID NO: 826382 - DNA, 25 bp, Mus musculus
tctaacatctgcacttgggttccca

SEQ ID NO: 826383 - DNA, 25 bp, Mus musculus
tctaacatctgctcttgggttccca

SEQ ID NO: 826384 - DNA, 25 bp, Mus musculus
tctaaccacgccaactgagcagagg

SEQ ID NO: 826385 - DNA, 25 bp, Mus musculus
tctaaccacgcctactgagcagagg

SEQ ID NO: 826386 - DNA, 25 bp, Mus musculus
tctaaccatacaccagcattgcatc

SEQ ID NO: 826387 - DNA, 25 bp, Mus musculus
tctaaccatacagcagcattgcatc

SEQ ID NO: 826388 - DNA, 25 bp, Mus musculus
tctaacccaagtactccggagagtg

SEQ ID NO: 826389 - DNA, 25 bp, Mus musculus
tctaacccaagttctccggagagtg

SEQ ID NO: 826390 - DNA, 25 bp, Mus musculus
tctaacccactgactccatatatta

SEQ ID NO: 826391 - DNA, 25 bp, Mus musculus
tctaacccactgtctccatatatta

SEQ ID NO: 826392 - DNA, 25 bp, Mus musculus
tctaaccccaggcaccctattatgg

SEQ ID NO: 826393 - DNA, 25 bp, Mus musculus
tctaaccccagggaccctattatgg

SEQ ID NO: 826394 - DNA, 25 bp, Mus musculus
tctaaccccattactatcgacattc

SEQ ID NO: 826395 - DNA, 25 bp, Mus musculus
tctaaccccatttctatcgacattc

SEQ ID NO: 826396 - DNA, 25 bp, Mus musculus
tctaacccctgcactgcaaaacaaa

SEQ ID NO: 826397 - DNA, 25 bp, Mus musculus
tctaacccctgctctgcaaaacaaa

SEQ ID NO: 826398 - DNA, 25 bp, Mus musculus
tctaaccctggcatgccttcttttt

SEQ ID NO: 826399 - DNA, 25 bp, Mus musculus
tctaaccctggcttgccttcttttt

SEQ ID NO: 826400 - DNA, 25 bp, Mus musculus
tctaacccttgactccttttgaaat

SEQ ID NO: 826401 - DNA, 25 bp, Mus musculus
tctaacccttgagtccttttgaaat

SEQ ID NO: 826402 - DNA, 25 bp, Mus musculus
tctaaccgtggccactcattgttaa

SEQ ID NO: 826403 - DNA, 25 bp, Mus musculus
tctaaccgtggcgactcattgttaa

SEQ ID NO: 826404 - DNA, 25 bp, Mus musculus
tctaacctaggcaacttcgggaaag

SEQ ID NO: 826405 - DNA, 25 bp, Mus musculus
tctaacctaggctacttcgggaaag

SEQ ID NO: 826406 - DNA, 25 bp, Mus musculus
tctaacctatttcagatctctacag

SEQ ID NO: 826407 - DNA, 25 bp, Mus musculus
tctaacctatttgagatctctacag

SEQ ID NO: 826408 - DNA, 25 bp, Mus musculus
tctaacctcatacagacctcaggct

SEQ ID NO: 826409 - DNA, 25 bp, Mus musculus
tctaacctcatagagacctcaggct

SEQ ID NO: 826410 - DNA, 25 bp, Mus musculus
tctaacctcttacccagaaaatgtg

SEQ ID NO: 826411 - DNA, 25 bp, Mus musculus
tctaacctcttagccagaaaatgtg

SEQ ID NO: 826412 - DNA, 25 bp, Mus musculus
tctaacctgcagaatgctctctttc

SEQ ID NO: 826413 - DNA, 25 bp, Mus musculus
tctaacctgcagtatgctctctttc

SEQ ID NO: 826414 - DNA, 25 bp, Mus musculus
tctaacctggatcttcctggaactc

SEQ ID NO: 826415 - DNA, 25 bp, Mus musculus
tctaacctggatgttcctggaactc

SEQ ID NO: 826416 - DNA, 25 bp, Mus musculus
tctaacctggtcatcacctactgaa

SEQ ID NO: 826417 - DNA, 25 bp, Mus musculus
tctaacctggtcttcacctactgaa

SEQ ID NO: 826418 - DNA, 25 bp, Mus musculus
tctaaccttaacacaggccacaagc

SEQ ID NO: 826419 - DNA, 25 bp, Mus musculus
tctaaccttaactcaggccacaagc

SEQ ID NO: 826420 - DNA, 25 bp, Mus musculus
tctaaccttctcatccatgttaact

SEQ ID NO: 826421 - DNA, 25 bp, Mus musculus
tctaaccttctcttccatgttaact

SEQ ID NO: 826422 - DNA, 25 bp, Mus musculus
tctaaccttgctacttggagggaag

SEQ ID NO: 826423 - DNA, 25 bp, Mus musculus
tctaaccttgcttcttggagggaag

SEQ ID NO: 826424 - DNA, 25 bp, Mus musculus
tctaacgcacagcagtttgattcgt

SEQ ID NO: 826425 - DNA, 25 bp, Mus musculus
tctaacgcacaggagtttgattcgt

SEQ ID NO: 826426 - DNA, 25 bp, Mus musculus
tctaacggcctcattgtgtaaaaca

SEQ ID NO: 826427 - DNA, 25 bp, Mus musculus
tctaacggcctctttgtgtaaaaca

SEQ ID NO: 826428 - DNA, 25 bp, Mus musculus
tctaacggtcctagagctgctggga

SEQ ID NO: 826429 - DNA, 25 bp, Mus musculus
tctaacggtccttgagctgctggga

SEQ ID NO: 826430 - DNA, 25 bp, Mus musculus
tctaacgtggtcaccttttgccttt

SEQ ID NO: 826431 - DNA, 25 bp, Mus musculus
tctaacgtggtctccttttgccttt

SEQ ID NO: 826432 - DNA, 25 bp, Mus musculus
tctaacgttctcctggtgctaatac

SEQ ID NO: 826433 - DNA, 25 bp, Mus musculus
tctaacgttctcgtggtgctaatac

SEQ ID NO: 826434 - DNA, 25 bp, Mus musculus
tctaactcacttcggaacattttcc

SEQ ID NO: 826435 - DNA, 25 bp, Mus musculus
tctaactcacttgggaacattttcc

SEQ ID NO: 826436 - DNA, 25 bp, Mus musculus
tctaactcagtacggtcagcagacc

SEQ ID NO: 826437 - DNA, 25 bp, Mus musculus
tctaactcagtagggtcagcagacc

SEQ ID NO: 826438 - DNA, 25 bp, Mus musculus
tctaactccgagacgactcaggttt

SEQ ID NO: 826439 - DNA, 25 bp, Mus musculus
tctaactccgagtcgactcaggttt

SEQ ID NO: 826440 - DNA, 25 bp, Mus musculus
tctaactccgtcacattttttattt

SEQ ID NO: 826441 - DNA, 25 bp, Mus musculus
tctaactccgtctcattttttattt

SEQ ID NO: 826442 - DNA, 25 bp, Mus musculus
tctaactccttgaaccagatcagta

SEQ ID NO: 826443 - DNA, 25 bp, Mus musculus
tctaactccttgtaccagatcagta

SEQ ID NO: 826444 - DNA, 25 bp, Mus musculus
tctaactcttatcagctgaaaccag

SEQ ID NO: 826445 - DNA, 25 bp, Mus musculus
tctaactcttatgagctgaaaccag

SEQ ID NO: 826446 - DNA, 25 bp, Mus musculus
tctaactcttcccttgaccaagagc

SEQ ID NO: 826447 - DNA, 25 bp, Mus musculus
tctaactcttccgttgaccaagagc

SEQ ID NO: 826448 - DNA, 25 bp, Mus musculus
tctaactgccatactgctagtcatg

SEQ ID NO: 826449 - DNA, 25 bp, Mus musculus
tctaactgccattctgctagtcatg

SEQ ID NO: 826450 - DNA, 25 bp, Mus musculus
tctaactgctggaagtgccttctat

SEQ ID NO: 826451 - DNA, 25 bp, Mus musculus
tctaactgctggtagtgccttctat

SEQ ID NO: 826452 - DNA, 25 bp, Mus musculus
tctaactggttcattctttcacccg

SEQ ID NO: 826453 - DNA, 25 bp, Mus musculus
tctaactggttctttctttcacccg

SEQ ID NO: 826454 - DNA, 25 bp, Mus musculus
tctaactgtagacattgccgacgca

SEQ ID NO: 826455 - DNA, 25 bp, Mus musculus
tctaactgtagagattgccgacgca

SEQ ID NO: 826456 - DNA, 25 bp, Mus musculus
tctaacttcagccaggaccggacgc

SEQ ID NO: 826457 - DNA, 25 bp, Mus musculus
tctaacttcagcgaggaccggacgc

SEQ ID NO: 826458 - DNA, 25 bp, Mus musculus
tctaacttctacagcgccgtgggtc

SEQ ID NO: 826459 - DNA, 25 bp, Mus musculus
tctaacttctactgcgccgtgggtc

SEQ ID NO: 826460 - DNA, 25 bp, Mus musculus
tctaacttcttaccttgtcttttcc

SEQ ID NO: 826461 - DNA, 25 bp, Mus musculus
tctaacttcttagcttgtcttttcc

SEQ ID NO: 826462 - DNA, 25 bp, Mus musculus
tctaacttcttccatatttcacctt

SEQ ID NO: 826463 - DNA, 25 bp, Mus musculus
tctaacttcttcgatatttcacctt

SEQ ID NO: 826464 - DNA, 25 bp, Mus musculus
tctaagaaacttcaactaaaaactg

SEQ ID NO: 826465 - DNA, 25 bp, Mus musculus
tctaagaaacttgaactaaaaactg

SEQ ID NO: 826466 - DNA, 25 bp, Mus musculus
tctaagaagttaatcatggcggact

SEQ ID NO: 826467 - DNA, 25 bp, Mus musculus
tctaagaagttattcatggcggact

SEQ ID NO: 826468 - DNA, 25 bp, Mus musculus
tctaagaattaacggccagctggtc

SEQ ID NO: 826469 - DNA, 25 bp, Mus musculus
tctaagaattaagggccagctggtc

SEQ ID NO: 826470 - DNA, 25 bp, Mus musculus
tctaagaccctcatgtcctcctgag

SEQ ID NO: 826471 - DNA, 25 bp, Mus musculus
tctaagaccctcttgtcctcctgag

SEQ ID NO: 826472 - DNA, 25 bp, Mus musculus
tctaagacgtagactcagccacaga

SEQ ID NO: 826473 - DNA, 25 bp, Mus musculus
tctaagacgtagtctcagccacaga

SEQ ID NO: 826474 - DNA, 25 bp, Mus musculus
tctaagactgtacatgaacctcgag

SEQ ID NO: 826475 - DNA, 25 bp, Mus musculus
tctaagactgtagatgaacctcgag

SEQ ID NO: 826476 - DNA, 25 bp, Mus musculus
tctaagactgtgcagacctccgcag

SEQ ID NO: 826477 - DNA, 25 bp, Mus musculus
tctaagactgtggagacctccgcag

SEQ ID NO: 826478 - DNA, 25 bp, Mus musculus
tctaagagatctatgtaccggttct

SEQ ID NO: 826479 - DNA, 25 bp, Mus musculus
tctaagagatctttgtaccggttct

SEQ ID NO: 826480 - DNA, 25 bp, Mus musculus
tctaagaggcgcagagttgttgatt

SEQ ID NO: 826481 - DNA, 25 bp, Mus musculus
tctaagaggcgctgagttgttgatt

SEQ ID NO: 826482 - DNA, 25 bp, Mus musculus
tctaagatccttcttttctctgccc

SEQ ID NO: 826483 - DNA, 25 bp, Mus musculus
tctaagatccttgttttctctgccc

SEQ ID NO: 826484 - DNA, 25 bp, Mus musculus
tctaagatcttcatttcggccttgg

SEQ ID NO: 826485 - DNA, 25 bp, Mus musculus
tctaagatcttcttttcggccttgg

SEQ ID NO: 826486 - DNA, 25 bp, Mus musculus
tctaagatggttccctgagtgtcct

SEQ ID NO: 826487 - DNA, 25 bp, Mus musculus
tctaagatggttgcctgagtgtcct

SEQ ID NO: 826488 - DNA, 25 bp, Mus musculus
tctaagcaacataaagcaagcccca

SEQ ID NO: 826489 - DNA, 25 bp, Mus musculus
tctaagcaacattaagcaagcccca

SEQ ID NO: 826490 - DNA, 25 bp, Mus musculus
tctaagcacacaacaattggtttct

SEQ ID NO: 826491 - DNA, 25 bp, Mus musculus
tctaagcacacatcaattggtttct

SEQ ID NO: 826492 - DNA, 25 bp, Mus musculus
tctaagcaccatagggtaagttcag

SEQ ID NO: 826493 - DNA, 25 bp, Mus musculus
tctaagcaccattgggtaagttcag

SEQ ID NO: 826494 - DNA, 25 bp, Mus musculus
tctaagcaccccacttatttccaga

SEQ ID NO: 826495 - DNA, 25 bp, Mus musculus
tctaagcacccctcttatttccaga

SEQ ID NO: 826496 - DNA, 25 bp, Mus musculus
tctaagcactgactggttgcctgga

SEQ ID NO: 826497 - DNA, 25 bp, Mus musculus
tctaagcactgagtggttgcctgga

SEQ ID NO: 826498 - DNA, 25 bp, Mus musculus
tctaagcaggacacttccttttcat

SEQ ID NO: 826499 - DNA, 25 bp, Mus musculus
tctaagcaggactcttccttttcat

SEQ ID NO: 826500 - DNA, 25 bp, Mus musculus
tctaagcagtgtatgccagtggcct

SEQ ID NO: 826501 - DNA, 25 bp, Mus musculus
tctaagcagtgtttgccagtggcct

SEQ ID NO: 826502 - DNA, 25 bp, Mus musculus
tctaagcatacaactctatccagtc

SEQ ID NO: 826503 - DNA, 25 bp, Mus musculus
tctaagcatacatctctatccagtc

SEQ ID NO: 826504 - DNA, 25 bp, Mus musculus
tctaagccacagaaatttctcacaa

SEQ ID NO: 826505 - DNA, 25 bp, Mus musculus
tctaagccacagtaatttctcacaa

SEQ ID NO: 826506 - DNA, 25 bp, Mus musculus
tctaagccaggtagccatgaagtgt

SEQ ID NO: 826507 - DNA, 25 bp, Mus musculus
tctaagccaggttgccatgaagtgt

SEQ ID NO: 826508 - DNA, 25 bp, Mus musculus
tctaagccccttcactttctagtta

SEQ ID NO: 826509 - DNA, 25 bp, Mus musculus
tctaagccccttgactttctagtta

SEQ ID NO: 826510 - DNA, 25 bp, Mus musculus
tctaagcgtttgcaagtctgcacaa

SEQ ID NO: 826511 - DNA, 25 bp, Mus musculus
tctaagcgtttggaagtctgcacaa

SEQ ID NO: 826512 - DNA, 25 bp, Mus musculus
tctaagctgcaacggaagccggacc

SEQ ID NO: 826513 - DNA, 25 bp, Mus musculus
tctaagctgcaagggaagccggacc

SEQ ID NO: 826514 - DNA, 25 bp, Mus musculus
tctaagcttacgcagatacctcatt

SEQ ID NO: 826515 - DNA, 25 bp, Mus musculus
tctaagcttacggagatacctcatt

SEQ ID NO: 826516 - DNA, 25 bp, Mus musculus
tctaagcttactactggcctggatg

SEQ ID NO: 826517 - DNA, 25 bp, Mus musculus
tctaagcttacttctggcctggatg

SEQ ID NO: 826518 - DNA, 25 bp, Mus musculus
tctaaggagaagacgcccctagagc

SEQ ID NO: 826519 - DNA, 25 bp, Mus musculus
tctaaggagaagtcgcccctagagc

SEQ ID NO: 826520 - DNA, 25 bp, Mus musculus
tctaaggagctgcactctcacctgt

SEQ ID NO: 826521 - DNA, 25 bp, Mus musculus
tctaaggagctggactctcacctgt

SEQ ID NO: 826522 - DNA, 25 bp, Mus musculus
tctaaggaggctcctgtcccaaagc

SEQ ID NO: 826523 - DNA, 25 bp, Mus musculus
tctaaggaggctgctgtcccaaagc

SEQ ID NO: 826524 - DNA, 25 bp, Mus musculus
tctaaggatgtcagccttcgtttca

SEQ ID NO: 826525 - DNA, 25 bp, Mus musculus
tctaaggatgtctgccttcgtttca

SEQ ID NO: 826526 - DNA, 25 bp, Mus musculus
tctaagggaactcaagtttttgtat

SEQ ID NO: 826527 - DNA, 25 bp, Mus musculus
tctaagggaactgaagtttttgtat

SEQ ID NO: 826528 - DNA, 25 bp, Mus musculus
tctaagggtcccacttttactgttg

SEQ ID NO: 826529 - DNA, 25 bp, Mus musculus
tctaagggtccctcttttactgttg

SEQ ID NO: 826530 - DNA, 25 bp, Mus musculus
tctaaggtaccacagccatgccagt

SEQ ID NO: 826531 - DNA, 25 bp, Mus musculus
tctaaggtaccagagccatgccagt

SEQ ID NO: 826532 - DNA, 25 bp, Mus musculus
tctaaggtccatcctttgcctgcaa

SEQ ID NO: 826533 - DNA, 25 bp, Mus musculus
tctaaggtccatgctttgcctgcaa

SEQ ID NO: 826534 - DNA, 25 bp, Mus musculus
tctaaggtcttgcaggcttccccac

SEQ ID NO: 826535 - DNA, 25 bp, Mus musculus
tctaaggtcttggaggcttccccac

SEQ ID NO: 826536 - DNA, 25 bp, Mus musculus
tctaagtccaatagcctctaacttc

SEQ ID NO: 826537 - DNA, 25 bp, Mus musculus
tctaagtccaattgcctctaacttc

SEQ ID NO: 826538 - DNA, 25 bp, Mus musculus
tctaagtccgtacgtaatgagtggt

SEQ ID NO: 826539 - DNA, 25 bp, Mus musculus
tctaagtccgtaggtaatgagtggt

SEQ ID NO: 826540 - DNA, 25 bp, Mus musculus
tctaagtcgaggacccaagttttct

SEQ ID NO: 826541 - DNA, 25 bp, Mus musculus
tctaagtcgaggtcccaagttttct

SEQ ID NO: 826542 - DNA, 25 bp, Mus musculus
tctaagtctccccttgtggattgtt

SEQ ID NO: 826543 - DNA, 25 bp, Mus musculus
tctaagtctcccgttgtggattgtt

SEQ ID NO: 826544 - DNA, 25 bp, Mus musculus
tctaagtctggaacaggcctggccc

SEQ ID NO: 826545 - DNA, 25 bp, Mus musculus
tctaagtctggatcaggcctggccc

SEQ ID NO: 826546 - DNA, 25 bp, Mus musculus
tctaagtgggacaaactgctgcttc

SEQ ID NO: 826547 - DNA, 25 bp, Mus musculus
tctaagtgggactaactgctgcttc

SEQ ID NO: 826548 - DNA, 25 bp, Mus musculus
tctaagtggtccattcctaaggagg

SEQ ID NO: 826549 - DNA, 25 bp, Mus musculus
tctaagtggtcctttcctaaggagg

SEQ ID NO: 826550 - DNA, 25 bp, Mus musculus
tctaagtgtactccattttataatc

SEQ ID NO: 826551 - DNA, 25 bp, Mus musculus
tctaagtgtactgcattttataatc

SEQ ID NO: 826552 - DNA, 25 bp, Mus musculus
tctaagtgtttacaccttgttggta

SEQ ID NO: 826553 - DNA, 25 bp, Mus musculus
tctaagtgtttagaccttgttggta

SEQ ID NO: 826554 - DNA, 25 bp, Mus musculus
tctaagttcaggctgcacagctgct

SEQ ID NO: 826555 - DNA, 25 bp, Mus musculus
tctaagttcagggtgcacagctgct

SEQ ID NO: 826556 - DNA, 25 bp, Mus musculus
tctaagttccaaaaacccagcacct

SEQ ID NO: 826557 - DNA, 25 bp, Mus musculus
tctaagttccaataacccagcacct

SEQ ID NO: 826558 - DNA, 25 bp, Mus musculus
tctaagttcctgactgttttactgg

SEQ ID NO: 826559 - DNA, 25 bp, Mus musculus
tctaagttcctgtctgttttactgg

SEQ ID NO: 826560 - DNA, 25 bp, Mus musculus
tctaagttctacaactgggttataa

SEQ ID NO: 826561 - DNA, 25 bp, Mus musculus
tctaagttctactactgggttataa

SEQ ID NO: 826562 - DNA, 25 bp, Mus musculus
tctaataactaaacacctccactac

SEQ ID NO: 826563 - DNA, 25 bp, Mus musculus
tctaataactaatcacctccactac

SEQ ID NO: 826564 - DNA, 25 bp, Mus musculus
tctaataactgcattctaacgaggt

SEQ ID NO: 826565 - DNA, 25 bp, Mus musculus
tctaataactgctttctaacgaggt

SEQ ID NO: 826566 - DNA, 25 bp, Mus musculus
tctaataagtgccactccccgagag

SEQ ID NO: 826567 - DNA, 25 bp, Mus musculus
tctaataagtgcgactccccgagag

SEQ ID NO: 826568 - DNA, 25 bp, Mus musculus
tctaatacacttactgtctgtgcgt

SEQ ID NO: 826569 - DNA, 25 bp, Mus musculus
tctaatacactttctgtctgtgcgt

SEQ ID NO: 826570 - DNA, 25 bp, Mus musculus
tctaatatgaacaaagccagtcaca

SEQ ID NO: 826571 - DNA, 25 bp, Mus musculus
tctaatatgaactaagccagtcaca

SEQ ID NO: 826572 - DNA, 25 bp, Mus musculus
tctaatatgctcacctgggtgggct

SEQ ID NO: 826573 - DNA, 25 bp, Mus musculus
tctaatatgctctcctgggtgggct

SEQ ID NO: 826574 - DNA, 25 bp, Mus musculus
tctaatattcttccttgtctttctg

SEQ ID NO: 826575 - DNA, 25 bp, Mus musculus
tctaatattcttgcttgtctttctg

SEQ ID NO: 826576 - DNA, 25 bp, Mus musculus
tctaatattgtaacccgtggcacta

SEQ ID NO: 826577 - DNA, 25 bp, Mus musculus
tctaatattgtatcccgtggcacta

SEQ ID NO: 826578 - DNA, 25 bp, Mus musculus
tctaatcaacctctgggagtccagc

SEQ ID NO: 826579 - DNA, 25 bp, Mus musculus
tctaatcaacctgtgggagtccagc

SEQ ID NO: 826580 - DNA, 25 bp, Mus musculus
tctaatccaaccacactacagtgta

SEQ ID NO: 826581 - DNA, 25 bp, Mus musculus
tctaatccaacctcactacagtgta

SEQ ID NO: 826582 - DNA, 25 bp, Mus musculus
tctaatccacaaactcaaccaaaac

SEQ ID NO: 826583 - DNA, 25 bp, Mus musculus
tctaatccacaatctcaaccaaaac

SEQ ID NO: 826584 - DNA, 25 bp, Mus musculus
tctaatcccatgcttctgtagtatt

SEQ ID NO: 826585 - DNA, 25 bp, Mus musculus
tctaatcccatggttctgtagtatt

SEQ ID NO: 826586 - DNA, 25 bp, Mus musculus
tctaatcctcgcactaaggaggcaa

SEQ ID NO: 826587 - DNA, 25 bp, Mus musculus
tctaatcctcgctctaaggaggcaa

SEQ ID NO: 826588 - DNA, 25 bp, Mus musculus
tctaatcctggacttgtacttcgaa

SEQ ID NO: 826589 - DNA, 25 bp, Mus musculus
tctaatcctggagttgtacttcgaa

SEQ ID NO: 826590 - DNA, 25 bp, Mus musculus
tctaatccttgtatcttggcagtgt

SEQ ID NO: 826591 - DNA, 25 bp, Mus musculus
tctaatccttgtttcttggcagtgt

SEQ ID NO: 826592 - DNA, 25 bp, Mus musculus
tctaatcgccgaagagtgtttttgg

SEQ ID NO: 826593 - DNA, 25 bp, Mus musculus
tctaatcgccgaccgctattaaaaa

SEQ ID NO: 826594 - DNA, 25 bp, Mus musculus
tctaatcgccgagcgctattaaaaa

SEQ ID NO: 826595 - DNA, 25 bp, Mus musculus
tctaatcgccgatgagtgtttttgg

SEQ ID NO: 826596 - DNA, 25 bp, Mus musculus
tctaatcgcgctaccaatcttgctg

SEQ ID NO: 826597 - DNA, 25 bp, Mus musculus
tctaatcgcgcttccaatcttgctg

SEQ ID NO: 826598 - DNA, 25 bp, Mus musculus
tctaatctacataggctctctctgt

SEQ ID NO: 826599 - DNA, 25 bp, Mus musculus
tctaatctacattggctctctctgt

SEQ ID NO: 826600 - DNA, 25 bp, Mus musculus
tctaatctctctccaggtattccta

SEQ ID NO: 826601 - DNA, 25 bp, Mus musculus
tctaatctctctgcaggtattccta

SEQ ID NO: 826602 - DNA, 25 bp, Mus musculus
tctaatctggaaacagtaggttcag

SEQ ID NO: 826603 - DNA, 25 bp, Mus musculus
tctaatctggaatcagtaggttcag

SEQ ID NO: 826604 - DNA, 25 bp, Mus musculus
tctaatctggttctgcttcatttcc

SEQ ID NO: 826605 - DNA, 25 bp, Mus musculus
tctaatctggttgtgcttcatttcc

SEQ ID NO: 826606 - DNA, 25 bp, Mus musculus
tctaatcttttcctgcatatatgtg

SEQ ID NO: 826607 - DNA, 25 bp, Mus musculus
tctaatcttttcgtgcatatatgtg

SEQ ID NO: 826608 - DNA, 25 bp, Mus musculus
tctaatgaagttatgagtccggtaa

SEQ ID NO: 826609 - DNA, 25 bp, Mus musculus
tctaatgaagttttgagtccggtaa

SEQ ID NO: 826610 - DNA, 25 bp, Mus musculus
tctaatgacactacgcacggttgtt

SEQ ID NO: 826611 - DNA, 25 bp, Mus musculus
tctaatgacacttcgcacggttgtt

SEQ ID NO: 826612 - DNA, 25 bp, Mus musculus
tctaatgatgaccagcgtattactg

SEQ ID NO: 826613 - DNA, 25 bp, Mus musculus
tctaatgatgacgagcgtattactg

SEQ ID NO: 826614 - DNA, 25 bp, Mus musculus
tctaatgccccaagagtaatcttct

SEQ ID NO: 826615 - DNA, 25 bp, Mus musculus
tctaatgccccatgagtaatcttct

SEQ ID NO: 826616 - DNA, 25 bp, Mus musculus
tctaatgcccctaaatgagttgttt

SEQ ID NO: 826617 - DNA, 25 bp, Mus musculus
tctaatgccccttaatgagttgttt

SEQ ID NO: 826618 - DNA, 25 bp, Mus musculus
tctaatgcctgcagtttcagaaatg

SEQ ID NO: 826619 - DNA, 25 bp, Mus musculus
tctaatgcctgctgtttcagaaatg

SEQ ID NO: 826620 - DNA, 25 bp, Mus musculus
tctaatgctacaagaatgctgtgaa

SEQ ID NO: 826621 - DNA, 25 bp, Mus musculus
tctaatgctacatgaatgctgtgaa

SEQ ID NO: 826622 - DNA, 25 bp, Mus musculus
tctaatgctctcatttggcctctgg

SEQ ID NO: 826623 - DNA, 25 bp, Mus musculus
tctaatgctctcttttggcctctgg

SEQ ID NO: 826624 - DNA, 25 bp, Mus musculus
tctaatgctcttactgtaatcccta

SEQ ID NO: 826625 - DNA, 25 bp, Mus musculus
tctaatgctctttctgtaatcccta

SEQ ID NO: 826626 - DNA, 25 bp, Mus musculus
tctaatgctgatcgcctacctctgg

SEQ ID NO: 826627 - DNA, 25 bp, Mus musculus
tctaatgctgatggcctacctctgg

SEQ ID NO: 826628 - DNA, 25 bp, Mus musculus
tctaatgctggtcgcaattctaccc

SEQ ID NO: 826629 - DNA, 25 bp, Mus musculus
tctaatgctggtggcaattctaccc

SEQ ID NO: 826630 - DNA, 25 bp, Mus musculus
tctaatgcttttctgctttggaata

SEQ ID NO: 826631 - DNA, 25 bp, Mus musculus
tctaatgcttttgtgctttggaata

SEQ ID NO: 826632 - DNA, 25 bp, Mus musculus
tctaatggaggtagtctgtctgtct

SEQ ID NO: 826633 - DNA, 25 bp, Mus musculus
tctaatggaggttgtctgtctgtct

SEQ ID NO: 826634 - DNA, 25 bp, Mus musculus
tctaatggtgatcgcccacctttgg

SEQ ID NO: 826635 - DNA, 25 bp, Mus musculus
tctaatggtgatggcccacctttgg

SEQ ID NO: 826636 - DNA, 25 bp, Mus musculus
tctaatgtcttcacaatgttcgaac

SEQ ID NO: 826637 - DNA, 25 bp, Mus musculus
tctaatgtcttctcaatgttcgaac

SEQ ID NO: 826638 - DNA, 25 bp, Mus musculus
tctaatgtggtacagtcactggctt

SEQ ID NO: 826639 - DNA, 25 bp, Mus musculus
tctaatgtggtagagtcactggctt

SEQ ID NO: 826640 - DNA, 25 bp, Mus musculus
tctaatgtgtaacacttcctctgaa

SEQ ID NO: 826641 - DNA, 25 bp, Mus musculus
tctaatgtgtaagacttcctctgaa

SEQ ID NO: 826642 - DNA, 25 bp, Mus musculus
tctaatgttgacactgttgcaatag

SEQ ID NO: 826643 - DNA, 25 bp, Mus musculus
tctaatgttgactctgttgcaatag

SEQ ID NO: 826644 - DNA, 25 bp, Mus musculus
tctaatgttgttactgcagcctgac

SEQ ID NO: 826645 - DNA, 25 bp, Mus musculus
tctaatgttgtttctgcagcctgac

SEQ ID NO: 826646 - DNA, 25 bp, Mus musculus
tctaattacatcatttacccctctc

SEQ ID NO: 826647 - DNA, 25 bp, Mus musculus
tctaattacatcttttacccctctc

SEQ ID NO: 826648 - DNA, 25 bp, Mus musculus
tctaattagcaaccgtattccacct

SEQ ID NO: 826649 - DNA, 25 bp, Mus musculus
tctaattagcaagcgtattccacct

SEQ ID NO: 826650 - DNA, 25 bp, Mus musculus
tctaattatacacttgtgtgtcatc

SEQ ID NO: 826651 - DNA, 25 bp, Mus musculus
tctaattatacagttgtgtgtcatc

SEQ ID NO: 826652 - DNA, 25 bp, Mus musculus
tctaattataccccgattcagcatt

SEQ ID NO: 826653 - DNA, 25 bp, Mus musculus
tctaattataccgcgattcagcatt

SEQ ID NO: 826654 - DNA, 25 bp, Mus musculus
tctaattcattgattctatcagatt

SEQ ID NO: 826655 - DNA, 25 bp, Mus musculus
tctaattcattgtttctatcagatt

SEQ ID NO: 826656 - DNA, 25 bp, Mus musculus
tctaattcccttcatggagcatgat

SEQ ID NO: 826657 - DNA, 25 bp, Mus musculus
tctaattcccttgatggagcatgat

SEQ ID NO: 826658 - DNA, 25 bp, Mus musculus
tctaattccttacccttccaaatgc

SEQ ID NO: 826659 - DNA, 25 bp, Mus musculus
tctaattccttagccttccaaatgc

SEQ ID NO: 826660 - DNA, 25 bp, Mus musculus
tctaattctcagctggcggcgtcca

SEQ ID NO: 826661 - DNA, 25 bp, Mus musculus
tctaattctcaggtggcggcgtcca

SEQ ID NO: 826662 - DNA, 25 bp, Mus musculus
tctaattctggtacttgttccctgc

SEQ ID NO: 826663 - DNA, 25 bp, Mus musculus
tctaattctggttcttgttccctgc

SEQ ID NO: 826664 - DNA, 25 bp, Mus musculus
tctaattggtccattgttatctaac

SEQ ID NO: 826665 - DNA, 25 bp, Mus musculus
tctaattggtcctttgttatctaac

SEQ ID NO: 826666 - DNA, 25 bp, Mus musculus
tctaatttagttcgccttatgtcga

SEQ ID NO: 826667 - DNA, 25 bp, Mus musculus
tctaatttagttggccttatgtcga

SEQ ID NO: 826668 - DNA, 25 bp, Mus musculus
tctaatttcttaactgggctgctgg

SEQ ID NO: 826669 - DNA, 25 bp, Mus musculus
tctaatttcttatctgggctgctgg

SEQ ID NO: 826670 - DNA, 25 bp, Mus musculus
tctaatttggatcgacttggcaagt

SEQ ID NO: 826671 - DNA, 25 bp, Mus musculus
tctaatttggatggacttggcaagt

SEQ ID NO: 826672 - DNA, 25 bp, Mus musculus
tctaatttttatctgctctgcatac

SEQ ID NO: 826673 - DNA, 25 bp, Mus musculus
tctaatttttatgtgctctgcatac

SEQ ID NO: 826674 - DNA, 25 bp, Mus musculus
tctaatttttcacctatctacccat

SEQ ID NO: 826675 - DNA, 25 bp, Mus musculus
tctaatttttcagctatctacccat

SEQ ID NO: 826676 - DNA, 25 bp, Mus musculus
tctacaaaaccgacccgttcatctt

SEQ ID NO: 826677 - DNA, 25 bp, Mus musculus
tctacaaaaccgtcccgttcatctt

SEQ ID NO: 826678 - DNA, 25 bp, Mus musculus
tctacaaaagcaatgattccaaggg

SEQ ID NO: 826679 - DNA, 25 bp, Mus musculus
tctacaaaagcattgattccaaggg

SEQ ID NO: 826680 - DNA, 25 bp, Mus musculus
tctacaaagcgcctcaagtctgtgg

SEQ ID NO: 826681 - DNA, 25 bp, Mus musculus
tctacaaagcgcgtcaagtctgtgg

SEQ ID NO: 826682 - DNA, 25 bp, Mus musculus
tctacaaagtcaatcccaagtggtg

SEQ ID NO: 826683 - DNA, 25 bp, Mus musculus
tctacaaagtcattcccaagtggtg

SEQ ID NO: 826684 - DNA, 25 bp, Mus musculus
tctacaaatgaaaacgtgtcacttg

SEQ ID NO: 826685 - DNA, 25 bp, Mus musculus
tctacaaatgaatacgtgtcacttg

SEQ ID NO: 826686 - DNA, 25 bp, Mus musculus
tctacaaatgatccccagcctatta

SEQ ID NO: 826687 - DNA, 25 bp, Mus musculus
tctacaaatgatgcccagcctatta

SEQ ID NO: 826688 - DNA, 25 bp, Mus musculus
tctacaacatcgaggaagccttcga

SEQ ID NO: 826689 - DNA, 25 bp, Mus musculus
tctacaacatcgtggaagccttcga

SEQ ID NO: 826690 - DNA, 25 bp, Mus musculus
tctacaacctgcacttcacattatt

SEQ ID NO: 826691 - DNA, 25 bp, Mus musculus
tctacaacctgctcttcacattatt

SEQ ID NO: 826692 - DNA, 25 bp, Mus musculus
tctacaacctttccgactttatctc

SEQ ID NO: 826693 - DNA, 25 bp, Mus musculus
tctacaacctttgcgactttatctc

SEQ ID NO: 826694 - DNA, 25 bp, Mus musculus
tctacaactttcacagcccgagctt

SEQ ID NO: 826695 - DNA, 25 bp, Mus musculus
tctacaactttctcagcccgagctt

SEQ ID NO: 826696 - DNA, 25 bp, Mus musculus
tctacaactttgatggtgggaactg

SEQ ID NO: 826697 - DNA, 25 bp, Mus musculus
tctacaactttgttggtgggaactg

SEQ ID NO: 826698 - DNA, 25 bp, Mus musculus
tctacaagacccatgcagttccaaa

SEQ ID NO: 826699 - DNA, 25 bp, Mus musculus
tctacaagacccttgcagttccaaa

SEQ ID NO: 826700 - DNA, 25 bp, Mus musculus
tctacaagccttagagttgctccca

SEQ ID NO: 826701 - DNA, 25 bp, Mus musculus
tctacaagcctttgagttgctccca

SEQ ID NO: 826702 - DNA, 25 bp, Mus musculus
tctacaaggaaacctgaagtccagt

SEQ ID NO: 826703 - DNA, 25 bp, Mus musculus
tctacaaggaaagctgaagtccagt

SEQ ID NO: 826704 - DNA, 25 bp, Mus musculus
tctacaaggccaacaggctcattca

SEQ ID NO: 826705 - DNA, 25 bp, Mus musculus
tctacaaggccatcaggctcattca

SEQ ID NO: 826706 - DNA, 25 bp, Mus musculus
tctacaaggcgtactgtccgacaaa

SEQ ID NO: 826707 - DNA, 25 bp, Mus musculus
tctacaaggcgttctgtccgacaaa

SEQ ID NO: 826708 - DNA, 25 bp, Mus musculus
tctacaagtgcaacaagaaggctgt

SEQ ID NO: 826709 - DNA, 25 bp, Mus musculus
tctacaagtgcatcaagaaggctgt

SEQ ID NO: 826710 - DNA, 25 bp, Mus musculus
tctacaatcatgcttgaccttttta

SEQ ID NO: 826711 - DNA, 25 bp, Mus musculus
tctacaatcatggttgaccttttta

SEQ ID NO: 826712 - DNA, 25 bp, Mus musculus
tctacaatctgaccttccacatgca

SEQ ID NO: 826713 - DNA, 25 bp, Mus musculus
tctacaatctgagcttccacatgca

SEQ ID NO: 826714 - DNA, 25 bp, Mus musculus
tctacaatctgtagttgagttcccc

SEQ ID NO: 826715 - DNA, 25 bp, Mus musculus
tctacaatctgttgttgagttcccc

SEQ ID NO: 826716 - DNA, 25 bp, Mus musculus
tctacaatcttaaacagttgattcg

SEQ ID NO: 826717 - DNA, 25 bp, Mus musculus
tctacaatcttatacagttgattcg

SEQ ID NO: 826718 - DNA, 25 bp, Mus musculus
tctacaatgagtctgggctgcacag

SEQ ID NO: 826719 - DNA, 25 bp, Mus musculus
tctacaatgagtgtgggctgcacag

SEQ ID NO: 826720 - DNA, 25 bp, Mus musculus
tctacaatgcaacgagacacttctt

SEQ ID NO: 826721 - DNA, 25 bp, Mus musculus
tctacaatgcaaggagacacttctt

SEQ ID NO: 826722 - DNA, 25 bp, Mus musculus
tctacaatgggcctgtccatcagcc

SEQ ID NO: 826723 - DNA, 25 bp, Mus musculus
tctacaatgggcgtgtccatcagcc

SEQ ID NO: 826724 - DNA, 25 bp, Mus musculus
tctacacacatgatttggaccctta

SEQ ID NO: 826725 - DNA, 25 bp, Mus musculus
tctacacacatgttttggaccctta

SEQ ID NO: 826726 - DNA, 25 bp, Mus musculus
tctacacagacccttgctccaaaaa

SEQ ID NO: 826727 - DNA, 25 bp, Mus musculus
tctacacagaccgttgctccaaaaa

SEQ ID NO: 826728 - DNA, 25 bp, Mus musculus
tctacacagatccacagcttcagag

SEQ ID NO: 826729 - DNA, 25 bp, Mus musculus
tctacacagatcgacagcttcagag

SEQ ID NO: 826730 - DNA, 25 bp, Mus musculus
tctacaccaacgacagccattatta

SEQ ID NO: 826731 - DNA, 25 bp, Mus musculus
tctacaccaacgtcagccattatta

SEQ ID NO: 826732 - DNA, 25 bp, Mus musculus
tctacaccactgagagctccagaga

SEQ ID NO: 826733 - DNA, 25 bp, Mus musculus
tctacaccactgtgagctccagaga

SEQ ID NO: 826734 - DNA, 25 bp, Mus musculus
tctacaccatgaactgattaataca

SEQ ID NO: 826735 - DNA, 25 bp, Mus musculus
tctacaccatgatctgattaataca

SEQ ID NO: 826736 - DNA, 25 bp, Mus musculus
tctacacccgagcagtggagaatcc

SEQ ID NO: 826737 - DNA, 25 bp, Mus musculus
tctacacccgaggagtggagaatcc

SEQ ID NO: 826738 - DNA, 25 bp, Mus musculus
tctacaccgaggactttgggaggta

SEQ ID NO: 826739 - DNA, 25 bp, Mus musculus
tctacaccgaggtctttgggaggta

SEQ ID NO: 826740 - DNA, 25 bp, Mus musculus
tctacacctatacagcgcccacagc

SEQ ID NO: 826741 - DNA, 25 bp, Mus musculus
tctacacctatagagcgcccacagc

SEQ ID NO: 826742 - DNA, 25 bp, Mus musculus
tctacacctgcacacttttacttct

SEQ ID NO: 826743 - DNA, 25 bp, Mus musculus
tctacacctgcagacttttacttct

SEQ ID NO: 826744 - DNA, 25 bp, Mus musculus
tctacactagtgatacgatgccttt

SEQ ID NO: 826745 - DNA, 25 bp, Mus musculus
tctacactagtgttacgatgccttt

SEQ ID NO: 826746 - DNA, 25 bp, Mus musculus
tctacactgaggagacgctggctga

SEQ ID NO: 826747 - DNA, 25 bp, Mus musculus
tctacactgaggtgacgctggctga

SEQ ID NO: 826748 - DNA, 25 bp, Mus musculus
tctacactgggtagcaggaggctgt

SEQ ID NO: 826749 - DNA, 25 bp, Mus musculus
tctacactgggttgcaggaggctgt

SEQ ID NO: 826750 - DNA, 25 bp, Mus musculus
tctacactgtatatctgtcttgccc

SEQ ID NO: 826751 - DNA, 25 bp, Mus musculus
tctacactgtatttctgtcttgccc

SEQ ID NO: 826752 - DNA, 25 bp, Mus musculus
tctacactgtcacggtgccttgggt

SEQ ID NO: 826753 - DNA, 25 bp, Mus musculus
tctacactgtcagggtgccttgggt

SEQ ID NO: 826754 - DNA, 25 bp, Mus musculus
tctacagaatctcaaacccttttct

SEQ ID NO: 826755 - DNA, 25 bp, Mus musculus
tctacagaatctgaaacccttttct

SEQ ID NO: 826756 - DNA, 25 bp, Mus musculus
tctacagatcccacaaagttcttga

SEQ ID NO: 826757 - DNA, 25 bp, Mus musculus
tctacagatccctcaaagttcttga

SEQ ID NO: 826758 - DNA, 25 bp, Mus musculus
tctacagcaagcacaatgtgcagaa

SEQ ID NO: 826759 - DNA, 25 bp, Mus musculus
tctacagcaagctcaatgtgcagaa

SEQ ID NO: 826760 - DNA, 25 bp, Mus musculus
tctacagcacctcctgccatgatta

SEQ ID NO: 826761 - DNA, 25 bp, Mus musculus
tctacagcacctgctgccatgatta

SEQ ID NO: 826762 - DNA, 25 bp, Mus musculus
tctacagcagtcagcatcaggtggt

SEQ ID NO: 826763 - DNA, 25 bp, Mus musculus
tctacagcagtctgcatcaggtggt

SEQ ID NO: 826764 - DNA, 25 bp, Mus musculus
tctacagccctgcacaatggtcatg

SEQ ID NO: 826765 - DNA, 25 bp, Mus musculus
tctacagccctggacaatggtcatg

SEQ ID NO: 826766 - DNA, 25 bp, Mus musculus
tctacagctaaaactcccttcagtg

SEQ ID NO: 826767 - DNA, 25 bp, Mus musculus
tctacagctaaatctcccttcagtg

SEQ ID NO: 826768 - DNA, 25 bp, Mus musculus
tctacagctgatctgctggtggcca

SEQ ID NO: 826769 - DNA, 25 bp, Mus musculus
tctacagctgatgtgctggtggcca

SEQ ID NO: 826770 - DNA, 25 bp, Mus musculus
tctacaggaagtctcgtgatgctaa

SEQ ID NO: 826771 - DNA, 25 bp, Mus musculus
tctacaggaagtgtcgtgatgctaa

SEQ ID NO: 826772 - DNA, 25 bp, Mus musculus
tctacaggacctagctcttttcctt

SEQ ID NO: 826773 - DNA, 25 bp, Mus musculus
tctacaggaccttgctcttttcctt

SEQ ID NO: 826774 - DNA, 25 bp, Mus musculus
tctacaggcactagacattctgtca

SEQ ID NO: 826775 - DNA, 25 bp, Mus musculus
tctacaggcacttgacattctgtca

SEQ ID NO: 826776 - DNA, 25 bp, Mus musculus
tctacaggcctcatctggcatcaga

SEQ ID NO: 826777 - DNA, 25 bp, Mus musculus
tctacaggcctcttctggcatcaga

SEQ ID NO: 826778 - DNA, 25 bp, Mus musculus
tctacaggctgcacccaggataaca

SEQ ID NO: 826779 - DNA, 25 bp, Mus musculus
tctacaggctgctcccaggataaca

SEQ ID NO: 826780 - DNA, 25 bp, Mus musculus
tctacaggctttcactaaatttaca

SEQ ID NO: 826781 - DNA, 25 bp, Mus musculus
tctacaggctttgactaaatttaca

SEQ ID NO: 826782 - DNA, 25 bp, Mus musculus
tctacagggccaagcgactcgtcag

SEQ ID NO: 826783 - DNA, 25 bp, Mus musculus
tctacagggccatgcgactcgtcag

SEQ ID NO: 826784 - DNA, 25 bp, Mus musculus
tctacaggttcaccaggctgggcaa

SEQ ID NO: 826785 - DNA, 25 bp, Mus musculus
tctacaggttcagcaggctgggcaa

SEQ ID NO: 826786 - DNA, 25 bp, Mus musculus
tctacagtacctaacctgctactaa

SEQ ID NO: 826787 - DNA, 25 bp, Mus musculus
tctacagtaccttacctgctactaa

SEQ ID NO: 826788 - DNA, 25 bp, Mus musculus
tctacagtcatgctaccttcaggat

SEQ ID NO: 826789 - DNA, 25 bp, Mus musculus
tctacagtcatggtaccttcaggat

SEQ ID NO: 826790 - DNA, 25 bp, Mus musculus
tctacagtctgtaggccctatgcct

SEQ ID NO: 826791 - DNA, 25 bp, Mus musculus
tctacagtctgttggccctatgcct

SEQ ID NO: 826792 - DNA, 25 bp, Mus musculus
tctacagtctttcagcagggagcac

SEQ ID NO: 826793 - DNA, 25 bp, Mus musculus
tctacagtctttgagcagggagcac

SEQ ID NO: 826794 - DNA, 25 bp, Mus musculus
tctacagtggctctattccgctcgt

SEQ ID NO: 826795 - DNA, 25 bp, Mus musculus
tctacagtggctgtattccgctcgt

SEQ ID NO: 826796 - DNA, 25 bp, Mus musculus
tctacagttgtaactattttcctac

SEQ ID NO: 826797 - DNA, 25 bp, Mus musculus
tctacagttgtatctattttcctac

SEQ ID NO: 826798 - DNA, 25 bp, Mus musculus
tctacataatgacgccagctagggc

SEQ ID NO: 826799 - DNA, 25 bp, Mus musculus
tctacataatgaggccagctagggc

SEQ ID NO: 826800 - DNA, 25 bp, Mus musculus
tctacatactatatgccacgctgga

SEQ ID NO: 826801 - DNA, 25 bp, Mus musculus
tctacatactatttgccacgctgga

SEQ ID NO: 826802 - DNA, 25 bp, Mus musculus
tctacatagacacctgggctcgcca

SEQ ID NO: 826803 - DNA, 25 bp, Mus musculus
tctacatagacagctgggctcgcca

SEQ ID NO: 826804 - DNA, 25 bp, Mus musculus
tctacatcatgaaggccgacacagt

SEQ ID NO: 826805 - DNA, 25 bp, Mus musculus
tctacatcatgatggccgacacagt

SEQ ID NO: 826806 - DNA, 25 bp, Mus musculus
tctacatccaccagcggaaacgtga

SEQ ID NO: 826807 - DNA, 25 bp, Mus musculus
tctacatccacctgcggaaacgtga

SEQ ID NO: 826808 - DNA, 25 bp, Mus musculus
tctacatccttacgtgactggctaa

SEQ ID NO: 826809 - DNA, 25 bp, Mus musculus
tctacatccttaggtgactggctaa

SEQ ID NO: 826810 - DNA, 25 bp, Mus musculus
tctacatccttcaaatggcctgtgc

SEQ ID NO: 826811 - DNA, 25 bp, Mus musculus
tctacatccttctaatggcctgtgc

SEQ ID NO: 826812 - DNA, 25 bp, Mus musculus
tctacatcgaaccagtccagcgaga

SEQ ID NO: 826813 - DNA, 25 bp, Mus musculus
tctacatcgaacgagtccagcgaga

SEQ ID NO: 826814 - DNA, 25 bp, Mus musculus
tctacatctgtcacttcattggcag

SEQ ID NO: 826815 - DNA, 25 bp, Mus musculus
tctacatctgtctcttcattggcag

SEQ ID NO: 826816 - DNA, 25 bp, Mus musculus
tctacatgaaccacgaattttgact

SEQ ID NO: 826817 - DNA, 25 bp, Mus musculus
tctacatgaacctcgaattttgact

SEQ ID NO: 826818 - DNA, 25 bp, Mus musculus
tctacatgcagaattgaactgaatt

SEQ ID NO: 826819 - DNA, 25 bp, Mus musculus
tctacatgcagatttgaactgaatt

SEQ ID NO: 826820 - DNA, 25 bp, Mus musculus
tctacatgtgggatgggacccagac

SEQ ID NO: 826821 - DNA, 25 bp, Mus musculus
tctacatgtgggttgggacccagac

SEQ ID NO: 826822 - DNA, 25 bp, Mus musculus
tctacatgtgttagtccattttccc

SEQ ID NO: 826823 - DNA, 25 bp, Mus musculus
tctacatgtgtttgtccattttccc

SEQ ID NO: 826824 - DNA, 25 bp, Mus musculus
tctacattaacccaggttctgccac

SEQ ID NO: 826825 - DNA, 25 bp, Mus musculus
tctacattaaccgaggttctgccac

SEQ ID NO: 826826 - DNA, 25 bp, Mus musculus
tctacattctaaactggaccgcaag

SEQ ID NO: 826827 - DNA, 25 bp, Mus musculus
tctacattctaacaccagttttttg

SEQ ID NO: 826828 - DNA, 25 bp, Mus musculus
tctacattctaagaccagttttttg

SEQ ID NO: 826829 - DNA, 25 bp, Mus musculus
tctacattctaatctggaccgcaag

SEQ ID NO: 826830 - DNA, 25 bp, Mus musculus
tctacattctatacccagaactcac

SEQ ID NO: 826831 - DNA, 25 bp, Mus musculus
tctacattctattcccagaactcac

SEQ ID NO: 826832 - DNA, 25 bp, Mus musculus
tctacattgattcccatgctactgt

SEQ ID NO: 826833 - DNA, 25 bp, Mus musculus
tctacattgattgccatgctactgt

SEQ ID NO: 826834 - DNA, 25 bp, Mus musculus
tctacatttcctacatgaccgagct

SEQ ID NO: 826835 - DNA, 25 bp, Mus musculus
tctacatttccttcatgaccgagct

SEQ ID NO: 826836 - DNA, 25 bp, Mus musculus
tctacatttcttctaatggggaaca

SEQ ID NO: 826837 - DNA, 25 bp, Mus musculus
tctacatttcttgtaatggggaaca

SEQ ID NO: 826838 - DNA, 25 bp, Mus musculus
tctacatttgttcagcaggtgagat

SEQ ID NO: 826839 - DNA, 25 bp, Mus musculus
tctacatttgttgagcaggtgagat

SEQ ID NO: 826840 - DNA, 25 bp, Mus musculus
tctacattttgcactctacgagata

SEQ ID NO: 826841 - DNA, 25 bp, Mus musculus
tctacattttgctctctacgagata

SEQ ID NO: 826842 - DNA, 25 bp, Mus musculus
tctacattttggacagcacgtgaag

SEQ ID NO: 826843 - DNA, 25 bp, Mus musculus
tctacattttggtcagcacgtgaag

SEQ ID NO: 826844 - DNA, 25 bp, Mus musculus
tctaccaaacttctccagctgataa

SEQ ID NO: 826845 - DNA, 25 bp, Mus musculus
tctaccaaacttgtccagctgataa

SEQ ID NO: 826846 - DNA, 25 bp, Mus musculus
tctaccaaccgaattacatcaacag

SEQ ID NO: 826847 - DNA, 25 bp, Mus musculus
tctaccaaccgatttacatcaacag

SEQ ID NO: 826848 - DNA, 25 bp, Mus musculus
tctaccaagctgataacataatgtt

SEQ ID NO: 826849 - DNA, 25 bp, Mus musculus
tctaccaagctgcacatatctctgt

SEQ ID NO: 826850 - DNA, 25 bp, Mus musculus
tctaccaagctggacatatctctgt

SEQ ID NO: 826851 - DNA, 25 bp, Mus musculus
tctaccaagctgttaacataatgtt

SEQ ID NO: 826852 - DNA, 25 bp, Mus musculus
tctaccaatcagatgtcattcccag

SEQ ID NO: 826853 - DNA, 25 bp, Mus musculus
tctaccaatcagttgtcattcccag

SEQ ID NO: 826854 - DNA, 25 bp, Mus musculus
tctaccaatggaccttgcttcgttc

SEQ ID NO: 826855 - DNA, 25 bp, Mus musculus
tctaccaatggagcttgcttcgttc

SEQ ID NO: 826856 - DNA, 25 bp, Mus musculus
tctaccacaggaagttgggttttgt

SEQ ID NO: 826857 - DNA, 25 bp, Mus musculus
tctaccacaggatgttgggttttgt

SEQ ID NO: 826858 - DNA, 25 bp, Mus musculus
tctaccacctagctttgctttctca

SEQ ID NO: 826859 - DNA, 25 bp, Mus musculus
tctaccacctaggtttgctttctca

SEQ ID NO: 826860 - DNA, 25 bp, Mus musculus
tctaccactgagcaccttgctgtgt

SEQ ID NO: 826861 - DNA, 25 bp, Mus musculus
tctaccactgaggaccttgctgtgt

SEQ ID NO: 826862 - DNA, 25 bp, Mus musculus
tctaccactgcaatgccactgagaa

SEQ ID NO: 826863 - DNA, 25 bp, Mus musculus
tctaccactgcattgccactgagaa

SEQ ID NO: 826864 - DNA, 25 bp, Mus musculus
tctaccactgtgaaccccaggtaag

SEQ ID NO: 826865 - DNA, 25 bp, Mus musculus
tctaccactgtgtaccccaggtaag

SEQ ID NO: 826866 - DNA, 25 bp, Mus musculus
tctaccagactgacttgggttttga

SEQ ID NO: 826867 - DNA, 25 bp, Mus musculus
tctaccagactgtcttgggttttga

SEQ ID NO: 826868 - DNA, 25 bp, Mus musculus
tctaccagataaagactccgtgtaa

SEQ ID NO: 826869 - DNA, 25 bp, Mus musculus
tctaccagataatgactccgtgtaa

SEQ ID NO: 826870 - DNA, 25 bp, Mus musculus
tctaccagcactatctttggccttt

SEQ ID NO: 826871 - DNA, 25 bp, Mus musculus
tctaccagcactttctttggccttt

SEQ ID NO: 826872 - DNA, 25 bp, Mus musculus
tctaccagcgagcttctgatgactg

SEQ ID NO: 826873 - DNA, 25 bp, Mus musculus
tctaccagcgaggttctgatgactg

SEQ ID NO: 826874 - DNA, 25 bp, Mus musculus
tctaccagggtacaggccgcgttga

SEQ ID NO: 826875 - DNA, 25 bp, Mus musculus
tctaccagggtagaggccgcgttga

SEQ ID NO: 826876 - DNA, 25 bp, Mus musculus
tctaccaggtgaacttttaacaaag

SEQ ID NO: 826877 - DNA, 25 bp, Mus musculus
tctaccaggtgatcttttaacaaag

SEQ ID NO: 826878 - DNA, 25 bp, Mus musculus
tctaccagtacaacatagccaagtt

SEQ ID NO: 826879 - DNA, 25 bp, Mus musculus
tctaccagtacatcatagccaagtt

SEQ ID NO: 826880 - DNA, 25 bp, Mus musculus
tctaccagtaggaatggctgacctt

SEQ ID NO: 826881 - DNA, 25 bp, Mus musculus
tctaccagtaggtatggctgacctt

SEQ ID NO: 826882 - DNA, 25 bp, Mus musculus
tctaccagttccaaatttctcctaa

SEQ ID NO: 826883 - DNA, 25 bp, Mus musculus
tctaccagttcctaatttctcctaa

SEQ ID NO: 826884 - DNA, 25 bp, Mus musculus
tctaccatcccccaaattagctttt

SEQ ID NO: 826885 - DNA, 25 bp, Mus musculus
tctaccatccccgaaattagctttt

SEQ ID NO: 826886 - DNA, 25 bp, Mus musculus
tctaccatgaacagcgggccaatgt

SEQ ID NO: 826887 - DNA, 25 bp, Mus musculus
tctaccatgaactgcgggccaatgt

SEQ ID NO: 826888 - DNA, 25 bp, Mus musculus
tctaccatgagcatgtcttgaccac

SEQ ID NO: 826889 - DNA, 25 bp, Mus musculus
tctaccatgagcttgtcttgaccac

SEQ ID NO: 826890 - DNA, 25 bp, Mus musculus
tctaccatgggtcggcgttatctgt

SEQ ID NO: 826891 - DNA, 25 bp, Mus musculus
tctaccatgggtgggcgttatctgt

SEQ ID NO: 826892 - DNA, 25 bp, Mus musculus
tctaccatgtctcgacgcggcaagc

SEQ ID NO: 826893 - DNA, 25 bp, Mus musculus
tctaccatgtctggacgcggcaagc

SEQ ID NO: 826894 - DNA, 25 bp, Mus musculus
tctaccatgttcattcaaacccagg

SEQ ID NO: 826895 - DNA, 25 bp, Mus musculus
tctaccatgttctttcaaacccagg

SEQ ID NO: 826896 - DNA, 25 bp, Mus musculus
tctaccatgttgatgccaggagcta

SEQ ID NO: 826897 - DNA, 25 bp, Mus musculus
tctaccatgttgttgccaggagcta

SEQ ID NO: 826898 - DNA, 25 bp, Mus musculus
tctaccattccaactttccacataa

SEQ ID NO: 826899 - DNA, 25 bp, Mus musculus
tctaccattccatctttccacataa

SEQ ID NO: 826900 - DNA, 25 bp, Mus musculus
tctaccatttggaacaagtaattct

SEQ ID NO: 826901 - DNA, 25 bp, Mus musculus
tctaccatttggtacaagtaattct

SEQ ID NO: 826902 - DNA, 25 bp, Mus musculus
tctacccaaagaactgagagtccag

SEQ ID NO: 826903 - DNA, 25 bp, Mus musculus
tctacccaaagatctgagagtccag

SEQ ID NO: 826904 - DNA, 25 bp, Mus musculus
tctacccaactcagacctgcgtgaa

SEQ ID NO: 826905 - DNA, 25 bp, Mus musculus
tctacccaactctgacctgcgtgaa

SEQ ID NO: 826906 - DNA, 25 bp, Mus musculus
tctacccaagcaagtttgtcctcat

SEQ ID NO: 826907 - DNA, 25 bp, Mus musculus
tctacccaagcatgtttgtcctcat

SEQ ID NO: 826908 - DNA, 25 bp, Mus musculus
tctacccacccgaataagcccagtg

SEQ ID NO: 826909 - DNA, 25 bp, Mus musculus
tctacccacccgtataagcccagtg

SEQ ID NO: 826910 - DNA, 25 bp, Mus musculus
tctacccacctaactcctttaagat

SEQ ID NO: 826911 - DNA, 25 bp, Mus musculus
tctacccacctatctcctttaagat

SEQ ID NO: 826912 - DNA, 25 bp, Mus musculus
tctacccactgtacaccatcgtgtt

SEQ ID NO: 826913 - DNA, 25 bp, Mus musculus
tctacccactgtatcacaactttta

SEQ ID NO: 826914 - DNA, 25 bp, Mus musculus
tctacccactgttcaccatcgtgtt

SEQ ID NO: 826915 - DNA, 25 bp, Mus musculus
tctacccactgtttcacaactttta

SEQ ID NO: 826916 - DNA, 25 bp, Mus musculus
tctacccagcccagtgctttggtga

SEQ ID NO: 826917 - DNA, 25 bp, Mus musculus
tctacccagccctgtgctttggtga

SEQ ID NO: 826918 - DNA, 25 bp, Mus musculus
tctacccagctgatttttacaacta

SEQ ID NO: 826919 - DNA, 25 bp, Mus musculus
tctacccagctgttttttacaacta

SEQ ID NO: 826920 - DNA, 25 bp, Mus musculus
tctacccagtcaaagagagcctctt

SEQ ID NO: 826921 - DNA, 25 bp, Mus musculus
tctacccagtcatagagagcctctt

SEQ ID NO: 826922 - DNA, 25 bp, Mus musculus
tctacccatctaagtatgagctgct

SEQ ID NO: 826923 - DNA, 25 bp, Mus musculus
tctacccatctatgtatgagctgct

SEQ ID NO: 826924 - DNA, 25 bp, Mus musculus
tctacccatggcagtcaggcaatct

SEQ ID NO: 826925 - DNA, 25 bp, Mus musculus
tctacccatggctgtcaggcaatct

SEQ ID NO: 826926 - DNA, 25 bp, Mus musculus
tctacccattgccatgaactgtggt

SEQ ID NO: 826927 - DNA, 25 bp, Mus musculus
tctacccattgcgatgaactgtggt

SEQ ID NO: 826928 - DNA, 25 bp, Mus musculus
tctaccccacagagatcagttcatg

SEQ ID NO: 826929 - DNA, 25 bp, Mus musculus
tctaccccacagtgatcagttcatg

SEQ ID NO: 826930 - DNA, 25 bp, Mus musculus
tctaccccaggccaggtttgagtgt

SEQ ID NO: 826931 - DNA, 25 bp, Mus musculus
tctaccccaggcgaggtttgagtgt

SEQ ID NO: 826932 - DNA, 25 bp, Mus musculus
tctacccctaaactcctatgttaat

SEQ ID NO: 826933 - DNA, 25 bp, Mus musculus
tctacccctaaagtcctatgttaat

SEQ ID NO: 826934 - DNA, 25 bp, Mus musculus
tctacccctcctcaataaaagcatt

SEQ ID NO: 826935 - DNA, 25 bp, Mus musculus
tctacccctcctgaataaaagcatt

SEQ ID NO: 826936 - DNA, 25 bp, Mus musculus
tctaccccttatatgttggcttctt

SEQ ID NO: 826937 - DNA, 25 bp, Mus musculus
tctaccccttatttgttggcttctt

SEQ ID NO: 826938 - DNA, 25 bp, Mus musculus
tctaccctacttacttaaatgatta

SEQ ID NO: 826939 - DNA, 25 bp, Mus musculus
tctaccctactttcttaaatgatta

SEQ ID NO: 826940 - DNA, 25 bp, Mus musculus
tctaccctaggaacatagcctgctt

SEQ ID NO: 826941 - DNA, 25 bp, Mus musculus
tctaccctaggatcatagcctgctt

SEQ ID NO: 826942 - DNA, 25 bp, Mus musculus
tctaccctattaatcctcacacaag

SEQ ID NO: 826943 - DNA, 25 bp, Mus musculus
tctaccctattattcctcacacaag

SEQ ID NO: 826944 - DNA, 25 bp, Mus musculus
tctaccctcatgagaatgtgagctt

SEQ ID NO: 826945 - DNA, 25 bp, Mus musculus
tctaccctcatgtgaatgtgagctt

SEQ ID NO: 826946 - DNA, 25 bp, Mus musculus
tctaccctctaccaatgacatttgt

SEQ ID NO: 826947 - DNA, 25 bp, Mus musculus
tctaccctctacgaatgacatttgt

SEQ ID NO: 826948 - DNA, 25 bp, Mus musculus
tctaccctctccagtaagaacaaga

SEQ ID NO: 826949 - DNA, 25 bp, Mus musculus
tctaccctctcctgtaagaacaaga

SEQ ID NO: 826950 - DNA, 25 bp, Mus musculus
tctaccctctgaatttaaaatgtta

SEQ ID NO: 826951 - DNA, 25 bp, Mus musculus
tctaccctctgattttaaaatgtta

SEQ ID NO: 826952 - DNA, 25 bp, Mus musculus
tctaccctcttccacatatgtatgt

SEQ ID NO: 826953 - DNA, 25 bp, Mus musculus
tctaccctcttcgacatatgtatgt

SEQ ID NO: 826954 - DNA, 25 bp, Mus musculus
tctaccctcttgcaacggtgtagga

SEQ ID NO: 826955 - DNA, 25 bp, Mus musculus
tctaccctcttggaacggtgtagga

SEQ ID NO: 826956 - DNA, 25 bp, Mus musculus
tctaccctctttctattgtctatgg

SEQ ID NO: 826957 - DNA, 25 bp, Mus musculus
tctaccctctttgtattgtctatgg

SEQ ID NO: 826958 - DNA, 25 bp, Mus musculus
tctaccctgacccatttgagcattt

SEQ ID NO: 826959 - DNA, 25 bp, Mus musculus
tctaccctgaccgatttgagcattt

SEQ ID NO: 826960 - DNA, 25 bp, Mus musculus
tctaccctgagcatgtaccctatag

SEQ ID NO: 826961 - DNA, 25 bp, Mus musculus
tctaccctgagcttgtaccctatag

SEQ ID NO: 826962 - DNA, 25 bp, Mus musculus
tctaccctgcgcatggtggcagtgt

SEQ ID NO: 826963 - DNA, 25 bp, Mus musculus
tctaccctgcgcttggtggcagtgt

SEQ ID NO: 826964 - DNA, 25 bp, Mus musculus
tctaccctggatccttgttttaaat

SEQ ID NO: 826965 - DNA, 25 bp, Mus musculus
tctaccctggatgcttgttttaaat

SEQ ID NO: 826966 - DNA, 25 bp, Mus musculus
tctaccctggttattactctgacaa

SEQ ID NO: 826967 - DNA, 25 bp, Mus musculus
tctaccctggtttttactctgacaa

SEQ ID NO: 826968 - DNA, 25 bp, Mus musculus
tctaccctgtgaatactctgggaaa

SEQ ID NO: 826969 - DNA, 25 bp, Mus musculus
tctaccctgtgattactctgggaaa

SEQ ID NO: 826970 - DNA, 25 bp, Mus musculus
tctaccctgtgcacttggtcaagca

SEQ ID NO: 826971 - DNA, 25 bp, Mus musculus
tctaccctgtgctcttggtcaagca

SEQ ID NO: 826972 - DNA, 25 bp, Mus musculus
tctacccttcctagatgtcatcata

SEQ ID NO: 826973 - DNA, 25 bp, Mus musculus
tctacccttccttgatgtcatcata

SEQ ID NO: 826974 - DNA, 25 bp, Mus musculus
tctacccttgtgctggaagtctcat

SEQ ID NO: 826975 - DNA, 25 bp, Mus musculus
tctacccttgtggtggaagtctcat

SEQ ID NO: 826976 - DNA, 25 bp, Mus musculus
tctaccgagaccaagctgcagtgat

SEQ ID NO: 826977 - DNA, 25 bp, Mus musculus
tctaccgagacctagctgcagtgat

SEQ ID NO: 826978 - DNA, 25 bp, Mus musculus
tctaccgagctgatgtggcttggct

SEQ ID NO: 826979 - DNA, 25 bp, Mus musculus
tctaccgagctgttgtggcttggct

SEQ ID NO: 826980 - DNA, 25 bp, Mus musculus
tctaccgaggatatactttgacttt

SEQ ID NO: 826981 - DNA, 25 bp, Mus musculus
tctaccgaggatttactttgacttt

SEQ ID NO: 826982 - DNA, 25 bp, Mus musculus
tctaccgagtctccttggcttgtgt

SEQ ID NO: 826983 - DNA, 25 bp, Mus musculus
tctaccgagtctgcttggcttgtgt

SEQ ID NO: 826984 - DNA, 25 bp, Mus musculus
tctaccgcaatgctagcgtttctca

SEQ ID NO: 826985 - DNA, 25 bp, Mus musculus
tctaccgcaatggtagcgtttctca

SEQ ID NO: 826986 - DNA, 25 bp, Mus musculus
tctaccgcaggcctgaattcagagt

SEQ ID NO: 826987 - DNA, 25 bp, Mus musculus
tctaccgcaggcgtgaattcagagt

SEQ ID NO: 826988 - DNA, 25 bp, Mus musculus
tctaccgctaacaaatcaggaattg

SEQ ID NO: 826989 - DNA, 25 bp, Mus musculus
tctaccgctaactaatcaggaattg

SEQ ID NO: 826990 - DNA, 25 bp, Mus musculus
tctaccgctgagctatacatccagt

SEQ ID NO: 826991 - DNA, 25 bp, Mus musculus
tctaccgctgaggtatacatccagt

SEQ ID NO: 826992 - DNA, 25 bp, Mus musculus
tctaccgtcgagagaccagtggagt

SEQ ID NO: 826993 - DNA, 25 bp, Mus musculus
tctaccgtcgagtgaccagtggagt

SEQ ID NO: 826994 - DNA, 25 bp, Mus musculus
tctacctaacaacattccaaagcag

SEQ ID NO: 826995 - DNA, 25 bp, Mus musculus
tctacctaacaagattccaaagcag

SEQ ID NO: 826996 - DNA, 25 bp, Mus musculus
tctacctaacaccagacttcagttt

SEQ ID NO: 826997 - DNA, 25 bp, Mus musculus
tctacctaacacgagacttcagttt

SEQ ID NO: 826998 - DNA, 25 bp, Mus musculus
tctacctaagctctccttgaccaag

SEQ ID NO: 826999 - DNA, 25 bp, Mus musculus
tctacctaagctgtccttgaccaag

SEQ ID NO: 827000 - DNA, 25 bp, Mus musculus
tctacctagagacggatggcacaga

SEQ ID NO: 827001 - DNA, 25 bp, Mus musculus
tctacctagagagggatggcacaga

SEQ ID NO: 827002 - DNA, 25 bp, Mus musculus
tctacctaggtaacatggcacaagt

SEQ ID NO: 827003 - DNA, 25 bp, Mus musculus
tctacctaggtatcatggcacaagt

SEQ ID NO: 827004 - DNA, 25 bp, Mus musculus
tctacctataccacgtgaccatcag

SEQ ID NO: 827005 - DNA, 25 bp, Mus musculus
tctacctatacctcgtgaccatcag

SEQ ID NO: 827006 - DNA, 25 bp, Mus musculus
tctacctatgccacactttaaataa

SEQ ID NO: 827007 - DNA, 25 bp, Mus musculus
tctacctatgcctcactttaaataa

SEQ ID NO: 827008 - DNA, 25 bp, Mus musculus
tctacctcacatccgtatcattgga

SEQ ID NO: 827009 - DNA, 25 bp, Mus musculus
tctacctcacatgcgtatcattgga

SEQ ID NO: 827010 - DNA, 25 bp, Mus musculus
tctacctccagcacgtcaccatgaa

SEQ ID NO: 827011 - DNA, 25 bp, Mus musculus
tctacctccagctcgtcaccatgaa

SEQ ID NO: 827012 - DNA, 25 bp, Mus musculus
tctacctccataaactccaggactg

SEQ ID NO: 827013 - DNA, 25 bp, Mus musculus
tctacctccatatactccaggactg

SEQ ID NO: 827014 - DNA, 25 bp, Mus musculus
tctacctcccgaatcctggaataat

SEQ ID NO: 827015 - DNA, 25 bp, Mus musculus
tctacctcccgattcctggaataat

SEQ ID NO: 827016 - DNA, 25 bp, Mus musculus
tctacctccgtaatgtacctactga

SEQ ID NO: 827017 - DNA, 25 bp, Mus musculus
tctacctccgtattgtacctactga

SEQ ID NO: 827018 - DNA, 25 bp, Mus musculus
tctacctcctagattctgcgattaa

SEQ ID NO: 827019 - DNA, 25 bp, Mus musculus
tctacctcctagtttctgcgattaa

SEQ ID NO: 827020 - DNA, 25 bp, Mus musculus
tctacctcctggcttttaggaatgg

SEQ ID NO: 827021 - DNA, 25 bp, Mus musculus
tctacctcctgggttttaggaatgg

SEQ ID NO: 827022 - DNA, 25 bp, Mus musculus
tctacctcgggtagaccagtttcct

SEQ ID NO: 827023 - DNA, 25 bp, Mus musculus
tctacctcgggttgaccagtttcct

SEQ ID NO: 827024 - DNA, 25 bp, Mus musculus
tctacctcgtgccagagtctgagta

SEQ ID NO: 827025 - DNA, 25 bp, Mus musculus
tctacctcgtgcgagagtctgagta

SEQ ID NO: 827026 - DNA, 25 bp, Mus musculus
tctacctctcccagcgaaggtttta

SEQ ID NO: 827027 - DNA, 25 bp, Mus musculus
tctacctctccctgcgaaggtttta

SEQ ID NO: 827028 - DNA, 25 bp, Mus musculus
tctacctctctgagcgtgactgcga

SEQ ID NO: 827029 - DNA, 25 bp, Mus musculus
tctacctctctgtgcgtgactgcga

SEQ ID NO: 827030 - DNA, 25 bp, Mus musculus
tctacctctgacctctggagatttg

SEQ ID NO: 827031 - DNA, 25 bp, Mus musculus
tctacctctgacgtctggagatttg

SEQ ID NO: 827032 - DNA, 25 bp, Mus musculus
tctacctctgggactatttggtgtt

SEQ ID NO: 827033 - DNA, 25 bp, Mus musculus
tctacctctgggtctatttggtgtt

SEQ ID NO: 827034 - DNA, 25 bp, Mus musculus
tctacctgaactatatccccagata

SEQ ID NO: 827035 - DNA, 25 bp, Mus musculus
tctacctgaactttatccccagata

SEQ ID NO: 827036 - DNA, 25 bp, Mus musculus
tctacctgcccaccggttgggagaa

SEQ ID NO: 827037 - DNA, 25 bp, Mus musculus
tctacctgcccagcggttgggagaa

SEQ ID NO: 827038 - DNA, 25 bp, Mus musculus
tctacctgctcccagagaggccagc

SEQ ID NO: 827039 - DNA, 25 bp, Mus musculus
tctacctgctccgagagaggccagc

SEQ ID NO: 827040 - DNA, 25 bp, Mus musculus
tctacctgctctagactatgaatgt

SEQ ID NO: 827041 - DNA, 25 bp, Mus musculus
tctacctgctcttgactatgaatgt

SEQ ID NO: 827042 - DNA, 25 bp, Mus musculus
tctacctgctgtactacagaaaggg

SEQ ID NO: 827043 - DNA, 25 bp, Mus musculus
tctacctgctgttctacagaaaggg

SEQ ID NO: 827044 - DNA, 25 bp, Mus musculus
tctacctgcttcagtgtctcaagtg

SEQ ID NO: 827045 - DNA, 25 bp, Mus musculus
tctacctgcttctgtgtctcaagtg

SEQ ID NO: 827046 - DNA, 25 bp, Mus musculus
tctacctggagtacctgcagaagtt

SEQ ID NO: 827047 - DNA, 25 bp, Mus musculus
tctacctggagttcctgcagaagtt

SEQ ID NO: 827048 - DNA, 25 bp, Mus musculus
tctacctggcgcacgatgtgtactt

SEQ ID NO: 827049 - DNA, 25 bp, Mus musculus
tctacctggcgctcgatgtgtactt

SEQ ID NO: 827050 - DNA, 25 bp, Mus musculus
tctacctgggttatgggcaagactt

SEQ ID NO: 827051 - DNA, 25 bp, Mus musculus
tctacctgggttttgggcaagactt

SEQ ID NO: 827052 - DNA, 25 bp, Mus musculus
tctacctgtgatatgcaagtattgt

SEQ ID NO: 827053 - DNA, 25 bp, Mus musculus
tctacctgtgatttgcaagtattgt

SEQ ID NO: 827054 - DNA, 25 bp, Mus musculus
tctacctgtgtgatctctgactacc

SEQ ID NO: 827055 - DNA, 25 bp, Mus musculus
tctacctgtgtgttctctgactacc

SEQ ID NO: 827056 - DNA, 25 bp, Mus musculus
tctacctgttcaaattcagtttctt

SEQ ID NO: 827057 - DNA, 25 bp, Mus musculus
tctacctgttcaattatttgtctct

SEQ ID NO: 827058 - DNA, 25 bp, Mus musculus
tctacctgttcatattcagtttctt

SEQ ID NO: 827059 - DNA, 25 bp, Mus musculus
tctacctgttcatttatttgtctct

SEQ ID NO: 827060 - DNA, 25 bp, Mus musculus
tctaccttaaaactagcctgtgtgg

SEQ ID NO: 827061 - DNA, 25 bp, Mus musculus
tctaccttaaaagtagcctgtgtgg

SEQ ID NO: 827062 - DNA, 25 bp, Mus musculus
tctaccttcctccttggcaattaaa

SEQ ID NO: 827063 - DNA, 25 bp, Mus musculus
tctaccttcctcgttggcaattaaa

SEQ ID NO: 827064 - DNA, 25 bp, Mus musculus
tctaccttgacaatccatgtagccg

SEQ ID NO: 827065 - DNA, 25 bp, Mus musculus
tctaccttgacattccatgtagccg

SEQ ID NO: 827066 - DNA, 25 bp, Mus musculus
tctaccttgcaaacagcactctgtc

SEQ ID NO: 827067 - DNA, 25 bp, Mus musculus
tctaccttgcaatcagcactctgtc

SEQ ID NO: 827068 - DNA, 25 bp, Mus musculus
tctaccttgcttattagatggagtc

SEQ ID NO: 827069 - DNA, 25 bp, Mus musculus
tctaccttgctttttagatggagtc

SEQ ID NO: 827070 - DNA, 25 bp, Mus musculus
tctaccttggaaatgctgtgttaat

SEQ ID NO: 827071 - DNA, 25 bp, Mus musculus
tctaccttggaattgctgtgttaat

SEQ ID NO: 827072 - DNA, 25 bp, Mus musculus
tctaccttgttcatgcgaagatcat

SEQ ID NO: 827073 - DNA, 25 bp, Mus musculus
tctaccttgttcttgcgaagatcat

SEQ ID NO: 827074 - DNA, 25 bp, Mus musculus
tctacctttaccagcggtggcttta

SEQ ID NO: 827075 - DNA, 25 bp, Mus musculus
tctacctttacctgcggtggcttta

SEQ ID NO: 827076 - DNA, 25 bp, Mus musculus
tctacctttcaaacaacatgagatt

SEQ ID NO: 827077 - DNA, 25 bp, Mus musculus
tctacctttcaatcaacatgagatt

SEQ ID NO: 827078 - DNA, 25 bp, Mus musculus
tctacctttccactcattgttggca

SEQ ID NO: 827079 - DNA, 25 bp, Mus musculus
tctacctttccagtcattgttggca

SEQ ID NO: 827080 - DNA, 25 bp, Mus musculus
tctacctttgtcagtattcttctcc

SEQ ID NO: 827081 - DNA, 25 bp, Mus musculus
tctacctttgtcattttctatattg

SEQ ID NO: 827082 - DNA, 25 bp, Mus musculus
tctacctttgtctgtattcttctcc

SEQ ID NO: 827083 - DNA, 25 bp, Mus musculus
tctacctttgtctttttctatattg

SEQ ID NO: 827084 - DNA, 25 bp, Mus musculus
tctacctttgtgaccccgtctcaaa

SEQ ID NO: 827085 - DNA, 25 bp, Mus musculus
tctacctttgtgtccccgtctcaaa

SEQ ID NO: 827086 - DNA, 25 bp, Mus musculus
tctacgaagcatagtgtgcatgttt

SEQ ID NO: 827087 - DNA, 25 bp, Mus musculus
tctacgaagcattgtgtgcatgttt

SEQ ID NO: 827088 - DNA, 25 bp, Mus musculus
tctacgacccgtacccagaggaagt

SEQ ID NO: 827089 - DNA, 25 bp, Mus musculus
tctacgacccgttcccagaggaagt

SEQ ID NO: 827090 - DNA, 25 bp, Mus musculus
tctacgacctccctaggtgaggatt

SEQ ID NO: 827091 - DNA, 25 bp, Mus musculus
tctacgacctccgtaggtgaggatt

SEQ ID NO: 827092 - DNA, 25 bp, Mus musculus
tctacgactacgaggcagctgacag

SEQ ID NO: 827093 - DNA, 25 bp, Mus musculus
tctacgactacgtggcagctgacag

SEQ ID NO: 827094 - DNA, 25 bp, Mus musculus
tctacgagtgcaactcccgctgttg

SEQ ID NO: 827095 - DNA, 25 bp, Mus musculus
tctacgagtgcatctcccgctgttg

SEQ ID NO: 827096 - DNA, 25 bp, Mus musculus
tctacgattggaagcctgtgagata

SEQ ID NO: 827097 - DNA, 25 bp, Mus musculus
tctacgattggatgcctgtgagata

SEQ ID NO: 827098 - DNA, 25 bp, Mus musculus
tctacgccaccgaggaagctgagat

SEQ ID NO: 827099 - DNA, 25 bp, Mus musculus
tctacgccaccgtggaagctgagat

SEQ ID NO: 827100 - DNA, 25 bp, Mus musculus
tctacgcctgtcatctcctgagttt

SEQ ID NO: 827101 - DNA, 25 bp, Mus musculus
tctacgcctgtcttctcctgagttt

SEQ ID NO: 827102 - DNA, 25 bp, Mus musculus
tctacgcctgttatgtttacggata

SEQ ID NO: 827103 - DNA, 25 bp, Mus musculus
tctacgcctgttttgtttacggata

SEQ ID NO: 827104 - DNA, 25 bp, Mus musculus
tctacgctaaagagaatcgcaccaa

SEQ ID NO: 827105 - DNA, 25 bp, Mus musculus
tctacgctaaagtgaatcgcaccaa

SEQ ID NO: 827106 - DNA, 25 bp, Mus musculus
tctacgctgggtcttcgggtttaag

SEQ ID NO: 827107 - DNA, 25 bp, Mus musculus
tctacgctgggtgttcgggtttaag

SEQ ID NO: 827108 - DNA, 25 bp, Mus musculus
tctacgcttgtaaccgcattaagta

SEQ ID NO: 827109 - DNA, 25 bp, Mus musculus
tctacgcttgtatccgcattaagta

SEQ ID NO: 827110 - DNA, 25 bp, Mus musculus
tctacggagctgaggtgcaagccat

SEQ ID NO: 827111 - DNA, 25 bp, Mus musculus
tctacggagctgtggtgcaagccat

SEQ ID NO: 827112 - DNA, 25 bp, Mus musculus
tctacggatactagatgcaaactca

SEQ ID NO: 827113 - DNA, 25 bp, Mus musculus
tctacggatacttgatgcaaactca

SEQ ID NO: 827114 - DNA, 25 bp, Mus musculus
tctacggcagctctatcttcatgta

SEQ ID NO: 827115 - DNA, 25 bp, Mus musculus
tctacggcagctgtatcttcatgta

SEQ ID NO: 827116 - DNA, 25 bp, Mus musculus
tctacgggagaacgttaaagtcaat

SEQ ID NO: 827117 - DNA, 25 bp, Mus musculus
tctacgggagaaggttaaagtcaat

SEQ ID NO: 827118 - DNA, 25 bp, Mus musculus
tctacgtcagagcttgtcagcgcac

SEQ ID NO: 827119 - DNA, 25 bp, Mus musculus
tctacgtcagaggttgtcagcgcac

SEQ ID NO: 827120 - DNA, 25 bp, Mus musculus
tctacgtcggaaatcacttgccaag

SEQ ID NO: 827121 - DNA, 25 bp, Mus musculus
tctacgtcggaattcacttgccaag

SEQ ID NO: 827122 - DNA, 25 bp, Mus musculus
tctacgtgtacaacacagacacaga

SEQ ID NO: 827123 - DNA, 25 bp, Mus musculus
tctacgtgtacatcacagacacaga

SEQ ID NO: 827124 - DNA, 25 bp, Mus musculus
tctacgtgtaggaaggccctgtcta

SEQ ID NO: 827125 - DNA, 25 bp, Mus musculus
tctacgtgtaggtaggccctgtcta

SEQ ID NO: 827126 - DNA, 25 bp, Mus musculus
tctacgttgaagagcgagcgcataa

SEQ ID NO: 827127 - DNA, 25 bp, Mus musculus
tctacgttgaagtgcgagcgcataa

SEQ ID NO: 827128 - DNA, 25 bp, Mus musculus
tctacgttggtaccaaggccttgat

SEQ ID NO: 827129 - DNA, 25 bp, Mus musculus
tctacgttggtagcaaggccttgat

SEQ ID NO: 827130 - DNA, 25 bp, Mus musculus
tctacgtttggacctttcttttgca

SEQ ID NO: 827131 - DNA, 25 bp, Mus musculus
tctacgtttggagctttcttttgca

SEQ ID NO: 827132 - DNA, 25 bp, Mus musculus
tctactaaagtcagttccacccatt

SEQ ID NO: 827133 - DNA, 25 bp, Mus musculus
tctactaaagtctgttccacccatt

SEQ ID NO: 827134 - DNA, 25 bp, Mus musculus
tctactaacgaccagcacttgctaa

SEQ ID NO: 827135 - DNA, 25 bp, Mus musculus
tctactaacgacgagcacttgctaa

SEQ ID NO: 827136 - DNA, 25 bp, Mus musculus
tctactaacttgcaaggagcctgtt

SEQ ID NO: 827137 - DNA, 25 bp, Mus musculus
tctactaacttggaaggagcctgtt

SEQ ID NO: 827138 - DNA, 25 bp, Mus musculus
tctactacatatacaccagcaacag

SEQ ID NO: 827139 - DNA, 25 bp, Mus musculus
tctactacatattcaccagcaacag

SEQ ID NO: 827140 - DNA, 25 bp, Mus musculus
tctactactcttctgtctcatttct

SEQ ID NO: 827141 - DNA, 25 bp, Mus musculus
tctactactcttgtgtctcatttct

SEQ ID NO: 827142 - DNA, 25 bp, Mus musculus
tctactactgatatggtgtgaactt

SEQ ID NO: 827143 - DNA, 25 bp, Mus musculus
tctactactgatttggtgtgaactt

SEQ ID NO: 827144 - DNA, 25 bp, Mus musculus
tctactacttcacctatcatgccag

SEQ ID NO: 827145 - DNA, 25 bp, Mus musculus
tctactacttcagctatcatgccag

SEQ ID NO: 827146 - DNA, 25 bp, Mus musculus
tctactacttcccagacaccaaagt

SEQ ID NO: 827147 - DNA, 25 bp, Mus musculus
tctactacttccgagacaccaaagt

SEQ ID NO: 827148 - DNA, 25 bp, Mus musculus
tctactagaaggaaacatacggctg

SEQ ID NO: 827149 - DNA, 25 bp, Mus musculus
tctactagaaggtaacatacggctg

SEQ ID NO: 827150 - DNA, 25 bp, Mus musculus
tctactagctatcctgaaaccacag

SEQ ID NO: 827151 - DNA, 25 bp, Mus musculus
tctactagctatgctgaaaccacag

SEQ ID NO: 827152 - DNA, 25 bp, Mus musculus
tctactatcagccataccatttccg

SEQ ID NO: 827153 - DNA, 25 bp, Mus musculus
tctactatcagcgataccatttccg

SEQ ID NO: 827154 - DNA, 25 bp, Mus musculus
tctactatgcctcatgttgcctacc

SEQ ID NO: 827155 - DNA, 25 bp, Mus musculus
tctactatgcctgatgttgcctacc

SEQ ID NO: 827156 - DNA, 25 bp, Mus musculus
tctactatgtctacatgacttcctc

SEQ ID NO: 827157 - DNA, 25 bp, Mus musculus
tctactatgtcttcatgacttcctc

SEQ ID NO: 827158 - DNA, 25 bp, Mus musculus
tctactatttcgatgactgcttcct

SEQ ID NO: 827159 - DNA, 25 bp, Mus musculus
tctactatttcgttgactgcttcct

SEQ ID NO: 827160 - DNA, 25 bp, Mus musculus
tctactcaagaccttttccactggg

SEQ ID NO: 827161 - DNA, 25 bp, Mus musculus
tctactcaagacgttttccactggg

SEQ ID NO: 827162 - DNA, 25 bp, Mus musculus
tctactcagactcacagctaggcag

SEQ ID NO: 827163 - DNA, 25 bp, Mus musculus
tctactcagactgacagctaggcag

SEQ ID NO: 827164 - DNA, 25 bp, Mus musculus
tctactcagcctagtgagctcaggg

SEQ ID NO: 827165 - DNA, 25 bp, Mus musculus
tctactcagccttgtgagctcaggg

SEQ ID NO: 827166 - DNA, 25 bp, Mus musculus
tctactcaggtcataattcccctaa

SEQ ID NO: 827167 - DNA, 25 bp, Mus musculus
tctactcaggtcttaattcccctaa

SEQ ID NO: 827168 - DNA, 25 bp, Mus musculus
tctactcaggtgaatgggcatgctt

SEQ ID NO: 827169 - DNA, 25 bp, Mus musculus
tctactcaggtgtatgggcatgctt

SEQ ID NO: 827170 - DNA, 25 bp, Mus musculus
tctactcatttgacagttttccatg

SEQ ID NO: 827171 - DNA, 25 bp, Mus musculus
tctactcatttgtcagttttccatg

SEQ ID NO: 827172 - DNA, 25 bp, Mus musculus
tctactccagccaaatcagtgggtt

SEQ ID NO: 827173 - DNA, 25 bp, Mus musculus
tctactccagcctaatcagtgggtt

SEQ ID NO: 827174 - DNA, 25 bp, Mus musculus
tctactccatctctccgtaatgatt

SEQ ID NO: 827175 - DNA, 25 bp, Mus musculus
tctactccatctgtccgtaatgatt

SEQ ID NO: 827176 - DNA, 25 bp, Mus musculus
tctactcccatgaattcacctttga

SEQ ID NO: 827177 - DNA, 25 bp, Mus musculus
tctactcccatgtattcacctttga

SEQ ID NO: 827178 - DNA, 25 bp, Mus musculus
tctactccctctcagagttttcaac

SEQ ID NO: 827179 - DNA, 25 bp, Mus musculus
tctactccctctgagagttttcaac

SEQ ID NO: 827180 - DNA, 25 bp, Mus musculus
tctactccctgcacctggatagttt

SEQ ID NO: 827181 - DNA, 25 bp, Mus musculus
tctactccctgctcctggatagttt

SEQ ID NO: 827182 - DNA, 25 bp, Mus musculus
tctactccgagtcttgtaccggttc

SEQ ID NO: 827183 - DNA, 25 bp, Mus musculus
tctactccgagtgttgtaccggttc

SEQ ID NO: 827184 - DNA, 25 bp, Mus musculus
tctactccgcagattagtagaggcc

SEQ ID NO: 827185 - DNA, 25 bp, Mus musculus
tctactccgcagtttagtagaggcc

SEQ ID NO: 827186 - DNA, 25 bp, Mus musculus
tctactccgtggatgaccgcacagg

SEQ ID NO: 827187 - DNA, 25 bp, Mus musculus
tctactccgtggttgaccgcacagg

SEQ ID NO: 827188 - DNA, 25 bp, Mus musculus
tctactcctgacaactacaaggaaa

SEQ ID NO: 827189 - DNA, 25 bp, Mus musculus
tctactcctgactactacaaggaaa

SEQ ID NO: 827190 - DNA, 25 bp, Mus musculus
tctactcctgagctgtgtacctagt

SEQ ID NO: 827191 - DNA, 25 bp, Mus musculus
tctactcctgaggtgtgtacctagt

SEQ ID NO: 827192 - DNA, 25 bp, Mus musculus
tctactcgcctcatagaattctcag

SEQ ID NO: 827193 - DNA, 25 bp, Mus musculus
tctactcgcctcttagaattctcag

SEQ ID NO: 827194 - DNA, 25 bp, Mus musculus
tctactcgtgcacattaagatcaca

SEQ ID NO: 827195 - DNA, 25 bp, Mus musculus
tctactcgtgcagattaagatcaca

SEQ ID NO: 827196 - DNA, 25 bp, Mus musculus
tctactctacgtcgctcagacaaga

SEQ ID NO: 827197 - DNA, 25 bp, Mus musculus
tctactctacgtggctcagacaaga

SEQ ID NO: 827198 - DNA, 25 bp, Mus musculus
tctactctcaccctgagagacctgg

SEQ ID NO: 827199 - DNA, 25 bp, Mus musculus
tctactctcaccgtgagagacctgg

SEQ ID NO: 827200 - DNA, 25 bp, Mus musculus
tctactctcatcatcacatactgtg

SEQ ID NO: 827201 - DNA, 25 bp, Mus musculus
tctactctcatcttcacatactgtg

SEQ ID NO: 827202 - DNA, 25 bp, Mus musculus
tctactctccatattcaatataata

SEQ ID NO: 827203 - DNA, 25 bp, Mus musculus
tctactctccattttcaatataata

SEQ ID NO: 827204 - DNA, 25 bp, Mus musculus
tctactctgaccctagacaatctgg

SEQ ID NO: 827205 - DNA, 25 bp, Mus musculus
tctactctgaccgtagacaatctgg

SEQ ID NO: 827206 - DNA, 25 bp, Mus musculus
tctactctggagctctaggtggctg

SEQ ID NO: 827207 - DNA, 25 bp, Mus musculus
tctactctggaggtctaggtggctg

SEQ ID NO: 827208 - DNA, 25 bp, Mus musculus
tctactctggttctggtttgtgatt

SEQ ID NO: 827209 - DNA, 25 bp, Mus musculus
tctactctggttgtggtttgtgatt

SEQ ID NO: 827210 - DNA, 25 bp, Mus musculus
tctactcttagcagcagtcttgcca

SEQ ID NO: 827211 - DNA, 25 bp, Mus musculus
tctactcttagctgcagtcttgcca

SEQ ID NO: 827212 - DNA, 25 bp, Mus musculus
tctactcttgtcattatcctttgga

SEQ ID NO: 827213 - DNA, 25 bp, Mus musculus
tctactcttgtctttatcctttgga

SEQ ID NO: 827214 - DNA, 25 bp, Mus musculus
tctactctttccagactggccactg

SEQ ID NO: 827215 - DNA, 25 bp, Mus musculus
tctactctttcctgactggccactg

SEQ ID NO: 827216 - DNA, 25 bp, Mus musculus
tctactgaaaggctgaactgggaaa

SEQ ID NO: 827217 - DNA, 25 bp, Mus musculus
tctactgaaagggtgaactgggaaa

SEQ ID NO: 827218 - DNA, 25 bp, Mus musculus
tctactgaacacatttgttgctcta

SEQ ID NO: 827219 - DNA, 25 bp, Mus musculus
tctactgaacacttttgttgctcta

SEQ ID NO: 827220 - DNA, 25 bp, Mus musculus
tctactgaagaaacaagtgctgtta

SEQ ID NO: 827221 - DNA, 25 bp, Mus musculus
tctactgaagaatcaagtgctgtta

SEQ ID NO: 827222 - DNA, 25 bp, Mus musculus
tctactgagcgccttctggaagagc

SEQ ID NO: 827223 - DNA, 25 bp, Mus musculus
tctactgagcgcgttctggaagagc

SEQ ID NO: 827224 - DNA, 25 bp, Mus musculus
tctactgatgctatgaggagcaagc

SEQ ID NO: 827225 - DNA, 25 bp, Mus musculus
tctactgatgctttgaggagcaagc

SEQ ID NO: 827226 - DNA, 25 bp, Mus musculus
tctactgcagcaagtgttcctacat

SEQ ID NO: 827227 - DNA, 25 bp, Mus musculus
tctactgcagcatgtgttcctacat

SEQ ID NO: 827228 - DNA, 25 bp, Mus musculus
tctactgccgttagaaaggccctgt

SEQ ID NO: 827229 - DNA, 25 bp, Mus musculus
tctactgccgtttgaaaggccctgt

SEQ ID NO: 827230 - DNA, 25 bp, Mus musculus
tctactgctaaacccttgtcactgc

SEQ ID NO: 827231 - DNA, 25 bp, Mus musculus
tctactgctaaagccttgtcactgc

SEQ ID NO: 827232 - DNA, 25 bp, Mus musculus
tctactgctcacacatggagggcac

SEQ ID NO: 827233 - DNA, 25 bp, Mus musculus
tctactgctcactcatggagggcac

SEQ ID NO: 827234 - DNA, 25 bp, Mus musculus
tctactgctgatattaaacttggct

SEQ ID NO: 827235 - DNA, 25 bp, Mus musculus
tctactgctgattttaaacttggct

SEQ ID NO: 827236 - DNA, 25 bp, Mus musculus
tctactgctgtaatcgaactctata

SEQ ID NO: 827237 - DNA, 25 bp, Mus musculus
tctactgctgtattcgaactctata

SEQ ID NO: 827238 - DNA, 25 bp, Mus musculus
tctactgctgtcatgtgtacgtgtc

SEQ ID NO: 827239 - DNA, 25 bp, Mus musculus
tctactgctgtcttgtgtacgtgtc

SEQ ID NO: 827240 - DNA, 25 bp, Mus musculus
tctactgcttggctgatcatcttat

SEQ ID NO: 827241 - DNA, 25 bp, Mus musculus
tctactgcttgggtgatcatcttat

SEQ ID NO: 827242 - DNA, 25 bp, Mus musculus
tctactggaaagagccacacaactg

SEQ ID NO: 827243 - DNA, 25 bp, Mus musculus
tctactggaaagtgccacacaactg

SEQ ID NO: 827244 - DNA, 25 bp, Mus musculus
tctactggagagctggagtgacctt

SEQ ID NO: 827245 - DNA, 25 bp, Mus musculus
tctactggagaggtggagtgacctt

SEQ ID NO: 827246 - DNA, 25 bp, Mus musculus
tctactggatccacagagagtagga

SEQ ID NO: 827247 - DNA, 25 bp, Mus musculus
tctactggatcctcagagagtagga

SEQ ID NO: 827248 - DNA, 25 bp, Mus musculus
tctactggcttgagtccaggatctt

SEQ ID NO: 827249 - DNA, 25 bp, Mus musculus
tctactggcttgtgtccaggatctt

SEQ ID NO: 827250 - DNA, 25 bp, Mus musculus
tctactgggccccatttctaggaag

SEQ ID NO: 827251 - DNA, 25 bp, Mus musculus
tctactgggcccgatttctaggaag

SEQ ID NO: 827252 - DNA, 25 bp, Mus musculus
tctactggtcagcatgcttttctca

SEQ ID NO: 827253 - DNA, 25 bp, Mus musculus
tctactggtcaggatgcttttctca

SEQ ID NO: 827254 - DNA, 25 bp, Mus musculus
tctactgtaaagcatgctatgccaa

SEQ ID NO: 827255 - DNA, 25 bp, Mus musculus
tctactgtaaaggatgctatgccaa

SEQ ID NO: 827256 - DNA, 25 bp, Mus musculus
tctactgtacagatagcaagcgaag

SEQ ID NO: 827257 - DNA, 25 bp, Mus musculus
tctactgtacagttagcaagcgaag

SEQ ID NO: 827258 - DNA, 25 bp, Mus musculus
tctactgtatagcattcaggaactg

SEQ ID NO: 827259 - DNA, 25 bp, Mus musculus
tctactgtataggattcaggaactg

SEQ ID NO: 827260 - DNA, 25 bp, Mus musculus
tctactgtctctacgtctgtgtaaa

SEQ ID NO: 827261 - DNA, 25 bp, Mus musculus
tctactgtctcttcgtctgtgtaaa

SEQ ID NO: 827262 - DNA, 25 bp, Mus musculus
tctactgtggaaagccaggctgctc

SEQ ID NO: 827263 - DNA, 25 bp, Mus musculus
tctactgtggaatgccaggctgctc

SEQ ID NO: 827264 - DNA, 25 bp, Mus musculus
tctactgtttatacccatcttgtat

SEQ ID NO: 827265 - DNA, 25 bp, Mus musculus
tctactgtttattcccatcttgtat

SEQ ID NO: 827266 - DNA, 25 bp, Mus musculus
tctactgtttcaagcaccgccgatt

SEQ ID NO: 827267 - DNA, 25 bp, Mus musculus
tctactgtttcatgcaccgccgatt

SEQ ID NO: 827268 - DNA, 25 bp, Mus musculus
tctacttaaacaacagggtctccct

SEQ ID NO: 827269 - DNA, 25 bp, Mus musculus
tctacttaaacatcagggtctccct

SEQ ID NO: 827270 - DNA, 25 bp, Mus musculus
tctacttagactattgcaaattcat

SEQ ID NO: 827271 - DNA, 25 bp, Mus musculus
tctacttagacttttgcaaattcat

SEQ ID NO: 827272 - DNA, 25 bp, Mus musculus
tctacttagcagctcataacactga

SEQ ID NO: 827273 - DNA, 25 bp, Mus musculus
tctacttagcaggtcataacactga

SEQ ID NO: 827274 - DNA, 25 bp, Mus musculus
tctacttatactctttccaaacatc

SEQ ID NO: 827275 - DNA, 25 bp, Mus musculus
tctacttatactgtttccaaacatc

SEQ ID NO: 827276 - DNA, 25 bp, Mus musculus
tctacttatgtgcagtatgactcac

SEQ ID NO: 827277 - DNA, 25 bp, Mus musculus
tctacttatgtggagtatgactcac

SEQ ID NO: 827278 - DNA, 25 bp, Mus musculus
tctacttcagacactgttgaagaga

SEQ ID NO: 827279 - DNA, 25 bp, Mus musculus
tctacttcagactctgttgaagaga

SEQ ID NO: 827280 - DNA, 25 bp, Mus musculus
tctacttcagtcacttttcaccatt

SEQ ID NO: 827281 - DNA, 25 bp, Mus musculus
tctacttcagtcagataccacaagg

SEQ ID NO: 827282 - DNA, 25 bp, Mus musculus
tctacttcagtctcttttcaccatt

SEQ ID NO: 827283 - DNA, 25 bp, Mus musculus
tctacttcagtctgataccacaagg

SEQ ID NO: 827284 - DNA, 25 bp, Mus musculus
tctacttcattgaccacctcttgga

SEQ ID NO: 827285 - DNA, 25 bp, Mus musculus
tctacttcattgtccacctcttgga

SEQ ID NO: 827286 - DNA, 25 bp, Mus musculus
tctacttccagtccaaatcttatat

SEQ ID NO: 827287 - DNA, 25 bp, Mus musculus
tctacttccagtgcaaatcttatat

SEQ ID NO: 827288 - DNA, 25 bp, Mus musculus
tctacttccgatatgtgggtcccaa

SEQ ID NO: 827289 - DNA, 25 bp, Mus musculus
tctacttccgatttgtgggtcccaa

SEQ ID NO: 827290 - DNA, 25 bp, Mus musculus
tctacttccgcaaagatagtcttgt

SEQ ID NO: 827291 - DNA, 25 bp, Mus musculus
tctacttccgcatagatagtcttgt

SEQ ID NO: 827292 - DNA, 25 bp, Mus musculus
tctacttccggtaatgaatgttggg

SEQ ID NO: 827293 - DNA, 25 bp, Mus musculus
tctacttccggttatgaatgttggg

SEQ ID NO: 827294 - DNA, 25 bp, Mus musculus
tctacttccgtaaatgattcttatc

SEQ ID NO: 827295 - DNA, 25 bp, Mus musculus
tctacttccgtatatgattcttatc

SEQ ID NO: 827296 - DNA, 25 bp, Mus musculus
tctacttcctatcacagtgactgct

SEQ ID NO: 827297 - DNA, 25 bp, Mus musculus
tctacttcctatgacagtgactgct

SEQ ID NO: 827298 - DNA, 25 bp, Mus musculus
tctacttcctgaccgactgagatgt

SEQ ID NO: 827299 - DNA, 25 bp, Mus musculus
tctacttcctgagcgactgagatgt

SEQ ID NO: 827300 - DNA, 25 bp, Mus musculus
tctacttcctggctactggattaca

SEQ ID NO: 827301 - DNA, 25 bp, Mus musculus
tctacttcctgggtactggattaca

SEQ ID NO: 827302 - DNA, 25 bp, Mus musculus
tctacttcgacgacagctctaatgt

SEQ ID NO: 827303 - DNA, 25 bp, Mus musculus
tctacttcgacgtcagctctaatgt

SEQ ID NO: 827304 - DNA, 25 bp, Mus musculus
tctacttcgtagctcagacactgac

SEQ ID NO: 827305 - DNA, 25 bp, Mus musculus
tctacttcgtaggtcagacactgac

SEQ ID NO: 827306 - DNA, 25 bp, Mus musculus
tctacttcgtgtattagtggcccaa

SEQ ID NO: 827307 - DNA, 25 bp, Mus musculus
tctacttcgtgttttagtggcccaa

SEQ ID NO: 827308 - DNA, 25 bp, Mus musculus
tctacttctaagactgagtccagtc

SEQ ID NO: 827309 - DNA, 25 bp, Mus musculus
tctacttctaagtctgagtccagtc

SEQ ID NO: 827310 - DNA, 25 bp, Mus musculus
tctacttctattcccgttcagagat

SEQ ID NO: 827311 - DNA, 25 bp, Mus musculus
tctacttctattgccgttcagagat

SEQ ID NO: 827312 - DNA, 25 bp, Mus musculus
tctacttctcatatctgtgcagtaa

SEQ ID NO: 827313 - DNA, 25 bp, Mus musculus
tctacttctcatttctgtgcagtaa

SEQ ID NO: 827314 - DNA, 25 bp, Mus musculus
tctacttctccaagattctgtcttt

SEQ ID NO: 827315 - DNA, 25 bp, Mus musculus
tctacttctccatgattctgtcttt

SEQ ID NO: 827316 - DNA, 25 bp, Mus musculus
tctacttctgatcagggtgctggca

SEQ ID NO: 827317 - DNA, 25 bp, Mus musculus
tctacttctgatgagggtgctggca

SEQ ID NO: 827318 - DNA, 25 bp, Mus musculus
tctacttctgggacctggtgtctct

SEQ ID NO: 827319 - DNA, 25 bp, Mus musculus
tctacttctgggtcctggtgtctct

SEQ ID NO: 827320 - DNA, 25 bp, Mus musculus
tctacttgatgtatataggtctggc

SEQ ID NO: 827321 - DNA, 25 bp, Mus musculus
tctacttgatgtttataggtctggc

SEQ ID NO: 827322 - DNA, 25 bp, Mus musculus
tctacttgcccacaccgagaacaaa

SEQ ID NO: 827323 - DNA, 25 bp, Mus musculus
tctacttgcccagaccgagaacaaa

SEQ ID NO: 827324 - DNA, 25 bp, Mus musculus
tctacttgtaggataatggacattc

SEQ ID NO: 827325 - DNA, 25 bp, Mus musculus
tctacttgtaggttaatggacattc

SEQ ID NO: 827326 - DNA, 25 bp, Mus musculus
tctacttgttcacacttgtttggta

SEQ ID NO: 827327 - DNA, 25 bp, Mus musculus
tctacttgttcagacttgtttggta

SEQ ID NO: 827328 - DNA, 25 bp, Mus musculus
tctactttcagaatcttggacacat

SEQ ID NO: 827329 - DNA, 25 bp, Mus musculus
tctactttcagattcttggacacat

SEQ ID NO: 827330 - DNA, 25 bp, Mus musculus
tctactttctaccatgtctggacgc

SEQ ID NO: 827331 - DNA, 25 bp, Mus musculus
tctactttctacgatgtctggacgc

SEQ ID NO: 827332 - DNA, 25 bp, Mus musculus
tctactttctagagctgccttgagg

SEQ ID NO: 827333 - DNA, 25 bp, Mus musculus
tctactttctagtgctgccttgagg

SEQ ID NO: 827334 - DNA, 25 bp, Mus musculus
tctactttctctaccgtgtgactgt

SEQ ID NO: 827335 - DNA, 25 bp, Mus musculus
tctactttctctacctttcttaagg

SEQ ID NO: 827336 - DNA, 25 bp, Mus musculus
tctactttctcttccgtgtgactgt

SEQ ID NO: 827337 - DNA, 25 bp, Mus musculus
tctactttctcttcctttcttaagg

SEQ ID NO: 827338 - DNA, 25 bp, Mus musculus
tctactttcttaagctttccaattg

SEQ ID NO: 827339 - DNA, 25 bp, Mus musculus
tctactttcttatgctttccaattg

SEQ ID NO: 827340 - DNA, 25 bp, Mus musculus
tctactttgataataaaacccacat

SEQ ID NO: 827341 - DNA, 25 bp, Mus musculus
tctactttgatattaaaacccacat

SEQ ID NO: 827342 - DNA, 25 bp, Mus musculus
tctactttgcacagtttatctcctc

SEQ ID NO: 827343 - DNA, 25 bp, Mus musculus
tctactttgcactgtttatctcctc

SEQ ID NO: 827344 - DNA, 25 bp, Mus musculus
tctactttgggcacctaggaagcaa

SEQ ID NO: 827345 - DNA, 25 bp, Mus musculus
tctactttgggctcctaggaagcaa

SEQ ID NO: 827346 - DNA, 25 bp, Mus musculus
tctacttttcatacagggctactct

SEQ ID NO: 827347 - DNA, 25 bp, Mus musculus
tctacttttcattcagggctactct

SEQ ID NO: 827348 - DNA, 25 bp, Mus musculus
tctacttttccaactaactagattg

SEQ ID NO: 827349 - DNA, 25 bp, Mus musculus
tctacttttccatctaactagattg

SEQ ID NO: 827350 - DNA, 25 bp, Mus musculus
tctactttttctcagctatcaacaa

SEQ ID NO: 827351 - DNA, 25 bp, Mus musculus
tctactttttctgagctatcaacaa

SEQ ID NO: 827352 - DNA, 25 bp, Mus musculus
tctagaaacaacattattgggatat

SEQ ID NO: 827353 - DNA, 25 bp, Mus musculus
tctagaaacaactttattgggatat

SEQ ID NO: 827354 - DNA, 25 bp, Mus musculus
tctagaaacatcatgctgtcctttt

SEQ ID NO: 827355 - DNA, 25 bp, Mus musculus
tctagaaacatcttgctgtcctttt

SEQ ID NO: 827356 - DNA, 25 bp, Mus musculus
tctagaaagcaccagtacgtttaag

SEQ ID NO: 827357 - DNA, 25 bp, Mus musculus
tctagaaagcacgagtacgtttaag

SEQ ID NO: 827358 - DNA, 25 bp, Mus musculus
tctagaaaggcgacagcacactgct

SEQ ID NO: 827359 - DNA, 25 bp, Mus musculus
tctagaaaggcgtcagcacactgct

SEQ ID NO: 827360 - DNA, 25 bp, Mus musculus
tctagaaagggcctcgtgctcacac

SEQ ID NO: 827361 - DNA, 25 bp, Mus musculus
tctagaaagggcgtcgtgctcacac

SEQ ID NO: 827362 - DNA, 25 bp, Mus musculus
tctagaacactgagccatcattcca

SEQ ID NO: 827363 - DNA, 25 bp, Mus musculus
tctagaacactgtgccatcattcca

SEQ ID NO: 827364 - DNA, 25 bp, Mus musculus
tctagaacattcatgtttcaccaat

SEQ ID NO: 827365 - DNA, 25 bp, Mus musculus
tctagaacattcttgtttcaccaat

SEQ ID NO: 827366 - DNA, 25 bp, Mus musculus
tctagaaccttcctggtcaccctta

SEQ ID NO: 827367 - DNA, 25 bp, Mus musculus
tctagaaccttcgtggtcaccctta

SEQ ID NO: 827368 - DNA, 25 bp, Mus musculus
tctagaacttgacgagatcagctgt

SEQ ID NO: 827369 - DNA, 25 bp, Mus musculus
tctagaacttgaggagatcagctgt

SEQ ID NO: 827370 - DNA, 25 bp, Mus musculus
tctagaagacgcagggtgtgcccgt

SEQ ID NO: 827371 - DNA, 25 bp, Mus musculus
tctagaagacgctgggtgtgcccgt

SEQ ID NO: 827372 - DNA, 25 bp, Mus musculus
tctagaagagggattcctggtgcaa

SEQ ID NO: 827373 - DNA, 25 bp, Mus musculus
tctagaagagggtttcctggtgcaa

SEQ ID NO: 827374 - DNA, 25 bp, Mus musculus
tctagaagccccaagtcatagccct

SEQ ID NO: 827375 - DNA, 25 bp, Mus musculus
tctagaagcccctagtcatagccct

SEQ ID NO: 827376 - DNA, 25 bp, Mus musculus
tctagaagccctcatgtaccattta

SEQ ID NO: 827377 - DNA, 25 bp, Mus musculus
tctagaagccctgatgtaccattta

SEQ ID NO: 827378 - DNA, 25 bp, Mus musculus
tctagaagccgaagtaggaccgtat

SEQ ID NO: 827379 - DNA, 25 bp, Mus musculus
tctagaagccgatgtaggaccgtat

SEQ ID NO: 827380 - DNA, 25 bp, Mus musculus
tctagaagggtaccgtgtccattag

SEQ ID NO: 827381 - DNA, 25 bp, Mus musculus
tctagaagggtagcgtgtccattag

SEQ ID NO: 827382 - DNA, 25 bp, Mus musculus
tctagaagtgctcactactgcccct

SEQ ID NO: 827383 - DNA, 25 bp, Mus musculus
tctagaagtgctgactactgcccct

SEQ ID NO: 827384 - DNA, 25 bp, Mus musculus
tctagaagtttcagttcaacaaagt

SEQ ID NO: 827385 - DNA, 25 bp, Mus musculus
tctagaagtttctgttcaacaaagt

SEQ ID NO: 827386 - DNA, 25 bp, Mus musculus
tctagaatagagcatttctccccgc

SEQ ID NO: 827387 - DNA, 25 bp, Mus musculus
tctagaatagaggatttctccccgc

SEQ ID NO: 827388 - DNA, 25 bp, Mus musculus
tctagaattccgacttacacctatt

SEQ ID NO: 827389 - DNA, 25 bp, Mus musculus
tctagaattccgtcttacacctatt

SEQ ID NO: 827390 - DNA, 25 bp, Mus musculus
tctagacacacgacacacctgatat

SEQ ID NO: 827391 - DNA, 25 bp, Mus musculus
tctagacacacgtcacacctgatat

SEQ ID NO: 827392 - DNA, 25 bp, Mus musculus
tctagacaccctctgaagttcttca

SEQ ID NO: 827393 - DNA, 25 bp, Mus musculus
tctagacaccctgtgaagttcttca

SEQ ID NO: 827394 - DNA, 25 bp, Mus musculus
tctagacagataccaaatatcaaag

SEQ ID NO: 827395 - DNA, 25 bp, Mus musculus
tctagacagatagcaaatatcaaag

SEQ ID NO: 827396 - DNA, 25 bp, Mus musculus
tctagaccagaacttcctaatgtta

SEQ ID NO: 827397 - DNA, 25 bp, Mus musculus
tctagaccagaagttcctaatgtta

SEQ ID NO: 827398 - DNA, 25 bp, Mus musculus
tctagaccagcgatggcaaggcaga

SEQ ID NO: 827399 - DNA, 25 bp, Mus musculus
tctagaccagcgttggcaaggcaga

SEQ ID NO: 827400 - DNA, 25 bp, Mus musculus
tctagaccctgaaccagcaagtgga

SEQ ID NO: 827401 - DNA, 25 bp, Mus musculus
tctagaccctgatccagcaagtgga

SEQ ID NO: 827402 - DNA, 25 bp, Mus musculus
tctagacctaaccttgttttatcat

SEQ ID NO: 827403 - DNA, 25 bp, Mus musculus
tctagacctaacgttgttttatcat

SEQ ID NO: 827404 - DNA, 25 bp, Mus musculus
tctagacctcttagtgctctgcatg

SEQ ID NO: 827405 - DNA, 25 bp, Mus musculus
tctagacctctttgtgctctgcatg

SEQ ID NO: 827406 - DNA, 25 bp, Mus musculus
tctagaccttgtaaggattccgggt

SEQ ID NO: 827407 - DNA, 25 bp, Mus musculus
tctagaccttgttaggattccgggt

SEQ ID NO: 827408 - DNA, 25 bp, Mus musculus
tctagacgggctctcggtggtcctt

SEQ ID NO: 827409 - DNA, 25 bp, Mus musculus
tctagacgggctgtcggtggtcctt

SEQ ID NO: 827410 - DNA, 25 bp, Mus musculus
tctagactagacatgggtgacctgc

SEQ ID NO: 827411 - DNA, 25 bp, Mus musculus
tctagactagacttgggtgacctgc

SEQ ID NO: 827412 - DNA, 25 bp, Mus musculus
tctagactattaacccatccatcca

SEQ ID NO: 827413 - DNA, 25 bp, Mus musculus
tctagactattatcccatccatcca

SEQ ID NO: 827414 - DNA, 25 bp, Mus musculus
tctagactccagatgtgaaccgcca

SEQ ID NO: 827415 - DNA, 25 bp, Mus musculus
tctagactccagttgtgaaccgcca

SEQ ID NO: 827416 - DNA, 25 bp, Mus musculus
tctagactgcctcccgggtaatagt

SEQ ID NO: 827417 - DNA, 25 bp, Mus musculus
tctagactgcctgccgggtaatagt

SEQ ID NO: 827418 - DNA, 25 bp, Mus musculus
tctagactggacattttctgtgaaa

SEQ ID NO: 827419 - DNA, 25 bp, Mus musculus
tctagactggactttttctgtgaaa

SEQ ID NO: 827420 - DNA, 25 bp, Mus musculus
tctagactgggtacaagccaccggt

SEQ ID NO: 827421 - DNA, 25 bp, Mus musculus
tctagactgggttcaagccaccggt

SEQ ID NO: 827422 - DNA, 25 bp, Mus musculus
tctagacttcatatactgacttgat

SEQ ID NO: 827423 - DNA, 25 bp, Mus musculus
tctagacttcatttactgacttgat

SEQ ID NO: 827424 - DNA, 25 bp, Mus musculus
tctagacttccgatcttggtaacta

SEQ ID NO: 827425 - DNA, 25 bp, Mus musculus
tctagacttccgttcttggtaacta

SEQ ID NO: 827426 - DNA, 25 bp, Mus musculus
tctagactttctatccctaaactat

SEQ ID NO: 827427 - DNA, 25 bp, Mus musculus
tctagactttctttccctaaactat

SEQ ID NO: 827428 - DNA, 25 bp, Mus musculus
tctagagaaagtacccgtgcttttt

SEQ ID NO: 827429 - DNA, 25 bp, Mus musculus
tctagagaaagttcccgtgcttttt

SEQ ID NO: 827430 - DNA, 25 bp, Mus musculus
tctagagactcgcaaacatgggaag

SEQ ID NO: 827431 - DNA, 25 bp, Mus musculus
tctagagactcggaaacatgggaag

SEQ ID NO: 827432 - DNA, 25 bp, Mus musculus
tctagagactgtatccacttttagc

SEQ ID NO: 827433 - DNA, 25 bp, Mus musculus
tctagagactgtttccacttttagc

SEQ ID NO: 827434 - DNA, 25 bp, Mus musculus
tctagagagatgaccgcgctgtttg

SEQ ID NO: 827435 - DNA, 25 bp, Mus musculus
tctagagagatgtccgcgctgtttg

SEQ ID NO: 827436 - DNA, 25 bp, Mus musculus
tctagagaggcgactgtcacaggct

SEQ ID NO: 827437 - DNA, 25 bp, Mus musculus
tctagagaggcgtctgtcacaggct

SEQ ID NO: 827438 - DNA, 25 bp, Mus musculus
tctagagagggtcaggcccagccta

SEQ ID NO: 827439 - DNA, 25 bp, Mus musculus
tctagagagggtgaggcccagccta

SEQ ID NO: 827440 - DNA, 25 bp, Mus musculus
tctagagatctgatggaccagacgc

SEQ ID NO: 827441 - DNA, 25 bp, Mus musculus
tctagagatctgttggaccagacgc

SEQ ID NO: 827442 - DNA, 25 bp, Mus musculus
tctagagcacttactggcctgtttt

SEQ ID NO: 827443 - DNA, 25 bp, Mus musculus
tctagagcactttctggcctgtttt

SEQ ID NO: 827444 - DNA, 25 bp, Mus musculus
tctagagccctactcattggagaca

SEQ ID NO: 827445 - DNA, 25 bp, Mus musculus
tctagagccctagtcattggagaca

SEQ ID NO: 827446 - DNA, 25 bp, Mus musculus
tctagagctaatacatgccgacggg

SEQ ID NO: 827447 - DNA, 25 bp, Mus musculus
tctagagctaattcatgccgacggg

SEQ ID NO: 827448 - DNA, 25 bp, Mus musculus
tctagagctgtgaggaagcaccttc

SEQ ID NO: 827449 - DNA, 25 bp, Mus musculus
tctagagctgtgtggaagcaccttc

SEQ ID NO: 827450 - DNA, 25 bp, Mus musculus
tctagagcttggcagcccgtcctcc

SEQ ID NO: 827451 - DNA, 25 bp, Mus musculus
tctagagcttgggagcccgtcctcc

SEQ ID NO: 827452 - DNA, 25 bp, Mus musculus
tctagaggacctcattcagtcccta

SEQ ID NO: 827453 - DNA, 25 bp, Mus musculus
tctagaggacctgattcagtcccta

SEQ ID NO: 827454 - DNA, 25 bp, Mus musculus
tctagaggactcagacatctccact

SEQ ID NO: 827455 - DNA, 25 bp, Mus musculus
tctagaggactctgacatctccact

SEQ ID NO: 827456 - DNA, 25 bp, Mus musculus
tctagagggccaatttgcatcatcc

SEQ ID NO: 827457 - DNA, 25 bp, Mus musculus
tctagagggccattttgcatcatcc

SEQ ID NO: 827458 - DNA, 25 bp, Mus musculus
tctagagggttacattcccgcgcca

SEQ ID NO: 827459 - DNA, 25 bp, Mus musculus
tctagagggttagattcccgcgcca

SEQ ID NO: 827460 - DNA, 25 bp, Mus musculus
tctagagggttcctcaccaccagca

SEQ ID NO: 827461 - DNA, 25 bp, Mus musculus
tctagagggttcgtcaccaccagca

SEQ ID NO: 827462 - DNA, 25 bp, Mus musculus
tctagagtcctaacagtgctgcgat

SEQ ID NO: 827463 - DNA, 25 bp, Mus musculus
tctagagtcctatcagtgctgcgat

SEQ ID NO: 827464 - DNA, 25 bp, Mus musculus
tctagagtccttctttcttgctgat

SEQ ID NO: 827465 - DNA, 25 bp, Mus musculus
tctagagtccttgtttcttgctgat

SEQ ID NO: 827466 - DNA, 25 bp, Mus musculus
tctagagtttccagagggtgtccca

SEQ ID NO: 827467 - DNA, 25 bp, Mus musculus
tctagagtttcctgagggtgtccca

SEQ ID NO: 827468 - DNA, 25 bp, Mus musculus
tctagataggtcaattgttctgcca

SEQ ID NO: 827469 - DNA, 25 bp, Mus musculus
tctagataggtctattgttctgcca

SEQ ID NO: 827470 - DNA, 25 bp, Mus musculus
tctagatatatgctggacatggccc

SEQ ID NO: 827471 - DNA, 25 bp, Mus musculus
tctagatatatggtggacatggccc

SEQ ID NO: 827472 - DNA, 25 bp, Mus musculus
tctagatatgctccttctaacctca

SEQ ID NO: 827473 - DNA, 25 bp, Mus musculus
tctagatatgctgcttctaacctca

SEQ ID NO: 827474 - DNA, 25 bp, Mus musculus
tctagatcaatcaaaacttcagggt

SEQ ID NO: 827475 - DNA, 25 bp, Mus musculus
tctagatcaatctaaacttcagggt

SEQ ID NO: 827476 - DNA, 25 bp, Mus musculus
tctagatccattctacagcacttcg

SEQ ID NO: 827477 - DNA, 25 bp, Mus musculus
tctagatccattgtacagcacttcg

SEQ ID NO: 827478 - DNA, 25 bp, Mus musculus
tctagatgagctccccgacatgcta

SEQ ID NO: 827479 - DNA, 25 bp, Mus musculus
tctagatgagctgcccgacatgcta

SEQ ID NO: 827480 - DNA, 25 bp, Mus musculus
tctagatgatgccttactctgcctt

SEQ ID NO: 827481 - DNA, 25 bp, Mus musculus
tctagatgatgcgttactctgcctt

SEQ ID NO: 827482 - DNA, 25 bp, Mus musculus
tctagatgcaccatgagttcttctc

SEQ ID NO: 827483 - DNA, 25 bp, Mus musculus
tctagatgcaccttgagttcttctc

SEQ ID NO: 827484 - DNA, 25 bp, Mus musculus
tctagatgctctccactgagtcagg

SEQ ID NO: 827485 - DNA, 25 bp, Mus musculus
tctagatgctctgcactgagtcagg

SEQ ID NO: 827486 - DNA, 25 bp, Mus musculus
tctagatgtgatcggcttcctactc

SEQ ID NO: 827487 - DNA, 25 bp, Mus musculus
tctagatgtgatgggcttcctactc

SEQ ID NO: 827488 - DNA, 25 bp, Mus musculus
tctagattcgagaactacaggcatt

SEQ ID NO: 827489 - DNA, 25 bp, Mus musculus
tctagattcgagtactacaggcatt

SEQ ID NO: 827490 - DNA, 25 bp, Mus musculus
tctagattgcttactgtccaggttt

SEQ ID NO: 827491 - DNA, 25 bp, Mus musculus
tctagattgctttctgtccaggttt

SEQ ID NO: 827492 - DNA, 25 bp, Mus musculus
tctagcaaagtcctgactgctgtct

SEQ ID NO: 827493 - DNA, 25 bp, Mus musculus
tctagcaaagtcgtgactgctgtct

SEQ ID NO: 827494 - DNA, 25 bp, Mus musculus
tctagcaaatcaaccatttctgttt

SEQ ID NO: 827495 - DNA, 25 bp, Mus musculus
tctagcaaatcatccatttctgttt

SEQ ID NO: 827496 - DNA, 25 bp, Mus musculus
tctagcaaatgcacttggtatacta

SEQ ID NO: 827497 - DNA, 25 bp, Mus musculus
tctagcaaatgctcttggtatacta

SEQ ID NO: 827498 - DNA, 25 bp, Mus musculus
tctagcaaccttaccatgctgagtt

SEQ ID NO: 827499 - DNA, 25 bp, Mus musculus
tctagcaacctttccatgctgagtt

SEQ ID NO: 827500 - DNA, 25 bp, Mus musculus
tctagcacagcccatggaactggca

SEQ ID NO: 827501 - DNA, 25 bp, Mus musculus
tctagcacagccgatggaactggca

SEQ ID NO: 827502 - DNA, 25 bp, Mus musculus
tctagcacccaacccagctaagatt

SEQ ID NO: 827503 - DNA, 25 bp, Mus musculus
tctagcacccaagccagctaagatt

SEQ ID NO: 827504 - DNA, 25 bp, Mus musculus
tctagcacccatcttacagcttaca

SEQ ID NO: 827505 - DNA, 25 bp, Mus musculus
tctagcacccatgttacagcttaca

SEQ ID NO: 827506 - DNA, 25 bp, Mus musculus
tctagcacccgtctgtaactgttgt

SEQ ID NO: 827507 - DNA, 25 bp, Mus musculus
tctagcacccgtgtgtaactgttgt

SEQ ID NO: 827508 - DNA, 25 bp, Mus musculus
tctagcaccgctctgtgttatgggc

SEQ ID NO: 827509 - DNA, 25 bp, Mus musculus
tctagcaccgctgtgtgttatgggc

SEQ ID NO: 827510 - DNA, 25 bp, Mus musculus
tctagcacctccatggagactagta

SEQ ID NO: 827511 - DNA, 25 bp, Mus musculus
tctagcacctccttggagactagta

SEQ ID NO: 827512 - DNA, 25 bp, Mus musculus
tctagcagacggaacggagctcact

SEQ ID NO: 827513 - DNA, 25 bp, Mus musculus
tctagcagacggtacggagctcact

SEQ ID NO: 827514 - DNA, 25 bp, Mus musculus
tctagcagagagagactgaacactc

SEQ ID NO: 827515 - DNA, 25 bp, Mus musculus
tctagcagagagtgactgaacactc

SEQ ID NO: 827516 - DNA, 25 bp, Mus musculus
tctagcagtgcaaggtgtccgcaaa

SEQ ID NO: 827517 - DNA, 25 bp, Mus musculus
tctagcagtgcatggtgtccgcaaa

SEQ ID NO: 827518 - DNA, 25 bp, Mus musculus
tctagcataaacatggcctccaggc

SEQ ID NO: 827519 - DNA, 25 bp, Mus musculus
tctagcataaacttggcctccaggc

SEQ ID NO: 827520 - DNA, 25 bp, Mus musculus
tctagcatatatatcagaagaccag

SEQ ID NO: 827521 - DNA, 25 bp, Mus musculus
tctagcatatatttcagaagaccag

SEQ ID NO: 827522 - DNA, 25 bp, Mus musculus
tctagcatcatgagcaggcttcttc

SEQ ID NO: 827523 - DNA, 25 bp, Mus musculus
tctagcatcatgtgcaggcttcttc

SEQ ID NO: 827524 - DNA, 25 bp, Mus musculus
tctagcatctggcagttttcaggtt

SEQ ID NO: 827525 - DNA, 25 bp, Mus musculus
tctagcatctgggagttttcaggtt

SEQ ID NO: 827526 - DNA, 25 bp, Mus musculus
tctagcatgaagacagctgccgggt

SEQ ID NO: 827527 - DNA, 25 bp, Mus musculus
tctagcatgaagtcagctgccgggt

SEQ ID NO: 827528 - DNA, 25 bp, Mus musculus
tctagcattaaactcttcggccctg

SEQ ID NO: 827529 - DNA, 25 bp, Mus musculus
tctagcattaaagtcttcggccctg

SEQ ID NO: 827530 - DNA, 25 bp, Mus musculus
tctagcatttctctgactgcaaggc

SEQ ID NO: 827531 - DNA, 25 bp, Mus musculus
tctagcatttctgtgactgcaaggc

SEQ ID NO: 827532 - DNA, 25 bp, Mus musculus
tctagccaaacaaccagccactttt

SEQ ID NO: 827533 - DNA, 25 bp, Mus musculus
tctagccaaacatccagccactttt

SEQ ID NO: 827534 - DNA, 25 bp, Mus musculus
tctagccaagctcaaccctgtgaag

SEQ ID NO: 827535 - DNA, 25 bp, Mus musculus
tctagccaagctgaaccctgtgaag

SEQ ID NO: 827536 - DNA, 25 bp, Mus musculus
tctagccaccccagctaagaatagc

SEQ ID NO: 827537 - DNA, 25 bp, Mus musculus
tctagccacccctgctaagaatagc

SEQ ID NO: 827538 - DNA, 25 bp, Mus musculus
tctagccactcccaggaattcagag

SEQ ID NO: 827539 - DNA, 25 bp, Mus musculus
tctagccactccgaggaattcagag

SEQ ID NO: 827540 - DNA, 25 bp, Mus musculus
tctagccaggcaacagtctgtgaat

SEQ ID NO: 827541 - DNA, 25 bp, Mus musculus
tctagccaggcatcagtctgtgaat

SEQ ID NO: 827542 - DNA, 25 bp, Mus musculus
tctagccatggcagtgtttgttggt

SEQ ID NO: 827543 - DNA, 25 bp, Mus musculus
tctagccatggctgtgtttgttggt

SEQ ID NO: 827544 - DNA, 25 bp, Mus musculus
tctagcccaagcacagtcttgctgc

SEQ ID NO: 827545 - DNA, 25 bp, Mus musculus
tctagcccaagctcagtcttgctgc

SEQ ID NO: 827546 - DNA, 25 bp, Mus musculus
tctagcccacccatggatgcatagt

SEQ ID NO: 827547 - DNA, 25 bp, Mus musculus
tctagcccacccttggatgcatagt

SEQ ID NO: 827548 - DNA, 25 bp, Mus musculus
tctagcccactgaaccttgagaaga

SEQ ID NO: 827549 - DNA, 25 bp, Mus musculus
tctagcccactgtaccttgagaaga

SEQ ID NO: 827550 - DNA, 25 bp, Mus musculus
tctagcccagttcctgacactgttc

SEQ ID NO: 827551 - DNA, 25 bp, Mus musculus
tctagcccagttgctgacactgttc

SEQ ID NO: 827552 - DNA, 25 bp, Mus musculus
tctagccccagacatacagtgttga

SEQ ID NO: 827553 - DNA, 25 bp, Mus musculus
tctagccccagagatacagtgttga

SEQ ID NO: 827554 - DNA, 25 bp, Mus musculus
tctagcccctgaacacacctttaaa

SEQ ID NO: 827555 - DNA, 25 bp, Mus musculus
tctagcccctgatcacacctttaaa

SEQ ID NO: 827556 - DNA, 25 bp, Mus musculus
tctagcccggaacttttaatgtatt

SEQ ID NO: 827557 - DNA, 25 bp, Mus musculus
tctagcccggaagttttaatgtatt

SEQ ID NO: 827558 - DNA, 25 bp, Mus musculus
tctagcccttctagcctgtatttaa

SEQ ID NO: 827559 - DNA, 25 bp, Mus musculus
tctagcccttcttgcctgtatttaa

SEQ ID NO: 827560 - DNA, 25 bp, Mus musculus
tctagccgtggcattggtgacgtga

SEQ ID NO: 827561 - DNA, 25 bp, Mus musculus
tctagccgtggctttggtgacgtga

SEQ ID NO: 827562 - DNA, 25 bp, Mus musculus
tctagcctagcgattgaacctgcca

SEQ ID NO: 827563 - DNA, 25 bp, Mus musculus
tctagcctagcgtttgaacctgcca

SEQ ID NO: 827564 - DNA, 25 bp, Mus musculus
tctagcctagttagcacaggacttg

SEQ ID NO: 827565 - DNA, 25 bp, Mus musculus
tctagcctagtttgcacaggacttg

SEQ ID NO: 827566 - DNA, 25 bp, Mus musculus
tctagcctcaacattaccagcaaat

SEQ ID NO: 827567 - DNA, 25 bp, Mus musculus
tctagcctcaactttaccagcaaat

SEQ ID NO: 827568 - DNA, 25 bp, Mus musculus
tctagcctgcatatatcttctaatg

SEQ ID NO: 827569 - DNA, 25 bp, Mus musculus
tctagcctgcatttatcttctaatg

SEQ ID NO: 827570 - DNA, 25 bp, Mus musculus
tctagcctttgtagactgtgttctg

SEQ ID NO: 827571 - DNA, 25 bp, Mus musculus
tctagcctttgttgactgtgttctg

SEQ ID NO: 827572 - DNA, 25 bp, Mus musculus
tctagcgacgtcaccattcagatga

SEQ ID NO: 827573 - DNA, 25 bp, Mus musculus
tctagcgacgtctccattcagatga

SEQ ID NO: 827574 - DNA, 25 bp, Mus musculus
tctagcgactcccacggcagcggag

SEQ ID NO: 827575 - DNA, 25 bp, Mus musculus
tctagcgactccgacggcagcggag

SEQ ID NO: 827576 - DNA, 25 bp, Mus musculus
tctagcgatgctcatacacatactc

SEQ ID NO: 827577 - DNA, 25 bp, Mus musculus
tctagcgatgctgatacacatactc

SEQ ID NO: 827578 - DNA, 25 bp, Mus musculus
tctagcgtgattattcttccagaaa

SEQ ID NO: 827579 - DNA, 25 bp, Mus musculus
tctagcgtgatttttcttccagaaa

SEQ ID NO: 827580 - DNA, 25 bp, Mus musculus
tctagctaaaagctggaattactgc

SEQ ID NO: 827581 - DNA, 25 bp, Mus musculus
tctagctaaaaggtggaattactgc

SEQ ID NO: 827582 - DNA, 25 bp, Mus musculus
tctagctaagacattaaggaccatt

SEQ ID NO: 827583 - DNA, 25 bp, Mus musculus
tctagctaagactttaaggaccatt

SEQ ID NO: 827584 - DNA, 25 bp, Mus musculus
tctagctaccatctgctttctatgt

SEQ ID NO: 827585 - DNA, 25 bp, Mus musculus
tctagctaccatgtgctttctatgt

SEQ ID NO: 827586 - DNA, 25 bp, Mus musculus
tctagctatctaaacgctggatgta

SEQ ID NO: 827587 - DNA, 25 bp, Mus musculus
tctagctatctatacgctggatgta

SEQ ID NO: 827588 - DNA, 25 bp, Mus musculus
tctagctatttgctctctcttcaaa

SEQ ID NO: 827589 - DNA, 25 bp, Mus musculus
tctagctatttggtctctcttcaaa

SEQ ID NO: 827590 - DNA, 25 bp, Mus musculus
tctagctcattccaccattacttat

SEQ ID NO: 827591 - DNA, 25 bp, Mus musculus
tctagctcattcgaccattacttat

SEQ ID NO: 827592 - DNA, 25 bp, Mus musculus
tctagctccataactttgaacttga

SEQ ID NO: 827593 - DNA, 25 bp, Mus musculus
tctagctccatatctttgaacttga

SEQ ID NO: 827594 - DNA, 25 bp, Mus musculus
tctagctcctctcagacgcctctgt

SEQ ID NO: 827595 - DNA, 25 bp, Mus musculus
tctagctcctctctgcaggtggtaa

SEQ ID NO: 827596 - DNA, 25 bp, Mus musculus
tctagctcctctgagacgcctctgt

SEQ ID NO: 827597 - DNA, 25 bp, Mus musculus
tctagctcctctgtgcaggtggtaa

SEQ ID NO: 827598 - DNA, 25 bp, Mus musculus
tctagctgacctctgcatgctgaat

SEQ ID NO: 827599 - DNA, 25 bp, Mus musculus
tctagctgacctgtgcatgctgaat

SEQ ID NO: 827600 - DNA, 25 bp, Mus musculus
tctagctgcacaaccacgagaagag

SEQ ID NO: 827601 - DNA, 25 bp, Mus musculus
tctagctgcacatccacgagaagag

SEQ ID NO: 827602 - DNA, 25 bp, Mus musculus
tctagctgctgaagtcttgcgaagt

SEQ ID NO: 827603 - DNA, 25 bp, Mus musculus
tctagctgctgatgtcttgcgaagt

SEQ ID NO: 827604 - DNA, 25 bp, Mus musculus
tctagctgctgcctggatttctttt

SEQ ID NO: 827605 - DNA, 25 bp, Mus musculus
tctagctgctgcgtggatttctttt

SEQ ID NO: 827606 - DNA, 25 bp, Mus musculus
tctagctgtttgcatcaaaggaaaa

SEQ ID NO: 827607 - DNA, 25 bp, Mus musculus
tctagctgtttggatcaaaggaaaa

SEQ ID NO: 827608 - DNA, 25 bp, Mus musculus
tctagcttacccagttcacatttgc

SEQ ID NO: 827609 - DNA, 25 bp, Mus musculus
tctagcttaccctgttcacatttgc

SEQ ID NO: 827610 - DNA, 25 bp, Mus musculus
tctagcttatttcgcgtctccagag

SEQ ID NO: 827611 - DNA, 25 bp, Mus musculus
tctagcttatttggcgtctccagag

SEQ ID NO: 827612 - DNA, 25 bp, Mus musculus
tctagcttcctacgtagctgaggtt

SEQ ID NO: 827613 - DNA, 25 bp, Mus musculus
tctagcttcctaggtagctgaggtt

SEQ ID NO: 827614 - DNA, 25 bp, Mus musculus
tctagcttgctcacgatacaccgaa

SEQ ID NO: 827615 - DNA, 25 bp, Mus musculus
tctagcttgctctcgatacaccgaa

SEQ ID NO: 827616 - DNA, 25 bp, Mus musculus
tctagctttcctctcctgtggtgga

SEQ ID NO: 827617 - DNA, 25 bp, Mus musculus
tctagctttcctgtcctgtggtgga

SEQ ID NO: 827618 - DNA, 25 bp, Mus musculus
tctagctttgccacggcactgtctg

SEQ ID NO: 827619 - DNA, 25 bp, Mus musculus
tctagctttgcctcggcactgtctg

SEQ ID NO: 827620 - DNA, 25 bp, Mus musculus
tctagcttttatccgagtgcacaca

SEQ ID NO: 827621 - DNA, 25 bp, Mus musculus
tctagcttttatgcgagtgcacaca

SEQ ID NO: 827622 - DNA, 25 bp, Mus musculus
tctaggaaacctaggtccctctgac

SEQ ID NO: 827623 - DNA, 25 bp, Mus musculus
tctaggaaaccttggtccctctgac

SEQ ID NO: 827624 - DNA, 25 bp, Mus musculus
tctaggaaatcacacaagctctctt

SEQ ID NO: 827625 - DNA, 25 bp, Mus musculus
tctaggaaatcagacaagctctctt

SEQ ID NO: 827626 - DNA, 25 bp, Mus musculus
tctaggaacacgagccgatggccgg

SEQ ID NO: 827627 - DNA, 25 bp, Mus musculus
tctaggaacacgtgccgatggccgg

SEQ ID NO: 827628 - DNA, 25 bp, Mus musculus
tctaggaacttcactggacttcggt

SEQ ID NO: 827629 - DNA, 25 bp, Mus musculus
tctaggaacttctctggacttcggt

SEQ ID NO: 827630 - DNA, 25 bp, Mus musculus
tctaggacagccatatttgacattt

SEQ ID NO: 827631 - DNA, 25 bp, Mus musculus
tctaggacagccttatttgacattt

SEQ ID NO: 827632 - DNA, 25 bp, Mus musculus
tctaggacgaggacgggctcagcct

SEQ ID NO: 827633 - DNA, 25 bp, Mus musculus
tctaggacgaggtcgggctcagcct

SEQ ID NO: 827634 - DNA, 25 bp, Mus musculus
tctaggactctgagcacctgttgtg

SEQ ID NO: 827635 - DNA, 25 bp, Mus musculus
tctaggactctgtgcacctgttgtg

SEQ ID NO: 827636 - DNA, 25 bp, Mus musculus
tctaggactgcaacttacaggtaca

SEQ ID NO: 827637 - DNA, 25 bp, Mus musculus
tctaggactgcatcttacaggtaca

SEQ ID NO: 827638 - DNA, 25 bp, Mus musculus
tctaggacttgccagggtgcctgaa

SEQ ID NO: 827639 - DNA, 25 bp, Mus musculus
tctaggacttgcgagggtgcctgaa

SEQ ID NO: 827640 - DNA, 25 bp, Mus musculus
tctaggagacatccagagctgtagg

SEQ ID NO: 827641 - DNA, 25 bp, Mus musculus
tctaggagacatgcagagctgtagg

SEQ ID NO: 827642 - DNA, 25 bp, Mus musculus
tctaggatacttaagcccatgacca

SEQ ID NO: 827643 - DNA, 25 bp, Mus musculus
tctaggatactttagcccatgacca

SEQ ID NO: 827644 - DNA, 25 bp, Mus musculus
tctaggatgtggctttgccaagcaa

SEQ ID NO: 827645 - DNA, 25 bp, Mus musculus
tctaggatgtgggtttgccaagcaa

SEQ ID NO: 827646 - DNA, 25 bp, Mus musculus
tctaggcaagagatggtccttcccc

SEQ ID NO: 827647 - DNA, 25 bp, Mus musculus
tctaggcaagagttggtccttcccc

SEQ ID NO: 827648 - DNA, 25 bp, Mus musculus
tctaggcactccaaaccttcatgaa

SEQ ID NO: 827649 - DNA, 25 bp, Mus musculus
tctaggcactcctaaccttcatgaa

SEQ ID NO: 827650 - DNA, 25 bp, Mus musculus
tctaggcagataccaaagtcatact

SEQ ID NO: 827651 - DNA, 25 bp, Mus musculus
tctaggcagatagcaaagtcatact

SEQ ID NO: 827652 - DNA, 25 bp, Mus musculus
tctaggccagctcagtttacatgag

SEQ ID NO: 827653 - DNA, 25 bp, Mus musculus
tctaggccagctgagtttacatgag

SEQ ID NO: 827654 - DNA, 25 bp, Mus musculus
tctaggcctggcacttaacaagctc

SEQ ID NO: 827655 - DNA, 25 bp, Mus musculus
tctaggcctggctcttaacaagctc

SEQ ID NO: 827656 - DNA, 25 bp, Mus musculus
tctaggccttaacttcctgttcaca

SEQ ID NO: 827657 - DNA, 25 bp, Mus musculus
tctaggccttaagttcctgttcaca

SEQ ID NO: 827658 - DNA, 25 bp, Mus musculus
tctaggctgattatagtgcccctat

SEQ ID NO: 827659 - DNA, 25 bp, Mus musculus
tctaggctgattttagtgcccctat

SEQ ID NO: 827660 - DNA, 25 bp, Mus musculus
tctaggctttcaaacatcatgtgtc

SEQ ID NO: 827661 - DNA, 25 bp, Mus musculus
tctaggctttcatacatcatgtgtc

SEQ ID NO: 827662 - DNA, 25 bp, Mus musculus
tctaggctttggactcgaatctgaa

SEQ ID NO: 827663 - DNA, 25 bp, Mus musculus
tctaggctttggtctcgaatctgaa

SEQ ID NO: 827664 - DNA, 25 bp, Mus musculus
tctagggactctcccagaactatgg

SEQ ID NO: 827665 - DNA, 25 bp, Mus musculus
tctagggactctgccagaactatgg

SEQ ID NO: 827666 - DNA, 25 bp, Mus musculus
tctagggagcctactgatgactcag

SEQ ID NO: 827667 - DNA, 25 bp, Mus musculus
tctagggagccttctgatgactcag

SEQ ID NO: 827668 - DNA, 25 bp, Mus musculus
tctagggagcgccaagagctttttt

SEQ ID NO: 827669 - DNA, 25 bp, Mus musculus
tctagggagcgcgaagagctttttt

SEQ ID NO: 827670 - DNA, 25 bp, Mus musculus
tctagggaggtgcttcatttgttaa

SEQ ID NO: 827671 - DNA, 25 bp, Mus musculus
tctagggaggtggttcatttgttaa

SEQ ID NO: 827672 - DNA, 25 bp, Mus musculus
tctagggcaacccagctacacagag

SEQ ID NO: 827673 - DNA, 25 bp, Mus musculus
tctagggcaaccgagctacacagag

SEQ ID NO: 827674 - DNA, 25 bp, Mus musculus
tctagggcatagatgttgagtttat

SEQ ID NO: 827675 - DNA, 25 bp, Mus musculus
tctagggcatagttgttgagtttat

SEQ ID NO: 827676 - DNA, 25 bp, Mus musculus
tctagggcatcaaactttaggtaac

SEQ ID NO: 827677 - DNA, 25 bp, Mus musculus
tctagggcatcatactttaggtaac

SEQ ID NO: 827678 - DNA, 25 bp, Mus musculus
tctagggccactatctttggtgaat

SEQ ID NO: 827679 - DNA, 25 bp, Mus musculus
tctagggccactttctttggtgaat

SEQ ID NO: 827680 - DNA, 25 bp, Mus musculus
tctagggcccaaagtgctgccagtg

SEQ ID NO: 827681 - DNA, 25 bp, Mus musculus
tctagggcccaatgtgctgccagtg

SEQ ID NO: 827682 - DNA, 25 bp, Mus musculus
tctagggccctcagaacaattctaa

SEQ ID NO: 827683 - DNA, 25 bp, Mus musculus
tctagggccctctgaacaattctaa

SEQ ID NO: 827684 - DNA, 25 bp, Mus musculus
tctagggccgccaaggcgaactaca

SEQ ID NO: 827685 - DNA, 25 bp, Mus musculus
tctagggccgcctaggcgaactaca

SEQ ID NO: 827686 - DNA, 25 bp, Mus musculus
tctagggcgttactatacacactaa

SEQ ID NO: 827687 - DNA, 25 bp, Mus musculus
tctagggcgttagtatacacactaa

SEQ ID NO: 827688 - DNA, 25 bp, Mus musculus
tctagggctattcgcttactgtgag

SEQ ID NO: 827689 - DNA, 25 bp, Mus musculus
tctagggctattggcttactgtgag

SEQ ID NO: 827690 - DNA, 25 bp, Mus musculus
tctagggctcaccaaagggttgcat

SEQ ID NO: 827691 - DNA, 25 bp, Mus musculus
tctagggctcacgaaagggttgcat

SEQ ID NO: 827692 - DNA, 25 bp, Mus musculus
tctagggctgtgcactttccacttt

SEQ ID NO: 827693 - DNA, 25 bp, Mus musculus
tctagggctgtggactttccacttt

SEQ ID NO: 827694 - DNA, 25 bp, Mus musculus
tctagggtaacacgagatgcagtca

SEQ ID NO: 827695 - DNA, 25 bp, Mus musculus
tctagggtaacaggagatgcagtca

SEQ ID NO: 827696 - DNA, 25 bp, Mus musculus
tctagggtagtacgctcatgcttta

SEQ ID NO: 827697 - DNA, 25 bp, Mus musculus
tctagggtagtaggctcatgcttta

SEQ ID NO: 827698 - DNA, 25 bp, Mus musculus
tctagggtcactactgggtggacat

SEQ ID NO: 827699 - DNA, 25 bp, Mus musculus
tctagggtcacttctgggtggacat

SEQ ID NO: 827700 - DNA, 25 bp, Mus musculus
tctagggtgttcacgtacgctctac

SEQ ID NO: 827701 - DNA, 25 bp, Mus musculus
tctagggtgttctcgtacgctctac

SEQ ID NO: 827702 - DNA, 25 bp, Mus musculus
tctagggttcaacgcaaagggcatt

SEQ ID NO: 827703 - DNA, 25 bp, Mus musculus
tctagggttcaaggcaaagggcatt

SEQ ID NO: 827704 - DNA, 25 bp, Mus musculus
tctagggttgacacacagcactttt

SEQ ID NO: 827705 - DNA, 25 bp, Mus musculus
tctagggttgactcacagcactttt

SEQ ID NO: 827706 - DNA, 25 bp, Mus musculus
tctagggtttctcaggttatttctt

SEQ ID NO: 827707 - DNA, 25 bp, Mus musculus
tctagggtttctgaggttatttctt

SEQ ID NO: 827708 - DNA, 25 bp, Mus musculus
tctaggtagacaagccaaggtggcc

SEQ ID NO: 827709 - DNA, 25 bp, Mus musculus
tctaggtagacatgccaaggtggcc

SEQ ID NO: 827710 - DNA, 25 bp, Mus musculus
tctaggtagtttctttccctccttg

SEQ ID NO: 827711 - DNA, 25 bp, Mus musculus
tctaggtagtttgtttccctccttg

SEQ ID NO: 827712 - DNA, 25 bp, Mus musculus
tctaggtatctgacaccatcacaca

SEQ ID NO: 827713 - DNA, 25 bp, Mus musculus
tctaggtatctgtcaccatcacaca

SEQ ID NO: 827714 - DNA, 25 bp, Mus musculus
tctaggtctcctcaagtcactatgt

SEQ ID NO: 827715 - DNA, 25 bp, Mus musculus
tctaggtctcctgaagtcactatgt

SEQ ID NO: 827716 - DNA, 25 bp, Mus musculus
tctaggtctgagcactggagttatg

SEQ ID NO: 827717 - DNA, 25 bp, Mus musculus
tctaggtctgaggactggagttatg

SEQ ID NO: 827718 - DNA, 25 bp, Mus musculus
tctaggtgaaccctcagagactctc

SEQ ID NO: 827719 - DNA, 25 bp, Mus musculus
tctaggtgaaccgtcagagactctc

SEQ ID NO: 827720 - DNA, 25 bp, Mus musculus
tctaggtgaggtcgaagcatacttc

SEQ ID NO: 827721 - DNA, 25 bp, Mus musculus
tctaggtgaggtggaagcatacttc

SEQ ID NO: 827722 - DNA, 25 bp, Mus musculus
tctaggtgatccagtgcctgtgtag

SEQ ID NO: 827723 - DNA, 25 bp, Mus musculus
tctaggtgatcctgtgcctgtgtag

SEQ ID NO: 827724 - DNA, 25 bp, Mus musculus
tctaggttctacaggtccaccaagt

SEQ ID NO: 827725 - DNA, 25 bp, Mus musculus
tctaggttctactggtccaccaagt

SEQ ID NO: 827726 - DNA, 25 bp, Mus musculus
tctaggttctgtcctgagggttcaa

SEQ ID NO: 827727 - DNA, 25 bp, Mus musculus
tctaggttctgtgctgagggttcaa

SEQ ID NO: 827728 - DNA, 25 bp, Mus musculus
tctaggttctttatcaaacgcgtct

SEQ ID NO: 827729 - DNA, 25 bp, Mus musculus
tctaggttctttttcaaacgcgtct

SEQ ID NO: 827730 - DNA, 25 bp, Mus musculus
tctaggttgaggcatggtgcgggta

SEQ ID NO: 827731 - DNA, 25 bp, Mus musculus
tctaggttgagggatggtgcgggta

SEQ ID NO: 827732 - DNA, 25 bp, Mus musculus
tctaggttgattcctatgtgacggg

SEQ ID NO: 827733 - DNA, 25 bp, Mus musculus
tctaggttgattgctatgtgacggg

SEQ ID NO: 827734 - DNA, 25 bp, Mus musculus
tctagtaaaattccccacggaccct

SEQ ID NO: 827735 - DNA, 25 bp, Mus musculus
tctagtaaaattgcccacggaccct

SEQ ID NO: 827736 - DNA, 25 bp, Mus musculus
tctagtaaactcaagctagccagta

SEQ ID NO: 827737 - DNA, 25 bp, Mus musculus
tctagtaaactctagctagccagta

SEQ ID NO: 827738 - DNA, 25 bp, Mus musculus
tctagtacacaaacccactcgtgtt

SEQ ID NO: 827739 - DNA, 25 bp, Mus musculus
tctagtacacaatcccactcgtgtt

SEQ ID NO: 827740 - DNA, 25 bp, Mus musculus
tctagtagtgtaaacaagtcccttt

SEQ ID NO: 827741 - DNA, 25 bp, Mus musculus
tctagtagtgtatacaagtcccttt

SEQ ID NO: 827742 - DNA, 25 bp, Mus musculus
tctagtatccctatctgacatccat

SEQ ID NO: 827743 - DNA, 25 bp, Mus musculus
tctagtatccctttctgacatccat

SEQ ID NO: 827744 - DNA, 25 bp, Mus musculus
tctagtatggcacgtttcctttaag

SEQ ID NO: 827745 - DNA, 25 bp, Mus musculus
tctagtatggcaggtttcctttaag

SEQ ID NO: 827746 - DNA, 25 bp, Mus musculus
tctagtatttccattctctctgatt

SEQ ID NO: 827747 - DNA, 25 bp, Mus musculus
tctagtatttcctttctctctgatt

SEQ ID NO: 827748 - DNA, 25 bp, Mus musculus
tctagtcaccttcattagcatcttc

SEQ ID NO: 827749 - DNA, 25 bp, Mus musculus
tctagtcaccttgattagcatcttc

SEQ ID NO: 827750 - DNA, 25 bp, Mus musculus
tctagtcactggaatatttttgcta

SEQ ID NO: 827751 - DNA, 25 bp, Mus musculus
tctagtcactggtatatttttgcta

SEQ ID NO: 827752 - DNA, 25 bp, Mus musculus
tctagtcagaagaccctgggcaggt

SEQ ID NO: 827753 - DNA, 25 bp, Mus musculus
tctagtcagaagtccctgggcaggt

SEQ ID NO: 827754 - DNA, 25 bp, Mus musculus
tctagtcattcccagaccgtgagct

SEQ ID NO: 827755 - DNA, 25 bp, Mus musculus
tctagtcattccgagaccgtgagct

SEQ ID NO: 827756 - DNA, 25 bp, Mus musculus
tctagtcattgaacacatccaggtg

SEQ ID NO: 827757 - DNA, 25 bp, Mus musculus
tctagtcattgatcacatccaggtg

SEQ ID NO: 827758 - DNA, 25 bp, Mus musculus
tctagtcccgtccatcagcaacaag

SEQ ID NO: 827759 - DNA, 25 bp, Mus musculus
tctagtcccgtcgatcagcaacaag

SEQ ID NO: 827760 - DNA, 25 bp, Mus musculus
tctagtccggcgagcccgtggtgta

SEQ ID NO: 827761 - DNA, 25 bp, Mus musculus
tctagtccggcgtgcccgtggtgta

SEQ ID NO: 827762 - DNA, 25 bp, Mus musculus
tctagtccgttaagtaaccccaagt

SEQ ID NO: 827763 - DNA, 25 bp, Mus musculus
tctagtccgttatgtaaccccaagt

SEQ ID NO: 827764 - DNA, 25 bp, Mus musculus
tctagtcctagcagggcagccatga

SEQ ID NO: 827765 - DNA, 25 bp, Mus musculus
tctagtcctagctgggcagccatga

SEQ ID NO: 827766 - DNA, 25 bp, Mus musculus
tctagtcctgtgagcccgtggtgta

SEQ ID NO: 827767 - DNA, 25 bp, Mus musculus
tctagtcctgtgtgcccgtggtgta

SEQ ID NO: 827768 - DNA, 25 bp, Mus musculus
tctagtcctgttacactcccaagta

SEQ ID NO: 827769 - DNA, 25 bp, Mus musculus
tctagtcctgtttcactcccaagta

SEQ ID NO: 827770 - DNA, 25 bp, Mus musculus
tctagtcctttgagagaatctctga

SEQ ID NO: 827771 - DNA, 25 bp, Mus musculus
tctagtcctttgtgagaatctctga

SEQ ID NO: 827772 - DNA, 25 bp, Mus musculus
tctagtcgacttataatgggctgtt

SEQ ID NO: 827773 - DNA, 25 bp, Mus musculus
tctagtcgacttttaatgggctgtt

SEQ ID NO: 827774 - DNA, 25 bp, Mus musculus
tctagtctctctccttctctttaat

SEQ ID NO: 827775 - DNA, 25 bp, Mus musculus
tctagtctctctgcttctctttaat

SEQ ID NO: 827776 - DNA, 25 bp, Mus musculus
tctagtctgactacctttccccttt

SEQ ID NO: 827777 - DNA, 25 bp, Mus musculus
tctagtctgacttcctttccccttt

SEQ ID NO: 827778 - DNA, 25 bp, Mus musculus
tctagtctttttcatcacagtcata

SEQ ID NO: 827779 - DNA, 25 bp, Mus musculus
tctagtctttttgatcacagtcata

SEQ ID NO: 827780 - DNA, 25 bp, Mus musculus
tctagtgaacacagatgtgcatttg

SEQ ID NO: 827781 - DNA, 25 bp, Mus musculus
tctagtgaacactgatgtgcatttg

SEQ ID NO: 827782 - DNA, 25 bp, Mus musculus
tctagtgaacccagattcgccactg

SEQ ID NO: 827783 - DNA, 25 bp, Mus musculus
tctagtgaaccctgattcgccactg

SEQ ID NO: 827784 - DNA, 25 bp, Mus musculus
tctagtgaattaccccttttcctga

SEQ ID NO: 827785 - DNA, 25 bp, Mus musculus
tctagtgaattagcccttttcctga

SEQ ID NO: 827786 - DNA, 25 bp, Mus musculus
tctagtgagcccagagcagcaatgt

SEQ ID NO: 827787 - DNA, 25 bp, Mus musculus
tctagtgagccctgagcagcaatgt

SEQ ID NO: 827788 - DNA, 25 bp, Mus musculus
tctagtgagcttctgatctgtggag

SEQ ID NO: 827789 - DNA, 25 bp, Mus musculus
tctagtgagcttgtgatctgtggag

SEQ ID NO: 827790 - DNA, 25 bp, Mus musculus
tctagtgatcctatagcctcctgac

SEQ ID NO: 827791 - DNA, 25 bp, Mus musculus
tctagtgatcctttagcctcctgac

SEQ ID NO: 827792 - DNA, 25 bp, Mus musculus
tctagtgatgcccacattcagctct

SEQ ID NO: 827793 - DNA, 25 bp, Mus musculus
tctagtgatgccgacattcagctct

SEQ ID NO: 827794 - DNA, 25 bp, Mus musculus
tctagtgcacacactaacctggttc

SEQ ID NO: 827795 - DNA, 25 bp, Mus musculus
tctagtgcacactctaacctggttc

SEQ ID NO: 827796 - DNA, 25 bp, Mus musculus
tctagtgcacggagggcttccagga

SEQ ID NO: 827797 - DNA, 25 bp, Mus musculus
tctagtgcacggtgggcttccagga

SEQ ID NO: 827798 - DNA, 25 bp, Mus musculus
tctagtgcctgcagtatgccagata

SEQ ID NO: 827799 - DNA, 25 bp, Mus musculus
tctagtgcctgctgtatgccagata

SEQ ID NO: 827800 - DNA, 25 bp, Mus musculus
tctagtgccttccttgggaccagtg

SEQ ID NO: 827801 - DNA, 25 bp, Mus musculus
tctagtgccttcgttgggaccagtg

SEQ ID NO: 827802 - DNA, 25 bp, Mus musculus
tctagtgctgctccctctaaaattt

SEQ ID NO: 827803 - DNA, 25 bp, Mus musculus
tctagtgctgctgcctctaaaattt

SEQ ID NO: 827804 - DNA, 25 bp, Mus musculus
tctagtgctgtcagctttcagggaa

SEQ ID NO: 827805 - DNA, 25 bp, Mus musculus
tctagtgctgtctgctttcagggaa

SEQ ID NO: 827806 - DNA, 25 bp, Mus musculus
tctagtggatttaccttgtgtgccc

SEQ ID NO: 827807 - DNA, 25 bp, Mus musculus
tctagtggattttccttgtgtgccc

SEQ ID NO: 827808 - DNA, 25 bp, Mus musculus
tctagtggtgctaaaatttgttttg

SEQ ID NO: 827809 - DNA, 25 bp, Mus musculus
tctagtggtgcttaaatttgttttg

SEQ ID NO: 827810 - DNA, 25 bp, Mus musculus
tctagtgtatagattcaggtctcat

SEQ ID NO: 827811 - DNA, 25 bp, Mus musculus
tctagtgtatagtttcaggtctcat

SEQ ID NO: 827812 - DNA, 25 bp, Mus musculus
tctagtgtcagtccttacagtacaa

SEQ ID NO: 827813 - DNA, 25 bp, Mus musculus
tctagtgtcagtgcttacagtacaa

SEQ ID NO: 827814 - DNA, 25 bp, Mus musculus
tctagtgtctccaggtccaagggat

SEQ ID NO: 827815 - DNA, 25 bp, Mus musculus
tctagtgtctcctggtccaagggat

SEQ ID NO: 827816 - DNA, 25 bp, Mus musculus
tctagtgtgaatccctactttccat

SEQ ID NO: 827817 - DNA, 25 bp, Mus musculus
tctagtgtgaatgcctactttccat

SEQ ID NO: 827818 - DNA, 25 bp, Mus musculus
tctagtgtgtatcgatctgggatct

SEQ ID NO: 827819 - DNA, 25 bp, Mus musculus
tctagtgtgtatggatctgggatct

SEQ ID NO: 827820 - DNA, 25 bp, Mus musculus
tctagtgttgctactcgtgttggac

SEQ ID NO: 827821 - DNA, 25 bp, Mus musculus
tctagtgttgcttctcgtgttggac

SEQ ID NO: 827822 - DNA, 25 bp, Mus musculus
tctagttaaaacatcgtgctcccca

SEQ ID NO: 827823 - DNA, 25 bp, Mus musculus
tctagttaaaacttcgtgctcccca

SEQ ID NO: 827824 - DNA, 25 bp, Mus musculus
tctagttactttaccgtcttgaagg

SEQ ID NO: 827825 - DNA, 25 bp, Mus musculus
tctagttacttttccgtcttgaagg

SEQ ID NO: 827826 - DNA, 25 bp, Mus musculus
tctagttagctgacccctggttgca

SEQ ID NO: 827827 - DNA, 25 bp, Mus musculus
tctagttagctgtcccctggttgca

SEQ ID NO: 827828 - DNA, 25 bp, Mus musculus
tctagttccaggatacatccagcca

SEQ ID NO: 827829 - DNA, 25 bp, Mus musculus
tctagttccaggttacatccagcca

SEQ ID NO: 827830 - DNA, 25 bp, Mus musculus
tctagttctgataatgattttctta

SEQ ID NO: 827831 - DNA, 25 bp, Mus musculus
tctagttctgattatgattttctta

SEQ ID NO: 827832 - DNA, 25 bp, Mus musculus
tctagttctgtgaaaggtgggctgc

SEQ ID NO: 827833 - DNA, 25 bp, Mus musculus
tctagttctgtgtaaggtgggctgc

SEQ ID NO: 827834 - DNA, 25 bp, Mus musculus
tctagttcttagctttcctagccat

SEQ ID NO: 827835 - DNA, 25 bp, Mus musculus
tctagttcttaggtttcctagccat

SEQ ID NO: 827836 - DNA, 25 bp, Mus musculus
tctagttgccaactaggaattcctt

SEQ ID NO: 827837 - DNA, 25 bp, Mus musculus
tctagttgccaagtaggaattcctt

SEQ ID NO: 827838 - DNA, 25 bp, Mus musculus
tctagttgcttcagcacacttccaa

SEQ ID NO: 827839 - DNA, 25 bp, Mus musculus
tctagttgcttctgcacacttccaa

SEQ ID NO: 827840 - DNA, 25 bp, Mus musculus
tctagttgggaaaggcttgtggaaa

SEQ ID NO: 827841 - DNA, 25 bp, Mus musculus
tctagttgggaatggcttgtggaaa

SEQ ID NO: 827842 - DNA, 25 bp, Mus musculus
tctagttggtaactgggctcgtgcc

SEQ ID NO: 827843 - DNA, 25 bp, Mus musculus
tctagttggtaagtgggctcgtgcc

SEQ ID NO: 827844 - DNA, 25 bp, Mus musculus
tctagttgtagactacttcctgttt

SEQ ID NO: 827845 - DNA, 25 bp, Mus musculus
tctagttgtagagtacttcctgttt

SEQ ID NO: 827846 - DNA, 25 bp, Mus musculus
tctagttgtctgatgctgctcactg

SEQ ID NO: 827847 - DNA, 25 bp, Mus musculus
tctagttgtctgttgctgctcactg

SEQ ID NO: 827848 - DNA, 25 bp, Mus musculus
tctagtttacccaggagcccttggt

SEQ ID NO: 827849 - DNA, 25 bp, Mus musculus
tctagtttaccctggagcccttggt

SEQ ID NO: 827850 - DNA, 25 bp, Mus musculus
tctagtttatagaggcttgccaccc

SEQ ID NO: 827851 - DNA, 25 bp, Mus musculus
tctagtttatagtggcttgccaccc

SEQ ID NO: 827852 - DNA, 25 bp, Mus musculus
tctagtttcaagaggatctgacaca

SEQ ID NO: 827853 - DNA, 25 bp, Mus musculus
tctagtttcaagtggatctgacaca

SEQ ID NO: 827854 - DNA, 25 bp, Mus musculus
tctagtttcagcctaatctttggtg

SEQ ID NO: 827855 - DNA, 25 bp, Mus musculus
tctagtttcagcgtaatctttggtg

SEQ ID NO: 827856 - DNA, 25 bp, Mus musculus
tctagtttcatcagagtgtctctct

SEQ ID NO: 827857 - DNA, 25 bp, Mus musculus
tctagtttcatctgagtgtctctct

SEQ ID NO: 827858 - DNA, 25 bp, Mus musculus
tctagtttcctgagtgatatcccaa

SEQ ID NO: 827859 - DNA, 25 bp, Mus musculus
tctagtttcctgtgtgatatcccaa

SEQ ID NO: 827860 - DNA, 25 bp, Mus musculus
tctagtttctaacccctcgcgtaga

SEQ ID NO: 827861 - DNA, 25 bp, Mus musculus
tctagtttctaagccctcgcgtaga

SEQ ID NO: 827862 - DNA, 25 bp, Mus musculus
tctagtttctcaccagtggtccaga

SEQ ID NO: 827863 - DNA, 25 bp, Mus musculus
tctagtttctcagcagtggtccaga

SEQ ID NO: 827864 - DNA, 25 bp, Mus musculus
tctagtttggctagtgacttgagaa

SEQ ID NO: 827865 - DNA, 25 bp, Mus musculus
tctagtttggcttgtgacttgagaa

SEQ ID NO: 827866 - DNA, 25 bp, Mus musculus
tctagtttgtatctgtcagtctcca

SEQ ID NO: 827867 - DNA, 25 bp, Mus musculus
tctagtttgtatgtgtcagtctcca

SEQ ID NO: 827868 - DNA, 25 bp, Mus musculus
tctagtttgtgtccattgtcctttc

SEQ ID NO: 827869 - DNA, 25 bp, Mus musculus
tctagtttgtgtgcattgtcctttc

SEQ ID NO: 827870 - DNA, 25 bp, Mus musculus
tctagttttaccacttttgtgtgtg

SEQ ID NO: 827871 - DNA, 25 bp, Mus musculus
tctagttttacctcttttgtgtgtg

SEQ ID NO: 827872 - DNA, 25 bp, Mus musculus
tctagttttacgcagtcggagtact

SEQ ID NO: 827873 - DNA, 25 bp, Mus musculus
tctagttttacggagtcggagtact

SEQ ID NO: 827874 - DNA, 25 bp, Mus musculus
tctagttttcacaccccagtgaggg

SEQ ID NO: 827875 - DNA, 25 bp, Mus musculus
tctagttttcactccccagtgaggg

SEQ ID NO: 827876 - DNA, 25 bp, Mus musculus
tctagttttctgaggttcttccttc

SEQ ID NO: 827877 - DNA, 25 bp, Mus musculus
tctagttttctgtggttcttccttc

SEQ ID NO: 827878 - DNA, 25 bp, Mus musculus
tctagttttcttatcactgggcagt

SEQ ID NO: 827879 - DNA, 25 bp, Mus musculus
tctagttttcttttcactgggcagt

SEQ ID NO: 827880 - DNA, 25 bp, Mus musculus
tctataacactaccagtctggccca

SEQ ID NO: 827881 - DNA, 25 bp, Mus musculus
tctataacactagcagtctggccca

SEQ ID NO: 827882 - DNA, 25 bp, Mus musculus
tctataacctagatcgtgcccaata

SEQ ID NO: 827883 - DNA, 25 bp, Mus musculus
tctataacctagttcgtgcccaata

SEQ ID NO: 827884 - DNA, 25 bp, Mus musculus
tctataagcaccacgtatccatgtt

SEQ ID NO: 827885 - DNA, 25 bp, Mus musculus
tctataagcacctcgtatccatgtt

SEQ ID NO: 827886 - DNA, 25 bp, Mus musculus
tctataagctcaccccagttgtgcc

SEQ ID NO: 827887 - DNA, 25 bp, Mus musculus
tctataagctcagcccagttgtgcc

SEQ ID NO: 827888 - DNA, 25 bp, Mus musculus
tctataagtttcatctcagctttac

SEQ ID NO: 827889 - DNA, 25 bp, Mus musculus
tctataagtttcttctcagctttac

SEQ ID NO: 827890 - DNA, 25 bp, Mus musculus
tctataatgaaaaaggacccgaggg

SEQ ID NO: 827891 - DNA, 25 bp, Mus musculus
tctataatgaaataggacccgaggg

SEQ ID NO: 827892 - DNA, 25 bp, Mus musculus
tctataatgcaaaacctttataagg

SEQ ID NO: 827893 - DNA, 25 bp, Mus musculus
tctataatgcaatacctttataagg

SEQ ID NO: 827894 - DNA, 25 bp, Mus musculus
tctatacatcttcttccacttttta

SEQ ID NO: 827895 - DNA, 25 bp, Mus musculus
tctatacatcttgttccacttttta

SEQ ID NO: 827896 - DNA, 25 bp, Mus musculus
tctataccatgcacatcactgatga

SEQ ID NO: 827897 - DNA, 25 bp, Mus musculus
tctataccatgctcatcactgatga

SEQ ID NO: 827898 - DNA, 25 bp, Mus musculus
tctatacctctaatttatcttttta

SEQ ID NO: 827899 - DNA, 25 bp, Mus musculus
tctatacctctattttatcttttta

SEQ ID NO: 827900 - DNA, 25 bp, Mus musculus
tctatacctttgcaccactggtggc

SEQ ID NO: 827901 - DNA, 25 bp, Mus musculus
tctatacctttggaccactggtggc

SEQ ID NO: 827902 - DNA, 25 bp, Mus musculus
tctatactcaataaccacacttaag

SEQ ID NO: 827903 - DNA, 25 bp, Mus musculus
tctatactcaattaccacacttaag

SEQ ID NO: 827904 - DNA, 25 bp, Mus musculus
tctatactccccaggaaggttttga

SEQ ID NO: 827905 - DNA, 25 bp, Mus musculus
tctatactcccctggaaggttttga

SEQ ID NO: 827906 - DNA, 25 bp, Mus musculus
tctatactctctacgatgccatcat

SEQ ID NO: 827907 - DNA, 25 bp, Mus musculus
tctatactctcttcgatgccatcat

SEQ ID NO: 827908 - DNA, 25 bp, Mus musculus
tctatactggatactgtaactatga

SEQ ID NO: 827909 - DNA, 25 bp, Mus musculus
tctatactggattctgtaactatga

SEQ ID NO: 827910 - DNA, 25 bp, Mus musculus
tctatacttgatctattcctggctt

SEQ ID NO: 827911 - DNA, 25 bp, Mus musculus
tctatacttgatgtattcctggctt

SEQ ID NO: 827912 - DNA, 25 bp, Mus musculus
tctatacttgtgagctggcttcata

SEQ ID NO: 827913 - DNA, 25 bp, Mus musculus
tctatacttgtgtgctggcttcata

SEQ ID NO: 827914 - DNA, 25 bp, Mus musculus
tctatagcatctagtttcctgttcc

SEQ ID NO: 827915 - DNA, 25 bp, Mus musculus
tctatagcatcttgtttcctgttcc

SEQ ID NO: 827916 - DNA, 25 bp, Mus musculus
tctatagctagaacttcatgagtgc

SEQ ID NO: 827917 - DNA, 25 bp, Mus musculus
tctatagctagatcttcatgagtgc

SEQ ID NO: 827918 - DNA, 25 bp, Mus musculus
tctatagcttgtctgacttcagtat

SEQ ID NO: 827919 - DNA, 25 bp, Mus musculus
tctatagcttgtgtgacttcagtat

SEQ ID NO: 827920 - DNA, 25 bp, Mus musculus
tctataggttctatgaccctgcctt

SEQ ID NO: 827921 - DNA, 25 bp, Mus musculus
tctataggttctttgaccctgcctt

SEQ ID NO: 827922 - DNA, 25 bp, Mus musculus
tctataggtttgctctaccctaggg

SEQ ID NO: 827923 - DNA, 25 bp, Mus musculus
tctataggtttggtctaccctaggg

SEQ ID NO: 827924 - DNA, 25 bp, Mus musculus
tctatagtcccacgccttaggaggc

SEQ ID NO: 827925 - DNA, 25 bp, Mus musculus
tctatagtcccaggccttaggaggc

SEQ ID NO: 827926 - DNA, 25 bp, Mus musculus
tctatagtgaacactgtgggcatct

SEQ ID NO: 827927 - DNA, 25 bp, Mus musculus
tctatagtgaactctgtgggcatct

SEQ ID NO: 827928 - DNA, 25 bp, Mus musculus
tctatagtgtctcttacctgctcaa

SEQ ID NO: 827929 - DNA, 25 bp, Mus musculus
tctatagtgtctgttacctgctcaa

SEQ ID NO: 827930 - DNA, 25 bp, Mus musculus
tctatataacaaccttggctctcct

SEQ ID NO: 827931 - DNA, 25 bp, Mus musculus
tctatataacaagcttggctctcct

SEQ ID NO: 827932 - DNA, 25 bp, Mus musculus
tctatataacccatgagaactcaga

SEQ ID NO: 827933 - DNA, 25 bp, Mus musculus
tctatataacccttgagaactcaga

SEQ ID NO: 827934 - DNA, 25 bp, Mus musculus
tctatatcttcacgcgcgcggtctg

SEQ ID NO: 827935 - DNA, 25 bp, Mus musculus
tctatatcttcaggcgcgcggtctg

SEQ ID NO: 827936 - DNA, 25 bp, Mus musculus
tctatatcttccacttcggattcga

SEQ ID NO: 827937 - DNA, 25 bp, Mus musculus
tctatatcttcctcttcggattcga

SEQ ID NO: 827938 - DNA, 25 bp, Mus musculus
tctatatgatctccctttgttccta

SEQ ID NO: 827939 - DNA, 25 bp, Mus musculus
tctatatgatctgcctttgttccta

SEQ ID NO: 827940 - DNA, 25 bp, Mus musculus
tctatatgattaagtgtccctggac

SEQ ID NO: 827941 - DNA, 25 bp, Mus musculus
tctatatgattatgtgtccctggac

SEQ ID NO: 827942 - DNA, 25 bp, Mus musculus
tctatattggatctggggccccaac

SEQ ID NO: 827943 - DNA, 25 bp, Mus musculus
tctatattggatgtggggccccaac

SEQ ID NO: 827944 - DNA, 25 bp, Mus musculus
tctatatttttgcgcagctttccct

SEQ ID NO: 827945 - DNA, 25 bp, Mus musculus
tctatatttttgggcagctttccct

SEQ ID NO: 827946 - DNA, 25 bp, Mus musculus
tctatcaactgacctataccgccag

SEQ ID NO: 827947 - DNA, 25 bp, Mus musculus
tctatcaactgagctataccgccag

SEQ ID NO: 827948 - DNA, 25 bp, Mus musculus
tctatcaactgtcttgcctttttca

SEQ ID NO: 827949 - DNA, 25 bp, Mus musculus
tctatcaactgtgttgcctttttca

SEQ ID NO: 827950 - DNA, 25 bp, Mus musculus
tctatcaagatcatccctagactct

SEQ ID NO: 827951 - DNA, 25 bp, Mus musculus
tctatcaagatcttccctagactct

SEQ ID NO: 827952 - DNA, 25 bp, Mus musculus
tctatcaataaaatcccactcaaag

SEQ ID NO: 827953 - DNA, 25 bp, Mus musculus
tctatcaataaattcccactcaaag

SEQ ID NO: 827954 - DNA, 25 bp, Mus musculus
tctatcacttttctatggcccctgt

SEQ ID NO: 827955 - DNA, 25 bp, Mus musculus
tctatcacttttgtatggcccctgt

SEQ ID NO: 827956 - DNA, 25 bp, Mus musculus
tctatcagatctcccactgtgcagg

SEQ ID NO: 827957 - DNA, 25 bp, Mus musculus
tctatcagatctgccactgtgcagg

SEQ ID NO: 827958 - DNA, 25 bp, Mus musculus
tctatcagatttctggctttagctc

SEQ ID NO: 827959 - DNA, 25 bp, Mus musculus
tctatcagatttgtggctttagctc

SEQ ID NO: 827960 - DNA, 25 bp, Mus musculus
tctatcagcgtgaacaggacatcct

SEQ ID NO: 827961 - DNA, 25 bp, Mus musculus
tctatcagcgtgtacaggacatcct

SEQ ID NO: 827962 - DNA, 25 bp, Mus musculus
tctatcagtccccaggcttagacag

SEQ ID NO: 827963 - DNA, 25 bp, Mus musculus
tctatcagtcccgaggcttagacag

SEQ ID NO: 827964 - DNA, 25 bp, Mus musculus
tctatcatcgtcacacaaaccgagc

SEQ ID NO: 827965 - DNA, 25 bp, Mus musculus
tctatcatcgtctcacaaaccgagc

SEQ ID NO: 827966 - DNA, 25 bp, Mus musculus
tctatcatgtttcctaaatgcagca

SEQ ID NO: 827967 - DNA, 25 bp, Mus musculus
tctatcatgtttgctaaatgcagca

SEQ ID NO: 827968 - DNA, 25 bp, Mus musculus
tctatccaaccaaatccacaaatac

SEQ ID NO: 827969 - DNA, 25 bp, Mus musculus
tctatccaaccatatccacaaatac

SEQ ID NO: 827970 - DNA, 25 bp, Mus musculus
tctatccaagttccgcaagatccag

SEQ ID NO: 827971 - DNA, 25 bp, Mus musculus
tctatccaagttgcgcaagatccag

SEQ ID NO: 827972 - DNA, 25 bp, Mus musculus
tctatccacaggaaaatttcatcag

SEQ ID NO: 827973 - DNA, 25 bp, Mus musculus
tctatccacaggtaaatttcatcag

SEQ ID NO: 827974 - DNA, 25 bp, Mus musculus
tctatccaccacaagtctatttctg

SEQ ID NO: 827975 - DNA, 25 bp, Mus musculus
tctatccaccactagtctatttctg

SEQ ID NO: 827976 - DNA, 25 bp, Mus musculus
tctatccaccagctcttcagacaga

SEQ ID NO: 827977 - DNA, 25 bp, Mus musculus
tctatccaccaggtcttcagacaga

SEQ ID NO: 827978 - DNA, 25 bp, Mus musculus
tctatccagaccaaaatacaagttt

SEQ ID NO: 827979 - DNA, 25 bp, Mus musculus
tctatccagacctaaatacaagttt

SEQ ID NO: 827980 - DNA, 25 bp, Mus musculus
tctatccataagattgcagcttcat

SEQ ID NO: 827981 - DNA, 25 bp, Mus musculus
tctatccataagtttgcagcttcat

SEQ ID NO: 827982 - DNA, 25 bp, Mus musculus
tctatccatcggactttccttttca

SEQ ID NO: 827983 - DNA, 25 bp, Mus musculus
tctatccatcggtctttccttttca

SEQ ID NO: 827984 - DNA, 25 bp, Mus musculus
tctatccatgttcaagctccttgta

SEQ ID NO: 827985 - DNA, 25 bp, Mus musculus
tctatccatgttgaagctccttgta

SEQ ID NO: 827986 - DNA, 25 bp, Mus musculus
tctatcccaacaccaaggatatgga

SEQ ID NO: 827987 - DNA, 25 bp, Mus musculus
tctatcccaacagcaaggatatgga

SEQ ID NO: 827988 - DNA, 25 bp, Mus musculus
tctatcccaataaacaaagggccac

SEQ ID NO: 827989 - DNA, 25 bp, Mus musculus
tctatcccaatatacaaagggccac

SEQ ID NO: 827990 - DNA, 25 bp, Mus musculus
tctatcccagatcctgtcaaacttg

SEQ ID NO: 827991 - DNA, 25 bp, Mus musculus
tctatcccagatgctgtcaaacttg

SEQ ID NO: 827992 - DNA, 25 bp, Mus musculus
tctatcccaggaaatagatcctttt

SEQ ID NO: 827993 - DNA, 25 bp, Mus musculus
tctatcccaggatatagatcctttt

SEQ ID NO: 827994 - DNA, 25 bp, Mus musculus
tctatccctctcacccaggagcaaa

SEQ ID NO: 827995 - DNA, 25 bp, Mus musculus
tctatccctctctcccaggagcaaa

SEQ ID NO: 827996 - DNA, 25 bp, Mus musculus
tctatccctgacagccccagtaaag

SEQ ID NO: 827997 - DNA, 25 bp, Mus musculus
tctatccctgactgccccagtaaag

SEQ ID NO: 827998 - DNA, 25 bp, Mus musculus
tctatccctgatccctgagtgacta

SEQ ID NO: 827999 - DNA, 25 bp, Mus musculus
tctatccctgatgcctgagtgacta

SEQ ID NO: 828000 - DNA, 25 bp, Mus musculus
tctatccctggtacagaagagcctt

SEQ ID NO: 828001 - DNA, 25 bp, Mus musculus
tctatccctggttcagaagagcctt

SEQ ID NO: 828002 - DNA, 25 bp, Mus musculus
tctatcccttatccatcagaggagt

SEQ ID NO: 828003 - DNA, 25 bp, Mus musculus
tctatcccttatgcatcagaggagt

SEQ ID NO: 828004 - DNA, 25 bp, Mus musculus
tctatccgtggcacaccggcggtga

SEQ ID NO: 828005 - DNA, 25 bp, Mus musculus
tctatccgtggctcaccggcggtga

SEQ ID NO: 828006 - DNA, 25 bp, Mus musculus
tctatcctaatcctcgagctacaga

SEQ ID NO: 828007 - DNA, 25 bp, Mus musculus
tctatcctaatcgtcgagctacaga

SEQ ID NO: 828008 - DNA, 25 bp, Mus musculus
tctatcctccaacatcagctgggat

SEQ ID NO: 828009 - DNA, 25 bp, Mus musculus
tctatcctccaagatcagctgggat

SEQ ID NO: 828010 - DNA, 25 bp, Mus musculus
tctatcctccctagtgaaaccatga

SEQ ID NO: 828011 - DNA, 25 bp, Mus musculus
tctatcctcccttgtgaaaccatga

SEQ ID NO: 828012 - DNA, 25 bp, Mus musculus
tctatcctgggtcgttcccgttaga

SEQ ID NO: 828013 - DNA, 25 bp, Mus musculus
tctatcctgggtggttcccgttaga

SEQ ID NO: 828014 - DNA, 25 bp, Mus musculus
tctatccttgctcatttttcctaaa

SEQ ID NO: 828015 - DNA, 25 bp, Mus musculus
tctatccttgctgatttttcctaaa

SEQ ID NO: 828016 - DNA, 25 bp, Mus musculus
tctatcgctcccctgggcagaagaa

SEQ ID NO: 828017 - DNA, 25 bp, Mus musculus
tctatcgctcccgtgggcagaagaa

SEQ ID NO: 828018 - DNA, 25 bp, Mus musculus
tctatcgtaagtaacacctcagtga

SEQ ID NO: 828019 - DNA, 25 bp, Mus musculus
tctatcgtaagttacacctcagtga

SEQ ID NO: 828020 - DNA, 25 bp, Mus musculus
tctatcgtcagacctacccatggac

SEQ ID NO: 828021 - DNA, 25 bp, Mus musculus
tctatcgtcagagctacccatggac

SEQ ID NO: 828022 - DNA, 25 bp, Mus musculus
tctatcgtgctcagctagagttgct

SEQ ID NO: 828023 - DNA, 25 bp, Mus musculus
tctatcgtgctctgctagagttgct

SEQ ID NO: 828024 - DNA, 25 bp, Mus musculus
tctatcgtgctgatcttcagaatat

SEQ ID NO: 828025 - DNA, 25 bp, Mus musculus
tctatcgtgctgttcttcagaatat

SEQ ID NO: 828026 - DNA, 25 bp, Mus musculus
tctatctaacttcttctgagtcctc

SEQ ID NO: 828027 - DNA, 25 bp, Mus musculus
tctatctaacttgttctgagtcctc

SEQ ID NO: 828028 - DNA, 25 bp, Mus musculus
tctatctaagtaccccagtgagact

SEQ ID NO: 828029 - DNA, 25 bp, Mus musculus
tctatctaagtagcccagtgagact

SEQ ID NO: 828030 - DNA, 25 bp, Mus musculus
tctatctacatgctgttttcctccc

SEQ ID NO: 828031 - DNA, 25 bp, Mus musculus
tctatctacatggtgttttcctccc

SEQ ID NO: 828032 - DNA, 25 bp, Mus musculus
tctatctacttaacccatctcattt

SEQ ID NO: 828033 - DNA, 25 bp, Mus musculus
tctatctacttatcccatctcattt

SEQ ID NO: 828034 - DNA, 25 bp, Mus musculus
tctatctactttcaacccagttcta

SEQ ID NO: 828035 - DNA, 25 bp, Mus musculus
tctatctactttgaacccagttcta

SEQ ID NO: 828036 - DNA, 25 bp, Mus musculus
tctatctcactgattacccttacaa

SEQ ID NO: 828037 - DNA, 25 bp, Mus musculus
tctatctcactgtttacccttacaa

SEQ ID NO: 828038 - DNA, 25 bp, Mus musculus
tctatctcgtgtccccagtttcagg

SEQ ID NO: 828039 - DNA, 25 bp, Mus musculus
tctatctcgtgtgcccagtttcagg

SEQ ID NO: 828040 - DNA, 25 bp, Mus musculus
tctatctcgtttattcttgtacttt

SEQ ID NO: 828041 - DNA, 25 bp, Mus musculus
tctatctcgttttttcttgtacttt

SEQ ID NO: 828042 - DNA, 25 bp, Mus musculus
tctatctctataattttgggcagct

SEQ ID NO: 828043 - DNA, 25 bp, Mus musculus
tctatctctatatttttgggcagct

SEQ ID NO: 828044 - DNA, 25 bp, Mus musculus
tctatctctctgctcctaatttgta

SEQ ID NO: 828045 - DNA, 25 bp, Mus musculus
tctatctctctggtcctaatttgta

SEQ ID NO: 828046 - DNA, 25 bp, Mus musculus
tctatctgaatgactttcattgaat

SEQ ID NO: 828047 - DNA, 25 bp, Mus musculus
tctatctgaatgtctttcattgaat

SEQ ID NO: 828048 - DNA, 25 bp, Mus musculus
tctatctggctgcagtctatgggca

SEQ ID NO: 828049 - DNA, 25 bp, Mus musculus
tctatctggctggagtctatgggca

SEQ ID NO: 828050 - DNA, 25 bp, Mus musculus
tctatctggtgtctttgccctctgg

SEQ ID NO: 828051 - DNA, 25 bp, Mus musculus
tctatctggtgtgtttgccctctgg

SEQ ID NO: 828052 - DNA, 25 bp, Mus musculus
tctatctgtatgaagtctgtggcac

SEQ ID NO: 828053 - DNA, 25 bp, Mus musculus
tctatctgtatgtagtctgtggcac

SEQ ID NO: 828054 - DNA, 25 bp, Mus musculus
tctatcttcaaacctactagttcgt

SEQ ID NO: 828055 - DNA, 25 bp, Mus musculus
tctatcttcaaagctactagttcgt

SEQ ID NO: 828056 - DNA, 25 bp, Mus musculus
tctatcttcgcaacgcttcttaaag

SEQ ID NO: 828057 - DNA, 25 bp, Mus musculus
tctatcttcgcatcgcttcttaaag

SEQ ID NO: 828058 - DNA, 25 bp, Mus musculus
tctatcttctgtaccacccaaacaa

SEQ ID NO: 828059 - DNA, 25 bp, Mus musculus
tctatcttctgttccacccaaacaa

SEQ ID NO: 828060 - DNA, 25 bp, Mus musculus
tctatctttaaaccggacacacaca

SEQ ID NO: 828061 - DNA, 25 bp, Mus musculus
tctatctttaaagcggacacacaca

SEQ ID NO: 828062 - DNA, 25 bp, Mus musculus
tctatctttgcaatctttccaacca

SEQ ID NO: 828063 - DNA, 25 bp, Mus musculus
tctatctttgcattctttccaacca

SEQ ID NO: 828064 - DNA, 25 bp, Mus musculus
tctatctttttgcaggaatctccat

SEQ ID NO: 828065 - DNA, 25 bp, Mus musculus
tctatctttttggaggaatctccat

SEQ ID NO: 828066 - DNA, 25 bp, Mus musculus
tctatgaactgcaggtaaacatgaa

SEQ ID NO: 828067 - DNA, 25 bp, Mus musculus
tctatgaactgctggtaaacatgaa

SEQ ID NO: 828068 - DNA, 25 bp, Mus musculus
tctatgaagcaaagatatgacccca

SEQ ID NO: 828069 - DNA, 25 bp, Mus musculus
tctatgaagcaatgatatgacccca

SEQ ID NO: 828070 - DNA, 25 bp, Mus musculus
tctatgaaggtgatggatccccaag

SEQ ID NO: 828071 - DNA, 25 bp, Mus musculus
tctatgaaggtgttggatccccaag

SEQ ID NO: 828072 - DNA, 25 bp, Mus musculus
tctatgaaggttatgctgaaggtac

SEQ ID NO: 828073 - DNA, 25 bp, Mus musculus
tctatgaaggttttgctgaaggtac

SEQ ID NO: 828074 - DNA, 25 bp, Mus musculus
tctatgacaaatcccctttactttc

SEQ ID NO: 828075 - DNA, 25 bp, Mus musculus
tctatgacaaatgccctttactttc

SEQ ID NO: 828076 - DNA, 25 bp, Mus musculus
tctatgacctaccatccgatcctaa

SEQ ID NO: 828077 - DNA, 25 bp, Mus musculus
tctatgacctacgatccgatcctaa

SEQ ID NO: 828078 - DNA, 25 bp, Mus musculus
tctatgactggaagatttgacccgt

SEQ ID NO: 828079 - DNA, 25 bp, Mus musculus
tctatgactggatgatttgacccgt

SEQ ID NO: 828080 - DNA, 25 bp, Mus musculus
tctatgactgtgaggtggatcactg

SEQ ID NO: 828081 - DNA, 25 bp, Mus musculus
tctatgactgtgtggtggatcactg

SEQ ID NO: 828082 - DNA, 25 bp, Mus musculus
tctatgagaccaaccagcgctggag

SEQ ID NO: 828083 - DNA, 25 bp, Mus musculus
tctatgagaccatccagcgctggag

SEQ ID NO: 828084 - DNA, 25 bp, Mus musculus
tctatgagacttaccttttcttagt

SEQ ID NO: 828085 - DNA, 25 bp, Mus musculus
tctatgagactttccttttcttagt

SEQ ID NO: 828086 - DNA, 25 bp, Mus musculus
tctatgaggaccatgtgcacatcct

SEQ ID NO: 828087 - DNA, 25 bp, Mus musculus
tctatgaggaccttgtgcacatcct

SEQ ID NO: 828088 - DNA, 25 bp, Mus musculus
tctatgagtgctcgctcagtttcct

SEQ ID NO: 828089 - DNA, 25 bp, Mus musculus
tctatgagtgctggctcagtttcct

SEQ ID NO: 828090 - DNA, 25 bp, Mus musculus
tctatgagtttccacaccagcctga

SEQ ID NO: 828091 - DNA, 25 bp, Mus musculus
tctatgagtttcgacaccagcctga

SEQ ID NO: 828092 - DNA, 25 bp, Mus musculus
tctatgatcccacaggtgagccttt

SEQ ID NO: 828093 - DNA, 25 bp, Mus musculus
tctatgatcccagaggtgagccttt

SEQ ID NO: 828094 - DNA, 25 bp, Mus musculus
tctatgatctctactggcaggccat

SEQ ID NO: 828095 - DNA, 25 bp, Mus musculus
tctatgatctcttctggcaggccat

SEQ ID NO: 828096 - DNA, 25 bp, Mus musculus
tctatgcaactgagtcccaaggact

SEQ ID NO: 828097 - DNA, 25 bp, Mus musculus
tctatgcaactgtgtcccaaggact

SEQ ID NO: 828098 - DNA, 25 bp, Mus musculus
tctatgcacacaaggcccaggtgag

SEQ ID NO: 828099 - DNA, 25 bp, Mus musculus
tctatgcacacatggcccaggtgag

SEQ ID NO: 828100 - DNA, 25 bp, Mus musculus
tctatgccaaatcctttcaccattg

SEQ ID NO: 828101 - DNA, 25 bp, Mus musculus
tctatgccaaatgctttcaccattg

SEQ ID NO: 828102 - DNA, 25 bp, Mus musculus
tctatgccccgtagtcgtgatcaga

SEQ ID NO: 828103 - DNA, 25 bp, Mus musculus
tctatgccccgttgtcgtgatcaga

SEQ ID NO: 828104 - DNA, 25 bp, Mus musculus
tctatgccctgcatttgggatgcta

SEQ ID NO: 828105 - DNA, 25 bp, Mus musculus
tctatgccctgcttttgggatgcta

SEQ ID NO: 828106 - DNA, 25 bp, Mus musculus
tctatgctagagaggtcctccctga

SEQ ID NO: 828107 - DNA, 25 bp, Mus musculus
tctatgctagagtggtcctccctga

SEQ ID NO: 828108 - DNA, 25 bp, Mus musculus
tctatgctccttaatgaacaatgaa

SEQ ID NO: 828109 - DNA, 25 bp, Mus musculus
tctatgctcctttatgaacaatgaa

SEQ ID NO: 828110 - DNA, 25 bp, Mus musculus
tctatgctgtaactggtcctgtcaa

SEQ ID NO: 828111 - DNA, 25 bp, Mus musculus
tctatgctgtaagtggtcctgtcaa

SEQ ID NO: 828112 - DNA, 25 bp, Mus musculus
tctatggaacacagattcttttcat

SEQ ID NO: 828113 - DNA, 25 bp, Mus musculus
tctatggaacactgattcttttcat

SEQ ID NO: 828114 - DNA, 25 bp, Mus musculus
tctatggaacagctttgaggccaga

SEQ ID NO: 828115 - DNA, 25 bp, Mus musculus
tctatggaacaggtttgaggccaga

SEQ ID NO: 828116 - DNA, 25 bp, Mus musculus
tctatggacctacctccttatctag

SEQ ID NO: 828117 - DNA, 25 bp, Mus musculus
tctatggacctagctccttatctag

SEQ ID NO: 828118 - DNA, 25 bp, Mus musculus
tctatggactggaagcaagcctggt

SEQ ID NO: 828119 - DNA, 25 bp, Mus musculus
tctatggactggtagcaagcctggt

SEQ ID NO: 828120 - DNA, 25 bp, Mus musculus
tctatggagagcagtgctgaatcct

SEQ ID NO: 828121 - DNA, 25 bp, Mus musculus
tctatggagagctgtgctgaatcct

SEQ ID NO: 828122 - DNA, 25 bp, Mus musculus
tctatggagcccctcaggatgtgaa

SEQ ID NO: 828123 - DNA, 25 bp, Mus musculus
tctatggagcccgtcaggatgtgaa

SEQ ID NO: 828124 - DNA, 25 bp, Mus musculus
tctatggagtcgaggtgcctgcaga

SEQ ID NO: 828125 - DNA, 25 bp, Mus musculus
tctatggagtcgtggtgcctgcaga

SEQ ID NO: 828126 - DNA, 25 bp, Mus musculus
tctatggccaccagatgcttatgtg

SEQ ID NO: 828127 - DNA, 25 bp, Mus musculus
tctatggccacctgatgcttatgtg

SEQ ID NO: 828128 - DNA, 25 bp, Mus musculus
tctatggccaggactctctgatgat

SEQ ID NO: 828129 - DNA, 25 bp, Mus musculus
tctatggccaggtctctctgatgat

SEQ ID NO: 828130 - DNA, 25 bp, Mus musculus
tctatggccatactgtcactgtggt

SEQ ID NO: 828131 - DNA, 25 bp, Mus musculus
tctatggccatagtgtcactgtggt

SEQ ID NO: 828132 - DNA, 25 bp, Mus musculus
tctatggcgatgaggcaaagcaagc

SEQ ID NO: 828133 - DNA, 25 bp, Mus musculus
tctatggcgatgtggcaaagcaagc

SEQ ID NO: 828134 - DNA, 25 bp, Mus musculus
tctatggcgggtactccggtctcgt

SEQ ID NO: 828135 - DNA, 25 bp, Mus musculus
tctatggcgggttctccggtctcgt

SEQ ID NO: 828136 - DNA, 25 bp, Mus musculus
tctatggctctcactgagacctgcc

SEQ ID NO: 828137 - DNA, 25 bp, Mus musculus
tctatggctctctctgagacctgcc

SEQ ID NO: 828138 - DNA, 25 bp, Mus musculus
tctatgggaaatctggtgtcctctt

SEQ ID NO: 828139 - DNA, 25 bp, Mus musculus
tctatgggaaatgtggtgtcctctt

SEQ ID NO: 828140 - DNA, 25 bp, Mus musculus
tctatgggacccatttttagtcaaa

SEQ ID NO: 828141 - DNA, 25 bp, Mus musculus
tctatgggacccttttttagtcaaa

SEQ ID NO: 828142 - DNA, 25 bp, Mus musculus
tctatgggttgtattatggaattta

SEQ ID NO: 828143 - DNA, 25 bp, Mus musculus
tctatgggttgttttatggaattta

SEQ ID NO: 828144 - DNA, 25 bp, Mus musculus
tctatggtacataggctcggcttta

SEQ ID NO: 828145 - DNA, 25 bp, Mus musculus
tctatggtacattggctcggcttta

SEQ ID NO: 828146 - DNA, 25 bp, Mus musculus
tctatggtctctacaagttctccct

SEQ ID NO: 828147 - DNA, 25 bp, Mus musculus
tctatggtctcttcaagttctccct

SEQ ID NO: 828148 - DNA, 25 bp, Mus musculus
tctatggtgtcactgggctcgacct

SEQ ID NO: 828149 - DNA, 25 bp, Mus musculus
tctatggtgtcagtgggctcgacct

SEQ ID NO: 828150 - DNA, 25 bp, Mus musculus
tctatgtacccaagatgacctgtaa

SEQ ID NO: 828151 - DNA, 25 bp, Mus musculus
tctatgtacccatgatgacctgtaa

SEQ ID NO: 828152 - DNA, 25 bp, Mus musculus
tctatgtagggcatgcctctgtaca

SEQ ID NO: 828153 - DNA, 25 bp, Mus musculus
tctatgtagggcttgcctctgtaca

SEQ ID NO: 828154 - DNA, 25 bp, Mus musculus
tctatgtctgaaagaggctcggtca

SEQ ID NO: 828155 - DNA, 25 bp, Mus musculus
tctatgtctgaatgaggctcggtca

SEQ ID NO: 828156 - DNA, 25 bp, Mus musculus
tctatgtctgttactttctcgagtt

SEQ ID NO: 828157 - DNA, 25 bp, Mus musculus
tctatgtctgtttctttctcgagtt

SEQ ID NO: 828158 - DNA, 25 bp, Mus musculus
tctatgtcttcccatgtgggctgaa

SEQ ID NO: 828159 - DNA, 25 bp, Mus musculus
tctatgtcttccgatgtgggctgaa

SEQ ID NO: 828160 - DNA, 25 bp, Mus musculus
tctatgtgacacattgtaactggag

SEQ ID NO: 828161 - DNA, 25 bp, Mus musculus
tctatgtgacactttgtaactggag

SEQ ID NO: 828162 - DNA, 25 bp, Mus musculus
tctatgtgaccaatgtgagctgcca

SEQ ID NO: 828163 - DNA, 25 bp, Mus musculus
tctatgtgaccattgtgagctgcca

SEQ ID NO: 828164 - DNA, 25 bp, Mus musculus
tctatgtgccaaactgtgacctcag

SEQ ID NO: 828165 - DNA, 25 bp, Mus musculus
tctatgtgccaatctgtgacctcag

SEQ ID NO: 828166 - DNA, 25 bp, Mus musculus
tctatgtgcctgatcttcattattt

SEQ ID NO: 828167 - DNA, 25 bp, Mus musculus
tctatgtgcctgttcttcattattt

SEQ ID NO: 828168 - DNA, 25 bp, Mus musculus
tctatgtggagacgctgctggtccc

SEQ ID NO: 828169 - DNA, 25 bp, Mus musculus
tctatgtggagaggctgctggtccc

SEQ ID NO: 828170 - DNA, 25 bp, Mus musculus
tctatgtgtgttacagtggatgaca

SEQ ID NO: 828171 - DNA, 25 bp, Mus musculus
tctatgtgtgtttcagtggatgaca

SEQ ID NO: 828172 - DNA, 25 bp, Mus musculus
tctatgtgtttgagtccagtaggct

SEQ ID NO: 828173 - DNA, 25 bp, Mus musculus
tctatgtgtttgtgtccagtaggct

SEQ ID NO: 828174 - DNA, 25 bp, Mus musculus
tctatgttacttactcactgacagc

SEQ ID NO: 828175 - DNA, 25 bp, Mus musculus
tctatgttactttctcactgacagc

SEQ ID NO: 828176 - DNA, 25 bp, Mus musculus
tctatgttgcaaatctgttcctttt

SEQ ID NO: 828177 - DNA, 25 bp, Mus musculus
tctatgttgcaattctgttcctttt

SEQ ID NO: 828178 - DNA, 25 bp, Mus musculus
tctatgtttactccagggcactgtt

SEQ ID NO: 828179 - DNA, 25 bp, Mus musculus
tctatgtttactgcagggcactgtt

SEQ ID NO: 828180 - DNA, 25 bp, Mus musculus
tctattaatttaccccaccactagc

SEQ ID NO: 828181 - DNA, 25 bp, Mus musculus
tctattaatttagcccaccactagc

SEQ ID NO: 828182 - DNA, 25 bp, Mus musculus
tctattaccgttaaagaactctagt

SEQ ID NO: 828183 - DNA, 25 bp, Mus musculus
tctattaccgtttaagaactctagt

SEQ ID NO: 828184 - DNA, 25 bp, Mus musculus
tctattacctacaatctcactactc

SEQ ID NO: 828185 - DNA, 25 bp, Mus musculus
tctattacctactatctcactactc

SEQ ID NO: 828186 - DNA, 25 bp, Mus musculus
tctattatatgtccttgcaacccct

SEQ ID NO: 828187 - DNA, 25 bp, Mus musculus
tctattatatgtgcttgcaacccct

SEQ ID NO: 828188 - DNA, 25 bp, Mus musculus
tctattatcaacacccaccagggag

SEQ ID NO: 828189 - DNA, 25 bp, Mus musculus
tctattatcaactcccaccagggag

SEQ ID NO: 828190 - DNA, 25 bp, Mus musculus
tctattattagtcagtctcctctcc

SEQ ID NO: 828191 - DNA, 25 bp, Mus musculus
tctattattagtgagtctcctctcc

SEQ ID NO: 828192 - DNA, 25 bp, Mus musculus
tctattcatttgatgatccactgag

SEQ ID NO: 828193 - DNA, 25 bp, Mus musculus
tctattcatttgttgatccactgag

SEQ ID NO: 828194 - DNA, 25 bp, Mus musculus
tctattccaatcaccatgacatcat

SEQ ID NO: 828195 - DNA, 25 bp, Mus musculus
tctattccaatctccatgacatcat

SEQ ID NO: 828196 - DNA, 25 bp, Mus musculus
tctattccaggaacttacccaagag

SEQ ID NO: 828197 - DNA, 25 bp, Mus musculus
tctattccaggatcttacccaagag

SEQ ID NO: 828198 - DNA, 25 bp, Mus musculus
tctattccccgtaccaataaagaag

SEQ ID NO: 828199 - DNA, 25 bp, Mus musculus
tctattccccgttccaataaagaag

SEQ ID NO: 828200 - DNA, 25 bp, Mus musculus
tctattcctaaacaacctgagcgtt

SEQ ID NO: 828201 - DNA, 25 bp, Mus musculus
tctattcctaaagaacctgagcgtt

SEQ ID NO: 828202 - DNA, 25 bp, Mus musculus
tctattcctttgctggtgtcatagc

SEQ ID NO: 828203 - DNA, 25 bp, Mus musculus
tctattcctttggtggtgtcatagc

SEQ ID NO: 828204 - DNA, 25 bp, Mus musculus
tctattctacacactggaactttgc

SEQ ID NO: 828205 - DNA, 25 bp, Mus musculus
tctattctacactctggaactttgc

SEQ ID NO: 828206 - DNA, 25 bp, Mus musculus
tctattctcagaacagttgactgtt

SEQ ID NO: 828207 - DNA, 25 bp, Mus musculus
tctattctcagatcagttgactgtt

SEQ ID NO: 828208 - DNA, 25 bp, Mus musculus
tctattctctagatattgccattaa

SEQ ID NO: 828209 - DNA, 25 bp, Mus musculus
tctattctctagttattgccattaa

SEQ ID NO: 828210 - DNA, 25 bp, Mus musculus
tctattctgatgattacccttgata

SEQ ID NO: 828211 - DNA, 25 bp, Mus musculus
tctattctgatgtttacccttgata

SEQ ID NO: 828212 - DNA, 25 bp, Mus musculus
tctattctggagcacttttaacaag

SEQ ID NO: 828213 - DNA, 25 bp, Mus musculus
tctattctggaggacttttaacaag

SEQ ID NO: 828214 - DNA, 25 bp, Mus musculus
tctattctgtctatatgccagccag

SEQ ID NO: 828215 - DNA, 25 bp, Mus musculus
tctattctgtctttatgccagccag

SEQ ID NO: 828216 - DNA, 25 bp, Mus musculus
tctattctgtgcctgtatagacagt

SEQ ID NO: 828217 - DNA, 25 bp, Mus musculus
tctattctgtgcgtgtatagacagt

SEQ ID NO: 828218 - DNA, 25 bp, Mus musculus
tctattcttgacagtgcagttttaa

SEQ ID NO: 828219 - DNA, 25 bp, Mus musculus
tctattcttgactgtgcagttttaa

SEQ ID NO: 828220 - DNA, 25 bp, Mus musculus
tctattcttttgctctggagtttgg

SEQ ID NO: 828221 - DNA, 25 bp, Mus musculus
tctattcttttggtctggagtttgg

SEQ ID NO: 828222 - DNA, 25 bp, Mus musculus
tctattgaccagatgtgaggtgcat

SEQ ID NO: 828223 - DNA, 25 bp, Mus musculus
tctattgaccagttgtgaggtgcat

SEQ ID NO: 828224 - DNA, 25 bp, Mus musculus
tctattgagactcccttttcaggtg

SEQ ID NO: 828225 - DNA, 25 bp, Mus musculus
tctattgagactgccttttcaggtg

SEQ ID NO: 828226 - DNA, 25 bp, Mus musculus
tctattgatgagaccttgtctgagc

SEQ ID NO: 828227 - DNA, 25 bp, Mus musculus
tctattgatgagtccttgtctgagc

SEQ ID NO: 828228 - DNA, 25 bp, Mus musculus
tctattgatggaaaccttggctggt

SEQ ID NO: 828229 - DNA, 25 bp, Mus musculus
tctattgatggataccttggctggt

SEQ ID NO: 828230 - DNA, 25 bp, Mus musculus
tctattgctgctatctctgtggaag

SEQ ID NO: 828231 - DNA, 25 bp, Mus musculus
tctattgctgctttctctgtggaag

SEQ ID NO: 828232 - DNA, 25 bp, Mus musculus
tctattgctttccaccctatgtttt

SEQ ID NO: 828233 - DNA, 25 bp, Mus musculus
tctattgctttcgaccctatgtttt

SEQ ID NO: 828234 - DNA, 25 bp, Mus musculus
tctattggaaagacacgttctaggt

SEQ ID NO: 828235 - DNA, 25 bp, Mus musculus
tctattggaaagtcacgttctaggt

SEQ ID NO: 828236 - DNA, 25 bp, Mus musculus
tctattgtagccattgtggtccctg

SEQ ID NO: 828237 - DNA, 25 bp, Mus musculus
tctattgtagcctttgtggtccctg

SEQ ID NO: 828238 - DNA, 25 bp, Mus musculus
tctattgtatttatccggcttctaa

SEQ ID NO: 828239 - DNA, 25 bp, Mus musculus
tctattgtatttttccggcttctaa

SEQ ID NO: 828240 - DNA, 25 bp, Mus musculus
tctattgtctgtccttggtgcaaca

SEQ ID NO: 828241 - DNA, 25 bp, Mus musculus
tctattgtctgtgcttggtgcaaca

SEQ ID NO: 828242 - DNA, 25 bp, Mus musculus
tctattgttcctcttccatgtggaa

SEQ ID NO: 828243 - DNA, 25 bp, Mus musculus
tctattgttcctgttccatgtggaa

SEQ ID NO: 828244 - DNA, 25 bp, Mus musculus
tctatttacgggattcgcctccgag

SEQ ID NO: 828245 - DNA, 25 bp, Mus musculus
tctatttacgggtttcgcctccgag

SEQ ID NO: 828246 - DNA, 25 bp, Mus musculus
tctatttataatatcaacctttcat

SEQ ID NO: 828247 - DNA, 25 bp, Mus musculus
tctatttataatttcaacctttcat

SEQ ID NO: 828248 - DNA, 25 bp, Mus musculus
tctatttatcttatttgctaatgag

SEQ ID NO: 828249 - DNA, 25 bp, Mus musculus
tctatttatcttttttgctaatgag

SEQ ID NO: 828250 - DNA, 25 bp, Mus musculus
tctatttattgtatgaatgcccatc

SEQ ID NO: 828251 - DNA, 25 bp, Mus musculus
tctatttattgtttgaatgcccatc

SEQ ID NO: 828252 - DNA, 25 bp, Mus musculus
tctatttcaattccattctgacccg

SEQ ID NO: 828253 - DNA, 25 bp, Mus musculus
tctatttcaattgcattctgacccg

SEQ ID NO: 828254 - DNA, 25 bp, Mus musculus
tctatttcaggccagagagctctaa

SEQ ID NO: 828255 - DNA, 25 bp, Mus musculus
tctatttcaggcgagagagctctaa

SEQ ID NO: 828256 - DNA, 25 bp, Mus musculus
tctatttccctgattggctctggcc

SEQ ID NO: 828257 - DNA, 25 bp, Mus musculus
tctatttccctgtttggctctggcc

SEQ ID NO: 828258 - DNA, 25 bp, Mus musculus
tctatttctgagatctctgagaccc

SEQ ID NO: 828259 - DNA, 25 bp, Mus musculus
tctatttctgagttctctgagaccc

SEQ ID NO: 828260 - DNA, 25 bp, Mus musculus
tctatttctttacacgtacagacat

SEQ ID NO: 828261 - DNA, 25 bp, Mus musculus
tctatttctttagacgtacagacat

SEQ ID NO: 828262 - DNA, 25 bp, Mus musculus
tctatttgagcaccaccttctggtg

SEQ ID NO: 828263 - DNA, 25 bp, Mus musculus
tctatttgagcagcaccttctggtg

SEQ ID NO: 828264 - DNA, 25 bp, Mus musculus
tctatttgatacaacaggacgcgta

SEQ ID NO: 828265 - DNA, 25 bp, Mus musculus
tctatttgatactacaggacgcgta

SEQ ID NO: 828266 - DNA, 25 bp, Mus musculus
tctatttgccttactagtctgctga

SEQ ID NO: 828267 - DNA, 25 bp, Mus musculus
tctatttgcctttctagtctgctga

SEQ ID NO: 828268 - DNA, 25 bp, Mus musculus
tctatttgtttgaaggcaggacctc

SEQ ID NO: 828269 - DNA, 25 bp, Mus musculus
tctatttgtttgtaggcaggacctc

SEQ ID NO: 828270 - DNA, 25 bp, Mus musculus
tctattttacaactatgcaatgcaa

SEQ ID NO: 828271 - DNA, 25 bp, Mus musculus
tctattttacaagtatgcaatgcaa

SEQ ID NO: 828272 - DNA, 25 bp, Mus musculus
tctattttaggcattttcatcgaag

SEQ ID NO: 828273 - DNA, 25 bp, Mus musculus
tctattttaggctttttcatcgaag

SEQ ID NO: 828274 - DNA, 25 bp, Mus musculus
tctattttctatcaatcctttccag

SEQ ID NO: 828275 - DNA, 25 bp, Mus musculus
tctattttctatgaatcctttccag

SEQ ID NO: 828276 - DNA, 25 bp, Mus musculus
tctattttctcacttctattttaat

SEQ ID NO: 828277 - DNA, 25 bp, Mus musculus
tctattttctcagttctattttaat

SEQ ID NO: 828278 - DNA, 25 bp, Mus musculus
tctattttgaataggacgctgacaa

SEQ ID NO: 828279 - DNA, 25 bp, Mus musculus
tctattttgaattggacgctgacaa

SEQ ID NO: 828280 - DNA, 25 bp, Mus musculus
tctatttttagccacgtacgattca

SEQ ID NO: 828281 - DNA, 25 bp, Mus musculus
tctatttttagcgacgtacgattca

SEQ ID NO: 828282 - DNA, 25 bp, Mus musculus
tctatttttgctaaggtcccaggga

SEQ ID NO: 828283 - DNA, 25 bp, Mus musculus
tctatttttgcttaggtcccaggga

SEQ ID NO: 828284 - DNA, 25 bp, Mus musculus
tctattttttggcttttcagtgtct

SEQ ID NO: 828285 - DNA, 25 bp, Mus musculus
tctattttttgggttttcagtgtct

SEQ ID NO: 828286 - DNA, 25 bp, Mus musculus
tctcaaaaacatcctgctcttactg

SEQ ID NO: 828287 - DNA, 25 bp, Mus musculus
tctcaaaaacatgctgctcttactg

SEQ ID NO: 828288 - DNA, 25 bp, Mus musculus
tctcaaaaatgtaatctccaaaaac

SEQ ID NO: 828289 - DNA, 25 bp, Mus musculus
tctcaaaaatgttatctccaaaaac

SEQ ID NO: 828290 - DNA, 25 bp, Mus musculus
tctcaaacagcgagggtacttcttc

SEQ ID NO: 828291 - DNA, 25 bp, Mus musculus
tctcaaacagcgtgggtacttcttc

SEQ ID NO: 828292 - DNA, 25 bp, Mus musculus
tctcaaactgataccctctttctca

SEQ ID NO: 828293 - DNA, 25 bp, Mus musculus
tctcaaactgattccctctttctca

SEQ ID NO: 828294 - DNA, 25 bp, Mus musculus
tctcaaacttttcgatgatcccgat

SEQ ID NO: 828295 - DNA, 25 bp, Mus musculus
tctcaaacttttggatgatcccgat

SEQ ID NO: 828296 - DNA, 25 bp, Mus musculus
tctcaaagtgctcccagttgaaaag

SEQ ID NO: 828297 - DNA, 25 bp, Mus musculus
tctcaaagtgctgccagttgaaaag

SEQ ID NO: 828298 - DNA, 25 bp, Mus musculus
tctcaaataagaaaccccaaggtgg

SEQ ID NO: 828299 - DNA, 25 bp, Mus musculus
tctcaaataagataccccaaggtgg

SEQ ID NO: 828300 - DNA, 25 bp, Mus musculus
tctcaaataggtcacccgtccgtct

SEQ ID NO: 828301 - DNA, 25 bp, Mus musculus
tctcaaataggtgacccgtccgtct

SEQ ID NO: 828302 - DNA, 25 bp, Mus musculus
tctcaaatcaaccaaatctgtgaag

SEQ ID NO: 828303 - DNA, 25 bp, Mus musculus
tctcaaatcaacgaaatctgtgaag

SEQ ID NO: 828304 - DNA, 25 bp, Mus musculus
tctcaaatctaaacttccgtgctct

SEQ ID NO: 828305 - DNA, 25 bp, Mus musculus
tctcaaatctaatcttccgtgctct

SEQ ID NO: 828306 - DNA, 25 bp, Mus musculus
tctcaaatctatagggctttaatcc

SEQ ID NO: 828307 - DNA, 25 bp, Mus musculus
tctcaaatctattgggctttaatcc

SEQ ID NO: 828308 - DNA, 25 bp, Mus musculus
tctcaaatgacaccagaagcccagg

SEQ ID NO: 828309 - DNA, 25 bp, Mus musculus
tctcaaatgacagcagaagcccagg

SEQ ID NO: 828310 - DNA, 25 bp, Mus musculus
tctcaaatggaactgtgctggctac

SEQ ID NO: 828311 - DNA, 25 bp, Mus musculus
tctcaaatggaagtgtgctggctac

SEQ ID NO: 828312 - DNA, 25 bp, Mus musculus
tctcaacaaccaccagttcctggca

SEQ ID NO: 828313 - DNA, 25 bp, Mus musculus
tctcaacaaccagcagttcctggca

SEQ ID NO: 828314 - DNA, 25 bp, Mus musculus
tctcaacaagacattctacaggaaa

SEQ ID NO: 828315 - DNA, 25 bp, Mus musculus
tctcaacaagactttctacaggaaa

SEQ ID NO: 828316 - DNA, 25 bp, Mus musculus
tctcaacaagtcacttgttctcctg

SEQ ID NO: 828317 - DNA, 25 bp, Mus musculus
tctcaacaagtctcttgttctcctg

SEQ ID NO: 828318 - DNA, 25 bp, Mus musculus
tctcaacaccacatccaaatacagg

SEQ ID NO: 828319 - DNA, 25 bp, Mus musculus
tctcaacaccacttccaaatacagg

SEQ ID NO: 828320 - DNA, 25 bp, Mus musculus
tctcaacacgagctagttcaaactg

SEQ ID NO: 828321 - DNA, 25 bp, Mus musculus
tctcaacacgaggtagttcaaactg

SEQ ID NO: 828322 - DNA, 25 bp, Mus musculus
tctcaacagccccaaattatttttt

SEQ ID NO: 828323 - DNA, 25 bp, Mus musculus
tctcaacagcccgaaattatttttt

SEQ ID NO: 828324 - DNA, 25 bp, Mus musculus
tctcaacagggcctgaccgcgtaca

SEQ ID NO: 828325 - DNA, 25 bp, Mus musculus
tctcaacagggcgtgaccgcgtaca

SEQ ID NO: 828326 - DNA, 25 bp, Mus musculus
tctcaacatcccattgcctgtaata

SEQ ID NO: 828327 - DNA, 25 bp, Mus musculus
tctcaacatccctttgcctgtaata

SEQ ID NO: 828328 - DNA, 25 bp, Mus musculus
tctcaaccccgtctaactaaatcaa

SEQ ID NO: 828329 - DNA, 25 bp, Mus musculus
tctcaaccccgtgtaactaaatcaa

SEQ ID NO: 828330 - DNA, 25 bp, Mus musculus
tctcaacctcccaagatgtgagtga

SEQ ID NO: 828331 - DNA, 25 bp, Mus musculus
tctcaacctccctagatgtgagtga

SEQ ID NO: 828332 - DNA, 25 bp, Mus musculus
tctcaacctttccaaagtagcctct

SEQ ID NO: 828333 - DNA, 25 bp, Mus musculus
tctcaacctttcgaaagtagcctct

SEQ ID NO: 828334 - DNA, 25 bp, Mus musculus
tctcaactacatcgccaccaaatat

SEQ ID NO: 828335 - DNA, 25 bp, Mus musculus
tctcaactacatggccaccaaatat

SEQ ID NO: 828336 - DNA, 25 bp, Mus musculus
tctcaactcaagccccacgggagaa

SEQ ID NO: 828337 - DNA, 25 bp, Mus musculus
tctcaactcaaggcccacgggagaa

SEQ ID NO: 828338 - DNA, 25 bp, Mus musculus
tctcaactcaataggactgtcctgt

SEQ ID NO: 828339 - DNA, 25 bp, Mus musculus
tctcaactcaattggactgtcctgt

SEQ ID NO: 828340 - DNA, 25 bp, Mus musculus
tctcaactcttgacccttgaatatt

SEQ ID NO: 828341 - DNA, 25 bp, Mus musculus
tctcaactcttgtcccttgaatatt

SEQ ID NO: 828342 - DNA, 25 bp, Mus musculus
tctcaacttaatacaggccacaaat

SEQ ID NO: 828343 - DNA, 25 bp, Mus musculus
tctcaacttaattcaggccacaaat

SEQ ID NO: 828344 - DNA, 25 bp, Mus musculus
tctcaacttcatacatggtggccct

SEQ ID NO: 828345 - DNA, 25 bp, Mus musculus
tctcaacttcattcatggtggccct

SEQ ID NO: 828346 - DNA, 25 bp, Mus musculus
tctcaagacagcaaccctgggaagg

SEQ ID NO: 828347 - DNA, 25 bp, Mus musculus
tctcaagacagctaccctgggaagg

SEQ ID NO: 828348 - DNA, 25 bp, Mus musculus
tctcaagatcaaaagcctgcagcct

SEQ ID NO: 828349 - DNA, 25 bp, Mus musculus
tctcaagatcaatagcctgcagcct

SEQ ID NO: 828350 - DNA, 25 bp, Mus musculus
tctcaagcacttcgcttttatctgt

SEQ ID NO: 828351 - DNA, 25 bp, Mus musculus
tctcaagcacttggcttttatctgt

SEQ ID NO: 828352 - DNA, 25 bp, Mus musculus
tctcaagcagatattttagagctgt

SEQ ID NO: 828353 - DNA, 25 bp, Mus musculus
tctcaagcagattttttagagctgt

SEQ ID NO: 828354 - DNA, 25 bp, Mus musculus
tctcaagcccggagtttccctgcag

SEQ ID NO: 828355 - DNA, 25 bp, Mus musculus
tctcaagcccggtgtttccctgcag

SEQ ID NO: 828356 - DNA, 25 bp, Mus musculus
tctcaagccggaaacctcagatgat

SEQ ID NO: 828357 - DNA, 25 bp, Mus musculus
tctcaagccggatacctcagatgat

SEQ ID NO: 828358 - DNA, 25 bp, Mus musculus
tctcaagcctgtaaaaatccctcac

SEQ ID NO: 828359 - DNA, 25 bp, Mus musculus
tctcaagcctgttaaaatccctcac

SEQ ID NO: 828360 - DNA, 25 bp, Mus musculus
tctcaagcgccactaatgccagacg

SEQ ID NO: 828361 - DNA, 25 bp, Mus musculus
tctcaagcgccagtaatgccagacg

SEQ ID NO: 828362 - DNA, 25 bp, Mus musculus
tctcaagctcctacagtacttacag

SEQ ID NO: 828363 - DNA, 25 bp, Mus musculus
tctcaagctccttcagtacttacag

SEQ ID NO: 828364 - DNA, 25 bp, Mus musculus
tctcaagctcttcttgtatgacaaa

SEQ ID NO: 828365 - DNA, 25 bp, Mus musculus
tctcaagctcttgttgtatgacaaa

SEQ ID NO: 828366 - DNA, 25 bp, Mus musculus
tctcaaggacttagctgctataatt

SEQ ID NO: 828367 - DNA, 25 bp, Mus musculus
tctcaaggacttcgtggacatcaca

SEQ ID NO: 828368 - DNA, 25 bp, Mus musculus
tctcaaggacttggtggacatcaca

SEQ ID NO: 828369 - DNA, 25 bp, Mus musculus
tctcaaggactttgctgctataatt

SEQ ID NO: 828370 - DNA, 25 bp, Mus musculus
tctcaaggctacatacgcagctctg

SEQ ID NO: 828371 - DNA, 25 bp, Mus musculus
tctcaaggctacttacgcagctctg

SEQ ID NO: 828372 - DNA, 25 bp, Mus musculus
tctcaaggctatatagagggtcttt

SEQ ID NO: 828373 - DNA, 25 bp, Mus musculus
tctcaaggctatttagagggtcttt

SEQ ID NO: 828374 - DNA, 25 bp, Mus musculus
tctcaaggttgcatttggtgttcaa

SEQ ID NO: 828375 - DNA, 25 bp, Mus musculus
tctcaaggttgcttttggtgttcaa

SEQ ID NO: 828376 - DNA, 25 bp, Mus musculus
tctcaagtcatgattgctttccgcc

SEQ ID NO: 828377 - DNA, 25 bp, Mus musculus
tctcaagtcatgtttgctttccgcc

SEQ ID NO: 828378 - DNA, 25 bp, Mus musculus
tctcaagtctcaccctaaccatgaa

SEQ ID NO: 828379 - DNA, 25 bp, Mus musculus
tctcaagtctcagcctaaccatgaa

SEQ ID NO: 828380 - DNA, 25 bp, Mus musculus
tctcaagtctccaaatgcatttaaa

SEQ ID NO: 828381 - DNA, 25 bp, Mus musculus
tctcaagtctcctaatgcatttaaa

SEQ ID NO: 828382 - DNA, 25 bp, Mus musculus
tctcaagtgcccagttgtgtggaac

SEQ ID NO: 828383 - DNA, 25 bp, Mus musculus
tctcaagtgccctgttgtgtggaac

SEQ ID NO: 828384 - DNA, 25 bp, Mus musculus
tctcaagtgtaaacttttagccaag

SEQ ID NO: 828385 - DNA, 25 bp, Mus musculus
tctcaagtgtaatcttttagccaag

SEQ ID NO: 828386 - DNA, 25 bp, Mus musculus
tctcaagttagtcttcctttgagaa

SEQ ID NO: 828387 - DNA, 25 bp, Mus musculus
tctcaagttagtgttcctttgagaa

SEQ ID NO: 828388 - DNA, 25 bp, Mus musculus
tctcaagttcatcctaagggtacgt

SEQ ID NO: 828389 - DNA, 25 bp, Mus musculus
tctcaagttcatgctaagggtacgt

SEQ ID NO: 828390 - DNA, 25 bp, Mus musculus
tctcaagttgagactggcttcggga

SEQ ID NO: 828391 - DNA, 25 bp, Mus musculus
tctcaagttgagtctggcttcggga

SEQ ID NO: 828392 - DNA, 25 bp, Mus musculus
tctcaataaagtccaccatgttgtg

SEQ ID NO: 828393 - DNA, 25 bp, Mus musculus
tctcaataaagtgcaccatgttgtg

SEQ ID NO: 828394 - DNA, 25 bp, Mus musculus
tctcaatagttaacacatctcacat

SEQ ID NO: 828395 - DNA, 25 bp, Mus musculus
tctcaatagttatcacatctcacat

SEQ ID NO: 828396 - DNA, 25 bp, Mus musculus
tctcaatatctccttccaagagctg

SEQ ID NO: 828397 - DNA, 25 bp, Mus musculus
tctcaatatctcgttccaagagctg

SEQ ID NO: 828398 - DNA, 25 bp, Mus musculus
tctcaatcctgcagggagctaccaa

SEQ ID NO: 828399 - DNA, 25 bp, Mus musculus
tctcaatcctgctgggagctaccaa

SEQ ID NO: 828400 - DNA, 25 bp, Mus musculus
tctcaatctgccaaggtaatgctca

SEQ ID NO: 828401 - DNA, 25 bp, Mus musculus
tctcaatctgcctaggtaatgctca

SEQ ID NO: 828402 - DNA, 25 bp, Mus musculus
tctcaatgaccacggccgcaagctt

SEQ ID NO: 828403 - DNA, 25 bp, Mus musculus
tctcaatgaccagggccgcaagctt

SEQ ID NO: 828404 - DNA, 25 bp, Mus musculus
tctcaatgctacagccaagggccag

SEQ ID NO: 828405 - DNA, 25 bp, Mus musculus
tctcaatgctactgccaagggccag

SEQ ID NO: 828406 - DNA, 25 bp, Mus musculus
tctcaatgctagattttgcacccca

SEQ ID NO: 828407 - DNA, 25 bp, Mus musculus
tctcaatgctagtttttgcacccca

SEQ ID NO: 828408 - DNA, 25 bp, Mus musculus
tctcaatgggctcacagggaagcca

SEQ ID NO: 828409 - DNA, 25 bp, Mus musculus
tctcaatgggctgacagggaagcca

SEQ ID NO: 828410 - DNA, 25 bp, Mus musculus
tctcaatgggtgagtacacaccagt

SEQ ID NO: 828411 - DNA, 25 bp, Mus musculus
tctcaatgggtgtgtacacaccagt

SEQ ID NO: 828412 - DNA, 25 bp, Mus musculus
tctcaattatttacagagctaaagt

SEQ ID NO: 828413 - DNA, 25 bp, Mus musculus
tctcaattattttcagagctaaagt

SEQ ID NO: 828414 - DNA, 25 bp, Mus musculus
tctcaatttataccctctccagagt

SEQ ID NO: 828415 - DNA, 25 bp, Mus musculus
tctcaatttatagcctctccagagt

SEQ ID NO: 828416 - DNA, 25 bp, Mus musculus
tctcaatttcccagactttcaaagc

SEQ ID NO: 828417 - DNA, 25 bp, Mus musculus
tctcaatttccctgactttcaaagc

SEQ ID NO: 828418 - DNA, 25 bp, Mus musculus
tctcaattttgcctgaatcgccaca

SEQ ID NO: 828419 - DNA, 25 bp, Mus musculus
tctcaattttgcgtgaatcgccaca

SEQ ID NO: 828420 - DNA, 25 bp, Mus musculus
tctcacaaactgaaggcattccttt

SEQ ID NO: 828421 - DNA, 25 bp, Mus musculus
tctcacaaactgtaggcattccttt

SEQ ID NO: 828422 - DNA, 25 bp, Mus musculus
tctcacaaatacacaaagacttgta

SEQ ID NO: 828423 - DNA, 25 bp, Mus musculus
tctcacaaatactcaaagacttgta

SEQ ID NO: 828424 - DNA, 25 bp, Mus musculus
tctcacaaggttaaactattttata

SEQ ID NO: 828425 - DNA, 25 bp, Mus musculus
tctcacaaggtttaactattttata

SEQ ID NO: 828426 - DNA, 25 bp, Mus musculus
tctcacaattgacgggaaaacagca

SEQ ID NO: 828427 - DNA, 25 bp, Mus musculus
tctcacaattgaggggaaaacagca

SEQ ID NO: 828428 - DNA, 25 bp, Mus musculus
tctcacacacatcgtcattgacagt

SEQ ID NO: 828429 - DNA, 25 bp, Mus musculus
tctcacacacatggtcattgacagt

SEQ ID NO: 828430 - DNA, 25 bp, Mus musculus
tctcacacactaattcccacatgta

SEQ ID NO: 828431 - DNA, 25 bp, Mus musculus
tctcacacactatttcccacatgta

SEQ ID NO: 828432 - DNA, 25 bp, Mus musculus
tctcacacctatatcctgctggaat

SEQ ID NO: 828433 - DNA, 25 bp, Mus musculus
tctcacacctatttcctgctggaat

SEQ ID NO: 828434 - DNA, 25 bp, Mus musculus
tctcacacctgtatgttccagtctt

SEQ ID NO: 828435 - DNA, 25 bp, Mus musculus
tctcacacctgtttgttccagtctt

SEQ ID NO: 828436 - DNA, 25 bp, Mus musculus
tctcacagaaggcagttccaggcat

SEQ ID NO: 828437 - DNA, 25 bp, Mus musculus
tctcacagaagggagttccaggcat

SEQ ID NO: 828438 - DNA, 25 bp, Mus musculus
tctcacagacagctccaatcctggt

SEQ ID NO: 828439 - DNA, 25 bp, Mus musculus
tctcacagacaggtccaatcctggt

SEQ ID NO: 828440 - DNA, 25 bp, Mus musculus
tctcacagaggcacccagagcagag

SEQ ID NO: 828441 - DNA, 25 bp, Mus musculus
tctcacagaggctcccagagcagag

SEQ ID NO: 828442 - DNA, 25 bp, Mus musculus
tctcacagcacacccgttaaaggta

SEQ ID NO: 828443 - DNA, 25 bp, Mus musculus
tctcacagcacagccgttaaaggta

SEQ ID NO: 828444 - DNA, 25 bp, Mus musculus
tctcacataggcagtaagctctctg

SEQ ID NO: 828445 - DNA, 25 bp, Mus musculus
tctcacataggctgtaagctctctg

SEQ ID NO: 828446 - DNA, 25 bp, Mus musculus
tctcacatcctcattggcggggaac

SEQ ID NO: 828447 - DNA, 25 bp, Mus musculus
tctcacatcctctttggcggggaac

SEQ ID NO: 828448 - DNA, 25 bp, Mus musculus
tctcacatgtggagcctagcctata

SEQ ID NO: 828449 - DNA, 25 bp, Mus musculus
tctcacatgtggtgcctagcctata

SEQ ID NO: 828450 - DNA, 25 bp, Mus musculus
tctcacattactaataccagaggag

SEQ ID NO: 828451 - DNA, 25 bp, Mus musculus
tctcacattacttataccagaggag

SEQ ID NO: 828452 - DNA, 25 bp, Mus musculus
tctcaccaccgcctttgaaatggaa

SEQ ID NO: 828453 - DNA, 25 bp, Mus musculus
tctcaccaccgcgtttgaaatggaa

SEQ ID NO: 828454 - DNA, 25 bp, Mus musculus
tctcaccacctgcaaaacactgaat

SEQ ID NO: 828455 - DNA, 25 bp, Mus musculus
tctcaccacctggaaaacactgaat

SEQ ID NO: 828456 - DNA, 25 bp, Mus musculus
tctcaccagaaccaggattcctgtg

SEQ ID NO: 828457 - DNA, 25 bp, Mus musculus
tctcaccagaacgaggattcctgtg

SEQ ID NO: 828458 - DNA, 25 bp, Mus musculus
tctcaccagcccataaatagtcttt

SEQ ID NO: 828459 - DNA, 25 bp, Mus musculus
tctcaccagcccttaaatagtcttt

SEQ ID NO: 828460 - DNA, 25 bp, Mus musculus
tctcaccagtgcaatgaccttgggt

SEQ ID NO: 828461 - DNA, 25 bp, Mus musculus
tctcaccagtgctatgaccttgggt

SEQ ID NO: 828462 - DNA, 25 bp, Mus musculus
tctcaccatcctcatgcagtagcat

SEQ ID NO: 828463 - DNA, 25 bp, Mus musculus
tctcaccatcctgatgcagtagcat

SEQ ID NO: 828464 - DNA, 25 bp, Mus musculus
tctcaccatgctctcgggttccata

SEQ ID NO: 828465 - DNA, 25 bp, Mus musculus
tctcaccatgctgtcgggttccata

SEQ ID NO: 828466 - DNA, 25 bp, Mus musculus
tctcaccattggctcggcgagtaga

SEQ ID NO: 828467 - DNA, 25 bp, Mus musculus
tctcaccattgggtcggcgagtaga

SEQ ID NO: 828468 - DNA, 25 bp, Mus musculus
tctcacccacctatgtctcattggg

SEQ ID NO: 828469 - DNA, 25 bp, Mus musculus
tctcacccacctttgtctcattggg

SEQ ID NO: 828470 - DNA, 25 bp, Mus musculus
tctcacccacttatttctcattagt

SEQ ID NO: 828471 - DNA, 25 bp, Mus musculus
tctcacccacttttttctcattagt

SEQ ID NO: 828472 - DNA, 25 bp, Mus musculus
tctcacccagatctttgttttcatc

SEQ ID NO: 828473 - DNA, 25 bp, Mus musculus
tctcacccagatgtttgttttcatc

SEQ ID NO: 828474 - DNA, 25 bp, Mus musculus
tctcacccaggaaggccaagtgcat

SEQ ID NO: 828475 - DNA, 25 bp, Mus musculus
tctcacccaggatggccaagtgcat

SEQ ID NO: 828476 - DNA, 25 bp, Mus musculus
tctcacccatacacagaaccaaaag

SEQ ID NO: 828477 - DNA, 25 bp, Mus musculus
tctcacccatactcagaaccaaaag

SEQ ID NO: 828478 - DNA, 25 bp, Mus musculus
tctcacccctaaaacatcagatgca

SEQ ID NO: 828479 - DNA, 25 bp, Mus musculus
tctcacccctaatacatcagatgca

SEQ ID NO: 828480 - DNA, 25 bp, Mus musculus
tctcacccctctcgtagggatgaaa

SEQ ID NO: 828481 - DNA, 25 bp, Mus musculus
tctcacccctctggtagggatgaaa

SEQ ID NO: 828482 - DNA, 25 bp, Mus musculus
tctcacccgaacagcgacagattta

SEQ ID NO: 828483 - DNA, 25 bp, Mus musculus
tctcacccgaactgcgacagattta

SEQ ID NO: 828484 - DNA, 25 bp, Mus musculus
tctcaccctgagagacctgggcagc

SEQ ID NO: 828485 - DNA, 25 bp, Mus musculus
tctcaccctgagtgacctgggcagc

SEQ ID NO: 828486 - DNA, 25 bp, Mus musculus
tctcaccctgggacctgatatggag

SEQ ID NO: 828487 - DNA, 25 bp, Mus musculus
tctcaccctgggtcctgatatggag

SEQ ID NO: 828488 - DNA, 25 bp, Mus musculus
tctcaccgggatacagtcatgcctg

SEQ ID NO: 828489 - DNA, 25 bp, Mus musculus
tctcaccgggattcagtcatgcctg

SEQ ID NO: 828490 - DNA, 25 bp, Mus musculus
tctcacctcacaaaggctgactttt

SEQ ID NO: 828491 - DNA, 25 bp, Mus musculus
tctcacctcacataggctgactttt

SEQ ID NO: 828492 - DNA, 25 bp, Mus musculus
tctcacctgcagctgaaaatgacgg

SEQ ID NO: 828493 - DNA, 25 bp, Mus musculus
tctcacctgcaggtgaaaatgacgg

SEQ ID NO: 828494 - DNA, 25 bp, Mus musculus
tctcacctggaaagggatttcaccc

SEQ ID NO: 828495 - DNA, 25 bp, Mus musculus
tctcacctggaatgggatttcaccc

SEQ ID NO: 828496 - DNA, 25 bp, Mus musculus
tctcacctgggtcttaaaagcatac

SEQ ID NO: 828497 - DNA, 25 bp, Mus musculus
tctcacctgggtgttaaaagcatac

SEQ ID NO: 828498 - DNA, 25 bp, Mus musculus
tctcacctgtagatgttactgcaga

SEQ ID NO: 828499 - DNA, 25 bp, Mus musculus
tctcacctgtagttgttactgcaga

SEQ ID NO: 828500 - DNA, 25 bp, Mus musculus
tctcacctgtccctggtttcatggg

SEQ ID NO: 828501 - DNA, 25 bp, Mus musculus
tctcacctgtccgtggtttcatggg

SEQ ID NO: 828502 - DNA, 25 bp, Mus musculus
tctcacctgtggctcctaaagagga

SEQ ID NO: 828503 - DNA, 25 bp, Mus musculus
tctcacctgtgggtcctaaagagga

SEQ ID NO: 828504 - DNA, 25 bp, Mus musculus
tctcaccttcccctgaaatgaataa

SEQ ID NO: 828505 - DNA, 25 bp, Mus musculus
tctcaccttcccgtgaaatgaataa

SEQ ID NO: 828506 - DNA, 25 bp, Mus musculus
tctcaccttgccctgtttgggtttt

SEQ ID NO: 828507 - DNA, 25 bp, Mus musculus
tctcaccttgccgtgtttgggtttt

SEQ ID NO: 828508 - DNA, 25 bp, Mus musculus
tctcacctttgaactaacagcactg

SEQ ID NO: 828509 - DNA, 25 bp, Mus musculus
tctcacctttgatctaacagcactg

SEQ ID NO: 828510 - DNA, 25 bp, Mus musculus
tctcacctttggacattcctaagtt

SEQ ID NO: 828511 - DNA, 25 bp, Mus musculus
tctcacctttggtcattcctaagtt

SEQ ID NO: 828512 - DNA, 25 bp, Mus musculus
tctcacgactgtaaacttccaactt

SEQ ID NO: 828513 - DNA, 25 bp, Mus musculus
tctcacgactgttaacttccaactt

SEQ ID NO: 828514 - DNA, 25 bp, Mus musculus
tctcacgagagccaggactgagtat

SEQ ID NO: 828515 - DNA, 25 bp, Mus musculus
tctcacgagagcgaggactgagtat

SEQ ID NO: 828516 - DNA, 25 bp, Mus musculus
tctcacgattctcaacagggcctga

SEQ ID NO: 828517 - DNA, 25 bp, Mus musculus
tctcacgattctgaacagggcctga

SEQ ID NO: 828518 - DNA, 25 bp, Mus musculus
tctcacgcagagagcatttgaaata

SEQ ID NO: 828519 - DNA, 25 bp, Mus musculus
tctcacgcagagtgcatttgaaata

SEQ ID NO: 828520 - DNA, 25 bp, Mus musculus
tctcacgcagcacttgtggtcaata

SEQ ID NO: 828521 - DNA, 25 bp, Mus musculus
tctcacgcagcagttgtggtcaata

SEQ ID NO: 828522 - DNA, 25 bp, Mus musculus
tctcacgcgtgacacttttgtgtct

SEQ ID NO: 828523 - DNA, 25 bp, Mus musculus
tctcacgcgtgagacttttgtgtct

SEQ ID NO: 828524 - DNA, 25 bp, Mus musculus
tctcacgctttcctgttatgaagat

SEQ ID NO: 828525 - DNA, 25 bp, Mus musculus
tctcacgctttcgtgttatgaagat

SEQ ID NO: 828526 - DNA, 25 bp, Mus musculus
tctcacggaaaaccagactctgtct

SEQ ID NO: 828527 - DNA, 25 bp, Mus musculus
tctcacggaaaagcagactctgtct

SEQ ID NO: 828528 - DNA, 25 bp, Mus musculus
tctcacggaaccatgcctttgcgaa

SEQ ID NO: 828529 - DNA, 25 bp, Mus musculus
tctcacggaaccttgcctttgcgaa

SEQ ID NO: 828530 - DNA, 25 bp, Mus musculus
tctcacggacctctcttttctgccc

SEQ ID NO: 828531 - DNA, 25 bp, Mus musculus
tctcacggacctgtcttttctgccc

SEQ ID NO: 828532 - DNA, 25 bp, Mus musculus
tctcacggagaacgctcttcacaga

SEQ ID NO: 828533 - DNA, 25 bp, Mus musculus
tctcacggagaaggctcttcacaga

SEQ ID NO: 828534 - DNA, 25 bp, Mus musculus
tctcacggggatcgcagacgatctg

SEQ ID NO: 828535 - DNA, 25 bp, Mus musculus
tctcacggggatggcagacgatctg

SEQ ID NO: 828536 - DNA, 25 bp, Mus musculus
tctcacggtgtaagcagaaggccct

SEQ ID NO: 828537 - DNA, 25 bp, Mus musculus
tctcacggtgtatgcagaaggccct

SEQ ID NO: 828538 - DNA, 25 bp, Mus musculus
tctcacgtaataaggaagtaggcat

SEQ ID NO: 828539 - DNA, 25 bp, Mus musculus
tctcacgtaatatggaagtaggcat

SEQ ID NO: 828540 - DNA, 25 bp, Mus musculus
tctcacgtgacacatggactgtggg

SEQ ID NO: 828541 - DNA, 25 bp, Mus musculus
tctcacgtgacagatggactgtggg

SEQ ID NO: 828542 - DNA, 25 bp, Mus musculus
tctcacgttgatcattggccacagg

SEQ ID NO: 828543 - DNA, 25 bp, Mus musculus
tctcacgttgatgattggccacagg

SEQ ID NO: 828544 - DNA, 25 bp, Mus musculus
tctcactaagcacccctcatggatg

SEQ ID NO: 828545 - DNA, 25 bp, Mus musculus
tctcactaagcagccctcatggatg

SEQ ID NO: 828546 - DNA, 25 bp, Mus musculus
tctcactaagtgctattggatcagt

SEQ ID NO: 828547 - DNA, 25 bp, Mus musculus
tctcactaagtggtattggatcagt

SEQ ID NO: 828548 - DNA, 25 bp, Mus musculus
tctcactaagttacccaggatggct

SEQ ID NO: 828549 - DNA, 25 bp, Mus musculus
tctcactaagtttcccaggatggct

SEQ ID NO: 828550 - DNA, 25 bp, Mus musculus
tctcactaggtcaatcaccctttaa

SEQ ID NO: 828551 - DNA, 25 bp, Mus musculus
tctcactaggtctatcaccctttaa

SEQ ID NO: 828552 - DNA, 25 bp, Mus musculus
tctcactatagaaaccgtcttgctg

SEQ ID NO: 828553 - DNA, 25 bp, Mus musculus
tctcactatagataccgtcttgctg

SEQ ID NO: 828554 - DNA, 25 bp, Mus musculus
tctcactatagcactggttatcctt

SEQ ID NO: 828555 - DNA, 25 bp, Mus musculus
tctcactatagctctggttatcctt

SEQ ID NO: 828556 - DNA, 25 bp, Mus musculus
tctcactatatgaccttgactgtcc

SEQ ID NO: 828557 - DNA, 25 bp, Mus musculus
tctcactatatgtccttgactgtcc

SEQ ID NO: 828558 - DNA, 25 bp, Mus musculus
tctcactatgggactctggctggtt

SEQ ID NO: 828559 - DNA, 25 bp, Mus musculus
tctcactatgggtctctggctggtt

SEQ ID NO: 828560 - DNA, 25 bp, Mus musculus
tctcactcagttatctaatttgcaa

SEQ ID NO: 828561 - DNA, 25 bp, Mus musculus
tctcactcagttttctaatttgcaa

SEQ ID NO: 828562 - DNA, 25 bp, Mus musculus
tctcactccagcacgtggaagatga

SEQ ID NO: 828563 - DNA, 25 bp, Mus musculus
tctcactccagctcgtggaagatga

SEQ ID NO: 828564 - DNA, 25 bp, Mus musculus
tctcactctaaaaaagccccattgg

SEQ ID NO: 828565 - DNA, 25 bp, Mus musculus
tctcactctaaataagccccattgg

SEQ ID NO: 828566 - DNA, 25 bp, Mus musculus
tctcactctaccatcatatcaatat

SEQ ID NO: 828567 - DNA, 25 bp, Mus musculus
tctcactctaccttcatatcaatat

SEQ ID NO: 828568 - DNA, 25 bp, Mus musculus
tctcactctgctcgtgtagcgggca

SEQ ID NO: 828569 - DNA, 25 bp, Mus musculus
tctcactctgctggtgtagcgggca

SEQ ID NO: 828570 - DNA, 25 bp, Mus musculus
tctcactcttcaacagtcagctgag

SEQ ID NO: 828571 - DNA, 25 bp, Mus musculus
tctcactcttcatcagtcagctgag

SEQ ID NO: 828572 - DNA, 25 bp, Mus musculus
tctcactgacagcatgtttctcaat

SEQ ID NO: 828573 - DNA, 25 bp, Mus musculus
tctcactgacaggatgtttctcaat

SEQ ID NO: 828574 - DNA, 25 bp, Mus musculus
tctcactgacttattccatttcttg

SEQ ID NO: 828575 - DNA, 25 bp, Mus musculus
tctcactgactttttccatttcttg

SEQ ID NO: 828576 - DNA, 25 bp, Mus musculus
tctcactgcctacgcgttgatatat

SEQ ID NO: 828577 - DNA, 25 bp, Mus musculus
tctcactgcctaggcgttgatatat

SEQ ID NO: 828578 - DNA, 25 bp, Mus musculus
tctcactggcatagcaagggtgcgg

SEQ ID NO: 828579 - DNA, 25 bp, Mus musculus
tctcactggcattgcaagggtgcgg

SEQ ID NO: 828580 - DNA, 25 bp, Mus musculus
tctcactgggagcacgcattaatac

SEQ ID NO: 828581 - DNA, 25 bp, Mus musculus
tctcactgggaggacgcattaatac

SEQ ID NO: 828582 - DNA, 25 bp, Mus musculus
tctcactggtaacttgacatctctc

SEQ ID NO: 828583 - DNA, 25 bp, Mus musculus
tctcactggtaagttgacatctctc

SEQ ID NO: 828584 - DNA, 25 bp, Mus musculus
tctcactggtgacaagggcctaggt

SEQ ID NO: 828585 - DNA, 25 bp, Mus musculus
tctcactggtgagaagggcctaggt

SEQ ID NO: 828586 - DNA, 25 bp, Mus musculus
tctcactgtctgcatatcagttgat

SEQ ID NO: 828587 - DNA, 25 bp, Mus musculus
tctcactgtctggatatcagttgat

SEQ ID NO: 828588 - DNA, 25 bp, Mus musculus
tctcacttcagtaaaacctctctag

SEQ ID NO: 828589 - DNA, 25 bp, Mus musculus
tctcacttcagttaaacctctctag

SEQ ID NO: 828590 - DNA, 25 bp, Mus musculus
tctcacttcctcctcgtgtttgttt

SEQ ID NO: 828591 - DNA, 25 bp, Mus musculus
tctcacttcctcgtcgtgtttgttt

SEQ ID NO: 828592 - DNA, 25 bp, Mus musculus
tctcacttctacagtggattccagg

SEQ ID NO: 828593 - DNA, 25 bp, Mus musculus
tctcacttctactgtggattccagg

SEQ ID NO: 828594 - DNA, 25 bp, Mus musculus
tctcacttctgactataggcacaga

SEQ ID NO: 828595 - DNA, 25 bp, Mus musculus
tctcacttctgagtataggcacaga

SEQ ID NO: 828596 - DNA, 25 bp, Mus musculus
tctcacttgcaccataaactctttg

SEQ ID NO: 828597 - DNA, 25 bp, Mus musculus
tctcacttgcacgataaactctttg

SEQ ID NO: 828598 - DNA, 25 bp, Mus musculus
tctcacttggtcattggtatatgct

SEQ ID NO: 828599 - DNA, 25 bp, Mus musculus
tctcacttggtctttggtatatgct

SEQ ID NO: 828600 - DNA, 25 bp, Mus musculus
tctcactttgacactcttctgtcat

SEQ ID NO: 828601 - DNA, 25 bp, Mus musculus
tctcactttgactctcttctgtcat

SEQ ID NO: 828602 - DNA, 25 bp, Mus musculus
tctcacttttcgcatcgggaaccac

SEQ ID NO: 828603 - DNA, 25 bp, Mus musculus
tctcacttttcgctagcctattcct

SEQ ID NO: 828604 - DNA, 25 bp, Mus musculus
tctcacttttcggatcgggaaccac

SEQ ID NO: 828605 - DNA, 25 bp, Mus musculus
tctcacttttcggtagcctattcct

SEQ ID NO: 828606 - DNA, 25 bp, Mus musculus
tctcacttttctcttggatggatgt

SEQ ID NO: 828607 - DNA, 25 bp, Mus musculus
tctcacttttctgttggatggatgt

SEQ ID NO: 828608 - DNA, 25 bp, Mus musculus
tctcagaagtccctgttccccagaa

SEQ ID NO: 828609 - DNA, 25 bp, Mus musculus
tctcagaagtccgtgttccccagaa

SEQ ID NO: 828610 - DNA, 25 bp, Mus musculus
tctcagaagtctcgaactcagctgt

SEQ ID NO: 828611 - DNA, 25 bp, Mus musculus
tctcagaagtctggaactcagctgt

SEQ ID NO: 828612 - DNA, 25 bp, Mus musculus
tctcagaagtgacgtcctttcctag

SEQ ID NO: 828613 - DNA, 25 bp, Mus musculus
tctcagaagtgaggtcctttcctag

SEQ ID NO: 828614 - DNA, 25 bp, Mus musculus
tctcagaatcctcaccggttggata

SEQ ID NO: 828615 - DNA, 25 bp, Mus musculus
tctcagaatcctgaccggttggata

SEQ ID NO: 828616 - DNA, 25 bp, Mus musculus
tctcagaatcgactggagctgcaaa

SEQ ID NO: 828617 - DNA, 25 bp, Mus musculus
tctcagaatcgagtggagctgcaaa

SEQ ID NO: 828618 - DNA, 25 bp, Mus musculus
tctcagaatctactctttacttgtt

SEQ ID NO: 828619 - DNA, 25 bp, Mus musculus
tctcagaatctagtctttacttgtt

SEQ ID NO: 828620 - DNA, 25 bp, Mus musculus
tctcagacatgcagtgctactggtt

SEQ ID NO: 828621 - DNA, 25 bp, Mus musculus
tctcagacatgctgtgctactggtt

SEQ ID NO: 828622 - DNA, 25 bp, Mus musculus
tctcagaccatgatctcaccatgaa

SEQ ID NO: 828623 - DNA, 25 bp, Mus musculus
tctcagaccatgttctcaccatgaa

SEQ ID NO: 828624 - DNA, 25 bp, Mus musculus
tctcagaccggtctgagcatgccca

SEQ ID NO: 828625 - DNA, 25 bp, Mus musculus
tctcagaccggtgtgagcatgccca

SEQ ID NO: 828626 - DNA, 25 bp, Mus musculus
tctcagactatactcgggacttcct

SEQ ID NO: 828627 - DNA, 25 bp, Mus musculus
tctcagactatagtcgggacttcct

SEQ ID NO: 828628 - DNA, 25 bp, Mus musculus
tctcagactctgataccttggaaca

SEQ ID NO: 828629 - DNA, 25 bp, Mus musculus
tctcagactctgttaccttggaaca

SEQ ID NO: 828630 - DNA, 25 bp, Mus musculus
tctcagactcttccattgttgctgg

SEQ ID NO: 828631 - DNA, 25 bp, Mus musculus
tctcagactcttgcattgttgctgg

SEQ ID NO: 828632 - DNA, 25 bp, Mus musculus
tctcagactgagaaccgggaaagat

SEQ ID NO: 828633 - DNA, 25 bp, Mus musculus
tctcagactgagtaccgggaaagat

SEQ ID NO: 828634 - DNA, 25 bp, Mus musculus
tctcagactggtccagatgccactt

SEQ ID NO: 828635 - DNA, 25 bp, Mus musculus
tctcagactggtgcagatgccactt

SEQ ID NO: 828636 - DNA, 25 bp, Mus musculus
tctcagagaattcccctaggttcac

SEQ ID NO: 828637 - DNA, 25 bp, Mus musculus
tctcagagaattgccctaggttcac

SEQ ID NO: 828638 - DNA, 25 bp, Mus musculus
tctcagagacctacgttcaagcagt

SEQ ID NO: 828639 - DNA, 25 bp, Mus musculus
tctcagagaccttcgttcaagcagt

SEQ ID NO: 828640 - DNA, 25 bp, Mus musculus
tctcagagcacacacttgctctctg

SEQ ID NO: 828641 - DNA, 25 bp, Mus musculus
tctcagagcacagacttgctctctg

SEQ ID NO: 828642 - DNA, 25 bp, Mus musculus
tctcagagccggaagcacaggctga

SEQ ID NO: 828643 - DNA, 25 bp, Mus musculus
tctcagagccggtagcacaggctga

SEQ ID NO: 828644 - DNA, 25 bp, Mus musculus
tctcagagctggagacatttttata

SEQ ID NO: 828645 - DNA, 25 bp, Mus musculus
tctcagagctggtgacatttttata

SEQ ID NO: 828646 - DNA, 25 bp, Mus musculus
tctcagagtccaagcacactcttac

SEQ ID NO: 828647 - DNA, 25 bp, Mus musculus
tctcagagtccatgcacactcttac

SEQ ID NO: 828648 - DNA, 25 bp, Mus musculus
tctcagagttccattctctctaagc

SEQ ID NO: 828649 - DNA, 25 bp, Mus musculus
tctcagagttcctttctctctaagc

SEQ ID NO: 828650 - DNA, 25 bp, Mus musculus
tctcagatatcacggccccagagtc

SEQ ID NO: 828651 - DNA, 25 bp, Mus musculus
tctcagatatcagggccccagagtc

SEQ ID NO: 828652 - DNA, 25 bp, Mus musculus
tctcagatcataccagaacttcaga

SEQ ID NO: 828653 - DNA, 25 bp, Mus musculus
tctcagatcatagcagaacttcaga

SEQ ID NO: 828654 - DNA, 25 bp, Mus musculus
tctcagatctgcctagcttggccac

SEQ ID NO: 828655 - DNA, 25 bp, Mus musculus
tctcagatctgcgtagcttggccac

SEQ ID NO: 828656 - DNA, 25 bp, Mus musculus
tctcagatgtccctacacatggttt

SEQ ID NO: 828657 - DNA, 25 bp, Mus musculus
tctcagatgtccgtacacatggttt

SEQ ID NO: 828658 - DNA, 25 bp, Mus musculus
tctcagatgtggctctccagcacct

SEQ ID NO: 828659 - DNA, 25 bp, Mus musculus
tctcagatgtgggtctccagcacct

SEQ ID NO: 828660 - DNA, 25 bp, Mus musculus
tctcagattctgctcatttttgttc

SEQ ID NO: 828661 - DNA, 25 bp, Mus musculus
tctcagattctggtcatttttgttc

SEQ ID NO: 828662 - DNA, 25 bp, Mus musculus
tctcagatttcacggtgggttccat

SEQ ID NO: 828663 - DNA, 25 bp, Mus musculus
tctcagatttcagggtgggttccat

SEQ ID NO: 828664 - DNA, 25 bp, Mus musculus
tctcagatttctctttcaggtcata

SEQ ID NO: 828665 - DNA, 25 bp, Mus musculus
tctcagatttctgtttcaggtcata

SEQ ID NO: 828666 - DNA, 25 bp, Mus musculus
tctcagcaaaagcttccgctgtggg

SEQ ID NO: 828667 - DNA, 25 bp, Mus musculus
tctcagcaaaaggttccgctgtggg

SEQ ID NO: 828668 - DNA, 25 bp, Mus musculus
tctcagcaaatcaatcttccttaag

SEQ ID NO: 828669 - DNA, 25 bp, Mus musculus
tctcagcaaatctatcttccttaag

SEQ ID NO: 828670 - DNA, 25 bp, Mus musculus
tctcagcaaccaaatctgtaatggg

SEQ ID NO: 828671 - DNA, 25 bp, Mus musculus
tctcagcaaccatatctgtaatggg

SEQ ID NO: 828672 - DNA, 25 bp, Mus musculus
tctcagcaacctatattccagtagt

SEQ ID NO: 828673 - DNA, 25 bp, Mus musculus
tctcagcaacctttattccagtagt

SEQ ID NO: 828674 - DNA, 25 bp, Mus musculus
tctcagcacaaaaggcaggggtcag

SEQ ID NO: 828675 - DNA, 25 bp, Mus musculus
tctcagcacaaatggcaggggtcag

SEQ ID NO: 828676 - DNA, 25 bp, Mus musculus
tctcagcaccaacttagggctactc

SEQ ID NO: 828677 - DNA, 25 bp, Mus musculus
tctcagcaccaagttagggctactc

SEQ ID NO: 828678 - DNA, 25 bp, Mus musculus
tctcagcacgcgcaagtttgaagtc

SEQ ID NO: 828679 - DNA, 25 bp, Mus musculus
tctcagcacgcggaagtttgaagtc

SEQ ID NO: 828680 - DNA, 25 bp, Mus musculus
tctcagcagcacagactagcagcag

SEQ ID NO: 828681 - DNA, 25 bp, Mus musculus
tctcagcagcactgactagcagcag

SEQ ID NO: 828682 - DNA, 25 bp, Mus musculus
tctcagcagttacgcttttcttggc

SEQ ID NO: 828683 - DNA, 25 bp, Mus musculus
tctcagcagttaggcttttcttggc

SEQ ID NO: 828684 - DNA, 25 bp, Mus musculus
tctcagcatattcacaaaagcatta

SEQ ID NO: 828685 - DNA, 25 bp, Mus musculus
tctcagcatattgacaaaagcatta

SEQ ID NO: 828686 - DNA, 25 bp, Mus musculus
tctcagcatcacaagggcattctct

SEQ ID NO: 828687 - DNA, 25 bp, Mus musculus
tctcagcatcactagggcattctct

SEQ ID NO: 828688 - DNA, 25 bp, Mus musculus
tctcagcatgctagttactcatatg

SEQ ID NO: 828689 - DNA, 25 bp, Mus musculus
tctcagcatgctccaaaacctgtgg

SEQ ID NO: 828690 - DNA, 25 bp, Mus musculus
tctcagcatgctgcaaaacctgtgg

SEQ ID NO: 828691 - DNA, 25 bp, Mus musculus
tctcagcatgcttgttactcatatg

SEQ ID NO: 828692 - DNA, 25 bp, Mus musculus
tctcagcattaacacaactttctcc

SEQ ID NO: 828693 - DNA, 25 bp, Mus musculus
tctcagcattaagacaactttctcc

SEQ ID NO: 828694 - DNA, 25 bp, Mus musculus
tctcagccacagagaacaaggatca

SEQ ID NO: 828695 - DNA, 25 bp, Mus musculus
tctcagccacagtgaacaaggatca

SEQ ID NO: 828696 - DNA, 25 bp, Mus musculus
tctcagccagtcactagcgtgaaaa

SEQ ID NO: 828697 - DNA, 25 bp, Mus musculus
tctcagccagtctctagcgtgaaaa

SEQ ID NO: 828698 - DNA, 25 bp, Mus musculus
tctcagccagttcacatccttagaa

SEQ ID NO: 828699 - DNA, 25 bp, Mus musculus
tctcagccagttgacatccttagaa

SEQ ID NO: 828700 - DNA, 25 bp, Mus musculus
tctcagccatctattggtcttcaat

SEQ ID NO: 828701 - DNA, 25 bp, Mus musculus
tctcagccatcttttggtcttcaat

SEQ ID NO: 828702 - DNA, 25 bp, Mus musculus
tctcagcccataactacctgttaag

SEQ ID NO: 828703 - DNA, 25 bp, Mus musculus
tctcagcccatatctacctgttaag

SEQ ID NO: 828704 - DNA, 25 bp, Mus musculus
tctcagcccattcaagtcacaaata

SEQ ID NO: 828705 - DNA, 25 bp, Mus musculus
tctcagcccattgaagtcacaaata

SEQ ID NO: 828706 - DNA, 25 bp, Mus musculus
tctcagccccagcagacataggcaa

SEQ ID NO: 828707 - DNA, 25 bp, Mus musculus
tctcagccccaggagacataggcaa

SEQ ID NO: 828708 - DNA, 25 bp, Mus musculus
tctcagcccgtaagctagggataca

SEQ ID NO: 828709 - DNA, 25 bp, Mus musculus
tctcagcccgtatgctagggataca

SEQ ID NO: 828710 - DNA, 25 bp, Mus musculus
tctcagccgagcatgaggcagccaa

SEQ ID NO: 828711 - DNA, 25 bp, Mus musculus
tctcagccgagcttgaggcagccaa

SEQ ID NO: 828712 - DNA, 25 bp, Mus musculus
tctcagcctcacatagtgaacatcc

SEQ ID NO: 828713 - DNA, 25 bp, Mus musculus
tctcagcctcacttagtgaacatcc

SEQ ID NO: 828714 - DNA, 25 bp, Mus musculus
tctcagcctcttctagttatcctag

SEQ ID NO: 828715 - DNA, 25 bp, Mus musculus
tctcagcctcttgtagttatcctag

SEQ ID NO: 828716 - DNA, 25 bp, Mus musculus
tctcagccttctatcagttgttaga

SEQ ID NO: 828717 - DNA, 25 bp, Mus musculus
tctcagccttctttcagttgttaga

SEQ ID NO: 828718 - DNA, 25 bp, Mus musculus
tctcagcgagaccttcgagggcttc

SEQ ID NO: 828719 - DNA, 25 bp, Mus musculus
tctcagcgagacgttcgagggcttc

SEQ ID NO: 828720 - DNA, 25 bp, Mus musculus
tctcagcgatggcaaacacgaactc

SEQ ID NO: 828721 - DNA, 25 bp, Mus musculus
tctcagcgatgggaaacacgaactc

SEQ ID NO: 828722 - DNA, 25 bp, Mus musculus
tctcagcggagcctcagctggagac

SEQ ID NO: 828723 - DNA, 25 bp, Mus musculus
tctcagcggagcgtcagctggagac

SEQ ID NO: 828724 - DNA, 25 bp, Mus musculus
tctcagcgtaaaccaatccatgctt

SEQ ID NO: 828725 - DNA, 25 bp, Mus musculus
tctcagcgtaaagcaatccatgctt

SEQ ID NO: 828726 - DNA, 25 bp, Mus musculus
tctcagctcacacagcatcagagtg

SEQ ID NO: 828727 - DNA, 25 bp, Mus musculus
tctcagctcacagagcatcagagtg

SEQ ID NO: 828728 - DNA, 25 bp, Mus musculus
tctcagctcatcacccagatgggta

SEQ ID NO: 828729 - DNA, 25 bp, Mus musculus
tctcagctcatctcccagatgggta

SEQ ID NO: 828730 - DNA, 25 bp, Mus musculus
tctcagctcccgaatgaacaatgat

SEQ ID NO: 828731 - DNA, 25 bp, Mus musculus
tctcagctcccgtatgaacaatgat

SEQ ID NO: 828732 - DNA, 25 bp, Mus musculus
tctcagctcctgaggcattggaata

SEQ ID NO: 828733 - DNA, 25 bp, Mus musculus
tctcagctcctgattatatgacgta

SEQ ID NO: 828734 - DNA, 25 bp, Mus musculus
tctcagctcctgtggcattggaata

SEQ ID NO: 828735 - DNA, 25 bp, Mus musculus
tctcagctcctgtttatatgacgta

SEQ ID NO: 828736 - DNA, 25 bp, Mus musculus
tctcagctctgtctaagctggaggt

SEQ ID NO: 828737 - DNA, 25 bp, Mus musculus
tctcagctctgtgtaagctggaggt

SEQ ID NO: 828738 - DNA, 25 bp, Mus musculus
tctcagctgagcctcctgaatggaa

SEQ ID NO: 828739 - DNA, 25 bp, Mus musculus
tctcagctgagcgtcctgaatggaa

SEQ ID NO: 828740 - DNA, 25 bp, Mus musculus
tctcagctgcttctaccatggatct

SEQ ID NO: 828741 - DNA, 25 bp, Mus musculus
tctcagctgcttgtaccatggatct

SEQ ID NO: 828742 - DNA, 25 bp, Mus musculus
tctcagctggagcactggtgcacat

SEQ ID NO: 828743 - DNA, 25 bp, Mus musculus
tctcagctggaggactggtgcacat

SEQ ID NO: 828744 - DNA, 25 bp, Mus musculus
tctcagctggcacctttgtgaggtt

SEQ ID NO: 828745 - DNA, 25 bp, Mus musculus
tctcagctggcagctttgtgaggtt

SEQ ID NO: 828746 - DNA, 25 bp, Mus musculus
tctcagctgtttctcatgcacacaa

SEQ ID NO: 828747 - DNA, 25 bp, Mus musculus
tctcagctgtttgtcatgcacacaa

SEQ ID NO: 828748 - DNA, 25 bp, Mus musculus
tctcagcttcaaaagagtcctccca

SEQ ID NO: 828749 - DNA, 25 bp, Mus musculus
tctcagcttcaatagagtcctccca

SEQ ID NO: 828750 - DNA, 25 bp, Mus musculus
tctcagcttgctacttttcattata

SEQ ID NO: 828751 - DNA, 25 bp, Mus musculus
tctcagcttgcttcttttcattata

SEQ ID NO: 828752 - DNA, 25 bp, Mus musculus
tctcagctttctagtaccttccagg

SEQ ID NO: 828753 - DNA, 25 bp, Mus musculus
tctcagctttcttgtaccttccagg

SEQ ID NO: 828754 - DNA, 25 bp, Mus musculus
tctcagctttgtatagtgtttccta

SEQ ID NO: 828755 - DNA, 25 bp, Mus musculus
tctcagctttgtttagtgtttccta

SEQ ID NO: 828756 - DNA, 25 bp, Mus musculus
tctcaggaaacaaagcgcgggcact

SEQ ID NO: 828757 - DNA, 25 bp, Mus musculus
tctcaggaaacaccttcctagacac

SEQ ID NO: 828758 - DNA, 25 bp, Mus musculus
tctcaggaaacagcttcctagacac

SEQ ID NO: 828759 - DNA, 25 bp, Mus musculus
tctcaggaaacatagcgcgggcact

SEQ ID NO: 828760 - DNA, 25 bp, Mus musculus
tctcaggaacaaacggtcccagagt

SEQ ID NO: 828761 - DNA, 25 bp, Mus musculus
tctcaggaacaatcggtcccagagt

SEQ ID NO: 828762 - DNA, 25 bp, Mus musculus
tctcaggaaccaattcatgattaaa

SEQ ID NO: 828763 - DNA, 25 bp, Mus musculus
tctcaggaaccatttcatgattaaa

SEQ ID NO: 828764 - DNA, 25 bp, Mus musculus
tctcaggaagttcgccttttctgga

SEQ ID NO: 828765 - DNA, 25 bp, Mus musculus
tctcaggaagttggccttttctgga

SEQ ID NO: 828766 - DNA, 25 bp, Mus musculus
tctcaggacaagcacagggagcttt

SEQ ID NO: 828767 - DNA, 25 bp, Mus musculus
tctcaggacaaggacagggagcttt

SEQ ID NO: 828768 - DNA, 25 bp, Mus musculus
tctcaggagagacagcggtcccagc

SEQ ID NO: 828769 - DNA, 25 bp, Mus musculus
tctcaggagagagagcggtcccagc

SEQ ID NO: 828770 - DNA, 25 bp, Mus musculus
tctcaggagaggcacaaagagttgt

SEQ ID NO: 828771 - DNA, 25 bp, Mus musculus
tctcaggagagggacaaagagttgt

SEQ ID NO: 828772 - DNA, 25 bp, Mus musculus
tctcaggagttgacaggctggcttg

SEQ ID NO: 828773 - DNA, 25 bp, Mus musculus
tctcaggagttgtcaggctggcttg

SEQ ID NO: 828774 - DNA, 25 bp, Mus musculus
tctcaggatcctcgccggttactag

SEQ ID NO: 828775 - DNA, 25 bp, Mus musculus
tctcaggatcctggccggttactag

SEQ ID NO: 828776 - DNA, 25 bp, Mus musculus
tctcaggatgccacttggaggacct

SEQ ID NO: 828777 - DNA, 25 bp, Mus musculus
tctcaggatgcctcttggaggacct

SEQ ID NO: 828778 - DNA, 25 bp, Mus musculus
tctcaggcacacataggcgcacaga

SEQ ID NO: 828779 - DNA, 25 bp, Mus musculus
tctcaggcacacttaggcgcacaga

SEQ ID NO: 828780 - DNA, 25 bp, Mus musculus
tctcaggcaccacaaaaactctact

SEQ ID NO: 828781 - DNA, 25 bp, Mus musculus
tctcaggcaccagaaaaactctact

SEQ ID NO: 828782 - DNA, 25 bp, Mus musculus
tctcaggcactgagtcccgggtgag

SEQ ID NO: 828783 - DNA, 25 bp, Mus musculus
tctcaggcactgtgtcccgggtgag

SEQ ID NO: 828784 - DNA, 25 bp, Mus musculus
tctcaggcagagactagctcaagct

SEQ ID NO: 828785 - DNA, 25 bp, Mus musculus
tctcaggcagagtctagctcaagct

SEQ ID NO: 828786 - DNA, 25 bp, Mus musculus
tctcaggcagataccaagcagcaga

SEQ ID NO: 828787 - DNA, 25 bp, Mus musculus
tctcaggcagattccaagcagcaga

SEQ ID NO: 828788 - DNA, 25 bp, Mus musculus
tctcaggcatgaaagtgccctggtt

SEQ ID NO: 828789 - DNA, 25 bp, Mus musculus
tctcaggcatgatagtgccctggtt

SEQ ID NO: 828790 - DNA, 25 bp, Mus musculus
tctcaggccagcagagtgacatgcc

SEQ ID NO: 828791 - DNA, 25 bp, Mus musculus
tctcaggccagctgagtgacatgcc

SEQ ID NO: 828792 - DNA, 25 bp, Mus musculus
tctcaggcctcacaacctagctggg

SEQ ID NO: 828793 - DNA, 25 bp, Mus musculus
tctcaggcctcagaacctagctggg

SEQ ID NO: 828794 - DNA, 25 bp, Mus musculus
tctcaggcgcggattctgattgaat

SEQ ID NO: 828795 - DNA, 25 bp, Mus musculus
tctcaggcgcggtttctgattgaat

SEQ ID NO: 828796 - DNA, 25 bp, Mus musculus
tctcaggctactagcactcagacaa

SEQ ID NO: 828797 - DNA, 25 bp, Mus musculus
tctcaggctacttgcactcagacaa

SEQ ID NO: 828798 - DNA, 25 bp, Mus musculus
tctcaggctcccacgggccatggaa

SEQ ID NO: 828799 - DNA, 25 bp, Mus musculus
tctcaggctccctcgggccatggaa

SEQ ID NO: 828800 - DNA, 25 bp, Mus musculus
tctcaggctgacactcgaagggtag

SEQ ID NO: 828801 - DNA, 25 bp, Mus musculus
tctcaggctgacagtgcagcaccat

SEQ ID NO: 828802 - DNA, 25 bp, Mus musculus
tctcaggctgactctcgaagggtag

SEQ ID NO: 828803 - DNA, 25 bp, Mus musculus
tctcaggctgactgtgcagcaccat

SEQ ID NO: 828804 - DNA, 25 bp, Mus musculus
tctcaggctgatacctagggtttca

SEQ ID NO: 828805 - DNA, 25 bp, Mus musculus
tctcaggctgattcctagggtttca

SEQ ID NO: 828806 - DNA, 25 bp, Mus musculus
tctcaggcttgacacctgtctgaat

SEQ ID NO: 828807 - DNA, 25 bp, Mus musculus
tctcaggcttgagacctgtctgaat

SEQ ID NO: 828808 - DNA, 25 bp, Mus musculus
tctcaggctttactcctcattaaag

SEQ ID NO: 828809 - DNA, 25 bp, Mus musculus
tctcaggctttagtcctcattaaag

SEQ ID NO: 828810 - DNA, 25 bp, Mus musculus
tctcagggaagcaggatgccgtcat

SEQ ID NO: 828811 - DNA, 25 bp, Mus musculus
tctcagggaagctggatgccgtcat

SEQ ID NO: 828812 - DNA, 25 bp, Mus musculus
tctcagggacccaagaactgacacc

SEQ ID NO: 828813 - DNA, 25 bp, Mus musculus
tctcagggaccctagaactgacacc

SEQ ID NO: 828814 - DNA, 25 bp, Mus musculus
tctcagggaggtactttattctttc

SEQ ID NO: 828815 - DNA, 25 bp, Mus musculus
tctcagggaggttctttattctttc

SEQ ID NO: 828816 - DNA, 25 bp, Mus musculus
tctcagggatgtaggccagttgatg

SEQ ID NO: 828817 - DNA, 25 bp, Mus musculus
tctcagggatgttggccagttgatg

SEQ ID NO: 828818 - DNA, 25 bp, Mus musculus
tctcagggcttgaacttgctccgat

SEQ ID NO: 828819 - DNA, 25 bp, Mus musculus
tctcagggcttgtacttgctccgat

SEQ ID NO: 828820 - DNA, 25 bp, Mus musculus
tctcagggtgacagggcggtttaaa

SEQ ID NO: 828821 - DNA, 25 bp, Mus musculus
tctcagggtgactgggcggtttaaa

SEQ ID NO: 828822 - DNA, 25 bp, Mus musculus
tctcagggtgagaaacgctctcggt

SEQ ID NO: 828823 - DNA, 25 bp, Mus musculus
tctcagggtgagtaacgctctcggt

SEQ ID NO: 828824 - DNA, 25 bp, Mus musculus
tctcaggtagtacaggctagcctcg

SEQ ID NO: 828825 - DNA, 25 bp, Mus musculus
tctcaggtagtagaggctagcctcg

SEQ ID NO: 828826 - DNA, 25 bp, Mus musculus
tctcaggtcaggatgtgacagacgt

SEQ ID NO: 828827 - DNA, 25 bp, Mus musculus
tctcaggtcaggttgtgacagacgt

SEQ ID NO: 828828 - DNA, 25 bp, Mus musculus
tctcaggtctgaaaggaaccatttt

SEQ ID NO: 828829 - DNA, 25 bp, Mus musculus
tctcaggtctgataggaaccatttt

SEQ ID NO: 828830 - DNA, 25 bp, Mus musculus
tctcaggtgcatctctcacaaacat

SEQ ID NO: 828831 - DNA, 25 bp, Mus musculus
tctcaggtgcatgtctcacaaacat

SEQ ID NO: 828832 - DNA, 25 bp, Mus musculus
tctcaggtgcccaggatcagggact

SEQ ID NO: 828833 - DNA, 25 bp, Mus musculus
tctcaggtgccctggatcagggact

SEQ ID NO: 828834 - DNA, 25 bp, Mus musculus
tctcaggtgcttactggacagtctt

SEQ ID NO: 828835 - DNA, 25 bp, Mus musculus
tctcaggtgctttctggacagtctt

SEQ ID NO: 828836 - DNA, 25 bp, Mus musculus
tctcaggtgtcaatcttgtggttcc

SEQ ID NO: 828837 - DNA, 25 bp, Mus musculus
tctcaggtgtcattcttgtggttcc

SEQ ID NO: 828838 - DNA, 25 bp, Mus musculus
tctcaggtgttcagtctggattagt

SEQ ID NO: 828839 - DNA, 25 bp, Mus musculus
tctcaggtgttctgtctggattagt

SEQ ID NO: 828840 - DNA, 25 bp, Mus musculus
tctcaggttaggaaggcctggcctg

SEQ ID NO: 828841 - DNA, 25 bp, Mus musculus
tctcaggttaggtaggcctggcctg

SEQ ID NO: 828842 - DNA, 25 bp, Mus musculus
tctcagtaagatccttcccattggt

SEQ ID NO: 828843 - DNA, 25 bp, Mus musculus
tctcagtaagatgcttcccattggt

SEQ ID NO: 828844 - DNA, 25 bp, Mus musculus
tctcagtaattcacttgttctaagg

SEQ ID NO: 828845 - DNA, 25 bp, Mus musculus
tctcagtaattctcttgttctaagg

SEQ ID NO: 828846 - DNA, 25 bp, Mus musculus
tctcagtactctccttctatatgta

SEQ ID NO: 828847 - DNA, 25 bp, Mus musculus
tctcagtactctgcttctatatgta

SEQ ID NO: 828848 - DNA, 25 bp, Mus musculus
tctcagtatctgaatctggtataag

SEQ ID NO: 828849 - DNA, 25 bp, Mus musculus
tctcagtatctgtatctggtataag

SEQ ID NO: 828850 - DNA, 25 bp, Mus musculus
tctcagtcaactctgaagctctaac

SEQ ID NO: 828851 - DNA, 25 bp, Mus musculus
tctcagtcaactgtgaagctctaac

SEQ ID NO: 828852 - DNA, 25 bp, Mus musculus
tctcagtcactaaacatacacagag

SEQ ID NO: 828853 - DNA, 25 bp, Mus musculus
tctcagtcactacaaggtgtcagat

SEQ ID NO: 828854 - DNA, 25 bp, Mus musculus
tctcagtcactagaaggtgtcagat

SEQ ID NO: 828855 - DNA, 25 bp, Mus musculus
tctcagtcactatacatacacagag

SEQ ID NO: 828856 - DNA, 25 bp, Mus musculus
tctcagtcatcacggttgcctaata

SEQ ID NO: 828857 - DNA, 25 bp, Mus musculus
tctcagtcatcagggttgcctaata

SEQ ID NO: 828858 - DNA, 25 bp, Mus musculus
tctcagtcattcctgtcaacaaggg

SEQ ID NO: 828859 - DNA, 25 bp, Mus musculus
tctcagtcattcgtgtcaacaaggg

SEQ ID NO: 828860 - DNA, 25 bp, Mus musculus
tctcagtccagcacatctagtagca

SEQ ID NO: 828861 - DNA, 25 bp, Mus musculus
tctcagtccagctcatctagtagca

SEQ ID NO: 828862 - DNA, 25 bp, Mus musculus
tctcagtccctacctacatggtcag

SEQ ID NO: 828863 - DNA, 25 bp, Mus musculus
tctcagtccctagctacatggtcag

SEQ ID NO: 828864 - DNA, 25 bp, Mus musculus
tctcagtcgcagacaatgcagtcgg

SEQ ID NO: 828865 - DNA, 25 bp, Mus musculus
tctcagtcgcagtcaatgcagtcgg

SEQ ID NO: 828866 - DNA, 25 bp, Mus musculus
tctcagtcggttcccatggtgacaa

SEQ ID NO: 828867 - DNA, 25 bp, Mus musculus
tctcagtcggttgccatggtgacaa

SEQ ID NO: 828868 - DNA, 25 bp, Mus musculus
tctcagtctgtgaggaatgtatggt

SEQ ID NO: 828869 - DNA, 25 bp, Mus musculus
tctcagtctgtgtggaatgtatggt

SEQ ID NO: 828870 - DNA, 25 bp, Mus musculus
tctcagtcttcccacactggcaaag

SEQ ID NO: 828871 - DNA, 25 bp, Mus musculus
tctcagtcttccgacactggcaaag

SEQ ID NO: 828872 - DNA, 25 bp, Mus musculus
tctcagtcttctcctacagtgacaa

SEQ ID NO: 828873 - DNA, 25 bp, Mus musculus
tctcagtcttctgctacagtgacaa

SEQ ID NO: 828874 - DNA, 25 bp, Mus musculus
tctcagtcttggaggtagcctgtga

SEQ ID NO: 828875 - DNA, 25 bp, Mus musculus
tctcagtcttggtggtagcctgtga

SEQ ID NO: 828876 - DNA, 25 bp, Mus musculus
tctcagtgactgacaccctctacaa

SEQ ID NO: 828877 - DNA, 25 bp, Mus musculus
tctcagtgactgtcaccctctacaa

SEQ ID NO: 828878 - DNA, 25 bp, Mus musculus
tctcagtgagcaattttcccttctt

SEQ ID NO: 828879 - DNA, 25 bp, Mus musculus
tctcagtgagcatttttcccttctt

SEQ ID NO: 828880 - DNA, 25 bp, Mus musculus
tctcagtgaggaccttctttttcca

SEQ ID NO: 828881 - DNA, 25 bp, Mus musculus
tctcagtgaggagcttctttttcca

SEQ ID NO: 828882 - DNA, 25 bp, Mus musculus
tctcagtgatgaagtcatggtgatt

SEQ ID NO: 828883 - DNA, 25 bp, Mus musculus
tctcagtgatgatgtcatggtgatt

SEQ ID NO: 828884 - DNA, 25 bp, Mus musculus
tctcagtgcaggcttactaagggct

SEQ ID NO: 828885 - DNA, 25 bp, Mus musculus
tctcagtgcagggttactaagggct

SEQ ID NO: 828886 - DNA, 25 bp, Mus musculus
tctcagtgcctaccagcgaaagtgc

SEQ ID NO: 828887 - DNA, 25 bp, Mus musculus
tctcagtgcctagcagcgaaagtgc

SEQ ID NO: 828888 - DNA, 25 bp, Mus musculus
tctcagtgctcgctttcagtattca

SEQ ID NO: 828889 - DNA, 25 bp, Mus musculus
tctcagtgctcggtttcagtattca

SEQ ID NO: 828890 - DNA, 25 bp, Mus musculus
tctcagtggacgcatctcagttcta

SEQ ID NO: 828891 - DNA, 25 bp, Mus musculus
tctcagtggacggatctcagttcta

SEQ ID NO: 828892 - DNA, 25 bp, Mus musculus
tctcagtgggtcctttgttttaagg

SEQ ID NO: 828893 - DNA, 25 bp, Mus musculus
tctcagtgggtcgtttgttttaagg

SEQ ID NO: 828894 - DNA, 25 bp, Mus musculus
tctcagtggtccagggcagagctca

SEQ ID NO: 828895 - DNA, 25 bp, Mus musculus
tctcagtggtcctgggcagagctca

SEQ ID NO: 828896 - DNA, 25 bp, Mus musculus
tctcagtgtaggcacttagcaccct

SEQ ID NO: 828897 - DNA, 25 bp, Mus musculus
tctcagtgtagggacttagcaccct

SEQ ID NO: 828898 - DNA, 25 bp, Mus musculus
tctcagtgtggaacaagtgttggaa

SEQ ID NO: 828899 - DNA, 25 bp, Mus musculus
tctcagtgtggatcaagtgttggaa

SEQ ID NO: 828900 - DNA, 25 bp, Mus musculus
tctcagtgtgtgaatggtccatgcc

SEQ ID NO: 828901 - DNA, 25 bp, Mus musculus
tctcagtgtgtgtatggtccatgcc

SEQ ID NO: 828902 - DNA, 25 bp, Mus musculus
tctcagttatgtcacctttacaggt

SEQ ID NO: 828903 - DNA, 25 bp, Mus musculus
tctcagttatgtgacctttacaggt

SEQ ID NO: 828904 - DNA, 25 bp, Mus musculus
tctcagttccagctataccacagga

SEQ ID NO: 828905 - DNA, 25 bp, Mus musculus
tctcagttccaggtataccacagga

SEQ ID NO: 828906 - DNA, 25 bp, Mus musculus
tctcagttcctcagctgtctataaa

SEQ ID NO: 828907 - DNA, 25 bp, Mus musculus
tctcagttcctctgctgtctataaa

SEQ ID NO: 828908 - DNA, 25 bp, Mus musculus
tctcagttcgggacaaggcaatggc

SEQ ID NO: 828909 - DNA, 25 bp, Mus musculus
tctcagttcgggtcaaggcaatggc

SEQ ID NO: 828910 - DNA, 25 bp, Mus musculus
tctcagttgggtatggaagcaggca

SEQ ID NO: 828911 - DNA, 25 bp, Mus musculus
tctcagttgggtttggaagcaggca

SEQ ID NO: 828912 - DNA, 25 bp, Mus musculus
tctcagttgtacattctgtgagact

SEQ ID NO: 828913 - DNA, 25 bp, Mus musculus
tctcagttgtactttctgtgagact

SEQ ID NO: 828914 - DNA, 25 bp, Mus musculus
tctcagtttcctctggatggacctg

SEQ ID NO: 828915 - DNA, 25 bp, Mus musculus
tctcagtttcctgtggatggacctg

SEQ ID NO: 828916 - DNA, 25 bp, Mus musculus
tctcagtttgccaaagagaccattg

SEQ ID NO: 828917 - DNA, 25 bp, Mus musculus
tctcagtttgcctaagagaccattg

SEQ ID NO: 828918 - DNA, 25 bp, Mus musculus
tctcagttttgtaacacccagcccc

SEQ ID NO: 828919 - DNA, 25 bp, Mus musculus
tctcagttttgttacacccagcccc

SEQ ID NO: 828920 - DNA, 25 bp, Mus musculus
tctcataaaattcccatggctcttt

SEQ ID NO: 828921 - DNA, 25 bp, Mus musculus
tctcataaaattgccatggctcttt

SEQ ID NO: 828922 - DNA, 25 bp, Mus musculus
tctcataaaggtcctgcttgctgct

SEQ ID NO: 828923 - DNA, 25 bp, Mus musculus
tctcataaaggtgctgcttgctgct

SEQ ID NO: 828924 - DNA, 25 bp, Mus musculus
tctcatacagatcaaggacgcctta

SEQ ID NO: 828925 - DNA, 25 bp, Mus musculus
tctcatacagatgaaggacgcctta

SEQ ID NO: 828926 - DNA, 25 bp, Mus musculus
tctcatacagcaaggactcggtcac

SEQ ID NO: 828927 - DNA, 25 bp, Mus musculus
tctcatacagcatggactcggtcac

SEQ ID NO: 828928 - DNA, 25 bp, Mus musculus
tctcatactataccagggcagaggc

SEQ ID NO: 828929 - DNA, 25 bp, Mus musculus
tctcatactatagcagggcagaggc

SEQ ID NO: 828930 - DNA, 25 bp, Mus musculus
tctcatacttcaaggattttggtag

SEQ ID NO: 828931 - DNA, 25 bp, Mus musculus
tctcatacttcatggattttggtag

SEQ ID NO: 828932 - DNA, 25 bp, Mus musculus
tctcatagacacagctacctacttc

SEQ ID NO: 828933 - DNA, 25 bp, Mus musculus
tctcatagacactgctacctacttc

SEQ ID NO: 828934 - DNA, 25 bp, Mus musculus
tctcatagccttagcactcacagta

SEQ ID NO: 828935 - DNA, 25 bp, Mus musculus
tctcatagcctttgcactcacagta

SEQ ID NO: 828936 - DNA, 25 bp, Mus musculus
tctcataggcatactaatatttaag

SEQ ID NO: 828937 - DNA, 25 bp, Mus musculus
tctcataggcattctaatatttaag

SEQ ID NO: 828938 - DNA, 25 bp, Mus musculus
tctcatatcactcatcagctacaca

SEQ ID NO: 828939 - DNA, 25 bp, Mus musculus
tctcatatcactgatcagctacaca

SEQ ID NO: 828940 - DNA, 25 bp, Mus musculus
tctcatatcccaacactaatgatgt

SEQ ID NO: 828941 - DNA, 25 bp, Mus musculus
tctcatatcccatcactaatgatgt

SEQ ID NO: 828942 - DNA, 25 bp, Mus musculus
tctcatatcctcatcacaatagcac

SEQ ID NO: 828943 - DNA, 25 bp, Mus musculus
tctcatatcctcttcacaatagcac

SEQ ID NO: 828944 - DNA, 25 bp, Mus musculus
tctcatatctctactttgtgatgca

SEQ ID NO: 828945 - DNA, 25 bp, Mus musculus
tctcatatctcttctttgtgatgca

SEQ ID NO: 828946 - DNA, 25 bp, Mus musculus
tctcatatgctccacataatctcca

SEQ ID NO: 828947 - DNA, 25 bp, Mus musculus
tctcatatgctcgacataatctcca

SEQ ID NO: 828948 - DNA, 25 bp, Mus musculus
tctcatatgtgtcgtgtcatagtat

SEQ ID NO: 828949 - DNA, 25 bp, Mus musculus
tctcatatgtgtggtgtcatagtat

SEQ ID NO: 828950 - DNA, 25 bp, Mus musculus
tctcatattttcacctgtagcaata

SEQ ID NO: 828951 - DNA, 25 bp, Mus musculus
tctcatattttctcctgtagcaata

SEQ ID NO: 828952 - DNA, 25 bp, Mus musculus
tctcatcaaagacgtcgggttccct

SEQ ID NO: 828953 - DNA, 25 bp, Mus musculus
tctcatcaaagaggtcgggttccct

SEQ ID NO: 828954 - DNA, 25 bp, Mus musculus
tctcatcaacccacaactaaggact

SEQ ID NO: 828955 - DNA, 25 bp, Mus musculus
tctcatcaaccctcaactaaggact

SEQ ID NO: 828956 - DNA, 25 bp, Mus musculus
tctcatcagcataacatcctcttat

SEQ ID NO: 828957 - DNA, 25 bp, Mus musculus
tctcatcagcattacatcctcttat

SEQ ID NO: 828958 - DNA, 25 bp, Mus musculus
tctcatcagtgtcgagtgcaccctc

SEQ ID NO: 828959 - DNA, 25 bp, Mus musculus
tctcatcagtgtggagtgcaccctc

SEQ ID NO: 828960 - DNA, 25 bp, Mus musculus
tctcatcatctgaatatagtgtttg

SEQ ID NO: 828961 - DNA, 25 bp, Mus musculus
tctcatcatctgtatatagtgtttg

SEQ ID NO: 828962 - DNA, 25 bp, Mus musculus
tctcatcattggcagcagcatcgga

SEQ ID NO: 828963 - DNA, 25 bp, Mus musculus
tctcatcattgggagcagcatcgga

SEQ ID NO: 828964 - DNA, 25 bp, Mus musculus
tctcatccacttcaatcctgttatg

SEQ ID NO: 828965 - DNA, 25 bp, Mus musculus
tctcatccacttgaatcctgttatg

SEQ ID NO: 828966 - DNA, 25 bp, Mus musculus
tctcatccatgtcccggtgtttgac

SEQ ID NO: 828967 - DNA, 25 bp, Mus musculus
tctcatccatgtgccggtgtttgac

SEQ ID NO: 828968 - DNA, 25 bp, Mus musculus
tctcatccattaaggatcctcctag

SEQ ID NO: 828969 - DNA, 25 bp, Mus musculus
tctcatccattatggatcctcctag

SEQ ID NO: 828970 - DNA, 25 bp, Mus musculus
tctcatcccaccataggagttctgg

SEQ ID NO: 828971 - DNA, 25 bp, Mus musculus
tctcatcccaccttaggagttctgg

SEQ ID NO: 828972 - DNA, 25 bp, Mus musculus
tctcatccccatctttagctgacac

SEQ ID NO: 828973 - DNA, 25 bp, Mus musculus
tctcatccccatgtttagctgacac

SEQ ID NO: 828974 - DNA, 25 bp, Mus musculus
tctcatcccctgctgaaaaatctag

SEQ ID NO: 828975 - DNA, 25 bp, Mus musculus
tctcatcccctggtgaaaaatctag

SEQ ID NO: 828976 - DNA, 25 bp, Mus musculus
tctcatcgaagtccccaacagttag

SEQ ID NO: 828977 - DNA, 25 bp, Mus musculus
tctcatcgaagtgcccaacagttag

SEQ ID NO: 828978 - DNA, 25 bp, Mus musculus
tctcatcggctgaggagctgtgtaa

SEQ ID NO: 828979 - DNA, 25 bp, Mus musculus
tctcatcggctgtggagctgtgtaa

SEQ ID NO: 828980 - DNA, 25 bp, Mus musculus
tctcatcggtgtctttctgtagcaa

SEQ ID NO: 828981 - DNA, 25 bp, Mus musculus
tctcatcggtgtgtttctgtagcaa

SEQ ID NO: 828982 - DNA, 25 bp, Mus musculus
tctcatctaaaaataaccaagggtg

SEQ ID NO: 828983 - DNA, 25 bp, Mus musculus
tctcatctaaaattaaccaagggtg

SEQ ID NO: 828984 - DNA, 25 bp, Mus musculus
tctcatctatcgctggtttctttat

SEQ ID NO: 828985 - DNA, 25 bp, Mus musculus
tctcatctatcggtggtttctttat

SEQ ID NO: 828986 - DNA, 25 bp, Mus musculus
tctcatctcaagaaaagccagtcat

SEQ ID NO: 828987 - DNA, 25 bp, Mus musculus
tctcatctcaagtaaagccagtcat

SEQ ID NO: 828988 - DNA, 25 bp, Mus musculus
tctcatctcgctccattcagaggaa

SEQ ID NO: 828989 - DNA, 25 bp, Mus musculus
tctcatctcgctgcattcagaggaa

SEQ ID NO: 828990 - DNA, 25 bp, Mus musculus
tctcatctgaggctaaacttttgct

SEQ ID NO: 828991 - DNA, 25 bp, Mus musculus
tctcatctgagggtaaacttttgct

SEQ ID NO: 828992 - DNA, 25 bp, Mus musculus
tctcatcttgaacggcaggaggtga

SEQ ID NO: 828993 - DNA, 25 bp, Mus musculus
tctcatcttgaagggcaggaggtga

SEQ ID NO: 828994 - DNA, 25 bp, Mus musculus
tctcatcttgacctgggttccagtt

SEQ ID NO: 828995 - DNA, 25 bp, Mus musculus
tctcatcttgacgtgggttccagtt

SEQ ID NO: 828996 - DNA, 25 bp, Mus musculus
tctcatcttggcctgaaagcagatt

SEQ ID NO: 828997 - DNA, 25 bp, Mus musculus
tctcatcttggcgtgaaagcagatt

SEQ ID NO: 828998 - DNA, 25 bp, Mus musculus
tctcatgaagttcctttcctggaca

SEQ ID NO: 828999 - DNA, 25 bp, Mus musculus
tctcatgaagttgctttcctggaca

SEQ ID NO: 829000 - DNA, 25 bp, Mus musculus
tctcatgaatatagagcggcccctg

SEQ ID NO: 829001 - DNA, 25 bp, Mus musculus
tctcatgaatattgagcggcccctg

SEQ ID NO: 829002 - DNA, 25 bp, Mus musculus
tctcatgcaattatactgggatctg

SEQ ID NO: 829003 - DNA, 25 bp, Mus musculus
tctcatgcaattttactgggatctg

SEQ ID NO: 829004 - DNA, 25 bp, Mus musculus
tctcatgcagcacttacaggccttg

SEQ ID NO: 829005 - DNA, 25 bp, Mus musculus
tctcatgcagcagttacaggccttg

SEQ ID NO: 829006 - DNA, 25 bp, Mus musculus
tctcatgcagttcccagtcaagtat

SEQ ID NO: 829007 - DNA, 25 bp, Mus musculus
tctcatgcagttgccagtcaagtat

SEQ ID NO: 829008 - DNA, 25 bp, Mus musculus
tctcatgcatggctttgcctgtact

SEQ ID NO: 829009 - DNA, 25 bp, Mus musculus
tctcatgcatgggtttgcctgtact

SEQ ID NO: 829010 - DNA, 25 bp, Mus musculus
tctcatgccaccaggtaggatctat

SEQ ID NO: 829011 - DNA, 25 bp, Mus musculus
tctcatgccacctggtaggatctat

SEQ ID NO: 829012 - DNA, 25 bp, Mus musculus
tctcatgctgcacttactgtttaca

SEQ ID NO: 829013 - DNA, 25 bp, Mus musculus
tctcatgctgcagttactgtttaca

SEQ ID NO: 829014 - DNA, 25 bp, Mus musculus
tctcatggcacccatgggcgtgtca

SEQ ID NO: 829015 - DNA, 25 bp, Mus musculus
tctcatggcaccgatgggcgtgtca

SEQ ID NO: 829016 - DNA, 25 bp, Mus musculus
tctcatggcgctcctaccgatgact

SEQ ID NO: 829017 - DNA, 25 bp, Mus musculus
tctcatggcgctgctaccgatgact

SEQ ID NO: 829018 - DNA, 25 bp, Mus musculus
tctcatgggtgcagctcctttgtga

SEQ ID NO: 829019 - DNA, 25 bp, Mus musculus
tctcatgggtgctgctcctttgtga

SEQ ID NO: 829020 - DNA, 25 bp, Mus musculus
tctcatgggttgctgaatcccgata

SEQ ID NO: 829021 - DNA, 25 bp, Mus musculus
tctcatgggttggtgaatcccgata

SEQ ID NO: 829022 - DNA, 25 bp, Mus musculus
tctcatggtagcaagcgcccagagt

SEQ ID NO: 829023 - DNA, 25 bp, Mus musculus
tctcatggtagctagcgcccagagt

SEQ ID NO: 829024 - DNA, 25 bp, Mus musculus
tctcatgtactaccgagctctgtaa

SEQ ID NO: 829025 - DNA, 25 bp, Mus musculus
tctcatgtactagcgagctctgtaa

SEQ ID NO: 829026 - DNA, 25 bp, Mus musculus
tctcatgtagtgagcagatggacag

SEQ ID NO: 829027 - DNA, 25 bp, Mus musculus
tctcatgtagtgtgcagatggacag

SEQ ID NO: 829028 - DNA, 25 bp, Mus musculus
tctcatgtcctcctattgattgttt

SEQ ID NO: 829029 - DNA, 25 bp, Mus musculus
tctcatgtcctcgtattgattgttt

SEQ ID NO: 829030 - DNA, 25 bp, Mus musculus
tctcatgtcttgatgttaggttctg

SEQ ID NO: 829031 - DNA, 25 bp, Mus musculus
tctcatgtcttgttgttaggttctg

SEQ ID NO: 829032 - DNA, 25 bp, Mus musculus
tctcatgttggccttgactttccat

SEQ ID NO: 829033 - DNA, 25 bp, Mus musculus
tctcatgttggcgttgactttccat

SEQ ID NO: 829034 - DNA, 25 bp, Mus musculus
tctcatgtttccaggtcagccttga

SEQ ID NO: 829035 - DNA, 25 bp, Mus musculus
tctcatgtttcctggtcagccttga

SEQ ID NO: 829036 - DNA, 25 bp, Mus musculus
tctcattagattatcccttggtatc

SEQ ID NO: 829037 - DNA, 25 bp, Mus musculus
tctcattagattttcccttggtatc

SEQ ID NO: 829038 - DNA, 25 bp, Mus musculus
tctcattagcttaacccgggtgtcc

SEQ ID NO: 829039 - DNA, 25 bp, Mus musculus
tctcattagctttacccgggtgtcc

SEQ ID NO: 829040 - DNA, 25 bp, Mus musculus
tctcattataacagcaccacacatc

SEQ ID NO: 829041 - DNA, 25 bp, Mus musculus
tctcattataactgcaccacacatc

SEQ ID NO: 829042 - DNA, 25 bp, Mus musculus
tctcattatctacctgaagtcctgg

SEQ ID NO: 829043 - DNA, 25 bp, Mus musculus
tctcattatctagctgaagtcctgg

SEQ ID NO: 829044 - DNA, 25 bp, Mus musculus
tctcattatggcagtgtgttgccct

SEQ ID NO: 829045 - DNA, 25 bp, Mus musculus
tctcattatggctgtgtgttgccct

SEQ ID NO: 829046 - DNA, 25 bp, Mus musculus
tctcattcagacatccactcaagta

SEQ ID NO: 829047 - DNA, 25 bp, Mus musculus
tctcattcagacttccactcaagta

SEQ ID NO: 829048 - DNA, 25 bp, Mus musculus
tctcattcatctacccatagtgaaa

SEQ ID NO: 829049 - DNA, 25 bp, Mus musculus
tctcattcatcttcccatagtgaaa

SEQ ID NO: 829050 - DNA, 25 bp, Mus musculus
tctcattccctaagtttattccacc

SEQ ID NO: 829051 - DNA, 25 bp, Mus musculus
tctcattccctatgtttattccacc

SEQ ID NO: 829052 - DNA, 25 bp, Mus musculus
tctcattcctttacatgttcaaatt

SEQ ID NO: 829053 - DNA, 25 bp, Mus musculus
tctcattccttttcatgttcaaatt

SEQ ID NO: 829054 - DNA, 25 bp, Mus musculus
tctcattctcctcacaattcggtta

SEQ ID NO: 829055 - DNA, 25 bp, Mus musculus
tctcattctcctgacaattcggtta

SEQ ID NO: 829056 - DNA, 25 bp, Mus musculus
tctcattgaagaagggttgcagctg

SEQ ID NO: 829057 - DNA, 25 bp, Mus musculus
tctcattgaagatgggttgcagctg

SEQ ID NO: 829058 - DNA, 25 bp, Mus musculus
tctcattgagacaggcttctatttc

SEQ ID NO: 829059 - DNA, 25 bp, Mus musculus
tctcattgagactggcttctatttc

SEQ ID NO: 829060 - DNA, 25 bp, Mus musculus
tctcattgagatatgttcccacaga

SEQ ID NO: 829061 - DNA, 25 bp, Mus musculus
tctcattgagatttgttcccacaga

SEQ ID NO: 829062 - DNA, 25 bp, Mus musculus
tctcattgggtcatgttccaggtgc

SEQ ID NO: 829063 - DNA, 25 bp, Mus musculus
tctcattgggtcttgttccaggtgc

SEQ ID NO: 829064 - DNA, 25 bp, Mus musculus
tctcattggtccatacctgccttaa

SEQ ID NO: 829065 - DNA, 25 bp, Mus musculus
tctcattggtccttacctgccttaa

SEQ ID NO: 829066 - DNA, 25 bp, Mus musculus
tctcattgtaagcaatcaccctcca

SEQ ID NO: 829067 - DNA, 25 bp, Mus musculus
tctcattgtaaggaatcaccctcca

SEQ ID NO: 829068 - DNA, 25 bp, Mus musculus
tctcatttaatcctgacacctgttc

SEQ ID NO: 829069 - DNA, 25 bp, Mus musculus
tctcatttaatcgtgacacctgttc

SEQ ID NO: 829070 - DNA, 25 bp, Mus musculus
tctcatttatagctcaaagcatcat

SEQ ID NO: 829071 - DNA, 25 bp, Mus musculus
tctcatttataggtcaaagcatcat

SEQ ID NO: 829072 - DNA, 25 bp, Mus musculus
tctcatttcaccaatcagggaccaa

SEQ ID NO: 829073 - DNA, 25 bp, Mus musculus
tctcatttcacctatcagggaccaa

SEQ ID NO: 829074 - DNA, 25 bp, Mus musculus
tctcatttctaaccttttcctcttc

SEQ ID NO: 829075 - DNA, 25 bp, Mus musculus
tctcatttctaagcttttcctcttc

SEQ ID NO: 829076 - DNA, 25 bp, Mus musculus
tctcatttggagaggatggtgttca

SEQ ID NO: 829077 - DNA, 25 bp, Mus musculus
tctcatttggagtggatggtgttca

SEQ ID NO: 829078 - DNA, 25 bp, Mus musculus
tctcatttgggcctagcagggtcag

SEQ ID NO: 829079 - DNA, 25 bp, Mus musculus
tctcatttgggcgtagcagggtcag

SEQ ID NO: 829080 - DNA, 25 bp, Mus musculus
tctcatttgtggatcctagatttta

SEQ ID NO: 829081 - DNA, 25 bp, Mus musculus
tctcatttgtggttcctagatttta

SEQ ID NO: 829082 - DNA, 25 bp, Mus musculus
tctcattttagaacttgcttctccc

SEQ ID NO: 829083 - DNA, 25 bp, Mus musculus
tctcattttagatcttgcttctccc

SEQ ID NO: 829084 - DNA, 25 bp, Mus musculus
tctcattttcccaccttgtaagatg

SEQ ID NO: 829085 - DNA, 25 bp, Mus musculus
tctcattttccctccttgtaagatg

SEQ ID NO: 829086 - DNA, 25 bp, Mus musculus
tctccaaaaagtagcccgtagatgt

SEQ ID NO: 829087 - DNA, 25 bp, Mus musculus
tctccaaaaagttgcccgtagatgt

SEQ ID NO: 829088 - DNA, 25 bp, Mus musculus
tctccaaaaccaaagtgcccatctg

SEQ ID NO: 829089 - DNA, 25 bp, Mus musculus
tctccaaaaccatagtgcccatctg

SEQ ID NO: 829090 - DNA, 25 bp, Mus musculus
tctccaaaattcaaggcttctattt

SEQ ID NO: 829091 - DNA, 25 bp, Mus musculus
tctccaaaattctaggcttctattt

SEQ ID NO: 829092 - DNA, 25 bp, Mus musculus
tctccaaacagaagaactttcctcc

SEQ ID NO: 829093 - DNA, 25 bp, Mus musculus
tctccaaacagatgaactttcctcc

SEQ ID NO: 829094 - DNA, 25 bp, Mus musculus
tctccaaactgaaactgctaaggca

SEQ ID NO: 829095 - DNA, 25 bp, Mus musculus
tctccaaactgaagcagaacgctct

SEQ ID NO: 829096 - DNA, 25 bp, Mus musculus
tctccaaactgatactgctaaggca

SEQ ID NO: 829097 - DNA, 25 bp, Mus musculus
tctccaaactgatgcagaacgctct

SEQ ID NO: 829098 - DNA, 25 bp, Mus musculus
tctccaaagaaacgacccttctgtg

SEQ ID NO: 829099 - DNA, 25 bp, Mus musculus
tctccaaagaaaggacccttctgtg

SEQ ID NO: 829100 - DNA, 25 bp, Mus musculus
tctccaaagatacctctgaggctgt

SEQ ID NO: 829101 - DNA, 25 bp, Mus musculus
tctccaaagatagctctgaggctgt

SEQ ID NO: 829102 - DNA, 25 bp, Mus musculus
tctccaaaggtgagaaacttatttt

SEQ ID NO: 829103 - DNA, 25 bp, Mus musculus
tctccaaaggtgtgaaacttatttt

SEQ ID NO: 829104 - DNA, 25 bp, Mus musculus
tctccaaattctctcaatcttcttt

SEQ ID NO: 829105 - DNA, 25 bp, Mus musculus
tctccaaattctgtcaatcttcttt

SEQ ID NO: 829106 - DNA, 25 bp, Mus musculus
tctccaacaagcacgcagcgtcgaa

SEQ ID NO: 829107 - DNA, 25 bp, Mus musculus
tctccaacaagctcgcagcgtcgaa

SEQ ID NO: 829108 - DNA, 25 bp, Mus musculus
tctccaacatcgctttcaactgtat

SEQ ID NO: 829109 - DNA, 25 bp, Mus musculus
tctccaacatcggtttcaactgtat

SEQ ID NO: 829110 - DNA, 25 bp, Mus musculus
tctccaaccaaacctgcttgcatgt

SEQ ID NO: 829111 - DNA, 25 bp, Mus musculus
tctccaaccaaagctgcttgcatgt

SEQ ID NO: 829112 - DNA, 25 bp, Mus musculus
tctccaacctctaacagactgctga

SEQ ID NO: 829113 - DNA, 25 bp, Mus musculus
tctccaacctcttacagactgctga

SEQ ID NO: 829114 - DNA, 25 bp, Mus musculus
tctccaaccttgctcttactcatat

SEQ ID NO: 829115 - DNA, 25 bp, Mus musculus
tctccaaccttggtcttactcatat

SEQ ID NO: 829116 - DNA, 25 bp, Mus musculus
tctccaactctcagggctacatgag

SEQ ID NO: 829117 - DNA, 25 bp, Mus musculus
tctccaactctctgggctacatgag

SEQ ID NO: 829118 - DNA, 25 bp, Mus musculus
tctccaagacttcagcacaggtata

SEQ ID NO: 829119 - DNA, 25 bp, Mus musculus
tctccaagacttgagcacaggtata

SEQ ID NO: 829120 - DNA, 25 bp, Mus musculus
tctccaagccttagccagagtgact

SEQ ID NO: 829121 - DNA, 25 bp, Mus musculus
tctccaagcctttgccagagtgact

SEQ ID NO: 829122 - DNA, 25 bp, Mus musculus
tctccaagcggcagacgaacggcta

SEQ ID NO: 829123 - DNA, 25 bp, Mus musculus
tctccaagcggctgacgaacggcta

SEQ ID NO: 829124 - DNA, 25 bp, Mus musculus
tctccaagctgtcagacttgcattt

SEQ ID NO: 829125 - DNA, 25 bp, Mus musculus
tctccaagctgtgagacttgcattt

SEQ ID NO: 829126 - DNA, 25 bp, Mus musculus
tctccaaggctgactgacgatgctt

SEQ ID NO: 829127 - DNA, 25 bp, Mus musculus
tctccaaggctgtctgacgatgctt

SEQ ID NO: 829128 - DNA, 25 bp, Mus musculus
tctccaagtgctactcaattcaact

SEQ ID NO: 829129 - DNA, 25 bp, Mus musculus
tctccaagtgcttctcaattcaact

SEQ ID NO: 829130 - DNA, 25 bp, Mus musculus
tctccaagtgttatgaagctggtgc

SEQ ID NO: 829131 - DNA, 25 bp, Mus musculus
tctccaagtgttttgaagctggtgc

SEQ ID NO: 829132 - DNA, 25 bp, Mus musculus
tctccaagttccagctaaagaggcc

SEQ ID NO: 829133 - DNA, 25 bp, Mus musculus
tctccaagttcctgctaaagaggcc

SEQ ID NO: 829134 - DNA, 25 bp, Mus musculus
tctccaagttgcatgtggtcacagt

SEQ ID NO: 829135 - DNA, 25 bp, Mus musculus
tctccaagttgcttgtggtcacagt

SEQ ID NO: 829136 - DNA, 25 bp, Mus musculus
tctccaatcggcatcatacaataca

SEQ ID NO: 829137 - DNA, 25 bp, Mus musculus
tctccaatcggcttcatacaataca

SEQ ID NO: 829138 - DNA, 25 bp, Mus musculus
tctccaatgcggatgagaggctgga

SEQ ID NO: 829139 - DNA, 25 bp, Mus musculus
tctccaatgcggttgagaggctgga

SEQ ID NO: 829140 - DNA, 25 bp, Mus musculus
tctccaatggctctgctactgcatg

SEQ ID NO: 829141 - DNA, 25 bp, Mus musculus
tctccaatggctgtgctactgcatg

SEQ ID NO: 829142 - DNA, 25 bp, Mus musculus
tctccaatgtgcatgttccaacgaa

SEQ ID NO: 829143 - DNA, 25 bp, Mus musculus
tctccaatgtgcttgttccaacgaa

SEQ ID NO: 829144 - DNA, 25 bp, Mus musculus
tctccaattcacatctcattacaca

SEQ ID NO: 829145 - DNA, 25 bp, Mus musculus
tctccaattcacttctcattacaca

SEQ ID NO: 829146 - DNA, 25 bp, Mus musculus
tctccaatttctccttttacaacct

SEQ ID NO: 829147 - DNA, 25 bp, Mus musculus
tctccaatttctgcttttacaacct

SEQ ID NO: 829148 - DNA, 25 bp, Mus musculus
tctccaatttgcatgggcggccaaa

SEQ ID NO: 829149 - DNA, 25 bp, Mus musculus
tctccaatttgcttgggcggccaaa

SEQ ID NO: 829150 - DNA, 25 bp, Mus musculus
tctccacaacccaggtgtaatacag

SEQ ID NO: 829151 - DNA, 25 bp, Mus musculus
tctccacaaccctggtgtaatacag

SEQ ID NO: 829152 - DNA, 25 bp, Mus musculus
tctccacaccagcttggaaccatgg

SEQ ID NO: 829153 - DNA, 25 bp, Mus musculus
tctccacaccaggttggaaccatgg

SEQ ID NO: 829154 - DNA, 25 bp, Mus musculus
tctccacaccttacttctgttcaaa

SEQ ID NO: 829155 - DNA, 25 bp, Mus musculus
tctccacacctttcttctgttcaaa

SEQ ID NO: 829156 - DNA, 25 bp, Mus musculus
tctccacacttgcacaccgaagaat

SEQ ID NO: 829157 - DNA, 25 bp, Mus musculus
tctccacacttggacaccgaagaat

SEQ ID NO: 829158 - DNA, 25 bp, Mus musculus
tctccacatcaacctcataatacaa

SEQ ID NO: 829159 - DNA, 25 bp, Mus musculus
tctccacatcaagctcataatacaa

SEQ ID NO: 829160 - DNA, 25 bp, Mus musculus
tctccacatgttatgcgacactgta

SEQ ID NO: 829161 - DNA, 25 bp, Mus musculus
tctccacatgttttgcgacactgta

SEQ ID NO: 829162 - DNA, 25 bp, Mus musculus
tctccaccacagatttaattatgtc

SEQ ID NO: 829163 - DNA, 25 bp, Mus musculus
tctccaccacagttttaattatgtc

SEQ ID NO: 829164 - DNA, 25 bp, Mus musculus
tctccaccataccagtcaaaacttt

SEQ ID NO: 829165 - DNA, 25 bp, Mus musculus
tctccaccatacgagtcaaaacttt

SEQ ID NO: 829166 - DNA, 25 bp, Mus musculus
tctccacccagtcagagaggaccta

SEQ ID NO: 829167 - DNA, 25 bp, Mus musculus
tctccacccagtgagagaggaccta

SEQ ID NO: 829168 - DNA, 25 bp, Mus musculus
tctccacccgagaaaacagttcctg

SEQ ID NO: 829169 - DNA, 25 bp, Mus musculus
tctccacccgagtaaacagttcctg

SEQ ID NO: 829170 - DNA, 25 bp, Mus musculus
tctccaccctttctgtgctgtgcat

SEQ ID NO: 829171 - DNA, 25 bp, Mus musculus
tctccaccctttgtgtgctgtgcat

SEQ ID NO: 829172 - DNA, 25 bp, Mus musculus
tctccaccgtgtattttgttacaca

SEQ ID NO: 829173 - DNA, 25 bp, Mus musculus
tctccaccgtgttttttgttacaca

SEQ ID NO: 829174 - DNA, 25 bp, Mus musculus
tctccacctcagctttattttatgc

SEQ ID NO: 829175 - DNA, 25 bp, Mus musculus
tctccacctcaggtttattttatgc

SEQ ID NO: 829176 - DNA, 25 bp, Mus musculus
tctccacctgctatcagtgacaaga

SEQ ID NO: 829177 - DNA, 25 bp, Mus musculus
tctccacctgctttcagtgacaaga

SEQ ID NO: 829178 - DNA, 25 bp, Mus musculus
tctccaccttcgatgccagggctgg

SEQ ID NO: 829179 - DNA, 25 bp, Mus musculus
tctccaccttcgttgccagggctgg

SEQ ID NO: 829180 - DNA, 25 bp, Mus musculus
tctccacgtcgacctaacagaatat

SEQ ID NO: 829181 - DNA, 25 bp, Mus musculus
tctccacgtcgagctaacagaatat

SEQ ID NO: 829182 - DNA, 25 bp, Mus musculus
tctccacgtgggaggcacatggttt

SEQ ID NO: 829183 - DNA, 25 bp, Mus musculus
tctccacgtgggtggcacatggttt

SEQ ID NO: 829184 - DNA, 25 bp, Mus musculus
tctccactaaggactctgccaagat

SEQ ID NO: 829185 - DNA, 25 bp, Mus musculus
tctccactaaggtctctgccaagat

SEQ ID NO: 829186 - DNA, 25 bp, Mus musculus
tctccactcagtattaataactcca

SEQ ID NO: 829187 - DNA, 25 bp, Mus musculus
tctccactcagttttaataactcca

SEQ ID NO: 829188 - DNA, 25 bp, Mus musculus
tctccactcattactgttcttctgt

SEQ ID NO: 829189 - DNA, 25 bp, Mus musculus
tctccactcatttctgttcttctgt

SEQ ID NO: 829190 - DNA, 25 bp, Mus musculus
tctccactgagtcttcatccatttg

SEQ ID NO: 829191 - DNA, 25 bp, Mus musculus
tctccactgagtgttcatccatttg

SEQ ID NO: 829192 - DNA, 25 bp, Mus musculus
tctccactgcctagtgtgtgtatag

SEQ ID NO: 829193 - DNA, 25 bp, Mus musculus
tctccactgccttgtgtgtgtatag

SEQ ID NO: 829194 - DNA, 25 bp, Mus musculus
tctccactggaaacacaaaccttgt

SEQ ID NO: 829195 - DNA, 25 bp, Mus musculus
tctccactggaatcacaaaccttgt

SEQ ID NO: 829196 - DNA, 25 bp, Mus musculus
tctccactgtccacattgtactgtt

SEQ ID NO: 829197 - DNA, 25 bp, Mus musculus
tctccactgtcctcattgtactgtt

SEQ ID NO: 829198 - DNA, 25 bp, Mus musculus
tctccactgtgcacggaggacgacg

SEQ ID NO: 829199 - DNA, 25 bp, Mus musculus
tctccactgtgctcggaggacgacg

SEQ ID NO: 829200 - DNA, 25 bp, Mus musculus
tctccacttcccaaaaggtagctta

SEQ ID NO: 829201 - DNA, 25 bp, Mus musculus
tctccacttcccaagacagttagca

SEQ ID NO: 829202 - DNA, 25 bp, Mus musculus
tctccacttccctaaaggtagctta

SEQ ID NO: 829203 - DNA, 25 bp, Mus musculus
tctccacttccctagacagttagca

SEQ ID NO: 829204 - DNA, 25 bp, Mus musculus
tctccacttggacgaactacatctg

SEQ ID NO: 829205 - DNA, 25 bp, Mus musculus
tctccacttggaggaactacatctg

SEQ ID NO: 829206 - DNA, 25 bp, Mus musculus
tctccacttggcacagaacaatttc

SEQ ID NO: 829207 - DNA, 25 bp, Mus musculus
tctccacttggctcagaacaatttc

SEQ ID NO: 829208 - DNA, 25 bp, Mus musculus
tctccagaaagcacaaactccacgg

SEQ ID NO: 829209 - DNA, 25 bp, Mus musculus
tctccagaaagctcaaactccacgg

SEQ ID NO: 829210 - DNA, 25 bp, Mus musculus
tctccagaatgcagacgaacttccg

SEQ ID NO: 829211 - DNA, 25 bp, Mus musculus
tctccagaatgctgacgaacttccg

SEQ ID NO: 829212 - DNA, 25 bp, Mus musculus
tctccagacaggaagccctcaaaga

SEQ ID NO: 829213 - DNA, 25 bp, Mus musculus
tctccagacaggtagccctcaaaga

SEQ ID NO: 829214 - DNA, 25 bp, Mus musculus
tctccagacccaaacgagggaaact

SEQ ID NO: 829215 - DNA, 25 bp, Mus musculus
tctccagacccatacgagggaaact

SEQ ID NO: 829216 - DNA, 25 bp, Mus musculus
tctccagagagcatagccatatttg

SEQ ID NO: 829217 - DNA, 25 bp, Mus musculus
tctccagagagcttagccatatttg

SEQ ID NO: 829218 - DNA, 25 bp, Mus musculus
tctccagagcctcaacattgagtct

SEQ ID NO: 829219 - DNA, 25 bp, Mus musculus
tctccagagcctgaacattgagtct

SEQ ID NO: 829220 - DNA, 25 bp, Mus musculus
tctccagagctgatccagcaacaag

SEQ ID NO: 829221 - DNA, 25 bp, Mus musculus
tctccagagctgttccagcaacaag

SEQ ID NO: 829222 - DNA, 25 bp, Mus musculus
tctccagagggactctttgttctct

SEQ ID NO: 829223 - DNA, 25 bp, Mus musculus
tctccagagggagtctttgttctct

SEQ ID NO: 829224 - DNA, 25 bp, Mus musculus
tctccagatattactctgccagcca

SEQ ID NO: 829225 - DNA, 25 bp, Mus musculus
tctccagatatttctctgccagcca

SEQ ID NO: 829226 - DNA, 25 bp, Mus musculus
tctccagcaacaatagcactctgag

SEQ ID NO: 829227 - DNA, 25 bp, Mus musculus
tctccagcaacattagcactctgag

SEQ ID NO: 829228 - DNA, 25 bp, Mus musculus
tctccagcaaccacttatacaaggc

SEQ ID NO: 829229 - DNA, 25 bp, Mus musculus
tctccagcaacctcttatacaaggc

SEQ ID NO: 829230 - DNA, 25 bp, Mus musculus
tctccagcaagcacatgttcacagg

SEQ ID NO: 829231 - DNA, 25 bp, Mus musculus
tctccagcaagctcatgttcacagg

SEQ ID NO: 829232 - DNA, 25 bp, Mus musculus
tctccagcacatatctcctaaaggt

SEQ ID NO: 829233 - DNA, 25 bp, Mus musculus
tctccagcacatttctcctaaaggt

SEQ ID NO: 829234 - DNA, 25 bp, Mus musculus
tctccagcaccaacattttcaattc

SEQ ID NO: 829235 - DNA, 25 bp, Mus musculus
tctccagcaccatcattttcaattc

SEQ ID NO: 829236 - DNA, 25 bp, Mus musculus
tctccagcactgacctgaccaaggg

SEQ ID NO: 829237 - DNA, 25 bp, Mus musculus
tctccagcactgtcctgaccaaggg

SEQ ID NO: 829238 - DNA, 25 bp, Mus musculus
tctccagcagcaactgaggttaaag

SEQ ID NO: 829239 - DNA, 25 bp, Mus musculus
tctccagcagcatctgaggttaaag

SEQ ID NO: 829240 - DNA, 25 bp, Mus musculus
tctccagcatcaccagaattcttga

SEQ ID NO: 829241 - DNA, 25 bp, Mus musculus
tctccagcatcagcagaattcttga

SEQ ID NO: 829242 - DNA, 25 bp, Mus musculus
tctccagccatgagcgcaaggtgaa

SEQ ID NO: 829243 - DNA, 25 bp, Mus musculus
tctccagccatgtgcgcaaggtgaa

SEQ ID NO: 829244 - DNA, 25 bp, Mus musculus
tctccagcccatcacagattattta

SEQ ID NO: 829245 - DNA, 25 bp, Mus musculus
tctccagcccatgacagattattta

SEQ ID NO: 829246 - DNA, 25 bp, Mus musculus
tctccagccccaaaatttaaagctt

SEQ ID NO: 829247 - DNA, 25 bp, Mus musculus
tctccagccccataatttaaagctt

SEQ ID NO: 829248 - DNA, 25 bp, Mus musculus
tctccagccccgaaaaatgtaactt

SEQ ID NO: 829249 - DNA, 25 bp, Mus musculus
tctccagccccgtaaaatgtaactt

SEQ ID NO: 829250 - DNA, 25 bp, Mus musculus
tctccagcccgtcataatggttttt

SEQ ID NO: 829251 - DNA, 25 bp, Mus musculus
tctccagcccgtgataatggttttt

SEQ ID NO: 829252 - DNA, 25 bp, Mus musculus
tctccagccctaattaggatatttg

SEQ ID NO: 829253 - DNA, 25 bp, Mus musculus
tctccagccctatttaggatatttg

SEQ ID NO: 829254 - DNA, 25 bp, Mus musculus
tctccagccctcatgctagttttta

SEQ ID NO: 829255 - DNA, 25 bp, Mus musculus
tctccagccctcttgctagttttta

SEQ ID NO: 829256 - DNA, 25 bp, Mus musculus
tctccagccctgaatgctggattct

SEQ ID NO: 829257 - DNA, 25 bp, Mus musculus
tctccagccctgtatgctggattct

SEQ ID NO: 829258 - DNA, 25 bp, Mus musculus
tctccagcccttaaaagtactattt

SEQ ID NO: 829259 - DNA, 25 bp, Mus musculus
tctccagcccttatcaaggagtgtt

SEQ ID NO: 829260 - DNA, 25 bp, Mus musculus
tctccagccctttaaagtactattt

SEQ ID NO: 829261 - DNA, 25 bp, Mus musculus
tctccagcccttttcaaggagtgtt

SEQ ID NO: 829262 - DNA, 25 bp, Mus musculus
tctccagccggaagcctgagggcat

SEQ ID NO: 829263 - DNA, 25 bp, Mus musculus
tctccagccggatgcctgagggcat

SEQ ID NO: 829264 - DNA, 25 bp, Mus musculus
tctccagcctctaaagatgaaattg

SEQ ID NO: 829265 - DNA, 25 bp, Mus musculus
tctccagcctctaagttactgattt

SEQ ID NO: 829266 - DNA, 25 bp, Mus musculus
tctccagcctcttaagatgaaattg

SEQ ID NO: 829267 - DNA, 25 bp, Mus musculus
tctccagcctcttagttactgattt

SEQ ID NO: 829268 - DNA, 25 bp, Mus musculus
tctccagcctgcaccagaggacaag

SEQ ID NO: 829269 - DNA, 25 bp, Mus musculus
tctccagcctgctccagaggacaag

SEQ ID NO: 829270 - DNA, 25 bp, Mus musculus
tctccagccttaattcttgcttcag

SEQ ID NO: 829271 - DNA, 25 bp, Mus musculus
tctccagccttatttcttgcttcag

SEQ ID NO: 829272 - DNA, 25 bp, Mus musculus
tctccagctatgaacatgccgtcag

SEQ ID NO: 829273 - DNA, 25 bp, Mus musculus
tctccagctatgtacatgccgtcag

SEQ ID NO: 829274 - DNA, 25 bp, Mus musculus
tctccagctccacatgtttctagtt

SEQ ID NO: 829275 - DNA, 25 bp, Mus musculus
tctccagctccagatgtttctagtt

SEQ ID NO: 829276 - DNA, 25 bp, Mus musculus
tctccagctctgacaaaaatcgaac

SEQ ID NO: 829277 - DNA, 25 bp, Mus musculus
tctccagctctgtcaaaaatcgaac

SEQ ID NO: 829278 - DNA, 25 bp, Mus musculus
tctccagctcttctattttcaagga

SEQ ID NO: 829279 - DNA, 25 bp, Mus musculus
tctccagctcttgtattttcaagga

SEQ ID NO: 829280 - DNA, 25 bp, Mus musculus
tctccaggaacaagctttgtgcttg

SEQ ID NO: 829281 - DNA, 25 bp, Mus musculus
tctccaggaacatgctttgtgcttg

SEQ ID NO: 829282 - DNA, 25 bp, Mus musculus
tctccaggacctactttttctatga

SEQ ID NO: 829283 - DNA, 25 bp, Mus musculus
tctccaggaccttctttttctatga

SEQ ID NO: 829284 - DNA, 25 bp, Mus musculus
tctccaggactcagggaagggcgct

SEQ ID NO: 829285 - DNA, 25 bp, Mus musculus
tctccaggactctgggaagggcgct

SEQ ID NO: 829286 - DNA, 25 bp, Mus musculus
tctccaggagagacaaccggtgtca

SEQ ID NO: 829287 - DNA, 25 bp, Mus musculus
tctccaggagagtcaaccggtgtca

SEQ ID NO: 829288 - DNA, 25 bp, Mus musculus
tctccaggatctcctttgccaagga

SEQ ID NO: 829289 - DNA, 25 bp, Mus musculus
tctccaggatctgctttgccaagga

SEQ ID NO: 829290 - DNA, 25 bp, Mus musculus
tctccaggattcaggaaagtcccta

SEQ ID NO: 829291 - DNA, 25 bp, Mus musculus
tctccaggattctggaaagtcccta

SEQ ID NO: 829292 - DNA, 25 bp, Mus musculus
tctccaggcagaaccgacaaaacta

SEQ ID NO: 829293 - DNA, 25 bp, Mus musculus
tctccaggcagatccgacaaaacta

SEQ ID NO: 829294 - DNA, 25 bp, Mus musculus
tctccaggccctactaaaaggtgtc

SEQ ID NO: 829295 - DNA, 25 bp, Mus musculus
tctccaggcccttctaaaaggtgtc

SEQ ID NO: 829296 - DNA, 25 bp, Mus musculus
tctccaggcgacatggctcccatag

SEQ ID NO: 829297 - DNA, 25 bp, Mus musculus
tctccaggcgacttggctcccatag

SEQ ID NO: 829298 - DNA, 25 bp, Mus musculus
tctccaggctcaactgttctagtta

SEQ ID NO: 829299 - DNA, 25 bp, Mus musculus
tctccaggctcatctgttctagtta

SEQ ID NO: 829300 - DNA, 25 bp, Mus musculus
tctccaggctctctagaggcaggca

SEQ ID NO: 829301 - DNA, 25 bp, Mus musculus
tctccaggctctgtagaggcaggca

SEQ ID NO: 829302 - DNA, 25 bp, Mus musculus
tctccagggcacatgagtggctctt

SEQ ID NO: 829303 - DNA, 25 bp, Mus musculus
tctccagggcacttgagtggctctt

SEQ ID NO: 829304 - DNA, 25 bp, Mus musculus
tctccagggctaactcagtgacttg

SEQ ID NO: 829305 - DNA, 25 bp, Mus musculus
tctccagggctatctcagtgacttg

SEQ ID NO: 829306 - DNA, 25 bp, Mus musculus
tctccagggtcacgcttgcagaacg

SEQ ID NO: 829307 - DNA, 25 bp, Mus musculus
tctccagggtcaggcttgcagaacg

SEQ ID NO: 829308 - DNA, 25 bp, Mus musculus
tctccaggtacaacattcattccct

SEQ ID NO: 829309 - DNA, 25 bp, Mus musculus
tctccaggtacatcattcattccct

SEQ ID NO: 829310 - DNA, 25 bp, Mus musculus
tctccaggtataacgtttctttctt

SEQ ID NO: 829311 - DNA, 25 bp, Mus musculus
tctccaggtatatcgtttctttctt

SEQ ID NO: 829312 - DNA, 25 bp, Mus musculus
tctccaggtgaccaactctatcagg

SEQ ID NO: 829313 - DNA, 25 bp, Mus musculus
tctccaggtgacgaactctatcagg

SEQ ID NO: 829314 - DNA, 25 bp, Mus musculus
tctccagtatggctgcaaacactca

SEQ ID NO: 829315 - DNA, 25 bp, Mus musculus
tctccagtatgggtgcaaacactca

SEQ ID NO: 829316 - DNA, 25 bp, Mus musculus
tctccagtccaccagtggttagcat

SEQ ID NO: 829317 - DNA, 25 bp, Mus musculus
tctccagtccacgagtggttagcat

SEQ ID NO: 829318 - DNA, 25 bp, Mus musculus
tctccagtccctaaggacttttgga

SEQ ID NO: 829319 - DNA, 25 bp, Mus musculus
tctccagtcccttaggacttttgga

SEQ ID NO: 829320 - DNA, 25 bp, Mus musculus
tctccagtccttagactctagagga

SEQ ID NO: 829321 - DNA, 25 bp, Mus musculus
tctccagtcctttgactctagagga

SEQ ID NO: 829322 - DNA, 25 bp, Mus musculus
tctccagtctgcacctccaaaagtg

SEQ ID NO: 829323 - DNA, 25 bp, Mus musculus
tctccagtctgctcctccaaaagtg

SEQ ID NO: 829324 - DNA, 25 bp, Mus musculus
tctccagtgaaccttttcccttagg

SEQ ID NO: 829325 - DNA, 25 bp, Mus musculus
tctccagtgaacgttttcccttagg

SEQ ID NO: 829326 - DNA, 25 bp, Mus musculus
tctccagtgagcacataccatgcgg

SEQ ID NO: 829327 - DNA, 25 bp, Mus musculus
tctccagtgagctcataccatgcgg

SEQ ID NO: 829328 - DNA, 25 bp, Mus musculus
tctccagtgcacatgactctttgtg

SEQ ID NO: 829329 - DNA, 25 bp, Mus musculus
tctccagtgcacttgactctttgtg

SEQ ID NO: 829330 - DNA, 25 bp, Mus musculus
tctccagtgccacatcacacaattt

SEQ ID NO: 829331 - DNA, 25 bp, Mus musculus
tctccagtgccagatcacacaattt

SEQ ID NO: 829332 - DNA, 25 bp, Mus musculus
tctccagtgtggcttcatcaagccc

SEQ ID NO: 829333 - DNA, 25 bp, Mus musculus
tctccagtgtgggttcatcaagccc

SEQ ID NO: 829334 - DNA, 25 bp, Mus musculus
tctccagttgcacgtgctgtttgca

SEQ ID NO: 829335 - DNA, 25 bp, Mus musculus
tctccagttgcaggtgctgtttgca

SEQ ID NO: 829336 - DNA, 25 bp, Mus musculus
tctccataacccacttgaaacacga

SEQ ID NO: 829337 - DNA, 25 bp, Mus musculus
tctccataaccctcttgaaacacga

SEQ ID NO: 829338 - DNA, 25 bp, Mus musculus
tctccatacttacccaaggcctttg

SEQ ID NO: 829339 - DNA, 25 bp, Mus musculus
tctccatacttagccaaggcctttg

SEQ ID NO: 829340 - DNA, 25 bp, Mus musculus
tctccatagcacagagcgccacaga

SEQ ID NO: 829341 - DNA, 25 bp, Mus musculus
tctccatagcactgagcgccacaga

SEQ ID NO: 829342 - DNA, 25 bp, Mus musculus
tctccatagtctacgtgccctgtgg

SEQ ID NO: 829343 - DNA, 25 bp, Mus musculus
tctccatagtcttcgtgccctgtgg

SEQ ID NO: 829344 - DNA, 25 bp, Mus musculus
tctccatattacattttatcttgtg

SEQ ID NO: 829345 - DNA, 25 bp, Mus musculus
tctccatattactttttatcttgtg

SEQ ID NO: 829346 - DNA, 25 bp, Mus musculus
tctccatatttcactctttgggatg

SEQ ID NO: 829347 - DNA, 25 bp, Mus musculus
tctccatatttctctctttgggatg

SEQ ID NO: 829348 - DNA, 25 bp, Mus musculus
tctccatcacacactatgttgactg

SEQ ID NO: 829349 - DNA, 25 bp, Mus musculus
tctccatcacactctatgttgactg

SEQ ID NO: 829350 - DNA, 25 bp, Mus musculus
tctccatcacatcctgatagtctat

SEQ ID NO: 829351 - DNA, 25 bp, Mus musculus
tctccatcacatgctgatagtctat

SEQ ID NO: 829352 - DNA, 25 bp, Mus musculus
tctccatccaggagagcggctaaaa

SEQ ID NO: 829353 - DNA, 25 bp, Mus musculus
tctccatccaggtgagcggctaaaa

SEQ ID NO: 829354 - DNA, 25 bp, Mus musculus
tctccatccttcaatctgtctgata

SEQ ID NO: 829355 - DNA, 25 bp, Mus musculus
tctccatccttcatggtgcaagctt

SEQ ID NO: 829356 - DNA, 25 bp, Mus musculus
tctccatccttctatctgtctgata

SEQ ID NO: 829357 - DNA, 25 bp, Mus musculus
tctccatccttcttggtgcaagctt

SEQ ID NO: 829358 - DNA, 25 bp, Mus musculus
tctccatcgggtcgtgtgtatcttg

SEQ ID NO: 829359 - DNA, 25 bp, Mus musculus
tctccatcgggtggtgtgtatcttg

SEQ ID NO: 829360 - DNA, 25 bp, Mus musculus
tctccatctggaatctttccttcat

SEQ ID NO: 829361 - DNA, 25 bp, Mus musculus
tctccatctggattctttccttcat

SEQ ID NO: 829362 - DNA, 25 bp, Mus musculus
tctccatgatccacagggtgaattt

SEQ ID NO: 829363 - DNA, 25 bp, Mus musculus
tctccatgatcctcagggtgaattt

SEQ ID NO: 829364 - DNA, 25 bp, Mus musculus
tctccatgcagacaacattaattat

SEQ ID NO: 829365 - DNA, 25 bp, Mus musculus
tctccatgcagagaacattaattat

SEQ ID NO: 829366 - DNA, 25 bp, Mus musculus
tctccatgcatccaggtctatcgac

SEQ ID NO: 829367 - DNA, 25 bp, Mus musculus
tctccatgcatcgaggtctatcgac

SEQ ID NO: 829368 - DNA, 25 bp, Mus musculus
tctccatgcctaccccgaaagtgag

SEQ ID NO: 829369 - DNA, 25 bp, Mus musculus
tctccatgcctagcccgaaagtgag

SEQ ID NO: 829370 - DNA, 25 bp, Mus musculus
tctccatgccttcagctgttttcag

SEQ ID NO: 829371 - DNA, 25 bp, Mus musculus
tctccatgccttgagctgttttcag

SEQ ID NO: 829372 - DNA, 25 bp, Mus musculus
tctccatgctctaggctgcagttaa

SEQ ID NO: 829373 - DNA, 25 bp, Mus musculus
tctccatgctcttggctgcagttaa

SEQ ID NO: 829374 - DNA, 25 bp, Mus musculus
tctccatgcttactgctaccataga

SEQ ID NO: 829375 - DNA, 25 bp, Mus musculus
tctccatgcttagtgctaccataga

SEQ ID NO: 829376 - DNA, 25 bp, Mus musculus
tctccatggctcaagacccggctaa

SEQ ID NO: 829377 - DNA, 25 bp, Mus musculus
tctccatggctctagacccggctaa

SEQ ID NO: 829378 - DNA, 25 bp, Mus musculus
tctccatgtaatagcacagggttaa

SEQ ID NO: 829379 - DNA, 25 bp, Mus musculus
tctccatgtaattgcacagggttaa

SEQ ID NO: 829380 - DNA, 25 bp, Mus musculus
tctccatgtaccaagcaacctattg

SEQ ID NO: 829381 - DNA, 25 bp, Mus musculus
tctccatgtacctagcaacctattg

SEQ ID NO: 829382 - DNA, 25 bp, Mus musculus
tctccatgtggcatgcagaatctgc

SEQ ID NO: 829383 - DNA, 25 bp, Mus musculus
tctccatgtggcttgcagaatctgc

SEQ ID NO: 829384 - DNA, 25 bp, Mus musculus
tctccatgtgtcaccaagtgaagtt

SEQ ID NO: 829385 - DNA, 25 bp, Mus musculus
tctccatgtgtctccaagtgaagtt

SEQ ID NO: 829386 - DNA, 25 bp, Mus musculus
tctccattcttcatccaataactta

SEQ ID NO: 829387 - DNA, 25 bp, Mus musculus
tctccattcttcttccaataactta

SEQ ID NO: 829388 - DNA, 25 bp, Mus musculus
tctccattgcagcccactgtagcgc

SEQ ID NO: 829389 - DNA, 25 bp, Mus musculus
tctccattgcaggccactgtagcgc

SEQ ID NO: 829390 - DNA, 25 bp, Mus musculus
tctccattgcttacttagtcttgta

SEQ ID NO: 829391 - DNA, 25 bp, Mus musculus
tctccattgctttcttagtcttgta

SEQ ID NO: 829392 - DNA, 25 bp, Mus musculus
tctccatttcctaacatgggcacag

SEQ ID NO: 829393 - DNA, 25 bp, Mus musculus
tctccatttccttacatgggcacag

SEQ ID NO: 829394 - DNA, 25 bp, Mus musculus
tctccatttgtcacatgttccgaat

SEQ ID NO: 829395 - DNA, 25 bp, Mus musculus
tctccatttgtctcatgttccgaat

SEQ ID NO: 829396 - DNA, 25 bp, Mus musculus
tctccattttccaatgcatcataag

SEQ ID NO: 829397 - DNA, 25 bp, Mus musculus
tctccattttcctatgcatcataag

SEQ ID NO: 829398 - DNA, 25 bp, Mus musculus
tctccattttctacagcatccagtg

SEQ ID NO: 829399 - DNA, 25 bp, Mus musculus
tctccattttcttcagcatccagtg

SEQ ID NO: 829400 - DNA, 25 bp, Mus musculus
tctccattttgacatccacgcataa

SEQ ID NO: 829401 - DNA, 25 bp, Mus musculus
tctccattttgagatccacgcataa

SEQ ID NO: 829402 - DNA, 25 bp, Mus musculus
tctcccaaactcaggatttatagga

SEQ ID NO: 829403 - DNA, 25 bp, Mus musculus
tctcccaaactctggatttatagga

SEQ ID NO: 829404 - DNA, 25 bp, Mus musculus
tctcccaaatcaataccactcaggt

SEQ ID NO: 829405 - DNA, 25 bp, Mus musculus
tctcccaaatcattaccactcaggt

SEQ ID NO: 829406 - DNA, 25 bp, Mus musculus
tctcccaaattgaaactcgtgtgct

SEQ ID NO: 829407 - DNA, 25 bp, Mus musculus
tctcccaaattgtaactcgtgtgct

SEQ ID NO: 829408 - DNA, 25 bp, Mus musculus
tctcccaagatgagactgaccctga

SEQ ID NO: 829409 - DNA, 25 bp, Mus musculus
tctcccaagatgtgactgaccctga

SEQ ID NO: 829410 - DNA, 25 bp, Mus musculus
tctcccaaggtacttcctatacttt

SEQ ID NO: 829411 - DNA, 25 bp, Mus musculus
tctcccaaggtagttcctatacttt

SEQ ID NO: 829412 - DNA, 25 bp, Mus musculus
tctcccaatgtgactgtcagtctgt

SEQ ID NO: 829413 - DNA, 25 bp, Mus musculus
tctcccaatgtgtctgtcagtctgt

SEQ ID NO: 829414 - DNA, 25 bp, Mus musculus
tctcccacaagaaggcctctgattt

SEQ ID NO: 829415 - DNA, 25 bp, Mus musculus
tctcccacaagatggcctctgattt

SEQ ID NO: 829416 - DNA, 25 bp, Mus musculus
tctcccacacacatgttcagatgga

SEQ ID NO: 829417 - DNA, 25 bp, Mus musculus
tctcccacacacttgttcagatgga

SEQ ID NO: 829418 - DNA, 25 bp, Mus musculus
tctcccacctaaagtacactaacta

SEQ ID NO: 829419 - DNA, 25 bp, Mus musculus
tctcccacctaatgtacactaacta

SEQ ID NO: 829420 - DNA, 25 bp, Mus musculus
tctcccacctgtcagatacaacaga

SEQ ID NO: 829421 - DNA, 25 bp, Mus musculus
tctcccacctgtgagatacaacaga

SEQ ID NO: 829422 - DNA, 25 bp, Mus musculus
tctcccacggttatggaccaacaga

SEQ ID NO: 829423 - DNA, 25 bp, Mus musculus
tctcccacggttttggaccaacaga

SEQ ID NO: 829424 - DNA, 25 bp, Mus musculus
tctcccactaagaagtccacagata

SEQ ID NO: 829425 - DNA, 25 bp, Mus musculus
tctcccactaagtagtccacagata

SEQ ID NO: 829426 - DNA, 25 bp, Mus musculus
tctcccactgagaccagataagact

SEQ ID NO: 829427 - DNA, 25 bp, Mus musculus
tctcccactgagatggcctgtgtag

SEQ ID NO: 829428 - DNA, 25 bp, Mus musculus
tctcccactgagtccagataagact

SEQ ID NO: 829429 - DNA, 25 bp, Mus musculus
tctcccactgagttggcctgtgtag

SEQ ID NO: 829430 - DNA, 25 bp, Mus musculus
tctcccacttgtataatctactcaa

SEQ ID NO: 829431 - DNA, 25 bp, Mus musculus
tctcccacttgtttaatctactcaa

SEQ ID NO: 829432 - DNA, 25 bp, Mus musculus
tctcccagactcatagcatcaactg

SEQ ID NO: 829433 - DNA, 25 bp, Mus musculus
tctcccagactcttagcatcaactg

SEQ ID NO: 829434 - DNA, 25 bp, Mus musculus
tctcccagagagacattaacgtact

SEQ ID NO: 829435 - DNA, 25 bp, Mus musculus
tctcccagagagtcattaacgtact

SEQ ID NO: 829436 - DNA, 25 bp, Mus musculus
tctcccagagtgacattatcgtgga

SEQ ID NO: 829437 - DNA, 25 bp, Mus musculus
tctcccagagtgtcattatcgtgga

SEQ ID NO: 829438 - DNA, 25 bp, Mus musculus
tctcccagatcgctgacagtcacta

SEQ ID NO: 829439 - DNA, 25 bp, Mus musculus
tctcccagatcggtgacagtcacta

SEQ ID NO: 829440 - DNA, 25 bp, Mus musculus
tctcccagatctcactttgtgtgca

SEQ ID NO: 829441 - DNA, 25 bp, Mus musculus
tctcccagatctgactttgtgtgca

SEQ ID NO: 829442 - DNA, 25 bp, Mus musculus
tctcccaggagaagagctgtatgtg

SEQ ID NO: 829443 - DNA, 25 bp, Mus musculus
tctcccaggagatgagctgtatgtg

SEQ ID NO: 829444 - DNA, 25 bp, Mus musculus
tctcccaggcatcttagcttcctct

SEQ ID NO: 829445 - DNA, 25 bp, Mus musculus
tctcccaggcatgttagcttcctct

SEQ ID NO: 829446 - DNA, 25 bp, Mus musculus
tctcccagggtgagcagactgcatt

SEQ ID NO: 829447 - DNA, 25 bp, Mus musculus
tctcccagggtgtgcagactgcatt

SEQ ID NO: 829448 - DNA, 25 bp, Mus musculus
tctcccaggtcactagcagttgaag

SEQ ID NO: 829449 - DNA, 25 bp, Mus musculus
tctcccaggtcagtagcagttgaag

SEQ ID NO: 829450 - DNA, 25 bp, Mus musculus
tctcccaggtcccttgtaaatagaa

SEQ ID NO: 829451 - DNA, 25 bp, Mus musculus
tctcccaggtccgttgtaaatagaa

SEQ ID NO: 829452 - DNA, 25 bp, Mus musculus
tctcccagtaagatccttctttagt

SEQ ID NO: 829453 - DNA, 25 bp, Mus musculus
tctcccagtaagttccttctttagt

SEQ ID NO: 829454 - DNA, 25 bp, Mus musculus
tctcccagtagaaggactttctctt

SEQ ID NO: 829455 - DNA, 25 bp, Mus musculus
tctcccagtagatggactttctctt

SEQ ID NO: 829456 - DNA, 25 bp, Mus musculus
tctcccagtgaaacttttaatttgt

SEQ ID NO: 829457 - DNA, 25 bp, Mus musculus
tctcccagtgaatcttttaatttgt

SEQ ID NO: 829458 - DNA, 25 bp, Mus musculus
tctcccagtgttagtggactcagat

SEQ ID NO: 829459 - DNA, 25 bp, Mus musculus
tctcccagtgtttgtggactcagat

SEQ ID NO: 829460 - DNA, 25 bp, Mus musculus
tctcccagtttaccactgtttcggg

SEQ ID NO: 829461 - DNA, 25 bp, Mus musculus
tctcccagtttagcactgtttcggg

SEQ ID NO: 829462 - DNA, 25 bp, Mus musculus
tctcccatagataaggctcgcccaa

SEQ ID NO: 829463 - DNA, 25 bp, Mus musculus
tctcccatagattaggctcgcccaa

SEQ ID NO: 829464 - DNA, 25 bp, Mus musculus
tctcccatcagcacatctgattctg

SEQ ID NO: 829465 - DNA, 25 bp, Mus musculus
tctcccatcagctcatctgattctg

SEQ ID NO: 829466 - DNA, 25 bp, Mus musculus
tctcccatccatcaggctgctaaaa

SEQ ID NO: 829467 - DNA, 25 bp, Mus musculus
tctcccatccatgaggctgctaaaa

SEQ ID NO: 829468 - DNA, 25 bp, Mus musculus
tctcccatgaccattttgtacctaa

SEQ ID NO: 829469 - DNA, 25 bp, Mus musculus
tctcccatgacctttttgtacctaa

SEQ ID NO: 829470 - DNA, 25 bp, Mus musculus
tctcccatgcataggacgctacaaa

SEQ ID NO: 829471 - DNA, 25 bp, Mus musculus
tctcccatgcattggacgctacaaa

SEQ ID NO: 829472 - DNA, 25 bp, Mus musculus
tctcccatggcaccaagatttcaaa

SEQ ID NO: 829473 - DNA, 25 bp, Mus musculus
tctcccatggcagcaagatttcaaa

SEQ ID NO: 829474 - DNA, 25 bp, Mus musculus
tctcccatggccacaaaggattata

SEQ ID NO: 829475 - DNA, 25 bp, Mus musculus
tctcccatggcctcaaaggattata

SEQ ID NO: 829476 - DNA, 25 bp, Mus musculus
tctccccaaacgaaggtcaccatgt

SEQ ID NO: 829477 - DNA, 25 bp, Mus musculus
tctccccaaacgtaggtcaccatgt

SEQ ID NO: 829478 - DNA, 25 bp, Mus musculus
tctccccaagccagtcaaggagagg

SEQ ID NO: 829479 - DNA, 25 bp, Mus musculus
tctccccaagcctgtcaaggagagg

SEQ ID NO: 829480 - DNA, 25 bp, Mus musculus
tctccccaaggcaagcttaaccttt

SEQ ID NO: 829481 - DNA, 25 bp, Mus musculus
tctccccaaggctagcttaaccttt

SEQ ID NO: 829482 - DNA, 25 bp, Mus musculus
tctccccaattcatcactgtgagtg

SEQ ID NO: 829483 - DNA, 25 bp, Mus musculus
tctccccaattcttcactgtgagtg

SEQ ID NO: 829484 - DNA, 25 bp, Mus musculus
tctccccacatcaatcaaatgctat

SEQ ID NO: 829485 - DNA, 25 bp, Mus musculus
tctccccacatctatcaaatgctat

SEQ ID NO: 829486 - DNA, 25 bp, Mus musculus
tctccccagaccaggacatttttga

SEQ ID NO: 829487 - DNA, 25 bp, Mus musculus
tctccccagacctggacatttttga

SEQ ID NO: 829488 - DNA, 25 bp, Mus musculus
tctccccagactcttgtatttacaa

SEQ ID NO: 829489 - DNA, 25 bp, Mus musculus
tctccccagactgttgtatttacaa

SEQ ID NO: 829490 - DNA, 25 bp, Mus musculus
tctccccaggaaatctcacgtaatt

SEQ ID NO: 829491 - DNA, 25 bp, Mus musculus
tctccccaggaattctcacgtaatt

SEQ ID NO: 829492 - DNA, 25 bp, Mus musculus
tctccccagttcaccacataaatag

SEQ ID NO: 829493 - DNA, 25 bp, Mus musculus
tctccccagttctccacataaatag

SEQ ID NO: 829494 - DNA, 25 bp, Mus musculus
tctccccatacacacagttgtcatt

SEQ ID NO: 829495 - DNA, 25 bp, Mus musculus
tctccccatacagacagttgtcatt

SEQ ID NO: 829496 - DNA, 25 bp, Mus musculus
tctccccatagcctgagtgatgagg

SEQ ID NO: 829497 - DNA, 25 bp, Mus musculus
tctccccatagcgtgagtgatgagg

SEQ ID NO: 829498 - DNA, 25 bp, Mus musculus
tctccccatctgcagtacatgaata

SEQ ID NO: 829499 - DNA, 25 bp, Mus musculus
tctccccatctggagtacatgaata

SEQ ID NO: 829500 - DNA, 25 bp, Mus musculus
tctccccatgtaatccaggcagtta

SEQ ID NO: 829501 - DNA, 25 bp, Mus musculus
tctccccatgtattccaggcagtta

SEQ ID NO: 829502 - DNA, 25 bp, Mus musculus
tctccccgagacactgtgatatgta

SEQ ID NO: 829503 - DNA, 25 bp, Mus musculus
tctccccgagactctgtgatatgta

SEQ ID NO: 829504 - DNA, 25 bp, Mus musculus
tctccccggaggatgttcggcagaa

SEQ ID NO: 829505 - DNA, 25 bp, Mus musculus
tctccccggaggttgttcggcagaa

SEQ ID NO: 829506 - DNA, 25 bp, Mus musculus
tctccccggcacatttgctttttaa

SEQ ID NO: 829507 - DNA, 25 bp, Mus musculus
tctccccggcacttttgctttttaa

SEQ ID NO: 829508 - DNA, 25 bp, Mus musculus
tctcccctagttctccaagggtgta

SEQ ID NO: 829509 - DNA, 25 bp, Mus musculus
tctcccctagttgtccaagggtgta

SEQ ID NO: 829510 - DNA, 25 bp, Mus musculus
tctcccctcactcaaggtaaagttt

SEQ ID NO: 829511 - DNA, 25 bp, Mus musculus
tctcccctcactgaaggtaaagttt

SEQ ID NO: 829512 - DNA, 25 bp, Mus musculus
tctcccctcattactactatttttg

SEQ ID NO: 829513 - DNA, 25 bp, Mus musculus
tctcccctcatttctactatttttg

SEQ ID NO: 829514 - DNA, 25 bp, Mus musculus
tctcccctccttatagtaatcttaa

SEQ ID NO: 829515 - DNA, 25 bp, Mus musculus
tctcccctccttttagtaatcttaa

SEQ ID NO: 829516 - DNA, 25 bp, Mus musculus
tctcccctctctacagaagtagctt

SEQ ID NO: 829517 - DNA, 25 bp, Mus musculus
tctcccctctcttcagaagtagctt

SEQ ID NO: 829518 - DNA, 25 bp, Mus musculus
tctcccctctgcagatggaaagata

SEQ ID NO: 829519 - DNA, 25 bp, Mus musculus
tctcccctctgctgatggaaagata

SEQ ID NO: 829520 - DNA, 25 bp, Mus musculus
tctcccctgagcaagaatacattcc

SEQ ID NO: 829521 - DNA, 25 bp, Mus musculus
tctcccctgagctagaatacattcc

SEQ ID NO: 829522 - DNA, 25 bp, Mus musculus
tctcccctgctcatgaatcagtaga

SEQ ID NO: 829523 - DNA, 25 bp, Mus musculus
tctcccctgctcttgaatcagtaga

SEQ ID NO: 829524 - DNA, 25 bp, Mus musculus
tctcccctggatctttcgatgacaa

SEQ ID NO: 829525 - DNA, 25 bp, Mus musculus
tctcccctggatgtttcgatgacaa

SEQ ID NO: 829526 - DNA, 25 bp, Mus musculus
tctcccctgtccagaagaatgtttt

SEQ ID NO: 829527 - DNA, 25 bp, Mus musculus
tctcccctgtcctgaagaatgtttt

SEQ ID NO: 829528 - DNA, 25 bp, Mus musculus
tctcccctgtgaccttacaaagatt

SEQ ID NO: 829529 - DNA, 25 bp, Mus musculus
tctcccctgtgagcttacaaagatt

SEQ ID NO: 829530 - DNA, 25 bp, Mus musculus
tctccccttcccaagaaggagagag

SEQ ID NO: 829531 - DNA, 25 bp, Mus musculus
tctccccttccctagaaggagagag

SEQ ID NO: 829532 - DNA, 25 bp, Mus musculus
tctccccttggactactggaatcag

SEQ ID NO: 829533 - DNA, 25 bp, Mus musculus
tctccccttggagtactggaatcag

SEQ ID NO: 829534 - DNA, 25 bp, Mus musculus
tctcccctttatcccatggatagag

SEQ ID NO: 829535 - DNA, 25 bp, Mus musculus
tctcccctttatgccatggatagag

SEQ ID NO: 829536 - DNA, 25 bp, Mus musculus
tctcccctttgtaaacgtttggcat

SEQ ID NO: 829537 - DNA, 25 bp, Mus musculus
tctcccctttgttaacgtttggcat

SEQ ID NO: 829538 - DNA, 25 bp, Mus musculus
tctcccgaagccaagtggcagtgaa

SEQ ID NO: 829539 - DNA, 25 bp, Mus musculus
tctcccgaagcctagtggcagtgaa

SEQ ID NO: 829540 - DNA, 25 bp, Mus musculus
tctcccgacttgaattgtcatcatg

SEQ ID NO: 829541 - DNA, 25 bp, Mus musculus
tctcccgacttgtattgtcatcatg

SEQ ID NO: 829542 - DNA, 25 bp, Mus musculus
tctcccgaggccagctggtggtaaa

SEQ ID NO: 829543 - DNA, 25 bp, Mus musculus
tctcccgaggcctgctggtggtaaa

SEQ ID NO: 829544 - DNA, 25 bp, Mus musculus
tctcccgagggtaatgtggcattca

SEQ ID NO: 829545 - DNA, 25 bp, Mus musculus
tctcccgagggttatgtggcattca

SEQ ID NO: 829546 - DNA, 25 bp, Mus musculus
tctcccgcggttcaagagagaccaa

SEQ ID NO: 829547 - DNA, 25 bp, Mus musculus
tctcccgcggttgaagagagaccaa

SEQ ID NO: 829548 - DNA, 25 bp, Mus musculus
tctcccgctccgaaaatattttagt

SEQ ID NO: 829549 - DNA, 25 bp, Mus musculus
tctcccgctccgtaaatattttagt

SEQ ID NO: 829550 - DNA, 25 bp, Mus musculus
tctcccggaggtagaaagcagttct

SEQ ID NO: 829551 - DNA, 25 bp, Mus musculus
tctcccggaggttgaaagcagttct

SEQ ID NO: 829552 - DNA, 25 bp, Mus musculus
tctcccggcccaagattgtcagttc

SEQ ID NO: 829553 - DNA, 25 bp, Mus musculus
tctcccggcccatgattgtcagttc

SEQ ID NO: 829554 - DNA, 25 bp, Mus musculus
tctcccgggccgaaggaggaagatg

SEQ ID NO: 829555 - DNA, 25 bp, Mus musculus
tctcccgggccgtaggaggaagatg

SEQ ID NO: 829556 - DNA, 25 bp, Mus musculus
tctcccggtttcctatgagcaagtg

SEQ ID NO: 829557 - DNA, 25 bp, Mus musculus
tctcccggtttcgtatgagcaagtg

SEQ ID NO: 829558 - DNA, 25 bp, Mus musculus
tctcccgtagtcataatgtgtctta

SEQ ID NO: 829559 - DNA, 25 bp, Mus musculus
tctcccgtagtcttaatgtgtctta

SEQ ID NO: 829560 - DNA, 25 bp, Mus musculus
tctcccgtctgcaatatcacactgt

SEQ ID NO: 829561 - DNA, 25 bp, Mus musculus
tctcccgtctgctatatcacactgt

SEQ ID NO: 829562 - DNA, 25 bp, Mus musculus
tctcccgtgcatcctcaatgctcgg

SEQ ID NO: 829563 - DNA, 25 bp, Mus musculus
tctcccgtgcatgctcaatgctcgg

SEQ ID NO: 829564 - DNA, 25 bp, Mus musculus
tctccctaaaggaccaagcgctgat

SEQ ID NO: 829565 - DNA, 25 bp, Mus musculus
tctccctaaaggtccaagcgctgat

SEQ ID NO: 829566 - DNA, 25 bp, Mus musculus
tctccctaacttatctcttatcagt

SEQ ID NO: 829567 - DNA, 25 bp, Mus musculus
tctccctaacttttctcttatcagt

SEQ ID NO: 829568 - DNA, 25 bp, Mus musculus
tctccctactacactgcctttgtta

SEQ ID NO: 829569 - DNA, 25 bp, Mus musculus
tctccctactactctgcctttgtta

SEQ ID NO: 829570 - DNA, 25 bp, Mus musculus
tctccctactgcaaggaagcaaaat

SEQ ID NO: 829571 - DNA, 25 bp, Mus musculus
tctccctactgctaggaagcaaaat

SEQ ID NO: 829572 - DNA, 25 bp, Mus musculus
tctccctattcaaccaggaagcaga

SEQ ID NO: 829573 - DNA, 25 bp, Mus musculus
tctccctattcatccaggaagcaga

SEQ ID NO: 829574 - DNA, 25 bp, Mus musculus
tctccctatttaaaactcttgtggt

SEQ ID NO: 829575 - DNA, 25 bp, Mus musculus
tctccctatttataactcttgtggt

SEQ ID NO: 829576 - DNA, 25 bp, Mus musculus
tctccctattttctctcatggtgtg

SEQ ID NO: 829577 - DNA, 25 bp, Mus musculus
tctccctattttgtctcatggtgtg

SEQ ID NO: 829578 - DNA, 25 bp, Mus musculus
tctccctcaccacgatttcattttc

SEQ ID NO: 829579 - DNA, 25 bp, Mus musculus
tctccctcaccaggatttcattttc

SEQ ID NO: 829580 - DNA, 25 bp, Mus musculus
tctccctcaggtactttatcatgtg

SEQ ID NO: 829581 - DNA, 25 bp, Mus musculus
tctccctcaggttctttatcatgtg

SEQ ID NO: 829582 - DNA, 25 bp, Mus musculus
tctccctcagttattcacggatgaa

SEQ ID NO: 829583 - DNA, 25 bp, Mus musculus
tctccctcagtttttcacggatgaa

SEQ ID NO: 829584 - DNA, 25 bp, Mus musculus
tctccctccatcctgcataataaga

SEQ ID NO: 829585 - DNA, 25 bp, Mus musculus
tctccctccatcgtgcataataaga

SEQ ID NO: 829586 - DNA, 25 bp, Mus musculus
tctccctccatgaaagtgtttttta

SEQ ID NO: 829587 - DNA, 25 bp, Mus musculus
tctccctccatgtaagtgtttttta

SEQ ID NO: 829588 - DNA, 25 bp, Mus musculus
tctccctcccggaagttactgaact

SEQ ID NO: 829589 - DNA, 25 bp, Mus musculus
tctccctcccggtagttactgaact

SEQ ID NO: 829590 - DNA, 25 bp, Mus musculus
tctccctcgtagcaaacggattcat

SEQ ID NO: 829591 - DNA, 25 bp, Mus musculus
tctccctcgtaggaaacggattcat

SEQ ID NO: 829592 - DNA, 25 bp, Mus musculus
tctccctcgtctatgcactaaatga

SEQ ID NO: 829593 - DNA, 25 bp, Mus musculus
tctccctcgtctttgcactaaatga

SEQ ID NO: 829594 - DNA, 25 bp, Mus musculus
tctccctcgtggacgccatgaacgg

SEQ ID NO: 829595 - DNA, 25 bp, Mus musculus
tctccctcgtggtcgccatgaacgg

SEQ ID NO: 829596 - DNA, 25 bp, Mus musculus
tctccctctatgactgtgtttttaa

SEQ ID NO: 829597 - DNA, 25 bp, Mus musculus
tctccctctatgtctgtgtttttaa

SEQ ID NO: 829598 - DNA, 25 bp, Mus musculus
tctccctctgacagttcaattgtta

SEQ ID NO: 829599 - DNA, 25 bp, Mus musculus
tctccctctgactgttcaattgtta

SEQ ID NO: 829600 - DNA, 25 bp, Mus musculus
tctccctctggcattaatgtgggtt

SEQ ID NO: 829601 - DNA, 25 bp, Mus musculus
tctccctctggctttaatgtgggtt

SEQ ID NO: 829602 - DNA, 25 bp, Mus musculus
tctccctctgtcagttccagaactt

SEQ ID NO: 829603 - DNA, 25 bp, Mus musculus
tctccctctgtctgttccagaactt

SEQ ID NO: 829604 - DNA, 25 bp, Mus musculus
tctccctgaactaagagctaggcta

SEQ ID NO: 829605 - DNA, 25 bp, Mus musculus
tctccctgaacttagagctaggcta

SEQ ID NO: 829606 - DNA, 25 bp, Mus musculus
tctccctgacgtctgcgttggtgaa

SEQ ID NO: 829607 - DNA, 25 bp, Mus musculus
tctccctgacgtgtgcgttggtgaa

SEQ ID NO: 829608 - DNA, 25 bp, Mus musculus
tctccctgagagacttgatctgttt

SEQ ID NO: 829609 - DNA, 25 bp, Mus musculus
tctccctgagagtcttgatctgttt

SEQ ID NO: 829610 - DNA, 25 bp, Mus musculus
tctccctgatctcttctaaaattga

SEQ ID NO: 829611 - DNA, 25 bp, Mus musculus
tctccctgatctgttctaaaattga

SEQ ID NO: 829612 - DNA, 25 bp, Mus musculus
tctccctgattcaacttcggtctaa

SEQ ID NO: 829613 - DNA, 25 bp, Mus musculus
tctccctgattctacttcggtctaa

SEQ ID NO: 829614 - DNA, 25 bp, Mus musculus
tctccctgcactctctttttactgt

SEQ ID NO: 829615 - DNA, 25 bp, Mus musculus
tctccctgcactgtctttttactgt

SEQ ID NO: 829616 - DNA, 25 bp, Mus musculus
tctccctgcatcagtaatattggca

SEQ ID NO: 829617 - DNA, 25 bp, Mus musculus
tctccctgcatctgtaatattggca

SEQ ID NO: 829618 - DNA, 25 bp, Mus musculus
tctccctgccgtagagtcgggagta

SEQ ID NO: 829619 - DNA, 25 bp, Mus musculus
tctccctgccgttgagtcgggagta

SEQ ID NO: 829620 - DNA, 25 bp, Mus musculus
tctccctgctttatgtgaagaacct

SEQ ID NO: 829621 - DNA, 25 bp, Mus musculus
tctccctgctttttgtgaagaacct

SEQ ID NO: 829622 - DNA, 25 bp, Mus musculus
tctccctggaacagctcttaggaaa

SEQ ID NO: 829623 - DNA, 25 bp, Mus musculus
tctccctggaactgctcttaggaaa

SEQ ID NO: 829624 - DNA, 25 bp, Mus musculus
tctccctggcaacaccatttatttc

SEQ ID NO: 829625 - DNA, 25 bp, Mus musculus
tctccctggcaagaccatttatttc

SEQ ID NO: 829626 - DNA, 25 bp, Mus musculus
tctccctggtgaagcctatctgtaa

SEQ ID NO: 829627 - DNA, 25 bp, Mus musculus
tctccctggtgatgcctatctgtaa

SEQ ID NO: 829628 - DNA, 25 bp, Mus musculus
tctccctgtcacattaacaccagga

SEQ ID NO: 829629 - DNA, 25 bp, Mus musculus
tctccctgtcactttaacaccagga

SEQ ID NO: 829630 - DNA, 25 bp, Mus musculus
tctccctgtggaagtgcgcatgcaa

SEQ ID NO: 829631 - DNA, 25 bp, Mus musculus
tctccctgtggatgtgcgcatgcaa

SEQ ID NO: 829632 - DNA, 25 bp, Mus musculus
tctccctgttcccactaaattgatt

SEQ ID NO: 829633 - DNA, 25 bp, Mus musculus
tctccctgttccgactaaattgatt

SEQ ID NO: 829634 - DNA, 25 bp, Mus musculus
tctcccttaagaattcctttggctc

SEQ ID NO: 829635 - DNA, 25 bp, Mus musculus
tctcccttaagatttcctttggctc

SEQ ID NO: 829636 - DNA, 25 bp, Mus musculus
tctcccttagacaaccaaagatctg

SEQ ID NO: 829637 - DNA, 25 bp, Mus musculus
tctcccttagactaccaaagatctg

SEQ ID NO: 829638 - DNA, 25 bp, Mus musculus
tctcccttagatcctagtgtggcta

SEQ ID NO: 829639 - DNA, 25 bp, Mus musculus
tctcccttagatgctagtgtggcta

SEQ ID NO: 829640 - DNA, 25 bp, Mus musculus
tctcccttagtgatgttatgtccct

SEQ ID NO: 829641 - DNA, 25 bp, Mus musculus
tctcccttagtgttgttatgtccct

SEQ ID NO: 829642 - DNA, 25 bp, Mus musculus
tctcccttatttccctatctttgta

SEQ ID NO: 829643 - DNA, 25 bp, Mus musculus
tctcccttatttgcctatctttgta

SEQ ID NO: 829644 - DNA, 25 bp, Mus musculus
tctcccttcatcattacatggtaca

SEQ ID NO: 829645 - DNA, 25 bp, Mus musculus
tctcccttcatctttacatggtaca

SEQ ID NO: 829646 - DNA, 25 bp, Mus musculus
tctcccttcgacattggcccgtagg

SEQ ID NO: 829647 - DNA, 25 bp, Mus musculus
tctcccttcgactttggcccgtagg

SEQ ID NO: 829648 - DNA, 25 bp, Mus musculus
tctcccttgcagcaacgtcgattta

SEQ ID NO: 829649 - DNA, 25 bp, Mus musculus
tctcccttgcaggaacgtcgattta

SEQ ID NO: 829650 - DNA, 25 bp, Mus musculus
tctcccttgcctctgagcagaaagt

SEQ ID NO: 829651 - DNA, 25 bp, Mus musculus
tctcccttgcctgtgagcagaaagt

SEQ ID NO: 829652 - DNA, 25 bp, Mus musculus
tctcccttgcgaaagagaacgaggt

SEQ ID NO: 829653 - DNA, 25 bp, Mus musculus
tctcccttgcgatagagaacgaggt

SEQ ID NO: 829654 - DNA, 25 bp, Mus musculus
tctcccttgcttaaggtcacttgaa

SEQ ID NO: 829655 - DNA, 25 bp, Mus musculus
tctcccttgctttaggtcacttgaa

SEQ ID NO: 829656 - DNA, 25 bp, Mus musculus
tctcccttggtcactgtgttcttca

SEQ ID NO: 829657 - DNA, 25 bp, Mus musculus
tctcccttggtctctgtgttcttca

SEQ ID NO: 829658 - DNA, 25 bp, Mus musculus
tctcccttgtggacaccaagaatgc

SEQ ID NO: 829659 - DNA, 25 bp, Mus musculus
tctcccttgtggtcaccaagaatgc

SEQ ID NO: 829660 - DNA, 25 bp, Mus musculus
tctccctttcataatactagccctg

SEQ ID NO: 829661 - DNA, 25 bp, Mus musculus
tctccctttcattatactagccctg

SEQ ID NO: 829662 - DNA, 25 bp, Mus musculus
tctccctttcctaaacatagctgca

SEQ ID NO: 829663 - DNA, 25 bp, Mus musculus
tctccctttccttaacatagctgca

SEQ ID NO: 829664 - DNA, 25 bp, Mus musculus
tctccctttgacaggagctaaagct

SEQ ID NO: 829665 - DNA, 25 bp, Mus musculus
tctccctttgactggagctaaagct

SEQ ID NO: 829666 - DNA, 25 bp, Mus musculus
tctcccttttcaacttttgctgtaa

SEQ ID NO: 829667 - DNA, 25 bp, Mus musculus
tctcccttttcatcttttgctgtaa

SEQ ID NO: 829668 - DNA, 25 bp, Mus musculus
tctcccttttgccaaaacggactgg

SEQ ID NO: 829669 - DNA, 25 bp, Mus musculus
tctcccttttgcgaaaacggactgg

SEQ ID NO: 829670 - DNA, 25 bp, Mus musculus
tctcccttttgtccatttgccaagt

SEQ ID NO: 829671 - DNA, 25 bp, Mus musculus
tctcccttttgtgcatttgccaagt

SEQ ID NO: 829672 - DNA, 25 bp, Mus musculus
tctccgaaaactagaacacctggtg

SEQ ID NO: 829673 - DNA, 25 bp, Mus musculus
tctccgaaaacttgaacacctggtg

SEQ ID NO: 829674 - DNA, 25 bp, Mus musculus
tctccgaaagcgagacgcgccgctg

SEQ ID NO: 829675 - DNA, 25 bp, Mus musculus
tctccgaaagcgtgacgcgccgctg

SEQ ID NO: 829676 - DNA, 25 bp, Mus musculus
tctccgaagagccatttggacagag

SEQ ID NO: 829677 - DNA, 25 bp, Mus musculus
tctccgaagagcgatttggacagag

SEQ ID NO: 829678 - DNA, 25 bp, Mus musculus
tctccgaagctgctctctagcagga

SEQ ID NO: 829679 - DNA, 25 bp, Mus musculus
tctccgaagctggtctctagcagga

SEQ ID NO: 829680 - DNA, 25 bp, Mus musculus
tctccgaattttacacctactgttc

SEQ ID NO: 829681 - DNA, 25 bp, Mus musculus
tctccgaatttttcacctactgttc

SEQ ID NO: 829682 - DNA, 25 bp, Mus musculus
tctccgacccaccatgagtatagta

SEQ ID NO: 829683 - DNA, 25 bp, Mus musculus
tctccgacccacgatgagtatagta

SEQ ID NO: 829684 - DNA, 25 bp, Mus musculus
tctccgactttcacagttcttggaa

SEQ ID NO: 829685 - DNA, 25 bp, Mus musculus
tctccgactttctcagttcttggaa

SEQ ID NO: 829686 - DNA, 25 bp, Mus musculus
tctccgagaccgatagtaacttcac

SEQ ID NO: 829687 - DNA, 25 bp, Mus musculus
tctccgagaccgttagtaacttcac

SEQ ID NO: 829688 - DNA, 25 bp, Mus musculus
tctccgagctctcggcagtgacaca

SEQ ID NO: 829689 - DNA, 25 bp, Mus musculus
tctccgagctctgggcagtgacaca

SEQ ID NO: 829690 - DNA, 25 bp, Mus musculus
tctccgaggatacatgctggcttac

SEQ ID NO: 829691 - DNA, 25 bp, Mus musculus
tctccgaggatagatgctggcttac

SEQ ID NO: 829692 - DNA, 25 bp, Mus musculus
tctccgagttctcaaccttcgggaa

SEQ ID NO: 829693 - DNA, 25 bp, Mus musculus
tctccgagttctgaaccttcgggaa

SEQ ID NO: 829694 - DNA, 25 bp, Mus musculus
tctccgcactatacttttgttctga

SEQ ID NO: 829695 - DNA, 25 bp, Mus musculus
tctccgcactattcttttgttctga

SEQ ID NO: 829696 - DNA, 25 bp, Mus musculus
tctccgcagctcatagtgaggtctg

SEQ ID NO: 829697 - DNA, 25 bp, Mus musculus
tctccgcagctcttagtgaggtctg

SEQ ID NO: 829698 - DNA, 25 bp, Mus musculus
tctccgcccatgaaagtttctgaaa

SEQ ID NO: 829699 - DNA, 25 bp, Mus musculus
tctccgcccatgtaagtttctgaaa

SEQ ID NO: 829700 - DNA, 25 bp, Mus musculus
tctccgccctaacgatggacaacgg

SEQ ID NO: 829701 - DNA, 25 bp, Mus musculus
tctccgccctaaggatggacaacgg

SEQ ID NO: 829702 - DNA, 25 bp, Mus musculus
tctccgcctgggacagacaaggtgt

SEQ ID NO: 829703 - DNA, 25 bp, Mus musculus
tctccgcctgggtcagacaaggtgt

SEQ ID NO: 829704 - DNA, 25 bp, Mus musculus
tctccgctgttgcaagaacataaaa

SEQ ID NO: 829705 - DNA, 25 bp, Mus musculus
tctccgctgttggaagaacataaaa

SEQ ID NO: 829706 - DNA, 25 bp, Mus musculus
tctccgcttagcacagtgactgaag

SEQ ID NO: 829707 - DNA, 25 bp, Mus musculus
tctccgcttagctcagtgactgaag

SEQ ID NO: 829708 - DNA, 25 bp, Mus musculus
tctccggacagcagcgacgtgtggc

SEQ ID NO: 829709 - DNA, 25 bp, Mus musculus
tctccggacagctgcgacgtgtggc

SEQ ID NO: 829710 - DNA, 25 bp, Mus musculus
tctccggagcttcaggtactggcaa

SEQ ID NO: 829711 - DNA, 25 bp, Mus musculus
tctccggagcttgaggtactggcaa

SEQ ID NO: 829712 - DNA, 25 bp, Mus musculus
tctccggcatcaaaaacacaggtgt

SEQ ID NO: 829713 - DNA, 25 bp, Mus musculus
tctccggcatcataaacacaggtgt

SEQ ID NO: 829714 - DNA, 25 bp, Mus musculus
tctccggcctttaccagatggatgt

SEQ ID NO: 829715 - DNA, 25 bp, Mus musculus
tctccggccttttccagatggatgt

SEQ ID NO: 829716 - DNA, 25 bp, Mus musculus
tctccgggatccatcctagaattta

SEQ ID NO: 829717 - DNA, 25 bp, Mus musculus
tctccgggatccttcctagaattta

SEQ ID NO: 829718 - DNA, 25 bp, Mus musculus
tctccggtcgtgaaagttctaggtc

SEQ ID NO: 829719 - DNA, 25 bp, Mus musculus
tctccggtcgtgtaagttctaggtc

SEQ ID NO: 829720 - DNA, 25 bp, Mus musculus
tctccggtggcaacacagaccagaa

SEQ ID NO: 829721 - DNA, 25 bp, Mus musculus
tctccggtggcatcacagaccagaa

SEQ ID NO: 829722 - DNA, 25 bp, Mus musculus
tctccgtcagcacgtggcccgagga

SEQ ID NO: 829723 - DNA, 25 bp, Mus musculus
tctccgtcagcaggtggcccgagga

SEQ ID NO: 829724 - DNA, 25 bp, Mus musculus
tctccgtcccaactgatgattgtac

SEQ ID NO: 829725 - DNA, 25 bp, Mus musculus
tctccgtcccaagtgatgattgtac

SEQ ID NO: 829726 - DNA, 25 bp, Mus musculus
tctccgtcctaaccatggtatgcaa

SEQ ID NO: 829727 - DNA, 25 bp, Mus musculus
tctccgtcctaagcatggtatgcaa

SEQ ID NO: 829728 - DNA, 25 bp, Mus musculus
tctccgtgaccacgcacgagaaggt

SEQ ID NO: 829729 - DNA, 25 bp, Mus musculus
tctccgtgaccaggcacgagaaggt

SEQ ID NO: 829730 - DNA, 25 bp, Mus musculus
tctccgtgactgactcatctgaagg

SEQ ID NO: 829731 - DNA, 25 bp, Mus musculus
tctccgtgactgtctcatctgaagg

SEQ ID NO: 829732 - DNA, 25 bp, Mus musculus
tctccgtgctttatccaatctggta

SEQ ID NO: 829733 - DNA, 25 bp, Mus musculus
tctccgtgctttttccaatctggta

SEQ ID NO: 829734 - DNA, 25 bp, Mus musculus
tctccgtggcgtatattctcttata

SEQ ID NO: 829735 - DNA, 25 bp, Mus musculus
tctccgtggcgtttattctcttata

SEQ ID NO: 829736 - DNA, 25 bp, Mus musculus
tctccgtgggttctggtcacaaaat

SEQ ID NO: 829737 - DNA, 25 bp, Mus musculus
tctccgtgggttgtggtcacaaaat

SEQ ID NO: 829738 - DNA, 25 bp, Mus musculus
tctccgtgtattaaaacagttggtt

SEQ ID NO: 829739 - DNA, 25 bp, Mus musculus
tctccgtgtatttaaacagttggtt

SEQ ID NO: 829740 - DNA, 25 bp, Mus musculus
tctccgtgtcctcggcacaggaagg

SEQ ID NO: 829741 - DNA, 25 bp, Mus musculus
tctccgtgtcctgggcacaggaagg

SEQ ID NO: 829742 - DNA, 25 bp, Mus musculus
tctccgtgttgcagagtcaccctgc

SEQ ID NO: 829743 - DNA, 25 bp, Mus musculus
tctccgtgttgctgagtcaccctgc

SEQ ID NO: 829744 - DNA, 25 bp, Mus musculus
tctccgttctatccatcggactttc

SEQ ID NO: 829745 - DNA, 25 bp, Mus musculus
tctccgttctatgcatcggactttc

SEQ ID NO: 829746 - DNA, 25 bp, Mus musculus
tctccgttctgcactaggaattgaa

SEQ ID NO: 829747 - DNA, 25 bp, Mus musculus
tctccgttctgctctaggaattgaa

SEQ ID NO: 829748 - DNA, 25 bp, Mus musculus
tctccgtttttgcatcttttcctag

SEQ ID NO: 829749 - DNA, 25 bp, Mus musculus
tctccgtttttggatcttttcctag

SEQ ID NO: 829750 - DNA, 25 bp, Mus musculus
tctcctaaccgtcgaaccgtggaat

SEQ ID NO: 829751 - DNA, 25 bp, Mus musculus
tctcctaaccgtggaaccgtggaat

SEQ ID NO: 829752 - DNA, 25 bp, Mus musculus
tctcctaagcccatctgtattttat

SEQ ID NO: 829753 - DNA, 25 bp, Mus musculus
tctcctaagcccttctgtattttat

SEQ ID NO: 829754 - DNA, 25 bp, Mus musculus
tctcctaaggacacatttgttcccc

SEQ ID NO: 829755 - DNA, 25 bp, Mus musculus
tctcctaaggactcatttgttcccc

SEQ ID NO: 829756 - DNA, 25 bp, Mus musculus
tctcctaagggaccaagtggcgcag

SEQ ID NO: 829757 - DNA, 25 bp, Mus musculus
tctcctaagggagcaagtggcgcag

SEQ ID NO: 829758 - DNA, 25 bp, Mus musculus
tctcctaattgtaacttgtgctggg

SEQ ID NO: 829759 - DNA, 25 bp, Mus musculus
tctcctaattgttacttgtgctggg

SEQ ID NO: 829760 - DNA, 25 bp, Mus musculus
tctcctacatggctttgctactgta

SEQ ID NO: 829761 - DNA, 25 bp, Mus musculus
tctcctacatgggtttgctactgta

SEQ ID NO: 829762 - DNA, 25 bp, Mus musculus
tctcctaccaacacgtctcagaata

SEQ ID NO: 829763 - DNA, 25 bp, Mus musculus
tctcctaccaactcgtctcagaata

SEQ ID NO: 829764 - DNA, 25 bp, Mus musculus
tctcctacctgcatgagggattcaa

SEQ ID NO: 829765 - DNA, 25 bp, Mus musculus
tctcctacctgcttgagggattcaa

SEQ ID NO: 829766 - DNA, 25 bp, Mus musculus
tctcctacctttcctagagtatata

SEQ ID NO: 829767 - DNA, 25 bp, Mus musculus
tctcctacctttctttcttcaaatt

SEQ ID NO: 829768 - DNA, 25 bp, Mus musculus
tctcctacctttgctagagtatata

SEQ ID NO: 829769 - DNA, 25 bp, Mus musculus
tctcctacctttgtttcttcaaatt

SEQ ID NO: 829770 - DNA, 25 bp, Mus musculus
tctcctacgagccagggaagtcctg

SEQ ID NO: 829771 - DNA, 25 bp, Mus musculus
tctcctacgagcgagggaagtcctg

SEQ ID NO: 829772 - DNA, 25 bp, Mus musculus
tctcctacgtgaaatatcgactggt

SEQ ID NO: 829773 - DNA, 25 bp, Mus musculus
tctcctacgtgatatatcgactggt

SEQ ID NO: 829774 - DNA, 25 bp, Mus musculus
tctcctactctgataaactgcctta

SEQ ID NO: 829775 - DNA, 25 bp, Mus musculus
tctcctactctgttaaactgcctta

SEQ ID NO: 829776 - DNA, 25 bp, Mus musculus
tctcctagatgtcctttggtttggg

SEQ ID NO: 829777 - DNA, 25 bp, Mus musculus
tctcctagatgtgctttggtttggg

SEQ ID NO: 829778 - DNA, 25 bp, Mus musculus
tctcctagccatcctgtgcatgcgg

SEQ ID NO: 829779 - DNA, 25 bp, Mus musculus
tctcctagccatgctgtgcatgcgg

SEQ ID NO: 829780 - DNA, 25 bp, Mus musculus
tctcctagctctcgaagaaaacatt

SEQ ID NO: 829781 - DNA, 25 bp, Mus musculus
tctcctagctctggaagaaaacatt

SEQ ID NO: 829782 - DNA, 25 bp, Mus musculus
tctcctagttatccactctgtaatc

SEQ ID NO: 829783 - DNA, 25 bp, Mus musculus
tctcctagttatgcactctgtaatc

SEQ ID NO: 829784 - DNA, 25 bp, Mus musculus
tctcctatccaaacccaattctttt

SEQ ID NO: 829785 - DNA, 25 bp, Mus musculus
tctcctatccaatcccaattctttt

SEQ ID NO: 829786 - DNA, 25 bp, Mus musculus
tctcctatccctattacgttgagtg

SEQ ID NO: 829787 - DNA, 25 bp, Mus musculus
tctcctatcccttttacgttgagtg

SEQ ID NO: 829788 - DNA, 25 bp, Mus musculus
tctcctatctaactcaactctcgag

SEQ ID NO: 829789 - DNA, 25 bp, Mus musculus
tctcctatctaagtcaactctcgag

SEQ ID NO: 829790 - DNA, 25 bp, Mus musculus
tctcctatgataagttgaaccgcat

SEQ ID NO: 829791 - DNA, 25 bp, Mus musculus
tctcctatgatatgttgaaccgcat

SEQ ID NO: 829792 - DNA, 25 bp, Mus musculus
tctcctatgccgctgagcaggcttc

SEQ ID NO: 829793 - DNA, 25 bp, Mus musculus
tctcctatgccggtgagcaggcttc

SEQ ID NO: 829794 - DNA, 25 bp, Mus musculus
tctcctatgtgactcttcctgaaaa

SEQ ID NO: 829795 - DNA, 25 bp, Mus musculus
tctcctatgtgagtcttcctgaaaa

SEQ ID NO: 829796 - DNA, 25 bp, Mus musculus
tctcctattgtactttacctcctgg

SEQ ID NO: 829797 - DNA, 25 bp, Mus musculus
tctcctattgtagtttacctcctgg

SEQ ID NO: 829798 - DNA, 25 bp, Mus musculus
tctcctattgtcacagttactggta

SEQ ID NO: 829799 - DNA, 25 bp, Mus musculus
tctcctattgtctcagttactggta

SEQ ID NO: 829800 - DNA, 25 bp, Mus musculus
tctcctatttctccctaactataag

SEQ ID NO: 829801 - DNA, 25 bp, Mus musculus
tctcctatttctgcctaactataag

SEQ ID NO: 829802 - DNA, 25 bp, Mus musculus
tctcctcaaactcaaggctatgtta

SEQ ID NO: 829803 - DNA, 25 bp, Mus musculus
tctcctcaaactctcaatccacttg

SEQ ID NO: 829804 - DNA, 25 bp, Mus musculus
tctcctcaaactgaaggctatgtta

SEQ ID NO: 829805 - DNA, 25 bp, Mus musculus
tctcctcaaactgtcaatccacttg

SEQ ID NO: 829806 - DNA, 25 bp, Mus musculus
tctcctcaccgtaagcggtatttaa

SEQ ID NO: 829807 - DNA, 25 bp, Mus musculus
tctcctcaccgttagcggtatttaa

SEQ ID NO: 829808 - DNA, 25 bp, Mus musculus
tctcctcaccttagattattcacag

SEQ ID NO: 829809 - DNA, 25 bp, Mus musculus
tctcctcacctttgattattcacag

SEQ ID NO: 829810 - DNA, 25 bp, Mus musculus
tctcctcactggatgaccctgtttg

SEQ ID NO: 829811 - DNA, 25 bp, Mus musculus
tctcctcactggttgaccctgtttg

SEQ ID NO: 829812 - DNA, 25 bp, Mus musculus
tctcctcacttgactacttctagat

SEQ ID NO: 829813 - DNA, 25 bp, Mus musculus
tctcctcacttgtctacttctagat

SEQ ID NO: 829814 - DNA, 25 bp, Mus musculus
tctcctcagaagaccgtccctgtgg

SEQ ID NO: 829815 - DNA, 25 bp, Mus musculus
tctcctcagaagtccgtccctgtgg

SEQ ID NO: 829816 - DNA, 25 bp, Mus musculus
tctcctcagaccagcaagggacaag

SEQ ID NO: 829817 - DNA, 25 bp, Mus musculus
tctcctcagacctgcaagggacaag

SEQ ID NO: 829818 - DNA, 25 bp, Mus musculus
tctcctcagataaactggctcccca

SEQ ID NO: 829819 - DNA, 25 bp, Mus musculus
tctcctcagatatactggctcccca

SEQ ID NO: 829820 - DNA, 25 bp, Mus musculus
tctcctcagtggctggatgcttaat

SEQ ID NO: 829821 - DNA, 25 bp, Mus musculus
tctcctcagtgggtggatgcttaat

SEQ ID NO: 829822 - DNA, 25 bp, Mus musculus
tctcctcatctgcaaggtcccatag

SEQ ID NO: 829823 - DNA, 25 bp, Mus musculus
tctcctcatctggaaggtcccatag

SEQ ID NO: 829824 - DNA, 25 bp, Mus musculus
tctcctcatgtgctaccagtggtga

SEQ ID NO: 829825 - DNA, 25 bp, Mus musculus
tctcctcatgtggtaccagtggtga

SEQ ID NO: 829826 - DNA, 25 bp, Mus musculus
tctcctccaaggcttccagagtgag

SEQ ID NO: 829827 - DNA, 25 bp, Mus musculus
tctcctccaagggttccagagtgag

SEQ ID NO: 829828 - DNA, 25 bp, Mus musculus
tctcctccagtcaatgtattacata

SEQ ID NO: 829829 - DNA, 25 bp, Mus musculus
tctcctccagtctatgtattacata

SEQ ID NO: 829830 - DNA, 25 bp, Mus musculus
tctcctcccattcatatcttacaag

SEQ ID NO: 829831 - DNA, 25 bp, Mus musculus
tctcctcccattgatatcttacaag

SEQ ID NO: 829832 - DNA, 25 bp, Mus musculus
tctcctccctgaaagcacattgttt

SEQ ID NO: 829833 - DNA, 25 bp, Mus musculus
tctcctccctgatagcacattgttt

SEQ ID NO: 829834 - DNA, 25 bp, Mus musculus
tctcctccgactacagaaaagcctt

SEQ ID NO: 829835 - DNA, 25 bp, Mus musculus
tctcctccgacttcagaaaagcctt

SEQ ID NO: 829836 - DNA, 25 bp, Mus musculus
tctcctccgggcatcccgggtgtgg

SEQ ID NO: 829837 - DNA, 25 bp, Mus musculus
tctcctccgggcttcccgggtgtgg

SEQ ID NO: 829838 - DNA, 25 bp, Mus musculus
tctcctccgtcaatcaaacatgcag

SEQ ID NO: 829839 - DNA, 25 bp, Mus musculus
tctcctccgtcattcaaacatgcag

SEQ ID NO: 829840 - DNA, 25 bp, Mus musculus
tctcctccttatcttttttgaactg

SEQ ID NO: 829841 - DNA, 25 bp, Mus musculus
tctcctccttatgttttttgaactg

SEQ ID NO: 829842 - DNA, 25 bp, Mus musculus
tctcctcgctttatgaaagttcctg

SEQ ID NO: 829843 - DNA, 25 bp, Mus musculus
tctcctcgctttttgaaagttcctg

SEQ ID NO: 829844 - DNA, 25 bp, Mus musculus
tctcctcggcttatccatggccagg

SEQ ID NO: 829845 - DNA, 25 bp, Mus musculus
tctcctcggcttttccatggccagg

SEQ ID NO: 829846 - DNA, 25 bp, Mus musculus
tctcctcggtctctaacagggcaga

SEQ ID NO: 829847 - DNA, 25 bp, Mus musculus
tctcctcggtctgtaacagggcaga

SEQ ID NO: 829848 - DNA, 25 bp, Mus musculus
tctcctcggtgtctccattgaaata

SEQ ID NO: 829849 - DNA, 25 bp, Mus musculus
tctcctcggtgtgtccattgaaata

SEQ ID NO: 829850 - DNA, 25 bp, Mus musculus
tctcctcgtatgctattatgatcct

SEQ ID NO: 829851 - DNA, 25 bp, Mus musculus
tctcctcgtatggtattatgatcct

SEQ ID NO: 829852 - DNA, 25 bp, Mus musculus
tctcctctacttcgtaccttgtaca

SEQ ID NO: 829853 - DNA, 25 bp, Mus musculus
tctcctctacttggtaccttgtaca

SEQ ID NO: 829854 - DNA, 25 bp, Mus musculus
tctcctctagaaccccaaatctggg

SEQ ID NO: 829855 - DNA, 25 bp, Mus musculus
tctcctctagaagcccaaatctggg

SEQ ID NO: 829856 - DNA, 25 bp, Mus musculus
tctcctctagctccagaagtcctgg

SEQ ID NO: 829857 - DNA, 25 bp, Mus musculus
tctcctctagctgcagaagtcctgg

SEQ ID NO: 829858 - DNA, 25 bp, Mus musculus
tctcctctaggtaaaatacacttac

SEQ ID NO: 829859 - DNA, 25 bp, Mus musculus
tctcctctaggtatatatcctcagc

SEQ ID NO: 829860 - DNA, 25 bp, Mus musculus
tctcctctaggttaaatacacttac

SEQ ID NO: 829861 - DNA, 25 bp, Mus musculus
tctcctctaggtttatatcctcagc

SEQ ID NO: 829862 - DNA, 25 bp, Mus musculus
tctcctctccttagggtactaggga

SEQ ID NO: 829863 - DNA, 25 bp, Mus musculus
tctcctctcctttgggtactaggga

SEQ ID NO: 829864 - DNA, 25 bp, Mus musculus
tctcctctcggtatagagttctaca

SEQ ID NO: 829865 - DNA, 25 bp, Mus musculus
tctcctctcggtttagagttctaca

SEQ ID NO: 829866 - DNA, 25 bp, Mus musculus
tctcctctctaaactactggcagga

SEQ ID NO: 829867 - DNA, 25 bp, Mus musculus
tctcctctctaatctactggcagga

SEQ ID NO: 829868 - DNA, 25 bp, Mus musculus
tctcctctctatatttgttccagta

SEQ ID NO: 829869 - DNA, 25 bp, Mus musculus
tctcctctctatcttctccttggag

SEQ ID NO: 829870 - DNA, 25 bp, Mus musculus
tctcctctctatgttctccttggag

SEQ ID NO: 829871 - DNA, 25 bp, Mus musculus
tctcctctctatttttgttccagta

SEQ ID NO: 829872 - DNA, 25 bp, Mus musculus
tctcctctctctcagtgtgtaagaa

SEQ ID NO: 829873 - DNA, 25 bp, Mus musculus
tctcctctctctgagtgtgtaagaa

SEQ ID NO: 829874 - DNA, 25 bp, Mus musculus
tctcctctgatgctgactgtgaaat

SEQ ID NO: 829875 - DNA, 25 bp, Mus musculus
tctcctctgatggtgactgtgaaat

SEQ ID NO: 829876 - DNA, 25 bp, Mus musculus
tctcctctgcatctgtttaagcatc

SEQ ID NO: 829877 - DNA, 25 bp, Mus musculus
tctcctctgcatgtgtttaagcatc

SEQ ID NO: 829878 - DNA, 25 bp, Mus musculus
tctcctctgccccttactggtttaa

SEQ ID NO: 829879 - DNA, 25 bp, Mus musculus
tctcctctgcccgttactggtttaa

SEQ ID NO: 829880 - DNA, 25 bp, Mus musculus
tctcctctgggaacgatagctacca

SEQ ID NO: 829881 - DNA, 25 bp, Mus musculus
tctcctctgggatcgatagctacca

SEQ ID NO: 829882 - DNA, 25 bp, Mus musculus
tctcctctggttccatgtctcttgt

SEQ ID NO: 829883 - DNA, 25 bp, Mus musculus
tctcctctggttgcatgtctcttgt

SEQ ID NO: 829884 - DNA, 25 bp, Mus musculus
tctcctctgtgtctgtcatgtctat

SEQ ID NO: 829885 - DNA, 25 bp, Mus musculus
tctcctctgtgtgtgtcatgtctat

SEQ ID NO: 829886 - DNA, 25 bp, Mus musculus
tctcctcttactcaatttctcgaat

SEQ ID NO: 829887 - DNA, 25 bp, Mus musculus
tctcctcttactgaatttctcgaat

SEQ ID NO: 829888 - DNA, 25 bp, Mus musculus
tctcctcttcctacataagactgtg

SEQ ID NO: 829889 - DNA, 25 bp, Mus musculus
tctcctcttcctctagcctaaagga

SEQ ID NO: 829890 - DNA, 25 bp, Mus musculus
tctcctcttcctgtagcctaaagga

SEQ ID NO: 829891 - DNA, 25 bp, Mus musculus
tctcctcttccttcataagactgtg

SEQ ID NO: 829892 - DNA, 25 bp, Mus musculus
tctcctcttgcacagggttaacgat

SEQ ID NO: 829893 - DNA, 25 bp, Mus musculus
tctcctcttgcagagggttaacgat

SEQ ID NO: 829894 - DNA, 25 bp, Mus musculus
tctcctcttggaattgttaattctg

SEQ ID NO: 829895 - DNA, 25 bp, Mus musculus
tctcctcttggatttgttaattctg

SEQ ID NO: 829896 - DNA, 25 bp, Mus musculus
tctcctctttcccaaaccaagagtt

SEQ ID NO: 829897 - DNA, 25 bp, Mus musculus
tctcctctttccgaaaccaagagtt

SEQ ID NO: 829898 - DNA, 25 bp, Mus musculus
tctcctgaaacgcaggctgcctttg

SEQ ID NO: 829899 - DNA, 25 bp, Mus musculus
tctcctgaaacggaggctgcctttg

SEQ ID NO: 829900 - DNA, 25 bp, Mus musculus
tctcctgaagcacgctgcctgggct

SEQ ID NO: 829901 - DNA, 25 bp, Mus musculus
tctcctgaagcaggctgcctgggct

SEQ ID NO: 829902 - DNA, 25 bp, Mus musculus
tctcctgaatctcaacaggcttcac

SEQ ID NO: 829903 - DNA, 25 bp, Mus musculus
tctcctgaatctgaacaggcttcac

SEQ ID NO: 829904 - DNA, 25 bp, Mus musculus
tctcctgacacgagtactgggaaac

SEQ ID NO: 829905 - DNA, 25 bp, Mus musculus
tctcctgacacgtgtactgggaaac

SEQ ID NO: 829906 - DNA, 25 bp, Mus musculus
tctcctgacagaattcaagtgattc

SEQ ID NO: 829907 - DNA, 25 bp, Mus musculus
tctcctgacagatttcaagtgattc

SEQ ID NO: 829908 - DNA, 25 bp, Mus musculus
tctcctgacatccaagttctgtcac

SEQ ID NO: 829909 - DNA, 25 bp, Mus musculus
tctcctgacatcgaagttctgtcac

SEQ ID NO: 829910 - DNA, 25 bp, Mus musculus
tctcctgaccacatctctttataga

SEQ ID NO: 829911 - DNA, 25 bp, Mus musculus
tctcctgaccacttctctttataga

SEQ ID NO: 829912 - DNA, 25 bp, Mus musculus
tctcctgactgtctggcaacatgtc

SEQ ID NO: 829913 - DNA, 25 bp, Mus musculus
tctcctgactgtgtggcaacatgtc

SEQ ID NO: 829914 - DNA, 25 bp, Mus musculus
tctcctgaggacatgactgcactta

SEQ ID NO: 829915 - DNA, 25 bp, Mus musculus
tctcctgaggacttgactgcactta

SEQ ID NO: 829916 - DNA, 25 bp, Mus musculus
tctcctgataccaagcttcatagga

SEQ ID NO: 829917 - DNA, 25 bp, Mus musculus
tctcctgatacctagcttcatagga

SEQ ID NO: 829918 - DNA, 25 bp, Mus musculus
tctcctgattccagctttacagcaa

SEQ ID NO: 829919 - DNA, 25 bp, Mus musculus
tctcctgattcctgctttacagcaa

SEQ ID NO: 829920 - DNA, 25 bp, Mus musculus
tctcctgcagacattctttgtaatg

SEQ ID NO: 829921 - DNA, 25 bp, Mus musculus
tctcctgcagactttctttgtaatg

SEQ ID NO: 829922 - DNA, 25 bp, Mus musculus
tctcctgcaggaagctatgtacaca

SEQ ID NO: 829923 - DNA, 25 bp, Mus musculus
tctcctgcaggatgctatgtacaca

SEQ ID NO: 829924 - DNA, 25 bp, Mus musculus
tctcctgcagttccatagttctcag

SEQ ID NO: 829925 - DNA, 25 bp, Mus musculus
tctcctgcagttgcatagttctcag

SEQ ID NO: 829926 - DNA, 25 bp, Mus musculus
tctcctgcatataactccttttggt

SEQ ID NO: 829927 - DNA, 25 bp, Mus musculus
tctcctgcatattactccttttggt

SEQ ID NO: 829928 - DNA, 25 bp, Mus musculus
tctcctgcctcgcagagagtttgaa

SEQ ID NO: 829929 - DNA, 25 bp, Mus musculus
tctcctgcctcggagagagtttgaa

SEQ ID NO: 829930 - DNA, 25 bp, Mus musculus
tctcctgcctctaaaaacctagaac

SEQ ID NO: 829931 - DNA, 25 bp, Mus musculus
tctcctgcctcttaaaacctagaac

SEQ ID NO: 829932 - DNA, 25 bp, Mus musculus
tctcctgccttaaaccaatcgggtc

SEQ ID NO: 829933 - DNA, 25 bp, Mus musculus
tctcctgccttataccaatcgggtc

SEQ ID NO: 829934 - DNA, 25 bp, Mus musculus
tctcctgcctttagtacagagttgc

SEQ ID NO: 829935 - DNA, 25 bp, Mus musculus
tctcctgccttttgtacagagttgc

SEQ ID NO: 829936 - DNA, 25 bp, Mus musculus
tctcctgcgggtatttcacttcgaa

SEQ ID NO: 829937 - DNA, 25 bp, Mus musculus
tctcctgcgggtttttcacttcgaa

SEQ ID NO: 829938 - DNA, 25 bp, Mus musculus
tctcctgctctactcatgtgatgaa

SEQ ID NO: 829939 - DNA, 25 bp, Mus musculus
tctcctgctctagtcatgtgatgaa

SEQ ID NO: 829940 - DNA, 25 bp, Mus musculus
tctcctgctctgaaattcagttgat

SEQ ID NO: 829941 - DNA, 25 bp, Mus musculus
tctcctgctctgtaattcagttgat

SEQ ID NO: 829942 - DNA, 25 bp, Mus musculus
tctcctgctcttcactatttattaa

SEQ ID NO: 829943 - DNA, 25 bp, Mus musculus
tctcctgctcttgactatttattaa

SEQ ID NO: 829944 - DNA, 25 bp, Mus musculus
tctcctgctgccatttgtgtcctgg

SEQ ID NO: 829945 - DNA, 25 bp, Mus musculus
tctcctgctgccttttgtgtcctgg

SEQ ID NO: 829946 - DNA, 25 bp, Mus musculus
tctcctgctgtgagctaatggcagc

SEQ ID NO: 829947 - DNA, 25 bp, Mus musculus
tctcctgctgtgtgctaatggcagc

SEQ ID NO: 829948 - DNA, 25 bp, Mus musculus
tctcctgctgttatgtcacgatatc

SEQ ID NO: 829949 - DNA, 25 bp, Mus musculus
tctcctgctgttttgtcacgatatc

SEQ ID NO: 829950 - DNA, 25 bp, Mus musculus
tctcctgcttatcaacatgtatgcg

SEQ ID NO: 829951 - DNA, 25 bp, Mus musculus
tctcctgcttatgaacatgtatgcg

SEQ ID NO: 829952 - DNA, 25 bp, Mus musculus
tctcctgcttcaacccaaaatgtag

SEQ ID NO: 829953 - DNA, 25 bp, Mus musculus
tctcctgcttcatcccaaaatgtag

SEQ ID NO: 829954 - DNA, 25 bp, Mus musculus
tctcctgcttctagccatacttgtg

SEQ ID NO: 829955 - DNA, 25 bp, Mus musculus
tctcctgcttcttgccatacttgtg

SEQ ID NO: 829956 - DNA, 25 bp, Mus musculus
tctcctggaactcgtgaggctgctg

SEQ ID NO: 829957 - DNA, 25 bp, Mus musculus
tctcctggaactggtgaggctgctg

SEQ ID NO: 829958 - DNA, 25 bp, Mus musculus
tctcctggagaccagcagagctgct

SEQ ID NO: 829959 - DNA, 25 bp, Mus musculus
tctcctggagacgagcagagctgct

SEQ ID NO: 829960 - DNA, 25 bp, Mus musculus
tctcctggaggaatgtggcctgctg

SEQ ID NO: 829961 - DNA, 25 bp, Mus musculus
tctcctggaggattgtggcctgctg

SEQ ID NO: 829962 - DNA, 25 bp, Mus musculus
tctcctggaggtatttaggacatca

SEQ ID NO: 829963 - DNA, 25 bp, Mus musculus
tctcctggaggtttttaggacatca

SEQ ID NO: 829964 - DNA, 25 bp, Mus musculus
tctcctggcaggctcattcatgaag

SEQ ID NO: 829965 - DNA, 25 bp, Mus musculus
tctcctggcagggtcattcatgaag

SEQ ID NO: 829966 - DNA, 25 bp, Mus musculus
tctcctggctctaaatgttgtgtct

SEQ ID NO: 829967 - DNA, 25 bp, Mus musculus
tctcctggctcttaatgttgtgtct

SEQ ID NO: 829968 - DNA, 25 bp, Mus musculus
tctcctggctgcagcaaatacgtgc

SEQ ID NO: 829969 - DNA, 25 bp, Mus musculus
tctcctggctgctgcaaatacgtgc

SEQ ID NO: 829970 - DNA, 25 bp, Mus musculus
tctcctggcttgagtcgtcagatac

SEQ ID NO: 829971 - DNA, 25 bp, Mus musculus
tctcctggcttgtgtcgtcagatac

SEQ ID NO: 829972 - DNA, 25 bp, Mus musculus
tctcctggggtaatagacctttcct

SEQ ID NO: 829973 - DNA, 25 bp, Mus musculus
tctcctggggtattagacctttcct

SEQ ID NO: 829974 - DNA, 25 bp, Mus musculus
tctcctggtgagaactgggctccca

SEQ ID NO: 829975 - DNA, 25 bp, Mus musculus
tctcctggtgagtactgggctccca

SEQ ID NO: 829976 - DNA, 25 bp, Mus musculus
tctcctggtgtcactagagtgtgat

SEQ ID NO: 829977 - DNA, 25 bp, Mus musculus
tctcctggtgtctctagagtgtgat

SEQ ID NO: 829978 - DNA, 25 bp, Mus musculus
tctcctgtacttctctttctgttta

SEQ ID NO: 829979 - DNA, 25 bp, Mus musculus
tctcctgtacttgtctttctgttta

SEQ ID NO: 829980 - DNA, 25 bp, Mus musculus
tctcctgtatcaaggcttcctgtga

SEQ ID NO: 829981 - DNA, 25 bp, Mus musculus
tctcctgtatcatggcttcctgtga

SEQ ID NO: 829982 - DNA, 25 bp, Mus musculus
tctcctgtccctctactgagtgttt

SEQ ID NO: 829983 - DNA, 25 bp, Mus musculus
tctcctgtccctgtactgagtgttt

SEQ ID NO: 829984 - DNA, 25 bp, Mus musculus
tctcctgtcgtacttccagcagcag

SEQ ID NO: 829985 - DNA, 25 bp, Mus musculus
tctcctgtcgtagttccagcagcag

SEQ ID NO: 829986 - DNA, 25 bp, Mus musculus
tctcctgtctatagaaagggaaccc

SEQ ID NO: 829987 - DNA, 25 bp, Mus musculus
tctcctgtctattgaaagggaaccc

SEQ ID NO: 829988 - DNA, 25 bp, Mus musculus
tctcctgtctcactaatcgtttagc

SEQ ID NO: 829989 - DNA, 25 bp, Mus musculus
tctcctgtctcagtaatcgtttagc

SEQ ID NO: 829990 - DNA, 25 bp, Mus musculus
tctcctgtctccacaaatggctgaa

SEQ ID NO: 829991 - DNA, 25 bp, Mus musculus
tctcctgtctcctcaaatggctgaa

SEQ ID NO: 829992 - DNA, 25 bp, Mus musculus
tctcctgtcttaacattcttcactc

SEQ ID NO: 829993 - DNA, 25 bp, Mus musculus
tctcctgtcttatcattcttcactc

SEQ ID NO: 829994 - DNA, 25 bp, Mus musculus
tctcctgtgcagactcagtcaccct

SEQ ID NO: 829995 - DNA, 25 bp, Mus musculus
tctcctgtgcagtctcagtcaccct

SEQ ID NO: 829996 - DNA, 25 bp, Mus musculus
tctcctgtgctgcacagtataagaa

SEQ ID NO: 829997 - DNA, 25 bp, Mus musculus
tctcctgtgctggacagtataagaa

SEQ ID NO: 829998 - DNA, 25 bp, Mus musculus
tctcctgtggaacggtcccggaaca

SEQ ID NO: 829999 - DNA, 25 bp, Mus musculus
tctcctgtggaagggtcccggaaca

SEQ ID NO: 830000 - DNA, 25 bp, Mus musculus
tctcctgtggccattgtattcgtga

SEQ ID NO: 830001 - DNA, 25 bp, Mus musculus
tctcctgtggcctttgtattcgtga

SEQ ID NO: 830002 - DNA, 25 bp, Mus musculus
tctcctgtggctcgtaggactgaat

SEQ ID NO: 830003 - DNA, 25 bp, Mus musculus
tctcctgtggctggtaggactgaat

SEQ ID NO: 830004 - DNA, 25 bp, Mus musculus
tctcctgtgggcagtaagttcaaat

SEQ ID NO: 830005 - DNA, 25 bp, Mus musculus
tctcctgtgggctgtaagttcaaat

SEQ ID NO: 830006 - DNA, 25 bp, Mus musculus
tctcctgtgtacactgtctgacagt

SEQ ID NO: 830007 - DNA, 25 bp, Mus musculus
tctcctgtgtactctgtctgacagt

SEQ ID NO: 830008 - DNA, 25 bp, Mus musculus
tctcctgtgtgcagagcccaaggtg

SEQ ID NO: 830009 - DNA, 25 bp, Mus musculus
tctcctgtgtgcagtttgtgggtgt

SEQ ID NO: 830010 - DNA, 25 bp, Mus musculus
tctcctgtgtgctgagcccaaggtg

SEQ ID NO: 830011 - DNA, 25 bp, Mus musculus
tctcctgtgtgctgtttgtgggtgt

SEQ ID NO: 830012 - DNA, 25 bp, Mus musculus
tctcctgtgttcagtaccctgagtt

SEQ ID NO: 830013 - DNA, 25 bp, Mus musculus
tctcctgtgttctgtaccctgagtt

SEQ ID NO: 830014 - DNA, 25 bp, Mus musculus
tctcctgttattatgtgttgtttcc

SEQ ID NO: 830015 - DNA, 25 bp, Mus musculus
tctcctgttattttgtgttgtttcc

SEQ ID NO: 830016 - DNA, 25 bp, Mus musculus
tctcctgttcacatctgcatgttag

SEQ ID NO: 830017 - DNA, 25 bp, Mus musculus
tctcctgttcacttctgcatgttag

SEQ ID NO: 830018 - DNA, 25 bp, Mus musculus
tctcctgttgcaatatttttctggg

SEQ ID NO: 830019 - DNA, 25 bp, Mus musculus
tctcctgttgcattatttttctggg

SEQ ID NO: 830020 - DNA, 25 bp, Mus musculus
tctcctgttgctccatccgataaag

SEQ ID NO: 830021 - DNA, 25 bp, Mus musculus
tctcctgttgctgcatccgataaag

SEQ ID NO: 830022 - DNA, 25 bp, Mus musculus
tctcctgtttacaacttaacttaag

SEQ ID NO: 830023 - DNA, 25 bp, Mus musculus
tctcctgtttactacttaacttaag

SEQ ID NO: 830024 - DNA, 25 bp, Mus musculus
tctccttaagccacaggcagattgt

SEQ ID NO: 830025 - DNA, 25 bp, Mus musculus
tctccttaagcctcaggcagattgt

SEQ ID NO: 830026 - DNA, 25 bp, Mus musculus
tctccttacatgctggtcgggtcac

SEQ ID NO: 830027 - DNA, 25 bp, Mus musculus
tctccttacatggtggtcgggtcac

SEQ ID NO: 830028 - DNA, 25 bp, Mus musculus
tctccttagctgaaaagccttctga

SEQ ID NO: 830029 - DNA, 25 bp, Mus musculus
tctccttagctgtaaagccttctga

SEQ ID NO: 830030 - DNA, 25 bp, Mus musculus
tctccttatcttccaggccaaagta

SEQ ID NO: 830031 - DNA, 25 bp, Mus musculus
tctccttatcttgcaggccaaagta

SEQ ID NO: 830032 - DNA, 25 bp, Mus musculus
tctccttcagatagacatgtaaaca

SEQ ID NO: 830033 - DNA, 25 bp, Mus musculus
tctccttcagattgacatgtaaaca

SEQ ID NO: 830034 - DNA, 25 bp, Mus musculus
tctccttcatttctggtggcttggc

SEQ ID NO: 830035 - DNA, 25 bp, Mus musculus
tctccttcatttgtggtggcttggc

SEQ ID NO: 830036 - DNA, 25 bp, Mus musculus
tctccttccaagaaaaccactacgg

SEQ ID NO: 830037 - DNA, 25 bp, Mus musculus
tctccttccaagtaaaccactacgg

SEQ ID NO: 830038 - DNA, 25 bp, Mus musculus
tctccttccaccaggtttcaggaat

SEQ ID NO: 830039 - DNA, 25 bp, Mus musculus
tctccttccacctggtttcaggaat

SEQ ID NO: 830040 - DNA, 25 bp, Mus musculus
tctccttccactcaacagtcattaa

SEQ ID NO: 830041 - DNA, 25 bp, Mus musculus
tctccttccactcatatctttgaca

SEQ ID NO: 830042 - DNA, 25 bp, Mus musculus
tctccttccactgaacagtcattaa

SEQ ID NO: 830043 - DNA, 25 bp, Mus musculus
tctccttccactgatatctttgaca

SEQ ID NO: 830044 - DNA, 25 bp, Mus musculus
tctccttccagactttccaagtatg

SEQ ID NO: 830045 - DNA, 25 bp, Mus musculus
tctccttccagagtttccaagtatg

SEQ ID NO: 830046 - DNA, 25 bp, Mus musculus
tctccttccattattgtaatgcttt

SEQ ID NO: 830047 - DNA, 25 bp, Mus musculus
tctccttccatttttgtaatgcttt

SEQ ID NO: 830048 - DNA, 25 bp, Mus musculus
tctccttcccttcaagaaactcgga

SEQ ID NO: 830049 - DNA, 25 bp, Mus musculus
tctccttcccttcgacctagatata

SEQ ID NO: 830050 - DNA, 25 bp, Mus musculus
tctccttcccttgaagaaactcgga

SEQ ID NO: 830051 - DNA, 25 bp, Mus musculus
tctccttcccttggacctagatata

SEQ ID NO: 830052 - DNA, 25 bp, Mus musculus
tctccttcctaccagttgcaaaaaa

SEQ ID NO: 830053 - DNA, 25 bp, Mus musculus
tctccttcctacgagttgcaaaaaa

SEQ ID NO: 830054 - DNA, 25 bp, Mus musculus
tctccttcctggctacttaaggtca

SEQ ID NO: 830055 - DNA, 25 bp, Mus musculus
tctccttcctgggtacttaaggtca

SEQ ID NO: 830056 - DNA, 25 bp, Mus musculus
tctccttccttgagtctgtcttttt

SEQ ID NO: 830057 - DNA, 25 bp, Mus musculus
tctccttccttgtgtctgtcttttt

SEQ ID NO: 830058 - DNA, 25 bp, Mus musculus
tctccttcgcatctgtgatggttag

SEQ ID NO: 830059 - DNA, 25 bp, Mus musculus
tctccttcgcatgtgtgatggttag

SEQ ID NO: 830060 - DNA, 25 bp, Mus musculus
tctccttctagacatcactgttcat

SEQ ID NO: 830061 - DNA, 25 bp, Mus musculus
tctccttctagagatcactgttcat

SEQ ID NO: 830062 - DNA, 25 bp, Mus musculus
tctccttctgggattgaggcatgcc

SEQ ID NO: 830063 - DNA, 25 bp, Mus musculus
tctccttctgggtttgaggcatgcc

SEQ ID NO: 830064 - DNA, 25 bp, Mus musculus
tctccttctgtaccctcagtgcaga

SEQ ID NO: 830065 - DNA, 25 bp, Mus musculus
tctccttctgtagcctcagtgcaga

SEQ ID NO: 830066 - DNA, 25 bp, Mus musculus
tctccttctgtgagcatggagttga

SEQ ID NO: 830067 - DNA, 25 bp, Mus musculus
tctccttctgtgtgcatggagttga

SEQ ID NO: 830068 - DNA, 25 bp, Mus musculus
tctccttcttcaatagcatcctagc

SEQ ID NO: 830069 - DNA, 25 bp, Mus musculus
tctccttcttcattagcatcctagc

SEQ ID NO: 830070 - DNA, 25 bp, Mus musculus
tctccttctttgatatgctactcag

SEQ ID NO: 830071 - DNA, 25 bp, Mus musculus
tctccttctttgttatgctactcag

SEQ ID NO: 830072 - DNA, 25 bp, Mus musculus
tctccttcttttagtgtggagccga

SEQ ID NO: 830073 - DNA, 25 bp, Mus musculus
tctccttcttttatcccttgggctt

SEQ ID NO: 830074 - DNA, 25 bp, Mus musculus
tctccttctttttgtgtggagccga

SEQ ID NO: 830075 - DNA, 25 bp, Mus musculus
tctccttcttttttcccttgggctt

SEQ ID NO: 830076 - DNA, 25 bp, Mus musculus
tctccttgaaccaggagtctattga

SEQ ID NO: 830077 - DNA, 25 bp, Mus musculus
tctccttgaacctggagtctattga

SEQ ID NO: 830078 - DNA, 25 bp, Mus musculus
tctccttgaggtatgttcaagatca

SEQ ID NO: 830079 - DNA, 25 bp, Mus musculus
tctccttgaggtttgttcaagatca

SEQ ID NO: 830080 - DNA, 25 bp, Mus musculus
tctccttgctcaattgtgtctgaca

SEQ ID NO: 830081 - DNA, 25 bp, Mus musculus
tctccttgctcatttgtgtctgaca

SEQ ID NO: 830082 - DNA, 25 bp, Mus musculus
tctccttgcttaagtctcccaatta

SEQ ID NO: 830083 - DNA, 25 bp, Mus musculus
tctccttgcttatgtctcccaatta

SEQ ID NO: 830084 - DNA, 25 bp, Mus musculus
tctccttgctttatgatgctctcaa

SEQ ID NO: 830085 - DNA, 25 bp, Mus musculus
tctccttgctttttgatgctctcaa

SEQ ID NO: 830086 - DNA, 25 bp, Mus musculus
tctccttggaagcttcctacattga

SEQ ID NO: 830087 - DNA, 25 bp, Mus musculus
tctccttggaaggttcctacattga

SEQ ID NO: 830088 - DNA, 25 bp, Mus musculus
tctccttggagaattttgacatggg

SEQ ID NO: 830089 - DNA, 25 bp, Mus musculus
tctccttggagaccctggtttggag

SEQ ID NO: 830090 - DNA, 25 bp, Mus musculus
tctccttggagagcctggtttggag

SEQ ID NO: 830091 - DNA, 25 bp, Mus musculus
tctccttggagatttttgacatggg

SEQ ID NO: 830092 - DNA, 25 bp, Mus musculus
tctccttggatgaaagcactgttcg

SEQ ID NO: 830093 - DNA, 25 bp, Mus musculus
tctccttggatgtaagcactgttcg

SEQ ID NO: 830094 - DNA, 25 bp, Mus musculus
tctccttgggagactgcctggcagt

SEQ ID NO: 830095 - DNA, 25 bp, Mus musculus
tctccttgggagtctgcctggcagt

SEQ ID NO: 830096 - DNA, 25 bp, Mus musculus
tctccttgggtgatcggtattttgt

SEQ ID NO: 830097 - DNA, 25 bp, Mus musculus
tctccttgggtgttcggtattttgt

SEQ ID NO: 830098 - DNA, 25 bp, Mus musculus
tctccttggtgacattctacgtcta

SEQ ID NO: 830099 - DNA, 25 bp, Mus musculus
tctccttggtgagattctacgtcta

SEQ ID NO: 830100 - DNA, 25 bp, Mus musculus
tctccttggttcctagtcatgtgga

SEQ ID NO: 830101 - DNA, 25 bp, Mus musculus
tctccttggttcgtagtcatgtgga

SEQ ID NO: 830102 - DNA, 25 bp, Mus musculus
tctccttgtacaaagattaagtctt

SEQ ID NO: 830103 - DNA, 25 bp, Mus musculus
tctccttgtacatagattaagtctt

SEQ ID NO: 830104 - DNA, 25 bp, Mus musculus
tctccttgttgaccctttagaccag

SEQ ID NO: 830105 - DNA, 25 bp, Mus musculus
tctccttgttgagcctttagaccag

SEQ ID NO: 830106 - DNA, 25 bp, Mus musculus
tctcctttaagaaggcctagcatgt

SEQ ID NO: 830107 - DNA, 25 bp, Mus musculus
tctcctttaagatggcctagcatgt

SEQ ID NO: 830108 - DNA, 25 bp, Mus musculus
tctcctttagtaattgtctgctgca

SEQ ID NO: 830109 - DNA, 25 bp, Mus musculus
tctcctttagtatttgtctgctgca

SEQ ID NO: 830110 - DNA, 25 bp, Mus musculus
tctcctttatatactgctgaccggg

SEQ ID NO: 830111 - DNA, 25 bp, Mus musculus
tctcctttatattctgctgaccggg

SEQ ID NO: 830112 - DNA, 25 bp, Mus musculus
tctcctttcagaagaaccacgaggc

SEQ ID NO: 830113 - DNA, 25 bp, Mus musculus
tctcctttcagatgaaccacgaggc

SEQ ID NO: 830114 - DNA, 25 bp, Mus musculus
tctcctttcattctgcacaagtgct

SEQ ID NO: 830115 - DNA, 25 bp, Mus musculus
tctcctttcattgtgcacaagtgct

SEQ ID NO: 830116 - DNA, 25 bp, Mus musculus
tctcctttcctcctgtggcattgct

SEQ ID NO: 830117 - DNA, 25 bp, Mus musculus
tctcctttcctcgtgtggcattgct

SEQ ID NO: 830118 - DNA, 25 bp, Mus musculus
tctcctttcctgaatgtgcactgta

SEQ ID NO: 830119 - DNA, 25 bp, Mus musculus
tctcctttcctgtatgtgcactgta

SEQ ID NO: 830120 - DNA, 25 bp, Mus musculus
tctcctttctatactcgcatgagag

SEQ ID NO: 830121 - DNA, 25 bp, Mus musculus
tctcctttctattctcgcatgagag

SEQ ID NO: 830122 - DNA, 25 bp, Mus musculus
tctcctttcttcctgttaagtctga

SEQ ID NO: 830123 - DNA, 25 bp, Mus musculus
tctcctttcttcgtgttaagtctga

SEQ ID NO: 830124 - DNA, 25 bp, Mus musculus
tctcctttgaccaataccctggtaa

SEQ ID NO: 830125 - DNA, 25 bp, Mus musculus
tctcctttgacctataccctggtaa

SEQ ID NO: 830126 - DNA, 25 bp, Mus musculus
tctcctttgctgaagttggtttgtg

SEQ ID NO: 830127 - DNA, 25 bp, Mus musculus
tctcctttgctgtagttggtttgtg

SEQ ID NO: 830128 - DNA, 25 bp, Mus musculus
tctcctttgcttatctcagtttgcc

SEQ ID NO: 830129 - DNA, 25 bp, Mus musculus
tctcctttgcttttctcagtttgcc

SEQ ID NO: 830130 - DNA, 25 bp, Mus musculus
tctccttttaccataaatcctcttg

SEQ ID NO: 830131 - DNA, 25 bp, Mus musculus
tctccttttaccttaaatcctcttg

SEQ ID NO: 830132 - DNA, 25 bp, Mus musculus
tctccttttactaccaaacagcatg

SEQ ID NO: 830133 - DNA, 25 bp, Mus musculus
tctccttttacttccaaacagcatg

SEQ ID NO: 830134 - DNA, 25 bp, Mus musculus
tctccttttatacccatgctgacta

SEQ ID NO: 830135 - DNA, 25 bp, Mus musculus
tctccttttatagccatgctgacta

SEQ ID NO: 830136 - DNA, 25 bp, Mus musculus
tctccttttcagacaccatgaggtt

SEQ ID NO: 830137 - DNA, 25 bp, Mus musculus
tctccttttcagtcaccatgaggtt

SEQ ID NO: 830138 - DNA, 25 bp, Mus musculus
tctccttttctcaaaactgacttta

SEQ ID NO: 830139 - DNA, 25 bp, Mus musculus
tctccttttctctaaactgacttta

SEQ ID NO: 830140 - DNA, 25 bp, Mus musculus
tctccttttggaccttggtcaataa

SEQ ID NO: 830141 - DNA, 25 bp, Mus musculus
tctccttttggagcttggtcaataa

SEQ ID NO: 830142 - DNA, 25 bp, Mus musculus
tctccttttttaagtctgagcataa

SEQ ID NO: 830143 - DNA, 25 bp, Mus musculus
tctccttttttatgtctgagcataa

SEQ ID NO: 830144 - DNA, 25 bp, Mus musculus
tctcgaaaagttcagtgatttattc

SEQ ID NO: 830145 - DNA, 25 bp, Mus musculus
tctcgaaaagttgagtgatttattc

SEQ ID NO: 830146 - DNA, 25 bp, Mus musculus
tctcgaagagtccaagacgagcggc

SEQ ID NO: 830147 - DNA, 25 bp, Mus musculus
tctcgaagagtcgaagacgagcggc

SEQ ID NO: 830148 - DNA, 25 bp, Mus musculus
tctcgaatcagtatcattcaccgac

SEQ ID NO: 830149 - DNA, 25 bp, Mus musculus
tctcgaatcagtttcattcaccgac

SEQ ID NO: 830150 - DNA, 25 bp, Mus musculus
tctcgaatccttcagttaccatcta

SEQ ID NO: 830151 - DNA, 25 bp, Mus musculus
tctcgaatccttgagttaccatcta

SEQ ID NO: 830152 - DNA, 25 bp, Mus musculus
tctcgaattacaacgctcattgtcc

SEQ ID NO: 830153 - DNA, 25 bp, Mus musculus
tctcgaattacatcgctcattgtcc

SEQ ID NO: 830154 - DNA, 25 bp, Mus musculus
tctcgacaatccctacggcaaaata

SEQ ID NO: 830155 - DNA, 25 bp, Mus musculus
tctcgacaatccgtacggcaaaata

SEQ ID NO: 830156 - DNA, 25 bp, Mus musculus
tctcgacatgtaatttcatttcttt

SEQ ID NO: 830157 - DNA, 25 bp, Mus musculus
tctcgacatgtattttcatttcttt

SEQ ID NO: 830158 - DNA, 25 bp, Mus musculus
tctcgacccgacagcagatcaggtt

SEQ ID NO: 830159 - DNA, 25 bp, Mus musculus
tctcgacccgactgcagatcaggtt

SEQ ID NO: 830160 - DNA, 25 bp, Mus musculus
tctcgactacagaaccggtcattag

SEQ ID NO: 830161 - DNA, 25 bp, Mus musculus
tctcgactacagtaccggtcattag

SEQ ID NO: 830162 - DNA, 25 bp, Mus musculus
tctcgacttcctcccttttatttat

SEQ ID NO: 830163 - DNA, 25 bp, Mus musculus
tctcgacttcctgccttttatttat

SEQ ID NO: 830164 - DNA, 25 bp, Mus musculus
tctcgagaacttagggatgacttac

SEQ ID NO: 830165 - DNA, 25 bp, Mus musculus
tctcgagaactttgggatgacttac

SEQ ID NO: 830166 - DNA, 25 bp, Mus musculus
tctcgagatttcatgaccactccca

SEQ ID NO: 830167 - DNA, 25 bp, Mus musculus
tctcgagatttcttgaccactccca

SEQ ID NO: 830168 - DNA, 25 bp, Mus musculus
tctcgagcttgaacctgttttgaat

SEQ ID NO: 830169 - DNA, 25 bp, Mus musculus
tctcgagcttgatcctgttttgaat

SEQ ID NO: 830170 - DNA, 25 bp, Mus musculus
tctcgaggctgaaatcacagaccag

SEQ ID NO: 830171 - DNA, 25 bp, Mus musculus
tctcgaggctgatatcacagaccag

SEQ ID NO: 830172 - DNA, 25 bp, Mus musculus
tctcgagggacaaacagcttcctgc

SEQ ID NO: 830173 - DNA, 25 bp, Mus musculus
tctcgagggacatacagcttcctgc

SEQ ID NO: 830174 - DNA, 25 bp, Mus musculus
tctcgagggcacactggagggtatc

SEQ ID NO: 830175 - DNA, 25 bp, Mus musculus
tctcgagggcactctggagggtatc

SEQ ID NO: 830176 - DNA, 25 bp, Mus musculus
tctcgaggtgccaccgctgaagacg

SEQ ID NO: 830177 - DNA, 25 bp, Mus musculus
tctcgaggtgcctccgctgaagacg

SEQ ID NO: 830178 - DNA, 25 bp, Mus musculus
tctcgaggtgttccaggccagtgat

SEQ ID NO: 830179 - DNA, 25 bp, Mus musculus
tctcgaggtgttgcaggccagtgat

SEQ ID NO: 830180 - DNA, 25 bp, Mus musculus
tctcgagtggccagagcgtggctta

SEQ ID NO: 830181 - DNA, 25 bp, Mus musculus
tctcgagtggcctgagcgtggctta

SEQ ID NO: 830182 - DNA, 25 bp, Mus musculus
tctcgatcctttcataccgtggtat

SEQ ID NO: 830183 - DNA, 25 bp, Mus musculus
tctcgatcctttgataccgtggtat

SEQ ID NO: 830184 - DNA, 25 bp, Mus musculus
tctcgatctcaacaagctgtgatgt

SEQ ID NO: 830185 - DNA, 25 bp, Mus musculus
tctcgatctcaagaagctgtgatgt

SEQ ID NO: 830186 - DNA, 25 bp, Mus musculus
tctcgatggcctaggtgatgaggtc

SEQ ID NO: 830187 - DNA, 25 bp, Mus musculus
tctcgatggccttggtgatgaggtc

SEQ ID NO: 830188 - DNA, 25 bp, Mus musculus
tctcgattttagcagcccagcttta

SEQ ID NO: 830189 - DNA, 25 bp, Mus musculus
tctcgattttaggagcccagcttta

SEQ ID NO: 830190 - DNA, 25 bp, Mus musculus
tctcgcaacgagattgaccggacca

SEQ ID NO: 830191 - DNA, 25 bp, Mus musculus
tctcgcaacgagtttgaccggacca

SEQ ID NO: 830192 - DNA, 25 bp, Mus musculus
tctcgcaagcagattgccattccca

SEQ ID NO: 830193 - DNA, 25 bp, Mus musculus
tctcgcaagcagtttgccattccca

SEQ ID NO: 830194 - DNA, 25 bp, Mus musculus
tctcgcaagttgatattgtacttag

SEQ ID NO: 830195 - DNA, 25 bp, Mus musculus
tctcgcaagttgttattgtacttag

SEQ ID NO: 830196 - DNA, 25 bp, Mus musculus
tctcgcaatggcatgtgactcacag

SEQ ID NO: 830197 - DNA, 25 bp, Mus musculus
tctcgcaatggcttgtgactcacag

SEQ ID NO: 830198 - DNA, 25 bp, Mus musculus
tctcgcagtttgacttgtctgtcac

SEQ ID NO: 830199 - DNA, 25 bp, Mus musculus
tctcgcagtttgtcttgtctgtcac

SEQ ID NO: 830200 - DNA, 25 bp, Mus musculus
tctcgcatggcaatgcagtggacct

SEQ ID NO: 830201 - DNA, 25 bp, Mus musculus
tctcgcatggcattgcagtggacct

SEQ ID NO: 830202 - DNA, 25 bp, Mus musculus
tctcgcatggtcctgcaacactgga

SEQ ID NO: 830203 - DNA, 25 bp, Mus musculus
tctcgcatggtcgtgcaacactgga

SEQ ID NO: 830204 - DNA, 25 bp, Mus musculus
tctcgccaaggcacgattagctgct

SEQ ID NO: 830205 - DNA, 25 bp, Mus musculus
tctcgccaaggctcgattagctgct

SEQ ID NO: 830206 - DNA, 25 bp, Mus musculus
tctcgccacaatcgagccatgtcat

SEQ ID NO: 830207 - DNA, 25 bp, Mus musculus
tctcgccacaatggagccatgtcat

SEQ ID NO: 830208 - DNA, 25 bp, Mus musculus
tctcgccagtcccagtaaattttta

SEQ ID NO: 830209 - DNA, 25 bp, Mus musculus
tctcgccagtccgagtaaattttta

SEQ ID NO: 830210 - DNA, 25 bp, Mus musculus
tctcgcccacccaattgagtaaatg

SEQ ID NO: 830211 - DNA, 25 bp, Mus musculus
tctcgcccaccctattgagtaaatg

SEQ ID NO: 830212 - DNA, 25 bp, Mus musculus
tctcgcccaggtcataaagccaggt

SEQ ID NO: 830213 - DNA, 25 bp, Mus musculus
tctcgcccaggtgataaagccaggt

SEQ ID NO: 830214 - DNA, 25 bp, Mus musculus
tctcgcccagtcactagtactgtga

SEQ ID NO: 830215 - DNA, 25 bp, Mus musculus
tctcgcccagtctctagtactgtga

SEQ ID NO: 830216 - DNA, 25 bp, Mus musculus
tctcgcccggagctttcaacaaagg

SEQ ID NO: 830217 - DNA, 25 bp, Mus musculus
tctcgcccggaggtttcaacaaagg

SEQ ID NO: 830218 - DNA, 25 bp, Mus musculus
tctcgccggttcaaactttgttcta

SEQ ID NO: 830219 - DNA, 25 bp, Mus musculus
tctcgccggttctaactttgttcta

SEQ ID NO: 830220 - DNA, 25 bp, Mus musculus
tctcgcctacctacttaacaattta

SEQ ID NO: 830221 - DNA, 25 bp, Mus musculus
tctcgcctaccttcttaacaattta

SEQ ID NO: 830222 - DNA, 25 bp, Mus musculus
tctcgcgatactacgggtcttcaaa

SEQ ID NO: 830223 - DNA, 25 bp, Mus musculus
tctcgcgatacttcgggtcttcaaa

SEQ ID NO: 830224 - DNA, 25 bp, Mus musculus
tctcgcgccatcagccaggtcagga

SEQ ID NO: 830225 - DNA, 25 bp, Mus musculus
tctcgcgccatctgccaggtcagga

SEQ ID NO: 830226 - DNA, 25 bp, Mus musculus
tctcgcgctgtcagagagatggccg

SEQ ID NO: 830227 - DNA, 25 bp, Mus musculus
tctcgcgctgtctgagagatggccg

SEQ ID NO: 830228 - DNA, 25 bp, Mus musculus
tctcgcggaaacctggaaataaagt

SEQ ID NO: 830229 - DNA, 25 bp, Mus musculus
tctcgcggaaacgtggaaataaagt

SEQ ID NO: 830230 - DNA, 25 bp, Mus musculus
tctcgcgtctgtcgcaatggcaaaa

SEQ ID NO: 830231 - DNA, 25 bp, Mus musculus
tctcgcgtctgtggcaatggcaaaa

SEQ ID NO: 830232 - DNA, 25 bp, Mus musculus
tctcgcgtgtcgacagcaagtagtt

SEQ ID NO: 830233 - DNA, 25 bp, Mus musculus
tctcgcgtgtcgtcagcaagtagtt

SEQ ID NO: 830234 - DNA, 25 bp, Mus musculus
tctcgctaagtcacagactctgaag

SEQ ID NO: 830235 - DNA, 25 bp, Mus musculus
tctcgctaagtctcagactctgaag

SEQ ID NO: 830236 - DNA, 25 bp, Mus musculus
tctcgctaattccagctggcttcaa

SEQ ID NO: 830237 - DNA, 25 bp, Mus musculus
tctcgctaattcgagctggcttcaa

SEQ ID NO: 830238 - DNA, 25 bp, Mus musculus
tctcgctcagataccattttaattt

SEQ ID NO: 830239 - DNA, 25 bp, Mus musculus
tctcgctcagattccattttaattt

SEQ ID NO: 830240 - DNA, 25 bp, Mus musculus
tctcgctcagtaaccgggctctctt

SEQ ID NO: 830241 - DNA, 25 bp, Mus musculus
tctcgctcagtatccgggctctctt

SEQ ID NO: 830242 - DNA, 25 bp, Mus musculus
tctcgctcattcacatccaatgtaa

SEQ ID NO: 830243 - DNA, 25 bp, Mus musculus
tctcgctcattctcatccaatgtaa

SEQ ID NO: 830244 - DNA, 25 bp, Mus musculus
tctcgctctaggacccctaagaaat

SEQ ID NO: 830245 - DNA, 25 bp, Mus musculus
tctcgctctaggtcccctaagaaat

SEQ ID NO: 830246 - DNA, 25 bp, Mus musculus
tctcgctgccctcgaagccaagaaa

SEQ ID NO: 830247 - DNA, 25 bp, Mus musculus
tctcgctgccctggaagccaagaaa

SEQ ID NO: 830248 - DNA, 25 bp, Mus musculus
tctcgctggtcacttcagagtcttg

SEQ ID NO: 830249 - DNA, 25 bp, Mus musculus
tctcgctggtcagttcagagtcttg

SEQ ID NO: 830250 - DNA, 25 bp, Mus musculus
tctcgcttatatagggcagacctca

SEQ ID NO: 830251 - DNA, 25 bp, Mus musculus
tctcgcttatattgggcagacctca

SEQ ID NO: 830252 - DNA, 25 bp, Mus musculus
tctcgcttgctgagtcgtggtttag

SEQ ID NO: 830253 - DNA, 25 bp, Mus musculus
tctcgcttgctgtgtcgtggtttag

SEQ ID NO: 830254 - DNA, 25 bp, Mus musculus
tctcggaaaaagacagatactacct

SEQ ID NO: 830255 - DNA, 25 bp, Mus musculus
tctcggaaaaagtcagatactacct

SEQ ID NO: 830256 - DNA, 25 bp, Mus musculus
tctcggacccgactggcgttggaaa

SEQ ID NO: 830257 - DNA, 25 bp, Mus musculus
tctcggacccgagtggcgttggaaa

SEQ ID NO: 830258 - DNA, 25 bp, Mus musculus
tctcggactcatccatatggctggg

SEQ ID NO: 830259 - DNA, 25 bp, Mus musculus
tctcggactcatgcatatggctggg

SEQ ID NO: 830260 - DNA, 25 bp, Mus musculus
tctcggagatcccacagacggctga

SEQ ID NO: 830261 - DNA, 25 bp, Mus musculus
tctcggagatccgacagacggctga

SEQ ID NO: 830262 - DNA, 25 bp, Mus musculus
tctcggaggtttactcatctcaggg

SEQ ID NO: 830263 - DNA, 25 bp, Mus musculus
tctcggaggttttctcatctcaggg

SEQ ID NO: 830264 - DNA, 25 bp, Mus musculus
tctcggagtgtgattttgctggacc

SEQ ID NO: 830265 - DNA, 25 bp, Mus musculus
tctcggagtgtgtttttgctggacc

SEQ ID NO: 830266 - DNA, 25 bp, Mus musculus
tctcggcaagcactttttattcctg

SEQ ID NO: 830267 - DNA, 25 bp, Mus musculus
tctcggcaagcagtttttattcctg

SEQ ID NO: 830268 - DNA, 25 bp, Mus musculus
tctcggcaagtacacacccacgtga

SEQ ID NO: 830269 - DNA, 25 bp, Mus musculus
tctcggcaagtagacacccacgtga

SEQ ID NO: 830270 - DNA, 25 bp, Mus musculus
tctcggcagcagacctgtgtgtcat

SEQ ID NO: 830271 - DNA, 25 bp, Mus musculus
tctcggcagcagtcctgtgtgtcat

SEQ ID NO: 830272 - DNA, 25 bp, Mus musculus
tctcggccctcaacctgtgggtagt

SEQ ID NO: 830273 - DNA, 25 bp, Mus musculus
tctcggccctcatcctgtgggtagt

SEQ ID NO: 830274 - DNA, 25 bp, Mus musculus
tctcggccgctacttggtgatcttt

SEQ ID NO: 830275 - DNA, 25 bp, Mus musculus
tctcggccgctagttggtgatcttt

SEQ ID NO: 830276 - DNA, 25 bp, Mus musculus
tctcggcctcgtaattgctttaaag

SEQ ID NO: 830277 - DNA, 25 bp, Mus musculus
tctcggcctcgttattgctttaaag

SEQ ID NO: 830278 - DNA, 25 bp, Mus musculus
tctcggcgggcactttacgtgtgac

SEQ ID NO: 830279 - DNA, 25 bp, Mus musculus
tctcggcgggcagtttacgtgtgac

SEQ ID NO: 830280 - DNA, 25 bp, Mus musculus
tctcggctacacacttgttgctcag

SEQ ID NO: 830281 - DNA, 25 bp, Mus musculus
tctcggctacactcttgttgctcag

SEQ ID NO: 830282 - DNA, 25 bp, Mus musculus
tctcggctggtgaggctagtagaca

SEQ ID NO: 830283 - DNA, 25 bp, Mus musculus
tctcggctggtgtggctagtagaca

SEQ ID NO: 830284 - DNA, 25 bp, Mus musculus
tctcggctgtccattattttctgaa

SEQ ID NO: 830285 - DNA, 25 bp, Mus musculus
tctcggctgtcctttattttctgaa

SEQ ID NO: 830286 - DNA, 25 bp, Mus musculus
tctcgggaaagcaactcgccatcaa

SEQ ID NO: 830287 - DNA, 25 bp, Mus musculus
tctcgggaaagctactcgccatcaa

SEQ ID NO: 830288 - DNA, 25 bp, Mus musculus
tctcgggacagaaacaagcctttta

SEQ ID NO: 830289 - DNA, 25 bp, Mus musculus
tctcgggacagatacaagcctttta

SEQ ID NO: 830290 - DNA, 25 bp, Mus musculus
tctcgggacctcagaaccgggagga

SEQ ID NO: 830291 - DNA, 25 bp, Mus musculus
tctcgggacctctgaaccgggagga

SEQ ID NO: 830292 - DNA, 25 bp, Mus musculus
tctcgggactccaagtagtaatgat

SEQ ID NO: 830293 - DNA, 25 bp, Mus musculus
tctcgggactcctagtagtaatgat

SEQ ID NO: 830294 - DNA, 25 bp, Mus musculus
tctcgggagattaacctggcagctg

SEQ ID NO: 830295 - DNA, 25 bp, Mus musculus
tctcgggagatttacctggcagctg

SEQ ID NO: 830296 - DNA, 25 bp, Mus musculus
tctcgggaggcacctttttgagcct

SEQ ID NO: 830297 - DNA, 25 bp, Mus musculus
tctcgggaggcagctttttgagcct

SEQ ID NO: 830298 - DNA, 25 bp, Mus musculus
tctcgggcaggtagggacctggagt

SEQ ID NO: 830299 - DNA, 25 bp, Mus musculus
tctcgggcaggttgggacctggagt

SEQ ID NO: 830300 - DNA, 25 bp, Mus musculus
tctcgggccacacaacactatcttt

SEQ ID NO: 830301 - DNA, 25 bp, Mus musculus
tctcgggccacagaacactatcttt

SEQ ID NO: 830302 - DNA, 25 bp, Mus musculus
tctcgggccactccatgataacaat

SEQ ID NO: 830303 - DNA, 25 bp, Mus musculus
tctcgggccactgcatgataacaat

SEQ ID NO: 830304 - DNA, 25 bp, Mus musculus
tctcgggccgaaaatagtgggatgt

SEQ ID NO: 830305 - DNA, 25 bp, Mus musculus
tctcgggccgaatatagtgggatgt

SEQ ID NO: 830306 - DNA, 25 bp, Mus musculus
tctcgggccgttactgtgggattga

SEQ ID NO: 830307 - DNA, 25 bp, Mus musculus
tctcgggccgtttctgtgggattga

SEQ ID NO: 830308 - DNA, 25 bp, Mus musculus
tctcgggcctccactctacggagga

SEQ ID NO: 830309 - DNA, 25 bp, Mus musculus
tctcgggcctcctctctacggagga

SEQ ID NO: 830310 - DNA, 25 bp, Mus musculus
tctcgggcctgcaacaacctgttca

SEQ ID NO: 830311 - DNA, 25 bp, Mus musculus
tctcgggcctgctacaacctgttca

SEQ ID NO: 830312 - DNA, 25 bp, Mus musculus
tctcgggctagtatatcttctttac

SEQ ID NO: 830313 - DNA, 25 bp, Mus musculus
tctcgggctagtttatcttctttac

SEQ ID NO: 830314 - DNA, 25 bp, Mus musculus
tctcgggctattaatccatttccaa

SEQ ID NO: 830315 - DNA, 25 bp, Mus musculus
tctcgggctatttatccatttccaa

SEQ ID NO: 830316 - DNA, 25 bp, Mus musculus
tctcgggctctcagattgttgacat

SEQ ID NO: 830317 - DNA, 25 bp, Mus musculus
tctcgggctctctgattgttgacat

SEQ ID NO: 830318 - DNA, 25 bp, Mus musculus
tctcgggtgataatggacctgcctg

SEQ ID NO: 830319 - DNA, 25 bp, Mus musculus
tctcgggtgatattggacctgcctg

SEQ ID NO: 830320 - DNA, 25 bp, Mus musculus
tctcgggttttaagcctcacagttt

SEQ ID NO: 830321 - DNA, 25 bp, Mus musculus
tctcgggttttatgcctcacagttt

SEQ ID NO: 830322 - DNA, 25 bp, Mus musculus
tctcggtactctatctccactcttt

SEQ ID NO: 830323 - DNA, 25 bp, Mus musculus
tctcggtactctttctccactcttt

SEQ ID NO: 830324 - DNA, 25 bp, Mus musculus
tctcggtatagtctggctggtcctg

SEQ ID NO: 830325 - DNA, 25 bp, Mus musculus
tctcggtatagtgtggctggtcctg

SEQ ID NO: 830326 - DNA, 25 bp, Mus musculus
tctcggtccacacagcatgggctac

SEQ ID NO: 830327 - DNA, 25 bp, Mus musculus
tctcggtccacagagcatgggctac

SEQ ID NO: 830328 - DNA, 25 bp, Mus musculus
tctcggtgacggctagaggcggagg

SEQ ID NO: 830329 - DNA, 25 bp, Mus musculus
tctcggtgacgggtagaggcggagg

SEQ ID NO: 830330 - DNA, 25 bp, Mus musculus
tctcggtgactcacaggtttagtca

SEQ ID NO: 830331 - DNA, 25 bp, Mus musculus
tctcggtgactctcaggtttagtca

SEQ ID NO: 830332 - DNA, 25 bp, Mus musculus
tctcggtgactgacccatggagcca

SEQ ID NO: 830333 - DNA, 25 bp, Mus musculus
tctcggtgactgtcccatggagcca

SEQ ID NO: 830334 - DNA, 25 bp, Mus musculus
tctcggtgcttcacccggaaataca

SEQ ID NO: 830335 - DNA, 25 bp, Mus musculus
tctcggtgcttctcccggaaataca

SEQ ID NO: 830336 - DNA, 25 bp, Mus musculus
tctcggtggagtacagctaccgtgc

SEQ ID NO: 830337 - DNA, 25 bp, Mus musculus
tctcggtggagttcagctaccgtgc

SEQ ID NO: 830338 - DNA, 25 bp, Mus musculus
tctcggtggcggagagccccatgtc

SEQ ID NO: 830339 - DNA, 25 bp, Mus musculus
tctcggtggcggtgagccccatgtc

SEQ ID NO: 830340 - DNA, 25 bp, Mus musculus
tctcggttaaggactactgctttgc

SEQ ID NO: 830341 - DNA, 25 bp, Mus musculus
tctcggttaaggtctactgctttgc

SEQ ID NO: 830342 - DNA, 25 bp, Mus musculus
tctcggtttagcagccagtcctggc

SEQ ID NO: 830343 - DNA, 25 bp, Mus musculus
tctcggtttagctgccagtcctggc

SEQ ID NO: 830344 - DNA, 25 bp, Mus musculus
tctcgtacagatcctaggccgctca

SEQ ID NO: 830345 - DNA, 25 bp, Mus musculus
tctcgtacagatgctaggccgctca

SEQ ID NO: 830346 - DNA, 25 bp, Mus musculus
tctcgtaggaggatcgcgcagtctg

SEQ ID NO: 830347 - DNA, 25 bp, Mus musculus
tctcgtaggaggttcgcgcagtctg

SEQ ID NO: 830348 - DNA, 25 bp, Mus musculus
tctcgtattataattttgtcatggc

SEQ ID NO: 830349 - DNA, 25 bp, Mus musculus
tctcgtattatatttttgtcatggc

SEQ ID NO: 830350 - DNA, 25 bp, Mus musculus
tctcgtattgagactggctgtgttt

SEQ ID NO: 830351 - DNA, 25 bp, Mus musculus
tctcgtattgagtctggctgtgttt

SEQ ID NO: 830352 - DNA, 25 bp, Mus musculus
tctcgtcccttcctgaggatggtaa

SEQ ID NO: 830353 - DNA, 25 bp, Mus musculus
tctcgtcccttcgtgaggatggtaa

SEQ ID NO: 830354 - DNA, 25 bp, Mus musculus
tctcgtccgttgagtctcacaaaga

SEQ ID NO: 830355 - DNA, 25 bp, Mus musculus
tctcgtccgttgtgtctcacaaaga

SEQ ID NO: 830356 - DNA, 25 bp, Mus musculus
tctcgtcgacggcaagacattcaca

SEQ ID NO: 830357 - DNA, 25 bp, Mus musculus
tctcgtcgacgggaagacattcaca

SEQ ID NO: 830358 - DNA, 25 bp, Mus musculus
tctcgtctcagcacaaatccaggga

SEQ ID NO: 830359 - DNA, 25 bp, Mus musculus
tctcgtctcagctcaaatccaggga

SEQ ID NO: 830360 - DNA, 25 bp, Mus musculus
tctcgtctggctactgctgcaggac

SEQ ID NO: 830361 - DNA, 25 bp, Mus musculus
tctcgtctggcttctgctgcaggac

SEQ ID NO: 830362 - DNA, 25 bp, Mus musculus
tctcgtctttccagttcttttatga

SEQ ID NO: 830363 - DNA, 25 bp, Mus musculus
tctcgtctttcctgttcttttatga

SEQ ID NO: 830364 - DNA, 25 bp, Mus musculus
tctcgtgaaattcccttccgtgaca

SEQ ID NO: 830365 - DNA, 25 bp, Mus musculus
tctcgtgaaattgccttccgtgaca

SEQ ID NO: 830366 - DNA, 25 bp, Mus musculus
tctcgtgattgaaaggaaccttctg

SEQ ID NO: 830367 - DNA, 25 bp, Mus musculus
tctcgtgattgataggaaccttctg

SEQ ID NO: 830368 - DNA, 25 bp, Mus musculus
tctcgtgattgcataatggactctt

SEQ ID NO: 830369 - DNA, 25 bp, Mus musculus
tctcgtgattgcttaatggactctt

SEQ ID NO: 830370 - DNA, 25 bp, Mus musculus
tctcgtgctgccattgttaaaatgc

SEQ ID NO: 830371 - DNA, 25 bp, Mus musculus
tctcgtgctgcctttgttaaaatgc

SEQ ID NO: 830372 - DNA, 25 bp, Mus musculus
tctcgtggcgagactgtaactagtg

SEQ ID NO: 830373 - DNA, 25 bp, Mus musculus
tctcgtggcgagtctgtaactagtg

SEQ ID NO: 830374 - DNA, 25 bp, Mus musculus
tctcgtggtggtaagctaggcagtt

SEQ ID NO: 830375 - DNA, 25 bp, Mus musculus
tctcgtggtggttagctaggcagtt

SEQ ID NO: 830376 - DNA, 25 bp, Mus musculus
tctcgtgtaaagcagctgccagctg

SEQ ID NO: 830377 - DNA, 25 bp, Mus musculus
tctcgtgtaaaggagctgccagctg

SEQ ID NO: 830378 - DNA, 25 bp, Mus musculus
tctcgtgttcatctgcagcatggaa

SEQ ID NO: 830379 - DNA, 25 bp, Mus musculus
tctcgtgttcatgtgcagcatggaa

SEQ ID NO: 830380 - DNA, 25 bp, Mus musculus
tctcgttagcacatctccagcttca

SEQ ID NO: 830381 - DNA, 25 bp, Mus musculus
tctcgttagcacttctccagcttca

SEQ ID NO: 830382 - DNA, 25 bp, Mus musculus
tctcgttatttaagcccctagtgaa

SEQ ID NO: 830383 - DNA, 25 bp, Mus musculus
tctcgttatttatgcccctagtgaa

SEQ ID NO: 830384 - DNA, 25 bp, Mus musculus
tctcgttccctgctttaccagtcta

SEQ ID NO: 830385 - DNA, 25 bp, Mus musculus
tctcgttccctggtttaccagtcta

SEQ ID NO: 830386 - DNA, 25 bp, Mus musculus
tctcgttccttgatccaatccctaa

SEQ ID NO: 830387 - DNA, 25 bp, Mus musculus
tctcgttccttgttccaatccctaa

SEQ ID NO: 830388 - DNA, 25 bp, Mus musculus
tctcgttctcttagctttaggtgaa

SEQ ID NO: 830389 - DNA, 25 bp, Mus musculus
tctcgttctctttgctttaggtgaa

SEQ ID NO: 830390 - DNA, 25 bp, Mus musculus
tctcgttctgacaccatgcatattt

SEQ ID NO: 830391 - DNA, 25 bp, Mus musculus
tctcgttctgactccatgcatattt

SEQ ID NO: 830392 - DNA, 25 bp, Mus musculus
tctcgttgaaagagcgtcagcctgt

SEQ ID NO: 830393 - DNA, 25 bp, Mus musculus
tctcgttgaaagtgcgtcagcctgt

SEQ ID NO: 830394 - DNA, 25 bp, Mus musculus
tctcgttggccaaggcttggagagc

SEQ ID NO: 830395 - DNA, 25 bp, Mus musculus
tctcgttggccatggcttggagagc

SEQ ID NO: 830396 - DNA, 25 bp, Mus musculus
tctcgttgggatcaaacgccggcga

SEQ ID NO: 830397 - DNA, 25 bp, Mus musculus
tctcgttgggatgaaacgccggcga

SEQ ID NO: 830398 - DNA, 25 bp, Mus musculus
tctcgttgtatcaatatcttctcta

SEQ ID NO: 830399 - DNA, 25 bp, Mus musculus
tctcgttgtatctatatcttctcta

SEQ ID NO: 830400 - DNA, 25 bp, Mus musculus
tctcgtttcctgagtttggcactgg

SEQ ID NO: 830401 - DNA, 25 bp, Mus musculus
tctcgtttcctgtgtttggcactgg

SEQ ID NO: 830402 - DNA, 25 bp, Mus musculus
tctcgtttgagaagaccaagcgtca

SEQ ID NO: 830403 - DNA, 25 bp, Mus musculus
tctcgtttgagatgaccaagcgtca

SEQ ID NO: 830404 - DNA, 25 bp, Mus musculus
tctctaaacagaaatggcagtcata

SEQ ID NO: 830405 - DNA, 25 bp, Mus musculus
tctctaaacagatatggcagtcata

SEQ ID NO: 830406 - DNA, 25 bp, Mus musculus
tctctaaagagtaccctgccagggc

SEQ ID NO: 830407 - DNA, 25 bp, Mus musculus
tctctaaagagttccctgccagggc

SEQ ID NO: 830408 - DNA, 25 bp, Mus musculus
tctctaaagccaactgggttcgagg

SEQ ID NO: 830409 - DNA, 25 bp, Mus musculus
tctctaaagccatctgggttcgagg

SEQ ID NO: 830410 - DNA, 25 bp, Mus musculus
tctctaaatccaagtgtctcctttt

SEQ ID NO: 830411 - DNA, 25 bp, Mus musculus
tctctaaatccatgtgtctcctttt

SEQ ID NO: 830412 - DNA, 25 bp, Mus musculus
tctctaacacccatccatgattaaa

SEQ ID NO: 830413 - DNA, 25 bp, Mus musculus
tctctaacacccttccatgattaaa

SEQ ID NO: 830414 - DNA, 25 bp, Mus musculus
tctctaaccagtacatcagcttgtc

SEQ ID NO: 830415 - DNA, 25 bp, Mus musculus
tctctaaccagttcatcagcttgtc

SEQ ID NO: 830416 - DNA, 25 bp, Mus musculus
tctctaaccctaccagtcgggaagc

SEQ ID NO: 830417 - DNA, 25 bp, Mus musculus
tctctaaccctagcagtcgggaagc

SEQ ID NO: 830418 - DNA, 25 bp, Mus musculus
tctctaacctggctgaataccgttt

SEQ ID NO: 830419 - DNA, 25 bp, Mus musculus
tctctaacctgggtgaataccgttt

SEQ ID NO: 830420 - DNA, 25 bp, Mus musculus
tctctaacctgtacatgtgtttaat

SEQ ID NO: 830421 - DNA, 25 bp, Mus musculus
tctctaacctgttcatgtgtttaat

SEQ ID NO: 830422 - DNA, 25 bp, Mus musculus
tctctaactagacgccacttacttg

SEQ ID NO: 830423 - DNA, 25 bp, Mus musculus
tctctaactagaggccacttacttg

SEQ ID NO: 830424 - DNA, 25 bp, Mus musculus
tctctaactgagcacccatatgcct

SEQ ID NO: 830425 - DNA, 25 bp, Mus musculus
tctctaactgaggacccatatgcct

SEQ ID NO: 830426 - DNA, 25 bp, Mus musculus
tctctaactgctctgaagccagtga

SEQ ID NO: 830427 - DNA, 25 bp, Mus musculus
tctctaactgctgtgaagccagtga

SEQ ID NO: 830428 - DNA, 25 bp, Mus musculus
tctctaagaactcggccacaccgtg

SEQ ID NO: 830429 - DNA, 25 bp, Mus musculus
tctctaagaactgggccacaccgtg

SEQ ID NO: 830430 - DNA, 25 bp, Mus musculus
tctctaagactgagcagacctccgc

SEQ ID NO: 830431 - DNA, 25 bp, Mus musculus
tctctaagactgtgcagacctccgc

SEQ ID NO: 830432 - DNA, 25 bp, Mus musculus
tctctaagcaccctgggccaagtga

SEQ ID NO: 830433 - DNA, 25 bp, Mus musculus
tctctaagcaccgtgggccaagtga

SEQ ID NO: 830434 - DNA, 25 bp, Mus musculus
tctctaagccttcgtctacaatggt

SEQ ID NO: 830435 - DNA, 25 bp, Mus musculus
tctctaagccttggtctacaatggt

SEQ ID NO: 830436 - DNA, 25 bp, Mus musculus
tctctaagtctgaggcctcaaagtg

SEQ ID NO: 830437 - DNA, 25 bp, Mus musculus
tctctaagtctgtggcctcaaagtg

SEQ ID NO: 830438 - DNA, 25 bp, Mus musculus
tctctaataccaagctaaggccgtt

SEQ ID NO: 830439 - DNA, 25 bp, Mus musculus
tctctaataccatgctaaggccgtt

SEQ ID NO: 830440 - DNA, 25 bp, Mus musculus
tctctaatgtccctatctcctcatt

SEQ ID NO: 830441 - DNA, 25 bp, Mus musculus
tctctaatgtccgtatctcctcatt

SEQ ID NO: 830442 - DNA, 25 bp, Mus musculus
tctctaatgtgcatgaaatcaggcc

SEQ ID NO: 830443 - DNA, 25 bp, Mus musculus
tctctaatgtgcttgaaatcaggcc

SEQ ID NO: 830444 - DNA, 25 bp, Mus musculus
tctctaattccaagtttctctcggc

SEQ ID NO: 830445 - DNA, 25 bp, Mus musculus
tctctaattccatgtttctctcggc

SEQ ID NO: 830446 - DNA, 25 bp, Mus musculus
tctctacagcttactatctctaggt

SEQ ID NO: 830447 - DNA, 25 bp, Mus musculus
tctctacagctttctatctctaggt

SEQ ID NO: 830448 - DNA, 25 bp, Mus musculus
tctctacatccacgcgcaggtgaga

SEQ ID NO: 830449 - DNA, 25 bp, Mus musculus
tctctacatccaggcgcaggtgaga

SEQ ID NO: 830450 - DNA, 25 bp, Mus musculus
tctctacatcttccattgcatttac

SEQ ID NO: 830451 - DNA, 25 bp, Mus musculus
tctctacatcttgcattgcatttac

SEQ ID NO: 830452 - DNA, 25 bp, Mus musculus
tctctacattgcagattcatcgtga

SEQ ID NO: 830453 - DNA, 25 bp, Mus musculus
tctctacattgctgattcatcgtga

SEQ ID NO: 830454 - DNA, 25 bp, Mus musculus
tctctaccactaattcttctttatc

SEQ ID NO: 830455 - DNA, 25 bp, Mus musculus
tctctaccactatttcttctttatc

SEQ ID NO: 830456 - DNA, 25 bp, Mus musculus
tctctaccacttctctttaactttt

SEQ ID NO: 830457 - DNA, 25 bp, Mus musculus
tctctaccacttgtctttaactttt

SEQ ID NO: 830458 - DNA, 25 bp, Mus musculus
tctctaccagcacactgggtggtta

SEQ ID NO: 830459 - DNA, 25 bp, Mus musculus
tctctaccagcagactgggtggtta

SEQ ID NO: 830460 - DNA, 25 bp, Mus musculus
tctctaccagggattcagtgtctct

SEQ ID NO: 830461 - DNA, 25 bp, Mus musculus
tctctaccagggtttcagtgtctct

SEQ ID NO: 830462 - DNA, 25 bp, Mus musculus
tctctaccctcaaacgacgtaaaag

SEQ ID NO: 830463 - DNA, 25 bp, Mus musculus
tctctaccctcatacgacgtaaaag

SEQ ID NO: 830464 - DNA, 25 bp, Mus musculus
tctctacctgacctaacatcttggt

SEQ ID NO: 830465 - DNA, 25 bp, Mus musculus
tctctacctgacgtaacatcttggt

SEQ ID NO: 830466 - DNA, 25 bp, Mus musculus
tctctacctgagctgcaacctgtta

SEQ ID NO: 830467 - DNA, 25 bp, Mus musculus
tctctacctgaggtgcaacctgtta

SEQ ID NO: 830468 - DNA, 25 bp, Mus musculus
tctctacctggaagggaatccctgg

SEQ ID NO: 830469 - DNA, 25 bp, Mus musculus
tctctacctggatgggaatccctgg

SEQ ID NO: 830470 - DNA, 25 bp, Mus musculus
tctctacctgtgaaaagccccattc

SEQ ID NO: 830471 - DNA, 25 bp, Mus musculus
tctctacctgtgtaaagccccattc

SEQ ID NO: 830472 - DNA, 25 bp, Mus musculus
tctctacgaaacaaacaactacaaa

SEQ ID NO: 830473 - DNA, 25 bp, Mus musculus
tctctacgaaactaacaactacaaa

SEQ ID NO: 830474 - DNA, 25 bp, Mus musculus
tctctactatgcctcatgttgccta

SEQ ID NO: 830475 - DNA, 25 bp, Mus musculus
tctctactatgcgtcatgttgccta

SEQ ID NO: 830476 - DNA, 25 bp, Mus musculus
tctctactccttcagcatggtggta

SEQ ID NO: 830477 - DNA, 25 bp, Mus musculus
tctctactccttgagcatggtggta

SEQ ID NO: 830478 - DNA, 25 bp, Mus musculus
tctctactcttcaggaccctagggt

SEQ ID NO: 830479 - DNA, 25 bp, Mus musculus
tctctactcttctggaccctagggt

SEQ ID NO: 830480 - DNA, 25 bp, Mus musculus
tctctactctttactatcctatcta

SEQ ID NO: 830481 - DNA, 25 bp, Mus musculus
tctctactcttttctatcctatcta

SEQ ID NO: 830482 - DNA, 25 bp, Mus musculus
tctctactgaagagtgtgtccttcc

SEQ ID NO: 830483 - DNA, 25 bp, Mus musculus
tctctactgaagtgtgtgtccttcc

SEQ ID NO: 830484 - DNA, 25 bp, Mus musculus
tctctactgaccacattagcacagg

SEQ ID NO: 830485 - DNA, 25 bp, Mus musculus
tctctactgacctcattagcacagg

SEQ ID NO: 830486 - DNA, 25 bp, Mus musculus
tctctactgccacgagtacttcaaa

SEQ ID NO: 830487 - DNA, 25 bp, Mus musculus
tctctactgccaggagtacttcaaa

SEQ ID NO: 830488 - DNA, 25 bp, Mus musculus
tctctacttcctaccagacagtaaa

SEQ ID NO: 830489 - DNA, 25 bp, Mus musculus
tctctacttccttccagacagtaaa

SEQ ID NO: 830490 - DNA, 25 bp, Mus musculus
tctctacttgggagatgttccagcc

SEQ ID NO: 830491 - DNA, 25 bp, Mus musculus
tctctacttgggtgatgttccagcc

SEQ ID NO: 830492 - DNA, 25 bp, Mus musculus
tctctacttttaatctttacaatgt

SEQ ID NO: 830493 - DNA, 25 bp, Mus musculus
tctctacttttattctttacaatgt

SEQ ID NO: 830494 - DNA, 25 bp, Mus musculus
tctctagaaggcattatgaagactg

SEQ ID NO: 830495 - DNA, 25 bp, Mus musculus
tctctagaaggctttatgaagactg

SEQ ID NO: 830496 - DNA, 25 bp, Mus musculus
tctctagacatacctttctgcttac

SEQ ID NO: 830497 - DNA, 25 bp, Mus musculus
tctctagacatagctttctgcttac

SEQ ID NO: 830498 - DNA, 25 bp, Mus musculus
tctctagacattacttaccttgaag

SEQ ID NO: 830499 - DNA, 25 bp, Mus musculus
tctctagacatttcttaccttgaag

SEQ ID NO: 830500 - DNA, 25 bp, Mus musculus
tctctagaccctctttattctcagg

SEQ ID NO: 830501 - DNA, 25 bp, Mus musculus
tctctagaccctgtttattctcagg

SEQ ID NO: 830502 - DNA, 25 bp, Mus musculus
tctctagatctcaaacccattgata

SEQ ID NO: 830503 - DNA, 25 bp, Mus musculus
tctctagatctctaacccattgata

SEQ ID NO: 830504 - DNA, 25 bp, Mus musculus
tctctagatgctcagctcaggtcac

SEQ ID NO: 830505 - DNA, 25 bp, Mus musculus
tctctagatgctgagctcaggtcac

SEQ ID NO: 830506 - DNA, 25 bp, Mus musculus
tctctagcccggagtggtgacgcac

SEQ ID NO: 830507 - DNA, 25 bp, Mus musculus
tctctagcccggtgtggtgacgcac

SEQ ID NO: 830508 - DNA, 25 bp, Mus musculus
tctctagcgtgaattttcttccaga

SEQ ID NO: 830509 - DNA, 25 bp, Mus musculus
tctctagcgtgatttttcttccaga

SEQ ID NO: 830510 - DNA, 25 bp, Mus musculus
tctctagctgagcactcgctgttgt

SEQ ID NO: 830511 - DNA, 25 bp, Mus musculus
tctctagctgaggactcgctgttgt

SEQ ID NO: 830512 - DNA, 25 bp, Mus musculus
tctctagctgtactctttttccata

SEQ ID NO: 830513 - DNA, 25 bp, Mus musculus
tctctagctgtagtctttttccata

SEQ ID NO: 830514 - DNA, 25 bp, Mus musculus
tctctaggcaatagtggatgtcttt

SEQ ID NO: 830515 - DNA, 25 bp, Mus musculus
tctctaggcaattgtggatgtcttt

SEQ ID NO: 830516 - DNA, 25 bp, Mus musculus
tctctagggcccattgctcatttag

SEQ ID NO: 830517 - DNA, 25 bp, Mus musculus
tctctagggccctttgctcatttag

SEQ ID NO: 830518 - DNA, 25 bp, Mus musculus
tctctaggtccccagtctaggtgtt

SEQ ID NO: 830519 - DNA, 25 bp, Mus musculus
tctctaggtcccgagtctaggtgtt

SEQ ID NO: 830520 - DNA, 25 bp, Mus musculus
tctctagtaactacattccgccctt

SEQ ID NO: 830521 - DNA, 25 bp, Mus musculus
tctctagtaacttcattccgccctt

SEQ ID NO: 830522 - DNA, 25 bp, Mus musculus
tctctagtgaacacctgaattccag

SEQ ID NO: 830523 - DNA, 25 bp, Mus musculus
tctctagtgaactcctgaattccag

SEQ ID NO: 830524 - DNA, 25 bp, Mus musculus
tctctagtgctacttgctgctaaca

SEQ ID NO: 830525 - DNA, 25 bp, Mus musculus
tctctagtgctagttgctgctaaca

SEQ ID NO: 830526 - DNA, 25 bp, Mus musculus
tctctagttacaagatcagcccctt

SEQ ID NO: 830527 - DNA, 25 bp, Mus musculus
tctctagttacatgatcagcccctt

SEQ ID NO: 830528 - DNA, 25 bp, Mus musculus
tctctataaaacatggctgcccttc

SEQ ID NO: 830529 - DNA, 25 bp, Mus musculus
tctctataaaacttggctgcccttc

SEQ ID NO: 830530 - DNA, 25 bp, Mus musculus
tctctatacaggacctcgcaggtaa

SEQ ID NO: 830531 - DNA, 25 bp, Mus musculus
tctctatacaggtcctcgcaggtaa

SEQ ID NO: 830532 - DNA, 25 bp, Mus musculus
tctctatattttagggcagctttcc

SEQ ID NO: 830533 - DNA, 25 bp, Mus musculus
tctctatatttttgggcagctttcc

SEQ ID NO: 830534 - DNA, 25 bp, Mus musculus
tctctatcaggacagctaacaacag

SEQ ID NO: 830535 - DNA, 25 bp, Mus musculus
tctctatcaggagagctaacaacag

SEQ ID NO: 830536 - DNA, 25 bp, Mus musculus
tctctatcattccttgctttcatta

SEQ ID NO: 830537 - DNA, 25 bp, Mus musculus
tctctatcattcgttgctttcatta

SEQ ID NO: 830538 - DNA, 25 bp, Mus musculus
tctctatccagtcaggagtctcttg

SEQ ID NO: 830539 - DNA, 25 bp, Mus musculus
tctctatccagtgaggagtctcttg

SEQ ID NO: 830540 - DNA, 25 bp, Mus musculus
tctctatcccagacaatgtcaccag

SEQ ID NO: 830541 - DNA, 25 bp, Mus musculus
tctctatcccagtcaatgtcaccag

SEQ ID NO: 830542 - DNA, 25 bp, Mus musculus
tctctatccctaagtatttcttcag

SEQ ID NO: 830543 - DNA, 25 bp, Mus musculus
tctctatccctatgtatttcttcag

SEQ ID NO: 830544 - DNA, 25 bp, Mus musculus
tctctatcctgaaaaccctgcgtga

SEQ ID NO: 830545 - DNA, 25 bp, Mus musculus
tctctatcctgataaccctgcgtga

SEQ ID NO: 830546 - DNA, 25 bp, Mus musculus
tctctatccttaacagccacagaat

SEQ ID NO: 830547 - DNA, 25 bp, Mus musculus
tctctatccttatcagccacagaat

SEQ ID NO: 830548 - DNA, 25 bp, Mus musculus
tctctatctaccctcctgaggaggg

SEQ ID NO: 830549 - DNA, 25 bp, Mus musculus
tctctatctaccgtcctgaggaggg

SEQ ID NO: 830550 - DNA, 25 bp, Mus musculus
tctctatctactaatcccatctcat

SEQ ID NO: 830551 - DNA, 25 bp, Mus musculus
tctctatctacttatcccatctcat

SEQ ID NO: 830552 - DNA, 25 bp, Mus musculus
tctctatctgcaactgatgtggcct

SEQ ID NO: 830553 - DNA, 25 bp, Mus musculus
tctctatctgcacaagagaacactg

SEQ ID NO: 830554 - DNA, 25 bp, Mus musculus
tctctatctgcagaagagaacactg

SEQ ID NO: 830555 - DNA, 25 bp, Mus musculus
tctctatctgcatctgatgtggcct

SEQ ID NO: 830556 - DNA, 25 bp, Mus musculus
tctctatgccagcagactgtttcaa

SEQ ID NO: 830557 - DNA, 25 bp, Mus musculus
tctctatgccaggagactgtttcaa

SEQ ID NO: 830558 - DNA, 25 bp, Mus musculus
tctctatgcttaacagctcctggat

SEQ ID NO: 830559 - DNA, 25 bp, Mus musculus
tctctatgcttatcagctcctggat

SEQ ID NO: 830560 - DNA, 25 bp, Mus musculus
tctctatggagaccacactgcagtg

SEQ ID NO: 830561 - DNA, 25 bp, Mus musculus
tctctatggagagcacactgcagtg

SEQ ID NO: 830562 - DNA, 25 bp, Mus musculus
tctctatggtatcttttgtgattat

SEQ ID NO: 830563 - DNA, 25 bp, Mus musculus
tctctatggtatgttttgtgattat

SEQ ID NO: 830564 - DNA, 25 bp, Mus musculus
tctctattacttatgctctatactg

SEQ ID NO: 830565 - DNA, 25 bp, Mus musculus
tctctattacttttgctctatactg

SEQ ID NO: 830566 - DNA, 25 bp, Mus musculus
tctctattctccaattgcactgtgt

SEQ ID NO: 830567 - DNA, 25 bp, Mus musculus
tctctattctcctattgcactgtgt

SEQ ID NO: 830568 - DNA, 25 bp, Mus musculus
tctctattgcctacctactagttat

SEQ ID NO: 830569 - DNA, 25 bp, Mus musculus
tctctattgccttcctactagttat

SEQ ID NO: 830570 - DNA, 25 bp, Mus musculus
tctctattttggatgttgtggtaac

SEQ ID NO: 830571 - DNA, 25 bp, Mus musculus
tctctattttggttgttgtggtaac

SEQ ID NO: 830572 - DNA, 25 bp, Mus musculus
tctctattttgtagtgcttttttgt

SEQ ID NO: 830573 - DNA, 25 bp, Mus musculus
tctctattttgttgtgcttttttgt

SEQ ID NO: 830574 - DNA, 25 bp, Mus musculus
tctctcaacatcaaactgcagcaga

SEQ ID NO: 830575 - DNA, 25 bp, Mus musculus
tctctcaacatctaactgcagcaga

SEQ ID NO: 830576 - DNA, 25 bp, Mus musculus
tctctcaaccttatgagttccgtct

SEQ ID NO: 830577 - DNA, 25 bp, Mus musculus
tctctcaaccttttgagttccgtct

SEQ ID NO: 830578 - DNA, 25 bp, Mus musculus
tctctcaactgccaaaaatctccga

SEQ ID NO: 830579 - DNA, 25 bp, Mus musculus
tctctcaactgcgaaaaatctccga

SEQ ID NO: 830580 - DNA, 25 bp, Mus musculus
tctctcaagaggaagtgatctgggc

SEQ ID NO: 830581 - DNA, 25 bp, Mus musculus
tctctcaagaggtagtgatctgggc

SEQ ID NO: 830582 - DNA, 25 bp, Mus musculus
tctctcaagtctccaaatgcattta

SEQ ID NO: 830583 - DNA, 25 bp, Mus musculus
tctctcaagtctgcaaatgcattta

SEQ ID NO: 830584 - DNA, 25 bp, Mus musculus
tctctcaagttcctgctaaacaggc

SEQ ID NO: 830585 - DNA, 25 bp, Mus musculus
tctctcaagttcgtgctaaacaggc

SEQ ID NO: 830586 - DNA, 25 bp, Mus musculus
tctctcacacaaactggctggttca

SEQ ID NO: 830587 - DNA, 25 bp, Mus musculus
tctctcacacaatctggctggttca

SEQ ID NO: 830588 - DNA, 25 bp, Mus musculus
tctctcacagtcctgaagtctcaaa

SEQ ID NO: 830589 - DNA, 25 bp, Mus musculus
tctctcacagtcgtgaagtctcaaa

SEQ ID NO: 830590 - DNA, 25 bp, Mus musculus
tctctcacagtgatggcatcttctc

SEQ ID NO: 830591 - DNA, 25 bp, Mus musculus
tctctcacagtgttggcatcttctc

SEQ ID NO: 830592 - DNA, 25 bp, Mus musculus
tctctcacatagaccttggattctg

SEQ ID NO: 830593 - DNA, 25 bp, Mus musculus
tctctcacatagtccttggattctg

SEQ ID NO: 830594 - DNA, 25 bp, Mus musculus
tctctcacatatcaagtctcacttc

SEQ ID NO: 830595 - DNA, 25 bp, Mus musculus
tctctcacatatgaagtctcacttc

SEQ ID NO: 830596 - DNA, 25 bp, Mus musculus
tctctcacccaaattcctgtaaata

SEQ ID NO: 830597 - DNA, 25 bp, Mus musculus
tctctcacccaatttcctgtaaata

SEQ ID NO: 830598 - DNA, 25 bp, Mus musculus
tctctcaccgagatggctgtaattt

SEQ ID NO: 830599 - DNA, 25 bp, Mus musculus
tctctcaccgagttggctgtaattt

SEQ ID NO: 830600 - DNA, 25 bp, Mus musculus
tctctcacgggcaggcactgtatga

SEQ ID NO: 830601 - DNA, 25 bp, Mus musculus
tctctcacgggctggcactgtatga

SEQ ID NO: 830602 - DNA, 25 bp, Mus musculus
tctctcacttcaactagcaagtctg

SEQ ID NO: 830603 - DNA, 25 bp, Mus musculus
tctctcacttcatctagcaagtctg

SEQ ID NO: 830604 - DNA, 25 bp, Mus musculus
tctctcactttgctatcatgcattc

SEQ ID NO: 830605 - DNA, 25 bp, Mus musculus
tctctcactttggtatcatgcattc

SEQ ID NO: 830606 - DNA, 25 bp, Mus musculus
tctctcagagcacctgctgggacag

SEQ ID NO: 830607 - DNA, 25 bp, Mus musculus
tctctcagagcagctgctgggacag

SEQ ID NO: 830608 - DNA, 25 bp, Mus musculus
tctctcagaggaccagcgacgatgt

SEQ ID NO: 830609 - DNA, 25 bp, Mus musculus
tctctcagaggagcagcgacgatgt

SEQ ID NO: 830610 - DNA, 25 bp, Mus musculus
tctctcagcatgctgcaaaacctgt

SEQ ID NO: 830611 - DNA, 25 bp, Mus musculus
tctctcagcatggtgcaaaacctgt

SEQ ID NO: 830612 - DNA, 25 bp, Mus musculus
tctctcagcctcagcttaaaggaga

SEQ ID NO: 830613 - DNA, 25 bp, Mus musculus
tctctcagcctctgcttaaaggaga

SEQ ID NO: 830614 - DNA, 25 bp, Mus musculus
tctctcagctttagtggagaacttg

SEQ ID NO: 830615 - DNA, 25 bp, Mus musculus
tctctcagcttttgtggagaacttg

SEQ ID NO: 830616 - DNA, 25 bp, Mus musculus
tctctcagggaacttagcgtgtctt

SEQ ID NO: 830617 - DNA, 25 bp, Mus musculus
tctctcagggaagttagcgtgtctt

SEQ ID NO: 830618 - DNA, 25 bp, Mus musculus
tctctcagtaccactttccctggtg

SEQ ID NO: 830619 - DNA, 25 bp, Mus musculus
tctctcagtacctctttccctggtg

SEQ ID NO: 830620 - DNA, 25 bp, Mus musculus
tctctcagtctaccctggagcaggt

SEQ ID NO: 830621 - DNA, 25 bp, Mus musculus
tctctcagtctagcctggagcaggt

SEQ ID NO: 830622 - DNA, 25 bp, Mus musculus
tctctcagtgtcactttgtgtgtat

SEQ ID NO: 830623 - DNA, 25 bp, Mus musculus
tctctcagtgtctctttgtgtgtat

SEQ ID NO: 830624 - DNA, 25 bp, Mus musculus
tctctcagtgttcgagtcgctgact

SEQ ID NO: 830625 - DNA, 25 bp, Mus musculus
tctctcagtgttggagtcgctgact

SEQ ID NO: 830626 - DNA, 25 bp, Mus musculus
tctctcataagacagacaatgcgag

SEQ ID NO: 830627 - DNA, 25 bp, Mus musculus
tctctcataagagagacaatgcgag

SEQ ID NO: 830628 - DNA, 25 bp, Mus musculus
tctctcatcaaccattaatcaccta

SEQ ID NO: 830629 - DNA, 25 bp, Mus musculus
tctctcatcaacgattaatcaccta

SEQ ID NO: 830630 - DNA, 25 bp, Mus musculus
tctctcatctcaaataggtcaatta

SEQ ID NO: 830631 - DNA, 25 bp, Mus musculus
tctctcatctcatataggtcaatta

SEQ ID NO: 830632 - DNA, 25 bp, Mus musculus
tctctcatcttaccgtggtcctggg

SEQ ID NO: 830633 - DNA, 25 bp, Mus musculus
tctctcatcttagcgtggtcctggg

SEQ ID NO: 830634 - DNA, 25 bp, Mus musculus
tctctcatcttgactccttgtcaaa

SEQ ID NO: 830635 - DNA, 25 bp, Mus musculus
tctctcatcttgtctccttgtcaaa

SEQ ID NO: 830636 - DNA, 25 bp, Mus musculus
tctctcattaccacatttccattga

SEQ ID NO: 830637 - DNA, 25 bp, Mus musculus
tctctcattacctcatttccattga

SEQ ID NO: 830638 - DNA, 25 bp, Mus musculus
tctctcatttttactctggctcacc

SEQ ID NO: 830639 - DNA, 25 bp, Mus musculus
tctctcatttttcagggcaccaaag

SEQ ID NO: 830640 - DNA, 25 bp, Mus musculus
tctctcatttttgagggcaccaaag

SEQ ID NO: 830641 - DNA, 25 bp, Mus musculus
tctctcattttttctctggctcacc

SEQ ID NO: 830642 - DNA, 25 bp, Mus musculus
tctctccaaacaagactgctgccag

SEQ ID NO: 830643 - DNA, 25 bp, Mus musculus
tctctccaaacatgactgctgccag

SEQ ID NO: 830644 - DNA, 25 bp, Mus musculus
tctctccaacagaatgtgatgctgg

SEQ ID NO: 830645 - DNA, 25 bp, Mus musculus
tctctccaacagtatgtgatgctgg

SEQ ID NO: 830646 - DNA, 25 bp, Mus musculus
tctctccaaggcacagttcctgtat

SEQ ID NO: 830647 - DNA, 25 bp, Mus musculus
tctctccaaggctcagttcctgtat

SEQ ID NO: 830648 - DNA, 25 bp, Mus musculus
tctctccaagtacgtggtgttagaa

SEQ ID NO: 830649 - DNA, 25 bp, Mus musculus
tctctccaagtaggtggtgttagaa

SEQ ID NO: 830650 - DNA, 25 bp, Mus musculus
tctctccacagaagcgccagaattt

SEQ ID NO: 830651 - DNA, 25 bp, Mus musculus
tctctccacagatgcgccagaattt

SEQ ID NO: 830652 - DNA, 25 bp, Mus musculus
tctctccaccttaatttgcttctga

SEQ ID NO: 830653 - DNA, 25 bp, Mus musculus
tctctccacctttatttgcttctga

SEQ ID NO: 830654 - DNA, 25 bp, Mus musculus
tctctccactctactagttcctggg

SEQ ID NO: 830655 - DNA, 25 bp, Mus musculus
tctctccactcttctagttcctggg

SEQ ID NO: 830656 - DNA, 25 bp, Mus musculus
tctctccagagaacccaagtatagt

SEQ ID NO: 830657 - DNA, 25 bp, Mus musculus
tctctccagagatcccaagtatagt

SEQ ID NO: 830658 - DNA, 25 bp, Mus musculus
tctctccagcaacagtccaggatta

SEQ ID NO: 830659 - DNA, 25 bp, Mus musculus
tctctccagcaagagtccaggatta

SEQ ID NO: 830660 - DNA, 25 bp, Mus musculus
tctctccagccacgtacctgatgtg

SEQ ID NO: 830661 - DNA, 25 bp, Mus musculus
tctctccagccaggtacctgatgtg

SEQ ID NO: 830662 - DNA, 25 bp, Mus musculus
tctctccagccgactgtggctaaaa

SEQ ID NO: 830663 - DNA, 25 bp, Mus musculus
tctctccagccgtctgtggctaaaa

SEQ ID NO: 830664 - DNA, 25 bp, Mus musculus
tctctccagtctccgggtctgtttt

SEQ ID NO: 830665 - DNA, 25 bp, Mus musculus
tctctccagtctgcgggtctgtttt

SEQ ID NO: 830666 - DNA, 25 bp, Mus musculus
tctctccagttccagatctgtagtt

SEQ ID NO: 830667 - DNA, 25 bp, Mus musculus
tctctccagttcgagatctgtagtt

SEQ ID NO: 830668 - DNA, 25 bp, Mus musculus
tctctccataagcttctcaaatcac

SEQ ID NO: 830669 - DNA, 25 bp, Mus musculus
tctctccataaggttctcaaatcac

SEQ ID NO: 830670 - DNA, 25 bp, Mus musculus
tctctccatcccaataggtgcatat

SEQ ID NO: 830671 - DNA, 25 bp, Mus musculus
tctctccatccctataggtgcatat

SEQ ID NO: 830672 - DNA, 25 bp, Mus musculus
tctctccatggtcctttttgaatca

SEQ ID NO: 830673 - DNA, 25 bp, Mus musculus
tctctccatggtgctttttgaatca

SEQ ID NO: 830674 - DNA, 25 bp, Mus musculus
tctctccatgtaattgcacagggtt

SEQ ID NO: 830675 - DNA, 25 bp, Mus musculus
tctctccatgtatttgcacagggtt

SEQ ID NO: 830676 - DNA, 25 bp, Mus musculus
tctctccattaccatctgaaacttc

SEQ ID NO: 830677 - DNA, 25 bp, Mus musculus
tctctccattacgatctgaaacttc

SEQ ID NO: 830678 - DNA, 25 bp, Mus musculus
tctctccattggatagcagcctcat

SEQ ID NO: 830679 - DNA, 25 bp, Mus musculus
tctctccattggttagcagcctcat

SEQ ID NO: 830680 - DNA, 25 bp, Mus musculus
tctctcccaacacagaagttcgctg

SEQ ID NO: 830681 - DNA, 25 bp, Mus musculus
tctctcccaacagagaagttcgctg

SEQ ID NO: 830682 - DNA, 25 bp, Mus musculus
tctctcccaattcacaattaacttg

SEQ ID NO: 830683 - DNA, 25 bp, Mus musculus
tctctcccaattgacaattaacttg

SEQ ID NO: 830684 - DNA, 25 bp, Mus musculus
tctctcccacttacacaaataacat

SEQ ID NO: 830685 - DNA, 25 bp, Mus musculus
tctctcccactttcacaaataacat

SEQ ID NO: 830686 - DNA, 25 bp, Mus musculus
tctctcccagcgctattttggtatg

SEQ ID NO: 830687 - DNA, 25 bp, Mus musculus
tctctcccagcggtattttggtatg

SEQ ID NO: 830688 - DNA, 25 bp, Mus musculus
tctctcccatccaagtgaccagata

SEQ ID NO: 830689 - DNA, 25 bp, Mus musculus
tctctcccatcctagtgaccagata

SEQ ID NO: 830690 - DNA, 25 bp, Mus musculus
tctctcccattcactgggcttgaaa

SEQ ID NO: 830691 - DNA, 25 bp, Mus musculus
tctctcccattctctgggcttgaaa

SEQ ID NO: 830692 - DNA, 25 bp, Mus musculus
tctctccccagtccataatggcaaa

SEQ ID NO: 830693 - DNA, 25 bp, Mus musculus
tctctccccagtgcataatggcaaa

SEQ ID NO: 830694 - DNA, 25 bp, Mus musculus
tctctcccctgcaatgattggtgag

SEQ ID NO: 830695 - DNA, 25 bp, Mus musculus
tctctcccctgctatgattggtgag

SEQ ID NO: 830696 - DNA, 25 bp, Mus musculus
tctctcccctggaatctgaaagcag

SEQ ID NO: 830697 - DNA, 25 bp, Mus musculus
tctctcccctggtatctgaaagcag

SEQ ID NO: 830698 - DNA, 25 bp, Mus musculus
tctctcccctgtccgggaatcgaag

SEQ ID NO: 830699 - DNA, 25 bp, Mus musculus
tctctcccctgtgcgggaatcgaag

SEQ ID NO: 830700 - DNA, 25 bp, Mus musculus
tctctccctaagctcctgagtagtt

SEQ ID NO: 830701 - DNA, 25 bp, Mus musculus
tctctccctaaggtcctgagtagtt

SEQ ID NO: 830702 - DNA, 25 bp, Mus musculus
tctctccctactaaactgacagtta

SEQ ID NO: 830703 - DNA, 25 bp, Mus musculus
tctctccctactccaaggaagcaaa

SEQ ID NO: 830704 - DNA, 25 bp, Mus musculus
tctctccctactgcaaggaagcaaa

SEQ ID NO: 830705 - DNA, 25 bp, Mus musculus
tctctccctacttaactgacagtta

SEQ ID NO: 830706 - DNA, 25 bp, Mus musculus
tctctccctagaaccaggtagatcc

SEQ ID NO: 830707 - DNA, 25 bp, Mus musculus
tctctccctagatccaggtagatcc

SEQ ID NO: 830708 - DNA, 25 bp, Mus musculus
tctctccctagcattgaaattgtgt

SEQ ID NO: 830709 - DNA, 25 bp, Mus musculus
tctctccctagctttgaaattgtgt

SEQ ID NO: 830710 - DNA, 25 bp, Mus musculus
tctctccctagtacttgtttcagta

SEQ ID NO: 830711 - DNA, 25 bp, Mus musculus
tctctccctagttcttgtttcagta

SEQ ID NO: 830712 - DNA, 25 bp, Mus musculus
tctctccctatactggatgatgaga

SEQ ID NO: 830713 - DNA, 25 bp, Mus musculus
tctctccctatactgtcttaatttc

SEQ ID NO: 830714 - DNA, 25 bp, Mus musculus
tctctccctatagtggatgatgaga

SEQ ID NO: 830715 - DNA, 25 bp, Mus musculus
tctctccctatagtgtcttaatttc

SEQ ID NO: 830716 - DNA, 25 bp, Mus musculus
tctctccctttgatacattgccata

SEQ ID NO: 830717 - DNA, 25 bp, Mus musculus
tctctccctttgttacattgccata

SEQ ID NO: 830718 - DNA, 25 bp, Mus musculus
tctctccgacccctaaggaagaaat

SEQ ID NO: 830719 - DNA, 25 bp, Mus musculus
tctctccgacccgtaaggaagaaat

SEQ ID NO: 830720 - DNA, 25 bp, Mus musculus
tctctccggtagaccttactgttta

SEQ ID NO: 830721 - DNA, 25 bp, Mus musculus
tctctccggtagtccttactgttta

SEQ ID NO: 830722 - DNA, 25 bp, Mus musculus
tctctcctaaagcaagccaactggt

SEQ ID NO: 830723 - DNA, 25 bp, Mus musculus
tctctcctaaaggaagccaactggt

SEQ ID NO: 830724 - DNA, 25 bp, Mus musculus
tctctcctacaaaacctaattccat

SEQ ID NO: 830725 - DNA, 25 bp, Mus musculus
tctctcctacaatacctaattccat

SEQ ID NO: 830726 - DNA, 25 bp, Mus musculus
tctctcctagctatggtttaaccag

SEQ ID NO: 830727 - DNA, 25 bp, Mus musculus
tctctcctagctctcttcggatcaa

SEQ ID NO: 830728 - DNA, 25 bp, Mus musculus
tctctcctagctgtcttcggatcaa

SEQ ID NO: 830729 - DNA, 25 bp, Mus musculus
tctctcctagctttggtttaaccag

SEQ ID NO: 830730 - DNA, 25 bp, Mus musculus
tctctcctatctcctacacatgaga

SEQ ID NO: 830731 - DNA, 25 bp, Mus musculus
tctctcctatctgctacacatgaga

SEQ ID NO: 830732 - DNA, 25 bp, Mus musculus
tctctcctatggctgacacatttta

SEQ ID NO: 830733 - DNA, 25 bp, Mus musculus
tctctcctatgggtgacacatttta

SEQ ID NO: 830734 - DNA, 25 bp, Mus musculus
tctctcctccagactatgtattaca

SEQ ID NO: 830735 - DNA, 25 bp, Mus musculus
tctctcctccagtctatgtattaca

SEQ ID NO: 830736 - DNA, 25 bp, Mus musculus
tctctcctctgtcattttccagttg

SEQ ID NO: 830737 - DNA, 25 bp, Mus musculus
tctctcctctgtctgatccaataga

SEQ ID NO: 830738 - DNA, 25 bp, Mus musculus
tctctcctctgtgattttccagttg

SEQ ID NO: 830739 - DNA, 25 bp, Mus musculus
tctctcctctgtgtgatccaataga

SEQ ID NO: 830740 - DNA, 25 bp, Mus musculus
tctctcctctttacccagatttctg

SEQ ID NO: 830741 - DNA, 25 bp, Mus musculus
tctctcctcttttcccagatttctg

SEQ ID NO: 830742 - DNA, 25 bp, Mus musculus
tctctcctgaagattggtatctctc

SEQ ID NO: 830743 - DNA, 25 bp, Mus musculus
tctctcctgaagtttggtatctctc

SEQ ID NO: 830744 - DNA, 25 bp, Mus musculus
tctctcctgaatacatcctatcctg

SEQ ID NO: 830745 - DNA, 25 bp, Mus musculus
tctctcctgaattcatcctatcctg

SEQ ID NO: 830746 - DNA, 25 bp, Mus musculus
tctctcctgactaacggatgtgtgg

SEQ ID NO: 830747 - DNA, 25 bp, Mus musculus
tctctcctgacttacggatgtgtgg

SEQ ID NO: 830748 - DNA, 25 bp, Mus musculus
tctctcctgcctatggaagttttag

SEQ ID NO: 830749 - DNA, 25 bp, Mus musculus
tctctcctgcctttggaagttttag

SEQ ID NO: 830750 - DNA, 25 bp, Mus musculus
tctctcctgctactaaccatttaag

SEQ ID NO: 830751 - DNA, 25 bp, Mus musculus
tctctcctgctagtaaccatttaag

SEQ ID NO: 830752 - DNA, 25 bp, Mus musculus
tctctcctggagagatcatcatggc

SEQ ID NO: 830753 - DNA, 25 bp, Mus musculus
tctctcctggagtgatcatcatggc

SEQ ID NO: 830754 - DNA, 25 bp, Mus musculus
tctctcctggtaccacctgttttaa

SEQ ID NO: 830755 - DNA, 25 bp, Mus musculus
tctctcctggtagcacctgttttaa

SEQ ID NO: 830756 - DNA, 25 bp, Mus musculus
tctctcctgtgaaatgctttttaat

SEQ ID NO: 830757 - DNA, 25 bp, Mus musculus
tctctcctgtgatatgctttttaat

SEQ ID NO: 830758 - DNA, 25 bp, Mus musculus
tctctccttaatagacccagggaag

SEQ ID NO: 830759 - DNA, 25 bp, Mus musculus
tctctccttaattgacccagggaag

SEQ ID NO: 830760 - DNA, 25 bp, Mus musculus
tctctccttcaaacattcagtgcct

SEQ ID NO: 830761 - DNA, 25 bp, Mus musculus
tctctccttcaatcattcagtgcct

SEQ ID NO: 830762 - DNA, 25 bp, Mus musculus
tctctccttcatacactgtaatatt

SEQ ID NO: 830763 - DNA, 25 bp, Mus musculus
tctctccttcattcactgtaatatt

SEQ ID NO: 830764 - DNA, 25 bp, Mus musculus
tctctccttcttactaatccgggag

SEQ ID NO: 830765 - DNA, 25 bp, Mus musculus
tctctccttctttctaatccgggag

SEQ ID NO: 830766 - DNA, 25 bp, Mus musculus
tctctcctttatctggcactgggca

SEQ ID NO: 830767 - DNA, 25 bp, Mus musculus
tctctcctttatgtggcactgggca

SEQ ID NO: 830768 - DNA, 25 bp, Mus musculus
tctctcctttgaacgaatgcactct

SEQ ID NO: 830769 - DNA, 25 bp, Mus musculus
tctctcctttgatcgaatgcactct

SEQ ID NO: 830770 - DNA, 25 bp, Mus musculus
tctctcgatctccaagatgcctgat

SEQ ID NO: 830771 - DNA, 25 bp, Mus musculus
tctctcgatctcgaagatgcctgat

SEQ ID NO: 830772 - DNA, 25 bp, Mus musculus
tctctcgcaagccaggacaaggtag

SEQ ID NO: 830773 - DNA, 25 bp, Mus musculus
tctctcgcaagcgaggacaaggtag

SEQ ID NO: 830774 - DNA, 25 bp, Mus musculus
tctctcgccagcctttgcaggcagg

SEQ ID NO: 830775 - DNA, 25 bp, Mus musculus
tctctcgccagcgtttgcaggcagg

SEQ ID NO: 830776 - DNA, 25 bp, Mus musculus
tctctcggatgcacaacctcactga

SEQ ID NO: 830777 - DNA, 25 bp, Mus musculus
tctctcggatgctcaacctcactga

SEQ ID NO: 830778 - DNA, 25 bp, Mus musculus
tctctcggatgtaaatgtgtagctc

SEQ ID NO: 830779 - DNA, 25 bp, Mus musculus
tctctcggatgttaatgtgtagctc

SEQ ID NO: 830780 - DNA, 25 bp, Mus musculus
tctctcggccaacttttttcccata

SEQ ID NO: 830781 - DNA, 25 bp, Mus musculus
tctctcggccaagttttttcccata

SEQ ID NO: 830782 - DNA, 25 bp, Mus musculus
tctctcgggctgatttgatctggtc

SEQ ID NO: 830783 - DNA, 25 bp, Mus musculus
tctctcgggctgcagattttgtgta

SEQ ID NO: 830784 - DNA, 25 bp, Mus musculus
tctctcgggctggagattttgtgta

SEQ ID NO: 830785 - DNA, 25 bp, Mus musculus
tctctcgggctgttttgatctggtc

SEQ ID NO: 830786 - DNA, 25 bp, Mus musculus
tctctcgggtctcttcagcactatt

SEQ ID NO: 830787 - DNA, 25 bp, Mus musculus
tctctcgggtctgttcagcactatt

SEQ ID NO: 830788 - DNA, 25 bp, Mus musculus
tctctcgtcaggctggaaaagacca

SEQ ID NO: 830789 - DNA, 25 bp, Mus musculus
tctctcgtcagggtggaaaagacca

SEQ ID NO: 830790 - DNA, 25 bp, Mus musculus
tctctcgtgggcaaaggcggcatcg

SEQ ID NO: 830791 - DNA, 25 bp, Mus musculus
tctctcgtgggctaaggcggcatcg

SEQ ID NO: 830792 - DNA, 25 bp, Mus musculus
tctctcgttcgcaatttgttttcta

SEQ ID NO: 830793 - DNA, 25 bp, Mus musculus
tctctcgttcgctatttgttttcta

SEQ ID NO: 830794 - DNA, 25 bp, Mus musculus
tctctctaaccgaaaacaccttgtt

SEQ ID NO: 830795 - DNA, 25 bp, Mus musculus
tctctctaaccgtaaacaccttgtt

SEQ ID NO: 830796 - DNA, 25 bp, Mus musculus
tctctctaagatcccagctgaccaa

SEQ ID NO: 830797 - DNA, 25 bp, Mus musculus
tctctctaagatgccagctgaccaa

SEQ ID NO: 830798 - DNA, 25 bp, Mus musculus
tctctctaaggcaacaggctgctca

SEQ ID NO: 830799 - DNA, 25 bp, Mus musculus
tctctctaaggctacaggctgctca

SEQ ID NO: 830800 - DNA, 25 bp, Mus musculus
tctctctacaccaagaagggcttca

SEQ ID NO: 830801 - DNA, 25 bp, Mus musculus
tctctctacacctagaagggcttca

SEQ ID NO: 830802 - DNA, 25 bp, Mus musculus
tctctctacagacggctctgacttt

SEQ ID NO: 830803 - DNA, 25 bp, Mus musculus
tctctctacagagggctctgacttt

SEQ ID NO: 830804 - DNA, 25 bp, Mus musculus
tctctctacagcaggagactgtgct

SEQ ID NO: 830805 - DNA, 25 bp, Mus musculus
tctctctacagctggagactgtgct

SEQ ID NO: 830806 - DNA, 25 bp, Mus musculus
tctctctaccctaggtatcattcaa

SEQ ID NO: 830807 - DNA, 25 bp, Mus musculus
tctctctaccctcgagtgcttggat

SEQ ID NO: 830808 - DNA, 25 bp, Mus musculus
tctctctaccctggagtgcttggat

SEQ ID NO: 830809 - DNA, 25 bp, Mus musculus
tctctctacccttggtatcattcaa

SEQ ID NO: 830810 - DNA, 25 bp, Mus musculus
tctctctaccgtagtccagatggag

SEQ ID NO: 830811 - DNA, 25 bp, Mus musculus
tctctctaccgttgtccagatggag

SEQ ID NO: 830812 - DNA, 25 bp, Mus musculus
tctctctacttaattccacatgaat

SEQ ID NO: 830813 - DNA, 25 bp, Mus musculus
tctctctacttatttccacatgaat

SEQ ID NO: 830814 - DNA, 25 bp, Mus musculus
tctctctacttcatggagctgtcaa

SEQ ID NO: 830815 - DNA, 25 bp, Mus musculus
tctctctacttcttggagctgtcaa

SEQ ID NO: 830816 - DNA, 25 bp, Mus musculus
tctctctagctcagggatctcagtg

SEQ ID NO: 830817 - DNA, 25 bp, Mus musculus
tctctctagctctgggatctcagtg

SEQ ID NO: 830818 - DNA, 25 bp, Mus musculus
tctctctaggagcggcttcgcacaa

SEQ ID NO: 830819 - DNA, 25 bp, Mus musculus
tctctctaggaggggcttcgcacaa

SEQ ID NO: 830820 - DNA, 25 bp, Mus musculus
tctctctagggaatctcatttgtta

SEQ ID NO: 830821 - DNA, 25 bp, Mus musculus
tctctctagggattctcatttgtta

SEQ ID NO: 830822 - DNA, 25 bp, Mus musculus
tctctctagtctctagcttgatttt

SEQ ID NO: 830823 - DNA, 25 bp, Mus musculus
tctctctagtctgtagcttgatttt

SEQ ID NO: 830824 - DNA, 25 bp, Mus musculus
tctctctagtgcagggactgctggt

SEQ ID NO: 830825 - DNA, 25 bp, Mus musculus
tctctctagtgctgggactgctggt

SEQ ID NO: 830826 - DNA, 25 bp, Mus musculus
tctctctagttgaaaggattggctt

SEQ ID NO: 830827 - DNA, 25 bp, Mus musculus
tctctctagttgtaaggattggctt

SEQ ID NO: 830828 - DNA, 25 bp, Mus musculus
tctctctatggaagaaactggttta

SEQ ID NO: 830829 - DNA, 25 bp, Mus musculus
tctctctatggatgaaactggttta

SEQ ID NO: 830830 - DNA, 25 bp, Mus musculus
tctctctatttaagcacaatcccac

SEQ ID NO: 830831 - DNA, 25 bp, Mus musculus
tctctctatttatgcacaatcccac

SEQ ID NO: 830832 - DNA, 25 bp, Mus musculus
tctctctcaagtcgcagcatggact

SEQ ID NO: 830833 - DNA, 25 bp, Mus musculus
tctctctcaagtggcagcatggact

SEQ ID NO: 830834 - DNA, 25 bp, Mus musculus
tctctctcatgaacaatctctgctt

SEQ ID NO: 830835 - DNA, 25 bp, Mus musculus
tctctctcatgacaactgatagctc

SEQ ID NO: 830836 - DNA, 25 bp, Mus musculus
tctctctcatgagaactgatagctc

SEQ ID NO: 830837 - DNA, 25 bp, Mus musculus
tctctctcatgatcaatctctgctt

SEQ ID NO: 830838 - DNA, 25 bp, Mus musculus
tctctctccaaacactctgttcata

SEQ ID NO: 830839 - DNA, 25 bp, Mus musculus
tctctctccaaagactctgttcata

SEQ ID NO: 830840 - DNA, 25 bp, Mus musculus
tctctctccagcagacatcaagtga

SEQ ID NO: 830841 - DNA, 25 bp, Mus musculus
tctctctccagctgacatcaagtga

SEQ ID NO: 830842 - DNA, 25 bp, Mus musculus
tctctctcccaacattggtgaccag

SEQ ID NO: 830843 - DNA, 25 bp, Mus musculus
tctctctcccaagattggtgaccag

SEQ ID NO: 830844 - DNA, 25 bp, Mus musculus
tctctctcccacagcagtgaagaga

SEQ ID NO: 830845 - DNA, 25 bp, Mus musculus
tctctctcccactgcagtgaagaga

SEQ ID NO: 830846 - DNA, 25 bp, Mus musculus
tctctctcccttaattgattttttg

SEQ ID NO: 830847 - DNA, 25 bp, Mus musculus
tctctctcccttatagtaatttgca

SEQ ID NO: 830848 - DNA, 25 bp, Mus musculus
tctctctccctttattgattttttg

SEQ ID NO: 830849 - DNA, 25 bp, Mus musculus
tctctctcccttttagtaatttgca

SEQ ID NO: 830850 - DNA, 25 bp, Mus musculus
tctctctccgttatggacccataaa

SEQ ID NO: 830851 - DNA, 25 bp, Mus musculus
tctctctccgttttggacccataaa

SEQ ID NO: 830852 - DNA, 25 bp, Mus musculus
tctctctcctaaaaggtactgtgga

SEQ ID NO: 830853 - DNA, 25 bp, Mus musculus
tctctctcctaataggtactgtgga

SEQ ID NO: 830854 - DNA, 25 bp, Mus musculus
tctctctccttaatccagtataatt

SEQ ID NO: 830855 - DNA, 25 bp, Mus musculus
tctctctccttattccagtataatt

SEQ ID NO: 830856 - DNA, 25 bp, Mus musculus
tctctctcctttctgcaaaactaaa

SEQ ID NO: 830857 - DNA, 25 bp, Mus musculus
tctctctcctttgtgcaaaactaaa

SEQ ID NO: 830858 - DNA, 25 bp, Mus musculus
tctctctcgagcaaatccttacaga

SEQ ID NO: 830859 - DNA, 25 bp, Mus musculus
tctctctcgagctaatccttacaga

SEQ ID NO: 830860 - DNA, 25 bp, Mus musculus
tctctctcggcaatgaggccagtta

SEQ ID NO: 830861 - DNA, 25 bp, Mus musculus
tctctctcggcattgaggccagtta

SEQ ID NO: 830862 - DNA, 25 bp, Mus musculus
tctctctctctaagaggcccagcag

SEQ ID NO: 830863 - DNA, 25 bp, Mus musculus
tctctctctctatgaggcccagcag

SEQ ID NO: 830864 - DNA, 25 bp, Mus musculus
tctctctctcttatataaatacttg

SEQ ID NO: 830865 - DNA, 25 bp, Mus musculus
tctctctctcttttataaatacttg

SEQ ID NO: 830866 - DNA, 25 bp, Mus musculus
tctctctctgccagcatgaggaaac

SEQ ID NO: 830867 - DNA, 25 bp, Mus musculus
tctctctctgcctgcatgaggaaac

SEQ ID NO: 830868 - DNA, 25 bp, Mus musculus
tctctctctgctctgtatagatttt

SEQ ID NO: 830869 - DNA, 25 bp, Mus musculus
tctctctctgctgtgtatagatttt

SEQ ID NO: 830870 - DNA, 25 bp, Mus musculus
tctctctctggaagaaacggccggc

SEQ ID NO: 830871 - DNA, 25 bp, Mus musculus
tctctctctggatgaaacggccggc

SEQ ID NO: 830872 - DNA, 25 bp, Mus musculus
tctctctcttaaactgggcaatggt

SEQ ID NO: 830873 - DNA, 25 bp, Mus musculus
tctctctcttaatctgggcaatggt

SEQ ID NO: 830874 - DNA, 25 bp, Mus musculus
tctctctcttgacttaacacctgat

SEQ ID NO: 830875 - DNA, 25 bp, Mus musculus
tctctctcttgagttaacacctgat

SEQ ID NO: 830876 - DNA, 25 bp, Mus musculus
tctctctctttgagtatctgaactt

SEQ ID NO: 830877 - DNA, 25 bp, Mus musculus
tctctctctttgatcttattctttt

SEQ ID NO: 830878 - DNA, 25 bp, Mus musculus
tctctctctttgtgtatctgaactt

SEQ ID NO: 830879 - DNA, 25 bp, Mus musculus
tctctctctttgttcttattctttt

SEQ ID NO: 830880 - DNA, 25 bp, Mus musculus
tctctctcttttagcttctgcaaaa

SEQ ID NO: 830881 - DNA, 25 bp, Mus musculus
tctctctctttttgcttctgcaaaa

SEQ ID NO: 830882 - DNA, 25 bp, Mus musculus
tctctctgaacaagcatgctattat

SEQ ID NO: 830883 - DNA, 25 bp, Mus musculus
tctctctgaacatgcatgctattat

SEQ ID NO: 830884 - DNA, 25 bp, Mus musculus
tctctctgaagacggatccagcctt

SEQ ID NO: 830885 - DNA, 25 bp, Mus musculus
tctctctgaagagggatccagcctt

SEQ ID NO: 830886 - DNA, 25 bp, Mus musculus
tctctctgactcatcttttcgagga

SEQ ID NO: 830887 - DNA, 25 bp, Mus musculus
tctctctgactcttcttttcgagga

SEQ ID NO: 830888 - DNA, 25 bp, Mus musculus
tctctctgacttagtactccttaat

SEQ ID NO: 830889 - DNA, 25 bp, Mus musculus
tctctctgactttgtactccttaat

SEQ ID NO: 830890 - DNA, 25 bp, Mus musculus
tctctctgagggacagcgtgactgt

SEQ ID NO: 830891 - DNA, 25 bp, Mus musculus
tctctctgagggtcagcgtgactgt

SEQ ID NO: 830892 - DNA, 25 bp, Mus musculus
tctctctgcagtatggtacttgctt

SEQ ID NO: 830893 - DNA, 25 bp, Mus musculus
tctctctgcagtttggtacttgctt

SEQ ID NO: 830894 - DNA, 25 bp, Mus musculus
tctctctgctcccttgtatttcaag

SEQ ID NO: 830895 - DNA, 25 bp, Mus musculus
tctctctgctccgttgtatttcaag

SEQ ID NO: 830896 - DNA, 25 bp, Mus musculus
tctctctgctctcacgccatgatga

SEQ ID NO: 830897 - DNA, 25 bp, Mus musculus
tctctctgctctgacgccatgatga

SEQ ID NO: 830898 - DNA, 25 bp, Mus musculus
tctctctggaatcgctcacagtgag

SEQ ID NO: 830899 - DNA, 25 bp, Mus musculus
tctctctggaatggctcacagtgag

SEQ ID NO: 830900 - DNA, 25 bp, Mus musculus
tctctctggagtaaatgtggttgtt

SEQ ID NO: 830901 - DNA, 25 bp, Mus musculus
tctctctggagtatcttggagccta

SEQ ID NO: 830902 - DNA, 25 bp, Mus musculus
tctctctggagttaatgtggttgtt

SEQ ID NO: 830903 - DNA, 25 bp, Mus musculus
tctctctggagtttcttggagccta

SEQ ID NO: 830904 - DNA, 25 bp, Mus musculus
tctctctgggagcaatttgggtatg

SEQ ID NO: 830905 - DNA, 25 bp, Mus musculus
tctctctgggaggaatttgggtatg

SEQ ID NO: 830906 - DNA, 25 bp, Mus musculus
tctctctgggcacgctctttgtggc

SEQ ID NO: 830907 - DNA, 25 bp, Mus musculus
tctctctgggcaggctctttgtggc

SEQ ID NO: 830908 - DNA, 25 bp, Mus musculus
tctctctgtaacagatatctatttt

SEQ ID NO: 830909 - DNA, 25 bp, Mus musculus
tctctctgtaactgatatctatttt

SEQ ID NO: 830910 - DNA, 25 bp, Mus musculus
tctctctgtgcacatgttaactatc

SEQ ID NO: 830911 - DNA, 25 bp, Mus musculus
tctctctgtgcagatgttaactatc

SEQ ID NO: 830912 - DNA, 25 bp, Mus musculus
tctctctgtggcactcttgctctgg

SEQ ID NO: 830913 - DNA, 25 bp, Mus musculus
tctctctgtggctctcttgctctgg

SEQ ID NO: 830914 - DNA, 25 bp, Mus musculus
tctctctgtgttactctggcatgaa

SEQ ID NO: 830915 - DNA, 25 bp, Mus musculus
tctctctgtgttctcggtgaggatg

SEQ ID NO: 830916 - DNA, 25 bp, Mus musculus
tctctctgtgttgtcggtgaggatg

SEQ ID NO: 830917 - DNA, 25 bp, Mus musculus
tctctctgtgtttctctggcatgaa

SEQ ID NO: 830918 - DNA, 25 bp, Mus musculus
tctctctgttttagttgctcccaca

SEQ ID NO: 830919 - DNA, 25 bp, Mus musculus
tctctctgtttttgttgctcccaca

SEQ ID NO: 830920 - DNA, 25 bp, Mus musculus
tctctcttaagcaaggccaggctgg

SEQ ID NO: 830921 - DNA, 25 bp, Mus musculus
tctctcttaagctaggccaggctgg

SEQ ID NO: 830922 - DNA, 25 bp, Mus musculus
tctctcttaataaacaatgctgccg

SEQ ID NO: 830923 - DNA, 25 bp, Mus musculus
tctctcttaatatacaatgctgccg

SEQ ID NO: 830924 - DNA, 25 bp, Mus musculus
tctctcttacagaccatcctgataa

SEQ ID NO: 830925 - DNA, 25 bp, Mus musculus
tctctcttacagtccatcctgataa

SEQ ID NO: 830926 - DNA, 25 bp, Mus musculus
tctctcttcaggatcgcttccactt

SEQ ID NO: 830927 - DNA, 25 bp, Mus musculus
tctctcttcaggttcgcttccactt

SEQ ID NO: 830928 - DNA, 25 bp, Mus musculus
tctctcttccaaacactctgagctt

SEQ ID NO: 830929 - DNA, 25 bp, Mus musculus
tctctcttccaatcactctgagctt

SEQ ID NO: 830930 - DNA, 25 bp, Mus musculus
tctctcttccttcctgaggcacaat

SEQ ID NO: 830931 - DNA, 25 bp, Mus musculus
tctctcttccttgctgaggcacaat

SEQ ID NO: 830932 - DNA, 25 bp, Mus musculus
tctctcttctctaccaatgttttgg

SEQ ID NO: 830933 - DNA, 25 bp, Mus musculus
tctctcttctcttccaatgttttgg

SEQ ID NO: 830934 - DNA, 25 bp, Mus musculus
tctctcttctggcattgcatgcggt

SEQ ID NO: 830935 - DNA, 25 bp, Mus musculus
tctctcttctgggattgcatgcggt

SEQ ID NO: 830936 - DNA, 25 bp, Mus musculus
tctctcttctgtaaatcgtgttctt

SEQ ID NO: 830937 - DNA, 25 bp, Mus musculus
tctctcttctgttaatcgtgttctt

SEQ ID NO: 830938 - DNA, 25 bp, Mus musculus
tctctcttcttcaaaacctagcagg

SEQ ID NO: 830939 - DNA, 25 bp, Mus musculus
tctctcttcttctaaacctagcagg

SEQ ID NO: 830940 - DNA, 25 bp, Mus musculus
tctctcttgccaaggttaccagttg

SEQ ID NO: 830941 - DNA, 25 bp, Mus musculus
tctctcttgccatggttaccagttg

SEQ ID NO: 830942 - DNA, 25 bp, Mus musculus
tctctcttggacaggaatgtttggc

SEQ ID NO: 830943 - DNA, 25 bp, Mus musculus
tctctcttggactggaatgtttggc

SEQ ID NO: 830944 - DNA, 25 bp, Mus musculus
tctctcttggatattggtgtttgaa

SEQ ID NO: 830945 - DNA, 25 bp, Mus musculus
tctctcttggattttggtgtttgaa

SEQ ID NO: 830946 - DNA, 25 bp, Mus musculus
tctctcttgggcaggcaagacacag

SEQ ID NO: 830947 - DNA, 25 bp, Mus musculus
tctctcttgggctggcaagacacag

SEQ ID NO: 830948 - DNA, 25 bp, Mus musculus
tctctcttgtcaccttctgtatctt

SEQ ID NO: 830949 - DNA, 25 bp, Mus musculus
tctctcttgtcagcttctgtatctt

SEQ ID NO: 830950 - DNA, 25 bp, Mus musculus
tctctctttacaatctggtctctac

SEQ ID NO: 830951 - DNA, 25 bp, Mus musculus
tctctctttacattctggtctctac

SEQ ID NO: 830952 - DNA, 25 bp, Mus musculus
tctctctttaggagcaaatttgtga

SEQ ID NO: 830953 - DNA, 25 bp, Mus musculus
tctctctttaggtgcaaatttgtga

SEQ ID NO: 830954 - DNA, 25 bp, Mus musculus
tctctctttagtctacctacaacag

SEQ ID NO: 830955 - DNA, 25 bp, Mus musculus
tctctctttagtgtacctacaacag

SEQ ID NO: 830956 - DNA, 25 bp, Mus musculus
tctctctttatgcatacaaggtttc

SEQ ID NO: 830957 - DNA, 25 bp, Mus musculus
tctctctttatggatacaaggtttc

SEQ ID NO: 830958 - DNA, 25 bp, Mus musculus
tctctctttctgatgtacaattgta

SEQ ID NO: 830959 - DNA, 25 bp, Mus musculus
tctctctttctgattaggccatctg

SEQ ID NO: 830960 - DNA, 25 bp, Mus musculus
tctctctttctgttgtacaattgta

SEQ ID NO: 830961 - DNA, 25 bp, Mus musculus
tctctctttctgtttaggccatctg

SEQ ID NO: 830962 - DNA, 25 bp, Mus musculus
tctctctttgtgaatctgaactttg

SEQ ID NO: 830963 - DNA, 25 bp, Mus musculus
tctctctttgtgtatctgaactttg

SEQ ID NO: 830964 - DNA, 25 bp, Mus musculus
tctctcttttgaaccaaagcttaaa

SEQ ID NO: 830965 - DNA, 25 bp, Mus musculus
tctctcttttgatccaaagcttaaa

SEQ ID NO: 830966 - DNA, 25 bp, Mus musculus
tctctcttttgtctagttctgaaga

SEQ ID NO: 830967 - DNA, 25 bp, Mus musculus
tctctcttttgtgtagttctgaaga

SEQ ID NO: 830968 - DNA, 25 bp, Mus musculus
tctctctttttcatgatgccgcaag

SEQ ID NO: 830969 - DNA, 25 bp, Mus musculus
tctctctttttcttgatgccgcaag

SEQ ID NO: 830970 - DNA, 25 bp, Mus musculus
tctctgaaaagcccgaatccctgtc

SEQ ID NO: 830971 - DNA, 25 bp, Mus musculus
tctctgaaaagcgcgaatccctgtc

SEQ ID NO: 830972 - DNA, 25 bp, Mus musculus
tctctgaacagcaagaccccaatgg

SEQ ID NO: 830973 - DNA, 25 bp, Mus musculus
tctctgaacagctagaccccaatgg

SEQ ID NO: 830974 - DNA, 25 bp, Mus musculus
tctctgaaccgtagccttgacactg

SEQ ID NO: 830975 - DNA, 25 bp, Mus musculus
tctctgaaccgttgccttgacactg

SEQ ID NO: 830976 - DNA, 25 bp, Mus musculus
tctctgaacgccagattaccatctg

SEQ ID NO: 830977 - DNA, 25 bp, Mus musculus
tctctgaacgcctgattaccatctg

SEQ ID NO: 830978 - DNA, 25 bp, Mus musculus
tctctgaactcaaccggccaatggt

SEQ ID NO: 830979 - DNA, 25 bp, Mus musculus
tctctgaactcatccggccaatggt

SEQ ID NO: 830980 - DNA, 25 bp, Mus musculus
tctctgaactctcccggtgagcggg

SEQ ID NO: 830981 - DNA, 25 bp, Mus musculus
tctctgaactctgccggtgagcggg

SEQ ID NO: 830982 - DNA, 25 bp, Mus musculus
tctctgaacttgattataatggcaa

SEQ ID NO: 830983 - DNA, 25 bp, Mus musculus
tctctgaacttgtttataatggcaa

SEQ ID NO: 830984 - DNA, 25 bp, Mus musculus
tctctgaagaggctggaagctgacc

SEQ ID NO: 830985 - DNA, 25 bp, Mus musculus
tctctgaagagggtggaagctgacc

SEQ ID NO: 830986 - DNA, 25 bp, Mus musculus
tctctgaagccgcaagcctgaacat

SEQ ID NO: 830987 - DNA, 25 bp, Mus musculus
tctctgaagccggaagcctgaacat

SEQ ID NO: 830988 - DNA, 25 bp, Mus musculus
tctctgaagctaagattccttggca

SEQ ID NO: 830989 - DNA, 25 bp, Mus musculus
tctctgaagctatgattccttggca

SEQ ID NO: 830990 - DNA, 25 bp, Mus musculus
tctctgaagcttaagctgaaagtac

SEQ ID NO: 830991 - DNA, 25 bp, Mus musculus
tctctgaagctttagctgaaagtac

SEQ ID NO: 830992 - DNA, 25 bp, Mus musculus
tctctgaatgccactaagtccaggt

SEQ ID NO: 830993 - DNA, 25 bp, Mus musculus
tctctgaatgcctctaagtccaggt

SEQ ID NO: 830994 - DNA, 25 bp, Mus musculus
tctctgaatggtataaaggtggtat

SEQ ID NO: 830995 - DNA, 25 bp, Mus musculus
tctctgaatggtttaaaggtggtat

SEQ ID NO: 830996 - DNA, 25 bp, Mus musculus
tctctgacaagtcttaaaggtaaaa

SEQ ID NO: 830997 - DNA, 25 bp, Mus musculus
tctctgacaagtgttaaaggtaaaa

SEQ ID NO: 830998 - DNA, 25 bp, Mus musculus
tctctgacaccaactactgaaggcc

SEQ ID NO: 830999 - DNA, 25 bp, Mus musculus
tctctgacaccatctactgaaggcc

SEQ ID NO: 831000 - DNA, 25 bp, Mus musculus
tctctgacagaacatctggtactgg

SEQ ID NO: 831001 - DNA, 25 bp, Mus musculus
tctctgacagaagatctggtactgg

SEQ ID NO: 831002 - DNA, 25 bp, Mus musculus
tctctgaccagtctgatcctaaggg

SEQ ID NO: 831003 - DNA, 25 bp, Mus musculus
tctctgaccagtgtgatcctaaggg

SEQ ID NO: 831004 - DNA, 25 bp, Mus musculus
tctctgaccattctagtgtactgcc

SEQ ID NO: 831005 - DNA, 25 bp, Mus musculus
tctctgaccattgtagtgtactgcc

SEQ ID NO: 831006 - DNA, 25 bp, Mus musculus
tctctgaccccaatgaaagtgctta

SEQ ID NO: 831007 - DNA, 25 bp, Mus musculus
tctctgaccccattgaaagtgctta

SEQ ID NO: 831008 - DNA, 25 bp, Mus musculus
tctctgaccctgcaagtgcattcat

SEQ ID NO: 831009 - DNA, 25 bp, Mus musculus
tctctgaccctggaagtgcattcat

SEQ ID NO: 831010 - DNA, 25 bp, Mus musculus
tctctgaccgggagaggttggctct

SEQ ID NO: 831011 - DNA, 25 bp, Mus musculus
tctctgaccgggtgaggttggctct

SEQ ID NO: 831012 - DNA, 25 bp, Mus musculus
tctctgacgggcacacttgagaagt

SEQ ID NO: 831013 - DNA, 25 bp, Mus musculus
tctctgacgggctcacttgagaagt

SEQ ID NO: 831014 - DNA, 25 bp, Mus musculus
tctctgacgtatctagcctctggtt

SEQ ID NO: 831015 - DNA, 25 bp, Mus musculus
tctctgacgtatgtagcctctggtt

SEQ ID NO: 831016 - DNA, 25 bp, Mus musculus
tctctgactcgaatcccatctgatt

SEQ ID NO: 831017 - DNA, 25 bp, Mus musculus
tctctgactcgattcccatctgatt

SEQ ID NO: 831018 - DNA, 25 bp, Mus musculus
tctctgactctgagcatgtactgta

SEQ ID NO: 831019 - DNA, 25 bp, Mus musculus
tctctgactctgtgcatgtactgta

SEQ ID NO: 831020 - DNA, 25 bp, Mus musculus
tctctgactgctatggcatatccaa

SEQ ID NO: 831021 - DNA, 25 bp, Mus musculus
tctctgactgctttggcatatccaa

SEQ ID NO: 831022 - DNA, 25 bp, Mus musculus
tctctgagagggagctttcgcgccg

SEQ ID NO: 831023 - DNA, 25 bp, Mus musculus
tctctgagagggtgctttcgcgccg

SEQ ID NO: 831024 - DNA, 25 bp, Mus musculus
tctctgagcaacctggcatctcatt

SEQ ID NO: 831025 - DNA, 25 bp, Mus musculus
tctctgagcaacgtggcatctcatt

SEQ ID NO: 831026 - DNA, 25 bp, Mus musculus
tctctgagccacatactcatctgtg

SEQ ID NO: 831027 - DNA, 25 bp, Mus musculus
tctctgagccacttactcatctgtg

SEQ ID NO: 831028 - DNA, 25 bp, Mus musculus
tctctgaggaacatagatgtgggca

SEQ ID NO: 831029 - DNA, 25 bp, Mus musculus
tctctgaggaacttagatgtgggca

SEQ ID NO: 831030 - DNA, 25 bp, Mus musculus
tctctgaggagtctgagctgtcccc

SEQ ID NO: 831031 - DNA, 25 bp, Mus musculus
tctctgaggagtgtgagctgtcccc

SEQ ID NO: 831032 - DNA, 25 bp, Mus musculus
tctctgaggatccagtgtcttccag

SEQ ID NO: 831033 - DNA, 25 bp, Mus musculus
tctctgaggatcgagtgtcttccag

SEQ ID NO: 831034 - DNA, 25 bp, Mus musculus
tctctgaggattacatgatagcaat

SEQ ID NO: 831035 - DNA, 25 bp, Mus musculus
tctctgaggatttcatgatagcaat

SEQ ID NO: 831036 - DNA, 25 bp, Mus musculus
tctctgaggcccatcaaagtggaca

SEQ ID NO: 831037 - DNA, 25 bp, Mus musculus
tctctgaggcccttcaaagtggaca

SEQ ID NO: 831038 - DNA, 25 bp, Mus musculus
tctctgaggcggaggactgagactt

SEQ ID NO: 831039 - DNA, 25 bp, Mus musculus
tctctgaggcggtggactgagactt

SEQ ID NO: 831040 - DNA, 25 bp, Mus musculus
tctctgagtaagagttcctgtccca

SEQ ID NO: 831041 - DNA, 25 bp, Mus musculus
tctctgagtaagtgttcctgtccca

SEQ ID NO: 831042 - DNA, 25 bp, Mus musculus
tctctgagtttgaagtctatatagt

SEQ ID NO: 831043 - DNA, 25 bp, Mus musculus
tctctgagtttgtagtctatatagt

SEQ ID NO: 831044 - DNA, 25 bp, Mus musculus
tctctgatacctcatattggcctca

SEQ ID NO: 831045 - DNA, 25 bp, Mus musculus
tctctgatacctgatattggcctca

SEQ ID NO: 831046 - DNA, 25 bp, Mus musculus
tctctgatagagacgttgtcctttg

SEQ ID NO: 831047 - DNA, 25 bp, Mus musculus
tctctgatagagtcgttgtcctttg

SEQ ID NO: 831048 - DNA, 25 bp, Mus musculus
tctctgatagatatggctgttggct

SEQ ID NO: 831049 - DNA, 25 bp, Mus musculus
tctctgatagatttggctgttggct

SEQ ID NO: 831050 - DNA, 25 bp, Mus musculus
tctctgatattgacggcccggatgg

SEQ ID NO: 831051 - DNA, 25 bp, Mus musculus
tctctgatattgtcggcccggatgg

SEQ ID NO: 831052 - DNA, 25 bp, Mus musculus
tctctgatccacaagccgggttcgg

SEQ ID NO: 831053 - DNA, 25 bp, Mus musculus
tctctgatccactagccgggttcgg

SEQ ID NO: 831054 - DNA, 25 bp, Mus musculus
tctctgatctctacatacatgtcat

SEQ ID NO: 831055 - DNA, 25 bp, Mus musculus
tctctgatctcttcatacatgtcat

SEQ ID NO: 831056 - DNA, 25 bp, Mus musculus
tctctgattacgaggaatttcctta

SEQ ID NO: 831057 - DNA, 25 bp, Mus musculus
tctctgattacgtggaatttcctta

SEQ ID NO: 831058 - DNA, 25 bp, Mus musculus
tctctgattttcatgggtaccgttt

SEQ ID NO: 831059 - DNA, 25 bp, Mus musculus
tctctgattttcttgggtaccgttt

SEQ ID NO: 831060 - DNA, 25 bp, Mus musculus
tctctgcaaaccctttcttacccac

SEQ ID NO: 831061 - DNA, 25 bp, Mus musculus
tctctgcaaaccgtttcttacccac

SEQ ID NO: 831062 - DNA, 25 bp, Mus musculus
tctctgcacattcggcgtctgggat

SEQ ID NO: 831063 - DNA, 25 bp, Mus musculus
tctctgcacattgggcgtctgggat

SEQ ID NO: 831064 - DNA, 25 bp, Mus musculus
tctctgcaccagcactagctatgaa

SEQ ID NO: 831065 - DNA, 25 bp, Mus musculus
tctctgcaccaggactagctatgaa

SEQ ID NO: 831066 - DNA, 25 bp, Mus musculus
tctctgcactgcatgcgttctaaag

SEQ ID NO: 831067 - DNA, 25 bp, Mus musculus
tctctgcactgcttgcgttctaaag

SEQ ID NO: 831068 - DNA, 25 bp, Mus musculus
tctctgcagcgcagcagcaaggttg

SEQ ID NO: 831069 - DNA, 25 bp, Mus musculus
tctctgcagcgctgcagcaaggttg

SEQ ID NO: 831070 - DNA, 25 bp, Mus musculus
tctctgcaggggaggctttgctaca

SEQ ID NO: 831071 - DNA, 25 bp, Mus musculus
tctctgcaggggtggctttgctaca

SEQ ID NO: 831072 - DNA, 25 bp, Mus musculus
tctctgcagttccttatttccttgc

SEQ ID NO: 831073 - DNA, 25 bp, Mus musculus
tctctgcagttcgttatttccttgc

SEQ ID NO: 831074 - DNA, 25 bp, Mus musculus
tctctgcatcagcaatttaccagga

SEQ ID NO: 831075 - DNA, 25 bp, Mus musculus
tctctgcatcaggaatttaccagga

SEQ ID NO: 831076 - DNA, 25 bp, Mus musculus
tctctgcatctccttcttaattaat

SEQ ID NO: 831077 - DNA, 25 bp, Mus musculus
tctctgcatctcgttcttaattaat

SEQ ID NO: 831078 - DNA, 25 bp, Mus musculus
tctctgcatctgagattgtagtgtt

SEQ ID NO: 831079 - DNA, 25 bp, Mus musculus
tctctgcatctgtgattgtagtgtt

SEQ ID NO: 831080 - DNA, 25 bp, Mus musculus
tctctgcatgcgcttttaatcctag

SEQ ID NO: 831081 - DNA, 25 bp, Mus musculus
tctctgcatgcggttttaatcctag

SEQ ID NO: 831082 - DNA, 25 bp, Mus musculus
tctctgcattctataattttctgta

SEQ ID NO: 831083 - DNA, 25 bp, Mus musculus
tctctgcattctttaattttctgta

SEQ ID NO: 831084 - DNA, 25 bp, Mus musculus
tctctgcattttctggcaacatgag

SEQ ID NO: 831085 - DNA, 25 bp, Mus musculus
tctctgcattttgtggcaacatgag

SEQ ID NO: 831086 - DNA, 25 bp, Mus musculus
tctctgccactcaggctatccttga

SEQ ID NO: 831087 - DNA, 25 bp, Mus musculus
tctctgccactctggctatccttga

SEQ ID NO: 831088 - DNA, 25 bp, Mus musculus
tctctgccaggcatcaacacagctt

SEQ ID NO: 831089 - DNA, 25 bp, Mus musculus
tctctgccaggcttcaacacagctt

SEQ ID NO: 831090 - DNA, 25 bp, Mus musculus
tctctgccatgcagctacaagcgca

SEQ ID NO: 831091 - DNA, 25 bp, Mus musculus
tctctgccatgctgctacaagcgca

SEQ ID NO: 831092 - DNA, 25 bp, Mus musculus
tctctgccgcatatgaaactacttt

SEQ ID NO: 831093 - DNA, 25 bp, Mus musculus
tctctgccgcatttgaaactacttt

SEQ ID NO: 831094 - DNA, 25 bp, Mus musculus
tctctgccggatctcagttcatgga

SEQ ID NO: 831095 - DNA, 25 bp, Mus musculus
tctctgccggatgtcagttcatgga

SEQ ID NO: 831096 - DNA, 25 bp, Mus musculus
tctctgcctagaccattcatcttgt

SEQ ID NO: 831097 - DNA, 25 bp, Mus musculus
tctctgcctagagcattcatcttgt

SEQ ID NO: 831098 - DNA, 25 bp, Mus musculus
tctctgcctctcaaggatgagatta

SEQ ID NO: 831099 - DNA, 25 bp, Mus musculus
tctctgcctctcagagcagtgaggt

SEQ ID NO: 831100 - DNA, 25 bp, Mus musculus
tctctgcctctctaggatgagatta

SEQ ID NO: 831101 - DNA, 25 bp, Mus musculus
tctctgcctctctgagcagtgaggt

SEQ ID NO: 831102 - DNA, 25 bp, Mus musculus
tctctgcctgatcgtcccagtcgtg

SEQ ID NO: 831103 - DNA, 25 bp, Mus musculus
tctctgcctgatggtcccagtcgtg

SEQ ID NO: 831104 - DNA, 25 bp, Mus musculus
tctctgcctgcaaagtgaagtttga

SEQ ID NO: 831105 - DNA, 25 bp, Mus musculus
tctctgcctgcaagatgtctagtga

SEQ ID NO: 831106 - DNA, 25 bp, Mus musculus
tctctgcctgcatagtgaagtttga

SEQ ID NO: 831107 - DNA, 25 bp, Mus musculus
tctctgcctgcatgatgtctagtga

SEQ ID NO: 831108 - DNA, 25 bp, Mus musculus
tctctgccttagctcttggactagg

SEQ ID NO: 831109 - DNA, 25 bp, Mus musculus
tctctgccttaggtcttggactagg

SEQ ID NO: 831110 - DNA, 25 bp, Mus musculus
tctctgccttccacagggaagtgat

SEQ ID NO: 831111 - DNA, 25 bp, Mus musculus
tctctgccttcctcagggaagtgat

SEQ ID NO: 831112 - DNA, 25 bp, Mus musculus
tctctgcgagtacccaggaaaccag

SEQ ID NO: 831113 - DNA, 25 bp, Mus musculus
tctctgcgagtagccaggaaaccag

SEQ ID NO: 831114 - DNA, 25 bp, Mus musculus
tctctgctactaaaatgtcgacttg

SEQ ID NO: 831115 - DNA, 25 bp, Mus musculus
tctctgctactataatgtcgacttg

SEQ ID NO: 831116 - DNA, 25 bp, Mus musculus
tctctgctcagacaaggatgcaaga

SEQ ID NO: 831117 - DNA, 25 bp, Mus musculus
tctctgctcagagaaggatgcaaga

SEQ ID NO: 831118 - DNA, 25 bp, Mus musculus
tctctgctcatccactgcaatatca

SEQ ID NO: 831119 - DNA, 25 bp, Mus musculus
tctctgctcatcgactgcaatatca

SEQ ID NO: 831120 - DNA, 25 bp, Mus musculus
tctctgctcatgctagttcactatt

SEQ ID NO: 831121 - DNA, 25 bp, Mus musculus
tctctgctcatggtagttcactatt

SEQ ID NO: 831122 - DNA, 25 bp, Mus musculus
tctctgctccagcttctcaaggaaa

SEQ ID NO: 831123 - DNA, 25 bp, Mus musculus
tctctgctccaggttctcaaggaaa

SEQ ID NO: 831124 - DNA, 25 bp, Mus musculus
tctctgctcggcaacattctagtct

SEQ ID NO: 831125 - DNA, 25 bp, Mus musculus
tctctgctcggctacattctagtct

SEQ ID NO: 831126 - DNA, 25 bp, Mus musculus
tctctgctctcacatatttaaccga

SEQ ID NO: 831127 - DNA, 25 bp, Mus musculus
tctctgctctcagatatttaaccga

SEQ ID NO: 831128 - DNA, 25 bp, Mus musculus
tctctgctctgcattgtagagccag

SEQ ID NO: 831129 - DNA, 25 bp, Mus musculus
tctctgctctgctttgtagagccag

SEQ ID NO: 831130 - DNA, 25 bp, Mus musculus
tctctgctcttgatagcactacata

SEQ ID NO: 831131 - DNA, 25 bp, Mus musculus
tctctgctcttgttagcactacata

SEQ ID NO: 831132 - DNA, 25 bp, Mus musculus
tctctgctgaagacggctctggacc

SEQ ID NO: 831133 - DNA, 25 bp, Mus musculus
tctctgctgaagtcggctctggacc

SEQ ID NO: 831134 - DNA, 25 bp, Mus musculus
tctctgctgactacatagcctattt

SEQ ID NO: 831135 - DNA, 25 bp, Mus musculus
tctctgctgacttcatagcctattt

SEQ ID NO: 831136 - DNA, 25 bp, Mus musculus
tctctgctgaggatggctttggctg

SEQ ID NO: 831137 - DNA, 25 bp, Mus musculus
tctctgctgaggttggctttggctg

SEQ ID NO: 831138 - DNA, 25 bp, Mus musculus
tctctgctgattcccgccagctggt

SEQ ID NO: 831139 - DNA, 25 bp, Mus musculus
tctctgctgattgccgccagctggt

SEQ ID NO: 831140 - DNA, 25 bp, Mus musculus
tctctgctgccccataaatctaaca

SEQ ID NO: 831141 - DNA, 25 bp, Mus musculus
tctctgctgcccgataaatctaaca

SEQ ID NO: 831142 - DNA, 25 bp, Mus musculus
tctctgctgctcatagtgtggctaa

SEQ ID NO: 831143 - DNA, 25 bp, Mus musculus
tctctgctgctcttagtgtggctaa

SEQ ID NO: 831144 - DNA, 25 bp, Mus musculus
tctctgctgctgcttcttggtgaaa

SEQ ID NO: 831145 - DNA, 25 bp, Mus musculus
tctctgctgctggttcttggtgaaa

SEQ ID NO: 831146 - DNA, 25 bp, Mus musculus
tctctgctgcttcctcatttggtag

SEQ ID NO: 831147 - DNA, 25 bp, Mus musculus
tctctgctgcttctttgttggaatg

SEQ ID NO: 831148 - DNA, 25 bp, Mus musculus
tctctgctgcttgctcatttggtag

SEQ ID NO: 831149 - DNA, 25 bp, Mus musculus
tctctgctgcttgtttgttggaatg

SEQ ID NO: 831150 - DNA, 25 bp, Mus musculus
tctctgctggaaccttcaacagaag

SEQ ID NO: 831151 - DNA, 25 bp, Mus musculus
tctctgctggaagcttcaacagaag

SEQ ID NO: 831152 - DNA, 25 bp, Mus musculus
tctctgctggtgcttctcaatccac

SEQ ID NO: 831153 - DNA, 25 bp, Mus musculus
tctctgctggtggttctcaatccac

SEQ ID NO: 831154 - DNA, 25 bp, Mus musculus
tctctgctgtccctatttaaacata

SEQ ID NO: 831155 - DNA, 25 bp, Mus musculus
tctctgctgtccgtatttaaacata

SEQ ID NO: 831156 - DNA, 25 bp, Mus musculus
tctctgctgtgtcgtccaggtactt

SEQ ID NO: 831157 - DNA, 25 bp, Mus musculus
tctctgctgtgtggtccaggtactt

SEQ ID NO: 831158 - DNA, 25 bp, Mus musculus
tctctgctgttcctgaaacaacttc

SEQ ID NO: 831159 - DNA, 25 bp, Mus musculus
tctctgctgttcgtgaaacaacttc

SEQ ID NO: 831160 - DNA, 25 bp, Mus musculus
tctctgcttagaagaacatctgtct

SEQ ID NO: 831161 - DNA, 25 bp, Mus musculus
tctctgcttagatgaacatctgtct

SEQ ID NO: 831162 - DNA, 25 bp, Mus musculus
tctctgcttatgctaaatcggttaa

SEQ ID NO: 831163 - DNA, 25 bp, Mus musculus
tctctgcttatggtaaatcggttaa

SEQ ID NO: 831164 - DNA, 25 bp, Mus musculus
tctctgcttcagattagtggtttct

SEQ ID NO: 831165 - DNA, 25 bp, Mus musculus
tctctgcttcagtttagtggtttct

SEQ ID NO: 831166 - DNA, 25 bp, Mus musculus
tctctgcttcccaatgtctgacatt

SEQ ID NO: 831167 - DNA, 25 bp, Mus musculus
tctctgcttccctatgtctgacatt

SEQ ID NO: 831168 - DNA, 25 bp, Mus musculus
tctctgcttggaaggcaacatttct

SEQ ID NO: 831169 - DNA, 25 bp, Mus musculus
tctctgcttggaagggctttaaatt

SEQ ID NO: 831170 - DNA, 25 bp, Mus musculus
tctctgcttggatggcaacatttct

SEQ ID NO: 831171 - DNA, 25 bp, Mus musculus
tctctgcttggatgggctttaaatt

SEQ ID NO: 831172 - DNA, 25 bp, Mus musculus
tctctgctttatccctggaaagctt

SEQ ID NO: 831173 - DNA, 25 bp, Mus musculus
tctctgctttatgcctggaaagctt

SEQ ID NO: 831174 - DNA, 25 bp, Mus musculus
tctctgctttgcacacttgcatgta

SEQ ID NO: 831175 - DNA, 25 bp, Mus musculus
tctctgctttgctcacttgcatgta

SEQ ID NO: 831176 - DNA, 25 bp, Mus musculus
tctctgctttggatggttggtctca

SEQ ID NO: 831177 - DNA, 25 bp, Mus musculus
tctctgctttggttggttggtctca

SEQ ID NO: 831178 - DNA, 25 bp, Mus musculus
tctctgctttgtaacttcgtgtttt

SEQ ID NO: 831179 - DNA, 25 bp, Mus musculus
tctctgctttgttacttcgtgtttt

SEQ ID NO: 831180 - DNA, 25 bp, Mus musculus
tctctgcttttcactcccattttct

SEQ ID NO: 831181 - DNA, 25 bp, Mus musculus
tctctgcttttctctcccattttct

SEQ ID NO: 831182 - DNA, 25 bp, Mus musculus
tctctgcttttgattttaggtaatt

SEQ ID NO: 831183 - DNA, 25 bp, Mus musculus
tctctgcttttgtttttaggtaatt

SEQ ID NO: 831184 - DNA, 25 bp, Mus musculus
tctctggaactaactaaaatctctt

SEQ ID NO: 831185 - DNA, 25 bp, Mus musculus
tctctggaactaactgacactgata

SEQ ID NO: 831186 - DNA, 25 bp, Mus musculus
tctctggaactatctaaaatctctt

SEQ ID NO: 831187 - DNA, 25 bp, Mus musculus
tctctggaactatctgacactgata

SEQ ID NO: 831188 - DNA, 25 bp, Mus musculus
tctctggaatccagttgcttgttaa

SEQ ID NO: 831189 - DNA, 25 bp, Mus musculus
tctctggaatcctgttgcttgttaa

SEQ ID NO: 831190 - DNA, 25 bp, Mus musculus
tctctggacaggctgagcagccagt

SEQ ID NO: 831191 - DNA, 25 bp, Mus musculus
tctctggacagggtgagcagccagt

SEQ ID NO: 831192 - DNA, 25 bp, Mus musculus
tctctggacttaattacgattggga

SEQ ID NO: 831193 - DNA, 25 bp, Mus musculus
tctctggacttatttacgattggga

SEQ ID NO: 831194 - DNA, 25 bp, Mus musculus
tctctggagaacaggaccctgggtg

SEQ ID NO: 831195 - DNA, 25 bp, Mus musculus
tctctggagaactggaccctgggtg

SEQ ID NO: 831196 - DNA, 25 bp, Mus musculus
tctctggagagcacgccagtgaaat

SEQ ID NO: 831197 - DNA, 25 bp, Mus musculus
tctctggagagctcgccagtgaaat

SEQ ID NO: 831198 - DNA, 25 bp, Mus musculus
tctctggagcctcagaacgggacgt

SEQ ID NO: 831199 - DNA, 25 bp, Mus musculus
tctctggagcctgagaacgggacgt

SEQ ID NO: 831200 - DNA, 25 bp, Mus musculus
tctctggagctcatcgaacgaggac

SEQ ID NO: 831201 - DNA, 25 bp, Mus musculus
tctctggagctcttcgaacgaggac

SEQ ID NO: 831202 - DNA, 25 bp, Mus musculus
tctctggaggagataagctggcaag

SEQ ID NO: 831203 - DNA, 25 bp, Mus musculus
tctctggaggagttaagctggcaag

SEQ ID NO: 831204 - DNA, 25 bp, Mus musculus
tctctggagttaaaagcgaccttct

SEQ ID NO: 831205 - DNA, 25 bp, Mus musculus
tctctggagttataagcgaccttct

SEQ ID NO: 831206 - DNA, 25 bp, Mus musculus
tctctggatatgagcgtccccactc

SEQ ID NO: 831207 - DNA, 25 bp, Mus musculus
tctctggatatgtgcgtccccactc

SEQ ID NO: 831208 - DNA, 25 bp, Mus musculus
tctctggatctactcaagtgcagaa

SEQ ID NO: 831209 - DNA, 25 bp, Mus musculus
tctctggatctagtcaagtgcagaa

SEQ ID NO: 831210 - DNA, 25 bp, Mus musculus
tctctggcactgacacatgcagcag

SEQ ID NO: 831211 - DNA, 25 bp, Mus musculus
tctctggcactgtcacatgcagcag

SEQ ID NO: 831212 - DNA, 25 bp, Mus musculus
tctctggcatcacctggcatgaata

SEQ ID NO: 831213 - DNA, 25 bp, Mus musculus
tctctggcatcagctggcatgaata

SEQ ID NO: 831214 - DNA, 25 bp, Mus musculus
tctctggccccgaattcaataatgt

SEQ ID NO: 831215 - DNA, 25 bp, Mus musculus
tctctggccccgtattcaataatgt

SEQ ID NO: 831216 - DNA, 25 bp, Mus musculus
tctctggccctaaatgtttataaat

SEQ ID NO: 831217 - DNA, 25 bp, Mus musculus
tctctggccctatatgtttataaat

SEQ ID NO: 831218 - DNA, 25 bp, Mus musculus
tctctggcctcccttttatagtttt

SEQ ID NO: 831219 - DNA, 25 bp, Mus musculus
tctctggcctccgttttatagtttt

SEQ ID NO: 831220 - DNA, 25 bp, Mus musculus
tctctggcctggcagggtcttacag

SEQ ID NO: 831221 - DNA, 25 bp, Mus musculus
tctctggcctgggagggtcttacag

SEQ ID NO: 831222 - DNA, 25 bp, Mus musculus
tctctggcctgtcacatgggtcata

SEQ ID NO: 831223 - DNA, 25 bp, Mus musculus
tctctggcctgtgacatgggtcata

SEQ ID NO: 831224 - DNA, 25 bp, Mus musculus
tctctggcctttcatggcaacgaaa

SEQ ID NO: 831225 - DNA, 25 bp, Mus musculus
tctctggcctttgatggcaacgaaa

SEQ ID NO: 831226 - DNA, 25 bp, Mus musculus
tctctggcgccaatactaactagga

SEQ ID NO: 831227 - DNA, 25 bp, Mus musculus
tctctggcgccattactaactagga

SEQ ID NO: 831228 - DNA, 25 bp, Mus musculus
tctctggctaagaatcaggtctctc

SEQ ID NO: 831229 - DNA, 25 bp, Mus musculus
tctctggctaagtatcaggtctctc

SEQ ID NO: 831230 - DNA, 25 bp, Mus musculus
tctctggctaatcactctgagctca

SEQ ID NO: 831231 - DNA, 25 bp, Mus musculus
tctctggctaatgactctgagctca

SEQ ID NO: 831232 - DNA, 25 bp, Mus musculus
tctctggctagccataaggctggct

SEQ ID NO: 831233 - DNA, 25 bp, Mus musculus
tctctggctagcgataaggctggct

SEQ ID NO: 831234 - DNA, 25 bp, Mus musculus
tctctggctcacagggtagggctca

SEQ ID NO: 831235 - DNA, 25 bp, Mus musculus
tctctggctcactgggtagggctca

SEQ ID NO: 831236 - DNA, 25 bp, Mus musculus
tctctggctcataacatatttcttt

SEQ ID NO: 831237 - DNA, 25 bp, Mus musculus
tctctggctcattacatatttcttt

SEQ ID NO: 831238 - DNA, 25 bp, Mus musculus
tctctggctcgaatctgggagcagt

SEQ ID NO: 831239 - DNA, 25 bp, Mus musculus
tctctggctcgattctgggagcagt

SEQ ID NO: 831240 - DNA, 25 bp, Mus musculus
tctctggctcgcagcagaagacgaa

SEQ ID NO: 831241 - DNA, 25 bp, Mus musculus
tctctggctcgctgcagaagacgaa

SEQ ID NO: 831242 - DNA, 25 bp, Mus musculus
tctctggctctgattgcacttgctt

SEQ ID NO: 831243 - DNA, 25 bp, Mus musculus
tctctggctctgtttgcacttgctt

SEQ ID NO: 831244 - DNA, 25 bp, Mus musculus
tctctggctgacaacatcaccgcag

SEQ ID NO: 831245 - DNA, 25 bp, Mus musculus
tctctggctgactacatcaccgcag

SEQ ID NO: 831246 - DNA, 25 bp, Mus musculus
tctctggctgccaaggagagtcctg

SEQ ID NO: 831247 - DNA, 25 bp, Mus musculus
tctctggctgcctaggagagtcctg

SEQ ID NO: 831248 - DNA, 25 bp, Mus musculus
tctctggctgtaacgagggcccttg

SEQ ID NO: 831249 - DNA, 25 bp, Mus musculus
tctctggctgtatcgagggcccttg

SEQ ID NO: 831250 - DNA, 25 bp, Mus musculus
tctctggctgtcaagcatgcaggca

SEQ ID NO: 831251 - DNA, 25 bp, Mus musculus
tctctggctgtctagcatgcaggca

SEQ ID NO: 831252 - DNA, 25 bp, Mus musculus
tctctggcttacaagtggctaaaat

SEQ ID NO: 831253 - DNA, 25 bp, Mus musculus
tctctggcttactagtggctaaaat

SEQ ID NO: 831254 - DNA, 25 bp, Mus musculus
tctctggcttcaactcttgtgtggg

SEQ ID NO: 831255 - DNA, 25 bp, Mus musculus
tctctggcttcatctcttgtgtggg

SEQ ID NO: 831256 - DNA, 25 bp, Mus musculus
tctctggcttcgaaataagtgtgtc

SEQ ID NO: 831257 - DNA, 25 bp, Mus musculus
tctctggcttcgtaataagtgtgtc

SEQ ID NO: 831258 - DNA, 25 bp, Mus musculus
tctctgggaaagcatctcttctgat

SEQ ID NO: 831259 - DNA, 25 bp, Mus musculus
tctctgggaaaggatctcttctgat

SEQ ID NO: 831260 - DNA, 25 bp, Mus musculus
tctctgggaacaccctgcctgagta

SEQ ID NO: 831261 - DNA, 25 bp, Mus musculus
tctctgggaacagcctgcctgagta

SEQ ID NO: 831262 - DNA, 25 bp, Mus musculus
tctctgggaattactttgccttacc

SEQ ID NO: 831263 - DNA, 25 bp, Mus musculus
tctctgggaatttctttgccttacc

SEQ ID NO: 831264 - DNA, 25 bp, Mus musculus
tctctgggactccaatgcttatatt

SEQ ID NO: 831265 - DNA, 25 bp, Mus musculus
tctctgggactcgaatgcttatatt

SEQ ID NO: 831266 - DNA, 25 bp, Mus musculus
tctctgggagcgacattgttcttaa

SEQ ID NO: 831267 - DNA, 25 bp, Mus musculus
tctctgggagcgtcattgttcttaa

SEQ ID NO: 831268 - DNA, 25 bp, Mus musculus
tctctgggagtccatctggtgcaga

SEQ ID NO: 831269 - DNA, 25 bp, Mus musculus
tctctgggagtcgatctggtgcaga

SEQ ID NO: 831270 - DNA, 25 bp, Mus musculus
tctctgggcacaagcacacactatt

SEQ ID NO: 831271 - DNA, 25 bp, Mus musculus
tctctgggcacatgcacacactatt

SEQ ID NO: 831272 - DNA, 25 bp, Mus musculus
tctctgggcatcaccagctgaggcc

SEQ ID NO: 831273 - DNA, 25 bp, Mus musculus
tctctgggcatctccagctgaggcc

SEQ ID NO: 831274 - DNA, 25 bp, Mus musculus
tctctgggccctacgtcagaaaatg

SEQ ID NO: 831275 - DNA, 25 bp, Mus musculus
tctctgggcccttcgtcagaaaatg

SEQ ID NO: 831276 - DNA, 25 bp, Mus musculus
tctctgggcgggagggttcttatct

SEQ ID NO: 831277 - DNA, 25 bp, Mus musculus
tctctgggcgggtgggttcttatct

SEQ ID NO: 831278 - DNA, 25 bp, Mus musculus
tctctgggtgacataaaccaccggg

SEQ ID NO: 831279 - DNA, 25 bp, Mus musculus
tctctgggtgacttaaaccaccggg

SEQ ID NO: 831280 - DNA, 25 bp, Mus musculus
tctctggtaaaaatccaggtggaag

SEQ ID NO: 831281 - DNA, 25 bp, Mus musculus
tctctggtaaaattccaggtggaag

SEQ ID NO: 831282 - DNA, 25 bp, Mus musculus
tctctggtacagagtgggtcttggt

SEQ ID NO: 831283 - DNA, 25 bp, Mus musculus
tctctggtacagtgtgggtcttggt

SEQ ID NO: 831284 - DNA, 25 bp, Mus musculus
tctctggtactcattgtgttcaaca

SEQ ID NO: 831285 - DNA, 25 bp, Mus musculus
tctctggtactctttgtgttcaaca

SEQ ID NO: 831286 - DNA, 25 bp, Mus musculus
tctctggtcaatccacagactcggg

SEQ ID NO: 831287 - DNA, 25 bp, Mus musculus
tctctggtcaatgcacagactcggg

SEQ ID NO: 831288 - DNA, 25 bp, Mus musculus
tctctggtcaggaatctggccatgg

SEQ ID NO: 831289 - DNA, 25 bp, Mus musculus
tctctggtcaggtatctggccatgg

SEQ ID NO: 831290 - DNA, 25 bp, Mus musculus
tctctggtcccacatgtcatggctg

SEQ ID NO: 831291 - DNA, 25 bp, Mus musculus
tctctggtcccagatgtcatggctg

SEQ ID NO: 831292 - DNA, 25 bp, Mus musculus
tctctggtcccgcaaaacttgaatg

SEQ ID NO: 831293 - DNA, 25 bp, Mus musculus
tctctggtcccggaaaacttgaatg

SEQ ID NO: 831294 - DNA, 25 bp, Mus musculus
tctctggtcgtgcactttgggacat

SEQ ID NO: 831295 - DNA, 25 bp, Mus musculus
tctctggtcgtggactttgggacat

SEQ ID NO: 831296 - DNA, 25 bp, Mus musculus
tctctggtctagcactctattaatc

SEQ ID NO: 831297 - DNA, 25 bp, Mus musculus
tctctggtctaggactctattaatc

SEQ ID NO: 831298 - DNA, 25 bp, Mus musculus
tctctggtcttgctctcagctcagt

SEQ ID NO: 831299 - DNA, 25 bp, Mus musculus
tctctggtcttggtctcagctcagt

SEQ ID NO: 831300 - DNA, 25 bp, Mus musculus
tctctggtgccactcgtatcacgaa

SEQ ID NO: 831301 - DNA, 25 bp, Mus musculus
tctctggtgccagtcgtatcacgaa

SEQ ID NO: 831302 - DNA, 25 bp, Mus musculus
tctctggtggcaatgatttcctttc

SEQ ID NO: 831303 - DNA, 25 bp, Mus musculus
tctctggtggcattgatttcctttc

SEQ ID NO: 831304 - DNA, 25 bp, Mus musculus
tctctggtggcgaagctgcagtaca

SEQ ID NO: 831305 - DNA, 25 bp, Mus musculus
tctctggtggcgtagctgcagtaca

SEQ ID NO: 831306 - DNA, 25 bp, Mus musculus
tctctggtgggcattccataagata

SEQ ID NO: 831307 - DNA, 25 bp, Mus musculus
tctctggtgggctttccataagata

SEQ ID NO: 831308 - DNA, 25 bp, Mus musculus
tctctggtgtcacgaaagaccggcc

SEQ ID NO: 831309 - DNA, 25 bp, Mus musculus
tctctggtgtcaggaaagaccggcc

SEQ ID NO: 831310 - DNA, 25 bp, Mus musculus
tctctggtgtttcgctgttttttat

SEQ ID NO: 831311 - DNA, 25 bp, Mus musculus
tctctggtgtttcttagctgtggtc

SEQ ID NO: 831312 - DNA, 25 bp, Mus musculus
tctctggtgtttggctgttttttat

SEQ ID NO: 831313 - DNA, 25 bp, Mus musculus
tctctggtgtttgttagctgtggtc

SEQ ID NO: 831314 - DNA, 25 bp, Mus musculus
tctctggttttgctcgtctaagtaa

SEQ ID NO: 831315 - DNA, 25 bp, Mus musculus
tctctggttttggtcgtctaagtaa

SEQ ID NO: 831316 - DNA, 25 bp, Mus musculus
tctctgtaaattacatgtcgccatg

SEQ ID NO: 831317 - DNA, 25 bp, Mus musculus
tctctgtaaatttcatgtcgccatg

SEQ ID NO: 831318 - DNA, 25 bp, Mus musculus
tctctgtaagagacgccgttactgt

SEQ ID NO: 831319 - DNA, 25 bp, Mus musculus
tctctgtaagagtcgccgttactgt

SEQ ID NO: 831320 - DNA, 25 bp, Mus musculus
tctctgtaatgaagactttgctgtt

SEQ ID NO: 831321 - DNA, 25 bp, Mus musculus
tctctgtaatgatgactttgctgtt

SEQ ID NO: 831322 - DNA, 25 bp, Mus musculus
tctctgtacagaccctggcacggaa

SEQ ID NO: 831323 - DNA, 25 bp, Mus musculus
tctctgtacagagcctggcacggaa

SEQ ID NO: 831324 - DNA, 25 bp, Mus musculus
tctctgtacagcacactgcagtggt

SEQ ID NO: 831325 - DNA, 25 bp, Mus musculus
tctctgtacagctcactgcagtggt

SEQ ID NO: 831326 - DNA, 25 bp, Mus musculus
tctctgtactgcagccagacttttg

SEQ ID NO: 831327 - DNA, 25 bp, Mus musculus
tctctgtactgctgccagacttttg

SEQ ID NO: 831328 - DNA, 25 bp, Mus musculus
tctctgtagcccacacttataattc

SEQ ID NO: 831329 - DNA, 25 bp, Mus musculus
tctctgtagccctcacttataattc

SEQ ID NO: 831330 - DNA, 25 bp, Mus musculus
tctctgtagcgtcgtgcggcaatat

SEQ ID NO: 831331 - DNA, 25 bp, Mus musculus
tctctgtagcgtggtgcggcaatat

SEQ ID NO: 831332 - DNA, 25 bp, Mus musculus
tctctgtataagagcctatttttaa

SEQ ID NO: 831333 - DNA, 25 bp, Mus musculus
tctctgtataagtgcctatttttaa

SEQ ID NO: 831334 - DNA, 25 bp, Mus musculus
tctctgtatccaaaaccctgaactt

SEQ ID NO: 831335 - DNA, 25 bp, Mus musculus
tctctgtatccataaccctgaactt

SEQ ID NO: 831336 - DNA, 25 bp, Mus musculus
tctctgtatgtgctggaagcctcct

SEQ ID NO: 831337 - DNA, 25 bp, Mus musculus
tctctgtatgtggtggaagcctcct

SEQ ID NO: 831338 - DNA, 25 bp, Mus musculus
tctctgtcaattacacacgaagttg

SEQ ID NO: 831339 - DNA, 25 bp, Mus musculus
tctctgtcaatttcacacgaagttg

SEQ ID NO: 831340 - DNA, 25 bp, Mus musculus
tctctgtcacctagttggtcaaagg

SEQ ID NO: 831341 - DNA, 25 bp, Mus musculus
tctctgtcaccttgttggtcaaagg

SEQ ID NO: 831342 - DNA, 25 bp, Mus musculus
tctctgtcagcccattggtgtggga

SEQ ID NO: 831343 - DNA, 25 bp, Mus musculus
tctctgtcagccgattggtgtggga

SEQ ID NO: 831344 - DNA, 25 bp, Mus musculus
tctctgtcatcccaataagctgttt

SEQ ID NO: 831345 - DNA, 25 bp, Mus musculus
tctctgtcatccgaataagctgttt

SEQ ID NO: 831346 - DNA, 25 bp, Mus musculus
tctctgtcatctctactaggatgtg

SEQ ID NO: 831347 - DNA, 25 bp, Mus musculus
tctctgtcatctgtactaggatgtg

SEQ ID NO: 831348 - DNA, 25 bp, Mus musculus
tctctgtcatgtcgaattctgttca

SEQ ID NO: 831349 - DNA, 25 bp, Mus musculus
tctctgtcatgtggaattctgttca

SEQ ID NO: 831350 - DNA, 25 bp, Mus musculus
tctctgtccaatccaatacttctga

SEQ ID NO: 831351 - DNA, 25 bp, Mus musculus
tctctgtccaatgcaatacttctga

SEQ ID NO: 831352 - DNA, 25 bp, Mus musculus
tctctgtccagacgttcccaaagat

SEQ ID NO: 831353 - DNA, 25 bp, Mus musculus
tctctgtccagaggttcccaaagat

SEQ ID NO: 831354 - DNA, 25 bp, Mus musculus
tctctgtcctgtaccagttttgata

SEQ ID NO: 831355 - DNA, 25 bp, Mus musculus
tctctgtcctgttccagttttgata

SEQ ID NO: 831356 - DNA, 25 bp, Mus musculus
tctctgtcggtactggatcgctact

SEQ ID NO: 831357 - DNA, 25 bp, Mus musculus
tctctgtcggtagtggatcgctact

SEQ ID NO: 831358 - DNA, 25 bp, Mus musculus
tctctgtcgtctatgcaacttaagt

SEQ ID NO: 831359 - DNA, 25 bp, Mus musculus
tctctgtcgtctttgcaacttaagt

SEQ ID NO: 831360 - DNA, 25 bp, Mus musculus
tctctgtctactatgcaaccaaatg

SEQ ID NO: 831361 - DNA, 25 bp, Mus musculus
tctctgtctactttgcaaccaaatg

SEQ ID NO: 831362 - DNA, 25 bp, Mus musculus
tctctgtctgcaatggcttggccat

SEQ ID NO: 831363 - DNA, 25 bp, Mus musculus
tctctgtctgcattggcttggccat

SEQ ID NO: 831364 - DNA, 25 bp, Mus musculus
tctctgtctggtctgctgtgaagca

SEQ ID NO: 831365 - DNA, 25 bp, Mus musculus
tctctgtctggtgtgctgtgaagca

SEQ ID NO: 831366 - DNA, 25 bp, Mus musculus
tctctgtctgtacgcgcaagcggcg

SEQ ID NO: 831367 - DNA, 25 bp, Mus musculus
tctctgtctgtaggcgcaagcggcg

SEQ ID NO: 831368 - DNA, 25 bp, Mus musculus
tctctgtctgtgcaaccgaactgaa

SEQ ID NO: 831369 - DNA, 25 bp, Mus musculus
tctctgtctgtggaaccgaactgaa

SEQ ID NO: 831370 - DNA, 25 bp, Mus musculus
tctctgtcttaacctgcccagggtc

SEQ ID NO: 831371 - DNA, 25 bp, Mus musculus
tctctgtcttaagctgcccagggtc

SEQ ID NO: 831372 - DNA, 25 bp, Mus musculus
tctctgtcttccacagtaaacatgg

SEQ ID NO: 831373 - DNA, 25 bp, Mus musculus
tctctgtcttcctcagtaaacatgg

SEQ ID NO: 831374 - DNA, 25 bp, Mus musculus
tctctgtgacccacagagtacactg

SEQ ID NO: 831375 - DNA, 25 bp, Mus musculus
tctctgtgaccctcagagtacactg

SEQ ID NO: 831376 - DNA, 25 bp, Mus musculus
tctctgtgacctcacgtagcacaaa

SEQ ID NO: 831377 - DNA, 25 bp, Mus musculus
tctctgtgacctgacgtagcacaaa

SEQ ID NO: 831378 - DNA, 25 bp, Mus musculus
tctctgtgacggcatgcgttgaatg

SEQ ID NO: 831379 - DNA, 25 bp, Mus musculus
tctctgtgacgggatgcgttgaatg

SEQ ID NO: 831380 - DNA, 25 bp, Mus musculus
tctctgtgagacagtgtggcttcta

SEQ ID NO: 831381 - DNA, 25 bp, Mus musculus
tctctgtgagactgtgtggcttcta

SEQ ID NO: 831382 - DNA, 25 bp, Mus musculus
tctctgtgccagcttggtgaagcag

SEQ ID NO: 831383 - DNA, 25 bp, Mus musculus
tctctgtgccaggttggtgaagcag

SEQ ID NO: 831384 - DNA, 25 bp, Mus musculus
tctctgtgcccaagaagttcggtgt

SEQ ID NO: 831385 - DNA, 25 bp, Mus musculus
tctctgtgcccatgaagttcggtgt

SEQ ID NO: 831386 - DNA, 25 bp, Mus musculus
tctctgtgctggaaactgaggctca

SEQ ID NO: 831387 - DNA, 25 bp, Mus musculus
tctctgtgctggtaactgaggctca

SEQ ID NO: 831388 - DNA, 25 bp, Mus musculus
tctctgtgctgtacttgccacagag

SEQ ID NO: 831389 - DNA, 25 bp, Mus musculus
tctctgtgctgttcttgccacagag

SEQ ID NO: 831390 - DNA, 25 bp, Mus musculus
tctctgtgcttaactactctgtgga

SEQ ID NO: 831391 - DNA, 25 bp, Mus musculus
tctctgtgcttatctactctgtgga

SEQ ID NO: 831392 - DNA, 25 bp, Mus musculus
tctctgtgctttattctcatctata

SEQ ID NO: 831393 - DNA, 25 bp, Mus musculus
tctctgtgctttcaagccacttgtt

SEQ ID NO: 831394 - DNA, 25 bp, Mus musculus
tctctgtgctttgaagccacttgtt

SEQ ID NO: 831395 - DNA, 25 bp, Mus musculus
tctctgtgcttttttctcatctata

SEQ ID NO: 831396 - DNA, 25 bp, Mus musculus
tctctgtggccaaccctgggaaatg

SEQ ID NO: 831397 - DNA, 25 bp, Mus musculus
tctctgtggccatccctgggaaatg

SEQ ID NO: 831398 - DNA, 25 bp, Mus musculus
tctctgtgggctccctggacgatga

SEQ ID NO: 831399 - DNA, 25 bp, Mus musculus
tctctgtgggctgcctggacgatga

SEQ ID NO: 831400 - DNA, 25 bp, Mus musculus
tctctgtgggtcaagttttcattac

SEQ ID NO: 831401 - DNA, 25 bp, Mus musculus
tctctgtgggtctagttttcattac

SEQ ID NO: 831402 - DNA, 25 bp, Mus musculus
tctctgtgtacgagatgcttgtgac

SEQ ID NO: 831403 - DNA, 25 bp, Mus musculus
tctctgtgtacgtgatgcttgtgac

SEQ ID NO: 831404 - DNA, 25 bp, Mus musculus
tctctgtgtcacatcttgccagaaa

SEQ ID NO: 831405 - DNA, 25 bp, Mus musculus
tctctgtgtcacttcttgccagaaa

SEQ ID NO: 831406 - DNA, 25 bp, Mus musculus
tctctgtgtcatagcagcaccgaag

SEQ ID NO: 831407 - DNA, 25 bp, Mus musculus
tctctgtgtcatagcctgattatgg

SEQ ID NO: 831408 - DNA, 25 bp, Mus musculus
tctctgtgtcattgcagcaccgaag

SEQ ID NO: 831409 - DNA, 25 bp, Mus musculus
tctctgtgtcattgcctgattatgg

SEQ ID NO: 831410 - DNA, 25 bp, Mus musculus
tctctgtgtcttctgtgaggtcatc

SEQ ID NO: 831411 - DNA, 25 bp, Mus musculus
tctctgtgtcttgtgtgaggtcatc

SEQ ID NO: 831412 - DNA, 25 bp, Mus musculus
tctctgtgtgaacccaactctactg

SEQ ID NO: 831413 - DNA, 25 bp, Mus musculus
tctctgtgtgaagccaactctactg

SEQ ID NO: 831414 - DNA, 25 bp, Mus musculus
tctctgtgtgtgaatgttccctctt

SEQ ID NO: 831415 - DNA, 25 bp, Mus musculus
tctctgtgtgtgtatgttccctctt

SEQ ID NO: 831416 - DNA, 25 bp, Mus musculus
tctctgtgttggactgactcataaa

SEQ ID NO: 831417 - DNA, 25 bp, Mus musculus
tctctgtgttggtctgactcataaa

SEQ ID NO: 831418 - DNA, 25 bp, Mus musculus
tctctgtgttttactcaacccaaga

SEQ ID NO: 831419 - DNA, 25 bp, Mus musculus
tctctgtgtttttctcaacccaaga

SEQ ID NO: 831420 - DNA, 25 bp, Mus musculus
tctctgttagttaaggagctagtca

SEQ ID NO: 831421 - DNA, 25 bp, Mus musculus
tctctgttagtttaggagctagtca

SEQ ID NO: 831422 - DNA, 25 bp, Mus musculus
tctctgttcaaaatggtctgctgac

SEQ ID NO: 831423 - DNA, 25 bp, Mus musculus
tctctgttcaaaatgtcttggtaaa

SEQ ID NO: 831424 - DNA, 25 bp, Mus musculus
tctctgttcaaattggtctgctgac

SEQ ID NO: 831425 - DNA, 25 bp, Mus musculus
tctctgttcaaattgtcttggtaaa

SEQ ID NO: 831426 - DNA, 25 bp, Mus musculus
tctctgttccctccgggctgcgtgt

SEQ ID NO: 831427 - DNA, 25 bp, Mus musculus
tctctgttccctgcgggctgcgtgt

SEQ ID NO: 831428 - DNA, 25 bp, Mus musculus
tctctgttcctaccctggtgcatag

SEQ ID NO: 831429 - DNA, 25 bp, Mus musculus
tctctgttcctagcctggtgcatag

SEQ ID NO: 831430 - DNA, 25 bp, Mus musculus
tctctgttccttctcctacaatgaa

SEQ ID NO: 831431 - DNA, 25 bp, Mus musculus
tctctgttccttgtcctacaatgaa

SEQ ID NO: 831432 - DNA, 25 bp, Mus musculus
tctctgttctaacccatcctagtgt

SEQ ID NO: 831433 - DNA, 25 bp, Mus musculus
tctctgttctaagccatcctagtgt

SEQ ID NO: 831434 - DNA, 25 bp, Mus musculus
tctctgttctgcaggtatgtctgac

SEQ ID NO: 831435 - DNA, 25 bp, Mus musculus
tctctgttctgctggtatgtctgac

SEQ ID NO: 831436 - DNA, 25 bp, Mus musculus
tctctgttggtgaccattggcctaa

SEQ ID NO: 831437 - DNA, 25 bp, Mus musculus
tctctgttggtgacctgttctatgg

SEQ ID NO: 831438 - DNA, 25 bp, Mus musculus
tctctgttggtgtccattggcctaa

SEQ ID NO: 831439 - DNA, 25 bp, Mus musculus
tctctgttggtgtcctgttctatgg

SEQ ID NO: 831440 - DNA, 25 bp, Mus musculus
tctctgttgtccctcactgatacac

SEQ ID NO: 831441 - DNA, 25 bp, Mus musculus
tctctgttgtccgtcactgatacac

SEQ ID NO: 831442 - DNA, 25 bp, Mus musculus
tctctgtttcctcgagtgccaagaa

SEQ ID NO: 831443 - DNA, 25 bp, Mus musculus
tctctgtttcctctagcattctata

SEQ ID NO: 831444 - DNA, 25 bp, Mus musculus
tctctgtttcctggagtgccaagaa

SEQ ID NO: 831445 - DNA, 25 bp, Mus musculus
tctctgtttcctgtagcattctata

SEQ ID NO: 831446 - DNA, 25 bp, Mus musculus
tctctgttttcaatttgatgcctga

SEQ ID NO: 831447 - DNA, 25 bp, Mus musculus
tctctgttttcattttgatgcctga

SEQ ID NO: 831448 - DNA, 25 bp, Mus musculus
tctctgttttcccagtcatgagctg

SEQ ID NO: 831449 - DNA, 25 bp, Mus musculus
tctctgttttccgagtcatgagctg

SEQ ID NO: 831450 - DNA, 25 bp, Mus musculus
tctctgttttgcctgactattcttc

SEQ ID NO: 831451 - DNA, 25 bp, Mus musculus
tctctgttttgcctgctcatgggac

SEQ ID NO: 831452 - DNA, 25 bp, Mus musculus
tctctgttttgcgtgactattcttc

SEQ ID NO: 831453 - DNA, 25 bp, Mus musculus
tctctgttttgcgtgctcatgggac

SEQ ID NO: 831454 - DNA, 25 bp, Mus musculus
tctcttaaccgcaacttcatcaaag

SEQ ID NO: 831455 - DNA, 25 bp, Mus musculus
tctcttaaccgctacttcatcaaag

SEQ ID NO: 831456 - DNA, 25 bp, Mus musculus
tctcttaacctccacttggactgga

SEQ ID NO: 831457 - DNA, 25 bp, Mus musculus
tctcttaacctcgacttggactgga

SEQ ID NO: 831458 - DNA, 25 bp, Mus musculus
tctcttaagcatcagactcaaaact

SEQ ID NO: 831459 - DNA, 25 bp, Mus musculus
tctcttaagcatgagactcaaaact

SEQ ID NO: 831460 - DNA, 25 bp, Mus musculus
tctcttaatggacgaggcagataaa

SEQ ID NO: 831461 - DNA, 25 bp, Mus musculus
tctcttaatggaggaggcagataaa

SEQ ID NO: 831462 - DNA, 25 bp, Mus musculus
tctcttaatttccatgtttccacca

SEQ ID NO: 831463 - DNA, 25 bp, Mus musculus
tctcttaatttcgatgtttccacca

SEQ ID NO: 831464 - DNA, 25 bp, Mus musculus
tctcttacactaaatggcacctttc

SEQ ID NO: 831465 - DNA, 25 bp, Mus musculus
tctcttacactatatggcacctttc

SEQ ID NO: 831466 - DNA, 25 bp, Mus musculus
tctcttacagggagctaccatacct

SEQ ID NO: 831467 - DNA, 25 bp, Mus musculus
tctcttacagggtgctaccatacct

SEQ ID NO: 831468 - DNA, 25 bp, Mus musculus
tctcttactgcactttcctttttta

SEQ ID NO: 831469 - DNA, 25 bp, Mus musculus
tctcttactgcagtttcctttttta

SEQ ID NO: 831470 - DNA, 25 bp, Mus musculus
tctcttagaccaccaccaatgtctg

SEQ ID NO: 831471 - DNA, 25 bp, Mus musculus
tctcttagaccagcaccaatgtctg

SEQ ID NO: 831472 - DNA, 25 bp, Mus musculus
tctcttagagagatgcggtgccatt

SEQ ID NO: 831473 - DNA, 25 bp, Mus musculus
tctcttagagagttgcggtgccatt

SEQ ID NO: 831474 - DNA, 25 bp, Mus musculus
tctcttagcagacatggttcataca

SEQ ID NO: 831475 - DNA, 25 bp, Mus musculus
tctcttagcagagatggttcataca

SEQ ID NO: 831476 - DNA, 25 bp, Mus musculus
tctcttagcaggcagacccaaatgg

SEQ ID NO: 831477 - DNA, 25 bp, Mus musculus
tctcttagcagggagacccaaatgg

SEQ ID NO: 831478 - DNA, 25 bp, Mus musculus
tctcttatcactcattctcggaaac

SEQ ID NO: 831479 - DNA, 25 bp, Mus musculus
tctcttatcactgattctcggaaac

SEQ ID NO: 831480 - DNA, 25 bp, Mus musculus
tctcttatcgtgcaagcccggctta

SEQ ID NO: 831481 - DNA, 25 bp, Mus musculus
tctcttatcgtggaagcccggctta

SEQ ID NO: 831482 - DNA, 25 bp, Mus musculus
tctcttatctacatcctgttggaca

SEQ ID NO: 831483 - DNA, 25 bp, Mus musculus
tctcttatctacttcctgttggaca

SEQ ID NO: 831484 - DNA, 25 bp, Mus musculus
tctcttatttgtacacctcatgctg

SEQ ID NO: 831485 - DNA, 25 bp, Mus musculus
tctcttatttgttcacctcatgctg

SEQ ID NO: 831486 - DNA, 25 bp, Mus musculus
tctcttcaacacactgggactcatt

SEQ ID NO: 831487 - DNA, 25 bp, Mus musculus
tctcttcaacactctgggactcatt

SEQ ID NO: 831488 - DNA, 25 bp, Mus musculus
tctcttcaacccatctatcttcaaa

SEQ ID NO: 831489 - DNA, 25 bp, Mus musculus
tctcttcaacccttctatcttcaaa

SEQ ID NO: 831490 - DNA, 25 bp, Mus musculus
tctcttcaatgcctgcctgcaaatt

SEQ ID NO: 831491 - DNA, 25 bp, Mus musculus
tctcttcaatgcgtgcctgcaaatt

SEQ ID NO: 831492 - DNA, 25 bp, Mus musculus
tctcttcaccaactcagagaagtga

SEQ ID NO: 831493 - DNA, 25 bp, Mus musculus
tctcttcaccaagtcagagaagtga

SEQ ID NO: 831494 - DNA, 25 bp, Mus musculus
tctcttcaccgaaataaaaggctct

SEQ ID NO: 831495 - DNA, 25 bp, Mus musculus
tctcttcaccgatataaaaggctct

SEQ ID NO: 831496 - DNA, 25 bp, Mus musculus
tctcttcacttcattgtttcccaga

SEQ ID NO: 831497 - DNA, 25 bp, Mus musculus
tctcttcacttctttgtttcccaga

SEQ ID NO: 831498 - DNA, 25 bp, Mus musculus
tctcttcagcatctacttgcaggtg

SEQ ID NO: 831499 - DNA, 25 bp, Mus musculus
tctcttcagcatgtacttgcaggtg

SEQ ID NO: 831500 - DNA, 25 bp, Mus musculus
tctcttcagtcccttagtgatggtt

SEQ ID NO: 831501 - DNA, 25 bp, Mus musculus
tctcttcagtccgttagtgatggtt

SEQ ID NO: 831502 - DNA, 25 bp, Mus musculus
tctcttcatgtactgggagctgtaa

SEQ ID NO: 831503 - DNA, 25 bp, Mus musculus
tctcttcatgtagtgggagctgtaa

SEQ ID NO: 831504 - DNA, 25 bp, Mus musculus
tctcttcatttcaccatacatcttg

SEQ ID NO: 831505 - DNA, 25 bp, Mus musculus
tctcttcatttctccatacatcttg

SEQ ID NO: 831506 - DNA, 25 bp, Mus musculus
tctcttccagccagagctccatgag

SEQ ID NO: 831507 - DNA, 25 bp, Mus musculus
tctcttccagcccttataaacaatt

SEQ ID NO: 831508 - DNA, 25 bp, Mus musculus
tctcttccagccgttataaacaatt

SEQ ID NO: 831509 - DNA, 25 bp, Mus musculus
tctcttccagcctgagctccatgag

SEQ ID NO: 831510 - DNA, 25 bp, Mus musculus
tctcttccaggaccacacttgatgc

SEQ ID NO: 831511 - DNA, 25 bp, Mus musculus
tctcttccaggagcacacttgatgc

SEQ ID NO: 831512 - DNA, 25 bp, Mus musculus
tctcttccagtgattgcagctccat

SEQ ID NO: 831513 - DNA, 25 bp, Mus musculus
tctcttccagtgtttgcagctccat

SEQ ID NO: 831514 - DNA, 25 bp, Mus musculus
tctcttccagttacctcaggtgtac

SEQ ID NO: 831515 - DNA, 25 bp, Mus musculus
tctcttccagtttcctcaggtgtac

SEQ ID NO: 831516 - DNA, 25 bp, Mus musculus
tctcttcccaatcaactatattatc

SEQ ID NO: 831517 - DNA, 25 bp, Mus musculus
tctcttcccaatgaactatattatc

SEQ ID NO: 831518 - DNA, 25 bp, Mus musculus
tctcttcccactaggtttaacggat

SEQ ID NO: 831519 - DNA, 25 bp, Mus musculus
tctcttcccacttggtttaacggat

SEQ ID NO: 831520 - DNA, 25 bp, Mus musculus
tctcttccccaactcaataggatgg

SEQ ID NO: 831521 - DNA, 25 bp, Mus musculus
tctcttccccaagtcaataggatgg

SEQ ID NO: 831522 - DNA, 25 bp, Mus musculus
tctcttccccttacttttctacaga

SEQ ID NO: 831523 - DNA, 25 bp, Mus musculus
tctcttcccctttcttttctacaga

SEQ ID NO: 831524 - DNA, 25 bp, Mus musculus
tctcttcccggaagcaaccttgttt

SEQ ID NO: 831525 - DNA, 25 bp, Mus musculus
tctcttcccggatgcaaccttgttt

SEQ ID NO: 831526 - DNA, 25 bp, Mus musculus
tctcttcccttaatgcagtacagat

SEQ ID NO: 831527 - DNA, 25 bp, Mus musculus
tctcttcccttattgcagtacagat

SEQ ID NO: 831528 - DNA, 25 bp, Mus musculus
tctcttccggttctgggacctggaa

SEQ ID NO: 831529 - DNA, 25 bp, Mus musculus
tctcttccggttgtgggacctggaa

SEQ ID NO: 831530 - DNA, 25 bp, Mus musculus
tctcttcctaacacttgtctcaaat

SEQ ID NO: 831531 - DNA, 25 bp, Mus musculus
tctcttcctaactcttgtctcaaat

SEQ ID NO: 831532 - DNA, 25 bp, Mus musculus
tctcttcctaccattaatttcactg

SEQ ID NO: 831533 - DNA, 25 bp, Mus musculus
tctcttcctacctttaatttcactg

SEQ ID NO: 831534 - DNA, 25 bp, Mus musculus
tctcttcctattaaaactctttcca

SEQ ID NO: 831535 - DNA, 25 bp, Mus musculus
tctcttcctatttaaactctttcca

SEQ ID NO: 831536 - DNA, 25 bp, Mus musculus
tctcttcctgttaatgcatttctta

SEQ ID NO: 831537 - DNA, 25 bp, Mus musculus
tctcttcctgtttatgcatttctta

SEQ ID NO: 831538 - DNA, 25 bp, Mus musculus
tctcttccttgaccattcagttgta

SEQ ID NO: 831539 - DNA, 25 bp, Mus musculus
tctcttccttgagcattcagttgta

SEQ ID NO: 831540 - DNA, 25 bp, Mus musculus
tctcttcctttgactggttccaaat

SEQ ID NO: 831541 - DNA, 25 bp, Mus musculus
tctcttcctttgtctggttccaaat

SEQ ID NO: 831542 - DNA, 25 bp, Mus musculus
tctcttcgggaaacatttgcatctt

SEQ ID NO: 831543 - DNA, 25 bp, Mus musculus
tctcttcgggaatcatttgcatctt

SEQ ID NO: 831544 - DNA, 25 bp, Mus musculus
tctcttctacagactctctctagac

SEQ ID NO: 831545 - DNA, 25 bp, Mus musculus
tctcttctacagtctctctctagac

SEQ ID NO: 831546 - DNA, 25 bp, Mus musculus
tctcttctcagaaatttgcctgtct

SEQ ID NO: 831547 - DNA, 25 bp, Mus musculus
tctcttctcagatatttgcctgtct

SEQ ID NO: 831548 - DNA, 25 bp, Mus musculus
tctcttctcattctttatcttcatc

SEQ ID NO: 831549 - DNA, 25 bp, Mus musculus
tctcttctcattgtttatcttcatc

SEQ ID NO: 831550 - DNA, 25 bp, Mus musculus
tctcttctcctaaatccactataat

SEQ ID NO: 831551 - DNA, 25 bp, Mus musculus
tctcttctcctatatccactataat

SEQ ID NO: 831552 - DNA, 25 bp, Mus musculus
tctcttctccttaggtgcttttagt

SEQ ID NO: 831553 - DNA, 25 bp, Mus musculus
tctcttctcctttggtgcttttagt

SEQ ID NO: 831554 - DNA, 25 bp, Mus musculus
tctcttctctcaagctgacagttac

SEQ ID NO: 831555 - DNA, 25 bp, Mus musculus
tctcttctctcatgctgacagttac

SEQ ID NO: 831556 - DNA, 25 bp, Mus musculus
tctcttctctgcaggatacatcatt

SEQ ID NO: 831557 - DNA, 25 bp, Mus musculus
tctcttctctgctggatacatcatt

SEQ ID NO: 831558 - DNA, 25 bp, Mus musculus
tctcttctgccgcacaagactcaaa

SEQ ID NO: 831559 - DNA, 25 bp, Mus musculus
tctcttctgccggacaagactcaaa

SEQ ID NO: 831560 - DNA, 25 bp, Mus musculus
tctcttctgtccaactgggtaatgg

SEQ ID NO: 831561 - DNA, 25 bp, Mus musculus
tctcttctgtcctactgggtaatgg

SEQ ID NO: 831562 - DNA, 25 bp, Mus musculus
tctcttcttaccacacattatcatt

SEQ ID NO: 831563 - DNA, 25 bp, Mus musculus
tctcttcttacctcacattatcatt

SEQ ID NO: 831564 - DNA, 25 bp, Mus musculus
tctcttcttataccctgtgacttag

SEQ ID NO: 831565 - DNA, 25 bp, Mus musculus
tctcttcttatagcctgtgacttag

SEQ ID NO: 831566 - DNA, 25 bp, Mus musculus
tctcttcttgaaccacaccggtctg

SEQ ID NO: 831567 - DNA, 25 bp, Mus musculus
tctcttcttgaagcacaccggtctg

SEQ ID NO: 831568 - DNA, 25 bp, Mus musculus
tctcttcttgcaagaatagcccact

SEQ ID NO: 831569 - DNA, 25 bp, Mus musculus
tctcttcttgcatgaatagcccact

SEQ ID NO: 831570 - DNA, 25 bp, Mus musculus
tctcttcttgtgatatttagtttgc

SEQ ID NO: 831571 - DNA, 25 bp, Mus musculus
tctcttcttgtgttatttagtttgc

SEQ ID NO: 831572 - DNA, 25 bp, Mus musculus
tctcttcttgttctttctgcatttg

SEQ ID NO: 831573 - DNA, 25 bp, Mus musculus
tctcttcttgttgtttctgcatttg

SEQ ID NO: 831574 - DNA, 25 bp, Mus musculus
tctcttctttggctgatgtgatcat

SEQ ID NO: 831575 - DNA, 25 bp, Mus musculus
tctcttctttgggtgatgtgatcat

SEQ ID NO: 831576 - DNA, 25 bp, Mus musculus
tctcttcttttgactctttcaagta

SEQ ID NO: 831577 - DNA, 25 bp, Mus musculus
tctcttcttttgtctctttcaagta

SEQ ID NO: 831578 - DNA, 25 bp, Mus musculus
tctcttgaattccagttccttcaat

SEQ ID NO: 831579 - DNA, 25 bp, Mus musculus
tctcttgaattcgagttccttcaat

SEQ ID NO: 831580 - DNA, 25 bp, Mus musculus
tctcttgaatttaagcatccacata

SEQ ID NO: 831581 - DNA, 25 bp, Mus musculus
tctcttgaattttagcatccacata

SEQ ID NO: 831582 - DNA, 25 bp, Mus musculus
tctcttgatcccaacagcgtttgta

SEQ ID NO: 831583 - DNA, 25 bp, Mus musculus
tctcttgatccctacagcgtttgta

SEQ ID NO: 831584 - DNA, 25 bp, Mus musculus
tctcttgatctacttttacggagtc

SEQ ID NO: 831585 - DNA, 25 bp, Mus musculus
tctcttgatctagttttacggagtc

SEQ ID NO: 831586 - DNA, 25 bp, Mus musculus
tctcttgatgcccttttgacagtta

SEQ ID NO: 831587 - DNA, 25 bp, Mus musculus
tctcttgatgccgttttgacagtta

SEQ ID NO: 831588 - DNA, 25 bp, Mus musculus
tctcttgcaacactgtagcttgacc

SEQ ID NO: 831589 - DNA, 25 bp, Mus musculus
tctcttgcaacagtgtagcttgacc

SEQ ID NO: 831590 - DNA, 25 bp, Mus musculus
tctcttgcaaccaacctagaatctg

SEQ ID NO: 831591 - DNA, 25 bp, Mus musculus
tctcttgcaacctacctagaatctg

SEQ ID NO: 831592 - DNA, 25 bp, Mus musculus
tctcttgcactaaacccagcagctg

SEQ ID NO: 831593 - DNA, 25 bp, Mus musculus
tctcttgcactatacccagcagctg

SEQ ID NO: 831594 - DNA, 25 bp, Mus musculus
tctcttgcagacacttgctactgta

SEQ ID NO: 831595 - DNA, 25 bp, Mus musculus
tctcttgcagactcttgctactgta

SEQ ID NO: 831596 - DNA, 25 bp, Mus musculus
tctcttgcagcaactaaacctcaca

SEQ ID NO: 831597 - DNA, 25 bp, Mus musculus
tctcttgcagcatctaaacctcaca

SEQ ID NO: 831598 - DNA, 25 bp, Mus musculus
tctcttgccagtctggaaagggctt

SEQ ID NO: 831599 - DNA, 25 bp, Mus musculus
tctcttgccagtgtggaaagggctt

SEQ ID NO: 831600 - DNA, 25 bp, Mus musculus
tctcttgcccaaagtaggtctggtt

SEQ ID NO: 831601 - DNA, 25 bp, Mus musculus
tctcttgcccaatgtaggtctggtt

SEQ ID NO: 831602 - DNA, 25 bp, Mus musculus
tctcttgcccacattgtgtctctgg

SEQ ID NO: 831603 - DNA, 25 bp, Mus musculus
tctcttgcccactttgtgtctctgg

SEQ ID NO: 831604 - DNA, 25 bp, Mus musculus
tctcttgcccatacagtagcagggt

SEQ ID NO: 831605 - DNA, 25 bp, Mus musculus
tctcttgcccattcagtagcagggt

SEQ ID NO: 831606 - DNA, 25 bp, Mus musculus
tctcttgccctacagtttaatcagg

SEQ ID NO: 831607 - DNA, 25 bp, Mus musculus
tctcttgccctagagtttaatcagg

SEQ ID NO: 831608 - DNA, 25 bp, Mus musculus
tctcttgcctacatgttttgaaccc

SEQ ID NO: 831609 - DNA, 25 bp, Mus musculus
tctcttgcctacttgttttgaaccc

SEQ ID NO: 831610 - DNA, 25 bp, Mus musculus
tctcttgcctagcaagatcctgtca

SEQ ID NO: 831611 - DNA, 25 bp, Mus musculus
tctcttgcctaggaagatcctgtca

SEQ ID NO: 831612 - DNA, 25 bp, Mus musculus
tctcttgcctgtagacttccacttg

SEQ ID NO: 831613 - DNA, 25 bp, Mus musculus
tctcttgcctgttgacttccacttg

SEQ ID NO: 831614 - DNA, 25 bp, Mus musculus
tctcttgcgagccttggaatctgta

SEQ ID NO: 831615 - DNA, 25 bp, Mus musculus
tctcttgcgagcgttggaatctgta

SEQ ID NO: 831616 - DNA, 25 bp, Mus musculus
tctcttgctcagatttgggactaca

SEQ ID NO: 831617 - DNA, 25 bp, Mus musculus
tctcttgctcagttttgggactaca

SEQ ID NO: 831618 - DNA, 25 bp, Mus musculus
tctcttgctgtacttctcatcctta

SEQ ID NO: 831619 - DNA, 25 bp, Mus musculus
tctcttgctgtagttctcatcctta

SEQ ID NO: 831620 - DNA, 25 bp, Mus musculus
tctcttgctttcatgataccttgct

SEQ ID NO: 831621 - DNA, 25 bp, Mus musculus
tctcttgctttcttgataccttgct

SEQ ID NO: 831622 - DNA, 25 bp, Mus musculus
tctcttggaggaaggaccgaccaag

SEQ ID NO: 831623 - DNA, 25 bp, Mus musculus
tctcttggaggatggaccgaccaag

SEQ ID NO: 831624 - DNA, 25 bp, Mus musculus
tctcttggatctctttcctggacat

SEQ ID NO: 831625 - DNA, 25 bp, Mus musculus
tctcttggatctgtttcctggacat

SEQ ID NO: 831626 - DNA, 25 bp, Mus musculus
tctcttggccgtagtctacagacat

SEQ ID NO: 831627 - DNA, 25 bp, Mus musculus
tctcttggccgttgtctacagacat

SEQ ID NO: 831628 - DNA, 25 bp, Mus musculus
tctcttggctctaaggtagttccga

SEQ ID NO: 831629 - DNA, 25 bp, Mus musculus
tctcttggctcttaggtagttccga

SEQ ID NO: 831630 - DNA, 25 bp, Mus musculus
tctcttgggctcatggtaccccttg

SEQ ID NO: 831631 - DNA, 25 bp, Mus musculus
tctcttgggctcttggtaccccttg

SEQ ID NO: 831632 - DNA, 25 bp, Mus musculus
tctcttggtctcataggaacgtggc

SEQ ID NO: 831633 - DNA, 25 bp, Mus musculus
tctcttggtctcttaggaacgtggc

SEQ ID NO: 831634 - DNA, 25 bp, Mus musculus
tctcttggttgaatggcactgcaca

SEQ ID NO: 831635 - DNA, 25 bp, Mus musculus
tctcttggttgattggcactgcaca

SEQ ID NO: 831636 - DNA, 25 bp, Mus musculus
tctcttgtaccgatcattcccatga

SEQ ID NO: 831637 - DNA, 25 bp, Mus musculus
tctcttgtaccgttcattcccatga

SEQ ID NO: 831638 - DNA, 25 bp, Mus musculus
tctcttgtatcaaagtgctttagtg

SEQ ID NO: 831639 - DNA, 25 bp, Mus musculus
tctcttgtatcatagtgctttagtg

SEQ ID NO: 831640 - DNA, 25 bp, Mus musculus
tctcttgtatggatcactgcttgtg

SEQ ID NO: 831641 - DNA, 25 bp, Mus musculus
tctcttgtatggttcactgcttgtg

SEQ ID NO: 831642 - DNA, 25 bp, Mus musculus
tctcttgtatttccttgacttggac

SEQ ID NO: 831643 - DNA, 25 bp, Mus musculus
tctcttgtatttgcttgacttggac

SEQ ID NO: 831644 - DNA, 25 bp, Mus musculus
tctcttgtctaaaatgtcacctttg

SEQ ID NO: 831645 - DNA, 25 bp, Mus musculus
tctcttgtctaatatgtcacctttg

SEQ ID NO: 831646 - DNA, 25 bp, Mus musculus
tctcttgtctcgatttgtttatact

SEQ ID NO: 831647 - DNA, 25 bp, Mus musculus
tctcttgtctcgttttgtttatact

SEQ ID NO: 831648 - DNA, 25 bp, Mus musculus
tctcttgtctgcacaggatttgaga

SEQ ID NO: 831649 - DNA, 25 bp, Mus musculus
tctcttgtctgctcaggatttgaga

SEQ ID NO: 831650 - DNA, 25 bp, Mus musculus
tctcttgtgcatattctaaagcctt

SEQ ID NO: 831651 - DNA, 25 bp, Mus musculus
tctcttgtgcattttctaaagcctt

SEQ ID NO: 831652 - DNA, 25 bp, Mus musculus
tctcttgtgccaacctagtgaagtt

SEQ ID NO: 831653 - DNA, 25 bp, Mus musculus
tctcttgtgccatcctagtgaagtt

SEQ ID NO: 831654 - DNA, 25 bp, Mus musculus
tctcttgtgcccactgagcaaaatg

SEQ ID NO: 831655 - DNA, 25 bp, Mus musculus
tctcttgtgccctctgagcaaaatg

SEQ ID NO: 831656 - DNA, 25 bp, Mus musculus
tctcttgttctgaatgctagtacca

SEQ ID NO: 831657 - DNA, 25 bp, Mus musculus
tctcttgttctgtatgctagtacca

SEQ ID NO: 831658 - DNA, 25 bp, Mus musculus
tctcttgtttctccagcatacttgc

SEQ ID NO: 831659 - DNA, 25 bp, Mus musculus
tctcttgtttctctgcttgttgata

SEQ ID NO: 831660 - DNA, 25 bp, Mus musculus
tctcttgtttctgcagcatacttgc

SEQ ID NO: 831661 - DNA, 25 bp, Mus musculus
tctcttgtttctgtgcttgttgata

SEQ ID NO: 831662 - DNA, 25 bp, Mus musculus
tctcttgtttgcaatcttacagatg

SEQ ID NO: 831663 - DNA, 25 bp, Mus musculus
tctcttgtttgctatcttacagatg

SEQ ID NO: 831664 - DNA, 25 bp, Mus musculus
tctcttgttttgctggaggccaaga

SEQ ID NO: 831665 - DNA, 25 bp, Mus musculus
tctcttgttttggtggaggccaaga

SEQ ID NO: 831666 - DNA, 25 bp, Mus musculus
tctctttaacttccctttcttctct

SEQ ID NO: 831667 - DNA, 25 bp, Mus musculus
tctctttaacttgcctttcttctct

SEQ ID NO: 831668 - DNA, 25 bp, Mus musculus
tctctttaaggccaactcccagtgt

SEQ ID NO: 831669 - DNA, 25 bp, Mus musculus
tctctttaaggcgaactcccagtgt

SEQ ID NO: 831670 - DNA, 25 bp, Mus musculus
tctctttaattcctacctaagcctt

SEQ ID NO: 831671 - DNA, 25 bp, Mus musculus
tctctttaattcgtacctaagcctt

SEQ ID NO: 831672 - DNA, 25 bp, Mus musculus
tctctttacacaacgttgtctgatg

SEQ ID NO: 831673 - DNA, 25 bp, Mus musculus
tctctttacacatcgttgtctgatg

SEQ ID NO: 831674 - DNA, 25 bp, Mus musculus
tctctttagaaacaggcccctaact

SEQ ID NO: 831675 - DNA, 25 bp, Mus musculus
tctctttagaaagaggcccctaact

SEQ ID NO: 831676 - DNA, 25 bp, Mus musculus
tctctttagacgacctcttccaaaa

SEQ ID NO: 831677 - DNA, 25 bp, Mus musculus
tctctttagacgtcctcttccaaaa

SEQ ID NO: 831678 - DNA, 25 bp, Mus musculus
tctctttagcttacagtctagtgga

SEQ ID NO: 831679 - DNA, 25 bp, Mus musculus
tctctttagctttcagtctagtgga

SEQ ID NO: 831680 - DNA, 25 bp, Mus musculus
tctctttaggccctactttcacaca

SEQ ID NO: 831681 - DNA, 25 bp, Mus musculus
tctctttaggccgtactttcacaca

SEQ ID NO: 831682 - DNA, 25 bp, Mus musculus
tctctttatcttattcctcgttaat

SEQ ID NO: 831683 - DNA, 25 bp, Mus musculus
tctctttatctttttcctcgttaat

SEQ ID NO: 831684 - DNA, 25 bp, Mus musculus
tctctttcacagaacaactttaggt

SEQ ID NO: 831685 - DNA, 25 bp, Mus musculus
tctctttcacagtacaactttaggt

SEQ ID NO: 831686 - DNA, 25 bp, Mus musculus
tctctttcacctccatggtttccag

SEQ ID NO: 831687 - DNA, 25 bp, Mus musculus
tctctttcacctgcatggtttccag

SEQ ID NO: 831688 - DNA, 25 bp, Mus musculus
tctctttccaggaaactatgtggag

SEQ ID NO: 831689 - DNA, 25 bp, Mus musculus
tctctttccaggtaactatgtggag

SEQ ID NO: 831690 - DNA, 25 bp, Mus musculus
tctctttccattagctgtgtgtggt

SEQ ID NO: 831691 - DNA, 25 bp, Mus musculus
tctctttccatttgctgtgtgtggt

SEQ ID NO: 831692 - DNA, 25 bp, Mus musculus
tctctttcccacctggtagaaacta

SEQ ID NO: 831693 - DNA, 25 bp, Mus musculus
tctctttcccacgtggtagaaacta

SEQ ID NO: 831694 - DNA, 25 bp, Mus musculus
tctctttccctcaccataagaaatc

SEQ ID NO: 831695 - DNA, 25 bp, Mus musculus
tctctttccctcataaaaccattgg

SEQ ID NO: 831696 - DNA, 25 bp, Mus musculus
tctctttccctctccataagaaatc

SEQ ID NO: 831697 - DNA, 25 bp, Mus musculus
tctctttccctcttaaaaccattgg

SEQ ID NO: 831698 - DNA, 25 bp, Mus musculus
tctctttcctaaagcggcagcgcaa

SEQ ID NO: 831699 - DNA, 25 bp, Mus musculus
tctctttcctaatgcggcagcgcaa

SEQ ID NO: 831700 - DNA, 25 bp, Mus musculus
tctctttctcacaagtgctgacatt

SEQ ID NO: 831701 - DNA, 25 bp, Mus musculus
tctctttctcactagtgctgacatt

SEQ ID NO: 831702 - DNA, 25 bp, Mus musculus
tctctttctcttatacttctgacat

SEQ ID NO: 831703 - DNA, 25 bp, Mus musculus
tctctttctcttttacttctgacat

SEQ ID NO: 831704 - DNA, 25 bp, Mus musculus
tctctttctgccaaagtctatctga

SEQ ID NO: 831705 - DNA, 25 bp, Mus musculus
tctctttctgcctaagtctatctga

SEQ ID NO: 831706 - DNA, 25 bp, Mus musculus
tctctttctggtctgatgtctggtg

SEQ ID NO: 831707 - DNA, 25 bp, Mus musculus
tctctttctggtgtgatgtctggtg

SEQ ID NO: 831708 - DNA, 25 bp, Mus musculus
tctctttctgtgagtccttctatat

SEQ ID NO: 831709 - DNA, 25 bp, Mus musculus
tctctttctgtgtgtccttctatat

SEQ ID NO: 831710 - DNA, 25 bp, Mus musculus
tctctttcttatcctagtaagttta

SEQ ID NO: 831711 - DNA, 25 bp, Mus musculus
tctctttcttatgctagtaagttta

SEQ ID NO: 831712 - DNA, 25 bp, Mus musculus
tctctttcttcgactgtacccaagg

SEQ ID NO: 831713 - DNA, 25 bp, Mus musculus
tctctttcttcgtctgtacccaagg

SEQ ID NO: 831714 - DNA, 25 bp, Mus musculus
tctctttcttgcctagtacttgtaa

SEQ ID NO: 831715 - DNA, 25 bp, Mus musculus
tctctttcttgcgtagtacttgtaa

SEQ ID NO: 831716 - DNA, 25 bp, Mus musculus
tctctttgaacaacagccacgctgg

SEQ ID NO: 831717 - DNA, 25 bp, Mus musculus
tctctttgaacatcagccacgctgg

SEQ ID NO: 831718 - DNA, 25 bp, Mus musculus
tctctttgaagaccagtagcaggca

SEQ ID NO: 831719 - DNA, 25 bp, Mus musculus
tctctttgaagagcagtagcaggca

SEQ ID NO: 831720 - DNA, 25 bp, Mus musculus
tctctttgatcccataaaattcgag

SEQ ID NO: 831721 - DNA, 25 bp, Mus musculus
tctctttgatccgataaaattcgag

SEQ ID NO: 831722 - DNA, 25 bp, Mus musculus
tctctttgcagaaacctgagtgttt

SEQ ID NO: 831723 - DNA, 25 bp, Mus musculus
tctctttgcagatacctgagtgttt

SEQ ID NO: 831724 - DNA, 25 bp, Mus musculus
tctctttgccaacctagctcttaga

SEQ ID NO: 831725 - DNA, 25 bp, Mus musculus
tctctttgccaagctagctcttaga

SEQ ID NO: 831726 - DNA, 25 bp, Mus musculus
tctctttgccacaattgctacttag

SEQ ID NO: 831727 - DNA, 25 bp, Mus musculus
tctctttgccactattgctacttag

SEQ ID NO: 831728 - DNA, 25 bp, Mus musculus
tctctttgcctacagaccacattgc

SEQ ID NO: 831729 - DNA, 25 bp, Mus musculus
tctctttgcctagagaccacattgc

SEQ ID NO: 831730 - DNA, 25 bp, Mus musculus
tctctttgcctcataatttgtgtta

SEQ ID NO: 831731 - DNA, 25 bp, Mus musculus
tctctttgcctcttaatttgtgtta

SEQ ID NO: 831732 - DNA, 25 bp, Mus musculus
tctctttgccttagcactagtgaca

SEQ ID NO: 831733 - DNA, 25 bp, Mus musculus
tctctttgcctttgcactagtgaca

SEQ ID NO: 831734 - DNA, 25 bp, Mus musculus
tctctttggaagacacaaccctgta

SEQ ID NO: 831735 - DNA, 25 bp, Mus musculus
tctctttggaagtcacaaccctgta

SEQ ID NO: 831736 - DNA, 25 bp, Mus musculus
tctctttggaggagttcgggtttag

SEQ ID NO: 831737 - DNA, 25 bp, Mus musculus
tctctttggaggtgttcgggtttag

SEQ ID NO: 831738 - DNA, 25 bp, Mus musculus
tctctttggatgatgctggtaaaat

SEQ ID NO: 831739 - DNA, 25 bp, Mus musculus
tctctttggatgttgctggtaaaat

SEQ ID NO: 831740 - DNA, 25 bp, Mus musculus
tctctttgggaaacgtcggctgaaa

SEQ ID NO: 831741 - DNA, 25 bp, Mus musculus
tctctttgggaatcgtcggctgaaa

SEQ ID NO: 831742 - DNA, 25 bp, Mus musculus
tctctttgggatactgcctggttta

SEQ ID NO: 831743 - DNA, 25 bp, Mus musculus
tctctttgggattctgcctggttta

SEQ ID NO: 831744 - DNA, 25 bp, Mus musculus
tctctttggtctcccatgtgtgcca

SEQ ID NO: 831745 - DNA, 25 bp, Mus musculus
tctctttggtctgccatgtgtgcca

SEQ ID NO: 831746 - DNA, 25 bp, Mus musculus
tctctttgtcgtatgttttcggtgg

SEQ ID NO: 831747 - DNA, 25 bp, Mus musculus
tctctttgtcgtttgttttcggtgg

SEQ ID NO: 831748 - DNA, 25 bp, Mus musculus
tctctttgtgtaactgaactttgcc

SEQ ID NO: 831749 - DNA, 25 bp, Mus musculus
tctctttgtgtatctgaactttgcc

SEQ ID NO: 831750 - DNA, 25 bp, Mus musculus
tctctttgtgtgcatcagcttctat

SEQ ID NO: 831751 - DNA, 25 bp, Mus musculus
tctctttgtgtggatcagcttctat

SEQ ID NO: 831752 - DNA, 25 bp, Mus musculus
tctctttgtttcctgtgacatccac

SEQ ID NO: 831753 - DNA, 25 bp, Mus musculus
tctctttgtttcgtgtgacatccac

SEQ ID NO: 831754 - DNA, 25 bp, Mus musculus
tctcttttacccatcttattgacac

SEQ ID NO: 831755 - DNA, 25 bp, Mus musculus
tctcttttacccttcttattgacac

SEQ ID NO: 831756 - DNA, 25 bp, Mus musculus
tctcttttactcaatttcaattcca

SEQ ID NO: 831757 - DNA, 25 bp, Mus musculus
tctcttttactctatttcaattcca

SEQ ID NO: 831758 - DNA, 25 bp, Mus musculus
tctcttttatctcattgccaaccta

SEQ ID NO: 831759 - DNA, 25 bp, Mus musculus
tctcttttatctgattgccaaccta

SEQ ID NO: 831760 - DNA, 25 bp, Mus musculus
tctcttttcatacaacatgctggtg

SEQ ID NO: 831761 - DNA, 25 bp, Mus musculus
tctcttttcatagaacatgctggtg

SEQ ID NO: 831762 - DNA, 25 bp, Mus musculus
tctcttttccatatgcccagaaagg

SEQ ID NO: 831763 - DNA, 25 bp, Mus musculus
tctcttttccatttgcccagaaagg

SEQ ID NO: 831764 - DNA, 25 bp, Mus musculus
tctcttttctatccctttttattct

SEQ ID NO: 831765 - DNA, 25 bp, Mus musculus
tctcttttctatgcctttttattct

SEQ ID NO: 831766 - DNA, 25 bp, Mus musculus
tctcttttctgcattcaaaccctaa

SEQ ID NO: 831767 - DNA, 25 bp, Mus musculus
tctcttttctgctttcaaaccctaa

SEQ ID NO: 831768 - DNA, 25 bp, Mus musculus
tctcttttgaggcaacctgtgactg

SEQ ID NO: 831769 - DNA, 25 bp, Mus musculus
tctcttttgagggaacctgtgactg

SEQ ID NO: 831770 - DNA, 25 bp, Mus musculus
tctcttttgcacaaccaggtctatg

SEQ ID NO: 831771 - DNA, 25 bp, Mus musculus
tctcttttgcactaccaggtctatg

SEQ ID NO: 831772 - DNA, 25 bp, Mus musculus
tctcttttggttcccatactgccat

SEQ ID NO: 831773 - DNA, 25 bp, Mus musculus
tctcttttggttgccatactgccat

SEQ ID NO: 831774 - DNA, 25 bp, Mus musculus
tctcttttgtatcttgcttgctaat

SEQ ID NO: 831775 - DNA, 25 bp, Mus musculus
tctcttttgtatgttgcttgctaat

SEQ ID NO: 831776 - DNA, 25 bp, Mus musculus
tctcttttgtttagtgacaggatca

SEQ ID NO: 831777 - DNA, 25 bp, Mus musculus
tctcttttgttttgtgacaggatca

SEQ ID NO: 831778 - DNA, 25 bp, Mus musculus
tctctttttactattgcactgttga

SEQ ID NO: 831779 - DNA, 25 bp, Mus musculus
tctctttttacttttgcactgttga

SEQ ID NO: 831780 - DNA, 25 bp, Mus musculus
tctctttttgatccttgtactgaaa

SEQ ID NO: 831781 - DNA, 25 bp, Mus musculus
tctctttttgatcgtcctggtcttt

SEQ ID NO: 831782 - DNA, 25 bp, Mus musculus
tctctttttgatgcttgtactgaaa

SEQ ID NO: 831783 - DNA, 25 bp, Mus musculus
tctctttttgatggtcctggtcttt

SEQ ID NO: 831784 - DNA, 25 bp, Mus musculus
tctgaaaaaatacccctaacatagg

SEQ ID NO: 831785 - DNA, 25 bp, Mus musculus
tctgaaaaaatagccctaacatagg

SEQ ID NO: 831786 - DNA, 25 bp, Mus musculus
tctgaaaaaccaaagggctgtgagt

SEQ ID NO: 831787 - DNA, 25 bp, Mus musculus
tctgaaaaaccatagggctgtgagt

SEQ ID NO: 831788 - DNA, 25 bp, Mus musculus
tctgaaaaatctccggcccttgtaa

SEQ ID NO: 831789 - DNA, 25 bp, Mus musculus
tctgaaaaatctgcggcccttgtaa

SEQ ID NO: 831790 - DNA, 25 bp, Mus musculus
tctgaaaacggacatcagagctgct

SEQ ID NO: 831791 - DNA, 25 bp, Mus musculus
tctgaaaacggagatcagagctgct

SEQ ID NO: 831792 - DNA, 25 bp, Mus musculus
tctgaaaagaccatgggcaccacta

SEQ ID NO: 831793 - DNA, 25 bp, Mus musculus
tctgaaaagaccttgggcaccacta

SEQ ID NO: 831794 - DNA, 25 bp, Mus musculus
tctgaaaaggctcagttacggttaa

SEQ ID NO: 831795 - DNA, 25 bp, Mus musculus
tctgaaaaggctgagttacggttaa

SEQ ID NO: 831796 - DNA, 25 bp, Mus musculus
tctgaaaaggtgaggcttgtccttc

SEQ ID NO: 831797 - DNA, 25 bp, Mus musculus
tctgaaaaggtgtggcttgtccttc

SEQ ID NO: 831798 - DNA, 25 bp, Mus musculus
tctgaaaattcactgctgcctttgt

SEQ ID NO: 831799 - DNA, 25 bp, Mus musculus
tctgaaaattcagtgctgcctttgt

SEQ ID NO: 831800 - DNA, 25 bp, Mus musculus
tctgaaacaagtacaccctagcttt

SEQ ID NO: 831801 - DNA, 25 bp, Mus musculus
tctgaaacaagttcaccctagcttt

SEQ ID NO: 831802 - DNA, 25 bp, Mus musculus
tctgaaacactcaatggacaccttt

SEQ ID NO: 831803 - DNA, 25 bp, Mus musculus
tctgaaacactctatggacaccttt

SEQ ID NO: 831804 - DNA, 25 bp, Mus musculus
tctgaaacccaacagagccgagact

SEQ ID NO: 831805 - DNA, 25 bp, Mus musculus
tctgaaacccaagagagccgagact

SEQ ID NO: 831806 - DNA, 25 bp, Mus musculus
tctgaaacccttcacgtgtgtaaat

SEQ ID NO: 831807 - DNA, 25 bp, Mus musculus
tctgaaacccttgacgtgtgtaaat

SEQ ID NO: 831808 - DNA, 25 bp, Mus musculus
tctgaaacctcaaataccctatatt

SEQ ID NO: 831809 - DNA, 25 bp, Mus musculus
tctgaaacctcatataccctatatt

SEQ ID NO: 831810 - DNA, 25 bp, Mus musculus
tctgaaactcagctgtgaatgacct

SEQ ID NO: 831811 - DNA, 25 bp, Mus musculus
tctgaaactcaggtgtgaatgacct

SEQ ID NO: 831812 - DNA, 25 bp, Mus musculus
tctgaaactgtgagtctcctgagac

SEQ ID NO: 831813 - DNA, 25 bp, Mus musculus
tctgaaactgtgtgtctcctgagac

SEQ ID NO: 831814 - DNA, 25 bp, Mus musculus
tctgaaactttcctatggttttctg

SEQ ID NO: 831815 - DNA, 25 bp, Mus musculus
tctgaaactttcgtatggttttctg

SEQ ID NO: 831816 - DNA, 25 bp, Mus musculus
tctgaaagagctccaaccgctttta

SEQ ID NO: 831817 - DNA, 25 bp, Mus musculus
tctgaaagagctgcaaccgctttta

SEQ ID NO: 831818 - DNA, 25 bp, Mus musculus
tctgaaagatccagacaaaatgtaa

SEQ ID NO: 831819 - DNA, 25 bp, Mus musculus
tctgaaagatcctgacaaaatgtaa

SEQ ID NO: 831820 - DNA, 25 bp, Mus musculus
tctgaaagattgatcttccccaggg

SEQ ID NO: 831821 - DNA, 25 bp, Mus musculus
tctgaaagattgttcttccccaggg

SEQ ID NO: 831822 - DNA, 25 bp, Mus musculus
tctgaaagccagagctcggagtgca

SEQ ID NO: 831823 - DNA, 25 bp, Mus musculus
tctgaaagccagtgctcggagtgca

SEQ ID NO: 831824 - DNA, 25 bp, Mus musculus
tctgaaaggattattgtgccccacc

SEQ ID NO: 831825 - DNA, 25 bp, Mus musculus
tctgaaaggatttttgtgccccacc

SEQ ID NO: 831826 - DNA, 25 bp, Mus musculus
tctgaaatgcagctggcaggcatat

SEQ ID NO: 831827 - DNA, 25 bp, Mus musculus
tctgaaatgcaggtggcaggcatat

SEQ ID NO: 831828 - DNA, 25 bp, Mus musculus
tctgaacacacaacaggcaccctgt

SEQ ID NO: 831829 - DNA, 25 bp, Mus musculus
tctgaacacacatcaggcaccctgt

SEQ ID NO: 831830 - DNA, 25 bp, Mus musculus
tctgaacactagcactgggctctta

SEQ ID NO: 831831 - DNA, 25 bp, Mus musculus
tctgaacactaggactgggctctta

SEQ ID NO: 831832 - DNA, 25 bp, Mus musculus
tctgaacacttccatcgttatgccg

SEQ ID NO: 831833 - DNA, 25 bp, Mus musculus
tctgaacacttcgatcgttatgccg

SEQ ID NO: 831834 - DNA, 25 bp, Mus musculus
tctgaacagggacatggcaccatct

SEQ ID NO: 831835 - DNA, 25 bp, Mus musculus
tctgaacagggagatggcaccatct

SEQ ID NO: 831836 - DNA, 25 bp, Mus musculus
tctgaacataaaccgtatatctcct

SEQ ID NO: 831837 - DNA, 25 bp, Mus musculus
tctgaacataaagcgtatatctcct

SEQ ID NO: 831838 - DNA, 25 bp, Mus musculus
tctgaacattttcgcatccacatat

SEQ ID NO: 831839 - DNA, 25 bp, Mus musculus
tctgaacattttggcatccacatat

SEQ ID NO: 831840 - DNA, 25 bp, Mus musculus
tctgaaccaatgctgtgcggcatgg

SEQ ID NO: 831841 - DNA, 25 bp, Mus musculus
tctgaaccaatggtgtgcggcatgg

SEQ ID NO: 831842 - DNA, 25 bp, Mus musculus
tctgaaccacttcctgtgaatagca

SEQ ID NO: 831843 - DNA, 25 bp, Mus musculus
tctgaaccacttgctgtgaatagca

SEQ ID NO: 831844 - DNA, 25 bp, Mus musculus
tctgaaccatctatccccaaggaag

SEQ ID NO: 831845 - DNA, 25 bp, Mus musculus
tctgaaccatctttccccaaggaag

SEQ ID NO: 831846 - DNA, 25 bp, Mus musculus
tctgaacccagaacttcatgcttgt

SEQ ID NO: 831847 - DNA, 25 bp, Mus musculus
tctgaacccagatcttcatgcttgt

SEQ ID NO: 831848 - DNA, 25 bp, Mus musculus
tctgaacccgcgcagacccgcataa

SEQ ID NO: 831849 - DNA, 25 bp, Mus musculus
tctgaacccgcggagacccgcataa

SEQ ID NO: 831850 - DNA, 25 bp, Mus musculus
tctgaacccggtctcaaaacattgt

SEQ ID NO: 831851 - DNA, 25 bp, Mus musculus
tctgaacccggtgtcaaaacattgt

SEQ ID NO: 831852 - DNA, 25 bp, Mus musculus
tctgaaccctctctaattctatcat

SEQ ID NO: 831853 - DNA, 25 bp, Mus musculus
tctgaaccctctgtaattctatcat

SEQ ID NO: 831854 - DNA, 25 bp, Mus musculus
tctgaaccctgtcgaccaggaagcg

SEQ ID NO: 831855 - DNA, 25 bp, Mus musculus
tctgaaccctgtggaccaggaagcg

SEQ ID NO: 831856 - DNA, 25 bp, Mus musculus
tctgaacctaggctgctgctgtgta

SEQ ID NO: 831857 - DNA, 25 bp, Mus musculus
tctgaacctagggtgctgctgtgta

SEQ ID NO: 831858 - DNA, 25 bp, Mus musculus
tctgaacctcctaggcagttggcgg

SEQ ID NO: 831859 - DNA, 25 bp, Mus musculus
tctgaacctccttggcagttggcgg

SEQ ID NO: 831860 - DNA, 25 bp, Mus musculus
tctgaacctgagaaagcctggacca

SEQ ID NO: 831861 - DNA, 25 bp, Mus musculus
tctgaacctgagtaagcctggacca

SEQ ID NO: 831862 - DNA, 25 bp, Mus musculus
tctgaacctgtactttgacaccttt

SEQ ID NO: 831863 - DNA, 25 bp, Mus musculus
tctgaacctgtagtttgacaccttt

SEQ ID NO: 831864 - DNA, 25 bp, Mus musculus
tctgaacgaattcttggatggcgaa

SEQ ID NO: 831865 - DNA, 25 bp, Mus musculus
tctgaacgaattgttggatggcgaa

SEQ ID NO: 831866 - DNA, 25 bp, Mus musculus
tctgaactacataggacaagcactt

SEQ ID NO: 831867 - DNA, 25 bp, Mus musculus
tctgaactacattggacaagcactt

SEQ ID NO: 831868 - DNA, 25 bp, Mus musculus
tctgaactaggtctgcaatctgcat

SEQ ID NO: 831869 - DNA, 25 bp, Mus musculus
tctgaactaggtgtgcaatctgcat

SEQ ID NO: 831870 - DNA, 25 bp, Mus musculus
tctgaactatagattgacctgcctc

SEQ ID NO: 831871 - DNA, 25 bp, Mus musculus
tctgaactatagtttgacctgcctc

SEQ ID NO: 831872 - DNA, 25 bp, Mus musculus
tctgaactatgtaagttctgagggc

SEQ ID NO: 831873 - DNA, 25 bp, Mus musculus
tctgaactatgttagttctgagggc

SEQ ID NO: 831874 - DNA, 25 bp, Mus musculus
tctgaactcagcaggctatgaaata

SEQ ID NO: 831875 - DNA, 25 bp, Mus musculus
tctgaactcagctggctatgaaata

SEQ ID NO: 831876 - DNA, 25 bp, Mus musculus
tctgaactccttcacctacggatat

SEQ ID NO: 831877 - DNA, 25 bp, Mus musculus
tctgaactccttgacctacggatat

SEQ ID NO: 831878 - DNA, 25 bp, Mus musculus
tctgaactctcacctgtcagaggga

SEQ ID NO: 831879 - DNA, 25 bp, Mus musculus
tctgaactctcagctgtcagaggga

SEQ ID NO: 831880 - DNA, 25 bp, Mus musculus
tctgaactgcccagtgccttccaaa

SEQ ID NO: 831881 - DNA, 25 bp, Mus musculus
tctgaactgccctgtgccttccaaa

SEQ ID NO: 831882 - DNA, 25 bp, Mus musculus
tctgaactgggcagccataaagaag

SEQ ID NO: 831883 - DNA, 25 bp, Mus musculus
tctgaactgggctgccataaagaag

SEQ ID NO: 831884 - DNA, 25 bp, Mus musculus
tctgaactggtcatgacacggcttc

SEQ ID NO: 831885 - DNA, 25 bp, Mus musculus
tctgaactggtcttgacacggcttc

SEQ ID NO: 831886 - DNA, 25 bp, Mus musculus
tctgaacttattaccatattccggg

SEQ ID NO: 831887 - DNA, 25 bp, Mus musculus
tctgaacttatttccatattccggg

SEQ ID NO: 831888 - DNA, 25 bp, Mus musculus
tctgaagaaaccctaagtgtgatgt

SEQ ID NO: 831889 - DNA, 25 bp, Mus musculus
tctgaagaaaccgtaagtgtgatgt

SEQ ID NO: 831890 - DNA, 25 bp, Mus musculus
tctgaagaaccaaaccgagcctatt

SEQ ID NO: 831891 - DNA, 25 bp, Mus musculus
tctgaagaaccataccgagcctatt

SEQ ID NO: 831892 - DNA, 25 bp, Mus musculus
tctgaagaagcccttcgggtttctg

SEQ ID NO: 831893 - DNA, 25 bp, Mus musculus
tctgaagaagccgttcgggtttctg

SEQ ID NO: 831894 - DNA, 25 bp, Mus musculus
tctgaagacagcagggccgcagtct

SEQ ID NO: 831895 - DNA, 25 bp, Mus musculus
tctgaagacagctgggccgcagtct

SEQ ID NO: 831896 - DNA, 25 bp, Mus musculus
tctgaagactcaccaggcctcaaac

SEQ ID NO: 831897 - DNA, 25 bp, Mus musculus
tctgaagactcagcaggcctcaaac

SEQ ID NO: 831898 - DNA, 25 bp, Mus musculus
tctgaagaggacagagccgccgtgc

SEQ ID NO: 831899 - DNA, 25 bp, Mus musculus
tctgaagaggactgagccgccgtgc

SEQ ID NO: 831900 - DNA, 25 bp, Mus musculus
tctgaagatcccctgtttactacac

SEQ ID NO: 831901 - DNA, 25 bp, Mus musculus
tctgaagatcccgtgtttactacac

SEQ ID NO: 831902 - DNA, 25 bp, Mus musculus
tctgaagatgcaatttattggatat

SEQ ID NO: 831903 - DNA, 25 bp, Mus musculus
tctgaagatgcattttattggatat

SEQ ID NO: 831904 - DNA, 25 bp, Mus musculus
tctgaagcaacaactcttctcctac

SEQ ID NO: 831905 - DNA, 25 bp, Mus musculus
tctgaagcaacatctcttctcctac

SEQ ID NO: 831906 - DNA, 25 bp, Mus musculus
tctgaagcacagacgtaggcctgag

SEQ ID NO: 831907 - DNA, 25 bp, Mus musculus
tctgaagcacagtcgtaggcctgag

SEQ ID NO: 831908 - DNA, 25 bp, Mus musculus
tctgaagcacttaggagctactgct

SEQ ID NO: 831909 - DNA, 25 bp, Mus musculus
tctgaagcactttggagctactgct

SEQ ID NO: 831910 - DNA, 25 bp, Mus musculus
tctgaagcagacctaagcactcctg

SEQ ID NO: 831911 - DNA, 25 bp, Mus musculus
tctgaagcagacgtaagcactcctg

SEQ ID NO: 831912 - DNA, 25 bp, Mus musculus
tctgaagcagccagatggcatcgct

SEQ ID NO: 831913 - DNA, 25 bp, Mus musculus
tctgaagcagcctgatggcatcgct

SEQ ID NO: 831914 - DNA, 25 bp, Mus musculus
tctgaagccagcctgctacctgaga

SEQ ID NO: 831915 - DNA, 25 bp, Mus musculus
tctgaagccagcgtgctacctgaga

SEQ ID NO: 831916 - DNA, 25 bp, Mus musculus
tctgaagctaaacccctgggactgt

SEQ ID NO: 831917 - DNA, 25 bp, Mus musculus
tctgaagctaaagccctgggactgt

SEQ ID NO: 831918 - DNA, 25 bp, Mus musculus
tctgaagcttgcctcatgctggttg

SEQ ID NO: 831919 - DNA, 25 bp, Mus musculus
tctgaagcttgcgtcatgctggttg

SEQ ID NO: 831920 - DNA, 25 bp, Mus musculus
tctgaaggatgacggtcttataacc

SEQ ID NO: 831921 - DNA, 25 bp, Mus musculus
tctgaaggatgagggtcttataacc

SEQ ID NO: 831922 - DNA, 25 bp, Mus musculus
tctgaaggcaaacgttggtgctggt

SEQ ID NO: 831923 - DNA, 25 bp, Mus musculus
tctgaaggcaaaggttggtgctggt

SEQ ID NO: 831924 - DNA, 25 bp, Mus musculus
tctgaaggctgaatatgaaacaaaa

SEQ ID NO: 831925 - DNA, 25 bp, Mus musculus
tctgaaggctgattatgaaacaaaa

SEQ ID NO: 831926 - DNA, 25 bp, Mus musculus
tctgaaggcttcaaataaaatatca

SEQ ID NO: 831927 - DNA, 25 bp, Mus musculus
tctgaaggcttctaataaaatatca

SEQ ID NO: 831928 - DNA, 25 bp, Mus musculus
tctgaagggaagaaccaccccgaat

SEQ ID NO: 831929 - DNA, 25 bp, Mus musculus
tctgaagggaagtaccaccccgaat

SEQ ID NO: 831930 - DNA, 25 bp, Mus musculus
tctgaagggactcactgcacataca

SEQ ID NO: 831931 - DNA, 25 bp, Mus musculus
tctgaagggactgactgcacataca

SEQ ID NO: 831932 - DNA, 25 bp, Mus musculus
tctgaagggcgacaatcctttcact

SEQ ID NO: 831933 - DNA, 25 bp, Mus musculus
tctgaagggcgagaatcctttcact

SEQ ID NO: 831934 - DNA, 25 bp, Mus musculus
tctgaaggtagtcccaaactgtttt

SEQ ID NO: 831935 - DNA, 25 bp, Mus musculus
tctgaaggtagtgccaaactgtttt

SEQ ID NO: 831936 - DNA, 25 bp, Mus musculus
tctgaaggtgagaccaagatccctc

SEQ ID NO: 831937 - DNA, 25 bp, Mus musculus
tctgaaggtgagtccaagatccctc

SEQ ID NO: 831938 - DNA, 25 bp, Mus musculus
tctgaaggtgctacccagagcaaag

SEQ ID NO: 831939 - DNA, 25 bp, Mus musculus
tctgaaggtgcttcccagagcaaag

SEQ ID NO: 831940 - DNA, 25 bp, Mus musculus
tctgaaggtggaattgtcccagctt

SEQ ID NO: 831941 - DNA, 25 bp, Mus musculus
tctgaaggtggatttgtcccagctt

SEQ ID NO: 831942 - DNA, 25 bp, Mus musculus
tctgaagtaggcatcttcctgcata

SEQ ID NO: 831943 - DNA, 25 bp, Mus musculus
tctgaagtaggcttcttcctgcata

SEQ ID NO: 831944 - DNA, 25 bp, Mus musculus
tctgaagtagtcagttttctcccat

SEQ ID NO: 831945 - DNA, 25 bp, Mus musculus
tctgaagtagtctgttttctcccat

SEQ ID NO: 831946 - DNA, 25 bp, Mus musculus
tctgaagtcaccaggagccatgttt

SEQ ID NO: 831947 - DNA, 25 bp, Mus musculus
tctgaagtcacctggagccatgttt

SEQ ID NO: 831948 - DNA, 25 bp, Mus musculus
tctgaagtcagcctagtctacgtgt

SEQ ID NO: 831949 - DNA, 25 bp, Mus musculus
tctgaagtcagcgtagtctacgtgt

SEQ ID NO: 831950 - DNA, 25 bp, Mus musculus
tctgaagtccctagtacaggctgtt

SEQ ID NO: 831951 - DNA, 25 bp, Mus musculus
tctgaagtcccttgtacaggctgtt

SEQ ID NO: 831952 - DNA, 25 bp, Mus musculus
tctgaagtctccctttagctacaat

SEQ ID NO: 831953 - DNA, 25 bp, Mus musculus
tctgaagtctccgtttagctacaat

SEQ ID NO: 831954 - DNA, 25 bp, Mus musculus
tctgaagtctgcacttcttgccact

SEQ ID NO: 831955 - DNA, 25 bp, Mus musculus
tctgaagtctgctcttcttgccact

SEQ ID NO: 831956 - DNA, 25 bp, Mus musculus
tctgaagtggatctcagctgactcc

SEQ ID NO: 831957 - DNA, 25 bp, Mus musculus
tctgaagtggatgtcagctgactcc

SEQ ID NO: 831958 - DNA, 25 bp, Mus musculus
tctgaagtgtgccagcctaagcctg

SEQ ID NO: 831959 - DNA, 25 bp, Mus musculus
tctgaagtgtgcgagcctaagcctg

SEQ ID NO: 831960 - DNA, 25 bp, Mus musculus
tctgaagtgttgacctgagtaaggc

SEQ ID NO: 831961 - DNA, 25 bp, Mus musculus
tctgaagtgttgtcctgagtaaggc

SEQ ID NO: 831962 - DNA, 25 bp, Mus musculus
tctgaagttacgcatgctgaaacac

SEQ ID NO: 831963 - DNA, 25 bp, Mus musculus
tctgaagttacggatgctgaaacac

SEQ ID NO: 831964 - DNA, 25 bp, Mus musculus
tctgaagttctaaattacatctaat

SEQ ID NO: 831965 - DNA, 25 bp, Mus musculus
tctgaagttctatattacatctaat

SEQ ID NO: 831966 - DNA, 25 bp, Mus musculus
tctgaagttcttctccaatttggga

SEQ ID NO: 831967 - DNA, 25 bp, Mus musculus
tctgaagttcttgtccaatttggga

SEQ ID NO: 831968 - DNA, 25 bp, Mus musculus
tctgaataaaaacgtgttgccacgt

SEQ ID NO: 831969 - DNA, 25 bp, Mus musculus
tctgaataaaaaggtgttgccacgt

SEQ ID NO: 831970 - DNA, 25 bp, Mus musculus
tctgaataaacacaactgcctcctg

SEQ ID NO: 831971 - DNA, 25 bp, Mus musculus
tctgaataaacagaactgcctcctg

SEQ ID NO: 831972 - DNA, 25 bp, Mus musculus
tctgaatagagtcactccctgtcac

SEQ ID NO: 831973 - DNA, 25 bp, Mus musculus
tctgaatagagtgactccctgtcac

SEQ ID NO: 831974 - DNA, 25 bp, Mus musculus
tctgaatagtggattttctaataag

SEQ ID NO: 831975 - DNA, 25 bp, Mus musculus
tctgaatagtggtttttctaataag

SEQ ID NO: 831976 - DNA, 25 bp, Mus musculus
tctgaatattttagatcctctgaca

SEQ ID NO: 831977 - DNA, 25 bp, Mus musculus
tctgaatatttttgatcctctgaca

SEQ ID NO: 831978 - DNA, 25 bp, Mus musculus
tctgaatcagataagcaaccaagta

SEQ ID NO: 831979 - DNA, 25 bp, Mus musculus
tctgaatcagattagcaaccaagta

SEQ ID NO: 831980 - DNA, 25 bp, Mus musculus
tctgaatccaacactaatgctcctg

SEQ ID NO: 831981 - DNA, 25 bp, Mus musculus
tctgaatccaactctaatgctcctg

SEQ ID NO: 831982 - DNA, 25 bp, Mus musculus
tctgaatcctgtaggccagccagaa

SEQ ID NO: 831983 - DNA, 25 bp, Mus musculus
tctgaatcctgttggccagccagaa

SEQ ID NO: 831984 - DNA, 25 bp, Mus musculus
tctgaatctgcactggcttttgctt

SEQ ID NO: 831985 - DNA, 25 bp, Mus musculus
tctgaatctgcagtggcttttgctt

SEQ ID NO: 831986 - DNA, 25 bp, Mus musculus
tctgaatctgctagtgatctgtcca

SEQ ID NO: 831987 - DNA, 25 bp, Mus musculus
tctgaatctgcttgtgatctgtcca

SEQ ID NO: 831988 - DNA, 25 bp, Mus musculus
tctgaatctgttatcttgtctttaa

SEQ ID NO: 831989 - DNA, 25 bp, Mus musculus
tctgaatctgttttcttgtctttaa

SEQ ID NO: 831990 - DNA, 25 bp, Mus musculus
tctgaatgatctctgcgacctacat

SEQ ID NO: 831991 - DNA, 25 bp, Mus musculus
tctgaatgatctgtgcgacctacat

SEQ ID NO: 831992 - DNA, 25 bp, Mus musculus
tctgaatgccgacgttctgagcgtc

SEQ ID NO: 831993 - DNA, 25 bp, Mus musculus
tctgaatgccgaggttctgagcgtc

SEQ ID NO: 831994 - DNA, 25 bp, Mus musculus
tctgaatggatgagcgaacgggaac

SEQ ID NO: 831995 - DNA, 25 bp, Mus musculus
tctgaatggatgtgcgaacgggaac

SEQ ID NO: 831996 - DNA, 25 bp, Mus musculus
tctgaatgtctcctgtccatggtgg

SEQ ID NO: 831997 - DNA, 25 bp, Mus musculus
tctgaatgtctcgtgtccatggtgg

SEQ ID NO: 831998 - DNA, 25 bp, Mus musculus
tctgaatgtgctactcttggtttct

SEQ ID NO: 831999 - DNA, 25 bp, Mus musculus
tctgaatgtgcttctcttggtttct

SEQ ID NO: 832000 - DNA, 25 bp, Mus musculus
tctgaatgtggcactttggatggaa

SEQ ID NO: 832001 - DNA, 25 bp, Mus musculus
tctgaatgtggctctttggatggaa

SEQ ID NO: 832002 - DNA, 25 bp, Mus musculus
tctgaatgtggtagtgggcacacgt

SEQ ID NO: 832003 - DNA, 25 bp, Mus musculus
tctgaatgtggttgtgggcacacgt

SEQ ID NO: 832004 - DNA, 25 bp, Mus musculus
tctgaatgtgtccataccatatgta

SEQ ID NO: 832005 - DNA, 25 bp, Mus musculus
tctgaatgtgtcgataccatatgta

SEQ ID NO: 832006 - DNA, 25 bp, Mus musculus
tctgaattgatgcagtcgaccctgg

SEQ ID NO: 832007 - DNA, 25 bp, Mus musculus
tctgaattgatggagtcgaccctgg

SEQ ID NO: 832008 - DNA, 25 bp, Mus musculus
tctgaattgattccgggcctagtgt

SEQ ID NO: 832009 - DNA, 25 bp, Mus musculus
tctgaattgattgcgggcctagtgt

SEQ ID NO: 832010 - DNA, 25 bp, Mus musculus
tctgaattgcctaaagtagtttctc

SEQ ID NO: 832011 - DNA, 25 bp, Mus musculus
tctgaattgccttaagtagtttctc

SEQ ID NO: 832012 - DNA, 25 bp, Mus musculus
tctgaattggatctgtacttttaaa

SEQ ID NO: 832013 - DNA, 25 bp, Mus musculus
tctgaattggatgtgtacttttaaa

SEQ ID NO: 832014 - DNA, 25 bp, Mus musculus
tctgaattggccctcctctacagag

SEQ ID NO: 832015 - DNA, 25 bp, Mus musculus
tctgaattggccgtcctctacagag

SEQ ID NO: 832016 - DNA, 25 bp, Mus musculus
tctgaatttgggagatgggaagcat

SEQ ID NO: 832017 - DNA, 25 bp, Mus musculus
tctgaatttgggtgatgggaagcat

SEQ ID NO: 832018 - DNA, 25 bp, Mus musculus
tctgaatttgtccatccccaaaatc

SEQ ID NO: 832019 - DNA, 25 bp, Mus musculus
tctgaatttgtcgatccccaaaatc

SEQ ID NO: 832020 - DNA, 25 bp, Mus musculus
tctgacaaaccgactactcctaaga

SEQ ID NO: 832021 - DNA, 25 bp, Mus musculus
tctgacaaaccgtctactcctaaga

SEQ ID NO: 832022 - DNA, 25 bp, Mus musculus
tctgacaaccagaccttaccaggtg

SEQ ID NO: 832023 - DNA, 25 bp, Mus musculus
tctgacaaccagtccttaccaggtg

SEQ ID NO: 832024 - DNA, 25 bp, Mus musculus
tctgacaacgagctgcctttgcctt

SEQ ID NO: 832025 - DNA, 25 bp, Mus musculus
tctgacaacgaggtgcctttgcctt

SEQ ID NO: 832026 - DNA, 25 bp, Mus musculus
tctgacaaggctattctctgctaca

SEQ ID NO: 832027 - DNA, 25 bp, Mus musculus
tctgacaaggcttttctctgctaca

SEQ ID NO: 832028 - DNA, 25 bp, Mus musculus
tctgacaattagactctgaaagtgc

SEQ ID NO: 832029 - DNA, 25 bp, Mus musculus
tctgacaattagtctctgaaagtgc

SEQ ID NO: 832030 - DNA, 25 bp, Mus musculus
tctgacacaccaatttccatgtaag

SEQ ID NO: 832031 - DNA, 25 bp, Mus musculus
tctgacacaccattttccatgtaag

SEQ ID NO: 832032 - DNA, 25 bp, Mus musculus
tctgacacacggcaccaatgacaaa

SEQ ID NO: 832033 - DNA, 25 bp, Mus musculus
tctgacacacgggaccaatgacaaa

SEQ ID NO: 832034 - DNA, 25 bp, Mus musculus
tctgacacctacattcaggtcatca

SEQ ID NO: 832035 - DNA, 25 bp, Mus musculus
tctgacacctactttcaggtcatca

SEQ ID NO: 832036 - DNA, 25 bp, Mus musculus
tctgacacgcaacacctacataggc

SEQ ID NO: 832037 - DNA, 25 bp, Mus musculus
tctgacacgcaagacctacataggc

SEQ ID NO: 832038 - DNA, 25 bp, Mus musculus
tctgacacggagcacacggaggtct

SEQ ID NO: 832039 - DNA, 25 bp, Mus musculus
tctgacacggaggacacggaggtct

SEQ ID NO: 832040 - DNA, 25 bp, Mus musculus
tctgacacggccagccctatgcgga

SEQ ID NO: 832041 - DNA, 25 bp, Mus musculus
tctgacacggcctgccctatgcgga

SEQ ID NO: 832042 - DNA, 25 bp, Mus musculus
tctgacactggaactgcttatccca

SEQ ID NO: 832043 - DNA, 25 bp, Mus musculus
tctgacactggatctgcttatccca

SEQ ID NO: 832044 - DNA, 25 bp, Mus musculus
tctgacactgtaatcctttctctct

SEQ ID NO: 832045 - DNA, 25 bp, Mus musculus
tctgacactgtattcctttctctct

SEQ ID NO: 832046 - DNA, 25 bp, Mus musculus
tctgacagaccgaacctgccgggta

SEQ ID NO: 832047 - DNA, 25 bp, Mus musculus
tctgacagaccgtacctgccgggta

SEQ ID NO: 832048 - DNA, 25 bp, Mus musculus
tctgacagactcacatctctttggg

SEQ ID NO: 832049 - DNA, 25 bp, Mus musculus
tctgacagactctcatctctttggg

SEQ ID NO: 832050 - DNA, 25 bp, Mus musculus
tctgacagactgaccgtttgtacca

SEQ ID NO: 832051 - DNA, 25 bp, Mus musculus
tctgacagactgtccgtttgtacca

SEQ ID NO: 832052 - DNA, 25 bp, Mus musculus
tctgacagaggcacgggcaaggtta

SEQ ID NO: 832053 - DNA, 25 bp, Mus musculus
tctgacagaggctcgggcaaggtta

SEQ ID NO: 832054 - DNA, 25 bp, Mus musculus
tctgacagccctatcgggatcagct

SEQ ID NO: 832055 - DNA, 25 bp, Mus musculus
tctgacagccctttcgggatcagct

SEQ ID NO: 832056 - DNA, 25 bp, Mus musculus
tctgacagctataaccatcttccat

SEQ ID NO: 832057 - DNA, 25 bp, Mus musculus
tctgacagctattaccatcttccat

SEQ ID NO: 832058 - DNA, 25 bp, Mus musculus
tctgacaggtgtctgcgccttcatt

SEQ ID NO: 832059 - DNA, 25 bp, Mus musculus
tctgacaggtgtgtgcgccttcatt

SEQ ID NO: 832060 - DNA, 25 bp, Mus musculus
tctgacagtcacaccgcagagatgt

SEQ ID NO: 832061 - DNA, 25 bp, Mus musculus
tctgacagtcactccgcagagatgt

SEQ ID NO: 832062 - DNA, 25 bp, Mus musculus
tctgacagttgccaagtggtttgaa

SEQ ID NO: 832063 - DNA, 25 bp, Mus musculus
tctgacagttgcgaagtggtttgaa

SEQ ID NO: 832064 - DNA, 25 bp, Mus musculus
tctgacatcatcacatctgaaggtg

SEQ ID NO: 832065 - DNA, 25 bp, Mus musculus
tctgacatcatctcatctgaaggtg

SEQ ID NO: 832066 - DNA, 25 bp, Mus musculus
tctgacatcctaaggacatattcaa

SEQ ID NO: 832067 - DNA, 25 bp, Mus musculus
tctgacatcctatggacatattcaa

SEQ ID NO: 832068 - DNA, 25 bp, Mus musculus
tctgacatcttgagggcaccctaga

SEQ ID NO: 832069 - DNA, 25 bp, Mus musculus
tctgacatcttgtgggcaccctaga

SEQ ID NO: 832070 - DNA, 25 bp, Mus musculus
tctgacatggccaaagttggtgttt

SEQ ID NO: 832071 - DNA, 25 bp, Mus musculus
tctgacatggcctaagttggtgttt

SEQ ID NO: 832072 - DNA, 25 bp, Mus musculus
tctgacattataagtggaaagtggc

SEQ ID NO: 832073 - DNA, 25 bp, Mus musculus
tctgacattatatgtggaaagtggc

SEQ ID NO: 832074 - DNA, 25 bp, Mus musculus
tctgacattgacactagcctactat

SEQ ID NO: 832075 - DNA, 25 bp, Mus musculus
tctgacattgactctagcctactat

SEQ ID NO: 832076 - DNA, 25 bp, Mus musculus
tctgacattgtcaacctaatcaaag

SEQ ID NO: 832077 - DNA, 25 bp, Mus musculus
tctgacattgtctacctaatcaaag

SEQ ID NO: 832078 - DNA, 25 bp, Mus musculus
tctgaccaacttcttactgcttcaa

SEQ ID NO: 832079 - DNA, 25 bp, Mus musculus
tctgaccaacttgttactgcttcaa

SEQ ID NO: 832080 - DNA, 25 bp, Mus musculus
tctgaccacacgatgtgttgggaaa

SEQ ID NO: 832081 - DNA, 25 bp, Mus musculus
tctgaccacacgttgtgttgggaaa

SEQ ID NO: 832082 - DNA, 25 bp, Mus musculus
tctgaccaccacctattacaatgag

SEQ ID NO: 832083 - DNA, 25 bp, Mus musculus
tctgaccaccacgtattacaatgag

SEQ ID NO: 832084 - DNA, 25 bp, Mus musculus
tctgaccaccgtcaaatctgtgaac

SEQ ID NO: 832085 - DNA, 25 bp, Mus musculus
tctgaccaccgtgaaatctgtgaac

SEQ ID NO: 832086 - DNA, 25 bp, Mus musculus
tctgaccacctaccagagtagtgag

SEQ ID NO: 832087 - DNA, 25 bp, Mus musculus
tctgaccacctagcagagtagtgag

SEQ ID NO: 832088 - DNA, 25 bp, Mus musculus
tctgaccactgaacttaaccttggc

SEQ ID NO: 832089 - DNA, 25 bp, Mus musculus
tctgaccactgatcttaaccttggc

SEQ ID NO: 832090 - DNA, 25 bp, Mus musculus
tctgaccaggacctatgatgtgtaa

SEQ ID NO: 832091 - DNA, 25 bp, Mus musculus
tctgaccaggacgtatgatgtgtaa

SEQ ID NO: 832092 - DNA, 25 bp, Mus musculus
tctgaccataatatccctgtatatt

SEQ ID NO: 832093 - DNA, 25 bp, Mus musculus
tctgaccataatttccctgtatatt

SEQ ID NO: 832094 - DNA, 25 bp, Mus musculus
tctgacccacacatatctgagggat

SEQ ID NO: 832095 - DNA, 25 bp, Mus musculus
tctgacccacacttatctgagggat

SEQ ID NO: 832096 - DNA, 25 bp, Mus musculus
tctgacccacggatgtagcggagtg

SEQ ID NO: 832097 - DNA, 25 bp, Mus musculus
tctgacccacggttgtagcggagtg

SEQ ID NO: 832098 - DNA, 25 bp, Mus musculus
tctgacccagtcatttgagcattca

SEQ ID NO: 832099 - DNA, 25 bp, Mus musculus
tctgacccagtcctactttatatgg

SEQ ID NO: 832100 - DNA, 25 bp, Mus musculus
tctgacccagtcgtactttatatgg

SEQ ID NO: 832101 - DNA, 25 bp, Mus musculus
tctgacccagtcttttgagcattca

SEQ ID NO: 832102 - DNA, 25 bp, Mus musculus
tctgaccccatcacagtggtgttac

SEQ ID NO: 832103 - DNA, 25 bp, Mus musculus
tctgaccccatctcagtggtgttac

SEQ ID NO: 832104 - DNA, 25 bp, Mus musculus
tctgacccctgtaagttcacttaat

SEQ ID NO: 832105 - DNA, 25 bp, Mus musculus
tctgacccctgttagttcacttaat

SEQ ID NO: 832106 - DNA, 25 bp, Mus musculus
tctgacccgagacgtacatttgttt

SEQ ID NO: 832107 - DNA, 25 bp, Mus musculus
tctgacccgagaggtacatttgttt

SEQ ID NO: 832108 - DNA, 25 bp, Mus musculus
tctgacccgccacgaccatgaggga

SEQ ID NO: 832109 - DNA, 25 bp, Mus musculus
tctgacccgccaggaccatgaggga

SEQ ID NO: 832110 - DNA, 25 bp, Mus musculus
tctgacccgtcgaggactgtcacct

SEQ ID NO: 832111 - DNA, 25 bp, Mus musculus
tctgacccgtcgtggactgtcacct

SEQ ID NO: 832112 - DNA, 25 bp, Mus musculus
tctgaccctcttaatcgtctgtgaa

SEQ ID NO: 832113 - DNA, 25 bp, Mus musculus
tctgaccctctttatcgtctgtgaa

SEQ ID NO: 832114 - DNA, 25 bp, Mus musculus
tctgaccgaattctgtgatggcatt

SEQ ID NO: 832115 - DNA, 25 bp, Mus musculus
tctgaccgaattgtgtgatggcatt

SEQ ID NO: 832116 - DNA, 25 bp, Mus musculus
tctgaccgatgcatgtgaattgtgt

SEQ ID NO: 832117 - DNA, 25 bp, Mus musculus
tctgaccgatgcttgtgaattgtgt

SEQ ID NO: 832118 - DNA, 25 bp, Mus musculus
tctgaccgccttagagttgctaatg

SEQ ID NO: 832119 - DNA, 25 bp, Mus musculus
tctgaccgcctttgagttgctaatg

SEQ ID NO: 832120 - DNA, 25 bp, Mus musculus
tctgaccgggccagcatcatgggta

SEQ ID NO: 832121 - DNA, 25 bp, Mus musculus
tctgaccgggcctgcatcatgggta

SEQ ID NO: 832122 - DNA, 25 bp, Mus musculus
tctgaccggtctcacatgaaagact

SEQ ID NO: 832123 - DNA, 25 bp, Mus musculus
tctgaccggtctgacatgaaagact

SEQ ID NO: 832124 - DNA, 25 bp, Mus musculus
tctgacctaaacatgcatgtaccac

SEQ ID NO: 832125 - DNA, 25 bp, Mus musculus
tctgacctaaacttgcatgtaccac

SEQ ID NO: 832126 - DNA, 25 bp, Mus musculus
tctgacctaaccacttttctgttgc

SEQ ID NO: 832127 - DNA, 25 bp, Mus musculus
tctgacctaacctcttttctgttgc

SEQ ID NO: 832128 - DNA, 25 bp, Mus musculus
tctgacctaagacgccagctgagag

SEQ ID NO: 832129 - DNA, 25 bp, Mus musculus
tctgacctaagaggccagctgagag

SEQ ID NO: 832130 - DNA, 25 bp, Mus musculus
tctgacctacccagtcctatatggt

SEQ ID NO: 832131 - DNA, 25 bp, Mus musculus
tctgacctaccctgtcctatatggt

SEQ ID NO: 832132 - DNA, 25 bp, Mus musculus
tctgacctatttctagagaatgcta

SEQ ID NO: 832133 - DNA, 25 bp, Mus musculus
tctgacctatttgtagagaatgcta

SEQ ID NO: 832134 - DNA, 25 bp, Mus musculus
tctgacctcacaactttggtgctgt

SEQ ID NO: 832135 - DNA, 25 bp, Mus musculus
tctgacctcacatctttggtgctgt

SEQ ID NO: 832136 - DNA, 25 bp, Mus musculus
tctgacctccacaattgatcaccaa

SEQ ID NO: 832137 - DNA, 25 bp, Mus musculus
tctgacctccactattgatcaccaa

SEQ ID NO: 832138 - DNA, 25 bp, Mus musculus
tctgacctccatagtcatgctgtga

SEQ ID NO: 832139 - DNA, 25 bp, Mus musculus
tctgacctccattgtcatgctgtga

SEQ ID NO: 832140 - DNA, 25 bp, Mus musculus
tctgacctcgagcactgttgaaata

SEQ ID NO: 832141 - DNA, 25 bp, Mus musculus
tctgacctcgaggactgttgaaata

SEQ ID NO: 832142 - DNA, 25 bp, Mus musculus
tctgacctcggtattttcctttacg

SEQ ID NO: 832143 - DNA, 25 bp, Mus musculus
tctgacctcggttttttcctttacg

SEQ ID NO: 832144 - DNA, 25 bp, Mus musculus
tctgacctctacatgctaactctga

SEQ ID NO: 832145 - DNA, 25 bp, Mus musculus
tctgacctctacttgctaactctga

SEQ ID NO: 832146 - DNA, 25 bp, Mus musculus
tctgacctctcgacaggaagcagtg

SEQ ID NO: 832147 - DNA, 25 bp, Mus musculus
tctgacctctcgtcaggaagcagtg

SEQ ID NO: 832148 - DNA, 25 bp, Mus musculus
tctgacctgagtatcctacggtaca

SEQ ID NO: 832149 - DNA, 25 bp, Mus musculus
tctgacctgagtttcctacggtaca

SEQ ID NO: 832150 - DNA, 25 bp, Mus musculus
tctgacctgcacacaatggcacagt

SEQ ID NO: 832151 - DNA, 25 bp, Mus musculus
tctgacctgcactcaatggcacagt

SEQ ID NO: 832152 - DNA, 25 bp, Mus musculus
tctgacctgccacggacatgagttt

SEQ ID NO: 832153 - DNA, 25 bp, Mus musculus
tctgacctgccagggacatgagttt

SEQ ID NO: 832154 - DNA, 25 bp, Mus musculus
tctgacctgctacatataacctact

SEQ ID NO: 832155 - DNA, 25 bp, Mus musculus
tctgacctgctagatataacctact

SEQ ID NO: 832156 - DNA, 25 bp, Mus musculus
tctgacctggaaatatcctttcaaa

SEQ ID NO: 832157 - DNA, 25 bp, Mus musculus
tctgacctggaattatcctttcaaa

SEQ ID NO: 832158 - DNA, 25 bp, Mus musculus
tctgacctggctaaactctaaactg

SEQ ID NO: 832159 - DNA, 25 bp, Mus musculus
tctgacctggcttaactctaaactg

SEQ ID NO: 832160 - DNA, 25 bp, Mus musculus
tctgacctgggcagatggacaaaca

SEQ ID NO: 832161 - DNA, 25 bp, Mus musculus
tctgacctgggccagagcttaaccc

SEQ ID NO: 832162 - DNA, 25 bp, Mus musculus
tctgacctgggcgagagcttaaccc

SEQ ID NO: 832163 - DNA, 25 bp, Mus musculus
tctgacctgggctgatggacaaaca

SEQ ID NO: 832164 - DNA, 25 bp, Mus musculus
tctgacctgtgcctatttttctctc

SEQ ID NO: 832165 - DNA, 25 bp, Mus musculus
tctgacctgtgcgtatttttctctc

SEQ ID NO: 832166 - DNA, 25 bp, Mus musculus
tctgaccttccaatgatccttcatt

SEQ ID NO: 832167 - DNA, 25 bp, Mus musculus
tctgaccttccattgatccttcatt

SEQ ID NO: 832168 - DNA, 25 bp, Mus musculus
tctgaccttgacaccaatcgggaag

SEQ ID NO: 832169 - DNA, 25 bp, Mus musculus
tctgaccttgactccaatcgggaag

SEQ ID NO: 832170 - DNA, 25 bp, Mus musculus
tctgaccttggacgcgcatgctgca

SEQ ID NO: 832171 - DNA, 25 bp, Mus musculus
tctgaccttggaggcgcatgctgca

SEQ ID NO: 832172 - DNA, 25 bp, Mus musculus
tctgaccttgtcaatactatttttg

SEQ ID NO: 832173 - DNA, 25 bp, Mus musculus
tctgaccttgtcaggagaattctaa

SEQ ID NO: 832174 - DNA, 25 bp, Mus musculus
tctgaccttgtctatactatttttg

SEQ ID NO: 832175 - DNA, 25 bp, Mus musculus
tctgaccttgtctggagaattctaa

SEQ ID NO: 832176 - DNA, 25 bp, Mus musculus
tctgaccttgttacacaaccttgta

SEQ ID NO: 832177 - DNA, 25 bp, Mus musculus
tctgaccttgtttcacaaccttgta

SEQ ID NO: 832178 - DNA, 25 bp, Mus musculus
tctgacgaatggactgacactcaag

SEQ ID NO: 832179 - DNA, 25 bp, Mus musculus
tctgacgaatggtctgacactcaag

SEQ ID NO: 832180 - DNA, 25 bp, Mus musculus
tctgacgactctctggtctattatt

SEQ ID NO: 832181 - DNA, 25 bp, Mus musculus
tctgacgactctgtggtctattatt

SEQ ID NO: 832182 - DNA, 25 bp, Mus musculus
tctgacgatatgatgcatgctttct

SEQ ID NO: 832183 - DNA, 25 bp, Mus musculus
tctgacgatatgttgcatgctttct

SEQ ID NO: 832184 - DNA, 25 bp, Mus musculus
tctgacggctctagggggcttatat

SEQ ID NO: 832185 - DNA, 25 bp, Mus musculus
tctgacggctcttgggggcttatat

SEQ ID NO: 832186 - DNA, 25 bp, Mus musculus
tctgacgtccgtattgttttactgt

SEQ ID NO: 832187 - DNA, 25 bp, Mus musculus
tctgacgtccgttttgttttactgt

SEQ ID NO: 832188 - DNA, 25 bp, Mus musculus
tctgacgtgccgcctggagaaacct

SEQ ID NO: 832189 - DNA, 25 bp, Mus musculus
tctgacgtgccggctggagaaacct

SEQ ID NO: 832190 - DNA, 25 bp, Mus musculus
tctgacgtgtttagagttgtgtttg

SEQ ID NO: 832191 - DNA, 25 bp, Mus musculus
tctgacgtgttttgagttgtgtttg

SEQ ID NO: 832192 - DNA, 25 bp, Mus musculus
tctgacgttcacagtttcctttcta

SEQ ID NO: 832193 - DNA, 25 bp, Mus musculus
tctgacgttcactgtttcctttcta

SEQ ID NO: 832194 - DNA, 25 bp, Mus musculus
tctgacgttttgagtatctatttat

SEQ ID NO: 832195 - DNA, 25 bp, Mus musculus
tctgacgttttgtgtatctatttat

SEQ ID NO: 832196 - DNA, 25 bp, Mus musculus
tctgactagagactggctgaagccg

SEQ ID NO: 832197 - DNA, 25 bp, Mus musculus
tctgactagagagtggctgaagccg

SEQ ID NO: 832198 - DNA, 25 bp, Mus musculus
tctgactattgcagacaccctctgg

SEQ ID NO: 832199 - DNA, 25 bp, Mus musculus
tctgactattgctgacaccctctgg

SEQ ID NO: 832200 - DNA, 25 bp, Mus musculus
tctgactcattaacctctgtggtaa

SEQ ID NO: 832201 - DNA, 25 bp, Mus musculus
tctgactcattatcctctgtggtaa

SEQ ID NO: 832202 - DNA, 25 bp, Mus musculus
tctgactccagaacgtgggtggcta

SEQ ID NO: 832203 - DNA, 25 bp, Mus musculus
tctgactccagatcgtgggtggcta

SEQ ID NO: 832204 - DNA, 25 bp, Mus musculus
tctgactccagcaactgtcctcagt

SEQ ID NO: 832205 - DNA, 25 bp, Mus musculus
tctgactccagctactgtcctcagt

SEQ ID NO: 832206 - DNA, 25 bp, Mus musculus
tctgactcccgcatcaatggtgtct

SEQ ID NO: 832207 - DNA, 25 bp, Mus musculus
tctgactcccgcttcaatggtgtct

SEQ ID NO: 832208 - DNA, 25 bp, Mus musculus
tctgactccctgattcttgaagtaa

SEQ ID NO: 832209 - DNA, 25 bp, Mus musculus
tctgactccctgtttcttgaagtaa

SEQ ID NO: 832210 - DNA, 25 bp, Mus musculus
tctgactccttgatgcagggcataa

SEQ ID NO: 832211 - DNA, 25 bp, Mus musculus
tctgactccttgttgcagggcataa

SEQ ID NO: 832212 - DNA, 25 bp, Mus musculus
tctgactcctttcctacaggatcca

SEQ ID NO: 832213 - DNA, 25 bp, Mus musculus
tctgactcctttgctacaggatcca

SEQ ID NO: 832214 - DNA, 25 bp, Mus musculus
tctgactctctgattgtttctccga

SEQ ID NO: 832215 - DNA, 25 bp, Mus musculus
tctgactctctgtttgtttctccga

SEQ ID NO: 832216 - DNA, 25 bp, Mus musculus
tctgactctgaaaccacttccagaa

SEQ ID NO: 832217 - DNA, 25 bp, Mus musculus
tctgactctgaatccacttccagaa

SEQ ID NO: 832218 - DNA, 25 bp, Mus musculus
tctgactctggcacagcctgtattc

SEQ ID NO: 832219 - DNA, 25 bp, Mus musculus
tctgactctggctcagcctgtattc

SEQ ID NO: 832220 - DNA, 25 bp, Mus musculus
tctgactctgtgattactaacatca

SEQ ID NO: 832221 - DNA, 25 bp, Mus musculus
tctgactctgtgtttactaacatca

SEQ ID NO: 832222 - DNA, 25 bp, Mus musculus
tctgactcttaacacaggatcatcc

SEQ ID NO: 832223 - DNA, 25 bp, Mus musculus
tctgactcttaagacaggatcatcc

SEQ ID NO: 832224 - DNA, 25 bp, Mus musculus
tctgactcttgaccgctagattact

SEQ ID NO: 832225 - DNA, 25 bp, Mus musculus
tctgactcttgagcgctagattact

SEQ ID NO: 832226 - DNA, 25 bp, Mus musculus
tctgactgagacatgtttgtacaaa

SEQ ID NO: 832227 - DNA, 25 bp, Mus musculus
tctgactgagacttgtttgtacaaa

SEQ ID NO: 832228 - DNA, 25 bp, Mus musculus
tctgactgagggagcttgtttctca

SEQ ID NO: 832229 - DNA, 25 bp, Mus musculus
tctgactgagggtgcttgtttctca

SEQ ID NO: 832230 - DNA, 25 bp, Mus musculus
tctgactgccttcctagtgttacca

SEQ ID NO: 832231 - DNA, 25 bp, Mus musculus
tctgactgccttgctagtgttacca

SEQ ID NO: 832232 - DNA, 25 bp, Mus musculus
tctgactgcgctatgttacttgatt

SEQ ID NO: 832233 - DNA, 25 bp, Mus musculus
tctgactgcgctttgttacttgatt

SEQ ID NO: 832234 - DNA, 25 bp, Mus musculus
tctgactgcggcaggagatgagtac

SEQ ID NO: 832235 - DNA, 25 bp, Mus musculus
tctgactgcggctggagatgagtac

SEQ ID NO: 832236 - DNA, 25 bp, Mus musculus
tctgactggaagcaacttgtgcccc

SEQ ID NO: 832237 - DNA, 25 bp, Mus musculus
tctgactggaaggaacttgtgcccc

SEQ ID NO: 832238 - DNA, 25 bp, Mus musculus
tctgactgtcatccttcacgaaaga

SEQ ID NO: 832239 - DNA, 25 bp, Mus musculus
tctgactgtcatgcttcacgaaaga

SEQ ID NO: 832240 - DNA, 25 bp, Mus musculus
tctgactgtgaccaccagccttgca

SEQ ID NO: 832241 - DNA, 25 bp, Mus musculus
tctgactgtgacgaccagccttgca

SEQ ID NO: 832242 - DNA, 25 bp, Mus musculus
tctgacttacacacatgcaccatgg

SEQ ID NO: 832243 - DNA, 25 bp, Mus musculus
tctgacttacactcatgcaccatgg

SEQ ID NO: 832244 - DNA, 25 bp, Mus musculus
tctgacttagtcattgttcttgaga

SEQ ID NO: 832245 - DNA, 25 bp, Mus musculus
tctgacttagtctttgttcttgaga

SEQ ID NO: 832246 - DNA, 25 bp, Mus musculus
tctgacttatttagcatgaaatatt

SEQ ID NO: 832247 - DNA, 25 bp, Mus musculus
tctgacttattttgcatgaaatatt

SEQ ID NO: 832248 - DNA, 25 bp, Mus musculus
tctgacttcaacattaaagactact

SEQ ID NO: 832249 - DNA, 25 bp, Mus musculus
tctgacttcaactttaaagactact

SEQ ID NO: 832250 - DNA, 25 bp, Mus musculus
tctgacttcaagaggacagtggtta

SEQ ID NO: 832251 - DNA, 25 bp, Mus musculus
tctgacttcaagtggacagtggtta

SEQ ID NO: 832252 - DNA, 25 bp, Mus musculus
tctgacttcagacttctacaaattg

SEQ ID NO: 832253 - DNA, 25 bp, Mus musculus
tctgacttcagagttctacaaattg

SEQ ID NO: 832254 - DNA, 25 bp, Mus musculus
tctgacttcagtctgtattgtgaca

SEQ ID NO: 832255 - DNA, 25 bp, Mus musculus
tctgacttcagtgtgtattgtgaca

SEQ ID NO: 832256 - DNA, 25 bp, Mus musculus
tctgacttcatacattgataccatt

SEQ ID NO: 832257 - DNA, 25 bp, Mus musculus
tctgacttcatagattgataccatt

SEQ ID NO: 832258 - DNA, 25 bp, Mus musculus
tctgacttccccagcaggtctaatt

SEQ ID NO: 832259 - DNA, 25 bp, Mus musculus
tctgacttcccctgcaggtctaatt

SEQ ID NO: 832260 - DNA, 25 bp, Mus musculus
tctgacttcctgactttttgttgag

SEQ ID NO: 832261 - DNA, 25 bp, Mus musculus
tctgacttcctgtctttttgttgag

SEQ ID NO: 832262 - DNA, 25 bp, Mus musculus
tctgacttccttctgggttggtact

SEQ ID NO: 832263 - DNA, 25 bp, Mus musculus
tctgacttccttgtgggttggtact

SEQ ID NO: 832264 - DNA, 25 bp, Mus musculus
tctgacttctcaactgtacaatgtt

SEQ ID NO: 832265 - DNA, 25 bp, Mus musculus
tctgacttctcatctgtacaatgtt

SEQ ID NO: 832266 - DNA, 25 bp, Mus musculus
tctgacttcttacacaatctccacg

SEQ ID NO: 832267 - DNA, 25 bp, Mus musculus
tctgacttcttagacaatctccacg

SEQ ID NO: 832268 - DNA, 25 bp, Mus musculus
tctgacttcttgacatcatcatcac

SEQ ID NO: 832269 - DNA, 25 bp, Mus musculus
tctgacttcttgtcatcatcatcac

SEQ ID NO: 832270 - DNA, 25 bp, Mus musculus
tctgacttgaatatccataaacctt

SEQ ID NO: 832271 - DNA, 25 bp, Mus musculus
tctgacttgaatttccataaacctt

SEQ ID NO: 832272 - DNA, 25 bp, Mus musculus
tctgactttatccaccctgggaaga

SEQ ID NO: 832273 - DNA, 25 bp, Mus musculus
tctgactttatcgaccctgggaaga

SEQ ID NO: 832274 - DNA, 25 bp, Mus musculus
tctgactttattactctcgctttaa

SEQ ID NO: 832275 - DNA, 25 bp, Mus musculus
tctgactttatttctctcgctttaa

SEQ ID NO: 832276 - DNA, 25 bp, Mus musculus
tctgactttctgctgcgttcccggg

SEQ ID NO: 832277 - DNA, 25 bp, Mus musculus
tctgactttctggtgcgttcccggg

SEQ ID NO: 832278 - DNA, 25 bp, Mus musculus
tctgactttgtccttggtgtttgtt

SEQ ID NO: 832279 - DNA, 25 bp, Mus musculus
tctgactttgtcgttggtgtttgtt

SEQ ID NO: 832280 - DNA, 25 bp, Mus musculus
tctgacttttccaaagccccagaaa

SEQ ID NO: 832281 - DNA, 25 bp, Mus musculus
tctgacttttcctaagccccagaaa

SEQ ID NO: 832282 - DNA, 25 bp, Mus musculus
tctgagaaattgcacacgtgtgtgt

SEQ ID NO: 832283 - DNA, 25 bp, Mus musculus
tctgagaaattggacacgtgtgtgt

SEQ ID NO: 832284 - DNA, 25 bp, Mus musculus
tctgagaacaacaccttggtctttt

SEQ ID NO: 832285 - DNA, 25 bp, Mus musculus
tctgagaacaactccttggtctttt

SEQ ID NO: 832286 - DNA, 25 bp, Mus musculus
tctgagaagtgtccaggcagcgcca

SEQ ID NO: 832287 - DNA, 25 bp, Mus musculus
tctgagaagtgtgcaggcagcgcca

SEQ ID NO: 832288 - DNA, 25 bp, Mus musculus
tctgagaagttcctgctcctggctt

SEQ ID NO: 832289 - DNA, 25 bp, Mus musculus
tctgagaagttcgtgctcctggctt

SEQ ID NO: 832290 - DNA, 25 bp, Mus musculus
tctgagaccccactgttcaaagttt

SEQ ID NO: 832291 - DNA, 25 bp, Mus musculus
tctgagaccccagtgttcaaagttt

SEQ ID NO: 832292 - DNA, 25 bp, Mus musculus
tctgagaccgatagctacttaattg

SEQ ID NO: 832293 - DNA, 25 bp, Mus musculus
tctgagaccgattgctacttaattg

SEQ ID NO: 832294 - DNA, 25 bp, Mus musculus
tctgagagacctcctggaaatcagt

SEQ ID NO: 832295 - DNA, 25 bp, Mus musculus
tctgagagacctgctggaaatcagt

SEQ ID NO: 832296 - DNA, 25 bp, Mus musculus
tctgagagattaaaggcttgcccat

SEQ ID NO: 832297 - DNA, 25 bp, Mus musculus
tctgagagattataggcttgcccat

SEQ ID NO: 832298 - DNA, 25 bp, Mus musculus
tctgagaggatgagttccaggtccc

SEQ ID NO: 832299 - DNA, 25 bp, Mus musculus
tctgagaggatgtgttccaggtccc

SEQ ID NO: 832300 - DNA, 25 bp, Mus musculus
tctgagaggctcaaataccggaaga

SEQ ID NO: 832301 - DNA, 25 bp, Mus musculus
tctgagaggctctaataccggaaga

SEQ ID NO: 832302 - DNA, 25 bp, Mus musculus
tctgagagggtccatgcagtcacag

SEQ ID NO: 832303 - DNA, 25 bp, Mus musculus
tctgagagggtcgatgcagtcacag

SEQ ID NO: 832304 - DNA, 25 bp, Mus musculus
tctgagaggttgacttccacaccca

SEQ ID NO: 832305 - DNA, 25 bp, Mus musculus
tctgagaggttgtcttccacaccca

SEQ ID NO: 832306 - DNA, 25 bp, Mus musculus
tctgagatcatgaggatgccttccc

SEQ ID NO: 832307 - DNA, 25 bp, Mus musculus
tctgagatcatgtggatgccttccc

SEQ ID NO: 832308 - DNA, 25 bp, Mus musculus
tctgagatctccctgctgtggctct

SEQ ID NO: 832309 - DNA, 25 bp, Mus musculus
tctgagatctccgtgctgtggctct

SEQ ID NO: 832310 - DNA, 25 bp, Mus musculus
tctgagatctttaactcttcttttc

SEQ ID NO: 832311 - DNA, 25 bp, Mus musculus
tctgagatcttttactcttcttttc

SEQ ID NO: 832312 - DNA, 25 bp, Mus musculus
tctgagatgaggacggtgcttgcca

SEQ ID NO: 832313 - DNA, 25 bp, Mus musculus
tctgagatgaggtcggtgcttgcca

SEQ ID NO: 832314 - DNA, 25 bp, Mus musculus
tctgagatgtggactgtgtcctgga

SEQ ID NO: 832315 - DNA, 25 bp, Mus musculus
tctgagatgtggtctgtgtcctgga

SEQ ID NO: 832316 - DNA, 25 bp, Mus musculus
tctgagattccactgcttctgttgt

SEQ ID NO: 832317 - DNA, 25 bp, Mus musculus
tctgagattccagtgcttctgttgt

SEQ ID NO: 832318 - DNA, 25 bp, Mus musculus
tctgagattgggagccgccgacact

SEQ ID NO: 832319 - DNA, 25 bp, Mus musculus
tctgagattgggtgccgccgacact

SEQ ID NO: 832320 - DNA, 25 bp, Mus musculus
tctgagatttctacacttgctttct

SEQ ID NO: 832321 - DNA, 25 bp, Mus musculus
tctgagatttcttcacttgctttct

SEQ ID NO: 832322 - DNA, 25 bp, Mus musculus
tctgagcaccttaatccatgttgaa

SEQ ID NO: 832323 - DNA, 25 bp, Mus musculus
tctgagcacctttatccatgttgaa

SEQ ID NO: 832324 - DNA, 25 bp, Mus musculus
tctgagcagaggctaagcaccacac

SEQ ID NO: 832325 - DNA, 25 bp, Mus musculus
tctgagcagagggtaagcaccacac

SEQ ID NO: 832326 - DNA, 25 bp, Mus musculus
tctgagcagatcagtcacatccact

SEQ ID NO: 832327 - DNA, 25 bp, Mus musculus
tctgagcagatctgtcacatccact

SEQ ID NO: 832328 - DNA, 25 bp, Mus musculus
tctgagcagcagagttgttccaatg

SEQ ID NO: 832329 - DNA, 25 bp, Mus musculus
tctgagcagcagtgttgttccaatg

SEQ ID NO: 832330 - DNA, 25 bp, Mus musculus
tctgagcagccgagtattaaacttc

SEQ ID NO: 832331 - DNA, 25 bp, Mus musculus
tctgagcagccgtgtattaaacttc

SEQ ID NO: 832332 - DNA, 25 bp, Mus musculus
tctgagcaggcgaggcaacttgaga

SEQ ID NO: 832333 - DNA, 25 bp, Mus musculus
tctgagcaggcgtggcaacttgaga

SEQ ID NO: 832334 - DNA, 25 bp, Mus musculus
tctgagcatagaactgcgagggctt

SEQ ID NO: 832335 - DNA, 25 bp, Mus musculus
tctgagcatagatctgcgagggctt

SEQ ID NO: 832336 - DNA, 25 bp, Mus musculus
tctgagcatcacacgagctgtgcgc

SEQ ID NO: 832337 - DNA, 25 bp, Mus musculus
tctgagcatcactcgagctgtgcgc

SEQ ID NO: 832338 - DNA, 25 bp, Mus musculus
tctgagcatcagacttgtgtctaga

SEQ ID NO: 832339 - DNA, 25 bp, Mus musculus
tctgagcatcagtcttgtgtctaga

SEQ ID NO: 832340 - DNA, 25 bp, Mus musculus
tctgagcatgaaagccacaccattt

SEQ ID NO: 832341 - DNA, 25 bp, Mus musculus
tctgagcatgaatgccacaccattt

SEQ ID NO: 832342 - DNA, 25 bp, Mus musculus
tctgagccaaaaattgaccaacctg

SEQ ID NO: 832343 - DNA, 25 bp, Mus musculus
tctgagccaaaatttgaccaacctg

SEQ ID NO: 832344 - DNA, 25 bp, Mus musculus
tctgagccacatcagcactacattt

SEQ ID NO: 832345 - DNA, 25 bp, Mus musculus
tctgagccacatgagcactacattt

SEQ ID NO: 832346 - DNA, 25 bp, Mus musculus
tctgagccagagattgggacccggc

SEQ ID NO: 832347 - DNA, 25 bp, Mus musculus
tctgagccagagcagtgcctctcca

SEQ ID NO: 832348 - DNA, 25 bp, Mus musculus
tctgagccagaggagtgcctctcca

SEQ ID NO: 832349 - DNA, 25 bp, Mus musculus
tctgagccagagtttgggacccggc

SEQ ID NO: 832350 - DNA, 25 bp, Mus musculus
tctgagccaggccccaggatggagg

SEQ ID NO: 832351 - DNA, 25 bp, Mus musculus
tctgagccaggcgccaggatggagg

SEQ ID NO: 832352 - DNA, 25 bp, Mus musculus
tctgagcccctcagggaccatggag

SEQ ID NO: 832353 - DNA, 25 bp, Mus musculus
tctgagcccctctgggaccatggag

SEQ ID NO: 832354 - DNA, 25 bp, Mus musculus
tctgagccctggaacactgcttagc

SEQ ID NO: 832355 - DNA, 25 bp, Mus musculus
tctgagccctggtacactgcttagc

SEQ ID NO: 832356 - DNA, 25 bp, Mus musculus
tctgagccgtagacccatagcaggt

SEQ ID NO: 832357 - DNA, 25 bp, Mus musculus
tctgagccgtagtcccatagcaggt

SEQ ID NO: 832358 - DNA, 25 bp, Mus musculus
tctgagcctagtctttgctttgtga

SEQ ID NO: 832359 - DNA, 25 bp, Mus musculus
tctgagcctagtgtttgctttgtga

SEQ ID NO: 832360 - DNA, 25 bp, Mus musculus
tctgagcctattactgtagcccctt

SEQ ID NO: 832361 - DNA, 25 bp, Mus musculus
tctgagcctatttctgtagcccctt

SEQ ID NO: 832362 - DNA, 25 bp, Mus musculus
tctgagcctcccactgaaacagagg

SEQ ID NO: 832363 - DNA, 25 bp, Mus musculus
tctgagcctccctctgaaacagagg

SEQ ID NO: 832364 - DNA, 25 bp, Mus musculus
tctgagcctgggaggccaccgtgcc

SEQ ID NO: 832365 - DNA, 25 bp, Mus musculus
tctgagcctgggtggccaccgtgcc

SEQ ID NO: 832366 - DNA, 25 bp, Mus musculus
tctgagccttctcagaggaagcccc

SEQ ID NO: 832367 - DNA, 25 bp, Mus musculus
tctgagccttctgagaggaagcccc

SEQ ID NO: 832368 - DNA, 25 bp, Mus musculus
tctgagcgcaggctcacacgcatgg

SEQ ID NO: 832369 - DNA, 25 bp, Mus musculus
tctgagcgcagggtcacacgcatgg

SEQ ID NO: 832370 - DNA, 25 bp, Mus musculus
tctgagcgcttgaagagggcttcgt

SEQ ID NO: 832371 - DNA, 25 bp, Mus musculus
tctgagcgcttgtagagggcttcgt

SEQ ID NO: 832372 - DNA, 25 bp, Mus musculus
tctgagcggcgcagtagtctactac

SEQ ID NO: 832373 - DNA, 25 bp, Mus musculus
tctgagcggcgctgtagtctactac

SEQ ID NO: 832374 - DNA, 25 bp, Mus musculus
tctgagctaattacctcagctccac

SEQ ID NO: 832375 - DNA, 25 bp, Mus musculus
tctgagctaatttcctcagctccac

SEQ ID NO: 832376 - DNA, 25 bp, Mus musculus
tctgagctagagagttgtggccact

SEQ ID NO: 832377 - DNA, 25 bp, Mus musculus
tctgagctagagtgttgtggccact

SEQ ID NO: 832378 - DNA, 25 bp, Mus musculus
tctgagctaggacgctttaccgctg

SEQ ID NO: 832379 - DNA, 25 bp, Mus musculus
tctgagctaggaggctttaccgctg

SEQ ID NO: 832380 - DNA, 25 bp, Mus musculus
tctgagctcaaacccagatcctaag

SEQ ID NO: 832381 - DNA, 25 bp, Mus musculus
tctgagctcaaagccagatcctaag

SEQ ID NO: 832382 - DNA, 25 bp, Mus musculus
tctgagctcatgacaacatattgca

SEQ ID NO: 832383 - DNA, 25 bp, Mus musculus
tctgagctcatgtcaacatattgca

SEQ ID NO: 832384 - DNA, 25 bp, Mus musculus
tctgagctccatctttggacacttc

SEQ ID NO: 832385 - DNA, 25 bp, Mus musculus
tctgagctccatgtttggacacttc

SEQ ID NO: 832386 - DNA, 25 bp, Mus musculus
tctgagctccgcatggacacatacc

SEQ ID NO: 832387 - DNA, 25 bp, Mus musculus
tctgagctccgcttggacacatacc

SEQ ID NO: 832388 - DNA, 25 bp, Mus musculus
tctgagctctgtcacaatatttgca

SEQ ID NO: 832389 - DNA, 25 bp, Mus musculus
tctgagctctgtgacaatatttgca

SEQ ID NO: 832390 - DNA, 25 bp, Mus musculus
tctgagctcttgctacagtcgcctt

SEQ ID NO: 832391 - DNA, 25 bp, Mus musculus
tctgagctcttggtacagtcgcctt

SEQ ID NO: 832392 - DNA, 25 bp, Mus musculus
tctgagctgatacccgaagagccag

SEQ ID NO: 832393 - DNA, 25 bp, Mus musculus
tctgagctgatagccgaagagccag

SEQ ID NO: 832394 - DNA, 25 bp, Mus musculus
tctgagcttaatattcccctgcagc

SEQ ID NO: 832395 - DNA, 25 bp, Mus musculus
tctgagcttaattttcccctgcagc

SEQ ID NO: 832396 - DNA, 25 bp, Mus musculus
tctgagcttactctcactactgttc

SEQ ID NO: 832397 - DNA, 25 bp, Mus musculus
tctgagcttactgtcactactgttc

SEQ ID NO: 832398 - DNA, 25 bp, Mus musculus
tctgagcttgctcgtagccattgca

SEQ ID NO: 832399 - DNA, 25 bp, Mus musculus
tctgagcttgctggtagccattgca

SEQ ID NO: 832400 - DNA, 25 bp, Mus musculus
tctgagcttttaacgttatcccttc

SEQ ID NO: 832401 - DNA, 25 bp, Mus musculus
tctgagcttttatcgttatcccttc

SEQ ID NO: 832402 - DNA, 25 bp, Mus musculus
tctgaggaaacaatcactgcaggtg

SEQ ID NO: 832403 - DNA, 25 bp, Mus musculus
tctgaggaaacattcactgcaggtg

SEQ ID NO: 832404 - DNA, 25 bp, Mus musculus
tctgaggaaatccatgtttttgcat

SEQ ID NO: 832405 - DNA, 25 bp, Mus musculus
tctgaggaaatcgatgtttttgcat

SEQ ID NO: 832406 - DNA, 25 bp, Mus musculus
tctgaggacaaaagcctggcccgtg

SEQ ID NO: 832407 - DNA, 25 bp, Mus musculus
tctgaggacaaatgcctggcccgtg

SEQ ID NO: 832408 - DNA, 25 bp, Mus musculus
tctgaggacatgagcacaggtgcct

SEQ ID NO: 832409 - DNA, 25 bp, Mus musculus
tctgaggacatgtgcacaggtgcct

SEQ ID NO: 832410 - DNA, 25 bp, Mus musculus
tctgaggaccagaacactctgatgg

SEQ ID NO: 832411 - DNA, 25 bp, Mus musculus
tctgaggaccagtacactctgatgg

SEQ ID NO: 832412 - DNA, 25 bp, Mus musculus
tctgaggaggataagcacgtgcata

SEQ ID NO: 832413 - DNA, 25 bp, Mus musculus
tctgaggaggattagcacgtgcata

SEQ ID NO: 832414 - DNA, 25 bp, Mus musculus
tctgaggagtgaattgcaacgcaat

SEQ ID NO: 832415 - DNA, 25 bp, Mus musculus
tctgaggagtgatttgcaacgcaat

SEQ ID NO: 832416 - DNA, 25 bp, Mus musculus
tctgaggagtggatcctccaagata

SEQ ID NO: 832417 - DNA, 25 bp, Mus musculus
tctgaggagtggttcctccaagata

SEQ ID NO: 832418 - DNA, 25 bp, Mus musculus
tctgaggagttcatggttgttacca

SEQ ID NO: 832419 - DNA, 25 bp, Mus musculus
tctgaggagttcttggttgttacca

SEQ ID NO: 832420 - DNA, 25 bp, Mus musculus
tctgaggatattccttcgcccttac

SEQ ID NO: 832421 - DNA, 25 bp, Mus musculus
tctgaggatattgcttcgcccttac

SEQ ID NO: 832422 - DNA, 25 bp, Mus musculus
tctgaggatgagcactcaagagcca

SEQ ID NO: 832423 - DNA, 25 bp, Mus musculus
tctgaggatgaggactcaagagcca

SEQ ID NO: 832424 - DNA, 25 bp, Mus musculus
tctgaggcacgtacctctgatccaa

SEQ ID NO: 832425 - DNA, 25 bp, Mus musculus
tctgaggcacgttcctctgatccaa

SEQ ID NO: 832426 - DNA, 25 bp, Mus musculus
tctgaggcacttagtttaggcaaag

SEQ ID NO: 832427 - DNA, 25 bp, Mus musculus
tctgaggcactttgtttaggcaaag

SEQ ID NO: 832428 - DNA, 25 bp, Mus musculus
tctgaggcagcaacgcctggtgcat

SEQ ID NO: 832429 - DNA, 25 bp, Mus musculus
tctgaggcagcatcgcctggtgcat

SEQ ID NO: 832430 - DNA, 25 bp, Mus musculus
tctgaggcagtccatgatatgagtt

SEQ ID NO: 832431 - DNA, 25 bp, Mus musculus
tctgaggcagtcgatgatatgagtt

SEQ ID NO: 832432 - DNA, 25 bp, Mus musculus
tctgaggcatgacaggtacacccct

SEQ ID NO: 832433 - DNA, 25 bp, Mus musculus
tctgaggcatgagaggtacacccct

SEQ ID NO: 832434 - DNA, 25 bp, Mus musculus
tctgaggcatggcacagccttgtct

SEQ ID NO: 832435 - DNA, 25 bp, Mus musculus
tctgaggcatgggacagccttgtct

SEQ ID NO: 832436 - DNA, 25 bp, Mus musculus
tctgaggccgcacaagctactgcag

SEQ ID NO: 832437 - DNA, 25 bp, Mus musculus
tctgaggccgcagaagctactgcag

SEQ ID NO: 832438 - DNA, 25 bp, Mus musculus
tctgaggccgccatcaccatcaggg

SEQ ID NO: 832439 - DNA, 25 bp, Mus musculus
tctgaggccgccttcaccatcaggg

SEQ ID NO: 832440 - DNA, 25 bp, Mus musculus
tctgaggcctccagcatgtctttat

SEQ ID NO: 832441 - DNA, 25 bp, Mus musculus
tctgaggcctcctgcatgtctttat

SEQ ID NO: 832442 - DNA, 25 bp, Mus musculus
tctgaggcctcgatgtccctctgaa

SEQ ID NO: 832443 - DNA, 25 bp, Mus musculus
tctgaggcctcgcactgaaagtgat

SEQ ID NO: 832444 - DNA, 25 bp, Mus musculus
tctgaggcctcggactgaaagtgat

SEQ ID NO: 832445 - DNA, 25 bp, Mus musculus
tctgaggcctcgttgtccctctgaa

SEQ ID NO: 832446 - DNA, 25 bp, Mus musculus
tctgaggcctggattgctcttaatc

SEQ ID NO: 832447 - DNA, 25 bp, Mus musculus
tctgaggcctggtttgctcttaatc

SEQ ID NO: 832448 - DNA, 25 bp, Mus musculus
tctgaggcggacaggactcgtgttc

SEQ ID NO: 832449 - DNA, 25 bp, Mus musculus
tctgaggcggactggactcgtgttc

SEQ ID NO: 832450 - DNA, 25 bp, Mus musculus
tctgaggctactactctattggtgc

SEQ ID NO: 832451 - DNA, 25 bp, Mus musculus
tctgaggctacttctctattggtgc

SEQ ID NO: 832452 - DNA, 25 bp, Mus musculus
tctgaggctccaattcttctgtgta

SEQ ID NO: 832453 - DNA, 25 bp, Mus musculus
tctgaggctccatttcttctgtgta

SEQ ID NO: 832454 - DNA, 25 bp, Mus musculus
tctgaggctctgctggattttgact

SEQ ID NO: 832455 - DNA, 25 bp, Mus musculus
tctgaggctctggtggattttgact

SEQ ID NO: 832456 - DNA, 25 bp, Mus musculus
tctgaggctggcaactgtttaggct

SEQ ID NO: 832457 - DNA, 25 bp, Mus musculus
tctgaggctggctactgtttaggct

SEQ ID NO: 832458 - DNA, 25 bp, Mus musculus
tctgaggctgtgctctctggatcca

SEQ ID NO: 832459 - DNA, 25 bp, Mus musculus
tctgaggctgtggtctctggatcca

SEQ ID NO: 832460 - DNA, 25 bp, Mus musculus
tctgaggcttctccaggctcaggaa

SEQ ID NO: 832461 - DNA, 25 bp, Mus musculus
tctgaggcttctgcaggctcaggaa

SEQ ID NO: 832462 - DNA, 25 bp, Mus musculus
tctgaggcttgacctcacagcaggc

SEQ ID NO: 832463 - DNA, 25 bp, Mus musculus
tctgaggcttgagctcacagcaggc

SEQ ID NO: 832464 - DNA, 25 bp, Mus musculus
tctgagggatgacagcttcttcctt

SEQ ID NO: 832465 - DNA, 25 bp, Mus musculus
tctgagggatgagagcttcttcctt

SEQ ID NO: 832466 - DNA, 25 bp, Mus musculus
tctgagggcaataacatgctgacgt

SEQ ID NO: 832467 - DNA, 25 bp, Mus musculus
tctgagggcaattacatgctgacgt

SEQ ID NO: 832468 - DNA, 25 bp, Mus musculus
tctgagggccccaactacttgacag

SEQ ID NO: 832469 - DNA, 25 bp, Mus musculus
tctgagggcccctactacttgacag

SEQ ID NO: 832470 - DNA, 25 bp, Mus musculus
tctgagggctgtactgaccccatct

SEQ ID NO: 832471 - DNA, 25 bp, Mus musculus
tctgagggctgttctgaccccatct

SEQ ID NO: 832472 - DNA, 25 bp, Mus musculus
tctgagggtactacaggtctggtga

SEQ ID NO: 832473 - DNA, 25 bp, Mus musculus
tctgagggtacttcaggtctggtga

SEQ ID NO: 832474 - DNA, 25 bp, Mus musculus
tctgagggtatcagttccctgtctg

SEQ ID NO: 832475 - DNA, 25 bp, Mus musculus
tctgagggtatctgttccctgtctg

SEQ ID NO: 832476 - DNA, 25 bp, Mus musculus
tctgagggtctcaggtaattctaac

SEQ ID NO: 832477 - DNA, 25 bp, Mus musculus
tctgagggtctctggtaattctaac

SEQ ID NO: 832478 - DNA, 25 bp, Mus musculus
tctgagggtgatcaacaactgaatt

SEQ ID NO: 832479 - DNA, 25 bp, Mus musculus
tctgagggtgatgaacaactgaatt

SEQ ID NO: 832480 - DNA, 25 bp, Mus musculus
tctgagggtgtgaccttgccaggcc

SEQ ID NO: 832481 - DNA, 25 bp, Mus musculus
tctgagggtgtgtccttgccaggcc

SEQ ID NO: 832482 - DNA, 25 bp, Mus musculus
tctgagggttccaagtagcttatca

SEQ ID NO: 832483 - DNA, 25 bp, Mus musculus
tctgagggttcctagtagcttatca

SEQ ID NO: 832484 - DNA, 25 bp, Mus musculus
tctgaggtagctcccactgtggaca

SEQ ID NO: 832485 - DNA, 25 bp, Mus musculus
tctgaggtagctgccactgtggaca

SEQ ID NO: 832486 - DNA, 25 bp, Mus musculus
tctgaggtagggagagccttctcac

SEQ ID NO: 832487 - DNA, 25 bp, Mus musculus
tctgaggtagggtgagccttctcac

SEQ ID NO: 832488 - DNA, 25 bp, Mus musculus
tctgaggtcaaaccagtccactgcc

SEQ ID NO: 832489 - DNA, 25 bp, Mus musculus
tctgaggtcaaagcagtccactgcc

SEQ ID NO: 832490 - DNA, 25 bp, Mus musculus
tctgaggtccagaacttctatttgc

SEQ ID NO: 832491 - DNA, 25 bp, Mus musculus
tctgaggtccagtacttctatttgc

SEQ ID NO: 832492 - DNA, 25 bp, Mus musculus
tctgaggtccccacaagtgtatttg

SEQ ID NO: 832493 - DNA, 25 bp, Mus musculus
tctgaggtcccctcaagtgtatttg

SEQ ID NO: 832494 - DNA, 25 bp, Mus musculus
tctgaggtcgggaatctaggctgaa

SEQ ID NO: 832495 - DNA, 25 bp, Mus musculus
tctgaggtcgggtatctaggctgaa

SEQ ID NO: 832496 - DNA, 25 bp, Mus musculus
tctgaggtctaactgagttgtgtgt

SEQ ID NO: 832497 - DNA, 25 bp, Mus musculus
tctgaggtctaagtgagttgtgtgt

SEQ ID NO: 832498 - DNA, 25 bp, Mus musculus
tctgaggtggagactcttcgagaga

SEQ ID NO: 832499 - DNA, 25 bp, Mus musculus
tctgaggtggagtctcttcgagaga

SEQ ID NO: 832500 - DNA, 25 bp, Mus musculus
tctgaggttaggctctcactaccac

SEQ ID NO: 832501 - DNA, 25 bp, Mus musculus
tctgaggttagggtctcactaccac

SEQ ID NO: 832502 - DNA, 25 bp, Mus musculus
tctgaggttcgcactttgcatttcc

SEQ ID NO: 832503 - DNA, 25 bp, Mus musculus
tctgaggttcgctctttgcatttcc

SEQ ID NO: 832504 - DNA, 25 bp, Mus musculus
tctgagtaagacacggcccaattcc

SEQ ID NO: 832505 - DNA, 25 bp, Mus musculus
tctgagtaagactcggcccaattcc

SEQ ID NO: 832506 - DNA, 25 bp, Mus musculus
tctgagtacacactgcaggaaagtc

SEQ ID NO: 832507 - DNA, 25 bp, Mus musculus
tctgagtacacagtgcaggaaagtc

SEQ ID NO: 832508 - DNA, 25 bp, Mus musculus
tctgagtactgtctgcatggctggt

SEQ ID NO: 832509 - DNA, 25 bp, Mus musculus
tctgagtactgtgtgcatggctggt

SEQ ID NO: 832510 - DNA, 25 bp, Mus musculus
tctgagtagaggctcggccagtcac

SEQ ID NO: 832511 - DNA, 25 bp, Mus musculus
tctgagtagagggtcggccagtcac

SEQ ID NO: 832512 - DNA, 25 bp, Mus musculus
tctgagtcagtcacacacaggctgt

SEQ ID NO: 832513 - DNA, 25 bp, Mus musculus
tctgagtcagtctcacacaggctgt

SEQ ID NO: 832514 - DNA, 25 bp, Mus musculus
tctgagtccaaaccctgggacgttt

SEQ ID NO: 832515 - DNA, 25 bp, Mus musculus
tctgagtccaaagcctgggacgttt

SEQ ID NO: 832516 - DNA, 25 bp, Mus musculus
tctgagtccagccacattgttatga

SEQ ID NO: 832517 - DNA, 25 bp, Mus musculus
tctgagtccagcgacattgttatga

SEQ ID NO: 832518 - DNA, 25 bp, Mus musculus
tctgagtcgggcacctgccagaagg

SEQ ID NO: 832519 - DNA, 25 bp, Mus musculus
tctgagtcgggctcctgccagaagg

SEQ ID NO: 832520 - DNA, 25 bp, Mus musculus
tctgagtctcaaaactgcctttgta

SEQ ID NO: 832521 - DNA, 25 bp, Mus musculus
tctgagtctcaatactgcctttgta

SEQ ID NO: 832522 - DNA, 25 bp, Mus musculus
tctgagtctgctattgctatcccgg

SEQ ID NO: 832523 - DNA, 25 bp, Mus musculus
tctgagtctgcttttgctatcccgg

SEQ ID NO: 832524 - DNA, 25 bp, Mus musculus
tctgagtgcatacaaaaagctctgg

SEQ ID NO: 832525 - DNA, 25 bp, Mus musculus
tctgagtgcatagaaaaagctctgg

SEQ ID NO: 832526 - DNA, 25 bp, Mus musculus
tctgagtgcccaagtagcttggaca

SEQ ID NO: 832527 - DNA, 25 bp, Mus musculus
tctgagtgcccatgtagcttggaca

SEQ ID NO: 832528 - DNA, 25 bp, Mus musculus
tctgagtggctcaaagtggccgcta

SEQ ID NO: 832529 - DNA, 25 bp, Mus musculus
tctgagtggctctaagtggccgcta

SEQ ID NO: 832530 - DNA, 25 bp, Mus musculus
tctgagtggttgagtcttgggacct

SEQ ID NO: 832531 - DNA, 25 bp, Mus musculus
tctgagtggttgtgtcttgggacct

SEQ ID NO: 832532 - DNA, 25 bp, Mus musculus
tctgagttcagccagggtcaccctg

SEQ ID NO: 832533 - DNA, 25 bp, Mus musculus
tctgagttcagcgagggtcaccctg

SEQ ID NO: 832534 - DNA, 25 bp, Mus musculus
tctgagttcaggacagtccataggc

SEQ ID NO: 832535 - DNA, 25 bp, Mus musculus
tctgagttcaggtcagtccataggc

SEQ ID NO: 832536 - DNA, 25 bp, Mus musculus
tctgagttcattcggatcggtggaa

SEQ ID NO: 832537 - DNA, 25 bp, Mus musculus
tctgagttcattgggatcggtggaa

SEQ ID NO: 832538 - DNA, 25 bp, Mus musculus
tctgagttccacctctgctgtgaga

SEQ ID NO: 832539 - DNA, 25 bp, Mus musculus
tctgagttccacgtctgctgtgaga

SEQ ID NO: 832540 - DNA, 25 bp, Mus musculus
tctgagttcgagcagtgagtttcag

SEQ ID NO: 832541 - DNA, 25 bp, Mus musculus
tctgagttcgaggagtgagtttcag

SEQ ID NO: 832542 - DNA, 25 bp, Mus musculus
tctgagttctaactgacatcgccct

SEQ ID NO: 832543 - DNA, 25 bp, Mus musculus
tctgagttctaagtgacatcgccct

SEQ ID NO: 832544 - DNA, 25 bp, Mus musculus
tctgagttgagaatgccctgggcta

SEQ ID NO: 832545 - DNA, 25 bp, Mus musculus
tctgagttgagattgccctgggcta

SEQ ID NO: 832546 - DNA, 25 bp, Mus musculus
tctgagttgtctctttctagaagaa

SEQ ID NO: 832547 - DNA, 25 bp, Mus musculus
tctgagttgtctgtttctagaagaa

SEQ ID NO: 832548 - DNA, 25 bp, Mus musculus
tctgataacgcacagattttttgtt

SEQ ID NO: 832549 - DNA, 25 bp, Mus musculus
tctgataacgcagagattttttgtt

SEQ ID NO: 832550 - DNA, 25 bp, Mus musculus
tctgataagtaaaccgtcaccggct

SEQ ID NO: 832551 - DNA, 25 bp, Mus musculus
tctgataagtaatccgtcaccggct

SEQ ID NO: 832552 - DNA, 25 bp, Mus musculus
tctgataatagactgacgctgagac

SEQ ID NO: 832553 - DNA, 25 bp, Mus musculus
tctgataatagagtgacgctgagac

SEQ ID NO: 832554 - DNA, 25 bp, Mus musculus
tctgatacagagctctagatactga

SEQ ID NO: 832555 - DNA, 25 bp, Mus musculus
tctgatacagaggtctagatactga

SEQ ID NO: 832556 - DNA, 25 bp, Mus musculus
tctgatacagtcacccattacgaaa

SEQ ID NO: 832557 - DNA, 25 bp, Mus musculus
tctgatacagtctcccattacgaaa

SEQ ID NO: 832558 - DNA, 25 bp, Mus musculus
tctgatacatctcgccaaactctgg

SEQ ID NO: 832559 - DNA, 25 bp, Mus musculus
tctgatacatctggccaaactctgg

SEQ ID NO: 832560 - DNA, 25 bp, Mus musculus
tctgataccaccatgttcctgggtg

SEQ ID NO: 832561 - DNA, 25 bp, Mus musculus
tctgataccaccttgttcctgggtg

SEQ ID NO: 832562 - DNA, 25 bp, Mus musculus
tctgataccttgctggagaagatag

SEQ ID NO: 832563 - DNA, 25 bp, Mus musculus
tctgataccttggtggagaagatag

SEQ ID NO: 832564 - DNA, 25 bp, Mus musculus
tctgataggatgagaagacacgccc

SEQ ID NO: 832565 - DNA, 25 bp, Mus musculus
tctgataggatgtgaagacacgccc

SEQ ID NO: 832566 - DNA, 25 bp, Mus musculus
tctgatagggctcttttatttcttc

SEQ ID NO: 832567 - DNA, 25 bp, Mus musculus
tctgatagggctgttttatttcttc

SEQ ID NO: 832568 - DNA, 25 bp, Mus musculus
tctgatagtactcctactcctattt

SEQ ID NO: 832569 - DNA, 25 bp, Mus musculus
tctgatagtactgctactcctattt

SEQ ID NO: 832570 - DNA, 25 bp, Mus musculus
tctgatagtgagagcaagcttggat

SEQ ID NO: 832571 - DNA, 25 bp, Mus musculus
tctgatagtgagtgcaagcttggat

SEQ ID NO: 832572 - DNA, 25 bp, Mus musculus
tctgatatagtgaatggcgctggac

SEQ ID NO: 832573 - DNA, 25 bp, Mus musculus
tctgatatagtgtatggcgctggac

SEQ ID NO: 832574 - DNA, 25 bp, Mus musculus
tctgatatcttcattgacttcttcc

SEQ ID NO: 832575 - DNA, 25 bp, Mus musculus
tctgatatcttctttgacttcttcc

SEQ ID NO: 832576 - DNA, 25 bp, Mus musculus
tctgatatgcatcgattcagtcccc

SEQ ID NO: 832577 - DNA, 25 bp, Mus musculus
tctgatatgcatggattcagtcccc

SEQ ID NO: 832578 - DNA, 25 bp, Mus musculus
tctgatattcatcgctccgagctgg

SEQ ID NO: 832579 - DNA, 25 bp, Mus musculus
tctgatattcatggctccgagctgg

SEQ ID NO: 832580 - DNA, 25 bp, Mus musculus
tctgatattgaaatgtggctgctgc

SEQ ID NO: 832581 - DNA, 25 bp, Mus musculus
tctgatattgaattgtggctgctgc

SEQ ID NO: 832582 - DNA, 25 bp, Mus musculus
tctgatattggcagtggtcttgctc

SEQ ID NO: 832583 - DNA, 25 bp, Mus musculus
tctgatattggctgtggtcttgctc

SEQ ID NO: 832584 - DNA, 25 bp, Mus musculus
tctgatattgttcgctgggatggtc

SEQ ID NO: 832585 - DNA, 25 bp, Mus musculus
tctgatattgttggctgggatggtc

SEQ ID NO: 832586 - DNA, 25 bp, Mus musculus
tctgatatttgtcttggaccatgaa

SEQ ID NO: 832587 - DNA, 25 bp, Mus musculus
tctgatatttgtgttggaccatgaa

SEQ ID NO: 832588 - DNA, 25 bp, Mus musculus
tctgatcaggaaccaggtgggcctt

SEQ ID NO: 832589 - DNA, 25 bp, Mus musculus
tctgatcaggaagcaggtgggcctt

SEQ ID NO: 832590 - DNA, 25 bp, Mus musculus
tctgatcatcccctggcaaaggcac

SEQ ID NO: 832591 - DNA, 25 bp, Mus musculus
tctgatcatcccgtggcaaaggcac

SEQ ID NO: 832592 - DNA, 25 bp, Mus musculus
tctgatcatctcctttctaatctta

SEQ ID NO: 832593 - DNA, 25 bp, Mus musculus
tctgatcatctcgtttctaatctta

SEQ ID NO: 832594 - DNA, 25 bp, Mus musculus
tctgatcattcacttctgtcattgt

SEQ ID NO: 832595 - DNA, 25 bp, Mus musculus
tctgatcattcagttctgtcattgt

SEQ ID NO: 832596 - DNA, 25 bp, Mus musculus
tctgatcattctatcccaaattcct

SEQ ID NO: 832597 - DNA, 25 bp, Mus musculus
tctgatcattctttcccaaattcct

SEQ ID NO: 832598 - DNA, 25 bp, Mus musculus
tctgatccaaacacaatgggccagt

SEQ ID NO: 832599 - DNA, 25 bp, Mus musculus
tctgatccaaactcaatgggccagt

SEQ ID NO: 832600 - DNA, 25 bp, Mus musculus
tctgatccacaaccagtaggccaag

SEQ ID NO: 832601 - DNA, 25 bp, Mus musculus
tctgatccacaagcagtaggccaag

SEQ ID NO: 832602 - DNA, 25 bp, Mus musculus
tctgatccacagactcttgcaagta

SEQ ID NO: 832603 - DNA, 25 bp, Mus musculus
tctgatccacagtctcttgcaagta

SEQ ID NO: 832604 - DNA, 25 bp, Mus musculus
tctgatccataaagtcttgaaaata

SEQ ID NO: 832605 - DNA, 25 bp, Mus musculus
tctgatccataatgtcttgaaaata

SEQ ID NO: 832606 - DNA, 25 bp, Mus musculus
tctgatccgcagagatccggcccgg

SEQ ID NO: 832607 - DNA, 25 bp, Mus musculus
tctgatccgcagtgatccggcccgg

SEQ ID NO: 832608 - DNA, 25 bp, Mus musculus
tctgatctaatgactggctgccaca

SEQ ID NO: 832609 - DNA, 25 bp, Mus musculus
tctgatctaatgtctggctgccaca

SEQ ID NO: 832610 - DNA, 25 bp, Mus musculus
tctgatctacagctgtttcaaacat

SEQ ID NO: 832611 - DNA, 25 bp, Mus musculus
tctgatctacaggtgtttcaaacat

SEQ ID NO: 832612 - DNA, 25 bp, Mus musculus
tctgatctattcatggtatctctgt

SEQ ID NO: 832613 - DNA, 25 bp, Mus musculus
tctgatctattcttggtatctctgt

SEQ ID NO: 832614 - DNA, 25 bp, Mus musculus
tctgatctcaacatctttctgctga

SEQ ID NO: 832615 - DNA, 25 bp, Mus musculus
tctgatctcaacttctttctgctga

SEQ ID NO: 832616 - DNA, 25 bp, Mus musculus
tctgatctcagcacatgatatatga

SEQ ID NO: 832617 - DNA, 25 bp, Mus musculus
tctgatctcagctcatgatatatga

SEQ ID NO: 832618 - DNA, 25 bp, Mus musculus
tctgatctccacagggtgccgtgcc

SEQ ID NO: 832619 - DNA, 25 bp, Mus musculus
tctgatctccactgggtgccgtgcc

SEQ ID NO: 832620 - DNA, 25 bp, Mus musculus
tctgatctctacatgcgcacacaaa

SEQ ID NO: 832621 - DNA, 25 bp, Mus musculus
tctgatctctacttgcgcacacaaa

SEQ ID NO: 832622 - DNA, 25 bp, Mus musculus
tctgatctctcacctggcagagaat

SEQ ID NO: 832623 - DNA, 25 bp, Mus musculus
tctgatctctcagctggcagagaat

SEQ ID NO: 832624 - DNA, 25 bp, Mus musculus
tctgatctctgaaacccacgtggtg

SEQ ID NO: 832625 - DNA, 25 bp, Mus musculus
tctgatctctgatacccacgtggtg

SEQ ID NO: 832626 - DNA, 25 bp, Mus musculus
tctgatctcttgactgtaactctca

SEQ ID NO: 832627 - DNA, 25 bp, Mus musculus
tctgatctcttgtctgtaactctca

SEQ ID NO: 832628 - DNA, 25 bp, Mus musculus
tctgatctgaaccttcctttgtttc

SEQ ID NO: 832629 - DNA, 25 bp, Mus musculus
tctgatctgaacgttcctttgtttc

SEQ ID NO: 832630 - DNA, 25 bp, Mus musculus
tctgatctgctaacaggcccgatgg

SEQ ID NO: 832631 - DNA, 25 bp, Mus musculus
tctgatctgctatcaggcccgatgg

SEQ ID NO: 832632 - DNA, 25 bp, Mus musculus
tctgatctggaccaagtcggaacag

SEQ ID NO: 832633 - DNA, 25 bp, Mus musculus
tctgatctggacgaagtcggaacag

SEQ ID NO: 832634 - DNA, 25 bp, Mus musculus
tctgatctgtcacccatattcatga

SEQ ID NO: 832635 - DNA, 25 bp, Mus musculus
tctgatctgtcagccatattcatga

SEQ ID NO: 832636 - DNA, 25 bp, Mus musculus
tctgatctgttaacttatgaggaca

SEQ ID NO: 832637 - DNA, 25 bp, Mus musculus
tctgatctgttatcttatgaggaca

SEQ ID NO: 832638 - DNA, 25 bp, Mus musculus
tctgatgacaggacagcagtgagtc

SEQ ID NO: 832639 - DNA, 25 bp, Mus musculus
tctgatgacaggtcagcagtgagtc

SEQ ID NO: 832640 - DNA, 25 bp, Mus musculus
tctgatgaccatactgatacaactg

SEQ ID NO: 832641 - DNA, 25 bp, Mus musculus
tctgatgaccattctgatacaactg

SEQ ID NO: 832642 - DNA, 25 bp, Mus musculus
tctgatgacgtaaccagttgaccct

SEQ ID NO: 832643 - DNA, 25 bp, Mus musculus
tctgatgacgtatccagttgaccct

SEQ ID NO: 832644 - DNA, 25 bp, Mus musculus
tctgatgagcacacactgcgggttt

SEQ ID NO: 832645 - DNA, 25 bp, Mus musculus
tctgatgagcactcactgcgggttt

SEQ ID NO: 832646 - DNA, 25 bp, Mus musculus
tctgatgagtaaccagaccctcggg

SEQ ID NO: 832647 - DNA, 25 bp, Mus musculus
tctgatgagtaagcagaccctcggg

SEQ ID NO: 832648 - DNA, 25 bp, Mus musculus
tctgatgattttcaaatgtgctttt

SEQ ID NO: 832649 - DNA, 25 bp, Mus musculus
tctgatgattttgaaatgtgctttt

SEQ ID NO: 832650 - DNA, 25 bp, Mus musculus
tctgatgcatatcgctgaccccaag

SEQ ID NO: 832651 - DNA, 25 bp, Mus musculus
tctgatgcatatggctgaccccaag

SEQ ID NO: 832652 - DNA, 25 bp, Mus musculus
tctgatgcattgaagcccgggagat

SEQ ID NO: 832653 - DNA, 25 bp, Mus musculus
tctgatgcattgtagcccgggagat

SEQ ID NO: 832654 - DNA, 25 bp, Mus musculus
tctgatgccataaagattgccttct

SEQ ID NO: 832655 - DNA, 25 bp, Mus musculus
tctgatgccatatagattgccttct

SEQ ID NO: 832656 - DNA, 25 bp, Mus musculus
tctgatgcccatcactagaggagga

SEQ ID NO: 832657 - DNA, 25 bp, Mus musculus
tctgatgcccatgactagaggagga

SEQ ID NO: 832658 - DNA, 25 bp, Mus musculus
tctgatgccctcattaaagtgttgc

SEQ ID NO: 832659 - DNA, 25 bp, Mus musculus
tctgatgccctctttaaagtgttgc

SEQ ID NO: 832660 - DNA, 25 bp, Mus musculus
tctgatgcctgtcctgggctatgac

SEQ ID NO: 832661 - DNA, 25 bp, Mus musculus
tctgatgcctgtgctgggctatgac

SEQ ID NO: 832662 - DNA, 25 bp, Mus musculus
tctgatgcttcacaacatgcctctc

SEQ ID NO: 832663 - DNA, 25 bp, Mus musculus
tctgatgcttcagaacatgcctctc

SEQ ID NO: 832664 - DNA, 25 bp, Mus musculus
tctgatggatgcagactgtgtctat

SEQ ID NO: 832665 - DNA, 25 bp, Mus musculus
tctgatggatgctgactgtgtctat

SEQ ID NO: 832666 - DNA, 25 bp, Mus musculus
tctgatggcattaatcttgaagtct

SEQ ID NO: 832667 - DNA, 25 bp, Mus musculus
tctgatggcatttatcttgaagtct

SEQ ID NO: 832668 - DNA, 25 bp, Mus musculus
tctgatggcccgagtggatctttgg

SEQ ID NO: 832669 - DNA, 25 bp, Mus musculus
tctgatggcccgtgtggatctttgg

SEQ ID NO: 832670 - DNA, 25 bp, Mus musculus
tctgatggctcaaagctgcctgtaa

SEQ ID NO: 832671 - DNA, 25 bp, Mus musculus
tctgatggctcatagctgcctgtaa

SEQ ID NO: 832672 - DNA, 25 bp, Mus musculus
tctgatggctctcataagggaccaa

SEQ ID NO: 832673 - DNA, 25 bp, Mus musculus
tctgatggctctgataagggaccaa

SEQ ID NO: 832674 - DNA, 25 bp, Mus musculus
tctgatgggcataaaaactgacttc

SEQ ID NO: 832675 - DNA, 25 bp, Mus musculus
tctgatgggcattaaaactgacttc

SEQ ID NO: 832676 - DNA, 25 bp, Mus musculus
tctgatggtacccaagttcacattt

SEQ ID NO: 832677 - DNA, 25 bp, Mus musculus
tctgatggtaccgaagttcacattt

SEQ ID NO: 832678 - DNA, 25 bp, Mus musculus
tctgatggtcagatttactcccctc

SEQ ID NO: 832679 - DNA, 25 bp, Mus musculus
tctgatggtcagttttactcccctc

SEQ ID NO: 832680 - DNA, 25 bp, Mus musculus
tctgatggtctcatctagattctga

SEQ ID NO: 832681 - DNA, 25 bp, Mus musculus
tctgatggtctcttctagattctga

SEQ ID NO: 832682 - DNA, 25 bp, Mus musculus
tctgatgtaccaagggcccgtgaaa

SEQ ID NO: 832683 - DNA, 25 bp, Mus musculus
tctgatgtaccatgggcccgtgaaa

SEQ ID NO: 832684 - DNA, 25 bp, Mus musculus
tctgatgtcaaacttacccggttct

SEQ ID NO: 832685 - DNA, 25 bp, Mus musculus
tctgatgtcaaagttacccggttct

SEQ ID NO: 832686 - DNA, 25 bp, Mus musculus
tctgatgtcatacgcctgtctttta

SEQ ID NO: 832687 - DNA, 25 bp, Mus musculus
tctgatgtcataggcctgtctttta

SEQ ID NO: 832688 - DNA, 25 bp, Mus musculus
tctgatgtcgtcagggacctctgac

SEQ ID NO: 832689 - DNA, 25 bp, Mus musculus
tctgatgtcgtctgggacctctgac

SEQ ID NO: 832690 - DNA, 25 bp, Mus musculus
tctgatgtggacctcaatggtaaaa

SEQ ID NO: 832691 - DNA, 25 bp, Mus musculus
tctgatgtggacgtcaatggtaaaa

SEQ ID NO: 832692 - DNA, 25 bp, Mus musculus
tctgatgtgtctcagagcatttcta

SEQ ID NO: 832693 - DNA, 25 bp, Mus musculus
tctgatgtgtctgagagcatttcta

SEQ ID NO: 832694 - DNA, 25 bp, Mus musculus
tctgatgttgctcttcacagctttt

SEQ ID NO: 832695 - DNA, 25 bp, Mus musculus
tctgatgttgctgttcacagctttt

SEQ ID NO: 832696 - DNA, 25 bp, Mus musculus
tctgatgttttgatctctattaatg

SEQ ID NO: 832697 - DNA, 25 bp, Mus musculus
tctgatgttttgttctctattaatg

SEQ ID NO: 832698 - DNA, 25 bp, Mus musculus
tctgattagctactgctgctgtgct

SEQ ID NO: 832699 - DNA, 25 bp, Mus musculus
tctgattagctagtgctgctgtgct

SEQ ID NO: 832700 - DNA, 25 bp, Mus musculus
tctgattcaaagctttaggtgtggc

SEQ ID NO: 832701 - DNA, 25 bp, Mus musculus
tctgattcaaaggtttaggtgtggc

SEQ ID NO: 832702 - DNA, 25 bp, Mus musculus
tctgattcagaaagcccatgttttt

SEQ ID NO: 832703 - DNA, 25 bp, Mus musculus
tctgattcagaatgcccatgttttt

SEQ ID NO: 832704 - DNA, 25 bp, Mus musculus
tctgattccagacaattacatgttg

SEQ ID NO: 832705 - DNA, 25 bp, Mus musculus
tctgattccagagaattacatgttg

SEQ ID NO: 832706 - DNA, 25 bp, Mus musculus
tctgattccgagaaccctgtcagac

SEQ ID NO: 832707 - DNA, 25 bp, Mus musculus
tctgattccgagtaccctgtcagac

SEQ ID NO: 832708 - DNA, 25 bp, Mus musculus
tctgattcctgtattcctgtattgg

SEQ ID NO: 832709 - DNA, 25 bp, Mus musculus
tctgattcctgttttcctgtattgg

SEQ ID NO: 832710 - DNA, 25 bp, Mus musculus
tctgattccttcattgggtatgtgt

SEQ ID NO: 832711 - DNA, 25 bp, Mus musculus
tctgattccttctttgggtatgtgt

SEQ ID NO: 832712 - DNA, 25 bp, Mus musculus
tctgattctcaccacgcagcgggaa

SEQ ID NO: 832713 - DNA, 25 bp, Mus musculus
tctgattctcacgacgcagcgggaa

SEQ ID NO: 832714 - DNA, 25 bp, Mus musculus
tctgattctgaaagcgcttccgaag

SEQ ID NO: 832715 - DNA, 25 bp, Mus musculus
tctgattctgaatgcgcttccgaag

SEQ ID NO: 832716 - DNA, 25 bp, Mus musculus
tctgattgacagctatgtgccacct

SEQ ID NO: 832717 - DNA, 25 bp, Mus musculus
tctgattgacaggtatgtgccacct

SEQ ID NO: 832718 - DNA, 25 bp, Mus musculus
tctgattgagaacccttcagcctgg

SEQ ID NO: 832719 - DNA, 25 bp, Mus musculus
tctgattgagaagccttcagcctgg

SEQ ID NO: 832720 - DNA, 25 bp, Mus musculus
tctgattggctactgaggcctgagt

SEQ ID NO: 832721 - DNA, 25 bp, Mus musculus
tctgattggctagtgaggcctgagt

SEQ ID NO: 832722 - DNA, 25 bp, Mus musculus
tctgatttcaacacttcaatttttt

SEQ ID NO: 832723 - DNA, 25 bp, Mus musculus
tctgatttcaactcttcaatttttt

SEQ ID NO: 832724 - DNA, 25 bp, Mus musculus
tctgatttcagcacactagagtgtg

SEQ ID NO: 832725 - DNA, 25 bp, Mus musculus
tctgatttcagctcactagagtgtg

SEQ ID NO: 832726 - DNA, 25 bp, Mus musculus
tctgatttccaacttttccccgagt

SEQ ID NO: 832727 - DNA, 25 bp, Mus musculus
tctgatttccaagttttccccgagt

SEQ ID NO: 832728 - DNA, 25 bp, Mus musculus
tctgatttccacctgcatgccaaaa

SEQ ID NO: 832729 - DNA, 25 bp, Mus musculus
tctgatttccacgtgcatgccaaaa

SEQ ID NO: 832730 - DNA, 25 bp, Mus musculus
tctgatttccagaactgcagccctg

SEQ ID NO: 832731 - DNA, 25 bp, Mus musculus
tctgatttccagtactgcagccctg

SEQ ID NO: 832732 - DNA, 25 bp, Mus musculus
tctgatttctgaattgatgatgcca

SEQ ID NO: 832733 - DNA, 25 bp, Mus musculus
tctgatttctgatttgatgatgcca

SEQ ID NO: 832734 - DNA, 25 bp, Mus musculus
tctgatttctggctgtgtattctga

SEQ ID NO: 832735 - DNA, 25 bp, Mus musculus
tctgatttctgggtgtgtattctga

SEQ ID NO: 832736 - DNA, 25 bp, Mus musculus
tctgatttgctacttcttcctggta

SEQ ID NO: 832737 - DNA, 25 bp, Mus musculus
tctgatttgctagttcttcctggta

SEQ ID NO: 832738 - DNA, 25 bp, Mus musculus
tctgatttgggcatgttacactgaa

SEQ ID NO: 832739 - DNA, 25 bp, Mus musculus
tctgatttgggcttgttacactgaa

SEQ ID NO: 832740 - DNA, 25 bp, Mus musculus
tctgatttggttactttacccactc

SEQ ID NO: 832741 - DNA, 25 bp, Mus musculus
tctgatttggtttctttacccactc

SEQ ID NO: 832742 - DNA, 25 bp, Mus musculus
tctgatttgtgtcagctgagtgcat

SEQ ID NO: 832743 - DNA, 25 bp, Mus musculus
tctgatttgtgtgagctgagtgcat

SEQ ID NO: 832744 - DNA, 25 bp, Mus musculus
tctgattttattaatccctcatgat

SEQ ID NO: 832745 - DNA, 25 bp, Mus musculus
tctgattttatttatccctcatgat

SEQ ID NO: 832746 - DNA, 25 bp, Mus musculus
tctgattttcagaatgtgtgtgtgc

SEQ ID NO: 832747 - DNA, 25 bp, Mus musculus
tctgattttcagtatgtgtgtgtgc

SEQ ID NO: 832748 - DNA, 25 bp, Mus musculus
tctgattttgccagacatgctgaaa

SEQ ID NO: 832749 - DNA, 25 bp, Mus musculus
tctgattttgcctgacatgctgaaa

SEQ ID NO: 832750 - DNA, 25 bp, Mus musculus
tctgatttttgcctctgggtagtgg

SEQ ID NO: 832751 - DNA, 25 bp, Mus musculus
tctgatttttgcgtctgggtagtgg

SEQ ID NO: 832752 - DNA, 25 bp, Mus musculus
tctgcaaaacccacacagtttctac

SEQ ID NO: 832753 - DNA, 25 bp, Mus musculus
tctgcaaaaccctcacagtttctac

SEQ ID NO: 832754 - DNA, 25 bp, Mus musculus
tctgcaaaactgagcgcccggctgt

SEQ ID NO: 832755 - DNA, 25 bp, Mus musculus
tctgcaaaactgtgcgcccggctgt

SEQ ID NO: 832756 - DNA, 25 bp, Mus musculus
tctgcaaacagtccggacctggcat

SEQ ID NO: 832757 - DNA, 25 bp, Mus musculus
tctgcaaacagtgcggacctggcat

SEQ ID NO: 832758 - DNA, 25 bp, Mus musculus
tctgcaaagagtacagtctgccgcc

SEQ ID NO: 832759 - DNA, 25 bp, Mus musculus
tctgcaaagagttcagtctgccgcc

SEQ ID NO: 832760 - DNA, 25 bp, Mus musculus
tctgcaaatggtcgatatttcttcc

SEQ ID NO: 832761 - DNA, 25 bp, Mus musculus
tctgcaaatggtggatatttcttcc

SEQ ID NO: 832762 - DNA, 25 bp, Mus musculus
tctgcaacactgcagaacgttattt

SEQ ID NO: 832763 - DNA, 25 bp, Mus musculus
tctgcaacactggagaacgttattt

SEQ ID NO: 832764 - DNA, 25 bp, Mus musculus
tctgcaaccagaaccacgcgaaaag

SEQ ID NO: 832765 - DNA, 25 bp, Mus musculus
tctgcaaccagatccacgcgaaaag

SEQ ID NO: 832766 - DNA, 25 bp, Mus musculus
tctgcaaccggcagtccatcaaagt

SEQ ID NO: 832767 - DNA, 25 bp, Mus musculus
tctgcaaccggctgtccatcaaagt

SEQ ID NO: 832768 - DNA, 25 bp, Mus musculus
tctgcaacctggacaatgctgcact

SEQ ID NO: 832769 - DNA, 25 bp, Mus musculus
tctgcaacctggtcaatgctgcact

SEQ ID NO: 832770 - DNA, 25 bp, Mus musculus
tctgcaaccttcaacagggagccct

SEQ ID NO: 832771 - DNA, 25 bp, Mus musculus
tctgcaaccttctacagggagccct

SEQ ID NO: 832772 - DNA, 25 bp, Mus musculus
tctgcaacgatgagctggagctgtt

SEQ ID NO: 832773 - DNA, 25 bp, Mus musculus
tctgcaacgatgtgctggagctgtt

SEQ ID NO: 832774 - DNA, 25 bp, Mus musculus
tctgcaacgggcagggcatctactg

SEQ ID NO: 832775 - DNA, 25 bp, Mus musculus
tctgcaacgggctgggcatctactg

SEQ ID NO: 832776 - DNA, 25 bp, Mus musculus
tctgcaactgtcatttcacctcgat

SEQ ID NO: 832777 - DNA, 25 bp, Mus musculus
tctgcaactgtcttttcacctcgat

SEQ ID NO: 832778 - DNA, 25 bp, Mus musculus
tctgcaacttccaagggctgccatg

SEQ ID NO: 832779 - DNA, 25 bp, Mus musculus
tctgcaacttcctagggctgccatg

SEQ ID NO: 832780 - DNA, 25 bp, Mus musculus
tctgcaagacttatattcctccatc

SEQ ID NO: 832781 - DNA, 25 bp, Mus musculus
tctgcaagacttttattcctccatc

SEQ ID NO: 832782 - DNA, 25 bp, Mus musculus
tctgcaagaggccaggagactccca

SEQ ID NO: 832783 - DNA, 25 bp, Mus musculus
tctgcaagaggcgaggagactccca

SEQ ID NO: 832784 - DNA, 25 bp, Mus musculus
tctgcaagcctcatctgggctgagg

SEQ ID NO: 832785 - DNA, 25 bp, Mus musculus
tctgcaagcctcttctgggctgagg

SEQ ID NO: 832786 - DNA, 25 bp, Mus musculus
tctgcaagcttccagtgggcacatg

SEQ ID NO: 832787 - DNA, 25 bp, Mus musculus
tctgcaagcttcgagtgggcacatg

SEQ ID NO: 832788 - DNA, 25 bp, Mus musculus
tctgcaagggttcttaccgaccaag

SEQ ID NO: 832789 - DNA, 25 bp, Mus musculus
tctgcaagggttgttaccgaccaag

SEQ ID NO: 832790 - DNA, 25 bp, Mus musculus
tctgcaataataaagccacgttgtg

SEQ ID NO: 832791 - DNA, 25 bp, Mus musculus
tctgcaataatatagccacgttgtg

SEQ ID NO: 832792 - DNA, 25 bp, Mus musculus
tctgcaatcaaactccccgttttgt

SEQ ID NO: 832793 - DNA, 25 bp, Mus musculus
tctgcaatcaaagtccccgttttgt

SEQ ID NO: 832794 - DNA, 25 bp, Mus musculus
tctgcaatcctgcttaaacttggct

SEQ ID NO: 832795 - DNA, 25 bp, Mus musculus
tctgcaatcctggttaaacttggct

SEQ ID NO: 832796 - DNA, 25 bp, Mus musculus
tctgcaattcttagtaaattccaga

SEQ ID NO: 832797 - DNA, 25 bp, Mus musculus
tctgcaattctttgtaaattccaga

SEQ ID NO: 832798 - DNA, 25 bp, Mus musculus
tctgcacaatccatcagtgttacac

SEQ ID NO: 832799 - DNA, 25 bp, Mus musculus
tctgcacaatccttcagtgttacac

SEQ ID NO: 832800 - DNA, 25 bp, Mus musculus
tctgcacacctcaagtgagtaccta

SEQ ID NO: 832801 - DNA, 25 bp, Mus musculus
tctgcacacctctagtgagtaccta

SEQ ID NO: 832802 - DNA, 25 bp, Mus musculus
tctgcacacctgagttccttttaga

SEQ ID NO: 832803 - DNA, 25 bp, Mus musculus
tctgcacacctgtgttccttttaga

SEQ ID NO: 832804 - DNA, 25 bp, Mus musculus
tctgcacagcgcactgtggagcaga

SEQ ID NO: 832805 - DNA, 25 bp, Mus musculus
tctgcacagcgctctgtggagcaga

SEQ ID NO: 832806 - DNA, 25 bp, Mus musculus
tctgcacagttcaacgttacgtttg

SEQ ID NO: 832807 - DNA, 25 bp, Mus musculus
tctgcacagttctacgttacgtttg

SEQ ID NO: 832808 - DNA, 25 bp, Mus musculus
tctgcacagtttaattgtatcttgt

SEQ ID NO: 832809 - DNA, 25 bp, Mus musculus
tctgcacagttttattgtatcttgt

SEQ ID NO: 832810 - DNA, 25 bp, Mus musculus
tctgcacatagtcgcttctggtcaa

SEQ ID NO: 832811 - DNA, 25 bp, Mus musculus
tctgcacatagtggcttctggtcaa

SEQ ID NO: 832812 - DNA, 25 bp, Mus musculus
tctgcacatattatcagttgcaaga

SEQ ID NO: 832813 - DNA, 25 bp, Mus musculus
tctgcacatattttcagttgcaaga

SEQ ID NO: 832814 - DNA, 25 bp, Mus musculus
tctgcacatggcctcgggtggcaaa

SEQ ID NO: 832815 - DNA, 25 bp, Mus musculus
tctgcacatggcgtcgggtggcaaa

SEQ ID NO: 832816 - DNA, 25 bp, Mus musculus
tctgcaccaaagacctcggtttgta

SEQ ID NO: 832817 - DNA, 25 bp, Mus musculus
tctgcaccaaagtcctcggtttgta

SEQ ID NO: 832818 - DNA, 25 bp, Mus musculus
tctgcaccagtgactaataatccta

SEQ ID NO: 832819 - DNA, 25 bp, Mus musculus
tctgcaccagtgtctaataatccta

SEQ ID NO: 832820 - DNA, 25 bp, Mus musculus
tctgcacccagacctgaactttggt

SEQ ID NO: 832821 - DNA, 25 bp, Mus musculus
tctgcacccagagctgaactttggt

SEQ ID NO: 832822 - DNA, 25 bp, Mus musculus
tctgcacccataactcttcgagtta

SEQ ID NO: 832823 - DNA, 25 bp, Mus musculus
tctgcacccatatctcttcgagtta

SEQ ID NO: 832824 - DNA, 25 bp, Mus musculus
tctgcacccggcagctccttcctgt

SEQ ID NO: 832825 - DNA, 25 bp, Mus musculus
tctgcacccggctgctccttcctgt

SEQ ID NO: 832826 - DNA, 25 bp, Mus musculus
tctgcaccctgacgattcctgattt

SEQ ID NO: 832827 - DNA, 25 bp, Mus musculus
tctgcaccctgaggattcctgattt

SEQ ID NO: 832828 - DNA, 25 bp, Mus musculus
tctgcacctcacatagctaatacat

SEQ ID NO: 832829 - DNA, 25 bp, Mus musculus
tctgcacctcacttagctaatacat

SEQ ID NO: 832830 - DNA, 25 bp, Mus musculus
tctgcacctctcctgttgaaaagtg

SEQ ID NO: 832831 - DNA, 25 bp, Mus musculus
tctgcacctctcgtgttgaaaagtg

SEQ ID NO: 832832 - DNA, 25 bp, Mus musculus
tctgcacctgcgcacactttgtgtt

SEQ ID NO: 832833 - DNA, 25 bp, Mus musculus
tctgcacctgcggacactttgtgtt

SEQ ID NO: 832834 - DNA, 25 bp, Mus musculus
tctgcacctggcagtagaagcccag

SEQ ID NO: 832835 - DNA, 25 bp, Mus musculus
tctgcacctggctgtagaagcccag

SEQ ID NO: 832836 - DNA, 25 bp, Mus musculus
tctgcacctgtaaccggaactgttc

SEQ ID NO: 832837 - DNA, 25 bp, Mus musculus
tctgcacctgtatccggaactgttc

SEQ ID NO: 832838 - DNA, 25 bp, Mus musculus
tctgcaccttagacgctttttagaa

SEQ ID NO: 832839 - DNA, 25 bp, Mus musculus
tctgcaccttagtcgctttttagaa

SEQ ID NO: 832840 - DNA, 25 bp, Mus musculus
tctgcaccttcaatttgcccagaga

SEQ ID NO: 832841 - DNA, 25 bp, Mus musculus
tctgcaccttcattttgcccagaga

SEQ ID NO: 832842 - DNA, 25 bp, Mus musculus
tctgcaccttccattcatactttag

SEQ ID NO: 832843 - DNA, 25 bp, Mus musculus
tctgcaccttcctttcatactttag

SEQ ID NO: 832844 - DNA, 25 bp, Mus musculus
tctgcacgaacaaaggaggcctccg

SEQ ID NO: 832845 - DNA, 25 bp, Mus musculus
tctgcacgaacataggaggcctccg

SEQ ID NO: 832846 - DNA, 25 bp, Mus musculus
tctgcactaagaagggttgatttgg

SEQ ID NO: 832847 - DNA, 25 bp, Mus musculus
tctgcactaagatgggttgatttgg

SEQ ID NO: 832848 - DNA, 25 bp, Mus musculus
tctgcactagaaaatctgggctctg

SEQ ID NO: 832849 - DNA, 25 bp, Mus musculus
tctgcactagaatatctgggctctg

SEQ ID NO: 832850 - DNA, 25 bp, Mus musculus
tctgcactccacactcagtagagag

SEQ ID NO: 832851 - DNA, 25 bp, Mus musculus
tctgcactccactctcagtagagag

SEQ ID NO: 832852 - DNA, 25 bp, Mus musculus
tctgcactctgcaacaggaaccagt

SEQ ID NO: 832853 - DNA, 25 bp, Mus musculus
tctgcactctgcagttgtagattta

SEQ ID NO: 832854 - DNA, 25 bp, Mus musculus
tctgcactctgctacaggaaccagt

SEQ ID NO: 832855 - DNA, 25 bp, Mus musculus
tctgcactctgctgttgtagattta

SEQ ID NO: 832856 - DNA, 25 bp, Mus musculus
tctgcactctggaatgactgggttc

SEQ ID NO: 832857 - DNA, 25 bp, Mus musculus
tctgcactctggtatgactgggttc

SEQ ID NO: 832858 - DNA, 25 bp, Mus musculus
tctgcactgaagctctccataaggt

SEQ ID NO: 832859 - DNA, 25 bp, Mus musculus
tctgcactgaaggtctccataaggt

SEQ ID NO: 832860 - DNA, 25 bp, Mus musculus
tctgcactgaatcctgccttagaga

SEQ ID NO: 832861 - DNA, 25 bp, Mus musculus
tctgcactgaatgctgccttagaga

SEQ ID NO: 832862 - DNA, 25 bp, Mus musculus
tctgcactgccccatggagatggga

SEQ ID NO: 832863 - DNA, 25 bp, Mus musculus
tctgcactgcccgatggagatggga

SEQ ID NO: 832864 - DNA, 25 bp, Mus musculus
tctgcactgctcatgcctagaaagc

SEQ ID NO: 832865 - DNA, 25 bp, Mus musculus
tctgcactgctcttgcctagaaagc

SEQ ID NO: 832866 - DNA, 25 bp, Mus musculus
tctgcactggccagtaaaccatgcc

SEQ ID NO: 832867 - DNA, 25 bp, Mus musculus
tctgcactggcctgtaaaccatgcc

SEQ ID NO: 832868 - DNA, 25 bp, Mus musculus
tctgcactgggcatcttaaagggct

SEQ ID NO: 832869 - DNA, 25 bp, Mus musculus
tctgcactgggcttcttaaagggct

SEQ ID NO: 832870 - DNA, 25 bp, Mus musculus
tctgcactttggcatatcggcggta

SEQ ID NO: 832871 - DNA, 25 bp, Mus musculus
tctgcactttgggatatcggcggta

SEQ ID NO: 832872 - DNA, 25 bp, Mus musculus
tctgcagaaactctacagactgtga

SEQ ID NO: 832873 - DNA, 25 bp, Mus musculus
tctgcagaaactgtacagactgtga

SEQ ID NO: 832874 - DNA, 25 bp, Mus musculus
tctgcagaaagcagtcattacacct

SEQ ID NO: 832875 - DNA, 25 bp, Mus musculus
tctgcagaaagctgtcattacacct

SEQ ID NO: 832876 - DNA, 25 bp, Mus musculus
tctgcagaacctcaccgacttatgc

SEQ ID NO: 832877 - DNA, 25 bp, Mus musculus
tctgcagaacctgaccgacttatgc

SEQ ID NO: 832878 - DNA, 25 bp, Mus musculus
tctgcagaagagaccctcactcagt

SEQ ID NO: 832879 - DNA, 25 bp, Mus musculus
tctgcagaagagtccctcactcagt

SEQ ID NO: 832880 - DNA, 25 bp, Mus musculus
tctgcagacactaggcatggatgtg

SEQ ID NO: 832881 - DNA, 25 bp, Mus musculus
tctgcagacacttggcatggatgtg

SEQ ID NO: 832882 - DNA, 25 bp, Mus musculus
tctgcagacatcaggcgggaggaca

SEQ ID NO: 832883 - DNA, 25 bp, Mus musculus
tctgcagacatctggcgggaggaca

SEQ ID NO: 832884 - DNA, 25 bp, Mus musculus
tctgcagacattcgttcccagggta

SEQ ID NO: 832885 - DNA, 25 bp, Mus musculus
tctgcagacattggttcccagggta

SEQ ID NO: 832886 - DNA, 25 bp, Mus musculus
tctgcagagaaccatctatgttgaa

SEQ ID NO: 832887 - DNA, 25 bp, Mus musculus
tctgcagagaacgatctatgttgaa

SEQ ID NO: 832888 - DNA, 25 bp, Mus musculus
tctgcagagacaaataaaccatttt

SEQ ID NO: 832889 - DNA, 25 bp, Mus musculus
tctgcagagacatataaaccatttt

SEQ ID NO: 832890 - DNA, 25 bp, Mus musculus
tctgcagaggcgagttctccttaag

SEQ ID NO: 832891 - DNA, 25 bp, Mus musculus
tctgcagaggcgtgttctccttaag

SEQ ID NO: 832892 - DNA, 25 bp, Mus musculus
tctgcagaggtaccagaagtttggt

SEQ ID NO: 832893 - DNA, 25 bp, Mus musculus
tctgcagaggtagcagaagtttggt

SEQ ID NO: 832894 - DNA, 25 bp, Mus musculus
tctgcagatcttctggcatttgtct

SEQ ID NO: 832895 - DNA, 25 bp, Mus musculus
tctgcagatcttgtggcatttgtct

SEQ ID NO: 832896 - DNA, 25 bp, Mus musculus
tctgcagatgtcctagggtttgagt

SEQ ID NO: 832897 - DNA, 25 bp, Mus musculus
tctgcagatgtcgtagggtttgagt

SEQ ID NO: 832898 - DNA, 25 bp, Mus musculus
tctgcagattctatgccccaagaaa

SEQ ID NO: 832899 - DNA, 25 bp, Mus musculus
tctgcagattctttgccccaagaaa

SEQ ID NO: 832900 - DNA, 25 bp, Mus musculus
tctgcagatttgatgggtgtcacct

SEQ ID NO: 832901 - DNA, 25 bp, Mus musculus
tctgcagatttgttgggtgtcacct

SEQ ID NO: 832902 - DNA, 25 bp, Mus musculus
tctgcagattttacatcttggtttc

SEQ ID NO: 832903 - DNA, 25 bp, Mus musculus
tctgcagatttttcatcttggtttc

SEQ ID NO: 832904 - DNA, 25 bp, Mus musculus
tctgcagcagagctctggcctagca

SEQ ID NO: 832905 - DNA, 25 bp, Mus musculus
tctgcagcagaggtctggcctagca

SEQ ID NO: 832906 - DNA, 25 bp, Mus musculus
tctgcagcagtacagcgtgctcgta

SEQ ID NO: 832907 - DNA, 25 bp, Mus musculus
tctgcagcagtagagcgtgctcgta

SEQ ID NO: 832908 - DNA, 25 bp, Mus musculus
tctgcagcagtcctggaagaagaaa

SEQ ID NO: 832909 - DNA, 25 bp, Mus musculus
tctgcagcagtcgtggaagaagaaa

SEQ ID NO: 832910 - DNA, 25 bp, Mus musculus
tctgcagcagttaatatcccggtgt

SEQ ID NO: 832911 - DNA, 25 bp, Mus musculus
tctgcagcagtttatatcccggtgt

SEQ ID NO: 832912 - DNA, 25 bp, Mus musculus
tctgcagccacaactgtcaggagac

SEQ ID NO: 832913 - DNA, 25 bp, Mus musculus
tctgcagccacatctgtcaggagac

SEQ ID NO: 832914 - DNA, 25 bp, Mus musculus
tctgcagcctacaatacacttatca

SEQ ID NO: 832915 - DNA, 25 bp, Mus musculus
tctgcagcctactatacacttatca

SEQ ID NO: 832916 - DNA, 25 bp, Mus musculus
tctgcagcctgaacctgccggacaa

SEQ ID NO: 832917 - DNA, 25 bp, Mus musculus
tctgcagcctgatcctgccggacaa

SEQ ID NO: 832918 - DNA, 25 bp, Mus musculus
tctgcagcgacacgctctgcgtgct

SEQ ID NO: 832919 - DNA, 25 bp, Mus musculus
tctgcagcgacaggctctgcgtgct

SEQ ID NO: 832920 - DNA, 25 bp, Mus musculus
tctgcagcggctactctaagaatgt

SEQ ID NO: 832921 - DNA, 25 bp, Mus musculus
tctgcagcggcttctctaagaatgt

SEQ ID NO: 832922 - DNA, 25 bp, Mus musculus
tctgcagctcacagtgactctggct

SEQ ID NO: 832923 - DNA, 25 bp, Mus musculus
tctgcagctcactgtgactctggct

SEQ ID NO: 832924 - DNA, 25 bp, Mus musculus
tctgcagctctcaggtggaggccct

SEQ ID NO: 832925 - DNA, 25 bp, Mus musculus
tctgcagctctctggtggaggccct

SEQ ID NO: 832926 - DNA, 25 bp, Mus musculus
tctgcagctggaactcaaccgaatg

SEQ ID NO: 832927 - DNA, 25 bp, Mus musculus
tctgcagctggatctcaaccgaatg

SEQ ID NO: 832928 - DNA, 25 bp, Mus musculus
tctgcagctgggatgttctagtctt

SEQ ID NO: 832929 - DNA, 25 bp, Mus musculus
tctgcagctgggttgttctagtctt

SEQ ID NO: 832930 - DNA, 25 bp, Mus musculus
tctgcagctgttcggcaccagggaa

SEQ ID NO: 832931 - DNA, 25 bp, Mus musculus
tctgcagctgttgggcaccagggaa

SEQ ID NO: 832932 - DNA, 25 bp, Mus musculus
tctgcagcttttaggcacctgtgct

SEQ ID NO: 832933 - DNA, 25 bp, Mus musculus
tctgcagctttttggcacctgtgct

SEQ ID NO: 832934 - DNA, 25 bp, Mus musculus
tctgcaggaaacctcaagtctgtgt

SEQ ID NO: 832935 - DNA, 25 bp, Mus musculus
tctgcaggaaacgtcaagtctgtgt

SEQ ID NO: 832936 - DNA, 25 bp, Mus musculus
tctgcaggaagactgggccacctct

SEQ ID NO: 832937 - DNA, 25 bp, Mus musculus
tctgcaggaagagtgggccacctct

SEQ ID NO: 832938 - DNA, 25 bp, Mus musculus
tctgcaggcagccatgttggtccat

SEQ ID NO: 832939 - DNA, 25 bp, Mus musculus
tctgcaggcagcgatgttggtccat

SEQ ID NO: 832940 - DNA, 25 bp, Mus musculus
tctgcaggcatcatggacacatctc

SEQ ID NO: 832941 - DNA, 25 bp, Mus musculus
tctgcaggcatcttggacacatctc

SEQ ID NO: 832942 - DNA, 25 bp, Mus musculus
tctgcaggccttcgcggtaatcaga

SEQ ID NO: 832943 - DNA, 25 bp, Mus musculus
tctgcaggccttggcggtaatcaga

SEQ ID NO: 832944 - DNA, 25 bp, Mus musculus
tctgcagggcgtacatcttctaggg

SEQ ID NO: 832945 - DNA, 25 bp, Mus musculus
tctgcagggcgttcatcttctaggg

SEQ ID NO: 832946 - DNA, 25 bp, Mus musculus
tctgcagggcttaactttacactct

SEQ ID NO: 832947 - DNA, 25 bp, Mus musculus
tctgcagggctttactttacactct

SEQ ID NO: 832948 - DNA, 25 bp, Mus musculus
tctgcagggtatctcaagcaaacca

SEQ ID NO: 832949 - DNA, 25 bp, Mus musculus
tctgcagggtatgtcaagcaaacca

SEQ ID NO: 832950 - DNA, 25 bp, Mus musculus
tctgcaggtccaaaaacatgagtta

SEQ ID NO: 832951 - DNA, 25 bp, Mus musculus
tctgcaggtccataaacatgagtta

SEQ ID NO: 832952 - DNA, 25 bp, Mus musculus
tctgcaggtgcccagtgtgtttcta

SEQ ID NO: 832953 - DNA, 25 bp, Mus musculus
tctgcaggtgccgagtgtgtttcta

SEQ ID NO: 832954 - DNA, 25 bp, Mus musculus
tctgcaggtgctctgagtctcttca

SEQ ID NO: 832955 - DNA, 25 bp, Mus musculus
tctgcaggtgctgtgagtctcttca

SEQ ID NO: 832956 - DNA, 25 bp, Mus musculus
tctgcaggtgttatttccaattttg

SEQ ID NO: 832957 - DNA, 25 bp, Mus musculus
tctgcaggtgttttttccaattttg

SEQ ID NO: 832958 - DNA, 25 bp, Mus musculus
tctgcagtacctaccatgagtgcta

SEQ ID NO: 832959 - DNA, 25 bp, Mus musculus
tctgcagtacctatggaggccggaa

SEQ ID NO: 832960 - DNA, 25 bp, Mus musculus
tctgcagtaccttccatgagtgcta

SEQ ID NO: 832961 - DNA, 25 bp, Mus musculus
tctgcagtacctttggaggccggaa

SEQ ID NO: 832962 - DNA, 25 bp, Mus musculus
tctgcagtataaaatactcttccgt

SEQ ID NO: 832963 - DNA, 25 bp, Mus musculus
tctgcagtataatatactcttccgt

SEQ ID NO: 832964 - DNA, 25 bp, Mus musculus
tctgcagtcaccataccaataaagt

SEQ ID NO: 832965 - DNA, 25 bp, Mus musculus
tctgcagtcaccttaccaataaagt

SEQ ID NO: 832966 - DNA, 25 bp, Mus musculus
tctgcagtcagcactgttcttgtaa

SEQ ID NO: 832967 - DNA, 25 bp, Mus musculus
tctgcagtcagctctgttcttgtaa

SEQ ID NO: 832968 - DNA, 25 bp, Mus musculus
tctgcagtccataggtttctatggc

SEQ ID NO: 832969 - DNA, 25 bp, Mus musculus
tctgcagtccattggtttctatggc

SEQ ID NO: 832970 - DNA, 25 bp, Mus musculus
tctgcagtcgtcaggctcacaggtg

SEQ ID NO: 832971 - DNA, 25 bp, Mus musculus
tctgcagtcgtctggctcacaggtg

SEQ ID NO: 832972 - DNA, 25 bp, Mus musculus
tctgcagtctgtacaccacatatgt

SEQ ID NO: 832973 - DNA, 25 bp, Mus musculus
tctgcagtctgttcaccacatatgt

SEQ ID NO: 832974 - DNA, 25 bp, Mus musculus
tctgcagtgaagacccgccaagctt

SEQ ID NO: 832975 - DNA, 25 bp, Mus musculus
tctgcagtgaagtcccgccaagctt

SEQ ID NO: 832976 - DNA, 25 bp, Mus musculus
tctgcagtgaccagactcacttgat

SEQ ID NO: 832977 - DNA, 25 bp, Mus musculus
tctgcagtgacctgactcacttgat

SEQ ID NO: 832978 - DNA, 25 bp, Mus musculus
tctgcagtgcccagggtgctcagga

SEQ ID NO: 832979 - DNA, 25 bp, Mus musculus
tctgcagtgccctgggtgctcagga

SEQ ID NO: 832980 - DNA, 25 bp, Mus musculus
tctgcagtgcttaacttaggaccaa

SEQ ID NO: 832981 - DNA, 25 bp, Mus musculus
tctgcagtgctttacttaggaccaa

SEQ ID NO: 832982 - DNA, 25 bp, Mus musculus
tctgcagtggaaactaagggttctt

SEQ ID NO: 832983 - DNA, 25 bp, Mus musculus
tctgcagtggaatctaagggttctt

SEQ ID NO: 832984 - DNA, 25 bp, Mus musculus
tctgcagtgggaattgagcgctttc

SEQ ID NO: 832985 - DNA, 25 bp, Mus musculus
tctgcagtgggatttgagcgctttc

SEQ ID NO: 832986 - DNA, 25 bp, Mus musculus
tctgcagtgggtcgatggtctctta

SEQ ID NO: 832987 - DNA, 25 bp, Mus musculus
tctgcagtgggtggatggtctctta

SEQ ID NO: 832988 - DNA, 25 bp, Mus musculus
tctgcagttagtctgttagtcccat

SEQ ID NO: 832989 - DNA, 25 bp, Mus musculus
tctgcagttagtgtgttagtcccat

SEQ ID NO: 832990 - DNA, 25 bp, Mus musculus
tctgcagttgctagtgctggacgct

SEQ ID NO: 832991 - DNA, 25 bp, Mus musculus
tctgcagttgcttgtgctggacgct

SEQ ID NO: 832992 - DNA, 25 bp, Mus musculus
tctgcataacttatcgtggcacaac

SEQ ID NO: 832993 - DNA, 25 bp, Mus musculus
tctgcataacttttcgtggcacaac

SEQ ID NO: 832994 - DNA, 25 bp, Mus musculus
tctgcataagctccgggacgttatc

SEQ ID NO: 832995 - DNA, 25 bp, Mus musculus
tctgcataagctgcgggacgttatc

SEQ ID NO: 832996 - DNA, 25 bp, Mus musculus
tctgcataccctagttgcccttgaa

SEQ ID NO: 832997 - DNA, 25 bp, Mus musculus
tctgcatacccttgttgcccttgaa

SEQ ID NO: 832998 - DNA, 25 bp, Mus musculus
tctgcatatgtccagattggacttc

SEQ ID NO: 832999 - DNA, 25 bp, Mus musculus
tctgcatatgtcgagattggacttc

SEQ ID NO: 833000 - DNA, 25 bp, Mus musculus
tctgcatcaggtaccaaggttccgg

SEQ ID NO: 833001 - DNA, 25 bp, Mus musculus
tctgcatcaggttccaaggttccgg

SEQ ID NO: 833002 - DNA, 25 bp, Mus musculus
tctgcatcagtcagtgccatcggat

SEQ ID NO: 833003 - DNA, 25 bp, Mus musculus
tctgcatcagtctgtgccatcggat

SEQ ID NO: 833004 - DNA, 25 bp, Mus musculus
tctgcatccgtcctgggaagcgagc

SEQ ID NO: 833005 - DNA, 25 bp, Mus musculus
tctgcatccgtcgtgggaagcgagc

SEQ ID NO: 833006 - DNA, 25 bp, Mus musculus
tctgcatcctacctcaggtttttaa

SEQ ID NO: 833007 - DNA, 25 bp, Mus musculus
tctgcatcctacgtcaggtttttaa

SEQ ID NO: 833008 - DNA, 25 bp, Mus musculus
tctgcatcctgcatttgaacatcct

SEQ ID NO: 833009 - DNA, 25 bp, Mus musculus
tctgcatcctgcttttgaacatcct

SEQ ID NO: 833010 - DNA, 25 bp, Mus musculus
tctgcatctacccaacacaaattta

SEQ ID NO: 833011 - DNA, 25 bp, Mus musculus
tctgcatctaccgaacacaaattta

SEQ ID NO: 833012 - DNA, 25 bp, Mus musculus
tctgcatctccccaaaaaatgtatt

SEQ ID NO: 833013 - DNA, 25 bp, Mus musculus
tctgcatctcccgaaaaaatgtatt

SEQ ID NO: 833014 - DNA, 25 bp, Mus musculus
tctgcatctctcatggacttgtatc

SEQ ID NO: 833015 - DNA, 25 bp, Mus musculus
tctgcatctctcttggacttgtatc

SEQ ID NO: 833016 - DNA, 25 bp, Mus musculus
tctgcatctgcccttgtaataggac

SEQ ID NO: 833017 - DNA, 25 bp, Mus musculus
tctgcatctgccgttgtaataggac

SEQ ID NO: 833018 - DNA, 25 bp, Mus musculus
tctgcatctgtaaatggtgagacta

SEQ ID NO: 833019 - DNA, 25 bp, Mus musculus
tctgcatctgtatatggtgagacta

SEQ ID NO: 833020 - DNA, 25 bp, Mus musculus
tctgcatgaagacactagggaacta

SEQ ID NO: 833021 - DNA, 25 bp, Mus musculus
tctgcatgaagagactagggaacta

SEQ ID NO: 833022 - DNA, 25 bp, Mus musculus
tctgcatgcagtactgggtgcggca

SEQ ID NO: 833023 - DNA, 25 bp, Mus musculus
tctgcatgcagttctgggtgcggca

SEQ ID NO: 833024 - DNA, 25 bp, Mus musculus
tctgcatgccgtctagtttaatctg

SEQ ID NO: 833025 - DNA, 25 bp, Mus musculus
tctgcatgccgtgtagtttaatctg

SEQ ID NO: 833026 - DNA, 25 bp, Mus musculus
tctgcatgctgcaccttagtgatat

SEQ ID NO: 833027 - DNA, 25 bp, Mus musculus
tctgcatgctgctccttagtgatat

SEQ ID NO: 833028 - DNA, 25 bp, Mus musculus
tctgcatggactccggaggcttccg

SEQ ID NO: 833029 - DNA, 25 bp, Mus musculus
tctgcatggactgcggaggcttccg

SEQ ID NO: 833030 - DNA, 25 bp, Mus musculus
tctgcatggtacattcatccacata

SEQ ID NO: 833031 - DNA, 25 bp, Mus musculus
tctgcatggtactttcatccacata

SEQ ID NO: 833032 - DNA, 25 bp, Mus musculus
tctgcatggtatctgcctccagttt

SEQ ID NO: 833033 - DNA, 25 bp, Mus musculus
tctgcatggtatgtgcctccagttt

SEQ ID NO: 833034 - DNA, 25 bp, Mus musculus
tctgcatggtttaatcaatttgctt

SEQ ID NO: 833035 - DNA, 25 bp, Mus musculus
tctgcatggttttatcaatttgctt

SEQ ID NO: 833036 - DNA, 25 bp, Mus musculus
tctgcatgtactacacgttttctat

SEQ ID NO: 833037 - DNA, 25 bp, Mus musculus
tctgcatgtacttcacgttttctat

SEQ ID NO: 833038 - DNA, 25 bp, Mus musculus
tctgcatgtattattggtgagccaa

SEQ ID NO: 833039 - DNA, 25 bp, Mus musculus
tctgcatgtatttttggtgagccaa

SEQ ID NO: 833040 - DNA, 25 bp, Mus musculus
tctgcatgtcgaagaggtcacctca

SEQ ID NO: 833041 - DNA, 25 bp, Mus musculus
tctgcatgtcgatgaggtcacctca

SEQ ID NO: 833042 - DNA, 25 bp, Mus musculus
tctgcatgtgatacaccatactggg

SEQ ID NO: 833043 - DNA, 25 bp, Mus musculus
tctgcatgtgattcaccatactggg

SEQ ID NO: 833044 - DNA, 25 bp, Mus musculus
tctgcatgtgcacgggtcactctaa

SEQ ID NO: 833045 - DNA, 25 bp, Mus musculus
tctgcatgtgcaggggtcactctaa

SEQ ID NO: 833046 - DNA, 25 bp, Mus musculus
tctgcatgtgctacctattacttta

SEQ ID NO: 833047 - DNA, 25 bp, Mus musculus
tctgcatgtgctacgggcccaagaa

SEQ ID NO: 833048 - DNA, 25 bp, Mus musculus
tctgcatgtgcttcctattacttta

SEQ ID NO: 833049 - DNA, 25 bp, Mus musculus
tctgcatgtgcttcgggcccaagaa

SEQ ID NO: 833050 - DNA, 25 bp, Mus musculus
tctgcatgtggcactctgggagtct

SEQ ID NO: 833051 - DNA, 25 bp, Mus musculus
tctgcatgtggctctctgggagtct

SEQ ID NO: 833052 - DNA, 25 bp, Mus musculus
tctgcatgtgtgctggtgtctgaca

SEQ ID NO: 833053 - DNA, 25 bp, Mus musculus
tctgcatgtgtggtggtgtctgaca

SEQ ID NO: 833054 - DNA, 25 bp, Mus musculus
tctgcatgttgcctagttgatttaa

SEQ ID NO: 833055 - DNA, 25 bp, Mus musculus
tctgcatgttgcgtagttgatttaa

SEQ ID NO: 833056 - DNA, 25 bp, Mus musculus
tctgcattcaggaaaaaattggttt

SEQ ID NO: 833057 - DNA, 25 bp, Mus musculus
tctgcattcaggtaaaaattggttt

SEQ ID NO: 833058 - DNA, 25 bp, Mus musculus
tctgcattcatgagtataggattca

SEQ ID NO: 833059 - DNA, 25 bp, Mus musculus
tctgcattcatgtgtataggattca

SEQ ID NO: 833060 - DNA, 25 bp, Mus musculus
tctgcattccagcaggattgtactg

SEQ ID NO: 833061 - DNA, 25 bp, Mus musculus
tctgcattccaggaggattgtactg

SEQ ID NO: 833062 - DNA, 25 bp, Mus musculus
tctgcattcccactgggcagtgatg

SEQ ID NO: 833063 - DNA, 25 bp, Mus musculus
tctgcattcccagtgggcagtgatg

SEQ ID NO: 833064 - DNA, 25 bp, Mus musculus
tctgcattccctcatctacaagatg

SEQ ID NO: 833065 - DNA, 25 bp, Mus musculus
tctgcattccctgatctacaagatg

SEQ ID NO: 833066 - DNA, 25 bp, Mus musculus
tctgcattcctgacacatgatggac

SEQ ID NO: 833067 - DNA, 25 bp, Mus musculus
tctgcattcctgtcacatgatggac

SEQ ID NO: 833068 - DNA, 25 bp, Mus musculus
tctgcattcgtcagcacggttggca

SEQ ID NO: 833069 - DNA, 25 bp, Mus musculus
tctgcattcgtctgcacggttggca

SEQ ID NO: 833070 - DNA, 25 bp, Mus musculus
tctgcattctccagtcacagaggtg

SEQ ID NO: 833071 - DNA, 25 bp, Mus musculus
tctgcattctcctgtcacagaggtg

SEQ ID NO: 833072 - DNA, 25 bp, Mus musculus
tctgcattctctacttgagtgccca

SEQ ID NO: 833073 - DNA, 25 bp, Mus musculus
tctgcattctcttcttgagtgccca

SEQ ID NO: 833074 - DNA, 25 bp, Mus musculus
tctgcattctgaccctagttctgat

SEQ ID NO: 833075 - DNA, 25 bp, Mus musculus
tctgcattctgagcctagttctgat

SEQ ID NO: 833076 - DNA, 25 bp, Mus musculus
tctgcattgaacacatctgcaagta

SEQ ID NO: 833077 - DNA, 25 bp, Mus musculus
tctgcattgaactcatctgcaagta

SEQ ID NO: 833078 - DNA, 25 bp, Mus musculus
tctgcattgcctagggttacacaaa

SEQ ID NO: 833079 - DNA, 25 bp, Mus musculus
tctgcattgccttgggttacacaaa

SEQ ID NO: 833080 - DNA, 25 bp, Mus musculus
tctgcattgcttctcaaatatccat

SEQ ID NO: 833081 - DNA, 25 bp, Mus musculus
tctgcattgcttgtcaaatatccat

SEQ ID NO: 833082 - DNA, 25 bp, Mus musculus
tctgcattggaaacatgtggtgagt

SEQ ID NO: 833083 - DNA, 25 bp, Mus musculus
tctgcattggaatcatgtggtgagt

SEQ ID NO: 833084 - DNA, 25 bp, Mus musculus
tctgcattgtctagggagtcttctg

SEQ ID NO: 833085 - DNA, 25 bp, Mus musculus
tctgcattgtcttgggagtcttctg

SEQ ID NO: 833086 - DNA, 25 bp, Mus musculus
tctgcatttagcagtatctatatat

SEQ ID NO: 833087 - DNA, 25 bp, Mus musculus
tctgcatttagctgtatctatatat

SEQ ID NO: 833088 - DNA, 25 bp, Mus musculus
tctgcatttcataacctgggttcta

SEQ ID NO: 833089 - DNA, 25 bp, Mus musculus
tctgcatttcattacctgggttcta

SEQ ID NO: 833090 - DNA, 25 bp, Mus musculus
tctgcatttcctcttttctcaggta

SEQ ID NO: 833091 - DNA, 25 bp, Mus musculus
tctgcatttcctgttttctcaggta

SEQ ID NO: 833092 - DNA, 25 bp, Mus musculus
tctgcatttgagcacacagggtcat

SEQ ID NO: 833093 - DNA, 25 bp, Mus musculus
tctgcatttgaggacacagggtcat

SEQ ID NO: 833094 - DNA, 25 bp, Mus musculus
tctgcatttgtactctgtggacggt

SEQ ID NO: 833095 - DNA, 25 bp, Mus musculus
tctgcatttgtagtctgtggacggt

SEQ ID NO: 833096 - DNA, 25 bp, Mus musculus
tctgcattttccattgtagaagttt

SEQ ID NO: 833097 - DNA, 25 bp, Mus musculus
tctgcattttcctttgtagaagttt

SEQ ID NO: 833098 - DNA, 25 bp, Mus musculus
tctgcattttctaaccttctaccga

SEQ ID NO: 833099 - DNA, 25 bp, Mus musculus
tctgcattttctaatcctcctggtg

SEQ ID NO: 833100 - DNA, 25 bp, Mus musculus
tctgcattttcttaccttctaccga

SEQ ID NO: 833101 - DNA, 25 bp, Mus musculus
tctgcattttcttatcctcctggtg

SEQ ID NO: 833102 - DNA, 25 bp, Mus musculus
tctgcatttttcattccgtgtgact

SEQ ID NO: 833103 - DNA, 25 bp, Mus musculus
tctgcatttttctttccgtgtgact

SEQ ID NO: 833104 - DNA, 25 bp, Mus musculus
tctgccaaagatatcatacgacatt

SEQ ID NO: 833105 - DNA, 25 bp, Mus musculus
tctgccaaagatttcatacgacatt

SEQ ID NO: 833106 - DNA, 25 bp, Mus musculus
tctgccaaatctaggtgcacagttt

SEQ ID NO: 833107 - DNA, 25 bp, Mus musculus
tctgccaaatcttggtgcacagttt

SEQ ID NO: 833108 - DNA, 25 bp, Mus musculus
tctgccaaccggattgtcagcatcg

SEQ ID NO: 833109 - DNA, 25 bp, Mus musculus
tctgccaaccggtttgtcagcatcg

SEQ ID NO: 833110 - DNA, 25 bp, Mus musculus
tctgccaaccttcctctagagtgct

SEQ ID NO: 833111 - DNA, 25 bp, Mus musculus
tctgccaaccttgctctagagtgct

SEQ ID NO: 833112 - DNA, 25 bp, Mus musculus
tctgccaacggcatgagctgggtaa

SEQ ID NO: 833113 - DNA, 25 bp, Mus musculus
tctgccaacggcttgagctgggtaa

SEQ ID NO: 833114 - DNA, 25 bp, Mus musculus
tctgccaactaaagtgctcgcgcac

SEQ ID NO: 833115 - DNA, 25 bp, Mus musculus
tctgccaactaatgtgctcgcgcac

SEQ ID NO: 833116 - DNA, 25 bp, Mus musculus
tctgccaactaccagccatcttggg

SEQ ID NO: 833117 - DNA, 25 bp, Mus musculus
tctgccaactacgagccatcttggg

SEQ ID NO: 833118 - DNA, 25 bp, Mus musculus
tctgccaagataccactgaccatgg

SEQ ID NO: 833119 - DNA, 25 bp, Mus musculus
tctgccaagatagcactgaccatgg

SEQ ID NO: 833120 - DNA, 25 bp, Mus musculus
tctgccaagcatattcctggttgta

SEQ ID NO: 833121 - DNA, 25 bp, Mus musculus
tctgccaagcattttcctggttgta

SEQ ID NO: 833122 - DNA, 25 bp, Mus musculus
tctgccaagcgcaccaaggaggagt

SEQ ID NO: 833123 - DNA, 25 bp, Mus musculus
tctgccaagcgctccaaggaggagt

SEQ ID NO: 833124 - DNA, 25 bp, Mus musculus
tctgccaagtgcctatttgccaaga

SEQ ID NO: 833125 - DNA, 25 bp, Mus musculus
tctgccaagtgcgtatttgccaaga

SEQ ID NO: 833126 - DNA, 25 bp, Mus musculus
tctgccaataccagctgaactgaac

SEQ ID NO: 833127 - DNA, 25 bp, Mus musculus
tctgccaatacctgctgaactgaac

SEQ ID NO: 833128 - DNA, 25 bp, Mus musculus
tctgccaatgtgctgggaagactga

SEQ ID NO: 833129 - DNA, 25 bp, Mus musculus
tctgccaatgtggtgggaagactga

SEQ ID NO: 833130 - DNA, 25 bp, Mus musculus
tctgccaattttcctcttggtattt

SEQ ID NO: 833131 - DNA, 25 bp, Mus musculus
tctgccaattttgctcttggtattt

SEQ ID NO: 833132 - DNA, 25 bp, Mus musculus
tctgccacactgcaatttaactgtt

SEQ ID NO: 833133 - DNA, 25 bp, Mus musculus
tctgccacactggaatttaactgtt

SEQ ID NO: 833134 - DNA, 25 bp, Mus musculus
tctgccacattgatccctgatagtt

SEQ ID NO: 833135 - DNA, 25 bp, Mus musculus
tctgccacattgttccctgatagtt

SEQ ID NO: 833136 - DNA, 25 bp, Mus musculus
tctgccactcacctatgaagtcatt

SEQ ID NO: 833137 - DNA, 25 bp, Mus musculus
tctgccactcacgtatgaagtcatt

SEQ ID NO: 833138 - DNA, 25 bp, Mus musculus
tctgccactgagaccagaacatgta

SEQ ID NO: 833139 - DNA, 25 bp, Mus musculus
tctgccactgagtccagaacatgta

SEQ ID NO: 833140 - DNA, 25 bp, Mus musculus
tctgccactgctactctaaggatga

SEQ ID NO: 833141 - DNA, 25 bp, Mus musculus
tctgccactgctcgtgttagtttag

SEQ ID NO: 833142 - DNA, 25 bp, Mus musculus
tctgccactgctggtgttagtttag

SEQ ID NO: 833143 - DNA, 25 bp, Mus musculus
tctgccactgcttctctaaggatga

SEQ ID NO: 833144 - DNA, 25 bp, Mus musculus
tctgccactgttccagagtaggtga

SEQ ID NO: 833145 - DNA, 25 bp, Mus musculus
tctgccactgttgcagagtaggtga

SEQ ID NO: 833146 - DNA, 25 bp, Mus musculus
tctgccagagagcaaatgctaaaaa

SEQ ID NO: 833147 - DNA, 25 bp, Mus musculus
tctgccagagaggaaatgctaaaaa

SEQ ID NO: 833148 - DNA, 25 bp, Mus musculus
tctgccagagccaaacctaacttgg

SEQ ID NO: 833149 - DNA, 25 bp, Mus musculus
tctgccagagcctaacctaacttgg

SEQ ID NO: 833150 - DNA, 25 bp, Mus musculus
tctgccagaggcattaccattggat

SEQ ID NO: 833151 - DNA, 25 bp, Mus musculus
tctgccagaggctttaccattggat

SEQ ID NO: 833152 - DNA, 25 bp, Mus musculus
tctgccagaggtagcgcacgactct

SEQ ID NO: 833153 - DNA, 25 bp, Mus musculus
tctgccagaggttgcgcacgactct

SEQ ID NO: 833154 - DNA, 25 bp, Mus musculus
tctgccagatcccaatcatgtacaa

SEQ ID NO: 833155 - DNA, 25 bp, Mus musculus
tctgccagatccgaatcatgtacaa

SEQ ID NO: 833156 - DNA, 25 bp, Mus musculus
tctgccagcacacacggagtctttg

SEQ ID NO: 833157 - DNA, 25 bp, Mus musculus
tctgccagcacagacggagtctttg

SEQ ID NO: 833158 - DNA, 25 bp, Mus musculus
tctgccagctccaagggaactttag

SEQ ID NO: 833159 - DNA, 25 bp, Mus musculus
tctgccagctcctagggaactttag

SEQ ID NO: 833160 - DNA, 25 bp, Mus musculus
tctgccagctgaagtgccctattgc

SEQ ID NO: 833161 - DNA, 25 bp, Mus musculus
tctgccagctgatgtgccctattgc

SEQ ID NO: 833162 - DNA, 25 bp, Mus musculus
tctgccagcttcaatcatggtctaa

SEQ ID NO: 833163 - DNA, 25 bp, Mus musculus
tctgccagcttctatcatggtctaa

SEQ ID NO: 833164 - DNA, 25 bp, Mus musculus
tctgccagggagacaagtacacacc

SEQ ID NO: 833165 - DNA, 25 bp, Mus musculus
tctgccagggagtcaagtacacacc

SEQ ID NO: 833166 - DNA, 25 bp, Mus musculus
tctgccaggtcactgtgttacttga

SEQ ID NO: 833167 - DNA, 25 bp, Mus musculus
tctgccaggtcagtgtgttacttga

SEQ ID NO: 833168 - DNA, 25 bp, Mus musculus
tctgccaggtggactgtttcctcca

SEQ ID NO: 833169 - DNA, 25 bp, Mus musculus
tctgccaggtggagcttagctcaaa

SEQ ID NO: 833170 - DNA, 25 bp, Mus musculus
tctgccaggtggtctgtttcctcca

SEQ ID NO: 833171 - DNA, 25 bp, Mus musculus
tctgccaggtggtgcttagctcaaa

SEQ ID NO: 833172 - DNA, 25 bp, Mus musculus
tctgccaggtttcttgtgagctaca

SEQ ID NO: 833173 - DNA, 25 bp, Mus musculus
tctgccaggtttgttgtgagctaca

SEQ ID NO: 833174 - DNA, 25 bp, Mus musculus
tctgccagtcccactatggtccgct

SEQ ID NO: 833175 - DNA, 25 bp, Mus musculus
tctgccagtccctctatggtccgct

SEQ ID NO: 833176 - DNA, 25 bp, Mus musculus
tctgccagtcctattgtatgcattt

SEQ ID NO: 833177 - DNA, 25 bp, Mus musculus
tctgccagtccttttgtatgcattt

SEQ ID NO: 833178 - DNA, 25 bp, Mus musculus
tctgccagtcttcacatgtcataat

SEQ ID NO: 833179 - DNA, 25 bp, Mus musculus
tctgccagtcttgacatgtcataat

SEQ ID NO: 833180 - DNA, 25 bp, Mus musculus
tctgccagttggcacgttctgacag

SEQ ID NO: 833181 - DNA, 25 bp, Mus musculus
tctgccagttgggacgttctgacag

SEQ ID NO: 833182 - DNA, 25 bp, Mus musculus
tctgccatcaccagacctggaatgt

SEQ ID NO: 833183 - DNA, 25 bp, Mus musculus
tctgccatcacctgacctggaatgt

SEQ ID NO: 833184 - DNA, 25 bp, Mus musculus
tctgccatcaggctaaattccccaa

SEQ ID NO: 833185 - DNA, 25 bp, Mus musculus
tctgccatcagggtaaattccccaa

SEQ ID NO: 833186 - DNA, 25 bp, Mus musculus
tctgccatcatgagccacttacagt

SEQ ID NO: 833187 - DNA, 25 bp, Mus musculus
tctgccatcatgtgccacttacagt

SEQ ID NO: 833188 - DNA, 25 bp, Mus musculus
tctgccatcattctgtgtcaacaag

SEQ ID NO: 833189 - DNA, 25 bp, Mus musculus
tctgccatcattgtgtgtcaacaag

SEQ ID NO: 833190 - DNA, 25 bp, Mus musculus
tctgccatctatccaatgtccatat

SEQ ID NO: 833191 - DNA, 25 bp, Mus musculus
tctgccatctatgcaatgtccatat

SEQ ID NO: 833192 - DNA, 25 bp, Mus musculus
tctgccatctgcagttatgggagca

SEQ ID NO: 833193 - DNA, 25 bp, Mus musculus
tctgccatctgctgttatgggagca

SEQ ID NO: 833194 - DNA, 25 bp, Mus musculus
tctgccatcttcagagcacaggtct

SEQ ID NO: 833195 - DNA, 25 bp, Mus musculus
tctgccatcttctgagcacaggtct

SEQ ID NO: 833196 - DNA, 25 bp, Mus musculus
tctgccatgaaacacttgtcctaga

SEQ ID NO: 833197 - DNA, 25 bp, Mus musculus
tctgccatgaaagacttgtcctaga

SEQ ID NO: 833198 - DNA, 25 bp, Mus musculus
tctgccatgacgattaaaagccaat

SEQ ID NO: 833199 - DNA, 25 bp, Mus musculus
tctgccatgacgtttaaaagccaat

SEQ ID NO: 833200 - DNA, 25 bp, Mus musculus
tctgccatgcccacgggacgcacgg

SEQ ID NO: 833201 - DNA, 25 bp, Mus musculus
tctgccatgccctcgggacgcacgg

SEQ ID NO: 833202 - DNA, 25 bp, Mus musculus
tctgccatgctgaaggagagattcc

SEQ ID NO: 833203 - DNA, 25 bp, Mus musculus
tctgccatgctgtaggagagattcc

SEQ ID NO: 833204 - DNA, 25 bp, Mus musculus
tctgccatggagacggagtgctgtc

SEQ ID NO: 833205 - DNA, 25 bp, Mus musculus
tctgccatggagtcggagtgctgtc

SEQ ID NO: 833206 - DNA, 25 bp, Mus musculus
tctgccatgtcccttactaaaacaa

SEQ ID NO: 833207 - DNA, 25 bp, Mus musculus
tctgccatgtccgttactaaaacaa

SEQ ID NO: 833208 - DNA, 25 bp, Mus musculus
tctgccatgttgaagaatccacaat

SEQ ID NO: 833209 - DNA, 25 bp, Mus musculus
tctgccatgttgtagaatccacaat

SEQ ID NO: 833210 - DNA, 25 bp, Mus musculus
tctgccattataccacatgttaaat

SEQ ID NO: 833211 - DNA, 25 bp, Mus musculus
tctgccattatagcacatgttaaat

SEQ ID NO: 833212 - DNA, 25 bp, Mus musculus
tctgccattatgacagtgacctgtg

SEQ ID NO: 833213 - DNA, 25 bp, Mus musculus
tctgccattatgtcagtgacctgtg

SEQ ID NO: 833214 - DNA, 25 bp, Mus musculus
tctgccattccaactgacttcatct

SEQ ID NO: 833215 - DNA, 25 bp, Mus musculus
tctgccattccatctgacttcatct

SEQ ID NO: 833216 - DNA, 25 bp, Mus musculus
tctgcccaaagtaatgatagtaggt

SEQ ID NO: 833217 - DNA, 25 bp, Mus musculus
tctgcccaaagttatgatagtaggt

SEQ ID NO: 833218 - DNA, 25 bp, Mus musculus
tctgcccaactaagctcctggtagg

SEQ ID NO: 833219 - DNA, 25 bp, Mus musculus
tctgcccaactatgctcctggtagg

SEQ ID NO: 833220 - DNA, 25 bp, Mus musculus
tctgcccaagccatgcaactatgaa

SEQ ID NO: 833221 - DNA, 25 bp, Mus musculus
tctgcccaagccttgcaactatgaa

SEQ ID NO: 833222 - DNA, 25 bp, Mus musculus
tctgcccaaggcagcattccagtat

SEQ ID NO: 833223 - DNA, 25 bp, Mus musculus
tctgcccaaggctgcattccagtat

SEQ ID NO: 833224 - DNA, 25 bp, Mus musculus
tctgcccacgtgctcaacgtgcagt

SEQ ID NO: 833225 - DNA, 25 bp, Mus musculus
tctgcccacgtggtcaacgtgcagt

SEQ ID NO: 833226 - DNA, 25 bp, Mus musculus
tctgcccactgtagctgttagcaaa

SEQ ID NO: 833227 - DNA, 25 bp, Mus musculus
tctgcccactgttgctgttagcaaa

SEQ ID NO: 833228 - DNA, 25 bp, Mus musculus
tctgcccagcaaagtttgaccaaat

SEQ ID NO: 833229 - DNA, 25 bp, Mus musculus
tctgcccagcaatgtttgaccaaat

SEQ ID NO: 833230 - DNA, 25 bp, Mus musculus
tctgcccaggatcgattaggttgtt

SEQ ID NO: 833231 - DNA, 25 bp, Mus musculus
tctgcccaggatggattaggttgtt

SEQ ID NO: 833232 - DNA, 25 bp, Mus musculus
tctgcccaggccctctgaagtaaat

SEQ ID NO: 833233 - DNA, 25 bp, Mus musculus
tctgcccaggccgtctgaagtaaat

SEQ ID NO: 833234 - DNA, 25 bp, Mus musculus
tctgcccagtgcaggttttatgcag

SEQ ID NO: 833235 - DNA, 25 bp, Mus musculus
tctgcccagtgctggttttatgcag

SEQ ID NO: 833236 - DNA, 25 bp, Mus musculus
tctgcccatcttcccgttttgtttt

SEQ ID NO: 833237 - DNA, 25 bp, Mus musculus
tctgcccatcttgccgttttgtttt

SEQ ID NO: 833238 - DNA, 25 bp, Mus musculus
tctgcccatgtaacacctcatttaa

SEQ ID NO: 833239 - DNA, 25 bp, Mus musculus
tctgcccatgtatcacctcatttaa

SEQ ID NO: 833240 - DNA, 25 bp, Mus musculus
tctgcccattggattctttgcgata

SEQ ID NO: 833241 - DNA, 25 bp, Mus musculus
tctgcccattggtttctttgcgata

SEQ ID NO: 833242 - DNA, 25 bp, Mus musculus
tctgccccaaggactgctgggaagt

SEQ ID NO: 833243 - DNA, 25 bp, Mus musculus
tctgccccaaggtctgctgggaagt

SEQ ID NO: 833244 - DNA, 25 bp, Mus musculus
tctgccccagagcttacatcaattg

SEQ ID NO: 833245 - DNA, 25 bp, Mus musculus
tctgccccagaggttacatcaattg

SEQ ID NO: 833246 - DNA, 25 bp, Mus musculus
tctgccccagctcgaaatccgagga

SEQ ID NO: 833247 - DNA, 25 bp, Mus musculus
tctgccccagctggaaatccgagga

SEQ ID NO: 833248 - DNA, 25 bp, Mus musculus
tctgccccagtcaggctgggtagcc

SEQ ID NO: 833249 - DNA, 25 bp, Mus musculus
tctgccccagtctggctgggtagcc

SEQ ID NO: 833250 - DNA, 25 bp, Mus musculus
tctgccccatccactgttgttgttt

SEQ ID NO: 833251 - DNA, 25 bp, Mus musculus
tctgccccatcctctgttgttgttt

SEQ ID NO: 833252 - DNA, 25 bp, Mus musculus
tctgccccgggacgcctaggagcct

SEQ ID NO: 833253 - DNA, 25 bp, Mus musculus
tctgccccgggaggcctaggagcct

SEQ ID NO: 833254 - DNA, 25 bp, Mus musculus
tctgcccctcacaatatacttttag

SEQ ID NO: 833255 - DNA, 25 bp, Mus musculus
tctgcccctcactatatacttttag

SEQ ID NO: 833256 - DNA, 25 bp, Mus musculus
tctgcccctgaaagtagcaacactc

SEQ ID NO: 833257 - DNA, 25 bp, Mus musculus
tctgcccctgaatgtagcaacactc

SEQ ID NO: 833258 - DNA, 25 bp, Mus musculus
tctgcccctggaactcagtgacttt

SEQ ID NO: 833259 - DNA, 25 bp, Mus musculus
tctgcccctggatctcagtgacttt

SEQ ID NO: 833260 - DNA, 25 bp, Mus musculus
tctgccccttgaccctgtgtatatc

SEQ ID NO: 833261 - DNA, 25 bp, Mus musculus
tctgccccttgagcctgtgtatatc

SEQ ID NO: 833262 - DNA, 25 bp, Mus musculus
tctgcccctttaacgtttcttctag

SEQ ID NO: 833263 - DNA, 25 bp, Mus musculus
tctgcccctttatcgtttcttctag

SEQ ID NO: 833264 - DNA, 25 bp, Mus musculus
tctgcccgaagaaccaagtccaagt

SEQ ID NO: 833265 - DNA, 25 bp, Mus musculus
tctgcccgaagatccaagtccaagt

SEQ ID NO: 833266 - DNA, 25 bp, Mus musculus
tctgcccggtcactggtgacaatag

SEQ ID NO: 833267 - DNA, 25 bp, Mus musculus
tctgcccggtcagtggtgacaatag

SEQ ID NO: 833268 - DNA, 25 bp, Mus musculus
tctgcccgtaccctggaatgacaaa

SEQ ID NO: 833269 - DNA, 25 bp, Mus musculus
tctgcccgtaccgtggaatgacaaa

SEQ ID NO: 833270 - DNA, 25 bp, Mus musculus
tctgccctagtcctctggtatgtaa

SEQ ID NO: 833271 - DNA, 25 bp, Mus musculus
tctgccctagtcgtctggtatgtaa

SEQ ID NO: 833272 - DNA, 25 bp, Mus musculus
tctgccctatcaactttcgatggta

SEQ ID NO: 833273 - DNA, 25 bp, Mus musculus
tctgccctatcatctttcgatggta

SEQ ID NO: 833274 - DNA, 25 bp, Mus musculus
tctgccctcaatccgatggtttatg

SEQ ID NO: 833275 - DNA, 25 bp, Mus musculus
tctgccctcaatgcgatggtttatg

SEQ ID NO: 833276 - DNA, 25 bp, Mus musculus
tctgccctcagaccttaggatagtg

SEQ ID NO: 833277 - DNA, 25 bp, Mus musculus
tctgccctcagagcttaggatagtg

SEQ ID NO: 833278 - DNA, 25 bp, Mus musculus
tctgccctccagacaggtgcaaagg

SEQ ID NO: 833279 - DNA, 25 bp, Mus musculus
tctgccctccagtcaggtgcaaagg

SEQ ID NO: 833280 - DNA, 25 bp, Mus musculus
tctgccctctgacttgctgaaatct

SEQ ID NO: 833281 - DNA, 25 bp, Mus musculus
tctgccctctgagttgctgaaatct

SEQ ID NO: 833282 - DNA, 25 bp, Mus musculus
tctgccctgagcagtttcactatgg

SEQ ID NO: 833283 - DNA, 25 bp, Mus musculus
tctgccctgagctgtttcactatgg

SEQ ID NO: 833284 - DNA, 25 bp, Mus musculus
tctgccctgagtaatgcgtatctta

SEQ ID NO: 833285 - DNA, 25 bp, Mus musculus
tctgccctgagttatgcgtatctta

SEQ ID NO: 833286 - DNA, 25 bp, Mus musculus
tctgccctgccaacttattaggttg

SEQ ID NO: 833287 - DNA, 25 bp, Mus musculus
tctgccctgccatcttattaggttg

SEQ ID NO: 833288 - DNA, 25 bp, Mus musculus
tctgccctggcacagactgagggtt

SEQ ID NO: 833289 - DNA, 25 bp, Mus musculus
tctgccctggcactatatggagttt

SEQ ID NO: 833290 - DNA, 25 bp, Mus musculus
tctgccctggcagagactgagggtt

SEQ ID NO: 833291 - DNA, 25 bp, Mus musculus
tctgccctggcagtatatggagttt

SEQ ID NO: 833292 - DNA, 25 bp, Mus musculus
tctgcccttaaccatgtgacttgga

SEQ ID NO: 833293 - DNA, 25 bp, Mus musculus
tctgcccttaacgatgtgacttgga

SEQ ID NO: 833294 - DNA, 25 bp, Mus musculus
tctgcccttaatatcaaaaggaaga

SEQ ID NO: 833295 - DNA, 25 bp, Mus musculus
tctgcccttaatttcaaaaggaaga

SEQ ID NO: 833296 - DNA, 25 bp, Mus musculus
tctgcccttcagcatgacaagaggt

SEQ ID NO: 833297 - DNA, 25 bp, Mus musculus
tctgcccttcaggatgacaagaggt

SEQ ID NO: 833298 - DNA, 25 bp, Mus musculus
tctgcccttctcctgaggaaacaga

SEQ ID NO: 833299 - DNA, 25 bp, Mus musculus
tctgcccttctcgtgaggaaacaga

SEQ ID NO: 833300 - DNA, 25 bp, Mus musculus
tctgcccttgaaatatctctgtata

SEQ ID NO: 833301 - DNA, 25 bp, Mus musculus
tctgcccttgaattatctctgtata

SEQ ID NO: 833302 - DNA, 25 bp, Mus musculus
tctgcccttgatagaatccaatggg

SEQ ID NO: 833303 - DNA, 25 bp, Mus musculus
tctgcccttgattgaatccaatggg

SEQ ID NO: 833304 - DNA, 25 bp, Mus musculus
tctgcccttggacacgtgtatatta

SEQ ID NO: 833305 - DNA, 25 bp, Mus musculus
tctgcccttggagacgtgtatatta

SEQ ID NO: 833306 - DNA, 25 bp, Mus musculus
tctgccctttctcgagacagttagc

SEQ ID NO: 833307 - DNA, 25 bp, Mus musculus
tctgccctttctggagacagttagc

SEQ ID NO: 833308 - DNA, 25 bp, Mus musculus
tctgcccttttaacaccctatagtg

SEQ ID NO: 833309 - DNA, 25 bp, Mus musculus
tctgcccttttatcaccctatagtg

SEQ ID NO: 833310 - DNA, 25 bp, Mus musculus
tctgccgacgctctctggagagcat

SEQ ID NO: 833311 - DNA, 25 bp, Mus musculus
tctgccgacgctgtctggagagcat

SEQ ID NO: 833312 - DNA, 25 bp, Mus musculus
tctgccgactctctattctagtttt

SEQ ID NO: 833313 - DNA, 25 bp, Mus musculus
tctgccgactctgtattctagtttt

SEQ ID NO: 833314 - DNA, 25 bp, Mus musculus
tctgccgagcacactaacagggtga

SEQ ID NO: 833315 - DNA, 25 bp, Mus musculus
tctgccgagcactctaacagggtga

SEQ ID NO: 833316 - DNA, 25 bp, Mus musculus
tctgccgcagaaatttgtctctgag

SEQ ID NO: 833317 - DNA, 25 bp, Mus musculus
tctgccgcagaattttgtctctgag

SEQ ID NO: 833318 - DNA, 25 bp, Mus musculus
tctgccgcagagaagcgagaaacca

SEQ ID NO: 833319 - DNA, 25 bp, Mus musculus
tctgccgcagagtagcgagaaacca

SEQ ID NO: 833320 - DNA, 25 bp, Mus musculus
tctgccggcgagcagcatctggtca

SEQ ID NO: 833321 - DNA, 25 bp, Mus musculus
tctgccggcgaggagcatctggtca

SEQ ID NO: 833322 - DNA, 25 bp, Mus musculus
tctgccgggctgacagtcactgaat

SEQ ID NO: 833323 - DNA, 25 bp, Mus musculus
tctgccgggctgtcagtcactgaat

SEQ ID NO: 833324 - DNA, 25 bp, Mus musculus
tctgccgggtgtcactaaaatgtta

SEQ ID NO: 833325 - DNA, 25 bp, Mus musculus
tctgccgggtgtgactaaaatgtta

SEQ ID NO: 833326 - DNA, 25 bp, Mus musculus
tctgccgtccaaagctgggattgaa

SEQ ID NO: 833327 - DNA, 25 bp, Mus musculus
tctgccgtccaatgctgggattgaa

SEQ ID NO: 833328 - DNA, 25 bp, Mus musculus
tctgccgtctctcgatgtgaagtct

SEQ ID NO: 833329 - DNA, 25 bp, Mus musculus
tctgccgtctctggatgtgaagtct

SEQ ID NO: 833330 - DNA, 25 bp, Mus musculus
tctgccgtggctccttccttactgg

SEQ ID NO: 833331 - DNA, 25 bp, Mus musculus
tctgccgtggctgcttccttactgg

SEQ ID NO: 833332 - DNA, 25 bp, Mus musculus
tctgccgtggtgaacttgtcgaata

SEQ ID NO: 833333 - DNA, 25 bp, Mus musculus
tctgccgtggtgtacttgtcgaata

SEQ ID NO: 833334 - DNA, 25 bp, Mus musculus
tctgcctaaagacctgtaccaatga

SEQ ID NO: 833335 - DNA, 25 bp, Mus musculus
tctgcctaaagagctgtaccaatga

SEQ ID NO: 833336 - DNA, 25 bp, Mus musculus
tctgcctaaagtatccggccatcca

SEQ ID NO: 833337 - DNA, 25 bp, Mus musculus
tctgcctaaagtttccggccatcca

SEQ ID NO: 833338 - DNA, 25 bp, Mus musculus
tctgcctaagtcaatctgatctatt

SEQ ID NO: 833339 - DNA, 25 bp, Mus musculus
tctgcctaagtctatctgatctatt

SEQ ID NO: 833340 - DNA, 25 bp, Mus musculus
tctgcctaatgtattgtttcaaaat

SEQ ID NO: 833341 - DNA, 25 bp, Mus musculus
tctgcctaatgttttgtttcaaaat

SEQ ID NO: 833342 - DNA, 25 bp, Mus musculus
tctgcctactgcctcaggtgacggg

SEQ ID NO: 833343 - DNA, 25 bp, Mus musculus
tctgcctactgcgtcaggtgacggg

SEQ ID NO: 833344 - DNA, 25 bp, Mus musculus
tctgcctagcttatgcaactcttta

SEQ ID NO: 833345 - DNA, 25 bp, Mus musculus
tctgcctagcttttgcaactcttta

SEQ ID NO: 833346 - DNA, 25 bp, Mus musculus
tctgcctagggaaggtgttatccac

SEQ ID NO: 833347 - DNA, 25 bp, Mus musculus
tctgcctagggatggtgttatccac

SEQ ID NO: 833348 - DNA, 25 bp, Mus musculus
tctgcctatagcacagggtgtgtct

SEQ ID NO: 833349 - DNA, 25 bp, Mus musculus
tctgcctatagctcagggtgtgtct

SEQ ID NO: 833350 - DNA, 25 bp, Mus musculus
tctgcctatcacagataactctgct

SEQ ID NO: 833351 - DNA, 25 bp, Mus musculus
tctgcctatcactgataactctgct

SEQ ID NO: 833352 - DNA, 25 bp, Mus musculus
tctgcctattttcaggccatgtttg

SEQ ID NO: 833353 - DNA, 25 bp, Mus musculus
tctgcctattttgaggccatgtttg

SEQ ID NO: 833354 - DNA, 25 bp, Mus musculus
tctgcctcaagaccttctcattgat

SEQ ID NO: 833355 - DNA, 25 bp, Mus musculus
tctgcctcaagagcttctcattgat

SEQ ID NO: 833356 - DNA, 25 bp, Mus musculus
tctgcctcacaaacggaacttaaag

SEQ ID NO: 833357 - DNA, 25 bp, Mus musculus
tctgcctcacaatcggaacttaaag

SEQ ID NO: 833358 - DNA, 25 bp, Mus musculus
tctgcctcacagaattgttccaaga

SEQ ID NO: 833359 - DNA, 25 bp, Mus musculus
tctgcctcacagtattgttccaaga

SEQ ID NO: 833360 - DNA, 25 bp, Mus musculus
tctgcctcagaaaccacacttgaag

SEQ ID NO: 833361 - DNA, 25 bp, Mus musculus
tctgcctcagaatccacacttgaag

SEQ ID NO: 833362 - DNA, 25 bp, Mus musculus
tctgcctcagccctgatcatcaaag

SEQ ID NO: 833363 - DNA, 25 bp, Mus musculus
tctgcctcagccgtgatcatcaaag

SEQ ID NO: 833364 - DNA, 25 bp, Mus musculus
tctgcctcatggacactcagaagtg

SEQ ID NO: 833365 - DNA, 25 bp, Mus musculus
tctgcctcatggtcactcagaagtg

SEQ ID NO: 833366 - DNA, 25 bp, Mus musculus
tctgcctcatttcctgtgggtgcat

SEQ ID NO: 833367 - DNA, 25 bp, Mus musculus
tctgcctcatttcctttcagtgaaa

SEQ ID NO: 833368 - DNA, 25 bp, Mus musculus
tctgcctcatttgctgtgggtgcat

SEQ ID NO: 833369 - DNA, 25 bp, Mus musculus
tctgcctcatttgctttcagtgaaa

SEQ ID NO: 833370 - DNA, 25 bp, Mus musculus
tctgcctccaagactatggctggta

SEQ ID NO: 833371 - DNA, 25 bp, Mus musculus
tctgcctccaagtctatggctggta

SEQ ID NO: 833372 - DNA, 25 bp, Mus musculus
tctgcctcgtgtcttctaggcaagg

SEQ ID NO: 833373 - DNA, 25 bp, Mus musculus
tctgcctcgtgtgttctaggcaagg

SEQ ID NO: 833374 - DNA, 25 bp, Mus musculus
tctgcctctagcacacaactgtgaa

SEQ ID NO: 833375 - DNA, 25 bp, Mus musculus
tctgcctctagctcacaactgtgaa

SEQ ID NO: 833376 - DNA, 25 bp, Mus musculus
tctgcctctataacgagtactcttg

SEQ ID NO: 833377 - DNA, 25 bp, Mus musculus
tctgcctctatatcgagtactcttg

SEQ ID NO: 833378 - DNA, 25 bp, Mus musculus
tctgcctctcctcatgattacaaag

SEQ ID NO: 833379 - DNA, 25 bp, Mus musculus
tctgcctctcctgatgattacaaag

SEQ ID NO: 833380 - DNA, 25 bp, Mus musculus
tctgcctctctaacttggatcattg

SEQ ID NO: 833381 - DNA, 25 bp, Mus musculus
tctgcctctctatcttggatcattg

SEQ ID NO: 833382 - DNA, 25 bp, Mus musculus
tctgcctctctcatggtctgtcctg

SEQ ID NO: 833383 - DNA, 25 bp, Mus musculus
tctgcctctctcttggtctgtcctg

SEQ ID NO: 833384 - DNA, 25 bp, Mus musculus
tctgcctctgggagtggaagacatc

SEQ ID NO: 833385 - DNA, 25 bp, Mus musculus
tctgcctctgggtgtggaagacatc

SEQ ID NO: 833386 - DNA, 25 bp, Mus musculus
tctgcctcttacaaaccactgagtg

SEQ ID NO: 833387 - DNA, 25 bp, Mus musculus
tctgcctcttactaaccactgagtg

SEQ ID NO: 833388 - DNA, 25 bp, Mus musculus
tctgcctcttctattctgcaaagaa

SEQ ID NO: 833389 - DNA, 25 bp, Mus musculus
tctgcctcttcttttctgcaaagaa

SEQ ID NO: 833390 - DNA, 25 bp, Mus musculus
tctgcctcttgaccgctagaactta

SEQ ID NO: 833391 - DNA, 25 bp, Mus musculus
tctgcctcttgagcgctagaactta

SEQ ID NO: 833392 - DNA, 25 bp, Mus musculus
tctgcctgaaaaacgttccacattc

SEQ ID NO: 833393 - DNA, 25 bp, Mus musculus
tctgcctgaaaatcgttccacattc

SEQ ID NO: 833394 - DNA, 25 bp, Mus musculus
tctgcctgacgccaggcttacaata

SEQ ID NO: 833395 - DNA, 25 bp, Mus musculus
tctgcctgacgcgaggcttacaata

SEQ ID NO: 833396 - DNA, 25 bp, Mus musculus
tctgcctgatatccaaacctgctgt

SEQ ID NO: 833397 - DNA, 25 bp, Mus musculus
tctgcctgatatgcaaacctgctgt

SEQ ID NO: 833398 - DNA, 25 bp, Mus musculus
tctgcctgatgacctttgacttttt

SEQ ID NO: 833399 - DNA, 25 bp, Mus musculus
tctgcctgatgagctttgacttttt

SEQ ID NO: 833400 - DNA, 25 bp, Mus musculus
tctgcctgatttaacaacacatttc

SEQ ID NO: 833401 - DNA, 25 bp, Mus musculus
tctgcctgattttacaacacatttc

SEQ ID NO: 833402 - DNA, 25 bp, Mus musculus
tctgcctgcagaatagtgtgtactc

SEQ ID NO: 833403 - DNA, 25 bp, Mus musculus
tctgcctgcagattagtgtgtactc

SEQ ID NO: 833404 - DNA, 25 bp, Mus musculus
tctgcctgcaggaacatgtatccca

SEQ ID NO: 833405 - DNA, 25 bp, Mus musculus
tctgcctgcaggtacatgtatccca

SEQ ID NO: 833406 - DNA, 25 bp, Mus musculus
tctgcctgcataaacggcgccaaag

SEQ ID NO: 833407 - DNA, 25 bp, Mus musculus
tctgcctgcatatacggcgccaaag

SEQ ID NO: 833408 - DNA, 25 bp, Mus musculus
tctgcctgcatgctgttggctagga

SEQ ID NO: 833409 - DNA, 25 bp, Mus musculus
tctgcctgcatggtgttggctagga

SEQ ID NO: 833410 - DNA, 25 bp, Mus musculus
tctgcctgccaaagaactatatcta

SEQ ID NO: 833411 - DNA, 25 bp, Mus musculus
tctgcctgccaatgaactatatcta

SEQ ID NO: 833412 - DNA, 25 bp, Mus musculus
tctgcctgccacattgggtcaaaga

SEQ ID NO: 833413 - DNA, 25 bp, Mus musculus
tctgcctgccactttgggtcaaaga

SEQ ID NO: 833414 - DNA, 25 bp, Mus musculus
tctgcctgcctgagattgcgagggc

SEQ ID NO: 833415 - DNA, 25 bp, Mus musculus
tctgcctgcctgtgattgcgagggc

SEQ ID NO: 833416 - DNA, 25 bp, Mus musculus
tctgcctgcggtcggagatgcctat

SEQ ID NO: 833417 - DNA, 25 bp, Mus musculus
tctgcctgcggtgggagatgcctat

SEQ ID NO: 833418 - DNA, 25 bp, Mus musculus
tctgcctgcgtcataaaaaataagc

SEQ ID NO: 833419 - DNA, 25 bp, Mus musculus
tctgcctgcgtcttaaaaaataagc

SEQ ID NO: 833420 - DNA, 25 bp, Mus musculus
tctgcctgctacctggaactaaaat

SEQ ID NO: 833421 - DNA, 25 bp, Mus musculus
tctgcctgctacgtggaactaaaat

SEQ ID NO: 833422 - DNA, 25 bp, Mus musculus
tctgcctgctctcccctaagtatag

SEQ ID NO: 833423 - DNA, 25 bp, Mus musculus
tctgcctgctctgccctaagtatag

SEQ ID NO: 833424 - DNA, 25 bp, Mus musculus
tctgcctggactccaaatgctagga

SEQ ID NO: 833425 - DNA, 25 bp, Mus musculus
tctgcctggactctgatgtctgttt

SEQ ID NO: 833426 - DNA, 25 bp, Mus musculus
tctgcctggactgcaaatgctagga

SEQ ID NO: 833427 - DNA, 25 bp, Mus musculus
tctgcctggactgtgatgtctgttt

SEQ ID NO: 833428 - DNA, 25 bp, Mus musculus
tctgcctggattatgcagtcaaagt

SEQ ID NO: 833429 - DNA, 25 bp, Mus musculus
tctgcctggattttgcagtcaaagt

SEQ ID NO: 833430 - DNA, 25 bp, Mus musculus
tctgcctggtcacagcaaacacgaa

SEQ ID NO: 833431 - DNA, 25 bp, Mus musculus
tctgcctggtcagagcaaacacgaa

SEQ ID NO: 833432 - DNA, 25 bp, Mus musculus
tctgcctggtggactgctctgtgag

SEQ ID NO: 833433 - DNA, 25 bp, Mus musculus
tctgcctggtggtctgctctgtgag

SEQ ID NO: 833434 - DNA, 25 bp, Mus musculus
tctgcctgtcgacactgaacaccgt

SEQ ID NO: 833435 - DNA, 25 bp, Mus musculus
tctgcctgtcgagactgaacaccgt

SEQ ID NO: 833436 - DNA, 25 bp, Mus musculus
tctgcctgtcgtatgttcacgtgaa

SEQ ID NO: 833437 - DNA, 25 bp, Mus musculus
tctgcctgtcgtttgttcacgtgaa

SEQ ID NO: 833438 - DNA, 25 bp, Mus musculus
tctgcctgtctgattattacatgga

SEQ ID NO: 833439 - DNA, 25 bp, Mus musculus
tctgcctgtctgtttattacatgga

SEQ ID NO: 833440 - DNA, 25 bp, Mus musculus
tctgcctgtgtaaactgggaactta

SEQ ID NO: 833441 - DNA, 25 bp, Mus musculus
tctgcctgtgtatactgggaactta

SEQ ID NO: 833442 - DNA, 25 bp, Mus musculus
tctgcctgtgtgagcatctgtgcac

SEQ ID NO: 833443 - DNA, 25 bp, Mus musculus
tctgcctgtgtgtgcatctgtgcac

SEQ ID NO: 833444 - DNA, 25 bp, Mus musculus
tctgcctgttagagattgtttccca

SEQ ID NO: 833445 - DNA, 25 bp, Mus musculus
tctgcctgttagtgattgtttccca

SEQ ID NO: 833446 - DNA, 25 bp, Mus musculus
tctgcctgttgtctgtccaataagt

SEQ ID NO: 833447 - DNA, 25 bp, Mus musculus
tctgcctgttgtgtgtccaataagt

SEQ ID NO: 833448 - DNA, 25 bp, Mus musculus
tctgccttagacatgactcggtact

SEQ ID NO: 833449 - DNA, 25 bp, Mus musculus
tctgccttagacttgactcggtact

SEQ ID NO: 833450 - DNA, 25 bp, Mus musculus
tctgccttagccctgtgaatgctgg

SEQ ID NO: 833451 - DNA, 25 bp, Mus musculus
tctgccttagcccttatcttataaa

SEQ ID NO: 833452 - DNA, 25 bp, Mus musculus
tctgccttagccgtgtgaatgctgg

SEQ ID NO: 833453 - DNA, 25 bp, Mus musculus
tctgccttagccgttatcttataaa

SEQ ID NO: 833454 - DNA, 25 bp, Mus musculus
tctgccttagctacatctactggat

SEQ ID NO: 833455 - DNA, 25 bp, Mus musculus
tctgccttagcttcatctactggat

SEQ ID NO: 833456 - DNA, 25 bp, Mus musculus
tctgccttatccataatctgttcat

SEQ ID NO: 833457 - DNA, 25 bp, Mus musculus
tctgccttatccttaatctgttcat

SEQ ID NO: 833458 - DNA, 25 bp, Mus musculus
tctgccttcaagaatttttgcatca

SEQ ID NO: 833459 - DNA, 25 bp, Mus musculus
tctgccttcaagtatttttgcatca

SEQ ID NO: 833460 - DNA, 25 bp, Mus musculus
tctgccttcagaacttccatgtggc

SEQ ID NO: 833461 - DNA, 25 bp, Mus musculus
tctgccttcagatcttccatgtggc

SEQ ID NO: 833462 - DNA, 25 bp, Mus musculus
tctgccttcatcattccacatactg

SEQ ID NO: 833463 - DNA, 25 bp, Mus musculus
tctgccttcatctttccacatactg

SEQ ID NO: 833464 - DNA, 25 bp, Mus musculus
tctgccttcatgcatttgaccttaa

SEQ ID NO: 833465 - DNA, 25 bp, Mus musculus
tctgccttcatggatttgaccttaa

SEQ ID NO: 833466 - DNA, 25 bp, Mus musculus
tctgccttccatatcactttaggaa

SEQ ID NO: 833467 - DNA, 25 bp, Mus musculus
tctgccttccatttcactttaggaa

SEQ ID NO: 833468 - DNA, 25 bp, Mus musculus
tctgccttcccaattgctagggttg

SEQ ID NO: 833469 - DNA, 25 bp, Mus musculus
tctgccttcccacagttgtgggagt

SEQ ID NO: 833470 - DNA, 25 bp, Mus musculus
tctgccttcccagagttgtgggagt

SEQ ID NO: 833471 - DNA, 25 bp, Mus musculus
tctgccttcccatttgctagggttg

SEQ ID NO: 833472 - DNA, 25 bp, Mus musculus
tctgccttccgtaagattgtacttg

SEQ ID NO: 833473 - DNA, 25 bp, Mus musculus
tctgccttccgttagattgtacttg

SEQ ID NO: 833474 - DNA, 25 bp, Mus musculus
tctgccttctgaaccagctactgtc

SEQ ID NO: 833475 - DNA, 25 bp, Mus musculus
tctgccttctgatccagctactgtc

SEQ ID NO: 833476 - DNA, 25 bp, Mus musculus
tctgccttgatactgcctcaggatt

SEQ ID NO: 833477 - DNA, 25 bp, Mus musculus
tctgccttgatagtgcctcaggatt

SEQ ID NO: 833478 - DNA, 25 bp, Mus musculus
tctgccttgcctatctcatgaaata

SEQ ID NO: 833479 - DNA, 25 bp, Mus musculus
tctgccttgcctcccgaagatgaag

SEQ ID NO: 833480 - DNA, 25 bp, Mus musculus
tctgccttgcctgccgaagatgaag

SEQ ID NO: 833481 - DNA, 25 bp, Mus musculus
tctgccttgcctttctcatgaaata

SEQ ID NO: 833482 - DNA, 25 bp, Mus musculus
tctgccttgggtcttgaatttttat

SEQ ID NO: 833483 - DNA, 25 bp, Mus musculus
tctgccttgggtgttgaatttttat

SEQ ID NO: 833484 - DNA, 25 bp, Mus musculus
tctgccttggtccttgttcagaagg

SEQ ID NO: 833485 - DNA, 25 bp, Mus musculus
tctgccttggtcgttgttcagaagg

SEQ ID NO: 833486 - DNA, 25 bp, Mus musculus
tctgccttgtctcatcctggtaatg

SEQ ID NO: 833487 - DNA, 25 bp, Mus musculus
tctgccttgtctgatcctggtaatg

SEQ ID NO: 833488 - DNA, 25 bp, Mus musculus
tctgccttgtttccatgccttgaat

SEQ ID NO: 833489 - DNA, 25 bp, Mus musculus
tctgccttgtttgcatgccttgaat

SEQ ID NO: 833490 - DNA, 25 bp, Mus musculus
tctgcctttaaacctaccttacaat

SEQ ID NO: 833491 - DNA, 25 bp, Mus musculus
tctgcctttaaagctaccttacaat

SEQ ID NO: 833492 - DNA, 25 bp, Mus musculus
tctgcctttattccctagttattgc

SEQ ID NO: 833493 - DNA, 25 bp, Mus musculus
tctgcctttattgcctagttattgc

SEQ ID NO: 833494 - DNA, 25 bp, Mus musculus
tctgcctttgctagtgtatcaccat

SEQ ID NO: 833495 - DNA, 25 bp, Mus musculus
tctgcctttgcttgtgtatcaccat

SEQ ID NO: 833496 - DNA, 25 bp, Mus musculus
tctgccttttaacgtcacgtgggta

SEQ ID NO: 833497 - DNA, 25 bp, Mus musculus
tctgccttttaactggaacctcaag

SEQ ID NO: 833498 - DNA, 25 bp, Mus musculus
tctgccttttaaggtcacgtgggta

SEQ ID NO: 833499 - DNA, 25 bp, Mus musculus
tctgccttttaagtggaacctcaag

SEQ ID NO: 833500 - DNA, 25 bp, Mus musculus
tctgccttttgaactcacttcaaag

SEQ ID NO: 833501 - DNA, 25 bp, Mus musculus
tctgccttttgatctcacttcaaag

SEQ ID NO: 833502 - DNA, 25 bp, Mus musculus
tctgcctttttaattctcgaaattg

SEQ ID NO: 833503 - DNA, 25 bp, Mus musculus
tctgcctttttatttctcgaaattg

SEQ ID NO: 833504 - DNA, 25 bp, Mus musculus
tctgcctttttcatggatcctcatg

SEQ ID NO: 833505 - DNA, 25 bp, Mus musculus
tctgcctttttcttggatcctcatg

SEQ ID NO: 833506 - DNA, 25 bp, Mus musculus
tctgcgaaaagcagctccccattgg

SEQ ID NO: 833507 - DNA, 25 bp, Mus musculus
tctgcgaaaagctgctccccattgg

SEQ ID NO: 833508 - DNA, 25 bp, Mus musculus
tctgcgaaaccgcatcaatgacaac

SEQ ID NO: 833509 - DNA, 25 bp, Mus musculus
tctgcgaaaccggatcaatgacaac

SEQ ID NO: 833510 - DNA, 25 bp, Mus musculus
tctgcgaaagttcttcctgcggata

SEQ ID NO: 833511 - DNA, 25 bp, Mus musculus
tctgcgaaagttgttcctgcggata

SEQ ID NO: 833512 - DNA, 25 bp, Mus musculus
tctgcgaaattgctgtctgttttaa

SEQ ID NO: 833513 - DNA, 25 bp, Mus musculus
tctgcgaaattggtgtctgttttaa

SEQ ID NO: 833514 - DNA, 25 bp, Mus musculus
tctgcgaccctactgtagcgagccg

SEQ ID NO: 833515 - DNA, 25 bp, Mus musculus
tctgcgaccctagtgtagcgagccg

SEQ ID NO: 833516 - DNA, 25 bp, Mus musculus
tctgcgacctttcttcaatgttggt

SEQ ID NO: 833517 - DNA, 25 bp, Mus musculus
tctgcgacctttgttcaatgttggt

SEQ ID NO: 833518 - DNA, 25 bp, Mus musculus
tctgcgagagcaccccatctatcaa

SEQ ID NO: 833519 - DNA, 25 bp, Mus musculus
tctgcgagagcagcccatctatcaa

SEQ ID NO: 833520 - DNA, 25 bp, Mus musculus
tctgcgaggcacagagttgctcagt

SEQ ID NO: 833521 - DNA, 25 bp, Mus musculus
tctgcgaggcactgagttgctcagt

SEQ ID NO: 833522 - DNA, 25 bp, Mus musculus
tctgcgatcgatattcatttctttt

SEQ ID NO: 833523 - DNA, 25 bp, Mus musculus
tctgcgatcgattttcatttctttt

SEQ ID NO: 833524 - DNA, 25 bp, Mus musculus
tctgcgattccgagggctgtgtaac

SEQ ID NO: 833525 - DNA, 25 bp, Mus musculus
tctgcgattccgtgggctgtgtaac

SEQ ID NO: 833526 - DNA, 25 bp, Mus musculus
tctgcgattgacatgacttcctcta

SEQ ID NO: 833527 - DNA, 25 bp, Mus musculus
tctgcgattgacttgacttcctcta

SEQ ID NO: 833528 - DNA, 25 bp, Mus musculus
tctgcgcacgagatcaccggcctgg

SEQ ID NO: 833529 - DNA, 25 bp, Mus musculus
tctgcgcacgagttcaccggcctgg

SEQ ID NO: 833530 - DNA, 25 bp, Mus musculus
tctgcgcaggcgcacttccaacgtt

SEQ ID NO: 833531 - DNA, 25 bp, Mus musculus
tctgcgcaggcggacttccaacgtt

SEQ ID NO: 833532 - DNA, 25 bp, Mus musculus
tctgcgcagtgtaaggtccagtcat

SEQ ID NO: 833533 - DNA, 25 bp, Mus musculus
tctgcgcagtgttaggtccagtcat

SEQ ID NO: 833534 - DNA, 25 bp, Mus musculus
tctgcgccctgcaaaggatgacttt

SEQ ID NO: 833535 - DNA, 25 bp, Mus musculus
tctgcgccctgctaaggatgacttt

SEQ ID NO: 833536 - DNA, 25 bp, Mus musculus
tctgcgcctcagaggcagattgtca

SEQ ID NO: 833537 - DNA, 25 bp, Mus musculus
tctgcgcctcagtggcagattgtca

SEQ ID NO: 833538 - DNA, 25 bp, Mus musculus
tctgcgcgactcatcagaatgttct

SEQ ID NO: 833539 - DNA, 25 bp, Mus musculus
tctgcgcgactcttcagaatgttct

SEQ ID NO: 833540 - DNA, 25 bp, Mus musculus
tctgcgcgctcgagtgagcgtagct

SEQ ID NO: 833541 - DNA, 25 bp, Mus musculus
tctgcgcgctcgtgtgagcgtagct

SEQ ID NO: 833542 - DNA, 25 bp, Mus musculus
tctgcgcgtactacagtactaactt

SEQ ID NO: 833543 - DNA, 25 bp, Mus musculus
tctgcgcgtacttcagtactaactt

SEQ ID NO: 833544 - DNA, 25 bp, Mus musculus
tctgcgctagtcagtctaagggagc

SEQ ID NO: 833545 - DNA, 25 bp, Mus musculus
tctgcgctagtctgtctaagggagc

SEQ ID NO: 833546 - DNA, 25 bp, Mus musculus
tctgcgctctgcaagtgtcatgctg

SEQ ID NO: 833547 - DNA, 25 bp, Mus musculus
tctgcgctctgctagtgtcatgctg

SEQ ID NO: 833548 - DNA, 25 bp, Mus musculus
tctgcgctgctaatgtggacttttc

SEQ ID NO: 833549 - DNA, 25 bp, Mus musculus
tctgcgctgctattgtggacttttc

SEQ ID NO: 833550 - DNA, 25 bp, Mus musculus
tctgcgctgggcagagcaggactta

SEQ ID NO: 833551 - DNA, 25 bp, Mus musculus
tctgcgctgggctgagcaggactta

SEQ ID NO: 833552 - DNA, 25 bp, Mus musculus
tctgcggcacgtctgtaatcacatg

SEQ ID NO: 833553 - DNA, 25 bp, Mus musculus
tctgcggcacgtgtgtaatcacatg

SEQ ID NO: 833554 - DNA, 25 bp, Mus musculus
tctgcggcataccacaactcaatgt

SEQ ID NO: 833555 - DNA, 25 bp, Mus musculus
tctgcggcatacgacaactcaatgt

SEQ ID NO: 833556 - DNA, 25 bp, Mus musculus
tctgcggcctctcctggtgaagaag

SEQ ID NO: 833557 - DNA, 25 bp, Mus musculus
tctgcggcctctgctggtgaagaag

SEQ ID NO: 833558 - DNA, 25 bp, Mus musculus
tctgcggcggtaactgacctcagag

SEQ ID NO: 833559 - DNA, 25 bp, Mus musculus
tctgcggcggtatctgacctcagag

SEQ ID NO: 833560 - DNA, 25 bp, Mus musculus
tctgcggctacccttgtgggtcgaa

SEQ ID NO: 833561 - DNA, 25 bp, Mus musculus
tctgcggctaccgttgtgggtcgaa

SEQ ID NO: 833562 - DNA, 25 bp, Mus musculus
tctgcggctcgtatgacatcattta

SEQ ID NO: 833563 - DNA, 25 bp, Mus musculus
tctgcggctcgtttgacatcattta

SEQ ID NO: 833564 - DNA, 25 bp, Mus musculus
tctgcggctgcacagccaccgtgtg

SEQ ID NO: 833565 - DNA, 25 bp, Mus musculus
tctgcggctgcacattgagctcaaa

SEQ ID NO: 833566 - DNA, 25 bp, Mus musculus
tctgcggctgcagagccaccgtgtg

SEQ ID NO: 833567 - DNA, 25 bp, Mus musculus
tctgcggctgcagattgagctcaaa

SEQ ID NO: 833568 - DNA, 25 bp, Mus musculus
tctgcgggaatgattgacggtcctt

SEQ ID NO: 833569 - DNA, 25 bp, Mus musculus
tctgcgggaatgtttgacggtcctt

SEQ ID NO: 833570 - DNA, 25 bp, Mus musculus
tctgcgggacacagtacggagacta

SEQ ID NO: 833571 - DNA, 25 bp, Mus musculus
tctgcgggacacagttacactcgac

SEQ ID NO: 833572 - DNA, 25 bp, Mus musculus
tctgcgggacactgtacggagacta

SEQ ID NO: 833573 - DNA, 25 bp, Mus musculus
tctgcgggacactgttacactcgac

SEQ ID NO: 833574 - DNA, 25 bp, Mus musculus
tctgcgggctcaaagtgaagaactg

SEQ ID NO: 833575 - DNA, 25 bp, Mus musculus
tctgcgggctcatagtgaagaactg

SEQ ID NO: 833576 - DNA, 25 bp, Mus musculus
tctgcgggtatcatgtaattcacaa

SEQ ID NO: 833577 - DNA, 25 bp, Mus musculus
tctgcgggtatcttgtaattcacaa

SEQ ID NO: 833578 - DNA, 25 bp, Mus musculus
tctgcggtcggtagtctgacaccaa

SEQ ID NO: 833579 - DNA, 25 bp, Mus musculus
tctgcggtcggttgtctgacaccaa

SEQ ID NO: 833580 - DNA, 25 bp, Mus musculus
tctgcggtctttctgatctatactt

SEQ ID NO: 833581 - DNA, 25 bp, Mus musculus
tctgcggtctttgtgatctatactt

SEQ ID NO: 833582 - DNA, 25 bp, Mus musculus
tctgcgtactgcagctgacgtcatc

SEQ ID NO: 833583 - DNA, 25 bp, Mus musculus
tctgcgtactgctgctgacgtcatc

SEQ ID NO: 833584 - DNA, 25 bp, Mus musculus
tctgcgtccctcaagaacgttgccg

SEQ ID NO: 833585 - DNA, 25 bp, Mus musculus
tctgcgtccctctagaacgttgccg

SEQ ID NO: 833586 - DNA, 25 bp, Mus musculus
tctgcgtctgcaaaggtgtcctgga

SEQ ID NO: 833587 - DNA, 25 bp, Mus musculus
tctgcgtctgcataggtgtcctgga

SEQ ID NO: 833588 - DNA, 25 bp, Mus musculus
tctgcgtgcagcacagtcccaagaa

SEQ ID NO: 833589 - DNA, 25 bp, Mus musculus
tctgcgtgcagctcagtcccaagaa

SEQ ID NO: 833590 - DNA, 25 bp, Mus musculus
tctgcgtggctcatggatgtgacat

SEQ ID NO: 833591 - DNA, 25 bp, Mus musculus
tctgcgtggctcttggatgtgacat

SEQ ID NO: 833592 - DNA, 25 bp, Mus musculus
tctgcgtggctgactgtgacgatta

SEQ ID NO: 833593 - DNA, 25 bp, Mus musculus
tctgcgtggctgtctgtgacgatta

SEQ ID NO: 833594 - DNA, 25 bp, Mus musculus
tctgcgttccctatgtgggcaaaag

SEQ ID NO: 833595 - DNA, 25 bp, Mus musculus
tctgcgttccctttgtgggcaaaag

SEQ ID NO: 833596 - DNA, 25 bp, Mus musculus
tctgcgttgaccctggtcttaatag

SEQ ID NO: 833597 - DNA, 25 bp, Mus musculus
tctgcgttgaccgtggtcttaatag

SEQ ID NO: 833598 - DNA, 25 bp, Mus musculus
tctgcgtttaccattttactgtgct

SEQ ID NO: 833599 - DNA, 25 bp, Mus musculus
tctgcgtttacctttttactgtgct

SEQ ID NO: 833600 - DNA, 25 bp, Mus musculus
tctgcgtttgctagtgaggactcaa

SEQ ID NO: 833601 - DNA, 25 bp, Mus musculus
tctgcgtttgcttgtgaggactcaa

SEQ ID NO: 833602 - DNA, 25 bp, Mus musculus
tctgcgtttggtctctggccacggc

SEQ ID NO: 833603 - DNA, 25 bp, Mus musculus
tctgcgtttggtgtctggccacggc

SEQ ID NO: 833604 - DNA, 25 bp, Mus musculus
tctgctaaacaccataccaccagat

SEQ ID NO: 833605 - DNA, 25 bp, Mus musculus
tctgctaaacacgataccaccagat

SEQ ID NO: 833606 - DNA, 25 bp, Mus musculus
tctgctaacatgaaggtgtaattac

SEQ ID NO: 833607 - DNA, 25 bp, Mus musculus
tctgctaacatgtaggtgtaattac

SEQ ID NO: 833608 - DNA, 25 bp, Mus musculus
tctgctaaccttatttgacggcccc

SEQ ID NO: 833609 - DNA, 25 bp, Mus musculus
tctgctaaccttttttgacggcccc

SEQ ID NO: 833610 - DNA, 25 bp, Mus musculus
tctgctaacgccctgtgaaccgaac

SEQ ID NO: 833611 - DNA, 25 bp, Mus musculus
tctgctaacgccgtgtgaaccgaac

SEQ ID NO: 833612 - DNA, 25 bp, Mus musculus
tctgctaacgttccactacttgttg

SEQ ID NO: 833613 - DNA, 25 bp, Mus musculus
tctgctaacgttctttctcaccatt

SEQ ID NO: 833614 - DNA, 25 bp, Mus musculus
tctgctaacgttgcactacttgttg

SEQ ID NO: 833615 - DNA, 25 bp, Mus musculus
tctgctaacgttgtttctcaccatt

SEQ ID NO: 833616 - DNA, 25 bp, Mus musculus
tctgctaataccagccaagagttta

SEQ ID NO: 833617 - DNA, 25 bp, Mus musculus
tctgctaatacctgccaagagttta

SEQ ID NO: 833618 - DNA, 25 bp, Mus musculus
tctgctaatagaccgtgagaggcca

SEQ ID NO: 833619 - DNA, 25 bp, Mus musculus
tctgctaatagagcgtgagaggcca

SEQ ID NO: 833620 - DNA, 25 bp, Mus musculus
tctgctaatagccaggtgaaattta

SEQ ID NO: 833621 - DNA, 25 bp, Mus musculus
tctgctaatagcgaggtgaaattta

SEQ ID NO: 833622 - DNA, 25 bp, Mus musculus
tctgctaattagatgacttctgtgg

SEQ ID NO: 833623 - DNA, 25 bp, Mus musculus
tctgctaattagttgacttctgtgg

SEQ ID NO: 833624 - DNA, 25 bp, Mus musculus
tctgctacaataaggtcactttttt

SEQ ID NO: 833625 - DNA, 25 bp, Mus musculus
tctgctacaatatggtcactttttt

SEQ ID NO: 833626 - DNA, 25 bp, Mus musculus
tctgctacaggcactttccaataga

SEQ ID NO: 833627 - DNA, 25 bp, Mus musculus
tctgctacaggctctttccaataga

SEQ ID NO: 833628 - DNA, 25 bp, Mus musculus
tctgctacatctcctggtttagttc

SEQ ID NO: 833629 - DNA, 25 bp, Mus musculus
tctgctacatctgctggtttagttc

SEQ ID NO: 833630 - DNA, 25 bp, Mus musculus
tctgctacccagatttgattgcttg

SEQ ID NO: 833631 - DNA, 25 bp, Mus musculus
tctgctacccagttttgattgcttg

SEQ ID NO: 833632 - DNA, 25 bp, Mus musculus
tctgctaccgttaacatcatccggt

SEQ ID NO: 833633 - DNA, 25 bp, Mus musculus
tctgctaccgtttacatcatccggt

SEQ ID NO: 833634 - DNA, 25 bp, Mus musculus
tctgctacctagataatcaccgttt

SEQ ID NO: 833635 - DNA, 25 bp, Mus musculus
tctgctacctagttaatcaccgttt

SEQ ID NO: 833636 - DNA, 25 bp, Mus musculus
tctgctacctgaagatcgttctctg

SEQ ID NO: 833637 - DNA, 25 bp, Mus musculus
tctgctacctgatgatcgttctctg

SEQ ID NO: 833638 - DNA, 25 bp, Mus musculus
tctgctacctggacctggaagatat

SEQ ID NO: 833639 - DNA, 25 bp, Mus musculus
tctgctacctggtcctggaagatat

SEQ ID NO: 833640 - DNA, 25 bp, Mus musculus
tctgctacgtctccagggaaaccaa

SEQ ID NO: 833641 - DNA, 25 bp, Mus musculus
tctgctacgtctgcagggaaaccaa

SEQ ID NO: 833642 - DNA, 25 bp, Mus musculus
tctgctactggactcctttgcaaaa

SEQ ID NO: 833643 - DNA, 25 bp, Mus musculus
tctgctactggagtcctttgcaaaa

SEQ ID NO: 833644 - DNA, 25 bp, Mus musculus
tctgctactgtcagtttggctcatt

SEQ ID NO: 833645 - DNA, 25 bp, Mus musculus
tctgctactgtctgtttggctcatt

SEQ ID NO: 833646 - DNA, 25 bp, Mus musculus
tctgctagactccaaaatcctcaag

SEQ ID NO: 833647 - DNA, 25 bp, Mus musculus
tctgctagactcgaaaatcctcaag

SEQ ID NO: 833648 - DNA, 25 bp, Mus musculus
tctgctagagcacccaattccatct

SEQ ID NO: 833649 - DNA, 25 bp, Mus musculus
tctgctagagcagccaattccatct

SEQ ID NO: 833650 - DNA, 25 bp, Mus musculus
tctgctagatagacttaagttactt

SEQ ID NO: 833651 - DNA, 25 bp, Mus musculus
tctgctagatagtcttaagttactt

SEQ ID NO: 833652 - DNA, 25 bp, Mus musculus
tctgctagctttctgcacactaaca

SEQ ID NO: 833653 - DNA, 25 bp, Mus musculus
tctgctagctttgtgcacactaaca

SEQ ID NO: 833654 - DNA, 25 bp, Mus musculus
tctgctaggattcttgaggacttct

SEQ ID NO: 833655 - DNA, 25 bp, Mus musculus
tctgctaggattgttgaggacttct

SEQ ID NO: 833656 - DNA, 25 bp, Mus musculus
tctgctagggaaagctgcccaaaaa

SEQ ID NO: 833657 - DNA, 25 bp, Mus musculus
tctgctagggaatgctgcccaaaaa

SEQ ID NO: 833658 - DNA, 25 bp, Mus musculus
tctgctagggtcatagaacttggat

SEQ ID NO: 833659 - DNA, 25 bp, Mus musculus
tctgctagggtcttagaacttggat

SEQ ID NO: 833660 - DNA, 25 bp, Mus musculus
tctgctaggtctcagagcatccggg

SEQ ID NO: 833661 - DNA, 25 bp, Mus musculus
tctgctaggtctgagagcatccggg

SEQ ID NO: 833662 - DNA, 25 bp, Mus musculus
tctgctagtctactaccctaaccaa

SEQ ID NO: 833663 - DNA, 25 bp, Mus musculus
tctgctagtctagtaccctaaccaa

SEQ ID NO: 833664 - DNA, 25 bp, Mus musculus
tctgctatagagactgccagctagt

SEQ ID NO: 833665 - DNA, 25 bp, Mus musculus
tctgctatagagtctgccagctagt

SEQ ID NO: 833666 - DNA, 25 bp, Mus musculus
tctgctatcgatccacactgccact

SEQ ID NO: 833667 - DNA, 25 bp, Mus musculus
tctgctatcgatgcacactgccact

SEQ ID NO: 833668 - DNA, 25 bp, Mus musculus
tctgctatcttcctagggcttggga

SEQ ID NO: 833669 - DNA, 25 bp, Mus musculus
tctgctatcttcgtagggcttggga

SEQ ID NO: 833670 - DNA, 25 bp, Mus musculus
tctgctatgatcctgagggccaatg

SEQ ID NO: 833671 - DNA, 25 bp, Mus musculus
tctgctatgatcgtgagggccaatg

SEQ ID NO: 833672 - DNA, 25 bp, Mus musculus
tctgctatgccactgatacccataa

SEQ ID NO: 833673 - DNA, 25 bp, Mus musculus
tctgctatgccagtgatacccataa

SEQ ID NO: 833674 - DNA, 25 bp, Mus musculus
tctgctatggcaaacatgtacatca

SEQ ID NO: 833675 - DNA, 25 bp, Mus musculus
tctgctatggcatacatgtacatca

SEQ ID NO: 833676 - DNA, 25 bp, Mus musculus
tctgctatgtagacagtctctggcc

SEQ ID NO: 833677 - DNA, 25 bp, Mus musculus
tctgctatgtagtcagtctctggcc

SEQ ID NO: 833678 - DNA, 25 bp, Mus musculus
tctgctattagcaatttctctggga

SEQ ID NO: 833679 - DNA, 25 bp, Mus musculus
tctgctattagctatttctctggga

SEQ ID NO: 833680 - DNA, 25 bp, Mus musculus
tctgctattgaaactgtggtttgac

SEQ ID NO: 833681 - DNA, 25 bp, Mus musculus
tctgctattgaatctgtggtttgac

SEQ ID NO: 833682 - DNA, 25 bp, Mus musculus
tctgctcaaaccatggagaactctt

SEQ ID NO: 833683 - DNA, 25 bp, Mus musculus
tctgctcaaaccttggagaactctt

SEQ ID NO: 833684 - DNA, 25 bp, Mus musculus
tctgctcaaaggattctttcctcca

SEQ ID NO: 833685 - DNA, 25 bp, Mus musculus
tctgctcaaaggtttctttcctcca

SEQ ID NO: 833686 - DNA, 25 bp, Mus musculus
tctgctcacaccctgtaagaactgg

SEQ ID NO: 833687 - DNA, 25 bp, Mus musculus
tctgctcacaccgtgtaagaactgg

SEQ ID NO: 833688 - DNA, 25 bp, Mus musculus
tctgctcacagcaggcgctgctgca

SEQ ID NO: 833689 - DNA, 25 bp, Mus musculus
tctgctcacagctggcgctgctgca

SEQ ID NO: 833690 - DNA, 25 bp, Mus musculus
tctgctcaccttcctgttgaagaat

SEQ ID NO: 833691 - DNA, 25 bp, Mus musculus
tctgctcaccttgctgttgaagaat

SEQ ID NO: 833692 - DNA, 25 bp, Mus musculus
tctgctcacggtcgaagtggatctc

SEQ ID NO: 833693 - DNA, 25 bp, Mus musculus
tctgctcacggtggaagtggatctc

SEQ ID NO: 833694 - DNA, 25 bp, Mus musculus
tctgctcactatcggagggtactct

SEQ ID NO: 833695 - DNA, 25 bp, Mus musculus
tctgctcactatgggagggtactct

SEQ ID NO: 833696 - DNA, 25 bp, Mus musculus
tctgctcactgcaaatcaatccaag

SEQ ID NO: 833697 - DNA, 25 bp, Mus musculus
tctgctcactgctaatcaatccaag

SEQ ID NO: 833698 - DNA, 25 bp, Mus musculus
tctgctcagacaagctctggtcatt

SEQ ID NO: 833699 - DNA, 25 bp, Mus musculus
tctgctcagacatgctctggtcatt

SEQ ID NO: 833700 - DNA, 25 bp, Mus musculus
tctgctcagaggcaggtcaggcact

SEQ ID NO: 833701 - DNA, 25 bp, Mus musculus
tctgctcagagggaggtcaggcact

SEQ ID NO: 833702 - DNA, 25 bp, Mus musculus
tctgctcagcacatcctatcacata

SEQ ID NO: 833703 - DNA, 25 bp, Mus musculus
tctgctcagcacttcctatcacata

SEQ ID NO: 833704 - DNA, 25 bp, Mus musculus
tctgctcagcagagatggctgccac

SEQ ID NO: 833705 - DNA, 25 bp, Mus musculus
tctgctcagcagtgatggctgccac

SEQ ID NO: 833706 - DNA, 25 bp, Mus musculus
tctgctcagcccagtgcgtacgtga

SEQ ID NO: 833707 - DNA, 25 bp, Mus musculus
tctgctcagccctgtgcgtacgtga

SEQ ID NO: 833708 - DNA, 25 bp, Mus musculus
tctgctcagtgtacctattttgggt

SEQ ID NO: 833709 - DNA, 25 bp, Mus musculus
tctgctcagtgttcctattttgggt

SEQ ID NO: 833710 - DNA, 25 bp, Mus musculus
tctgctcatagaaccccttgacatt

SEQ ID NO: 833711 - DNA, 25 bp, Mus musculus
tctgctcatagatccccttgacatt

SEQ ID NO: 833712 - DNA, 25 bp, Mus musculus
tctgctcatcccacggagtgggagg

SEQ ID NO: 833713 - DNA, 25 bp, Mus musculus
tctgctcatccctcggagtgggagg

SEQ ID NO: 833714 - DNA, 25 bp, Mus musculus
tctgctcatgtacaatccagtgaaa

SEQ ID NO: 833715 - DNA, 25 bp, Mus musculus
tctgctcatgtagaatccagtgaaa

SEQ ID NO: 833716 - DNA, 25 bp, Mus musculus
tctgctcatgtcaatgcttggcgtg

SEQ ID NO: 833717 - DNA, 25 bp, Mus musculus
tctgctcatgtctatgcttggcgtg

SEQ ID NO: 833718 - DNA, 25 bp, Mus musculus
tctgctcattccagggctacaaatg

SEQ ID NO: 833719 - DNA, 25 bp, Mus musculus
tctgctcattcctgggctacaaatg

SEQ ID NO: 833720 - DNA, 25 bp, Mus musculus
tctgctcatttgcaccatctcaggg

SEQ ID NO: 833721 - DNA, 25 bp, Mus musculus
tctgctcatttggaccatctcaggg

SEQ ID NO: 833722 - DNA, 25 bp, Mus musculus
tctgctccaccaagggtacctctga

SEQ ID NO: 833723 - DNA, 25 bp, Mus musculus
tctgctccaccacagagtgtctcta

SEQ ID NO: 833724 - DNA, 25 bp, Mus musculus
tctgctccaccagagagtgtctcta

SEQ ID NO: 833725 - DNA, 25 bp, Mus musculus
tctgctccaccatgggtacctctga

SEQ ID NO: 833726 - DNA, 25 bp, Mus musculus
tctgctccacgtctttgatgaatac

SEQ ID NO: 833727 - DNA, 25 bp, Mus musculus
tctgctccacgtgtttgatgaatac

SEQ ID NO: 833728 - DNA, 25 bp, Mus musculus
tctgctccaggcacaggttagtgaa

SEQ ID NO: 833729 - DNA, 25 bp, Mus musculus
tctgctccaggctcaggttagtgaa

SEQ ID NO: 833730 - DNA, 25 bp, Mus musculus
tctgctccatacatcgtaactcctt

SEQ ID NO: 833731 - DNA, 25 bp, Mus musculus
tctgctccatacttcgtaactcctt

SEQ ID NO: 833732 - DNA, 25 bp, Mus musculus
tctgctccatctcaagttcatttgc

SEQ ID NO: 833733 - DNA, 25 bp, Mus musculus
tctgctccatctgaagttcatttgc

SEQ ID NO: 833734 - DNA, 25 bp, Mus musculus
tctgctcccagaaaacctacataca

SEQ ID NO: 833735 - DNA, 25 bp, Mus musculus
tctgctcccagataacctacataca

SEQ ID NO: 833736 - DNA, 25 bp, Mus musculus
tctgctccctgaaggactgatgttc

SEQ ID NO: 833737 - DNA, 25 bp, Mus musculus
tctgctccctgatggactgatgttc

SEQ ID NO: 833738 - DNA, 25 bp, Mus musculus
tctgctccgttaaacattctttaag

SEQ ID NO: 833739 - DNA, 25 bp, Mus musculus
tctgctccgttatacattctttaag

SEQ ID NO: 833740 - DNA, 25 bp, Mus musculus
tctgctcctcatcctaaaacactgg

SEQ ID NO: 833741 - DNA, 25 bp, Mus musculus
tctgctcctcatgctaaaacactgg

SEQ ID NO: 833742 - DNA, 25 bp, Mus musculus
tctgctcctgataaccactgtccag

SEQ ID NO: 833743 - DNA, 25 bp, Mus musculus
tctgctcctgattaccactgtccag

SEQ ID NO: 833744 - DNA, 25 bp, Mus musculus
tctgctcctgtcctttctttggatg

SEQ ID NO: 833745 - DNA, 25 bp, Mus musculus
tctgctcctgtcgtttctttggatg

SEQ ID NO: 833746 - DNA, 25 bp, Mus musculus
tctgctccttgacatcctttgataa

SEQ ID NO: 833747 - DNA, 25 bp, Mus musculus
tctgctccttgagatcctttgataa

SEQ ID NO: 833748 - DNA, 25 bp, Mus musculus
tctgctccttttctagtgcatgata

SEQ ID NO: 833749 - DNA, 25 bp, Mus musculus
tctgctccttttgtagtgcatgata

SEQ ID NO: 833750 - DNA, 25 bp, Mus musculus
tctgctctacagaggtttccggtga

SEQ ID NO: 833751 - DNA, 25 bp, Mus musculus
tctgctctacagtggtttccggtga

SEQ ID NO: 833752 - DNA, 25 bp, Mus musculus
tctgctctatacattatctccatat

SEQ ID NO: 833753 - DNA, 25 bp, Mus musculus
tctgctctatactttatctccatat

SEQ ID NO: 833754 - DNA, 25 bp, Mus musculus
tctgctctatctcctgatgcaatta

SEQ ID NO: 833755 - DNA, 25 bp, Mus musculus
tctgctctatctgctgatgcaatta

SEQ ID NO: 833756 - DNA, 25 bp, Mus musculus
tctgctctcaacaaggcctggtgtg

SEQ ID NO: 833757 - DNA, 25 bp, Mus musculus
tctgctctcaacacatacacaaaca

SEQ ID NO: 833758 - DNA, 25 bp, Mus musculus
tctgctctcaactaggcctggtgtg

SEQ ID NO: 833759 - DNA, 25 bp, Mus musculus
tctgctctcaactcatacacaaaca

SEQ ID NO: 833760 - DNA, 25 bp, Mus musculus
tctgctctccagaggaacacatctg

SEQ ID NO: 833761 - DNA, 25 bp, Mus musculus
tctgctctccagtggaacacatctg

SEQ ID NO: 833762 - DNA, 25 bp, Mus musculus
tctgctctccatcaaacccaatgaa

SEQ ID NO: 833763 - DNA, 25 bp, Mus musculus
tctgctctccatgaaacccaatgaa

SEQ ID NO: 833764 - DNA, 25 bp, Mus musculus
tctgctctctttacaggctgtgaaa

SEQ ID NO: 833765 - DNA, 25 bp, Mus musculus
tctgctctcttttcaggctgtgaaa

SEQ ID NO: 833766 - DNA, 25 bp, Mus musculus
tctgctctgagactttttgtagact

SEQ ID NO: 833767 - DNA, 25 bp, Mus musculus
tctgctctgagagtttttgtagact

SEQ ID NO: 833768 - DNA, 25 bp, Mus musculus
tctgctctgatcaatttctttatca

SEQ ID NO: 833769 - DNA, 25 bp, Mus musculus
tctgctctgatctatttctttatca

SEQ ID NO: 833770 - DNA, 25 bp, Mus musculus
tctgctctgcagacgttagctcctt

SEQ ID NO: 833771 - DNA, 25 bp, Mus musculus
tctgctctgcagtcgttagctcctt

SEQ ID NO: 833772 - DNA, 25 bp, Mus musculus
tctgctctgccaatctacaatacaa

SEQ ID NO: 833773 - DNA, 25 bp, Mus musculus
tctgctctgccattctacaatacaa

SEQ ID NO: 833774 - DNA, 25 bp, Mus musculus
tctgctctggcccttaagaaatgta

SEQ ID NO: 833775 - DNA, 25 bp, Mus musculus
tctgctctggccgttaagaaatgta

SEQ ID NO: 833776 - DNA, 25 bp, Mus musculus
tctgctctggttatgaattctctca

SEQ ID NO: 833777 - DNA, 25 bp, Mus musculus
tctgctctggttttgaattctctca

SEQ ID NO: 833778 - DNA, 25 bp, Mus musculus
tctgctctgtaaactggactcaact

SEQ ID NO: 833779 - DNA, 25 bp, Mus musculus
tctgctctgtaatctggactcaact

SEQ ID NO: 833780 - DNA, 25 bp, Mus musculus
tctgctctgtgcattgtactttgtt

SEQ ID NO: 833781 - DNA, 25 bp, Mus musculus
tctgctctgtgctttgtactttgtt

SEQ ID NO: 833782 - DNA, 25 bp, Mus musculus
tctgctcttagtagagattttccaa

SEQ ID NO: 833783 - DNA, 25 bp, Mus musculus
tctgctcttagtcgctaggtcagcc

SEQ ID NO: 833784 - DNA, 25 bp, Mus musculus
tctgctcttagtggctaggtcagcc

SEQ ID NO: 833785 - DNA, 25 bp, Mus musculus
tctgctcttagttgagattttccaa

SEQ ID NO: 833786 - DNA, 25 bp, Mus musculus
tctgctcttctcatcagcaataggg

SEQ ID NO: 833787 - DNA, 25 bp, Mus musculus
tctgctcttctcttcagcaataggg

SEQ ID NO: 833788 - DNA, 25 bp, Mus musculus
tctgctctttttcgaaatccattcc

SEQ ID NO: 833789 - DNA, 25 bp, Mus musculus
tctgctctttttggaaatccattcc

SEQ ID NO: 833790 - DNA, 25 bp, Mus musculus
tctgctgaagacatctgtatttaca

SEQ ID NO: 833791 - DNA, 25 bp, Mus musculus
tctgctgaagacttctgtatttaca

SEQ ID NO: 833792 - DNA, 25 bp, Mus musculus
tctgctgaataacttgtccattggt

SEQ ID NO: 833793 - DNA, 25 bp, Mus musculus
tctgctgaataagttgtccattggt

SEQ ID NO: 833794 - DNA, 25 bp, Mus musculus
tctgctgacactattgtcctaaagg

SEQ ID NO: 833795 - DNA, 25 bp, Mus musculus
tctgctgacacttttgtcctaaagg

SEQ ID NO: 833796 - DNA, 25 bp, Mus musculus
tctgctgacaggagtttactggcct

SEQ ID NO: 833797 - DNA, 25 bp, Mus musculus
tctgctgacaggtgtttactggcct

SEQ ID NO: 833798 - DNA, 25 bp, Mus musculus
tctgctgacctacccaatactggaa

SEQ ID NO: 833799 - DNA, 25 bp, Mus musculus
tctgctgacctagccaatactggaa

SEQ ID NO: 833800 - DNA, 25 bp, Mus musculus
tctgctgagccactgataagctggg

SEQ ID NO: 833801 - DNA, 25 bp, Mus musculus
tctgctgagccagtgataagctggg

SEQ ID NO: 833802 - DNA, 25 bp, Mus musculus
tctgctgagctcagccattaatcac

SEQ ID NO: 833803 - DNA, 25 bp, Mus musculus
tctgctgagctctgccattaatcac

SEQ ID NO: 833804 - DNA, 25 bp, Mus musculus
tctgctgagtgtccttcaaactcac

SEQ ID NO: 833805 - DNA, 25 bp, Mus musculus
tctgctgagtgtgcttcaaactcac

SEQ ID NO: 833806 - DNA, 25 bp, Mus musculus
tctgctgataccatgctaaattact

SEQ ID NO: 833807 - DNA, 25 bp, Mus musculus
tctgctgataccttgctaaattact

SEQ ID NO: 833808 - DNA, 25 bp, Mus musculus
tctgctgatcatagcctgccttgcc

SEQ ID NO: 833809 - DNA, 25 bp, Mus musculus
tctgctgatcattgcctgccttgcc

SEQ ID NO: 833810 - DNA, 25 bp, Mus musculus
tctgctgcaattcatcccgaatcaa

SEQ ID NO: 833811 - DNA, 25 bp, Mus musculus
tctgctgcaattgatcccgaatcaa

SEQ ID NO: 833812 - DNA, 25 bp, Mus musculus
tctgctgcacctcctatgatagcta

SEQ ID NO: 833813 - DNA, 25 bp, Mus musculus
tctgctgcacctgctatgatagcta

SEQ ID NO: 833814 - DNA, 25 bp, Mus musculus
tctgctgcacttctgtctgactata

SEQ ID NO: 833815 - DNA, 25 bp, Mus musculus
tctgctgcacttgtgtctgactata

SEQ ID NO: 833816 - DNA, 25 bp, Mus musculus
tctgctgcagaacttagtgtcattg

SEQ ID NO: 833817 - DNA, 25 bp, Mus musculus
tctgctgcagaagttagtgtcattg

SEQ ID NO: 833818 - DNA, 25 bp, Mus musculus
tctgctgcagatagtcaagtgaggt

SEQ ID NO: 833819 - DNA, 25 bp, Mus musculus
tctgctgcagattgtcaagtgaggt

SEQ ID NO: 833820 - DNA, 25 bp, Mus musculus
tctgctgcatctaccatgactgaaa

SEQ ID NO: 833821 - DNA, 25 bp, Mus musculus
tctgctgcatcttccatgactgaaa

SEQ ID NO: 833822 - DNA, 25 bp, Mus musculus
tctgctgcattacctgagagctgct

SEQ ID NO: 833823 - DNA, 25 bp, Mus musculus
tctgctgcattagctgagagctgct

SEQ ID NO: 833824 - DNA, 25 bp, Mus musculus
tctgctgccacaatgcaagcatagt

SEQ ID NO: 833825 - DNA, 25 bp, Mus musculus
tctgctgccacattgcaagcatagt

SEQ ID NO: 833826 - DNA, 25 bp, Mus musculus
tctgctgccaccacttaacaaggtg

SEQ ID NO: 833827 - DNA, 25 bp, Mus musculus
tctgctgccacctcttaacaaggtg

SEQ ID NO: 833828 - DNA, 25 bp, Mus musculus
tctgctgccataatgtagcttgtta

SEQ ID NO: 833829 - DNA, 25 bp, Mus musculus
tctgctgccatattgtagcttgtta

SEQ ID NO: 833830 - DNA, 25 bp, Mus musculus
tctgctgccatcagcacagctggaa

SEQ ID NO: 833831 - DNA, 25 bp, Mus musculus
tctgctgccatctgcacagctggaa

SEQ ID NO: 833832 - DNA, 25 bp, Mus musculus
tctgctgccattactaagcaagatc

SEQ ID NO: 833833 - DNA, 25 bp, Mus musculus
tctgctgccatttctaagcaagatc

SEQ ID NO: 833834 - DNA, 25 bp, Mus musculus
tctgctgcccttcgagtgtggagca

SEQ ID NO: 833835 - DNA, 25 bp, Mus musculus
tctgctgcccttggagtgtggagca

SEQ ID NO: 833836 - DNA, 25 bp, Mus musculus
tctgctgcgatacgaagttcctgaa

SEQ ID NO: 833837 - DNA, 25 bp, Mus musculus
tctgctgcgataggaagttcctgaa

SEQ ID NO: 833838 - DNA, 25 bp, Mus musculus
tctgctgctccgaatgatcaatgtt

SEQ ID NO: 833839 - DNA, 25 bp, Mus musculus
tctgctgctccgtatgatcaatgtt

SEQ ID NO: 833840 - DNA, 25 bp, Mus musculus
tctgctgctctgacatgctaaaaga

SEQ ID NO: 833841 - DNA, 25 bp, Mus musculus
tctgctgctctgtcatgctaaaaga

SEQ ID NO: 833842 - DNA, 25 bp, Mus musculus
tctgctgctgcaattgtatttctta

SEQ ID NO: 833843 - DNA, 25 bp, Mus musculus
tctgctgctgcatttgtatttctta

SEQ ID NO: 833844 - DNA, 25 bp, Mus musculus
tctgctgctgctagtggaccaaaga

SEQ ID NO: 833845 - DNA, 25 bp, Mus musculus
tctgctgctgcttgtggaccaaaga

SEQ ID NO: 833846 - DNA, 25 bp, Mus musculus
tctgctgctggaattatgcttcagt

SEQ ID NO: 833847 - DNA, 25 bp, Mus musculus
tctgctgctggatttatgcttcagt

SEQ ID NO: 833848 - DNA, 25 bp, Mus musculus
tctgctgctgtcaacatgtttggtc

SEQ ID NO: 833849 - DNA, 25 bp, Mus musculus
tctgctgctgtctacatgtttggtc

SEQ ID NO: 833850 - DNA, 25 bp, Mus musculus
tctgctgcttcgacttgatgacact

SEQ ID NO: 833851 - DNA, 25 bp, Mus musculus
tctgctgcttcgtcttgatgacact

SEQ ID NO: 833852 - DNA, 25 bp, Mus musculus
tctgctggacacaacacatgggagt

SEQ ID NO: 833853 - DNA, 25 bp, Mus musculus
tctgctggacactacacatgggagt

SEQ ID NO: 833854 - DNA, 25 bp, Mus musculus
tctgctggatgaaattgcgactcta

SEQ ID NO: 833855 - DNA, 25 bp, Mus musculus
tctgctggatgatattgcgactcta

SEQ ID NO: 833856 - DNA, 25 bp, Mus musculus
tctgctggattacacctcttggaag

SEQ ID NO: 833857 - DNA, 25 bp, Mus musculus
tctgctggattagacctcttggaag

SEQ ID NO: 833858 - DNA, 25 bp, Mus musculus
tctgctggatttcgactcacagtct

SEQ ID NO: 833859 - DNA, 25 bp, Mus musculus
tctgctggatttggactcacagtct

SEQ ID NO: 833860 - DNA, 25 bp, Mus musculus
tctgctggccaactcgtgggtcttc

SEQ ID NO: 833861 - DNA, 25 bp, Mus musculus
tctgctggccaagtcgtgggtcttc

SEQ ID NO: 833862 - DNA, 25 bp, Mus musculus
tctgctggccggacacaacaataaa

SEQ ID NO: 833863 - DNA, 25 bp, Mus musculus
tctgctggccggtcacaacaataaa

SEQ ID NO: 833864 - DNA, 25 bp, Mus musculus
tctgctggcgaccttaactgctaac

SEQ ID NO: 833865 - DNA, 25 bp, Mus musculus
tctgctggcgacgttaactgctaac

SEQ ID NO: 833866 - DNA, 25 bp, Mus musculus
tctgctggctggactattgaacaca

SEQ ID NO: 833867 - DNA, 25 bp, Mus musculus
tctgctggctggtctattgaacaca

SEQ ID NO: 833868 - DNA, 25 bp, Mus musculus
tctgctggcttgctacccaagttaa

SEQ ID NO: 833869 - DNA, 25 bp, Mus musculus
tctgctggcttggtacccaagttaa

SEQ ID NO: 833870 - DNA, 25 bp, Mus musculus
tctgctgggaatcctgacgtgaaca

SEQ ID NO: 833871 - DNA, 25 bp, Mus musculus
tctgctgggaatgctgacgtgaaca

SEQ ID NO: 833872 - DNA, 25 bp, Mus musculus
tctgctgggctcagagggtacacgt

SEQ ID NO: 833873 - DNA, 25 bp, Mus musculus
tctgctgggctctgagggtacacgt

SEQ ID NO: 833874 - DNA, 25 bp, Mus musculus
tctgctggtagacctctgagtgccc

SEQ ID NO: 833875 - DNA, 25 bp, Mus musculus
tctgctggtagagctctgagtgccc

SEQ ID NO: 833876 - DNA, 25 bp, Mus musculus
tctgctggtcatctgaggcagcctc

SEQ ID NO: 833877 - DNA, 25 bp, Mus musculus
tctgctggtcatgtgaggcagcctc

SEQ ID NO: 833878 - DNA, 25 bp, Mus musculus
tctgctggtccgaatgatcagttat

SEQ ID NO: 833879 - DNA, 25 bp, Mus musculus
tctgctggtccgtatgatcagttat

SEQ ID NO: 833880 - DNA, 25 bp, Mus musculus
tctgctggtgcccatttcaagtagt

SEQ ID NO: 833881 - DNA, 25 bp, Mus musculus
tctgctggtgccgatttcaagtagt

SEQ ID NO: 833882 - DNA, 25 bp, Mus musculus
tctgctggtgctactcaattgtgat

SEQ ID NO: 833883 - DNA, 25 bp, Mus musculus
tctgctggtgcttctcaattgtgat

SEQ ID NO: 833884 - DNA, 25 bp, Mus musculus
tctgctggtgttcattttgttcttt

SEQ ID NO: 833885 - DNA, 25 bp, Mus musculus
tctgctggtgttgattttgttcttt

SEQ ID NO: 833886 - DNA, 25 bp, Mus musculus
tctgctggttcacaagctgggcttg

SEQ ID NO: 833887 - DNA, 25 bp, Mus musculus
tctgctggttcactagggcttctag

SEQ ID NO: 833888 - DNA, 25 bp, Mus musculus
tctgctggttcagaagctgggcttg

SEQ ID NO: 833889 - DNA, 25 bp, Mus musculus
tctgctggttcagtagggcttctag

SEQ ID NO: 833890 - DNA, 25 bp, Mus musculus
tctgctggtttgcatgcctgggtcc

SEQ ID NO: 833891 - DNA, 25 bp, Mus musculus
tctgctggtttggatgcctgggtcc

SEQ ID NO: 833892 - DNA, 25 bp, Mus musculus
tctgctgtaataaaggaccacaata

SEQ ID NO: 833893 - DNA, 25 bp, Mus musculus
tctgctgtaatataggaccacaata

SEQ ID NO: 833894 - DNA, 25 bp, Mus musculus
tctgctgtacagacccctaaggctt

SEQ ID NO: 833895 - DNA, 25 bp, Mus musculus
tctgctgtacagtcccctaaggctt

SEQ ID NO: 833896 - DNA, 25 bp, Mus musculus
tctgctgtaccactgcagtctgctt

SEQ ID NO: 833897 - DNA, 25 bp, Mus musculus
tctgctgtaccagtgcagtctgctt

SEQ ID NO: 833898 - DNA, 25 bp, Mus musculus
tctgctgtactaagctctacttaat

SEQ ID NO: 833899 - DNA, 25 bp, Mus musculus
tctgctgtactatgctctacttaat

SEQ ID NO: 833900 - DNA, 25 bp, Mus musculus
tctgctgtactgcttattgaagtat

SEQ ID NO: 833901 - DNA, 25 bp, Mus musculus
tctgctgtactggttattgaagtat

SEQ ID NO: 833902 - DNA, 25 bp, Mus musculus
tctgctgtaggaccatgagatgtag

SEQ ID NO: 833903 - DNA, 25 bp, Mus musculus
tctgctgtaggagcatgagatgtag

SEQ ID NO: 833904 - DNA, 25 bp, Mus musculus
tctgctgtaggtaactgctagaggt

SEQ ID NO: 833905 - DNA, 25 bp, Mus musculus
tctgctgtaggttactgctagaggt

SEQ ID NO: 833906 - DNA, 25 bp, Mus musculus
tctgctgtatatacttccccaagtg

SEQ ID NO: 833907 - DNA, 25 bp, Mus musculus
tctgctgtatattcttccccaagtg

SEQ ID NO: 833908 - DNA, 25 bp, Mus musculus
tctgctgtatctagcccagttgata

SEQ ID NO: 833909 - DNA, 25 bp, Mus musculus
tctgctgtatcttgcccagttgata

SEQ ID NO: 833910 - DNA, 25 bp, Mus musculus
tctgctgtcaacagatgtaaagata

SEQ ID NO: 833911 - DNA, 25 bp, Mus musculus
tctgctgtcaactgatgtaaagata

SEQ ID NO: 833912 - DNA, 25 bp, Mus musculus
tctgctgtcacaatgtgagtcagag

SEQ ID NO: 833913 - DNA, 25 bp, Mus musculus
tctgctgtcacaccgtcgctttgtg

SEQ ID NO: 833914 - DNA, 25 bp, Mus musculus
tctgctgtcacagcgtcgctttgtg

SEQ ID NO: 833915 - DNA, 25 bp, Mus musculus
tctgctgtcacattgtgagtcagag

SEQ ID NO: 833916 - DNA, 25 bp, Mus musculus
tctgctgtcaggatttcagatcata

SEQ ID NO: 833917 - DNA, 25 bp, Mus musculus
tctgctgtcaggcaaccgccgttgg

SEQ ID NO: 833918 - DNA, 25 bp, Mus musculus
tctgctgtcagggaaccgccgttgg

SEQ ID NO: 833919 - DNA, 25 bp, Mus musculus
tctgctgtcaggttttcagatcata

SEQ ID NO: 833920 - DNA, 25 bp, Mus musculus
tctgctgtcagtcgaccattgtttt

SEQ ID NO: 833921 - DNA, 25 bp, Mus musculus
tctgctgtcagtggaccattgtttt

SEQ ID NO: 833922 - DNA, 25 bp, Mus musculus
tctgctgtccataattatgcatgtt

SEQ ID NO: 833923 - DNA, 25 bp, Mus musculus
tctgctgtccattattatgcatgtt

SEQ ID NO: 833924 - DNA, 25 bp, Mus musculus
tctgctgtcgccactcagtgggagc

SEQ ID NO: 833925 - DNA, 25 bp, Mus musculus
tctgctgtcgcctctcagtgggagc

SEQ ID NO: 833926 - DNA, 25 bp, Mus musculus
tctgctgtcgtaattcaccatggaa

SEQ ID NO: 833927 - DNA, 25 bp, Mus musculus
tctgctgtcgtatttcaccatggaa

SEQ ID NO: 833928 - DNA, 25 bp, Mus musculus
tctgctgtctctagaaccatcatga

SEQ ID NO: 833929 - DNA, 25 bp, Mus musculus
tctgctgtctcttgaaccatcatga

SEQ ID NO: 833930 - DNA, 25 bp, Mus musculus
tctgctgtgaatctggcattcgaag

SEQ ID NO: 833931 - DNA, 25 bp, Mus musculus
tctgctgtgaatgtggcattcgaag

SEQ ID NO: 833932 - DNA, 25 bp, Mus musculus
tctgctgtgattcagggacccttgg

SEQ ID NO: 833933 - DNA, 25 bp, Mus musculus
tctgctgtgattgagggacccttgg

SEQ ID NO: 833934 - DNA, 25 bp, Mus musculus
tctgctgtgcaaaccctgctgtgtg

SEQ ID NO: 833935 - DNA, 25 bp, Mus musculus
tctgctgtgcaatccctgctgtgtg

SEQ ID NO: 833936 - DNA, 25 bp, Mus musculus
tctgctgtgcctcccagaagactag

SEQ ID NO: 833937 - DNA, 25 bp, Mus musculus
tctgctgtgcctgccagaagactag

SEQ ID NO: 833938 - DNA, 25 bp, Mus musculus
tctgctgtgcgtcctagagctggca

SEQ ID NO: 833939 - DNA, 25 bp, Mus musculus
tctgctgtgcgtgctagagctggca

SEQ ID NO: 833940 - DNA, 25 bp, Mus musculus
tctgctgtgctgctagaaccaccac

SEQ ID NO: 833941 - DNA, 25 bp, Mus musculus
tctgctgtgctggtagaaccaccac

SEQ ID NO: 833942 - DNA, 25 bp, Mus musculus
tctgctgtgcttagtggttttacct

SEQ ID NO: 833943 - DNA, 25 bp, Mus musculus
tctgctgtgctttgtggttttacct

SEQ ID NO: 833944 - DNA, 25 bp, Mus musculus
tctgctgtggagcttttgggacacc

SEQ ID NO: 833945 - DNA, 25 bp, Mus musculus
tctgctgtggaggttttgggacacc

SEQ ID NO: 833946 - DNA, 25 bp, Mus musculus
tctgctgtggcaactttaattctgt

SEQ ID NO: 833947 - DNA, 25 bp, Mus musculus
tctgctgtggcatctttaattctgt

SEQ ID NO: 833948 - DNA, 25 bp, Mus musculus
tctgctgtgtggcataggccttaaa

SEQ ID NO: 833949 - DNA, 25 bp, Mus musculus
tctgctgtgtgggataggccttaaa

SEQ ID NO: 833950 - DNA, 25 bp, Mus musculus
tctgctgttactaagggccccaaag

SEQ ID NO: 833951 - DNA, 25 bp, Mus musculus
tctgctgttacttagggccccaaag

SEQ ID NO: 833952 - DNA, 25 bp, Mus musculus
tctgctgttcatctcacatcaccag

SEQ ID NO: 833953 - DNA, 25 bp, Mus musculus
tctgctgttcatgtcacatcaccag

SEQ ID NO: 833954 - DNA, 25 bp, Mus musculus
tctgctgttgttagctctgtcttta

SEQ ID NO: 833955 - DNA, 25 bp, Mus musculus
tctgctgttgtttgctctgtcttta

SEQ ID NO: 833956 - DNA, 25 bp, Mus musculus
tctgctgttttaatccaaatctcaa

SEQ ID NO: 833957 - DNA, 25 bp, Mus musculus
tctgctgttttacgatcttgattct

SEQ ID NO: 833958 - DNA, 25 bp, Mus musculus
tctgctgttttaggatcttgattct

SEQ ID NO: 833959 - DNA, 25 bp, Mus musculus
tctgctgttttattccaaatctcaa

SEQ ID NO: 833960 - DNA, 25 bp, Mus musculus
tctgcttaagttagacgccaaaaat

SEQ ID NO: 833961 - DNA, 25 bp, Mus musculus
tctgcttaagtttgacgccaaaaat

SEQ ID NO: 833962 - DNA, 25 bp, Mus musculus
tctgcttaatttccttcccgtttca

SEQ ID NO: 833963 - DNA, 25 bp, Mus musculus
tctgcttaatttgcttcccgtttca

SEQ ID NO: 833964 - DNA, 25 bp, Mus musculus
tctgcttaccagctgctgggatcag

SEQ ID NO: 833965 - DNA, 25 bp, Mus musculus
tctgcttaccaggtgctgggatcag

SEQ ID NO: 833966 - DNA, 25 bp, Mus musculus
tctgcttactaaataaacagtgcat

SEQ ID NO: 833967 - DNA, 25 bp, Mus musculus
tctgcttactaattaaacagtgcat

SEQ ID NO: 833968 - DNA, 25 bp, Mus musculus
tctgcttactgcattatgagttcat

SEQ ID NO: 833969 - DNA, 25 bp, Mus musculus
tctgcttactgctttatgagttcat

SEQ ID NO: 833970 - DNA, 25 bp, Mus musculus
tctgcttagaagaacatctgtctgt

SEQ ID NO: 833971 - DNA, 25 bp, Mus musculus
tctgcttagaagtacatctgtctgt

SEQ ID NO: 833972 - DNA, 25 bp, Mus musculus
tctgcttagcagataccgacaggac

SEQ ID NO: 833973 - DNA, 25 bp, Mus musculus
tctgcttagcagttaccgacaggac

SEQ ID NO: 833974 - DNA, 25 bp, Mus musculus
tctgcttaggcgctactggtttaaa

SEQ ID NO: 833975 - DNA, 25 bp, Mus musculus
tctgcttaggcggtactggtttaaa

SEQ ID NO: 833976 - DNA, 25 bp, Mus musculus
tctgcttagtatagatgctgctgct

SEQ ID NO: 833977 - DNA, 25 bp, Mus musculus
tctgcttagtattgatgctgctgct

SEQ ID NO: 833978 - DNA, 25 bp, Mus musculus
tctgcttatatgatcccatatctga

SEQ ID NO: 833979 - DNA, 25 bp, Mus musculus
tctgcttatatgttcccatatctga

SEQ ID NO: 833980 - DNA, 25 bp, Mus musculus
tctgcttatattattcctctgagta

SEQ ID NO: 833981 - DNA, 25 bp, Mus musculus
tctgcttatatttttcctctgagta

SEQ ID NO: 833982 - DNA, 25 bp, Mus musculus
tctgcttattatcggttatccaatg

SEQ ID NO: 833983 - DNA, 25 bp, Mus musculus
tctgcttattatgggttatccaatg

SEQ ID NO: 833984 - DNA, 25 bp, Mus musculus
tctgcttcaaatcatcagctcaaga

SEQ ID NO: 833985 - DNA, 25 bp, Mus musculus
tctgcttcaaatgatcagctcaaga

SEQ ID NO: 833986 - DNA, 25 bp, Mus musculus
tctgcttcacagctctctagccagt

SEQ ID NO: 833987 - DNA, 25 bp, Mus musculus
tctgcttcacaggtctctagccagt

SEQ ID NO: 833988 - DNA, 25 bp, Mus musculus
tctgcttcagctacttgaacactgg

SEQ ID NO: 833989 - DNA, 25 bp, Mus musculus
tctgcttcagcttcttgaacactgg

SEQ ID NO: 833990 - DNA, 25 bp, Mus musculus
tctgcttccaaacacaggagggcgt

SEQ ID NO: 833991 - DNA, 25 bp, Mus musculus
tctgcttccaaagacaggagggcgt

SEQ ID NO: 833992 - DNA, 25 bp, Mus musculus
tctgcttccagaagtgcttgcgtgc

SEQ ID NO: 833993 - DNA, 25 bp, Mus musculus
tctgcttccagatgtgcttgcgtgc

SEQ ID NO: 833994 - DNA, 25 bp, Mus musculus
tctgcttccccaagagtcaccatta

SEQ ID NO: 833995 - DNA, 25 bp, Mus musculus
tctgcttccccatgagtcaccatta

SEQ ID NO: 833996 - DNA, 25 bp, Mus musculus
tctgcttcccgacaggcacaagtaa

SEQ ID NO: 833997 - DNA, 25 bp, Mus musculus
tctgcttcccgagaggcacaagtaa

SEQ ID NO: 833998 - DNA, 25 bp, Mus musculus
tctgcttccctgaaggtgcaacaac

SEQ ID NO: 833999 - DNA, 25 bp, Mus musculus
tctgcttccctgctaaggtcacaag

SEQ ID NO: 834000 - DNA, 25 bp, Mus musculus
tctgcttccctggtaaggtcacaag

SEQ ID NO: 834001 - DNA, 25 bp, Mus musculus
tctgcttccctgtaggtgcaacaac

SEQ ID NO: 834002 - DNA, 25 bp, Mus musculus
tctgcttcccttaggttcaaccttg

SEQ ID NO: 834003 - DNA, 25 bp, Mus musculus
tctgcttccctttggttcaaccttg

SEQ ID NO: 834004 - DNA, 25 bp, Mus musculus
tctgcttccggtagctacaatgggc

SEQ ID NO: 834005 - DNA, 25 bp, Mus musculus
tctgcttccggttgctacaatgggc

SEQ ID NO: 834006 - DNA, 25 bp, Mus musculus
tctgcttcctatcccagtgaggttg

SEQ ID NO: 834007 - DNA, 25 bp, Mus musculus
tctgcttcctatgccagtgaggttg

SEQ ID NO: 834008 - DNA, 25 bp, Mus musculus
tctgcttcctttcatcatggctaaa

SEQ ID NO: 834009 - DNA, 25 bp, Mus musculus
tctgcttcctttctgtttgcaaatg

SEQ ID NO: 834010 - DNA, 25 bp, Mus musculus
tctgcttcctttgatcatggctaaa

SEQ ID NO: 834011 - DNA, 25 bp, Mus musculus
tctgcttcctttgtgtttgcaaatg

SEQ ID NO: 834012 - DNA, 25 bp, Mus musculus
tctgcttcggcaacgcgttggtgga

SEQ ID NO: 834013 - DNA, 25 bp, Mus musculus
tctgcttcggcatcgcgttggtgga

SEQ ID NO: 834014 - DNA, 25 bp, Mus musculus
tctgcttctctacgccactgggtgg

SEQ ID NO: 834015 - DNA, 25 bp, Mus musculus
tctgcttctctaggccactgggtgg

SEQ ID NO: 834016 - DNA, 25 bp, Mus musculus
tctgcttctctgagatggcccaacc

SEQ ID NO: 834017 - DNA, 25 bp, Mus musculus
tctgcttctctgtgatggcccaacc

SEQ ID NO: 834018 - DNA, 25 bp, Mus musculus
tctgcttctgcactgagcactggga

SEQ ID NO: 834019 - DNA, 25 bp, Mus musculus
tctgcttctgcagtgagcactggga

SEQ ID NO: 834020 - DNA, 25 bp, Mus musculus
tctgcttctgcccaacgtacaatag

SEQ ID NO: 834021 - DNA, 25 bp, Mus musculus
tctgcttctgccgaacgtacaatag

SEQ ID NO: 834022 - DNA, 25 bp, Mus musculus
tctgcttctggtacggccgcttcgc

SEQ ID NO: 834023 - DNA, 25 bp, Mus musculus
tctgcttctggtcacctctaacaag

SEQ ID NO: 834024 - DNA, 25 bp, Mus musculus
tctgcttctggtcatcctgaagtag

SEQ ID NO: 834025 - DNA, 25 bp, Mus musculus
tctgcttctggtgacctctaacaag

SEQ ID NO: 834026 - DNA, 25 bp, Mus musculus
tctgcttctggtgatcctgaagtag

SEQ ID NO: 834027 - DNA, 25 bp, Mus musculus
tctgcttctggttcggccgcttcgc

SEQ ID NO: 834028 - DNA, 25 bp, Mus musculus
tctgcttctttcacacagtcacagt

SEQ ID NO: 834029 - DNA, 25 bp, Mus musculus
tctgcttctttctcacagtcacagt

SEQ ID NO: 834030 - DNA, 25 bp, Mus musculus
tctgcttctttgacattactaggta

SEQ ID NO: 834031 - DNA, 25 bp, Mus musculus
tctgcttctttgtcattactaggta

SEQ ID NO: 834032 - DNA, 25 bp, Mus musculus
tctgcttgacccagccatgaagtag

SEQ ID NO: 834033 - DNA, 25 bp, Mus musculus
tctgcttgaccctgccatgaagtag

SEQ ID NO: 834034 - DNA, 25 bp, Mus musculus
tctgcttgcactagatgtgccttca

SEQ ID NO: 834035 - DNA, 25 bp, Mus musculus
tctgcttgcacttgatgtgccttca

SEQ ID NO: 834036 - DNA, 25 bp, Mus musculus
tctgcttgctcaactgccaagggtt

SEQ ID NO: 834037 - DNA, 25 bp, Mus musculus
tctgcttgctcatctgccaagggtt

SEQ ID NO: 834038 - DNA, 25 bp, Mus musculus
tctgcttgctctctactgttactct

SEQ ID NO: 834039 - DNA, 25 bp, Mus musculus
tctgcttgctctgtactgttactct

SEQ ID NO: 834040 - DNA, 25 bp, Mus musculus
tctgcttgctttccctatgttagga

SEQ ID NO: 834041 - DNA, 25 bp, Mus musculus
tctgcttgctttcctagcctagttt

SEQ ID NO: 834042 - DNA, 25 bp, Mus musculus
tctgcttgctttgcctatgttagga

SEQ ID NO: 834043 - DNA, 25 bp, Mus musculus
tctgcttgctttgctagcctagttt

SEQ ID NO: 834044 - DNA, 25 bp, Mus musculus
tctgcttggcaaagctctctccatt

SEQ ID NO: 834045 - DNA, 25 bp, Mus musculus
tctgcttggcaatgctctctccatt

SEQ ID NO: 834046 - DNA, 25 bp, Mus musculus
tctgcttggctcagcatgaaactgg

SEQ ID NO: 834047 - DNA, 25 bp, Mus musculus
tctgcttggctctgcatgaaactgg

SEQ ID NO: 834048 - DNA, 25 bp, Mus musculus
tctgcttgggttctgtgctgtatgt

SEQ ID NO: 834049 - DNA, 25 bp, Mus musculus
tctgcttgggttgtgtgctgtatgt

SEQ ID NO: 834050 - DNA, 25 bp, Mus musculus
tctgcttgtccaagttaaggttttg

SEQ ID NO: 834051 - DNA, 25 bp, Mus musculus
tctgcttgtccatgttaaggttttg

SEQ ID NO: 834052 - DNA, 25 bp, Mus musculus
tctgcttgtctgaacactctgaaag

SEQ ID NO: 834053 - DNA, 25 bp, Mus musculus
tctgcttgtctgtacactctgaaag

SEQ ID NO: 834054 - DNA, 25 bp, Mus musculus
tctgcttgtgacatttccttcgctg

SEQ ID NO: 834055 - DNA, 25 bp, Mus musculus
tctgcttgtgacttttccttcgctg

SEQ ID NO: 834056 - DNA, 25 bp, Mus musculus
tctgcttgttaaccattgttaacta

SEQ ID NO: 834057 - DNA, 25 bp, Mus musculus
tctgcttgttaagcattgttaacta

SEQ ID NO: 834058 - DNA, 25 bp, Mus musculus
tctgctttaagcacacgcctctttc

SEQ ID NO: 834059 - DNA, 25 bp, Mus musculus
tctgctttaagcacatgtgtccgtg

SEQ ID NO: 834060 - DNA, 25 bp, Mus musculus
tctgctttaagctcacgcctctttc

SEQ ID NO: 834061 - DNA, 25 bp, Mus musculus
tctgctttaagctcatgtgtccgtg

SEQ ID NO: 834062 - DNA, 25 bp, Mus musculus
tctgctttacaaatccaaccacagg

SEQ ID NO: 834063 - DNA, 25 bp, Mus musculus
tctgctttacaattccaaccacagg

SEQ ID NO: 834064 - DNA, 25 bp, Mus musculus
tctgctttacgtatcctgattgttg

SEQ ID NO: 834065 - DNA, 25 bp, Mus musculus
tctgctttacgtttcctgattgttg

SEQ ID NO: 834066 - DNA, 25 bp, Mus musculus
tctgctttatgacaccagttggaaa

SEQ ID NO: 834067 - DNA, 25 bp, Mus musculus
tctgctttatgagaccagttggaaa

SEQ ID NO: 834068 - DNA, 25 bp, Mus musculus
tctgctttatgtatctttccatgcc

SEQ ID NO: 834069 - DNA, 25 bp, Mus musculus
tctgctttatgtttctttccatgcc

SEQ ID NO: 834070 - DNA, 25 bp, Mus musculus
tctgctttatttcatgcgacgtaca

SEQ ID NO: 834071 - DNA, 25 bp, Mus musculus
tctgctttatttgatgcgacgtaca

SEQ ID NO: 834072 - DNA, 25 bp, Mus musculus
tctgctttcaagatatctggattca

SEQ ID NO: 834073 - DNA, 25 bp, Mus musculus
tctgctttcaagttatctggattca

SEQ ID NO: 834074 - DNA, 25 bp, Mus musculus
tctgctttccgactgctgaatcaac

SEQ ID NO: 834075 - DNA, 25 bp, Mus musculus
tctgctttccgagtgctgaatcaac

SEQ ID NO: 834076 - DNA, 25 bp, Mus musculus
tctgctttcctgcaaaagatgaata

SEQ ID NO: 834077 - DNA, 25 bp, Mus musculus
tctgctttcctggaaaagatgaata

SEQ ID NO: 834078 - DNA, 25 bp, Mus musculus
tctgctttcgcaaaataccagtttt

SEQ ID NO: 834079 - DNA, 25 bp, Mus musculus
tctgctttcgcataataccagtttt

SEQ ID NO: 834080 - DNA, 25 bp, Mus musculus
tctgctttctctacatgactatctc

SEQ ID NO: 834081 - DNA, 25 bp, Mus musculus
tctgctttctcttcatgactatctc

SEQ ID NO: 834082 - DNA, 25 bp, Mus musculus
tctgctttctggaggcattgagtct

SEQ ID NO: 834083 - DNA, 25 bp, Mus musculus
tctgctttctggtggcattgagtct

SEQ ID NO: 834084 - DNA, 25 bp, Mus musculus
tctgctttcttgctgcctgtaatca

SEQ ID NO: 834085 - DNA, 25 bp, Mus musculus
tctgctttcttggtgcctgtaatca

SEQ ID NO: 834086 - DNA, 25 bp, Mus musculus
tctgctttctttcatcagctactgt

SEQ ID NO: 834087 - DNA, 25 bp, Mus musculus
tctgctttctttgatcagctactgt

SEQ ID NO: 834088 - DNA, 25 bp, Mus musculus
tctgctttgaatagaatctcattga

SEQ ID NO: 834089 - DNA, 25 bp, Mus musculus
tctgctttgaattgaatctcattga

SEQ ID NO: 834090 - DNA, 25 bp, Mus musculus
tctgctttgacacttgactgacggg

SEQ ID NO: 834091 - DNA, 25 bp, Mus musculus
tctgctttgacagttgactgacggg

SEQ ID NO: 834092 - DNA, 25 bp, Mus musculus
tctgctttgaggactgatgacgaaa

SEQ ID NO: 834093 - DNA, 25 bp, Mus musculus
tctgctttgaggtctgatgacgaaa

SEQ ID NO: 834094 - DNA, 25 bp, Mus musculus
tctgctttgcaccttgagaatccta

SEQ ID NO: 834095 - DNA, 25 bp, Mus musculus
tctgctttgcacgttgagaatccta

SEQ ID NO: 834096 - DNA, 25 bp, Mus musculus
tctgctttgctcagcgtgtaagaac

SEQ ID NO: 834097 - DNA, 25 bp, Mus musculus
tctgctttgctctgcgtgtaagaac

SEQ ID NO: 834098 - DNA, 25 bp, Mus musculus
tctgctttggcaagaagacctgatt

SEQ ID NO: 834099 - DNA, 25 bp, Mus musculus
tctgctttggcatgaagacctgatt

SEQ ID NO: 834100 - DNA, 25 bp, Mus musculus
tctgctttgggtaaagggactccct

SEQ ID NO: 834101 - DNA, 25 bp, Mus musculus
tctgctttgggttaagggactccct

SEQ ID NO: 834102 - DNA, 25 bp, Mus musculus
tctgctttgtaaattcttttgtaaa

SEQ ID NO: 834103 - DNA, 25 bp, Mus musculus
tctgctttgtaatttcttttgtaaa

SEQ ID NO: 834104 - DNA, 25 bp, Mus musculus
tctgctttgtccattattctcttgg

SEQ ID NO: 834105 - DNA, 25 bp, Mus musculus
tctgctttgtcctttattctcttgg

SEQ ID NO: 834106 - DNA, 25 bp, Mus musculus
tctgcttttaggctgaggagttctg

SEQ ID NO: 834107 - DNA, 25 bp, Mus musculus
tctgcttttagggtgaggagttctg

SEQ ID NO: 834108 - DNA, 25 bp, Mus musculus
tctgcttttcctacacggttttatt

SEQ ID NO: 834109 - DNA, 25 bp, Mus musculus
tctgcttttccttcacggttttatt

SEQ ID NO: 834110 - DNA, 25 bp, Mus musculus
tctgcttttcggaggaataactttt

SEQ ID NO: 834111 - DNA, 25 bp, Mus musculus
tctgcttttcggtggaataactttt

SEQ ID NO: 834112 - DNA, 25 bp, Mus musculus
tctgcttttctcattccatggcagc

SEQ ID NO: 834113 - DNA, 25 bp, Mus musculus
tctgcttttctctttccatggcagc

SEQ ID NO: 834114 - DNA, 25 bp, Mus musculus
tctgcttttgacacctgagctggtt

SEQ ID NO: 834115 - DNA, 25 bp, Mus musculus
tctgcttttgactcctgagctggtt

SEQ ID NO: 834116 - DNA, 25 bp, Mus musculus
tctgcttttgatagtctacatcaca

SEQ ID NO: 834117 - DNA, 25 bp, Mus musculus
tctgcttttgatagtgtgtcactct

SEQ ID NO: 834118 - DNA, 25 bp, Mus musculus
tctgcttttgattgtctacatcaca

SEQ ID NO: 834119 - DNA, 25 bp, Mus musculus
tctgcttttgattgtgtgtcactct

SEQ ID NO: 834120 - DNA, 25 bp, Mus musculus
tctgcttttgctctctcctccaaaa

SEQ ID NO: 834121 - DNA, 25 bp, Mus musculus
tctgcttttgctgtctcctccaaaa

SEQ ID NO: 834122 - DNA, 25 bp, Mus musculus
tctgcttttttgcagctcattcctt

SEQ ID NO: 834123 - DNA, 25 bp, Mus musculus
tctgcttttttggagctcattcctt

SEQ ID NO: 834124 - DNA, 25 bp, Mus musculus
tctggaaacaccaccaacgcaatgt

SEQ ID NO: 834125 - DNA, 25 bp, Mus musculus
tctggaaacacctccaacgcaatgt

SEQ ID NO: 834126 - DNA, 25 bp, Mus musculus
tctggaaaccagatgtttgggaact

SEQ ID NO: 834127 - DNA, 25 bp, Mus musculus
tctggaaaccagttgtttgggaact

SEQ ID NO: 834128 - DNA, 25 bp, Mus musculus
tctggaaaccctagtgtacctgact

SEQ ID NO: 834129 - DNA, 25 bp, Mus musculus
tctggaaacccttgtgtacctgact

SEQ ID NO: 834130 - DNA, 25 bp, Mus musculus
tctggaaacctcatatccctttctt

SEQ ID NO: 834131 - DNA, 25 bp, Mus musculus
tctggaaacctcttatccctttctt

SEQ ID NO: 834132 - DNA, 25 bp, Mus musculus
tctggaaactggagccgacccattg

SEQ ID NO: 834133 - DNA, 25 bp, Mus musculus
tctggaaactggtgccgacccattg

SEQ ID NO: 834134 - DNA, 25 bp, Mus musculus
tctggaaagactagttcctctgttt

SEQ ID NO: 834135 - DNA, 25 bp, Mus musculus
tctggaaagacttgttcctctgttt

SEQ ID NO: 834136 - DNA, 25 bp, Mus musculus
tctggaaaggctatagtgctccctc

SEQ ID NO: 834137 - DNA, 25 bp, Mus musculus
tctggaaaggctttagtgctccctc

SEQ ID NO: 834138 - DNA, 25 bp, Mus musculus
tctggaaagggacttcaagccagtt

SEQ ID NO: 834139 - DNA, 25 bp, Mus musculus
tctggaaagggagttcaagccagtt

SEQ ID NO: 834140 - DNA, 25 bp, Mus musculus
tctggaaataaaattgctggcacaa

SEQ ID NO: 834141 - DNA, 25 bp, Mus musculus
tctggaaataaatttgctggcacaa

SEQ ID NO: 834142 - DNA, 25 bp, Mus musculus
tctggaaatcacctcgtgtcggcca

SEQ ID NO: 834143 - DNA, 25 bp, Mus musculus
tctggaaatcacgtcgtgtcggcca

SEQ ID NO: 834144 - DNA, 25 bp, Mus musculus
tctggaaatggtatagcctgacctt

SEQ ID NO: 834145 - DNA, 25 bp, Mus musculus
tctggaaatggtttagcctgacctt

SEQ ID NO: 834146 - DNA, 25 bp, Mus musculus
tctggaaattgcacttgcagcttct

SEQ ID NO: 834147 - DNA, 25 bp, Mus musculus
tctggaaattgctcttgcagcttct

SEQ ID NO: 834148 - DNA, 25 bp, Mus musculus
tctggaacaggcacttccaccggcc

SEQ ID NO: 834149 - DNA, 25 bp, Mus musculus
tctggaacaggctcttccaccggcc

SEQ ID NO: 834150 - DNA, 25 bp, Mus musculus
tctggaacatcaacaccagtgtatt

SEQ ID NO: 834151 - DNA, 25 bp, Mus musculus
tctggaacatcatcaccagtgtatt

SEQ ID NO: 834152 - DNA, 25 bp, Mus musculus
tctggaaccaatcttcctggcagag

SEQ ID NO: 834153 - DNA, 25 bp, Mus musculus
tctggaaccaatgttcctggcagag

SEQ ID NO: 834154 - DNA, 25 bp, Mus musculus
tctggaacctcactcttctttattt

SEQ ID NO: 834155 - DNA, 25 bp, Mus musculus
tctggaacctcagtcttctttattt

SEQ ID NO: 834156 - DNA, 25 bp, Mus musculus
tctggaacctcgagcttcataggca

SEQ ID NO: 834157 - DNA, 25 bp, Mus musculus
tctggaacctcgtgcttcataggca

SEQ ID NO: 834158 - DNA, 25 bp, Mus musculus
tctggaacttgacgcgtcaccatca

SEQ ID NO: 834159 - DNA, 25 bp, Mus musculus
tctggaacttgaggcgtcaccatca

SEQ ID NO: 834160 - DNA, 25 bp, Mus musculus
tctggaagcagaacctagactgagc

SEQ ID NO: 834161 - DNA, 25 bp, Mus musculus
tctggaagcagatcctagactgagc

SEQ ID NO: 834162 - DNA, 25 bp, Mus musculus
tctggaagcagtctgtcctctccca

SEQ ID NO: 834163 - DNA, 25 bp, Mus musculus
tctggaagcagtgtgtcctctccca

SEQ ID NO: 834164 - DNA, 25 bp, Mus musculus
tctggaagcatcaacctgctcgaat

SEQ ID NO: 834165 - DNA, 25 bp, Mus musculus
tctggaagcatcactcagtgcacat

SEQ ID NO: 834166 - DNA, 25 bp, Mus musculus
tctggaagcatctacctgctcgaat

SEQ ID NO: 834167 - DNA, 25 bp, Mus musculus
tctggaagcatctctcagtgcacat

SEQ ID NO: 834168 - DNA, 25 bp, Mus musculus
tctggaagcggaaacccttgaattg

SEQ ID NO: 834169 - DNA, 25 bp, Mus musculus
tctggaagcggatacccttgaattg

SEQ ID NO: 834170 - DNA, 25 bp, Mus musculus
tctggaagtattagtattctctatc

SEQ ID NO: 834171 - DNA, 25 bp, Mus musculus
tctggaagtatttgtattctctatc

SEQ ID NO: 834172 - DNA, 25 bp, Mus musculus
tctggaagtccacgctatgatcagc

SEQ ID NO: 834173 - DNA, 25 bp, Mus musculus
tctggaagtccaggctatgatcagc

SEQ ID NO: 834174 - DNA, 25 bp, Mus musculus
tctggaagtcgaacgaggagtcgct

SEQ ID NO: 834175 - DNA, 25 bp, Mus musculus
tctggaagtcgatcgaggagtcgct

SEQ ID NO: 834176 - DNA, 25 bp, Mus musculus
tctggaagtctgagtggtcacccac

SEQ ID NO: 834177 - DNA, 25 bp, Mus musculus
tctggaagtctgtgtggtcacccac

SEQ ID NO: 834178 - DNA, 25 bp, Mus musculus
tctggaagtgacacacctttgtttt

SEQ ID NO: 834179 - DNA, 25 bp, Mus musculus
tctggaagtgactcacctttgtttt

SEQ ID NO: 834180 - DNA, 25 bp, Mus musculus
tctggaataaaccatccccgtctgt

SEQ ID NO: 834181 - DNA, 25 bp, Mus musculus
tctggaataaacgatccccgtctgt

SEQ ID NO: 834182 - DNA, 25 bp, Mus musculus
tctggaatcatgagctagtgggttt

SEQ ID NO: 834183 - DNA, 25 bp, Mus musculus
tctggaatcatgtgctagtgggttt

SEQ ID NO: 834184 - DNA, 25 bp, Mus musculus
tctggaatcattcagttgctcctgg

SEQ ID NO: 834185 - DNA, 25 bp, Mus musculus
tctggaatcattgagttgctcctgg

SEQ ID NO: 834186 - DNA, 25 bp, Mus musculus
tctggaatctgtctgtcatgcacac

SEQ ID NO: 834187 - DNA, 25 bp, Mus musculus
tctggaatctgtgtgtcatgcacac

SEQ ID NO: 834188 - DNA, 25 bp, Mus musculus
tctggaatgaaacttgactggtctc

SEQ ID NO: 834189 - DNA, 25 bp, Mus musculus
tctggaatgaaagttgactggtctc

SEQ ID NO: 834190 - DNA, 25 bp, Mus musculus
tctggaatgcccaagtgccacatag

SEQ ID NO: 834191 - DNA, 25 bp, Mus musculus
tctggaatgccctagtgccacatag

SEQ ID NO: 834192 - DNA, 25 bp, Mus musculus
tctggaatggttatcctgaacacct

SEQ ID NO: 834193 - DNA, 25 bp, Mus musculus
tctggaatggttttcctgaacacct

SEQ ID NO: 834194 - DNA, 25 bp, Mus musculus
tctggaatttagaccactggatttt

SEQ ID NO: 834195 - DNA, 25 bp, Mus musculus
tctggaatttagtccactggatttt

SEQ ID NO: 834196 - DNA, 25 bp, Mus musculus
tctggaatttatcagcttggctgtg

SEQ ID NO: 834197 - DNA, 25 bp, Mus musculus
tctggaatttatgagcttggctgtg

SEQ ID NO: 834198 - DNA, 25 bp, Mus musculus
tctggaattttcacagctcaagttc

SEQ ID NO: 834199 - DNA, 25 bp, Mus musculus
tctggaattttctcagctcaagttc

SEQ ID NO: 834200 - DNA, 25 bp, Mus musculus
tctggacaccaacaacaatgggctt

SEQ ID NO: 834201 - DNA, 25 bp, Mus musculus
tctggacaccaagaacaatgggctt

SEQ ID NO: 834202 - DNA, 25 bp, Mus musculus
tctggacaccttccgtgcgctttca

SEQ ID NO: 834203 - DNA, 25 bp, Mus musculus
tctggacaccttgcgtgcgctttca

SEQ ID NO: 834204 - DNA, 25 bp, Mus musculus
tctggacactttcgagcttttactc

SEQ ID NO: 834205 - DNA, 25 bp, Mus musculus
tctggacactttggagcttttactc

SEQ ID NO: 834206 - DNA, 25 bp, Mus musculus
tctggacagacgctctagcctagtt

SEQ ID NO: 834207 - DNA, 25 bp, Mus musculus
tctggacagacggtctagcctagtt

SEQ ID NO: 834208 - DNA, 25 bp, Mus musculus
tctggacagactaaggcccagccct

SEQ ID NO: 834209 - DNA, 25 bp, Mus musculus
tctggacagacttaggcccagccct

SEQ ID NO: 834210 - DNA, 25 bp, Mus musculus
tctggacagctgagtgtgtttctta

SEQ ID NO: 834211 - DNA, 25 bp, Mus musculus
tctggacagctgtgtgtgtttctta

SEQ ID NO: 834212 - DNA, 25 bp, Mus musculus
tctggacagcttccttggaacccat

SEQ ID NO: 834213 - DNA, 25 bp, Mus musculus
tctggacagcttgcttggaacccat

SEQ ID NO: 834214 - DNA, 25 bp, Mus musculus
tctggacagtcacccgcaacacatg

SEQ ID NO: 834215 - DNA, 25 bp, Mus musculus
tctggacagtcagccgcaacacatg

SEQ ID NO: 834216 - DNA, 25 bp, Mus musculus
tctggacagtctcatcgtctctggg

SEQ ID NO: 834217 - DNA, 25 bp, Mus musculus
tctggacagtctgatcgtctctggg

SEQ ID NO: 834218 - DNA, 25 bp, Mus musculus
tctggacatgatcaccactggtttt

SEQ ID NO: 834219 - DNA, 25 bp, Mus musculus
tctggacatgatgaccactggtttt

SEQ ID NO: 834220 - DNA, 25 bp, Mus musculus
tctggacattacactccaccataag

SEQ ID NO: 834221 - DNA, 25 bp, Mus musculus
tctggacattactctccaccataag

SEQ ID NO: 834222 - DNA, 25 bp, Mus musculus
tctggaccaaggaagccctgagtta

SEQ ID NO: 834223 - DNA, 25 bp, Mus musculus
tctggaccaaggtagccctgagtta

SEQ ID NO: 834224 - DNA, 25 bp, Mus musculus
tctggacccaagagggctctcagaa

SEQ ID NO: 834225 - DNA, 25 bp, Mus musculus
tctggacccaagtgggctctcagaa

SEQ ID NO: 834226 - DNA, 25 bp, Mus musculus
tctggacccagtcatgcatgatctt

SEQ ID NO: 834227 - DNA, 25 bp, Mus musculus
tctggacccagtgatgcatgatctt

SEQ ID NO: 834228 - DNA, 25 bp, Mus musculus
tctggaccccatatttgataggctt

SEQ ID NO: 834229 - DNA, 25 bp, Mus musculus
tctggaccccatttttgataggctt

SEQ ID NO: 834230 - DNA, 25 bp, Mus musculus
tctggaccctagaagtcactcttgg

SEQ ID NO: 834231 - DNA, 25 bp, Mus musculus
tctggaccctagtagtcactcttgg

SEQ ID NO: 834232 - DNA, 25 bp, Mus musculus
tctggacctctcatttcacttcagt

SEQ ID NO: 834233 - DNA, 25 bp, Mus musculus
tctggacctctcttttcacttcagt

SEQ ID NO: 834234 - DNA, 25 bp, Mus musculus
tctggacctttgaagtgatgcataa

SEQ ID NO: 834235 - DNA, 25 bp, Mus musculus
tctggacctttgtagtgatgcataa

SEQ ID NO: 834236 - DNA, 25 bp, Mus musculus
tctggacgcggcaagcagggtggca

SEQ ID NO: 834237 - DNA, 25 bp, Mus musculus
tctggacgcggctagcagggtggca

SEQ ID NO: 834238 - DNA, 25 bp, Mus musculus
tctggacgctgcactggtcttatca

SEQ ID NO: 834239 - DNA, 25 bp, Mus musculus
tctggacgctgctctggtcttatca

SEQ ID NO: 834240 - DNA, 25 bp, Mus musculus
tctggacgggccaaaggagctttca

SEQ ID NO: 834241 - DNA, 25 bp, Mus musculus
tctggacgggcctaaggagctttca

SEQ ID NO: 834242 - DNA, 25 bp, Mus musculus
tctggacggtcacccactgagccat

SEQ ID NO: 834243 - DNA, 25 bp, Mus musculus
tctggacggtcagccactgagccat

SEQ ID NO: 834244 - DNA, 25 bp, Mus musculus
tctggacgttacaatgttccccgaa

SEQ ID NO: 834245 - DNA, 25 bp, Mus musculus
tctggacgttactatgttccccgaa

SEQ ID NO: 834246 - DNA, 25 bp, Mus musculus
tctggacgtttgagcagtattgaaa

SEQ ID NO: 834247 - DNA, 25 bp, Mus musculus
tctggacgtttgtgcagtattgaaa

SEQ ID NO: 834248 - DNA, 25 bp, Mus musculus
tctggactaacacacttctgttcta

SEQ ID NO: 834249 - DNA, 25 bp, Mus musculus
tctggactaacagacttctgttcta

SEQ ID NO: 834250 - DNA, 25 bp, Mus musculus
tctggactactacaaaacatggttt

SEQ ID NO: 834251 - DNA, 25 bp, Mus musculus
tctggactactagaaaacatggttt

SEQ ID NO: 834252 - DNA, 25 bp, Mus musculus
tctggactatttctgattctcaggg

SEQ ID NO: 834253 - DNA, 25 bp, Mus musculus
tctggactatttgtgattctcaggg

SEQ ID NO: 834254 - DNA, 25 bp, Mus musculus
tctggactcaccagctgttagagaa

SEQ ID NO: 834255 - DNA, 25 bp, Mus musculus
tctggactcacctgctgttagagaa

SEQ ID NO: 834256 - DNA, 25 bp, Mus musculus
tctggactcagaatcaacaccttgt

SEQ ID NO: 834257 - DNA, 25 bp, Mus musculus
tctggactcagattcaacaccttgt

SEQ ID NO: 834258 - DNA, 25 bp, Mus musculus
tctggactccacaaggcctgggatg

SEQ ID NO: 834259 - DNA, 25 bp, Mus musculus
tctggactccactaggcctgggatg

SEQ ID NO: 834260 - DNA, 25 bp, Mus musculus
tctggactcccaaggaggctggtgc

SEQ ID NO: 834261 - DNA, 25 bp, Mus musculus
tctggactcccatggaggctggtgc

SEQ ID NO: 834262 - DNA, 25 bp, Mus musculus
tctggactcgttatacctctagcaa

SEQ ID NO: 834263 - DNA, 25 bp, Mus musculus
tctggactcgttttacctctagcaa

SEQ ID NO: 834264 - DNA, 25 bp, Mus musculus
tctggactctacactatgagcagct

SEQ ID NO: 834265 - DNA, 25 bp, Mus musculus
tctggactctactctatgagcagct

SEQ ID NO: 834266 - DNA, 25 bp, Mus musculus
tctggactctcacttgcttccaaag

SEQ ID NO: 834267 - DNA, 25 bp, Mus musculus
tctggactctcagttgcttccaaag

SEQ ID NO: 834268 - DNA, 25 bp, Mus musculus
tctggactctctagacctggacaac

SEQ ID NO: 834269 - DNA, 25 bp, Mus musculus
tctggactctcttgacctggacaac

SEQ ID NO: 834270 - DNA, 25 bp, Mus musculus
tctggactcttgcaaatccttctgt

SEQ ID NO: 834271 - DNA, 25 bp, Mus musculus
tctggactcttggaaatccttctgt

SEQ ID NO: 834272 - DNA, 25 bp, Mus musculus
tctggactgacacgtgatcctctta

SEQ ID NO: 834273 - DNA, 25 bp, Mus musculus
tctggactgacaggtgatcctctta

SEQ ID NO: 834274 - DNA, 25 bp, Mus musculus
tctggactggacatcatgaccctaa

SEQ ID NO: 834275 - DNA, 25 bp, Mus musculus
tctggactggacttcatgaccctaa

SEQ ID NO: 834276 - DNA, 25 bp, Mus musculus
tctggactgttcaagatacctggaa

SEQ ID NO: 834277 - DNA, 25 bp, Mus musculus
tctggactgttctagatacctggaa

SEQ ID NO: 834278 - DNA, 25 bp, Mus musculus
tctggacttgaaatctgtactttga

SEQ ID NO: 834279 - DNA, 25 bp, Mus musculus
tctggacttgaattctgtactttga

SEQ ID NO: 834280 - DNA, 25 bp, Mus musculus
tctggagaagttagcctaccgggta

SEQ ID NO: 834281 - DNA, 25 bp, Mus musculus
tctggagaagtttgcctaccgggta

SEQ ID NO: 834282 - DNA, 25 bp, Mus musculus
tctggagaattccctattttcagtg

SEQ ID NO: 834283 - DNA, 25 bp, Mus musculus
tctggagaattcgctattttcagtg

SEQ ID NO: 834284 - DNA, 25 bp, Mus musculus
tctggagacaagagcggttcaatca

SEQ ID NO: 834285 - DNA, 25 bp, Mus musculus
tctggagacaagtgcggttcaatca

SEQ ID NO: 834286 - DNA, 25 bp, Mus musculus
tctggagacaggctgaaactggacc

SEQ ID NO: 834287 - DNA, 25 bp, Mus musculus
tctggagacagggtgaaactggacc

SEQ ID NO: 834288 - DNA, 25 bp, Mus musculus
tctggagacgacagttaataatagc

SEQ ID NO: 834289 - DNA, 25 bp, Mus musculus
tctggagacgactgttaataatagc

SEQ ID NO: 834290 - DNA, 25 bp, Mus musculus
tctggagacgcaaaaccctgttcaa

SEQ ID NO: 834291 - DNA, 25 bp, Mus musculus
tctggagacgcataaccctgttcaa

SEQ ID NO: 834292 - DNA, 25 bp, Mus musculus
tctggagactataagaaggccctgc

SEQ ID NO: 834293 - DNA, 25 bp, Mus musculus
tctggagactattagaaggccctgc

SEQ ID NO: 834294 - DNA, 25 bp, Mus musculus
tctggagactctccagcgggagatc

SEQ ID NO: 834295 - DNA, 25 bp, Mus musculus
tctggagactctgcagcgggagatc

SEQ ID NO: 834296 - DNA, 25 bp, Mus musculus
tctggagagactcaggcatcaagca

SEQ ID NO: 834297 - DNA, 25 bp, Mus musculus
tctggagagactgaggcatcaagca

SEQ ID NO: 834298 - DNA, 25 bp, Mus musculus
tctggagaggctccagcggcaccaa

SEQ ID NO: 834299 - DNA, 25 bp, Mus musculus
tctggagaggctgcagcggcaccaa

SEQ ID NO: 834300 - DNA, 25 bp, Mus musculus
tctggagaggtacgtgtttagcact

SEQ ID NO: 834301 - DNA, 25 bp, Mus musculus
tctggagaggtaggtgtttagcact

SEQ ID NO: 834302 - DNA, 25 bp, Mus musculus
tctggagagtgtactggttccaccc

SEQ ID NO: 834303 - DNA, 25 bp, Mus musculus
tctggagagtgttctggttccaccc

SEQ ID NO: 834304 - DNA, 25 bp, Mus musculus
tctggagataagagcccttaccctg

SEQ ID NO: 834305 - DNA, 25 bp, Mus musculus
tctggagataagtgcccttaccctg

SEQ ID NO: 834306 - DNA, 25 bp, Mus musculus
tctggagattcaagttctctcagct

SEQ ID NO: 834307 - DNA, 25 bp, Mus musculus
tctggagattcatgttctctcagct

SEQ ID NO: 834308 - DNA, 25 bp, Mus musculus
tctggagcaacacctactccacaga

SEQ ID NO: 834309 - DNA, 25 bp, Mus musculus
tctggagcaacagctactccacaga

SEQ ID NO: 834310 - DNA, 25 bp, Mus musculus
tctggagcacgacctggccatcaaa

SEQ ID NO: 834311 - DNA, 25 bp, Mus musculus
tctggagcacgagctggccatcaaa

SEQ ID NO: 834312 - DNA, 25 bp, Mus musculus
tctggagcagacactttgtgcccca

SEQ ID NO: 834313 - DNA, 25 bp, Mus musculus
tctggagcagactctttgtgcccca

SEQ ID NO: 834314 - DNA, 25 bp, Mus musculus
tctggagcagcccatactgggaact

SEQ ID NO: 834315 - DNA, 25 bp, Mus musculus
tctggagcagccgatactgggaact

SEQ ID NO: 834316 - DNA, 25 bp, Mus musculus
tctggagcagcgactgtctttgaca

SEQ ID NO: 834317 - DNA, 25 bp, Mus musculus
tctggagcagcgtctgtctttgaca

SEQ ID NO: 834318 - DNA, 25 bp, Mus musculus
tctggagcagtcattccttgctgat

SEQ ID NO: 834319 - DNA, 25 bp, Mus musculus
tctggagcagtctttccttgctgat

SEQ ID NO: 834320 - DNA, 25 bp, Mus musculus
tctggagcatctcgtcttttgcttt

SEQ ID NO: 834321 - DNA, 25 bp, Mus musculus
tctggagcatctggtcttttgcttt

SEQ ID NO: 834322 - DNA, 25 bp, Mus musculus
tctggagcctcaccgcaagcacaaa

SEQ ID NO: 834323 - DNA, 25 bp, Mus musculus
tctggagcctcagcgcaagcacaaa

SEQ ID NO: 834324 - DNA, 25 bp, Mus musculus
tctggagcctgtagtctttgaaatc

SEQ ID NO: 834325 - DNA, 25 bp, Mus musculus
tctggagcctgttgtctttgaaatc

SEQ ID NO: 834326 - DNA, 25 bp, Mus musculus
tctggagccttcatctgcaaggaag

SEQ ID NO: 834327 - DNA, 25 bp, Mus musculus
tctggagccttcttctgcaaggaag

SEQ ID NO: 834328 - DNA, 25 bp, Mus musculus
tctggagcgcagctgctactggaaa

SEQ ID NO: 834329 - DNA, 25 bp, Mus musculus
tctggagcgcaggtgctactggaaa

SEQ ID NO: 834330 - DNA, 25 bp, Mus musculus
tctggagctcatcgaacgaggactt

SEQ ID NO: 834331 - DNA, 25 bp, Mus musculus
tctggagctcatggaacgaggactt

SEQ ID NO: 834332 - DNA, 25 bp, Mus musculus
tctggagctcttcgtggactggaaa

SEQ ID NO: 834333 - DNA, 25 bp, Mus musculus
tctggagctcttggtggactggaaa

SEQ ID NO: 834334 - DNA, 25 bp, Mus musculus
tctggagctgacatactgttctggg

SEQ ID NO: 834335 - DNA, 25 bp, Mus musculus
tctggagctgacttactgttctggg

SEQ ID NO: 834336 - DNA, 25 bp, Mus musculus
tctggagctttcaggctgtgaggca

SEQ ID NO: 834337 - DNA, 25 bp, Mus musculus
tctggagctttctggctgtgaggca

SEQ ID NO: 834338 - DNA, 25 bp, Mus musculus
tctggaggaaaacaacttgctgaca

SEQ ID NO: 834339 - DNA, 25 bp, Mus musculus
tctggaggaaaagaacttgctgaca

SEQ ID NO: 834340 - DNA, 25 bp, Mus musculus
tctggaggaattagtgagccaccta

SEQ ID NO: 834341 - DNA, 25 bp, Mus musculus
tctggaggaatttgtgagccaccta

SEQ ID NO: 834342 - DNA, 25 bp, Mus musculus
tctggaggaccgcttatctgtaaca

SEQ ID NO: 834343 - DNA, 25 bp, Mus musculus
tctggaggaccggttatctgtaaca

SEQ ID NO: 834344 - DNA, 25 bp, Mus musculus
tctggaggagttaagctggcaagcc

SEQ ID NO: 834345 - DNA, 25 bp, Mus musculus
tctggaggagtttagctggcaagcc

SEQ ID NO: 834346 - DNA, 25 bp, Mus musculus
tctggaggcatcatgcgctggtgct

SEQ ID NO: 834347 - DNA, 25 bp, Mus musculus
tctggaggcatcttgcgctggtgct

SEQ ID NO: 834348 - DNA, 25 bp, Mus musculus
tctggaggccttagtgtgcccaggc

SEQ ID NO: 834349 - DNA, 25 bp, Mus musculus
tctggaggcctttgtgtgcccaggc

SEQ ID NO: 834350 - DNA, 25 bp, Mus musculus
tctggaggcgatagcaccttccacc

SEQ ID NO: 834351 - DNA, 25 bp, Mus musculus
tctggaggcgattgcaccttccacc

SEQ ID NO: 834352 - DNA, 25 bp, Mus musculus
tctggaggctgaacacacttcatgt

SEQ ID NO: 834353 - DNA, 25 bp, Mus musculus
tctggaggctgatcacacttcatgt

SEQ ID NO: 834354 - DNA, 25 bp, Mus musculus
tctggagggcccaccatcgaggaag

SEQ ID NO: 834355 - DNA, 25 bp, Mus musculus
tctggagggccctccatcgaggaag

SEQ ID NO: 834356 - DNA, 25 bp, Mus musculus
tctggagggtgacgacattgcctac

SEQ ID NO: 834357 - DNA, 25 bp, Mus musculus
tctggagggtgaggacattgcctac

SEQ ID NO: 834358 - DNA, 25 bp, Mus musculus
tctggaggtcagagcctgttgggaa

SEQ ID NO: 834359 - DNA, 25 bp, Mus musculus
tctggaggtcagtgcctgttgggaa

SEQ ID NO: 834360 - DNA, 25 bp, Mus musculus
tctggaggtcggactctcagttgta

SEQ ID NO: 834361 - DNA, 25 bp, Mus musculus
tctggaggtcggtctctcagttgta

SEQ ID NO: 834362 - DNA, 25 bp, Mus musculus
tctggaggtctcagcgtggacacaa

SEQ ID NO: 834363 - DNA, 25 bp, Mus musculus
tctggaggtctctgcgtggacacaa

SEQ ID NO: 834364 - DNA, 25 bp, Mus musculus
tctggaggtgttcctcattgggccc

SEQ ID NO: 834365 - DNA, 25 bp, Mus musculus
tctggaggtgttgctcattgggccc

SEQ ID NO: 834366 - DNA, 25 bp, Mus musculus
tctggagtaaatcgagtgctccgtg

SEQ ID NO: 834367 - DNA, 25 bp, Mus musculus
tctggagtaaatggagtgctccgtg

SEQ ID NO: 834368 - DNA, 25 bp, Mus musculus
tctggagtatctcgtttgaattcta

SEQ ID NO: 834369 - DNA, 25 bp, Mus musculus
tctggagtatctggtttgaattcta

SEQ ID NO: 834370 - DNA, 25 bp, Mus musculus
tctggagtcactctatatctggatt

SEQ ID NO: 834371 - DNA, 25 bp, Mus musculus
tctggagtcactgtatatctggatt

SEQ ID NO: 834372 - DNA, 25 bp, Mus musculus
tctggagtccccagtatagatagct

SEQ ID NO: 834373 - DNA, 25 bp, Mus musculus
tctggagtcccctgtatagatagct

SEQ ID NO: 834374 - DNA, 25 bp, Mus musculus
tctggagtccggatgctgactgtaa

SEQ ID NO: 834375 - DNA, 25 bp, Mus musculus
tctggagtccggttgctgactgtaa

SEQ ID NO: 834376 - DNA, 25 bp, Mus musculus
tctggagtgaagagagtgacgttac

SEQ ID NO: 834377 - DNA, 25 bp, Mus musculus
tctggagtgaagtgagtgacgttac

SEQ ID NO: 834378 - DNA, 25 bp, Mus musculus
tctggagtgtgcagtcctgaggtct

SEQ ID NO: 834379 - DNA, 25 bp, Mus musculus
tctggagtgtgctgtcctgaggtct

SEQ ID NO: 834380 - DNA, 25 bp, Mus musculus
tctggataaatcagactcgttgctc

SEQ ID NO: 834381 - DNA, 25 bp, Mus musculus
tctggataaatctgactcgttgctc

SEQ ID NO: 834382 - DNA, 25 bp, Mus musculus
tctggataactaatcgcgggtgctt

SEQ ID NO: 834383 - DNA, 25 bp, Mus musculus
tctggataactattcgcgggtgctt

SEQ ID NO: 834384 - DNA, 25 bp, Mus musculus
tctggatacctgataagccctttcc

SEQ ID NO: 834385 - DNA, 25 bp, Mus musculus
tctggatacctgttaagccctttcc

SEQ ID NO: 834386 - DNA, 25 bp, Mus musculus
tctggataggtgatcgttcgtgttt

SEQ ID NO: 834387 - DNA, 25 bp, Mus musculus
tctggataggtgttcgttcgtgttt

SEQ ID NO: 834388 - DNA, 25 bp, Mus musculus
tctggatcagtacagagccctccca

SEQ ID NO: 834389 - DNA, 25 bp, Mus musculus
tctggatcagtagagagccctccca

SEQ ID NO: 834390 - DNA, 25 bp, Mus musculus
tctggatccaagaaaagttgtactg

SEQ ID NO: 834391 - DNA, 25 bp, Mus musculus
tctggatccaagtaaagttgtactg

SEQ ID NO: 834392 - DNA, 25 bp, Mus musculus
tctggatcccagattcttagagagg

SEQ ID NO: 834393 - DNA, 25 bp, Mus musculus
tctggatcccagtttcttagagagg

SEQ ID NO: 834394 - DNA, 25 bp, Mus musculus
tctggatcctacctgaacagcagta

SEQ ID NO: 834395 - DNA, 25 bp, Mus musculus
tctggatcctacgtgaacagcagta

SEQ ID NO: 834396 - DNA, 25 bp, Mus musculus
tctggatcctgacgcaccatactgg

SEQ ID NO: 834397 - DNA, 25 bp, Mus musculus
tctggatcctgaggcaccatactgg

SEQ ID NO: 834398 - DNA, 25 bp, Mus musculus
tctggatcctgtactcacattctac

SEQ ID NO: 834399 - DNA, 25 bp, Mus musculus
tctggatcctgttctcacattctac

SEQ ID NO: 834400 - DNA, 25 bp, Mus musculus
tctggatctagcagtaggtcatcct

SEQ ID NO: 834401 - DNA, 25 bp, Mus musculus
tctggatctagctgtaggtcatcct

SEQ ID NO: 834402 - DNA, 25 bp, Mus musculus
tctggatctatcaatcaaagcttgc

SEQ ID NO: 834403 - DNA, 25 bp, Mus musculus
tctggatctatctatcaaagcttgc

SEQ ID NO: 834404 - DNA, 25 bp, Mus musculus
tctggatctctgctcagcccaagct

SEQ ID NO: 834405 - DNA, 25 bp, Mus musculus
tctggatctctggtcagcccaagct

SEQ ID NO: 834406 - DNA, 25 bp, Mus musculus
tctggatctgaacgctcgcactagg

SEQ ID NO: 834407 - DNA, 25 bp, Mus musculus
tctggatctgaaggctcgcactagg

SEQ ID NO: 834408 - DNA, 25 bp, Mus musculus
tctggatctgggacattcaaaagct

SEQ ID NO: 834409 - DNA, 25 bp, Mus musculus
tctggatctgggtcattcaaaagct

SEQ ID NO: 834410 - DNA, 25 bp, Mus musculus
tctggatcttccaagtgacttgtca

SEQ ID NO: 834411 - DNA, 25 bp, Mus musculus
tctggatcttcctagtgacttgtca

SEQ ID NO: 834412 - DNA, 25 bp, Mus musculus
tctggatcttgtcacctgtgacggt

SEQ ID NO: 834413 - DNA, 25 bp, Mus musculus
tctggatcttgtgacctgtgacggt

SEQ ID NO: 834414 - DNA, 25 bp, Mus musculus
tctggatctttgactttgtctgtgt

SEQ ID NO: 834415 - DNA, 25 bp, Mus musculus
tctggatctttgtctttgtctgtgt

SEQ ID NO: 834416 - DNA, 25 bp, Mus musculus
tctggatcttttccttagaactctg

SEQ ID NO: 834417 - DNA, 25 bp, Mus musculus
tctggatcttttgcttagaactctg

SEQ ID NO: 834418 - DNA, 25 bp, Mus musculus
tctggatgctaaagctgtgtcccat

SEQ ID NO: 834419 - DNA, 25 bp, Mus musculus
tctggatgctaatgctgtgtcccat

SEQ ID NO: 834420 - DNA, 25 bp, Mus musculus
tctggatggaccaagccgcatacag

SEQ ID NO: 834421 - DNA, 25 bp, Mus musculus
tctggatggacctagccgcatacag

SEQ ID NO: 834422 - DNA, 25 bp, Mus musculus
tctggatggtccatcaaagctgaga

SEQ ID NO: 834423 - DNA, 25 bp, Mus musculus
tctggatggtccttcaaagctgaga

SEQ ID NO: 834424 - DNA, 25 bp, Mus musculus
tctggatgtagtcgtgcaaggcttt

SEQ ID NO: 834425 - DNA, 25 bp, Mus musculus
tctggatgtagtggtgcaaggcttt

SEQ ID NO: 834426 - DNA, 25 bp, Mus musculus
tctggatgtcacagtccttcccggg

SEQ ID NO: 834427 - DNA, 25 bp, Mus musculus
tctggatgtcactgtccttcccggg

SEQ ID NO: 834428 - DNA, 25 bp, Mus musculus
tctggatgtctacgtgagggacact

SEQ ID NO: 834429 - DNA, 25 bp, Mus musculus
tctggatgtctaggtgagggacact

SEQ ID NO: 834430 - DNA, 25 bp, Mus musculus
tctggatgtgcacctggctcaggaa

SEQ ID NO: 834431 - DNA, 25 bp, Mus musculus
tctggatgtgcagctggctcaggaa

SEQ ID NO: 834432 - DNA, 25 bp, Mus musculus
tctggatgttctcacccatcagggt

SEQ ID NO: 834433 - DNA, 25 bp, Mus musculus
tctggatgttctgacccatcagggt

SEQ ID NO: 834434 - DNA, 25 bp, Mus musculus
tctggatgttgtagtctgacagggt

SEQ ID NO: 834435 - DNA, 25 bp, Mus musculus
tctggatgttgttgtctgacagggt

SEQ ID NO: 834436 - DNA, 25 bp, Mus musculus
tctggattcaatactcagcagccac

SEQ ID NO: 834437 - DNA, 25 bp, Mus musculus
tctggattcaattctcagcagccac

SEQ ID NO: 834438 - DNA, 25 bp, Mus musculus
tctggattcagaactcattcttcgt

SEQ ID NO: 834439 - DNA, 25 bp, Mus musculus
tctggattcagaattcaaccccaca

SEQ ID NO: 834440 - DNA, 25 bp, Mus musculus
tctggattcagatctcattcttcgt

SEQ ID NO: 834441 - DNA, 25 bp, Mus musculus
tctggattcagatttcaaccccaca

SEQ ID NO: 834442 - DNA, 25 bp, Mus musculus
tctggattccaaacaactctcgact

SEQ ID NO: 834443 - DNA, 25 bp, Mus musculus
tctggattccaatcaactctcgact

SEQ ID NO: 834444 - DNA, 25 bp, Mus musculus
tctggattggtgagccctgagcaag

SEQ ID NO: 834445 - DNA, 25 bp, Mus musculus
tctggattggtgtgccctgagcaag

SEQ ID NO: 834446 - DNA, 25 bp, Mus musculus
tctggatttggaaatcttagaagca

SEQ ID NO: 834447 - DNA, 25 bp, Mus musculus
tctggatttggatatcttagaagca

SEQ ID NO: 834448 - DNA, 25 bp, Mus musculus
tctggatttgggatcagctcaaaac

SEQ ID NO: 834449 - DNA, 25 bp, Mus musculus
tctggatttgggttcagctcaaaac

SEQ ID NO: 834450 - DNA, 25 bp, Mus musculus
tctggcaaaccaacaaggacatctt

SEQ ID NO: 834451 - DNA, 25 bp, Mus musculus
tctggcaaaccatcaaggacatctt

SEQ ID NO: 834452 - DNA, 25 bp, Mus musculus
tctggcaaagatatcctcggagcat

SEQ ID NO: 834453 - DNA, 25 bp, Mus musculus
tctggcaaagatttcctcggagcat

SEQ ID NO: 834454 - DNA, 25 bp, Mus musculus
tctggcaacggtaaccacaccaggg

SEQ ID NO: 834455 - DNA, 25 bp, Mus musculus
tctggcaacggttaccacaccaggg

SEQ ID NO: 834456 - DNA, 25 bp, Mus musculus
tctggcaactatcaccgtgaatgac

SEQ ID NO: 834457 - DNA, 25 bp, Mus musculus
tctggcaactatgaccgtgaatgac

SEQ ID NO: 834458 - DNA, 25 bp, Mus musculus
tctggcaacttgaagcaaagcccca

SEQ ID NO: 834459 - DNA, 25 bp, Mus musculus
tctggcaacttgtagcaaagcccca

SEQ ID NO: 834460 - DNA, 25 bp, Mus musculus
tctggcaataaacttgcagaccttg

SEQ ID NO: 834461 - DNA, 25 bp, Mus musculus
tctggcaataaagttgcagaccttg

SEQ ID NO: 834462 - DNA, 25 bp, Mus musculus
tctggcacatgaagtccccgaggga

SEQ ID NO: 834463 - DNA, 25 bp, Mus musculus
tctggcacatgacacagtgttcatg

SEQ ID NO: 834464 - DNA, 25 bp, Mus musculus
tctggcacatgagacagtgttcatg

SEQ ID NO: 834465 - DNA, 25 bp, Mus musculus
tctggcacatgatgtccccgaggga

SEQ ID NO: 834466 - DNA, 25 bp, Mus musculus
tctggcacatgcactaactcatctt

SEQ ID NO: 834467 - DNA, 25 bp, Mus musculus
tctggcacatgctctaactcatctt

SEQ ID NO: 834468 - DNA, 25 bp, Mus musculus
tctggcaccacaacactcaaaggag

SEQ ID NO: 834469 - DNA, 25 bp, Mus musculus
tctggcaccacacatcctgtagata

SEQ ID NO: 834470 - DNA, 25 bp, Mus musculus
tctggcaccacagatcctgtagata

SEQ ID NO: 834471 - DNA, 25 bp, Mus musculus
tctggcaccacatcactcaaaggag

SEQ ID NO: 834472 - DNA, 25 bp, Mus musculus
tctggcacctccataagtttgctga

SEQ ID NO: 834473 - DNA, 25 bp, Mus musculus
tctggcacctccttaagtttgctga

SEQ ID NO: 834474 - DNA, 25 bp, Mus musculus
tctggcaccttgactttagaggaat

SEQ ID NO: 834475 - DNA, 25 bp, Mus musculus
tctggcaccttgtctttagaggaat

SEQ ID NO: 834476 - DNA, 25 bp, Mus musculus
tctggcacgggtatccccaggctga

SEQ ID NO: 834477 - DNA, 25 bp, Mus musculus
tctggcacgggtttccccaggctga

SEQ ID NO: 834478 - DNA, 25 bp, Mus musculus
tctggcacgtgaaggcggtttctga

SEQ ID NO: 834479 - DNA, 25 bp, Mus musculus
tctggcacgtgatggcggtttctga

SEQ ID NO: 834480 - DNA, 25 bp, Mus musculus
tctggcactctaagtcttagctaaa

SEQ ID NO: 834481 - DNA, 25 bp, Mus musculus
tctggcactctatgtcttagctaaa

SEQ ID NO: 834482 - DNA, 25 bp, Mus musculus
tctggcacttgaccaagcccagctg

SEQ ID NO: 834483 - DNA, 25 bp, Mus musculus
tctggcacttgagcaagcccagctg

SEQ ID NO: 834484 - DNA, 25 bp, Mus musculus
tctggcagaaatcgcaataaaagtt

SEQ ID NO: 834485 - DNA, 25 bp, Mus musculus
tctggcagaaatggcaataaaagtt

SEQ ID NO: 834486 - DNA, 25 bp, Mus musculus
tctggcagagagcaccgaggacttc

SEQ ID NO: 834487 - DNA, 25 bp, Mus musculus
tctggcagagaggaccgaggacttc

SEQ ID NO: 834488 - DNA, 25 bp, Mus musculus
tctggcagcctgcataattctgaat

SEQ ID NO: 834489 - DNA, 25 bp, Mus musculus
tctggcagcctggataattctgaat

SEQ ID NO: 834490 - DNA, 25 bp, Mus musculus
tctggcagcggaatcacttctacta

SEQ ID NO: 834491 - DNA, 25 bp, Mus musculus
tctggcagcggattcacttctacta

SEQ ID NO: 834492 - DNA, 25 bp, Mus musculus
tctggcagcttacaatagctctgtt

SEQ ID NO: 834493 - DNA, 25 bp, Mus musculus
tctggcagcttagaatagctctgtt

SEQ ID NO: 834494 - DNA, 25 bp, Mus musculus
tctggcagctttcctgtcctacgtt

SEQ ID NO: 834495 - DNA, 25 bp, Mus musculus
tctggcagctttgctgtcctacgtt

SEQ ID NO: 834496 - DNA, 25 bp, Mus musculus
tctggcagggttcgatgttgaaaaa

SEQ ID NO: 834497 - DNA, 25 bp, Mus musculus
tctggcagggttggatgttgaaaaa

SEQ ID NO: 834498 - DNA, 25 bp, Mus musculus
tctggcaggttaatacttctcggac

SEQ ID NO: 834499 - DNA, 25 bp, Mus musculus
tctggcaggttattacttctcggac

SEQ ID NO: 834500 - DNA, 25 bp, Mus musculus
tctggcagtcagctgcttgccctgc

SEQ ID NO: 834501 - DNA, 25 bp, Mus musculus
tctggcagtcaggtgcttgccctgc

SEQ ID NO: 834502 - DNA, 25 bp, Mus musculus
tctggcagttcaatggaggtgtttt

SEQ ID NO: 834503 - DNA, 25 bp, Mus musculus
tctggcagttcattggaggtgtttt

SEQ ID NO: 834504 - DNA, 25 bp, Mus musculus
tctggcatacaccaggttcctctct

SEQ ID NO: 834505 - DNA, 25 bp, Mus musculus
tctggcatacacgaggttcctctct

SEQ ID NO: 834506 - DNA, 25 bp, Mus musculus
tctggcatatcaaggcttctggact

SEQ ID NO: 834507 - DNA, 25 bp, Mus musculus
tctggcatatcatggcttctggact

SEQ ID NO: 834508 - DNA, 25 bp, Mus musculus
tctggcatcaacacgttaaagaatg

SEQ ID NO: 834509 - DNA, 25 bp, Mus musculus
tctggcatcaactcgttaaagaatg

SEQ ID NO: 834510 - DNA, 25 bp, Mus musculus
tctggcatcaatactgttctgttag

SEQ ID NO: 834511 - DNA, 25 bp, Mus musculus
tctggcatcaattctgttctgttag

SEQ ID NO: 834512 - DNA, 25 bp, Mus musculus
tctggcatcccacagtgttccaaca

SEQ ID NO: 834513 - DNA, 25 bp, Mus musculus
tctggcatcccagagtgttccaaca

SEQ ID NO: 834514 - DNA, 25 bp, Mus musculus
tctggcatctggctgggtacacacc

SEQ ID NO: 834515 - DNA, 25 bp, Mus musculus
tctggcatctgggtgggtacacacc

SEQ ID NO: 834516 - DNA, 25 bp, Mus musculus
tctggcatgagccaggttccgcatc

SEQ ID NO: 834517 - DNA, 25 bp, Mus musculus
tctggcatgagcgaggttccgcatc

SEQ ID NO: 834518 - DNA, 25 bp, Mus musculus
tctggcatggagagatctttcttct

SEQ ID NO: 834519 - DNA, 25 bp, Mus musculus
tctggcatggagcacttcgggttca

SEQ ID NO: 834520 - DNA, 25 bp, Mus musculus
tctggcatggaggacttcgggttca

SEQ ID NO: 834521 - DNA, 25 bp, Mus musculus
tctggcatggagtgatctttcttct

SEQ ID NO: 834522 - DNA, 25 bp, Mus musculus
tctggcatggatctgactgttgtca

SEQ ID NO: 834523 - DNA, 25 bp, Mus musculus
tctggcatggatgtgactgttgtca

SEQ ID NO: 834524 - DNA, 25 bp, Mus musculus
tctggcatgtctacacaccataaac

SEQ ID NO: 834525 - DNA, 25 bp, Mus musculus
tctggcatgtcttcacaccataaac

SEQ ID NO: 834526 - DNA, 25 bp, Mus musculus
tctggcatgttcaaaatgcagatta

SEQ ID NO: 834527 - DNA, 25 bp, Mus musculus
tctggcatgttctaaatgcagatta

SEQ ID NO: 834528 - DNA, 25 bp, Mus musculus
tctggcattgatactataggaggtc

SEQ ID NO: 834529 - DNA, 25 bp, Mus musculus
tctggcattgattctataggaggtc

SEQ ID NO: 834530 - DNA, 25 bp, Mus musculus
tctggcatttgtcatttgtgggaaa

SEQ ID NO: 834531 - DNA, 25 bp, Mus musculus
tctggcatttgtgatttgtgggaaa

SEQ ID NO: 834532 - DNA, 25 bp, Mus musculus
tctggccaagtgactggagggtaca

SEQ ID NO: 834533 - DNA, 25 bp, Mus musculus
tctggccaagtgtctggagggtaca

SEQ ID NO: 834534 - DNA, 25 bp, Mus musculus
tctggccaatagcactcgatatttt

SEQ ID NO: 834535 - DNA, 25 bp, Mus musculus
tctggccaataggactcgatatttt

SEQ ID NO: 834536 - DNA, 25 bp, Mus musculus
tctggccacttgcacttcacagtaa

SEQ ID NO: 834537 - DNA, 25 bp, Mus musculus
tctggccacttggacttcacagtaa

SEQ ID NO: 834538 - DNA, 25 bp, Mus musculus
tctggccagaagctcacaccactgt

SEQ ID NO: 834539 - DNA, 25 bp, Mus musculus
tctggccagaaggtcacaccactgt

SEQ ID NO: 834540 - DNA, 25 bp, Mus musculus
tctggccagcacatcttacaaggat

SEQ ID NO: 834541 - DNA, 25 bp, Mus musculus
tctggccagcacttcttacaaggat

SEQ ID NO: 834542 - DNA, 25 bp, Mus musculus
tctggccagccaaggtctgagactt

SEQ ID NO: 834543 - DNA, 25 bp, Mus musculus
tctggccagccatggtctgagactt

SEQ ID NO: 834544 - DNA, 25 bp, Mus musculus
tctggccaggccctgactgtttcga

SEQ ID NO: 834545 - DNA, 25 bp, Mus musculus
tctggccaggccgtgactgtttcga

SEQ ID NO: 834546 - DNA, 25 bp, Mus musculus
tctggccagggcacaaattaaagtt

SEQ ID NO: 834547 - DNA, 25 bp, Mus musculus
tctggccagggctcaaattaaagtt

SEQ ID NO: 834548 - DNA, 25 bp, Mus musculus
tctggccaggtgatgatgttaattc

SEQ ID NO: 834549 - DNA, 25 bp, Mus musculus
tctggccaggtgttgatgttaattc

SEQ ID NO: 834550 - DNA, 25 bp, Mus musculus
tctggccagtgtacatcaaggtgca

SEQ ID NO: 834551 - DNA, 25 bp, Mus musculus
tctggccagtgttcatcaaggtgca

SEQ ID NO: 834552 - DNA, 25 bp, Mus musculus
tctggcccaatcaggctgtgatgta

SEQ ID NO: 834553 - DNA, 25 bp, Mus musculus
tctggcccaatctggctgtgatgta

SEQ ID NO: 834554 - DNA, 25 bp, Mus musculus
tctggcccacttacataggcaactt

SEQ ID NO: 834555 - DNA, 25 bp, Mus musculus
tctggcccactttcataggcaactt

SEQ ID NO: 834556 - DNA, 25 bp, Mus musculus
tctggcccagctcaaggaaaattga

SEQ ID NO: 834557 - DNA, 25 bp, Mus musculus
tctggcccagctgaaggaaaattga

SEQ ID NO: 834558 - DNA, 25 bp, Mus musculus
tctggcccaggaatcatgttgagca

SEQ ID NO: 834559 - DNA, 25 bp, Mus musculus
tctggcccaggattcatgttgagca

SEQ ID NO: 834560 - DNA, 25 bp, Mus musculus
tctggcccaggcagtttggaaacaa

SEQ ID NO: 834561 - DNA, 25 bp, Mus musculus
tctggcccaggctgtttggaaacaa

SEQ ID NO: 834562 - DNA, 25 bp, Mus musculus
tctggcccagggatctaggagtatg

SEQ ID NO: 834563 - DNA, 25 bp, Mus musculus
tctggcccagggttctaggagtatg

SEQ ID NO: 834564 - DNA, 25 bp, Mus musculus
tctggccccattcctggattctcag

SEQ ID NO: 834565 - DNA, 25 bp, Mus musculus
tctggccccattgctggattctcag

SEQ ID NO: 834566 - DNA, 25 bp, Mus musculus
tctggcccctatcagcattgtttga

SEQ ID NO: 834567 - DNA, 25 bp, Mus musculus
tctggcccctatgagcattgtttga

SEQ ID NO: 834568 - DNA, 25 bp, Mus musculus
tctggcccctttcggtaacaggtat

SEQ ID NO: 834569 - DNA, 25 bp, Mus musculus
tctggcccctttgggtaacaggtat

SEQ ID NO: 834570 - DNA, 25 bp, Mus musculus
tctggcccgctacatagatgatgaa

SEQ ID NO: 834571 - DNA, 25 bp, Mus musculus
tctggcccgctagatagatgatgaa

SEQ ID NO: 834572 - DNA, 25 bp, Mus musculus
tctggccctcttagagagtgtgttt

SEQ ID NO: 834573 - DNA, 25 bp, Mus musculus
tctggccctctttgagagtgtgttt

SEQ ID NO: 834574 - DNA, 25 bp, Mus musculus
tctggccctgctatggatcctcaag

SEQ ID NO: 834575 - DNA, 25 bp, Mus musculus
tctggccctgctttggatcctcaag

SEQ ID NO: 834576 - DNA, 25 bp, Mus musculus
tctggccctgggaagatttgataca

SEQ ID NO: 834577 - DNA, 25 bp, Mus musculus
tctggccctgggactaagtcaggaa

SEQ ID NO: 834578 - DNA, 25 bp, Mus musculus
tctggccctgggtagatttgataca

SEQ ID NO: 834579 - DNA, 25 bp, Mus musculus
tctggccctgggtctaagtcaggaa

SEQ ID NO: 834580 - DNA, 25 bp, Mus musculus
tctggccctggtatgagcgcctgga

SEQ ID NO: 834581 - DNA, 25 bp, Mus musculus
tctggccctggtttgagcgcctgga

SEQ ID NO: 834582 - DNA, 25 bp, Mus musculus
tctggcccttccaaggcatcgtggc

SEQ ID NO: 834583 - DNA, 25 bp, Mus musculus
tctggcccttcctaggcatcgtggc

SEQ ID NO: 834584 - DNA, 25 bp, Mus musculus
tctggccctttgacatggcgcctca

SEQ ID NO: 834585 - DNA, 25 bp, Mus musculus
tctggccctttgtcatggcgcctca

SEQ ID NO: 834586 - DNA, 25 bp, Mus musculus
tctggcctacagctctagatggaca

SEQ ID NO: 834587 - DNA, 25 bp, Mus musculus
tctggcctacaggtctagatggaca

SEQ ID NO: 834588 - DNA, 25 bp, Mus musculus
tctggcctagggagtgtttgttgaa

SEQ ID NO: 834589 - DNA, 25 bp, Mus musculus
tctggcctagggtgtgtttgttgaa

SEQ ID NO: 834590 - DNA, 25 bp, Mus musculus
tctggcctatgtcacattgacccca

SEQ ID NO: 834591 - DNA, 25 bp, Mus musculus
tctggcctatgtgacattgacccca

SEQ ID NO: 834592 - DNA, 25 bp, Mus musculus
tctggcctccgaaggtgacattata

SEQ ID NO: 834593 - DNA, 25 bp, Mus musculus
tctggcctccgatggtgacattata

SEQ ID NO: 834594 - DNA, 25 bp, Mus musculus
tctggcctcctgatgtcatgggaag

SEQ ID NO: 834595 - DNA, 25 bp, Mus musculus
tctggcctcctgttgtcatgggaag

SEQ ID NO: 834596 - DNA, 25 bp, Mus musculus
tctggcctctacaagtgcgcgcacg

SEQ ID NO: 834597 - DNA, 25 bp, Mus musculus
tctggcctctactagtgcgcgcacg

SEQ ID NO: 834598 - DNA, 25 bp, Mus musculus
tctggcctgatgaatacatttctct

SEQ ID NO: 834599 - DNA, 25 bp, Mus musculus
tctggcctgatgtatacatttctct

SEQ ID NO: 834600 - DNA, 25 bp, Mus musculus
tctggcctgctaagggcgtttctac

SEQ ID NO: 834601 - DNA, 25 bp, Mus musculus
tctggcctgctatgggcgtttctac

SEQ ID NO: 834602 - DNA, 25 bp, Mus musculus
tctggcctgcttaggcctgtgctct

SEQ ID NO: 834603 - DNA, 25 bp, Mus musculus
tctggcctgctttggcctgtgctct

SEQ ID NO: 834604 - DNA, 25 bp, Mus musculus
tctggcctgggacgcccatgtatat

SEQ ID NO: 834605 - DNA, 25 bp, Mus musculus
tctggcctgggaggcccatgtatat

SEQ ID NO: 834606 - DNA, 25 bp, Mus musculus
tctggcctgggcaagtcattgtagt

SEQ ID NO: 834607 - DNA, 25 bp, Mus musculus
tctggcctgggctagtcattgtagt

SEQ ID NO: 834608 - DNA, 25 bp, Mus musculus
tctggcctggtgagccagagccccg

SEQ ID NO: 834609 - DNA, 25 bp, Mus musculus
tctggcctggtgtgccagagccccg

SEQ ID NO: 834610 - DNA, 25 bp, Mus musculus
tctggccttgagctgcatcacttta

SEQ ID NO: 834611 - DNA, 25 bp, Mus musculus
tctggccttgaggtgcatcacttta

SEQ ID NO: 834612 - DNA, 25 bp, Mus musculus
tctggccttggaaggtactgggaac

SEQ ID NO: 834613 - DNA, 25 bp, Mus musculus
tctggccttggatggtactgggaac

SEQ ID NO: 834614 - DNA, 25 bp, Mus musculus
tctggcctttccaccttgagtgata

SEQ ID NO: 834615 - DNA, 25 bp, Mus musculus
tctggcctttcctccttgagtgata

SEQ ID NO: 834616 - DNA, 25 bp, Mus musculus
tctggcctttgtcgaaactttcata

SEQ ID NO: 834617 - DNA, 25 bp, Mus musculus
tctggcctttgtggaaactttcata

SEQ ID NO: 834618 - DNA, 25 bp, Mus musculus
tctggcgaacaaccggcggactcac

SEQ ID NO: 834619 - DNA, 25 bp, Mus musculus
tctggcgaacaagcggcggactcac

SEQ ID NO: 834620 - DNA, 25 bp, Mus musculus
tctggcgaattcacttggcactgag

SEQ ID NO: 834621 - DNA, 25 bp, Mus musculus
tctggcgaattctcttggcactgag

SEQ ID NO: 834622 - DNA, 25 bp, Mus musculus
tctggcgcatgcagcagggttttcc

SEQ ID NO: 834623 - DNA, 25 bp, Mus musculus
tctggcgcatgctgcagggttttcc

SEQ ID NO: 834624 - DNA, 25 bp, Mus musculus
tctggcggaagccaccttacaaggt

SEQ ID NO: 834625 - DNA, 25 bp, Mus musculus
tctggcggaagcgaccttacaaggt

SEQ ID NO: 834626 - DNA, 25 bp, Mus musculus
tctggcggagcgcataaagcctacc

SEQ ID NO: 834627 - DNA, 25 bp, Mus musculus
tctggcggagcggataaagcctacc

SEQ ID NO: 834628 - DNA, 25 bp, Mus musculus
tctggcggtcttaagtcaactctga

SEQ ID NO: 834629 - DNA, 25 bp, Mus musculus
tctggcggtctttagtcaactctga

SEQ ID NO: 834630 - DNA, 25 bp, Mus musculus
tctggcgtcttgctttatgaatgga

SEQ ID NO: 834631 - DNA, 25 bp, Mus musculus
tctggcgtcttggtttatgaatgga

SEQ ID NO: 834632 - DNA, 25 bp, Mus musculus
tctggcgtggcaagaggtctgctaa

SEQ ID NO: 834633 - DNA, 25 bp, Mus musculus
tctggcgtggcatgaggtctgctaa

SEQ ID NO: 834634 - DNA, 25 bp, Mus musculus
tctggctaacagcagagtgggcaat

SEQ ID NO: 834635 - DNA, 25 bp, Mus musculus
tctggctaacaggagagtgggcaat

SEQ ID NO: 834636 - DNA, 25 bp, Mus musculus
tctggctaattgctgggacttctgg

SEQ ID NO: 834637 - DNA, 25 bp, Mus musculus
tctggctaattggtgggacttctgg

SEQ ID NO: 834638 - DNA, 25 bp, Mus musculus
tctggctaccagaaagatgattttg

SEQ ID NO: 834639 - DNA, 25 bp, Mus musculus
tctggctaccagtaagatgattttg

SEQ ID NO: 834640 - DNA, 25 bp, Mus musculus
tctggctagcccagagttgcatgcc

SEQ ID NO: 834641 - DNA, 25 bp, Mus musculus
tctggctagccctgagttgcatgcc

SEQ ID NO: 834642 - DNA, 25 bp, Mus musculus
tctggctagtgtagttcacctttta

SEQ ID NO: 834643 - DNA, 25 bp, Mus musculus
tctggctagtgttgttcacctttta

SEQ ID NO: 834644 - DNA, 25 bp, Mus musculus
tctggctatgtgactgtgaccttat

SEQ ID NO: 834645 - DNA, 25 bp, Mus musculus
tctggctatgtgtctgtgaccttat

SEQ ID NO: 834646 - DNA, 25 bp, Mus musculus
tctggctcaactctcaagtgtacat

SEQ ID NO: 834647 - DNA, 25 bp, Mus musculus
tctggctcaactgtcaagtgtacat

SEQ ID NO: 834648 - DNA, 25 bp, Mus musculus
tctggctcacatccattatggcgta

SEQ ID NO: 834649 - DNA, 25 bp, Mus musculus
tctggctcacatgcattatggcgta

SEQ ID NO: 834650 - DNA, 25 bp, Mus musculus
tctggctcagacagctaagtgacta

SEQ ID NO: 834651 - DNA, 25 bp, Mus musculus
tctggctcagactgctaagtgacta

SEQ ID NO: 834652 - DNA, 25 bp, Mus musculus
tctggctcaggtagctcaaagcaca

SEQ ID NO: 834653 - DNA, 25 bp, Mus musculus
tctggctcaggttgctcaaagcaca

SEQ ID NO: 834654 - DNA, 25 bp, Mus musculus
tctggctcatccaagaagtagccct

SEQ ID NO: 834655 - DNA, 25 bp, Mus musculus
tctggctcatcctagaagtagccct

SEQ ID NO: 834656 - DNA, 25 bp, Mus musculus
tctggctcatctcctccagtgaata

SEQ ID NO: 834657 - DNA, 25 bp, Mus musculus
tctggctcatctgctccagtgaata

SEQ ID NO: 834658 - DNA, 25 bp, Mus musculus
tctggctcatttcttgcctttgcaa

SEQ ID NO: 834659 - DNA, 25 bp, Mus musculus
tctggctcatttgttgcctttgcaa

SEQ ID NO: 834660 - DNA, 25 bp, Mus musculus
tctggctccaatacacactcctgag

SEQ ID NO: 834661 - DNA, 25 bp, Mus musculus
tctggctccaattcacactcctgag

SEQ ID NO: 834662 - DNA, 25 bp, Mus musculus
tctggctccagaacaaggctgggct

SEQ ID NO: 834663 - DNA, 25 bp, Mus musculus
tctggctccagacatggctaggtga

SEQ ID NO: 834664 - DNA, 25 bp, Mus musculus
tctggctccagagatggctaggtga

SEQ ID NO: 834665 - DNA, 25 bp, Mus musculus
tctggctccagatcaaggctgggct

SEQ ID NO: 834666 - DNA, 25 bp, Mus musculus
tctggctccatcaggactgcagatt

SEQ ID NO: 834667 - DNA, 25 bp, Mus musculus
tctggctccatctggactgcagatt

SEQ ID NO: 834668 - DNA, 25 bp, Mus musculus
tctggctccatgcgcacccaggtat

SEQ ID NO: 834669 - DNA, 25 bp, Mus musculus
tctggctccatgggcacccaggtat

SEQ ID NO: 834670 - DNA, 25 bp, Mus musculus
tctggctcccaccatgaatcagtga

SEQ ID NO: 834671 - DNA, 25 bp, Mus musculus
tctggctcccacgatgaatcagtga

SEQ ID NO: 834672 - DNA, 25 bp, Mus musculus
tctggctcccggcttctgggtttat

SEQ ID NO: 834673 - DNA, 25 bp, Mus musculus
tctggctcccgggttctgggtttat

SEQ ID NO: 834674 - DNA, 25 bp, Mus musculus
tctggctcccttattacaattgttg

SEQ ID NO: 834675 - DNA, 25 bp, Mus musculus
tctggctccctttttacaattgttg

SEQ ID NO: 834676 - DNA, 25 bp, Mus musculus
tctggctccgatcagagtgatccta

SEQ ID NO: 834677 - DNA, 25 bp, Mus musculus
tctggctccgatgagagtgatccta

SEQ ID NO: 834678 - DNA, 25 bp, Mus musculus
tctggctcctacaggagatatcctt

SEQ ID NO: 834679 - DNA, 25 bp, Mus musculus
tctggctcctacaggtgtgaggcag

SEQ ID NO: 834680 - DNA, 25 bp, Mus musculus
tctggctcctactggagatatcctt

SEQ ID NO: 834681 - DNA, 25 bp, Mus musculus
tctggctcctactggtgtgaggcag

SEQ ID NO: 834682 - DNA, 25 bp, Mus musculus
tctggctcctcaagactgtgatgtg

SEQ ID NO: 834683 - DNA, 25 bp, Mus musculus
tctggctcctcatgactgtgatgtg

SEQ ID NO: 834684 - DNA, 25 bp, Mus musculus
tctggctcctgtacaagcatcaaca

SEQ ID NO: 834685 - DNA, 25 bp, Mus musculus
tctggctcctgttcaagcatcaaca

SEQ ID NO: 834686 - DNA, 25 bp, Mus musculus
tctggctccttaagtttgctgctga

SEQ ID NO: 834687 - DNA, 25 bp, Mus musculus
tctggctccttatgtttgctgctga

SEQ ID NO: 834688 - DNA, 25 bp, Mus musculus
tctggctcgtggcaatattggttac

SEQ ID NO: 834689 - DNA, 25 bp, Mus musculus
tctggctcgtgggaatattggttac

SEQ ID NO: 834690 - DNA, 25 bp, Mus musculus
tctggctctgagctccgcaatcgga

SEQ ID NO: 834691 - DNA, 25 bp, Mus musculus
tctggctctgaggtccgcaatcgga

SEQ ID NO: 834692 - DNA, 25 bp, Mus musculus
tctggctctgtgagtctttcatggc

SEQ ID NO: 834693 - DNA, 25 bp, Mus musculus
tctggctctgtgattggtgctccac

SEQ ID NO: 834694 - DNA, 25 bp, Mus musculus
tctggctctgtgtgtctttcatggc

SEQ ID NO: 834695 - DNA, 25 bp, Mus musculus
tctggctctgtgtttggtgctccac

SEQ ID NO: 834696 - DNA, 25 bp, Mus musculus
tctggctgaactctctgggaattat

SEQ ID NO: 834697 - DNA, 25 bp, Mus musculus
tctggctgaactgtctgggaattat

SEQ ID NO: 834698 - DNA, 25 bp, Mus musculus
tctggctgaatcacttggctgggta

SEQ ID NO: 834699 - DNA, 25 bp, Mus musculus
tctggctgaatctcttggctgggta

SEQ ID NO: 834700 - DNA, 25 bp, Mus musculus
tctggctgagatccttgaagacctt

SEQ ID NO: 834701 - DNA, 25 bp, Mus musculus
tctggctgagatgcttgaagacctt

SEQ ID NO: 834702 - DNA, 25 bp, Mus musculus
tctggctgcagaccgccgacttgct

SEQ ID NO: 834703 - DNA, 25 bp, Mus musculus
tctggctgcagagcgccgacttgct

SEQ ID NO: 834704 - DNA, 25 bp, Mus musculus
tctggctgcctgactttgctgccat

SEQ ID NO: 834705 - DNA, 25 bp, Mus musculus
tctggctgcctgtctttgctgccat

SEQ ID NO: 834706 - DNA, 25 bp, Mus musculus
tctggctgctccaggagtcactctc

SEQ ID NO: 834707 - DNA, 25 bp, Mus musculus
tctggctgctcctggagtcactctc

SEQ ID NO: 834708 - DNA, 25 bp, Mus musculus
tctggctgctggacggacttgtcgt

SEQ ID NO: 834709 - DNA, 25 bp, Mus musculus
tctggctgctggtcggacttgtcgt

SEQ ID NO: 834710 - DNA, 25 bp, Mus musculus
tctggctggcaccaccacagttcta

SEQ ID NO: 834711 - DNA, 25 bp, Mus musculus
tctggctggcacctcttaattttca

SEQ ID NO: 834712 - DNA, 25 bp, Mus musculus
tctggctggcacgaccacagttcta

SEQ ID NO: 834713 - DNA, 25 bp, Mus musculus
tctggctggcacgtcttaattttca

SEQ ID NO: 834714 - DNA, 25 bp, Mus musculus
tctggctggccacgaacttgagtga

SEQ ID NO: 834715 - DNA, 25 bp, Mus musculus
tctggctggccaggaacttgagtga

SEQ ID NO: 834716 - DNA, 25 bp, Mus musculus
tctggctggctgagttttatttttg

SEQ ID NO: 834717 - DNA, 25 bp, Mus musculus
tctggctggctgtgttttatttttg

SEQ ID NO: 834718 - DNA, 25 bp, Mus musculus
tctggctgggacagaagacccgtgt

SEQ ID NO: 834719 - DNA, 25 bp, Mus musculus
tctggctgggactgaagacccgtgt

SEQ ID NO: 834720 - DNA, 25 bp, Mus musculus
tctggctgggctacttcaacagctg

SEQ ID NO: 834721 - DNA, 25 bp, Mus musculus
tctggctgggcttcttcaacagctg

SEQ ID NO: 834722 - DNA, 25 bp, Mus musculus
tctggctggtagaggacgttcatga

SEQ ID NO: 834723 - DNA, 25 bp, Mus musculus
tctggctggtagtggacgttcatga

SEQ ID NO: 834724 - DNA, 25 bp, Mus musculus
tctggctggtctcttgtatgagtta

SEQ ID NO: 834725 - DNA, 25 bp, Mus musculus
tctggctggtctgttgtatgagtta

SEQ ID NO: 834726 - DNA, 25 bp, Mus musculus
tctggctggttaccacaaggacata

SEQ ID NO: 834727 - DNA, 25 bp, Mus musculus
tctggctggttagcacaaggacata

SEQ ID NO: 834728 - DNA, 25 bp, Mus musculus
tctggctgtagaactctgagggtct

SEQ ID NO: 834729 - DNA, 25 bp, Mus musculus
tctggctgtagatctctgagggtct

SEQ ID NO: 834730 - DNA, 25 bp, Mus musculus
tctggctgtagcagtggagaccaca

SEQ ID NO: 834731 - DNA, 25 bp, Mus musculus
tctggctgtagctgtggagaccaca

SEQ ID NO: 834732 - DNA, 25 bp, Mus musculus
tctggctgtctgatgtgcagtcgac

SEQ ID NO: 834733 - DNA, 25 bp, Mus musculus
tctggctgtctgttgtgcagtcgac

SEQ ID NO: 834734 - DNA, 25 bp, Mus musculus
tctggctgtgccatagattttaaat

SEQ ID NO: 834735 - DNA, 25 bp, Mus musculus
tctggctgtgccttagattttaaat

SEQ ID NO: 834736 - DNA, 25 bp, Mus musculus
tctggctgttggatgcctggctgac

SEQ ID NO: 834737 - DNA, 25 bp, Mus musculus
tctggctgttggttgcctggctgac

SEQ ID NO: 834738 - DNA, 25 bp, Mus musculus
tctggctgtttaacccaactgtgat

SEQ ID NO: 834739 - DNA, 25 bp, Mus musculus
tctggctgtttatcccaactgtgat

SEQ ID NO: 834740 - DNA, 25 bp, Mus musculus
tctggctgtttgaacagcagcgttt

SEQ ID NO: 834741 - DNA, 25 bp, Mus musculus
tctggctgtttgacatccatagtcc

SEQ ID NO: 834742 - DNA, 25 bp, Mus musculus
tctggctgtttgagtcagtgagtca

SEQ ID NO: 834743 - DNA, 25 bp, Mus musculus
tctggctgtttgtacagcagcgttt

SEQ ID NO: 834744 - DNA, 25 bp, Mus musculus
tctggctgtttgtcatccatagtcc

SEQ ID NO: 834745 - DNA, 25 bp, Mus musculus
tctggctgtttgtgtcagtgagtca

SEQ ID NO: 834746 - DNA, 25 bp, Mus musculus
tctggctgttttcgtctttcttaag

SEQ ID NO: 834747 - DNA, 25 bp, Mus musculus
tctggctgttttggtctttcttaag

SEQ ID NO: 834748 - DNA, 25 bp, Mus musculus
tctggcttaaagcagattcctatta

SEQ ID NO: 834749 - DNA, 25 bp, Mus musculus
tctggcttaaaggagattcctatta

SEQ ID NO: 834750 - DNA, 25 bp, Mus musculus
tctggcttacctcgctatacaagta

SEQ ID NO: 834751 - DNA, 25 bp, Mus musculus
tctggcttacctggctatacaagta

SEQ ID NO: 834752 - DNA, 25 bp, Mus musculus
tctggcttagccactagtacactag

SEQ ID NO: 834753 - DNA, 25 bp, Mus musculus
tctggcttagcctctagtacactag

SEQ ID NO: 834754 - DNA, 25 bp, Mus musculus
tctggcttcaaccaagtcattgctg

SEQ ID NO: 834755 - DNA, 25 bp, Mus musculus
tctggcttcaacgaagtcattgctg

SEQ ID NO: 834756 - DNA, 25 bp, Mus musculus
tctggcttcactatttacctggaag

SEQ ID NO: 834757 - DNA, 25 bp, Mus musculus
tctggcttcactttttacctggaag

SEQ ID NO: 834758 - DNA, 25 bp, Mus musculus
tctggcttccacataggcagacaag

SEQ ID NO: 834759 - DNA, 25 bp, Mus musculus
tctggcttccacttaggcagacaag

SEQ ID NO: 834760 - DNA, 25 bp, Mus musculus
tctggcttccagacaaattaccttc

SEQ ID NO: 834761 - DNA, 25 bp, Mus musculus
tctggcttccagagcatcatttttg

SEQ ID NO: 834762 - DNA, 25 bp, Mus musculus
tctggcttccagtcaaattaccttc

SEQ ID NO: 834763 - DNA, 25 bp, Mus musculus
tctggcttccagtgcatcatttttg

SEQ ID NO: 834764 - DNA, 25 bp, Mus musculus
tctggcttcgagaaagctggtgcag

SEQ ID NO: 834765 - DNA, 25 bp, Mus musculus
tctggcttcgagtaagctggtgcag

SEQ ID NO: 834766 - DNA, 25 bp, Mus musculus
tctggcttctcgatgcaacaggagg

SEQ ID NO: 834767 - DNA, 25 bp, Mus musculus
tctggcttctcgttgcaacaggagg

SEQ ID NO: 834768 - DNA, 25 bp, Mus musculus
tctggcttgagtatcttgtgcattc

SEQ ID NO: 834769 - DNA, 25 bp, Mus musculus
tctggcttgagtttcttgtgcattc

SEQ ID NO: 834770 - DNA, 25 bp, Mus musculus
tctggcttgcttatcctgtgtctag

SEQ ID NO: 834771 - DNA, 25 bp, Mus musculus
tctggcttgcttttcctgtgtctag

SEQ ID NO: 834772 - DNA, 25 bp, Mus musculus
tctggcttggttatgcacttttctc

SEQ ID NO: 834773 - DNA, 25 bp, Mus musculus
tctggcttggttttgcacttttctc

SEQ ID NO: 834774 - DNA, 25 bp, Mus musculus
tctggcttgttgcaagagatgcccc

SEQ ID NO: 834775 - DNA, 25 bp, Mus musculus
tctggcttgttggaagagatgcccc

SEQ ID NO: 834776 - DNA, 25 bp, Mus musculus
tctggctttattaaatccctgatac

SEQ ID NO: 834777 - DNA, 25 bp, Mus musculus
tctggctttatttaatccctgatac

SEQ ID NO: 834778 - DNA, 25 bp, Mus musculus
tctggctttgccaacggtgataatc

SEQ ID NO: 834779 - DNA, 25 bp, Mus musculus
tctggctttgcctacggtgataatc

SEQ ID NO: 834780 - DNA, 25 bp, Mus musculus
tctggctttggtatgcacacgaagc

SEQ ID NO: 834781 - DNA, 25 bp, Mus musculus
tctggctttggtttgcacacgaagc

SEQ ID NO: 834782 - DNA, 25 bp, Mus musculus
tctggctttgtaacttatgtattca

SEQ ID NO: 834783 - DNA, 25 bp, Mus musculus
tctggctttgtatcttatgtattca

SEQ ID NO: 834784 - DNA, 25 bp, Mus musculus
tctggctttgttaaactggcttttc

SEQ ID NO: 834785 - DNA, 25 bp, Mus musculus
tctggctttgtttaactggcttttc

SEQ ID NO: 834786 - DNA, 25 bp, Mus musculus
tctggcttttaaactcggctgtgac

SEQ ID NO: 834787 - DNA, 25 bp, Mus musculus
tctggcttttaatctcggctgtgac

SEQ ID NO: 834788 - DNA, 25 bp, Mus musculus
tctggcttttgacatagtatcctga

SEQ ID NO: 834789 - DNA, 25 bp, Mus musculus
tctggcttttgagatagtatcctga

SEQ ID NO: 834790 - DNA, 25 bp, Mus musculus
tctggctttttgatcccttggctga

SEQ ID NO: 834791 - DNA, 25 bp, Mus musculus
tctggctttttgttcccttggctga

SEQ ID NO: 834792 - DNA, 25 bp, Mus musculus
tctgggaaaacaagcgcatcacttt

SEQ ID NO: 834793 - DNA, 25 bp, Mus musculus
tctgggaaaacatgcgcatcacttt

SEQ ID NO: 834794 - DNA, 25 bp, Mus musculus
tctgggaaaagacttggccatattc

SEQ ID NO: 834795 - DNA, 25 bp, Mus musculus
tctgggaaaagagttggccatattc

SEQ ID NO: 834796 - DNA, 25 bp, Mus musculus
tctgggaaaattagaaggtgacatt

SEQ ID NO: 834797 - DNA, 25 bp, Mus musculus
tctgggaaaatttgaaggtgacatt

SEQ ID NO: 834798 - DNA, 25 bp, Mus musculus
tctgggaaaggcacgaccgaaccac

SEQ ID NO: 834799 - DNA, 25 bp, Mus musculus
tctgggaaaggctcgaccgaaccac

SEQ ID NO: 834800 - DNA, 25 bp, Mus musculus
tctgggaaatgaccaagcctatgga

SEQ ID NO: 834801 - DNA, 25 bp, Mus musculus
tctgggaaatgagcaagcctatgga

SEQ ID NO: 834802 - DNA, 25 bp, Mus musculus
tctgggaacaggacccaagtcccca

SEQ ID NO: 834803 - DNA, 25 bp, Mus musculus
tctgggaacaggtcccaagtcccca

SEQ ID NO: 834804 - DNA, 25 bp, Mus musculus
tctgggaaccctcccacaggattaa

SEQ ID NO: 834805 - DNA, 25 bp, Mus musculus
tctgggaaccctgccacaggattaa

SEQ ID NO: 834806 - DNA, 25 bp, Mus musculus
tctgggaactggaaggacacctcac

SEQ ID NO: 834807 - DNA, 25 bp, Mus musculus
tctgggaactggtaggacacctcac

SEQ ID NO: 834808 - DNA, 25 bp, Mus musculus
tctgggaagacgcatcctcagctga

SEQ ID NO: 834809 - DNA, 25 bp, Mus musculus
tctgggaagacggatcctcagctga

SEQ ID NO: 834810 - DNA, 25 bp, Mus musculus
tctgggaatcaaagcttgttattgg

SEQ ID NO: 834811 - DNA, 25 bp, Mus musculus
tctgggaatcaatgcttgttattgg

SEQ ID NO: 834812 - DNA, 25 bp, Mus musculus
tctgggaatcggaggcagctgaagc

SEQ ID NO: 834813 - DNA, 25 bp, Mus musculus
tctgggaatcggtggcagctgaagc

SEQ ID NO: 834814 - DNA, 25 bp, Mus musculus
tctgggaatctaagcccgcgccaga

SEQ ID NO: 834815 - DNA, 25 bp, Mus musculus
tctgggaatctatgcccgcgccaga

SEQ ID NO: 834816 - DNA, 25 bp, Mus musculus
tctgggaatcttctcttgccttggc

SEQ ID NO: 834817 - DNA, 25 bp, Mus musculus
tctgggaatcttgtcttgccttggc

SEQ ID NO: 834818 - DNA, 25 bp, Mus musculus
tctgggaattaaatttctccttcta

SEQ ID NO: 834819 - DNA, 25 bp, Mus musculus
tctgggaattaattttctccttcta

SEQ ID NO: 834820 - DNA, 25 bp, Mus musculus
tctgggaattacctgtcactgcctc

SEQ ID NO: 834821 - DNA, 25 bp, Mus musculus
tctgggaattacgtgtcactgcctc

SEQ ID NO: 834822 - DNA, 25 bp, Mus musculus
tctgggacactcaagaggttcccca

SEQ ID NO: 834823 - DNA, 25 bp, Mus musculus
tctgggacactctagaggttcccca

SEQ ID NO: 834824 - DNA, 25 bp, Mus musculus
tctgggacactgacataggcttttt

SEQ ID NO: 834825 - DNA, 25 bp, Mus musculus
tctgggacactgatctctcatcgtg

SEQ ID NO: 834826 - DNA, 25 bp, Mus musculus
tctgggacactgtcataggcttttt

SEQ ID NO: 834827 - DNA, 25 bp, Mus musculus
tctgggacactgttctctcatcgtg

SEQ ID NO: 834828 - DNA, 25 bp, Mus musculus
tctgggaccacaagatgcgcactgg

SEQ ID NO: 834829 - DNA, 25 bp, Mus musculus
tctgggaccacatgatgcgcactgg

SEQ ID NO: 834830 - DNA, 25 bp, Mus musculus
tctgggaccccacaaaatcggttgg

SEQ ID NO: 834831 - DNA, 25 bp, Mus musculus
tctgggaccccagaaaatcggttgg

SEQ ID NO: 834832 - DNA, 25 bp, Mus musculus
tctgggaccgacattgtttctttgt

SEQ ID NO: 834833 - DNA, 25 bp, Mus musculus
tctgggaccgactttgtttctttgt

SEQ ID NO: 834834 - DNA, 25 bp, Mus musculus
tctgggacctttagccttttgtaag

SEQ ID NO: 834835 - DNA, 25 bp, Mus musculus
tctgggaccttttgccttttgtaag

SEQ ID NO: 834836 - DNA, 25 bp, Mus musculus
tctgggacgctcatccagatagcat

SEQ ID NO: 834837 - DNA, 25 bp, Mus musculus
tctgggacgctcttccagatagcat

SEQ ID NO: 834838 - DNA, 25 bp, Mus musculus
tctgggactgatatgctgctgtgca

SEQ ID NO: 834839 - DNA, 25 bp, Mus musculus
tctgggactgatttgctgctgtgca

SEQ ID NO: 834840 - DNA, 25 bp, Mus musculus
tctgggactgtaagctcaggttggc

SEQ ID NO: 834841 - DNA, 25 bp, Mus musculus
tctgggactgtatgctcaggttggc

SEQ ID NO: 834842 - DNA, 25 bp, Mus musculus
tctgggacttgtcattgcttgagca

SEQ ID NO: 834843 - DNA, 25 bp, Mus musculus
tctgggacttgtgattgcttgagca

SEQ ID NO: 834844 - DNA, 25 bp, Mus musculus
tctgggactttcaccagcacagatc

SEQ ID NO: 834845 - DNA, 25 bp, Mus musculus
tctgggactttctccagcacagatc

SEQ ID NO: 834846 - DNA, 25 bp, Mus musculus
tctgggagacatccacctcagcact

SEQ ID NO: 834847 - DNA, 25 bp, Mus musculus
tctgggagacatgcacctcagcact

SEQ ID NO: 834848 - DNA, 25 bp, Mus musculus
tctgggagatccacagtgatgtcac

SEQ ID NO: 834849 - DNA, 25 bp, Mus musculus
tctgggagatcctcagtgatgtcac

SEQ ID NO: 834850 - DNA, 25 bp, Mus musculus
tctgggagatttcttcttgctctgc

SEQ ID NO: 834851 - DNA, 25 bp, Mus musculus
tctgggagatttgttcttgctctgc

SEQ ID NO: 834852 - DNA, 25 bp, Mus musculus
tctgggagcagcaaggccatctgga

SEQ ID NO: 834853 - DNA, 25 bp, Mus musculus
tctgggagcagctaggccatctgga

SEQ ID NO: 834854 - DNA, 25 bp, Mus musculus
tctgggagccctcgtggacgcctac

SEQ ID NO: 834855 - DNA, 25 bp, Mus musculus
tctgggagccctggtggacgcctac

SEQ ID NO: 834856 - DNA, 25 bp, Mus musculus
tctgggagctataagccttctggct

SEQ ID NO: 834857 - DNA, 25 bp, Mus musculus
tctgggagctattagccttctggct

SEQ ID NO: 834858 - DNA, 25 bp, Mus musculus
tctgggaggcttagttccctaactc

SEQ ID NO: 834859 - DNA, 25 bp, Mus musculus
tctgggaggctttgttccctaactc

SEQ ID NO: 834860 - DNA, 25 bp, Mus musculus
tctgggagtccccagaacactacga

SEQ ID NO: 834861 - DNA, 25 bp, Mus musculus
tctgggagtcccgagaacactacga

SEQ ID NO: 834862 - DNA, 25 bp, Mus musculus
tctgggagtttaatactgctttcaa

SEQ ID NO: 834863 - DNA, 25 bp, Mus musculus
tctgggagtttattactgctttcaa

SEQ ID NO: 834864 - DNA, 25 bp, Mus musculus
tctgggatactacagccctggagcc

SEQ ID NO: 834865 - DNA, 25 bp, Mus musculus
tctgggatactagagccctggagcc

SEQ ID NO: 834866 - DNA, 25 bp, Mus musculus
tctgggatcaagatgctgagcctga

SEQ ID NO: 834867 - DNA, 25 bp, Mus musculus
tctgggatcaagttgctgagcctga

SEQ ID NO: 834868 - DNA, 25 bp, Mus musculus
tctgggatccagatgccttgaagat

SEQ ID NO: 834869 - DNA, 25 bp, Mus musculus
tctgggatccagttgccttgaagat

SEQ ID NO: 834870 - DNA, 25 bp, Mus musculus
tctgggatcccaatcactcatagtc

SEQ ID NO: 834871 - DNA, 25 bp, Mus musculus
tctgggatcccattcactcatagtc

SEQ ID NO: 834872 - DNA, 25 bp, Mus musculus
tctgggatccgacgcagccaataca

SEQ ID NO: 834873 - DNA, 25 bp, Mus musculus
tctgggatccgaggcagccaataca

SEQ ID NO: 834874 - DNA, 25 bp, Mus musculus
tctgggatgagcaccttgtgagcag

SEQ ID NO: 834875 - DNA, 25 bp, Mus musculus
tctgggatgagcctaaacaactttt

SEQ ID NO: 834876 - DNA, 25 bp, Mus musculus
tctgggatgagcgtaaacaactttt

SEQ ID NO: 834877 - DNA, 25 bp, Mus musculus
tctgggatgagctccttgtgagcag

SEQ ID NO: 834878 - DNA, 25 bp, Mus musculus
tctgggatggacatgatgggcttct

SEQ ID NO: 834879 - DNA, 25 bp, Mus musculus
tctgggatggacttgatgggcttct

SEQ ID NO: 834880 - DNA, 25 bp, Mus musculus
tctgggatgggacatgctgttcccc

SEQ ID NO: 834881 - DNA, 25 bp, Mus musculus
tctgggatgggagatgctgttcccc

SEQ ID NO: 834882 - DNA, 25 bp, Mus musculus
tctgggatgtatcctcctaccctca

SEQ ID NO: 834883 - DNA, 25 bp, Mus musculus
tctgggatgtatgctcctaccctca

SEQ ID NO: 834884 - DNA, 25 bp, Mus musculus
tctgggatgttgatggtattgctta

SEQ ID NO: 834885 - DNA, 25 bp, Mus musculus
tctgggatgttgttggtattgctta

SEQ ID NO: 834886 - DNA, 25 bp, Mus musculus
tctgggattactctctcagctgtat

SEQ ID NO: 834887 - DNA, 25 bp, Mus musculus
tctgggattactgtctcagctgtat

SEQ ID NO: 834888 - DNA, 25 bp, Mus musculus
tctgggattcacagccatcaagtca

SEQ ID NO: 834889 - DNA, 25 bp, Mus musculus
tctgggattcactgccatcaagtca

SEQ ID NO: 834890 - DNA, 25 bp, Mus musculus
tctgggattcatacaatacattacc

SEQ ID NO: 834891 - DNA, 25 bp, Mus musculus
tctgggattcattcaatacattacc

SEQ ID NO: 834892 - DNA, 25 bp, Mus musculus
tctgggattcccagtgaatatccat

SEQ ID NO: 834893 - DNA, 25 bp, Mus musculus
tctgggattccctgtgaatatccat

SEQ ID NO: 834894 - DNA, 25 bp, Mus musculus
tctgggattcgtcactctcaccctg

SEQ ID NO: 834895 - DNA, 25 bp, Mus musculus
tctgggattcgtgactctcaccctg

SEQ ID NO: 834896 - DNA, 25 bp, Mus musculus
tctgggatttacagagcctctgagc

SEQ ID NO: 834897 - DNA, 25 bp, Mus musculus
tctgggatttactgagcctctgagc

SEQ ID NO: 834898 - DNA, 25 bp, Mus musculus
tctgggcaacagctcagccaagcag

SEQ ID NO: 834899 - DNA, 25 bp, Mus musculus
tctgggcaacaggtcagccaagcag

SEQ ID NO: 834900 - DNA, 25 bp, Mus musculus
tctgggcaatgacgtgaacgatgac

SEQ ID NO: 834901 - DNA, 25 bp, Mus musculus
tctgggcaatgaggtgaacgatgac

SEQ ID NO: 834902 - DNA, 25 bp, Mus musculus
tctgggcacagacggctctgctctc

SEQ ID NO: 834903 - DNA, 25 bp, Mus musculus
tctgggcacagagggctctgctctc

SEQ ID NO: 834904 - DNA, 25 bp, Mus musculus
tctgggcaccagctctgatgcttgc

SEQ ID NO: 834905 - DNA, 25 bp, Mus musculus
tctgggcaccaggtctgatgcttgc

SEQ ID NO: 834906 - DNA, 25 bp, Mus musculus
tctgggcactttcaccactatgctt

SEQ ID NO: 834907 - DNA, 25 bp, Mus musculus
tctgggcactttgaccactatgctt

SEQ ID NO: 834908 - DNA, 25 bp, Mus musculus
tctgggcagatcaagtccgaggtcc

SEQ ID NO: 834909 - DNA, 25 bp, Mus musculus
tctgggcagatctagtccgaggtcc

SEQ ID NO: 834910 - DNA, 25 bp, Mus musculus
tctgggcagcttacctgagatgtgc

SEQ ID NO: 834911 - DNA, 25 bp, Mus musculus
tctgggcagctttcctgagatgtgc

SEQ ID NO: 834912 - DNA, 25 bp, Mus musculus
tctgggcagggcagcaatttctgaa

SEQ ID NO: 834913 - DNA, 25 bp, Mus musculus
tctgggcagggctgcaatttctgaa

SEQ ID NO: 834914 - DNA, 25 bp, Mus musculus
tctgggcatcctcaagctttttgaa

SEQ ID NO: 834915 - DNA, 25 bp, Mus musculus
tctgggcatcctgaagctttttgaa

SEQ ID NO: 834916 - DNA, 25 bp, Mus musculus
tctgggcatcttcagaaccggcatg

SEQ ID NO: 834917 - DNA, 25 bp, Mus musculus
tctgggcatcttgagaaccggcatg

SEQ ID NO: 834918 - DNA, 25 bp, Mus musculus
tctgggcatgaactatatgcagaac

SEQ ID NO: 834919 - DNA, 25 bp, Mus musculus
tctgggcatgaagtatatgcagaac

SEQ ID NO: 834920 - DNA, 25 bp, Mus musculus
tctgggcatggaatccaggatcttg

SEQ ID NO: 834921 - DNA, 25 bp, Mus musculus
tctgggcatggattccaggatcttg

SEQ ID NO: 834922 - DNA, 25 bp, Mus musculus
tctgggcattcacagccatgatggc

SEQ ID NO: 834923 - DNA, 25 bp, Mus musculus
tctgggcattcagagccatgatggc

SEQ ID NO: 834924 - DNA, 25 bp, Mus musculus
tctgggccaaccactgacaacgaag

SEQ ID NO: 834925 - DNA, 25 bp, Mus musculus
tctgggccaacctctgacaacgaag

SEQ ID NO: 834926 - DNA, 25 bp, Mus musculus
tctgggccagcaattgatgcagaga

SEQ ID NO: 834927 - DNA, 25 bp, Mus musculus
tctgggccagcatttgatgcagaga

SEQ ID NO: 834928 - DNA, 25 bp, Mus musculus
tctgggccaggcaagacgtttgtat

SEQ ID NO: 834929 - DNA, 25 bp, Mus musculus
tctgggccaggctagacgtttgtat

SEQ ID NO: 834930 - DNA, 25 bp, Mus musculus
tctgggccagtcaacaccgtgattc

SEQ ID NO: 834931 - DNA, 25 bp, Mus musculus
tctgggccagtctacaccgtgattc

SEQ ID NO: 834932 - DNA, 25 bp, Mus musculus
tctgggcccgcgagtgtaatgtcaa

SEQ ID NO: 834933 - DNA, 25 bp, Mus musculus
tctgggcccgcgtgtgtaatgtcaa

SEQ ID NO: 834934 - DNA, 25 bp, Mus musculus
tctgggcctaatacagaatcaacaa

SEQ ID NO: 834935 - DNA, 25 bp, Mus musculus
tctgggcctaattcagaatcaacaa

SEQ ID NO: 834936 - DNA, 25 bp, Mus musculus
tctgggcctatgaggcacaccttgg

SEQ ID NO: 834937 - DNA, 25 bp, Mus musculus
tctgggcctatgtggcacaccttgg

SEQ ID NO: 834938 - DNA, 25 bp, Mus musculus
tctgggctaacgagagatctcatct

SEQ ID NO: 834939 - DNA, 25 bp, Mus musculus
tctgggctaacgtgagatctcatct

SEQ ID NO: 834940 - DNA, 25 bp, Mus musculus
tctgggctaccactatgaccctgaa

SEQ ID NO: 834941 - DNA, 25 bp, Mus musculus
tctgggctaccagtatgaccctgaa

SEQ ID NO: 834942 - DNA, 25 bp, Mus musculus
tctgggctccagcatgacagcatct

SEQ ID NO: 834943 - DNA, 25 bp, Mus musculus
tctgggctccaggatgacagcatct

SEQ ID NO: 834944 - DNA, 25 bp, Mus musculus
tctgggctccctagcaaacctctgt

SEQ ID NO: 834945 - DNA, 25 bp, Mus musculus
tctgggctcccttgcaaacctctgt

SEQ ID NO: 834946 - DNA, 25 bp, Mus musculus
tctgggctcgggattgaacttaaca

SEQ ID NO: 834947 - DNA, 25 bp, Mus musculus
tctgggctcgggtttgaacttaaca

SEQ ID NO: 834948 - DNA, 25 bp, Mus musculus
tctgggctctcaatacctgtatggc

SEQ ID NO: 834949 - DNA, 25 bp, Mus musculus
tctgggctctcattacctgtatggc

SEQ ID NO: 834950 - DNA, 25 bp, Mus musculus
tctgggctctgaagacgtcgtgtga

SEQ ID NO: 834951 - DNA, 25 bp, Mus musculus
tctgggctctgatgacgtcgtgtga

SEQ ID NO: 834952 - DNA, 25 bp, Mus musculus
tctgggctcttcacagtccttggac

SEQ ID NO: 834953 - DNA, 25 bp, Mus musculus
tctgggctcttctcagtccttggac

SEQ ID NO: 834954 - DNA, 25 bp, Mus musculus
tctgggctgacaactgacaacatta

SEQ ID NO: 834955 - DNA, 25 bp, Mus musculus
tctgggctgacatctgacaacatta

SEQ ID NO: 834956 - DNA, 25 bp, Mus musculus
tctgggctgaggatcagcgtttctc

SEQ ID NO: 834957 - DNA, 25 bp, Mus musculus
tctgggctgaggttcagcgtttctc

SEQ ID NO: 834958 - DNA, 25 bp, Mus musculus
tctgggctgcttcggataactgcat

SEQ ID NO: 834959 - DNA, 25 bp, Mus musculus
tctgggctgcttgggataactgcat

SEQ ID NO: 834960 - DNA, 25 bp, Mus musculus
tctgggctgggcagtaactcactct

SEQ ID NO: 834961 - DNA, 25 bp, Mus musculus
tctgggctgggctgtaactcactct

SEQ ID NO: 834962 - DNA, 25 bp, Mus musculus
tctgggctgtgccagagatcataca

SEQ ID NO: 834963 - DNA, 25 bp, Mus musculus
tctgggctgtgcgagagatcataca

SEQ ID NO: 834964 - DNA, 25 bp, Mus musculus
tctgggctgtgtatagtggcatgtc

SEQ ID NO: 834965 - DNA, 25 bp, Mus musculus
tctgggctgtgtttagtggcatgtc

SEQ ID NO: 834966 - DNA, 25 bp, Mus musculus
tctgggcttactaatgcattccttc

SEQ ID NO: 834967 - DNA, 25 bp, Mus musculus
tctgggcttacttatgcattccttc

SEQ ID NO: 834968 - DNA, 25 bp, Mus musculus
tctgggcttatgacctaggctctgg

SEQ ID NO: 834969 - DNA, 25 bp, Mus musculus
tctgggcttatgtcctaggctctgg

SEQ ID NO: 834970 - DNA, 25 bp, Mus musculus
tctgggcttcacactcatgtacaca

SEQ ID NO: 834971 - DNA, 25 bp, Mus musculus
tctgggcttcactctcatgtacaca

SEQ ID NO: 834972 - DNA, 25 bp, Mus musculus
tctgggcttgatctttgcactgact

SEQ ID NO: 834973 - DNA, 25 bp, Mus musculus
tctgggcttgatgtttgcactgact

SEQ ID NO: 834974 - DNA, 25 bp, Mus musculus
tctgggcttgtgcagtaggtctcta

SEQ ID NO: 834975 - DNA, 25 bp, Mus musculus
tctgggcttgtggagtaggtctcta

SEQ ID NO: 834976 - DNA, 25 bp, Mus musculus
tctgggcttgttactgctgttcccc

SEQ ID NO: 834977 - DNA, 25 bp, Mus musculus
tctgggcttgtttctgctgttcccc

SEQ ID NO: 834978 - DNA, 25 bp, Mus musculus
tctgggctttcacatctgctttgag

SEQ ID NO: 834979 - DNA, 25 bp, Mus musculus
tctgggctttcagatctgctttgag

SEQ ID NO: 834980 - DNA, 25 bp, Mus musculus
tctgggggtcctcttgcagctgcaa

SEQ ID NO: 834981 - DNA, 25 bp, Mus musculus
tctgggggtcctgttgcagctgcaa

SEQ ID NO: 834982 - DNA, 25 bp, Mus musculus
tctggggtacacatcccaaatccaa

SEQ ID NO: 834983 - DNA, 25 bp, Mus musculus
tctggggtacacttcccaaatccaa

SEQ ID NO: 834984 - DNA, 25 bp, Mus musculus
tctggggtttttactctgttacctg

SEQ ID NO: 834985 - DNA, 25 bp, Mus musculus
tctggggttttttctctgttacctg

SEQ ID NO: 834986 - DNA, 25 bp, Mus musculus
tctgggtaactcatggcactgtggc

SEQ ID NO: 834987 - DNA, 25 bp, Mus musculus
tctgggtaactcttggcactgtggc

SEQ ID NO: 834988 - DNA, 25 bp, Mus musculus
tctgggtaagatattagtggactgt

SEQ ID NO: 834989 - DNA, 25 bp, Mus musculus
tctgggtaagattttagtggactgt

SEQ ID NO: 834990 - DNA, 25 bp, Mus musculus
tctgggtagcacatgaagaggagcc

SEQ ID NO: 834991 - DNA, 25 bp, Mus musculus
tctgggtagcacttgaagaggagcc

SEQ ID NO: 834992 - DNA, 25 bp, Mus musculus
tctgggtagctgctccttcattggc

SEQ ID NO: 834993 - DNA, 25 bp, Mus musculus
tctgggtagctggtccttcattggc

SEQ ID NO: 834994 - DNA, 25 bp, Mus musculus
tctgggtataacatagagcttagga

SEQ ID NO: 834995 - DNA, 25 bp, Mus musculus
tctgggtataacttagagcttagga

SEQ ID NO: 834996 - DNA, 25 bp, Mus musculus
tctgggtcaaacatgcttctcctct

SEQ ID NO: 834997 - DNA, 25 bp, Mus musculus
tctgggtcaaacttgcttctcctct

SEQ ID NO: 834998 - DNA, 25 bp, Mus musculus
tctgggtcaagaaaataatcatgtt

SEQ ID NO: 834999 - DNA, 25 bp, Mus musculus
tctgggtcaagataataatcatgtt

SEQ ID NO: 835000 - DNA, 25 bp, Mus musculus
tctgggtcacagcttgtttgctcag

SEQ ID NO: 835001 - DNA, 25 bp, Mus musculus
tctgggtcacaggttgtttgctcag

SEQ ID NO: 835002 - DNA, 25 bp, Mus musculus
tctgggtcatacacctgatctggaa

SEQ ID NO: 835003 - DNA, 25 bp, Mus musculus
tctgggtcatactcctgatctggaa

SEQ ID NO: 835004 - DNA, 25 bp, Mus musculus
tctgggtccaacacgtgaaatctca

SEQ ID NO: 835005 - DNA, 25 bp, Mus musculus
tctgggtccaactcgtgaaatctca

SEQ ID NO: 835006 - DNA, 25 bp, Mus musculus
tctgggtcccagcaacacagtcatg

SEQ ID NO: 835007 - DNA, 25 bp, Mus musculus
tctgggtcccaggaacacagtcatg

SEQ ID NO: 835008 - DNA, 25 bp, Mus musculus
tctgggtccgtcacgtagcaaatga

SEQ ID NO: 835009 - DNA, 25 bp, Mus musculus
tctgggtccgtctcgtagcaaatga

SEQ ID NO: 835010 - DNA, 25 bp, Mus musculus
tctgggtcctatagagcgactacca

SEQ ID NO: 835011 - DNA, 25 bp, Mus musculus
tctgggtcctattgagcgactacca

SEQ ID NO: 835012 - DNA, 25 bp, Mus musculus
tctgggtctaacattgcacatccta

SEQ ID NO: 835013 - DNA, 25 bp, Mus musculus
tctgggtctaactttgcacatccta

SEQ ID NO: 835014 - DNA, 25 bp, Mus musculus
tctgggtctcacacggcctttgttt

SEQ ID NO: 835015 - DNA, 25 bp, Mus musculus
tctgggtctcactcggcctttgttt

SEQ ID NO: 835016 - DNA, 25 bp, Mus musculus
tctgggtctgaacccattctggtca

SEQ ID NO: 835017 - DNA, 25 bp, Mus musculus
tctgggtctgaagccattctggtca

SEQ ID NO: 835018 - DNA, 25 bp, Mus musculus
tctgggtctgagctgcttagagtca

SEQ ID NO: 835019 - DNA, 25 bp, Mus musculus
tctgggtctgaggtgcttagagtca

SEQ ID NO: 835020 - DNA, 25 bp, Mus musculus
tctgggtctgctaccctttgatttt

SEQ ID NO: 835021 - DNA, 25 bp, Mus musculus
tctgggtctgcttccctttgatttt

SEQ ID NO: 835022 - DNA, 25 bp, Mus musculus
tctgggtctgtcaccgaagaaagtt

SEQ ID NO: 835023 - DNA, 25 bp, Mus musculus
tctgggtctgtctccgaagaaagtt

SEQ ID NO: 835024 - DNA, 25 bp, Mus musculus
tctgggtctgttactgagtccttta

SEQ ID NO: 835025 - DNA, 25 bp, Mus musculus
tctgggtctgtttctgagtccttta

SEQ ID NO: 835026 - DNA, 25 bp, Mus musculus
tctgggtgacgcatgcctctggtct

SEQ ID NO: 835027 - DNA, 25 bp, Mus musculus
tctgggtgacgcttgcctctggtct

SEQ ID NO: 835028 - DNA, 25 bp, Mus musculus
tctgggtgcagacccatctgcaaat

SEQ ID NO: 835029 - DNA, 25 bp, Mus musculus
tctgggtgcagagccatctgcaaat

SEQ ID NO: 835030 - DNA, 25 bp, Mus musculus
tctgggtgcagtctctgccagtatc

SEQ ID NO: 835031 - DNA, 25 bp, Mus musculus
tctgggtgcagtgtctgccagtatc

SEQ ID NO: 835032 - DNA, 25 bp, Mus musculus
tctgggtggatacactggaccgcat

SEQ ID NO: 835033 - DNA, 25 bp, Mus musculus
tctgggtggatagactggaccgcat

SEQ ID NO: 835034 - DNA, 25 bp, Mus musculus
tctgggtggcacaaagtacatctct

SEQ ID NO: 835035 - DNA, 25 bp, Mus musculus
tctgggtggcactaagtacatctct

SEQ ID NO: 835036 - DNA, 25 bp, Mus musculus
tctgggtggccaactcttagggagc

SEQ ID NO: 835037 - DNA, 25 bp, Mus musculus
tctgggtggccatctcttagggagc

SEQ ID NO: 835038 - DNA, 25 bp, Mus musculus
tctgggtggcccagttttaacaagg

SEQ ID NO: 835039 - DNA, 25 bp, Mus musculus
tctgggtggccctgttttaacaagg

SEQ ID NO: 835040 - DNA, 25 bp, Mus musculus
tctgggtggcctcggaaatgtccct

SEQ ID NO: 835041 - DNA, 25 bp, Mus musculus
tctgggtggcctgggaaatgtccct

SEQ ID NO: 835042 - DNA, 25 bp, Mus musculus
tctgggtgtctgactggtcagcctc

SEQ ID NO: 835043 - DNA, 25 bp, Mus musculus
tctgggtgtctgtctggtcagcctc

SEQ ID NO: 835044 - DNA, 25 bp, Mus musculus
tctgggtgttgaagacgctgctgaa

SEQ ID NO: 835045 - DNA, 25 bp, Mus musculus
tctgggtgttgatgacgctgctgaa

SEQ ID NO: 835046 - DNA, 25 bp, Mus musculus
tctgggttaggcagtagaaatatca

SEQ ID NO: 835047 - DNA, 25 bp, Mus musculus
tctgggttaggctgtagaaatatca

SEQ ID NO: 835048 - DNA, 25 bp, Mus musculus
tctgggttcaaacgtcagtactacc

SEQ ID NO: 835049 - DNA, 25 bp, Mus musculus
tctgggttcaaaggtcagtactacc

SEQ ID NO: 835050 - DNA, 25 bp, Mus musculus
tctgggttcaataccaactactcta

SEQ ID NO: 835051 - DNA, 25 bp, Mus musculus
tctgggttcaattccaactactcta

SEQ ID NO: 835052 - DNA, 25 bp, Mus musculus
tctgggttcacactccgtggaaatg

SEQ ID NO: 835053 - DNA, 25 bp, Mus musculus
tctgggttcacagtccgtggaaatg

SEQ ID NO: 835054 - DNA, 25 bp, Mus musculus
tctgggttcactcacttggctgaga

SEQ ID NO: 835055 - DNA, 25 bp, Mus musculus
tctgggttcactgacttggctgaga

SEQ ID NO: 835056 - DNA, 25 bp, Mus musculus
tctgggttcctaattttggtggtgt

SEQ ID NO: 835057 - DNA, 25 bp, Mus musculus
tctgggttcctatttttggtggtgt

SEQ ID NO: 835058 - DNA, 25 bp, Mus musculus
tctgggttctacatgaggctggccc

SEQ ID NO: 835059 - DNA, 25 bp, Mus musculus
tctgggttctacttgaggctggccc

SEQ ID NO: 835060 - DNA, 25 bp, Mus musculus
tctgggttctccaaagcccaaggtg

SEQ ID NO: 835061 - DNA, 25 bp, Mus musculus
tctgggttctcctaagcccaaggtg

SEQ ID NO: 835062 - DNA, 25 bp, Mus musculus
tctgggttgtaaagaccacctcaat

SEQ ID NO: 835063 - DNA, 25 bp, Mus musculus
tctgggttgtaatgaccacctcaat

SEQ ID NO: 835064 - DNA, 25 bp, Mus musculus
tctgggtttcagcatggccttctaa

SEQ ID NO: 835065 - DNA, 25 bp, Mus musculus
tctgggtttcaggatggccttctaa

SEQ ID NO: 835066 - DNA, 25 bp, Mus musculus
tctgggtttcatacttatctgctac

SEQ ID NO: 835067 - DNA, 25 bp, Mus musculus
tctgggtttcattcttatctgctac

SEQ ID NO: 835068 - DNA, 25 bp, Mus musculus
tctgggtttccgctcaactgaaaac

SEQ ID NO: 835069 - DNA, 25 bp, Mus musculus
tctgggtttccggtcaactgaaaac

SEQ ID NO: 835070 - DNA, 25 bp, Mus musculus
tctgggtttgagagctagcactgca

SEQ ID NO: 835071 - DNA, 25 bp, Mus musculus
tctgggtttgagtgctagcactgca

SEQ ID NO: 835072 - DNA, 25 bp, Mus musculus
tctgggttttacagtctaatttttg

SEQ ID NO: 835073 - DNA, 25 bp, Mus musculus
tctgggttttactgtctaatttttg

SEQ ID NO: 835074 - DNA, 25 bp, Mus musculus
tctgggttttctaagttactagccg

SEQ ID NO: 835075 - DNA, 25 bp, Mus musculus
tctgggttttcttagttactagccg

SEQ ID NO: 835076 - DNA, 25 bp, Mus musculus
tctgggtttttcaactcttgccaaa

SEQ ID NO: 835077 - DNA, 25 bp, Mus musculus
tctgggtttttctactcttgccaaa

SEQ ID NO: 835078 - DNA, 25 bp, Mus musculus
tctggtaagtaactgttcaccacag

SEQ ID NO: 835079 - DNA, 25 bp, Mus musculus
tctggtaagtaagtgttcaccacag

SEQ ID NO: 835080 - DNA, 25 bp, Mus musculus
tctggtacaaccatcttcgcagtgg

SEQ ID NO: 835081 - DNA, 25 bp, Mus musculus
tctggtacaaccttcttcgcagtgg

SEQ ID NO: 835082 - DNA, 25 bp, Mus musculus
tctggtacacacatcttggcatgga

SEQ ID NO: 835083 - DNA, 25 bp, Mus musculus
tctggtacacacttcttggcatgga

SEQ ID NO: 835084 - DNA, 25 bp, Mus musculus
tctggtacacgcataaagttttacg

SEQ ID NO: 835085 - DNA, 25 bp, Mus musculus
tctggtacacgcttaaagttttacg

SEQ ID NO: 835086 - DNA, 25 bp, Mus musculus
tctggtaccaagaattgagcactat

SEQ ID NO: 835087 - DNA, 25 bp, Mus musculus
tctggtaccaagtattgagcactat

SEQ ID NO: 835088 - DNA, 25 bp, Mus musculus
tctggtaccctgagcttgtgtttgt

SEQ ID NO: 835089 - DNA, 25 bp, Mus musculus
tctggtaccctgtgcttgtgtttgt

SEQ ID NO: 835090 - DNA, 25 bp, Mus musculus
tctggtaccgaactcttgagcctcc

SEQ ID NO: 835091 - DNA, 25 bp, Mus musculus
tctggtaccgaagtcttgagcctcc

SEQ ID NO: 835092 - DNA, 25 bp, Mus musculus
tctggtacctatcttctgagatccc

SEQ ID NO: 835093 - DNA, 25 bp, Mus musculus
tctggtacctatgttctgagatccc

SEQ ID NO: 835094 - DNA, 25 bp, Mus musculus
tctggtacctttcggccgcgtcgga

SEQ ID NO: 835095 - DNA, 25 bp, Mus musculus
tctggtacctttgggccgcgtcgga

SEQ ID NO: 835096 - DNA, 25 bp, Mus musculus
tctggtactcatcagcttgtcactg

SEQ ID NO: 835097 - DNA, 25 bp, Mus musculus
tctggtactcatgagcttgtcactg

SEQ ID NO: 835098 - DNA, 25 bp, Mus musculus
tctggtacttttacaaacttcctag

SEQ ID NO: 835099 - DNA, 25 bp, Mus musculus
tctggtacttttacactgtatgctg

SEQ ID NO: 835100 - DNA, 25 bp, Mus musculus
tctggtactttttcaaacttcctag

SEQ ID NO: 835101 - DNA, 25 bp, Mus musculus
tctggtactttttcactgtatgctg

SEQ ID NO: 835102 - DNA, 25 bp, Mus musculus
tctggtaggagacacgattctgtta

SEQ ID NO: 835103 - DNA, 25 bp, Mus musculus
tctggtaggagagacgattctgtta

SEQ ID NO: 835104 - DNA, 25 bp, Mus musculus
tctggtagggatccactttctcttt

SEQ ID NO: 835105 - DNA, 25 bp, Mus musculus
tctggtagggatgcactttctcttt

SEQ ID NO: 835106 - DNA, 25 bp, Mus musculus
tctggtagggtacccaaagttactt

SEQ ID NO: 835107 - DNA, 25 bp, Mus musculus
tctggtagggtagccaaagttactt

SEQ ID NO: 835108 - DNA, 25 bp, Mus musculus
tctggtagtctgcttatctcatatg

SEQ ID NO: 835109 - DNA, 25 bp, Mus musculus
tctggtagtctggttatctcatatg

SEQ ID NO: 835110 - DNA, 25 bp, Mus musculus
tctggtagtgctccctgggatgaca

SEQ ID NO: 835111 - DNA, 25 bp, Mus musculus
tctggtagtgctgcctgggatgaca

SEQ ID NO: 835112 - DNA, 25 bp, Mus musculus
tctggtagtggcatggcccctttgg

SEQ ID NO: 835113 - DNA, 25 bp, Mus musculus
tctggtagtggcttggcccctttgg

SEQ ID NO: 835114 - DNA, 25 bp, Mus musculus
tctggtatacccatagccatgctgg

SEQ ID NO: 835115 - DNA, 25 bp, Mus musculus
tctggtatacccttagccatgctgg

SEQ ID NO: 835116 - DNA, 25 bp, Mus musculus
tctggtatagtgaatcagtgttcta

SEQ ID NO: 835117 - DNA, 25 bp, Mus musculus
tctggtatagtgtatcagtgttcta

SEQ ID NO: 835118 - DNA, 25 bp, Mus musculus
tctggtatgtgcactatgctctata

SEQ ID NO: 835119 - DNA, 25 bp, Mus musculus
tctggtatgtgctctatgctctata

SEQ ID NO: 835120 - DNA, 25 bp, Mus musculus
tctggtattgggacgcttggtttcc

SEQ ID NO: 835121 - DNA, 25 bp, Mus musculus
tctggtattgggtcgcttggtttcc

SEQ ID NO: 835122 - DNA, 25 bp, Mus musculus
tctggtcaccagaaacatcttctga

SEQ ID NO: 835123 - DNA, 25 bp, Mus musculus
tctggtcaccagtaacatcttctga

SEQ ID NO: 835124 - DNA, 25 bp, Mus musculus
tctggtcacctactacacatgtgtt

SEQ ID NO: 835125 - DNA, 25 bp, Mus musculus
tctggtcacctagtacacatgtgtt

SEQ ID NO: 835126 - DNA, 25 bp, Mus musculus
tctggtcactctctcactaaccggg

SEQ ID NO: 835127 - DNA, 25 bp, Mus musculus
tctggtcactctgtcactaaccggg

SEQ ID NO: 835128 - DNA, 25 bp, Mus musculus
tctggtcagaaaccttttgatctct

SEQ ID NO: 835129 - DNA, 25 bp, Mus musculus
tctggtcagaaagcttttgatctct

SEQ ID NO: 835130 - DNA, 25 bp, Mus musculus
tctggtcagaggcattctatgggta

SEQ ID NO: 835131 - DNA, 25 bp, Mus musculus
tctggtcagagggattctatgggta

SEQ ID NO: 835132 - DNA, 25 bp, Mus musculus
tctggtcagcagctgggttgtacat

SEQ ID NO: 835133 - DNA, 25 bp, Mus musculus
tctggtcagcaggtgggttgtacat

SEQ ID NO: 835134 - DNA, 25 bp, Mus musculus
tctggtcagtagaggaattcgattt

SEQ ID NO: 835135 - DNA, 25 bp, Mus musculus
tctggtcagtagtggaattcgattt

SEQ ID NO: 835136 - DNA, 25 bp, Mus musculus
tctggtcagtgccaagtcggccaga

SEQ ID NO: 835137 - DNA, 25 bp, Mus musculus
tctggtcagtgcgaagtcggccaga

SEQ ID NO: 835138 - DNA, 25 bp, Mus musculus
tctggtccacctagtgagttcctga

SEQ ID NO: 835139 - DNA, 25 bp, Mus musculus
tctggtccaccttgtgagttcctga

SEQ ID NO: 835140 - DNA, 25 bp, Mus musculus
tctggtccatggatgctgtaatcta

SEQ ID NO: 835141 - DNA, 25 bp, Mus musculus
tctggtccatggttgctgtaatcta

SEQ ID NO: 835142 - DNA, 25 bp, Mus musculus
tctggtcccaagaggaaggtggcct

SEQ ID NO: 835143 - DNA, 25 bp, Mus musculus
tctggtcccaagtggaaggtggcct

SEQ ID NO: 835144 - DNA, 25 bp, Mus musculus
tctggtcccaccaataggaatgttg

SEQ ID NO: 835145 - DNA, 25 bp, Mus musculus
tctggtcccacctataggaatgttg

SEQ ID NO: 835146 - DNA, 25 bp, Mus musculus
tctggtcccagaagtcatggctgca

SEQ ID NO: 835147 - DNA, 25 bp, Mus musculus
tctggtcccagatgtcatggctgca

SEQ ID NO: 835148 - DNA, 25 bp, Mus musculus
tctggtcccgcaaaacttgaatgaa

SEQ ID NO: 835149 - DNA, 25 bp, Mus musculus
tctggtcccgcataacttgaatgaa

SEQ ID NO: 835150 - DNA, 25 bp, Mus musculus
tctggtccctatatgtggttattgg

SEQ ID NO: 835151 - DNA, 25 bp, Mus musculus
tctggtccctatttgtggttattgg

SEQ ID NO: 835152 - DNA, 25 bp, Mus musculus
tctggtccctgtctctgatgacagg

SEQ ID NO: 835153 - DNA, 25 bp, Mus musculus
tctggtccctgtgtctgatgacagg

SEQ ID NO: 835154 - DNA, 25 bp, Mus musculus
tctggtccggtcagtgtgaaaacct

SEQ ID NO: 835155 - DNA, 25 bp, Mus musculus
tctggtccggtctgtgtgaaaacct

SEQ ID NO: 835156 - DNA, 25 bp, Mus musculus
tctggtcctaacacactcttggaaa

SEQ ID NO: 835157 - DNA, 25 bp, Mus musculus
tctggtcctaactcactcttggaaa

SEQ ID NO: 835158 - DNA, 25 bp, Mus musculus
tctggtcctctaacttgctgcctgc

SEQ ID NO: 835159 - DNA, 25 bp, Mus musculus
tctggtcctctatcttgctgcctgc

SEQ ID NO: 835160 - DNA, 25 bp, Mus musculus
tctggtcctgagcacagtcagtgtg

SEQ ID NO: 835161 - DNA, 25 bp, Mus musculus
tctggtcctgaggacagtcagtgtg

SEQ ID NO: 835162 - DNA, 25 bp, Mus musculus
tctggtcctggaaagttcttacatg

SEQ ID NO: 835163 - DNA, 25 bp, Mus musculus
tctggtcctggatagttcttacatg

SEQ ID NO: 835164 - DNA, 25 bp, Mus musculus
tctggtcgacagaactgggaagtca

SEQ ID NO: 835165 - DNA, 25 bp, Mus musculus
tctggtcgacagtactgggaagtca

SEQ ID NO: 835166 - DNA, 25 bp, Mus musculus
tctggtcgcccaaaagtacttgcct

SEQ ID NO: 835167 - DNA, 25 bp, Mus musculus
tctggtcgcccataagtacttgcct

SEQ ID NO: 835168 - DNA, 25 bp, Mus musculus
tctggtcgctccattacttgctttg

SEQ ID NO: 835169 - DNA, 25 bp, Mus musculus
tctggtcgctcctttacttgctttg

SEQ ID NO: 835170 - DNA, 25 bp, Mus musculus
tctggtctaagaagagggcctccga

SEQ ID NO: 835171 - DNA, 25 bp, Mus musculus
tctggtctaagatgagggcctccga

SEQ ID NO: 835172 - DNA, 25 bp, Mus musculus
tctggtctaagtcgagtgtgtgcat

SEQ ID NO: 835173 - DNA, 25 bp, Mus musculus
tctggtctaagtggagtgtgtgcat

SEQ ID NO: 835174 - DNA, 25 bp, Mus musculus
tctggtctatacatattcctcccaa

SEQ ID NO: 835175 - DNA, 25 bp, Mus musculus
tctggtctatacttattcctcccaa

SEQ ID NO: 835176 - DNA, 25 bp, Mus musculus
tctggtctcaaaaccaccgtcggaa

SEQ ID NO: 835177 - DNA, 25 bp, Mus musculus
tctggtctcaaatccaccgtcggaa

SEQ ID NO: 835178 - DNA, 25 bp, Mus musculus
tctggtctcaaccaccctgtaaaaa

SEQ ID NO: 835179 - DNA, 25 bp, Mus musculus
tctggtctcaacgaccctgtaaaaa

SEQ ID NO: 835180 - DNA, 25 bp, Mus musculus
tctggtctcaataacaggttagatc

SEQ ID NO: 835181 - DNA, 25 bp, Mus musculus
tctggtctcaatacccgtctcaagg

SEQ ID NO: 835182 - DNA, 25 bp, Mus musculus
tctggtctcaattacaggttagatc

SEQ ID NO: 835183 - DNA, 25 bp, Mus musculus
tctggtctcaattcccgtctcaagg

SEQ ID NO: 835184 - DNA, 25 bp, Mus musculus
tctggtctcgttctgactagactgt

SEQ ID NO: 835185 - DNA, 25 bp, Mus musculus
tctggtctcgttgtgactagactgt

SEQ ID NO: 835186 - DNA, 25 bp, Mus musculus
tctggtctctacaagcaggcacaaa

SEQ ID NO: 835187 - DNA, 25 bp, Mus musculus
tctggtctctactagcaggcacaaa

SEQ ID NO: 835188 - DNA, 25 bp, Mus musculus
tctggtctctgtagagttcccgagg

SEQ ID NO: 835189 - DNA, 25 bp, Mus musculus
tctggtctctgtccatgcatgaaaa

SEQ ID NO: 835190 - DNA, 25 bp, Mus musculus
tctggtctctgtgcatgcatgaaaa

SEQ ID NO: 835191 - DNA, 25 bp, Mus musculus
tctggtctctgttgagttcccgagg

SEQ ID NO: 835192 - DNA, 25 bp, Mus musculus
tctggtctctttcgtacctagaaca

SEQ ID NO: 835193 - DNA, 25 bp, Mus musculus
tctggtctctttggtacctagaaca

SEQ ID NO: 835194 - DNA, 25 bp, Mus musculus
tctggtctgactactggaagcccca

SEQ ID NO: 835195 - DNA, 25 bp, Mus musculus
tctggtctgacttctggaagcccca

SEQ ID NO: 835196 - DNA, 25 bp, Mus musculus
tctggtctgagaaccttatgactgg

SEQ ID NO: 835197 - DNA, 25 bp, Mus musculus
tctggtctgagatccttatgactgg

SEQ ID NO: 835198 - DNA, 25 bp, Mus musculus
tctggtctgagcctattggaaacag

SEQ ID NO: 835199 - DNA, 25 bp, Mus musculus
tctggtctgagcgtattggaaacag

SEQ ID NO: 835200 - DNA, 25 bp, Mus musculus
tctggtctggctcagcactgccttt

SEQ ID NO: 835201 - DNA, 25 bp, Mus musculus
tctggtctggctgagcactgccttt

SEQ ID NO: 835202 - DNA, 25 bp, Mus musculus
tctggtctgggtatcacttatttta

SEQ ID NO: 835203 - DNA, 25 bp, Mus musculus
tctggtctgggtttcacttatttta

SEQ ID NO: 835204 - DNA, 25 bp, Mus musculus
tctggtctgtctacagcacgatgta

SEQ ID NO: 835205 - DNA, 25 bp, Mus musculus
tctggtctgtcttcagcacgatgta

SEQ ID NO: 835206 - DNA, 25 bp, Mus musculus
tctggtctgtgaatgtctggaaatg

SEQ ID NO: 835207 - DNA, 25 bp, Mus musculus
tctggtctgtgattgtctggaaatg

SEQ ID NO: 835208 - DNA, 25 bp, Mus musculus
tctggtcttcacacctgagtggtaa

SEQ ID NO: 835209 - DNA, 25 bp, Mus musculus
tctggtcttcacaggcaccatgcat

SEQ ID NO: 835210 - DNA, 25 bp, Mus musculus
tctggtcttcactcctgagtggtaa

SEQ ID NO: 835211 - DNA, 25 bp, Mus musculus
tctggtcttcactggcaccatgcat

SEQ ID NO: 835212 - DNA, 25 bp, Mus musculus
tctggtcttgctcttctgtggattc

SEQ ID NO: 835213 - DNA, 25 bp, Mus musculus
tctggtcttgctgttctgtggattc

SEQ ID NO: 835214 - DNA, 25 bp, Mus musculus
tctggtcttttcatcctctgcagaa

SEQ ID NO: 835215 - DNA, 25 bp, Mus musculus
tctggtcttttcttcctctgcagaa

SEQ ID NO: 835216 - DNA, 25 bp, Mus musculus
tctggtgaacagatcgagccgtcat

SEQ ID NO: 835217 - DNA, 25 bp, Mus musculus
tctggtgaacagttcgagccgtcat

SEQ ID NO: 835218 - DNA, 25 bp, Mus musculus
tctggtgaagcccaagatcgtcaaa

SEQ ID NO: 835219 - DNA, 25 bp, Mus musculus
tctggtgaagccgaagatcgtcaaa

SEQ ID NO: 835220 - DNA, 25 bp, Mus musculus
tctggtgacaacacactctgaagtt

SEQ ID NO: 835221 - DNA, 25 bp, Mus musculus
tctggtgacaactcactctgaagtt

SEQ ID NO: 835222 - DNA, 25 bp, Mus musculus
tctggtgagaacagagaatcggact

SEQ ID NO: 835223 - DNA, 25 bp, Mus musculus
tctggtgagaactgagaatcggact

SEQ ID NO: 835224 - DNA, 25 bp, Mus musculus
tctggtgagctccttcctttttaac

SEQ ID NO: 835225 - DNA, 25 bp, Mus musculus
tctggtgagctcgttcctttttaac

SEQ ID NO: 835226 - DNA, 25 bp, Mus musculus
tctggtgagtacagctttataattt

SEQ ID NO: 835227 - DNA, 25 bp, Mus musculus
tctggtgagtactgctttataattt

SEQ ID NO: 835228 - DNA, 25 bp, Mus musculus
tctggtgatgaaaagcgctgcctct

SEQ ID NO: 835229 - DNA, 25 bp, Mus musculus
tctggtgatgaatagcgctgcctct

SEQ ID NO: 835230 - DNA, 25 bp, Mus musculus
tctggtgatgagacttagccctgaa

SEQ ID NO: 835231 - DNA, 25 bp, Mus musculus
tctggtgatgagtcttagccctgaa

SEQ ID NO: 835232 - DNA, 25 bp, Mus musculus
tctggtgatttaatgtctcccgcta

SEQ ID NO: 835233 - DNA, 25 bp, Mus musculus
tctggtgatttattgtctcccgcta

SEQ ID NO: 835234 - DNA, 25 bp, Mus musculus
tctggtgcacacatactggatgtca

SEQ ID NO: 835235 - DNA, 25 bp, Mus musculus
tctggtgcacacctagagtccaagg

SEQ ID NO: 835236 - DNA, 25 bp, Mus musculus
tctggtgcacacgtagagtccaagg

SEQ ID NO: 835237 - DNA, 25 bp, Mus musculus
tctggtgcacacttactggatgtca

SEQ ID NO: 835238 - DNA, 25 bp, Mus musculus
tctggtgccaaaagaaaattcttag

SEQ ID NO: 835239 - DNA, 25 bp, Mus musculus
tctggtgccaaatgaaaattcttag

SEQ ID NO: 835240 - DNA, 25 bp, Mus musculus
tctggtgccaggagaaccacggtgt

SEQ ID NO: 835241 - DNA, 25 bp, Mus musculus
tctggtgccaggtgaaccacggtgt

SEQ ID NO: 835242 - DNA, 25 bp, Mus musculus
tctggtgcccagatgactatcatga

SEQ ID NO: 835243 - DNA, 25 bp, Mus musculus
tctggtgcccagttgactatcatga

SEQ ID NO: 835244 - DNA, 25 bp, Mus musculus
tctggtgccgtgcattaaccgtgat

SEQ ID NO: 835245 - DNA, 25 bp, Mus musculus
tctggtgccgtggattaaccgtgat

SEQ ID NO: 835246 - DNA, 25 bp, Mus musculus
tctggtgcctctcgagtcaagggat

SEQ ID NO: 835247 - DNA, 25 bp, Mus musculus
tctggtgcctctggagtcaagggat

SEQ ID NO: 835248 - DNA, 25 bp, Mus musculus
tctggtgcctgaaattgctccggac

SEQ ID NO: 835249 - DNA, 25 bp, Mus musculus
tctggtgcctgatattgctccggac

SEQ ID NO: 835250 - DNA, 25 bp, Mus musculus
tctggtgcgaacaatgagcctgcat

SEQ ID NO: 835251 - DNA, 25 bp, Mus musculus
tctggtgcgaactatgagcctgcat

SEQ ID NO: 835252 - DNA, 25 bp, Mus musculus
tctggtgctctactcagcgcctgct

SEQ ID NO: 835253 - DNA, 25 bp, Mus musculus
tctggtgctctagtcagcgcctgct

SEQ ID NO: 835254 - DNA, 25 bp, Mus musculus
tctggtgctggacactggacactgt

SEQ ID NO: 835255 - DNA, 25 bp, Mus musculus
tctggtgctggagactggacactgt

SEQ ID NO: 835256 - DNA, 25 bp, Mus musculus
tctggtgcttcccatttggatagtg

SEQ ID NO: 835257 - DNA, 25 bp, Mus musculus
tctggtgcttccgatttggatagtg

SEQ ID NO: 835258 - DNA, 25 bp, Mus musculus
tctggtggaagaagctgcccgtcct

SEQ ID NO: 835259 - DNA, 25 bp, Mus musculus
tctggtggaagatgctgcccgtcct

SEQ ID NO: 835260 - DNA, 25 bp, Mus musculus
tctggtggagagctctacttccggt

SEQ ID NO: 835261 - DNA, 25 bp, Mus musculus
tctggtggagaggtctacttccggt

SEQ ID NO: 835262 - DNA, 25 bp, Mus musculus
tctggtggcaatcatttcctttccc

SEQ ID NO: 835263 - DNA, 25 bp, Mus musculus
tctggtggcaatgatttcctttccc

SEQ ID NO: 835264 - DNA, 25 bp, Mus musculus
tctggtggcactctccaaaaatgca

SEQ ID NO: 835265 - DNA, 25 bp, Mus musculus
tctggtggcactgtccaaaaatgca

SEQ ID NO: 835266 - DNA, 25 bp, Mus musculus
tctggtggccctatgatctgcaaag

SEQ ID NO: 835267 - DNA, 25 bp, Mus musculus
tctggtggccctttgatctgcaaag

SEQ ID NO: 835268 - DNA, 25 bp, Mus musculus
tctggtggccgtactgatactgaca

SEQ ID NO: 835269 - DNA, 25 bp, Mus musculus
tctggtggccgttctgatactgaca

SEQ ID NO: 835270 - DNA, 25 bp, Mus musculus
tctggtggctagagagaccctcaaa

SEQ ID NO: 835271 - DNA, 25 bp, Mus musculus
tctggtggctagtgagaccctcaaa

SEQ ID NO: 835272 - DNA, 25 bp, Mus musculus
tctggtggctttcctcatctaaaaa

SEQ ID NO: 835273 - DNA, 25 bp, Mus musculus
tctggtggctttgctcatctaaaaa

SEQ ID NO: 835274 - DNA, 25 bp, Mus musculus
tctggtgggtcacttagcctctcac

SEQ ID NO: 835275 - DNA, 25 bp, Mus musculus
tctggtgggtcagttagcctctcac

SEQ ID NO: 835276 - DNA, 25 bp, Mus musculus
tctggtggtatcacacgatggccaa

SEQ ID NO: 835277 - DNA, 25 bp, Mus musculus
tctggtggtatctcacgatggccaa

SEQ ID NO: 835278 - DNA, 25 bp, Mus musculus
tctggtggtcatctgtctgtgtaat

SEQ ID NO: 835279 - DNA, 25 bp, Mus musculus
tctggtggtcatgtgtctgtgtaat

SEQ ID NO: 835280 - DNA, 25 bp, Mus musculus
tctggtggttcgatgatcttattct

SEQ ID NO: 835281 - DNA, 25 bp, Mus musculus
tctggtggttcgttgatcttattct

SEQ ID NO: 835282 - DNA, 25 bp, Mus musculus
tctggtgtaattctgatctcgagtc

SEQ ID NO: 835283 - DNA, 25 bp, Mus musculus
tctggtgtaattgtgatctcgagtc

SEQ ID NO: 835284 - DNA, 25 bp, Mus musculus
tctggtgtacacatgtaatcttact

SEQ ID NO: 835285 - DNA, 25 bp, Mus musculus
tctggtgtacacttgtaatcttact

SEQ ID NO: 835286 - DNA, 25 bp, Mus musculus
tctggtgtacctactgtcgtagtca

SEQ ID NO: 835287 - DNA, 25 bp, Mus musculus
tctggtgtaccttctgtcgtagtca

SEQ ID NO: 835288 - DNA, 25 bp, Mus musculus
tctggtgtactaagctttttctcta

SEQ ID NO: 835289 - DNA, 25 bp, Mus musculus
tctggtgtactatgctttttctcta

SEQ ID NO: 835290 - DNA, 25 bp, Mus musculus
tctggtgtcagcacaagtcagggct

SEQ ID NO: 835291 - DNA, 25 bp, Mus musculus
tctggtgtcagctcaagtcagggct

SEQ ID NO: 835292 - DNA, 25 bp, Mus musculus
tctggtgtcatcaatttgagttcct

SEQ ID NO: 835293 - DNA, 25 bp, Mus musculus
tctggtgtcatctatttgagttcct

SEQ ID NO: 835294 - DNA, 25 bp, Mus musculus
tctggtgtccgtagctagtaggata

SEQ ID NO: 835295 - DNA, 25 bp, Mus musculus
tctggtgtccgttgctagtaggata

SEQ ID NO: 835296 - DNA, 25 bp, Mus musculus
tctggtgtctacagtttgttgggag

SEQ ID NO: 835297 - DNA, 25 bp, Mus musculus
tctggtgtctactgtttgttgggag

SEQ ID NO: 835298 - DNA, 25 bp, Mus musculus
tctggtgtctccacattatgtagct

SEQ ID NO: 835299 - DNA, 25 bp, Mus musculus
tctggtgtctcctcattatgtagct

SEQ ID NO: 835300 - DNA, 25 bp, Mus musculus
tctggtgtcttacacctgaaatcct

SEQ ID NO: 835301 - DNA, 25 bp, Mus musculus
tctggtgtcttagacctgaaatcct

SEQ ID NO: 835302 - DNA, 25 bp, Mus musculus
tctggtgtgagaaatatggctgtat

SEQ ID NO: 835303 - DNA, 25 bp, Mus musculus
tctggtgtgagatatatggctgtat

SEQ ID NO: 835304 - DNA, 25 bp, Mus musculus
tctggtgtgggaaattttccacact

SEQ ID NO: 835305 - DNA, 25 bp, Mus musculus
tctggtgtgggatattttccacact

SEQ ID NO: 835306 - DNA, 25 bp, Mus musculus
tctggtgtgtagctttctacctcaa

SEQ ID NO: 835307 - DNA, 25 bp, Mus musculus
tctggtgtgtaggtttctacctcaa

SEQ ID NO: 835308 - DNA, 25 bp, Mus musculus
tctggtgtgtccacataagccaata

SEQ ID NO: 835309 - DNA, 25 bp, Mus musculus
tctggtgtgtccatgcggctggtca

SEQ ID NO: 835310 - DNA, 25 bp, Mus musculus
tctggtgtgtcctcataagccaata

SEQ ID NO: 835311 - DNA, 25 bp, Mus musculus
tctggtgtgtccttgcggctggtca

SEQ ID NO: 835312 - DNA, 25 bp, Mus musculus
tctggtgttcggatatggagcctct

SEQ ID NO: 835313 - DNA, 25 bp, Mus musculus
tctggtgttcggttatggagcctct

SEQ ID NO: 835314 - DNA, 25 bp, Mus musculus
tctggtgttgaacctaggtcttgag

SEQ ID NO: 835315 - DNA, 25 bp, Mus musculus
tctggtgttgaagctaggtcttgag

SEQ ID NO: 835316 - DNA, 25 bp, Mus musculus
tctggtgttgtgaagtggcatctca

SEQ ID NO: 835317 - DNA, 25 bp, Mus musculus
tctggtgttgtgtagtggcatctca

SEQ ID NO: 835318 - DNA, 25 bp, Mus musculus
tctggtgtttccagctttgttatgt

SEQ ID NO: 835319 - DNA, 25 bp, Mus musculus
tctggtgtttcctgctttgttatgt

SEQ ID NO: 835320 - DNA, 25 bp, Mus musculus
tctggtgttttcacagtcgataaaa

SEQ ID NO: 835321 - DNA, 25 bp, Mus musculus
tctggtgttttctcagtcgataaaa

SEQ ID NO: 835322 - DNA, 25 bp, Mus musculus
tctggttacggccagctaactagtt

SEQ ID NO: 835323 - DNA, 25 bp, Mus musculus
tctggttacggcgagctaactagtt

SEQ ID NO: 835324 - DNA, 25 bp, Mus musculus
tctggttacgtgctgcctataggta

SEQ ID NO: 835325 - DNA, 25 bp, Mus musculus
tctggttacgtggtgcctataggta

SEQ ID NO: 835326 - DNA, 25 bp, Mus musculus
tctggttagcttagtgtctgccatg

SEQ ID NO: 835327 - DNA, 25 bp, Mus musculus
tctggttagctttgtgtctgccatg

SEQ ID NO: 835328 - DNA, 25 bp, Mus musculus
tctggttatatactgcttatatctg

SEQ ID NO: 835329 - DNA, 25 bp, Mus musculus
tctggttatatagtgcttatatctg

SEQ ID NO: 835330 - DNA, 25 bp, Mus musculus
tctggttatcatcaccgatcatcag

SEQ ID NO: 835331 - DNA, 25 bp, Mus musculus
tctggttatcatgaccgatcatcag

SEQ ID NO: 835332 - DNA, 25 bp, Mus musculus
tctggttatctaaatgctggtgaca

SEQ ID NO: 835333 - DNA, 25 bp, Mus musculus
tctggttatctatatgctggtgaca

SEQ ID NO: 835334 - DNA, 25 bp, Mus musculus
tctggttattttactgctgttggtg

SEQ ID NO: 835335 - DNA, 25 bp, Mus musculus
tctggttatttttctgctgttggtg

SEQ ID NO: 835336 - DNA, 25 bp, Mus musculus
tctggttcagctatgcgacattctt

SEQ ID NO: 835337 - DNA, 25 bp, Mus musculus
tctggttcagctttgcgacattctt

SEQ ID NO: 835338 - DNA, 25 bp, Mus musculus
tctggttcagttcatttgtcgctca

SEQ ID NO: 835339 - DNA, 25 bp, Mus musculus
tctggttcagttgatttgtcgctca

SEQ ID NO: 835340 - DNA, 25 bp, Mus musculus
tctggttcatttactggtggcctca

SEQ ID NO: 835341 - DNA, 25 bp, Mus musculus
tctggttcattttctggtggcctca

SEQ ID NO: 835342 - DNA, 25 bp, Mus musculus
tctggttccaggactacctacaata

SEQ ID NO: 835343 - DNA, 25 bp, Mus musculus
tctggttccaggtctacctacaata

SEQ ID NO: 835344 - DNA, 25 bp, Mus musculus
tctggttccgtgaaagcgtctcaaa

SEQ ID NO: 835345 - DNA, 25 bp, Mus musculus
tctggttccgtgtaagcgtctcaaa

SEQ ID NO: 835346 - DNA, 25 bp, Mus musculus
tctggttcctgacacccaactcagt

SEQ ID NO: 835347 - DNA, 25 bp, Mus musculus
tctggttcctgagacccaactcagt

SEQ ID NO: 835348 - DNA, 25 bp, Mus musculus
tctggttctcaaatccaacagttta

SEQ ID NO: 835349 - DNA, 25 bp, Mus musculus
tctggttctcaattccaacagttta

SEQ ID NO: 835350 - DNA, 25 bp, Mus musculus
tctggttctcctcgattgtggttca

SEQ ID NO: 835351 - DNA, 25 bp, Mus musculus
tctggttctcctggattgtggttca

SEQ ID NO: 835352 - DNA, 25 bp, Mus musculus
tctggttctgagagccaaggtgaac

SEQ ID NO: 835353 - DNA, 25 bp, Mus musculus
tctggttctgagtgccaaggtgaac

SEQ ID NO: 835354 - DNA, 25 bp, Mus musculus
tctggttctgtgaattgagaattta

SEQ ID NO: 835355 - DNA, 25 bp, Mus musculus
tctggttctgtgtattgagaattta

SEQ ID NO: 835356 - DNA, 25 bp, Mus musculus
tctggttcttcactgctgcatacta

SEQ ID NO: 835357 - DNA, 25 bp, Mus musculus
tctggttcttcagtgctgcatacta

SEQ ID NO: 835358 - DNA, 25 bp, Mus musculus
tctggttcttggcaaaccgtgtgtt

SEQ ID NO: 835359 - DNA, 25 bp, Mus musculus
tctggttcttgggaaaccgtgtgtt

SEQ ID NO: 835360 - DNA, 25 bp, Mus musculus
tctggttgaattcccggtttttgaa

SEQ ID NO: 835361 - DNA, 25 bp, Mus musculus
tctggttgaattgccggtttttgaa

SEQ ID NO: 835362 - DNA, 25 bp, Mus musculus
tctggttgcaagagctgcatactgc

SEQ ID NO: 835363 - DNA, 25 bp, Mus musculus
tctggttgcaagtgctgcatactgc

SEQ ID NO: 835364 - DNA, 25 bp, Mus musculus
tctggttgccatagtgaggatgcta

SEQ ID NO: 835365 - DNA, 25 bp, Mus musculus
tctggttgccattgtgaggatgcta

SEQ ID NO: 835366 - DNA, 25 bp, Mus musculus
tctggttgctttcaaccctttggaa

SEQ ID NO: 835367 - DNA, 25 bp, Mus musculus
tctggttgctttctgcataatggcc

SEQ ID NO: 835368 - DNA, 25 bp, Mus musculus
tctggttgctttgaaccctttggaa

SEQ ID NO: 835369 - DNA, 25 bp, Mus musculus
tctggttgctttgtgcataatggcc

SEQ ID NO: 835370 - DNA, 25 bp, Mus musculus
tctggttggcctccgaggagttcaa

SEQ ID NO: 835371 - DNA, 25 bp, Mus musculus
tctggttggcctgcgaggagttcaa

SEQ ID NO: 835372 - DNA, 25 bp, Mus musculus
tctggttgtaacacagggcaggctg

SEQ ID NO: 835373 - DNA, 25 bp, Mus musculus
tctggttgtaactcagggcaggctg

SEQ ID NO: 835374 - DNA, 25 bp, Mus musculus
tctggttgtactatccagttccctg

SEQ ID NO: 835375 - DNA, 25 bp, Mus musculus
tctggttgtactttccagttccctg

SEQ ID NO: 835376 - DNA, 25 bp, Mus musculus
tctggttgtcctatttgatgtcttc

SEQ ID NO: 835377 - DNA, 25 bp, Mus musculus
tctggttgtcctttttgatgtcttc

SEQ ID NO: 835378 - DNA, 25 bp, Mus musculus
tctggttgtcggagccacattgtgg

SEQ ID NO: 835379 - DNA, 25 bp, Mus musculus
tctggttgtcggtgccacattgtgg

SEQ ID NO: 835380 - DNA, 25 bp, Mus musculus
tctggttgttcaagtatcagtgttt

SEQ ID NO: 835381 - DNA, 25 bp, Mus musculus
tctggttgttcatgtatcagtgttt

SEQ ID NO: 835382 - DNA, 25 bp, Mus musculus
tctggtttacttaggctccctttag

SEQ ID NO: 835383 - DNA, 25 bp, Mus musculus
tctggtttacttattgcatctctat

SEQ ID NO: 835384 - DNA, 25 bp, Mus musculus
tctggtttactttggctccctttag

SEQ ID NO: 835385 - DNA, 25 bp, Mus musculus
tctggtttactttttgcatctctat

SEQ ID NO: 835386 - DNA, 25 bp, Mus musculus
tctggtttcaatctgaacactgtga

SEQ ID NO: 835387 - DNA, 25 bp, Mus musculus
tctggtttcaatgtgaacactgtga

SEQ ID NO: 835388 - DNA, 25 bp, Mus musculus
tctggtttcagtctctctctttggc

SEQ ID NO: 835389 - DNA, 25 bp, Mus musculus
tctggtttcagtgtctctctttggc

SEQ ID NO: 835390 - DNA, 25 bp, Mus musculus
tctggtttccacaccatgtgttggg

SEQ ID NO: 835391 - DNA, 25 bp, Mus musculus
tctggtttccactccatgtgttggg

SEQ ID NO: 835392 - DNA, 25 bp, Mus musculus
tctggtttccctacccagaggacaa

SEQ ID NO: 835393 - DNA, 25 bp, Mus musculus
tctggtttcccttcccagaggacaa

SEQ ID NO: 835394 - DNA, 25 bp, Mus musculus
tctggtttcctaaccgttatccatc

SEQ ID NO: 835395 - DNA, 25 bp, Mus musculus
tctggtttcctaatctagctatccc

SEQ ID NO: 835396 - DNA, 25 bp, Mus musculus
tctggtttcctacttcggcagggac

SEQ ID NO: 835397 - DNA, 25 bp, Mus musculus
tctggtttcctagttcggcagggac

SEQ ID NO: 835398 - DNA, 25 bp, Mus musculus
tctggtttcctatccgttatccatc

SEQ ID NO: 835399 - DNA, 25 bp, Mus musculus
tctggtttcctattctagctatccc

SEQ ID NO: 835400 - DNA, 25 bp, Mus musculus
tctggtttccttatatttactaatg

SEQ ID NO: 835401 - DNA, 25 bp, Mus musculus
tctggtttccttttatttactaatg

SEQ ID NO: 835402 - DNA, 25 bp, Mus musculus
tctggtttcgggaggtgagtaccca

SEQ ID NO: 835403 - DNA, 25 bp, Mus musculus
tctggtttcgggtggtgagtaccca

SEQ ID NO: 835404 - DNA, 25 bp, Mus musculus
tctggtttctaaatctattccccac

SEQ ID NO: 835405 - DNA, 25 bp, Mus musculus
tctggtttctaattctattccccac

SEQ ID NO: 835406 - DNA, 25 bp, Mus musculus
tctggtttctctctgcggtgacgca

SEQ ID NO: 835407 - DNA, 25 bp, Mus musculus
tctggtttctctgtgcggtgacgca

SEQ ID NO: 835408 - DNA, 25 bp, Mus musculus
tctggtttctgcaacacaatgtgaa

SEQ ID NO: 835409 - DNA, 25 bp, Mus musculus
tctggtttctgcctactccttttaa

SEQ ID NO: 835410 - DNA, 25 bp, Mus musculus
tctggtttctgcgtactccttttaa

SEQ ID NO: 835411 - DNA, 25 bp, Mus musculus
tctggtttctgctacacaatgtgaa

SEQ ID NO: 835412 - DNA, 25 bp, Mus musculus
tctggtttgctaactagtctgccta

SEQ ID NO: 835413 - DNA, 25 bp, Mus musculus
tctggtttgctatctagtctgccta

SEQ ID NO: 835414 - DNA, 25 bp, Mus musculus
tctggttttcctattgacactattt

SEQ ID NO: 835415 - DNA, 25 bp, Mus musculus
tctggttttccttttgacactattt

SEQ ID NO: 835416 - DNA, 25 bp, Mus musculus
tctggttttctccttgatattttgg

SEQ ID NO: 835417 - DNA, 25 bp, Mus musculus
tctggttttctcgttgatattttgg

SEQ ID NO: 835418 - DNA, 25 bp, Mus musculus
tctggttttggcaacgaccatctta

SEQ ID NO: 835419 - DNA, 25 bp, Mus musculus
tctggttttggctacgaccatctta

SEQ ID NO: 835420 - DNA, 25 bp, Mus musculus
tctggttttgtcagttacagtaaac

SEQ ID NO: 835421 - DNA, 25 bp, Mus musculus
tctggttttgtctgttacagtaaac

SEQ ID NO: 835422 - DNA, 25 bp, Mus musculus
tctggtttttccatggcccagcaga

SEQ ID NO: 835423 - DNA, 25 bp, Mus musculus
tctggtttttccttggcccagcaga

SEQ ID NO: 835424 - DNA, 25 bp, Mus musculus
tctggtttttctacatggcattatt

SEQ ID NO: 835425 - DNA, 25 bp, Mus musculus
tctggtttttcttcatggcattatt

SEQ ID NO: 835426 - DNA, 25 bp, Mus musculus
tctggtttttggatacactttgccc

SEQ ID NO: 835427 - DNA, 25 bp, Mus musculus
tctggtttttggttacactttgccc

SEQ ID NO: 835428 - DNA, 25 bp, Mus musculus
tctggttttttgacctttgcccata

SEQ ID NO: 835429 - DNA, 25 bp, Mus musculus
tctggttttttgtcctttgcccata

SEQ ID NO: 835430 - DNA, 25 bp, Mus musculus
tctgtaaaatgtatggaaccgtggt

SEQ ID NO: 835431 - DNA, 25 bp, Mus musculus
tctgtaaaatgtttggaaccgtggt

SEQ ID NO: 835432 - DNA, 25 bp, Mus musculus
tctgtaaacagacgccaatgccatt

SEQ ID NO: 835433 - DNA, 25 bp, Mus musculus
tctgtaaacagaggccaatgccatt

SEQ ID NO: 835434 - DNA, 25 bp, Mus musculus
tctgtaaacatccttgaactgcccc

SEQ ID NO: 835435 - DNA, 25 bp, Mus musculus
tctgtaaacatcgttgaactgcccc

SEQ ID NO: 835436 - DNA, 25 bp, Mus musculus
tctgtaaaccgtcccggcctggaac

SEQ ID NO: 835437 - DNA, 25 bp, Mus musculus
tctgtaaaccgtgccggcctggaac

SEQ ID NO: 835438 - DNA, 25 bp, Mus musculus
tctgtaaactttaggtgtttccact

SEQ ID NO: 835439 - DNA, 25 bp, Mus musculus
tctgtaaacttttggtgtttccact

SEQ ID NO: 835440 - DNA, 25 bp, Mus musculus
tctgtaaagaggctggctccttcct

SEQ ID NO: 835441 - DNA, 25 bp, Mus musculus
tctgtaaagagggtggctccttcct

SEQ ID NO: 835442 - DNA, 25 bp, Mus musculus
tctgtaaagcccacagccatgagat

SEQ ID NO: 835443 - DNA, 25 bp, Mus musculus
tctgtaaagccctcagccatgagat

SEQ ID NO: 835444 - DNA, 25 bp, Mus musculus
tctgtaaaggccaacatatcaaata

SEQ ID NO: 835445 - DNA, 25 bp, Mus musculus
tctgtaaaggcctacatatcaaata

SEQ ID NO: 835446 - DNA, 25 bp, Mus musculus
tctgtaaaggttacaggcttcccac

SEQ ID NO: 835447 - DNA, 25 bp, Mus musculus
tctgtaaaggtttcaggcttcccac

SEQ ID NO: 835448 - DNA, 25 bp, Mus musculus
tctgtaaagtccaccttgtcggctt

SEQ ID NO: 835449 - DNA, 25 bp, Mus musculus
tctgtaaagtcctccttgtcggctt

SEQ ID NO: 835450 - DNA, 25 bp, Mus musculus
tctgtaaatcttagcaagccctgta

SEQ ID NO: 835451 - DNA, 25 bp, Mus musculus
tctgtaaatctttgcaagccctgta

SEQ ID NO: 835452 - DNA, 25 bp, Mus musculus
tctgtaaatgctactgccggtccaa

SEQ ID NO: 835453 - DNA, 25 bp, Mus musculus
tctgtaaatgcttctgccggtccaa

SEQ ID NO: 835454 - DNA, 25 bp, Mus musculus
tctgtaaattccatcctatgataat

SEQ ID NO: 835455 - DNA, 25 bp, Mus musculus
tctgtaaattccttcctatgataat

SEQ ID NO: 835456 - DNA, 25 bp, Mus musculus
tctgtaacctgccacctctcatatg

SEQ ID NO: 835457 - DNA, 25 bp, Mus musculus
tctgtaacctgcgacctctcatatg

SEQ ID NO: 835458 - DNA, 25 bp, Mus musculus
tctgtaactaccaatttcaatttgg

SEQ ID NO: 835459 - DNA, 25 bp, Mus musculus
tctgtaactacctatttcaatttgg

SEQ ID NO: 835460 - DNA, 25 bp, Mus musculus
tctgtaactcagcttcttccttaaa

SEQ ID NO: 835461 - DNA, 25 bp, Mus musculus
tctgtaactcaggttcttccttaaa

SEQ ID NO: 835462 - DNA, 25 bp, Mus musculus
tctgtaactcttactagggaaccca

SEQ ID NO: 835463 - DNA, 25 bp, Mus musculus
tctgtaactctttctagggaaccca

SEQ ID NO: 835464 - DNA, 25 bp, Mus musculus
tctgtaacttaccagttttgtttgc

SEQ ID NO: 835465 - DNA, 25 bp, Mus musculus
tctgtaacttacgagttttgtttgc

SEQ ID NO: 835466 - DNA, 25 bp, Mus musculus
tctgtaactttgaactggacaaaac

SEQ ID NO: 835467 - DNA, 25 bp, Mus musculus
tctgtaactttgtactggacaaaac

SEQ ID NO: 835468 - DNA, 25 bp, Mus musculus
tctgtaacttttcctaaacacttta

SEQ ID NO: 835469 - DNA, 25 bp, Mus musculus
tctgtaacttttgctaaacacttta

SEQ ID NO: 835470 - DNA, 25 bp, Mus musculus
tctgtaagaactaactccagtatca

SEQ ID NO: 835471 - DNA, 25 bp, Mus musculus
tctgtaagaacttactccagtatca

SEQ ID NO: 835472 - DNA, 25 bp, Mus musculus
tctgtaagcaagagccctgggccta

SEQ ID NO: 835473 - DNA, 25 bp, Mus musculus
tctgtaagcaagtgccctgggccta

SEQ ID NO: 835474 - DNA, 25 bp, Mus musculus
tctgtaagcttgagagggcctcctg

SEQ ID NO: 835475 - DNA, 25 bp, Mus musculus
tctgtaagcttgtgagggcctcctg

SEQ ID NO: 835476 - DNA, 25 bp, Mus musculus
tctgtaagggagaatcttgcctggc

SEQ ID NO: 835477 - DNA, 25 bp, Mus musculus
tctgtaagggagtatcttgcctggc

SEQ ID NO: 835478 - DNA, 25 bp, Mus musculus
tctgtaaggttcctattctagttca

SEQ ID NO: 835479 - DNA, 25 bp, Mus musculus
tctgtaaggttcgtattctagttca

SEQ ID NO: 835480 - DNA, 25 bp, Mus musculus
tctgtaagtcagagccggatccgtt

SEQ ID NO: 835481 - DNA, 25 bp, Mus musculus
tctgtaagtcagtgccggatccgtt

SEQ ID NO: 835482 - DNA, 25 bp, Mus musculus
tctgtaatcattagccccacattgt

SEQ ID NO: 835483 - DNA, 25 bp, Mus musculus
tctgtaatcatttgccccacattgt

SEQ ID NO: 835484 - DNA, 25 bp, Mus musculus
tctgtaatccacaaaataaggcata

SEQ ID NO: 835485 - DNA, 25 bp, Mus musculus
tctgtaatccaccttttcagctata

SEQ ID NO: 835486 - DNA, 25 bp, Mus musculus
tctgtaatccacgttttcagctata

SEQ ID NO: 835487 - DNA, 25 bp, Mus musculus
tctgtaatccactaaataaggcata

SEQ ID NO: 835488 - DNA, 25 bp, Mus musculus
tctgtaatccccatattgctgcagg

SEQ ID NO: 835489 - DNA, 25 bp, Mus musculus
tctgtaatccccttattgctgcagg

SEQ ID NO: 835490 - DNA, 25 bp, Mus musculus
tctgtaatctccacacttagggact

SEQ ID NO: 835491 - DNA, 25 bp, Mus musculus
tctgtaatctcctcacttagggact

SEQ ID NO: 835492 - DNA, 25 bp, Mus musculus
tctgtaattcctatcccagggatca

SEQ ID NO: 835493 - DNA, 25 bp, Mus musculus
tctgtaattcctttcccagggatca

SEQ ID NO: 835494 - DNA, 25 bp, Mus musculus
tctgtacagaaaataagaccctgag

SEQ ID NO: 835495 - DNA, 25 bp, Mus musculus
tctgtacagaaattaagaccctgag

SEQ ID NO: 835496 - DNA, 25 bp, Mus musculus
tctgtacagaggagagctgtccggt

SEQ ID NO: 835497 - DNA, 25 bp, Mus musculus
tctgtacagaggtgagctgtccggt

SEQ ID NO: 835498 - DNA, 25 bp, Mus musculus
tctgtacaggcccacatgcgtgtgg

SEQ ID NO: 835499 - DNA, 25 bp, Mus musculus
tctgtacaggccgacatgcgtgtgg

SEQ ID NO: 835500 - DNA, 25 bp, Mus musculus
tctgtacaggttcaccaagccgcac

SEQ ID NO: 835501 - DNA, 25 bp, Mus musculus
tctgtacaggttgaccaagccgcac

SEQ ID NO: 835502 - DNA, 25 bp, Mus musculus
tctgtacagtgacctccttgaaggt

SEQ ID NO: 835503 - DNA, 25 bp, Mus musculus
tctgtacagtgagctccttgaaggt

SEQ ID NO: 835504 - DNA, 25 bp, Mus musculus
tctgtacatactcgatctcttttct

SEQ ID NO: 835505 - DNA, 25 bp, Mus musculus
tctgtacatactggatctcttttct

SEQ ID NO: 835506 - DNA, 25 bp, Mus musculus
tctgtaccacatctctgtgacaaaa

SEQ ID NO: 835507 - DNA, 25 bp, Mus musculus
tctgtaccacatgtctgtgacaaaa

SEQ ID NO: 835508 - DNA, 25 bp, Mus musculus
tctgtaccaggcaacagctccagtt

SEQ ID NO: 835509 - DNA, 25 bp, Mus musculus
tctgtaccaggctacagctccagtt

SEQ ID NO: 835510 - DNA, 25 bp, Mus musculus
tctgtaccaggtagcccaatagaaa

SEQ ID NO: 835511 - DNA, 25 bp, Mus musculus
tctgtaccaggttgcccaatagaaa

SEQ ID NO: 835512 - DNA, 25 bp, Mus musculus
tctgtacctataaggcagtgggttt

SEQ ID NO: 835513 - DNA, 25 bp, Mus musculus
tctgtacctatatggcagtgggttt

SEQ ID NO: 835514 - DNA, 25 bp, Mus musculus
tctgtacgtctgatttgtcagcttc

SEQ ID NO: 835515 - DNA, 25 bp, Mus musculus
tctgtacgtctgttttgtcagcttc

SEQ ID NO: 835516 - DNA, 25 bp, Mus musculus
tctgtactaggcaaccattacatgt

SEQ ID NO: 835517 - DNA, 25 bp, Mus musculus
tctgtactaggctaccattacatgt

SEQ ID NO: 835518 - DNA, 25 bp, Mus musculus
tctgtactatgaagtcactaaaaga

SEQ ID NO: 835519 - DNA, 25 bp, Mus musculus
tctgtactatgatgtcactaaaaga

SEQ ID NO: 835520 - DNA, 25 bp, Mus musculus
tctgtactctgccaagctcttgaaa

SEQ ID NO: 835521 - DNA, 25 bp, Mus musculus
tctgtactctgcgaagctcttgaaa

SEQ ID NO: 835522 - DNA, 25 bp, Mus musculus
tctgtactgaacacgtggatatgta

SEQ ID NO: 835523 - DNA, 25 bp, Mus musculus
tctgtactgaactcgtggatatgta

SEQ ID NO: 835524 - DNA, 25 bp, Mus musculus
tctgtactgggcactactgctcagc

SEQ ID NO: 835525 - DNA, 25 bp, Mus musculus
tctgtactgggctctactgctcagc

SEQ ID NO: 835526 - DNA, 25 bp, Mus musculus
tctgtactgtatattatacgcaacg

SEQ ID NO: 835527 - DNA, 25 bp, Mus musculus
tctgtactgtattttatacgcaacg

SEQ ID NO: 835528 - DNA, 25 bp, Mus musculus
tctgtactgtgcagactttataaaa

SEQ ID NO: 835529 - DNA, 25 bp, Mus musculus
tctgtactgtgctgactttataaaa

SEQ ID NO: 835530 - DNA, 25 bp, Mus musculus
tctgtacttcctcgtgcttttcctt

SEQ ID NO: 835531 - DNA, 25 bp, Mus musculus
tctgtacttcctggtgcttttcctt

SEQ ID NO: 835532 - DNA, 25 bp, Mus musculus
tctgtacttcggctgcagtgtgaca

SEQ ID NO: 835533 - DNA, 25 bp, Mus musculus
tctgtacttcgggtgcagtgtgaca

SEQ ID NO: 835534 - DNA, 25 bp, Mus musculus
tctgtacttggcatggtttctaata

SEQ ID NO: 835535 - DNA, 25 bp, Mus musculus
tctgtacttggcttggtttctaata

SEQ ID NO: 835536 - DNA, 25 bp, Mus musculus
tctgtagaagtgactggtgtgtttc

SEQ ID NO: 835537 - DNA, 25 bp, Mus musculus
tctgtagaagtgtctggtgtgtttc

SEQ ID NO: 835538 - DNA, 25 bp, Mus musculus
tctgtagaatgtcagccctgctggg

SEQ ID NO: 835539 - DNA, 25 bp, Mus musculus
tctgtagaatgtgagccctgctggg

SEQ ID NO: 835540 - DNA, 25 bp, Mus musculus
tctgtagacactaggtgtcccctgg

SEQ ID NO: 835541 - DNA, 25 bp, Mus musculus
tctgtagacacttggtgtcccctgg

SEQ ID NO: 835542 - DNA, 25 bp, Mus musculus
tctgtagaccgaatggatgtatgtg

SEQ ID NO: 835543 - DNA, 25 bp, Mus musculus
tctgtagaccgattggatgtatgtg

SEQ ID NO: 835544 - DNA, 25 bp, Mus musculus
tctgtagacctcaggctcattcatg

SEQ ID NO: 835545 - DNA, 25 bp, Mus musculus
tctgtagacctctggctcattcatg

SEQ ID NO: 835546 - DNA, 25 bp, Mus musculus
tctgtagactgtcgcgactggatcc

SEQ ID NO: 835547 - DNA, 25 bp, Mus musculus
tctgtagactgtggcgactggatcc

SEQ ID NO: 835548 - DNA, 25 bp, Mus musculus
tctgtagacttgaccacattgtgat

SEQ ID NO: 835549 - DNA, 25 bp, Mus musculus
tctgtagacttgtccacattgtgat

SEQ ID NO: 835550 - DNA, 25 bp, Mus musculus
tctgtagagataattggtttttcac

SEQ ID NO: 835551 - DNA, 25 bp, Mus musculus
tctgtagagatatttggtttttcac

SEQ ID NO: 835552 - DNA, 25 bp, Mus musculus
tctgtagagcgccttcttgaagaca

SEQ ID NO: 835553 - DNA, 25 bp, Mus musculus
tctgtagagcgcgttcttgaagaca

SEQ ID NO: 835554 - DNA, 25 bp, Mus musculus
tctgtagaggttataggtgggtcct

SEQ ID NO: 835555 - DNA, 25 bp, Mus musculus
tctgtagaggttttaggtgggtcct

SEQ ID NO: 835556 - DNA, 25 bp, Mus musculus
tctgtagagtagctgtgtggattca

SEQ ID NO: 835557 - DNA, 25 bp, Mus musculus
tctgtagagtaggtgtgtggattca

SEQ ID NO: 835558 - DNA, 25 bp, Mus musculus
tctgtagagtcccatatagcattta

SEQ ID NO: 835559 - DNA, 25 bp, Mus musculus
tctgtagagtccgatatagcattta

SEQ ID NO: 835560 - DNA, 25 bp, Mus musculus
tctgtagagtcgattcttattaaaa

SEQ ID NO: 835561 - DNA, 25 bp, Mus musculus
tctgtagagtcgtttcttattaaaa

SEQ ID NO: 835562 - DNA, 25 bp, Mus musculus
tctgtagatactacaggagcaccct

SEQ ID NO: 835563 - DNA, 25 bp, Mus musculus
tctgtagatacttcaggagcaccct

SEQ ID NO: 835564 - DNA, 25 bp, Mus musculus
tctgtagatctcagatgtttccaaa

SEQ ID NO: 835565 - DNA, 25 bp, Mus musculus
tctgtagatctctgatgtttccaaa

SEQ ID NO: 835566 - DNA, 25 bp, Mus musculus
tctgtagcacacctcataggtatgg

SEQ ID NO: 835567 - DNA, 25 bp, Mus musculus
tctgtagcacacgtcataggtatgg

SEQ ID NO: 835568 - DNA, 25 bp, Mus musculus
tctgtagcactgcatctgaaaaggt

SEQ ID NO: 835569 - DNA, 25 bp, Mus musculus
tctgtagcactggatctgaaaaggt

SEQ ID NO: 835570 - DNA, 25 bp, Mus musculus
tctgtagcagaaattggtgttgcct

SEQ ID NO: 835571 - DNA, 25 bp, Mus musculus
tctgtagcagaatttggtgttgcct

SEQ ID NO: 835572 - DNA, 25 bp, Mus musculus
tctgtagccaaaccagtcccatgac

SEQ ID NO: 835573 - DNA, 25 bp, Mus musculus
tctgtagccaaagcagtcccatgac

SEQ ID NO: 835574 - DNA, 25 bp, Mus musculus
tctgtagccagcatgtggaccagta

SEQ ID NO: 835575 - DNA, 25 bp, Mus musculus
tctgtagccagcttgtggaccagta

SEQ ID NO: 835576 - DNA, 25 bp, Mus musculus
tctgtagccatcagcgccaatagct

SEQ ID NO: 835577 - DNA, 25 bp, Mus musculus
tctgtagccatctgcgccaatagct

SEQ ID NO: 835578 - DNA, 25 bp, Mus musculus
tctgtagcccagatagttgtgttca

SEQ ID NO: 835579 - DNA, 25 bp, Mus musculus
tctgtagcccagcagtactagaata

SEQ ID NO: 835580 - DNA, 25 bp, Mus musculus
tctgtagcccaggagtactagaata

SEQ ID NO: 835581 - DNA, 25 bp, Mus musculus
tctgtagcccagttagttgtgttca

SEQ ID NO: 835582 - DNA, 25 bp, Mus musculus
tctgtagccgaaaacttctgttccg

SEQ ID NO: 835583 - DNA, 25 bp, Mus musculus
tctgtagccgaatacttctgttccg

SEQ ID NO: 835584 - DNA, 25 bp, Mus musculus
tctgtagcctaacaattactgtggt

SEQ ID NO: 835585 - DNA, 25 bp, Mus musculus
tctgtagcctaagaattactgtggt

SEQ ID NO: 835586 - DNA, 25 bp, Mus musculus
tctgtagcctggcttgagccacaat

SEQ ID NO: 835587 - DNA, 25 bp, Mus musculus
tctgtagcctgggttgagccacaat

SEQ ID NO: 835588 - DNA, 25 bp, Mus musculus
tctgtagctcagcagagcgtcccta

SEQ ID NO: 835589 - DNA, 25 bp, Mus musculus
tctgtagctcaggagagcgtcccta

SEQ ID NO: 835590 - DNA, 25 bp, Mus musculus
tctgtagctgctcagtccacactga

SEQ ID NO: 835591 - DNA, 25 bp, Mus musculus
tctgtagctgctgagtccacactga

SEQ ID NO: 835592 - DNA, 25 bp, Mus musculus
tctgtagcttcaccacacactgatg

SEQ ID NO: 835593 - DNA, 25 bp, Mus musculus
tctgtagcttcagcacacactgatg

SEQ ID NO: 835594 - DNA, 25 bp, Mus musculus
tctgtagcttggcttggccttgaac

SEQ ID NO: 835595 - DNA, 25 bp, Mus musculus
tctgtagcttgggttggccttgaac

SEQ ID NO: 835596 - DNA, 25 bp, Mus musculus
tctgtaggcaccatagtggcttttc

SEQ ID NO: 835597 - DNA, 25 bp, Mus musculus
tctgtaggcaccttagtggcttttc

SEQ ID NO: 835598 - DNA, 25 bp, Mus musculus
tctgtaggccttagctaagtgtctt

SEQ ID NO: 835599 - DNA, 25 bp, Mus musculus
tctgtaggcctttgctaagtgtctt

SEQ ID NO: 835600 - DNA, 25 bp, Mus musculus
tctgtaggcgcaagcggcggaattt

SEQ ID NO: 835601 - DNA, 25 bp, Mus musculus
tctgtaggcgcatgcggcggaattt

SEQ ID NO: 835602 - DNA, 25 bp, Mus musculus
tctgtaggtaacaggatgatagctt

SEQ ID NO: 835603 - DNA, 25 bp, Mus musculus
tctgtaggtaactggatgatagctt

SEQ ID NO: 835604 - DNA, 25 bp, Mus musculus
tctgtagtagcccagtccaggactt

SEQ ID NO: 835605 - DNA, 25 bp, Mus musculus
tctgtagtagccgagtccaggactt

SEQ ID NO: 835606 - DNA, 25 bp, Mus musculus
tctgtagtatgcactgcctgctgaa

SEQ ID NO: 835607 - DNA, 25 bp, Mus musculus
tctgtagtatgctctgcctgctgaa

SEQ ID NO: 835608 - DNA, 25 bp, Mus musculus
tctgtagtcactatttcttcctcat

SEQ ID NO: 835609 - DNA, 25 bp, Mus musculus
tctgtagtcactttttcttcctcat

SEQ ID NO: 835610 - DNA, 25 bp, Mus musculus
tctgtagtcctcacatctgcagcat

SEQ ID NO: 835611 - DNA, 25 bp, Mus musculus
tctgtagtcctctcatctgcagcat

SEQ ID NO: 835612 - DNA, 25 bp, Mus musculus
tctgtagtccttaccctaaaataat

SEQ ID NO: 835613 - DNA, 25 bp, Mus musculus
tctgtagtcctttccctaaaataat

SEQ ID NO: 835614 - DNA, 25 bp, Mus musculus
tctgtagtctaccttctttggaagc

SEQ ID NO: 835615 - DNA, 25 bp, Mus musculus
tctgtagtctacgttctttggaagc

SEQ ID NO: 835616 - DNA, 25 bp, Mus musculus
tctgtagtcttgactcattgtccaa

SEQ ID NO: 835617 - DNA, 25 bp, Mus musculus
tctgtagtcttgtctcattgtccaa

SEQ ID NO: 835618 - DNA, 25 bp, Mus musculus
tctgtagtgagaagagccggcagca

SEQ ID NO: 835619 - DNA, 25 bp, Mus musculus
tctgtagtgagatgagccggcagca

SEQ ID NO: 835620 - DNA, 25 bp, Mus musculus
tctgtagtgcccataagtcatctta

SEQ ID NO: 835621 - DNA, 25 bp, Mus musculus
tctgtagtgcccttaagtcatctta

SEQ ID NO: 835622 - DNA, 25 bp, Mus musculus
tctgtagtgctcacctgggagacca

SEQ ID NO: 835623 - DNA, 25 bp, Mus musculus
tctgtagtgctctcctgggagacca

SEQ ID NO: 835624 - DNA, 25 bp, Mus musculus
tctgtagtgttcatgccagaccact

SEQ ID NO: 835625 - DNA, 25 bp, Mus musculus
tctgtagtgttcttgccagaccact

SEQ ID NO: 835626 - DNA, 25 bp, Mus musculus
tctgtagttcagacacgggcatata

SEQ ID NO: 835627 - DNA, 25 bp, Mus musculus
tctgtagttcagtcacgggcatata

SEQ ID NO: 835628 - DNA, 25 bp, Mus musculus
tctgtagttctgagtagttcatata

SEQ ID NO: 835629 - DNA, 25 bp, Mus musculus
tctgtagttctgtgtagttcatata

SEQ ID NO: 835630 - DNA, 25 bp, Mus musculus
tctgtagttgcacctattgcctgaa

SEQ ID NO: 835631 - DNA, 25 bp, Mus musculus
tctgtagttgcagctattgcctgaa

SEQ ID NO: 835632 - DNA, 25 bp, Mus musculus
tctgtagttgctactcttttatgag

SEQ ID NO: 835633 - DNA, 25 bp, Mus musculus
tctgtagttgcttctcttttatgag

SEQ ID NO: 835634 - DNA, 25 bp, Mus musculus
tctgtataaatcagccacggcctta

SEQ ID NO: 835635 - DNA, 25 bp, Mus musculus
tctgtataaatctgccacggcctta

SEQ ID NO: 835636 - DNA, 25 bp, Mus musculus
tctgtatagattccttctcgtccac

SEQ ID NO: 835637 - DNA, 25 bp, Mus musculus
tctgtatagattgcttctcgtccac

SEQ ID NO: 835638 - DNA, 25 bp, Mus musculus
tctgtatatagcaacacttcggttg

SEQ ID NO: 835639 - DNA, 25 bp, Mus musculus
tctgtatatagctacacttcggttg

SEQ ID NO: 835640 - DNA, 25 bp, Mus musculus
tctgtatatcccagggctgccgtag

SEQ ID NO: 835641 - DNA, 25 bp, Mus musculus
tctgtatatccctgggctgccgtag

SEQ ID NO: 835642 - DNA, 25 bp, Mus musculus
tctgtatcagaacacaatatcatgc

SEQ ID NO: 835643 - DNA, 25 bp, Mus musculus
tctgtatcagaagacaatatcatgc

SEQ ID NO: 835644 - DNA, 25 bp, Mus musculus
tctgtatcataaacactaaggtagt

SEQ ID NO: 835645 - DNA, 25 bp, Mus musculus
tctgtatcataatcactaaggtagt

SEQ ID NO: 835646 - DNA, 25 bp, Mus musculus
tctgtatcataccatggcggtcccg

SEQ ID NO: 835647 - DNA, 25 bp, Mus musculus
tctgtatcatacgatggcggtcccg

SEQ ID NO: 835648 - DNA, 25 bp, Mus musculus
tctgtatccagtcgtcacagtcact

SEQ ID NO: 835649 - DNA, 25 bp, Mus musculus
tctgtatccagtggtcacagtcact

SEQ ID NO: 835650 - DNA, 25 bp, Mus musculus
tctgtatctgcgaagtactctccga

SEQ ID NO: 835651 - DNA, 25 bp, Mus musculus
tctgtatctgcgtagtactctccga

SEQ ID NO: 835652 - DNA, 25 bp, Mus musculus
tctgtatgccccagtaggcgatcaa

SEQ ID NO: 835653 - DNA, 25 bp, Mus musculus
tctgtatgcccctgtaggcgatcaa

SEQ ID NO: 835654 - DNA, 25 bp, Mus musculus
tctgtatgccggatagttgctctgc

SEQ ID NO: 835655 - DNA, 25 bp, Mus musculus
tctgtatgccggttagttgctctgc

SEQ ID NO: 835656 - DNA, 25 bp, Mus musculus
tctgtatgcttgagcttctccgaaa

SEQ ID NO: 835657 - DNA, 25 bp, Mus musculus
tctgtatgcttgtgcttctccgaaa

SEQ ID NO: 835658 - DNA, 25 bp, Mus musculus
tctgtatggcccattctgtgaagca

SEQ ID NO: 835659 - DNA, 25 bp, Mus musculus
tctgtatggccctttctgtgaagca

SEQ ID NO: 835660 - DNA, 25 bp, Mus musculus
tctgtatgggtcagagctaggtctc

SEQ ID NO: 835661 - DNA, 25 bp, Mus musculus
tctgtatgggtctgagctaggtctc

SEQ ID NO: 835662 - DNA, 25 bp, Mus musculus
tctgtatggtacaggagcacagcaa

SEQ ID NO: 835663 - DNA, 25 bp, Mus musculus
tctgtatggtactggagcacagcaa

SEQ ID NO: 835664 - DNA, 25 bp, Mus musculus
tctgtatgtactatctggctggcca

SEQ ID NO: 835665 - DNA, 25 bp, Mus musculus
tctgtatgtactccagctgtgagac

SEQ ID NO: 835666 - DNA, 25 bp, Mus musculus
tctgtatgtactgcagctgtgagac

SEQ ID NO: 835667 - DNA, 25 bp, Mus musculus
tctgtatgtactttctggctggcca

SEQ ID NO: 835668 - DNA, 25 bp, Mus musculus
tctgtatgtcacactcacctaaata

SEQ ID NO: 835669 - DNA, 25 bp, Mus musculus
tctgtatgtcactctcacctaaata

SEQ ID NO: 835670 - DNA, 25 bp, Mus musculus
tctgtatgttctaagagccagcccc

SEQ ID NO: 835671 - DNA, 25 bp, Mus musculus
tctgtatgttcttagagccagcccc

SEQ ID NO: 835672 - DNA, 25 bp, Mus musculus
tctgtattcactcctgttcaatggt

SEQ ID NO: 835673 - DNA, 25 bp, Mus musculus
tctgtattcactgctgttcaatggt

SEQ ID NO: 835674 - DNA, 25 bp, Mus musculus
tctgtattctgccaatcataatttt

SEQ ID NO: 835675 - DNA, 25 bp, Mus musculus
tctgtattctgcgaatcataatttt

SEQ ID NO: 835676 - DNA, 25 bp, Mus musculus
tctgtattgtggcttttgaaagagt

SEQ ID NO: 835677 - DNA, 25 bp, Mus musculus
tctgtattgtgggttttgaaagagt

SEQ ID NO: 835678 - DNA, 25 bp, Mus musculus
tctgtatttatgaggaggacattct

SEQ ID NO: 835679 - DNA, 25 bp, Mus musculus
tctgtatttatgtggaggacattct

SEQ ID NO: 835680 - DNA, 25 bp, Mus musculus
tctgtatttttaatggatgccacta

SEQ ID NO: 835681 - DNA, 25 bp, Mus musculus
tctgtatttttattggatgccacta

SEQ ID NO: 835682 - DNA, 25 bp, Mus musculus
tctgtcaaagggagaaacaaagttc

SEQ ID NO: 835683 - DNA, 25 bp, Mus musculus
tctgtcaaagggtgaaacaaagttc

SEQ ID NO: 835684 - DNA, 25 bp, Mus musculus
tctgtcaaattgatatgttcctgtg

SEQ ID NO: 835685 - DNA, 25 bp, Mus musculus
tctgtcaaattgttatgttcctgtg

SEQ ID NO: 835686 - DNA, 25 bp, Mus musculus
tctgtcaatgtaaatgacacctttt

SEQ ID NO: 835687 - DNA, 25 bp, Mus musculus
tctgtcaatgtatatgacacctttt

SEQ ID NO: 835688 - DNA, 25 bp, Mus musculus
tctgtcacacacaccagggactttg

SEQ ID NO: 835689 - DNA, 25 bp, Mus musculus
tctgtcacacactccagggactttg

SEQ ID NO: 835690 - DNA, 25 bp, Mus musculus
tctgtcacacagctcatgccaattt

SEQ ID NO: 835691 - DNA, 25 bp, Mus musculus
tctgtcacacaggtcatgccaattt

SEQ ID NO: 835692 - DNA, 25 bp, Mus musculus
tctgtcacaccacagtggcttagtg

SEQ ID NO: 835693 - DNA, 25 bp, Mus musculus
tctgtcacaccagagtggcttagtg

SEQ ID NO: 835694 - DNA, 25 bp, Mus musculus
tctgtcacactgacagctggctgtg

SEQ ID NO: 835695 - DNA, 25 bp, Mus musculus
tctgtcacactgtcagctggctgtg

SEQ ID NO: 835696 - DNA, 25 bp, Mus musculus
tctgtcacaggcctgatcctcttgg

SEQ ID NO: 835697 - DNA, 25 bp, Mus musculus
tctgtcacaggcgtgatcctcttgg

SEQ ID NO: 835698 - DNA, 25 bp, Mus musculus
tctgtcacagtgacagtgcccctgc

SEQ ID NO: 835699 - DNA, 25 bp, Mus musculus
tctgtcacagtgattcaagctcatt

SEQ ID NO: 835700 - DNA, 25 bp, Mus musculus
tctgtcacagtgtcagtgcccctgc

SEQ ID NO: 835701 - DNA, 25 bp, Mus musculus
tctgtcacagtgtttcaagctcatt

SEQ ID NO: 835702 - DNA, 25 bp, Mus musculus
tctgtcacattcacatcagccatgg

SEQ ID NO: 835703 - DNA, 25 bp, Mus musculus
tctgtcacattctcatcagccatgg

SEQ ID NO: 835704 - DNA, 25 bp, Mus musculus
tctgtcaccacaacctacaatttag

SEQ ID NO: 835705 - DNA, 25 bp, Mus musculus
tctgtcaccacatcctacaatttag

SEQ ID NO: 835706 - DNA, 25 bp, Mus musculus
tctgtcaccagcaattcccttgggc

SEQ ID NO: 835707 - DNA, 25 bp, Mus musculus
tctgtcaccagctattcccttgggc

SEQ ID NO: 835708 - DNA, 25 bp, Mus musculus
tctgtcacctacctcttgaatttga

SEQ ID NO: 835709 - DNA, 25 bp, Mus musculus
tctgtcacctacgtcttgaatttga

SEQ ID NO: 835710 - DNA, 25 bp, Mus musculus
tctgtcacctggacaattgcctctt

SEQ ID NO: 835711 - DNA, 25 bp, Mus musculus
tctgtcacctggtcaattgcctctt

SEQ ID NO: 835712 - DNA, 25 bp, Mus musculus
tctgtcactaccacaatttggttag

SEQ ID NO: 835713 - DNA, 25 bp, Mus musculus
tctgtcactacctcaatttggttag

SEQ ID NO: 835714 - DNA, 25 bp, Mus musculus
tctgtcactatgctcagcaggactt

SEQ ID NO: 835715 - DNA, 25 bp, Mus musculus
tctgtcactatggtcagcaggactt

SEQ ID NO: 835716 - DNA, 25 bp, Mus musculus
tctgtcactccaagggatccgatgc

SEQ ID NO: 835717 - DNA, 25 bp, Mus musculus
tctgtcactccatgggatccgatgc

SEQ ID NO: 835718 - DNA, 25 bp, Mus musculus
tctgtcactctgacagctagtgttt

SEQ ID NO: 835719 - DNA, 25 bp, Mus musculus
tctgtcactctgtcagctagtgttt

SEQ ID NO: 835720 - DNA, 25 bp, Mus musculus
tctgtcactgataagtacattttaa

SEQ ID NO: 835721 - DNA, 25 bp, Mus musculus
tctgtcactgattagtacattttaa

SEQ ID NO: 835722 - DNA, 25 bp, Mus musculus
tctgtcactgttcccggaagcacag

SEQ ID NO: 835723 - DNA, 25 bp, Mus musculus
tctgtcactgttgccggaagcacag

SEQ ID NO: 835724 - DNA, 25 bp, Mus musculus
tctgtcacttagcagtatttggcca

SEQ ID NO: 835725 - DNA, 25 bp, Mus musculus
tctgtcacttaggagtatttggcca

SEQ ID NO: 835726 - DNA, 25 bp, Mus musculus
tctgtcacttgaccagggtagttgt

SEQ ID NO: 835727 - DNA, 25 bp, Mus musculus
tctgtcacttgagcagggtagttgt

SEQ ID NO: 835728 - DNA, 25 bp, Mus musculus
tctgtcagaaaacccaagctctaga

SEQ ID NO: 835729 - DNA, 25 bp, Mus musculus
tctgtcagaaaagccaagctctaga

SEQ ID NO: 835730 - DNA, 25 bp, Mus musculus
tctgtcagaagactgcatgtgcccg

SEQ ID NO: 835731 - DNA, 25 bp, Mus musculus
tctgtcagaagagtgcatgtgcccg

SEQ ID NO: 835732 - DNA, 25 bp, Mus musculus
tctgtcagagccagagccggcagta

SEQ ID NO: 835733 - DNA, 25 bp, Mus musculus
tctgtcagagcctgagccggcagta

SEQ ID NO: 835734 - DNA, 25 bp, Mus musculus
tctgtcagcacaaccaatggagtca

SEQ ID NO: 835735 - DNA, 25 bp, Mus musculus
tctgtcagcacatccaatggagtca

SEQ ID NO: 835736 - DNA, 25 bp, Mus musculus
tctgtcagcctcacgatcaatattt

SEQ ID NO: 835737 - DNA, 25 bp, Mus musculus
tctgtcagcctctcgatcaatattt

SEQ ID NO: 835738 - DNA, 25 bp, Mus musculus
tctgtcagcctgagcttgagaccag

SEQ ID NO: 835739 - DNA, 25 bp, Mus musculus
tctgtcagcctgtgcttgagaccag

SEQ ID NO: 835740 - DNA, 25 bp, Mus musculus
tctgtcagtacaagccccaactcag

SEQ ID NO: 835741 - DNA, 25 bp, Mus musculus
tctgtcagtacatgccccaactcag

SEQ ID NO: 835742 - DNA, 25 bp, Mus musculus
tctgtcagtgcaacgagaggctcgc

SEQ ID NO: 835743 - DNA, 25 bp, Mus musculus
tctgtcagtgcatcgagaggctcgc

SEQ ID NO: 835744 - DNA, 25 bp, Mus musculus
tctgtcatagagcagatgggcaaag

SEQ ID NO: 835745 - DNA, 25 bp, Mus musculus
tctgtcatagaggagatgggcaaag

SEQ ID NO: 835746 - DNA, 25 bp, Mus musculus
tctgtcatagccctggagcgtccaa

SEQ ID NO: 835747 - DNA, 25 bp, Mus musculus
tctgtcatagccgtggagcgtccaa

SEQ ID NO: 835748 - DNA, 25 bp, Mus musculus
tctgtcatctaacatgtctcccaaa

SEQ ID NO: 835749 - DNA, 25 bp, Mus musculus
tctgtcatctaagatgtctcccaaa

SEQ ID NO: 835750 - DNA, 25 bp, Mus musculus
tctgtcatctttattatccccataa

SEQ ID NO: 835751 - DNA, 25 bp, Mus musculus
tctgtcatctttcgtggactgccac

SEQ ID NO: 835752 - DNA, 25 bp, Mus musculus
tctgtcatctttggtggactgccac

SEQ ID NO: 835753 - DNA, 25 bp, Mus musculus
tctgtcatcttttttatccccataa

SEQ ID NO: 835754 - DNA, 25 bp, Mus musculus
tctgtcatgtgaaggagcctagaga

SEQ ID NO: 835755 - DNA, 25 bp, Mus musculus
tctgtcatgtgatggagcctagaga

SEQ ID NO: 835756 - DNA, 25 bp, Mus musculus
tctgtcattaaactcgggtacaaat

SEQ ID NO: 835757 - DNA, 25 bp, Mus musculus
tctgtcattaaagtcgggtacaaat

SEQ ID NO: 835758 - DNA, 25 bp, Mus musculus
tctgtcattgttagtggccctggag

SEQ ID NO: 835759 - DNA, 25 bp, Mus musculus
tctgtcattgtttgtggccctggag

SEQ ID NO: 835760 - DNA, 25 bp, Mus musculus
tctgtccaaagaaagcctgtcgttt

SEQ ID NO: 835761 - DNA, 25 bp, Mus musculus
tctgtccaaagatagcctgtcgttt

SEQ ID NO: 835762 - DNA, 25 bp, Mus musculus
tctgtccaaatgagttcacctccat

SEQ ID NO: 835763 - DNA, 25 bp, Mus musculus
tctgtccaaatgtgttcacctccat

SEQ ID NO: 835764 - DNA, 25 bp, Mus musculus
tctgtccaacatatcatctgtgtat

SEQ ID NO: 835765 - DNA, 25 bp, Mus musculus
tctgtccaacatttcatctgtgtat

SEQ ID NO: 835766 - DNA, 25 bp, Mus musculus
tctgtccaagacagttatcatgatg

SEQ ID NO: 835767 - DNA, 25 bp, Mus musculus
tctgtccaagactgttatcatgatg

SEQ ID NO: 835768 - DNA, 25 bp, Mus musculus
tctgtccaatgcctgaagactctgg

SEQ ID NO: 835769 - DNA, 25 bp, Mus musculus
tctgtccaatgcgtgaagactctgg

SEQ ID NO: 835770 - DNA, 25 bp, Mus musculus
tctgtccacaacagtctgctcatag

SEQ ID NO: 835771 - DNA, 25 bp, Mus musculus
tctgtccacaactgtctgctcatag

SEQ ID NO: 835772 - DNA, 25 bp, Mus musculus
tctgtccaccaaactaatccaggga

SEQ ID NO: 835773 - DNA, 25 bp, Mus musculus
tctgtccaccaatctaatccaggga

SEQ ID NO: 835774 - DNA, 25 bp, Mus musculus
tctgtccacgtactcatcgctgcgt

SEQ ID NO: 835775 - DNA, 25 bp, Mus musculus
tctgtccacgtagtcatcgctgcgt

SEQ ID NO: 835776 - DNA, 25 bp, Mus musculus
tctgtccacgtgcataccaatgctt

SEQ ID NO: 835777 - DNA, 25 bp, Mus musculus
tctgtccacgtggataccaatgctt

SEQ ID NO: 835778 - DNA, 25 bp, Mus musculus
tctgtccactgtatgcacacgaaca

SEQ ID NO: 835779 - DNA, 25 bp, Mus musculus
tctgtccactgtttgcacacgaaca

SEQ ID NO: 835780 - DNA, 25 bp, Mus musculus
tctgtccagctaccagagagaacat

SEQ ID NO: 835781 - DNA, 25 bp, Mus musculus
tctgtccagctagcagagagaacat

SEQ ID NO: 835782 - DNA, 25 bp, Mus musculus
tctgtccaggctaaggatttggtcc

SEQ ID NO: 835783 - DNA, 25 bp, Mus musculus
tctgtccaggcttaggatttggtcc

SEQ ID NO: 835784 - DNA, 25 bp, Mus musculus
tctgtccagggaagggctctacttt

SEQ ID NO: 835785 - DNA, 25 bp, Mus musculus
tctgtccagggatgggctctacttt

SEQ ID NO: 835786 - DNA, 25 bp, Mus musculus
tctgtccagggtaggcttttaggct

SEQ ID NO: 835787 - DNA, 25 bp, Mus musculus
tctgtccagggttggcttttaggct

SEQ ID NO: 835788 - DNA, 25 bp, Mus musculus
tctgtccaggtcaattccgtcaaat

SEQ ID NO: 835789 - DNA, 25 bp, Mus musculus
tctgtccaggtctattccgtcaaat

SEQ ID NO: 835790 - DNA, 25 bp, Mus musculus
tctgtccatatgattctctcataag

SEQ ID NO: 835791 - DNA, 25 bp, Mus musculus
tctgtccatatgtttctctcataag

SEQ ID NO: 835792 - DNA, 25 bp, Mus musculus
tctgtccatgaacctcagtaggtgg

SEQ ID NO: 835793 - DNA, 25 bp, Mus musculus
tctgtccatgaagctcagtaggtgg

SEQ ID NO: 835794 - DNA, 25 bp, Mus musculus
tctgtcccaagcagacatccctaag

SEQ ID NO: 835795 - DNA, 25 bp, Mus musculus
tctgtcccaagctgacatccctaag

SEQ ID NO: 835796 - DNA, 25 bp, Mus musculus
tctgtcccagatccccaagtgtcta

SEQ ID NO: 835797 - DNA, 25 bp, Mus musculus
tctgtcccagatgcccaagtgtcta

SEQ ID NO: 835798 - DNA, 25 bp, Mus musculus
tctgtcccatctcagtttgcaaaaa

SEQ ID NO: 835799 - DNA, 25 bp, Mus musculus
tctgtcccatctgagtttgcaaaaa

SEQ ID NO: 835800 - DNA, 25 bp, Mus musculus
tctgtcccattgaccacagtatatt

SEQ ID NO: 835801 - DNA, 25 bp, Mus musculus
tctgtcccattgtccacagtatatt

SEQ ID NO: 835802 - DNA, 25 bp, Mus musculus
tctgtccccagaaccaacgtaaaag

SEQ ID NO: 835803 - DNA, 25 bp, Mus musculus
tctgtccccagatccaacgtaaaag

SEQ ID NO: 835804 - DNA, 25 bp, Mus musculus
tctgtccccgagcaggctgaaagca

SEQ ID NO: 835805 - DNA, 25 bp, Mus musculus
tctgtccccgaggaggctgaaagca

SEQ ID NO: 835806 - DNA, 25 bp, Mus musculus
tctgtccccttaattggttagtcct

SEQ ID NO: 835807 - DNA, 25 bp, Mus musculus
tctgtccccttatttggttagtcct

SEQ ID NO: 835808 - DNA, 25 bp, Mus musculus
tctgtcccggcaaaacaccatttga

SEQ ID NO: 835809 - DNA, 25 bp, Mus musculus
tctgtcccggcataacaccatttga

SEQ ID NO: 835810 - DNA, 25 bp, Mus musculus
tctgtcccgtctctggcagaggttt

SEQ ID NO: 835811 - DNA, 25 bp, Mus musculus
tctgtcccgtctgtggcagaggttt

SEQ ID NO: 835812 - DNA, 25 bp, Mus musculus
tctgtcccgtgtcatgggtctcagc

SEQ ID NO: 835813 - DNA, 25 bp, Mus musculus
tctgtcccgtgtgatgggtctcagc

SEQ ID NO: 835814 - DNA, 25 bp, Mus musculus
tctgtccctaagctcatatggttct

SEQ ID NO: 835815 - DNA, 25 bp, Mus musculus
tctgtccctaaggtcatatggttct

SEQ ID NO: 835816 - DNA, 25 bp, Mus musculus
tctgtccctacaactgtgtgacttt

SEQ ID NO: 835817 - DNA, 25 bp, Mus musculus
tctgtccctacatctgtgtgacttt

SEQ ID NO: 835818 - DNA, 25 bp, Mus musculus
tctgtccctaccatggacaccaggt

SEQ ID NO: 835819 - DNA, 25 bp, Mus musculus
tctgtccctaccttggacaccaggt

SEQ ID NO: 835820 - DNA, 25 bp, Mus musculus
tctgtccctaggaggctgaacactg

SEQ ID NO: 835821 - DNA, 25 bp, Mus musculus
tctgtccctaggtggctgaacactg

SEQ ID NO: 835822 - DNA, 25 bp, Mus musculus
tctgtccctcatacagacctagagg

SEQ ID NO: 835823 - DNA, 25 bp, Mus musculus
tctgtccctcattcagacctagagg

SEQ ID NO: 835824 - DNA, 25 bp, Mus musculus
tctgtccctgggatggaactgttgc

SEQ ID NO: 835825 - DNA, 25 bp, Mus musculus
tctgtccctgggttggaactgttgc

SEQ ID NO: 835826 - DNA, 25 bp, Mus musculus
tctgtccctgtcatgaagtttacag

SEQ ID NO: 835827 - DNA, 25 bp, Mus musculus
tctgtccctgtcttgaagtttacag

SEQ ID NO: 835828 - DNA, 25 bp, Mus musculus
tctgtcccttatcgtgtggtaaccc

SEQ ID NO: 835829 - DNA, 25 bp, Mus musculus
tctgtcccttatggtgtggtaaccc

SEQ ID NO: 835830 - DNA, 25 bp, Mus musculus
tctgtcccttggcaggttcctgaga

SEQ ID NO: 835831 - DNA, 25 bp, Mus musculus
tctgtcccttgggaggttcctgaga

SEQ ID NO: 835832 - DNA, 25 bp, Mus musculus
tctgtccctttgagccatctaacaa

SEQ ID NO: 835833 - DNA, 25 bp, Mus musculus
tctgtccctttgtgccatctaacaa

SEQ ID NO: 835834 - DNA, 25 bp, Mus musculus
tctgtccgattacctgccttaaaac

SEQ ID NO: 835835 - DNA, 25 bp, Mus musculus
tctgtccgattagctgccttaaaac

SEQ ID NO: 835836 - DNA, 25 bp, Mus musculus
tctgtccgcacacatacttaagtgt

SEQ ID NO: 835837 - DNA, 25 bp, Mus musculus
tctgtccgcacagatacttaagtgt

SEQ ID NO: 835838 - DNA, 25 bp, Mus musculus
tctgtccgcaccatgctaagattag

SEQ ID NO: 835839 - DNA, 25 bp, Mus musculus
tctgtccgcaccttgctaagattag

SEQ ID NO: 835840 - DNA, 25 bp, Mus musculus
tctgtccggagcagacaaccgatga

SEQ ID NO: 835841 - DNA, 25 bp, Mus musculus
tctgtccggagctgacaaccgatga

SEQ ID NO: 835842 - DNA, 25 bp, Mus musculus
tctgtccggccactgtctgttcagg

SEQ ID NO: 835843 - DNA, 25 bp, Mus musculus
tctgtccggccagtgtctgttcagg

SEQ ID NO: 835844 - DNA, 25 bp, Mus musculus
tctgtccgtttgccggtcgtgggcg

SEQ ID NO: 835845 - DNA, 25 bp, Mus musculus
tctgtccgtttggcggtcgtgggcg

SEQ ID NO: 835846 - DNA, 25 bp, Mus musculus
tctgtcctacatcccgtatgcaagg

SEQ ID NO: 835847 - DNA, 25 bp, Mus musculus
tctgtcctacatgccgtatgcaagg

SEQ ID NO: 835848 - DNA, 25 bp, Mus musculus
tctgtcctagtcagagtataccctg

SEQ ID NO: 835849 - DNA, 25 bp, Mus musculus
tctgtcctagtctgagtataccctg

SEQ ID NO: 835850 - DNA, 25 bp, Mus musculus
tctgtcctcaagcttgcagttctaa

SEQ ID NO: 835851 - DNA, 25 bp, Mus musculus
tctgtcctcaaggttgcagttctaa

SEQ ID NO: 835852 - DNA, 25 bp, Mus musculus
tctgtcctcagaaataccagaaaag

SEQ ID NO: 835853 - DNA, 25 bp, Mus musculus
tctgtcctcagatataccagaaaag

SEQ ID NO: 835854 - DNA, 25 bp, Mus musculus
tctgtcctcatgagggcatttaaga

SEQ ID NO: 835855 - DNA, 25 bp, Mus musculus
tctgtcctcatgtgggcatttaaga

SEQ ID NO: 835856 - DNA, 25 bp, Mus musculus
tctgtcctccgtcgtaacagtggga

SEQ ID NO: 835857 - DNA, 25 bp, Mus musculus
tctgtcctccgtggtaacagtggga

SEQ ID NO: 835858 - DNA, 25 bp, Mus musculus
tctgtcctcctcaagaacattgcta

SEQ ID NO: 835859 - DNA, 25 bp, Mus musculus
tctgtcctcctctagaacattgcta

SEQ ID NO: 835860 - DNA, 25 bp, Mus musculus
tctgtcctgagtaatgtgactgacc

SEQ ID NO: 835861 - DNA, 25 bp, Mus musculus
tctgtcctgagttatgtgactgacc

SEQ ID NO: 835862 - DNA, 25 bp, Mus musculus
tctgtcctgcaaatcgctgtgtgaa

SEQ ID NO: 835863 - DNA, 25 bp, Mus musculus
tctgtcctgcaattcgctgtgtgaa

SEQ ID NO: 835864 - DNA, 25 bp, Mus musculus
tctgtcctgggcacatgactgatat

SEQ ID NO: 835865 - DNA, 25 bp, Mus musculus
tctgtcctgggctcatgactgatat

SEQ ID NO: 835866 - DNA, 25 bp, Mus musculus
tctgtcctggtgcactatattgttc

SEQ ID NO: 835867 - DNA, 25 bp, Mus musculus
tctgtcctggtggactatattgttc

SEQ ID NO: 835868 - DNA, 25 bp, Mus musculus
tctgtcctggttcgtcttttgtcaa

SEQ ID NO: 835869 - DNA, 25 bp, Mus musculus
tctgtcctggttggtcttttgtcaa

SEQ ID NO: 835870 - DNA, 25 bp, Mus musculus
tctgtcctgtaacctgatgtctcaa

SEQ ID NO: 835871 - DNA, 25 bp, Mus musculus
tctgtcctgtaagctgatgtctcaa

SEQ ID NO: 835872 - DNA, 25 bp, Mus musculus
tctgtccttgaaagagtcccctgtg

SEQ ID NO: 835873 - DNA, 25 bp, Mus musculus
tctgtccttgaatgagtcccctgtg

SEQ ID NO: 835874 - DNA, 25 bp, Mus musculus
tctgtcgacagaatgagtacggtgt

SEQ ID NO: 835875 - DNA, 25 bp, Mus musculus
tctgtcgacagattgagtacggtgt

SEQ ID NO: 835876 - DNA, 25 bp, Mus musculus
tctgtcgagaacactgttccgacgt

SEQ ID NO: 835877 - DNA, 25 bp, Mus musculus
tctgtcgagaactctgttccgacgt

SEQ ID NO: 835878 - DNA, 25 bp, Mus musculus
tctgtcgagagaattcatatgctta

SEQ ID NO: 835879 - DNA, 25 bp, Mus musculus
tctgtcgagagatttcatatgctta

SEQ ID NO: 835880 - DNA, 25 bp, Mus musculus
tctgtcgccacaccagtttccaatg

SEQ ID NO: 835881 - DNA, 25 bp, Mus musculus
tctgtcgccacagcagtttccaatg

SEQ ID NO: 835882 - DNA, 25 bp, Mus musculus
tctgtcgctaggaagcaggcaaccg

SEQ ID NO: 835883 - DNA, 25 bp, Mus musculus
tctgtcgctaggtagcaggcaaccg

SEQ ID NO: 835884 - DNA, 25 bp, Mus musculus
tctgtcggcgggagatcaccagggt

SEQ ID NO: 835885 - DNA, 25 bp, Mus musculus
tctgtcggcgggtgatcaccagggt

SEQ ID NO: 835886 - DNA, 25 bp, Mus musculus
tctgtcgggttaactttttctcttt

SEQ ID NO: 835887 - DNA, 25 bp, Mus musculus
tctgtcgggttatctttttctcttt

SEQ ID NO: 835888 - DNA, 25 bp, Mus musculus
tctgtcggtgaacagatgcctttgt

SEQ ID NO: 835889 - DNA, 25 bp, Mus musculus
tctgtcggtgaagagatgcctttgt

SEQ ID NO: 835890 - DNA, 25 bp, Mus musculus
tctgtcggtgttacagtcagggaca

SEQ ID NO: 835891 - DNA, 25 bp, Mus musculus
tctgtcggtgtttcagtcagggaca

SEQ ID NO: 835892 - DNA, 25 bp, Mus musculus
tctgtcggttcacctgcactgtcag

SEQ ID NO: 835893 - DNA, 25 bp, Mus musculus
tctgtcggttcagctgcactgtcag

SEQ ID NO: 835894 - DNA, 25 bp, Mus musculus
tctgtcggttcccagtccatcaggg

SEQ ID NO: 835895 - DNA, 25 bp, Mus musculus
tctgtcggttccgagtccatcaggg

SEQ ID NO: 835896 - DNA, 25 bp, Mus musculus
tctgtcggtttgcaaaagtaatgaa

SEQ ID NO: 835897 - DNA, 25 bp, Mus musculus
tctgtcggtttggaaaagtaatgaa

SEQ ID NO: 835898 - DNA, 25 bp, Mus musculus
tctgtcgtcgtgattctttattact

SEQ ID NO: 835899 - DNA, 25 bp, Mus musculus
tctgtcgtcgtgtttctttattact

SEQ ID NO: 835900 - DNA, 25 bp, Mus musculus
tctgtcgtctgtattaagtccttcc

SEQ ID NO: 835901 - DNA, 25 bp, Mus musculus
tctgtcgtctgttttaagtccttcc

SEQ ID NO: 835902 - DNA, 25 bp, Mus musculus
tctgtcgttcacacggtgtgattta

SEQ ID NO: 835903 - DNA, 25 bp, Mus musculus
tctgtcgttcactcggtgtgattta

SEQ ID NO: 835904 - DNA, 25 bp, Mus musculus
tctgtctaactcattccggaattct

SEQ ID NO: 835905 - DNA, 25 bp, Mus musculus
tctgtctaactctttccggaattct

SEQ ID NO: 835906 - DNA, 25 bp, Mus musculus
tctgtctaagaaagatgtgttgtga

SEQ ID NO: 835907 - DNA, 25 bp, Mus musculus
tctgtctaagaatgatgtgttgtga

SEQ ID NO: 835908 - DNA, 25 bp, Mus musculus
tctgtctacacaccattagctgtca

SEQ ID NO: 835909 - DNA, 25 bp, Mus musculus
tctgtctacacagcattagctgtca

SEQ ID NO: 835910 - DNA, 25 bp, Mus musculus
tctgtctactcacagatctgcaaat

SEQ ID NO: 835911 - DNA, 25 bp, Mus musculus
tctgtctactcagagatctgcaaat

SEQ ID NO: 835912 - DNA, 25 bp, Mus musculus
tctgtctagaggacatctggcctac

SEQ ID NO: 835913 - DNA, 25 bp, Mus musculus
tctgtctagaggtcatctggcctac

SEQ ID NO: 835914 - DNA, 25 bp, Mus musculus
tctgtctagcccattgggtcacagg

SEQ ID NO: 835915 - DNA, 25 bp, Mus musculus
tctgtctagccctttgggtcacagg

SEQ ID NO: 835916 - DNA, 25 bp, Mus musculus
tctgtctagtctacccggtcctttt

SEQ ID NO: 835917 - DNA, 25 bp, Mus musculus
tctgtctagtcttcccggtcctttt

SEQ ID NO: 835918 - DNA, 25 bp, Mus musculus
tctgtctatctcagtggcgttcagc

SEQ ID NO: 835919 - DNA, 25 bp, Mus musculus
tctgtctatctctgtggcgttcagc

SEQ ID NO: 835920 - DNA, 25 bp, Mus musculus
tctgtctatgaaaacctttttgaac

SEQ ID NO: 835921 - DNA, 25 bp, Mus musculus
tctgtctatgaatacctttttgaac

SEQ ID NO: 835922 - DNA, 25 bp, Mus musculus
tctgtctatggacatttcttgactc

SEQ ID NO: 835923 - DNA, 25 bp, Mus musculus
tctgtctatggagatttcttgactc

SEQ ID NO: 835924 - DNA, 25 bp, Mus musculus
tctgtctcacataggctgtaagctc

SEQ ID NO: 835925 - DNA, 25 bp, Mus musculus
tctgtctcacattggctgtaagctc

SEQ ID NO: 835926 - DNA, 25 bp, Mus musculus
tctgtctcaggactgcatttattgc

SEQ ID NO: 835927 - DNA, 25 bp, Mus musculus
tctgtctcaggagtgcatttattgc

SEQ ID NO: 835928 - DNA, 25 bp, Mus musculus
tctgtctcatcgctcactagcggca

SEQ ID NO: 835929 - DNA, 25 bp, Mus musculus
tctgtctcatcggtcactagcggca

SEQ ID NO: 835930 - DNA, 25 bp, Mus musculus
tctgtctcctccagagtctatggga

SEQ ID NO: 835931 - DNA, 25 bp, Mus musculus
tctgtctcctcctgagtctatggga

SEQ ID NO: 835932 - DNA, 25 bp, Mus musculus
tctgtctcctgaaatagtttgcacc

SEQ ID NO: 835933 - DNA, 25 bp, Mus musculus
tctgtctcctgatatagtttgcacc

SEQ ID NO: 835934 - DNA, 25 bp, Mus musculus
tctgtctccttaccctgaaggcagg

SEQ ID NO: 835935 - DNA, 25 bp, Mus musculus
tctgtctccttagcctgaaggcagg

SEQ ID NO: 835936 - DNA, 25 bp, Mus musculus
tctgtctcctttcccgttcatattt

SEQ ID NO: 835937 - DNA, 25 bp, Mus musculus
tctgtctcctttgccgttcatattt

SEQ ID NO: 835938 - DNA, 25 bp, Mus musculus
tctgtctcgactactccataaactt

SEQ ID NO: 835939 - DNA, 25 bp, Mus musculus
tctgtctcgacttctccataaactt

SEQ ID NO: 835940 - DNA, 25 bp, Mus musculus
tctgtctcgtgtctcttcctgtaaa

SEQ ID NO: 835941 - DNA, 25 bp, Mus musculus
tctgtctcgtgtgtcttcctgtaaa

SEQ ID NO: 835942 - DNA, 25 bp, Mus musculus
tctgtctcgttcagttaacccaaac

SEQ ID NO: 835943 - DNA, 25 bp, Mus musculus
tctgtctcgttctgttaacccaaac

SEQ ID NO: 835944 - DNA, 25 bp, Mus musculus
tctgtctctacaaggatggactgaa

SEQ ID NO: 835945 - DNA, 25 bp, Mus musculus
tctgtctctacatggatggactgaa

SEQ ID NO: 835946 - DNA, 25 bp, Mus musculus
tctgtctctaccaatgaggtgctga

SEQ ID NO: 835947 - DNA, 25 bp, Mus musculus
tctgtctctacctatgaggtgctga

SEQ ID NO: 835948 - DNA, 25 bp, Mus musculus
tctgtctctatgcaccagctctgga

SEQ ID NO: 835949 - DNA, 25 bp, Mus musculus
tctgtctctatggaccagctctgga

SEQ ID NO: 835950 - DNA, 25 bp, Mus musculus
tctgtctctattacgcaatgttccg

SEQ ID NO: 835951 - DNA, 25 bp, Mus musculus
tctgtctctatttcgcaatgttccg

SEQ ID NO: 835952 - DNA, 25 bp, Mus musculus
tctgtctctcaaagctttctggtaa

SEQ ID NO: 835953 - DNA, 25 bp, Mus musculus
tctgtctctcaatgctttctggtaa

SEQ ID NO: 835954 - DNA, 25 bp, Mus musculus
tctgtctctcagaagactgggtctt

SEQ ID NO: 835955 - DNA, 25 bp, Mus musculus
tctgtctctcagtagactgggtctt

SEQ ID NO: 835956 - DNA, 25 bp, Mus musculus
tctgtctctctcaatagcaaaggtc

SEQ ID NO: 835957 - DNA, 25 bp, Mus musculus
tctgtctctctcatgattaaccatt

SEQ ID NO: 835958 - DNA, 25 bp, Mus musculus
tctgtctctctctatagcaaaggtc

SEQ ID NO: 835959 - DNA, 25 bp, Mus musculus
tctgtctctctcttgattaaccatt

SEQ ID NO: 835960 - DNA, 25 bp, Mus musculus
tctgtctctgcaaagagagaggtga

SEQ ID NO: 835961 - DNA, 25 bp, Mus musculus
tctgtctctgcatagagagaggtga

SEQ ID NO: 835962 - DNA, 25 bp, Mus musculus
tctgtctctgggatgataaaggctc

SEQ ID NO: 835963 - DNA, 25 bp, Mus musculus
tctgtctctgggttgataaaggctc

SEQ ID NO: 835964 - DNA, 25 bp, Mus musculus
tctgtctctgtaccgtcgtgcggca

SEQ ID NO: 835965 - DNA, 25 bp, Mus musculus
tctgtctctgtagcgtcgtgcggca

SEQ ID NO: 835966 - DNA, 25 bp, Mus musculus
tctgtctctgttaatgtcttgctca

SEQ ID NO: 835967 - DNA, 25 bp, Mus musculus
tctgtctctgtttatgtcttgctca

SEQ ID NO: 835968 - DNA, 25 bp, Mus musculus
tctgtctcttcaacacatggtacac

SEQ ID NO: 835969 - DNA, 25 bp, Mus musculus
tctgtctcttcatcacatggtacac

SEQ ID NO: 835970 - DNA, 25 bp, Mus musculus
tctgtctcttgtctcaccagaagac

SEQ ID NO: 835971 - DNA, 25 bp, Mus musculus
tctgtctcttgtgtcaccagaagac

SEQ ID NO: 835972 - DNA, 25 bp, Mus musculus
tctgtctctttgcacttttcttggt

SEQ ID NO: 835973 - DNA, 25 bp, Mus musculus
tctgtctctttggacttttcttggt

SEQ ID NO: 835974 - DNA, 25 bp, Mus musculus
tctgtctgaactcactccgaagcag

SEQ ID NO: 835975 - DNA, 25 bp, Mus musculus
tctgtctgaactgactccgaagcag

SEQ ID NO: 835976 - DNA, 25 bp, Mus musculus
tctgtctgaagccaacgcgttgaat

SEQ ID NO: 835977 - DNA, 25 bp, Mus musculus
tctgtctgaagcgaacgcgttgaat

SEQ ID NO: 835978 - DNA, 25 bp, Mus musculus
tctgtctgactgacctgtgtgcccg

SEQ ID NO: 835979 - DNA, 25 bp, Mus musculus
tctgtctgactgtcctgtgtgcccg

SEQ ID NO: 835980 - DNA, 25 bp, Mus musculus
tctgtctgccagacattagtgctga

SEQ ID NO: 835981 - DNA, 25 bp, Mus musculus
tctgtctgccagtcattagtgctga

SEQ ID NO: 835982 - DNA, 25 bp, Mus musculus
tctgtctgcgacatcattgggtgtt

SEQ ID NO: 835983 - DNA, 25 bp, Mus musculus
tctgtctgcgacttcattgggtgtt

SEQ ID NO: 835984 - DNA, 25 bp, Mus musculus
tctgtctgcgccagttacaaagtga

SEQ ID NO: 835985 - DNA, 25 bp, Mus musculus
tctgtctgcgcctgttacaaagtga

SEQ ID NO: 835986 - DNA, 25 bp, Mus musculus
tctgtctgctccaagcctaatggac

SEQ ID NO: 835987 - DNA, 25 bp, Mus musculus
tctgtctgctcctagcctaatggac

SEQ ID NO: 835988 - DNA, 25 bp, Mus musculus
tctgtctggatgaggagctaaaggt

SEQ ID NO: 835989 - DNA, 25 bp, Mus musculus
tctgtctggatgtggagctaaaggt

SEQ ID NO: 835990 - DNA, 25 bp, Mus musculus
tctgtctggcggagagtatgtctgc

SEQ ID NO: 835991 - DNA, 25 bp, Mus musculus
tctgtctggcggtgagtatgtctgc

SEQ ID NO: 835992 - DNA, 25 bp, Mus musculus
tctgtctgggaactttacctacttc

SEQ ID NO: 835993 - DNA, 25 bp, Mus musculus
tctgtctgggaagtttacctacttc

SEQ ID NO: 835994 - DNA, 25 bp, Mus musculus
tctgtctgggttaagctgagaaagt

SEQ ID NO: 835995 - DNA, 25 bp, Mus musculus
tctgtctgggtttagctgagaaagt

SEQ ID NO: 835996 - DNA, 25 bp, Mus musculus
tctgtctgtacgcacatgggcagcc

SEQ ID NO: 835997 - DNA, 25 bp, Mus musculus
tctgtctgtacggacatgggcagcc

SEQ ID NO: 835998 - DNA, 25 bp, Mus musculus
tctgtctgtaggcagctatgggaca

SEQ ID NO: 835999 - DNA, 25 bp, Mus musculus
tctgtctgtagggagctatgggaca

SEQ ID NO: 836000 - DNA, 25 bp, Mus musculus
tctgtctgtcacattctatctgcca

SEQ ID NO: 836001 - DNA, 25 bp, Mus musculus
tctgtctgtcactttctatctgcca

SEQ ID NO: 836002 - DNA, 25 bp, Mus musculus
tctgtctgtccactcggtgctgaga

SEQ ID NO: 836003 - DNA, 25 bp, Mus musculus
tctgtctgtccagtcggtgctgaga

SEQ ID NO: 836004 - DNA, 25 bp, Mus musculus
tctgtctgtcctccaccagtgtgtt

SEQ ID NO: 836005 - DNA, 25 bp, Mus musculus
tctgtctgtcctgcaccagtgtgtt

SEQ ID NO: 836006 - DNA, 25 bp, Mus musculus
tctgtctgtcggacttttttctttc

SEQ ID NO: 836007 - DNA, 25 bp, Mus musculus
tctgtctgtcggtcttttttctttc

SEQ ID NO: 836008 - DNA, 25 bp, Mus musculus
tctgtctgtctacctagctagctat

SEQ ID NO: 836009 - DNA, 25 bp, Mus musculus
tctgtctgtctagctagctagctat

SEQ ID NO: 836010 - DNA, 25 bp, Mus musculus
tctgtctgtgacagcggcaggccta

SEQ ID NO: 836011 - DNA, 25 bp, Mus musculus
tctgtctgtgacataatgtaactgt

SEQ ID NO: 836012 - DNA, 25 bp, Mus musculus
tctgtctgtgactgcggcaggccta

SEQ ID NO: 836013 - DNA, 25 bp, Mus musculus
tctgtctgtgacttaatgtaactgt

SEQ ID NO: 836014 - DNA, 25 bp, Mus musculus
tctgtctgtgagagctgatgctttt

SEQ ID NO: 836015 - DNA, 25 bp, Mus musculus
tctgtctgtgagtgctgatgctttt

SEQ ID NO: 836016 - DNA, 25 bp, Mus musculus
tctgtctgttccataccattgggta

SEQ ID NO: 836017 - DNA, 25 bp, Mus musculus
tctgtctgttccttaccattgggta

SEQ ID NO: 836018 - DNA, 25 bp, Mus musculus
tctgtctgtttcactttcgtcctca

SEQ ID NO: 836019 - DNA, 25 bp, Mus musculus
tctgtctgtttctctttcgtcctca

SEQ ID NO: 836020 - DNA, 25 bp, Mus musculus
tctgtcttagtgaaactgcctctgc

SEQ ID NO: 836021 - DNA, 25 bp, Mus musculus
tctgtcttagtgtaactgcctctgc

SEQ ID NO: 836022 - DNA, 25 bp, Mus musculus
tctgtcttcagaaactaaaggaggg

SEQ ID NO: 836023 - DNA, 25 bp, Mus musculus
tctgtcttcagatactaaaggaggg

SEQ ID NO: 836024 - DNA, 25 bp, Mus musculus
tctgtcttcatgacaggctgtgtac

SEQ ID NO: 836025 - DNA, 25 bp, Mus musculus
tctgtcttcatgtcaggctgtgtac

SEQ ID NO: 836026 - DNA, 25 bp, Mus musculus
tctgtcttccagaccaatttggtaa

SEQ ID NO: 836027 - DNA, 25 bp, Mus musculus
tctgtcttccagtccaatttggtaa

SEQ ID NO: 836028 - DNA, 25 bp, Mus musculus
tctgtcttcgcgagtttctttttct

SEQ ID NO: 836029 - DNA, 25 bp, Mus musculus
tctgtcttcgcgtgtttctttttct

SEQ ID NO: 836030 - DNA, 25 bp, Mus musculus
tctgtcttcggactttcagtgtgaa

SEQ ID NO: 836031 - DNA, 25 bp, Mus musculus
tctgtcttcggagtttcagtgtgaa

SEQ ID NO: 836032 - DNA, 25 bp, Mus musculus
tctgtcttgatcagtgcattaagaa

SEQ ID NO: 836033 - DNA, 25 bp, Mus musculus
tctgtcttgatctgtgcattaagaa

SEQ ID NO: 836034 - DNA, 25 bp, Mus musculus
tctgtcttggtgcttactgttccta

SEQ ID NO: 836035 - DNA, 25 bp, Mus musculus
tctgtcttggtggttactgttccta

SEQ ID NO: 836036 - DNA, 25 bp, Mus musculus
tctgtctttagtccttttggtataa

SEQ ID NO: 836037 - DNA, 25 bp, Mus musculus
tctgtctttagtgcttttggtataa

SEQ ID NO: 836038 - DNA, 25 bp, Mus musculus
tctgtctttcaacagctgggatggc

SEQ ID NO: 836039 - DNA, 25 bp, Mus musculus
tctgtctttcaagagctgggatggc

SEQ ID NO: 836040 - DNA, 25 bp, Mus musculus
tctgtctttctccatcagtctgaaa

SEQ ID NO: 836041 - DNA, 25 bp, Mus musculus
tctgtctttctcgatcagtctgaaa

SEQ ID NO: 836042 - DNA, 25 bp, Mus musculus
tctgtctttcttaatgtatgtgttt

SEQ ID NO: 836043 - DNA, 25 bp, Mus musculus
tctgtctttctttatgtatgtgttt

SEQ ID NO: 836044 - DNA, 25 bp, Mus musculus
tctgtcttttgtaagactgtgggct

SEQ ID NO: 836045 - DNA, 25 bp, Mus musculus
tctgtcttttgttagactgtgggct

SEQ ID NO: 836046 - DNA, 25 bp, Mus musculus
tctgtctttttaaagtaagcttcct

SEQ ID NO: 836047 - DNA, 25 bp, Mus musculus
tctgtctttttatagtaagcttcct

SEQ ID NO: 836048 - DNA, 25 bp, Mus musculus
tctgtgaaaacaaccggccattccg

SEQ ID NO: 836049 - DNA, 25 bp, Mus musculus
tctgtgaaaacatccggccattccg

SEQ ID NO: 836050 - DNA, 25 bp, Mus musculus
tctgtgaaacagaaagttcctccaa

SEQ ID NO: 836051 - DNA, 25 bp, Mus musculus
tctgtgaaacagtaagttcctccaa

SEQ ID NO: 836052 - DNA, 25 bp, Mus musculus
tctgtgaacatcatatatcctgtta

SEQ ID NO: 836053 - DNA, 25 bp, Mus musculus
tctgtgaacatcttatatcctgtta

SEQ ID NO: 836054 - DNA, 25 bp, Mus musculus
tctgtgaacatgaccttgggatatt

SEQ ID NO: 836055 - DNA, 25 bp, Mus musculus
tctgtgaacatgtccttgggatatt

SEQ ID NO: 836056 - DNA, 25 bp, Mus musculus
tctgtgaaccatacccctttaaact

SEQ ID NO: 836057 - DNA, 25 bp, Mus musculus
tctgtgaaccattcccctttaaact

SEQ ID NO: 836058 - DNA, 25 bp, Mus musculus
tctgtgaaccctagaccccactgat

SEQ ID NO: 836059 - DNA, 25 bp, Mus musculus
tctgtgaacccttgaccccactgat

SEQ ID NO: 836060 - DNA, 25 bp, Mus musculus
tctgtgaaccttctcagcggagcgt

SEQ ID NO: 836061 - DNA, 25 bp, Mus musculus
tctgtgaaccttgtcagcggagcgt

SEQ ID NO: 836062 - DNA, 25 bp, Mus musculus
tctgtgaagacgaaaggacacttga

SEQ ID NO: 836063 - DNA, 25 bp, Mus musculus
tctgtgaagacgtaaggacacttga

SEQ ID NO: 836064 - DNA, 25 bp, Mus musculus
tctgtgaaggaacgcccttccctag

SEQ ID NO: 836065 - DNA, 25 bp, Mus musculus
tctgtgaaggaaggcccttccctag

SEQ ID NO: 836066 - DNA, 25 bp, Mus musculus
tctgtgaagtggcttttctgaagct

SEQ ID NO: 836067 - DNA, 25 bp, Mus musculus
tctgtgaagtgggttttctgaagct

SEQ ID NO: 836068 - DNA, 25 bp, Mus musculus
tctgtgaatttgcactcatgtactg

SEQ ID NO: 836069 - DNA, 25 bp, Mus musculus
tctgtgaatttggactcatgtactg

SEQ ID NO: 836070 - DNA, 25 bp, Mus musculus
tctgtgacaatgaccgtgttactgt

SEQ ID NO: 836071 - DNA, 25 bp, Mus musculus
tctgtgacaatgtccgtgttactgt

SEQ ID NO: 836072 - DNA, 25 bp, Mus musculus
tctgtgacaattatagcctattctg

SEQ ID NO: 836073 - DNA, 25 bp, Mus musculus
tctgtgacaattttagcctattctg

SEQ ID NO: 836074 - DNA, 25 bp, Mus musculus
tctgtgacacagctctggccaagca

SEQ ID NO: 836075 - DNA, 25 bp, Mus musculus
tctgtgacacaggtctggccaagca

SEQ ID NO: 836076 - DNA, 25 bp, Mus musculus
tctgtgaccaaccatgcaggctaag

SEQ ID NO: 836077 - DNA, 25 bp, Mus musculus
tctgtgaccaacgatgcaggctaag

SEQ ID NO: 836078 - DNA, 25 bp, Mus musculus
tctgtgaccctcagagtacactgca

SEQ ID NO: 836079 - DNA, 25 bp, Mus musculus
tctgtgaccctctgagtacactgca

SEQ ID NO: 836080 - DNA, 25 bp, Mus musculus
tctgtgacccttagcaactcaaggg

SEQ ID NO: 836081 - DNA, 25 bp, Mus musculus
tctgtgaccctttgcaactcaaggg

SEQ ID NO: 836082 - DNA, 25 bp, Mus musculus
tctgtgacctagcatttagagacta

SEQ ID NO: 836083 - DNA, 25 bp, Mus musculus
tctgtgacctaggatttagagacta

SEQ ID NO: 836084 - DNA, 25 bp, Mus musculus
tctgtgacctccaatcccagtgtgg

SEQ ID NO: 836085 - DNA, 25 bp, Mus musculus
tctgtgacctcctatcccagtgtgg

SEQ ID NO: 836086 - DNA, 25 bp, Mus musculus
tctgtgacctctatgccttaaacgg

SEQ ID NO: 836087 - DNA, 25 bp, Mus musculus
tctgtgacctctttgccttaaacgg

SEQ ID NO: 836088 - DNA, 25 bp, Mus musculus
tctgtgacctggagacctttgaaga

SEQ ID NO: 836089 - DNA, 25 bp, Mus musculus
tctgtgacctggcagcctagggaca

SEQ ID NO: 836090 - DNA, 25 bp, Mus musculus
tctgtgacctgggagcctagggaca

SEQ ID NO: 836091 - DNA, 25 bp, Mus musculus
tctgtgacctggtgacctttgaaga

SEQ ID NO: 836092 - DNA, 25 bp, Mus musculus
tctgtgacctgtctattggcccact

SEQ ID NO: 836093 - DNA, 25 bp, Mus musculus
tctgtgacctgtgtattggcccact

SEQ ID NO: 836094 - DNA, 25 bp, Mus musculus
tctgtgaccttgctccagcagacag

SEQ ID NO: 836095 - DNA, 25 bp, Mus musculus
tctgtgaccttggtccagcagacag

SEQ ID NO: 836096 - DNA, 25 bp, Mus musculus
tctgtgacgtatcgaacccataata

SEQ ID NO: 836097 - DNA, 25 bp, Mus musculus
tctgtgacgtatggaacccataata

SEQ ID NO: 836098 - DNA, 25 bp, Mus musculus
tctgtgactcgcatagctgaaacct

SEQ ID NO: 836099 - DNA, 25 bp, Mus musculus
tctgtgactcgcttagctgaaacct

SEQ ID NO: 836100 - DNA, 25 bp, Mus musculus
tctgtgactctgattccatgtcagc

SEQ ID NO: 836101 - DNA, 25 bp, Mus musculus
tctgtgactctgtttccatgtcagc

SEQ ID NO: 836102 - DNA, 25 bp, Mus musculus
tctgtgactgagcatgctgccataa

SEQ ID NO: 836103 - DNA, 25 bp, Mus musculus
tctgtgactgaggatgctgccataa

SEQ ID NO: 836104 - DNA, 25 bp, Mus musculus
tctgtgactgcgaaccttttgtata

SEQ ID NO: 836105 - DNA, 25 bp, Mus musculus
tctgtgactgcgtaccttttgtata

SEQ ID NO: 836106 - DNA, 25 bp, Mus musculus
tctgtgacttctagactaatatttt

SEQ ID NO: 836107 - DNA, 25 bp, Mus musculus
tctgtgacttcttgactaatatttt

SEQ ID NO: 836108 - DNA, 25 bp, Mus musculus
tctgtgagaccaacttccaatattt

SEQ ID NO: 836109 - DNA, 25 bp, Mus musculus
tctgtgagaccatcttccaatattt

SEQ ID NO: 836110 - DNA, 25 bp, Mus musculus
tctgtgagatagagcggtcccttct

SEQ ID NO: 836111 - DNA, 25 bp, Mus musculus
tctgtgagatagtgcggtcccttct

SEQ ID NO: 836112 - DNA, 25 bp, Mus musculus
tctgtgagtgtgaaactagcctggt

SEQ ID NO: 836113 - DNA, 25 bp, Mus musculus
tctgtgagtgtgtaactagcctggt

SEQ ID NO: 836114 - DNA, 25 bp, Mus musculus
tctgtgagttttacctggttcttgt

SEQ ID NO: 836115 - DNA, 25 bp, Mus musculus
tctgtgagtttttcctggttcttgt

SEQ ID NO: 836116 - DNA, 25 bp, Mus musculus
tctgtgatacatattgtcactaccc

SEQ ID NO: 836117 - DNA, 25 bp, Mus musculus
tctgtgatacattttgtcactaccc

SEQ ID NO: 836118 - DNA, 25 bp, Mus musculus
tctgtgatcagaaactccgaccaaa

SEQ ID NO: 836119 - DNA, 25 bp, Mus musculus
tctgtgatcagatactccgaccaaa

SEQ ID NO: 836120 - DNA, 25 bp, Mus musculus
tctgtgatcattagattcccctccc

SEQ ID NO: 836121 - DNA, 25 bp, Mus musculus
tctgtgatcatttgattcccctccc

SEQ ID NO: 836122 - DNA, 25 bp, Mus musculus
tctgtgatccatctctgctctgtgt

SEQ ID NO: 836123 - DNA, 25 bp, Mus musculus
tctgtgatccatgtctgctctgtgt

SEQ ID NO: 836124 - DNA, 25 bp, Mus musculus
tctgtgatccccacagctaagtagc

SEQ ID NO: 836125 - DNA, 25 bp, Mus musculus
tctgtgatcccctcagctaagtagc

SEQ ID NO: 836126 - DNA, 25 bp, Mus musculus
tctgtgatgaaccatagcccaatgt

SEQ ID NO: 836127 - DNA, 25 bp, Mus musculus
tctgtgatgaacgatagcccaatgt

SEQ ID NO: 836128 - DNA, 25 bp, Mus musculus
tctgtgatgggaaccgatgccagtg

SEQ ID NO: 836129 - DNA, 25 bp, Mus musculus
tctgtgatgggatccgatgccagtg

SEQ ID NO: 836130 - DNA, 25 bp, Mus musculus
tctgtgatgtgcatccagcaacccc

SEQ ID NO: 836131 - DNA, 25 bp, Mus musculus
tctgtgatgtgcttccagcaacccc

SEQ ID NO: 836132 - DNA, 25 bp, Mus musculus
tctgtgattaacagcattctctttg

SEQ ID NO: 836133 - DNA, 25 bp, Mus musculus
tctgtgattaactgcattctctttg

SEQ ID NO: 836134 - DNA, 25 bp, Mus musculus
tctgtgattacacccacgtaccact

SEQ ID NO: 836135 - DNA, 25 bp, Mus musculus
tctgtgattacagccacgtaccact

SEQ ID NO: 836136 - DNA, 25 bp, Mus musculus
tctgtgattaggcatagctctgctt

SEQ ID NO: 836137 - DNA, 25 bp, Mus musculus
tctgtgattagggatagctctgctt

SEQ ID NO: 836138 - DNA, 25 bp, Mus musculus
tctgtgattatgcttgccacgtcat

SEQ ID NO: 836139 - DNA, 25 bp, Mus musculus
tctgtgattatggttgccacgtcat

SEQ ID NO: 836140 - DNA, 25 bp, Mus musculus
tctgtgattcttatagcttgccgaa

SEQ ID NO: 836141 - DNA, 25 bp, Mus musculus
tctgtgattcttttagcttgccgaa

SEQ ID NO: 836142 - DNA, 25 bp, Mus musculus
tctgtgattgagaccctcggctggg

SEQ ID NO: 836143 - DNA, 25 bp, Mus musculus
tctgtgattgagtccctcggctggg

SEQ ID NO: 836144 - DNA, 25 bp, Mus musculus
tctgtgattgctctgtagccatgtg

SEQ ID NO: 836145 - DNA, 25 bp, Mus musculus
tctgtgattgctgtgtagccatgtg

SEQ ID NO: 836146 - DNA, 25 bp, Mus musculus
tctgtgatttaaactcggtaccata

SEQ ID NO: 836147 - DNA, 25 bp, Mus musculus
tctgtgatttaatctcggtaccata

SEQ ID NO: 836148 - DNA, 25 bp, Mus musculus
tctgtgatttagatgatccccgtgg

SEQ ID NO: 836149 - DNA, 25 bp, Mus musculus
tctgtgatttagttgatccccgtgg

SEQ ID NO: 836150 - DNA, 25 bp, Mus musculus
tctgtgcaagtcataacctctccga

SEQ ID NO: 836151 - DNA, 25 bp, Mus musculus
tctgtgcaagtcttaacctctccga

SEQ ID NO: 836152 - DNA, 25 bp, Mus musculus
tctgtgcaattgagttccctttacc

SEQ ID NO: 836153 - DNA, 25 bp, Mus musculus
tctgtgcaattgtgttccctttacc

SEQ ID NO: 836154 - DNA, 25 bp, Mus musculus
tctgtgcacagccttaaaccgtatt

SEQ ID NO: 836155 - DNA, 25 bp, Mus musculus
tctgtgcacagcgttaaaccgtatt

SEQ ID NO: 836156 - DNA, 25 bp, Mus musculus
tctgtgcacaggcttttggtttgtt

SEQ ID NO: 836157 - DNA, 25 bp, Mus musculus
tctgtgcacagggttttggtttgtt

SEQ ID NO: 836158 - DNA, 25 bp, Mus musculus
tctgtgcacatcagtatcaagactg

SEQ ID NO: 836159 - DNA, 25 bp, Mus musculus
tctgtgcacatctgtatcaagactg

SEQ ID NO: 836160 - DNA, 25 bp, Mus musculus
tctgtgcacgcaagcgtgcacgtgt

SEQ ID NO: 836161 - DNA, 25 bp, Mus musculus
tctgtgcacgcaccagagatgtcac

SEQ ID NO: 836162 - DNA, 25 bp, Mus musculus
tctgtgcacgcagcagagatgtcac

SEQ ID NO: 836163 - DNA, 25 bp, Mus musculus
tctgtgcacgcatgcgtgcacgtgt

SEQ ID NO: 836164 - DNA, 25 bp, Mus musculus
tctgtgcatacaagggagctgccct

SEQ ID NO: 836165 - DNA, 25 bp, Mus musculus
tctgtgcatacatgggagctgccct

SEQ ID NO: 836166 - DNA, 25 bp, Mus musculus
tctgtgcatcttataccctgtttaa

SEQ ID NO: 836167 - DNA, 25 bp, Mus musculus
tctgtgcatcttatcctgagggaag

SEQ ID NO: 836168 - DNA, 25 bp, Mus musculus
tctgtgcatcttttaccctgtttaa

SEQ ID NO: 836169 - DNA, 25 bp, Mus musculus
tctgtgcatcttttcctgagggaag

SEQ ID NO: 836170 - DNA, 25 bp, Mus musculus
tctgtgcatttaatgtagctgttaa

SEQ ID NO: 836171 - DNA, 25 bp, Mus musculus
tctgtgcatttattgtagctgttaa

SEQ ID NO: 836172 - DNA, 25 bp, Mus musculus
tctgtgccaacacctgcttgcagga

SEQ ID NO: 836173 - DNA, 25 bp, Mus musculus
tctgtgccaacagctgcttgcagga

SEQ ID NO: 836174 - DNA, 25 bp, Mus musculus
tctgtgccaatcctaacaacgtgtg

SEQ ID NO: 836175 - DNA, 25 bp, Mus musculus
tctgtgccaatcgtaacaacgtgtg

SEQ ID NO: 836176 - DNA, 25 bp, Mus musculus
tctgtgccacctccgataagtgtgc

SEQ ID NO: 836177 - DNA, 25 bp, Mus musculus
tctgtgccacctgcgataagtgtgc

SEQ ID NO: 836178 - DNA, 25 bp, Mus musculus
tctgtgccagcgatcagcagccaat

SEQ ID NO: 836179 - DNA, 25 bp, Mus musculus
tctgtgccagcgttcagcagccaat

SEQ ID NO: 836180 - DNA, 25 bp, Mus musculus
tctgtgccatcaacggcggaacctt

SEQ ID NO: 836181 - DNA, 25 bp, Mus musculus
tctgtgccatcatcggcggaacctt

SEQ ID NO: 836182 - DNA, 25 bp, Mus musculus
tctgtgcccagtcactaggctggct

SEQ ID NO: 836183 - DNA, 25 bp, Mus musculus
tctgtgcccagtgactaggctggct

SEQ ID NO: 836184 - DNA, 25 bp, Mus musculus
tctgtgcccattaaataccctcaat

SEQ ID NO: 836185 - DNA, 25 bp, Mus musculus
tctgtgcccatttaataccctcaat

SEQ ID NO: 836186 - DNA, 25 bp, Mus musculus
tctgtgccccagaccttgtgctaag

SEQ ID NO: 836187 - DNA, 25 bp, Mus musculus
tctgtgccccagtccttgtgctaag

SEQ ID NO: 836188 - DNA, 25 bp, Mus musculus
tctgtgcccttgatattcctagcat

SEQ ID NO: 836189 - DNA, 25 bp, Mus musculus
tctgtgcccttgttattcctagcat

SEQ ID NO: 836190 - DNA, 25 bp, Mus musculus
tctgtgccggaacccaagcctagga

SEQ ID NO: 836191 - DNA, 25 bp, Mus musculus
tctgtgccggaagccaagcctagga

SEQ ID NO: 836192 - DNA, 25 bp, Mus musculus
tctgtgccggacctcagctgtgaag

SEQ ID NO: 836193 - DNA, 25 bp, Mus musculus
tctgtgccggacgtcagctgtgaag

SEQ ID NO: 836194 - DNA, 25 bp, Mus musculus
tctgtgcctacaatgttgagtttaa

SEQ ID NO: 836195 - DNA, 25 bp, Mus musculus
tctgtgcctacattgttgagtttaa

SEQ ID NO: 836196 - DNA, 25 bp, Mus musculus
tctgtgcctacgaaagacctgggag

SEQ ID NO: 836197 - DNA, 25 bp, Mus musculus
tctgtgcctacgtaagacctgggag

SEQ ID NO: 836198 - DNA, 25 bp, Mus musculus
tctgtgcctggaaatactgatgaat

SEQ ID NO: 836199 - DNA, 25 bp, Mus musculus
tctgtgcctggacataaaaattgct

SEQ ID NO: 836200 - DNA, 25 bp, Mus musculus
tctgtgcctggagataaaaattgct

SEQ ID NO: 836201 - DNA, 25 bp, Mus musculus
tctgtgcctggatatactgatgaat

SEQ ID NO: 836202 - DNA, 25 bp, Mus musculus
tctgtgcgcaaaaggaagggcttct

SEQ ID NO: 836203 - DNA, 25 bp, Mus musculus
tctgtgcgcaaatggaagggcttct

SEQ ID NO: 836204 - DNA, 25 bp, Mus musculus
tctgtgcgctggatggtttaagtca

SEQ ID NO: 836205 - DNA, 25 bp, Mus musculus
tctgtgcgctggttggtttaagtca

SEQ ID NO: 836206 - DNA, 25 bp, Mus musculus
tctgtgcgtctcaaattcctgtcaa

SEQ ID NO: 836207 - DNA, 25 bp, Mus musculus
tctgtgcgtctctaattcctgtcaa

SEQ ID NO: 836208 - DNA, 25 bp, Mus musculus
tctgtgctaagtctgtggcccatga

SEQ ID NO: 836209 - DNA, 25 bp, Mus musculus
tctgtgctaagtgtgtggcccatga

SEQ ID NO: 836210 - DNA, 25 bp, Mus musculus
tctgtgctaccaagtgcctatgaat

SEQ ID NO: 836211 - DNA, 25 bp, Mus musculus
tctgtgctaccatgtgcctatgaat

SEQ ID NO: 836212 - DNA, 25 bp, Mus musculus
tctgtgctcactagtctctataatc

SEQ ID NO: 836213 - DNA, 25 bp, Mus musculus
tctgtgctcacttgtctctataatc

SEQ ID NO: 836214 - DNA, 25 bp, Mus musculus
tctgtgctcagaacatctacctgaa

SEQ ID NO: 836215 - DNA, 25 bp, Mus musculus
tctgtgctcagatcatctacctgaa

SEQ ID NO: 836216 - DNA, 25 bp, Mus musculus
tctgtgctccccatatgagagtgca

SEQ ID NO: 836217 - DNA, 25 bp, Mus musculus
tctgtgctccccttatgagagtgca

SEQ ID NO: 836218 - DNA, 25 bp, Mus musculus
tctgtgctctctcttaggtgtccat

SEQ ID NO: 836219 - DNA, 25 bp, Mus musculus
tctgtgctctctgttaggtgtccat

SEQ ID NO: 836220 - DNA, 25 bp, Mus musculus
tctgtgctcttaactcgctagacat

SEQ ID NO: 836221 - DNA, 25 bp, Mus musculus
tctgtgctcttatctcgctagacat

SEQ ID NO: 836222 - DNA, 25 bp, Mus musculus
tctgtgctgaaacaccccaagttct

SEQ ID NO: 836223 - DNA, 25 bp, Mus musculus
tctgtgctgaaagaccccaagttct

SEQ ID NO: 836224 - DNA, 25 bp, Mus musculus
tctgtgctgaccatctgcgccatga

SEQ ID NO: 836225 - DNA, 25 bp, Mus musculus
tctgtgctgaccttctgcgccatga

SEQ ID NO: 836226 - DNA, 25 bp, Mus musculus
tctgtgctgacgagaatgtgacctt

SEQ ID NO: 836227 - DNA, 25 bp, Mus musculus
tctgtgctgacgtgaatgtgacctt

SEQ ID NO: 836228 - DNA, 25 bp, Mus musculus
tctgtgctgcagattaggtgccaat

SEQ ID NO: 836229 - DNA, 25 bp, Mus musculus
tctgtgctgcagtttaggtgccaat

SEQ ID NO: 836230 - DNA, 25 bp, Mus musculus
tctgtgctgccaacattgagtttac

SEQ ID NO: 836231 - DNA, 25 bp, Mus musculus
tctgtgctgccatcattgagtttac

SEQ ID NO: 836232 - DNA, 25 bp, Mus musculus
tctgtgctgcgtagtgttggagtca

SEQ ID NO: 836233 - DNA, 25 bp, Mus musculus
tctgtgctgcgttgtgttggagtca

SEQ ID NO: 836234 - DNA, 25 bp, Mus musculus
tctgtgctgctacgttgtggccaca

SEQ ID NO: 836235 - DNA, 25 bp, Mus musculus
tctgtgctgctaggttgtggccaca

SEQ ID NO: 836236 - DNA, 25 bp, Mus musculus
tctgtgctgctcaaggtgtaattca

SEQ ID NO: 836237 - DNA, 25 bp, Mus musculus
tctgtgctgctctaggtgtaattca

SEQ ID NO: 836238 - DNA, 25 bp, Mus musculus
tctgtgctgcttctatctggcggaa

SEQ ID NO: 836239 - DNA, 25 bp, Mus musculus
tctgtgctgcttgtatctggcggaa

SEQ ID NO: 836240 - DNA, 25 bp, Mus musculus
tctgtgctgtgaactagactggtca

SEQ ID NO: 836241 - DNA, 25 bp, Mus musculus
tctgtgctgtgatctagactggtca

SEQ ID NO: 836242 - DNA, 25 bp, Mus musculus
tctgtgctgtgtcagttccacagta

SEQ ID NO: 836243 - DNA, 25 bp, Mus musculus
tctgtgctgtgtgagttccacagta

SEQ ID NO: 836244 - DNA, 25 bp, Mus musculus
tctgtgctgttcatctgtgactgag

SEQ ID NO: 836245 - DNA, 25 bp, Mus musculus
tctgtgctgttcttctgtgactgag

SEQ ID NO: 836246 - DNA, 25 bp, Mus musculus
tctgtgcttaagaccgggaccacgg

SEQ ID NO: 836247 - DNA, 25 bp, Mus musculus
tctgtgcttaagtccgggaccacgg

SEQ ID NO: 836248 - DNA, 25 bp, Mus musculus
tctgtgcttattaatggactttggt

SEQ ID NO: 836249 - DNA, 25 bp, Mus musculus
tctgtgcttatttatggactttggt

SEQ ID NO: 836250 - DNA, 25 bp, Mus musculus
tctgtgcttcaacatccggtatgga

SEQ ID NO: 836251 - DNA, 25 bp, Mus musculus
tctgtgcttcaagatccggtatgga

SEQ ID NO: 836252 - DNA, 25 bp, Mus musculus
tctgtgctttgtcaccctttaccct

SEQ ID NO: 836253 - DNA, 25 bp, Mus musculus
tctgtgctttgtgaccctttaccct

SEQ ID NO: 836254 - DNA, 25 bp, Mus musculus
tctgtggaaccccttttacggatca

SEQ ID NO: 836255 - DNA, 25 bp, Mus musculus
tctgtggaacccgttttacggatca

SEQ ID NO: 836256 - DNA, 25 bp, Mus musculus
tctgtggacaccaatacccatgtgt

SEQ ID NO: 836257 - DNA, 25 bp, Mus musculus
tctgtggacacctatacccatgtgt

SEQ ID NO: 836258 - DNA, 25 bp, Mus musculus
tctgtggacccgaggaggcgaaaca

SEQ ID NO: 836259 - DNA, 25 bp, Mus musculus
tctgtggacccgtggaggcgaaaca

SEQ ID NO: 836260 - DNA, 25 bp, Mus musculus
tctgtggaccgcctgggactcatca

SEQ ID NO: 836261 - DNA, 25 bp, Mus musculus
tctgtggaccgcgtgggactcatca

SEQ ID NO: 836262 - DNA, 25 bp, Mus musculus
tctgtggacggcaggatctattttc

SEQ ID NO: 836263 - DNA, 25 bp, Mus musculus
tctgtggacggctggatctattttc

SEQ ID NO: 836264 - DNA, 25 bp, Mus musculus
tctgtggacgggagggacccactca

SEQ ID NO: 836265 - DNA, 25 bp, Mus musculus
tctgtggacgggtgggacccactca

SEQ ID NO: 836266 - DNA, 25 bp, Mus musculus
tctgtggacgtgctaatcacctgca

SEQ ID NO: 836267 - DNA, 25 bp, Mus musculus
tctgtggacgtggtaatcacctgca

SEQ ID NO: 836268 - DNA, 25 bp, Mus musculus
tctgtggactcaacttcattgtcag

SEQ ID NO: 836269 - DNA, 25 bp, Mus musculus
tctgtggactcatcttcattgtcag

SEQ ID NO: 836270 - DNA, 25 bp, Mus musculus
tctgtggagatcctggcaatttgct

SEQ ID NO: 836271 - DNA, 25 bp, Mus musculus
tctgtggagatcgtggcaatttgct

SEQ ID NO: 836272 - DNA, 25 bp, Mus musculus
tctgtggagtgactcctgctccctc

SEQ ID NO: 836273 - DNA, 25 bp, Mus musculus
tctgtggagtgagtcctgctccctc

SEQ ID NO: 836274 - DNA, 25 bp, Mus musculus
tctgtggatccaaccccgagggcgg

SEQ ID NO: 836275 - DNA, 25 bp, Mus musculus
tctgtggatccatccccgagggcgg

SEQ ID NO: 836276 - DNA, 25 bp, Mus musculus
tctgtggatgagacagaggctttcc

SEQ ID NO: 836277 - DNA, 25 bp, Mus musculus
tctgtggatgagtcagaggctttcc

SEQ ID NO: 836278 - DNA, 25 bp, Mus musculus
tctgtggatttccaacactctctgg

SEQ ID NO: 836279 - DNA, 25 bp, Mus musculus
tctgtggatttcgaacactctctgg

SEQ ID NO: 836280 - DNA, 25 bp, Mus musculus
tctgtggccccaaaggaggacacca

SEQ ID NO: 836281 - DNA, 25 bp, Mus musculus
tctgtggccccataggaggacacca

SEQ ID NO: 836282 - DNA, 25 bp, Mus musculus
tctgtggccctgctgaatcagctgc

SEQ ID NO: 836283 - DNA, 25 bp, Mus musculus
tctgtggccctggtgaatcagctgc

SEQ ID NO: 836284 - DNA, 25 bp, Mus musculus
tctgtggcgaacacgctggctccgc

SEQ ID NO: 836285 - DNA, 25 bp, Mus musculus
tctgtggcgaactcgctggctccgc

SEQ ID NO: 836286 - DNA, 25 bp, Mus musculus
tctgtggctgacaccagttgctttt

SEQ ID NO: 836287 - DNA, 25 bp, Mus musculus
tctgtggctgactccagttgctttt

SEQ ID NO: 836288 - DNA, 25 bp, Mus musculus
tctgtggctgtgactgctgtgtcca

SEQ ID NO: 836289 - DNA, 25 bp, Mus musculus
tctgtggctgtgtctgctgtgtcca

SEQ ID NO: 836290 - DNA, 25 bp, Mus musculus
tctgtgggactacaggtccccgtgc

SEQ ID NO: 836291 - DNA, 25 bp, Mus musculus
tctgtgggactagaggtccccgtgc

SEQ ID NO: 836292 - DNA, 25 bp, Mus musculus
tctgtgggaggcctattttttcata

SEQ ID NO: 836293 - DNA, 25 bp, Mus musculus
tctgtgggaggcgtattttttcata

SEQ ID NO: 836294 - DNA, 25 bp, Mus musculus
tctgtgggatgtaacgtcgtcacta

SEQ ID NO: 836295 - DNA, 25 bp, Mus musculus
tctgtgggatgttacgtcgtcacta

SEQ ID NO: 836296 - DNA, 25 bp, Mus musculus
tctgtgggcccaattttctttgaaa

SEQ ID NO: 836297 - DNA, 25 bp, Mus musculus
tctgtgggcccatttttctttgaaa

SEQ ID NO: 836298 - DNA, 25 bp, Mus musculus
tctgtgggctctagtcacctgtggg

SEQ ID NO: 836299 - DNA, 25 bp, Mus musculus
tctgtgggctcttgtcacctgtggg

SEQ ID NO: 836300 - DNA, 25 bp, Mus musculus
tctgtgggctttcggctatttctgt

SEQ ID NO: 836301 - DNA, 25 bp, Mus musculus
tctgtgggctttgggctatttctgt

SEQ ID NO: 836302 - DNA, 25 bp, Mus musculus
tctgtgggtcagattgaacatctcc

SEQ ID NO: 836303 - DNA, 25 bp, Mus musculus
tctgtgggtcagtttgaacatctcc

SEQ ID NO: 836304 - DNA, 25 bp, Mus musculus
tctgtgggtcctccaagagcactaa

SEQ ID NO: 836305 - DNA, 25 bp, Mus musculus
tctgtgggtcctgcaagagcactaa

SEQ ID NO: 836306 - DNA, 25 bp, Mus musculus
tctgtgggtggcacttaactcaagt

SEQ ID NO: 836307 - DNA, 25 bp, Mus musculus
tctgtgggtggctcttaactcaagt

SEQ ID NO: 836308 - DNA, 25 bp, Mus musculus
tctgtggtaatcacgtccagctcgt

SEQ ID NO: 836309 - DNA, 25 bp, Mus musculus
tctgtggtaatctcgtccagctcgt

SEQ ID NO: 836310 - DNA, 25 bp, Mus musculus
tctgtggtagagatcgccagcctgc

SEQ ID NO: 836311 - DNA, 25 bp, Mus musculus
tctgtggtagagttcgccagcctgc

SEQ ID NO: 836312 - DNA, 25 bp, Mus musculus
tctgtggtaggcacttcatcggtgg

SEQ ID NO: 836313 - DNA, 25 bp, Mus musculus
tctgtggtaggctcttcatcggtgg

SEQ ID NO: 836314 - DNA, 25 bp, Mus musculus
tctgtggtcaggacgatgctgcaat

SEQ ID NO: 836315 - DNA, 25 bp, Mus musculus
tctgtggtcaggtcgatgctgcaat

SEQ ID NO: 836316 - DNA, 25 bp, Mus musculus
tctgtggtcattcctgccaggaact

SEQ ID NO: 836317 - DNA, 25 bp, Mus musculus
tctgtggtcattgctgccaggaact

SEQ ID NO: 836318 - DNA, 25 bp, Mus musculus
tctgtggtccagcagatccggtgaa

SEQ ID NO: 836319 - DNA, 25 bp, Mus musculus
tctgtggtccaggagatccggtgaa

SEQ ID NO: 836320 - DNA, 25 bp, Mus musculus
tctgtggtccatactttactctcat

SEQ ID NO: 836321 - DNA, 25 bp, Mus musculus
tctgtggtccattctttactctcat

SEQ ID NO: 836322 - DNA, 25 bp, Mus musculus
tctgtggtccctcatgaagatgtag

SEQ ID NO: 836323 - DNA, 25 bp, Mus musculus
tctgtggtccctgatgaagatgtag

SEQ ID NO: 836324 - DNA, 25 bp, Mus musculus
tctgtggtcgatcctgctgtgactc

SEQ ID NO: 836325 - DNA, 25 bp, Mus musculus
tctgtggtcgatgctgctgtgactc

SEQ ID NO: 836326 - DNA, 25 bp, Mus musculus
tctgtggtcttccttttgagatggc

SEQ ID NO: 836327 - DNA, 25 bp, Mus musculus
tctgtggtcttcgttttgagatggc

SEQ ID NO: 836328 - DNA, 25 bp, Mus musculus
tctgtggtgaagaatacctagggaa

SEQ ID NO: 836329 - DNA, 25 bp, Mus musculus
tctgtggtgaagtatacctagggaa

SEQ ID NO: 836330 - DNA, 25 bp, Mus musculus
tctgtggtgggcactgttgtactag

SEQ ID NO: 836331 - DNA, 25 bp, Mus musculus
tctgtggtgggctctgttgtactag

SEQ ID NO: 836332 - DNA, 25 bp, Mus musculus
tctgtggtgtttctaaattgcttaa

SEQ ID NO: 836333 - DNA, 25 bp, Mus musculus
tctgtggtgtttgtaaattgcttaa

SEQ ID NO: 836334 - DNA, 25 bp, Mus musculus
tctgtggttattattatcacccttt

SEQ ID NO: 836335 - DNA, 25 bp, Mus musculus
tctgtggttatttttatcacccttt

SEQ ID NO: 836336 - DNA, 25 bp, Mus musculus
tctgtggttcacaaggttgcctgaa

SEQ ID NO: 836337 - DNA, 25 bp, Mus musculus
tctgtggttcactaggttgcctgaa

SEQ ID NO: 836338 - DNA, 25 bp, Mus musculus
tctgtggttcctcaccctgggttca

SEQ ID NO: 836339 - DNA, 25 bp, Mus musculus
tctgtggttcctgaccctgggttca

SEQ ID NO: 836340 - DNA, 25 bp, Mus musculus
tctgtggttctcagggctaataaag

SEQ ID NO: 836341 - DNA, 25 bp, Mus musculus
tctgtggttctctgggctaataaag

SEQ ID NO: 836342 - DNA, 25 bp, Mus musculus
tctgtggttgccaaagccctctgtg

SEQ ID NO: 836343 - DNA, 25 bp, Mus musculus
tctgtggttgcctaagccctctgtg

SEQ ID NO: 836344 - DNA, 25 bp, Mus musculus
tctgtggttgctcagcagtagccaa

SEQ ID NO: 836345 - DNA, 25 bp, Mus musculus
tctgtggttgctgagcagtagccaa

SEQ ID NO: 836346 - DNA, 25 bp, Mus musculus
tctgtggttgtaattcttttgtctc

SEQ ID NO: 836347 - DNA, 25 bp, Mus musculus
tctgtggttgtatttcttttgtctc

SEQ ID NO: 836348 - DNA, 25 bp, Mus musculus
tctgtggttgtcacctgcagagcta

SEQ ID NO: 836349 - DNA, 25 bp, Mus musculus
tctgtggttgtctcctgcagagcta

SEQ ID NO: 836350 - DNA, 25 bp, Mus musculus
tctgtggtttagactctgctggtca

SEQ ID NO: 836351 - DNA, 25 bp, Mus musculus
tctgtggtttagtctctgctggtca

SEQ ID NO: 836352 - DNA, 25 bp, Mus musculus
tctgtggtttccagatccatcatct

SEQ ID NO: 836353 - DNA, 25 bp, Mus musculus
tctgtggtttcctgatccatcatct

SEQ ID NO: 836354 - DNA, 25 bp, Mus musculus
tctgtggttttcctgtgccatccac

SEQ ID NO: 836355 - DNA, 25 bp, Mus musculus
tctgtggttttcgtgtgccatccac

SEQ ID NO: 836356 - DNA, 25 bp, Mus musculus
tctgtggtttttctgcacagcccca

SEQ ID NO: 836357 - DNA, 25 bp, Mus musculus
tctgtggtttttgtgcacagcccca

SEQ ID NO: 836358 - DNA, 25 bp, Mus musculus
tctgtgtaatgaccccgtcttgtga

SEQ ID NO: 836359 - DNA, 25 bp, Mus musculus
tctgtgtaatgagcccgtcttgtga

SEQ ID NO: 836360 - DNA, 25 bp, Mus musculus
tctgtgtaatgtagctagtctgtaa

SEQ ID NO: 836361 - DNA, 25 bp, Mus musculus
tctgtgtaatgttgctagtctgtaa

SEQ ID NO: 836362 - DNA, 25 bp, Mus musculus
tctgtgtaatttcggactgagtcta

SEQ ID NO: 836363 - DNA, 25 bp, Mus musculus
tctgtgtaatttgggactgagtcta

SEQ ID NO: 836364 - DNA, 25 bp, Mus musculus
tctgtgtacatacggaataagttat

SEQ ID NO: 836365 - DNA, 25 bp, Mus musculus
tctgtgtacatagggaataagttat

SEQ ID NO: 836366 - DNA, 25 bp, Mus musculus
tctgtgtacttaaccccaggattcc

SEQ ID NO: 836367 - DNA, 25 bp, Mus musculus
tctgtgtacttatccccaggattcc

SEQ ID NO: 836368 - DNA, 25 bp, Mus musculus
tctgtgtagtgaaccattgagcata

SEQ ID NO: 836369 - DNA, 25 bp, Mus musculus
tctgtgtagtgatccattgagcata

SEQ ID NO: 836370 - DNA, 25 bp, Mus musculus
tctgtgtatcctatcttagtgcttt

SEQ ID NO: 836371 - DNA, 25 bp, Mus musculus
tctgtgtatcctttcttagtgcttt

SEQ ID NO: 836372 - DNA, 25 bp, Mus musculus
tctgtgtatgacaatggaccccttg

SEQ ID NO: 836373 - DNA, 25 bp, Mus musculus
tctgtgtatgactatggaccccttg

SEQ ID NO: 836374 - DNA, 25 bp, Mus musculus
tctgtgtattaaactgggcctgacc

SEQ ID NO: 836375 - DNA, 25 bp, Mus musculus
tctgtgtattaatctgggcctgacc

SEQ ID NO: 836376 - DNA, 25 bp, Mus musculus
tctgtgtattgacgaagctgtgttc

SEQ ID NO: 836377 - DNA, 25 bp, Mus musculus
tctgtgtattgaggaagctgtgttc

SEQ ID NO: 836378 - DNA, 25 bp, Mus musculus
tctgtgtatttacccgtgttttaag

SEQ ID NO: 836379 - DNA, 25 bp, Mus musculus
tctgtgtatttagccgtgttttaag

SEQ ID NO: 836380 - DNA, 25 bp, Mus musculus
tctgtgtcaaccctctgcctgcagg

SEQ ID NO: 836381 - DNA, 25 bp, Mus musculus
tctgtgtcaaccgtctgcctgcagg

SEQ ID NO: 836382 - DNA, 25 bp, Mus musculus
tctgtgtcaaggacacctactacaa

SEQ ID NO: 836383 - DNA, 25 bp, Mus musculus
tctgtgtcaaggtcacctactacaa

SEQ ID NO: 836384 - DNA, 25 bp, Mus musculus
tctgtgtcacagaccattcattgta

SEQ ID NO: 836385 - DNA, 25 bp, Mus musculus
tctgtgtcacagtccattcattgta

SEQ ID NO: 836386 - DNA, 25 bp, Mus musculus
tctgtgtcactccagtggaatttaa

SEQ ID NO: 836387 - DNA, 25 bp, Mus musculus
tctgtgtcactcgagtggaatttaa

SEQ ID NO: 836388 - DNA, 25 bp, Mus musculus
tctgtgtcagccatctgggattaga

SEQ ID NO: 836389 - DNA, 25 bp, Mus musculus
tctgtgtcagccttctgggattaga

SEQ ID NO: 836390 - DNA, 25 bp, Mus musculus
tctgtgtcaggcattgagccacaca

SEQ ID NO: 836391 - DNA, 25 bp, Mus musculus
tctgtgtcaggctttgagccacaca

SEQ ID NO: 836392 - DNA, 25 bp, Mus musculus
tctgtgtcatccaaactgtgaaatg

SEQ ID NO: 836393 - DNA, 25 bp, Mus musculus
tctgtgtcatcctaactgtgaaatg

SEQ ID NO: 836394 - DNA, 25 bp, Mus musculus
tctgtgtcattcctcgttcatgaga

SEQ ID NO: 836395 - DNA, 25 bp, Mus musculus
tctgtgtcattcgtcgttcatgaga

SEQ ID NO: 836396 - DNA, 25 bp, Mus musculus
tctgtgtccattaaagacaccgagt

SEQ ID NO: 836397 - DNA, 25 bp, Mus musculus
tctgtgtccatttaagacaccgagt

SEQ ID NO: 836398 - DNA, 25 bp, Mus musculus
tctgtgtcccatcagtcactgcatt

SEQ ID NO: 836399 - DNA, 25 bp, Mus musculus
tctgtgtcccatgagtcactgcatt

SEQ ID NO: 836400 - DNA, 25 bp, Mus musculus
tctgtgtcccgacgcctgtcaggaa

SEQ ID NO: 836401 - DNA, 25 bp, Mus musculus
tctgtgtcccgaggcctgtcaggaa

SEQ ID NO: 836402 - DNA, 25 bp, Mus musculus
tctgtgtcccttcatcctggtaaaa

SEQ ID NO: 836403 - DNA, 25 bp, Mus musculus
tctgtgtcccttgatcctggtaaaa

SEQ ID NO: 836404 - DNA, 25 bp, Mus musculus
tctgtgtccgcactgcttattgttg

SEQ ID NO: 836405 - DNA, 25 bp, Mus musculus
tctgtgtccgcagtgcttattgttg

SEQ ID NO: 836406 - DNA, 25 bp, Mus musculus
tctgtgtcctctatatagcattaag

SEQ ID NO: 836407 - DNA, 25 bp, Mus musculus
tctgtgtcctctttatagcattaag

SEQ ID NO: 836408 - DNA, 25 bp, Mus musculus
tctgtgtcgcctacttgtaaatgtt

SEQ ID NO: 836409 - DNA, 25 bp, Mus musculus
tctgtgtcgccttcttgtaaatgtt

SEQ ID NO: 836410 - DNA, 25 bp, Mus musculus
tctgtgtcgttcagggtctttaagc

SEQ ID NO: 836411 - DNA, 25 bp, Mus musculus
tctgtgtcgttctgggtctttaagc

SEQ ID NO: 836412 - DNA, 25 bp, Mus musculus
tctgtgtctacacgtggctgacttc

SEQ ID NO: 836413 - DNA, 25 bp, Mus musculus
tctgtgtctacaggtggctgacttc

SEQ ID NO: 836414 - DNA, 25 bp, Mus musculus
tctgtgtctgaaatgtggaatgtgc

SEQ ID NO: 836415 - DNA, 25 bp, Mus musculus
tctgtgtctgaattgtggaatgtgc

SEQ ID NO: 836416 - DNA, 25 bp, Mus musculus
tctgtgtctgataccgccggcggca

SEQ ID NO: 836417 - DNA, 25 bp, Mus musculus
tctgtgtctgattccgccggcggca

SEQ ID NO: 836418 - DNA, 25 bp, Mus musculus
tctgtgtctgccctgcatagccaag

SEQ ID NO: 836419 - DNA, 25 bp, Mus musculus
tctgtgtctgccgtgcatagccaag

SEQ ID NO: 836420 - DNA, 25 bp, Mus musculus
tctgtgtctgcgaggccaatgcaaa

SEQ ID NO: 836421 - DNA, 25 bp, Mus musculus
tctgtgtctgcgtggccaatgcaaa

SEQ ID NO: 836422 - DNA, 25 bp, Mus musculus
tctgtgtctgggagtagtgtcttat

SEQ ID NO: 836423 - DNA, 25 bp, Mus musculus
tctgtgtctgggtgtagtgtcttat

SEQ ID NO: 836424 - DNA, 25 bp, Mus musculus
tctgtgtctgtgaacgggcatgcaa

SEQ ID NO: 836425 - DNA, 25 bp, Mus musculus
tctgtgtctgtgtacgggcatgcaa

SEQ ID NO: 836426 - DNA, 25 bp, Mus musculus
tctgtgtcttcaccagcagtagtgc

SEQ ID NO: 836427 - DNA, 25 bp, Mus musculus
tctgtgtcttcagcagcagtagtgc

SEQ ID NO: 836428 - DNA, 25 bp, Mus musculus
tctgtgtgacagattccacccacta

SEQ ID NO: 836429 - DNA, 25 bp, Mus musculus
tctgtgtgacagtttccacccacta

SEQ ID NO: 836430 - DNA, 25 bp, Mus musculus
tctgtgtgacatagatgccccattg

SEQ ID NO: 836431 - DNA, 25 bp, Mus musculus
tctgtgtgacattgatgccccattg

SEQ ID NO: 836432 - DNA, 25 bp, Mus musculus
tctgtgtgacccaccagtggcaggg

SEQ ID NO: 836433 - DNA, 25 bp, Mus musculus
tctgtgtgaccctccagtggcaggg

SEQ ID NO: 836434 - DNA, 25 bp, Mus musculus
tctgtgtgacttccttagacttgca

SEQ ID NO: 836435 - DNA, 25 bp, Mus musculus
tctgtgtgacttgcttagacttgca

SEQ ID NO: 836436 - DNA, 25 bp, Mus musculus
tctgtgtgagtaacccctagaggta

SEQ ID NO: 836437 - DNA, 25 bp, Mus musculus
tctgtgtgagtatcccctagaggta

SEQ ID NO: 836438 - DNA, 25 bp, Mus musculus
tctgtgtgatgcctgcatttcttca

SEQ ID NO: 836439 - DNA, 25 bp, Mus musculus
tctgtgtgatgcgtgcatttcttca

SEQ ID NO: 836440 - DNA, 25 bp, Mus musculus
tctgtgtgcactagggagcaagctt

SEQ ID NO: 836441 - DNA, 25 bp, Mus musculus
tctgtgtgcacttgggagcaagctt

SEQ ID NO: 836442 - DNA, 25 bp, Mus musculus
tctgtgtgcagcatggtgtttcaca

SEQ ID NO: 836443 - DNA, 25 bp, Mus musculus
tctgtgtgcagcttggtgtttcaca

SEQ ID NO: 836444 - DNA, 25 bp, Mus musculus
tctgtgtgccagatcctcctagcgc

SEQ ID NO: 836445 - DNA, 25 bp, Mus musculus
tctgtgtgccagttcctcctagcgc

SEQ ID NO: 836446 - DNA, 25 bp, Mus musculus
tctgtgtgcctgcagcgcctggaca

SEQ ID NO: 836447 - DNA, 25 bp, Mus musculus
tctgtgtgcctggagcgcctggaca

SEQ ID NO: 836448 - DNA, 25 bp, Mus musculus
tctgtgtgcgtgcagccctccatta

SEQ ID NO: 836449 - DNA, 25 bp, Mus musculus
tctgtgtgcgtggagccctccatta

SEQ ID NO: 836450 - DNA, 25 bp, Mus musculus
tctgtgtgctcaccgccatgaagat

SEQ ID NO: 836451 - DNA, 25 bp, Mus musculus
tctgtgtgctcagcgccatgaagat

SEQ ID NO: 836452 - DNA, 25 bp, Mus musculus
tctgtgtgctgaccccagggaaaca

SEQ ID NO: 836453 - DNA, 25 bp, Mus musculus
tctgtgtgctgagcccagggaaaca

SEQ ID NO: 836454 - DNA, 25 bp, Mus musculus
tctgtgtgctgtaggatgatcgaac

SEQ ID NO: 836455 - DNA, 25 bp, Mus musculus
tctgtgtgctgttggatgatcgaac

SEQ ID NO: 836456 - DNA, 25 bp, Mus musculus
tctgtgtgcttgagaacccgtgtta

SEQ ID NO: 836457 - DNA, 25 bp, Mus musculus
tctgtgtgcttgtgaacccgtgtta

SEQ ID NO: 836458 - DNA, 25 bp, Mus musculus
tctgtgtgggacaatgacctgggca

SEQ ID NO: 836459 - DNA, 25 bp, Mus musculus
tctgtgtgggactatgacctgggca

SEQ ID NO: 836460 - DNA, 25 bp, Mus musculus
tctgtgtggtagagtccttaggccg

SEQ ID NO: 836461 - DNA, 25 bp, Mus musculus
tctgtgtggtagtgtccttaggccg

SEQ ID NO: 836462 - DNA, 25 bp, Mus musculus
tctgtgtgtacaaagctagcgcgca

SEQ ID NO: 836463 - DNA, 25 bp, Mus musculus
tctgtgtgtacaagtgactgcagta

SEQ ID NO: 836464 - DNA, 25 bp, Mus musculus
tctgtgtgtacatagctagcgcgca

SEQ ID NO: 836465 - DNA, 25 bp, Mus musculus
tctgtgtgtacatgtgactgcagta

SEQ ID NO: 836466 - DNA, 25 bp, Mus musculus
tctgtgtgtctgagacagtcaggga

SEQ ID NO: 836467 - DNA, 25 bp, Mus musculus
tctgtgtgtctgtgacagtcaggga

SEQ ID NO: 836468 - DNA, 25 bp, Mus musculus
tctgtgtgtcttaccgatggtgaga

SEQ ID NO: 836469 - DNA, 25 bp, Mus musculus
tctgtgtgtcttctggtcaatgtaa

SEQ ID NO: 836470 - DNA, 25 bp, Mus musculus
tctgtgtgtcttgtggtcaatgtaa

SEQ ID NO: 836471 - DNA, 25 bp, Mus musculus
tctgtgtgtctttccgatggtgaga

SEQ ID NO: 836472 - DNA, 25 bp, Mus musculus
tctgtgtgtgatccggatcgccccc

SEQ ID NO: 836473 - DNA, 25 bp, Mus musculus
tctgtgtgtgatgcggatcgccccc

SEQ ID NO: 836474 - DNA, 25 bp, Mus musculus
tctgtgtgtgcacttttgctttcag

SEQ ID NO: 836475 - DNA, 25 bp, Mus musculus
tctgtgtgtgcagttttgctttcag

SEQ ID NO: 836476 - DNA, 25 bp, Mus musculus
tctgtgtgttgtcaaagtttggaag

SEQ ID NO: 836477 - DNA, 25 bp, Mus musculus
tctgtgtgttgtgaaagtttggaag

SEQ ID NO: 836478 - DNA, 25 bp, Mus musculus
tctgtgttaaacatgggtctaattt

SEQ ID NO: 836479 - DNA, 25 bp, Mus musculus
tctgtgttaaacttgggtctaattt

SEQ ID NO: 836480 - DNA, 25 bp, Mus musculus
tctgtgttacagaaccggtaggtat

SEQ ID NO: 836481 - DNA, 25 bp, Mus musculus
tctgtgttacagattggtatgcatg

SEQ ID NO: 836482 - DNA, 25 bp, Mus musculus
tctgtgttacagtaccggtaggtat

SEQ ID NO: 836483 - DNA, 25 bp, Mus musculus
tctgtgttacagtttggtatgcatg

SEQ ID NO: 836484 - DNA, 25 bp, Mus musculus
tctgtgttacctcttggcctaggcc

SEQ ID NO: 836485 - DNA, 25 bp, Mus musculus
tctgtgttacctgttggcctaggcc

SEQ ID NO: 836486 - DNA, 25 bp, Mus musculus
tctgtgttagctaagatcctgccct

SEQ ID NO: 836487 - DNA, 25 bp, Mus musculus
tctgtgttagcttagatcctgccct

SEQ ID NO: 836488 - DNA, 25 bp, Mus musculus
tctgtgttatccctgtgacttgcca

SEQ ID NO: 836489 - DNA, 25 bp, Mus musculus
tctgtgttatccgtgtgacttgcca

SEQ ID NO: 836490 - DNA, 25 bp, Mus musculus
tctgtgttatctatcatgtttgctt

SEQ ID NO: 836491 - DNA, 25 bp, Mus musculus
tctgtgttatctttcatgtttgctt

SEQ ID NO: 836492 - DNA, 25 bp, Mus musculus
tctgtgttattgcttcaacctaaga

SEQ ID NO: 836493 - DNA, 25 bp, Mus musculus
tctgtgttattggttcaacctaaga

SEQ ID NO: 836494 - DNA, 25 bp, Mus musculus
tctgtgttcaccattttcaccctta

SEQ ID NO: 836495 - DNA, 25 bp, Mus musculus
tctgtgttcacctttttcaccctta

SEQ ID NO: 836496 - DNA, 25 bp, Mus musculus
tctgtgttcagaaccctttgacgtg

SEQ ID NO: 836497 - DNA, 25 bp, Mus musculus
tctgtgttcagatccctttgacgtg

SEQ ID NO: 836498 - DNA, 25 bp, Mus musculus
tctgtgttcatccccagaaccgcag

SEQ ID NO: 836499 - DNA, 25 bp, Mus musculus
tctgtgttcatcgccagaaccgcag

SEQ ID NO: 836500 - DNA, 25 bp, Mus musculus
tctgtgttccaaatcttaaatagtc

SEQ ID NO: 836501 - DNA, 25 bp, Mus musculus
tctgtgttccaattcttaaatagtc

SEQ ID NO: 836502 - DNA, 25 bp, Mus musculus
tctgtgttccatactccactgagtg

SEQ ID NO: 836503 - DNA, 25 bp, Mus musculus
tctgtgttccattctccactgagtg

SEQ ID NO: 836504 - DNA, 25 bp, Mus musculus
tctgtgttcccaccggttgcacgaa

SEQ ID NO: 836505 - DNA, 25 bp, Mus musculus
tctgtgttcccagcggttgcacgaa

SEQ ID NO: 836506 - DNA, 25 bp, Mus musculus
tctgtgttccttccagctgactgag

SEQ ID NO: 836507 - DNA, 25 bp, Mus musculus
tctgtgttccttgcagctgactgag

SEQ ID NO: 836508 - DNA, 25 bp, Mus musculus
tctgtgttctgacactgaggaccta

SEQ ID NO: 836509 - DNA, 25 bp, Mus musculus
tctgtgttctgagactgaggaccta

SEQ ID NO: 836510 - DNA, 25 bp, Mus musculus
tctgtgttcttgcttctagggtcca

SEQ ID NO: 836511 - DNA, 25 bp, Mus musculus
tctgtgttcttggttctagggtcca

SEQ ID NO: 836512 - DNA, 25 bp, Mus musculus
tctgtgttgggacttggacatctgt

SEQ ID NO: 836513 - DNA, 25 bp, Mus musculus
tctgtgttgggagttggacatctgt

SEQ ID NO: 836514 - DNA, 25 bp, Mus musculus
tctgtgttggtgactctccagagat

SEQ ID NO: 836515 - DNA, 25 bp, Mus musculus
tctgtgttggtgtctctccagagat

SEQ ID NO: 836516 - DNA, 25 bp, Mus musculus
tctgtgtttcgtcgactggattaac

SEQ ID NO: 836517 - DNA, 25 bp, Mus musculus
tctgtgtttcgtggactggattaac

SEQ ID NO: 836518 - DNA, 25 bp, Mus musculus
tctgtgtttgtcagcatggatgtca

SEQ ID NO: 836519 - DNA, 25 bp, Mus musculus
tctgtgtttgtctgcatggatgtca

SEQ ID NO: 836520 - DNA, 25 bp, Mus musculus
tctgtgttttcactgaatatctttg

SEQ ID NO: 836521 - DNA, 25 bp, Mus musculus
tctgtgttttcagtgaatatctttg

SEQ ID NO: 836522 - DNA, 25 bp, Mus musculus
tctgtgttttctacgtttaatttca

SEQ ID NO: 836523 - DNA, 25 bp, Mus musculus
tctgtgttttcttcgtttaatttca

SEQ ID NO: 836524 - DNA, 25 bp, Mus musculus
tctgttaactgaatgtgctcacgga

SEQ ID NO: 836525 - DNA, 25 bp, Mus musculus
tctgttaactgattgtgctcacgga

SEQ ID NO: 836526 - DNA, 25 bp, Mus musculus
tctgttaacttcacctgagcaggaa

SEQ ID NO: 836527 - DNA, 25 bp, Mus musculus
tctgttaacttctcctgagcaggaa

SEQ ID NO: 836528 - DNA, 25 bp, Mus musculus
tctgttaaggaaatggactttagct

SEQ ID NO: 836529 - DNA, 25 bp, Mus musculus
tctgttaaggaattggactttagct

SEQ ID NO: 836530 - DNA, 25 bp, Mus musculus
tctgttaatgccagggattagaccc

SEQ ID NO: 836531 - DNA, 25 bp, Mus musculus
tctgttaatgcctgggattagaccc

SEQ ID NO: 836532 - DNA, 25 bp, Mus musculus
tctgttacacccaggaatccttgaa

SEQ ID NO: 836533 - DNA, 25 bp, Mus musculus
tctgttacaccctggaatccttgaa

SEQ ID NO: 836534 - DNA, 25 bp, Mus musculus
tctgttaccatgctctcctccaatt

SEQ ID NO: 836535 - DNA, 25 bp, Mus musculus
tctgttaccatggtctcctccaatt

SEQ ID NO: 836536 - DNA, 25 bp, Mus musculus
tctgttaccccacaggctagcatgg

SEQ ID NO: 836537 - DNA, 25 bp, Mus musculus
tctgttaccccagaggctagcatgg

SEQ ID NO: 836538 - DNA, 25 bp, Mus musculus
tctgttaccggtcgatacactttaa

SEQ ID NO: 836539 - DNA, 25 bp, Mus musculus
tctgttaccggtggatacactttaa

SEQ ID NO: 836540 - DNA, 25 bp, Mus musculus
tctgttacctgcagctgattggcaa

SEQ ID NO: 836541 - DNA, 25 bp, Mus musculus
tctgttacctgctgctgattggcaa

SEQ ID NO: 836542 - DNA, 25 bp, Mus musculus
tctgttacctgtacacacaagctta

SEQ ID NO: 836543 - DNA, 25 bp, Mus musculus
tctgttacctgttcacacaagctta

SEQ ID NO: 836544 - DNA, 25 bp, Mus musculus
tctgttactatgactcgaatttggt

SEQ ID NO: 836545 - DNA, 25 bp, Mus musculus
tctgttactatgtctcgaatttggt

SEQ ID NO: 836546 - DNA, 25 bp, Mus musculus
tctgttactcaccaggctgggaaga

SEQ ID NO: 836547 - DNA, 25 bp, Mus musculus
tctgttactcacgaggctgggaaga

SEQ ID NO: 836548 - DNA, 25 bp, Mus musculus
tctgttactctacaagcccctgaag

SEQ ID NO: 836549 - DNA, 25 bp, Mus musculus
tctgttactctagaagcccctgaag

SEQ ID NO: 836550 - DNA, 25 bp, Mus musculus
tctgttactgaactgtgggtccaaa

SEQ ID NO: 836551 - DNA, 25 bp, Mus musculus
tctgttactgaagtgtgggtccaaa

SEQ ID NO: 836552 - DNA, 25 bp, Mus musculus
tctgttacttttagaagggctcatg

SEQ ID NO: 836553 - DNA, 25 bp, Mus musculus
tctgttactttttgaagggctcatg

SEQ ID NO: 836554 - DNA, 25 bp, Mus musculus
tctgttagcagcatgttcacatttg

SEQ ID NO: 836555 - DNA, 25 bp, Mus musculus
tctgttagcagcttgttcacatttg

SEQ ID NO: 836556 - DNA, 25 bp, Mus musculus
tctgttagctcccaagagacttgga

SEQ ID NO: 836557 - DNA, 25 bp, Mus musculus
tctgttagctccgaagagacttgga

SEQ ID NO: 836558 - DNA, 25 bp, Mus musculus
tctgttatacttactgttccctatg

SEQ ID NO: 836559 - DNA, 25 bp, Mus musculus
tctgttatactttctgttccctatg

SEQ ID NO: 836560 - DNA, 25 bp, Mus musculus
tctgttatattcaaagccctgggcc

SEQ ID NO: 836561 - DNA, 25 bp, Mus musculus
tctgttatattctaagccctgggcc

SEQ ID NO: 836562 - DNA, 25 bp, Mus musculus
tctgttatcccacccagagtttcga

SEQ ID NO: 836563 - DNA, 25 bp, Mus musculus
tctgttatcccagccagagtttcga

SEQ ID NO: 836564 - DNA, 25 bp, Mus musculus
tctgttatctctccgtagtccaaaa

SEQ ID NO: 836565 - DNA, 25 bp, Mus musculus
tctgttatctctgcgtagtccaaaa

SEQ ID NO: 836566 - DNA, 25 bp, Mus musculus
tctgttatgagactggtggtcccag

SEQ ID NO: 836567 - DNA, 25 bp, Mus musculus
tctgttatgagagtggtggtcccag

SEQ ID NO: 836568 - DNA, 25 bp, Mus musculus
tctgttatgagtccctgaccaagtg

SEQ ID NO: 836569 - DNA, 25 bp, Mus musculus
tctgttatgagtgcctgaccaagtg

SEQ ID NO: 836570 - DNA, 25 bp, Mus musculus
tctgttatgggtattcctgttttgt

SEQ ID NO: 836571 - DNA, 25 bp, Mus musculus
tctgttatgggttttcctgttttgt

SEQ ID NO: 836572 - DNA, 25 bp, Mus musculus
tctgttatttttctcacctttatgt

SEQ ID NO: 836573 - DNA, 25 bp, Mus musculus
tctgttatttttgtcacctttatgt

SEQ ID NO: 836574 - DNA, 25 bp, Mus musculus
tctgttcaacaacgtggacggccat

SEQ ID NO: 836575 - DNA, 25 bp, Mus musculus
tctgttcaacaaggtggacggccat

SEQ ID NO: 836576 - DNA, 25 bp, Mus musculus
tctgttcaacttacaaaagggtagc

SEQ ID NO: 836577 - DNA, 25 bp, Mus musculus
tctgttcaactttcaaaagggtagc

SEQ ID NO: 836578 - DNA, 25 bp, Mus musculus
tctgttcacgggaccaaagtcctta

SEQ ID NO: 836579 - DNA, 25 bp, Mus musculus
tctgttcacgggtccaaagtcctta

SEQ ID NO: 836580 - DNA, 25 bp, Mus musculus
tctgttcagccaccaagtggcactt

SEQ ID NO: 836581 - DNA, 25 bp, Mus musculus
tctgttcagccagcaagtggcactt

SEQ ID NO: 836582 - DNA, 25 bp, Mus musculus
tctgttcagcttccagtgccatctt

SEQ ID NO: 836583 - DNA, 25 bp, Mus musculus
tctgttcagcttgcagtgccatctt

SEQ ID NO: 836584 - DNA, 25 bp, Mus musculus
tctgttcataccaaccgtatcaagg

SEQ ID NO: 836585 - DNA, 25 bp, Mus musculus
tctgttcatacctaccgtatcaagg

SEQ ID NO: 836586 - DNA, 25 bp, Mus musculus
tctgttcatcccaaccatatgaggc

SEQ ID NO: 836587 - DNA, 25 bp, Mus musculus
tctgttcatccctaccatatgaggc

SEQ ID NO: 836588 - DNA, 25 bp, Mus musculus
tctgttcatgaactgggttgcccat

SEQ ID NO: 836589 - DNA, 25 bp, Mus musculus
tctgttcatgaagtgggttgcccat

SEQ ID NO: 836590 - DNA, 25 bp, Mus musculus
tctgttcatgatctttagcagggaa

SEQ ID NO: 836591 - DNA, 25 bp, Mus musculus
tctgttcatgatgtttagcagggaa

SEQ ID NO: 836592 - DNA, 25 bp, Mus musculus
tctgttcatgccagcaagtgttgct

SEQ ID NO: 836593 - DNA, 25 bp, Mus musculus
tctgttcatgcccagttgctgtaca

SEQ ID NO: 836594 - DNA, 25 bp, Mus musculus
tctgttcatgccgagttgctgtaca

SEQ ID NO: 836595 - DNA, 25 bp, Mus musculus
tctgttcatgcctgcaagtgttgct

SEQ ID NO: 836596 - DNA, 25 bp, Mus musculus
tctgttcatggacctggtgacctgt

SEQ ID NO: 836597 - DNA, 25 bp, Mus musculus
tctgttcatggagctggtgacctgt

SEQ ID NO: 836598 - DNA, 25 bp, Mus musculus
tctgttcccacaagagtgtgacgtg

SEQ ID NO: 836599 - DNA, 25 bp, Mus musculus
tctgttcccacatgagtgtgacgtg

SEQ ID NO: 836600 - DNA, 25 bp, Mus musculus
tctgttccccttattattctcagga

SEQ ID NO: 836601 - DNA, 25 bp, Mus musculus
tctgttcccctttttattctcagga

SEQ ID NO: 836602 - DNA, 25 bp, Mus musculus
tctgttccctctcttggctttaaaa

SEQ ID NO: 836603 - DNA, 25 bp, Mus musculus
tctgttccctctgttggctttaaaa

SEQ ID NO: 836604 - DNA, 25 bp, Mus musculus
tctgttcccttcaaatgctgtcgaa

SEQ ID NO: 836605 - DNA, 25 bp, Mus musculus
tctgttcccttcatctgtgaagtgt

SEQ ID NO: 836606 - DNA, 25 bp, Mus musculus
tctgttcccttctaatgctgtcgaa

SEQ ID NO: 836607 - DNA, 25 bp, Mus musculus
tctgttcccttcttctgtgaagtgt

SEQ ID NO: 836608 - DNA, 25 bp, Mus musculus
tctgttcctcttcaaatttacctcc

SEQ ID NO: 836609 - DNA, 25 bp, Mus musculus
tctgttcctcttgaaatttacctcc

SEQ ID NO: 836610 - DNA, 25 bp, Mus musculus
tctgttcctggtccagctggaagca

SEQ ID NO: 836611 - DNA, 25 bp, Mus musculus
tctgttcctggtgcagctggaagca

SEQ ID NO: 836612 - DNA, 25 bp, Mus musculus
tctgttcctgtgactaggcggacta

SEQ ID NO: 836613 - DNA, 25 bp, Mus musculus
tctgttcctgtgatcatgcctgttt

SEQ ID NO: 836614 - DNA, 25 bp, Mus musculus
tctgttcctgtgtctaggcggacta

SEQ ID NO: 836615 - DNA, 25 bp, Mus musculus
tctgttcctgtgttcatgcctgttt

SEQ ID NO: 836616 - DNA, 25 bp, Mus musculus
tctgttccttttctgactgtcattc

SEQ ID NO: 836617 - DNA, 25 bp, Mus musculus
tctgttccttttgtgactgtcattc

SEQ ID NO: 836618 - DNA, 25 bp, Mus musculus
tctgttcgcaagaccctggccgttt

SEQ ID NO: 836619 - DNA, 25 bp, Mus musculus
tctgttcgcaagtccctggccgttt

SEQ ID NO: 836620 - DNA, 25 bp, Mus musculus
tctgttcgctgcacaggagagctct

SEQ ID NO: 836621 - DNA, 25 bp, Mus musculus
tctgttcgctgctcaggagagctct

SEQ ID NO: 836622 - DNA, 25 bp, Mus musculus
tctgttcggcgactgtgctgctgaa

SEQ ID NO: 836623 - DNA, 25 bp, Mus musculus
tctgttcggcgagtgtgctgctgaa

SEQ ID NO: 836624 - DNA, 25 bp, Mus musculus
tctgttctaattatcttggtccttc

SEQ ID NO: 836625 - DNA, 25 bp, Mus musculus
tctgttctaattttcttggtccttc

SEQ ID NO: 836626 - DNA, 25 bp, Mus musculus
tctgttctacccaattgacttactt

SEQ ID NO: 836627 - DNA, 25 bp, Mus musculus
tctgttctaccctattgacttactt

SEQ ID NO: 836628 - DNA, 25 bp, Mus musculus
tctgttctagagaacccgagcatta

SEQ ID NO: 836629 - DNA, 25 bp, Mus musculus
tctgttctagagtacccgagcatta

SEQ ID NO: 836630 - DNA, 25 bp, Mus musculus
tctgttctatacacagtgtcacact

SEQ ID NO: 836631 - DNA, 25 bp, Mus musculus
tctgttctatactcagtgtcacact

SEQ ID NO: 836632 - DNA, 25 bp, Mus musculus
tctgttctattgaacttctttattg

SEQ ID NO: 836633 - DNA, 25 bp, Mus musculus
tctgttctattgtacttctttattg

SEQ ID NO: 836634 - DNA, 25 bp, Mus musculus
tctgttctcactcatcaacggagac

SEQ ID NO: 836635 - DNA, 25 bp, Mus musculus
tctgttctcactgatcaacggagac

SEQ ID NO: 836636 - DNA, 25 bp, Mus musculus
tctgttctcagcagactggttgagc

SEQ ID NO: 836637 - DNA, 25 bp, Mus musculus
tctgttctcagctgactggttgagc

SEQ ID NO: 836638 - DNA, 25 bp, Mus musculus
tctgttctcagtccagcagggctta

SEQ ID NO: 836639 - DNA, 25 bp, Mus musculus
tctgttctcagtgcagcagggctta

SEQ ID NO: 836640 - DNA, 25 bp, Mus musculus
tctgttctcatcctgctgggtgaga

SEQ ID NO: 836641 - DNA, 25 bp, Mus musculus
tctgttctcatcgtgctgggtgaga

SEQ ID NO: 836642 - DNA, 25 bp, Mus musculus
tctgttctcctacggttgagtcact

SEQ ID NO: 836643 - DNA, 25 bp, Mus musculus
tctgttctcctagggttgagtcact

SEQ ID NO: 836644 - DNA, 25 bp, Mus musculus
tctgttctcgtgactggtttggaaa

SEQ ID NO: 836645 - DNA, 25 bp, Mus musculus
tctgttctcgtgtctggtttggaaa

SEQ ID NO: 836646 - DNA, 25 bp, Mus musculus
tctgttctctacaactcaccaatga

SEQ ID NO: 836647 - DNA, 25 bp, Mus musculus
tctgttctctacattctctggaaga

SEQ ID NO: 836648 - DNA, 25 bp, Mus musculus
tctgttctctactactcaccaatga

SEQ ID NO: 836649 - DNA, 25 bp, Mus musculus
tctgttctctactttctctggaaga

SEQ ID NO: 836650 - DNA, 25 bp, Mus musculus
tctgttctctgtagtttctgcacgg

SEQ ID NO: 836651 - DNA, 25 bp, Mus musculus
tctgttctctgttgtttctgcacgg

SEQ ID NO: 836652 - DNA, 25 bp, Mus musculus
tctgttctgaagatacaatgtcctc

SEQ ID NO: 836653 - DNA, 25 bp, Mus musculus
tctgttctgaagttacaatgtcctc

SEQ ID NO: 836654 - DNA, 25 bp, Mus musculus
tctgttctgagcagtgagattccac

SEQ ID NO: 836655 - DNA, 25 bp, Mus musculus
tctgttctgagcctagtgtttgctt

SEQ ID NO: 836656 - DNA, 25 bp, Mus musculus
tctgttctgagcgtagtgtttgctt

SEQ ID NO: 836657 - DNA, 25 bp, Mus musculus
tctgttctgagctgtgagattccac

SEQ ID NO: 836658 - DNA, 25 bp, Mus musculus
tctgttctgatcaagctgacacttc

SEQ ID NO: 836659 - DNA, 25 bp, Mus musculus
tctgttctgatctagctgacacttc

SEQ ID NO: 836660 - DNA, 25 bp, Mus musculus
tctgttctgctactaacggctggag

SEQ ID NO: 836661 - DNA, 25 bp, Mus musculus
tctgttctgctagtaacggctggag

SEQ ID NO: 836662 - DNA, 25 bp, Mus musculus
tctgttctgtccagggcagcactga

SEQ ID NO: 836663 - DNA, 25 bp, Mus musculus
tctgttctgtcctgggcagcactga

SEQ ID NO: 836664 - DNA, 25 bp, Mus musculus
tctgttcttaaacctctgtccactg

SEQ ID NO: 836665 - DNA, 25 bp, Mus musculus
tctgttcttaaagctctgtccactg

SEQ ID NO: 836666 - DNA, 25 bp, Mus musculus
tctgttcttatcaattttctctcaa

SEQ ID NO: 836667 - DNA, 25 bp, Mus musculus
tctgttcttatctattttctctcaa

SEQ ID NO: 836668 - DNA, 25 bp, Mus musculus
tctgttcttcctattctgggttcct

SEQ ID NO: 836669 - DNA, 25 bp, Mus musculus
tctgttcttccttttctgggttcct

SEQ ID NO: 836670 - DNA, 25 bp, Mus musculus
tctgttcttgggaggatgctgcgct

SEQ ID NO: 836671 - DNA, 25 bp, Mus musculus
tctgttcttgggtggatgctgcgct

SEQ ID NO: 836672 - DNA, 25 bp, Mus musculus
tctgttcttgtcctgcactttagca

SEQ ID NO: 836673 - DNA, 25 bp, Mus musculus
tctgttcttgtcgtgcactttagca

SEQ ID NO: 836674 - DNA, 25 bp, Mus musculus
tctgttctttttcggatagagctcc

SEQ ID NO: 836675 - DNA, 25 bp, Mus musculus
tctgttctttttgggatagagctcc

SEQ ID NO: 836676 - DNA, 25 bp, Mus musculus
tctgttgaactgctttcctcttttg

SEQ ID NO: 836677 - DNA, 25 bp, Mus musculus
tctgttgaactggtttcctcttttg

SEQ ID NO: 836678 - DNA, 25 bp, Mus musculus
tctgttgaagatcagataaactgag

SEQ ID NO: 836679 - DNA, 25 bp, Mus musculus
tctgttgaagatgagataaactgag

SEQ ID NO: 836680 - DNA, 25 bp, Mus musculus
tctgttgacggcatgtggtggcaca

SEQ ID NO: 836681 - DNA, 25 bp, Mus musculus
tctgttgacggcttgtggtggcaca

SEQ ID NO: 836682 - DNA, 25 bp, Mus musculus
tctgttgagatccttgattcacttg

SEQ ID NO: 836683 - DNA, 25 bp, Mus musculus
tctgttgagatcgttgattcacttg

SEQ ID NO: 836684 - DNA, 25 bp, Mus musculus
tctgttgagccaagttcgaatccca

SEQ ID NO: 836685 - DNA, 25 bp, Mus musculus
tctgttgagccatgttcgaatccca

SEQ ID NO: 836686 - DNA, 25 bp, Mus musculus
tctgttgagcttcttcccagggaag

SEQ ID NO: 836687 - DNA, 25 bp, Mus musculus
tctgttgagcttgttcccagggaag

SEQ ID NO: 836688 - DNA, 25 bp, Mus musculus
tctgttgatattcctactgttaatt

SEQ ID NO: 836689 - DNA, 25 bp, Mus musculus
tctgttgatattgctactgttaatt

SEQ ID NO: 836690 - DNA, 25 bp, Mus musculus
tctgttgatcctatatattcccgtc

SEQ ID NO: 836691 - DNA, 25 bp, Mus musculus
tctgttgatcctttatattcccgtc

SEQ ID NO: 836692 - DNA, 25 bp, Mus musculus
tctgttgcacaacgattccagccct

SEQ ID NO: 836693 - DNA, 25 bp, Mus musculus
tctgttgcacaaggattccagccct

SEQ ID NO: 836694 - DNA, 25 bp, Mus musculus
tctgttgcagagagtccagcacctt

SEQ ID NO: 836695 - DNA, 25 bp, Mus musculus
tctgttgcagagtgtccagcacctt

SEQ ID NO: 836696 - DNA, 25 bp, Mus musculus
tctgttgccaaaagtactctctatt

SEQ ID NO: 836697 - DNA, 25 bp, Mus musculus
tctgttgccaaatgtactctctatt

SEQ ID NO: 836698 - DNA, 25 bp, Mus musculus
tctgttgccaacattttataatggg

SEQ ID NO: 836699 - DNA, 25 bp, Mus musculus
tctgttgccaactttttataatggg

SEQ ID NO: 836700 - DNA, 25 bp, Mus musculus
tctgttgcccagaactataacctag

SEQ ID NO: 836701 - DNA, 25 bp, Mus musculus
tctgttgcccagtactataacctag

SEQ ID NO: 836702 - DNA, 25 bp, Mus musculus
tctgttgccccgagaatagatttgg

SEQ ID NO: 836703 - DNA, 25 bp, Mus musculus
tctgttgccccgtgaatagatttgg

SEQ ID NO: 836704 - DNA, 25 bp, Mus musculus
tctgttgcctttcctctgatgacct

SEQ ID NO: 836705 - DNA, 25 bp, Mus musculus
tctgttgcctttgctctgatgacct

SEQ ID NO: 836706 - DNA, 25 bp, Mus musculus
tctgttgcgctaatacatctgcgtt

SEQ ID NO: 836707 - DNA, 25 bp, Mus musculus
tctgttgcgctattacatctgcgtt

SEQ ID NO: 836708 - DNA, 25 bp, Mus musculus
tctgttgcttttaccgctgctcacc

SEQ ID NO: 836709 - DNA, 25 bp, Mus musculus
tctgttgctttttccgctgctcacc

SEQ ID NO: 836710 - DNA, 25 bp, Mus musculus
tctgttggaataagcaaggactgtg

SEQ ID NO: 836711 - DNA, 25 bp, Mus musculus
tctgttggaatatgcaaggactgtg

SEQ ID NO: 836712 - DNA, 25 bp, Mus musculus
tctgttggcaaaaggaggcacactt

SEQ ID NO: 836713 - DNA, 25 bp, Mus musculus
tctgttggcaaatggaggcacactt

SEQ ID NO: 836714 - DNA, 25 bp, Mus musculus
tctgttggcataccctcgtggagga

SEQ ID NO: 836715 - DNA, 25 bp, Mus musculus
tctgttggcatagcctcgtggagga

SEQ ID NO: 836716 - DNA, 25 bp, Mus musculus
tctgttgggcctctaagatggttca

SEQ ID NO: 836717 - DNA, 25 bp, Mus musculus
tctgttgggcctgtaagatggttca

SEQ ID NO: 836718 - DNA, 25 bp, Mus musculus
tctgttggtgttagtgtggcacttg

SEQ ID NO: 836719 - DNA, 25 bp, Mus musculus
tctgttggtgtttgtgtggcacttg

SEQ ID NO: 836720 - DNA, 25 bp, Mus musculus
tctgttggttcccaatgtgtagtct

SEQ ID NO: 836721 - DNA, 25 bp, Mus musculus
tctgttggttccgaatgtgtagtct

SEQ ID NO: 836722 - DNA, 25 bp, Mus musculus
tctgttgtaaatacccctcacggag

SEQ ID NO: 836723 - DNA, 25 bp, Mus musculus
tctgttgtaaatattccgctcgggt

SEQ ID NO: 836724 - DNA, 25 bp, Mus musculus
tctgttgtaaattcccctcacggag

SEQ ID NO: 836725 - DNA, 25 bp, Mus musculus
tctgttgtaaattttccgctcgggt

SEQ ID NO: 836726 - DNA, 25 bp, Mus musculus
tctgttgtacatcactacctaccgg

SEQ ID NO: 836727 - DNA, 25 bp, Mus musculus
tctgttgtacatgactacctaccgg

SEQ ID NO: 836728 - DNA, 25 bp, Mus musculus
tctgttgtaccaagaccaggtcttc

SEQ ID NO: 836729 - DNA, 25 bp, Mus musculus
tctgttgtaccactgcagaacatgg

SEQ ID NO: 836730 - DNA, 25 bp, Mus musculus
tctgttgtaccagtgcagaacatgg

SEQ ID NO: 836731 - DNA, 25 bp, Mus musculus
tctgttgtaccatgaccaggtcttc

SEQ ID NO: 836732 - DNA, 25 bp, Mus musculus
tctgttgtactgctaatttaactct

SEQ ID NO: 836733 - DNA, 25 bp, Mus musculus
tctgttgtactggtaatttaactct

SEQ ID NO: 836734 - DNA, 25 bp, Mus musculus
tctgttgtaggtctcagccagccaa

SEQ ID NO: 836735 - DNA, 25 bp, Mus musculus
tctgttgtaggtgtcagccagccaa

SEQ ID NO: 836736 - DNA, 25 bp, Mus musculus
tctgttgtcaaaatgaggcctccat

SEQ ID NO: 836737 - DNA, 25 bp, Mus musculus
tctgttgtcaaattgaggcctccat

SEQ ID NO: 836738 - DNA, 25 bp, Mus musculus
tctgttgtcatcacgcagcaggcag

SEQ ID NO: 836739 - DNA, 25 bp, Mus musculus
tctgttgtcatctcgcagcaggcag

SEQ ID NO: 836740 - DNA, 25 bp, Mus musculus
tctgttgtccagacgggcacatgca

SEQ ID NO: 836741 - DNA, 25 bp, Mus musculus
tctgttgtccagtcgggcacatgca

SEQ ID NO: 836742 - DNA, 25 bp, Mus musculus
tctgttgtccgtcactgatacactg

SEQ ID NO: 836743 - DNA, 25 bp, Mus musculus
tctgttgtccgtgactgatacactg

SEQ ID NO: 836744 - DNA, 25 bp, Mus musculus
tctgttgtctgaagtgcctcattct

SEQ ID NO: 836745 - DNA, 25 bp, Mus musculus
tctgttgtctgacggctctcttcaa

SEQ ID NO: 836746 - DNA, 25 bp, Mus musculus
tctgttgtctgagggctctcttcaa

SEQ ID NO: 836747 - DNA, 25 bp, Mus musculus
tctgttgtctgatgtgcctcattct

SEQ ID NO: 836748 - DNA, 25 bp, Mus musculus
tctgttgtctggactctgtgtagaa

SEQ ID NO: 836749 - DNA, 25 bp, Mus musculus
tctgttgtctggtctctgtgtagaa

SEQ ID NO: 836750 - DNA, 25 bp, Mus musculus
tctgttgtgatcaaccctcttttaa

SEQ ID NO: 836751 - DNA, 25 bp, Mus musculus
tctgttgtgatcataggaccacttt

SEQ ID NO: 836752 - DNA, 25 bp, Mus musculus
tctgttgtgatccactgaacacata

SEQ ID NO: 836753 - DNA, 25 bp, Mus musculus
tctgttgtgatcgactgaacacata

SEQ ID NO: 836754 - DNA, 25 bp, Mus musculus
tctgttgtgatctaccctcttttaa

SEQ ID NO: 836755 - DNA, 25 bp, Mus musculus
tctgttgtgatcttaggaccacttt

SEQ ID NO: 836756 - DNA, 25 bp, Mus musculus
tctgttgtgattctcaaactgcgtt

SEQ ID NO: 836757 - DNA, 25 bp, Mus musculus
tctgttgtgattgtcaaactgcgtt

SEQ ID NO: 836758 - DNA, 25 bp, Mus musculus
tctgttgtggctcctagactttaga

SEQ ID NO: 836759 - DNA, 25 bp, Mus musculus
tctgttgtggctgctagactttaga

SEQ ID NO: 836760 - DNA, 25 bp, Mus musculus
tctgttgtgttgagctttggtttag

SEQ ID NO: 836761 - DNA, 25 bp, Mus musculus
tctgttgtgttgtgctttggtttag

SEQ ID NO: 836762 - DNA, 25 bp, Mus musculus
tctgttgttccaattcaggggatcc

SEQ ID NO: 836763 - DNA, 25 bp, Mus musculus
tctgttgttccatttcaggggatcc

SEQ ID NO: 836764 - DNA, 25 bp, Mus musculus
tctgttgttgctatataggcttcct

SEQ ID NO: 836765 - DNA, 25 bp, Mus musculus
tctgttgttgctttataggcttcct

SEQ ID NO: 836766 - DNA, 25 bp, Mus musculus
tctgttgttggtcgaaccctgaaca

SEQ ID NO: 836767 - DNA, 25 bp, Mus musculus
tctgttgttggtggaaccctgaaca

SEQ ID NO: 836768 - DNA, 25 bp, Mus musculus
tctgttgttttgcactcgtccactg

SEQ ID NO: 836769 - DNA, 25 bp, Mus musculus
tctgttgttttggactcgtccactg

SEQ ID NO: 836770 - DNA, 25 bp, Mus musculus
tctgtttaaaacacgggcagaccca

SEQ ID NO: 836771 - DNA, 25 bp, Mus musculus
tctgtttaaaactcgggcagaccca

SEQ ID NO: 836772 - DNA, 25 bp, Mus musculus
tctgtttaaatgctgtgcgtgcata

SEQ ID NO: 836773 - DNA, 25 bp, Mus musculus
tctgtttaaatggtgtgcgtgcata

SEQ ID NO: 836774 - DNA, 25 bp, Mus musculus
tctgtttaagccctcattttgtaat

SEQ ID NO: 836775 - DNA, 25 bp, Mus musculus
tctgtttaagccgtcattttgtaat

SEQ ID NO: 836776 - DNA, 25 bp, Mus musculus
tctgtttacagcatccgtgggaggc

SEQ ID NO: 836777 - DNA, 25 bp, Mus musculus
tctgtttacagcttccgtgggaggc

SEQ ID NO: 836778 - DNA, 25 bp, Mus musculus
tctgtttacagtcacctgctccagc

SEQ ID NO: 836779 - DNA, 25 bp, Mus musculus
tctgtttacagtccgtctacacagc

SEQ ID NO: 836780 - DNA, 25 bp, Mus musculus
tctgtttacagtgacctgctccagc

SEQ ID NO: 836781 - DNA, 25 bp, Mus musculus
tctgtttacagtgcgtctacacagc

SEQ ID NO: 836782 - DNA, 25 bp, Mus musculus
tctgtttactgcctacaataaatgc

SEQ ID NO: 836783 - DNA, 25 bp, Mus musculus
tctgtttactgcgtacaataaatgc

SEQ ID NO: 836784 - DNA, 25 bp, Mus musculus
tctgtttatcaactcttcctccggg

SEQ ID NO: 836785 - DNA, 25 bp, Mus musculus
tctgtttatcaagtcttcctccggg

SEQ ID NO: 836786 - DNA, 25 bp, Mus musculus
tctgtttatcacatgtaggccaggt

SEQ ID NO: 836787 - DNA, 25 bp, Mus musculus
tctgtttatcaccagggaacatatt

SEQ ID NO: 836788 - DNA, 25 bp, Mus musculus
tctgtttatcacgagggaacatatt

SEQ ID NO: 836789 - DNA, 25 bp, Mus musculus
tctgtttatcacttgtaggccaggt

SEQ ID NO: 836790 - DNA, 25 bp, Mus musculus
tctgtttcagaacttgtggaaggca

SEQ ID NO: 836791 - DNA, 25 bp, Mus musculus
tctgtttcagaagttgtggaaggca

SEQ ID NO: 836792 - DNA, 25 bp, Mus musculus
tctgtttcatatctatgattcggac

SEQ ID NO: 836793 - DNA, 25 bp, Mus musculus
tctgtttcatatgtatgattcggac

SEQ ID NO: 836794 - DNA, 25 bp, Mus musculus
tctgtttcatccacctgtcatttca

SEQ ID NO: 836795 - DNA, 25 bp, Mus musculus
tctgtttcatcctcctgtcatttca

SEQ ID NO: 836796 - DNA, 25 bp, Mus musculus
tctgtttcatgtcgagaatttgtct

SEQ ID NO: 836797 - DNA, 25 bp, Mus musculus
tctgtttcatgtcgtgtcgatattc

SEQ ID NO: 836798 - DNA, 25 bp, Mus musculus
tctgtttcatgtggagaatttgtct

SEQ ID NO: 836799 - DNA, 25 bp, Mus musculus
tctgtttcatgtggtgtcgatattc

SEQ ID NO: 836800 - DNA, 25 bp, Mus musculus
tctgtttcattgaggctctgagttc

SEQ ID NO: 836801 - DNA, 25 bp, Mus musculus
tctgtttcattgtggctctgagttc

SEQ ID NO: 836802 - DNA, 25 bp, Mus musculus
tctgtttccactacacatttgtgag

SEQ ID NO: 836803 - DNA, 25 bp, Mus musculus
tctgtttccacttcacatttgtgag

SEQ ID NO: 836804 - DNA, 25 bp, Mus musculus
tctgtttccatgactcaagtgtttg

SEQ ID NO: 836805 - DNA, 25 bp, Mus musculus
tctgtttccatgtctcaagtgtttg

SEQ ID NO: 836806 - DNA, 25 bp, Mus musculus
tctgtttcccaactgagctactcac

SEQ ID NO: 836807 - DNA, 25 bp, Mus musculus
tctgtttcccaagtgagctactcac

SEQ ID NO: 836808 - DNA, 25 bp, Mus musculus
tctgtttcctagacttatacacgtg

SEQ ID NO: 836809 - DNA, 25 bp, Mus musculus
tctgtttcctagtcttatacacgtg

SEQ ID NO: 836810 - DNA, 25 bp, Mus musculus
tctgtttcctatcttgaggtttaat

SEQ ID NO: 836811 - DNA, 25 bp, Mus musculus
tctgtttcctatgttgaggtttaat

SEQ ID NO: 836812 - DNA, 25 bp, Mus musculus
tctgtttcctgaactacttgtcttg

SEQ ID NO: 836813 - DNA, 25 bp, Mus musculus
tctgtttcctgatctacttgtcttg

SEQ ID NO: 836814 - DNA, 25 bp, Mus musculus
tctgtttcctttcccggttcttcga

SEQ ID NO: 836815 - DNA, 25 bp, Mus musculus
tctgtttcctttgccggttcttcga

SEQ ID NO: 836816 - DNA, 25 bp, Mus musculus
tctgtttcggttacgctttgcccac

SEQ ID NO: 836817 - DNA, 25 bp, Mus musculus
tctgtttcggtttcgctttgcccac

SEQ ID NO: 836818 - DNA, 25 bp, Mus musculus
tctgtttctaggctgaatgtccact

SEQ ID NO: 836819 - DNA, 25 bp, Mus musculus
tctgtttctagggtgaatgtccact

SEQ ID NO: 836820 - DNA, 25 bp, Mus musculus
tctgtttctattccttcctttttta

SEQ ID NO: 836821 - DNA, 25 bp, Mus musculus
tctgtttctattgcttcctttttta

SEQ ID NO: 836822 - DNA, 25 bp, Mus musculus
tctgtttctctgatgctgtcagaaa

SEQ ID NO: 836823 - DNA, 25 bp, Mus musculus
tctgtttctctgttgctgtcagaaa

SEQ ID NO: 836824 - DNA, 25 bp, Mus musculus
tctgtttctgacactcgctggtcag

SEQ ID NO: 836825 - DNA, 25 bp, Mus musculus
tctgtttctgactctcgctggtcag

SEQ ID NO: 836826 - DNA, 25 bp, Mus musculus
tctgtttctgtgagactatgtgact

SEQ ID NO: 836827 - DNA, 25 bp, Mus musculus
tctgtttctgtgtgactatgtgact

SEQ ID NO: 836828 - DNA, 25 bp, Mus musculus
tctgtttcttcaatctacatcttga

SEQ ID NO: 836829 - DNA, 25 bp, Mus musculus
tctgtttcttcattctacatcttga

SEQ ID NO: 836830 - DNA, 25 bp, Mus musculus
tctgtttcttgtaatcgcctttgtc

SEQ ID NO: 836831 - DNA, 25 bp, Mus musculus
tctgtttcttgttatcgcctttgtc

SEQ ID NO: 836832 - DNA, 25 bp, Mus musculus
tctgtttcttttctactctgactac

SEQ ID NO: 836833 - DNA, 25 bp, Mus musculus
tctgtttcttttgtactctgactac

SEQ ID NO: 836834 - DNA, 25 bp, Mus musculus
tctgtttgacgtatcaaaggcttcc

SEQ ID NO: 836835 - DNA, 25 bp, Mus musculus
tctgtttgacgtttcaaaggcttcc

SEQ ID NO: 836836 - DNA, 25 bp, Mus musculus
tctgtttgaggcagtttcttcgctt

SEQ ID NO: 836837 - DNA, 25 bp, Mus musculus
tctgtttgaggctgtttcttcgctt

SEQ ID NO: 836838 - DNA, 25 bp, Mus musculus
tctgtttgccagatgcctggagctc

SEQ ID NO: 836839 - DNA, 25 bp, Mus musculus
tctgtttgccagttgcctggagctc

SEQ ID NO: 836840 - DNA, 25 bp, Mus musculus
tctgtttgctggacttccttccaaa

SEQ ID NO: 836841 - DNA, 25 bp, Mus musculus
tctgtttgctggtcttccttccaaa

SEQ ID NO: 836842 - DNA, 25 bp, Mus musculus
tctgtttgctgtcttttgagttctg

SEQ ID NO: 836843 - DNA, 25 bp, Mus musculus
tctgtttgctgtgttttgagttctg

SEQ ID NO: 836844 - DNA, 25 bp, Mus musculus
tctgtttggaagcagttgcggcatc

SEQ ID NO: 836845 - DNA, 25 bp, Mus musculus
tctgtttggaaggagttgcggcatc

SEQ ID NO: 836846 - DNA, 25 bp, Mus musculus
tctgtttgggttactgcacgcactt

SEQ ID NO: 836847 - DNA, 25 bp, Mus musculus
tctgtttgggtttctgcacgcactt

SEQ ID NO: 836848 - DNA, 25 bp, Mus musculus
tctgtttgtccaactgctgaaatat

SEQ ID NO: 836849 - DNA, 25 bp, Mus musculus
tctgtttgtccatctgctgaaatat

SEQ ID NO: 836850 - DNA, 25 bp, Mus musculus
tctgtttgtggtagtttcactgtat

SEQ ID NO: 836851 - DNA, 25 bp, Mus musculus
tctgtttgtggttgtttcactgtat

SEQ ID NO: 836852 - DNA, 25 bp, Mus musculus
tctgttttacatattacctttgaat

SEQ ID NO: 836853 - DNA, 25 bp, Mus musculus
tctgttttacattttacctttgaat

SEQ ID NO: 836854 - DNA, 25 bp, Mus musculus
tctgttttacggcatcatggctgcc

SEQ ID NO: 836855 - DNA, 25 bp, Mus musculus
tctgttttacgggatcatggctgcc

SEQ ID NO: 836856 - DNA, 25 bp, Mus musculus
tctgttttactccattttggtttgg

SEQ ID NO: 836857 - DNA, 25 bp, Mus musculus
tctgttttactcgattttggtttgg

SEQ ID NO: 836858 - DNA, 25 bp, Mus musculus
tctgttttatttcgctcatgaattg

SEQ ID NO: 836859 - DNA, 25 bp, Mus musculus
tctgttttatttggctcatgaattg

SEQ ID NO: 836860 - DNA, 25 bp, Mus musculus
tctgttttcaagaagagttccatat

SEQ ID NO: 836861 - DNA, 25 bp, Mus musculus
tctgttttcaagtagagttccatat

SEQ ID NO: 836862 - DNA, 25 bp, Mus musculus
tctgttttcaatatgtataagtgtc

SEQ ID NO: 836863 - DNA, 25 bp, Mus musculus
tctgttttcaatttgtataagtgtc

SEQ ID NO: 836864 - DNA, 25 bp, Mus musculus
tctgttttccttaaaagatcagtat

SEQ ID NO: 836865 - DNA, 25 bp, Mus musculus
tctgttttccttctcattgtgtatg

SEQ ID NO: 836866 - DNA, 25 bp, Mus musculus
tctgttttccttgtcattgtgtatg

SEQ ID NO: 836867 - DNA, 25 bp, Mus musculus
tctgttttcctttaaagatcagtat

SEQ ID NO: 836868 - DNA, 25 bp, Mus musculus
tctgttttcgtcaggttttgccgta

SEQ ID NO: 836869 - DNA, 25 bp, Mus musculus
tctgttttcgtctggttttgccgta

SEQ ID NO: 836870 - DNA, 25 bp, Mus musculus
tctgttttgctgctgattggtttaa

SEQ ID NO: 836871 - DNA, 25 bp, Mus musculus
tctgttttgctggtgattggtttaa

SEQ ID NO: 836872 - DNA, 25 bp, Mus musculus
tctgttttgtaaaggaactttcaag

SEQ ID NO: 836873 - DNA, 25 bp, Mus musculus
tctgttttgtaatggaactttcaag

SEQ ID NO: 836874 - DNA, 25 bp, Mus musculus
tctgttttgtgaaatggtcctgttt

SEQ ID NO: 836875 - DNA, 25 bp, Mus musculus
tctgttttgtgatatggtcctgttt

SEQ ID NO: 836876 - DNA, 25 bp, Mus musculus
tctgttttgtggatactgaagttca

SEQ ID NO: 836877 - DNA, 25 bp, Mus musculus
tctgttttgtggttactgaagttca

SEQ ID NO: 836878 - DNA, 25 bp, Mus musculus
tctgtttttaacacacctagtgtgg

SEQ ID NO: 836879 - DNA, 25 bp, Mus musculus
tctgtttttaactcacctagtgtgg

SEQ ID NO: 836880 - DNA, 25 bp, Mus musculus
tctgtttttcagaacgggtcgtgct

SEQ ID NO: 836881 - DNA, 25 bp, Mus musculus
tctgtttttcagtacgggtcgtgct

SEQ ID NO: 836882 - DNA, 25 bp, Mus musculus
tctgtttttccacttgtccgtctgt

SEQ ID NO: 836883 - DNA, 25 bp, Mus musculus
tctgtttttccagttgtccgtctgt

SEQ ID NO: 836884 - DNA, 25 bp, Mus musculus
tctgtttttcttctaataaacgatt

SEQ ID NO: 836885 - DNA, 25 bp, Mus musculus
tctgtttttcttctttccaccttgt

SEQ ID NO: 836886 - DNA, 25 bp, Mus musculus
tctgtttttcttgtaataaacgatt

SEQ ID NO: 836887 - DNA, 25 bp, Mus musculus
tctgtttttcttgtttccaccttgt

SEQ ID NO: 836888 - DNA, 25 bp, Mus musculus
tcttaaaaatgactagcttggcctt

SEQ ID NO: 836889 - DNA, 25 bp, Mus musculus
tcttaaaaatgagtagcttggcctt

SEQ ID NO: 836890 - DNA, 25 bp, Mus musculus
tcttaaaccagtatcttccagaagg

SEQ ID NO: 836891 - DNA, 25 bp, Mus musculus
tcttaaaccagtttcttccagaagg

SEQ ID NO: 836892 - DNA, 25 bp, Mus musculus
tcttaaagatccctaaacctgacaa

SEQ ID NO: 836893 - DNA, 25 bp, Mus musculus
tcttaaagatccgtaaacctgacaa

SEQ ID NO: 836894 - DNA, 25 bp, Mus musculus
tcttaaagggccagcaggagctcac

SEQ ID NO: 836895 - DNA, 25 bp, Mus musculus
tcttaaagggcctgcaggagctcac

SEQ ID NO: 836896 - DNA, 25 bp, Mus musculus
tcttaaagtcagctggtgtttcttg

SEQ ID NO: 836897 - DNA, 25 bp, Mus musculus
tcttaaagtcaggtggtgtttcttg

SEQ ID NO: 836898 - DNA, 25 bp, Mus musculus
tcttaaataaatatgctgtcctggg

SEQ ID NO: 836899 - DNA, 25 bp, Mus musculus
tcttaaataaatttgctgtcctggg

SEQ ID NO: 836900 - DNA, 25 bp, Mus musculus
tcttaaataaccattcactcccagc

SEQ ID NO: 836901 - DNA, 25 bp, Mus musculus
tcttaaataacctttcactcccagc

SEQ ID NO: 836902 - DNA, 25 bp, Mus musculus
tcttaaatacacatcactagccagg

SEQ ID NO: 836903 - DNA, 25 bp, Mus musculus
tcttaaatacacttcactagccagg

SEQ ID NO: 836904 - DNA, 25 bp, Mus musculus
tcttaaatagcaatttaacccatct

SEQ ID NO: 836905 - DNA, 25 bp, Mus musculus
tcttaaatagcattttaacccatct

SEQ ID NO: 836906 - DNA, 25 bp, Mus musculus
tcttaaatgctgattgattcgtggc

SEQ ID NO: 836907 - DNA, 25 bp, Mus musculus
tcttaaatgctgtttgattcgtggc

SEQ ID NO: 836908 - DNA, 25 bp, Mus musculus
tcttaaatgggtcgccgctgctcaa

SEQ ID NO: 836909 - DNA, 25 bp, Mus musculus
tcttaaatgggtggccgctgctcaa

SEQ ID NO: 836910 - DNA, 25 bp, Mus musculus
tcttaaatggtgctctttgagtcaa

SEQ ID NO: 836911 - DNA, 25 bp, Mus musculus
tcttaaatggtggtctttgagtcaa

SEQ ID NO: 836912 - DNA, 25 bp, Mus musculus
tcttaaattttcatgaatctcgaga

SEQ ID NO: 836913 - DNA, 25 bp, Mus musculus
tcttaaattttcttgaatctcgaga

SEQ ID NO: 836914 - DNA, 25 bp, Mus musculus
tcttaacacaggatcatccaagctg

SEQ ID NO: 836915 - DNA, 25 bp, Mus musculus
tcttaacacaggttcatccaagctg

SEQ ID NO: 836916 - DNA, 25 bp, Mus musculus
tcttaacagccgaccattcacagag

SEQ ID NO: 836917 - DNA, 25 bp, Mus musculus
tcttaacagccgtccattcacagag

SEQ ID NO: 836918 - DNA, 25 bp, Mus musculus
tcttaacatcttagaatggtaccta

SEQ ID NO: 836919 - DNA, 25 bp, Mus musculus
tcttaacatctttgaatggtaccta

SEQ ID NO: 836920 - DNA, 25 bp, Mus musculus
tcttaacattccagtttcctttcct

SEQ ID NO: 836921 - DNA, 25 bp, Mus musculus
tcttaacattcctgtttcctttcct

SEQ ID NO: 836922 - DNA, 25 bp, Mus musculus
tcttaacatttgacccatttctcca

SEQ ID NO: 836923 - DNA, 25 bp, Mus musculus
tcttaacatttgtcccatttctcca

SEQ ID NO: 836924 - DNA, 25 bp, Mus musculus
tcttaaccactacacagtacaccat

SEQ ID NO: 836925 - DNA, 25 bp, Mus musculus
tcttaaccactagacagtacaccat

SEQ ID NO: 836926 - DNA, 25 bp, Mus musculus
tcttaaccatgaccagcggaagcag

SEQ ID NO: 836927 - DNA, 25 bp, Mus musculus
tcttaaccatgagcagcggaagcag

SEQ ID NO: 836928 - DNA, 25 bp, Mus musculus
tcttaaccccagatttccaacaagg

SEQ ID NO: 836929 - DNA, 25 bp, Mus musculus
tcttaaccccagttttccaacaagg

SEQ ID NO: 836930 - DNA, 25 bp, Mus musculus
tcttaaccccttacctgagaatgaa

SEQ ID NO: 836931 - DNA, 25 bp, Mus musculus
tcttaacccctttcctgagaatgaa

SEQ ID NO: 836932 - DNA, 25 bp, Mus musculus
tcttaaccctgtaacaagctgcttg

SEQ ID NO: 836933 - DNA, 25 bp, Mus musculus
tcttaaccctgttacaagctgcttg

SEQ ID NO: 836934 - DNA, 25 bp, Mus musculus
tcttaacctggactaaattctgtag

SEQ ID NO: 836935 - DNA, 25 bp, Mus musculus
tcttaacctggagtaaattctgtag

SEQ ID NO: 836936 - DNA, 25 bp, Mus musculus
tcttaacgttcgctttctgtcacag

SEQ ID NO: 836937 - DNA, 25 bp, Mus musculus
tcttaacgttcggtttctgtcacag

SEQ ID NO: 836938 - DNA, 25 bp, Mus musculus
tcttaactatttctctaacgctccc

SEQ ID NO: 836939 - DNA, 25 bp, Mus musculus
tcttaactatttgtctaacgctccc

SEQ ID NO: 836940 - DNA, 25 bp, Mus musculus
tcttaactccagactcataaggatg

SEQ ID NO: 836941 - DNA, 25 bp, Mus musculus
tcttaactccagtctcataaggatg

SEQ ID NO: 836942 - DNA, 25 bp, Mus musculus
tcttaactgtgaagctgtgctgtaa

SEQ ID NO: 836943 - DNA, 25 bp, Mus musculus
tcttaactgtgatgctgtgctgtaa

SEQ ID NO: 836944 - DNA, 25 bp, Mus musculus
tcttaacttcttactgataccccag

SEQ ID NO: 836945 - DNA, 25 bp, Mus musculus
tcttaacttctttctgataccccag

SEQ ID NO: 836946 - DNA, 25 bp, Mus musculus
tcttaacttggaatttattctccca

SEQ ID NO: 836947 - DNA, 25 bp, Mus musculus
tcttaacttggattttattctccca

SEQ ID NO: 836948 - DNA, 25 bp, Mus musculus
tcttaagaaacgaagggtgcctgcc

SEQ ID NO: 836949 - DNA, 25 bp, Mus musculus
tcttaagaaacgtagggtgcctgcc

SEQ ID NO: 836950 - DNA, 25 bp, Mus musculus
tcttaagagggcaagtgaccattga

SEQ ID NO: 836951 - DNA, 25 bp, Mus musculus
tcttaagagggctagtgaccattga

SEQ ID NO: 836952 - DNA, 25 bp, Mus musculus
tcttaagcagaaagagctcttcctc

SEQ ID NO: 836953 - DNA, 25 bp, Mus musculus
tcttaagcagaatgagctcttcctc

SEQ ID NO: 836954 - DNA, 25 bp, Mus musculus
tcttaagcagccagtggagggtttt

SEQ ID NO: 836955 - DNA, 25 bp, Mus musculus
tcttaagcagcctgtggagggtttt

SEQ ID NO: 836956 - DNA, 25 bp, Mus musculus
tcttaagccctccaaggtgacctta

SEQ ID NO: 836957 - DNA, 25 bp, Mus musculus
tcttaagccctcgaaggtgacctta

SEQ ID NO: 836958 - DNA, 25 bp, Mus musculus
tcttaagcgattccccagaaccttc

SEQ ID NO: 836959 - DNA, 25 bp, Mus musculus
tcttaagcgattgcccagaaccttc

SEQ ID NO: 836960 - DNA, 25 bp, Mus musculus
tcttaaggaaatcgcccccagaaag

SEQ ID NO: 836961 - DNA, 25 bp, Mus musculus
tcttaaggaaatggcccccagaaag

SEQ ID NO: 836962 - DNA, 25 bp, Mus musculus
tcttaaggacctcgccttgaacctg

SEQ ID NO: 836963 - DNA, 25 bp, Mus musculus
tcttaaggacctggccttgaacctg

SEQ ID NO: 836964 - DNA, 25 bp, Mus musculus
tcttaaggtcctaacactgatgaac

SEQ ID NO: 836965 - DNA, 25 bp, Mus musculus
tcttaaggtccttacactgatgaac

SEQ ID NO: 836966 - DNA, 25 bp, Mus musculus
tcttaagtgaacattggcgtcgctc

SEQ ID NO: 836967 - DNA, 25 bp, Mus musculus
tcttaagtgaactttggcgtcgctc

SEQ ID NO: 836968 - DNA, 25 bp, Mus musculus
tcttaagtgctgcataatggataca

SEQ ID NO: 836969 - DNA, 25 bp, Mus musculus
tcttaagtgctggataatggataca

SEQ ID NO: 836970 - DNA, 25 bp, Mus musculus
tcttaatatttgagttcctcctcct

SEQ ID NO: 836971 - DNA, 25 bp, Mus musculus
tcttaatatttgtgttcctcctcct

SEQ ID NO: 836972 - DNA, 25 bp, Mus musculus
tcttaatcacatcagctgtgtcatc

SEQ ID NO: 836973 - DNA, 25 bp, Mus musculus
tcttaatcacatgagctgtgtcatc

SEQ ID NO: 836974 - DNA, 25 bp, Mus musculus
tcttaatccattcttgctgcacagc

SEQ ID NO: 836975 - DNA, 25 bp, Mus musculus
tcttaatccattgttgctgcacagc

SEQ ID NO: 836976 - DNA, 25 bp, Mus musculus
tcttaatctctgatgtgtactattt

SEQ ID NO: 836977 - DNA, 25 bp, Mus musculus
tcttaatctctgttgtgtactattt

SEQ ID NO: 836978 - DNA, 25 bp, Mus musculus
tcttaatgacacacttggccagggt

SEQ ID NO: 836979 - DNA, 25 bp, Mus musculus
tcttaatgacactcttggccagggt

SEQ ID NO: 836980 - DNA, 25 bp, Mus musculus
tcttaatgagagacgcgaccctgac

SEQ ID NO: 836981 - DNA, 25 bp, Mus musculus
tcttaatgagagtcgcgaccctgac

SEQ ID NO: 836982 - DNA, 25 bp, Mus musculus
tcttaatgagctacccaacttctac

SEQ ID NO: 836983 - DNA, 25 bp, Mus musculus
tcttaatgagcttcccaacttctac

SEQ ID NO: 836984 - DNA, 25 bp, Mus musculus
tcttaatgtgttatgcatatcgcat

SEQ ID NO: 836985 - DNA, 25 bp, Mus musculus
tcttaatgtgttttgcatatcgcat

SEQ ID NO: 836986 - DNA, 25 bp, Mus musculus
tcttaattcaaaaccagccccaatg

SEQ ID NO: 836987 - DNA, 25 bp, Mus musculus
tcttaattcaaatccagccccaatg

SEQ ID NO: 836988 - DNA, 25 bp, Mus musculus
tcttaattcaatagtccccatctac

SEQ ID NO: 836989 - DNA, 25 bp, Mus musculus
tcttaattcaattgtccccatctac

SEQ ID NO: 836990 - DNA, 25 bp, Mus musculus
tcttaattcattacagggctctctc

SEQ ID NO: 836991 - DNA, 25 bp, Mus musculus
tcttaattcatttcagggctctctc

SEQ ID NO: 836992 - DNA, 25 bp, Mus musculus
tcttaattctctcacaaattctgtg

SEQ ID NO: 836993 - DNA, 25 bp, Mus musculus
tcttaattctctgacaaattctgtg

SEQ ID NO: 836994 - DNA, 25 bp, Mus musculus
tcttaattgcttatttcgtgtttca

SEQ ID NO: 836995 - DNA, 25 bp, Mus musculus
tcttaattgcttttttcgtgtttca

SEQ ID NO: 836996 - DNA, 25 bp, Mus musculus
tcttacaaaaagatcccctgacatt

SEQ ID NO: 836997 - DNA, 25 bp, Mus musculus
tcttacaaaaagttcccctgacatt

SEQ ID NO: 836998 - DNA, 25 bp, Mus musculus
tcttacaacgtgcatgagtttgcat

SEQ ID NO: 836999 - DNA, 25 bp, Mus musculus
tcttacaacgtggatgagtttgcat

SEQ ID NO: 837000 - DNA, 25 bp, Mus musculus
tcttacaactctcacgggcaacggc

SEQ ID NO: 837001 - DNA, 25 bp, Mus musculus
tcttacaactctgacgggcaacggc

SEQ ID NO: 837002 - DNA, 25 bp, Mus musculus
tcttacaagcttcttctgatcgttg

SEQ ID NO: 837003 - DNA, 25 bp, Mus musculus
tcttacaagcttgttctgatcgttg

SEQ ID NO: 837004 - DNA, 25 bp, Mus musculus
tcttacaatacaagaccgctgcgtg

SEQ ID NO: 837005 - DNA, 25 bp, Mus musculus
tcttacaatacatgaccgctgcgtg

SEQ ID NO: 837006 - DNA, 25 bp, Mus musculus
tcttacaccatgctactgacttcta

SEQ ID NO: 837007 - DNA, 25 bp, Mus musculus
tcttacaccatggtactgacttcta

SEQ ID NO: 837008 - DNA, 25 bp, Mus musculus
tcttacagacttacttggcccgcag

SEQ ID NO: 837009 - DNA, 25 bp, Mus musculus
tcttacagactttcttggcccgcag

SEQ ID NO: 837010 - DNA, 25 bp, Mus musculus
tcttacagagtaatctttctacagt

SEQ ID NO: 837011 - DNA, 25 bp, Mus musculus
tcttacagagtattctttctacagt

SEQ ID NO: 837012 - DNA, 25 bp, Mus musculus
tcttacagccacaatgtctatacct

SEQ ID NO: 837013 - DNA, 25 bp, Mus musculus
tcttacagccactatgtctatacct

SEQ ID NO: 837014 - DNA, 25 bp, Mus musculus
tcttacagtggacagtatggaggta

SEQ ID NO: 837015 - DNA, 25 bp, Mus musculus
tcttacagtggagagtatggaggta

SEQ ID NO: 837016 - DNA, 25 bp, Mus musculus
tcttacagttgcactctcagatcaa

SEQ ID NO: 837017 - DNA, 25 bp, Mus musculus
tcttacagttgctctctcagatcaa

SEQ ID NO: 837018 - DNA, 25 bp, Mus musculus
tcttacatatagacctttctgacat

SEQ ID NO: 837019 - DNA, 25 bp, Mus musculus
tcttacatatagtcctttctgacat

SEQ ID NO: 837020 - DNA, 25 bp, Mus musculus
tcttacatccccaatgactgcacta

SEQ ID NO: 837021 - DNA, 25 bp, Mus musculus
tcttacatcccctatgactgcacta

SEQ ID NO: 837022 - DNA, 25 bp, Mus musculus
tcttacatgaagagacctccgtgct

SEQ ID NO: 837023 - DNA, 25 bp, Mus musculus
tcttacatgaagtgacctccgtgct

SEQ ID NO: 837024 - DNA, 25 bp, Mus musculus
tcttacatgcttagcacagattcac

SEQ ID NO: 837025 - DNA, 25 bp, Mus musculus
tcttacatgctttgcacagattcac

SEQ ID NO: 837026 - DNA, 25 bp, Mus musculus
tcttacatggtgatcgttgctgttc

SEQ ID NO: 837027 - DNA, 25 bp, Mus musculus
tcttacatggtgttcgttgctgttc

SEQ ID NO: 837028 - DNA, 25 bp, Mus musculus
tcttacattgttctgtataattcta

SEQ ID NO: 837029 - DNA, 25 bp, Mus musculus
tcttacattgttgtgtataattcta

SEQ ID NO: 837030 - DNA, 25 bp, Mus musculus
tcttacatttctacccttcagtctg

SEQ ID NO: 837031 - DNA, 25 bp, Mus musculus
tcttacatttcttcccttcagtctg

SEQ ID NO: 837032 - DNA, 25 bp, Mus musculus
tcttaccactatcttttggcatccc

SEQ ID NO: 837033 - DNA, 25 bp, Mus musculus
tcttaccactatgttttggcatccc

SEQ ID NO: 837034 - DNA, 25 bp, Mus musculus
tcttaccacttaattttgtaccatg

SEQ ID NO: 837035 - DNA, 25 bp, Mus musculus
tcttaccacttatttttgtaccatg

SEQ ID NO: 837036 - DNA, 25 bp, Mus musculus
tcttaccagcttatccagaccagga

SEQ ID NO: 837037 - DNA, 25 bp, Mus musculus
tcttaccagcttttccagaccagga

SEQ ID NO: 837038 - DNA, 25 bp, Mus musculus
tcttaccagtgcatccctatgaaac

SEQ ID NO: 837039 - DNA, 25 bp, Mus musculus
tcttaccagtgcttccctatgaaac

SEQ ID NO: 837040 - DNA, 25 bp, Mus musculus
tcttaccatagaaggaccgggatgg

SEQ ID NO: 837041 - DNA, 25 bp, Mus musculus
tcttaccatagatggaccgggatgg

SEQ ID NO: 837042 - DNA, 25 bp, Mus musculus
tcttaccatcatatctatgcatgta

SEQ ID NO: 837043 - DNA, 25 bp, Mus musculus
tcttaccatcatttctatgcatgta

SEQ ID NO: 837044 - DNA, 25 bp, Mus musculus
tcttaccattctcttcctcatggtt

SEQ ID NO: 837045 - DNA, 25 bp, Mus musculus
tcttaccattctgttcctcatggtt

SEQ ID NO: 837046 - DNA, 25 bp, Mus musculus
tcttaccatttactgatacttttgg

SEQ ID NO: 837047 - DNA, 25 bp, Mus musculus
tcttaccatttagtgatacttttgg

SEQ ID NO: 837048 - DNA, 25 bp, Mus musculus
tcttaccccttaaggctctccaaag

SEQ ID NO: 837049 - DNA, 25 bp, Mus musculus
tcttaccccttatggctctccaaag

SEQ ID NO: 837050 - DNA, 25 bp, Mus musculus
tcttacccgccaagatcgactagat

SEQ ID NO: 837051 - DNA, 25 bp, Mus musculus
tcttacccgccatgatcgactagat

SEQ ID NO: 837052 - DNA, 25 bp, Mus musculus
tcttaccctatgcacagtcatccaa

SEQ ID NO: 837053 - DNA, 25 bp, Mus musculus
tcttaccctatggacagtcatccaa

SEQ ID NO: 837054 - DNA, 25 bp, Mus musculus
tcttaccctcaaaagcctaccattg

SEQ ID NO: 837055 - DNA, 25 bp, Mus musculus
tcttaccctcaaagccaaacagctg

SEQ ID NO: 837056 - DNA, 25 bp, Mus musculus
tcttaccctcaatagcctaccattg

SEQ ID NO: 837057 - DNA, 25 bp, Mus musculus
tcttaccctcaatgccaaacagctg

SEQ ID NO: 837058 - DNA, 25 bp, Mus musculus
tcttaccctcagatgaagcacaagg

SEQ ID NO: 837059 - DNA, 25 bp, Mus musculus
tcttaccctcagttgaagcacaagg

SEQ ID NO: 837060 - DNA, 25 bp, Mus musculus
tcttaccgaagtactgagagactac

SEQ ID NO: 837061 - DNA, 25 bp, Mus musculus
tcttaccgaagttctgagagactac

SEQ ID NO: 837062 - DNA, 25 bp, Mus musculus
tcttaccgagtaagcactgctcttt

SEQ ID NO: 837063 - DNA, 25 bp, Mus musculus
tcttaccgagtatgcactgctcttt

SEQ ID NO: 837064 - DNA, 25 bp, Mus musculus
tcttacctactcattattcacttat

SEQ ID NO: 837065 - DNA, 25 bp, Mus musculus
tcttacctactctttattcacttat

SEQ ID NO: 837066 - DNA, 25 bp, Mus musculus
tcttacctcggaagcccagaaggcc

SEQ ID NO: 837067 - DNA, 25 bp, Mus musculus
tcttacctcggatgcccagaaggcc

SEQ ID NO: 837068 - DNA, 25 bp, Mus musculus
tcttacctctatacagttttgctgt

SEQ ID NO: 837069 - DNA, 25 bp, Mus musculus
tcttacctctattcagttttgctgt

SEQ ID NO: 837070 - DNA, 25 bp, Mus musculus
tcttaccttgtaaccacgagttcca

SEQ ID NO: 837071 - DNA, 25 bp, Mus musculus
tcttaccttgtatccacgagttcca

SEQ ID NO: 837072 - DNA, 25 bp, Mus musculus
tcttacctttgtccacagggctcta

SEQ ID NO: 837073 - DNA, 25 bp, Mus musculus
tcttacctttgtgcacagggctcta

SEQ ID NO: 837074 - DNA, 25 bp, Mus musculus
tcttacgagagacatcctggaggtg

SEQ ID NO: 837075 - DNA, 25 bp, Mus musculus
tcttacgagagagatcctggaggtg

SEQ ID NO: 837076 - DNA, 25 bp, Mus musculus
tcttacggagaaagggctgggccca

SEQ ID NO: 837077 - DNA, 25 bp, Mus musculus
tcttacggagaatgggctgggccca

SEQ ID NO: 837078 - DNA, 25 bp, Mus musculus
tcttacggtgtcctacagttgccaa

SEQ ID NO: 837079 - DNA, 25 bp, Mus musculus
tcttacggtgtcgtacagttgccaa

SEQ ID NO: 837080 - DNA, 25 bp, Mus musculus
tcttacggttccactgtatacagct

SEQ ID NO: 837081 - DNA, 25 bp, Mus musculus
tcttacggttcctctgtatacagct

SEQ ID NO: 837082 - DNA, 25 bp, Mus musculus
tcttacggttgtccatgcggtttga

SEQ ID NO: 837083 - DNA, 25 bp, Mus musculus
tcttacggttgtgcatgcggtttga

SEQ ID NO: 837084 - DNA, 25 bp, Mus musculus
tcttacgtatgtcctgcccatgagg

SEQ ID NO: 837085 - DNA, 25 bp, Mus musculus
tcttacgtatgtgctgcccatgagg

SEQ ID NO: 837086 - DNA, 25 bp, Mus musculus
tcttacgttgttatctcaccatgag

SEQ ID NO: 837087 - DNA, 25 bp, Mus musculus
tcttacgttgttttctcaccatgag

SEQ ID NO: 837088 - DNA, 25 bp, Mus musculus
tcttactaccatctccatggagctt

SEQ ID NO: 837089 - DNA, 25 bp, Mus musculus
tcttactaccatgtccatggagctt

SEQ ID NO: 837090 - DNA, 25 bp, Mus musculus
tcttactagccgatccttattctat

SEQ ID NO: 837091 - DNA, 25 bp, Mus musculus
tcttactagccgttccttattctat

SEQ ID NO: 837092 - DNA, 25 bp, Mus musculus
tcttactcaaacctttcgtaccaag

SEQ ID NO: 837093 - DNA, 25 bp, Mus musculus
tcttactcaaacgtttcgtaccaag

SEQ ID NO: 837094 - DNA, 25 bp, Mus musculus
tcttactccaagctgtggtgtcacc

SEQ ID NO: 837095 - DNA, 25 bp, Mus musculus
tcttactccaaggtgtggtgtcacc

SEQ ID NO: 837096 - DNA, 25 bp, Mus musculus
tcttactccgttaccagtggtggca

SEQ ID NO: 837097 - DNA, 25 bp, Mus musculus
tcttactccgtttccagtggtggca

SEQ ID NO: 837098 - DNA, 25 bp, Mus musculus
tcttactcctggaatcaaggcatgt

SEQ ID NO: 837099 - DNA, 25 bp, Mus musculus
tcttactcctggtatcaaggcatgt

SEQ ID NO: 837100 - DNA, 25 bp, Mus musculus
tcttactctgcactcggaatgtcca

SEQ ID NO: 837101 - DNA, 25 bp, Mus musculus
tcttactctgcagtcggaatgtcca

SEQ ID NO: 837102 - DNA, 25 bp, Mus musculus
tcttactctgccaatttaccgtggg

SEQ ID NO: 837103 - DNA, 25 bp, Mus musculus
tcttactctgcctatttaccgtggg

SEQ ID NO: 837104 - DNA, 25 bp, Mus musculus
tcttactgaagtccccagggcccaa

SEQ ID NO: 837105 - DNA, 25 bp, Mus musculus
tcttactgaagtgcccagggcccaa

SEQ ID NO: 837106 - DNA, 25 bp, Mus musculus
tcttactgaggccatgtgtggagtt

SEQ ID NO: 837107 - DNA, 25 bp, Mus musculus
tcttactgaggcgatgtgtggagtt

SEQ ID NO: 837108 - DNA, 25 bp, Mus musculus
tcttactgagttaggacctggaaca

SEQ ID NO: 837109 - DNA, 25 bp, Mus musculus
tcttactgagtttggacctggaaca

SEQ ID NO: 837110 - DNA, 25 bp, Mus musculus
tcttactgcattaactatagataat

SEQ ID NO: 837111 - DNA, 25 bp, Mus musculus
tcttactgcatttactatagataat

SEQ ID NO: 837112 - DNA, 25 bp, Mus musculus
tcttactggagactctgggactggt

SEQ ID NO: 837113 - DNA, 25 bp, Mus musculus
tcttactggagagtctgggactggt

SEQ ID NO: 837114 - DNA, 25 bp, Mus musculus
tcttactggcagacacctagaagtt

SEQ ID NO: 837115 - DNA, 25 bp, Mus musculus
tcttactggcagctagttgctcaca

SEQ ID NO: 837116 - DNA, 25 bp, Mus musculus
tcttactggcaggtagttgctcaca

SEQ ID NO: 837117 - DNA, 25 bp, Mus musculus
tcttactggcagtcacctagaagtt

SEQ ID NO: 837118 - DNA, 25 bp, Mus musculus
tcttactgtgggaagttagcttctt

SEQ ID NO: 837119 - DNA, 25 bp, Mus musculus
tcttactgtgggtagttagcttctt

SEQ ID NO: 837120 - DNA, 25 bp, Mus musculus
tcttactgtgtaccacatgctggtc

SEQ ID NO: 837121 - DNA, 25 bp, Mus musculus
tcttactgtgtagcacatgctggtc

SEQ ID NO: 837122 - DNA, 25 bp, Mus musculus
tcttactgtgttaggtggtggctca

SEQ ID NO: 837123 - DNA, 25 bp, Mus musculus
tcttactgtgtttggtggtggctca

SEQ ID NO: 837124 - DNA, 25 bp, Mus musculus
tcttacttcacacaaacgtggttaa

SEQ ID NO: 837125 - DNA, 25 bp, Mus musculus
tcttacttcacagaaacgtggttaa

SEQ ID NO: 837126 - DNA, 25 bp, Mus musculus
tcttacttcagaagtccctctggtt

SEQ ID NO: 837127 - DNA, 25 bp, Mus musculus
tcttacttcagatgtccctctggtt

SEQ ID NO: 837128 - DNA, 25 bp, Mus musculus
tcttacttcaggagactgctgggtt

SEQ ID NO: 837129 - DNA, 25 bp, Mus musculus
tcttacttcaggtgactgctgggtt

SEQ ID NO: 837130 - DNA, 25 bp, Mus musculus
tcttacttccgtacctttcttatgt

SEQ ID NO: 837131 - DNA, 25 bp, Mus musculus
tcttacttccgttcctttcttatgt

SEQ ID NO: 837132 - DNA, 25 bp, Mus musculus
tcttacttcctgaacataagcctaa

SEQ ID NO: 837133 - DNA, 25 bp, Mus musculus
tcttacttcctgtacataagcctaa

SEQ ID NO: 837134 - DNA, 25 bp, Mus musculus
tcttacttctaccatattgctgcct

SEQ ID NO: 837135 - DNA, 25 bp, Mus musculus
tcttacttctacgatattgctgcct

SEQ ID NO: 837136 - DNA, 25 bp, Mus musculus
tcttacttgaaacgagccccattat

SEQ ID NO: 837137 - DNA, 25 bp, Mus musculus
tcttacttgaaaggagccccattat

SEQ ID NO: 837138 - DNA, 25 bp, Mus musculus
tcttacttggatcctttgaatgact

SEQ ID NO: 837139 - DNA, 25 bp, Mus musculus
tcttacttggatgctttgaatgact

SEQ ID NO: 837140 - DNA, 25 bp, Mus musculus
tcttactttggtaaaaggtctcact

SEQ ID NO: 837141 - DNA, 25 bp, Mus musculus
tcttactttggttaaaggtctcact

SEQ ID NO: 837142 - DNA, 25 bp, Mus musculus
tcttacttttctctgttgacttcat

SEQ ID NO: 837143 - DNA, 25 bp, Mus musculus
tcttacttttctgtgttgacttcat

SEQ ID NO: 837144 - DNA, 25 bp, Mus musculus
tcttactttttgaaggcagctgctg

SEQ ID NO: 837145 - DNA, 25 bp, Mus musculus
tcttactttttgtaggcagctgctg

SEQ ID NO: 837146 - DNA, 25 bp, Mus musculus
tcttagaacaagcaatcccaattat

SEQ ID NO: 837147 - DNA, 25 bp, Mus musculus
tcttagaacaaggaatcccaattat

SEQ ID NO: 837148 - DNA, 25 bp, Mus musculus
tcttagaacccacatgagggctcat

SEQ ID NO: 837149 - DNA, 25 bp, Mus musculus
tcttagaacccagatgagggctcat

SEQ ID NO: 837150 - DNA, 25 bp, Mus musculus
tcttagaagaacagctgagtcactc

SEQ ID NO: 837151 - DNA, 25 bp, Mus musculus
tcttagaagaactgctgagtcactc

SEQ ID NO: 837152 - DNA, 25 bp, Mus musculus
tcttagaagactcctgattttctct

SEQ ID NO: 837153 - DNA, 25 bp, Mus musculus
tcttagaagactgctgattttctct

SEQ ID NO: 837154 - DNA, 25 bp, Mus musculus
tcttagaagccaaccagttgcaatt

SEQ ID NO: 837155 - DNA, 25 bp, Mus musculus
tcttagaagccatccagttgcaatt

SEQ ID NO: 837156 - DNA, 25 bp, Mus musculus
tcttagaaggttctgtcccctttga

SEQ ID NO: 837157 - DNA, 25 bp, Mus musculus
tcttagaaggttgtgtcccctttga

SEQ ID NO: 837158 - DNA, 25 bp, Mus musculus
tcttagaatatgagctgagcctggt

SEQ ID NO: 837159 - DNA, 25 bp, Mus musculus
tcttagaatatgtgctgagcctggt

SEQ ID NO: 837160 - DNA, 25 bp, Mus musculus
tcttagaatcttaccttttcctctt

SEQ ID NO: 837161 - DNA, 25 bp, Mus musculus
tcttagaatctttccttttcctctt

SEQ ID NO: 837162 - DNA, 25 bp, Mus musculus
tcttagacaccacttatgttgcata

SEQ ID NO: 837163 - DNA, 25 bp, Mus musculus
tcttagacaccagttatgttgcata

SEQ ID NO: 837164 - DNA, 25 bp, Mus musculus
tcttagacatagatgggaggagcca

SEQ ID NO: 837165 - DNA, 25 bp, Mus musculus
tcttagacatagttgggaggagcca

SEQ ID NO: 837166 - DNA, 25 bp, Mus musculus
tcttagagagagcagcacgcgcact

SEQ ID NO: 837167 - DNA, 25 bp, Mus musculus
tcttagagagaggagcacgcgcact

SEQ ID NO: 837168 - DNA, 25 bp, Mus musculus
tcttagagcaagctctgggctcgga

SEQ ID NO: 837169 - DNA, 25 bp, Mus musculus
tcttagagcaaggtctgggctcgga

SEQ ID NO: 837170 - DNA, 25 bp, Mus musculus
tcttagagccctccgaggaaggtat

SEQ ID NO: 837171 - DNA, 25 bp, Mus musculus
tcttagagccctgcgaggaaggtat

SEQ ID NO: 837172 - DNA, 25 bp, Mus musculus
tcttagagcttaaattagtagtttt

SEQ ID NO: 837173 - DNA, 25 bp, Mus musculus
tcttagagcttatattagtagtttt

SEQ ID NO: 837174 - DNA, 25 bp, Mus musculus
tcttagaggttgctttccctcggag

SEQ ID NO: 837175 - DNA, 25 bp, Mus musculus
tcttagaggttggtttccctcggag

SEQ ID NO: 837176 - DNA, 25 bp, Mus musculus
tcttagagttttacttctgtacaca

SEQ ID NO: 837177 - DNA, 25 bp, Mus musculus
tcttagagtttttcttctgtacaca

SEQ ID NO: 837178 - DNA, 25 bp, Mus musculus
tcttagatcactaccatgtatgttg

SEQ ID NO: 837179 - DNA, 25 bp, Mus musculus
tcttagatcacttccatgtatgttg

SEQ ID NO: 837180 - DNA, 25 bp, Mus musculus
tcttagatgactcagcactgcttga

SEQ ID NO: 837181 - DNA, 25 bp, Mus musculus
tcttagatgactgagcactgcttga

SEQ ID NO: 837182 - DNA, 25 bp, Mus musculus
tcttagatggctatcaactctgttt

SEQ ID NO: 837183 - DNA, 25 bp, Mus musculus
tcttagatggctttcaactctgttt

SEQ ID NO: 837184 - DNA, 25 bp, Mus musculus
tcttagattgtgagcccttgggcag

SEQ ID NO: 837185 - DNA, 25 bp, Mus musculus
tcttagattgtgtgcccttgggcag

SEQ ID NO: 837186 - DNA, 25 bp, Mus musculus
tcttagcacacacacgacagcttat

SEQ ID NO: 837187 - DNA, 25 bp, Mus musculus
tcttagcacacagacgacagcttat

SEQ ID NO: 837188 - DNA, 25 bp, Mus musculus
tcttagcacagtaggttattgtaga

SEQ ID NO: 837189 - DNA, 25 bp, Mus musculus
tcttagcacagtctacagagccaga

SEQ ID NO: 837190 - DNA, 25 bp, Mus musculus
tcttagcacagtgtacagagccaga

SEQ ID NO: 837191 - DNA, 25 bp, Mus musculus
tcttagcacagttggttattgtaga

SEQ ID NO: 837192 - DNA, 25 bp, Mus musculus
tcttagcactttctgcaggccaggg

SEQ ID NO: 837193 - DNA, 25 bp, Mus musculus
tcttagcactttgtgcaggccaggg

SEQ ID NO: 837194 - DNA, 25 bp, Mus musculus
tcttagcagacgaactttttcggga

SEQ ID NO: 837195 - DNA, 25 bp, Mus musculus
tcttagcagacgtactttttcggga

SEQ ID NO: 837196 - DNA, 25 bp, Mus musculus
tcttagccactgagcatattgaatg

SEQ ID NO: 837197 - DNA, 25 bp, Mus musculus
tcttagccactgtgcatattgaatg

SEQ ID NO: 837198 - DNA, 25 bp, Mus musculus
tcttagccaggacacgctgctactg

SEQ ID NO: 837199 - DNA, 25 bp, Mus musculus
tcttagccaggagacgctgctactg

SEQ ID NO: 837200 - DNA, 25 bp, Mus musculus
tcttagccgggactcttaaagcgtg

SEQ ID NO: 837201 - DNA, 25 bp, Mus musculus
tcttagccgggagtcttaaagcgtg

SEQ ID NO: 837202 - DNA, 25 bp, Mus musculus
tcttagccgttccatctttgggaga

SEQ ID NO: 837203 - DNA, 25 bp, Mus musculus
tcttagccgttcgatctttgggaga

SEQ ID NO: 837204 - DNA, 25 bp, Mus musculus
tcttagcctgctattatcgtttctt

SEQ ID NO: 837205 - DNA, 25 bp, Mus musculus
tcttagcctgcttttatcgtttctt

SEQ ID NO: 837206 - DNA, 25 bp, Mus musculus
tcttagccttgtagatcgtttccta

SEQ ID NO: 837207 - DNA, 25 bp, Mus musculus
tcttagccttgttgatcgtttccta

SEQ ID NO: 837208 - DNA, 25 bp, Mus musculus
tcttagctaaccctggactaccagc

SEQ ID NO: 837209 - DNA, 25 bp, Mus musculus
tcttagctaaccgtggactaccagc

SEQ ID NO: 837210 - DNA, 25 bp, Mus musculus
tcttagctcccgcagatagggaaca

SEQ ID NO: 837211 - DNA, 25 bp, Mus musculus
tcttagctcccggagatagggaaca

SEQ ID NO: 837212 - DNA, 25 bp, Mus musculus
tcttagctgcagacttgccagagcc

SEQ ID NO: 837213 - DNA, 25 bp, Mus musculus
tcttagctgcagtcttgccagagcc

SEQ ID NO: 837214 - DNA, 25 bp, Mus musculus
tcttagctggacacgacaaccgagt

SEQ ID NO: 837215 - DNA, 25 bp, Mus musculus
tcttagctggactcgacaaccgagt

SEQ ID NO: 837216 - DNA, 25 bp, Mus musculus
tcttagctgtgaagaatcctatttg

SEQ ID NO: 837217 - DNA, 25 bp, Mus musculus
tcttagctgtgatgaatcctatttg

SEQ ID NO: 837218 - DNA, 25 bp, Mus musculus
tcttagcttacaaccgggcgaaccg

SEQ ID NO: 837219 - DNA, 25 bp, Mus musculus
tcttagcttacatccgggcgaaccg

SEQ ID NO: 837220 - DNA, 25 bp, Mus musculus
tcttagcttaggacaaaactcgtag

SEQ ID NO: 837221 - DNA, 25 bp, Mus musculus
tcttagcttaggtcaaaactcgtag

SEQ ID NO: 837222 - DNA, 25 bp, Mus musculus
tcttagctttcccactggagagcag

SEQ ID NO: 837223 - DNA, 25 bp, Mus musculus
tcttagctttccgactggagagcag

SEQ ID NO: 837224 - DNA, 25 bp, Mus musculus
tcttagctttttccatctactcctt

SEQ ID NO: 837225 - DNA, 25 bp, Mus musculus
tcttagctttttgcatctactcctt

SEQ ID NO: 837226 - DNA, 25 bp, Mus musculus
tcttaggaaaccagtgtcacctttt

SEQ ID NO: 837227 - DNA, 25 bp, Mus musculus
tcttaggaaacctgtgtcacctttt

SEQ ID NO: 837228 - DNA, 25 bp, Mus musculus
tcttaggaacttctacctataaaca

SEQ ID NO: 837229 - DNA, 25 bp, Mus musculus
tcttaggaacttgtacctataaaca

SEQ ID NO: 837230 - DNA, 25 bp, Mus musculus
tcttaggacattatattcagtgtgt

SEQ ID NO: 837231 - DNA, 25 bp, Mus musculus
tcttaggacattttattcagtgtgt

SEQ ID NO: 837232 - DNA, 25 bp, Mus musculus
tcttaggagcctattactccggtag

SEQ ID NO: 837233 - DNA, 25 bp, Mus musculus
tcttaggagccttttactccggtag

SEQ ID NO: 837234 - DNA, 25 bp, Mus musculus
tcttaggagtagatctttttagtct

SEQ ID NO: 837235 - DNA, 25 bp, Mus musculus
tcttaggagtagttctttttagtct

SEQ ID NO: 837236 - DNA, 25 bp, Mus musculus
tcttaggatataatggatctctccc

SEQ ID NO: 837237 - DNA, 25 bp, Mus musculus
tcttaggatatattggatctctccc

SEQ ID NO: 837238 - DNA, 25 bp, Mus musculus
tcttaggatgaaaatttgacattat

SEQ ID NO: 837239 - DNA, 25 bp, Mus musculus
tcttaggatgaatatttgacattat

SEQ ID NO: 837240 - DNA, 25 bp, Mus musculus
tcttaggattttaattgctcacagt

SEQ ID NO: 837241 - DNA, 25 bp, Mus musculus
tcttaggatttttattgctcacagt

SEQ ID NO: 837242 - DNA, 25 bp, Mus musculus
tcttaggcacatctatccctatggg

SEQ ID NO: 837243 - DNA, 25 bp, Mus musculus
tcttaggcacatgtatccctatggg

SEQ ID NO: 837244 - DNA, 25 bp, Mus musculus
tcttaggcgttactggatgatacaa

SEQ ID NO: 837245 - DNA, 25 bp, Mus musculus
tcttaggcgttagtggatgatacaa

SEQ ID NO: 837246 - DNA, 25 bp, Mus musculus
tcttaggcgtttcccttccatagaa

SEQ ID NO: 837247 - DNA, 25 bp, Mus musculus
tcttaggcgtttgccttccatagaa

SEQ ID NO: 837248 - DNA, 25 bp, Mus musculus
tcttaggctagaagacggtttattt

SEQ ID NO: 837249 - DNA, 25 bp, Mus musculus
tcttaggctagatgacggtttattt

SEQ ID NO: 837250 - DNA, 25 bp, Mus musculus
tcttaggctgctagtgctcagagca

SEQ ID NO: 837251 - DNA, 25 bp, Mus musculus
tcttaggctgcttgtgctcagagca

SEQ ID NO: 837252 - DNA, 25 bp, Mus musculus
tcttagggaaatactgcactgcagc

SEQ ID NO: 837253 - DNA, 25 bp, Mus musculus
tcttagggaaattctgcactgcagc

SEQ ID NO: 837254 - DNA, 25 bp, Mus musculus
tcttagggacctacacagaaatgag

SEQ ID NO: 837255 - DNA, 25 bp, Mus musculus
tcttagggaccttcacagaaatgag

SEQ ID NO: 837256 - DNA, 25 bp, Mus musculus
tcttagggatctcctttctctatgg

SEQ ID NO: 837257 - DNA, 25 bp, Mus musculus
tcttagggatctgctttctctatgg

SEQ ID NO: 837258 - DNA, 25 bp, Mus musculus
tcttagggccctctaggagttttct

SEQ ID NO: 837259 - DNA, 25 bp, Mus musculus
tcttagggccctgtaggagttttct

SEQ ID NO: 837260 - DNA, 25 bp, Mus musculus
tcttagggcggtctgaaactcttct

SEQ ID NO: 837261 - DNA, 25 bp, Mus musculus
tcttagggcggtgtgaaactcttct

SEQ ID NO: 837262 - DNA, 25 bp, Mus musculus
tcttagggcttgctgttcttcatag

SEQ ID NO: 837263 - DNA, 25 bp, Mus musculus
tcttagggcttggtgttcttcatag

SEQ ID NO: 837264 - DNA, 25 bp, Mus musculus
tcttagggctttatgtcgttatttg

SEQ ID NO: 837265 - DNA, 25 bp, Mus musculus
tcttagggctttttgtcgttatttg

SEQ ID NO: 837266 - DNA, 25 bp, Mus musculus
tcttagggtcagatgctggttccag

SEQ ID NO: 837267 - DNA, 25 bp, Mus musculus
tcttagggtcagttgctggttccag

SEQ ID NO: 837268 - DNA, 25 bp, Mus musculus
tcttaggtagaactcatatcagcat

SEQ ID NO: 837269 - DNA, 25 bp, Mus musculus
tcttaggtagaagtcatatcagcat

SEQ ID NO: 837270 - DNA, 25 bp, Mus musculus
tcttaggtatagagtttgtttacac

SEQ ID NO: 837271 - DNA, 25 bp, Mus musculus
tcttaggtatagtgtttgtttacac

SEQ ID NO: 837272 - DNA, 25 bp, Mus musculus
tcttagtaagttatccttctctgtt

SEQ ID NO: 837273 - DNA, 25 bp, Mus musculus
tcttagtaagttttccttctctgtt

SEQ ID NO: 837274 - DNA, 25 bp, Mus musculus
tcttagtacttcctgcctttgtgaa

SEQ ID NO: 837275 - DNA, 25 bp, Mus musculus
tcttagtacttcgtgcctttgtgaa

SEQ ID NO: 837276 - DNA, 25 bp, Mus musculus
tcttagtagattactattgctgtga

SEQ ID NO: 837277 - DNA, 25 bp, Mus musculus
tcttagtagatttctattgctgtga

SEQ ID NO: 837278 - DNA, 25 bp, Mus musculus
tcttagtcacttctgttgctgtgca

SEQ ID NO: 837279 - DNA, 25 bp, Mus musculus
tcttagtcacttgtgttgctgtgca

SEQ ID NO: 837280 - DNA, 25 bp, Mus musculus
tcttagtcagcgctgctgttgctgt

SEQ ID NO: 837281 - DNA, 25 bp, Mus musculus
tcttagtcagcggtgctgttgctgt

SEQ ID NO: 837282 - DNA, 25 bp, Mus musculus
tcttagtcaggcacagctttctgcc

SEQ ID NO: 837283 - DNA, 25 bp, Mus musculus
tcttagtcaggctcagctttctgcc

SEQ ID NO: 837284 - DNA, 25 bp, Mus musculus
tcttagtcatctacttctgtctgtt

SEQ ID NO: 837285 - DNA, 25 bp, Mus musculus
tcttagtcatcttcttctgtctgtt

SEQ ID NO: 837286 - DNA, 25 bp, Mus musculus
tcttagtcccacactcatgttgtag

SEQ ID NO: 837287 - DNA, 25 bp, Mus musculus
tcttagtcccactctcatgttgtag

SEQ ID NO: 837288 - DNA, 25 bp, Mus musculus
tcttagtccctgatttcgggatgtt

SEQ ID NO: 837289 - DNA, 25 bp, Mus musculus
tcttagtccctgttttcgggatgtt

SEQ ID NO: 837290 - DNA, 25 bp, Mus musculus
tcttagtcttgccttcaggatgcac

SEQ ID NO: 837291 - DNA, 25 bp, Mus musculus
tcttagtcttgcgttcaggatgcac

SEQ ID NO: 837292 - DNA, 25 bp, Mus musculus
tcttagtgtccaagtgccaagtggc

SEQ ID NO: 837293 - DNA, 25 bp, Mus musculus
tcttagtgtccatgtgccaagtggc

SEQ ID NO: 837294 - DNA, 25 bp, Mus musculus
tcttagtgtttcattctggttccaa

SEQ ID NO: 837295 - DNA, 25 bp, Mus musculus
tcttagtgtttctttctggttccaa

SEQ ID NO: 837296 - DNA, 25 bp, Mus musculus
tcttagtgttttaaacctgtacatt

SEQ ID NO: 837297 - DNA, 25 bp, Mus musculus
tcttagtgtttttaacctgtacatt

SEQ ID NO: 837298 - DNA, 25 bp, Mus musculus
tcttagttactacgtctggcaggaa

SEQ ID NO: 837299 - DNA, 25 bp, Mus musculus
tcttagttactaggtctggcaggaa

SEQ ID NO: 837300 - DNA, 25 bp, Mus musculus
tcttagttacttatgttcttgtgac

SEQ ID NO: 837301 - DNA, 25 bp, Mus musculus
tcttagttacttttgttcttgtgac

SEQ ID NO: 837302 - DNA, 25 bp, Mus musculus
tcttagttctatagacaggacattt

SEQ ID NO: 837303 - DNA, 25 bp, Mus musculus
tcttagttctattgacaggacattt

SEQ ID NO: 837304 - DNA, 25 bp, Mus musculus
tcttagttgtaacactgacctctgg

SEQ ID NO: 837305 - DNA, 25 bp, Mus musculus
tcttagttgtaagactgacctctgg

SEQ ID NO: 837306 - DNA, 25 bp, Mus musculus
tcttagttgttgacctccctacact

SEQ ID NO: 837307 - DNA, 25 bp, Mus musculus
tcttagttgttgtcctccctacact

SEQ ID NO: 837308 - DNA, 25 bp, Mus musculus
tcttataaatctaaacaaaatccag

SEQ ID NO: 837309 - DNA, 25 bp, Mus musculus
tcttataaatcttaacaaaatccag

SEQ ID NO: 837310 - DNA, 25 bp, Mus musculus
tcttatacaaatcaggatggacaaa

SEQ ID NO: 837311 - DNA, 25 bp, Mus musculus
tcttatacaaatgaggatggacaaa

SEQ ID NO: 837312 - DNA, 25 bp, Mus musculus
tcttatacccagacggctctgagaa

SEQ ID NO: 837313 - DNA, 25 bp, Mus musculus
tcttatacccagtcggctctgagaa

SEQ ID NO: 837314 - DNA, 25 bp, Mus musculus
tcttatacccttcatggctgccatg

SEQ ID NO: 837315 - DNA, 25 bp, Mus musculus
tcttatacccttgatggctgccatg

SEQ ID NO: 837316 - DNA, 25 bp, Mus musculus
tcttatactatcatgaccacctgtc

SEQ ID NO: 837317 - DNA, 25 bp, Mus musculus
tcttatactatcttgaccacctgtc

SEQ ID NO: 837318 - DNA, 25 bp, Mus musculus
tcttatactcctccgaccctgagag

SEQ ID NO: 837319 - DNA, 25 bp, Mus musculus
tcttatactcctgcgaccctgagag

SEQ ID NO: 837320 - DNA, 25 bp, Mus musculus
tcttatactgctaggatggattact

SEQ ID NO: 837321 - DNA, 25 bp, Mus musculus
tcttatactgcttggatggattact

SEQ ID NO: 837322 - DNA, 25 bp, Mus musculus
tcttatagaaccatgggtggcccca

SEQ ID NO: 837323 - DNA, 25 bp, Mus musculus
tcttatagaaccttgggtggcccca

SEQ ID NO: 837324 - DNA, 25 bp, Mus musculus
tcttatagcttgaataccacctgcc

SEQ ID NO: 837325 - DNA, 25 bp, Mus musculus
tcttatagcttgtataccacctgcc

SEQ ID NO: 837326 - DNA, 25 bp, Mus musculus
tcttatatgggcaccctaacgagga

SEQ ID NO: 837327 - DNA, 25 bp, Mus musculus
tcttatatgggctccctaacgagga

SEQ ID NO: 837328 - DNA, 25 bp, Mus musculus
tcttatattgtcatgcttcaccttc

SEQ ID NO: 837329 - DNA, 25 bp, Mus musculus
tcttatattgtcttgcttcaccttc

SEQ ID NO: 837330 - DNA, 25 bp, Mus musculus
tcttatcaaactctctttcacgtgt

SEQ ID NO: 837331 - DNA, 25 bp, Mus musculus
tcttatcaaactgtctttcacgtgt

SEQ ID NO: 837332 - DNA, 25 bp, Mus musculus
tcttatcacttgctgtagatggctt

SEQ ID NO: 837333 - DNA, 25 bp, Mus musculus
tcttatcacttggtgtagatggctt

SEQ ID NO: 837334 - DNA, 25 bp, Mus musculus
tcttatcagtacatccgctgaccac

SEQ ID NO: 837335 - DNA, 25 bp, Mus musculus
tcttatcagtacttccgctgaccac

SEQ ID NO: 837336 - DNA, 25 bp, Mus musculus
tcttatcagtcaccttactaaatga

SEQ ID NO: 837337 - DNA, 25 bp, Mus musculus
tcttatcagtcagcttactaaatga

SEQ ID NO: 837338 - DNA, 25 bp, Mus musculus
tcttatcataggctgtctggtaaaa

SEQ ID NO: 837339 - DNA, 25 bp, Mus musculus
tcttatcatagggtgtctggtaaaa

SEQ ID NO: 837340 - DNA, 25 bp, Mus musculus
tcttatccaaccaaatcaatagacg

SEQ ID NO: 837341 - DNA, 25 bp, Mus musculus
tcttatccaacctaatcaatagacg

SEQ ID NO: 837342 - DNA, 25 bp, Mus musculus
tcttatccaggtatataggtgacag

SEQ ID NO: 837343 - DNA, 25 bp, Mus musculus
tcttatccaggtttataggtgacag

SEQ ID NO: 837344 - DNA, 25 bp, Mus musculus
tcttatcccctactctatgttactg

SEQ ID NO: 837345 - DNA, 25 bp, Mus musculus
tcttatcccctagtctatgttactg

SEQ ID NO: 837346 - DNA, 25 bp, Mus musculus
tcttatccctacctttatgatccta

SEQ ID NO: 837347 - DNA, 25 bp, Mus musculus
tcttatccctacgtttatgatccta

SEQ ID NO: 837348 - DNA, 25 bp, Mus musculus
tcttatccctcactgtactgtaatc

SEQ ID NO: 837349 - DNA, 25 bp, Mus musculus
tcttatccctcagtgtactgtaatc

SEQ ID NO: 837350 - DNA, 25 bp, Mus musculus
tcttatctcagaaatctgatgctct

SEQ ID NO: 837351 - DNA, 25 bp, Mus musculus
tcttatctcagatatctgatgctct

SEQ ID NO: 837352 - DNA, 25 bp, Mus musculus
tcttatctcagtcatgtctatcgct

SEQ ID NO: 837353 - DNA, 25 bp, Mus musculus
tcttatctcagtgatgtctatcgct

SEQ ID NO: 837354 - DNA, 25 bp, Mus musculus
tcttatctccttcagtaggtggaag

SEQ ID NO: 837355 - DNA, 25 bp, Mus musculus
tcttatctccttgagtaggtggaag

SEQ ID NO: 837356 - DNA, 25 bp, Mus musculus
tcttatctgcacaggccagaatact

SEQ ID NO: 837357 - DNA, 25 bp, Mus musculus
tcttatctgcactggccagaatact

SEQ ID NO: 837358 - DNA, 25 bp, Mus musculus
tcttatctgcatagaattgacccta

SEQ ID NO: 837359 - DNA, 25 bp, Mus musculus
tcttatctgcattgaattgacccta

SEQ ID NO: 837360 - DNA, 25 bp, Mus musculus
tcttatctggcaacaactcgttaaa

SEQ ID NO: 837361 - DNA, 25 bp, Mus musculus
tcttatctggcatcaactcgttaaa

SEQ ID NO: 837362 - DNA, 25 bp, Mus musculus
tcttatctgtgcatcatgtccacga

SEQ ID NO: 837363 - DNA, 25 bp, Mus musculus
tcttatctgtgcttcatgtccacga

SEQ ID NO: 837364 - DNA, 25 bp, Mus musculus
tcttatcttaaccttcctgttttat

SEQ ID NO: 837365 - DNA, 25 bp, Mus musculus
tcttatcttaacgttcctgttttat

SEQ ID NO: 837366 - DNA, 25 bp, Mus musculus
tcttatcttcgtacagaaggcccaa

SEQ ID NO: 837367 - DNA, 25 bp, Mus musculus
tcttatcttcgttcagaaggcccaa

SEQ ID NO: 837368 - DNA, 25 bp, Mus musculus
tcttatgaagcaaaggcccctgcag

SEQ ID NO: 837369 - DNA, 25 bp, Mus musculus
tcttatgaagcataggcccctgcag

SEQ ID NO: 837370 - DNA, 25 bp, Mus musculus
tcttatgatggtactgccttgccaa

SEQ ID NO: 837371 - DNA, 25 bp, Mus musculus
tcttatgatggttctgccttgccaa

SEQ ID NO: 837372 - DNA, 25 bp, Mus musculus
tcttatgcctttacaatatatctga

SEQ ID NO: 837373 - DNA, 25 bp, Mus musculus
tcttatgccttttcaatatatctga

SEQ ID NO: 837374 - DNA, 25 bp, Mus musculus
tcttatggaagtccctagcctctaa

SEQ ID NO: 837375 - DNA, 25 bp, Mus musculus
tcttatggaagtgcctagcctctaa

SEQ ID NO: 837376 - DNA, 25 bp, Mus musculus
tcttatggacgacaagaccgccgat

SEQ ID NO: 837377 - DNA, 25 bp, Mus musculus
tcttatggacgagaagaccgccgat

SEQ ID NO: 837378 - DNA, 25 bp, Mus musculus
tcttatggcacccataatctgtatc

SEQ ID NO: 837379 - DNA, 25 bp, Mus musculus
tcttatggcaccgataatctgtatc

SEQ ID NO: 837380 - DNA, 25 bp, Mus musculus
tcttatggccctaggacagagaatt

SEQ ID NO: 837381 - DNA, 25 bp, Mus musculus
tcttatggcccttggacagagaatt

SEQ ID NO: 837382 - DNA, 25 bp, Mus musculus
tcttatgtagcacaaagatcagtct

SEQ ID NO: 837383 - DNA, 25 bp, Mus musculus
tcttatgtagcagaaagatcagtct

SEQ ID NO: 837384 - DNA, 25 bp, Mus musculus
tcttatgtccctaaaattcaccctg

SEQ ID NO: 837385 - DNA, 25 bp, Mus musculus
tcttatgtcccttaaattcaccctg

SEQ ID NO: 837386 - DNA, 25 bp, Mus musculus
tcttatgtgagtacagtctctgtcc

SEQ ID NO: 837387 - DNA, 25 bp, Mus musculus
tcttatgtgagttcagtctctgtcc

SEQ ID NO: 837388 - DNA, 25 bp, Mus musculus
tcttatgtgctcaaatgcccctgaa

SEQ ID NO: 837389 - DNA, 25 bp, Mus musculus
tcttatgtgctctaatgcccctgaa

SEQ ID NO: 837390 - DNA, 25 bp, Mus musculus
tcttatgtggctccaggatcctctg

SEQ ID NO: 837391 - DNA, 25 bp, Mus musculus
tcttatgtggctgcaggatcctctg

SEQ ID NO: 837392 - DNA, 25 bp, Mus musculus
tcttatgtttggctttggcctctaa

SEQ ID NO: 837393 - DNA, 25 bp, Mus musculus
tcttatgtttgggtttggcctctaa

SEQ ID NO: 837394 - DNA, 25 bp, Mus musculus
tcttattcaaagacctgctcagcac

SEQ ID NO: 837395 - DNA, 25 bp, Mus musculus
tcttattcaaagtcctgctcagcac

SEQ ID NO: 837396 - DNA, 25 bp, Mus musculus
tcttattcaaatcactacatcgccc

SEQ ID NO: 837397 - DNA, 25 bp, Mus musculus
tcttattcaaatgactacatcgccc

SEQ ID NO: 837398 - DNA, 25 bp, Mus musculus
tcttattcagtgaagacacccaagg

SEQ ID NO: 837399 - DNA, 25 bp, Mus musculus
tcttattcagtgtagacacccaagg

SEQ ID NO: 837400 - DNA, 25 bp, Mus musculus
tcttattcccctctatgctgtgata

SEQ ID NO: 837401 - DNA, 25 bp, Mus musculus
tcttattcccctgtatgctgtgata

SEQ ID NO: 837402 - DNA, 25 bp, Mus musculus
tcttattcccttaaatgtgagaact

SEQ ID NO: 837403 - DNA, 25 bp, Mus musculus
tcttattccctttaatgtgagaact

SEQ ID NO: 837404 - DNA, 25 bp, Mus musculus
tcttattcctttcacgttctctacc

SEQ ID NO: 837405 - DNA, 25 bp, Mus musculus
tcttattcctttgacgttctctacc

SEQ ID NO: 837406 - DNA, 25 bp, Mus musculus
tcttattcttgtccctcaaattcag

SEQ ID NO: 837407 - DNA, 25 bp, Mus musculus
tcttattcttgtgcctcaaattcag

SEQ ID NO: 837408 - DNA, 25 bp, Mus musculus
tcttattgagaccataccttcttct

SEQ ID NO: 837409 - DNA, 25 bp, Mus musculus
tcttattgagacgataccttcttct

SEQ ID NO: 837410 - DNA, 25 bp, Mus musculus
tcttattgtggccttaattctgtac

SEQ ID NO: 837411 - DNA, 25 bp, Mus musculus
tcttattgtggcgttaattctgtac

SEQ ID NO: 837412 - DNA, 25 bp, Mus musculus
tcttatttagttctcgggagcgcct

SEQ ID NO: 837413 - DNA, 25 bp, Mus musculus
tcttatttagttgtcgggagcgcct

SEQ ID NO: 837414 - DNA, 25 bp, Mus musculus
tcttatttcagtattaggccttggt

SEQ ID NO: 837415 - DNA, 25 bp, Mus musculus
tcttatttcagttttaggccttggt

SEQ ID NO: 837416 - DNA, 25 bp, Mus musculus
tcttatttccagctcaggagatggc

SEQ ID NO: 837417 - DNA, 25 bp, Mus musculus
tcttatttccaggtcaggagatggc

SEQ ID NO: 837418 - DNA, 25 bp, Mus musculus
tcttatttctgaccttcattcagga

SEQ ID NO: 837419 - DNA, 25 bp, Mus musculus
tcttatttctgagcttcattcagga

SEQ ID NO: 837420 - DNA, 25 bp, Mus musculus
tcttatttctgtcacgtatggaacc

SEQ ID NO: 837421 - DNA, 25 bp, Mus musculus
tcttatttctgtgacgtatggaacc

SEQ ID NO: 837422 - DNA, 25 bp, Mus musculus
tcttattttctaaacatggatcctg

SEQ ID NO: 837423 - DNA, 25 bp, Mus musculus
tcttattttctatacatggatcctg

SEQ ID NO: 837424 - DNA, 25 bp, Mus musculus
tcttattttggacatgcagggatca

SEQ ID NO: 837425 - DNA, 25 bp, Mus musculus
tcttattttggagatgcagggatca

SEQ ID NO: 837426 - DNA, 25 bp, Mus musculus
tcttcaaaaccaaactccaaaaaag

SEQ ID NO: 837427 - DNA, 25 bp, Mus musculus
tcttcaaaaccatactccaaaaaag

SEQ ID NO: 837428 - DNA, 25 bp, Mus musculus
tcttcaaaatccctggtgaaagggc

SEQ ID NO: 837429 - DNA, 25 bp, Mus musculus
tcttcaaaatccgtggtgaaagggc

SEQ ID NO: 837430 - DNA, 25 bp, Mus musculus
tcttcaaactctacagtgatgatct

SEQ ID NO: 837431 - DNA, 25 bp, Mus musculus
tcttcaaactcttcagtgatgatct

SEQ ID NO: 837432 - DNA, 25 bp, Mus musculus
tcttcaaagagaccaacgccaccta

SEQ ID NO: 837433 - DNA, 25 bp, Mus musculus
tcttcaaagagagcaacgccaccta

SEQ ID NO: 837434 - DNA, 25 bp, Mus musculus
tcttcaaagaggaatttttccacat

SEQ ID NO: 837435 - DNA, 25 bp, Mus musculus
tcttcaaagaggtatttttccacat

SEQ ID NO: 837436 - DNA, 25 bp, Mus musculus
tcttcaaagcttcctctctacacta

SEQ ID NO: 837437 - DNA, 25 bp, Mus musculus
tcttcaaagcttgctctctacacta

SEQ ID NO: 837438 - DNA, 25 bp, Mus musculus
tcttcaaagtgaactgcccagcggg

SEQ ID NO: 837439 - DNA, 25 bp, Mus musculus
tcttcaaagtgatctgcccagcggg

SEQ ID NO: 837440 - DNA, 25 bp, Mus musculus
tcttcaaatgaaccttacagtgtgc

SEQ ID NO: 837441 - DNA, 25 bp, Mus musculus
tcttcaaatgaagcttacagtgtgc

SEQ ID NO: 837442 - DNA, 25 bp, Mus musculus
tcttcaacacacagggactcatttg

SEQ ID NO: 837443 - DNA, 25 bp, Mus musculus
tcttcaacacactgggactcatttg

SEQ ID NO: 837444 - DNA, 25 bp, Mus musculus
tcttcaacaccgattttctaggatt

SEQ ID NO: 837445 - DNA, 25 bp, Mus musculus
tcttcaacaccgtttttctaggatt

SEQ ID NO: 837446 - DNA, 25 bp, Mus musculus
tcttcaacagtcagctgagggcttt

SEQ ID NO: 837447 - DNA, 25 bp, Mus musculus
tcttcaacagtctgctgagggcttt

SEQ ID NO: 837448 - DNA, 25 bp, Mus musculus
tcttcaacattgaccgcatcctcat

SEQ ID NO: 837449 - DNA, 25 bp, Mus musculus
tcttcaacattgtccgcatcctcat

SEQ ID NO: 837450 - DNA, 25 bp, Mus musculus
tcttcaaccagcagacagcggatta

SEQ ID NO: 837451 - DNA, 25 bp, Mus musculus
tcttcaaccagctgacagcggatta

SEQ ID NO: 837452 - DNA, 25 bp, Mus musculus
tcttcaaccccaaactctaaaaaag

SEQ ID NO: 837453 - DNA, 25 bp, Mus musculus
tcttcaaccccatactctaaaaaag

SEQ ID NO: 837454 - DNA, 25 bp, Mus musculus
tcttcaacccttctatcttcaaaga

SEQ ID NO: 837455 - DNA, 25 bp, Mus musculus
tcttcaacccttgtatcttcaaaga

SEQ ID NO: 837456 - DNA, 25 bp, Mus musculus
tcttcaaccgaactgtcacactaaa

SEQ ID NO: 837457 - DNA, 25 bp, Mus musculus
tcttcaaccgaagtgtcacactaaa

SEQ ID NO: 837458 - DNA, 25 bp, Mus musculus
tcttcaactccaagaacgtcaatcc

SEQ ID NO: 837459 - DNA, 25 bp, Mus musculus
tcttcaactccatgaacgtcaatcc

SEQ ID NO: 837460 - DNA, 25 bp, Mus musculus
tcttcaagaccccttttggagtcac

SEQ ID NO: 837461 - DNA, 25 bp, Mus musculus
tcttcaagacccgttttggagtcac

SEQ ID NO: 837462 - DNA, 25 bp, Mus musculus
tcttcaagagccctggcctcttggg

SEQ ID NO: 837463 - DNA, 25 bp, Mus musculus
tcttcaagagccgtggcctcttggg

SEQ ID NO: 837464 - DNA, 25 bp, Mus musculus
tcttcaatattgaatcgatgccagg

SEQ ID NO: 837465 - DNA, 25 bp, Mus musculus
tcttcaatattgtatcgatgccagg

SEQ ID NO: 837466 - DNA, 25 bp, Mus musculus
tcttcaatcccaaaattcctttctc

SEQ ID NO: 837467 - DNA, 25 bp, Mus musculus
tcttcaatcccataattcctttctc

SEQ ID NO: 837468 - DNA, 25 bp, Mus musculus
tcttcaatccccattccttattatt

SEQ ID NO: 837469 - DNA, 25 bp, Mus musculus
tcttcaatcccctttccttattatt

SEQ ID NO: 837470 - DNA, 25 bp, Mus musculus
tcttcaatgcctccctgcaaatttc

SEQ ID NO: 837471 - DNA, 25 bp, Mus musculus
tcttcaatgcctgcctgcaaatttc

SEQ ID NO: 837472 - DNA, 25 bp, Mus musculus
tcttcaatggtccagatgccaactc

SEQ ID NO: 837473 - DNA, 25 bp, Mus musculus
tcttcaatggtcgagatgccaactc

SEQ ID NO: 837474 - DNA, 25 bp, Mus musculus
tcttcaattcctcctctgttttctt

SEQ ID NO: 837475 - DNA, 25 bp, Mus musculus
tcttcaattcctgctctgttttctt

SEQ ID NO: 837476 - DNA, 25 bp, Mus musculus
tcttcaatttagctatttatgctta

SEQ ID NO: 837477 - DNA, 25 bp, Mus musculus
tcttcaatttaggtatttatgctta

SEQ ID NO: 837478 - DNA, 25 bp, Mus musculus
tcttcacaaagaactgcatgccacc

SEQ ID NO: 837479 - DNA, 25 bp, Mus musculus
tcttcacaaagatctgcatgccacc

SEQ ID NO: 837480 - DNA, 25 bp, Mus musculus
tcttcacaagcaccctgttccagat

SEQ ID NO: 837481 - DNA, 25 bp, Mus musculus
tcttcacaagcagcctgttccagat

SEQ ID NO: 837482 - DNA, 25 bp, Mus musculus
tcttcacacagaacctcagagtcaa

SEQ ID NO: 837483 - DNA, 25 bp, Mus musculus
tcttcacacagatcctcagagtcaa

SEQ ID NO: 837484 - DNA, 25 bp, Mus musculus
tcttcacagaagacaaccggcttat

SEQ ID NO: 837485 - DNA, 25 bp, Mus musculus
tcttcacagaagtcaaccggcttat

SEQ ID NO: 837486 - DNA, 25 bp, Mus musculus
tcttcacagttacggcttctggagt

SEQ ID NO: 837487 - DNA, 25 bp, Mus musculus
tcttcacagttagggcttctggagt

SEQ ID NO: 837488 - DNA, 25 bp, Mus musculus
tcttcacatctgactgtggtgacag

SEQ ID NO: 837489 - DNA, 25 bp, Mus musculus
tcttcacatctgtctgtggtgacag

SEQ ID NO: 837490 - DNA, 25 bp, Mus musculus
tcttcacatgttccctatagaattg

SEQ ID NO: 837491 - DNA, 25 bp, Mus musculus
tcttcacatgttgcctatagaattg

SEQ ID NO: 837492 - DNA, 25 bp, Mus musculus
tcttcacattgcaattagcctccga

SEQ ID NO: 837493 - DNA, 25 bp, Mus musculus
tcttcacattgctattagcctccga

SEQ ID NO: 837494 - DNA, 25 bp, Mus musculus
tcttcaccagcaagcaagccagagt

SEQ ID NO: 837495 - DNA, 25 bp, Mus musculus
tcttcaccagcatgcaagccagagt

SEQ ID NO: 837496 - DNA, 25 bp, Mus musculus
tcttcaccaggcactttcagccgtg

SEQ ID NO: 837497 - DNA, 25 bp, Mus musculus
tcttcaccaggctctttcagccgtg

SEQ ID NO: 837498 - DNA, 25 bp, Mus musculus
tcttcaccatcaattacagagtgtg

SEQ ID NO: 837499 - DNA, 25 bp, Mus musculus
tcttcaccatcacgttctggctgct

SEQ ID NO: 837500 - DNA, 25 bp, Mus musculus
tcttcaccatcaggttctggctgct

SEQ ID NO: 837501 - DNA, 25 bp, Mus musculus
tcttcaccatcatttacagagtgtg

SEQ ID NO: 837502 - DNA, 25 bp, Mus musculus
tcttcaccatgcagagacttcggag

SEQ ID NO: 837503 - DNA, 25 bp, Mus musculus
tcttcaccatgctgagacttcggag

SEQ ID NO: 837504 - DNA, 25 bp, Mus musculus
tcttcaccattcagtcacctgtaga

SEQ ID NO: 837505 - DNA, 25 bp, Mus musculus
tcttcaccattctgtcacctgtaga

SEQ ID NO: 837506 - DNA, 25 bp, Mus musculus
tcttcaccatttactcctgatgttt

SEQ ID NO: 837507 - DNA, 25 bp, Mus musculus
tcttcaccattttctcctgatgttt

SEQ ID NO: 837508 - DNA, 25 bp, Mus musculus
tcttcacccagcagaggacctaatg

SEQ ID NO: 837509 - DNA, 25 bp, Mus musculus
tcttcacccagcctaagcgacagca

SEQ ID NO: 837510 - DNA, 25 bp, Mus musculus
tcttcacccagcgtaagcgacagca

SEQ ID NO: 837511 - DNA, 25 bp, Mus musculus
tcttcacccagctgaggacctaatg

SEQ ID NO: 837512 - DNA, 25 bp, Mus musculus
tcttcacccatgctagcaagtgcta

SEQ ID NO: 837513 - DNA, 25 bp, Mus musculus
tcttcacccatggtagcaagtgcta

SEQ ID NO: 837514 - DNA, 25 bp, Mus musculus
tcttcacccgagcaaaactagaatg

SEQ ID NO: 837515 - DNA, 25 bp, Mus musculus
tcttcacccgaggaaaactagaatg

SEQ ID NO: 837516 - DNA, 25 bp, Mus musculus
tcttcaccctttccgtatcttgaat

SEQ ID NO: 837517 - DNA, 25 bp, Mus musculus
tcttcaccctttgcgtatcttgaat

SEQ ID NO: 837518 - DNA, 25 bp, Mus musculus
tcttcaccgcgcacaaggtcatcaa

SEQ ID NO: 837519 - DNA, 25 bp, Mus musculus
tcttcaccgcgctcaaggtcatcaa

SEQ ID NO: 837520 - DNA, 25 bp, Mus musculus
tcttcaccggagcatttccatttaa

SEQ ID NO: 837521 - DNA, 25 bp, Mus musculus
tcttcaccggaggatttccatttaa

SEQ ID NO: 837522 - DNA, 25 bp, Mus musculus
tcttcacctgagcatgaacacggtt

SEQ ID NO: 837523 - DNA, 25 bp, Mus musculus
tcttcacctgaggatgaacacggtt

SEQ ID NO: 837524 - DNA, 25 bp, Mus musculus
tcttcaccttcacgctctactgtgt

SEQ ID NO: 837525 - DNA, 25 bp, Mus musculus
tcttcaccttcaggctctactgtgt

SEQ ID NO: 837526 - DNA, 25 bp, Mus musculus
tcttcaccttctaccacatcagctg

SEQ ID NO: 837527 - DNA, 25 bp, Mus musculus
tcttcaccttcttccacatcagctg

SEQ ID NO: 837528 - DNA, 25 bp, Mus musculus
tcttcaccttgcagatgccatacat

SEQ ID NO: 837529 - DNA, 25 bp, Mus musculus
tcttcaccttgctgatgccatacat

SEQ ID NO: 837530 - DNA, 25 bp, Mus musculus
tcttcacgaggacgaggccacagct

SEQ ID NO: 837531 - DNA, 25 bp, Mus musculus
tcttcacgaggaggaggccacagct

SEQ ID NO: 837532 - DNA, 25 bp, Mus musculus
tcttcacggtgcatcttagtctgaa

SEQ ID NO: 837533 - DNA, 25 bp, Mus musculus
tcttcacggtgcttcttagtctgaa

SEQ ID NO: 837534 - DNA, 25 bp, Mus musculus
tcttcacgtaacagtttctcaccca

SEQ ID NO: 837535 - DNA, 25 bp, Mus musculus
tcttcacgtaactgtttctcaccca

SEQ ID NO: 837536 - DNA, 25 bp, Mus musculus
tcttcacgtagtcgccaggatgtcc

SEQ ID NO: 837537 - DNA, 25 bp, Mus musculus
tcttcacgtagtggccaggatgtcc

SEQ ID NO: 837538 - DNA, 25 bp, Mus musculus
tcttcactaactccctgggtcagat

SEQ ID NO: 837539 - DNA, 25 bp, Mus musculus
tcttcactaactgcctgggtcagat

SEQ ID NO: 837540 - DNA, 25 bp, Mus musculus
tcttcactaattatagcaaatgcat

SEQ ID NO: 837541 - DNA, 25 bp, Mus musculus
tcttcactaattttagcaaatgcat

SEQ ID NO: 837542 - DNA, 25 bp, Mus musculus
tcttcactaccccagaccttgaaag

SEQ ID NO: 837543 - DNA, 25 bp, Mus musculus
tcttcactacccgagaccttgaaag

SEQ ID NO: 837544 - DNA, 25 bp, Mus musculus
tcttcactagagactccggaaacgt

SEQ ID NO: 837545 - DNA, 25 bp, Mus musculus
tcttcactagagtctccggaaacgt

SEQ ID NO: 837546 - DNA, 25 bp, Mus musculus
tcttcactattacctccaggcagga

SEQ ID NO: 837547 - DNA, 25 bp, Mus musculus
tcttcactattagctccaggcagga

SEQ ID NO: 837548 - DNA, 25 bp, Mus musculus
tcttcactccgcatcagttgaccat

SEQ ID NO: 837549 - DNA, 25 bp, Mus musculus
tcttcactccgcttcagttgaccat

SEQ ID NO: 837550 - DNA, 25 bp, Mus musculus
tcttcactgaccaatgggggtggaa

SEQ ID NO: 837551 - DNA, 25 bp, Mus musculus
tcttcactgacctatgggggtggaa

SEQ ID NO: 837552 - DNA, 25 bp, Mus musculus
tcttcactgcaaccgctcgctgagg

SEQ ID NO: 837553 - DNA, 25 bp, Mus musculus
tcttcactgcaagcgctcgctgagg

SEQ ID NO: 837554 - DNA, 25 bp, Mus musculus
tcttcactgggtacacttccaagga

SEQ ID NO: 837555 - DNA, 25 bp, Mus musculus
tcttcactgggttcacttccaagga

SEQ ID NO: 837556 - DNA, 25 bp, Mus musculus
tcttcactgtgcactgtgtcgaggt

SEQ ID NO: 837557 - DNA, 25 bp, Mus musculus
tcttcactgtgctctgtgtcgaggt

SEQ ID NO: 837558 - DNA, 25 bp, Mus musculus
tcttcactgttcatcacttccataa

SEQ ID NO: 837559 - DNA, 25 bp, Mus musculus
tcttcactgttcttcacttccataa

SEQ ID NO: 837560 - DNA, 25 bp, Mus musculus
tcttcactgtttctggccaaagcag

SEQ ID NO: 837561 - DNA, 25 bp, Mus musculus
tcttcactgtttgtggccaaagcag

SEQ ID NO: 837562 - DNA, 25 bp, Mus musculus
tcttcacttgtgagcttcgaggctt

SEQ ID NO: 837563 - DNA, 25 bp, Mus musculus
tcttcacttgtgataactcatactg

SEQ ID NO: 837564 - DNA, 25 bp, Mus musculus
tcttcacttgtgtgcttcgaggctt

SEQ ID NO: 837565 - DNA, 25 bp, Mus musculus
tcttcacttgtgttaactcatactg

SEQ ID NO: 837566 - DNA, 25 bp, Mus musculus
tcttcactttcaagctcctgggcga

SEQ ID NO: 837567 - DNA, 25 bp, Mus musculus
tcttcactttcatgctcctgggcga

SEQ ID NO: 837568 - DNA, 25 bp, Mus musculus
tcttcactttccaggttaagtaaag

SEQ ID NO: 837569 - DNA, 25 bp, Mus musculus
tcttcactttcctggttaagtaaag

SEQ ID NO: 837570 - DNA, 25 bp, Mus musculus
tcttcacttttaccaagtctatatt

SEQ ID NO: 837571 - DNA, 25 bp, Mus musculus
tcttcacttttagcaagtctatatt

SEQ ID NO: 837572 - DNA, 25 bp, Mus musculus
tcttcagaaaccaaccgcttcggaa

SEQ ID NO: 837573 - DNA, 25 bp, Mus musculus
tcttcagaaacctaccgcttcggaa

SEQ ID NO: 837574 - DNA, 25 bp, Mus musculus
tcttcagaagggatctcttggcaac

SEQ ID NO: 837575 - DNA, 25 bp, Mus musculus
tcttcagaagggttctcttggcaac

SEQ ID NO: 837576 - DNA, 25 bp, Mus musculus
tcttcagaatgtactccggaaagtg

SEQ ID NO: 837577 - DNA, 25 bp, Mus musculus
tcttcagaatgttctccggaaagtg

SEQ ID NO: 837578 - DNA, 25 bp, Mus musculus
tcttcagacaccagcgattcagact

SEQ ID NO: 837579 - DNA, 25 bp, Mus musculus
tcttcagacacctgcgattcagact

SEQ ID NO: 837580 - DNA, 25 bp, Mus musculus
tcttcagacgtgaggactggctcga

SEQ ID NO: 837581 - DNA, 25 bp, Mus musculus
tcttcagacgtgtggactggctcga

SEQ ID NO: 837582 - DNA, 25 bp, Mus musculus
tcttcagagcaaccacagtactaga

SEQ ID NO: 837583 - DNA, 25 bp, Mus musculus
tcttcagagcaagcacagtactaga

SEQ ID NO: 837584 - DNA, 25 bp, Mus musculus
tcttcagagccgagtatctgtgcag

SEQ ID NO: 837585 - DNA, 25 bp, Mus musculus
tcttcagagccgtgtatctgtgcag

SEQ ID NO: 837586 - DNA, 25 bp, Mus musculus
tcttcagagtccctgtgactgatgc

SEQ ID NO: 837587 - DNA, 25 bp, Mus musculus
tcttcagagtccgtgtgactgatgc

SEQ ID NO: 837588 - DNA, 25 bp, Mus musculus
tcttcagataacaatgtggaacccc

SEQ ID NO: 837589 - DNA, 25 bp, Mus musculus
tcttcagataactatgtggaacccc

SEQ ID NO: 837590 - DNA, 25 bp, Mus musculus
tcttcagattctccagtagctcttt

SEQ ID NO: 837591 - DNA, 25 bp, Mus musculus
tcttcagattctgcagtagctcttt

SEQ ID NO: 837592 - DNA, 25 bp, Mus musculus
tcttcagattgcattaaagcaccca

SEQ ID NO: 837593 - DNA, 25 bp, Mus musculus
tcttcagattgctttaaagcaccca

SEQ ID NO: 837594 - DNA, 25 bp, Mus musculus
tcttcagatttcattcaggcatatg

SEQ ID NO: 837595 - DNA, 25 bp, Mus musculus
tcttcagatttctttcaggcatatg

SEQ ID NO: 837596 - DNA, 25 bp, Mus musculus
tcttcagcaagtacaccatgtctgg

SEQ ID NO: 837597 - DNA, 25 bp, Mus musculus
tcttcagcaagttcaccatgtctgg

SEQ ID NO: 837598 - DNA, 25 bp, Mus musculus
tcttcagcactcagtgaaacaaggc

SEQ ID NO: 837599 - DNA, 25 bp, Mus musculus
tcttcagcactctgtgaaacaaggc

SEQ ID NO: 837600 - DNA, 25 bp, Mus musculus
tcttcagcatacagctcccatgtgg

SEQ ID NO: 837601 - DNA, 25 bp, Mus musculus
tcttcagcatactgctcccatgtgg

SEQ ID NO: 837602 - DNA, 25 bp, Mus musculus
tcttcagccaagaagcttctgctat

SEQ ID NO: 837603 - DNA, 25 bp, Mus musculus
tcttcagccaagagcatctcgtgat

SEQ ID NO: 837604 - DNA, 25 bp, Mus musculus
tcttcagccaagaggtctgtgtcct

SEQ ID NO: 837605 - DNA, 25 bp, Mus musculus
tcttcagccaagtagcttctgctat

SEQ ID NO: 837606 - DNA, 25 bp, Mus musculus
tcttcagccaagtgcatctcgtgat

SEQ ID NO: 837607 - DNA, 25 bp, Mus musculus
tcttcagccaagtggtctgtgtcct

SEQ ID NO: 837608 - DNA, 25 bp, Mus musculus
tcttcagccctgacaatgcctttta

SEQ ID NO: 837609 - DNA, 25 bp, Mus musculus
tcttcagccctgtcaatgcctttta

SEQ ID NO: 837610 - DNA, 25 bp, Mus musculus
tcttcagccgagcagctccgaaaag

SEQ ID NO: 837611 - DNA, 25 bp, Mus musculus
tcttcagccgaggagctccgaaaag

SEQ ID NO: 837612 - DNA, 25 bp, Mus musculus
tcttcagcctcaatgcaggtaaaga

SEQ ID NO: 837613 - DNA, 25 bp, Mus musculus
tcttcagcctcattgcaggtaaaga

SEQ ID NO: 837614 - DNA, 25 bp, Mus musculus
tcttcagcgaccagggatgggacca

SEQ ID NO: 837615 - DNA, 25 bp, Mus musculus
tcttcagcgacctgggatgggacca

SEQ ID NO: 837616 - DNA, 25 bp, Mus musculus
tcttcagctccccacagtattgata

SEQ ID NO: 837617 - DNA, 25 bp, Mus musculus
tcttcagctcccgacagtattgata

SEQ ID NO: 837618 - DNA, 25 bp, Mus musculus
tcttcagctgcccatatgacctttg

SEQ ID NO: 837619 - DNA, 25 bp, Mus musculus
tcttcagctgccgatatgacctttg

SEQ ID NO: 837620 - DNA, 25 bp, Mus musculus
tcttcagctgtcagtgttgttcctt

SEQ ID NO: 837621 - DNA, 25 bp, Mus musculus
tcttcagctgtctgtgttgttcctt

SEQ ID NO: 837622 - DNA, 25 bp, Mus musculus
tcttcagcttagactcagagggccc

SEQ ID NO: 837623 - DNA, 25 bp, Mus musculus
tcttcagcttagtctcagagggccc

SEQ ID NO: 837624 - DNA, 25 bp, Mus musculus
tcttcagcttcacaaagagcattgc

SEQ ID NO: 837625 - DNA, 25 bp, Mus musculus
tcttcagcttcagaaagagcattgc

SEQ ID NO: 837626 - DNA, 25 bp, Mus musculus
tcttcaggactcataaagcacattt

SEQ ID NO: 837627 - DNA, 25 bp, Mus musculus
tcttcaggactcttaaagcacattt

SEQ ID NO: 837628 - DNA, 25 bp, Mus musculus
tcttcaggacttacatggaatttta

SEQ ID NO: 837629 - DNA, 25 bp, Mus musculus
tcttcaggactttcatggaatttta

SEQ ID NO: 837630 - DNA, 25 bp, Mus musculus
tcttcaggaggacgagccgcatgct

SEQ ID NO: 837631 - DNA, 25 bp, Mus musculus
tcttcaggaggaggagccgcatgct

SEQ ID NO: 837632 - DNA, 25 bp, Mus musculus
tcttcaggagtgagcccttatgcca

SEQ ID NO: 837633 - DNA, 25 bp, Mus musculus
tcttcaggagtgtgcccttatgcca

SEQ ID NO: 837634 - DNA, 25 bp, Mus musculus
tcttcaggcactctgtgtggcagac

SEQ ID NO: 837635 - DNA, 25 bp, Mus musculus
tcttcaggcactgtgtgtggcagac

SEQ ID NO: 837636 - DNA, 25 bp, Mus musculus
tcttcaggcagcaaagatgtctgtt

SEQ ID NO: 837637 - DNA, 25 bp, Mus musculus
tcttcaggcagctaagatgtctgtt

SEQ ID NO: 837638 - DNA, 25 bp, Mus musculus
tcttcaggcaggctaaacccagtac

SEQ ID NO: 837639 - DNA, 25 bp, Mus musculus
tcttcaggcagggtaaacccagtac

SEQ ID NO: 837640 - DNA, 25 bp, Mus musculus
tcttcaggccacacagatcaaagta

SEQ ID NO: 837641 - DNA, 25 bp, Mus musculus
tcttcaggccactcagatcaaagta

SEQ ID NO: 837642 - DNA, 25 bp, Mus musculus
tcttcaggcctaaagcaagctgctg

SEQ ID NO: 837643 - DNA, 25 bp, Mus musculus
tcttcaggcctatagcaagctgctg

SEQ ID NO: 837644 - DNA, 25 bp, Mus musculus
tcttcaggcgctatcccaggtggca

SEQ ID NO: 837645 - DNA, 25 bp, Mus musculus
tcttcaggcgctttcccaggtggca

SEQ ID NO: 837646 - DNA, 25 bp, Mus musculus
tcttcaggcggtagctgattctgga

SEQ ID NO: 837647 - DNA, 25 bp, Mus musculus
tcttcaggcggttgctgattctgga

SEQ ID NO: 837648 - DNA, 25 bp, Mus musculus
tcttcagggaatattttggtggaag

SEQ ID NO: 837649 - DNA, 25 bp, Mus musculus
tcttcagggaattttttggtggaag

SEQ ID NO: 837650 - DNA, 25 bp, Mus musculus
tcttcagggacaagtttgggtctct

SEQ ID NO: 837651 - DNA, 25 bp, Mus musculus
tcttcagggacatgtttgggtctct

SEQ ID NO: 837652 - DNA, 25 bp, Mus musculus
tcttcagggactcgctattctctgt

SEQ ID NO: 837653 - DNA, 25 bp, Mus musculus
tcttcagggactggctattctctgt

SEQ ID NO: 837654 - DNA, 25 bp, Mus musculus
tcttcagggttcatattttcctcct

SEQ ID NO: 837655 - DNA, 25 bp, Mus musculus
tcttcagggttcttattttcctcct

SEQ ID NO: 837656 - DNA, 25 bp, Mus musculus
tcttcagtaaataagttcccaccat

SEQ ID NO: 837657 - DNA, 25 bp, Mus musculus
tcttcagtaaattagttcccaccat

SEQ ID NO: 837658 - DNA, 25 bp, Mus musculus
tcttcagtagagaacttttcacatt

SEQ ID NO: 837659 - DNA, 25 bp, Mus musculus
tcttcagtagagtacttttcacatt

SEQ ID NO: 837660 - DNA, 25 bp, Mus musculus
tcttcagtagtactgggacttttac

SEQ ID NO: 837661 - DNA, 25 bp, Mus musculus
tcttcagtagtagtgggacttttac

SEQ ID NO: 837662 - DNA, 25 bp, Mus musculus
tcttcagtccggaggtattgtgaca

SEQ ID NO: 837663 - DNA, 25 bp, Mus musculus
tcttcagtccggtggtattgtgaca

SEQ ID NO: 837664 - DNA, 25 bp, Mus musculus
tcttcagtcgctctccacagagaag

SEQ ID NO: 837665 - DNA, 25 bp, Mus musculus
tcttcagtcgctgtccacagagaag

SEQ ID NO: 837666 - DNA, 25 bp, Mus musculus
tcttcagtgaagcagcccaagccaa

SEQ ID NO: 837667 - DNA, 25 bp, Mus musculus
tcttcagtgaaggagcccaagccaa

SEQ ID NO: 837668 - DNA, 25 bp, Mus musculus
tcttcagtgactaggtttagggtac

SEQ ID NO: 837669 - DNA, 25 bp, Mus musculus
tcttcagtgacttggtttagggtac

SEQ ID NO: 837670 - DNA, 25 bp, Mus musculus
tcttcagtgtcaaaagcctgtccac

SEQ ID NO: 837671 - DNA, 25 bp, Mus musculus
tcttcagtgtcaccactagggtttg

SEQ ID NO: 837672 - DNA, 25 bp, Mus musculus
tcttcagtgtcagcactagggtttg

SEQ ID NO: 837673 - DNA, 25 bp, Mus musculus
tcttcagtgtcataagcctgtccac

SEQ ID NO: 837674 - DNA, 25 bp, Mus musculus
tcttcagtgtctaacctaggtccta

SEQ ID NO: 837675 - DNA, 25 bp, Mus musculus
tcttcagtgtcttacctaggtccta

SEQ ID NO: 837676 - DNA, 25 bp, Mus musculus
tcttcagtgttaagctactggtaat

SEQ ID NO: 837677 - DNA, 25 bp, Mus musculus
tcttcagtgttatgctactggtaat

SEQ ID NO: 837678 - DNA, 25 bp, Mus musculus
tcttcagttaacactccatgtctca

SEQ ID NO: 837679 - DNA, 25 bp, Mus musculus
tcttcagttaactctccatgtctca

SEQ ID NO: 837680 - DNA, 25 bp, Mus musculus
tcttcagttcctagagtcctctaga

SEQ ID NO: 837681 - DNA, 25 bp, Mus musculus
tcttcagttccttgagtcctctaga

SEQ ID NO: 837682 - DNA, 25 bp, Mus musculus
tcttcagttctcatactttttgaca

SEQ ID NO: 837683 - DNA, 25 bp, Mus musculus
tcttcagttctcttactttttgaca

SEQ ID NO: 837684 - DNA, 25 bp, Mus musculus
tcttcagttggtctgtttccgggat

SEQ ID NO: 837685 - DNA, 25 bp, Mus musculus
tcttcagttggtgtgtttccgggat

SEQ ID NO: 837686 - DNA, 25 bp, Mus musculus
tcttcagttgtgaagtcagtcctca

SEQ ID NO: 837687 - DNA, 25 bp, Mus musculus
tcttcagttgtgctgtgtggctgta

SEQ ID NO: 837688 - DNA, 25 bp, Mus musculus
tcttcagttgtggtgtgtggctgta

SEQ ID NO: 837689 - DNA, 25 bp, Mus musculus
tcttcagttgtgtagtcagtcctca

SEQ ID NO: 837690 - DNA, 25 bp, Mus musculus
tcttcagtttccctagctttcagca

SEQ ID NO: 837691 - DNA, 25 bp, Mus musculus
tcttcagtttccgtagctttcagca

SEQ ID NO: 837692 - DNA, 25 bp, Mus musculus
tcttcagtttgcacgggttgacgcg

SEQ ID NO: 837693 - DNA, 25 bp, Mus musculus
tcttcagtttgctcgggttgacgcg

SEQ ID NO: 837694 - DNA, 25 bp, Mus musculus
tcttcataatccaagtatttggtgt

SEQ ID NO: 837695 - DNA, 25 bp, Mus musculus
tcttcataatcctagtatttggtgt

SEQ ID NO: 837696 - DNA, 25 bp, Mus musculus
tcttcatagagacacaaccgtgttg

SEQ ID NO: 837697 - DNA, 25 bp, Mus musculus
tcttcatagagagacaaccgtgttg

SEQ ID NO: 837698 - DNA, 25 bp, Mus musculus
tcttcatatgctccagaaaccgctg

SEQ ID NO: 837699 - DNA, 25 bp, Mus musculus
tcttcatatgctgcagaaaccgctg

SEQ ID NO: 837700 - DNA, 25 bp, Mus musculus
tcttcatattgccatactttcctgc

SEQ ID NO: 837701 - DNA, 25 bp, Mus musculus
tcttcatattgcgatactttcctgc

SEQ ID NO: 837702 - DNA, 25 bp, Mus musculus
tcttcatattgtcctttggtttgta

SEQ ID NO: 837703 - DNA, 25 bp, Mus musculus
tcttcatattgtgctttggtttgta

SEQ ID NO: 837704 - DNA, 25 bp, Mus musculus
tcttcatcatcactatcgtcatcat

SEQ ID NO: 837705 - DNA, 25 bp, Mus musculus
tcttcatcatcagtatcgtcatcat

SEQ ID NO: 837706 - DNA, 25 bp, Mus musculus
tcttcatcatctacaggacttcagt

SEQ ID NO: 837707 - DNA, 25 bp, Mus musculus
tcttcatcatcttcaggacttcagt

SEQ ID NO: 837708 - DNA, 25 bp, Mus musculus
tcttcatccacgcaggattggcagg

SEQ ID NO: 837709 - DNA, 25 bp, Mus musculus
tcttcatccacggaggattggcagg

SEQ ID NO: 837710 - DNA, 25 bp, Mus musculus
tcttcatccatcagtctgttagcat

SEQ ID NO: 837711 - DNA, 25 bp, Mus musculus
tcttcatccatcagtgcaactacat

SEQ ID NO: 837712 - DNA, 25 bp, Mus musculus
tcttcatccatctgtctgttagcat

SEQ ID NO: 837713 - DNA, 25 bp, Mus musculus
tcttcatccatctgtgcaactacat

SEQ ID NO: 837714 - DNA, 25 bp, Mus musculus
tcttcatccattaacctagcaacat

SEQ ID NO: 837715 - DNA, 25 bp, Mus musculus
tcttcatccatttacctagcaacat

SEQ ID NO: 837716 - DNA, 25 bp, Mus musculus
tcttcatcctacagcacatctgtta

SEQ ID NO: 837717 - DNA, 25 bp, Mus musculus
tcttcatcctactgcacatctgtta

SEQ ID NO: 837718 - DNA, 25 bp, Mus musculus
tcttcatccttgagacaatcctgag

SEQ ID NO: 837719 - DNA, 25 bp, Mus musculus
tcttcatccttgtgacaatcctgag

SEQ ID NO: 837720 - DNA, 25 bp, Mus musculus
tcttcatcgccactggtccaaaggg

SEQ ID NO: 837721 - DNA, 25 bp, Mus musculus
tcttcatcgccagtggtccaaaggg

SEQ ID NO: 837722 - DNA, 25 bp, Mus musculus
tcttcatcggtgctcagcagtgcta

SEQ ID NO: 837723 - DNA, 25 bp, Mus musculus
tcttcatcggtggtcagcagtgcta

SEQ ID NO: 837724 - DNA, 25 bp, Mus musculus
tcttcatctaataacagctgcctct

SEQ ID NO: 837725 - DNA, 25 bp, Mus musculus
tcttcatctaattacagctgcctct

SEQ ID NO: 837726 - DNA, 25 bp, Mus musculus
tcttcatctcacatatccaacattt

SEQ ID NO: 837727 - DNA, 25 bp, Mus musculus
tcttcatctcacttatccaacattt

SEQ ID NO: 837728 - DNA, 25 bp, Mus musculus
tcttcatctgataccaccagtgcca

SEQ ID NO: 837729 - DNA, 25 bp, Mus musculus
tcttcatctgattccaccagtgcca

SEQ ID NO: 837730 - DNA, 25 bp, Mus musculus
tcttcatcttcaatgtcatcctaca

SEQ ID NO: 837731 - DNA, 25 bp, Mus musculus
tcttcatcttcattgtcatcctaca

SEQ ID NO: 837732 - DNA, 25 bp, Mus musculus
tcttcatcttccactactcagtttt

SEQ ID NO: 837733 - DNA, 25 bp, Mus musculus
tcttcatcttcctctactcagtttt

SEQ ID NO: 837734 - DNA, 25 bp, Mus musculus
tcttcatcttttactctgcattgaa

SEQ ID NO: 837735 - DNA, 25 bp, Mus musculus
tcttcatctttttctctgcattgaa

SEQ ID NO: 837736 - DNA, 25 bp, Mus musculus
tcttcatgatgcattcgctatcttt

SEQ ID NO: 837737 - DNA, 25 bp, Mus musculus
tcttcatgatgctttcgctatcttt

SEQ ID NO: 837738 - DNA, 25 bp, Mus musculus
tcttcatgcttcatatgtagagcgt

SEQ ID NO: 837739 - DNA, 25 bp, Mus musculus
tcttcatgcttcttatgtagagcgt

SEQ ID NO: 837740 - DNA, 25 bp, Mus musculus
tcttcatgggaaatccaccaactgt

SEQ ID NO: 837741 - DNA, 25 bp, Mus musculus
tcttcatgggaattccaccaactgt

SEQ ID NO: 837742 - DNA, 25 bp, Mus musculus
tcttcatggtcaatgccttctgcaa

SEQ ID NO: 837743 - DNA, 25 bp, Mus musculus
tcttcatggtcattgccttctgcaa

SEQ ID NO: 837744 - DNA, 25 bp, Mus musculus
tcttcatggtgtcgctcattactca

SEQ ID NO: 837745 - DNA, 25 bp, Mus musculus
tcttcatggtgtggctcattactca

SEQ ID NO: 837746 - DNA, 25 bp, Mus musculus
tcttcatgtatgaccggtctggcaa

SEQ ID NO: 837747 - DNA, 25 bp, Mus musculus
tcttcatgtatgtccggtctggcaa

SEQ ID NO: 837748 - DNA, 25 bp, Mus musculus
tcttcatgtcaacttctactatgtc

SEQ ID NO: 837749 - DNA, 25 bp, Mus musculus
tcttcatgtcaagttctactatgtc

SEQ ID NO: 837750 - DNA, 25 bp, Mus musculus
tcttcatgtccacaatccttcaggg

SEQ ID NO: 837751 - DNA, 25 bp, Mus musculus
tcttcatgtccagaatccttcaggg

SEQ ID NO: 837752 - DNA, 25 bp, Mus musculus
tcttcatgtctaatctgtcttataa

SEQ ID NO: 837753 - DNA, 25 bp, Mus musculus
tcttcatgtctattctgtcttataa

SEQ ID NO: 837754 - DNA, 25 bp, Mus musculus
tcttcatgtgaactggtgtgaccaa

SEQ ID NO: 837755 - DNA, 25 bp, Mus musculus
tcttcatgtgaagtggtgtgaccaa

SEQ ID NO: 837756 - DNA, 25 bp, Mus musculus
tcttcatgttatccagcctactcta

SEQ ID NO: 837757 - DNA, 25 bp, Mus musculus
tcttcatgttatgcagcctactcta

SEQ ID NO: 837758 - DNA, 25 bp, Mus musculus
tcttcattagacattgagccagtgg

SEQ ID NO: 837759 - DNA, 25 bp, Mus musculus
tcttcattagactttgagccagtgg

SEQ ID NO: 837760 - DNA, 25 bp, Mus musculus
tcttcattatttacaaatgcaggcc

SEQ ID NO: 837761 - DNA, 25 bp, Mus musculus
tcttcattattttcaaatgcaggcc

SEQ ID NO: 837762 - DNA, 25 bp, Mus musculus
tcttcattcattaccagttgctacc

SEQ ID NO: 837763 - DNA, 25 bp, Mus musculus
tcttcattcatttccagttgctacc

SEQ ID NO: 837764 - DNA, 25 bp, Mus musculus
tcttcattccacagccatgacttta

SEQ ID NO: 837765 - DNA, 25 bp, Mus musculus
tcttcattccactgccatgacttta

SEQ ID NO: 837766 - DNA, 25 bp, Mus musculus
tcttcattcctgattgtgtacatac

SEQ ID NO: 837767 - DNA, 25 bp, Mus musculus
tcttcattcctgcaatattttccat

SEQ ID NO: 837768 - DNA, 25 bp, Mus musculus
tcttcattcctggaatattttccat

SEQ ID NO: 837769 - DNA, 25 bp, Mus musculus
tcttcattcctgtttgtgtacatac

SEQ ID NO: 837770 - DNA, 25 bp, Mus musculus
tcttcattccttatgtcggtatctt

SEQ ID NO: 837771 - DNA, 25 bp, Mus musculus
tcttcattccttttgtcggtatctt

SEQ ID NO: 837772 - DNA, 25 bp, Mus musculus
tcttcattcgaactgatgctagaac

SEQ ID NO: 837773 - DNA, 25 bp, Mus musculus
tcttcattcgaagtgatgctagaac

SEQ ID NO: 837774 - DNA, 25 bp, Mus musculus
tcttcattctggatctctgtagcaa

SEQ ID NO: 837775 - DNA, 25 bp, Mus musculus
tcttcattctggttctctgtagcaa

SEQ ID NO: 837776 - DNA, 25 bp, Mus musculus
tcttcattctgtcggagctgctcaa

SEQ ID NO: 837777 - DNA, 25 bp, Mus musculus
tcttcattctgtgggagctgctcaa

SEQ ID NO: 837778 - DNA, 25 bp, Mus musculus
tcttcattcttgatgggaggtttaa

SEQ ID NO: 837779 - DNA, 25 bp, Mus musculus
tcttcattcttgttgggaggtttaa

SEQ ID NO: 837780 - DNA, 25 bp, Mus musculus
tcttcattctttcgtagatagtgac

SEQ ID NO: 837781 - DNA, 25 bp, Mus musculus
tcttcattctttggtagatagtgac

SEQ ID NO: 837782 - DNA, 25 bp, Mus musculus
tcttcattgaacatggagtcacata

SEQ ID NO: 837783 - DNA, 25 bp, Mus musculus
tcttcattgaacttggagtcacata

SEQ ID NO: 837784 - DNA, 25 bp, Mus musculus
tcttcattgaagaccgcgaggagga

SEQ ID NO: 837785 - DNA, 25 bp, Mus musculus
tcttcattgaagtccgcgaggagga

SEQ ID NO: 837786 - DNA, 25 bp, Mus musculus
tcttcattgtgtagggccagaaaca

SEQ ID NO: 837787 - DNA, 25 bp, Mus musculus
tcttcattgtgttgggccagaaaca

SEQ ID NO: 837788 - DNA, 25 bp, Mus musculus
tcttcattgttaaggacctcgggct

SEQ ID NO: 837789 - DNA, 25 bp, Mus musculus
tcttcattgttatggacctcgggct

SEQ ID NO: 837790 - DNA, 25 bp, Mus musculus
tcttcatttaggaagtgtggccgtt

SEQ ID NO: 837791 - DNA, 25 bp, Mus musculus
tcttcatttaggtagtgtggccgtt

SEQ ID NO: 837792 - DNA, 25 bp, Mus musculus
tcttcatttcacactgactgtgctc

SEQ ID NO: 837793 - DNA, 25 bp, Mus musculus
tcttcatttcactctgactgtgctc

SEQ ID NO: 837794 - DNA, 25 bp, Mus musculus
tcttcatttcccatttctcatttaa

SEQ ID NO: 837795 - DNA, 25 bp, Mus musculus
tcttcatttcccttttctcatttaa

SEQ ID NO: 837796 - DNA, 25 bp, Mus musculus
tcttcatttcctcaggacggactgg

SEQ ID NO: 837797 - DNA, 25 bp, Mus musculus
tcttcatttcctgaggacggactgg

SEQ ID NO: 837798 - DNA, 25 bp, Mus musculus
tcttcatttcgactgttctgtagca

SEQ ID NO: 837799 - DNA, 25 bp, Mus musculus
tcttcatttcgagtgttctgtagca

SEQ ID NO: 837800 - DNA, 25 bp, Mus musculus
tcttcatttcttagtcatttatctc

SEQ ID NO: 837801 - DNA, 25 bp, Mus musculus
tcttcatttcttcaggttggtaaaa

SEQ ID NO: 837802 - DNA, 25 bp, Mus musculus
tcttcatttcttgaggttggtaaaa

SEQ ID NO: 837803 - DNA, 25 bp, Mus musculus
tcttcatttctttgtcatttatctc

SEQ ID NO: 837804 - DNA, 25 bp, Mus musculus
tcttcattttccacatttttgagaa

SEQ ID NO: 837805 - DNA, 25 bp, Mus musculus
tcttcattttcctcatttttgagaa

SEQ ID NO: 837806 - DNA, 25 bp, Mus musculus
tcttcatttttgactcagccggcaa

SEQ ID NO: 837807 - DNA, 25 bp, Mus musculus
tcttcatttttgtctcagccggcaa

SEQ ID NO: 837808 - DNA, 25 bp, Mus musculus
tcttccaaagacagcaggctttcat

SEQ ID NO: 837809 - DNA, 25 bp, Mus musculus
tcttccaaagactgcaggctttcat

SEQ ID NO: 837810 - DNA, 25 bp, Mus musculus
tcttccaaattaccaccccttttat

SEQ ID NO: 837811 - DNA, 25 bp, Mus musculus
tcttccaaattagcaccccttttat

SEQ ID NO: 837812 - DNA, 25 bp, Mus musculus
tcttccaaattgaaccgtctgtaat

SEQ ID NO: 837813 - DNA, 25 bp, Mus musculus
tcttccaaattgtaccgtctgtaat

SEQ ID NO: 837814 - DNA, 25 bp, Mus musculus
tcttccaacactctgacatgactag

SEQ ID NO: 837815 - DNA, 25 bp, Mus musculus
tcttccaacactgtgacatgactag

SEQ ID NO: 837816 - DNA, 25 bp, Mus musculus
tcttccaacagaaccagagcaacct

SEQ ID NO: 837817 - DNA, 25 bp, Mus musculus
tcttccaacagatccagagcaacct

SEQ ID NO: 837818 - DNA, 25 bp, Mus musculus
tcttccaacttgagacccttgagcg

SEQ ID NO: 837819 - DNA, 25 bp, Mus musculus
tcttccaacttgtgacccttgagcg

SEQ ID NO: 837820 - DNA, 25 bp, Mus musculus
tcttccaagatcagtttttaaattg

SEQ ID NO: 837821 - DNA, 25 bp, Mus musculus
tcttccaagatctgtttttaaattg

SEQ ID NO: 837822 - DNA, 25 bp, Mus musculus
tcttccaaggacacgttacaggatt

SEQ ID NO: 837823 - DNA, 25 bp, Mus musculus
tcttccaaggactcgttacaggatt

SEQ ID NO: 837824 - DNA, 25 bp, Mus musculus
tcttccaaggagcatggccaccatt

SEQ ID NO: 837825 - DNA, 25 bp, Mus musculus
tcttccaaggagctcccacatgtag

SEQ ID NO: 837826 - DNA, 25 bp, Mus musculus
tcttccaaggaggatggccaccatt

SEQ ID NO: 837827 - DNA, 25 bp, Mus musculus
tcttccaaggaggtcccacatgtag

SEQ ID NO: 837828 - DNA, 25 bp, Mus musculus
tcttccaatgttactaacagtgaac

SEQ ID NO: 837829 - DNA, 25 bp, Mus musculus
tcttccaatgtttctaacagtgaac

SEQ ID NO: 837830 - DNA, 25 bp, Mus musculus
tcttccaattttcggccgatgaagg

SEQ ID NO: 837831 - DNA, 25 bp, Mus musculus
tcttccaattttgggccgatgaagg

SEQ ID NO: 837832 - DNA, 25 bp, Mus musculus
tcttccacagatatgatccccagaa

SEQ ID NO: 837833 - DNA, 25 bp, Mus musculus
tcttccacagatttgatccccagaa

SEQ ID NO: 837834 - DNA, 25 bp, Mus musculus
tcttccacagtcatagcagtcagtt

SEQ ID NO: 837835 - DNA, 25 bp, Mus musculus
tcttccacagtcttagcagtcagtt

SEQ ID NO: 837836 - DNA, 25 bp, Mus musculus
tcttccacagttaaccagatctcca

SEQ ID NO: 837837 - DNA, 25 bp, Mus musculus
tcttccacagtttaccagatctcca

SEQ ID NO: 837838 - DNA, 25 bp, Mus musculus
tcttccacatgtaagctcacagcag

SEQ ID NO: 837839 - DNA, 25 bp, Mus musculus
tcttccacatgttagctcacagcag

SEQ ID NO: 837840 - DNA, 25 bp, Mus musculus
tcttccacccctacaattgagaggg

SEQ ID NO: 837841 - DNA, 25 bp, Mus musculus
tcttccaccccttcaattgagaggg

SEQ ID NO: 837842 - DNA, 25 bp, Mus musculus
tcttccacccgcattgggaactcgg

SEQ ID NO: 837843 - DNA, 25 bp, Mus musculus
tcttccacccgctttgggaactcgg

SEQ ID NO: 837844 - DNA, 25 bp, Mus musculus
tcttccaccctcaggcttatgggat

SEQ ID NO: 837845 - DNA, 25 bp, Mus musculus
tcttccaccctctggcttatgggat

SEQ ID NO: 837846 - DNA, 25 bp, Mus musculus
tcttccaccttcagagggaggctca

SEQ ID NO: 837847 - DNA, 25 bp, Mus musculus
tcttccaccttctgagggaggctca

SEQ ID NO: 837848 - DNA, 25 bp, Mus musculus
tcttccacgaggcactcaaaaactg

SEQ ID NO: 837849 - DNA, 25 bp, Mus musculus
tcttccacgagggactcaaaaactg

SEQ ID NO: 837850 - DNA, 25 bp, Mus musculus
tcttccacggaaccatgacgctagt

SEQ ID NO: 837851 - DNA, 25 bp, Mus musculus
tcttccacggaagcatgacgctagt

SEQ ID NO: 837852 - DNA, 25 bp, Mus musculus
tcttccactactccgtgggcagcgg

SEQ ID NO: 837853 - DNA, 25 bp, Mus musculus
tcttccactactgcgtgggcagcgg

SEQ ID NO: 837854 - DNA, 25 bp, Mus musculus
tcttccactctccaagtacttgagt

SEQ ID NO: 837855 - DNA, 25 bp, Mus musculus
tcttccactctcgaagtacttgagt

SEQ ID NO: 837856 - DNA, 25 bp, Mus musculus
tcttccactgtgattgcagcagtca

SEQ ID NO: 837857 - DNA, 25 bp, Mus musculus
tcttccactgtgtttgcagcagtca

SEQ ID NO: 837858 - DNA, 25 bp, Mus musculus
tcttccagaactcagtcaccagaga

SEQ ID NO: 837859 - DNA, 25 bp, Mus musculus
tcttccagaactgagtcaccagaga

SEQ ID NO: 837860 - DNA, 25 bp, Mus musculus
tcttccagaagaccttggtaggatt

SEQ ID NO: 837861 - DNA, 25 bp, Mus musculus
tcttccagaagagcttggtaggatt

SEQ ID NO: 837862 - DNA, 25 bp, Mus musculus
tcttccagaccgatttcctagcaaa

SEQ ID NO: 837863 - DNA, 25 bp, Mus musculus
tcttccagaccgttttcctagcaaa

SEQ ID NO: 837864 - DNA, 25 bp, Mus musculus
tcttccagacgtcaggaaggattct

SEQ ID NO: 837865 - DNA, 25 bp, Mus musculus
tcttccagacgtgaggaaggattct

SEQ ID NO: 837866 - DNA, 25 bp, Mus musculus
tcttccagactgcagttcaagtgct

SEQ ID NO: 837867 - DNA, 25 bp, Mus musculus
tcttccagactggagttcaagtgct

SEQ ID NO: 837868 - DNA, 25 bp, Mus musculus
tcttccagatataggtgtctccttg

SEQ ID NO: 837869 - DNA, 25 bp, Mus musculus
tcttccagatattggtgtctccttg

SEQ ID NO: 837870 - DNA, 25 bp, Mus musculus
tcttccagattcacaccagcaggat

SEQ ID NO: 837871 - DNA, 25 bp, Mus musculus
tcttccagattctcaccagcaggat

SEQ ID NO: 837872 - DNA, 25 bp, Mus musculus
tcttccagcaagacggccctgtttt

SEQ ID NO: 837873 - DNA, 25 bp, Mus musculus
tcttccagcaagtcggccctgtttt

SEQ ID NO: 837874 - DNA, 25 bp, Mus musculus
tcttccagcgacatgtaaggctgtc

SEQ ID NO: 837875 - DNA, 25 bp, Mus musculus
tcttccagcgacttgtaaggctgtc

SEQ ID NO: 837876 - DNA, 25 bp, Mus musculus
tcttccaggaggagacactcaggct

SEQ ID NO: 837877 - DNA, 25 bp, Mus musculus
tcttccaggaggtgacactcaggct

SEQ ID NO: 837878 - DNA, 25 bp, Mus musculus
tcttccaggcttaatgacccatttc

SEQ ID NO: 837879 - DNA, 25 bp, Mus musculus
tcttccaggctttatgacccatttc

SEQ ID NO: 837880 - DNA, 25 bp, Mus musculus
tcttccagtcgtcttctaagagggc

SEQ ID NO: 837881 - DNA, 25 bp, Mus musculus
tcttccagtcgtgttctaagagggc

SEQ ID NO: 837882 - DNA, 25 bp, Mus musculus
tcttccataggtaaagcatatcaag

SEQ ID NO: 837883 - DNA, 25 bp, Mus musculus
tcttccataggttaagcatatcaag

SEQ ID NO: 837884 - DNA, 25 bp, Mus musculus
tcttccatcaagcactctgggaaag

SEQ ID NO: 837885 - DNA, 25 bp, Mus musculus
tcttccatcaaggactctgggaaag

SEQ ID NO: 837886 - DNA, 25 bp, Mus musculus
tcttccatcacaactgcagggttta

SEQ ID NO: 837887 - DNA, 25 bp, Mus musculus
tcttccatcacatctgcagggttta

SEQ ID NO: 837888 - DNA, 25 bp, Mus musculus
tcttccatcaccatatgaacttctg

SEQ ID NO: 837889 - DNA, 25 bp, Mus musculus
tcttccatcaccttatgaacttctg

SEQ ID NO: 837890 - DNA, 25 bp, Mus musculus
tcttccatcagtaacacatcaccag

SEQ ID NO: 837891 - DNA, 25 bp, Mus musculus
tcttccatcagttacacatcaccag

SEQ ID NO: 837892 - DNA, 25 bp, Mus musculus
tcttccatcgtactcactgaggcag

SEQ ID NO: 837893 - DNA, 25 bp, Mus musculus
tcttccatcgtagtcactgaggcag

SEQ ID NO: 837894 - DNA, 25 bp, Mus musculus
tcttccatctgacaaatccttctta

SEQ ID NO: 837895 - DNA, 25 bp, Mus musculus
tcttccatctgagaaatccttctta

SEQ ID NO: 837896 - DNA, 25 bp, Mus musculus
tcttccatgaacatgcgtcctgtca

SEQ ID NO: 837897 - DNA, 25 bp, Mus musculus
tcttccatgaacttgcgtcctgtca

SEQ ID NO: 837898 - DNA, 25 bp, Mus musculus
tcttccatgacaagggtttggtctc

SEQ ID NO: 837899 - DNA, 25 bp, Mus musculus
tcttccatgacatgggtttggtctc

SEQ ID NO: 837900 - DNA, 25 bp, Mus musculus
tcttccatgagcaagcaacaggcca

SEQ ID NO: 837901 - DNA, 25 bp, Mus musculus
tcttccatgagctagcaacaggcca

SEQ ID NO: 837902 - DNA, 25 bp, Mus musculus
tcttccatgcctatgaggaaccttt

SEQ ID NO: 837903 - DNA, 25 bp, Mus musculus
tcttccatgcctttgaggaaccttt

SEQ ID NO: 837904 - DNA, 25 bp, Mus musculus
tcttccatgcttagatgtgactctt

SEQ ID NO: 837905 - DNA, 25 bp, Mus musculus
tcttccatgcttcagagttgggcct

SEQ ID NO: 837906 - DNA, 25 bp, Mus musculus
tcttccatgcttgagagttgggcct

SEQ ID NO: 837907 - DNA, 25 bp, Mus musculus
tcttccatgctttgatgtgactctt

SEQ ID NO: 837908 - DNA, 25 bp, Mus musculus
tcttcccaacagctgggaggatcgc

SEQ ID NO: 837909 - DNA, 25 bp, Mus musculus
tcttcccaacaggtgggaggatcgc

SEQ ID NO: 837910 - DNA, 25 bp, Mus musculus
tcttcccaacatcatttgccagagt

SEQ ID NO: 837911 - DNA, 25 bp, Mus musculus
tcttcccaacatgatttgccagagt

SEQ ID NO: 837912 - DNA, 25 bp, Mus musculus
tcttcccaactgattctagctgtgt

SEQ ID NO: 837913 - DNA, 25 bp, Mus musculus
tcttcccaactgtttctagctgtgt

SEQ ID NO: 837914 - DNA, 25 bp, Mus musculus
tcttcccaagatacctttgtcaagc

SEQ ID NO: 837915 - DNA, 25 bp, Mus musculus
tcttcccaagattcctttgtcaagc

SEQ ID NO: 837916 - DNA, 25 bp, Mus musculus
tcttcccaagcccacatatattagc

SEQ ID NO: 837917 - DNA, 25 bp, Mus musculus
tcttcccaagccgacatatattagc

SEQ ID NO: 837918 - DNA, 25 bp, Mus musculus
tcttcccaatacatttttcataaaa

SEQ ID NO: 837919 - DNA, 25 bp, Mus musculus
tcttcccaatacttttttcataaaa

SEQ ID NO: 837920 - DNA, 25 bp, Mus musculus
tcttcccaatttcccgtgcttagag

SEQ ID NO: 837921 - DNA, 25 bp, Mus musculus
tcttcccaatttgccgtgcttagag

SEQ ID NO: 837922 - DNA, 25 bp, Mus musculus
tcttcccacacaaaattatctcagc

SEQ ID NO: 837923 - DNA, 25 bp, Mus musculus
tcttcccacacataattatctcagc

SEQ ID NO: 837924 - DNA, 25 bp, Mus musculus
tcttcccacactacatctagaaagt

SEQ ID NO: 837925 - DNA, 25 bp, Mus musculus
tcttcccacacttcatctagaaagt

SEQ ID NO: 837926 - DNA, 25 bp, Mus musculus
tcttcccacatgacctgaatttcat

SEQ ID NO: 837927 - DNA, 25 bp, Mus musculus
tcttcccacatgtcctgaatttcat

SEQ ID NO: 837928 - DNA, 25 bp, Mus musculus
tcttcccagaaaccccacttggtag

SEQ ID NO: 837929 - DNA, 25 bp, Mus musculus
tcttcccagaaagcccacttggtag

SEQ ID NO: 837930 - DNA, 25 bp, Mus musculus
tcttcccagaccaggcaatggttta

SEQ ID NO: 837931 - DNA, 25 bp, Mus musculus
tcttcccagacctggcaatggttta

SEQ ID NO: 837932 - DNA, 25 bp, Mus musculus
tcttcccagagcagatgtcggcaag

SEQ ID NO: 837933 - DNA, 25 bp, Mus musculus
tcttcccagagctgatgtcggcaag

SEQ ID NO: 837934 - DNA, 25 bp, Mus musculus
tcttcccagatgaccagctttaatg

SEQ ID NO: 837935 - DNA, 25 bp, Mus musculus
tcttcccagatgtccagctttaatg

SEQ ID NO: 837936 - DNA, 25 bp, Mus musculus
tcttcccagcacactgatggtagaa

SEQ ID NO: 837937 - DNA, 25 bp, Mus musculus
tcttcccagcactctgatggtagaa

SEQ ID NO: 837938 - DNA, 25 bp, Mus musculus
tcttcccagcccaaattttgtgaaa

SEQ ID NO: 837939 - DNA, 25 bp, Mus musculus
tcttcccagccctaattttgtgaaa

SEQ ID NO: 837940 - DNA, 25 bp, Mus musculus
tcttcccaggaactcttgtgtgttg

SEQ ID NO: 837941 - DNA, 25 bp, Mus musculus
tcttcccaggaagtcttgtgtgttg

SEQ ID NO: 837942 - DNA, 25 bp, Mus musculus
tcttcccaggccaaactttcatgaa

SEQ ID NO: 837943 - DNA, 25 bp, Mus musculus
tcttcccaggcctaactttcatgaa

SEQ ID NO: 837944 - DNA, 25 bp, Mus musculus
tcttcccaggtaactcaattttgtg

SEQ ID NO: 837945 - DNA, 25 bp, Mus musculus
tcttcccaggtatctcaattttgtg

SEQ ID NO: 837946 - DNA, 25 bp, Mus musculus
tcttcccaggtgactatacgctgtg

SEQ ID NO: 837947 - DNA, 25 bp, Mus musculus
tcttcccaggtgtctatacgctgtg

SEQ ID NO: 837948 - DNA, 25 bp, Mus musculus
tcttcccagtctatgctgtggctga

SEQ ID NO: 837949 - DNA, 25 bp, Mus musculus
tcttcccagtctttgctgtggctga

SEQ ID NO: 837950 - DNA, 25 bp, Mus musculus
tcttcccatactcaagcaattgcgt

SEQ ID NO: 837951 - DNA, 25 bp, Mus musculus
tcttcccatactgaagcaattgcgt

SEQ ID NO: 837952 - DNA, 25 bp, Mus musculus
tcttcccatatactctatgagttgg

SEQ ID NO: 837953 - DNA, 25 bp, Mus musculus
tcttcccatatagtctatgagttgg

SEQ ID NO: 837954 - DNA, 25 bp, Mus musculus
tcttcccatcacagatcagatttga

SEQ ID NO: 837955 - DNA, 25 bp, Mus musculus
tcttcccatcactgatcagatttga

SEQ ID NO: 837956 - DNA, 25 bp, Mus musculus
tcttcccatccacccaatgaggaaa

SEQ ID NO: 837957 - DNA, 25 bp, Mus musculus
tcttcccatccagccaatgaggaaa

SEQ ID NO: 837958 - DNA, 25 bp, Mus musculus
tcttcccatcctcgtgatcagagga

SEQ ID NO: 837959 - DNA, 25 bp, Mus musculus
tcttcccatcctggtgatcagagga

SEQ ID NO: 837960 - DNA, 25 bp, Mus musculus
tcttcccatgaccagagtgtccatc

SEQ ID NO: 837961 - DNA, 25 bp, Mus musculus
tcttcccatgacgagagtgtccatc

SEQ ID NO: 837962 - DNA, 25 bp, Mus musculus
tcttcccatgcgagaaacgttctgt

SEQ ID NO: 837963 - DNA, 25 bp, Mus musculus
tcttcccatgcgtgaaacgttctgt

SEQ ID NO: 837964 - DNA, 25 bp, Mus musculus
tcttcccatttaagacacctctgta

SEQ ID NO: 837965 - DNA, 25 bp, Mus musculus
tcttcccatttatgacacctctgta

SEQ ID NO: 837966 - DNA, 25 bp, Mus musculus
tcttcccatttgaaaatgtcctgaa

SEQ ID NO: 837967 - DNA, 25 bp, Mus musculus
tcttcccatttgaaatgtatcttat

SEQ ID NO: 837968 - DNA, 25 bp, Mus musculus
tcttcccatttgtaaatgtcctgaa

SEQ ID NO: 837969 - DNA, 25 bp, Mus musculus
tcttcccatttgtaatgtatcttat

SEQ ID NO: 837970 - DNA, 25 bp, Mus musculus
tcttcccattttcttatgttgactt

SEQ ID NO: 837971 - DNA, 25 bp, Mus musculus
tcttcccattttgttatgttgactt

SEQ ID NO: 837972 - DNA, 25 bp, Mus musculus
tcttccccaaagagccttagacaga

SEQ ID NO: 837973 - DNA, 25 bp, Mus musculus
tcttccccaaagtgccttagacaga

SEQ ID NO: 837974 - DNA, 25 bp, Mus musculus
tcttccccaatcagactgaggactt

SEQ ID NO: 837975 - DNA, 25 bp, Mus musculus
tcttccccaatctgactgaggactt

SEQ ID NO: 837976 - DNA, 25 bp, Mus musculus
tcttccccaattagtgccagtttaa

SEQ ID NO: 837977 - DNA, 25 bp, Mus musculus
tcttccccaatttgtgccagtttaa

SEQ ID NO: 837978 - DNA, 25 bp, Mus musculus
tcttccccagagaatcttggagcaa

SEQ ID NO: 837979 - DNA, 25 bp, Mus musculus
tcttccccagagtatcttggagcaa

SEQ ID NO: 837980 - DNA, 25 bp, Mus musculus
tcttccccagcgcaactgaaataaa

SEQ ID NO: 837981 - DNA, 25 bp, Mus musculus
tcttccccagcggaactgaaataaa

SEQ ID NO: 837982 - DNA, 25 bp, Mus musculus
tcttccccaggaatatcaaggctgc

SEQ ID NO: 837983 - DNA, 25 bp, Mus musculus
tcttccccaggattatcaaggctgc

SEQ ID NO: 837984 - DNA, 25 bp, Mus musculus
tcttccccagtacgtgttttctgag

SEQ ID NO: 837985 - DNA, 25 bp, Mus musculus
tcttccccagtaggtgttttctgag

SEQ ID NO: 837986 - DNA, 25 bp, Mus musculus
tcttccccagtgctttgaaaacttt

SEQ ID NO: 837987 - DNA, 25 bp, Mus musculus
tcttccccagtggtttgaaaacttt

SEQ ID NO: 837988 - DNA, 25 bp, Mus musculus
tcttccccatcgagggtggaggcct

SEQ ID NO: 837989 - DNA, 25 bp, Mus musculus
tcttccccatcgtgggtggaggcct

SEQ ID NO: 837990 - DNA, 25 bp, Mus musculus
tcttcccccccaagtatgctttttt

SEQ ID NO: 837991 - DNA, 25 bp, Mus musculus
tcttcccccccatgtatgctttttt

SEQ ID NO: 837992 - DNA, 25 bp, Mus musculus
tcttccccgatgagttttgtatgtg

SEQ ID NO: 837993 - DNA, 25 bp, Mus musculus
tcttccccgatgtgttttgtatgtg

SEQ ID NO: 837994 - DNA, 25 bp, Mus musculus
tcttccccggagaactttatattct

SEQ ID NO: 837995 - DNA, 25 bp, Mus musculus
tcttccccggagtactttatattct

SEQ ID NO: 837996 - DNA, 25 bp, Mus musculus
tcttcccctcaactggtcaaatcaa

SEQ ID NO: 837997 - DNA, 25 bp, Mus musculus
tcttcccctcaagtggtcaaatcaa

SEQ ID NO: 837998 - DNA, 25 bp, Mus musculus
tcttcccctcatagtgttcaagtgc

SEQ ID NO: 837999 - DNA, 25 bp, Mus musculus
tcttcccctcattgtgttcaagtgc

SEQ ID NO: 838000 - DNA, 25 bp, Mus musculus
tcttcccctctcattgttaataacc

SEQ ID NO: 838001 - DNA, 25 bp, Mus musculus
tcttcccctctctttgttaataacc

SEQ ID NO: 838002 - DNA, 25 bp, Mus musculus
tcttcccctgagagttggtgtgaaa

SEQ ID NO: 838003 - DNA, 25 bp, Mus musculus
tcttcccctgagtgttggtgtgaaa

SEQ ID NO: 838004 - DNA, 25 bp, Mus musculus
tcttcccctgatctcaagtcatgaa

SEQ ID NO: 838005 - DNA, 25 bp, Mus musculus
tcttcccctgatgtcaagtcatgaa

SEQ ID NO: 838006 - DNA, 25 bp, Mus musculus
tcttcccgcagaaggagaggcgcca

SEQ ID NO: 838007 - DNA, 25 bp, Mus musculus
tcttcccgcagatggagaggcgcca

SEQ ID NO: 838008 - DNA, 25 bp, Mus musculus
tcttcccgccttcagtattagtgaa

SEQ ID NO: 838009 - DNA, 25 bp, Mus musculus
tcttcccgccttgagtattagtgaa

SEQ ID NO: 838010 - DNA, 25 bp, Mus musculus
tcttcccggataaggcccggagcct

SEQ ID NO: 838011 - DNA, 25 bp, Mus musculus
tcttcccggatatggcccggagcct

SEQ ID NO: 838012 - DNA, 25 bp, Mus musculus
tcttcccgtccaattacgatgtgaa

SEQ ID NO: 838013 - DNA, 25 bp, Mus musculus
tcttcccgtccatttacgatgtgaa

SEQ ID NO: 838014 - DNA, 25 bp, Mus musculus
tcttcccgtctcatttgagttgaat

SEQ ID NO: 838015 - DNA, 25 bp, Mus musculus
tcttcccgtctcttttgagttgaat

SEQ ID NO: 838016 - DNA, 25 bp, Mus musculus
tcttccctacacatcaatgctttta

SEQ ID NO: 838017 - DNA, 25 bp, Mus musculus
tcttccctacacttcaatgctttta

SEQ ID NO: 838018 - DNA, 25 bp, Mus musculus
tcttccctccatcttcagagaataa

SEQ ID NO: 838019 - DNA, 25 bp, Mus musculus
tcttccctccatgttcagagaataa

SEQ ID NO: 838020 - DNA, 25 bp, Mus musculus
tcttccctccgcagatctagtataa

SEQ ID NO: 838021 - DNA, 25 bp, Mus musculus
tcttccctccgctgatctagtataa

SEQ ID NO: 838022 - DNA, 25 bp, Mus musculus
tcttccctcctcattattgaaacca

SEQ ID NO: 838023 - DNA, 25 bp, Mus musculus
tcttccctcctctttattgaaacca

SEQ ID NO: 838024 - DNA, 25 bp, Mus musculus
tcttccctgacaaaatgctgctgaa

SEQ ID NO: 838025 - DNA, 25 bp, Mus musculus
tcttccctgacataatgctgctgaa

SEQ ID NO: 838026 - DNA, 25 bp, Mus musculus
tcttccctgaccaggaagctgtgat

SEQ ID NO: 838027 - DNA, 25 bp, Mus musculus
tcttccctgacctggaagctgtgat

SEQ ID NO: 838028 - DNA, 25 bp, Mus musculus
tcttccctgggtaatctgtactgaa

SEQ ID NO: 838029 - DNA, 25 bp, Mus musculus
tcttccctgggttatctgtactgaa

SEQ ID NO: 838030 - DNA, 25 bp, Mus musculus
tcttccctgtatagttaacttttag

SEQ ID NO: 838031 - DNA, 25 bp, Mus musculus
tcttccctgtattgttaacttttag

SEQ ID NO: 838032 - DNA, 25 bp, Mus musculus
tcttccctgtccacggtggtctggc

SEQ ID NO: 838033 - DNA, 25 bp, Mus musculus
tcttccctgtcctcggtggtctggc

SEQ ID NO: 838034 - DNA, 25 bp, Mus musculus
tcttccctgtctatactgagttgga

SEQ ID NO: 838035 - DNA, 25 bp, Mus musculus
tcttccctgtctttactgagttgga

SEQ ID NO: 838036 - DNA, 25 bp, Mus musculus
tcttccctgttcaagtttctttcat

SEQ ID NO: 838037 - DNA, 25 bp, Mus musculus
tcttccctgttctagtttctttcat

SEQ ID NO: 838038 - DNA, 25 bp, Mus musculus
tcttcccttaaactctttctccatc

SEQ ID NO: 838039 - DNA, 25 bp, Mus musculus
tcttcccttaaagtctttctccatc

SEQ ID NO: 838040 - DNA, 25 bp, Mus musculus
tcttcccttagacacaataatggtc

SEQ ID NO: 838041 - DNA, 25 bp, Mus musculus
tcttcccttagacaccataatgggt

SEQ ID NO: 838042 - DNA, 25 bp, Mus musculus
tcttcccttagagacaataatggtc

SEQ ID NO: 838043 - DNA, 25 bp, Mus musculus
tcttcccttagagaccataatgggt

SEQ ID NO: 838044 - DNA, 25 bp, Mus musculus
tcttcccttagtacttcaaagccat

SEQ ID NO: 838045 - DNA, 25 bp, Mus musculus
tcttcccttagtctttttcctatga

SEQ ID NO: 838046 - DNA, 25 bp, Mus musculus
tcttcccttagtgtttttcctatga

SEQ ID NO: 838047 - DNA, 25 bp, Mus musculus
tcttcccttagttcttcaaagccat

SEQ ID NO: 838048 - DNA, 25 bp, Mus musculus
tcttcccttcagaatcttaacctca

SEQ ID NO: 838049 - DNA, 25 bp, Mus musculus
tcttcccttcagtatcttaacctca

SEQ ID NO: 838050 - DNA, 25 bp, Mus musculus
tcttcccttcgccaatgaggaaggc

SEQ ID NO: 838051 - DNA, 25 bp, Mus musculus
tcttcccttcgcgaatgaggaaggc

SEQ ID NO: 838052 - DNA, 25 bp, Mus musculus
tcttcccttggcctgaaatagagaa

SEQ ID NO: 838053 - DNA, 25 bp, Mus musculus
tcttcccttggcgtgaaatagagaa

SEQ ID NO: 838054 - DNA, 25 bp, Mus musculus
tcttcccttgtgatcatttcttctg

SEQ ID NO: 838055 - DNA, 25 bp, Mus musculus
tcttcccttgtgttcatttcttctg

SEQ ID NO: 838056 - DNA, 25 bp, Mus musculus
tcttccctttatactgcttcacttt

SEQ ID NO: 838057 - DNA, 25 bp, Mus musculus
tcttccctttattctgcttcacttt

SEQ ID NO: 838058 - DNA, 25 bp, Mus musculus
tcttccctttgcagtcacagcatag

SEQ ID NO: 838059 - DNA, 25 bp, Mus musculus
tcttccctttgccttgacatagcaa

SEQ ID NO: 838060 - DNA, 25 bp, Mus musculus
tcttccctttgcgttgacatagcaa

SEQ ID NO: 838061 - DNA, 25 bp, Mus musculus
tcttccctttgctgtcacagcatag

SEQ ID NO: 838062 - DNA, 25 bp, Mus musculus
tcttccctttgtataggagcactgc

SEQ ID NO: 838063 - DNA, 25 bp, Mus musculus
tcttccctttgtttaggagcactgc

SEQ ID NO: 838064 - DNA, 25 bp, Mus musculus
tcttccgaagagctttgcgaggtct

SEQ ID NO: 838065 - DNA, 25 bp, Mus musculus
tcttccgaagaggtttgcgaggtct

SEQ ID NO: 838066 - DNA, 25 bp, Mus musculus
tcttccgacaccatgagctccttga

SEQ ID NO: 838067 - DNA, 25 bp, Mus musculus
tcttccgacaccttgagctccttga

SEQ ID NO: 838068 - DNA, 25 bp, Mus musculus
tcttccgaccacctcagaaaatagt

SEQ ID NO: 838069 - DNA, 25 bp, Mus musculus
tcttccgaccacgtcagaaaatagt

SEQ ID NO: 838070 - DNA, 25 bp, Mus musculus
tcttccgaccggagggagttgatgt

SEQ ID NO: 838071 - DNA, 25 bp, Mus musculus
tcttccgaccggtgggagttgatgt

SEQ ID NO: 838072 - DNA, 25 bp, Mus musculus
tcttccgagaaacgctcagcaactc

SEQ ID NO: 838073 - DNA, 25 bp, Mus musculus
tcttccgagaaaggctcagcaactc

SEQ ID NO: 838074 - DNA, 25 bp, Mus musculus
tcttccgatcgaaacagcattgggt

SEQ ID NO: 838075 - DNA, 25 bp, Mus musculus
tcttccgatcgatacagcattgggt

SEQ ID NO: 838076 - DNA, 25 bp, Mus musculus
tcttccgcaccaacagtgtttgagg

SEQ ID NO: 838077 - DNA, 25 bp, Mus musculus
tcttccgcaccatcagtgtttgagg

SEQ ID NO: 838078 - DNA, 25 bp, Mus musculus
tcttccgcactaatgatggccgagg

SEQ ID NO: 838079 - DNA, 25 bp, Mus musculus
tcttccgcactattgatggccgagg

SEQ ID NO: 838080 - DNA, 25 bp, Mus musculus
tcttccgcagaaacagtcaacacct

SEQ ID NO: 838081 - DNA, 25 bp, Mus musculus
tcttccgcagaacgtacaaagagat

SEQ ID NO: 838082 - DNA, 25 bp, Mus musculus
tcttccgcagaaggtacaaagagat

SEQ ID NO: 838083 - DNA, 25 bp, Mus musculus
tcttccgcagaatcagtcaacacct

SEQ ID NO: 838084 - DNA, 25 bp, Mus musculus
tcttccgccaccagtgttccagatg

SEQ ID NO: 838085 - DNA, 25 bp, Mus musculus
tcttccgccacctgtgttccagatg

SEQ ID NO: 838086 - DNA, 25 bp, Mus musculus
tcttccgccagtctggcagtgatgg

SEQ ID NO: 838087 - DNA, 25 bp, Mus musculus
tcttccgccagtgtggcagtgatgg

SEQ ID NO: 838088 - DNA, 25 bp, Mus musculus
tcttccgccctaacatgggagacgt

SEQ ID NO: 838089 - DNA, 25 bp, Mus musculus
tcttccgccctatcatgggagacgt

SEQ ID NO: 838090 - DNA, 25 bp, Mus musculus
tcttccgcctggacagcctgttggg

SEQ ID NO: 838091 - DNA, 25 bp, Mus musculus
tcttccgcctggtcagcctgttggg

SEQ ID NO: 838092 - DNA, 25 bp, Mus musculus
tcttccgcgaataggccgaggagaa

SEQ ID NO: 838093 - DNA, 25 bp, Mus musculus
tcttccgcgaattggccgaggagaa

SEQ ID NO: 838094 - DNA, 25 bp, Mus musculus
tcttccgctgtgatcttgagccttg

SEQ ID NO: 838095 - DNA, 25 bp, Mus musculus
tcttccgctgtgttcttgagccttg

SEQ ID NO: 838096 - DNA, 25 bp, Mus musculus
tcttccggacaaccatcaacagggc

SEQ ID NO: 838097 - DNA, 25 bp, Mus musculus
tcttccggacaagcatcaacagggc

SEQ ID NO: 838098 - DNA, 25 bp, Mus musculus
tcttccggagggactgagtttggtt

SEQ ID NO: 838099 - DNA, 25 bp, Mus musculus
tcttccggagggtctgagtttggtt

SEQ ID NO: 838100 - DNA, 25 bp, Mus musculus
tcttccggatctcttttggtctgga

SEQ ID NO: 838101 - DNA, 25 bp, Mus musculus
tcttccggatctgttttggtctgga

SEQ ID NO: 838102 - DNA, 25 bp, Mus musculus
tcttccggccttcgtttatttattg

SEQ ID NO: 838103 - DNA, 25 bp, Mus musculus
tcttccggccttggtttatttattg

SEQ ID NO: 838104 - DNA, 25 bp, Mus musculus
tcttccgggtgtctgtttccggcgt

SEQ ID NO: 838105 - DNA, 25 bp, Mus musculus
tcttccgggtgtgtgtttccggcgt

SEQ ID NO: 838106 - DNA, 25 bp, Mus musculus
tcttccggtcccaaggaaagcgatg

SEQ ID NO: 838107 - DNA, 25 bp, Mus musculus
tcttccggtccctaggaaagcgatg

SEQ ID NO: 838108 - DNA, 25 bp, Mus musculus
tcttccggtctcagggctgggatgt

SEQ ID NO: 838109 - DNA, 25 bp, Mus musculus
tcttccggtctctgggctgggatgt

SEQ ID NO: 838110 - DNA, 25 bp, Mus musculus
tcttccgtactgcatctgatcacaa

SEQ ID NO: 838111 - DNA, 25 bp, Mus musculus
tcttccgtactgctgtttcatctct

SEQ ID NO: 838112 - DNA, 25 bp, Mus musculus
tcttccgtactggatctgatcacaa

SEQ ID NO: 838113 - DNA, 25 bp, Mus musculus
tcttccgtactggtgtttcatctct

SEQ ID NO: 838114 - DNA, 25 bp, Mus musculus
tcttccgtattcacgcatactgtat

SEQ ID NO: 838115 - DNA, 25 bp, Mus musculus
tcttccgtattctcgcatactgtat

SEQ ID NO: 838116 - DNA, 25 bp, Mus musculus
tcttccgtatttcctgttatctgct

SEQ ID NO: 838117 - DNA, 25 bp, Mus musculus
tcttccgtatttgctgttatctgct

SEQ ID NO: 838118 - DNA, 25 bp, Mus musculus
tcttccgtgagccttcacagtagag

SEQ ID NO: 838119 - DNA, 25 bp, Mus musculus
tcttccgtgagcgttcacagtagag

SEQ ID NO: 838120 - DNA, 25 bp, Mus musculus
tcttccgtggtgctcaggatccaaa

SEQ ID NO: 838121 - DNA, 25 bp, Mus musculus
tcttccgtggtggtcaggatccaaa

SEQ ID NO: 838122 - DNA, 25 bp, Mus musculus
tcttccgtttgtactgtgcaacagt

SEQ ID NO: 838123 - DNA, 25 bp, Mus musculus
tcttccgtttgttctgtgcaacagt

SEQ ID NO: 838124 - DNA, 25 bp, Mus musculus
tcttcctacattactctggttgtgc

SEQ ID NO: 838125 - DNA, 25 bp, Mus musculus
tcttcctacatttctctggttgtgc

SEQ ID NO: 838126 - DNA, 25 bp, Mus musculus
tcttcctacgggaatcgtaattcca

SEQ ID NO: 838127 - DNA, 25 bp, Mus musculus
tcttcctacgggtatcgtaattcca

SEQ ID NO: 838128 - DNA, 25 bp, Mus musculus
tcttcctagctcaagtctcccaagt

SEQ ID NO: 838129 - DNA, 25 bp, Mus musculus
tcttcctagctctagtctcccaagt

SEQ ID NO: 838130 - DNA, 25 bp, Mus musculus
tcttcctaggagatactggcagggt

SEQ ID NO: 838131 - DNA, 25 bp, Mus musculus
tcttcctaggagttactggcagggt

SEQ ID NO: 838132 - DNA, 25 bp, Mus musculus
tcttcctagggaccctctgggcagg

SEQ ID NO: 838133 - DNA, 25 bp, Mus musculus
tcttcctagggagcctctgggcagg

SEQ ID NO: 838134 - DNA, 25 bp, Mus musculus
tcttcctatcacctttctatgtgtg

SEQ ID NO: 838135 - DNA, 25 bp, Mus musculus
tcttcctatcacgtttctatgtgtg

SEQ ID NO: 838136 - DNA, 25 bp, Mus musculus
tcttcctatcagcttcttattccaa

SEQ ID NO: 838137 - DNA, 25 bp, Mus musculus
tcttcctatcaggttcttattccaa

SEQ ID NO: 838138 - DNA, 25 bp, Mus musculus
tcttcctatgacaagaactggttaa

SEQ ID NO: 838139 - DNA, 25 bp, Mus musculus
tcttcctatgactagaactggttaa

SEQ ID NO: 838140 - DNA, 25 bp, Mus musculus
tcttcctatgggaggtccagacaaa

SEQ ID NO: 838141 - DNA, 25 bp, Mus musculus
tcttcctatgggattatcacattgg

SEQ ID NO: 838142 - DNA, 25 bp, Mus musculus
tcttcctatgggtggtccagacaaa

SEQ ID NO: 838143 - DNA, 25 bp, Mus musculus
tcttcctatgggtttatcacattgg

SEQ ID NO: 838144 - DNA, 25 bp, Mus musculus
tcttcctattccagtaatacatgta

SEQ ID NO: 838145 - DNA, 25 bp, Mus musculus
tcttcctattcctgtaatacatgta

SEQ ID NO: 838146 - DNA, 25 bp, Mus musculus
tcttcctattctcgcctttgttaca

SEQ ID NO: 838147 - DNA, 25 bp, Mus musculus
tcttcctattctggcctttgttaca

SEQ ID NO: 838148 - DNA, 25 bp, Mus musculus
tcttcctcaagtctacatagatttg

SEQ ID NO: 838149 - DNA, 25 bp, Mus musculus
tcttcctcaagtgtacatagatttg

SEQ ID NO: 838150 - DNA, 25 bp, Mus musculus
tcttcctcacagcatctttataaat

SEQ ID NO: 838151 - DNA, 25 bp, Mus musculus
tcttcctcacaggatctttataaat

SEQ ID NO: 838152 - DNA, 25 bp, Mus musculus
tcttcctcacccatttacagtggaa

SEQ ID NO: 838153 - DNA, 25 bp, Mus musculus
tcttcctcacccttttacagtggaa

SEQ ID NO: 838154 - DNA, 25 bp, Mus musculus
tcttcctcacctcaggtttgaaggg

SEQ ID NO: 838155 - DNA, 25 bp, Mus musculus
tcttcctcacctgaggtttgaaggg

SEQ ID NO: 838156 - DNA, 25 bp, Mus musculus
tcttcctcacgaatgtaattccatg

SEQ ID NO: 838157 - DNA, 25 bp, Mus musculus
tcttcctcacgattgtaattccatg

SEQ ID NO: 838158 - DNA, 25 bp, Mus musculus
tcttcctcacttcctacattattta

SEQ ID NO: 838159 - DNA, 25 bp, Mus musculus
tcttcctcacttgctacattattta

SEQ ID NO: 838160 - DNA, 25 bp, Mus musculus
tcttcctcagaacctccattcagtt

SEQ ID NO: 838161 - DNA, 25 bp, Mus musculus
tcttcctcagaagctccattcagtt

SEQ ID NO: 838162 - DNA, 25 bp, Mus musculus
tcttcctcagagcttcttgggttga

SEQ ID NO: 838163 - DNA, 25 bp, Mus musculus
tcttcctcagaggttcttgggttga

SEQ ID NO: 838164 - DNA, 25 bp, Mus musculus
tcttcctcaggacccattcattgtg

SEQ ID NO: 838165 - DNA, 25 bp, Mus musculus
tcttcctcaggagccattcattgtg

SEQ ID NO: 838166 - DNA, 25 bp, Mus musculus
tcttcctcaggcaatcactgtggta

SEQ ID NO: 838167 - DNA, 25 bp, Mus musculus
tcttcctcaggctatcactgtggta

SEQ ID NO: 838168 - DNA, 25 bp, Mus musculus
tcttcctcagttcacatttccttca

SEQ ID NO: 838169 - DNA, 25 bp, Mus musculus
tcttcctcagttgacatttccttca

SEQ ID NO: 838170 - DNA, 25 bp, Mus musculus
tcttcctccacaccagggagtgttc

SEQ ID NO: 838171 - DNA, 25 bp, Mus musculus
tcttcctccacagcagggagtgttc

SEQ ID NO: 838172 - DNA, 25 bp, Mus musculus
tcttcctccatgaggctgtcctggt

SEQ ID NO: 838173 - DNA, 25 bp, Mus musculus
tcttcctccatgtggctgtcctggt

SEQ ID NO: 838174 - DNA, 25 bp, Mus musculus
tcttcctcctaaccttcagtagact

SEQ ID NO: 838175 - DNA, 25 bp, Mus musculus
tcttcctcctaagcttcagtagact

SEQ ID NO: 838176 - DNA, 25 bp, Mus musculus
tcttcctcctcaagaagcttgacat

SEQ ID NO: 838177 - DNA, 25 bp, Mus musculus
tcttcctcctcatgaagcttgacat

SEQ ID NO: 838178 - DNA, 25 bp, Mus musculus
tcttcctcctgcacttaggaaacaa

SEQ ID NO: 838179 - DNA, 25 bp, Mus musculus
tcttcctcctgctcttaggaaacaa

SEQ ID NO: 838180 - DNA, 25 bp, Mus musculus
tcttcctccttgaaagagcttcaac

SEQ ID NO: 838181 - DNA, 25 bp, Mus musculus
tcttcctccttgtaagagcttcaac

SEQ ID NO: 838182 - DNA, 25 bp, Mus musculus
tcttcctcctttaccattaaacgtg

SEQ ID NO: 838183 - DNA, 25 bp, Mus musculus
tcttcctcctttagacagtttcatt

SEQ ID NO: 838184 - DNA, 25 bp, Mus musculus
tcttcctcctttagtgtaaatactg

SEQ ID NO: 838185 - DNA, 25 bp, Mus musculus
tcttcctccttttccattaaacgtg

SEQ ID NO: 838186 - DNA, 25 bp, Mus musculus
tcttcctccttttgacagtttcatt

SEQ ID NO: 838187 - DNA, 25 bp, Mus musculus
tcttcctccttttgtgtaaatactg

SEQ ID NO: 838188 - DNA, 25 bp, Mus musculus
tcttcctcgactcgtatgacagcta

SEQ ID NO: 838189 - DNA, 25 bp, Mus musculus
tcttcctcgactggtatgacagcta

SEQ ID NO: 838190 - DNA, 25 bp, Mus musculus
tcttcctcggccagagcgagttcga

SEQ ID NO: 838191 - DNA, 25 bp, Mus musculus
tcttcctcggcctgagcgagttcga

SEQ ID NO: 838192 - DNA, 25 bp, Mus musculus
tcttcctctcaaagttcccatttaa

SEQ ID NO: 838193 - DNA, 25 bp, Mus musculus
tcttcctctcaatgttcccatttaa

SEQ ID NO: 838194 - DNA, 25 bp, Mus musculus
tcttcctctctgcattgatcttgtt

SEQ ID NO: 838195 - DNA, 25 bp, Mus musculus
tcttcctctctggattgatcttgtt

SEQ ID NO: 838196 - DNA, 25 bp, Mus musculus
tcttcctctgtacgagctcgtgtat

SEQ ID NO: 838197 - DNA, 25 bp, Mus musculus
tcttcctctgtaggagctcgtgtat

SEQ ID NO: 838198 - DNA, 25 bp, Mus musculus
tcttcctctgtgaatctcaactgca

SEQ ID NO: 838199 - DNA, 25 bp, Mus musculus
tcttcctctgtgtatctcaactgca

SEQ ID NO: 838200 - DNA, 25 bp, Mus musculus
tcttcctcttatcgcaccgataatc

SEQ ID NO: 838201 - DNA, 25 bp, Mus musculus
tcttcctcttatggcaccgataatc

SEQ ID NO: 838202 - DNA, 25 bp, Mus musculus
tcttcctcttccatatagttactca

SEQ ID NO: 838203 - DNA, 25 bp, Mus musculus
tcttcctcttccttatagttactca

SEQ ID NO: 838204 - DNA, 25 bp, Mus musculus
tcttcctgaacccttgtgtaagtgg

SEQ ID NO: 838205 - DNA, 25 bp, Mus musculus
tcttcctgaaccgttgtgtaagtgg

SEQ ID NO: 838206 - DNA, 25 bp, Mus musculus
tcttcctgacagaaatttggcatat

SEQ ID NO: 838207 - DNA, 25 bp, Mus musculus
tcttcctgacagtaatttggcatat

SEQ ID NO: 838208 - DNA, 25 bp, Mus musculus
tcttcctgactgaaatacaatcttg

SEQ ID NO: 838209 - DNA, 25 bp, Mus musculus
tcttcctgactgtaatacaatcttg

SEQ ID NO: 838210 - DNA, 25 bp, Mus musculus
tcttcctgagaaaactaaccaccga

SEQ ID NO: 838211 - DNA, 25 bp, Mus musculus
tcttcctgagaatactaaccaccga

SEQ ID NO: 838212 - DNA, 25 bp, Mus musculus
tcttcctgagatattcctgggatag

SEQ ID NO: 838213 - DNA, 25 bp, Mus musculus
tcttcctgagattttcctgggatag

SEQ ID NO: 838214 - DNA, 25 bp, Mus musculus
tcttcctgagttcctgtttcctttc

SEQ ID NO: 838215 - DNA, 25 bp, Mus musculus
tcttcctgagttgctgtttcctttc

SEQ ID NO: 838216 - DNA, 25 bp, Mus musculus
tcttcctgatccaaaaactgccttt

SEQ ID NO: 838217 - DNA, 25 bp, Mus musculus
tcttcctgatcctaaaactgccttt

SEQ ID NO: 838218 - DNA, 25 bp, Mus musculus
tcttcctgatgacaggtggcccagg

SEQ ID NO: 838219 - DNA, 25 bp, Mus musculus
tcttcctgatgagaggtggcccagg

SEQ ID NO: 838220 - DNA, 25 bp, Mus musculus
tcttcctgatgtatttcagggcaca

SEQ ID NO: 838221 - DNA, 25 bp, Mus musculus
tcttcctgatgtttttcagggcaca

SEQ ID NO: 838222 - DNA, 25 bp, Mus musculus
tcttcctgcggtacgggttttggca

SEQ ID NO: 838223 - DNA, 25 bp, Mus musculus
tcttcctgcggttcgggttttggca

SEQ ID NO: 838224 - DNA, 25 bp, Mus musculus
tcttcctgctatctcagaaccgagt

SEQ ID NO: 838225 - DNA, 25 bp, Mus musculus
tcttcctgctatgtcagaaccgagt

SEQ ID NO: 838226 - DNA, 25 bp, Mus musculus
tcttcctgcttacaaatcgccatag

SEQ ID NO: 838227 - DNA, 25 bp, Mus musculus
tcttcctgcttagaaatcgccatag

SEQ ID NO: 838228 - DNA, 25 bp, Mus musculus
tcttcctggacaagctgttgtgtca

SEQ ID NO: 838229 - DNA, 25 bp, Mus musculus
tcttcctggacatgctgttgtgtca

SEQ ID NO: 838230 - DNA, 25 bp, Mus musculus
tcttcctggagacacattcttgctt

SEQ ID NO: 838231 - DNA, 25 bp, Mus musculus
tcttcctggagagacattcttgctt

SEQ ID NO: 838232 - DNA, 25 bp, Mus musculus
tcttcctggccaagcagaagggcaa

SEQ ID NO: 838233 - DNA, 25 bp, Mus musculus
tcttcctggccatgcagaagggcaa

SEQ ID NO: 838234 - DNA, 25 bp, Mus musculus
tcttcctgggagcacctggattttc

SEQ ID NO: 838235 - DNA, 25 bp, Mus musculus
tcttcctgggaggacctggattttc

SEQ ID NO: 838236 - DNA, 25 bp, Mus musculus
tcttcctgggcgatgctggacgtcg

SEQ ID NO: 838237 - DNA, 25 bp, Mus musculus
tcttcctgggcgcaggctccatatt

SEQ ID NO: 838238 - DNA, 25 bp, Mus musculus
tcttcctgggcggaggctccatatt

SEQ ID NO: 838239 - DNA, 25 bp, Mus musculus
tcttcctgggcgttgctggacgtcg

SEQ ID NO: 838240 - DNA, 25 bp, Mus musculus
tcttcctggtgacgacagcaaaagg

SEQ ID NO: 838241 - DNA, 25 bp, Mus musculus
tcttcctggtgaggacagcaaaagg

SEQ ID NO: 838242 - DNA, 25 bp, Mus musculus
tcttcctggtggcaaatgagctatc

SEQ ID NO: 838243 - DNA, 25 bp, Mus musculus
tcttcctggtgggaaatgagctatc

SEQ ID NO: 838244 - DNA, 25 bp, Mus musculus
tcttcctggttcactcatgagtggg

SEQ ID NO: 838245 - DNA, 25 bp, Mus musculus
tcttcctggttctctcatgagtggg

SEQ ID NO: 838246 - DNA, 25 bp, Mus musculus
tcttcctggtttatcatagtcaaca

SEQ ID NO: 838247 - DNA, 25 bp, Mus musculus
tcttcctggtttttcatagtcaaca

SEQ ID NO: 838248 - DNA, 25 bp, Mus musculus
tcttcctgtagtaagcacaccagtt

SEQ ID NO: 838249 - DNA, 25 bp, Mus musculus
tcttcctgtagtacatccaattcac

SEQ ID NO: 838250 - DNA, 25 bp, Mus musculus
tcttcctgtagttagcacaccagtt

SEQ ID NO: 838251 - DNA, 25 bp, Mus musculus
tcttcctgtagttcatccaattcac

SEQ ID NO: 838252 - DNA, 25 bp, Mus musculus
tcttcctgtcctcattgtggtcgta

SEQ ID NO: 838253 - DNA, 25 bp, Mus musculus
tcttcctgtcctgattgtggtcgta

SEQ ID NO: 838254 - DNA, 25 bp, Mus musculus
tcttcctgtctgagtgttgtccaga

SEQ ID NO: 838255 - DNA, 25 bp, Mus musculus
tcttcctgtctgtgtgttgtccaga

SEQ ID NO: 838256 - DNA, 25 bp, Mus musculus
tcttcctgtgatattacctgggtca

SEQ ID NO: 838257 - DNA, 25 bp, Mus musculus
tcttcctgtgattttacctgggtca

SEQ ID NO: 838258 - DNA, 25 bp, Mus musculus
tcttcctgtgtgacttgaacgtagt

SEQ ID NO: 838259 - DNA, 25 bp, Mus musculus
tcttcctgtgtgtcttgaacgtagt

SEQ ID NO: 838260 - DNA, 25 bp, Mus musculus
tcttcctgttgtactcttggctcag

SEQ ID NO: 838261 - DNA, 25 bp, Mus musculus
tcttcctgttgttctcttggctcag

SEQ ID NO: 838262 - DNA, 25 bp, Mus musculus
tcttcctgtttaagcatttcttcca

SEQ ID NO: 838263 - DNA, 25 bp, Mus musculus
tcttcctgtttatgcatttcttcca

SEQ ID NO: 838264 - DNA, 25 bp, Mus musculus
tcttccttaagtatttggtctgcag

SEQ ID NO: 838265 - DNA, 25 bp, Mus musculus
tcttccttaagtttttggtctgcag

SEQ ID NO: 838266 - DNA, 25 bp, Mus musculus
tcttccttattcagtgttttcagtg

SEQ ID NO: 838267 - DNA, 25 bp, Mus musculus
tcttccttattctgtgttttcagtg

SEQ ID NO: 838268 - DNA, 25 bp, Mus musculus
tcttccttcaaaagtgatatgtatg

SEQ ID NO: 838269 - DNA, 25 bp, Mus musculus
tcttccttcaaatgtgatatgtatg

SEQ ID NO: 838270 - DNA, 25 bp, Mus musculus
tcttccttcattagcctctaggcaa

SEQ ID NO: 838271 - DNA, 25 bp, Mus musculus
tcttccttcatttgcctctaggcaa

SEQ ID NO: 838272 - DNA, 25 bp, Mus musculus
tcttccttccagagctattgtgggt

SEQ ID NO: 838273 - DNA, 25 bp, Mus musculus
tcttccttccagtgctattgtgggt

SEQ ID NO: 838274 - DNA, 25 bp, Mus musculus
tcttccttcccacaatgcttgcaat

SEQ ID NO: 838275 - DNA, 25 bp, Mus musculus
tcttccttcccagaatgcttgcaat

SEQ ID NO: 838276 - DNA, 25 bp, Mus musculus
tcttccttccgacgcagcggcgatg

SEQ ID NO: 838277 - DNA, 25 bp, Mus musculus
tcttccttccgaggcagcggcgatg

SEQ ID NO: 838278 - DNA, 25 bp, Mus musculus
tcttccttctgacatatcctcagat

SEQ ID NO: 838279 - DNA, 25 bp, Mus musculus
tcttccttctgagatatcctcagat

SEQ ID NO: 838280 - DNA, 25 bp, Mus musculus
tcttccttctggagaggcaccctgc

SEQ ID NO: 838281 - DNA, 25 bp, Mus musculus
tcttccttctggtgaggcaccctgc

SEQ ID NO: 838282 - DNA, 25 bp, Mus musculus
tcttccttctgtagatgaccgtggg

SEQ ID NO: 838283 - DNA, 25 bp, Mus musculus
tcttccttctgttgatgaccgtggg

SEQ ID NO: 838284 - DNA, 25 bp, Mus musculus
tcttccttgcaaacatctgaatgtc

SEQ ID NO: 838285 - DNA, 25 bp, Mus musculus
tcttccttgcaactttgattccata

SEQ ID NO: 838286 - DNA, 25 bp, Mus musculus
tcttccttgcaagtttgattccata

SEQ ID NO: 838287 - DNA, 25 bp, Mus musculus
tcttccttgcaatcatctgaatgtc

SEQ ID NO: 838288 - DNA, 25 bp, Mus musculus
tcttccttgctcctccgataattat

SEQ ID NO: 838289 - DNA, 25 bp, Mus musculus
tcttccttgctcgtccgataattat

SEQ ID NO: 838290 - DNA, 25 bp, Mus musculus
tcttccttgcttaggctactgtata

SEQ ID NO: 838291 - DNA, 25 bp, Mus musculus
tcttccttgcttagttaaccatcat

SEQ ID NO: 838292 - DNA, 25 bp, Mus musculus
tcttccttgctttggctactgtata

SEQ ID NO: 838293 - DNA, 25 bp, Mus musculus
tcttccttgctttgttaaccatcat

SEQ ID NO: 838294 - DNA, 25 bp, Mus musculus
tcttccttggctcttgctttttgac

SEQ ID NO: 838295 - DNA, 25 bp, Mus musculus
tcttccttggctgttgctttttgac

SEQ ID NO: 838296 - DNA, 25 bp, Mus musculus
tcttccttggtgactagttgcttct

SEQ ID NO: 838297 - DNA, 25 bp, Mus musculus
tcttccttggtgactgtgtatccag

SEQ ID NO: 838298 - DNA, 25 bp, Mus musculus
tcttccttggtgtctagttgcttct

SEQ ID NO: 838299 - DNA, 25 bp, Mus musculus
tcttccttggtgtctgtgtatccag

SEQ ID NO: 838300 - DNA, 25 bp, Mus musculus
tcttccttgtggcttgaattctggt

SEQ ID NO: 838301 - DNA, 25 bp, Mus musculus
tcttccttgtgggttgaattctggt

SEQ ID NO: 838302 - DNA, 25 bp, Mus musculus
tcttccttgttgatctacgtagtaa

SEQ ID NO: 838303 - DNA, 25 bp, Mus musculus
tcttccttgttgttctacgtagtaa

SEQ ID NO: 838304 - DNA, 25 bp, Mus musculus
tcttcctttactaagcttcagagct

SEQ ID NO: 838305 - DNA, 25 bp, Mus musculus
tcttcctttacttagcttcagagct

SEQ ID NO: 838306 - DNA, 25 bp, Mus musculus
tcttcctttagaattaaccaagcca

SEQ ID NO: 838307 - DNA, 25 bp, Mus musculus
tcttcctttagatttaaccaagcca

SEQ ID NO: 838308 - DNA, 25 bp, Mus musculus
tcttcctttgagagccggcttcctt

SEQ ID NO: 838309 - DNA, 25 bp, Mus musculus
tcttcctttgagtgccggcttcctt

SEQ ID NO: 838310 - DNA, 25 bp, Mus musculus
tcttcctttgctcctgaattttata

SEQ ID NO: 838311 - DNA, 25 bp, Mus musculus
tcttcctttgctgctgaattttata

SEQ ID NO: 838312 - DNA, 25 bp, Mus musculus
tcttccttttctactgacagacttt

SEQ ID NO: 838313 - DNA, 25 bp, Mus musculus
tcttccttttcttctgacagacttt

SEQ ID NO: 838314 - DNA, 25 bp, Mus musculus
tcttcgaaatccaagactttgcttt

SEQ ID NO: 838315 - DNA, 25 bp, Mus musculus
tcttcgaaatcctagactttgcttt

SEQ ID NO: 838316 - DNA, 25 bp, Mus musculus
tcttcgaagtccagtagcccagaaa

SEQ ID NO: 838317 - DNA, 25 bp, Mus musculus
tcttcgaagtcctgtagcccagaaa

SEQ ID NO: 838318 - DNA, 25 bp, Mus musculus
tcttcgaggaaccagctgccttctc

SEQ ID NO: 838319 - DNA, 25 bp, Mus musculus
tcttcgaggaacgagctgccttctc

SEQ ID NO: 838320 - DNA, 25 bp, Mus musculus
tcttcgagggcaaggtttgtcacgg

SEQ ID NO: 838321 - DNA, 25 bp, Mus musculus
tcttcgagggcatggtttgtcacgg

SEQ ID NO: 838322 - DNA, 25 bp, Mus musculus
tcttcgatctcacgacttcaggcga

SEQ ID NO: 838323 - DNA, 25 bp, Mus musculus
tcttcgatctcaggacttcaggcga

SEQ ID NO: 838324 - DNA, 25 bp, Mus musculus
tcttcgatgcagctgatgcttcata

SEQ ID NO: 838325 - DNA, 25 bp, Mus musculus
tcttcgatgcaggtgatgcttcata

SEQ ID NO: 838326 - DNA, 25 bp, Mus musculus
tcttcgcaaagacttccagggacaa

SEQ ID NO: 838327 - DNA, 25 bp, Mus musculus
tcttcgcaaagagttccagggacaa

SEQ ID NO: 838328 - DNA, 25 bp, Mus musculus
tcttcgcccgaaacatcatgattgg

SEQ ID NO: 838329 - DNA, 25 bp, Mus musculus
tcttcgcccgaatcatcatgattgg

SEQ ID NO: 838330 - DNA, 25 bp, Mus musculus
tcttcgccctgaagcgggccgcagg

SEQ ID NO: 838331 - DNA, 25 bp, Mus musculus
tcttcgccctgatgcgggccgcagg

SEQ ID NO: 838332 - DNA, 25 bp, Mus musculus
tcttcgcctcttctcggaagggtta

SEQ ID NO: 838333 - DNA, 25 bp, Mus musculus
tcttcgcctcttgtcggaagggtta

SEQ ID NO: 838334 - DNA, 25 bp, Mus musculus
tcttcgctcttcaacaggccaggaa

SEQ ID NO: 838335 - DNA, 25 bp, Mus musculus
tcttcgctcttctacaggccaggaa

SEQ ID NO: 838336 - DNA, 25 bp, Mus musculus
tcttcgctggcaagcagatctacag

SEQ ID NO: 838337 - DNA, 25 bp, Mus musculus
tcttcgctggcatgcagatctacag

SEQ ID NO: 838338 - DNA, 25 bp, Mus musculus
tcttcgcttcagcttcaatcatggc

SEQ ID NO: 838339 - DNA, 25 bp, Mus musculus
tcttcgcttcaggttcaatcatggc

SEQ ID NO: 838340 - DNA, 25 bp, Mus musculus
tcttcgctttccattatcacatgtg

SEQ ID NO: 838341 - DNA, 25 bp, Mus musculus
tcttcgctttcctttatcacatgtg

SEQ ID NO: 838342 - DNA, 25 bp, Mus musculus
tcttcggaaacccaagagtggaata

SEQ ID NO: 838343 - DNA, 25 bp, Mus musculus
tcttcggaaaccgaagagtggaata

SEQ ID NO: 838344 - DNA, 25 bp, Mus musculus
tcttcggaagggatggcagttgcta

SEQ ID NO: 838345 - DNA, 25 bp, Mus musculus
tcttcggaagggttggcagttgcta

SEQ ID NO: 838346 - DNA, 25 bp, Mus musculus
tcttcggagatacgttcctctacct

SEQ ID NO: 838347 - DNA, 25 bp, Mus musculus
tcttcggagataggttcctctacct

SEQ ID NO: 838348 - DNA, 25 bp, Mus musculus
tcttcggcaaggagagcgttcacct

SEQ ID NO: 838349 - DNA, 25 bp, Mus musculus
tcttcggcaaggtgagcgttcacct

SEQ ID NO: 838350 - DNA, 25 bp, Mus musculus
tcttcggcaatgatggttactacgt

SEQ ID NO: 838351 - DNA, 25 bp, Mus musculus
tcttcggcaatgttggttactacgt

SEQ ID NO: 838352 - DNA, 25 bp, Mus musculus
tcttcggctgtgacatttattagaa

SEQ ID NO: 838353 - DNA, 25 bp, Mus musculus
tcttcggctgtgtcatttattagaa

SEQ ID NO: 838354 - DNA, 25 bp, Mus musculus
tcttcgggaggcaaatgtaaacatt

SEQ ID NO: 838355 - DNA, 25 bp, Mus musculus
tcttcgggaggctaatgtaaacatt

SEQ ID NO: 838356 - DNA, 25 bp, Mus musculus
tcttcgggcctacgcatagttgtgc

SEQ ID NO: 838357 - DNA, 25 bp, Mus musculus
tcttcgggcctaggcatagttgtgc

SEQ ID NO: 838358 - DNA, 25 bp, Mus musculus
tcttcgggctagacccaggttagat

SEQ ID NO: 838359 - DNA, 25 bp, Mus musculus
tcttcgggctagtcccaggttagat

SEQ ID NO: 838360 - DNA, 25 bp, Mus musculus
tcttcgggtgacatgcttctaatca

SEQ ID NO: 838361 - DNA, 25 bp, Mus musculus
tcttcgggtgacttgcttctaatca

SEQ ID NO: 838362 - DNA, 25 bp, Mus musculus
tcttcggtaagaatgtcattttttg

SEQ ID NO: 838363 - DNA, 25 bp, Mus musculus
tcttcggtaagattgtcattttttg

SEQ ID NO: 838364 - DNA, 25 bp, Mus musculus
tcttcggttccgacaatacatgatg

SEQ ID NO: 838365 - DNA, 25 bp, Mus musculus
tcttcggttccgtcaatacatgatg

SEQ ID NO: 838366 - DNA, 25 bp, Mus musculus
tcttcgtcccgaatgctgggtttaa

SEQ ID NO: 838367 - DNA, 25 bp, Mus musculus
tcttcgtcccgattgctgggtttaa

SEQ ID NO: 838368 - DNA, 25 bp, Mus musculus
tcttcgtccttccttacagaaacta

SEQ ID NO: 838369 - DNA, 25 bp, Mus musculus
tcttcgtccttcgttacagaaacta

SEQ ID NO: 838370 - DNA, 25 bp, Mus musculus
tcttcgtgacggacaagggccgcta

SEQ ID NO: 838371 - DNA, 25 bp, Mus musculus
tcttcgtgacggtcaagggccgcta

SEQ ID NO: 838372 - DNA, 25 bp, Mus musculus
tcttcgtgagtgactgggctggacc

SEQ ID NO: 838373 - DNA, 25 bp, Mus musculus
tcttcgtgagtgtctgggctggacc

SEQ ID NO: 838374 - DNA, 25 bp, Mus musculus
tcttcgtgcactctggccactgtgt

SEQ ID NO: 838375 - DNA, 25 bp, Mus musculus
tcttcgtgcactgtggccactgtgt

SEQ ID NO: 838376 - DNA, 25 bp, Mus musculus
tcttcgtgtctgagttctattgttt

SEQ ID NO: 838377 - DNA, 25 bp, Mus musculus
tcttcgtgtctgtgttctattgttt

SEQ ID NO: 838378 - DNA, 25 bp, Mus musculus
tcttctaaaccgaactcttcccagg

SEQ ID NO: 838379 - DNA, 25 bp, Mus musculus
tcttctaaaccgtactcttcccagg

SEQ ID NO: 838380 - DNA, 25 bp, Mus musculus
tcttctaagaacctggactccatct

SEQ ID NO: 838381 - DNA, 25 bp, Mus musculus
tcttctaagaacgtggactccatct

SEQ ID NO: 838382 - DNA, 25 bp, Mus musculus
tcttctaagggacccgtgacaacca

SEQ ID NO: 838383 - DNA, 25 bp, Mus musculus
tcttctaagggagccgtgacaacca

SEQ ID NO: 838384 - DNA, 25 bp, Mus musculus
tcttctaagttactgccttttctgc

SEQ ID NO: 838385 - DNA, 25 bp, Mus musculus
tcttctaagttagtgccttttctgc

SEQ ID NO: 838386 - DNA, 25 bp, Mus musculus
tcttctaatgttaccagctatttca

SEQ ID NO: 838387 - DNA, 25 bp, Mus musculus
tcttctaatgtttccagctatttca

SEQ ID NO: 838388 - DNA, 25 bp, Mus musculus
tcttctaattttcctcttgtctctg

SEQ ID NO: 838389 - DNA, 25 bp, Mus musculus
tcttctaattttgctcttgtctctg

SEQ ID NO: 838390 - DNA, 25 bp, Mus musculus
tcttctacatgcagcaccagttcct

SEQ ID NO: 838391 - DNA, 25 bp, Mus musculus
tcttctacatgctgcaccagttcct

SEQ ID NO: 838392 - DNA, 25 bp, Mus musculus
tcttctacccacctggcttttgggt

SEQ ID NO: 838393 - DNA, 25 bp, Mus musculus
tcttctacccacgtggcttttgggt

SEQ ID NO: 838394 - DNA, 25 bp, Mus musculus
tcttctaccctgacttctaatgtca

SEQ ID NO: 838395 - DNA, 25 bp, Mus musculus
tcttctaccctgtcttctaatgtca

SEQ ID NO: 838396 - DNA, 25 bp, Mus musculus
tcttctacccttcccttgccctcat

SEQ ID NO: 838397 - DNA, 25 bp, Mus musculus
tcttctacccttgccttgccctcat

SEQ ID NO: 838398 - DNA, 25 bp, Mus musculus
tcttctacctgcctaggacaataag

SEQ ID NO: 838399 - DNA, 25 bp, Mus musculus
tcttctacctgcgtaggacaataag

SEQ ID NO: 838400 - DNA, 25 bp, Mus musculus
tcttctacctttcctaggaagtcat

SEQ ID NO: 838401 - DNA, 25 bp, Mus musculus
tcttctacctttgctaggaagtcat

SEQ ID NO: 838402 - DNA, 25 bp, Mus musculus
tcttctagaccccactgggatagag

SEQ ID NO: 838403 - DNA, 25 bp, Mus musculus
tcttctagacccgactgggatagag

SEQ ID NO: 838404 - DNA, 25 bp, Mus musculus
tcttctagacctaatgagcgacgcc

SEQ ID NO: 838405 - DNA, 25 bp, Mus musculus
tcttctagaccttatgagcgacgcc

SEQ ID NO: 838406 - DNA, 25 bp, Mus musculus
tcttctagaggtaactgcagtgctc

SEQ ID NO: 838407 - DNA, 25 bp, Mus musculus
tcttctagaggttactgcagtgctc

SEQ ID NO: 838408 - DNA, 25 bp, Mus musculus
tcttctagccgccaagggcactgga

SEQ ID NO: 838409 - DNA, 25 bp, Mus musculus
tcttctagccgcgaagggcactgga

SEQ ID NO: 838410 - DNA, 25 bp, Mus musculus
tcttctaggctgagagggacattca

SEQ ID NO: 838411 - DNA, 25 bp, Mus musculus
tcttctaggctgtgagggacattca

SEQ ID NO: 838412 - DNA, 25 bp, Mus musculus
tcttctataatcaatcccaataaac

SEQ ID NO: 838413 - DNA, 25 bp, Mus musculus
tcttctataatctatcccaataaac

SEQ ID NO: 838414 - DNA, 25 bp, Mus musculus
tcttctatatgcactctcttctttt

SEQ ID NO: 838415 - DNA, 25 bp, Mus musculus
tcttctatatgctctctcttctttt

SEQ ID NO: 838416 - DNA, 25 bp, Mus musculus
tcttctatccttctcctgatccaaa

SEQ ID NO: 838417 - DNA, 25 bp, Mus musculus
tcttctatccttgtcctgatccaaa

SEQ ID NO: 838418 - DNA, 25 bp, Mus musculus
tcttctatcgcccttatccgggagc

SEQ ID NO: 838419 - DNA, 25 bp, Mus musculus
tcttctatcgccgttatccgggagc

SEQ ID NO: 838420 - DNA, 25 bp, Mus musculus
tcttctatctcacctttgctttttt

SEQ ID NO: 838421 - DNA, 25 bp, Mus musculus
tcttctatctcagctttgctttttt

SEQ ID NO: 838422 - DNA, 25 bp, Mus musculus
tcttctatcttaacttactgcacat

SEQ ID NO: 838423 - DNA, 25 bp, Mus musculus
tcttctatcttatcttactgcacat

SEQ ID NO: 838424 - DNA, 25 bp, Mus musculus
tcttctatggctccggttttcgaca

SEQ ID NO: 838425 - DNA, 25 bp, Mus musculus
tcttctatggctgcggttttcgaca

SEQ ID NO: 838426 - DNA, 25 bp, Mus musculus
tcttctattatacgccatatcgata

SEQ ID NO: 838427 - DNA, 25 bp, Mus musculus
tcttctattataggccatatcgata

SEQ ID NO: 838428 - DNA, 25 bp, Mus musculus
tcttctattgaaatgtggccccagc

SEQ ID NO: 838429 - DNA, 25 bp, Mus musculus
tcttctattgaattgtggccccagc

SEQ ID NO: 838430 - DNA, 25 bp, Mus musculus
tcttctcaatctatgctgcatttgg

SEQ ID NO: 838431 - DNA, 25 bp, Mus musculus
tcttctcaatctttgctgcatttgg

SEQ ID NO: 838432 - DNA, 25 bp, Mus musculus
tcttctcaccggaaaactgttattg

SEQ ID NO: 838433 - DNA, 25 bp, Mus musculus
tcttctcaccggtaaactgttattg

SEQ ID NO: 838434 - DNA, 25 bp, Mus musculus
tcttctcacctacctggagcaggtg

SEQ ID NO: 838435 - DNA, 25 bp, Mus musculus
tcttctcacctagctggagcaggtg

SEQ ID NO: 838436 - DNA, 25 bp, Mus musculus
tcttctcactgcaagattggagctg

SEQ ID NO: 838437 - DNA, 25 bp, Mus musculus
tcttctcactgctagattggagctg

SEQ ID NO: 838438 - DNA, 25 bp, Mus musculus
tcttctcagaggcactttagggcag

SEQ ID NO: 838439 - DNA, 25 bp, Mus musculus
tcttctcagagggactttagggcag

SEQ ID NO: 838440 - DNA, 25 bp, Mus musculus
tcttctcagcacagctggcttaaag

SEQ ID NO: 838441 - DNA, 25 bp, Mus musculus
tcttctcagcactgctggcttaaag

SEQ ID NO: 838442 - DNA, 25 bp, Mus musculus
tcttctcagcagatgggaggtgtcc

SEQ ID NO: 838443 - DNA, 25 bp, Mus musculus
tcttctcagcagttgggaggtgtcc

SEQ ID NO: 838444 - DNA, 25 bp, Mus musculus
tcttctcagctgatgtccctctgtg

SEQ ID NO: 838445 - DNA, 25 bp, Mus musculus
tcttctcagctgcagttgaaggctt

SEQ ID NO: 838446 - DNA, 25 bp, Mus musculus
tcttctcagctggagttgaaggctt

SEQ ID NO: 838447 - DNA, 25 bp, Mus musculus
tcttctcagctgttgtccctctgtg

SEQ ID NO: 838448 - DNA, 25 bp, Mus musculus
tcttctcagtatatggatctccatt

SEQ ID NO: 838449 - DNA, 25 bp, Mus musculus
tcttctcagtatttggatctccatt

SEQ ID NO: 838450 - DNA, 25 bp, Mus musculus
tcttctcagtgaacaatgtcttctt

SEQ ID NO: 838451 - DNA, 25 bp, Mus musculus
tcttctcagtgatcaatgtcttctt

SEQ ID NO: 838452 - DNA, 25 bp, Mus musculus
tcttctcagtgtctgtagcttccac

SEQ ID NO: 838453 - DNA, 25 bp, Mus musculus
tcttctcagtgtgtgtagcttccac

SEQ ID NO: 838454 - DNA, 25 bp, Mus musculus
tcttctcataacatctcctgtgcca

SEQ ID NO: 838455 - DNA, 25 bp, Mus musculus
tcttctcataacttctcctgtgcca

SEQ ID NO: 838456 - DNA, 25 bp, Mus musculus
tcttctcatcacatcaatatttttt

SEQ ID NO: 838457 - DNA, 25 bp, Mus musculus
tcttctcatcacttcaatatttttt

SEQ ID NO: 838458 - DNA, 25 bp, Mus musculus
tcttctcatctgctgccaaaagttc

SEQ ID NO: 838459 - DNA, 25 bp, Mus musculus
tcttctcatctggtgccaaaagttc

SEQ ID NO: 838460 - DNA, 25 bp, Mus musculus
tcttctcattcaagtttagacactg

SEQ ID NO: 838461 - DNA, 25 bp, Mus musculus
tcttctcattcatgtttagacactg

SEQ ID NO: 838462 - DNA, 25 bp, Mus musculus
tcttctcattccatcccagaaaaag

SEQ ID NO: 838463 - DNA, 25 bp, Mus musculus
tcttctcattccttcccagaaaaag

SEQ ID NO: 838464 - DNA, 25 bp, Mus musculus
tcttctcatttaaagctcaaagcat

SEQ ID NO: 838465 - DNA, 25 bp, Mus musculus
tcttctcatttatagctcaaagcat

SEQ ID NO: 838466 - DNA, 25 bp, Mus musculus
tcttctccactgatgatctctgaac

SEQ ID NO: 838467 - DNA, 25 bp, Mus musculus
tcttctccactgttgatctctgaac

SEQ ID NO: 838468 - DNA, 25 bp, Mus musculus
tcttctccagtgacctgttagtaca

SEQ ID NO: 838469 - DNA, 25 bp, Mus musculus
tcttctccagtgtcctgttagtaca

SEQ ID NO: 838470 - DNA, 25 bp, Mus musculus
tcttctccatctagacatctttttt

SEQ ID NO: 838471 - DNA, 25 bp, Mus musculus
tcttctccatctagcaatctcaaat

SEQ ID NO: 838472 - DNA, 25 bp, Mus musculus
tcttctccatcttgacatctttttt

SEQ ID NO: 838473 - DNA, 25 bp, Mus musculus
tcttctccatcttgcaatctcaaat

SEQ ID NO: 838474 - DNA, 25 bp, Mus musculus
tcttctccatgcatccctatttttt

SEQ ID NO: 838475 - DNA, 25 bp, Mus musculus
tcttctccatgcttccctatttttt

SEQ ID NO: 838476 - DNA, 25 bp, Mus musculus
tcttctccatggatggtctgtacta

SEQ ID NO: 838477 - DNA, 25 bp, Mus musculus
tcttctccatggttggtctgtacta

SEQ ID NO: 838478 - DNA, 25 bp, Mus musculus
tcttctccatgtatgaccagactca

SEQ ID NO: 838479 - DNA, 25 bp, Mus musculus
tcttctccatgtttgaccagactca

SEQ ID NO: 838480 - DNA, 25 bp, Mus musculus
tcttctccattaacccacagtgagt

SEQ ID NO: 838481 - DNA, 25 bp, Mus musculus
tcttctccattatcccacagtgagt

SEQ ID NO: 838482 - DNA, 25 bp, Mus musculus
tcttctccattcatatctgtgatga

SEQ ID NO: 838483 - DNA, 25 bp, Mus musculus
tcttctccattcttatctgtgatga

SEQ ID NO: 838484 - DNA, 25 bp, Mus musculus
tcttctccccagatgaattctcata

SEQ ID NO: 838485 - DNA, 25 bp, Mus musculus
tcttctccccagttgaattctcata

SEQ ID NO: 838486 - DNA, 25 bp, Mus musculus
tcttctcccctaagggccaagaata

SEQ ID NO: 838487 - DNA, 25 bp, Mus musculus
tcttctcccctatgggccaagaata

SEQ ID NO: 838488 - DNA, 25 bp, Mus musculus
tcttctcccctgacaaagtacaata

SEQ ID NO: 838489 - DNA, 25 bp, Mus musculus
tcttctcccctgtcaaagtacaata

SEQ ID NO: 838490 - DNA, 25 bp, Mus musculus
tcttctccctctaggatgcatagga

SEQ ID NO: 838491 - DNA, 25 bp, Mus musculus
tcttctccctctcccaaaagattga

SEQ ID NO: 838492 - DNA, 25 bp, Mus musculus
tcttctccctctgccaaaagattga

SEQ ID NO: 838493 - DNA, 25 bp, Mus musculus
tcttctccctcttggatgcatagga

SEQ ID NO: 838494 - DNA, 25 bp, Mus musculus
tcttctcccttaaactgcttgacaa

SEQ ID NO: 838495 - DNA, 25 bp, Mus musculus
tcttctcccttaatctgccatagaa

SEQ ID NO: 838496 - DNA, 25 bp, Mus musculus
tcttctcccttatactgcttgacaa

SEQ ID NO: 838497 - DNA, 25 bp, Mus musculus
tcttctcccttattctgccatagaa

SEQ ID NO: 838498 - DNA, 25 bp, Mus musculus
tcttctccgagccatgactcaagaa

SEQ ID NO: 838499 - DNA, 25 bp, Mus musculus
tcttctccgagcgatgactcaagaa

SEQ ID NO: 838500 - DNA, 25 bp, Mus musculus
tcttctccgttaccaggtgtgtgtg

SEQ ID NO: 838501 - DNA, 25 bp, Mus musculus
tcttctccgttagcaggtgtgtgtg

SEQ ID NO: 838502 - DNA, 25 bp, Mus musculus
tcttctcctacaaacgacactggga

SEQ ID NO: 838503 - DNA, 25 bp, Mus musculus
tcttctcctacatacgacactggga

SEQ ID NO: 838504 - DNA, 25 bp, Mus musculus
tcttctcctacgatttgattctcaa

SEQ ID NO: 838505 - DNA, 25 bp, Mus musculus
tcttctcctacgttttgattctcaa

SEQ ID NO: 838506 - DNA, 25 bp, Mus musculus
tcttctcctcccctttaatgaaaag

SEQ ID NO: 838507 - DNA, 25 bp, Mus musculus
tcttctcctcccgtttaatgaaaag

SEQ ID NO: 838508 - DNA, 25 bp, Mus musculus
tcttctcctgtaatgacaagttctg

SEQ ID NO: 838509 - DNA, 25 bp, Mus musculus
tcttctcctgtattgacaagttctg

SEQ ID NO: 838510 - DNA, 25 bp, Mus musculus
tcttctccttacctgtcttacataa

SEQ ID NO: 838511 - DNA, 25 bp, Mus musculus
tcttctccttacgtgtcttacataa

SEQ ID NO: 838512 - DNA, 25 bp, Mus musculus
tcttctccttccacggcaagaaatg

SEQ ID NO: 838513 - DNA, 25 bp, Mus musculus
tcttctccttcctcggcaagaaatg

SEQ ID NO: 838514 - DNA, 25 bp, Mus musculus
tcttctcctttgagggaggtggtgc

SEQ ID NO: 838515 - DNA, 25 bp, Mus musculus
tcttctcctttgtgggaggtggtgc

SEQ ID NO: 838516 - DNA, 25 bp, Mus musculus
tcttctcgaatgcactgagtaattg

SEQ ID NO: 838517 - DNA, 25 bp, Mus musculus
tcttctcgaatggactgagtaattg

SEQ ID NO: 838518 - DNA, 25 bp, Mus musculus
tcttctcgcaagctcaggtctttga

SEQ ID NO: 838519 - DNA, 25 bp, Mus musculus
tcttctcgcaaggtcaggtctttga

SEQ ID NO: 838520 - DNA, 25 bp, Mus musculus
tcttctcgcatcatttctgtgggaa

SEQ ID NO: 838521 - DNA, 25 bp, Mus musculus
tcttctcgcatcttttctgtgggaa

SEQ ID NO: 838522 - DNA, 25 bp, Mus musculus
tcttctcgcttccagtgattgttag

SEQ ID NO: 838523 - DNA, 25 bp, Mus musculus
tcttctcgcttcgagtgattgttag

SEQ ID NO: 838524 - DNA, 25 bp, Mus musculus
tcttctcgggtgataatggacctgc

SEQ ID NO: 838525 - DNA, 25 bp, Mus musculus
tcttctcgggtgttaatggacctgc

SEQ ID NO: 838526 - DNA, 25 bp, Mus musculus
tcttctctaaccctcgattgccgga

SEQ ID NO: 838527 - DNA, 25 bp, Mus musculus
tcttctctaaccgtcgattgccgga

SEQ ID NO: 838528 - DNA, 25 bp, Mus musculus
tcttctctactcatttggcttctaa

SEQ ID NO: 838529 - DNA, 25 bp, Mus musculus
tcttctctactcttttggcttctaa

SEQ ID NO: 838530 - DNA, 25 bp, Mus musculus
tcttctctcagcactttcctatgga

SEQ ID NO: 838531 - DNA, 25 bp, Mus musculus
tcttctctcagctctttcctatgga

SEQ ID NO: 838532 - DNA, 25 bp, Mus musculus
tcttctctccaaaaataactgcctt

SEQ ID NO: 838533 - DNA, 25 bp, Mus musculus
tcttctctccaataataactgcctt

SEQ ID NO: 838534 - DNA, 25 bp, Mus musculus
tcttctctccagacctaaggtttca

SEQ ID NO: 838535 - DNA, 25 bp, Mus musculus
tcttctctccagtcctaaggtttca

SEQ ID NO: 838536 - DNA, 25 bp, Mus musculus
tcttctctctctacatgttgacttt

SEQ ID NO: 838537 - DNA, 25 bp, Mus musculus
tcttctctctcttcatgttgacttt

SEQ ID NO: 838538 - DNA, 25 bp, Mus musculus
tcttctctctgcaatggcctcattg

SEQ ID NO: 838539 - DNA, 25 bp, Mus musculus
tcttctctctgctatggcctcattg

SEQ ID NO: 838540 - DNA, 25 bp, Mus musculus
tcttctctcttgcacactttagtca

SEQ ID NO: 838541 - DNA, 25 bp, Mus musculus
tcttctctcttggacactttagtca

SEQ ID NO: 838542 - DNA, 25 bp, Mus musculus
tcttctctgaagcagttccccaaat

SEQ ID NO: 838543 - DNA, 25 bp, Mus musculus
tcttctctgaaggagttccccaaat

SEQ ID NO: 838544 - DNA, 25 bp, Mus musculus
tcttctctgataccccaaagcttgg

SEQ ID NO: 838545 - DNA, 25 bp, Mus musculus
tcttctctgatagcccaaagcttgg

SEQ ID NO: 838546 - DNA, 25 bp, Mus musculus
tcttctctgccaatcatctctgttt

SEQ ID NO: 838547 - DNA, 25 bp, Mus musculus
tcttctctgccattcatctctgttt

SEQ ID NO: 838548 - DNA, 25 bp, Mus musculus
tcttctctgcctatttaattgtaag

SEQ ID NO: 838549 - DNA, 25 bp, Mus musculus
tcttctctgcctccaaagcccagag

SEQ ID NO: 838550 - DNA, 25 bp, Mus musculus
tcttctctgcctgcaaagcccagag

SEQ ID NO: 838551 - DNA, 25 bp, Mus musculus
tcttctctgcctttttaattgtaag

SEQ ID NO: 838552 - DNA, 25 bp, Mus musculus
tcttctctggacatgttggttggct

SEQ ID NO: 838553 - DNA, 25 bp, Mus musculus
tcttctctggacttgttggttggct

SEQ ID NO: 838554 - DNA, 25 bp, Mus musculus
tcttctctggagctatgtgcactaa

SEQ ID NO: 838555 - DNA, 25 bp, Mus musculus
tcttctctggagctttttgggataa

SEQ ID NO: 838556 - DNA, 25 bp, Mus musculus
tcttctctggaggtatgtgcactaa

SEQ ID NO: 838557 - DNA, 25 bp, Mus musculus
tcttctctggaggtttttgggataa

SEQ ID NO: 838558 - DNA, 25 bp, Mus musculus
tcttctctggtgacggttcctgaca

SEQ ID NO: 838559 - DNA, 25 bp, Mus musculus
tcttctctggtgctggttcatggga

SEQ ID NO: 838560 - DNA, 25 bp, Mus musculus
tcttctctggtggtggttcatggga

SEQ ID NO: 838561 - DNA, 25 bp, Mus musculus
tcttctctggtgtcggttcctgaca

SEQ ID NO: 838562 - DNA, 25 bp, Mus musculus
tcttctctgtcactccacgaagtag

SEQ ID NO: 838563 - DNA, 25 bp, Mus musculus
tcttctctgtcagtccacgaagtag

SEQ ID NO: 838564 - DNA, 25 bp, Mus musculus
tcttctctgtgcatgatgggatttg

SEQ ID NO: 838565 - DNA, 25 bp, Mus musculus
tcttctctgtgcttgatgggatttg

SEQ ID NO: 838566 - DNA, 25 bp, Mus musculus
tcttctcttatgatattctctccga

SEQ ID NO: 838567 - DNA, 25 bp, Mus musculus
tcttctcttatgttattctctccga

SEQ ID NO: 838568 - DNA, 25 bp, Mus musculus
tcttctcttgacatctgtaggttta

SEQ ID NO: 838569 - DNA, 25 bp, Mus musculus
tcttctcttgacttctgtaggttta

SEQ ID NO: 838570 - DNA, 25 bp, Mus musculus
tcttctcttggacgaaggaccgacc

SEQ ID NO: 838571 - DNA, 25 bp, Mus musculus
tcttctcttggaggaaggaccgacc

SEQ ID NO: 838572 - DNA, 25 bp, Mus musculus
tcttctcttgtcaccagcatatata

SEQ ID NO: 838573 - DNA, 25 bp, Mus musculus
tcttctcttgtctccagcatatata

SEQ ID NO: 838574 - DNA, 25 bp, Mus musculus
tcttctctttctaggtgggtagcat

SEQ ID NO: 838575 - DNA, 25 bp, Mus musculus
tcttctctttctcgactcttgatag

SEQ ID NO: 838576 - DNA, 25 bp, Mus musculus
tcttctctttctggactcttgatag

SEQ ID NO: 838577 - DNA, 25 bp, Mus musculus
tcttctctttcttggtgggtagcat

SEQ ID NO: 838578 - DNA, 25 bp, Mus musculus
tcttctctttgaagtgcaataaaac

SEQ ID NO: 838579 - DNA, 25 bp, Mus musculus
tcttctctttgatgtgcaataaaac

SEQ ID NO: 838580 - DNA, 25 bp, Mus musculus
tcttctgaaagacccacgtttgggt

SEQ ID NO: 838581 - DNA, 25 bp, Mus musculus
tcttctgaaagagccacgtttgggt

SEQ ID NO: 838582 - DNA, 25 bp, Mus musculus
tcttctgaacagaacctttgtggaa

SEQ ID NO: 838583 - DNA, 25 bp, Mus musculus
tcttctgaacagtacctttgtggaa

SEQ ID NO: 838584 - DNA, 25 bp, Mus musculus
tcttctgaacatcggcacttataat

SEQ ID NO: 838585 - DNA, 25 bp, Mus musculus
tcttctgaacatgggcacttataat

SEQ ID NO: 838586 - DNA, 25 bp, Mus musculus
tcttctgaactgcttaatgagtgta

SEQ ID NO: 838587 - DNA, 25 bp, Mus musculus
tcttctgaactggttaatgagtgta

SEQ ID NO: 838588 - DNA, 25 bp, Mus musculus
tcttctgaagccaatactgacgctg

SEQ ID NO: 838589 - DNA, 25 bp, Mus musculus
tcttctgaagcccagtctgctgtgt

SEQ ID NO: 838590 - DNA, 25 bp, Mus musculus
tcttctgaagccgagtctgctgtgt

SEQ ID NO: 838591 - DNA, 25 bp, Mus musculus
tcttctgaagcctatactgacgctg

SEQ ID NO: 838592 - DNA, 25 bp, Mus musculus
tcttctgaaggaagagggtcttata

SEQ ID NO: 838593 - DNA, 25 bp, Mus musculus
tcttctgaaggatgagggtcttata

SEQ ID NO: 838594 - DNA, 25 bp, Mus musculus
tcttctgacaaactcctctgttagt

SEQ ID NO: 838595 - DNA, 25 bp, Mus musculus
tcttctgacaaagtcctctgttagt

SEQ ID NO: 838596 - DNA, 25 bp, Mus musculus
tcttctgaccacagtacacggactg

SEQ ID NO: 838597 - DNA, 25 bp, Mus musculus
tcttctgaccactgtacacggactg

SEQ ID NO: 838598 - DNA, 25 bp, Mus musculus
tcttctgaccgtaccttgggttctt

SEQ ID NO: 838599 - DNA, 25 bp, Mus musculus
tcttctgaccgttccttgggttctt

SEQ ID NO: 838600 - DNA, 25 bp, Mus musculus
tcttctgaccttcatagataccagg

SEQ ID NO: 838601 - DNA, 25 bp, Mus musculus
tcttctgaccttgatagataccagg

SEQ ID NO: 838602 - DNA, 25 bp, Mus musculus
tcttctgacttaaatgacgcagcga

SEQ ID NO: 838603 - DNA, 25 bp, Mus musculus
tcttctgacttatatgacgcagcga

SEQ ID NO: 838604 - DNA, 25 bp, Mus musculus
tcttctgacttcaatgagcacaaca

SEQ ID NO: 838605 - DNA, 25 bp, Mus musculus
tcttctgacttccttcattgatgaa

SEQ ID NO: 838606 - DNA, 25 bp, Mus musculus
tcttctgacttcgttcattgatgaa

SEQ ID NO: 838607 - DNA, 25 bp, Mus musculus
tcttctgacttctatgagcacaaca

SEQ ID NO: 838608 - DNA, 25 bp, Mus musculus
tcttctgactttacaggaactcaca

SEQ ID NO: 838609 - DNA, 25 bp, Mus musculus
tcttctgacttttcaggaactcaca

SEQ ID NO: 838610 - DNA, 25 bp, Mus musculus
tcttctgagaatctgttcccatcat

SEQ ID NO: 838611 - DNA, 25 bp, Mus musculus
tcttctgagaatgtgttcccatcat

SEQ ID NO: 838612 - DNA, 25 bp, Mus musculus
tcttctgagattcattcaatgtaac

SEQ ID NO: 838613 - DNA, 25 bp, Mus musculus
tcttctgagattgattcaatgtaac

SEQ ID NO: 838614 - DNA, 25 bp, Mus musculus
tcttctgatcagagtgatgggttct

SEQ ID NO: 838615 - DNA, 25 bp, Mus musculus
tcttctgatcagtgtgatgggttct

SEQ ID NO: 838616 - DNA, 25 bp, Mus musculus
tcttctgatgtgctgtacgttttct

SEQ ID NO: 838617 - DNA, 25 bp, Mus musculus
tcttctgatgtggtgtacgttttct

SEQ ID NO: 838618 - DNA, 25 bp, Mus musculus
tcttctgatgttctcccagatgctg

SEQ ID NO: 838619 - DNA, 25 bp, Mus musculus
tcttctgatgttgtcccagatgctg

SEQ ID NO: 838620 - DNA, 25 bp, Mus musculus
tcttctgcagtactctcattttcat

SEQ ID NO: 838621 - DNA, 25 bp, Mus musculus
tcttctgcagtagtctcattttcat

SEQ ID NO: 838622 - DNA, 25 bp, Mus musculus
tcttctgcagtgactcatctcatag

SEQ ID NO: 838623 - DNA, 25 bp, Mus musculus
tcttctgcagtgtctcatctcatag

SEQ ID NO: 838624 - DNA, 25 bp, Mus musculus
tcttctgccaccatagtgagtgtgt

SEQ ID NO: 838625 - DNA, 25 bp, Mus musculus
tcttctgccaccttagtgagtgtgt

SEQ ID NO: 838626 - DNA, 25 bp, Mus musculus
tcttctgcccatataatccagctgt

SEQ ID NO: 838627 - DNA, 25 bp, Mus musculus
tcttctgcccatttaatccagctgt

SEQ ID NO: 838628 - DNA, 25 bp, Mus musculus
tcttctgcctaaacagccacagttt

SEQ ID NO: 838629 - DNA, 25 bp, Mus musculus
tcttctgcctaatcagccacagttt

SEQ ID NO: 838630 - DNA, 25 bp, Mus musculus
tcttctgcctatagtgtgcactgat

SEQ ID NO: 838631 - DNA, 25 bp, Mus musculus
tcttctgcctattgtgtgcactgat

SEQ ID NO: 838632 - DNA, 25 bp, Mus musculus
tcttctgcctccatcaagagggagg

SEQ ID NO: 838633 - DNA, 25 bp, Mus musculus
tcttctgcctccttcaagagggagg

SEQ ID NO: 838634 - DNA, 25 bp, Mus musculus
tcttctgcctgcagtttgtaaaagc

SEQ ID NO: 838635 - DNA, 25 bp, Mus musculus
tcttctgcctgctgtttgtaaaagc

SEQ ID NO: 838636 - DNA, 25 bp, Mus musculus
tcttctgcctggctctatgccttag

SEQ ID NO: 838637 - DNA, 25 bp, Mus musculus
tcttctgcctgggtctatgccttag

SEQ ID NO: 838638 - DNA, 25 bp, Mus musculus
tcttctgcctgtatttgtgtgcaca

SEQ ID NO: 838639 - DNA, 25 bp, Mus musculus
tcttctgcctgtttttgtgtgcaca

SEQ ID NO: 838640 - DNA, 25 bp, Mus musculus
tcttctgctaaccagcaactgcttg

SEQ ID NO: 838641 - DNA, 25 bp, Mus musculus
tcttctgctaacgagcaactgcttg

SEQ ID NO: 838642 - DNA, 25 bp, Mus musculus
tcttctgctcctaccaaaggacatt

SEQ ID NO: 838643 - DNA, 25 bp, Mus musculus
tcttctgctccttccaaaggacatt

SEQ ID NO: 838644 - DNA, 25 bp, Mus musculus
tcttctgctctgcagtttggtgaac

SEQ ID NO: 838645 - DNA, 25 bp, Mus musculus
tcttctgctctggagtttggtgaac

SEQ ID NO: 838646 - DNA, 25 bp, Mus musculus
tcttctgctgacaggcccttctgtg

SEQ ID NO: 838647 - DNA, 25 bp, Mus musculus
tcttctgctgactggcccttctgtg

SEQ ID NO: 838648 - DNA, 25 bp, Mus musculus
tcttctgctgagcttgacatccaat

SEQ ID NO: 838649 - DNA, 25 bp, Mus musculus
tcttctgctgaggttgacatccaat

SEQ ID NO: 838650 - DNA, 25 bp, Mus musculus
tcttctgctgctagaaagcattcga

SEQ ID NO: 838651 - DNA, 25 bp, Mus musculus
tcttctgctgcttgaaagcattcga

SEQ ID NO: 838652 - DNA, 25 bp, Mus musculus
tcttctgctttccatactgttagga

SEQ ID NO: 838653 - DNA, 25 bp, Mus musculus
tcttctgctttcgatactgttagga

SEQ ID NO: 838654 - DNA, 25 bp, Mus musculus
tcttctggaaccagatcctcatgtt

SEQ ID NO: 838655 - DNA, 25 bp, Mus musculus
tcttctggaacctgatcctcatgtt

SEQ ID NO: 838656 - DNA, 25 bp, Mus musculus
tcttctggaacgactttgcctatga

SEQ ID NO: 838657 - DNA, 25 bp, Mus musculus
tcttctggaacgtctttgcctatga

SEQ ID NO: 838658 - DNA, 25 bp, Mus musculus
tcttctggaatcaggctgagctctg

SEQ ID NO: 838659 - DNA, 25 bp, Mus musculus
tcttctggaatctggctgagctctg

SEQ ID NO: 838660 - DNA, 25 bp, Mus musculus
tcttctggagatctgtccccaggac

SEQ ID NO: 838661 - DNA, 25 bp, Mus musculus
tcttctggagatgtgtccccaggac

SEQ ID NO: 838662 - DNA, 25 bp, Mus musculus
tcttctggaggcctgacaacattaa

SEQ ID NO: 838663 - DNA, 25 bp, Mus musculus
tcttctggaggcgtgacaacattaa

SEQ ID NO: 838664 - DNA, 25 bp, Mus musculus
tcttctggcatacagctgtacacac

SEQ ID NO: 838665 - DNA, 25 bp, Mus musculus
tcttctggcatagagctgtacacac

SEQ ID NO: 838666 - DNA, 25 bp, Mus musculus
tcttctggccaaacgactgtgatta

SEQ ID NO: 838667 - DNA, 25 bp, Mus musculus
tcttctggccaatcgactgtgatta

SEQ ID NO: 838668 - DNA, 25 bp, Mus musculus
tcttctggccatctctcttggcaga

SEQ ID NO: 838669 - DNA, 25 bp, Mus musculus
tcttctggccatgtctcttggcaga

SEQ ID NO: 838670 - DNA, 25 bp, Mus musculus
tcttctggcctgaacgggtgcacac

SEQ ID NO: 838671 - DNA, 25 bp, Mus musculus
tcttctggcctgtacgggtgcacac

SEQ ID NO: 838672 - DNA, 25 bp, Mus musculus
tcttctggccttattgacaacaggt

SEQ ID NO: 838673 - DNA, 25 bp, Mus musculus
tcttctggcctttttgacaacaggt

SEQ ID NO: 838674 - DNA, 25 bp, Mus musculus
tcttctggcgaaattaccattactt

SEQ ID NO: 838675 - DNA, 25 bp, Mus musculus
tcttctggcgaatttaccattactt

SEQ ID NO: 838676 - DNA, 25 bp, Mus musculus
tcttctggctcacttccaggaggtt

SEQ ID NO: 838677 - DNA, 25 bp, Mus musculus
tcttctggctcagttccaggaggtt

SEQ ID NO: 838678 - DNA, 25 bp, Mus musculus
tcttctggctgcaccaacatttggg

SEQ ID NO: 838679 - DNA, 25 bp, Mus musculus
tcttctggctgctccaacatttggg

SEQ ID NO: 838680 - DNA, 25 bp, Mus musculus
tcttctggcttccaaatgcacattc

SEQ ID NO: 838681 - DNA, 25 bp, Mus musculus
tcttctggcttcgaaatgcacattc

SEQ ID NO: 838682 - DNA, 25 bp, Mus musculus
tcttctgggaagagctaccagtgct

SEQ ID NO: 838683 - DNA, 25 bp, Mus musculus
tcttctgggaagtgctaccagtgct

SEQ ID NO: 838684 - DNA, 25 bp, Mus musculus
tcttctgggcccaggcaaagaaaat

SEQ ID NO: 838685 - DNA, 25 bp, Mus musculus
tcttctgggccctggcaaagaaaat

SEQ ID NO: 838686 - DNA, 25 bp, Mus musculus
tcttctgggtgccttttccaagatg

SEQ ID NO: 838687 - DNA, 25 bp, Mus musculus
tcttctgggtgcgttttccaagatg

SEQ ID NO: 838688 - DNA, 25 bp, Mus musculus
tcttctgggttccttatgctaattt

SEQ ID NO: 838689 - DNA, 25 bp, Mus musculus
tcttctgggttcgttatgctaattt

SEQ ID NO: 838690 - DNA, 25 bp, Mus musculus
tcttctggtaagatgttaactctga

SEQ ID NO: 838691 - DNA, 25 bp, Mus musculus
tcttctggtaagttgttaactctga

SEQ ID NO: 838692 - DNA, 25 bp, Mus musculus
tcttctggtcctaactgctattaac

SEQ ID NO: 838693 - DNA, 25 bp, Mus musculus
tcttctggtccttactgctattaac

SEQ ID NO: 838694 - DNA, 25 bp, Mus musculus
tcttctggtctaccgggagtcctga

SEQ ID NO: 838695 - DNA, 25 bp, Mus musculus
tcttctggtctagcgggagtcctga

SEQ ID NO: 838696 - DNA, 25 bp, Mus musculus
tcttctggtgacagcgtgactactg

SEQ ID NO: 838697 - DNA, 25 bp, Mus musculus
tcttctggtgactgcgtgactactg

SEQ ID NO: 838698 - DNA, 25 bp, Mus musculus
tcttctggttctatttgacactttt

SEQ ID NO: 838699 - DNA, 25 bp, Mus musculus
tcttctggttctttttgacactttt

SEQ ID NO: 838700 - DNA, 25 bp, Mus musculus
tcttctgtaaggatgttgcggacca

SEQ ID NO: 838701 - DNA, 25 bp, Mus musculus
tcttctgtaaggttgttgcggacca

SEQ ID NO: 838702 - DNA, 25 bp, Mus musculus
tcttctgtacagagctttcttttgt

SEQ ID NO: 838703 - DNA, 25 bp, Mus musculus
tcttctgtacagtgctttcttttgt

SEQ ID NO: 838704 - DNA, 25 bp, Mus musculus
tcttctgtactacagccaacacctt

SEQ ID NO: 838705 - DNA, 25 bp, Mus musculus
tcttctgtactagagccaacacctt

SEQ ID NO: 838706 - DNA, 25 bp, Mus musculus
tcttctgtatcaactgtagccaggg

SEQ ID NO: 838707 - DNA, 25 bp, Mus musculus
tcttctgtatcatctgtagccaggg

SEQ ID NO: 838708 - DNA, 25 bp, Mus musculus
tcttctgtatttaatgcccatgtat

SEQ ID NO: 838709 - DNA, 25 bp, Mus musculus
tcttctgtattttatgcccatgtat

SEQ ID NO: 838710 - DNA, 25 bp, Mus musculus
tcttctgtcaatctgatgcactgtg

SEQ ID NO: 838711 - DNA, 25 bp, Mus musculus
tcttctgtcaatgtgatgcactgtg

SEQ ID NO: 838712 - DNA, 25 bp, Mus musculus
tcttctgtcagcctgaacactagaa

SEQ ID NO: 838713 - DNA, 25 bp, Mus musculus
tcttctgtcagcgtgaacactagaa

SEQ ID NO: 838714 - DNA, 25 bp, Mus musculus
tcttctgtcaggcatgtctctctga

SEQ ID NO: 838715 - DNA, 25 bp, Mus musculus
tcttctgtcagggatgtctctctga

SEQ ID NO: 838716 - DNA, 25 bp, Mus musculus
tcttctgtcattccaggttgggtgg

SEQ ID NO: 838717 - DNA, 25 bp, Mus musculus
tcttctgtcattgcaggttgggtgg

SEQ ID NO: 838718 - DNA, 25 bp, Mus musculus
tcttctgtcccaatagctgctgagt

SEQ ID NO: 838719 - DNA, 25 bp, Mus musculus
tcttctgtcccattagctgctgagt

SEQ ID NO: 838720 - DNA, 25 bp, Mus musculus
tcttctgtcgaactttctccctcag

SEQ ID NO: 838721 - DNA, 25 bp, Mus musculus
tcttctgtcgaagtttctccctcag

SEQ ID NO: 838722 - DNA, 25 bp, Mus musculus
tcttctgtcgtgattgcttgtgaac

SEQ ID NO: 838723 - DNA, 25 bp, Mus musculus
tcttctgtcgtgtttgcttgtgaac

SEQ ID NO: 838724 - DNA, 25 bp, Mus musculus
tcttctgtctgcagtctatgagggt

SEQ ID NO: 838725 - DNA, 25 bp, Mus musculus
tcttctgtctgctgtctatgagggt

SEQ ID NO: 838726 - DNA, 25 bp, Mus musculus
tcttctgtgagaacttggcagtgct

SEQ ID NO: 838727 - DNA, 25 bp, Mus musculus
tcttctgtgagatcttggcagtgct

SEQ ID NO: 838728 - DNA, 25 bp, Mus musculus
tcttctgtgcccaagctatatcaag

SEQ ID NO: 838729 - DNA, 25 bp, Mus musculus
tcttctgtgccctagctatatcaag

SEQ ID NO: 838730 - DNA, 25 bp, Mus musculus
tcttctgtggccacgaggcagacat

SEQ ID NO: 838731 - DNA, 25 bp, Mus musculus
tcttctgtggcctcgaggcagacat

SEQ ID NO: 838732 - DNA, 25 bp, Mus musculus
tcttctgtgtagctacggtggccgt

SEQ ID NO: 838733 - DNA, 25 bp, Mus musculus
tcttctgtgtaggtacggtggccgt

SEQ ID NO: 838734 - DNA, 25 bp, Mus musculus
tcttctgtgtccagttatttgggtc

SEQ ID NO: 838735 - DNA, 25 bp, Mus musculus
tcttctgtgtccatggcgacgggca

SEQ ID NO: 838736 - DNA, 25 bp, Mus musculus
tcttctgtgtcctgttatttgggtc

SEQ ID NO: 838737 - DNA, 25 bp, Mus musculus
tcttctgtgtccttggcgacgggca

SEQ ID NO: 838738 - DNA, 25 bp, Mus musculus
tcttctgtgtgcctagcatcgggaa

SEQ ID NO: 838739 - DNA, 25 bp, Mus musculus
tcttctgtgtgcgtagcatcgggaa

SEQ ID NO: 838740 - DNA, 25 bp, Mus musculus
tcttctgtgtgtcacgcgtgtattg

SEQ ID NO: 838741 - DNA, 25 bp, Mus musculus
tcttctgtgtgtgacgcgtgtattg

SEQ ID NO: 838742 - DNA, 25 bp, Mus musculus
tcttctgttacaaatggctgagcaa

SEQ ID NO: 838743 - DNA, 25 bp, Mus musculus
tcttctgttacatatggctgagcaa

SEQ ID NO: 838744 - DNA, 25 bp, Mus musculus
tcttctgttctacacatggtgttca

SEQ ID NO: 838745 - DNA, 25 bp, Mus musculus
tcttctgttctagacatggtgttca

SEQ ID NO: 838746 - DNA, 25 bp, Mus musculus
tcttctgttcttatggctgtcttca

SEQ ID NO: 838747 - DNA, 25 bp, Mus musculus
tcttctgttcttttggctgtcttca

SEQ ID NO: 838748 - DNA, 25 bp, Mus musculus
tcttctgttgaacggatttccccat

SEQ ID NO: 838749 - DNA, 25 bp, Mus musculus
tcttctgttgaagggatttccccat

SEQ ID NO: 838750 - DNA, 25 bp, Mus musculus
tcttctgttgcaatgactatcaact

SEQ ID NO: 838751 - DNA, 25 bp, Mus musculus
tcttctgttgcattgactatcaact

SEQ ID NO: 838752 - DNA, 25 bp, Mus musculus
tcttctgttgtcattccttcatctt

SEQ ID NO: 838753 - DNA, 25 bp, Mus musculus
tcttctgttgtctttccttcatctt

SEQ ID NO: 838754 - DNA, 25 bp, Mus musculus
tcttctgtttggaaactctcttgga

SEQ ID NO: 838755 - DNA, 25 bp, Mus musculus
tcttctgtttggattggcttgagtc

SEQ ID NO: 838756 - DNA, 25 bp, Mus musculus
tcttctgtttggtaactctcttgga

SEQ ID NO: 838757 - DNA, 25 bp, Mus musculus
tcttctgtttggtttggcttgagtc

SEQ ID NO: 838758 - DNA, 25 bp, Mus musculus
tcttctgttttgaggttacttttgt

SEQ ID NO: 838759 - DNA, 25 bp, Mus musculus
tcttctgttttgtggttacttttgt

SEQ ID NO: 838760 - DNA, 25 bp, Mus musculus
tcttcttaacacaactagatgtagt

SEQ ID NO: 838761 - DNA, 25 bp, Mus musculus
tcttcttaacactactagatgtagt

SEQ ID NO: 838762 - DNA, 25 bp, Mus musculus
tcttcttaacctcgagcatctccaa

SEQ ID NO: 838763 - DNA, 25 bp, Mus musculus
tcttcttaacctggagcatctccaa

SEQ ID NO: 838764 - DNA, 25 bp, Mus musculus
tcttcttacactcagtacatttaca

SEQ ID NO: 838765 - DNA, 25 bp, Mus musculus
tcttcttacactgagtacatttaca

SEQ ID NO: 838766 - DNA, 25 bp, Mus musculus
tcttcttacccaaaatgccacttta

SEQ ID NO: 838767 - DNA, 25 bp, Mus musculus
tcttcttacccataatgccacttta

SEQ ID NO: 838768 - DNA, 25 bp, Mus musculus
tcttcttatatcacttgtcctgagt

SEQ ID NO: 838769 - DNA, 25 bp, Mus musculus
tcttcttatatctcttgtcctgagt

SEQ ID NO: 838770 - DNA, 25 bp, Mus musculus
tcttcttatgggattgtttttgatt

SEQ ID NO: 838771 - DNA, 25 bp, Mus musculus
tcttcttatgggtttgtttttgatt

SEQ ID NO: 838772 - DNA, 25 bp, Mus musculus
tcttcttcaaacaccggctacagtg

SEQ ID NO: 838773 - DNA, 25 bp, Mus musculus
tcttcttcaaactccggctacagtg

SEQ ID NO: 838774 - DNA, 25 bp, Mus musculus
tcttcttcaactctagccttcaaga

SEQ ID NO: 838775 - DNA, 25 bp, Mus musculus
tcttcttcaactgtagccttcaaga

SEQ ID NO: 838776 - DNA, 25 bp, Mus musculus
tcttcttcaagacctatgggatcaa

SEQ ID NO: 838777 - DNA, 25 bp, Mus musculus
tcttcttcaagagctatgggatcaa

SEQ ID NO: 838778 - DNA, 25 bp, Mus musculus
tcttcttcaatcacagcccagttca

SEQ ID NO: 838779 - DNA, 25 bp, Mus musculus
tcttcttcaatctcagcccagttca

SEQ ID NO: 838780 - DNA, 25 bp, Mus musculus
tcttcttcagctacaaacagttcag

SEQ ID NO: 838781 - DNA, 25 bp, Mus musculus
tcttcttcagcttcaaacagttcag

SEQ ID NO: 838782 - DNA, 25 bp, Mus musculus
tcttcttcaggtattgtgtttccaa

SEQ ID NO: 838783 - DNA, 25 bp, Mus musculus
tcttcttcaggttttgtgtttccaa

SEQ ID NO: 838784 - DNA, 25 bp, Mus musculus
tcttcttcattcactttgggaagca

SEQ ID NO: 838785 - DNA, 25 bp, Mus musculus
tcttcttcattctctttgggaagca

SEQ ID NO: 838786 - DNA, 25 bp, Mus musculus
tcttcttcattgatcgagcagctgg

SEQ ID NO: 838787 - DNA, 25 bp, Mus musculus
tcttcttcattgttcgagcagctgg

SEQ ID NO: 838788 - DNA, 25 bp, Mus musculus
tcttcttccagaaccgctgtactct

SEQ ID NO: 838789 - DNA, 25 bp, Mus musculus
tcttcttccagaatgttccagtcag

SEQ ID NO: 838790 - DNA, 25 bp, Mus musculus
tcttcttccagatccgctgtactct

SEQ ID NO: 838791 - DNA, 25 bp, Mus musculus
tcttcttccagattgttccagtcag

SEQ ID NO: 838792 - DNA, 25 bp, Mus musculus
tcttcttccatcagcatttatctgc

SEQ ID NO: 838793 - DNA, 25 bp, Mus musculus
tcttcttccatctgcatttatctgc

SEQ ID NO: 838794 - DNA, 25 bp, Mus musculus
tcttcttccatgaattcacccatat

SEQ ID NO: 838795 - DNA, 25 bp, Mus musculus
tcttcttccatgtattcacccatat

SEQ ID NO: 838796 - DNA, 25 bp, Mus musculus
tcttcttccccaatttgaagttcgg

SEQ ID NO: 838797 - DNA, 25 bp, Mus musculus
tcttcttccccattttgaagttcgg

SEQ ID NO: 838798 - DNA, 25 bp, Mus musculus
tcttcttccgaaacttctcaggcta

SEQ ID NO: 838799 - DNA, 25 bp, Mus musculus
tcttcttccgaatcttctcaggcta

SEQ ID NO: 838800 - DNA, 25 bp, Mus musculus
tcttcttccgggaggcagctgacat

SEQ ID NO: 838801 - DNA, 25 bp, Mus musculus
tcttcttccgggtggcagctgacat

SEQ ID NO: 838802 - DNA, 25 bp, Mus musculus
tcttcttccgtacgtgaccgcaagt

SEQ ID NO: 838803 - DNA, 25 bp, Mus musculus
tcttcttccgtaggtgaccgcaagt

SEQ ID NO: 838804 - DNA, 25 bp, Mus musculus
tcttcttcctatacttttcagacag

SEQ ID NO: 838805 - DNA, 25 bp, Mus musculus
tcttcttcctattcttttcagacag

SEQ ID NO: 838806 - DNA, 25 bp, Mus musculus
tcttcttcctcgagatgtgttcctt

SEQ ID NO: 838807 - DNA, 25 bp, Mus musculus
tcttcttcctcgtgatgtgttcctt

SEQ ID NO: 838808 - DNA, 25 bp, Mus musculus
tcttcttcctctaatggcaccgata

SEQ ID NO: 838809 - DNA, 25 bp, Mus musculus
tcttcttcctcttatggcaccgata

SEQ ID NO: 838810 - DNA, 25 bp, Mus musculus
tcttcttcctgacgtttccatggaa

SEQ ID NO: 838811 - DNA, 25 bp, Mus musculus
tcttcttcctgaggtttccatggaa

SEQ ID NO: 838812 - DNA, 25 bp, Mus musculus
tcttcttcctgcattcctagttgta

SEQ ID NO: 838813 - DNA, 25 bp, Mus musculus
tcttcttcctgctttcctagttgta

SEQ ID NO: 838814 - DNA, 25 bp, Mus musculus
tcttcttccttgctcttggtgtata

SEQ ID NO: 838815 - DNA, 25 bp, Mus musculus
tcttcttccttggtcttggtgtata

SEQ ID NO: 838816 - DNA, 25 bp, Mus musculus
tcttcttcctttcccatttaatggt

SEQ ID NO: 838817 - DNA, 25 bp, Mus musculus
tcttcttcctttccggtactataga

SEQ ID NO: 838818 - DNA, 25 bp, Mus musculus
tcttcttcctttgccatttaatggt

SEQ ID NO: 838819 - DNA, 25 bp, Mus musculus
tcttcttcctttgcggtactataga

SEQ ID NO: 838820 - DNA, 25 bp, Mus musculus
tcttcttctacacttgttgctctca

SEQ ID NO: 838821 - DNA, 25 bp, Mus musculus
tcttcttctacagttgttgctctca

SEQ ID NO: 838822 - DNA, 25 bp, Mus musculus
tcttcttctaccagttagtatgttc

SEQ ID NO: 838823 - DNA, 25 bp, Mus musculus
tcttcttctacctgttagtatgttc

SEQ ID NO: 838824 - DNA, 25 bp, Mus musculus
tcttcttctgagatatttctaccat

SEQ ID NO: 838825 - DNA, 25 bp, Mus musculus
tcttcttctgagttatttctaccat

SEQ ID NO: 838826 - DNA, 25 bp, Mus musculus
tcttcttctgccacattgtgtgttt

SEQ ID NO: 838827 - DNA, 25 bp, Mus musculus
tcttcttctgcctcattgtgtgttt

SEQ ID NO: 838828 - DNA, 25 bp, Mus musculus
tcttcttctttcactagtgcaagta

SEQ ID NO: 838829 - DNA, 25 bp, Mus musculus
tcttcttctttctctagtgcaagta

SEQ ID NO: 838830 - DNA, 25 bp, Mus musculus
tcttcttcttttcagctcgtagggt

SEQ ID NO: 838831 - DNA, 25 bp, Mus musculus
tcttcttcttttgagctcgtagggt

SEQ ID NO: 838832 - DNA, 25 bp, Mus musculus
tcttcttgatggactaactagtaac

SEQ ID NO: 838833 - DNA, 25 bp, Mus musculus
tcttcttgatggtctaactagtaac

SEQ ID NO: 838834 - DNA, 25 bp, Mus musculus
tcttcttgattgcattcatgagtgg

SEQ ID NO: 838835 - DNA, 25 bp, Mus musculus
tcttcttgattggattcatgagtgg

SEQ ID NO: 838836 - DNA, 25 bp, Mus musculus
tcttcttgcagaagcctagaatata

SEQ ID NO: 838837 - DNA, 25 bp, Mus musculus
tcttcttgcagatgcctagaatata

SEQ ID NO: 838838 - DNA, 25 bp, Mus musculus
tcttcttgctttcagcccgtgtaaa

SEQ ID NO: 838839 - DNA, 25 bp, Mus musculus
tcttcttgctttgagcccgtgtaaa

SEQ ID NO: 838840 - DNA, 25 bp, Mus musculus
tcttcttggtctctggtttgcataa

SEQ ID NO: 838841 - DNA, 25 bp, Mus musculus
tcttcttggtctgtggtttgcataa

SEQ ID NO: 838842 - DNA, 25 bp, Mus musculus
tcttcttggtggcttagtatgtctc

SEQ ID NO: 838843 - DNA, 25 bp, Mus musculus
tcttcttggtgggttagtatgtctc

SEQ ID NO: 838844 - DNA, 25 bp, Mus musculus
tcttcttgtaatataagtgactgtg

SEQ ID NO: 838845 - DNA, 25 bp, Mus musculus
tcttcttgtaatttaagtgactgtg

SEQ ID NO: 838846 - DNA, 25 bp, Mus musculus
tcttcttgtattcccttgctgtaat

SEQ ID NO: 838847 - DNA, 25 bp, Mus musculus
tcttcttgtattgccttgctgtaat

SEQ ID NO: 838848 - DNA, 25 bp, Mus musculus
tcttcttgtcacaattgggcttact

SEQ ID NO: 838849 - DNA, 25 bp, Mus musculus
tcttcttgtcactattgggcttact

SEQ ID NO: 838850 - DNA, 25 bp, Mus musculus
tcttcttgtcagctaccaacaggcc

SEQ ID NO: 838851 - DNA, 25 bp, Mus musculus
tcttcttgtcaggtaccaacaggcc

SEQ ID NO: 838852 - DNA, 25 bp, Mus musculus
tcttcttgtctactggcccagatag

SEQ ID NO: 838853 - DNA, 25 bp, Mus musculus
tcttcttgtctagtggcccagatag

SEQ ID NO: 838854 - DNA, 25 bp, Mus musculus
tcttctttaggcagaacattgtaat

SEQ ID NO: 838855 - DNA, 25 bp, Mus musculus
tcttctttaggctgaacattgtaat

SEQ ID NO: 838856 - DNA, 25 bp, Mus musculus
tcttctttagtcaagggctgaggcc

SEQ ID NO: 838857 - DNA, 25 bp, Mus musculus
tcttctttagtctagggctgaggcc

SEQ ID NO: 838858 - DNA, 25 bp, Mus musculus
tcttctttatccaggcatagccctg

SEQ ID NO: 838859 - DNA, 25 bp, Mus musculus
tcttctttatcctggcatagccctg

SEQ ID NO: 838860 - DNA, 25 bp, Mus musculus
tcttctttcagactgctggtgggca

SEQ ID NO: 838861 - DNA, 25 bp, Mus musculus
tcttctttcagagtgctggtgggca

SEQ ID NO: 838862 - DNA, 25 bp, Mus musculus
tcttctttccaccttgtgggaaggt

SEQ ID NO: 838863 - DNA, 25 bp, Mus musculus
tcttctttccacgttgtgggaaggt

SEQ ID NO: 838864 - DNA, 25 bp, Mus musculus
tcttctttccccaaaatacaatgtt

SEQ ID NO: 838865 - DNA, 25 bp, Mus musculus
tcttctttcccctaaatacaatgtt

SEQ ID NO: 838866 - DNA, 25 bp, Mus musculus
tcttctttccctatcaactaactat

SEQ ID NO: 838867 - DNA, 25 bp, Mus musculus
tcttctttccctttcaactaactat

SEQ ID NO: 838868 - DNA, 25 bp, Mus musculus
tcttctttctaacagatgactacaa

SEQ ID NO: 838869 - DNA, 25 bp, Mus musculus
tcttctttctaagagatgactacaa

SEQ ID NO: 838870 - DNA, 25 bp, Mus musculus
tcttctttctggacccagccaagaa

SEQ ID NO: 838871 - DNA, 25 bp, Mus musculus
tcttctttctggtcccagccaagaa

SEQ ID NO: 838872 - DNA, 25 bp, Mus musculus
tcttctttctgtattttaccattat

SEQ ID NO: 838873 - DNA, 25 bp, Mus musculus
tcttctttctgttttttaccattat

SEQ ID NO: 838874 - DNA, 25 bp, Mus musculus
tcttctttgaggattttgctttctt

SEQ ID NO: 838875 - DNA, 25 bp, Mus musculus
tcttctttgaggtttttgctttctt

SEQ ID NO: 838876 - DNA, 25 bp, Mus musculus
tcttctttgcctcttccaaaagcca

SEQ ID NO: 838877 - DNA, 25 bp, Mus musculus
tcttctttgcctgttccaaaagcca

SEQ ID NO: 838878 - DNA, 25 bp, Mus musculus
tcttctttggacacttctggcaact

SEQ ID NO: 838879 - DNA, 25 bp, Mus musculus
tcttctttggactcttctggcaact

SEQ ID NO: 838880 - DNA, 25 bp, Mus musculus
tcttctttgtcaatcctggcgagga

SEQ ID NO: 838881 - DNA, 25 bp, Mus musculus
tcttctttgtcattcctggcgagga

SEQ ID NO: 838882 - DNA, 25 bp, Mus musculus
tcttctttgtgacgagtgatgcatc

SEQ ID NO: 838883 - DNA, 25 bp, Mus musculus
tcttctttgtgaggagtgatgcatc

SEQ ID NO: 838884 - DNA, 25 bp, Mus musculus
tcttctttgttcacttggatgccaa

SEQ ID NO: 838885 - DNA, 25 bp, Mus musculus
tcttctttgttctcttggatgccaa

SEQ ID NO: 838886 - DNA, 25 bp, Mus musculus
tcttcttttagcaactctgtgggag

SEQ ID NO: 838887 - DNA, 25 bp, Mus musculus
tcttcttttagctactctgtgggag

SEQ ID NO: 838888 - DNA, 25 bp, Mus musculus
tcttcttttatgaaactcctactgg

SEQ ID NO: 838889 - DNA, 25 bp, Mus musculus
tcttcttttatgtaactcctactgg

SEQ ID NO: 838890 - DNA, 25 bp, Mus musculus
tcttcttttctcagtatattgggct

SEQ ID NO: 838891 - DNA, 25 bp, Mus musculus
tcttcttttctctgtatattgggct

SEQ ID NO: 838892 - DNA, 25 bp, Mus musculus
tcttcttttggccactgtactggca

SEQ ID NO: 838893 - DNA, 25 bp, Mus musculus
tcttcttttggcgactgtactggca

SEQ ID NO: 838894 - DNA, 25 bp, Mus musculus
tcttcttttgttaacgtttcacata

SEQ ID NO: 838895 - DNA, 25 bp, Mus musculus
tcttcttttgtttacgtttcacata

SEQ ID NO: 838896 - DNA, 25 bp, Mus musculus
tcttctttttatctgcttgggtgct

SEQ ID NO: 838897 - DNA, 25 bp, Mus musculus
tcttctttttatgtgcttgggtgct

SEQ ID NO: 838898 - DNA, 25 bp, Mus musculus
tcttcttttttaaagccttcacagg

SEQ ID NO: 838899 - DNA, 25 bp, Mus musculus
tcttcttttttaatgactcctggaa

SEQ ID NO: 838900 - DNA, 25 bp, Mus musculus
tcttcttttttatagccttcacagg

SEQ ID NO: 838901 - DNA, 25 bp, Mus musculus
tcttcttttttattgactcctggaa

SEQ ID NO: 838902 - DNA, 25 bp, Mus musculus
tcttgaaaaagcacctcgtccttat

SEQ ID NO: 838903 - DNA, 25 bp, Mus musculus
tcttgaaaaagctcctcgtccttat

SEQ ID NO: 838904 - DNA, 25 bp, Mus musculus
tcttgaaaaatgacccattcgggac

SEQ ID NO: 838905 - DNA, 25 bp, Mus musculus
tcttgaaaaatgtcccattcgggac

SEQ ID NO: 838906 - DNA, 25 bp, Mus musculus
tcttgaaaagtgcactcaggccctt

SEQ ID NO: 838907 - DNA, 25 bp, Mus musculus
tcttgaaaagtggactcaggccctt

SEQ ID NO: 838908 - DNA, 25 bp, Mus musculus
tcttgaaaatcgagtggctgtgctt

SEQ ID NO: 838909 - DNA, 25 bp, Mus musculus
tcttgaaaatcgtgtggctgtgctt

SEQ ID NO: 838910 - DNA, 25 bp, Mus musculus
tcttgaaatcttctcccttttgtgg

SEQ ID NO: 838911 - DNA, 25 bp, Mus musculus
tcttgaaatcttgtcccttttgtgg

SEQ ID NO: 838912 - DNA, 25 bp, Mus musculus
tcttgaacccacatcaggagacaac

SEQ ID NO: 838913 - DNA, 25 bp, Mus musculus
tcttgaacccacttcaggagacaac

SEQ ID NO: 838914 - DNA, 25 bp, Mus musculus
tcttgaaccgacagctggcacatat

SEQ ID NO: 838915 - DNA, 25 bp, Mus musculus
tcttgaaccgactgctggcacatat

SEQ ID NO: 838916 - DNA, 25 bp, Mus musculus
tcttgaacctctcattgtacctagt

SEQ ID NO: 838917 - DNA, 25 bp, Mus musculus
tcttgaacctctgattgtacctagt

SEQ ID NO: 838918 - DNA, 25 bp, Mus musculus
tcttgaagacttcggctggagcgac

SEQ ID NO: 838919 - DNA, 25 bp, Mus musculus
tcttgaagacttgggctggagcgac

SEQ ID NO: 838920 - DNA, 25 bp, Mus musculus
tcttgaagattcaccacctggcaaa

SEQ ID NO: 838921 - DNA, 25 bp, Mus musculus
tcttgaagattctccacctggcaaa

SEQ ID NO: 838922 - DNA, 25 bp, Mus musculus
tcttgaagccttactcacttgagac

SEQ ID NO: 838923 - DNA, 25 bp, Mus musculus
tcttgaagcctttctcacttgagac

SEQ ID NO: 838924 - DNA, 25 bp, Mus musculus
tcttgaagctctcgaaagcactcca

SEQ ID NO: 838925 - DNA, 25 bp, Mus musculus
tcttgaagctctggaaagcactcca

SEQ ID NO: 838926 - DNA, 25 bp, Mus musculus
tcttgaagtagacctggaactccag

SEQ ID NO: 838927 - DNA, 25 bp, Mus musculus
tcttgaagtagagctggaactccag

SEQ ID NO: 838928 - DNA, 25 bp, Mus musculus
tcttgaatagacacgagggcctgta

SEQ ID NO: 838929 - DNA, 25 bp, Mus musculus
tcttgaatagactcgagggcctgta

SEQ ID NO: 838930 - DNA, 25 bp, Mus musculus
tcttgaatcatccagacgctctttg

SEQ ID NO: 838931 - DNA, 25 bp, Mus musculus
tcttgaatcatcgagacgctctttg

SEQ ID NO: 838932 - DNA, 25 bp, Mus musculus
tcttgaatgttccagggccatccct

SEQ ID NO: 838933 - DNA, 25 bp, Mus musculus
tcttgaatgttcgagggccatccct

SEQ ID NO: 838934 - DNA, 25 bp, Mus musculus
tcttgacaagaacctgattggacct

SEQ ID NO: 838935 - DNA, 25 bp, Mus musculus
tcttgacaagaagctgattggacct

SEQ ID NO: 838936 - DNA, 25 bp, Mus musculus
tcttgacaatgtcgaggcctctaat

SEQ ID NO: 838937 - DNA, 25 bp, Mus musculus
tcttgacaatgtggaggcctctaat

SEQ ID NO: 838938 - DNA, 25 bp, Mus musculus
tcttgacactatattgccatttccc

SEQ ID NO: 838939 - DNA, 25 bp, Mus musculus
tcttgacactattttgccatttccc

SEQ ID NO: 838940 - DNA, 25 bp, Mus musculus
tcttgacactctcattaggactgct

SEQ ID NO: 838941 - DNA, 25 bp, Mus musculus
tcttgacactctgattaggactgct

SEQ ID NO: 838942 - DNA, 25 bp, Mus musculus
tcttgacagagaactgaggcgactg

SEQ ID NO: 838943 - DNA, 25 bp, Mus musculus
tcttgacagagatctgaggcgactg

SEQ ID NO: 838944 - DNA, 25 bp, Mus musculus
tcttgacagcccatgacaggacagt

SEQ ID NO: 838945 - DNA, 25 bp, Mus musculus
tcttgacagcccttgacaggacagt

SEQ ID NO: 838946 - DNA, 25 bp, Mus musculus
tcttgacagtttccccagtcagtgg

SEQ ID NO: 838947 - DNA, 25 bp, Mus musculus
tcttgacagtttgcccagtcagtgg

SEQ ID NO: 838948 - DNA, 25 bp, Mus musculus
tcttgacataatcatccagcctcat

SEQ ID NO: 838949 - DNA, 25 bp, Mus musculus
tcttgacataatgatccagcctcat

SEQ ID NO: 838950 - DNA, 25 bp, Mus musculus
tcttgacatattatggctgcgggat

SEQ ID NO: 838951 - DNA, 25 bp, Mus musculus
tcttgacatattttggctgcgggat

SEQ ID NO: 838952 - DNA, 25 bp, Mus musculus
tcttgaccacagctccagaagttgt

SEQ ID NO: 838953 - DNA, 25 bp, Mus musculus
tcttgaccacaggtccagaagttgt

SEQ ID NO: 838954 - DNA, 25 bp, Mus musculus
tcttgaccagatacagtgatagctt

SEQ ID NO: 838955 - DNA, 25 bp, Mus musculus
tcttgaccagattcagtgatagctt

SEQ ID NO: 838956 - DNA, 25 bp, Mus musculus
tcttgacccacccaggtgccattgt

SEQ ID NO: 838957 - DNA, 25 bp, Mus musculus
tcttgacccaccgaggtgccattgt

SEQ ID NO: 838958 - DNA, 25 bp, Mus musculus
tcttgacccagtcagctgcgacctg

SEQ ID NO: 838959 - DNA, 25 bp, Mus musculus
tcttgacccagtgagctgcgacctg

SEQ ID NO: 838960 - DNA, 25 bp, Mus musculus
tcttgacccctaaaagccattgcaa

SEQ ID NO: 838961 - DNA, 25 bp, Mus musculus
tcttgacccctataagccattgcaa

SEQ ID NO: 838962 - DNA, 25 bp, Mus musculus
tcttgaccccttacatctttattag

SEQ ID NO: 838963 - DNA, 25 bp, Mus musculus
tcttgacccctttcatctttattag

SEQ ID NO: 838964 - DNA, 25 bp, Mus musculus
tcttgaccctgaaggtctgtggtcc

SEQ ID NO: 838965 - DNA, 25 bp, Mus musculus
tcttgaccctgatggtctgtggtcc

SEQ ID NO: 838966 - DNA, 25 bp, Mus musculus
tcttgacctcggaccctcatagaga

SEQ ID NO: 838967 - DNA, 25 bp, Mus musculus
tcttgacctcggtccctcatagaga

SEQ ID NO: 838968 - DNA, 25 bp, Mus musculus
tcttgaccttcactctgtctatagt

SEQ ID NO: 838969 - DNA, 25 bp, Mus musculus
tcttgaccttcagtctgtctatagt

SEQ ID NO: 838970 - DNA, 25 bp, Mus musculus
tcttgaccttctagggcttggtgac

SEQ ID NO: 838971 - DNA, 25 bp, Mus musculus
tcttgaccttcttgggcttggtgac

SEQ ID NO: 838972 - DNA, 25 bp, Mus musculus
tcttgaccttgcagtgcccaaaagt

SEQ ID NO: 838973 - DNA, 25 bp, Mus musculus
tcttgaccttgctgtgcccaaaagt

SEQ ID NO: 838974 - DNA, 25 bp, Mus musculus
tcttgactcagcatggatggaccaa

SEQ ID NO: 838975 - DNA, 25 bp, Mus musculus
tcttgactcagcttggatggaccaa

SEQ ID NO: 838976 - DNA, 25 bp, Mus musculus
tcttgactcctgaggatcctacaga

SEQ ID NO: 838977 - DNA, 25 bp, Mus musculus
tcttgactcctgtggatcctacaga

SEQ ID NO: 838978 - DNA, 25 bp, Mus musculus
tcttgactggatagctttgggagtt

SEQ ID NO: 838979 - DNA, 25 bp, Mus musculus
tcttgactggattgctttgggagtt

SEQ ID NO: 838980 - DNA, 25 bp, Mus musculus
tcttgacttcaacgctggtgacttc

SEQ ID NO: 838981 - DNA, 25 bp, Mus musculus
tcttgacttcaaggctggtgacttc

SEQ ID NO: 838982 - DNA, 25 bp, Mus musculus
tcttgacttgctcccttggaagttg

SEQ ID NO: 838983 - DNA, 25 bp, Mus musculus
tcttgacttgctgccttggaagttg

SEQ ID NO: 838984 - DNA, 25 bp, Mus musculus
tcttgagaactcaaccatcatggtg

SEQ ID NO: 838985 - DNA, 25 bp, Mus musculus
tcttgagaactctaccatcatggtg

SEQ ID NO: 838986 - DNA, 25 bp, Mus musculus
tcttgagaagttaccttttgatgat

SEQ ID NO: 838987 - DNA, 25 bp, Mus musculus
tcttgagaagtttccttttgatgat

SEQ ID NO: 838988 - DNA, 25 bp, Mus musculus
tcttgagaatttcgagcttttgggc

SEQ ID NO: 838989 - DNA, 25 bp, Mus musculus
tcttgagaatttggagcttttgggc

SEQ ID NO: 838990 - DNA, 25 bp, Mus musculus
tcttgagacacaataactcatattt

SEQ ID NO: 838991 - DNA, 25 bp, Mus musculus
tcttgagacacattaactcatattt

SEQ ID NO: 838992 - DNA, 25 bp, Mus musculus
tcttgagacaccacggaacaggagc

SEQ ID NO: 838993 - DNA, 25 bp, Mus musculus
tcttgagacacctcggaacaggagc

SEQ ID NO: 838994 - DNA, 25 bp, Mus musculus
tcttgagaccatagcctttctgaaa

SEQ ID NO: 838995 - DNA, 25 bp, Mus musculus
tcttgagaccattgcctttctgaaa

SEQ ID NO: 838996 - DNA, 25 bp, Mus musculus
tcttgagagccgctatcctaagctc

SEQ ID NO: 838997 - DNA, 25 bp, Mus musculus
tcttgagagccggtatcctaagctc

SEQ ID NO: 838998 - DNA, 25 bp, Mus musculus
tcttgagatcacatgtactgctatt

SEQ ID NO: 838999 - DNA, 25 bp, Mus musculus
tcttgagatcacttgtactgctatt

SEQ ID NO: 839000 - DNA, 25 bp, Mus musculus
tcttgagatgatcagcatggccaca

SEQ ID NO: 839001 - DNA, 25 bp, Mus musculus
tcttgagatgatgagcatggccaca

SEQ ID NO: 839002 - DNA, 25 bp, Mus musculus
tcttgagatggcacattcctacaat

SEQ ID NO: 839003 - DNA, 25 bp, Mus musculus
tcttgagatggctcattcctacaat

SEQ ID NO: 839004 - DNA, 25 bp, Mus musculus
tcttgagatttcaggcatgtttcag

SEQ ID NO: 839005 - DNA, 25 bp, Mus musculus
tcttgagatttctggcatgtttcag

SEQ ID NO: 839006 - DNA, 25 bp, Mus musculus
tcttgagcactgatataaattactt

SEQ ID NO: 839007 - DNA, 25 bp, Mus musculus
tcttgagcactgttataaattactt

SEQ ID NO: 839008 - DNA, 25 bp, Mus musculus
tcttgagcagacaggacacagagcg

SEQ ID NO: 839009 - DNA, 25 bp, Mus musculus
tcttgagcagactggacacagagcg

SEQ ID NO: 839010 - DNA, 25 bp, Mus musculus
tcttgagcatttcagacgcaccgag

SEQ ID NO: 839011 - DNA, 25 bp, Mus musculus
tcttgagcatttgagacgcaccgag

SEQ ID NO: 839012 - DNA, 25 bp, Mus musculus
tcttgagccattccatccagtgcgt

SEQ ID NO: 839013 - DNA, 25 bp, Mus musculus
tcttgagccattgcatccagtgcgt

SEQ ID NO: 839014 - DNA, 25 bp, Mus musculus
tcttgagccccgagttatcgaggat

SEQ ID NO: 839015 - DNA, 25 bp, Mus musculus
tcttgagccccgtgttatcgaggat

SEQ ID NO: 839016 - DNA, 25 bp, Mus musculus
tcttgagccgctagtttctgcattt

SEQ ID NO: 839017 - DNA, 25 bp, Mus musculus
tcttgagccgcttgtttctgcattt

SEQ ID NO: 839018 - DNA, 25 bp, Mus musculus
tcttgagcctttagttttatggtat

SEQ ID NO: 839019 - DNA, 25 bp, Mus musculus
tcttgagccttttgttttatggtat

SEQ ID NO: 839020 - DNA, 25 bp, Mus musculus
tcttgagctcacaaaaacccatctg

SEQ ID NO: 839021 - DNA, 25 bp, Mus musculus
tcttgagctcactaaaacccatctg

SEQ ID NO: 839022 - DNA, 25 bp, Mus musculus
tcttgagcttgccccccacccagca

SEQ ID NO: 839023 - DNA, 25 bp, Mus musculus
tcttgagcttgcgccccacccagca

SEQ ID NO: 839024 - DNA, 25 bp, Mus musculus
tcttgaggagagagaccgacgccaa

SEQ ID NO: 839025 - DNA, 25 bp, Mus musculus
tcttgaggagagtgaccgacgccaa

SEQ ID NO: 839026 - DNA, 25 bp, Mus musculus
tcttgaggagttacgtagaactacc

SEQ ID NO: 839027 - DNA, 25 bp, Mus musculus
tcttgaggagtttcgtagaactacc

SEQ ID NO: 839028 - DNA, 25 bp, Mus musculus
tcttgaggcaccaggcagagtttat

SEQ ID NO: 839029 - DNA, 25 bp, Mus musculus
tcttgaggcacctggcagagtttat

SEQ ID NO: 839030 - DNA, 25 bp, Mus musculus
tcttgaggcagacagagtcccttat

SEQ ID NO: 839031 - DNA, 25 bp, Mus musculus
tcttgaggcagagagagtcccttat

SEQ ID NO: 839032 - DNA, 25 bp, Mus musculus
tcttgaggcagtcctccccggagga

SEQ ID NO: 839033 - DNA, 25 bp, Mus musculus
tcttgaggcagtgctccccggagga

SEQ ID NO: 839034 - DNA, 25 bp, Mus musculus
tcttgaggctcacaggtaacatcta

SEQ ID NO: 839035 - DNA, 25 bp, Mus musculus
tcttgaggctcagaggtaacatcta

SEQ ID NO: 839036 - DNA, 25 bp, Mus musculus
tcttgagggcctagcctactcattt

SEQ ID NO: 839037 - DNA, 25 bp, Mus musculus
tcttgagggccttgcctactcattt

SEQ ID NO: 839038 - DNA, 25 bp, Mus musculus
tcttgaggtaggaggacccacccac

SEQ ID NO: 839039 - DNA, 25 bp, Mus musculus
tcttgaggtaggtggacccacccac

SEQ ID NO: 839040 - DNA, 25 bp, Mus musculus
tcttgaggtcctcgaatgtcctgga

SEQ ID NO: 839041 - DNA, 25 bp, Mus musculus
tcttgaggtcctggaatgtcctgga

SEQ ID NO: 839042 - DNA, 25 bp, Mus musculus
tcttgaggttcacgtatgtcctaat

SEQ ID NO: 839043 - DNA, 25 bp, Mus musculus
tcttgaggttcaggtatgtcctaat

SEQ ID NO: 839044 - DNA, 25 bp, Mus musculus
tcttgaggttgtatgatgctttaaa

SEQ ID NO: 839045 - DNA, 25 bp, Mus musculus
tcttgaggttgtttgatgctttaaa

SEQ ID NO: 839046 - DNA, 25 bp, Mus musculus
tcttgaggtttaaggacgacaactt

SEQ ID NO: 839047 - DNA, 25 bp, Mus musculus
tcttgaggtttatggacgacaactt

SEQ ID NO: 839048 - DNA, 25 bp, Mus musculus
tcttgaggtttgcagttttcgctca

SEQ ID NO: 839049 - DNA, 25 bp, Mus musculus
tcttgaggtttggagttttcgctca

SEQ ID NO: 839050 - DNA, 25 bp, Mus musculus
tcttgagtaacaaaccctgtatgaa

SEQ ID NO: 839051 - DNA, 25 bp, Mus musculus
tcttgagtaacataccctgtatgaa

SEQ ID NO: 839052 - DNA, 25 bp, Mus musculus
tcttgagtatccatgtctcgctgaa

SEQ ID NO: 839053 - DNA, 25 bp, Mus musculus
tcttgagtatccttgtctcgctgaa

SEQ ID NO: 839054 - DNA, 25 bp, Mus musculus
tcttgagtcatcctgcttccaaaca

SEQ ID NO: 839055 - DNA, 25 bp, Mus musculus
tcttgagtcatcgtgcttccaaaca

SEQ ID NO: 839056 - DNA, 25 bp, Mus musculus
tcttgagtgctcctcctttcctgga

SEQ ID NO: 839057 - DNA, 25 bp, Mus musculus
tcttgagtgctcgtcctttcctgga

SEQ ID NO: 839058 - DNA, 25 bp, Mus musculus
tcttgagttcaaaccactccctgaa

SEQ ID NO: 839059 - DNA, 25 bp, Mus musculus
tcttgagttcaatccactccctgaa

SEQ ID NO: 839060 - DNA, 25 bp, Mus musculus
tcttgagttccactatgagatggcc

SEQ ID NO: 839061 - DNA, 25 bp, Mus musculus
tcttgagttccagtatgagatggcc

SEQ ID NO: 839062 - DNA, 25 bp, Mus musculus
tcttgagttcccacctttctagaat

SEQ ID NO: 839063 - DNA, 25 bp, Mus musculus
tcttgagttccctcctttctagaat

SEQ ID NO: 839064 - DNA, 25 bp, Mus musculus
tcttgagttcctcctcagagaaatt

SEQ ID NO: 839065 - DNA, 25 bp, Mus musculus
tcttgagttcctgctcagagaaatt

SEQ ID NO: 839066 - DNA, 25 bp, Mus musculus
tcttgagttgtcatggtctccctac

SEQ ID NO: 839067 - DNA, 25 bp, Mus musculus
tcttgagttgtcttggtctccctac

SEQ ID NO: 839068 - DNA, 25 bp, Mus musculus
tcttgataaaggcaagaggacctct

SEQ ID NO: 839069 - DNA, 25 bp, Mus musculus
tcttgataaagggaagaggacctct

SEQ ID NO: 839070 - DNA, 25 bp, Mus musculus
tcttgatacagactgagaggcagta

SEQ ID NO: 839071 - DNA, 25 bp, Mus musculus
tcttgatacagagtgagaggcagta

SEQ ID NO: 839072 - DNA, 25 bp, Mus musculus
tcttgataccagacactccgagtgc

SEQ ID NO: 839073 - DNA, 25 bp, Mus musculus
tcttgataccagtcactccgagtgc

SEQ ID NO: 839074 - DNA, 25 bp, Mus musculus
tcttgatcaagaccctgttgttcga

SEQ ID NO: 839075 - DNA, 25 bp, Mus musculus
tcttgatcaagagcctgttgttcga

SEQ ID NO: 839076 - DNA, 25 bp, Mus musculus
tcttgatcacctattctggaaattg

SEQ ID NO: 839077 - DNA, 25 bp, Mus musculus
tcttgatcaccttttctggaaattg

SEQ ID NO: 839078 - DNA, 25 bp, Mus musculus
tcttgatcatggcacttgtaatcag

SEQ ID NO: 839079 - DNA, 25 bp, Mus musculus
tcttgatcatgggacttgtaatcag

SEQ ID NO: 839080 - DNA, 25 bp, Mus musculus
tcttgatccaatccctgtgcagcat

SEQ ID NO: 839081 - DNA, 25 bp, Mus musculus
tcttgatccaatgcctgtgcagcat

SEQ ID NO: 839082 - DNA, 25 bp, Mus musculus
tcttgatcccaaccagcactttaac

SEQ ID NO: 839083 - DNA, 25 bp, Mus musculus
tcttgatcccaagcagcactttaac

SEQ ID NO: 839084 - DNA, 25 bp, Mus musculus
tcttgatcctctcctatctttcttg

SEQ ID NO: 839085 - DNA, 25 bp, Mus musculus
tcttgatcctctgctatctttcttg

SEQ ID NO: 839086 - DNA, 25 bp, Mus musculus
tcttgatctgtgcaagggcactgaa

SEQ ID NO: 839087 - DNA, 25 bp, Mus musculus
tcttgatctgtggaagggcactgaa

SEQ ID NO: 839088 - DNA, 25 bp, Mus musculus
tcttgatgaaaactttggggcacct

SEQ ID NO: 839089 - DNA, 25 bp, Mus musculus
tcttgatgaaaagtttggggcacct

SEQ ID NO: 839090 - DNA, 25 bp, Mus musculus
tcttgatgacgactgctaagcacac

SEQ ID NO: 839091 - DNA, 25 bp, Mus musculus
tcttgatgacgagtgctaagcacac

SEQ ID NO: 839092 - DNA, 25 bp, Mus musculus
tcttgatgagcacggccggcccatc

SEQ ID NO: 839093 - DNA, 25 bp, Mus musculus
tcttgatgagcagggccggcccatc

SEQ ID NO: 839094 - DNA, 25 bp, Mus musculus
tcttgatgccgaactggtattttct

SEQ ID NO: 839095 - DNA, 25 bp, Mus musculus
tcttgatgccgatctggtattttct

SEQ ID NO: 839096 - DNA, 25 bp, Mus musculus
tcttgatgctttcctccttgagaat

SEQ ID NO: 839097 - DNA, 25 bp, Mus musculus
tcttgatgctttgctccttgagaat

SEQ ID NO: 839098 - DNA, 25 bp, Mus musculus
tcttgattacccacggctgttgcaa

SEQ ID NO: 839099 - DNA, 25 bp, Mus musculus
tcttgattaccctcggctgttgcaa

SEQ ID NO: 839100 - DNA, 25 bp, Mus musculus
tcttgattccaacctcgagtgagta

SEQ ID NO: 839101 - DNA, 25 bp, Mus musculus
tcttgattccaagctcgagtgagta

SEQ ID NO: 839102 - DNA, 25 bp, Mus musculus
tcttgattctccagaggctgtttga

SEQ ID NO: 839103 - DNA, 25 bp, Mus musculus
tcttgattctcctgaggctgtttga

SEQ ID NO: 839104 - DNA, 25 bp, Mus musculus
tcttgattcttgagtcatcggaggt

SEQ ID NO: 839105 - DNA, 25 bp, Mus musculus
tcttgattcttgtgtcatcggaggt

SEQ ID NO: 839106 - DNA, 25 bp, Mus musculus
tcttgattgattaaacaacgcccga

SEQ ID NO: 839107 - DNA, 25 bp, Mus musculus
tcttgattgatttaacaacgcccga

SEQ ID NO: 839108 - DNA, 25 bp, Mus musculus
tcttgattgctaatctcttaccaac

SEQ ID NO: 839109 - DNA, 25 bp, Mus musculus
tcttgattgctattctcttaccaac

SEQ ID NO: 839110 - DNA, 25 bp, Mus musculus
tcttgattggctatgcagaaataaa

SEQ ID NO: 839111 - DNA, 25 bp, Mus musculus
tcttgattggctttgcagaaataaa

SEQ ID NO: 839112 - DNA, 25 bp, Mus musculus
tcttgattgtccctgtgactgctgc

SEQ ID NO: 839113 - DNA, 25 bp, Mus musculus
tcttgattgtccgtgtgactgctgc

SEQ ID NO: 839114 - DNA, 25 bp, Mus musculus
tcttgcaaacccatgtgaactgaag

SEQ ID NO: 839115 - DNA, 25 bp, Mus musculus
tcttgcaaacccttgtgaactgaag

SEQ ID NO: 839116 - DNA, 25 bp, Mus musculus
tcttgcaacagacttcaccttcgaa

SEQ ID NO: 839117 - DNA, 25 bp, Mus musculus
tcttgcaacagagttcaccttcgaa

SEQ ID NO: 839118 - DNA, 25 bp, Mus musculus
tcttgcaacgccaagttccttcaga

SEQ ID NO: 839119 - DNA, 25 bp, Mus musculus
tcttgcaacgcctagttccttcaga

SEQ ID NO: 839120 - DNA, 25 bp, Mus musculus
tcttgcaagtatcaggacactggaa

SEQ ID NO: 839121 - DNA, 25 bp, Mus musculus
tcttgcaagtatgaggacactggaa

SEQ ID NO: 839122 - DNA, 25 bp, Mus musculus
tcttgcaattgtctggaagtagttt

SEQ ID NO: 839123 - DNA, 25 bp, Mus musculus
tcttgcaattgtgtggaagtagttt

SEQ ID NO: 839124 - DNA, 25 bp, Mus musculus
tcttgcacaaaaatgatcgtttcct

SEQ ID NO: 839125 - DNA, 25 bp, Mus musculus
tcttgcacaaaattgatcgtttcct

SEQ ID NO: 839126 - DNA, 25 bp, Mus musculus
tcttgcacacaaacttttttacttc

SEQ ID NO: 839127 - DNA, 25 bp, Mus musculus
tcttgcacacaatcttttttacttc

SEQ ID NO: 839128 - DNA, 25 bp, Mus musculus
tcttgcacacgcacacggcgagggt

SEQ ID NO: 839129 - DNA, 25 bp, Mus musculus
tcttgcacacgctcacggcgagggt

SEQ ID NO: 839130 - DNA, 25 bp, Mus musculus
tcttgcacactgattccagcttctc

SEQ ID NO: 839131 - DNA, 25 bp, Mus musculus
tcttgcacactgtttccagcttctc

SEQ ID NO: 839132 - DNA, 25 bp, Mus musculus
tcttgcacagggatccagtgttttt

SEQ ID NO: 839133 - DNA, 25 bp, Mus musculus
tcttgcacagggttccagtgttttt

SEQ ID NO: 839134 - DNA, 25 bp, Mus musculus
tcttgcacctttcagcttcttcgta

SEQ ID NO: 839135 - DNA, 25 bp, Mus musculus
tcttgcacctttgagcttcttcgta

SEQ ID NO: 839136 - DNA, 25 bp, Mus musculus
tcttgcacgaggctgaaggccacat

SEQ ID NO: 839137 - DNA, 25 bp, Mus musculus
tcttgcacgagggtgaaggccacat

SEQ ID NO: 839138 - DNA, 25 bp, Mus musculus
tcttgcactacgagggctccaggga

SEQ ID NO: 839139 - DNA, 25 bp, Mus musculus
tcttgcactacgtgggctccaggga

SEQ ID NO: 839140 - DNA, 25 bp, Mus musculus
tcttgcagacacaagcattttaagg

SEQ ID NO: 839141 - DNA, 25 bp, Mus musculus
tcttgcagacactagcattttaagg

SEQ ID NO: 839142 - DNA, 25 bp, Mus musculus
tcttgcagaggcatgagttttgttc

SEQ ID NO: 839143 - DNA, 25 bp, Mus musculus
tcttgcagaggcttgagttttgttc

SEQ ID NO: 839144 - DNA, 25 bp, Mus musculus
tcttgcagagggaccaggaactctt

SEQ ID NO: 839145 - DNA, 25 bp, Mus musculus
tcttgcagagggtccaggaactctt

SEQ ID NO: 839146 - DNA, 25 bp, Mus musculus
tcttgcagcgtacgtgggttgtaca

SEQ ID NO: 839147 - DNA, 25 bp, Mus musculus
tcttgcagcgtaggtgggttgtaca

SEQ ID NO: 839148 - DNA, 25 bp, Mus musculus
tcttgcagctttaattccctgtgca

SEQ ID NO: 839149 - DNA, 25 bp, Mus musculus
tcttgcagcttttattccctgtgca

SEQ ID NO: 839150 - DNA, 25 bp, Mus musculus
tcttgcagtctgacctcatgctggt

SEQ ID NO: 839151 - DNA, 25 bp, Mus musculus
tcttgcagtctgtcctcatgctggt

SEQ ID NO: 839152 - DNA, 25 bp, Mus musculus
tcttgcagtggtcctttagatctgt

SEQ ID NO: 839153 - DNA, 25 bp, Mus musculus
tcttgcagtggtgctttagatctgt

SEQ ID NO: 839154 - DNA, 25 bp, Mus musculus
tcttgcagttttctacagtatttga

SEQ ID NO: 839155 - DNA, 25 bp, Mus musculus
tcttgcagttttgtacagtatttga

SEQ ID NO: 839156 - DNA, 25 bp, Mus musculus
tcttgcatctctcgattcctttttt

SEQ ID NO: 839157 - DNA, 25 bp, Mus musculus
tcttgcatctctggattcctttttt

SEQ ID NO: 839158 - DNA, 25 bp, Mus musculus
tcttgcatgattattccatgggcta

SEQ ID NO: 839159 - DNA, 25 bp, Mus musculus
tcttgcatgatttttccatgggcta

SEQ ID NO: 839160 - DNA, 25 bp, Mus musculus
tcttgcatgccacattccttcataa

SEQ ID NO: 839161 - DNA, 25 bp, Mus musculus
tcttgcatgccagattccttcataa

SEQ ID NO: 839162 - DNA, 25 bp, Mus musculus
tcttgcatgcttaacctatccagca

SEQ ID NO: 839163 - DNA, 25 bp, Mus musculus
tcttgcatgctttacctatccagca

SEQ ID NO: 839164 - DNA, 25 bp, Mus musculus
tcttgcattcccatcactcatgtga

SEQ ID NO: 839165 - DNA, 25 bp, Mus musculus
tcttgcattcccttcactcatgtga

SEQ ID NO: 839166 - DNA, 25 bp, Mus musculus
tcttgcattttgagcatggagtaac

SEQ ID NO: 839167 - DNA, 25 bp, Mus musculus
tcttgcattttgtgcatggagtaac

SEQ ID NO: 839168 - DNA, 25 bp, Mus musculus
tcttgccaaagacagctactcttct

SEQ ID NO: 839169 - DNA, 25 bp, Mus musculus
tcttgccaaagagagctactcttct

SEQ ID NO: 839170 - DNA, 25 bp, Mus musculus
tcttgccaatggattttgtttcgtt

SEQ ID NO: 839171 - DNA, 25 bp, Mus musculus
tcttgccaatggtttttgtttcgtt

SEQ ID NO: 839172 - DNA, 25 bp, Mus musculus
tcttgccacacacgctctgggtgaa

SEQ ID NO: 839173 - DNA, 25 bp, Mus musculus
tcttgccacacaggctctgggtgaa

SEQ ID NO: 839174 - DNA, 25 bp, Mus musculus
tcttgccactgtctggtggttatat

SEQ ID NO: 839175 - DNA, 25 bp, Mus musculus
tcttgccactgtgtggtggttatat

SEQ ID NO: 839176 - DNA, 25 bp, Mus musculus
tcttgccagagaaccaattgatgct

SEQ ID NO: 839177 - DNA, 25 bp, Mus musculus
tcttgccagagatccaattgatgct

SEQ ID NO: 839178 - DNA, 25 bp, Mus musculus
tcttgccagatgctacgaggttcca

SEQ ID NO: 839179 - DNA, 25 bp, Mus musculus
tcttgccagatggtacgaggttcca

SEQ ID NO: 839180 - DNA, 25 bp, Mus musculus
tcttgccagcttaaccagaggtcag

SEQ ID NO: 839181 - DNA, 25 bp, Mus musculus
tcttgccagctttaccagaggtcag

SEQ ID NO: 839182 - DNA, 25 bp, Mus musculus
tcttgccatctgatggtaatttaca

SEQ ID NO: 839183 - DNA, 25 bp, Mus musculus
tcttgccatctgttggtaatttaca

SEQ ID NO: 839184 - DNA, 25 bp, Mus musculus
tcttgccattgtaacctccggagaa

SEQ ID NO: 839185 - DNA, 25 bp, Mus musculus
tcttgccattgttacctccggagaa

SEQ ID NO: 839186 - DNA, 25 bp, Mus musculus
tcttgcccaaagatctcaactgtgt

SEQ ID NO: 839187 - DNA, 25 bp, Mus musculus
tcttgcccaaagttctcaactgtgt

SEQ ID NO: 839188 - DNA, 25 bp, Mus musculus
tcttgcccagacaatataatggctt

SEQ ID NO: 839189 - DNA, 25 bp, Mus musculus
tcttgcccagactatataatggctt

SEQ ID NO: 839190 - DNA, 25 bp, Mus musculus
tcttgcccaggtagccaggagactg

SEQ ID NO: 839191 - DNA, 25 bp, Mus musculus
tcttgcccaggttgccaggagactg

SEQ ID NO: 839192 - DNA, 25 bp, Mus musculus
tcttgcccatgaagcgcccattgtt

SEQ ID NO: 839193 - DNA, 25 bp, Mus musculus
tcttgcccatgatgcgcccattgtt

SEQ ID NO: 839194 - DNA, 25 bp, Mus musculus
tcttgcccatggatccaaagaagtc

SEQ ID NO: 839195 - DNA, 25 bp, Mus musculus
tcttgcccatggttccaaagaagtc

SEQ ID NO: 839196 - DNA, 25 bp, Mus musculus
tcttgccccagacttcatccttagg

SEQ ID NO: 839197 - DNA, 25 bp, Mus musculus
tcttgccccagagttcatccttagg

SEQ ID NO: 839198 - DNA, 25 bp, Mus musculus
tcttgcccgagaagcccgaggtgcc

SEQ ID NO: 839199 - DNA, 25 bp, Mus musculus
tcttgcccgagatgcccgaggtgcc

SEQ ID NO: 839200 - DNA, 25 bp, Mus musculus
tcttgcccgcctcattaataaagtg

SEQ ID NO: 839201 - DNA, 25 bp, Mus musculus
tcttgcccgcctgattaataaagtg

SEQ ID NO: 839202 - DNA, 25 bp, Mus musculus
tcttgccctatgcaacagcccgggt

SEQ ID NO: 839203 - DNA, 25 bp, Mus musculus
tcttgccctatggaacagcccgggt

SEQ ID NO: 839204 - DNA, 25 bp, Mus musculus
tcttgccctccaactcttaggattc

SEQ ID NO: 839205 - DNA, 25 bp, Mus musculus
tcttgccctccatctcttaggattc

SEQ ID NO: 839206 - DNA, 25 bp, Mus musculus
tcttgccctgctcaggacaaggtta

SEQ ID NO: 839207 - DNA, 25 bp, Mus musculus
tcttgccctgctgaggacaaggtta

SEQ ID NO: 839208 - DNA, 25 bp, Mus musculus
tcttgccctggtctgtctttgttca

SEQ ID NO: 839209 - DNA, 25 bp, Mus musculus
tcttgccctggtgtgtctttgttca

SEQ ID NO: 839210 - DNA, 25 bp, Mus musculus
tcttgccctttgaggagagtgacct

SEQ ID NO: 839211 - DNA, 25 bp, Mus musculus
tcttgccctttgtggagagtgacct

SEQ ID NO: 839212 - DNA, 25 bp, Mus musculus
tcttgccggcctctggatacatcaa

SEQ ID NO: 839213 - DNA, 25 bp, Mus musculus
tcttgccggcctgtggatacatcaa

SEQ ID NO: 839214 - DNA, 25 bp, Mus musculus
tcttgccggctccatggatatttag

SEQ ID NO: 839215 - DNA, 25 bp, Mus musculus
tcttgccggctcgatggatatttag

SEQ ID NO: 839216 - DNA, 25 bp, Mus musculus
tcttgccgtgtgatgggatgtgctt

SEQ ID NO: 839217 - DNA, 25 bp, Mus musculus
tcttgccgtgtgttgggatgtgctt

SEQ ID NO: 839218 - DNA, 25 bp, Mus musculus
tcttgcctaaggatcagtggacaaa

SEQ ID NO: 839219 - DNA, 25 bp, Mus musculus
tcttgcctaaggttcagtggacaaa

SEQ ID NO: 839220 - DNA, 25 bp, Mus musculus
tcttgcctagctatgtgacacttat

SEQ ID NO: 839221 - DNA, 25 bp, Mus musculus
tcttgcctagctttgtgacacttat

SEQ ID NO: 839222 - DNA, 25 bp, Mus musculus
tcttgcctatgaaagtttgcctgtt

SEQ ID NO: 839223 - DNA, 25 bp, Mus musculus
tcttgcctatgatagtttgcctgtt

SEQ ID NO: 839224 - DNA, 25 bp, Mus musculus
tcttgcctccaaattcagtgatttc

SEQ ID NO: 839225 - DNA, 25 bp, Mus musculus
tcttgcctccaatttcagtgatttc

SEQ ID NO: 839226 - DNA, 25 bp, Mus musculus
tcttgcctccacatactgtacaaac

SEQ ID NO: 839227 - DNA, 25 bp, Mus musculus
tcttgcctccacttactgtacaaac

SEQ ID NO: 839228 - DNA, 25 bp, Mus musculus
tcttgcctccatcttcaactgtata

SEQ ID NO: 839229 - DNA, 25 bp, Mus musculus
tcttgcctccatgttcaactgtata

SEQ ID NO: 839230 - DNA, 25 bp, Mus musculus
tcttgcctcggtacccaaataggaa

SEQ ID NO: 839231 - DNA, 25 bp, Mus musculus
tcttgcctcggttcccaaataggaa

SEQ ID NO: 839232 - DNA, 25 bp, Mus musculus
tcttgcctctgcaattgaatctgtg

SEQ ID NO: 839233 - DNA, 25 bp, Mus musculus
tcttgcctctgctattgaatctgtg

SEQ ID NO: 839234 - DNA, 25 bp, Mus musculus
tcttgcctgcccatcaaggttaaag

SEQ ID NO: 839235 - DNA, 25 bp, Mus musculus
tcttgcctgcccttcaaggttaaag

SEQ ID NO: 839236 - DNA, 25 bp, Mus musculus
tcttgcctgctcatatatattcttt

SEQ ID NO: 839237 - DNA, 25 bp, Mus musculus
tcttgcctgctcttatatattcttt

SEQ ID NO: 839238 - DNA, 25 bp, Mus musculus
tcttgcctggttctagacagctttg

SEQ ID NO: 839239 - DNA, 25 bp, Mus musculus
tcttgcctggttgtagacagctttg

SEQ ID NO: 839240 - DNA, 25 bp, Mus musculus
tcttgcctgtctcagaaggtgctgg

SEQ ID NO: 839241 - DNA, 25 bp, Mus musculus
tcttgcctgtctgagaaggtgctgg

SEQ ID NO: 839242 - DNA, 25 bp, Mus musculus
tcttgcctgtggagacatgagggct

SEQ ID NO: 839243 - DNA, 25 bp, Mus musculus
tcttgcctgtggtgacatgagggct

SEQ ID NO: 839244 - DNA, 25 bp, Mus musculus
tcttgcctgttgacttccacttgta

SEQ ID NO: 839245 - DNA, 25 bp, Mus musculus
tcttgcctgttgtcttccacttgta

SEQ ID NO: 839246 - DNA, 25 bp, Mus musculus
tcttgccttatgatgaatttgtttg

SEQ ID NO: 839247 - DNA, 25 bp, Mus musculus
tcttgccttatgttgaatttgtttg

SEQ ID NO: 839248 - DNA, 25 bp, Mus musculus
tcttgccttgcaaattggaacactt

SEQ ID NO: 839249 - DNA, 25 bp, Mus musculus
tcttgccttgcatattggaacactt

SEQ ID NO: 839250 - DNA, 25 bp, Mus musculus
tcttgccttggaaccatttctcttt

SEQ ID NO: 839251 - DNA, 25 bp, Mus musculus
tcttgccttggatccatttctcttt

SEQ ID NO: 839252 - DNA, 25 bp, Mus musculus
tcttgccttggcatttcttaatagt

SEQ ID NO: 839253 - DNA, 25 bp, Mus musculus
tcttgccttggcttttcttaatagt

SEQ ID NO: 839254 - DNA, 25 bp, Mus musculus
tcttgccttgttaactggacttgag

SEQ ID NO: 839255 - DNA, 25 bp, Mus musculus
tcttgccttgtttactggacttgag

SEQ ID NO: 839256 - DNA, 25 bp, Mus musculus
tcttgcctttccactgtgttgataa

SEQ ID NO: 839257 - DNA, 25 bp, Mus musculus
tcttgcctttcctctgtgttgataa

SEQ ID NO: 839258 - DNA, 25 bp, Mus musculus
tcttgcctttgtcttaatgctttaa

SEQ ID NO: 839259 - DNA, 25 bp, Mus musculus
tcttgcctttgtgttaatgctttaa

SEQ ID NO: 839260 - DNA, 25 bp, Mus musculus
tcttgccttttgacatggagtgcta

SEQ ID NO: 839261 - DNA, 25 bp, Mus musculus
tcttgccttttgtcatggagtgcta

SEQ ID NO: 839262 - DNA, 25 bp, Mus musculus
tcttgcgatacactctggtgctcaa

SEQ ID NO: 839263 - DNA, 25 bp, Mus musculus
tcttgcgatacagtctggtgctcaa

SEQ ID NO: 839264 - DNA, 25 bp, Mus musculus
tcttgcgcttataactggagagttt

SEQ ID NO: 839265 - DNA, 25 bp, Mus musculus
tcttgcgcttattactggagagttt

SEQ ID NO: 839266 - DNA, 25 bp, Mus musculus
tcttgcggccttcgatctggttatc

SEQ ID NO: 839267 - DNA, 25 bp, Mus musculus
tcttgcggccttggatctggttatc

SEQ ID NO: 839268 - DNA, 25 bp, Mus musculus
tcttgcgggcagctaaactttgaag

SEQ ID NO: 839269 - DNA, 25 bp, Mus musculus
tcttgcgggcaggtaaactttgaag

SEQ ID NO: 839270 - DNA, 25 bp, Mus musculus
tcttgcgggccacctcacagttagc

SEQ ID NO: 839271 - DNA, 25 bp, Mus musculus
tcttgcgggccagctcacagttagc

SEQ ID NO: 839272 - DNA, 25 bp, Mus musculus
tcttgcgtctgcctttaccttttta

SEQ ID NO: 839273 - DNA, 25 bp, Mus musculus
tcttgcgtctgcgtttaccttttta

SEQ ID NO: 839274 - DNA, 25 bp, Mus musculus
tcttgcgtgtataatgttccttctc

SEQ ID NO: 839275 - DNA, 25 bp, Mus musculus
tcttgcgtgtattatgttccttctc

SEQ ID NO: 839276 - DNA, 25 bp, Mus musculus
tcttgcgttccccagaggaagttag

SEQ ID NO: 839277 - DNA, 25 bp, Mus musculus
tcttgcgttcccgagaggaagttag

SEQ ID NO: 839278 - DNA, 25 bp, Mus musculus
tcttgcgttggtactggtattctaa

SEQ ID NO: 839279 - DNA, 25 bp, Mus musculus
tcttgcgttggttctggtattctaa

SEQ ID NO: 839280 - DNA, 25 bp, Mus musculus
tcttgctaaacccactggcatgtgt

SEQ ID NO: 839281 - DNA, 25 bp, Mus musculus
tcttgctaaaccgactggcatgtgt

SEQ ID NO: 839282 - DNA, 25 bp, Mus musculus
tcttgctaatctaggaaccgccgag

SEQ ID NO: 839283 - DNA, 25 bp, Mus musculus
tcttgctaatcttggaaccgccgag

SEQ ID NO: 839284 - DNA, 25 bp, Mus musculus
tcttgctatcagcaccacagcggaa

SEQ ID NO: 839285 - DNA, 25 bp, Mus musculus
tcttgctatcaggaccacagcggaa

SEQ ID NO: 839286 - DNA, 25 bp, Mus musculus
tcttgctattcacctgctctgcagg

SEQ ID NO: 839287 - DNA, 25 bp, Mus musculus
tcttgctattcagctgctctgcagg

SEQ ID NO: 839288 - DNA, 25 bp, Mus musculus
tcttgctattccaagatctggtcat

SEQ ID NO: 839289 - DNA, 25 bp, Mus musculus
tcttgctattcctagatctggtcat

SEQ ID NO: 839290 - DNA, 25 bp, Mus musculus
tcttgctattctcaactcagctggc

SEQ ID NO: 839291 - DNA, 25 bp, Mus musculus
tcttgctattctgaactcagctggc

SEQ ID NO: 839292 - DNA, 25 bp, Mus musculus
tcttgctattgcaatggtacgcttt

SEQ ID NO: 839293 - DNA, 25 bp, Mus musculus
tcttgctattgctatggtacgcttt

SEQ ID NO: 839294 - DNA, 25 bp, Mus musculus
tcttgctcaatgcttttccctttca

SEQ ID NO: 839295 - DNA, 25 bp, Mus musculus
tcttgctcaatggttttccctttca

SEQ ID NO: 839296 - DNA, 25 bp, Mus musculus
tcttgctcagctagaatagtgactg

SEQ ID NO: 839297 - DNA, 25 bp, Mus musculus
tcttgctcagcttgaatagtgactg

SEQ ID NO: 839298 - DNA, 25 bp, Mus musculus
tcttgctccagtaaggcctctaatc

SEQ ID NO: 839299 - DNA, 25 bp, Mus musculus
tcttgctccagttaggcctctaatc

SEQ ID NO: 839300 - DNA, 25 bp, Mus musculus
tcttgctcccatatgcacatggaac

SEQ ID NO: 839301 - DNA, 25 bp, Mus musculus
tcttgctcccatttgcacatggaac

SEQ ID NO: 839302 - DNA, 25 bp, Mus musculus
tcttgctccccaaatcatcaaatat

SEQ ID NO: 839303 - DNA, 25 bp, Mus musculus
tcttgctccccatatcatcaaatat

SEQ ID NO: 839304 - DNA, 25 bp, Mus musculus
tcttgctcccctcaaatgttgagac

SEQ ID NO: 839305 - DNA, 25 bp, Mus musculus
tcttgctcccctgaaatgttgagac

SEQ ID NO: 839306 - DNA, 25 bp, Mus musculus
tcttgctcccgtcgaccatgaatat

SEQ ID NO: 839307 - DNA, 25 bp, Mus musculus
tcttgctcccgtggaccatgaatat

SEQ ID NO: 839308 - DNA, 25 bp, Mus musculus
tcttgctcctggcttcaagacagag

SEQ ID NO: 839309 - DNA, 25 bp, Mus musculus
tcttgctcctgggttcaagacagag

SEQ ID NO: 839310 - DNA, 25 bp, Mus musculus
tcttgctcgcatcagcagttttcct

SEQ ID NO: 839311 - DNA, 25 bp, Mus musculus
tcttgctcgcatgagcagttttcct

SEQ ID NO: 839312 - DNA, 25 bp, Mus musculus
tcttgctctgaccttgttctgaaaa

SEQ ID NO: 839313 - DNA, 25 bp, Mus musculus
tcttgctctgacgttgttctgaaaa

SEQ ID NO: 839314 - DNA, 25 bp, Mus musculus
tcttgctcttgaaacagactgagag

SEQ ID NO: 839315 - DNA, 25 bp, Mus musculus
tcttgctcttgatacagactgagag

SEQ ID NO: 839316 - DNA, 25 bp, Mus musculus
tcttgctcttggaggacacgcataa

SEQ ID NO: 839317 - DNA, 25 bp, Mus musculus
tcttgctcttggtggacacgcataa

SEQ ID NO: 839318 - DNA, 25 bp, Mus musculus
tcttgctctttcagactctggatac

SEQ ID NO: 839319 - DNA, 25 bp, Mus musculus
tcttgctctttctgactctggatac

SEQ ID NO: 839320 - DNA, 25 bp, Mus musculus
tcttgctgaagccaccttttcatat

SEQ ID NO: 839321 - DNA, 25 bp, Mus musculus
tcttgctgaagcgaccttttcatat

SEQ ID NO: 839322 - DNA, 25 bp, Mus musculus
tcttgctgacaacatttgcctctgc

SEQ ID NO: 839323 - DNA, 25 bp, Mus musculus
tcttgctgacaagatttgcctctgc

SEQ ID NO: 839324 - DNA, 25 bp, Mus musculus
tcttgctgacccagagctatgctca

SEQ ID NO: 839325 - DNA, 25 bp, Mus musculus
tcttgctgaccctgagctatgctca

SEQ ID NO: 839326 - DNA, 25 bp, Mus musculus
tcttgctgagcaatgttgacattag

SEQ ID NO: 839327 - DNA, 25 bp, Mus musculus
tcttgctgagcattgttgacattag

SEQ ID NO: 839328 - DNA, 25 bp, Mus musculus
tcttgctgagggatgccacaccggg

SEQ ID NO: 839329 - DNA, 25 bp, Mus musculus
tcttgctgagggttgccacaccggg

SEQ ID NO: 839330 - DNA, 25 bp, Mus musculus
tcttgctgcactcctcttaaatagg

SEQ ID NO: 839331 - DNA, 25 bp, Mus musculus
tcttgctgcactgctcttaaatagg

SEQ ID NO: 839332 - DNA, 25 bp, Mus musculus
tcttgctgcagcatccacctagaag

SEQ ID NO: 839333 - DNA, 25 bp, Mus musculus
tcttgctgcagcttccacctagaag

SEQ ID NO: 839334 - DNA, 25 bp, Mus musculus
tcttgctgcattaattcaccatcca

SEQ ID NO: 839335 - DNA, 25 bp, Mus musculus
tcttgctgcatttattcaccatcca

SEQ ID NO: 839336 - DNA, 25 bp, Mus musculus
tcttgctgccacacgacagaggaag

SEQ ID NO: 839337 - DNA, 25 bp, Mus musculus
tcttgctgccactcgacagaggaag

SEQ ID NO: 839338 - DNA, 25 bp, Mus musculus
tcttgctgcggccttcactgtaagg

SEQ ID NO: 839339 - DNA, 25 bp, Mus musculus
tcttgctgcggcgttcactgtaagg

SEQ ID NO: 839340 - DNA, 25 bp, Mus musculus
tcttgctgctacaactggcagccaa

SEQ ID NO: 839341 - DNA, 25 bp, Mus musculus
tcttgctgctactactggcagccaa

SEQ ID NO: 839342 - DNA, 25 bp, Mus musculus
tcttgctgctttcgtatcaaataat

SEQ ID NO: 839343 - DNA, 25 bp, Mus musculus
tcttgctgctttggtatcaaataat

SEQ ID NO: 839344 - DNA, 25 bp, Mus musculus
tcttgctggagcaagccatcctggt

SEQ ID NO: 839345 - DNA, 25 bp, Mus musculus
tcttgctggagctagccatcctggt

SEQ ID NO: 839346 - DNA, 25 bp, Mus musculus
tcttgctgggacaggagcttgttgc

SEQ ID NO: 839347 - DNA, 25 bp, Mus musculus
tcttgctgggactggagcttgttgc

SEQ ID NO: 839348 - DNA, 25 bp, Mus musculus
tcttgctgtcagacctgtagtcaaa

SEQ ID NO: 839349 - DNA, 25 bp, Mus musculus
tcttgctgtcagtcctgtagtcaaa

SEQ ID NO: 839350 - DNA, 25 bp, Mus musculus
tcttgctgtccgagaaaacttatgt

SEQ ID NO: 839351 - DNA, 25 bp, Mus musculus
tcttgctgtccgtgaaaacttatgt

SEQ ID NO: 839352 - DNA, 25 bp, Mus musculus
tcttgctgtctgaaaccttttgttt

SEQ ID NO: 839353 - DNA, 25 bp, Mus musculus
tcttgctgtctgtaaccttttgttt

SEQ ID NO: 839354 - DNA, 25 bp, Mus musculus
tcttgctgtgaaccctacatatcta

SEQ ID NO: 839355 - DNA, 25 bp, Mus musculus
tcttgctgtgaagcctacatatcta

SEQ ID NO: 839356 - DNA, 25 bp, Mus musculus
tcttgctgtgtcctcactcgagcat

SEQ ID NO: 839357 - DNA, 25 bp, Mus musculus
tcttgctgtgtcgtcactcgagcat

SEQ ID NO: 839358 - DNA, 25 bp, Mus musculus
tcttgcttacacagtgcctgatcac

SEQ ID NO: 839359 - DNA, 25 bp, Mus musculus
tcttgcttacactgtgcctgatcac

SEQ ID NO: 839360 - DNA, 25 bp, Mus musculus
tcttgcttatatcctgtcaagctat

SEQ ID NO: 839361 - DNA, 25 bp, Mus musculus
tcttgcttatatgctgtcaagctat

SEQ ID NO: 839362 - DNA, 25 bp, Mus musculus
tcttgcttattcctgctaccaaggg

SEQ ID NO: 839363 - DNA, 25 bp, Mus musculus
tcttgcttattcgtgctaccaaggg

SEQ ID NO: 839364 - DNA, 25 bp, Mus musculus
tcttgcttcataacgagtggctgtc

SEQ ID NO: 839365 - DNA, 25 bp, Mus musculus
tcttgcttcatatcgagtggctgtc

SEQ ID NO: 839366 - DNA, 25 bp, Mus musculus
tcttgcttcattcagagtttgtgct

SEQ ID NO: 839367 - DNA, 25 bp, Mus musculus
tcttgcttcattgagagtttgtgct

SEQ ID NO: 839368 - DNA, 25 bp, Mus musculus
tcttgcttccaaaggattgacagta

SEQ ID NO: 839369 - DNA, 25 bp, Mus musculus
tcttgcttccaatggattgacagta

SEQ ID NO: 839370 - DNA, 25 bp, Mus musculus
tcttgcttcctcaaaaccggtcaga

SEQ ID NO: 839371 - DNA, 25 bp, Mus musculus
tcttgcttcctctaaaccggtcaga

SEQ ID NO: 839372 - DNA, 25 bp, Mus musculus
tcttgcttctataaatgatttcggt

SEQ ID NO: 839373 - DNA, 25 bp, Mus musculus
tcttgcttctattaatgatttcggt

SEQ ID NO: 839374 - DNA, 25 bp, Mus musculus
tcttgcttctgcactgcgtggagta

SEQ ID NO: 839375 - DNA, 25 bp, Mus musculus
tcttgcttctgctctgcgtggagta

SEQ ID NO: 839376 - DNA, 25 bp, Mus musculus
tcttgcttgacacaccttaaatcaa

SEQ ID NO: 839377 - DNA, 25 bp, Mus musculus
tcttgcttgacagaccttaaatcaa

SEQ ID NO: 839378 - DNA, 25 bp, Mus musculus
tcttgcttgctcatcctaattagat

SEQ ID NO: 839379 - DNA, 25 bp, Mus musculus
tcttgcttgctcttcctaattagat

SEQ ID NO: 839380 - DNA, 25 bp, Mus musculus
tcttgctttaaccttaactctgggc

SEQ ID NO: 839381 - DNA, 25 bp, Mus musculus
tcttgctttaacgttaactctgggc

SEQ ID NO: 839382 - DNA, 25 bp, Mus musculus
tcttgctttaagcagttccactgaa

SEQ ID NO: 839383 - DNA, 25 bp, Mus musculus
tcttgctttaaggagttccactgaa

SEQ ID NO: 839384 - DNA, 25 bp, Mus musculus
tcttgctttacacatgagaatccac

SEQ ID NO: 839385 - DNA, 25 bp, Mus musculus
tcttgctttacagatgagaatccac

SEQ ID NO: 839386 - DNA, 25 bp, Mus musculus
tcttgctttcttaccctctgtcttt

SEQ ID NO: 839387 - DNA, 25 bp, Mus musculus
tcttgctttctttccctctgtcttt

SEQ ID NO: 839388 - DNA, 25 bp, Mus musculus
tcttgctttgaccatgtgatgagag

SEQ ID NO: 839389 - DNA, 25 bp, Mus musculus
tcttgctttgacgatgtgatgagag

SEQ ID NO: 839390 - DNA, 25 bp, Mus musculus
tcttgctttggactgcctctgtcaa

SEQ ID NO: 839391 - DNA, 25 bp, Mus musculus
tcttgctttggagtgcctctgtcaa

SEQ ID NO: 839392 - DNA, 25 bp, Mus musculus
tcttgctttgggaaaggtaaatcct

SEQ ID NO: 839393 - DNA, 25 bp, Mus musculus
tcttgctttgggtaaggtaaatcct

SEQ ID NO: 839394 - DNA, 25 bp, Mus musculus
tcttgctttggtctggactgccagg

SEQ ID NO: 839395 - DNA, 25 bp, Mus musculus
tcttgctttggtgtggactgccagg

SEQ ID NO: 839396 - DNA, 25 bp, Mus musculus
tcttgcttttatactctaatcgagg

SEQ ID NO: 839397 - DNA, 25 bp, Mus musculus
tcttgcttttatactgcagtcaaat

SEQ ID NO: 839398 - DNA, 25 bp, Mus musculus
tcttgcttttattctctaatcgagg

SEQ ID NO: 839399 - DNA, 25 bp, Mus musculus
tcttgcttttattctgcagtcaaat

SEQ ID NO: 839400 - DNA, 25 bp, Mus musculus
tcttgcttttcactgaggctatgct

SEQ ID NO: 839401 - DNA, 25 bp, Mus musculus
tcttgcttttcagtgaggctatgct

SEQ ID NO: 839402 - DNA, 25 bp, Mus musculus
tcttggaaaggaaacgatattcatc

SEQ ID NO: 839403 - DNA, 25 bp, Mus musculus
tcttggaaaggatacgatattcatc

SEQ ID NO: 839404 - DNA, 25 bp, Mus musculus
tcttggaaaggcaagcagatgtcag

SEQ ID NO: 839405 - DNA, 25 bp, Mus musculus
tcttggaaaggcatcccctttcttg

SEQ ID NO: 839406 - DNA, 25 bp, Mus musculus
tcttggaaaggctagcagatgtcag

SEQ ID NO: 839407 - DNA, 25 bp, Mus musculus
tcttggaaaggcttcccctttcttg

SEQ ID NO: 839408 - DNA, 25 bp, Mus musculus
tcttggaaattacatgcatcacatc

SEQ ID NO: 839409 - DNA, 25 bp, Mus musculus
tcttggaaattagatgcatcacatc

SEQ ID NO: 839410 - DNA, 25 bp, Mus musculus
tcttggaacaagatgctctggcttt

SEQ ID NO: 839411 - DNA, 25 bp, Mus musculus
tcttggaacaagttgctctggcttt

SEQ ID NO: 839412 - DNA, 25 bp, Mus musculus
tcttggaacagaacagtcgaacggt

SEQ ID NO: 839413 - DNA, 25 bp, Mus musculus
tcttggaacagatcagtcgaacggt

SEQ ID NO: 839414 - DNA, 25 bp, Mus musculus
tcttggaagggaaggagcaccactt

SEQ ID NO: 839415 - DNA, 25 bp, Mus musculus
tcttggaagggatggagcaccactt

SEQ ID NO: 839416 - DNA, 25 bp, Mus musculus
tcttggaatactacctcatgcagat

SEQ ID NO: 839417 - DNA, 25 bp, Mus musculus
tcttggaatacttcctcatgcagat

SEQ ID NO: 839418 - DNA, 25 bp, Mus musculus
tcttggaatcaacacctgacaataa

SEQ ID NO: 839419 - DNA, 25 bp, Mus musculus
tcttggaatcaagacctgacaataa

SEQ ID NO: 839420 - DNA, 25 bp, Mus musculus
tcttggaattacaagccccagggtt

SEQ ID NO: 839421 - DNA, 25 bp, Mus musculus
tcttggaattactagccccagggtt

SEQ ID NO: 839422 - DNA, 25 bp, Mus musculus
tcttggacatccactctcagggacc

SEQ ID NO: 839423 - DNA, 25 bp, Mus musculus
tcttggacatcctctctcagggacc

SEQ ID NO: 839424 - DNA, 25 bp, Mus musculus
tcttggacggtgatcagttctgttg

SEQ ID NO: 839425 - DNA, 25 bp, Mus musculus
tcttggacggtgttcagttctgttg

SEQ ID NO: 839426 - DNA, 25 bp, Mus musculus
tcttggactactatatccccacctg

SEQ ID NO: 839427 - DNA, 25 bp, Mus musculus
tcttggactactatggtggacctaa

SEQ ID NO: 839428 - DNA, 25 bp, Mus musculus
tcttggactactttatccccacctg

SEQ ID NO: 839429 - DNA, 25 bp, Mus musculus
tcttggactactttggtggacctaa

SEQ ID NO: 839430 - DNA, 25 bp, Mus musculus
tcttggactccacaattaaagctga

SEQ ID NO: 839431 - DNA, 25 bp, Mus musculus
tcttggactccagaattaaagctga

SEQ ID NO: 839432 - DNA, 25 bp, Mus musculus
tcttggactctgccatatttttata

SEQ ID NO: 839433 - DNA, 25 bp, Mus musculus
tcttggactctggcatatttttata

SEQ ID NO: 839434 - DNA, 25 bp, Mus musculus
tcttggactgttacctaccctaata

SEQ ID NO: 839435 - DNA, 25 bp, Mus musculus
tcttggactgtttcctaccctaata

SEQ ID NO: 839436 - DNA, 25 bp, Mus musculus
tcttggagcctcagatcttggacat

SEQ ID NO: 839437 - DNA, 25 bp, Mus musculus
tcttggagcctctgatcttggacat

SEQ ID NO: 839438 - DNA, 25 bp, Mus musculus
tcttggagcttacgcccctgttctt

SEQ ID NO: 839439 - DNA, 25 bp, Mus musculus
tcttggagcttaggcccctgttctt

SEQ ID NO: 839440 - DNA, 25 bp, Mus musculus
tcttggaggcttcgcgttttctgta

SEQ ID NO: 839441 - DNA, 25 bp, Mus musculus
tcttggaggcttggcgttttctgta

SEQ ID NO: 839442 - DNA, 25 bp, Mus musculus
tcttggagggtacctgttcccactg

SEQ ID NO: 839443 - DNA, 25 bp, Mus musculus
tcttggagggtagctgttcccactg

SEQ ID NO: 839444 - DNA, 25 bp, Mus musculus
tcttggatatggaacgggacaccct

SEQ ID NO: 839445 - DNA, 25 bp, Mus musculus
tcttggatatggtacgggacaccct

SEQ ID NO: 839446 - DNA, 25 bp, Mus musculus
tcttggatattcaactgtgtgttta

SEQ ID NO: 839447 - DNA, 25 bp, Mus musculus
tcttggatattctactgtgtgttta

SEQ ID NO: 839448 - DNA, 25 bp, Mus musculus
tcttggatccccatgaggaagagta

SEQ ID NO: 839449 - DNA, 25 bp, Mus musculus
tcttggatccccttgaggaagagta

SEQ ID NO: 839450 - DNA, 25 bp, Mus musculus
tcttggatgctgctgtggctactgc

SEQ ID NO: 839451 - DNA, 25 bp, Mus musculus
tcttggatgctggtgtggctactgc

SEQ ID NO: 839452 - DNA, 25 bp, Mus musculus
tcttggatggcgaaggacgcacttg

SEQ ID NO: 839453 - DNA, 25 bp, Mus musculus
tcttggatggcgtaggacgcacttg

SEQ ID NO: 839454 - DNA, 25 bp, Mus musculus
tcttggatgtcgaggaagctctgca

SEQ ID NO: 839455 - DNA, 25 bp, Mus musculus
tcttggatgtcgtggaagctctgca

SEQ ID NO: 839456 - DNA, 25 bp, Mus musculus
tcttggatgttcattgtccctactg

SEQ ID NO: 839457 - DNA, 25 bp, Mus musculus
tcttggatgttctttgtccctactg

SEQ ID NO: 839458 - DNA, 25 bp, Mus musculus
tcttggattgatctcagagcaactt

SEQ ID NO: 839459 - DNA, 25 bp, Mus musculus
tcttggattgatgtcagagcaactt

SEQ ID NO: 839460 - DNA, 25 bp, Mus musculus
tcttggatttttaccgtaggcggct

SEQ ID NO: 839461 - DNA, 25 bp, Mus musculus
tcttggattttttccgtaggcggct

SEQ ID NO: 839462 - DNA, 25 bp, Mus musculus
tcttggcaaagcaggtggttttaac

SEQ ID NO: 839463 - DNA, 25 bp, Mus musculus
tcttggcaaagctggtggttttaac

SEQ ID NO: 839464 - DNA, 25 bp, Mus musculus
tcttggcacactctacgcatgagaa

SEQ ID NO: 839465 - DNA, 25 bp, Mus musculus
tcttggcacactgtacgcatgagaa

SEQ ID NO: 839466 - DNA, 25 bp, Mus musculus
tcttggcacagaaggtcaggaccac

SEQ ID NO: 839467 - DNA, 25 bp, Mus musculus
tcttggcacagatggtcaggaccac

SEQ ID NO: 839468 - DNA, 25 bp, Mus musculus
tcttggcacctgaggacaaagtctg

SEQ ID NO: 839469 - DNA, 25 bp, Mus musculus
tcttggcacctgtggacaaagtctg

SEQ ID NO: 839470 - DNA, 25 bp, Mus musculus
tcttggcactgaagggcagcactgt

SEQ ID NO: 839471 - DNA, 25 bp, Mus musculus
tcttggcactgatgggcagcactgt

SEQ ID NO: 839472 - DNA, 25 bp, Mus musculus
tcttggcactttaacctgggcatat

SEQ ID NO: 839473 - DNA, 25 bp, Mus musculus
tcttggcacttttacctgggcatat

SEQ ID NO: 839474 - DNA, 25 bp, Mus musculus
tcttggcagaatcagtgttcagctt

SEQ ID NO: 839475 - DNA, 25 bp, Mus musculus
tcttggcagaatgagtgttcagctt

SEQ ID NO: 839476 - DNA, 25 bp, Mus musculus
tcttggcagactcagggttggttct

SEQ ID NO: 839477 - DNA, 25 bp, Mus musculus
tcttggcagactgagggttggttct

SEQ ID NO: 839478 - DNA, 25 bp, Mus musculus
tcttggcagggaccgacttatattc

SEQ ID NO: 839479 - DNA, 25 bp, Mus musculus
tcttggcagggagcgacttatattc

SEQ ID NO: 839480 - DNA, 25 bp, Mus musculus
tcttggcatagtattcctgcttttc

SEQ ID NO: 839481 - DNA, 25 bp, Mus musculus
tcttggcatagttttcctgcttttc

SEQ ID NO: 839482 - DNA, 25 bp, Mus musculus
tcttggcatctaaactacatttccc

SEQ ID NO: 839483 - DNA, 25 bp, Mus musculus
tcttggcatctatactacatttccc

SEQ ID NO: 839484 - DNA, 25 bp, Mus musculus
tcttggccagtgacatcgcagagaa

SEQ ID NO: 839485 - DNA, 25 bp, Mus musculus
tcttggccagtgtcatcgcagagaa

SEQ ID NO: 839486 - DNA, 25 bp, Mus musculus
tcttggccccagcacagatcagttt

SEQ ID NO: 839487 - DNA, 25 bp, Mus musculus
tcttggccccaggacagatcagttt

SEQ ID NO: 839488 - DNA, 25 bp, Mus musculus
tcttggccgctaatcgcggcgtgtc

SEQ ID NO: 839489 - DNA, 25 bp, Mus musculus
tcttggccgctattcgcggcgtgtc

SEQ ID NO: 839490 - DNA, 25 bp, Mus musculus
tcttggccgtcactgttatccagta

SEQ ID NO: 839491 - DNA, 25 bp, Mus musculus
tcttggccgtcagtgttatccagta

SEQ ID NO: 839492 - DNA, 25 bp, Mus musculus
tcttggccgttcacaatgattcgct

SEQ ID NO: 839493 - DNA, 25 bp, Mus musculus
tcttggccgttctcaatgattcgct

SEQ ID NO: 839494 - DNA, 25 bp, Mus musculus
tcttggcctggtactacatgtgaag

SEQ ID NO: 839495 - DNA, 25 bp, Mus musculus
tcttggcctggttctacatgtgaag

SEQ ID NO: 839496 - DNA, 25 bp, Mus musculus
tcttggccttgcaagggaggatcct

SEQ ID NO: 839497 - DNA, 25 bp, Mus musculus
tcttggccttgctagggaggatcct

SEQ ID NO: 839498 - DNA, 25 bp, Mus musculus
tcttggctgaagatgacaatgtaat

SEQ ID NO: 839499 - DNA, 25 bp, Mus musculus
tcttggctgaagttgacaatgtaat

SEQ ID NO: 839500 - DNA, 25 bp, Mus musculus
tcttggctgaatacccctagaacag

SEQ ID NO: 839501 - DNA, 25 bp, Mus musculus
tcttggctgaattcccctagaacag

SEQ ID NO: 839502 - DNA, 25 bp, Mus musculus
tcttggctgcgacatgatagacgac

SEQ ID NO: 839503 - DNA, 25 bp, Mus musculus
tcttggctgcgagatgatagacgac

SEQ ID NO: 839504 - DNA, 25 bp, Mus musculus
tcttggctggacagatcatccccac

SEQ ID NO: 839505 - DNA, 25 bp, Mus musculus
tcttggctggactgatcatccccac

SEQ ID NO: 839506 - DNA, 25 bp, Mus musculus
tcttggctgggaaggcactaccctg

SEQ ID NO: 839507 - DNA, 25 bp, Mus musculus
tcttggctgggatggcactaccctg

SEQ ID NO: 839508 - DNA, 25 bp, Mus musculus
tcttggcttcccagtagtggctctc

SEQ ID NO: 839509 - DNA, 25 bp, Mus musculus
tcttggcttccctgtagtggctctc

SEQ ID NO: 839510 - DNA, 25 bp, Mus musculus
tcttggctttacagaggacttctgg

SEQ ID NO: 839511 - DNA, 25 bp, Mus musculus
tcttggctttactgaggacttctgg

SEQ ID NO: 839512 - DNA, 25 bp, Mus musculus
tcttggctttcaaaatccctaccga

SEQ ID NO: 839513 - DNA, 25 bp, Mus musculus
tcttggctttcataatccctaccga

SEQ ID NO: 839514 - DNA, 25 bp, Mus musculus
tcttggctttgacacaggcgatgca

SEQ ID NO: 839515 - DNA, 25 bp, Mus musculus
tcttggctttgagacaggcgatgca

SEQ ID NO: 839516 - DNA, 25 bp, Mus musculus
tcttggctttgcaatggttttcgaa

SEQ ID NO: 839517 - DNA, 25 bp, Mus musculus
tcttggctttgctatggttttcgaa

SEQ ID NO: 839518 - DNA, 25 bp, Mus musculus
tcttggcttttacagctttttcatt

SEQ ID NO: 839519 - DNA, 25 bp, Mus musculus
tcttggcttttagagctttttcatt

SEQ ID NO: 839520 - DNA, 25 bp, Mus musculus
tcttggcttttccatcggatgaggt

SEQ ID NO: 839521 - DNA, 25 bp, Mus musculus
tcttggcttttcgatcggatgaggt

SEQ ID NO: 839522 - DNA, 25 bp, Mus musculus
tcttgggaaagcagtactcaccttt

SEQ ID NO: 839523 - DNA, 25 bp, Mus musculus
tcttgggaaagctgtactcaccttt

SEQ ID NO: 839524 - DNA, 25 bp, Mus musculus
tcttgggaatatacctaccgcccct

SEQ ID NO: 839525 - DNA, 25 bp, Mus musculus
tcttgggaatattcctaccgcccct

SEQ ID NO: 839526 - DNA, 25 bp, Mus musculus
tcttgggacagaagtgcccgtgcat

SEQ ID NO: 839527 - DNA, 25 bp, Mus musculus
tcttgggacagatgtgcccgtgcat

SEQ ID NO: 839528 - DNA, 25 bp, Mus musculus
tcttgggacttcacattatcagatg

SEQ ID NO: 839529 - DNA, 25 bp, Mus musculus
tcttgggacttctcattatcagatg

SEQ ID NO: 839530 - DNA, 25 bp, Mus musculus
tcttgggcaacgcaaagttcctggt

SEQ ID NO: 839531 - DNA, 25 bp, Mus musculus
tcttgggcaacggaaagttcctggt

SEQ ID NO: 839532 - DNA, 25 bp, Mus musculus
tcttgggcacagctctggatataga

SEQ ID NO: 839533 - DNA, 25 bp, Mus musculus
tcttgggcacaggtctggatataga

SEQ ID NO: 839534 - DNA, 25 bp, Mus musculus
tcttgggcaccaaatacctggaggt

SEQ ID NO: 839535 - DNA, 25 bp, Mus musculus
tcttgggcaccatatacctggaggt

SEQ ID NO: 839536 - DNA, 25 bp, Mus musculus
tcttgggcatagcaagacttgcttt

SEQ ID NO: 839537 - DNA, 25 bp, Mus musculus
tcttgggcataggaagacttgcttt

SEQ ID NO: 839538 - DNA, 25 bp, Mus musculus
tcttgggcccagctatcatatacac

SEQ ID NO: 839539 - DNA, 25 bp, Mus musculus
tcttgggcccaggtatcatatacac

SEQ ID NO: 839540 - DNA, 25 bp, Mus musculus
tcttgggccccaagtagaggtacta

SEQ ID NO: 839541 - DNA, 25 bp, Mus musculus
tcttgggccccatgtagaggtacta

SEQ ID NO: 839542 - DNA, 25 bp, Mus musculus
tcttgggcccccagtaaggactaca

SEQ ID NO: 839543 - DNA, 25 bp, Mus musculus
tcttgggccccctgtaaggactaca

SEQ ID NO: 839544 - DNA, 25 bp, Mus musculus
tcttgggccctcaggtagaagccaa

SEQ ID NO: 839545 - DNA, 25 bp, Mus musculus
tcttgggccctctggtagaagccaa

SEQ ID NO: 839546 - DNA, 25 bp, Mus musculus
tcttgggccgaacatgcagcctgaa

SEQ ID NO: 839547 - DNA, 25 bp, Mus musculus
tcttgggccgaagatgcagcctgaa

SEQ ID NO: 839548 - DNA, 25 bp, Mus musculus
tcttgggcctcacctgacacagaac

SEQ ID NO: 839549 - DNA, 25 bp, Mus musculus
tcttgggcctcagctgacacagaac

SEQ ID NO: 839550 - DNA, 25 bp, Mus musculus
tcttgggcctctagctttatcagaa

SEQ ID NO: 839551 - DNA, 25 bp, Mus musculus
tcttgggcctcttgctttatcagaa

SEQ ID NO: 839552 - DNA, 25 bp, Mus musculus
tcttgggcctgcactaggctttaga

SEQ ID NO: 839553 - DNA, 25 bp, Mus musculus
tcttgggcctgctctaggctttaga

SEQ ID NO: 839554 - DNA, 25 bp, Mus musculus
tcttgggccttcacttttggatgaa

SEQ ID NO: 839555 - DNA, 25 bp, Mus musculus
tcttgggccttctcttttggatgaa

SEQ ID NO: 839556 - DNA, 25 bp, Mus musculus
tcttgggctaaacatagcacctttt

SEQ ID NO: 839557 - DNA, 25 bp, Mus musculus
tcttgggctaaagatagcacctttt

SEQ ID NO: 839558 - DNA, 25 bp, Mus musculus
tcttgggctcccacaaagagacaaa

SEQ ID NO: 839559 - DNA, 25 bp, Mus musculus
tcttgggctccctcaaagagacaaa

SEQ ID NO: 839560 - DNA, 25 bp, Mus musculus
tcttgggctcttcaacaacatttgg

SEQ ID NO: 839561 - DNA, 25 bp, Mus musculus
tcttgggctcttgaacaacatttgg

SEQ ID NO: 839562 - DNA, 25 bp, Mus musculus
tcttgggcttttactgaagttattc

SEQ ID NO: 839563 - DNA, 25 bp, Mus musculus
tcttgggctttttctgaagttattc

SEQ ID NO: 839564 - DNA, 25 bp, Mus musculus
tcttgggtaattctttgtgtcagct

SEQ ID NO: 839565 - DNA, 25 bp, Mus musculus
tcttgggtaattgtttgtgtcagct

SEQ ID NO: 839566 - DNA, 25 bp, Mus musculus
tcttgggtagtaattgcctgcagtt

SEQ ID NO: 839567 - DNA, 25 bp, Mus musculus
tcttgggtagtatttgcctgcagtt

SEQ ID NO: 839568 - DNA, 25 bp, Mus musculus
tcttgggtccacataatagcatgaa

SEQ ID NO: 839569 - DNA, 25 bp, Mus musculus
tcttgggtccacttaatagcatgaa

SEQ ID NO: 839570 - DNA, 25 bp, Mus musculus
tcttgggtccttcctgagttttagg

SEQ ID NO: 839571 - DNA, 25 bp, Mus musculus
tcttgggtccttgctgagttttagg

SEQ ID NO: 839572 - DNA, 25 bp, Mus musculus
tcttgggtgaacattctgcccctat

SEQ ID NO: 839573 - DNA, 25 bp, Mus musculus
tcttgggtgaactttctgcccctat

SEQ ID NO: 839574 - DNA, 25 bp, Mus musculus
tcttgggtgctaaggcctcaatcac

SEQ ID NO: 839575 - DNA, 25 bp, Mus musculus
tcttgggtgctatggcctcaatcac

SEQ ID NO: 839576 - DNA, 25 bp, Mus musculus
tcttgggtgggcacctaatactgtg

SEQ ID NO: 839577 - DNA, 25 bp, Mus musculus
tcttgggtgggctcctaatactgtg

SEQ ID NO: 839578 - DNA, 25 bp, Mus musculus
tcttgggtggtactgacagcagccc

SEQ ID NO: 839579 - DNA, 25 bp, Mus musculus
tcttgggtggtagtgacagcagccc

SEQ ID NO: 839580 - DNA, 25 bp, Mus musculus
tcttgggttagtaagctttcagctt

SEQ ID NO: 839581 - DNA, 25 bp, Mus musculus
tcttgggttagttagctttcagctt

SEQ ID NO: 839582 - DNA, 25 bp, Mus musculus
tcttgggttccgagtatttttgaag

SEQ ID NO: 839583 - DNA, 25 bp, Mus musculus
tcttgggttccgtgtatttttgaag

SEQ ID NO: 839584 - DNA, 25 bp, Mus musculus
tcttgggttttcagtgtgctgcttg

SEQ ID NO: 839585 - DNA, 25 bp, Mus musculus
tcttgggttttctgtgtgctgcttg

SEQ ID NO: 839586 - DNA, 25 bp, Mus musculus
tcttggtaagttaggcatcatctgc

SEQ ID NO: 839587 - DNA, 25 bp, Mus musculus
tcttggtaagtttggcatcatctgc

SEQ ID NO: 839588 - DNA, 25 bp, Mus musculus
tcttggtacaaccagctgcccattt

SEQ ID NO: 839589 - DNA, 25 bp, Mus musculus
tcttggtacaacgagctgcccattt

SEQ ID NO: 839590 - DNA, 25 bp, Mus musculus
tcttggtacttacatgataacatca

SEQ ID NO: 839591 - DNA, 25 bp, Mus musculus
tcttggtacttagatgataacatca

SEQ ID NO: 839592 - DNA, 25 bp, Mus musculus
tcttggtatgtgaaacactgtatgt

SEQ ID NO: 839593 - DNA, 25 bp, Mus musculus
tcttggtatgtgtaacactgtatgt

SEQ ID NO: 839594 - DNA, 25 bp, Mus musculus
tcttggtcacacagggctcgcttgc

SEQ ID NO: 839595 - DNA, 25 bp, Mus musculus
tcttggtcacactgggctcgcttgc

SEQ ID NO: 839596 - DNA, 25 bp, Mus musculus
tcttggtcagctatgtagcatccat

SEQ ID NO: 839597 - DNA, 25 bp, Mus musculus
tcttggtcagctttgtagcatccat

SEQ ID NO: 839598 - DNA, 25 bp, Mus musculus
tcttggtccagcatagtaaattttg

SEQ ID NO: 839599 - DNA, 25 bp, Mus musculus
tcttggtccagcttagtaaattttg

SEQ ID NO: 839600 - DNA, 25 bp, Mus musculus
tcttggtctcaacaatcttacattt

SEQ ID NO: 839601 - DNA, 25 bp, Mus musculus
tcttggtctcaagaatcttacattt

SEQ ID NO: 839602 - DNA, 25 bp, Mus musculus
tcttggtctgatatattgtctgata

SEQ ID NO: 839603 - DNA, 25 bp, Mus musculus
tcttggtctgatttattgtctgata

SEQ ID NO: 839604 - DNA, 25 bp, Mus musculus
tcttggtgaccactctctgagctgt

SEQ ID NO: 839605 - DNA, 25 bp, Mus musculus
tcttggtgaccagtctctgagctgt

SEQ ID NO: 839606 - DNA, 25 bp, Mus musculus
tcttggtgacttcagtttttagact

SEQ ID NO: 839607 - DNA, 25 bp, Mus musculus
tcttggtgacttgagtttttagact

SEQ ID NO: 839608 - DNA, 25 bp, Mus musculus
tcttggtgcacaagaaggtccttgt

SEQ ID NO: 839609 - DNA, 25 bp, Mus musculus
tcttggtgcacatgaaggtccttgt

SEQ ID NO: 839610 - DNA, 25 bp, Mus musculus
tcttggtgccgaatccagaccagcc

SEQ ID NO: 839611 - DNA, 25 bp, Mus musculus
tcttggtgccgattccagaccagcc

SEQ ID NO: 839612 - DNA, 25 bp, Mus musculus
tcttggtgggtccaggatcatccta

SEQ ID NO: 839613 - DNA, 25 bp, Mus musculus
tcttggtgggtcgaggatcatccta

SEQ ID NO: 839614 - DNA, 25 bp, Mus musculus
tcttggtgtaggcagggtgggcgtt

SEQ ID NO: 839615 - DNA, 25 bp, Mus musculus
tcttggtgtagggagggtgggcgtt

SEQ ID NO: 839616 - DNA, 25 bp, Mus musculus
tcttggtgtcctagcacccagagtg

SEQ ID NO: 839617 - DNA, 25 bp, Mus musculus
tcttggtgtccttgcacccagagtg

SEQ ID NO: 839618 - DNA, 25 bp, Mus musculus
tcttggtgtgctcagttgttctcag

SEQ ID NO: 839619 - DNA, 25 bp, Mus musculus
tcttggtgtgctgagttgttctcag

SEQ ID NO: 839620 - DNA, 25 bp, Mus musculus
tcttggttacttcctggtgtaggcc

SEQ ID NO: 839621 - DNA, 25 bp, Mus musculus
tcttggttacttgctggtgtaggcc

SEQ ID NO: 839622 - DNA, 25 bp, Mus musculus
tcttggttaggaagctactacactt

SEQ ID NO: 839623 - DNA, 25 bp, Mus musculus
tcttggttaggatgctactacactt

SEQ ID NO: 839624 - DNA, 25 bp, Mus musculus
tcttggttccctcgcgtactctgag

SEQ ID NO: 839625 - DNA, 25 bp, Mus musculus
tcttggttccctggcgtactctgag

SEQ ID NO: 839626 - DNA, 25 bp, Mus musculus
tcttggttcttaagggtcagtggac

SEQ ID NO: 839627 - DNA, 25 bp, Mus musculus
tcttggttcttatgggtcagtggac

SEQ ID NO: 839628 - DNA, 25 bp, Mus musculus
tcttggttgaatactctgcaggaca

SEQ ID NO: 839629 - DNA, 25 bp, Mus musculus
tcttggttgaattctctgcaggaca

SEQ ID NO: 839630 - DNA, 25 bp, Mus musculus
tcttggttgcctaaactttttcttg

SEQ ID NO: 839631 - DNA, 25 bp, Mus musculus
tcttggttgccttaactttttcttg

SEQ ID NO: 839632 - DNA, 25 bp, Mus musculus
tcttggttggcaagctgcagagtca

SEQ ID NO: 839633 - DNA, 25 bp, Mus musculus
tcttggttggcatgctgcagagtca

SEQ ID NO: 839634 - DNA, 25 bp, Mus musculus
tcttggttggttactagctgagttt

SEQ ID NO: 839635 - DNA, 25 bp, Mus musculus
tcttggttggtttctagctgagttt

SEQ ID NO: 839636 - DNA, 25 bp, Mus musculus
tcttggttgtttacttccaggaaag

SEQ ID NO: 839637 - DNA, 25 bp, Mus musculus
tcttggttgttttcttccaggaaag

SEQ ID NO: 839638 - DNA, 25 bp, Mus musculus
tcttggtttacaacccaagggcctt

SEQ ID NO: 839639 - DNA, 25 bp, Mus musculus
tcttggtttacatcccaagggcctt

SEQ ID NO: 839640 - DNA, 25 bp, Mus musculus
tcttggtttaggatggtgttaattt

SEQ ID NO: 839641 - DNA, 25 bp, Mus musculus
tcttggtttaggttggtgttaattt

SEQ ID NO: 839642 - DNA, 25 bp, Mus musculus
tcttggtttatgctggccacttcca

SEQ ID NO: 839643 - DNA, 25 bp, Mus musculus
tcttggtttatggtggccacttcca

SEQ ID NO: 839644 - DNA, 25 bp, Mus musculus
tcttggtttgctacgatttttaaat

SEQ ID NO: 839645 - DNA, 25 bp, Mus musculus
tcttggtttgcttcgatttttaaat

SEQ ID NO: 839646 - DNA, 25 bp, Mus musculus
tcttggtttggaagctagggactaa

SEQ ID NO: 839647 - DNA, 25 bp, Mus musculus
tcttggtttggatgctagggactaa

SEQ ID NO: 839648 - DNA, 25 bp, Mus musculus
tcttggtttgtgaccttcgtacctt

SEQ ID NO: 839649 - DNA, 25 bp, Mus musculus
tcttggtttgtgtccttcgtacctt

SEQ ID NO: 839650 - DNA, 25 bp, Mus musculus
tcttggttttcacgctataacagca

SEQ ID NO: 839651 - DNA, 25 bp, Mus musculus
tcttggttttcaggctataacagca

SEQ ID NO: 839652 - DNA, 25 bp, Mus musculus
tcttgtaaaacaagactttcctttt

SEQ ID NO: 839653 - DNA, 25 bp, Mus musculus
tcttgtaaaacatgactttcctttt

SEQ ID NO: 839654 - DNA, 25 bp, Mus musculus
tcttgtaacataatgctcctctgcc

SEQ ID NO: 839655 - DNA, 25 bp, Mus musculus
tcttgtaacatattgctcctctgcc

SEQ ID NO: 839656 - DNA, 25 bp, Mus musculus
tcttgtaagtatcattctgagaact

SEQ ID NO: 839657 - DNA, 25 bp, Mus musculus
tcttgtaagtatgattctgagaact

SEQ ID NO: 839658 - DNA, 25 bp, Mus musculus
tcttgtacacctcgcatcctggttt

SEQ ID NO: 839659 - DNA, 25 bp, Mus musculus
tcttgtacacctggcatcctggttt

SEQ ID NO: 839660 - DNA, 25 bp, Mus musculus
tcttgtacagctcaatgtgcaataa

SEQ ID NO: 839661 - DNA, 25 bp, Mus musculus
tcttgtacagctgaatgtgcaataa

SEQ ID NO: 839662 - DNA, 25 bp, Mus musculus
tcttgtacatctctctcagcttaca

SEQ ID NO: 839663 - DNA, 25 bp, Mus musculus
tcttgtacatctgtctcagcttaca

SEQ ID NO: 839664 - DNA, 25 bp, Mus musculus
tcttgtactattcaagttggaacca

SEQ ID NO: 839665 - DNA, 25 bp, Mus musculus
tcttgtactattgaagttggaacca

SEQ ID NO: 839666 - DNA, 25 bp, Mus musculus
tcttgtactggtaacaccggctcaa

SEQ ID NO: 839667 - DNA, 25 bp, Mus musculus
tcttgtactggttacaccggctcaa

SEQ ID NO: 839668 - DNA, 25 bp, Mus musculus
tcttgtactttgactcttcttcagg

SEQ ID NO: 839669 - DNA, 25 bp, Mus musculus
tcttgtactttgtctcttcttcagg

SEQ ID NO: 839670 - DNA, 25 bp, Mus musculus
tcttgtagacacatgaccactcatt

SEQ ID NO: 839671 - DNA, 25 bp, Mus musculus
tcttgtagacacttgaccactcatt

SEQ ID NO: 839672 - DNA, 25 bp, Mus musculus
tcttgtagcgatcgttctggaacca

SEQ ID NO: 839673 - DNA, 25 bp, Mus musculus
tcttgtagcgatggttctggaacca

SEQ ID NO: 839674 - DNA, 25 bp, Mus musculus
tcttgtagctgtctgattgtgacca

SEQ ID NO: 839675 - DNA, 25 bp, Mus musculus
tcttgtagctgtgtgattgtgacca

SEQ ID NO: 839676 - DNA, 25 bp, Mus musculus
tcttgtaggagtagtttttcagatc

SEQ ID NO: 839677 - DNA, 25 bp, Mus musculus
tcttgtaggagttgtttttcagatc

SEQ ID NO: 839678 - DNA, 25 bp, Mus musculus
tcttgtagggccctgtgtgttaaca

SEQ ID NO: 839679 - DNA, 25 bp, Mus musculus
tcttgtagggccgtgtgtgttaaca

SEQ ID NO: 839680 - DNA, 25 bp, Mus musculus
tcttgtagtgcccaggattgccagc

SEQ ID NO: 839681 - DNA, 25 bp, Mus musculus
tcttgtagtgccgaggattgccagc

SEQ ID NO: 839682 - DNA, 25 bp, Mus musculus
tcttgtatagttcagttcctctttg

SEQ ID NO: 839683 - DNA, 25 bp, Mus musculus
tcttgtatagttgagttcctctttg

SEQ ID NO: 839684 - DNA, 25 bp, Mus musculus
tcttgtatatgtccagacgtgacaa

SEQ ID NO: 839685 - DNA, 25 bp, Mus musculus
tcttgtatatgtgcagacgtgacaa

SEQ ID NO: 839686 - DNA, 25 bp, Mus musculus
tcttgtatcgagaccatgaggtcta

SEQ ID NO: 839687 - DNA, 25 bp, Mus musculus
tcttgtatcgagtccatgaggtcta

SEQ ID NO: 839688 - DNA, 25 bp, Mus musculus
tcttgtatgacccaatagttaccta

SEQ ID NO: 839689 - DNA, 25 bp, Mus musculus
tcttgtatgaccgaatagttaccta

SEQ ID NO: 839690 - DNA, 25 bp, Mus musculus
tcttgtatgagaccccggttggctc

SEQ ID NO: 839691 - DNA, 25 bp, Mus musculus
tcttgtatgagagcccggttggctc

SEQ ID NO: 839692 - DNA, 25 bp, Mus musculus
tcttgtatgcaaagttcctgtatgt

SEQ ID NO: 839693 - DNA, 25 bp, Mus musculus
tcttgtatgcaatgttcctgtatgt

SEQ ID NO: 839694 - DNA, 25 bp, Mus musculus
tcttgtatgcatatgagagaaataa

SEQ ID NO: 839695 - DNA, 25 bp, Mus musculus
tcttgtatgcatttgagagaaataa

SEQ ID NO: 839696 - DNA, 25 bp, Mus musculus
tcttgtatgcttaggttttctgacc

SEQ ID NO: 839697 - DNA, 25 bp, Mus musculus
tcttgtatgctttggttttctgacc

SEQ ID NO: 839698 - DNA, 25 bp, Mus musculus
tcttgtattctgctatcccatcagg

SEQ ID NO: 839699 - DNA, 25 bp, Mus musculus
tcttgtattctggtatcccatcagg

SEQ ID NO: 839700 - DNA, 25 bp, Mus musculus
tcttgtcaatataaactagtaggat

SEQ ID NO: 839701 - DNA, 25 bp, Mus musculus
tcttgtcaatattaactagtaggat

SEQ ID NO: 839702 - DNA, 25 bp, Mus musculus
tcttgtcacctcacgctgaagataa

SEQ ID NO: 839703 - DNA, 25 bp, Mus musculus
tcttgtcacctctcgctgaagataa

SEQ ID NO: 839704 - DNA, 25 bp, Mus musculus
tcttgtcaggaaatccatcgcctcc

SEQ ID NO: 839705 - DNA, 25 bp, Mus musculus
tcttgtcaggaattccatcgcctcc

SEQ ID NO: 839706 - DNA, 25 bp, Mus musculus
tcttgtcaggagctggaaaccgaaa

SEQ ID NO: 839707 - DNA, 25 bp, Mus musculus
tcttgtcaggaggtggaaaccgaaa

SEQ ID NO: 839708 - DNA, 25 bp, Mus musculus
tcttgtcagggcatggaccgcatgc

SEQ ID NO: 839709 - DNA, 25 bp, Mus musculus
tcttgtcagggcttggaccgcatgc

SEQ ID NO: 839710 - DNA, 25 bp, Mus musculus
tcttgtcagtgaaggagcttggtat

SEQ ID NO: 839711 - DNA, 25 bp, Mus musculus
tcttgtcagtgatggagcttggtat

SEQ ID NO: 839712 - DNA, 25 bp, Mus musculus
tcttgtcagtgtattgggcacaggt

SEQ ID NO: 839713 - DNA, 25 bp, Mus musculus
tcttgtcagtgttttgggcacaggt

SEQ ID NO: 839714 - DNA, 25 bp, Mus musculus
tcttgtcatctcactggtctttcag

SEQ ID NO: 839715 - DNA, 25 bp, Mus musculus
tcttgtcatctctctggtctttcag

SEQ ID NO: 839716 - DNA, 25 bp, Mus musculus
tcttgtcattgtagtgccaatctgc

SEQ ID NO: 839717 - DNA, 25 bp, Mus musculus
tcttgtcattgttgtgccaatctgc

SEQ ID NO: 839718 - DNA, 25 bp, Mus musculus
tcttgtccaacaactatccacgagt

SEQ ID NO: 839719 - DNA, 25 bp, Mus musculus
tcttgtccaacatctatccacgagt

SEQ ID NO: 839720 - DNA, 25 bp, Mus musculus
tcttgtccattcattcgtcacacat

SEQ ID NO: 839721 - DNA, 25 bp, Mus musculus
tcttgtccattctttcgtcacacat

SEQ ID NO: 839722 - DNA, 25 bp, Mus musculus
tcttgtcccagccttctgtggtctg

SEQ ID NO: 839723 - DNA, 25 bp, Mus musculus
tcttgtcccagcgttctgtggtctg

SEQ ID NO: 839724 - DNA, 25 bp, Mus musculus
tcttgtcccctcagtattttgactg

SEQ ID NO: 839725 - DNA, 25 bp, Mus musculus
tcttgtcccctctgtattttgactg

SEQ ID NO: 839726 - DNA, 25 bp, Mus musculus
tcttgtcccctgaaggcctagaaga

SEQ ID NO: 839727 - DNA, 25 bp, Mus musculus
tcttgtcccctgtaggcctagaaga

SEQ ID NO: 839728 - DNA, 25 bp, Mus musculus
tcttgtccctcactatcttagatgg

SEQ ID NO: 839729 - DNA, 25 bp, Mus musculus
tcttgtccctcagtatcttagatgg

SEQ ID NO: 839730 - DNA, 25 bp, Mus musculus
tcttgtcccttaagagtccttcata

SEQ ID NO: 839731 - DNA, 25 bp, Mus musculus
tcttgtcccttatgagtccttcata

SEQ ID NO: 839732 - DNA, 25 bp, Mus musculus
tcttgtcctaagacagtaccttctg

SEQ ID NO: 839733 - DNA, 25 bp, Mus musculus
tcttgtcctaagtcagtaccttctg

SEQ ID NO: 839734 - DNA, 25 bp, Mus musculus
tcttgtcctaccacgtggaaagcag

SEQ ID NO: 839735 - DNA, 25 bp, Mus musculus
tcttgtcctacctcgtggaaagcag

SEQ ID NO: 839736 - DNA, 25 bp, Mus musculus
tcttgtcctataacatgattaacag

SEQ ID NO: 839737 - DNA, 25 bp, Mus musculus
tcttgtcctatatcatgattaacag

SEQ ID NO: 839738 - DNA, 25 bp, Mus musculus
tcttgtcctcagaaggaacctgctc

SEQ ID NO: 839739 - DNA, 25 bp, Mus musculus
tcttgtcctcagtaggaacctgctc

SEQ ID NO: 839740 - DNA, 25 bp, Mus musculus
tcttgtcctcgcagtgtctacagtg

SEQ ID NO: 839741 - DNA, 25 bp, Mus musculus
tcttgtcctcgctgtgtctacagtg

SEQ ID NO: 839742 - DNA, 25 bp, Mus musculus
tcttgtcctggaaaaagtgtacttg

SEQ ID NO: 839743 - DNA, 25 bp, Mus musculus
tcttgtcctggataaagtgtacttg

SEQ ID NO: 839744 - DNA, 25 bp, Mus musculus
tcttgtcctttcagttggtcagcat

SEQ ID NO: 839745 - DNA, 25 bp, Mus musculus
tcttgtcctttctgttggtcagcat

SEQ ID NO: 839746 - DNA, 25 bp, Mus musculus
tcttgtcgatttctgaactgactcg

SEQ ID NO: 839747 - DNA, 25 bp, Mus musculus
tcttgtcgatttgtgaactgactcg

SEQ ID NO: 839748 - DNA, 25 bp, Mus musculus
tcttgtcgttttaatgtgctgtcta

SEQ ID NO: 839749 - DNA, 25 bp, Mus musculus
tcttgtcgtttttatgtgctgtcta

SEQ ID NO: 839750 - DNA, 25 bp, Mus musculus
tcttgtctattacttctgtaggcac

SEQ ID NO: 839751 - DNA, 25 bp, Mus musculus
tcttgtctattagttctgtaggcac

SEQ ID NO: 839752 - DNA, 25 bp, Mus musculus
tcttgtctcctgagtcatattggtc

SEQ ID NO: 839753 - DNA, 25 bp, Mus musculus
tcttgtctcctgctttaacactgtt

SEQ ID NO: 839754 - DNA, 25 bp, Mus musculus
tcttgtctcctggtttaacactgtt

SEQ ID NO: 839755 - DNA, 25 bp, Mus musculus
tcttgtctcctgtgtcatattggtc

SEQ ID NO: 839756 - DNA, 25 bp, Mus musculus
tcttgtctctccaatcagactgaga

SEQ ID NO: 839757 - DNA, 25 bp, Mus musculus
tcttgtctctcctatcagactgaga

SEQ ID NO: 839758 - DNA, 25 bp, Mus musculus
tcttgtctctgacgcccttcaaaaa

SEQ ID NO: 839759 - DNA, 25 bp, Mus musculus
tcttgtctctgaggcccttcaaaaa

SEQ ID NO: 839760 - DNA, 25 bp, Mus musculus
tcttgtctctgtaacaaccacactt

SEQ ID NO: 839761 - DNA, 25 bp, Mus musculus
tcttgtctctgtattctgttactga

SEQ ID NO: 839762 - DNA, 25 bp, Mus musculus
tcttgtctctgttacaaccacactt

SEQ ID NO: 839763 - DNA, 25 bp, Mus musculus
tcttgtctctgttttctgttactga

SEQ ID NO: 839764 - DNA, 25 bp, Mus musculus
tcttgtctgctcaggatttgagaaa

SEQ ID NO: 839765 - DNA, 25 bp, Mus musculus
tcttgtctgctcatcagttttccaa

SEQ ID NO: 839766 - DNA, 25 bp, Mus musculus
tcttgtctgctctggatttgagaaa

SEQ ID NO: 839767 - DNA, 25 bp, Mus musculus
tcttgtctgctcttcagttttccaa

SEQ ID NO: 839768 - DNA, 25 bp, Mus musculus
tcttgtctgctgaaccagctgggaa

SEQ ID NO: 839769 - DNA, 25 bp, Mus musculus
tcttgtctgctgtaccagctgggaa

SEQ ID NO: 839770 - DNA, 25 bp, Mus musculus
tcttgtctgggaactgagctctgtc

SEQ ID NO: 839771 - DNA, 25 bp, Mus musculus
tcttgtctgggatctgagctctgtc

SEQ ID NO: 839772 - DNA, 25 bp, Mus musculus
tcttgtctgtctatctttgataaac

SEQ ID NO: 839773 - DNA, 25 bp, Mus musculus
tcttgtctgtctcataacttcctga

SEQ ID NO: 839774 - DNA, 25 bp, Mus musculus
tcttgtctgtctgataacttcctga

SEQ ID NO: 839775 - DNA, 25 bp, Mus musculus
tcttgtctgtctttctttgataaac

SEQ ID NO: 839776 - DNA, 25 bp, Mus musculus
tcttgtcttctcataaattcacagg

SEQ ID NO: 839777 - DNA, 25 bp, Mus musculus
tcttgtcttctcttaaattcacagg

SEQ ID NO: 839778 - DNA, 25 bp, Mus musculus
tcttgtcttgcaattcttatcgagg

SEQ ID NO: 839779 - DNA, 25 bp, Mus musculus
tcttgtcttgcatttcttatcgagg

SEQ ID NO: 839780 - DNA, 25 bp, Mus musculus
tcttgtcttggcatccgttaaggaa

SEQ ID NO: 839781 - DNA, 25 bp, Mus musculus
tcttgtcttggcttccgttaaggaa

SEQ ID NO: 839782 - DNA, 25 bp, Mus musculus
tcttgtctttcaatgctagcaggtc

SEQ ID NO: 839783 - DNA, 25 bp, Mus musculus
tcttgtctttcattgctagcaggtc

SEQ ID NO: 839784 - DNA, 25 bp, Mus musculus
tcttgtgaaacgaaacgccccgtgt

SEQ ID NO: 839785 - DNA, 25 bp, Mus musculus
tcttgtgaaacgtaacgccccgtgt

SEQ ID NO: 839786 - DNA, 25 bp, Mus musculus
tcttgtgagatgaccccttttgaag

SEQ ID NO: 839787 - DNA, 25 bp, Mus musculus
tcttgtgagatgtccccttttgaag

SEQ ID NO: 839788 - DNA, 25 bp, Mus musculus
tcttgtgagtgccaatgtataatgc

SEQ ID NO: 839789 - DNA, 25 bp, Mus musculus
tcttgtgagtgcgaatgtataatgc

SEQ ID NO: 839790 - DNA, 25 bp, Mus musculus
tcttgtgagtgtcctgcttgagaca

SEQ ID NO: 839791 - DNA, 25 bp, Mus musculus
tcttgtgagtgtgctgcttgagaca

SEQ ID NO: 839792 - DNA, 25 bp, Mus musculus
tcttgtgatgtcagtaggtgctcgc

SEQ ID NO: 839793 - DNA, 25 bp, Mus musculus
tcttgtgatgtctgtaggtgctcgc

SEQ ID NO: 839794 - DNA, 25 bp, Mus musculus
tcttgtgcagcgcactccagtacca

SEQ ID NO: 839795 - DNA, 25 bp, Mus musculus
tcttgtgcagcggactccagtacca

SEQ ID NO: 839796 - DNA, 25 bp, Mus musculus
tcttgtgcagtaatgtgactcccaa

SEQ ID NO: 839797 - DNA, 25 bp, Mus musculus
tcttgtgcagtattgtgactcccaa

SEQ ID NO: 839798 - DNA, 25 bp, Mus musculus
tcttgtgcatgtacccactgtttca

SEQ ID NO: 839799 - DNA, 25 bp, Mus musculus
tcttgtgcatgttcccactgtttca

SEQ ID NO: 839800 - DNA, 25 bp, Mus musculus
tcttgtgcattgaattggtcgcaac

SEQ ID NO: 839801 - DNA, 25 bp, Mus musculus
tcttgtgcattgtattggtcgcaac

SEQ ID NO: 839802 - DNA, 25 bp, Mus musculus
tcttgtgccccaagaataaaatgtt

SEQ ID NO: 839803 - DNA, 25 bp, Mus musculus
tcttgtgccccatgaataaaatgtt

SEQ ID NO: 839804 - DNA, 25 bp, Mus musculus
tcttgtgcctctcagcagtagtgag

SEQ ID NO: 839805 - DNA, 25 bp, Mus musculus
tcttgtgcctctgagcagtagtgag

SEQ ID NO: 839806 - DNA, 25 bp, Mus musculus
tcttgtgcctgtactagagccgtag

SEQ ID NO: 839807 - DNA, 25 bp, Mus musculus
tcttgtgcctgttctagagccgtag

SEQ ID NO: 839808 - DNA, 25 bp, Mus musculus
tcttgtgcgcttatattgtgcttct

SEQ ID NO: 839809 - DNA, 25 bp, Mus musculus
tcttgtgcgcttttattgtgcttct

SEQ ID NO: 839810 - DNA, 25 bp, Mus musculus
tcttgtgctacccagctccaagggt

SEQ ID NO: 839811 - DNA, 25 bp, Mus musculus
tcttgtgctaccgagctccaagggt

SEQ ID NO: 839812 - DNA, 25 bp, Mus musculus
tcttgtgctagcattcagtggtcat

SEQ ID NO: 839813 - DNA, 25 bp, Mus musculus
tcttgtgctagctttcagtggtcat

SEQ ID NO: 839814 - DNA, 25 bp, Mus musculus
tcttgtgctctgcatagacagacct

SEQ ID NO: 839815 - DNA, 25 bp, Mus musculus
tcttgtgctctggatagacagacct

SEQ ID NO: 839816 - DNA, 25 bp, Mus musculus
tcttgtgctgcacatgggctggatt

SEQ ID NO: 839817 - DNA, 25 bp, Mus musculus
tcttgtgctgcagatgggctggatt

SEQ ID NO: 839818 - DNA, 25 bp, Mus musculus
tcttgtgctgctcttggacagtcaa

SEQ ID NO: 839819 - DNA, 25 bp, Mus musculus
tcttgtgctgctgttggacagtcaa

SEQ ID NO: 839820 - DNA, 25 bp, Mus musculus
tcttgtgctgtactggctggtcacg

SEQ ID NO: 839821 - DNA, 25 bp, Mus musculus
tcttgtgctgtagtggctggtcacg

SEQ ID NO: 839822 - DNA, 25 bp, Mus musculus
tcttgtgcttttattggacttccca

SEQ ID NO: 839823 - DNA, 25 bp, Mus musculus
tcttgtgctttttttggacttccca

SEQ ID NO: 839824 - DNA, 25 bp, Mus musculus
tcttgtggaggtagtgttagctagt

SEQ ID NO: 839825 - DNA, 25 bp, Mus musculus
tcttgtggaggttgtgttagctagt

SEQ ID NO: 839826 - DNA, 25 bp, Mus musculus
tcttgtggcagcagtaggaagtcca

SEQ ID NO: 839827 - DNA, 25 bp, Mus musculus
tcttgtggcagctgtaggaagtcca

SEQ ID NO: 839828 - DNA, 25 bp, Mus musculus
tcttgtggcattctttgtctttggg

SEQ ID NO: 839829 - DNA, 25 bp, Mus musculus
tcttgtggcattgtttgtctttggg

SEQ ID NO: 839830 - DNA, 25 bp, Mus musculus
tcttgtggcctgattgtcaatgtca

SEQ ID NO: 839831 - DNA, 25 bp, Mus musculus
tcttgtggcctgtttgtcaatgtca

SEQ ID NO: 839832 - DNA, 25 bp, Mus musculus
tcttgtggcttaaatgggcatatat

SEQ ID NO: 839833 - DNA, 25 bp, Mus musculus
tcttgtggcttatatgggcatatat

SEQ ID NO: 839834 - DNA, 25 bp, Mus musculus
tcttgtgggccgagtggtcatcgaa

SEQ ID NO: 839835 - DNA, 25 bp, Mus musculus
tcttgtgggccgtgtggtcatcgaa

SEQ ID NO: 839836 - DNA, 25 bp, Mus musculus
tcttgtggtattccggctgcttctt

SEQ ID NO: 839837 - DNA, 25 bp, Mus musculus
tcttgtggtattgcggctgcttctt

SEQ ID NO: 839838 - DNA, 25 bp, Mus musculus
tcttgtggtccaattagttgaatca

SEQ ID NO: 839839 - DNA, 25 bp, Mus musculus
tcttgtggtccatttagttgaatca

SEQ ID NO: 839840 - DNA, 25 bp, Mus musculus
tcttgtgtaatgactaacctgattt

SEQ ID NO: 839841 - DNA, 25 bp, Mus musculus
tcttgtgtaatgtctaacctgattt

SEQ ID NO: 839842 - DNA, 25 bp, Mus musculus
tcttgtgtcctgaggttgatttcct

SEQ ID NO: 839843 - DNA, 25 bp, Mus musculus
tcttgtgtcctgtggttgatttcct

SEQ ID NO: 839844 - DNA, 25 bp, Mus musculus
tcttgtgtgaagagccaagctgcct

SEQ ID NO: 839845 - DNA, 25 bp, Mus musculus
tcttgtgtgaagtgccaagctgcct

SEQ ID NO: 839846 - DNA, 25 bp, Mus musculus
tcttgtgtgctacgcagaggctcta

SEQ ID NO: 839847 - DNA, 25 bp, Mus musculus
tcttgtgtgctaggcagaggctcta

SEQ ID NO: 839848 - DNA, 25 bp, Mus musculus
tcttgtgtgctccttgtgttcgttc

SEQ ID NO: 839849 - DNA, 25 bp, Mus musculus
tcttgtgtgctcgttgtgttcgttc

SEQ ID NO: 839850 - DNA, 25 bp, Mus musculus
tcttgtgtgggcagcttcatcctag

SEQ ID NO: 839851 - DNA, 25 bp, Mus musculus
tcttgtgtgggctgcttcatcctag

SEQ ID NO: 839852 - DNA, 25 bp, Mus musculus
tcttgtgtgtgaaccagcagtgctg

SEQ ID NO: 839853 - DNA, 25 bp, Mus musculus
tcttgtgtgtgatccagcagtgctg

SEQ ID NO: 839854 - DNA, 25 bp, Mus musculus
tcttgtgtgtttattgtctaatgtc

SEQ ID NO: 839855 - DNA, 25 bp, Mus musculus
tcttgtgtgttttttgtctaatgtc

SEQ ID NO: 839856 - DNA, 25 bp, Mus musculus
tcttgtgttagaagacattccaact

SEQ ID NO: 839857 - DNA, 25 bp, Mus musculus
tcttgtgttagatgacattccaact

SEQ ID NO: 839858 - DNA, 25 bp, Mus musculus
tcttgtgttattaaacccagtaaca

SEQ ID NO: 839859 - DNA, 25 bp, Mus musculus
tcttgtgttatttaacccagtaaca

SEQ ID NO: 839860 - DNA, 25 bp, Mus musculus
tcttgtgttcatccagtcctggaat

SEQ ID NO: 839861 - DNA, 25 bp, Mus musculus
tcttgtgttcatgcagtcctggaat

SEQ ID NO: 839862 - DNA, 25 bp, Mus musculus
tcttgtgttctgattggtctccctt

SEQ ID NO: 839863 - DNA, 25 bp, Mus musculus
tcttgtgttctgtttggtctccctt

SEQ ID NO: 839864 - DNA, 25 bp, Mus musculus
tcttgtgttcttatgtactctgtta

SEQ ID NO: 839865 - DNA, 25 bp, Mus musculus
tcttgtgttcttcttagtttataaa

SEQ ID NO: 839866 - DNA, 25 bp, Mus musculus
tcttgtgttcttgttagtttataaa

SEQ ID NO: 839867 - DNA, 25 bp, Mus musculus
tcttgtgttcttttgtactctgtta

SEQ ID NO: 839868 - DNA, 25 bp, Mus musculus
tcttgtgttgcaaaaaaccttttgg

SEQ ID NO: 839869 - DNA, 25 bp, Mus musculus
tcttgtgttgcataaaaccttttgg

SEQ ID NO: 839870 - DNA, 25 bp, Mus musculus
tcttgtgttttcatcctttgtgaat

SEQ ID NO: 839871 - DNA, 25 bp, Mus musculus
tcttgtgttttcttcctttgtgaat

SEQ ID NO: 839872 - DNA, 25 bp, Mus musculus
tcttgttaaagcattgaccattgtc

SEQ ID NO: 839873 - DNA, 25 bp, Mus musculus
tcttgttaaagctttgaccattgtc

SEQ ID NO: 839874 - DNA, 25 bp, Mus musculus
tcttgttacgttacactgttcagaa

SEQ ID NO: 839875 - DNA, 25 bp, Mus musculus
tcttgttacgtttcactgttcagaa

SEQ ID NO: 839876 - DNA, 25 bp, Mus musculus
tcttgttactgcagcttccataaag

SEQ ID NO: 839877 - DNA, 25 bp, Mus musculus
tcttgttactgctgcttccataaag

SEQ ID NO: 839878 - DNA, 25 bp, Mus musculus
tcttgttatataactgcctcatgca

SEQ ID NO: 839879 - DNA, 25 bp, Mus musculus
tcttgttatatatctgcctcatgca

SEQ ID NO: 839880 - DNA, 25 bp, Mus musculus
tcttgttatcaaagccccatgagaa

SEQ ID NO: 839881 - DNA, 25 bp, Mus musculus
tcttgttatcaatgccccatgagaa

SEQ ID NO: 839882 - DNA, 25 bp, Mus musculus
tcttgttatgagaaaatgactccaa

SEQ ID NO: 839883 - DNA, 25 bp, Mus musculus
tcttgttatgagtaaatgactccaa

SEQ ID NO: 839884 - DNA, 25 bp, Mus musculus
tcttgttatgtaagctctgtagacc

SEQ ID NO: 839885 - DNA, 25 bp, Mus musculus
tcttgttatgtatgctctgtagacc

SEQ ID NO: 839886 - DNA, 25 bp, Mus musculus
tcttgttatgttacttgatttgtca

SEQ ID NO: 839887 - DNA, 25 bp, Mus musculus
tcttgttatgtttcttgatttgtca

SEQ ID NO: 839888 - DNA, 25 bp, Mus musculus
tcttgttcaaaccttctttacctgg

SEQ ID NO: 839889 - DNA, 25 bp, Mus musculus
tcttgttcaaacgttctttacctgg

SEQ ID NO: 839890 - DNA, 25 bp, Mus musculus
tcttgttcaaataattggactgtta

SEQ ID NO: 839891 - DNA, 25 bp, Mus musculus
tcttgttcaaattattggactgtta

SEQ ID NO: 839892 - DNA, 25 bp, Mus musculus
tcttgttcaaccaaccttcttgaat

SEQ ID NO: 839893 - DNA, 25 bp, Mus musculus
tcttgttcaacctaccttcttgaat

SEQ ID NO: 839894 - DNA, 25 bp, Mus musculus
tcttgttcagagagcggtccctaga

SEQ ID NO: 839895 - DNA, 25 bp, Mus musculus
tcttgttcagagtgcggtccctaga

SEQ ID NO: 839896 - DNA, 25 bp, Mus musculus
tcttgttccaagacaatttgcctat

SEQ ID NO: 839897 - DNA, 25 bp, Mus musculus
tcttgttccaagtcaatttgcctat

SEQ ID NO: 839898 - DNA, 25 bp, Mus musculus
tcttgttcctgtcggcgaacatcta

SEQ ID NO: 839899 - DNA, 25 bp, Mus musculus
tcttgttcctgtgggcgaacatcta

SEQ ID NO: 839900 - DNA, 25 bp, Mus musculus
tcttgttcctttacaagggtgtctt

SEQ ID NO: 839901 - DNA, 25 bp, Mus musculus
tcttgttcctttccagatgtttgag

SEQ ID NO: 839902 - DNA, 25 bp, Mus musculus
tcttgttcctttgcagatgtttgag

SEQ ID NO: 839903 - DNA, 25 bp, Mus musculus
tcttgttccttttcaagggtgtctt

SEQ ID NO: 839904 - DNA, 25 bp, Mus musculus
tcttgttctagacttgtgtgtgcaa

SEQ ID NO: 839905 - DNA, 25 bp, Mus musculus
tcttgttctagagttgtgtgtgcaa

SEQ ID NO: 839906 - DNA, 25 bp, Mus musculus
tcttgttctatgaatcacacttcat

SEQ ID NO: 839907 - DNA, 25 bp, Mus musculus
tcttgttctatgtatcacacttcat

SEQ ID NO: 839908 - DNA, 25 bp, Mus musculus
tcttgttctcaaccaagttaaattt

SEQ ID NO: 839909 - DNA, 25 bp, Mus musculus
tcttgttctcaagcaagttaaattt

SEQ ID NO: 839910 - DNA, 25 bp, Mus musculus
tcttgttctccaccctagcttaatt

SEQ ID NO: 839911 - DNA, 25 bp, Mus musculus
tcttgttctccagcctagcttaatt

SEQ ID NO: 839912 - DNA, 25 bp, Mus musculus
tcttgttctgagaatccttgacatt

SEQ ID NO: 839913 - DNA, 25 bp, Mus musculus
tcttgttctgagtatccttgacatt

SEQ ID NO: 839914 - DNA, 25 bp, Mus musculus
tcttgttctgtaatagcatgccact

SEQ ID NO: 839915 - DNA, 25 bp, Mus musculus
tcttgttctgtattagcatgccact

SEQ ID NO: 839916 - DNA, 25 bp, Mus musculus
tcttgttcttagatcccaaccttgt

SEQ ID NO: 839917 - DNA, 25 bp, Mus musculus
tcttgttcttagttcccaaccttgt

SEQ ID NO: 839918 - DNA, 25 bp, Mus musculus
tcttgttcttctattcatttctatt

SEQ ID NO: 839919 - DNA, 25 bp, Mus musculus
tcttgttcttcttttcatttctatt

SEQ ID NO: 839920 - DNA, 25 bp, Mus musculus
tcttgttcttggagtgtacctgtac

SEQ ID NO: 839921 - DNA, 25 bp, Mus musculus
tcttgttcttggtgtgtacctgtac

SEQ ID NO: 839922 - DNA, 25 bp, Mus musculus
tcttgttgaaatccaattacctttt

SEQ ID NO: 839923 - DNA, 25 bp, Mus musculus
tcttgttgaaatgcaattacctttt

SEQ ID NO: 839924 - DNA, 25 bp, Mus musculus
tcttgttgaacaatactggtggctt

SEQ ID NO: 839925 - DNA, 25 bp, Mus musculus
tcttgttgaacattactggtggctt

SEQ ID NO: 839926 - DNA, 25 bp, Mus musculus
tcttgttgacatcgaatatgacttt

SEQ ID NO: 839927 - DNA, 25 bp, Mus musculus
tcttgttgacatggaatatgacttt

SEQ ID NO: 839928 - DNA, 25 bp, Mus musculus
tcttgttgccagagtacccaggtac

SEQ ID NO: 839929 - DNA, 25 bp, Mus musculus
tcttgttgccagtgtacccaggtac

SEQ ID NO: 839930 - DNA, 25 bp, Mus musculus
tcttgttgccggcttttgcaccaca

SEQ ID NO: 839931 - DNA, 25 bp, Mus musculus
tcttgttgccgggttttgcaccaca

SEQ ID NO: 839932 - DNA, 25 bp, Mus musculus
tcttgttggcacacactgagttcta

SEQ ID NO: 839933 - DNA, 25 bp, Mus musculus
tcttgttggcactcactgagttcta

SEQ ID NO: 839934 - DNA, 25 bp, Mus musculus
tcttgttgtagacgctccagaattc

SEQ ID NO: 839935 - DNA, 25 bp, Mus musculus
tcttgttgtagaggctccagaattc

SEQ ID NO: 839936 - DNA, 25 bp, Mus musculus
tcttgttgtaggaaaacggcttgca

SEQ ID NO: 839937 - DNA, 25 bp, Mus musculus
tcttgttgtaggtaaacggcttgca

SEQ ID NO: 839938 - DNA, 25 bp, Mus musculus
tcttgttgttcaatgtaacctttgt

SEQ ID NO: 839939 - DNA, 25 bp, Mus musculus
tcttgttgttcattgtaacctttgt

SEQ ID NO: 839940 - DNA, 25 bp, Mus musculus
tcttgtttaaatccagctcctccac

SEQ ID NO: 839941 - DNA, 25 bp, Mus musculus
tcttgtttaaatgcagctcctccac

SEQ ID NO: 839942 - DNA, 25 bp, Mus musculus
tcttgtttaactactggagcccagg

SEQ ID NO: 839943 - DNA, 25 bp, Mus musculus
tcttgtttaacttctggagcccagg

SEQ ID NO: 839944 - DNA, 25 bp, Mus musculus
tcttgtttacgaaattagcttccct

SEQ ID NO: 839945 - DNA, 25 bp, Mus musculus
tcttgtttacgatattagcttccct

SEQ ID NO: 839946 - DNA, 25 bp, Mus musculus
tcttgtttactgagccatggtctca

SEQ ID NO: 839947 - DNA, 25 bp, Mus musculus
tcttgtttactgtgccatggtctca

SEQ ID NO: 839948 - DNA, 25 bp, Mus musculus
tcttgtttcactctgtggaggaggc

SEQ ID NO: 839949 - DNA, 25 bp, Mus musculus
tcttgtttcactgtgtggaggaggc

SEQ ID NO: 839950 - DNA, 25 bp, Mus musculus
tcttgtttcattctgaacatggcat

SEQ ID NO: 839951 - DNA, 25 bp, Mus musculus
tcttgtttcattgtgaacatggcat

SEQ ID NO: 839952 - DNA, 25 bp, Mus musculus
tcttgtttccatagctgcggtcagg

SEQ ID NO: 839953 - DNA, 25 bp, Mus musculus
tcttgtttccattgctgcggtcagg

SEQ ID NO: 839954 - DNA, 25 bp, Mus musculus
tcttgtttcctcagacagggtggaa

SEQ ID NO: 839955 - DNA, 25 bp, Mus musculus
tcttgtttcctctgacagggtggaa

SEQ ID NO: 839956 - DNA, 25 bp, Mus musculus
tcttgtttctatcaagttctccagt

SEQ ID NO: 839957 - DNA, 25 bp, Mus musculus
tcttgtttctatgaagttctccagt

SEQ ID NO: 839958 - DNA, 25 bp, Mus musculus
tcttgtttctgtcattgtcattaaa

SEQ ID NO: 839959 - DNA, 25 bp, Mus musculus
tcttgtttctgtgattgtcattaaa

SEQ ID NO: 839960 - DNA, 25 bp, Mus musculus
tcttgtttctttaatatgataatat

SEQ ID NO: 839961 - DNA, 25 bp, Mus musculus
tcttgtttcttttatatgataatat

SEQ ID NO: 839962 - DNA, 25 bp, Mus musculus
tcttgtttgaatactcatgggatat

SEQ ID NO: 839963 - DNA, 25 bp, Mus musculus
tcttgtttgaattctcatgggatat

SEQ ID NO: 839964 - DNA, 25 bp, Mus musculus
tcttgtttgagccactttgctttaa

SEQ ID NO: 839965 - DNA, 25 bp, Mus musculus
tcttgtttgagcgactttgctttaa

SEQ ID NO: 839966 - DNA, 25 bp, Mus musculus
tcttgtttgaggactgtctgtccac

SEQ ID NO: 839967 - DNA, 25 bp, Mus musculus
tcttgtttgaggtctgtctgtccac

SEQ ID NO: 839968 - DNA, 25 bp, Mus musculus
tcttgtttgattatgcctcatggtc

SEQ ID NO: 839969 - DNA, 25 bp, Mus musculus
tcttgtttgattttgcctcatggtc

SEQ ID NO: 839970 - DNA, 25 bp, Mus musculus
tcttgtttgcctatggtgtttccta

SEQ ID NO: 839971 - DNA, 25 bp, Mus musculus
tcttgtttgcctctagacacctgga

SEQ ID NO: 839972 - DNA, 25 bp, Mus musculus
tcttgtttgcctgtagacacctgga

SEQ ID NO: 839973 - DNA, 25 bp, Mus musculus
tcttgtttgcctttggtgtttccta

SEQ ID NO: 839974 - DNA, 25 bp, Mus musculus
tcttgtttgtggattgacgagctct

SEQ ID NO: 839975 - DNA, 25 bp, Mus musculus
tcttgtttgtggtttgacgagctct

SEQ ID NO: 839976 - DNA, 25 bp, Mus musculus
tcttgttttaatacacatttgaaat

SEQ ID NO: 839977 - DNA, 25 bp, Mus musculus
tcttgttttaattcacatttgaaat

SEQ ID NO: 839978 - DNA, 25 bp, Mus musculus
tcttgttttactagaaatgggaatc

SEQ ID NO: 839979 - DNA, 25 bp, Mus musculus
tcttgttttacttgaaatgggaatc

SEQ ID NO: 839980 - DNA, 25 bp, Mus musculus
tcttgttttctcatgcatacagtga

SEQ ID NO: 839981 - DNA, 25 bp, Mus musculus
tcttgttttctcttgcatacagtga

SEQ ID NO: 839982 - DNA, 25 bp, Mus musculus
tcttgttttctgacaataccaaaga

SEQ ID NO: 839983 - DNA, 25 bp, Mus musculus
tcttgttttctgtcaataccaaaga

SEQ ID NO: 839984 - DNA, 25 bp, Mus musculus
tcttgttttgttccttggatcgaaa

SEQ ID NO: 839985 - DNA, 25 bp, Mus musculus
tcttgttttgttgcttggatcgaaa

SEQ ID NO: 839986 - DNA, 25 bp, Mus musculus
tctttaaaagctacttgttaatagc

SEQ ID NO: 839987 - DNA, 25 bp, Mus musculus
tctttaaaagcttcttgttaatagc

SEQ ID NO: 839988 - DNA, 25 bp, Mus musculus
tctttaaatgtgaatcccctcaggg

SEQ ID NO: 839989 - DNA, 25 bp, Mus musculus
tctttaaatgtgtatcccctcaggg

SEQ ID NO: 839990 - DNA, 25 bp, Mus musculus
tctttaaccctgaggagtcggagct

SEQ ID NO: 839991 - DNA, 25 bp, Mus musculus
tctttaaccctgtggagtcggagct

SEQ ID NO: 839992 - DNA, 25 bp, Mus musculus
tctttaacctgaatccaggctggag

SEQ ID NO: 839993 - DNA, 25 bp, Mus musculus
tctttaacctgattccaggctggag

SEQ ID NO: 839994 - DNA, 25 bp, Mus musculus
tctttaaccttcagttgcctattca

SEQ ID NO: 839995 - DNA, 25 bp, Mus musculus
tctttaaccttctgttgcctattca

SEQ ID NO: 839996 - DNA, 25 bp, Mus musculus
tctttaacctttcagctgtgtttgc

SEQ ID NO: 839997 - DNA, 25 bp, Mus musculus
tctttaacctttgagctgtgtttgc

SEQ ID NO: 839998 - DNA, 25 bp, Mus musculus
tctttaactcaacacgtccctgata

SEQ ID NO: 839999 - DNA, 25 bp, Mus musculus
tctttaactcaagacgtccctgata

SEQ ID NO: 840000 - DNA, 25 bp, Mus musculus
tctttaagcctaaacaatgattcac

SEQ ID NO: 840001 - DNA, 25 bp, Mus musculus
tctttaagcctatacaatgattcac

SEQ ID NO: 840002 - DNA, 25 bp, Mus musculus
tctttaaggaacagctttctctccc

SEQ ID NO: 840003 - DNA, 25 bp, Mus musculus
tctttaaggaactgctttctctccc

SEQ ID NO: 840004 - DNA, 25 bp, Mus musculus
tctttaagggctcgtctgagtcctc

SEQ ID NO: 840005 - DNA, 25 bp, Mus musculus
tctttaagggctggtctgagtcctc

SEQ ID NO: 840006 - DNA, 25 bp, Mus musculus
tctttaatcctcagcagtcattctg

SEQ ID NO: 840007 - DNA, 25 bp, Mus musculus
tctttaatcctctgcagtcattctg

SEQ ID NO: 840008 - DNA, 25 bp, Mus musculus
tctttaatgtgcatccagagatcat

SEQ ID NO: 840009 - DNA, 25 bp, Mus musculus
tctttaatgtgcttccagagatcat

SEQ ID NO: 840010 - DNA, 25 bp, Mus musculus
tctttaattactctggttcctcctc

SEQ ID NO: 840011 - DNA, 25 bp, Mus musculus
tctttaattactgtggttcctcctc

SEQ ID NO: 840012 - DNA, 25 bp, Mus musculus
tctttaattctccttcagccctcat

SEQ ID NO: 840013 - DNA, 25 bp, Mus musculus
tctttaattctcgttcagccctcat

SEQ ID NO: 840014 - DNA, 25 bp, Mus musculus
tctttaatttttacagctggagctg

SEQ ID NO: 840015 - DNA, 25 bp, Mus musculus
tctttaattttttcagctggagctg

SEQ ID NO: 840016 - DNA, 25 bp, Mus musculus
tctttacaatttactcccttatctc

SEQ ID NO: 840017 - DNA, 25 bp, Mus musculus
tctttacaattttctcccttatctc

SEQ ID NO: 840018 - DNA, 25 bp, Mus musculus
tctttacacaaccttgtctgatgtt

SEQ ID NO: 840019 - DNA, 25 bp, Mus musculus
tctttacacaacgttgtctgatgtt

SEQ ID NO: 840020 - DNA, 25 bp, Mus musculus
tctttacacacactagcttcatgag

SEQ ID NO: 840021 - DNA, 25 bp, Mus musculus
tctttacacacagtagcttcatgag

SEQ ID NO: 840022 - DNA, 25 bp, Mus musculus
tctttacacggtacctaaggcctgg

SEQ ID NO: 840023 - DNA, 25 bp, Mus musculus
tctttacacggttcctaaggcctgg

SEQ ID NO: 840024 - DNA, 25 bp, Mus musculus
tctttacaggcaatccccaaggctc

SEQ ID NO: 840025 - DNA, 25 bp, Mus musculus
tctttacaggcattccccaaggctc

SEQ ID NO: 840026 - DNA, 25 bp, Mus musculus
tctttacagtcacgaagcatagaat

SEQ ID NO: 840027 - DNA, 25 bp, Mus musculus
tctttacagtcaggaagcatagaat

SEQ ID NO: 840028 - DNA, 25 bp, Mus musculus
tctttacatgctcattctgcttctc

SEQ ID NO: 840029 - DNA, 25 bp, Mus musculus
tctttacatgctgattctgcttctc

SEQ ID NO: 840030 - DNA, 25 bp, Mus musculus
tctttaccaaagcagctcgctgcag

SEQ ID NO: 840031 - DNA, 25 bp, Mus musculus
tctttaccaaaggagctcgctgcag

SEQ ID NO: 840032 - DNA, 25 bp, Mus musculus
tctttaccaggtagagctgctgttt

SEQ ID NO: 840033 - DNA, 25 bp, Mus musculus
tctttaccaggttgagctgctgttt

SEQ ID NO: 840034 - DNA, 25 bp, Mus musculus
tctttaccctggacattctgtattc

SEQ ID NO: 840035 - DNA, 25 bp, Mus musculus
tctttaccctggtcattctgtattc

SEQ ID NO: 840036 - DNA, 25 bp, Mus musculus
tctttacctactccttggctgtaaa

SEQ ID NO: 840037 - DNA, 25 bp, Mus musculus
tctttacctactgcttggctgtaaa

SEQ ID NO: 840038 - DNA, 25 bp, Mus musculus
tctttacctgtaattggcgtgcaaa

SEQ ID NO: 840039 - DNA, 25 bp, Mus musculus
tctttacctgtatttggcgtgcaaa

SEQ ID NO: 840040 - DNA, 25 bp, Mus musculus
tctttaccttgcaccttcttcagga

SEQ ID NO: 840041 - DNA, 25 bp, Mus musculus
tctttaccttgctccttcttcagga

SEQ ID NO: 840042 - DNA, 25 bp, Mus musculus
tctttacggttcatcgggaagagag

SEQ ID NO: 840043 - DNA, 25 bp, Mus musculus
tctttacggttcttcgggaagagag

SEQ ID NO: 840044 - DNA, 25 bp, Mus musculus
tctttactatacacggatggggatg

SEQ ID NO: 840045 - DNA, 25 bp, Mus musculus
tctttactatactcggatggggatg

SEQ ID NO: 840046 - DNA, 25 bp, Mus musculus
tctttactcattcctctgtgggcca

SEQ ID NO: 840047 - DNA, 25 bp, Mus musculus
tctttactcattgctctgtgggcca

SEQ ID NO: 840048 - DNA, 25 bp, Mus musculus
tctttactcggtagagtggatctgg

SEQ ID NO: 840049 - DNA, 25 bp, Mus musculus
tctttactcggttgagtggatctgg

SEQ ID NO: 840050 - DNA, 25 bp, Mus musculus
tctttactctgcatttatagaccgt

SEQ ID NO: 840051 - DNA, 25 bp, Mus musculus
tctttactctgcttttatagaccgt

SEQ ID NO: 840052 - DNA, 25 bp, Mus musculus
tctttactgagacacccaggatcca

SEQ ID NO: 840053 - DNA, 25 bp, Mus musculus
tctttactgagagacccaggatcca

SEQ ID NO: 840054 - DNA, 25 bp, Mus musculus
tctttactgaggatggaataaacag

SEQ ID NO: 840055 - DNA, 25 bp, Mus musculus
tctttactgaggttggaataaacag

SEQ ID NO: 840056 - DNA, 25 bp, Mus musculus
tctttagacccgctggactttgtgt

SEQ ID NO: 840057 - DNA, 25 bp, Mus musculus
tctttagacccggtggactttgtgt

SEQ ID NO: 840058 - DNA, 25 bp, Mus musculus
tctttagacctcatagctgctgctt

SEQ ID NO: 840059 - DNA, 25 bp, Mus musculus
tctttagacctcttagctgctgctt

SEQ ID NO: 840060 - DNA, 25 bp, Mus musculus
tctttagatggcctactgcagtcac

SEQ ID NO: 840061 - DNA, 25 bp, Mus musculus
tctttagatggcgtactgcagtcac

SEQ ID NO: 840062 - DNA, 25 bp, Mus musculus
tctttagatgtcctatccggaggag

SEQ ID NO: 840063 - DNA, 25 bp, Mus musculus
tctttagatgtcgtatccggaggag

SEQ ID NO: 840064 - DNA, 25 bp, Mus musculus
tctttagcacaaatcttgcttttag

SEQ ID NO: 840065 - DNA, 25 bp, Mus musculus
tctttagcacaattcttgcttttag

SEQ ID NO: 840066 - DNA, 25 bp, Mus musculus
tctttagcatttccaccgtgttgat

SEQ ID NO: 840067 - DNA, 25 bp, Mus musculus
tctttagcatttgcaccgtgttgat

SEQ ID NO: 840068 - DNA, 25 bp, Mus musculus
tctttagccaggaggctgccgacga

SEQ ID NO: 840069 - DNA, 25 bp, Mus musculus
tctttagccaggtggctgccgacga

SEQ ID NO: 840070 - DNA, 25 bp, Mus musculus
tctttagcccctatctagttttgag

SEQ ID NO: 840071 - DNA, 25 bp, Mus musculus
tctttagcccctttctagttttgag

SEQ ID NO: 840072 - DNA, 25 bp, Mus musculus
tctttagctcacaggtcccatctat

SEQ ID NO: 840073 - DNA, 25 bp, Mus musculus
tctttagctcactggtcccatctat

SEQ ID NO: 840074 - DNA, 25 bp, Mus musculus
tctttagctgttacaatgagatcga

SEQ ID NO: 840075 - DNA, 25 bp, Mus musculus
tctttagctgtttcaatgagatcga

SEQ ID NO: 840076 - DNA, 25 bp, Mus musculus
tctttaggaaataatctcgtcataa

SEQ ID NO: 840077 - DNA, 25 bp, Mus musculus
tctttaggaaattatctcgtcataa

SEQ ID NO: 840078 - DNA, 25 bp, Mus musculus
tctttaggacctacattgcaggaga

SEQ ID NO: 840079 - DNA, 25 bp, Mus musculus
tctttaggaccttcattgcaggaga

SEQ ID NO: 840080 - DNA, 25 bp, Mus musculus
tctttaggcacgagggtcccaagtg

SEQ ID NO: 840081 - DNA, 25 bp, Mus musculus
tctttaggcacgtgggtcccaagtg

SEQ ID NO: 840082 - DNA, 25 bp, Mus musculus
tctttagggctcagacaaccccatg

SEQ ID NO: 840083 - DNA, 25 bp, Mus musculus
tctttagggctctgacaaccccatg

SEQ ID NO: 840084 - DNA, 25 bp, Mus musculus
tctttagttttcagtggtccacata

SEQ ID NO: 840085 - DNA, 25 bp, Mus musculus
tctttagttttctgtggtccacata

SEQ ID NO: 840086 - DNA, 25 bp, Mus musculus
tctttataatgcctttctacccttc

SEQ ID NO: 840087 - DNA, 25 bp, Mus musculus
tctttataatgcgtttctacccttc

SEQ ID NO: 840088 - DNA, 25 bp, Mus musculus
tctttatcccacatcaacatagctg

SEQ ID NO: 840089 - DNA, 25 bp, Mus musculus
tctttatcccacttcaacatagctg

SEQ ID NO: 840090 - DNA, 25 bp, Mus musculus
tctttatccctcaaacagatgtata

SEQ ID NO: 840091 - DNA, 25 bp, Mus musculus
tctttatccctctaacagatgtata

SEQ ID NO: 840092 - DNA, 25 bp, Mus musculus
tctttatcgatacccacaaccgcaa

SEQ ID NO: 840093 - DNA, 25 bp, Mus musculus
tctttatcgatagccacaaccgcaa

SEQ ID NO: 840094 - DNA, 25 bp, Mus musculus
tctttatcttctcctcacaacgact

SEQ ID NO: 840095 - DNA, 25 bp, Mus musculus
tctttatcttctgctcacaacgact

SEQ ID NO: 840096 - DNA, 25 bp, Mus musculus
tctttatctttgcaactctaggcgc

SEQ ID NO: 840097 - DNA, 25 bp, Mus musculus
tctttatctttggaactctaggcgc

SEQ ID NO: 840098 - DNA, 25 bp, Mus musculus
tctttatgacgtacctcatatcctc

SEQ ID NO: 840099 - DNA, 25 bp, Mus musculus
tctttatgacgttcctcatatcctc

SEQ ID NO: 840100 - DNA, 25 bp, Mus musculus
tctttatggcacatctagacaaaca

SEQ ID NO: 840101 - DNA, 25 bp, Mus musculus
tctttatggcacttctagacaaaca

SEQ ID NO: 840102 - DNA, 25 bp, Mus musculus
tctttatggtatcctcttcattttt

SEQ ID NO: 840103 - DNA, 25 bp, Mus musculus
tctttatggtatgctcttcattttt

SEQ ID NO: 840104 - DNA, 25 bp, Mus musculus
tctttatggttgaagtgttgctgaa

SEQ ID NO: 840105 - DNA, 25 bp, Mus musculus
tctttatggttgtagtgttgctgaa

SEQ ID NO: 840106 - DNA, 25 bp, Mus musculus
tctttatggtttctgcacttgggag

SEQ ID NO: 840107 - DNA, 25 bp, Mus musculus
tctttatggtttgtgcacttgggag

SEQ ID NO: 840108 - DNA, 25 bp, Mus musculus
tctttatgtccacagtaactgcaga

SEQ ID NO: 840109 - DNA, 25 bp, Mus musculus
tctttatgtccagagtaactgcaga

SEQ ID NO: 840110 - DNA, 25 bp, Mus musculus
tctttatgtcctctttgaagccagt

SEQ ID NO: 840111 - DNA, 25 bp, Mus musculus
tctttatgtcctgtttgaagccagt

SEQ ID NO: 840112 - DNA, 25 bp, Mus musculus
tctttatgttgaccatgctggcctt

SEQ ID NO: 840113 - DNA, 25 bp, Mus musculus
tctttatgttgagcatgctggcctt

SEQ ID NO: 840114 - DNA, 25 bp, Mus musculus
tctttattcgcacactcctggattt

SEQ ID NO: 840115 - DNA, 25 bp, Mus musculus
tctttattcgcagactcctggattt

SEQ ID NO: 840116 - DNA, 25 bp, Mus musculus
tctttattgataccccattgcctat

SEQ ID NO: 840117 - DNA, 25 bp, Mus musculus
tctttattgatagcccattgcctat

SEQ ID NO: 840118 - DNA, 25 bp, Mus musculus
tctttatttaccactttacttatca

SEQ ID NO: 840119 - DNA, 25 bp, Mus musculus
tctttatttaccagttcctagctct

SEQ ID NO: 840120 - DNA, 25 bp, Mus musculus
tctttatttacctctttacttatca

SEQ ID NO: 840121 - DNA, 25 bp, Mus musculus
tctttatttacctgttcctagctct

SEQ ID NO: 840122 - DNA, 25 bp, Mus musculus
tctttatttcttagcagtaagtgtt

SEQ ID NO: 840123 - DNA, 25 bp, Mus musculus
tctttatttctttgcagtaagtgtt

SEQ ID NO: 840124 - DNA, 25 bp, Mus musculus
tctttatttttcagtgtacacatgc

SEQ ID NO: 840125 - DNA, 25 bp, Mus musculus
tctttatttttctgtgtacacatgc

SEQ ID NO: 840126 - DNA, 25 bp, Mus musculus
tctttcaaaactatgggacgagttg

SEQ ID NO: 840127 - DNA, 25 bp, Mus musculus
tctttcaaaactttgggacgagttg

SEQ ID NO: 840128 - DNA, 25 bp, Mus musculus
tctttcaaagagagacagtagctgc

SEQ ID NO: 840129 - DNA, 25 bp, Mus musculus
tctttcaaagagtgacagtagctgc

SEQ ID NO: 840130 - DNA, 25 bp, Mus musculus
tctttcaacacaacgcggagtacct

SEQ ID NO: 840131 - DNA, 25 bp, Mus musculus
tctttcaacacatcgcggagtacct

SEQ ID NO: 840132 - DNA, 25 bp, Mus musculus
tctttcaacactagcgtcttctgga

SEQ ID NO: 840133 - DNA, 25 bp, Mus musculus
tctttcaacactcactcctcagtga

SEQ ID NO: 840134 - DNA, 25 bp, Mus musculus
tctttcaacactgactcctcagtga

SEQ ID NO: 840135 - DNA, 25 bp, Mus musculus
tctttcaacacttgcgtcttctgga

SEQ ID NO: 840136 - DNA, 25 bp, Mus musculus
tctttcaacatgcttcagttttatc

SEQ ID NO: 840137 - DNA, 25 bp, Mus musculus
tctttcaacatggttcagttttatc

SEQ ID NO: 840138 - DNA, 25 bp, Mus musculus
tctttcaagatcacagtattgtctc

SEQ ID NO: 840139 - DNA, 25 bp, Mus musculus
tctttcaagatctcagtattgtctc

SEQ ID NO: 840140 - DNA, 25 bp, Mus musculus
tctttcaaggacaaaccccgggcag

SEQ ID NO: 840141 - DNA, 25 bp, Mus musculus
tctttcaaggactaaccccgggcag

SEQ ID NO: 840142 - DNA, 25 bp, Mus musculus
tctttcaagtttacatggcctggga

SEQ ID NO: 840143 - DNA, 25 bp, Mus musculus
tctttcaagttttcatggcctggga

SEQ ID NO: 840144 - DNA, 25 bp, Mus musculus
tctttcaataagctcctgtgtctaa

SEQ ID NO: 840145 - DNA, 25 bp, Mus musculus
tctttcaataaggtcctgtgtctaa

SEQ ID NO: 840146 - DNA, 25 bp, Mus musculus
tctttcacagtcctatagagagaca

SEQ ID NO: 840147 - DNA, 25 bp, Mus musculus
tctttcacagtcgtatagagagaca

SEQ ID NO: 840148 - DNA, 25 bp, Mus musculus
tctttcacccacagtgttggagtta

SEQ ID NO: 840149 - DNA, 25 bp, Mus musculus
tctttcacccactgtgttggagtta

SEQ ID NO: 840150 - DNA, 25 bp, Mus musculus
tctttcacccagatatatcacatgt

SEQ ID NO: 840151 - DNA, 25 bp, Mus musculus
tctttcacccagttatatcacatgt

SEQ ID NO: 840152 - DNA, 25 bp, Mus musculus
tctttcaccctcaagtttctaaaat

SEQ ID NO: 840153 - DNA, 25 bp, Mus musculus
tctttcaccctctagtttctaaaat

SEQ ID NO: 840154 - DNA, 25 bp, Mus musculus
tctttcaccgaaagctttgggcgta

SEQ ID NO: 840155 - DNA, 25 bp, Mus musculus
tctttcaccgaatgctttgggcgta

SEQ ID NO: 840156 - DNA, 25 bp, Mus musculus
tctttcaccgttatgactttttgag

SEQ ID NO: 840157 - DNA, 25 bp, Mus musculus
tctttcaccgttttgactttttgag

SEQ ID NO: 840158 - DNA, 25 bp, Mus musculus
tctttcactaatatatcttttggat

SEQ ID NO: 840159 - DNA, 25 bp, Mus musculus
tctttcactaatttatcttttggat

SEQ ID NO: 840160 - DNA, 25 bp, Mus musculus
tctttcactgttatcaaatatccct

SEQ ID NO: 840161 - DNA, 25 bp, Mus musculus
tctttcactgttatgtgccagagat

SEQ ID NO: 840162 - DNA, 25 bp, Mus musculus
tctttcactgttttcaaatatccct

SEQ ID NO: 840163 - DNA, 25 bp, Mus musculus
tctttcactgttttgtgccagagat

SEQ ID NO: 840164 - DNA, 25 bp, Mus musculus
tctttcacttccagtccctgtagaa

SEQ ID NO: 840165 - DNA, 25 bp, Mus musculus
tctttcacttcctgtccctgtagaa

SEQ ID NO: 840166 - DNA, 25 bp, Mus musculus
tctttcagacacatctttctatctt

SEQ ID NO: 840167 - DNA, 25 bp, Mus musculus
tctttcagacacttctttctatctt

SEQ ID NO: 840168 - DNA, 25 bp, Mus musculus
tctttcagacccatctgaatcacgt

SEQ ID NO: 840169 - DNA, 25 bp, Mus musculus
tctttcagacccttctgaatcacgt

SEQ ID NO: 840170 - DNA, 25 bp, Mus musculus
tctttcagagaccaggccaggatct

SEQ ID NO: 840171 - DNA, 25 bp, Mus musculus
tctttcagagacgaggccaggatct

SEQ ID NO: 840172 - DNA, 25 bp, Mus musculus
tctttcagatagctttgggataccc

SEQ ID NO: 840173 - DNA, 25 bp, Mus musculus
tctttcagataggtttgggataccc

SEQ ID NO: 840174 - DNA, 25 bp, Mus musculus
tctttcagatctcccactgtgcagg

SEQ ID NO: 840175 - DNA, 25 bp, Mus musculus
tctttcagatctgccactgtgcagg

SEQ ID NO: 840176 - DNA, 25 bp, Mus musculus
tctttcagatgccaacatagccctg

SEQ ID NO: 840177 - DNA, 25 bp, Mus musculus
tctttcagatgcgaacatagccctg

SEQ ID NO: 840178 - DNA, 25 bp, Mus musculus
tctttcagcagaactttaggttaaa

SEQ ID NO: 840179 - DNA, 25 bp, Mus musculus
tctttcagcagatctttaggttaaa

SEQ ID NO: 840180 - DNA, 25 bp, Mus musculus
tctttcagccatcctatccttgagc

SEQ ID NO: 840181 - DNA, 25 bp, Mus musculus
tctttcagccatgctatccttgagc

SEQ ID NO: 840182 - DNA, 25 bp, Mus musculus
tctttcagccctaacgtaagagcaa

SEQ ID NO: 840183 - DNA, 25 bp, Mus musculus
tctttcagcccttacgtaagagcaa

SEQ ID NO: 840184 - DNA, 25 bp, Mus musculus
tctttcagggctagaccgtgatgac

SEQ ID NO: 840185 - DNA, 25 bp, Mus musculus
tctttcagggcttgaccgtgatgac

SEQ ID NO: 840186 - DNA, 25 bp, Mus musculus
tctttcagggtccactgacacacag

SEQ ID NO: 840187 - DNA, 25 bp, Mus musculus
tctttcagggtcgactgacacacag

SEQ ID NO: 840188 - DNA, 25 bp, Mus musculus
tctttcaggtctcccctgcgcagga

SEQ ID NO: 840189 - DNA, 25 bp, Mus musculus
tctttcaggtctgccctgcgcagga

SEQ ID NO: 840190 - DNA, 25 bp, Mus musculus
tctttcagtagccaggatcctttca

SEQ ID NO: 840191 - DNA, 25 bp, Mus musculus
tctttcagtagcgaggatcctttca

SEQ ID NO: 840192 - DNA, 25 bp, Mus musculus
tctttcagtgacctcatcagtacgg

SEQ ID NO: 840193 - DNA, 25 bp, Mus musculus
tctttcagtgacgtcatcagtacgg

SEQ ID NO: 840194 - DNA, 25 bp, Mus musculus
tctttcagtgatatctcagtgcata

SEQ ID NO: 840195 - DNA, 25 bp, Mus musculus
tctttcagtgatttctcagtgcata

SEQ ID NO: 840196 - DNA, 25 bp, Mus musculus
tctttcagttgcatgatgtttggaa

SEQ ID NO: 840197 - DNA, 25 bp, Mus musculus
tctttcagttgcttgatgtttggaa

SEQ ID NO: 840198 - DNA, 25 bp, Mus musculus
tctttcatccttcaccaacaaagca

SEQ ID NO: 840199 - DNA, 25 bp, Mus musculus
tctttcatccttgaccaacaaagca

SEQ ID NO: 840200 - DNA, 25 bp, Mus musculus
tctttcatgaagactgccccatagc

SEQ ID NO: 840201 - DNA, 25 bp, Mus musculus
tctttcatgaagtctgccccatagc

SEQ ID NO: 840202 - DNA, 25 bp, Mus musculus
tctttcatgcataccacagctaggc

SEQ ID NO: 840203 - DNA, 25 bp, Mus musculus
tctttcatgcattccacagctaggc

SEQ ID NO: 840204 - DNA, 25 bp, Mus musculus
tctttcatgcccatctaccaatgaa

SEQ ID NO: 840205 - DNA, 25 bp, Mus musculus
tctttcatgcccttctaccaatgaa

SEQ ID NO: 840206 - DNA, 25 bp, Mus musculus
tctttcatggtgcagtctaagaata

SEQ ID NO: 840207 - DNA, 25 bp, Mus musculus
tctttcatggtggagtctaagaata

SEQ ID NO: 840208 - DNA, 25 bp, Mus musculus
tctttcattagcagtgcctctgcgt

SEQ ID NO: 840209 - DNA, 25 bp, Mus musculus
tctttcattagctgtgcctctgcgt

SEQ ID NO: 840210 - DNA, 25 bp, Mus musculus
tctttcattgtaatgtgatttcttt

SEQ ID NO: 840211 - DNA, 25 bp, Mus musculus
tctttcattgtattgtgatttcttt

SEQ ID NO: 840212 - DNA, 25 bp, Mus musculus
tctttcatttcaactgcataccgac

SEQ ID NO: 840213 - DNA, 25 bp, Mus musculus
tctttcatttcatctgcataccgac

SEQ ID NO: 840214 - DNA, 25 bp, Mus musculus
tctttcatttccaacccgataacaa

SEQ ID NO: 840215 - DNA, 25 bp, Mus musculus
tctttcatttcctacccgataacaa

SEQ ID NO: 840216 - DNA, 25 bp, Mus musculus
tctttccaccctacattaatttcct

SEQ ID NO: 840217 - DNA, 25 bp, Mus musculus
tctttccacccttcattaatttcct

SEQ ID NO: 840218 - DNA, 25 bp, Mus musculus
tctttccacgtgcaacgagggttag

SEQ ID NO: 840219 - DNA, 25 bp, Mus musculus
tctttccacgtggaacgagggttag

SEQ ID NO: 840220 - DNA, 25 bp, Mus musculus
tctttccagattcgtggcccaggtg

SEQ ID NO: 840221 - DNA, 25 bp, Mus musculus
tctttccagattggtggcccaggtg

SEQ ID NO: 840222 - DNA, 25 bp, Mus musculus
tctttccagctgaaaaaccaccata

SEQ ID NO: 840223 - DNA, 25 bp, Mus musculus
tctttccagctgtaaaaccaccata

SEQ ID NO: 840224 - DNA, 25 bp, Mus musculus
tctttccaggatccaagcctagtga

SEQ ID NO: 840225 - DNA, 25 bp, Mus musculus
tctttccaggatgcaagcctagtga

SEQ ID NO: 840226 - DNA, 25 bp, Mus musculus
tctttccatcatcctgggtaaagct

SEQ ID NO: 840227 - DNA, 25 bp, Mus musculus
tctttccatcatgctgggtaaagct

SEQ ID NO: 840228 - DNA, 25 bp, Mus musculus
tctttccatccaagccaagggcaga

SEQ ID NO: 840229 - DNA, 25 bp, Mus musculus
tctttccatccatgccaagggcaga

SEQ ID NO: 840230 - DNA, 25 bp, Mus musculus
tctttccatgaaccgcactgcaaaa

SEQ ID NO: 840231 - DNA, 25 bp, Mus musculus
tctttccatgaagcgcactgcaaaa

SEQ ID NO: 840232 - DNA, 25 bp, Mus musculus
tctttccatgtgaattctcctagcc

SEQ ID NO: 840233 - DNA, 25 bp, Mus musculus
tctttccatgtgtattctcctagcc

SEQ ID NO: 840234 - DNA, 25 bp, Mus musculus
tctttccattagatacaggcccctg

SEQ ID NO: 840235 - DNA, 25 bp, Mus musculus
tctttccattagttacaggcccctg

SEQ ID NO: 840236 - DNA, 25 bp, Mus musculus
tctttccattcaccagaccattccg

SEQ ID NO: 840237 - DNA, 25 bp, Mus musculus
tctttccattcagcagaccattccg

SEQ ID NO: 840238 - DNA, 25 bp, Mus musculus
tctttccatttcaccagtttcctga

SEQ ID NO: 840239 - DNA, 25 bp, Mus musculus
tctttccatttcataactggatgat

SEQ ID NO: 840240 - DNA, 25 bp, Mus musculus
tctttccatttctccagtttcctga

SEQ ID NO: 840241 - DNA, 25 bp, Mus musculus
tctttccatttcttaactggatgat

SEQ ID NO: 840242 - DNA, 25 bp, Mus musculus
tctttcccaacacaagaggatccac

SEQ ID NO: 840243 - DNA, 25 bp, Mus musculus
tctttcccaacagaagaggatccac

SEQ ID NO: 840244 - DNA, 25 bp, Mus musculus
tctttcccaactaaaatctgagatg

SEQ ID NO: 840245 - DNA, 25 bp, Mus musculus
tctttcccaacttaaatctgagatg

SEQ ID NO: 840246 - DNA, 25 bp, Mus musculus
tctttcccaatgagtaggctgccat

SEQ ID NO: 840247 - DNA, 25 bp, Mus musculus
tctttcccaatgtgtaggctgccat

SEQ ID NO: 840248 - DNA, 25 bp, Mus musculus
tctttcccactcactgggttcaatt

SEQ ID NO: 840249 - DNA, 25 bp, Mus musculus
tctttcccactctctgggttcaatt

SEQ ID NO: 840250 - DNA, 25 bp, Mus musculus
tctttcccagaaacgctaggcagag

SEQ ID NO: 840251 - DNA, 25 bp, Mus musculus
tctttcccagaatcgctaggcagag

SEQ ID NO: 840252 - DNA, 25 bp, Mus musculus
tctttcccagacagcggaagtactg

SEQ ID NO: 840253 - DNA, 25 bp, Mus musculus
tctttcccagactgcggaagtactg

SEQ ID NO: 840254 - DNA, 25 bp, Mus musculus
tctttcccagagcacatcacagttt

SEQ ID NO: 840255 - DNA, 25 bp, Mus musculus
tctttcccagaggacatcacagttt

SEQ ID NO: 840256 - DNA, 25 bp, Mus musculus
tctttcccatacaacatttcttcag

SEQ ID NO: 840257 - DNA, 25 bp, Mus musculus
tctttcccatactacatttcttcag

SEQ ID NO: 840258 - DNA, 25 bp, Mus musculus
tctttccccatgagacctgggaaga

SEQ ID NO: 840259 - DNA, 25 bp, Mus musculus
tctttccccatgtgacctgggaaga

SEQ ID NO: 840260 - DNA, 25 bp, Mus musculus
tctttcccctcactacaaagttgtg

SEQ ID NO: 840261 - DNA, 25 bp, Mus musculus
tctttcccctcagtacaaagttgtg

SEQ ID NO: 840262 - DNA, 25 bp, Mus musculus
tctttcccctgaccagcagatctgt

SEQ ID NO: 840263 - DNA, 25 bp, Mus musculus
tctttcccctgagcagcagatctgt

SEQ ID NO: 840264 - DNA, 25 bp, Mus musculus
tctttcccgattaagtcacttcctc

SEQ ID NO: 840265 - DNA, 25 bp, Mus musculus
tctttcccgatttagtcacttcctc

SEQ ID NO: 840266 - DNA, 25 bp, Mus musculus
tctttcccgcttacgcttaagattt

SEQ ID NO: 840267 - DNA, 25 bp, Mus musculus
tctttcccgctttcgcttaagattt

SEQ ID NO: 840268 - DNA, 25 bp, Mus musculus
tctttccctactcttcattgtaaag

SEQ ID NO: 840269 - DNA, 25 bp, Mus musculus
tctttccctactgttcattgtaaag

SEQ ID NO: 840270 - DNA, 25 bp, Mus musculus
tctttccctcttccattaacctttg

SEQ ID NO: 840271 - DNA, 25 bp, Mus musculus
tctttccctcttgcattaacctttg

SEQ ID NO: 840272 - DNA, 25 bp, Mus musculus
tctttccctgagagctatctttaag

SEQ ID NO: 840273 - DNA, 25 bp, Mus musculus
tctttccctgagtgctatctttaag

SEQ ID NO: 840274 - DNA, 25 bp, Mus musculus
tctttcccttatcatctagcagcta

SEQ ID NO: 840275 - DNA, 25 bp, Mus musculus
tctttcccttatgatctagcagcta

SEQ ID NO: 840276 - DNA, 25 bp, Mus musculus
tctttccctttgatcacttggaagg

SEQ ID NO: 840277 - DNA, 25 bp, Mus musculus
tctttccctttgttcacttggaagg

SEQ ID NO: 840278 - DNA, 25 bp, Mus musculus
tctttccgacgcaggatgaggaggt

SEQ ID NO: 840279 - DNA, 25 bp, Mus musculus
tctttccgacgctggatgaggaggt

SEQ ID NO: 840280 - DNA, 25 bp, Mus musculus
tctttccgactgaatgttctgtgta

SEQ ID NO: 840281 - DNA, 25 bp, Mus musculus
tctttccgactgtatgttctgtgta

SEQ ID NO: 840282 - DNA, 25 bp, Mus musculus
tctttccgaggtactgaaacagtga

SEQ ID NO: 840283 - DNA, 25 bp, Mus musculus
tctttccgaggttctgaaacagtga

SEQ ID NO: 840284 - DNA, 25 bp, Mus musculus
tctttccggagaaagggtgtaatgt

SEQ ID NO: 840285 - DNA, 25 bp, Mus musculus
tctttccggagatagggtgtaatgt

SEQ ID NO: 840286 - DNA, 25 bp, Mus musculus
tctttccgggaaaatgcagttgaca

SEQ ID NO: 840287 - DNA, 25 bp, Mus musculus
tctttccgggaatatgcagttgaca

SEQ ID NO: 840288 - DNA, 25 bp, Mus musculus
tctttccgtggactggtcttcgaaa

SEQ ID NO: 840289 - DNA, 25 bp, Mus musculus
tctttccgtggagtggtcttcgaaa

SEQ ID NO: 840290 - DNA, 25 bp, Mus musculus
tctttccgttatatcgcgtcttaag

SEQ ID NO: 840291 - DNA, 25 bp, Mus musculus
tctttccgttatttcgcgtcttaag

SEQ ID NO: 840292 - DNA, 25 bp, Mus musculus
tctttccgtttcaatggtccaaggt

SEQ ID NO: 840293 - DNA, 25 bp, Mus musculus
tctttccgtttctatggtccaaggt

SEQ ID NO: 840294 - DNA, 25 bp, Mus musculus
tctttcctaaagagtctcaactgtg

SEQ ID NO: 840295 - DNA, 25 bp, Mus musculus
tctttcctaaagtgtctcaactgtg

SEQ ID NO: 840296 - DNA, 25 bp, Mus musculus
tctttcctaacacttgggccttggc

SEQ ID NO: 840297 - DNA, 25 bp, Mus musculus
tctttcctaacagttgggccttggc

SEQ ID NO: 840298 - DNA, 25 bp, Mus musculus
tctttcctcaaaaccttatcttaga

SEQ ID NO: 840299 - DNA, 25 bp, Mus musculus
tctttcctcaaatccttatcttaga

SEQ ID NO: 840300 - DNA, 25 bp, Mus musculus
tctttcctccgcagaacacaaagct

SEQ ID NO: 840301 - DNA, 25 bp, Mus musculus
tctttcctccgctgaacacaaagct

SEQ ID NO: 840302 - DNA, 25 bp, Mus musculus
tctttcctctacagtatgctgatga

SEQ ID NO: 840303 - DNA, 25 bp, Mus musculus
tctttcctctactgtatgctgatga

SEQ ID NO: 840304 - DNA, 25 bp, Mus musculus
tctttcctctcaatgggtgtgtaca

SEQ ID NO: 840305 - DNA, 25 bp, Mus musculus
tctttcctctcattgggtgtgtaca

SEQ ID NO: 840306 - DNA, 25 bp, Mus musculus
tctttcctgggcatagactcttaca

SEQ ID NO: 840307 - DNA, 25 bp, Mus musculus
tctttcctgggcttagactcttaca

SEQ ID NO: 840308 - DNA, 25 bp, Mus musculus
tctttcctgtgaatggctagaaaca

SEQ ID NO: 840309 - DNA, 25 bp, Mus musculus
tctttcctgtgattggctagaaaca

SEQ ID NO: 840310 - DNA, 25 bp, Mus musculus
tctttcctgttgaaacactcaggag

SEQ ID NO: 840311 - DNA, 25 bp, Mus musculus
tctttcctgttgtaacactcaggag

SEQ ID NO: 840312 - DNA, 25 bp, Mus musculus
tctttcctgtttcttggctgaagat

SEQ ID NO: 840313 - DNA, 25 bp, Mus musculus
tctttcctgtttgttggctgaagat

SEQ ID NO: 840314 - DNA, 25 bp, Mus musculus
tctttccttactctgtctgcaatga

SEQ ID NO: 840315 - DNA, 25 bp, Mus musculus
tctttccttactgtgtctgcaatga

SEQ ID NO: 840316 - DNA, 25 bp, Mus musculus
tctttccttattaaaactctgtgtc

SEQ ID NO: 840317 - DNA, 25 bp, Mus musculus
tctttccttatttaaactctgtgtc

SEQ ID NO: 840318 - DNA, 25 bp, Mus musculus
tctttccttcaccatttaggccaag

SEQ ID NO: 840319 - DNA, 25 bp, Mus musculus
tctttccttcacgatttaggccaag

SEQ ID NO: 840320 - DNA, 25 bp, Mus musculus
tctttccttccaacctgttccagat

SEQ ID NO: 840321 - DNA, 25 bp, Mus musculus
tctttccttccacctaaatatgtca

SEQ ID NO: 840322 - DNA, 25 bp, Mus musculus
tctttccttccagctaaatatgtca

SEQ ID NO: 840323 - DNA, 25 bp, Mus musculus
tctttccttccatcctgttccagat

SEQ ID NO: 840324 - DNA, 25 bp, Mus musculus
tctttccttgccagatcctgctcat

SEQ ID NO: 840325 - DNA, 25 bp, Mus musculus
tctttccttgcctgatcctgctcat

SEQ ID NO: 840326 - DNA, 25 bp, Mus musculus
tctttccttggcacattccatgtag

SEQ ID NO: 840327 - DNA, 25 bp, Mus musculus
tctttccttggcactgcgcaagaat

SEQ ID NO: 840328 - DNA, 25 bp, Mus musculus
tctttccttggctcattccatgtag

SEQ ID NO: 840329 - DNA, 25 bp, Mus musculus
tctttccttggctctgcgcaagaat

SEQ ID NO: 840330 - DNA, 25 bp, Mus musculus
tctttccttgttactaggttattgc

SEQ ID NO: 840331 - DNA, 25 bp, Mus musculus
tctttccttgtttctaggttattgc

SEQ ID NO: 840332 - DNA, 25 bp, Mus musculus
tctttcctttagctatcaaccatca

SEQ ID NO: 840333 - DNA, 25 bp, Mus musculus
tctttcctttaggtatcaaccatca

SEQ ID NO: 840334 - DNA, 25 bp, Mus musculus
tctttcctttgaagcagatgcttgg

SEQ ID NO: 840335 - DNA, 25 bp, Mus musculus
tctttcctttgatgcagatgcttgg

SEQ ID NO: 840336 - DNA, 25 bp, Mus musculus
tctttcctttgcaactttaggtaat

SEQ ID NO: 840337 - DNA, 25 bp, Mus musculus
tctttcctttgctactttaggtaat

SEQ ID NO: 840338 - DNA, 25 bp, Mus musculus
tctttcctttgtagtattctgtaat

SEQ ID NO: 840339 - DNA, 25 bp, Mus musculus
tctttcctttgttgtattctgtaat

SEQ ID NO: 840340 - DNA, 25 bp, Mus musculus
tctttccttttcaacctaaatctca

SEQ ID NO: 840341 - DNA, 25 bp, Mus musculus
tctttccttttctacctaaatctca

SEQ ID NO: 840342 - DNA, 25 bp, Mus musculus
tctttcgacatcatatccctgtgtt

SEQ ID NO: 840343 - DNA, 25 bp, Mus musculus
tctttcgacatcttatccctgtgtt

SEQ ID NO: 840344 - DNA, 25 bp, Mus musculus
tctttcgaggaaatgcagtgactgg

SEQ ID NO: 840345 - DNA, 25 bp, Mus musculus
tctttcgaggaattgcagtgactgg

SEQ ID NO: 840346 - DNA, 25 bp, Mus musculus
tctttcgccattccaccagagtatg

SEQ ID NO: 840347 - DNA, 25 bp, Mus musculus
tctttcgccattgcaccagagtatg

SEQ ID NO: 840348 - DNA, 25 bp, Mus musculus
tctttcgggtaaaaccagggtcgag

SEQ ID NO: 840349 - DNA, 25 bp, Mus musculus
tctttcgggtaataccagggtcgag

SEQ ID NO: 840350 - DNA, 25 bp, Mus musculus
tctttcgtaagaacactggctggag

SEQ ID NO: 840351 - DNA, 25 bp, Mus musculus
tctttcgtaagatcactggctggag

SEQ ID NO: 840352 - DNA, 25 bp, Mus musculus
tctttcgtactaatctttcctaaga

SEQ ID NO: 840353 - DNA, 25 bp, Mus musculus
tctttcgtactattctttcctaaga

SEQ ID NO: 840354 - DNA, 25 bp, Mus musculus
tctttcgtcagaaacctcatggttg

SEQ ID NO: 840355 - DNA, 25 bp, Mus musculus
tctttcgtcagatacctcatggttg

SEQ ID NO: 840356 - DNA, 25 bp, Mus musculus
tctttcgtttgtatacctgagccca

SEQ ID NO: 840357 - DNA, 25 bp, Mus musculus
tctttcgtttgtttacctgagccca

SEQ ID NO: 840358 - DNA, 25 bp, Mus musculus
tctttctaacctatgtgggcatcag

SEQ ID NO: 840359 - DNA, 25 bp, Mus musculus
tctttctaacctttgtgggcatcag

SEQ ID NO: 840360 - DNA, 25 bp, Mus musculus
tctttctaagcactacccagttctc

SEQ ID NO: 840361 - DNA, 25 bp, Mus musculus
tctttctaagcagtacccagttctc

SEQ ID NO: 840362 - DNA, 25 bp, Mus musculus
tctttctaagtaacctttcctggca

SEQ ID NO: 840363 - DNA, 25 bp, Mus musculus
tctttctaagtatcctttcctggca

SEQ ID NO: 840364 - DNA, 25 bp, Mus musculus
tctttctaatagagcactgcaccta

SEQ ID NO: 840365 - DNA, 25 bp, Mus musculus
tctttctaatagtgcactgcaccta

SEQ ID NO: 840366 - DNA, 25 bp, Mus musculus
tctttctacaccctgggtactttgt

SEQ ID NO: 840367 - DNA, 25 bp, Mus musculus
tctttctacaccgtgggtactttgt

SEQ ID NO: 840368 - DNA, 25 bp, Mus musculus
tctttctacataaccacagtttctg

SEQ ID NO: 840369 - DNA, 25 bp, Mus musculus
tctttctacatatccacagtttctg

SEQ ID NO: 840370 - DNA, 25 bp, Mus musculus
tctttctacatcatctgtcttactc

SEQ ID NO: 840371 - DNA, 25 bp, Mus musculus
tctttctacatcttctgtcttactc

SEQ ID NO: 840372 - DNA, 25 bp, Mus musculus
tctttctacctgagagacaatgaca

SEQ ID NO: 840373 - DNA, 25 bp, Mus musculus
tctttctacctgtgagacaatgaca

SEQ ID NO: 840374 - DNA, 25 bp, Mus musculus
tctttctacgtgatgcagctactaa

SEQ ID NO: 840375 - DNA, 25 bp, Mus musculus
tctttctacgtgttgcagctactaa

SEQ ID NO: 840376 - DNA, 25 bp, Mus musculus
tctttctactaaaccagccctaaag

SEQ ID NO: 840377 - DNA, 25 bp, Mus musculus
tctttctactaatccagccctaaag

SEQ ID NO: 840378 - DNA, 25 bp, Mus musculus
tctttctactatactgccctgtaat

SEQ ID NO: 840379 - DNA, 25 bp, Mus musculus
tctttctactattctgccctgtaat

SEQ ID NO: 840380 - DNA, 25 bp, Mus musculus
tctttctatatcatctcctttccct

SEQ ID NO: 840381 - DNA, 25 bp, Mus musculus
tctttctatatcttctcctttccct

SEQ ID NO: 840382 - DNA, 25 bp, Mus musculus
tctttctatctcaaccccttttaag

SEQ ID NO: 840383 - DNA, 25 bp, Mus musculus
tctttctatctctaccccttttaag

SEQ ID NO: 840384 - DNA, 25 bp, Mus musculus
tctttctatgaactcatgtctcctt

SEQ ID NO: 840385 - DNA, 25 bp, Mus musculus
tctttctatgaagtcatgtctcctt

SEQ ID NO: 840386 - DNA, 25 bp, Mus musculus
tctttctatgtacctcagtctgaac

SEQ ID NO: 840387 - DNA, 25 bp, Mus musculus
tctttctatgtagctcagtctgaac

SEQ ID NO: 840388 - DNA, 25 bp, Mus musculus
tctttctatgttagggaagcctgca

SEQ ID NO: 840389 - DNA, 25 bp, Mus musculus
tctttctatgtttgggaagcctgca

SEQ ID NO: 840390 - DNA, 25 bp, Mus musculus
tctttctattcaacctgcttgtata

SEQ ID NO: 840391 - DNA, 25 bp, Mus musculus
tctttctattcatcctgcttgtata

SEQ ID NO: 840392 - DNA, 25 bp, Mus musculus
tctttctcaaacctccactaaaatg

SEQ ID NO: 840393 - DNA, 25 bp, Mus musculus
tctttctcaaacgtccactaaaatg

SEQ ID NO: 840394 - DNA, 25 bp, Mus musculus
tctttctcaactctctcctggaaag

SEQ ID NO: 840395 - DNA, 25 bp, Mus musculus
tctttctcaactgtctcctggaaag

SEQ ID NO: 840396 - DNA, 25 bp, Mus musculus
tctttctcacacagtctacacgaag

SEQ ID NO: 840397 - DNA, 25 bp, Mus musculus
tctttctcacactgtctacacgaag

SEQ ID NO: 840398 - DNA, 25 bp, Mus musculus
tctttctcatcaacactcaggctgc

SEQ ID NO: 840399 - DNA, 25 bp, Mus musculus
tctttctcatcatcactcaggctgc

SEQ ID NO: 840400 - DNA, 25 bp, Mus musculus
tctttctcatttacctcagctatga

SEQ ID NO: 840401 - DNA, 25 bp, Mus musculus
tctttctcattttcctcagctatga

SEQ ID NO: 840402 - DNA, 25 bp, Mus musculus
tctttctccaccatgaggatctctg

SEQ ID NO: 840403 - DNA, 25 bp, Mus musculus
tctttctccaccttgaggatctctg

SEQ ID NO: 840404 - DNA, 25 bp, Mus musculus
tctttctccactctattcctttggg

SEQ ID NO: 840405 - DNA, 25 bp, Mus musculus
tctttctccactgtattcctttggg

SEQ ID NO: 840406 - DNA, 25 bp, Mus musculus
tctttctccatgaacaatgtgcaga

SEQ ID NO: 840407 - DNA, 25 bp, Mus musculus
tctttctccatgaaggcagggctga

SEQ ID NO: 840408 - DNA, 25 bp, Mus musculus
tctttctccatgtacaatgtgcaga

SEQ ID NO: 840409 - DNA, 25 bp, Mus musculus
tctttctccatgtaggcagggctga

SEQ ID NO: 840410 - DNA, 25 bp, Mus musculus
tctttctcccagctttggtctcagg

SEQ ID NO: 840411 - DNA, 25 bp, Mus musculus
tctttctcccaggtttggtctcagg

SEQ ID NO: 840412 - DNA, 25 bp, Mus musculus
tctttctccccacttgagttttatg

SEQ ID NO: 840413 - DNA, 25 bp, Mus musculus
tctttctccccagttgagttttatg

SEQ ID NO: 840414 - DNA, 25 bp, Mus musculus
tctttctccctgaaggattccttga

SEQ ID NO: 840415 - DNA, 25 bp, Mus musculus
tctttctccctgtaggattccttga

SEQ ID NO: 840416 - DNA, 25 bp, Mus musculus
tctttctcctaactttgcccagaac

SEQ ID NO: 840417 - DNA, 25 bp, Mus musculus
tctttctcctaagtttgcccagaac

SEQ ID NO: 840418 - DNA, 25 bp, Mus musculus
tctttctcctcacggcttttacaaa

SEQ ID NO: 840419 - DNA, 25 bp, Mus musculus
tctttctcctcagggcttttacaaa

SEQ ID NO: 840420 - DNA, 25 bp, Mus musculus
tctttctccttaaccaggctgcatt

SEQ ID NO: 840421 - DNA, 25 bp, Mus musculus
tctttctccttaccctgtggtggat

SEQ ID NO: 840422 - DNA, 25 bp, Mus musculus
tctttctccttagcctgtggtggat

SEQ ID NO: 840423 - DNA, 25 bp, Mus musculus
tctttctccttatccaggctgcatt

SEQ ID NO: 840424 - DNA, 25 bp, Mus musculus
tctttctccttgagtgtgtagtctt

SEQ ID NO: 840425 - DNA, 25 bp, Mus musculus
tctttctccttgtgtgtgtagtctt

SEQ ID NO: 840426 - DNA, 25 bp, Mus musculus
tctttctctaaactgagctcctggg

SEQ ID NO: 840427 - DNA, 25 bp, Mus musculus
tctttctctaaagtgagctcctggg

SEQ ID NO: 840428 - DNA, 25 bp, Mus musculus
tctttctctacaatcttgccaacat

SEQ ID NO: 840429 - DNA, 25 bp, Mus musculus
tctttctctacattcttgccaacat

SEQ ID NO: 840430 - DNA, 25 bp, Mus musculus
tctttctctagaagaaagcttgcgg

SEQ ID NO: 840431 - DNA, 25 bp, Mus musculus
tctttctctagatgaaagcttgcgg

SEQ ID NO: 840432 - DNA, 25 bp, Mus musculus
tctttctctagtctgggtggtgaac

SEQ ID NO: 840433 - DNA, 25 bp, Mus musculus
tctttctctagtgtgggtggtgaac

SEQ ID NO: 840434 - DNA, 25 bp, Mus musculus
tctttctctcagaccctaaatctga

SEQ ID NO: 840435 - DNA, 25 bp, Mus musculus
tctttctctcagtccctaaatctga

SEQ ID NO: 840436 - DNA, 25 bp, Mus musculus
tctttctctccaatgacctttgtgt

SEQ ID NO: 840437 - DNA, 25 bp, Mus musculus
tctttctctccattgacctttgtgt

SEQ ID NO: 840438 - DNA, 25 bp, Mus musculus
tctttctctctgactttagaagaaa

SEQ ID NO: 840439 - DNA, 25 bp, Mus musculus
tctttctctctgtctttagaagaaa

SEQ ID NO: 840440 - DNA, 25 bp, Mus musculus
tctttctctcttcgattttggtgtt

SEQ ID NO: 840441 - DNA, 25 bp, Mus musculus
tctttctctcttggattttggtgtt

SEQ ID NO: 840442 - DNA, 25 bp, Mus musculus
tctttctctgccattaatttagggt

SEQ ID NO: 840443 - DNA, 25 bp, Mus musculus
tctttctctgcctttaatttagggt

SEQ ID NO: 840444 - DNA, 25 bp, Mus musculus
tctttctcttccctgctttattgaa

SEQ ID NO: 840445 - DNA, 25 bp, Mus musculus
tctttctcttccgtgctttattgaa

SEQ ID NO: 840446 - DNA, 25 bp, Mus musculus
tctttctcttcgcatttctcaaagt

SEQ ID NO: 840447 - DNA, 25 bp, Mus musculus
tctttctcttcggatttctcaaagt

SEQ ID NO: 840448 - DNA, 25 bp, Mus musculus
tctttctcttctatcataaaccatt

SEQ ID NO: 840449 - DNA, 25 bp, Mus musculus
tctttctcttctttcataaaccatt

SEQ ID NO: 840450 - DNA, 25 bp, Mus musculus
tctttctctttcactacatatggcc

SEQ ID NO: 840451 - DNA, 25 bp, Mus musculus
tctttctctttctctacatatggcc

SEQ ID NO: 840452 - DNA, 25 bp, Mus musculus
tctttctctttgagtcttccctgac

SEQ ID NO: 840453 - DNA, 25 bp, Mus musculus
tctttctctttgtgtcttccctgac

SEQ ID NO: 840454 - DNA, 25 bp, Mus musculus
tctttctgaaaaaagggtacttgga

SEQ ID NO: 840455 - DNA, 25 bp, Mus musculus
tctttctgaaaatagggtacttgga

SEQ ID NO: 840456 - DNA, 25 bp, Mus musculus
tctttctgaactcttggttggtgta

SEQ ID NO: 840457 - DNA, 25 bp, Mus musculus
tctttctgaactgttggttggtgta

SEQ ID NO: 840458 - DNA, 25 bp, Mus musculus
tctttctgaaggacaccaactgtgg

SEQ ID NO: 840459 - DNA, 25 bp, Mus musculus
tctttctgaaggtcaccaactgtgg

SEQ ID NO: 840460 - DNA, 25 bp, Mus musculus
tctttctgacagcttcggttttggg

SEQ ID NO: 840461 - DNA, 25 bp, Mus musculus
tctttctgacaggttcggttttggg

SEQ ID NO: 840462 - DNA, 25 bp, Mus musculus
tctttctgactcagttctgccatcc

SEQ ID NO: 840463 - DNA, 25 bp, Mus musculus
tctttctgactctgttctgccatcc

SEQ ID NO: 840464 - DNA, 25 bp, Mus musculus
tctttctgatgtactggtgatgcaa

SEQ ID NO: 840465 - DNA, 25 bp, Mus musculus
tctttctgatgttctggtgatgcaa

SEQ ID NO: 840466 - DNA, 25 bp, Mus musculus
tctttctgatttctctccataccat

SEQ ID NO: 840467 - DNA, 25 bp, Mus musculus
tctttctgatttgtctccataccat

SEQ ID NO: 840468 - DNA, 25 bp, Mus musculus
tctttctgcaacactggagaacgtt

SEQ ID NO: 840469 - DNA, 25 bp, Mus musculus
tctttctgcaactctggagaacgtt

SEQ ID NO: 840470 - DNA, 25 bp, Mus musculus
tctttctgccacaccagcacagtgt

SEQ ID NO: 840471 - DNA, 25 bp, Mus musculus
tctttctgccactccagcacagtgt

SEQ ID NO: 840472 - DNA, 25 bp, Mus musculus
tctttctgcgatcccgttgttaaaa

SEQ ID NO: 840473 - DNA, 25 bp, Mus musculus
tctttctgcgatgccgttgttaaaa

SEQ ID NO: 840474 - DNA, 25 bp, Mus musculus
tctttctgctcactgcttgcaataa

SEQ ID NO: 840475 - DNA, 25 bp, Mus musculus
tctttctgctcagtgcttgcaataa

SEQ ID NO: 840476 - DNA, 25 bp, Mus musculus
tctttctgctctacgttctcatcat

SEQ ID NO: 840477 - DNA, 25 bp, Mus musculus
tctttctgctcttcgttctcatcat

SEQ ID NO: 840478 - DNA, 25 bp, Mus musculus
tctttctgctttataccttagctct

SEQ ID NO: 840479 - DNA, 25 bp, Mus musculus
tctttctgctttcggtggcaaaagg

SEQ ID NO: 840480 - DNA, 25 bp, Mus musculus
tctttctgctttgggtggcaaaagg

SEQ ID NO: 840481 - DNA, 25 bp, Mus musculus
tctttctgctttttaccttagctct

SEQ ID NO: 840482 - DNA, 25 bp, Mus musculus
tctttctggacaatgaggcgggctt

SEQ ID NO: 840483 - DNA, 25 bp, Mus musculus
tctttctggacattgaggcgggctt

SEQ ID NO: 840484 - DNA, 25 bp, Mus musculus
tctttctggaggcaggacaccacag

SEQ ID NO: 840485 - DNA, 25 bp, Mus musculus
tctttctggagggaggacaccacag

SEQ ID NO: 840486 - DNA, 25 bp, Mus musculus
tctttctggcagactcctcgaagga

SEQ ID NO: 840487 - DNA, 25 bp, Mus musculus
tctttctggcagtctcctcgaagga

SEQ ID NO: 840488 - DNA, 25 bp, Mus musculus
tctttctgtaagaaccacctggaga

SEQ ID NO: 840489 - DNA, 25 bp, Mus musculus
tctttctgtaagtaccacctggaga

SEQ ID NO: 840490 - DNA, 25 bp, Mus musculus
tctttctgtacactagatttctttc

SEQ ID NO: 840491 - DNA, 25 bp, Mus musculus
tctttctgtacagtagatttctttc

SEQ ID NO: 840492 - DNA, 25 bp, Mus musculus
tctttctgtctgagaaggccttaga

SEQ ID NO: 840493 - DNA, 25 bp, Mus musculus
tctttctgtctgtgaaggccttaga

SEQ ID NO: 840494 - DNA, 25 bp, Mus musculus
tctttctgtgaccggctctttccca

SEQ ID NO: 840495 - DNA, 25 bp, Mus musculus
tctttctgtgacgggctctttccca

SEQ ID NO: 840496 - DNA, 25 bp, Mus musculus
tctttcttaaagacgtctcactcca

SEQ ID NO: 840497 - DNA, 25 bp, Mus musculus
tctttcttaaagtcgtctcactcca

SEQ ID NO: 840498 - DNA, 25 bp, Mus musculus
tctttcttaactaacgcagcctagg

SEQ ID NO: 840499 - DNA, 25 bp, Mus musculus
tctttcttaactatcagggcaagct

SEQ ID NO: 840500 - DNA, 25 bp, Mus musculus
tctttcttaacttacgcagcctagg

SEQ ID NO: 840501 - DNA, 25 bp, Mus musculus
tctttcttaactttcagggcaagct

SEQ ID NO: 840502 - DNA, 25 bp, Mus musculus
tctttcttaatcattccaggttgaa

SEQ ID NO: 840503 - DNA, 25 bp, Mus musculus
tctttcttaatctttccaggttgaa

SEQ ID NO: 840504 - DNA, 25 bp, Mus musculus
tctttcttagacaatgcttgccagt

SEQ ID NO: 840505 - DNA, 25 bp, Mus musculus
tctttcttagactatgcttgccagt

SEQ ID NO: 840506 - DNA, 25 bp, Mus musculus
tctttcttatacaaccgagggtcat

SEQ ID NO: 840507 - DNA, 25 bp, Mus musculus
tctttcttatactaccgagggtcat

SEQ ID NO: 840508 - DNA, 25 bp, Mus musculus
tctttcttattcagacagatttaag

SEQ ID NO: 840509 - DNA, 25 bp, Mus musculus
tctttcttattctgacagatttaag

SEQ ID NO: 840510 - DNA, 25 bp, Mus musculus
tctttcttcaggcttgtgtctttag

SEQ ID NO: 840511 - DNA, 25 bp, Mus musculus
tctttcttcagggttgtgtctttag

SEQ ID NO: 840512 - DNA, 25 bp, Mus musculus
tctttcttccgtattccaaaggcct

SEQ ID NO: 840513 - DNA, 25 bp, Mus musculus
tctttcttccgttttccaaaggcct

SEQ ID NO: 840514 - DNA, 25 bp, Mus musculus
tctttcttcctacgatgcataaact

SEQ ID NO: 840515 - DNA, 25 bp, Mus musculus
tctttcttcctaggatgcataaact

SEQ ID NO: 840516 - DNA, 25 bp, Mus musculus
tctttcttcgcaaatctcttagtaa

SEQ ID NO: 840517 - DNA, 25 bp, Mus musculus
tctttcttcgcatatctcttagtaa

SEQ ID NO: 840518 - DNA, 25 bp, Mus musculus
tctttcttcttgaaaccagttagcg

SEQ ID NO: 840519 - DNA, 25 bp, Mus musculus
tctttcttcttgtaaccagttagcg

SEQ ID NO: 840520 - DNA, 25 bp, Mus musculus
tctttcttgcacatttgtactaaaa

SEQ ID NO: 840521 - DNA, 25 bp, Mus musculus
tctttcttgcacttttgtactaaaa

SEQ ID NO: 840522 - DNA, 25 bp, Mus musculus
tctttcttgctgcttgagtgggacg

SEQ ID NO: 840523 - DNA, 25 bp, Mus musculus
tctttcttgctggttgagtgggacg

SEQ ID NO: 840524 - DNA, 25 bp, Mus musculus
tctttcttggttctcacatgctcca

SEQ ID NO: 840525 - DNA, 25 bp, Mus musculus
tctttcttggttgtcacatgctcca

SEQ ID NO: 840526 - DNA, 25 bp, Mus musculus
tctttcttgttaattctgtgtggag

SEQ ID NO: 840527 - DNA, 25 bp, Mus musculus
tctttcttgttatttctgtgtggag

SEQ ID NO: 840528 - DNA, 25 bp, Mus musculus
tctttctttattcttgctgtagtgt

SEQ ID NO: 840529 - DNA, 25 bp, Mus musculus
tctttctttattgttgctgtagtgt

SEQ ID NO: 840530 - DNA, 25 bp, Mus musculus
tctttctttcacatcgtcatgtagt

SEQ ID NO: 840531 - DNA, 25 bp, Mus musculus
tctttctttcacttcgtcatgtagt

SEQ ID NO: 840532 - DNA, 25 bp, Mus musculus
tctttctttcagctgctgttcttgt

SEQ ID NO: 840533 - DNA, 25 bp, Mus musculus
tctttctttcaggtgctgttcttgt

SEQ ID NO: 840534 - DNA, 25 bp, Mus musculus
tctttgaaatctatgtcctggactg

SEQ ID NO: 840535 - DNA, 25 bp, Mus musculus
tctttgaaatctttgtcctggactg

SEQ ID NO: 840536 - DNA, 25 bp, Mus musculus
tctttgaaccctagtccctttatat

SEQ ID NO: 840537 - DNA, 25 bp, Mus musculus
tctttgaacccttgtccctttatat

SEQ ID NO: 840538 - DNA, 25 bp, Mus musculus
tctttgaagccgatcctatgtctat

SEQ ID NO: 840539 - DNA, 25 bp, Mus musculus
tctttgaagccgttcctatgtctat

SEQ ID NO: 840540 - DNA, 25 bp, Mus musculus
tctttgaagctgagcccactactgc

SEQ ID NO: 840541 - DNA, 25 bp, Mus musculus
tctttgaagctgtgcccactactgc

SEQ ID NO: 840542 - DNA, 25 bp, Mus musculus
tctttgaagtacaacacgaaccctt

SEQ ID NO: 840543 - DNA, 25 bp, Mus musculus
tctttgaagtactacacgaaccctt

SEQ ID NO: 840544 - DNA, 25 bp, Mus musculus
tctttgaatagacccagttttccct

SEQ ID NO: 840545 - DNA, 25 bp, Mus musculus
tctttgaatagagccagttttccct

SEQ ID NO: 840546 - DNA, 25 bp, Mus musculus
tctttgaatccacccctactgtaag

SEQ ID NO: 840547 - DNA, 25 bp, Mus musculus
tctttgaatccagccctactgtaag

SEQ ID NO: 840548 - DNA, 25 bp, Mus musculus
tctttgaatgttattccgctgtgaa

SEQ ID NO: 840549 - DNA, 25 bp, Mus musculus
tctttgaatgtttttccgctgtgaa

SEQ ID NO: 840550 - DNA, 25 bp, Mus musculus
tctttgacagtgatgaccctagtat

SEQ ID NO: 840551 - DNA, 25 bp, Mus musculus
tctttgacagtgttgaccctagtat

SEQ ID NO: 840552 - DNA, 25 bp, Mus musculus
tctttgacatttagtagaagctaca

SEQ ID NO: 840553 - DNA, 25 bp, Mus musculus
tctttgacattttgtagaagctaca

SEQ ID NO: 840554 - DNA, 25 bp, Mus musculus
tctttgaccacaaccgtactgcaat

SEQ ID NO: 840555 - DNA, 25 bp, Mus musculus
tctttgaccacatccgtactgcaat

SEQ ID NO: 840556 - DNA, 25 bp, Mus musculus
tctttgaccaccaactatattgaaa

SEQ ID NO: 840557 - DNA, 25 bp, Mus musculus
tctttgaccacctactatattgaaa

SEQ ID NO: 840558 - DNA, 25 bp, Mus musculus
tctttgaccctgacaactagggcag

SEQ ID NO: 840559 - DNA, 25 bp, Mus musculus
tctttgaccctgtcaactagggcag

SEQ ID NO: 840560 - DNA, 25 bp, Mus musculus
tctttgacctctacagcatgctgtg

SEQ ID NO: 840561 - DNA, 25 bp, Mus musculus
tctttgacctcttcagcatgctgtg

SEQ ID NO: 840562 - DNA, 25 bp, Mus musculus
tctttgacctttctgtgctatagca

SEQ ID NO: 840563 - DNA, 25 bp, Mus musculus
tctttgacctttgtgtgctatagca

SEQ ID NO: 840564 - DNA, 25 bp, Mus musculus
tctttgacgggaaggctttgacatt

SEQ ID NO: 840565 - DNA, 25 bp, Mus musculus
tctttgacgggatggctttgacatt

SEQ ID NO: 840566 - DNA, 25 bp, Mus musculus
tctttgactctgaggatcgtccatc

SEQ ID NO: 840567 - DNA, 25 bp, Mus musculus
tctttgactctgtggatcgtccatc

SEQ ID NO: 840568 - DNA, 25 bp, Mus musculus
tctttgactggcatggtgctgtctt

SEQ ID NO: 840569 - DNA, 25 bp, Mus musculus
tctttgactggcttggtgctgtctt

SEQ ID NO: 840570 - DNA, 25 bp, Mus musculus
tctttgacttcaccctatcatgttg

SEQ ID NO: 840571 - DNA, 25 bp, Mus musculus
tctttgacttcagcctatcatgttg

SEQ ID NO: 840572 - DNA, 25 bp, Mus musculus
tctttgagaagcctgtcttactgtg

SEQ ID NO: 840573 - DNA, 25 bp, Mus musculus
tctttgagaagcgtgtcttactgtg

SEQ ID NO: 840574 - DNA, 25 bp, Mus musculus
tctttgagatcaatgaggcctttgc

SEQ ID NO: 840575 - DNA, 25 bp, Mus musculus
tctttgagatcattgaggcctttgc

SEQ ID NO: 840576 - DNA, 25 bp, Mus musculus
tctttgagcatacatgacccctttc

SEQ ID NO: 840577 - DNA, 25 bp, Mus musculus
tctttgagcatagatgacccctttc

SEQ ID NO: 840578 - DNA, 25 bp, Mus musculus
tctttgagccagcactgtggtagtc

SEQ ID NO: 840579 - DNA, 25 bp, Mus musculus
tctttgagccaggactgtggtagtc

SEQ ID NO: 840580 - DNA, 25 bp, Mus musculus
tctttgaggaagacaagggccagcc

SEQ ID NO: 840581 - DNA, 25 bp, Mus musculus
tctttgaggaagtcaagggccagcc

SEQ ID NO: 840582 - DNA, 25 bp, Mus musculus
tctttgaggcagagggagaacccag

SEQ ID NO: 840583 - DNA, 25 bp, Mus musculus
tctttgaggcagtgggagaacccag

SEQ ID NO: 840584 - DNA, 25 bp, Mus musculus
tctttgaggctcagttttggtgcag

SEQ ID NO: 840585 - DNA, 25 bp, Mus musculus
tctttgaggctctgttttggtgcag

SEQ ID NO: 840586 - DNA, 25 bp, Mus musculus
tctttgatcccacaataatgactct

SEQ ID NO: 840587 - DNA, 25 bp, Mus musculus
tctttgatcccagaataatgactct

SEQ ID NO: 840588 - DNA, 25 bp, Mus musculus
tctttgatctcaatgctgtggtggc

SEQ ID NO: 840589 - DNA, 25 bp, Mus musculus
tctttgatctcattgctgtggtggc

SEQ ID NO: 840590 - DNA, 25 bp, Mus musculus
tctttgatgatcaccattgcattga

SEQ ID NO: 840591 - DNA, 25 bp, Mus musculus
tctttgatgatctccattgcattga

SEQ ID NO: 840592 - DNA, 25 bp, Mus musculus
tctttgatgattactgtgattctcc

SEQ ID NO: 840593 - DNA, 25 bp, Mus musculus
tctttgatgatttctgtgattctcc

SEQ ID NO: 840594 - DNA, 25 bp, Mus musculus
tctttgatggtgcttgcaggttttc

SEQ ID NO: 840595 - DNA, 25 bp, Mus musculus
tctttgatggtggttgcaggttttc

SEQ ID NO: 840596 - DNA, 25 bp, Mus musculus
tctttgattaaacgaaatccactgc

SEQ ID NO: 840597 - DNA, 25 bp, Mus musculus
tctttgattaaaggaaatccactgc

SEQ ID NO: 840598 - DNA, 25 bp, Mus musculus
tctttgattcctcgtactccagacc

SEQ ID NO: 840599 - DNA, 25 bp, Mus musculus
tctttgattcctggtactccagacc

SEQ ID NO: 840600 - DNA, 25 bp, Mus musculus
tctttgattgttccaatgagaatcc

SEQ ID NO: 840601 - DNA, 25 bp, Mus musculus
tctttgattgttgcaatgagaatcc

SEQ ID NO: 840602 - DNA, 25 bp, Mus musculus
tctttgatttccagttgagtgacga

SEQ ID NO: 840603 - DNA, 25 bp, Mus musculus
tctttgatttcctgttgagtgacga

SEQ ID NO: 840604 - DNA, 25 bp, Mus musculus
tctttgatttctaggccttgactct

SEQ ID NO: 840605 - DNA, 25 bp, Mus musculus
tctttgatttcttggccttgactct

SEQ ID NO: 840606 - DNA, 25 bp, Mus musculus
tctttgcaaagacgccacagatggt

SEQ ID NO: 840607 - DNA, 25 bp, Mus musculus
tctttgcaaagaggccacagatggt

SEQ ID NO: 840608 - DNA, 25 bp, Mus musculus
tctttgcaccacagttctacacaat

SEQ ID NO: 840609 - DNA, 25 bp, Mus musculus
tctttgcaccactgttctacacaat

SEQ ID NO: 840610 - DNA, 25 bp, Mus musculus
tctttgcagtggagctggctggctt

SEQ ID NO: 840611 - DNA, 25 bp, Mus musculus
tctttgcagtggtgctggctggctt

SEQ ID NO: 840612 - DNA, 25 bp, Mus musculus
tctttgcatcgtacagggactggac

SEQ ID NO: 840613 - DNA, 25 bp, Mus musculus
tctttgcatcgttcagggactggac

SEQ ID NO: 840614 - DNA, 25 bp, Mus musculus
tctttgcatctaactgccagtgcca

SEQ ID NO: 840615 - DNA, 25 bp, Mus musculus
tctttgcatctatctgccagtgcca

SEQ ID NO: 840616 - DNA, 25 bp, Mus musculus
tctttgcattgccactccaggacaa

SEQ ID NO: 840617 - DNA, 25 bp, Mus musculus
tctttgcattgcgactccaggacaa

SEQ ID NO: 840618 - DNA, 25 bp, Mus musculus
tctttgccaataccttaatgtgcct

SEQ ID NO: 840619 - DNA, 25 bp, Mus musculus
tctttgccaatagcttaatgtgcct

SEQ ID NO: 840620 - DNA, 25 bp, Mus musculus
tctttgccacctagtttgaccataa

SEQ ID NO: 840621 - DNA, 25 bp, Mus musculus
tctttgccaccttgtttgaccataa

SEQ ID NO: 840622 - DNA, 25 bp, Mus musculus
tctttgcccgggacagtacgaggta

SEQ ID NO: 840623 - DNA, 25 bp, Mus musculus
tctttgcccgggtcagtacgaggta

SEQ ID NO: 840624 - DNA, 25 bp, Mus musculus
tctttgccctagagatttttgtctc

SEQ ID NO: 840625 - DNA, 25 bp, Mus musculus
tctttgccctagtgatttttgtctc

SEQ ID NO: 840626 - DNA, 25 bp, Mus musculus
tctttgccctataaatctttccttc

SEQ ID NO: 840627 - DNA, 25 bp, Mus musculus
tctttgccctattaatctttccttc

SEQ ID NO: 840628 - DNA, 25 bp, Mus musculus
tctttgccctcacgcaccgaataaa

SEQ ID NO: 840629 - DNA, 25 bp, Mus musculus
tctttgccctcaggcaccgaataaa

SEQ ID NO: 840630 - DNA, 25 bp, Mus musculus
tctttgccctgtccccagtattgat

SEQ ID NO: 840631 - DNA, 25 bp, Mus musculus
tctttgccctgtgcccagtattgat

SEQ ID NO: 840632 - DNA, 25 bp, Mus musculus
tctttgccggttagcatgagtggaa

SEQ ID NO: 840633 - DNA, 25 bp, Mus musculus
tctttgccggtttgcatgagtggaa

SEQ ID NO: 840634 - DNA, 25 bp, Mus musculus
tctttgcctaagctgtcctacgtaa

SEQ ID NO: 840635 - DNA, 25 bp, Mus musculus
tctttgcctaaggtgtcctacgtaa

SEQ ID NO: 840636 - DNA, 25 bp, Mus musculus
tctttgcctgtgagatttcaacatt

SEQ ID NO: 840637 - DNA, 25 bp, Mus musculus
tctttgcctgtgtgatttcaacatt

SEQ ID NO: 840638 - DNA, 25 bp, Mus musculus
tctttgcctgttatccgtaaagtat

SEQ ID NO: 840639 - DNA, 25 bp, Mus musculus
tctttgcctgttttccgtaaagtat

SEQ ID NO: 840640 - DNA, 25 bp, Mus musculus
tctttgcctttactgtcctatcctg

SEQ ID NO: 840641 - DNA, 25 bp, Mus musculus
tctttgcctttagtgtcctatcctg

SEQ ID NO: 840642 - DNA, 25 bp, Mus musculus
tctttgcgcattcttgtctaggttt

SEQ ID NO: 840643 - DNA, 25 bp, Mus musculus
tctttgcgcattgttgtctaggttt

SEQ ID NO: 840644 - DNA, 25 bp, Mus musculus
tctttgcggagaaccagtgtgggct

SEQ ID NO: 840645 - DNA, 25 bp, Mus musculus
tctttgcggagatccagtgtgggct

SEQ ID NO: 840646 - DNA, 25 bp, Mus musculus
tctttgcggctcatagtaaccctta

SEQ ID NO: 840647 - DNA, 25 bp, Mus musculus
tctttgcggctcttagtaaccctta

SEQ ID NO: 840648 - DNA, 25 bp, Mus musculus
tctttgctactgagccttatctccc

SEQ ID NO: 840649 - DNA, 25 bp, Mus musculus
tctttgctactgtgccttatctccc

SEQ ID NO: 840650 - DNA, 25 bp, Mus musculus
tctttgctagccacatgcgtgtatt

SEQ ID NO: 840651 - DNA, 25 bp, Mus musculus
tctttgctagcctcatgcgtgtatt

SEQ ID NO: 840652 - DNA, 25 bp, Mus musculus
tctttgctagggatgctcctgtaga

SEQ ID NO: 840653 - DNA, 25 bp, Mus musculus
tctttgctagggttgctcctgtaga

SEQ ID NO: 840654 - DNA, 25 bp, Mus musculus
tctttgctatataaggtttataaac

SEQ ID NO: 840655 - DNA, 25 bp, Mus musculus
tctttgctatattaggtttataaac

SEQ ID NO: 840656 - DNA, 25 bp, Mus musculus
tctttgctccaaagttacctgcatt

SEQ ID NO: 840657 - DNA, 25 bp, Mus musculus
tctttgctccaatgttacctgcatt

SEQ ID NO: 840658 - DNA, 25 bp, Mus musculus
tctttgctgaaaagcccttataaat

SEQ ID NO: 840659 - DNA, 25 bp, Mus musculus
tctttgctgaaaatccctctgacta

SEQ ID NO: 840660 - DNA, 25 bp, Mus musculus
tctttgctgaaatgcccttataaat

SEQ ID NO: 840661 - DNA, 25 bp, Mus musculus
tctttgctgaaattccctctgacta

SEQ ID NO: 840662 - DNA, 25 bp, Mus musculus
tctttgctgccacttaccataggct

SEQ ID NO: 840663 - DNA, 25 bp, Mus musculus
tctttgctgccagttaccataggct

SEQ ID NO: 840664 - DNA, 25 bp, Mus musculus
tctttgctgggcattcttcctggga

SEQ ID NO: 840665 - DNA, 25 bp, Mus musculus
tctttgctgggctttcttcctggga

SEQ ID NO: 840666 - DNA, 25 bp, Mus musculus
tctttgctgtcgagcactttgccag

SEQ ID NO: 840667 - DNA, 25 bp, Mus musculus
tctttgctgtcgtgcactttgccag

SEQ ID NO: 840668 - DNA, 25 bp, Mus musculus
tctttgctgtgtcgaaatctcattt

SEQ ID NO: 840669 - DNA, 25 bp, Mus musculus
tctttgctgtgtggaaatctcattt

SEQ ID NO: 840670 - DNA, 25 bp, Mus musculus
tctttgctgttgcttggttatttcc

SEQ ID NO: 840671 - DNA, 25 bp, Mus musculus
tctttgctgttggttggttatttcc

SEQ ID NO: 840672 - DNA, 25 bp, Mus musculus
tctttgcttacgagtttctcagatt

SEQ ID NO: 840673 - DNA, 25 bp, Mus musculus
tctttgcttacgtgtttctcagatt

SEQ ID NO: 840674 - DNA, 25 bp, Mus musculus
tctttgcttagcatgttagggccat

SEQ ID NO: 840675 - DNA, 25 bp, Mus musculus
tctttgcttagcttgttagggccat

SEQ ID NO: 840676 - DNA, 25 bp, Mus musculus
tctttgcttcatctaccaactcttt

SEQ ID NO: 840677 - DNA, 25 bp, Mus musculus
tctttgcttcatcttaaatgggaga

SEQ ID NO: 840678 - DNA, 25 bp, Mus musculus
tctttgcttcatgtaccaactcttt

SEQ ID NO: 840679 - DNA, 25 bp, Mus musculus
tctttgcttcatgttaaatgggaga

SEQ ID NO: 840680 - DNA, 25 bp, Mus musculus
tctttgcttcctagctggaaccaaa

SEQ ID NO: 840681 - DNA, 25 bp, Mus musculus
tctttgcttcctctttgctgtttga

SEQ ID NO: 840682 - DNA, 25 bp, Mus musculus
tctttgcttcctgtttgctgtttga

SEQ ID NO: 840683 - DNA, 25 bp, Mus musculus
tctttgcttccttgctggaaccaaa

SEQ ID NO: 840684 - DNA, 25 bp, Mus musculus
tctttgcttctaatcagccatcact

SEQ ID NO: 840685 - DNA, 25 bp, Mus musculus
tctttgcttctattcagccatcact

SEQ ID NO: 840686 - DNA, 25 bp, Mus musculus
tctttgctttcaatccgcgccagtg

SEQ ID NO: 840687 - DNA, 25 bp, Mus musculus
tctttgctttcattccgcgccagtg

SEQ ID NO: 840688 - DNA, 25 bp, Mus musculus
tctttggaaagaacggctactacct

SEQ ID NO: 840689 - DNA, 25 bp, Mus musculus
tctttggaaagatcggctactacct

SEQ ID NO: 840690 - DNA, 25 bp, Mus musculus
tctttggagtccaatgaaaatatca

SEQ ID NO: 840691 - DNA, 25 bp, Mus musculus
tctttggagtcctatgaaaatatca

SEQ ID NO: 840692 - DNA, 25 bp, Mus musculus
tctttggagttacctgacctgggaa

SEQ ID NO: 840693 - DNA, 25 bp, Mus musculus
tctttggagttagctgacctgggaa

SEQ ID NO: 840694 - DNA, 25 bp, Mus musculus
tctttggatgtgacacttattggat

SEQ ID NO: 840695 - DNA, 25 bp, Mus musculus
tctttggatgtgatgtttttgcttt

SEQ ID NO: 840696 - DNA, 25 bp, Mus musculus
tctttggatgtgtcacttattggat

SEQ ID NO: 840697 - DNA, 25 bp, Mus musculus
tctttggatgtgttgtttttgcttt

SEQ ID NO: 840698 - DNA, 25 bp, Mus musculus
tctttggcacacagactggtcagta

SEQ ID NO: 840699 - DNA, 25 bp, Mus musculus
tctttggcacactgactggtcagta

SEQ ID NO: 840700 - DNA, 25 bp, Mus musculus
tctttggcatcccagcaaaaagggc

SEQ ID NO: 840701 - DNA, 25 bp, Mus musculus
tctttggcatccgagcaaaaagggc

SEQ ID NO: 840702 - DNA, 25 bp, Mus musculus
tctttggcatgcaggcctattttaa

SEQ ID NO: 840703 - DNA, 25 bp, Mus musculus
tctttggcatgctggcctattttaa

SEQ ID NO: 840704 - DNA, 25 bp, Mus musculus
tctttggccaaccttagtctgcagg

SEQ ID NO: 840705 - DNA, 25 bp, Mus musculus
tctttggccaacgttagtctgcagg

SEQ ID NO: 840706 - DNA, 25 bp, Mus musculus
tctttggccatcctggtgaacagca

SEQ ID NO: 840707 - DNA, 25 bp, Mus musculus
tctttggccatcgtggtgaacagca

SEQ ID NO: 840708 - DNA, 25 bp, Mus musculus
tctttggcctataagtgtggacact

SEQ ID NO: 840709 - DNA, 25 bp, Mus musculus
tctttggcctattagtgtggacact

SEQ ID NO: 840710 - DNA, 25 bp, Mus musculus
tctttggctaccactagctgaacac

SEQ ID NO: 840711 - DNA, 25 bp, Mus musculus
tctttggctacctctagctgaacac

SEQ ID NO: 840712 - DNA, 25 bp, Mus musculus
tctttggctcctatagttatctgag

SEQ ID NO: 840713 - DNA, 25 bp, Mus musculus
tctttggctcctttagttatctgag

SEQ ID NO: 840714 - DNA, 25 bp, Mus musculus
tctttggctgagagctcaccacata

SEQ ID NO: 840715 - DNA, 25 bp, Mus musculus
tctttggctgagtgctcaccacata

SEQ ID NO: 840716 - DNA, 25 bp, Mus musculus
tctttggctgccaggaagctcagaa

SEQ ID NO: 840717 - DNA, 25 bp, Mus musculus
tctttggctgcctggaagctcagaa

SEQ ID NO: 840718 - DNA, 25 bp, Mus musculus
tctttggctgggacacattttctgc

SEQ ID NO: 840719 - DNA, 25 bp, Mus musculus
tctttggctgggtcacattttctgc

SEQ ID NO: 840720 - DNA, 25 bp, Mus musculus
tctttggctgttctaattatctggg

SEQ ID NO: 840721 - DNA, 25 bp, Mus musculus
tctttggctgttgtaattatctggg

SEQ ID NO: 840722 - DNA, 25 bp, Mus musculus
tctttggcttgaacttactgtttaa

SEQ ID NO: 840723 - DNA, 25 bp, Mus musculus
tctttggcttgatcttactgtttaa

SEQ ID NO: 840724 - DNA, 25 bp, Mus musculus
tctttggcttttcccgtggtccata

SEQ ID NO: 840725 - DNA, 25 bp, Mus musculus
tctttggcttttgccgtggtccata

SEQ ID NO: 840726 - DNA, 25 bp, Mus musculus
tctttgggaccaccttcgtggctta

SEQ ID NO: 840727 - DNA, 25 bp, Mus musculus
tctttgggaccagcttcgtggctta

SEQ ID NO: 840728 - DNA, 25 bp, Mus musculus
tctttgggaggtagagaccagcctg

SEQ ID NO: 840729 - DNA, 25 bp, Mus musculus
tctttgggaggttgagaccagcctg

SEQ ID NO: 840730 - DNA, 25 bp, Mus musculus
tctttgggatctcggcatgcggaaa

SEQ ID NO: 840731 - DNA, 25 bp, Mus musculus
tctttgggatctgggcatgcggaaa

SEQ ID NO: 840732 - DNA, 25 bp, Mus musculus
tctttgggcatgatactatctaatc

SEQ ID NO: 840733 - DNA, 25 bp, Mus musculus
tctttgggcatgttactatctaatc

SEQ ID NO: 840734 - DNA, 25 bp, Mus musculus
tctttgggcttacaagtgacggcat

SEQ ID NO: 840735 - DNA, 25 bp, Mus musculus
tctttgggcttagaagtgacggcat

SEQ ID NO: 840736 - DNA, 25 bp, Mus musculus
tctttggggtgtattcaggtgtgcc

SEQ ID NO: 840737 - DNA, 25 bp, Mus musculus
tctttggggtgttttcaggtgtgcc

SEQ ID NO: 840738 - DNA, 25 bp, Mus musculus
tctttgggtggtccagtaagtgcca

SEQ ID NO: 840739 - DNA, 25 bp, Mus musculus
tctttgggtggtgcagtaagtgcca

SEQ ID NO: 840740 - DNA, 25 bp, Mus musculus
tctttgggttctcatgtgagagctg

SEQ ID NO: 840741 - DNA, 25 bp, Mus musculus
tctttgggttctgatgtgagagctg

SEQ ID NO: 840742 - DNA, 25 bp, Mus musculus
tctttgggttttatcctggaggctt

SEQ ID NO: 840743 - DNA, 25 bp, Mus musculus
tctttgggttttttcctggaggctt

SEQ ID NO: 840744 - DNA, 25 bp, Mus musculus
tctttggtaaaccgctcagatctta

SEQ ID NO: 840745 - DNA, 25 bp, Mus musculus
tctttggtaaacggctcagatctta

SEQ ID NO: 840746 - DNA, 25 bp, Mus musculus
tctttggtcgacaagctttcccaac

SEQ ID NO: 840747 - DNA, 25 bp, Mus musculus
tctttggtcgactagctttcccaac

SEQ ID NO: 840748 - DNA, 25 bp, Mus musculus
tctttggtgctaatgggcgtcacat

SEQ ID NO: 840749 - DNA, 25 bp, Mus musculus
tctttggtgctattgggcgtcacat

SEQ ID NO: 840750 - DNA, 25 bp, Mus musculus
tctttggtgtgtaaagtcagaattc

SEQ ID NO: 840751 - DNA, 25 bp, Mus musculus
tctttggtgtgttaagtcagaattc

SEQ ID NO: 840752 - DNA, 25 bp, Mus musculus
tctttggttgctcaagcttattttc

SEQ ID NO: 840753 - DNA, 25 bp, Mus musculus
tctttggttgctgaagcttattttc

SEQ ID NO: 840754 - DNA, 25 bp, Mus musculus
tctttggtttacctgacttgtcctg

SEQ ID NO: 840755 - DNA, 25 bp, Mus musculus
tctttggtttacgtgacttgtcctg

SEQ ID NO: 840756 - DNA, 25 bp, Mus musculus
tctttggtttttcgtcctgactact

SEQ ID NO: 840757 - DNA, 25 bp, Mus musculus
tctttggtttttggtcctgactact

SEQ ID NO: 840758 - DNA, 25 bp, Mus musculus
tctttgtacatccttttgcacttag

SEQ ID NO: 840759 - DNA, 25 bp, Mus musculus
tctttgtacatcgttttgcacttag

SEQ ID NO: 840760 - DNA, 25 bp, Mus musculus
tctttgtacattacccacctttgtt

SEQ ID NO: 840761 - DNA, 25 bp, Mus musculus
tctttgtacatttcccacctttgtt

SEQ ID NO: 840762 - DNA, 25 bp, Mus musculus
tctttgtaccgcagggatctaccct

SEQ ID NO: 840763 - DNA, 25 bp, Mus musculus
tctttgtaccgctgggatctaccct

SEQ ID NO: 840764 - DNA, 25 bp, Mus musculus
tctttgtactacacagcccagagca

SEQ ID NO: 840765 - DNA, 25 bp, Mus musculus
tctttgtactactcagcccagagca

SEQ ID NO: 840766 - DNA, 25 bp, Mus musculus
tctttgtagtctaccccgttatcca

SEQ ID NO: 840767 - DNA, 25 bp, Mus musculus
tctttgtagtcttccccgttatcca

SEQ ID NO: 840768 - DNA, 25 bp, Mus musculus
tctttgtatattactagtacggcac

SEQ ID NO: 840769 - DNA, 25 bp, Mus musculus
tctttgtatatttctagtacggcac

SEQ ID NO: 840770 - DNA, 25 bp, Mus musculus
tctttgtatccccaacagtctataa

SEQ ID NO: 840771 - DNA, 25 bp, Mus musculus
tctttgtatcccgaacagtctataa

SEQ ID NO: 840772 - DNA, 25 bp, Mus musculus
tctttgtatgctcggatctgtcctc

SEQ ID NO: 840773 - DNA, 25 bp, Mus musculus
tctttgtatgctgggatctgtcctc

SEQ ID NO: 840774 - DNA, 25 bp, Mus musculus
tctttgtcaagacgtggtgacgaga

SEQ ID NO: 840775 - DNA, 25 bp, Mus musculus
tctttgtcaagaggtggtgacgaga

SEQ ID NO: 840776 - DNA, 25 bp, Mus musculus
tctttgtcacacactgcaccttaca

SEQ ID NO: 840777 - DNA, 25 bp, Mus musculus
tctttgtcacacagccaaactgagc

SEQ ID NO: 840778 - DNA, 25 bp, Mus musculus
tctttgtcacactctgcaccttaca

SEQ ID NO: 840779 - DNA, 25 bp, Mus musculus
tctttgtcacactgccaaactgagc

SEQ ID NO: 840780 - DNA, 25 bp, Mus musculus
tctttgtcactcagttttgtactca

SEQ ID NO: 840781 - DNA, 25 bp, Mus musculus
tctttgtcactctgttttgtactca

SEQ ID NO: 840782 - DNA, 25 bp, Mus musculus
tctttgtcccaactgcatcttataa

SEQ ID NO: 840783 - DNA, 25 bp, Mus musculus
tctttgtcccaagtgcatcttataa

SEQ ID NO: 840784 - DNA, 25 bp, Mus musculus
tctttgtctctcagtttttctctgc

SEQ ID NO: 840785 - DNA, 25 bp, Mus musculus
tctttgtctctctgtttttctctgc

SEQ ID NO: 840786 - DNA, 25 bp, Mus musculus
tctttgtctcttaatttggcttcca

SEQ ID NO: 840787 - DNA, 25 bp, Mus musculus
tctttgtctctttatttggcttcca

SEQ ID NO: 840788 - DNA, 25 bp, Mus musculus
tctttgtctgacatactaagcaata

SEQ ID NO: 840789 - DNA, 25 bp, Mus musculus
tctttgtctgacttactaagcaata

SEQ ID NO: 840790 - DNA, 25 bp, Mus musculus
tctttgtctggtagcattcctaatt

SEQ ID NO: 840791 - DNA, 25 bp, Mus musculus
tctttgtctggttgcattcctaatt

SEQ ID NO: 840792 - DNA, 25 bp, Mus musculus
tctttgtcttagagggaaccccagg

SEQ ID NO: 840793 - DNA, 25 bp, Mus musculus
tctttgtcttagtgggaaccccagg

SEQ ID NO: 840794 - DNA, 25 bp, Mus musculus
tctttgtctttcaccccggatagaa

SEQ ID NO: 840795 - DNA, 25 bp, Mus musculus
tctttgtctttctccccggatagaa

SEQ ID NO: 840796 - DNA, 25 bp, Mus musculus
tctttgtgaaagcagttcttccagc

SEQ ID NO: 840797 - DNA, 25 bp, Mus musculus
tctttgtgaaaggagttcttccagc

SEQ ID NO: 840798 - DNA, 25 bp, Mus musculus
tctttgtgacaaatatgacccatta

SEQ ID NO: 840799 - DNA, 25 bp, Mus musculus
tctttgtgacaattatgacccatta

SEQ ID NO: 840800 - DNA, 25 bp, Mus musculus
tctttgtgagtccaaggtcaacttg

SEQ ID NO: 840801 - DNA, 25 bp, Mus musculus
tctttgtgagtcgaaggtcaacttg

SEQ ID NO: 840802 - DNA, 25 bp, Mus musculus
tctttgtgctaaataccgtagtgtg

SEQ ID NO: 840803 - DNA, 25 bp, Mus musculus
tctttgtgctaattaccgtagtgtg

SEQ ID NO: 840804 - DNA, 25 bp, Mus musculus
tctttgtgcttccttgtgtactctg

SEQ ID NO: 840805 - DNA, 25 bp, Mus musculus
tctttgtgcttcgttgtgtactctg

SEQ ID NO: 840806 - DNA, 25 bp, Mus musculus
tctttgtggagacgatttgatcatt

SEQ ID NO: 840807 - DNA, 25 bp, Mus musculus
tctttgtggagaggatttgatcatt

SEQ ID NO: 840808 - DNA, 25 bp, Mus musculus
tctttgtggcttaggacctggacag

SEQ ID NO: 840809 - DNA, 25 bp, Mus musculus
tctttgtggcttcgaagcgtcccag

SEQ ID NO: 840810 - DNA, 25 bp, Mus musculus
tctttgtggcttggaagcgtcccag

SEQ ID NO: 840811 - DNA, 25 bp, Mus musculus
tctttgtggctttggacctggacag

SEQ ID NO: 840812 - DNA, 25 bp, Mus musculus
tctttgtgggtacgatcttaatctc

SEQ ID NO: 840813 - DNA, 25 bp, Mus musculus
tctttgtgggtaggatcttaatctc

SEQ ID NO: 840814 - DNA, 25 bp, Mus musculus
tctttgtgggtgatgttgcgactgt

SEQ ID NO: 840815 - DNA, 25 bp, Mus musculus
tctttgtgggtgttgttgcgactgt

SEQ ID NO: 840816 - DNA, 25 bp, Mus musculus
tctttgtggtagcaggaggcaacta

SEQ ID NO: 840817 - DNA, 25 bp, Mus musculus
tctttgtggtagcagtctgacatca

SEQ ID NO: 840818 - DNA, 25 bp, Mus musculus
tctttgtggtaggaggaggcaacta

SEQ ID NO: 840819 - DNA, 25 bp, Mus musculus
tctttgtggtaggagtctgacatca

SEQ ID NO: 840820 - DNA, 25 bp, Mus musculus
tctttgtgtatcagaactttgcctt

SEQ ID NO: 840821 - DNA, 25 bp, Mus musculus
tctttgtgtatctgaactttgcctt

SEQ ID NO: 840822 - DNA, 25 bp, Mus musculus
tctttgtgtcatatgcttgctactt

SEQ ID NO: 840823 - DNA, 25 bp, Mus musculus
tctttgtgtcatttgcttgctactt

SEQ ID NO: 840824 - DNA, 25 bp, Mus musculus
tctttgtgtcctcgtcatagcagag

SEQ ID NO: 840825 - DNA, 25 bp, Mus musculus
tctttgtgtcctggtcatagcagag

SEQ ID NO: 840826 - DNA, 25 bp, Mus musculus
tctttgtgtgacatgtggttgcctt

SEQ ID NO: 840827 - DNA, 25 bp, Mus musculus
tctttgtgtgacttgtggttgcctt

SEQ ID NO: 840828 - DNA, 25 bp, Mus musculus
tctttgtgtgataattctgcgcctc

SEQ ID NO: 840829 - DNA, 25 bp, Mus musculus
tctttgtgtgattattctgcgcctc

SEQ ID NO: 840830 - DNA, 25 bp, Mus musculus
tctttgtgtgtcacataaatgttct

SEQ ID NO: 840831 - DNA, 25 bp, Mus musculus
tctttgtgtgtctcataaatgttct

SEQ ID NO: 840832 - DNA, 25 bp, Mus musculus
tctttgtgtgtgacctagacccaga

SEQ ID NO: 840833 - DNA, 25 bp, Mus musculus
tctttgtgtgtgtcctagacccaga

SEQ ID NO: 840834 - DNA, 25 bp, Mus musculus
tctttgttagatctcatatagccat

SEQ ID NO: 840835 - DNA, 25 bp, Mus musculus
tctttgttagatgtcatatagccat

SEQ ID NO: 840836 - DNA, 25 bp, Mus musculus
tctttgttccaccacacgtgaaaac

SEQ ID NO: 840837 - DNA, 25 bp, Mus musculus
tctttgttccacgacacgtgaaaac

SEQ ID NO: 840838 - DNA, 25 bp, Mus musculus
tctttgttccctcttccaaggtgag

SEQ ID NO: 840839 - DNA, 25 bp, Mus musculus
tctttgttccctgttccaaggtgag

SEQ ID NO: 840840 - DNA, 25 bp, Mus musculus
tctttgttctatacacatgcttaaa

SEQ ID NO: 840841 - DNA, 25 bp, Mus musculus
tctttgttctattcacatgcttaaa

SEQ ID NO: 840842 - DNA, 25 bp, Mus musculus
tctttgttctccaaagctgcattga

SEQ ID NO: 840843 - DNA, 25 bp, Mus musculus
tctttgttctcctaagctgcattga

SEQ ID NO: 840844 - DNA, 25 bp, Mus musculus
tctttgttgcacagctctttggcat

SEQ ID NO: 840845 - DNA, 25 bp, Mus musculus
tctttgttgcactgctctttggcat

SEQ ID NO: 840846 - DNA, 25 bp, Mus musculus
tctttgttggtgaacagactcttac

SEQ ID NO: 840847 - DNA, 25 bp, Mus musculus
tctttgttggtgtacagactcttac

SEQ ID NO: 840848 - DNA, 25 bp, Mus musculus
tctttgttgtgtcaattgtgctgtt

SEQ ID NO: 840849 - DNA, 25 bp, Mus musculus
tctttgttgtgtgaattgtgctgtt

SEQ ID NO: 840850 - DNA, 25 bp, Mus musculus
tctttgttgttcacctgacagtctt

SEQ ID NO: 840851 - DNA, 25 bp, Mus musculus
tctttgttgttctcctgacagtctt

SEQ ID NO: 840852 - DNA, 25 bp, Mus musculus
tctttgtttcaccatgtgctgtgtt

SEQ ID NO: 840853 - DNA, 25 bp, Mus musculus
tctttgtttcacgatgtgctgtgtt

SEQ ID NO: 840854 - DNA, 25 bp, Mus musculus
tctttgtttcagagatttctcctcc

SEQ ID NO: 840855 - DNA, 25 bp, Mus musculus
tctttgtttcagtgatttctcctcc

SEQ ID NO: 840856 - DNA, 25 bp, Mus musculus
tctttgtttctcattgttcccagct

SEQ ID NO: 840857 - DNA, 25 bp, Mus musculus
tctttgtttctctttgttcccagct

SEQ ID NO: 840858 - DNA, 25 bp, Mus musculus
tctttgtttgggactgattctattt

SEQ ID NO: 840859 - DNA, 25 bp, Mus musculus
tctttgtttgggtctgattctattt

SEQ ID NO: 840860 - DNA, 25 bp, Mus musculus
tctttgttttatctgcctgggtttc

SEQ ID NO: 840861 - DNA, 25 bp, Mus musculus
tctttgttttatgtgcctgggtttc

SEQ ID NO: 840862 - DNA, 25 bp, Mus musculus
tctttgttttccactccattttgaa

SEQ ID NO: 840863 - DNA, 25 bp, Mus musculus
tctttgttttcctctccattttgaa

SEQ ID NO: 840864 - DNA, 25 bp, Mus musculus
tcttttaaagacattcaggagaaac

SEQ ID NO: 840865 - DNA, 25 bp, Mus musculus
tcttttaaagactttcaggagaaac

SEQ ID NO: 840866 - DNA, 25 bp, Mus musculus
tcttttaacgtcaaggagatgctaa

SEQ ID NO: 840867 - DNA, 25 bp, Mus musculus
tcttttaacgtctaggagatgctaa

SEQ ID NO: 840868 - DNA, 25 bp, Mus musculus
tcttttaactgacaagccatctgcg

SEQ ID NO: 840869 - DNA, 25 bp, Mus musculus
tcttttaactgagaagccatctgcg

SEQ ID NO: 840870 - DNA, 25 bp, Mus musculus
tcttttaagcagatttgtcggactt

SEQ ID NO: 840871 - DNA, 25 bp, Mus musculus
tcttttaagcagttttgtcggactt

SEQ ID NO: 840872 - DNA, 25 bp, Mus musculus
tcttttaagctacgctttggaggca

SEQ ID NO: 840873 - DNA, 25 bp, Mus musculus
tcttttaagctaggctttggaggca

SEQ ID NO: 840874 - DNA, 25 bp, Mus musculus
tcttttaagctcattcctgcttttt

SEQ ID NO: 840875 - DNA, 25 bp, Mus musculus
tcttttaagctctttcctgcttttt

SEQ ID NO: 840876 - DNA, 25 bp, Mus musculus
tcttttaagtagaactatgggtctt

SEQ ID NO: 840877 - DNA, 25 bp, Mus musculus
tcttttaagtagtactatgggtctt

SEQ ID NO: 840878 - DNA, 25 bp, Mus musculus
tcttttaatttgcatcattctctaa

SEQ ID NO: 840879 - DNA, 25 bp, Mus musculus
tcttttaatttggatcattctctaa

SEQ ID NO: 840880 - DNA, 25 bp, Mus musculus
tcttttacagttatcatgagtaaat

SEQ ID NO: 840881 - DNA, 25 bp, Mus musculus
tcttttacagttttcatgagtaaat

SEQ ID NO: 840882 - DNA, 25 bp, Mus musculus
tcttttacccacatcttttcaataa

SEQ ID NO: 840883 - DNA, 25 bp, Mus musculus
tcttttacccacttcttttcaataa

SEQ ID NO: 840884 - DNA, 25 bp, Mus musculus
tcttttactatgactggcctttttg

SEQ ID NO: 840885 - DNA, 25 bp, Mus musculus
tcttttactatgtctggcctttttg

SEQ ID NO: 840886 - DNA, 25 bp, Mus musculus
tcttttactcagcaataggcatata

SEQ ID NO: 840887 - DNA, 25 bp, Mus musculus
tcttttactcaggaataggcatata

SEQ ID NO: 840888 - DNA, 25 bp, Mus musculus
tcttttactcatagtctgtagacat

SEQ ID NO: 840889 - DNA, 25 bp, Mus musculus
tcttttactcattgtctgtagacat

SEQ ID NO: 840890 - DNA, 25 bp, Mus musculus
tcttttacttggctcttggactttt

SEQ ID NO: 840891 - DNA, 25 bp, Mus musculus
tcttttacttgggtcttggactttt

SEQ ID NO: 840892 - DNA, 25 bp, Mus musculus
tcttttagatttcttgatgtcactt

SEQ ID NO: 840893 - DNA, 25 bp, Mus musculus
tcttttagatttgttgatgtcactt

SEQ ID NO: 840894 - DNA, 25 bp, Mus musculus
tcttttagcgatagggaggcaccat

SEQ ID NO: 840895 - DNA, 25 bp, Mus musculus
tcttttagcgattgggaggcaccat

SEQ ID NO: 840896 - DNA, 25 bp, Mus musculus
tcttttagggtcacctacatgctgg

SEQ ID NO: 840897 - DNA, 25 bp, Mus musculus
tcttttagggtctcctacatgctgg

SEQ ID NO: 840898 - DNA, 25 bp, Mus musculus
tcttttagtctaagtatgccccggg

SEQ ID NO: 840899 - DNA, 25 bp, Mus musculus
tcttttagtctatgtatgccccggg

SEQ ID NO: 840900 - DNA, 25 bp, Mus musculus
tcttttagtgtacgatcctgattat

SEQ ID NO: 840901 - DNA, 25 bp, Mus musculus
tcttttagtgtaggatcctgattat

SEQ ID NO: 840902 - DNA, 25 bp, Mus musculus
tcttttagttttactgtcacaggtt

SEQ ID NO: 840903 - DNA, 25 bp, Mus musculus
tcttttagtttttctgtcacaggtt

SEQ ID NO: 840904 - DNA, 25 bp, Mus musculus
tcttttatacggaacacagacctta

SEQ ID NO: 840905 - DNA, 25 bp, Mus musculus
tcttttatacggtacacagacctta

SEQ ID NO: 840906 - DNA, 25 bp, Mus musculus
tcttttataggaatctccctccctt

SEQ ID NO: 840907 - DNA, 25 bp, Mus musculus
tcttttataggattctccctccctt

SEQ ID NO: 840908 - DNA, 25 bp, Mus musculus
tcttttatcatgcagactgagcctg

SEQ ID NO: 840909 - DNA, 25 bp, Mus musculus
tcttttatcatggagactgagcctg

SEQ ID NO: 840910 - DNA, 25 bp, Mus musculus
tcttttatccagcaatgatgttcgt

SEQ ID NO: 840911 - DNA, 25 bp, Mus musculus
tcttttatccaggaatgatgttcgt

SEQ ID NO: 840912 - DNA, 25 bp, Mus musculus
tcttttatgtctaatgtggctgtgc

SEQ ID NO: 840913 - DNA, 25 bp, Mus musculus
tcttttatgtcttatgtggctgtgc

SEQ ID NO: 840914 - DNA, 25 bp, Mus musculus
tcttttatgtgacagcgggactcct

SEQ ID NO: 840915 - DNA, 25 bp, Mus musculus
tcttttatgtgagagcgggactcct

SEQ ID NO: 840916 - DNA, 25 bp, Mus musculus
tcttttattatcaacagaaggctgg

SEQ ID NO: 840917 - DNA, 25 bp, Mus musculus
tcttttattatctacagaaggctgg

SEQ ID NO: 840918 - DNA, 25 bp, Mus musculus
tcttttattcacctgggcagttttg

SEQ ID NO: 840919 - DNA, 25 bp, Mus musculus
tcttttattcacgtgggcagttttg

SEQ ID NO: 840920 - DNA, 25 bp, Mus musculus
tcttttattttcaatgggcgcacac

SEQ ID NO: 840921 - DNA, 25 bp, Mus musculus
tcttttattttcacggtctctgaga

SEQ ID NO: 840922 - DNA, 25 bp, Mus musculus
tcttttattttctatgggcgcacac

SEQ ID NO: 840923 - DNA, 25 bp, Mus musculus
tcttttattttctcggtctctgaga

SEQ ID NO: 840924 - DNA, 25 bp, Mus musculus
tcttttcaaaggattctgatctctg

SEQ ID NO: 840925 - DNA, 25 bp, Mus musculus
tcttttcaaaggtttctgatctctg

SEQ ID NO: 840926 - DNA, 25 bp, Mus musculus
tcttttcaactgaagcactgtgcct

SEQ ID NO: 840927 - DNA, 25 bp, Mus musculus
tcttttcaactgtagcactgtgcct

SEQ ID NO: 840928 - DNA, 25 bp, Mus musculus
tcttttcaatctacaccaggccaga

SEQ ID NO: 840929 - DNA, 25 bp, Mus musculus
tcttttcaatcttcaccaggccaga

SEQ ID NO: 840930 - DNA, 25 bp, Mus musculus
tcttttcacgtacttctagtaccct

SEQ ID NO: 840931 - DNA, 25 bp, Mus musculus
tcttttcacgtagttctagtaccct

SEQ ID NO: 840932 - DNA, 25 bp, Mus musculus
tcttttcacttacaagtcatctggg

SEQ ID NO: 840933 - DNA, 25 bp, Mus musculus
tcttttcacttagaagtcatctggg

SEQ ID NO: 840934 - DNA, 25 bp, Mus musculus
tcttttcagctcatcctaatttact

SEQ ID NO: 840935 - DNA, 25 bp, Mus musculus
tcttttcagctcattcttattgtaa

SEQ ID NO: 840936 - DNA, 25 bp, Mus musculus
tcttttcagctcttcctaatttact

SEQ ID NO: 840937 - DNA, 25 bp, Mus musculus
tcttttcagctctttcttattgtaa

SEQ ID NO: 840938 - DNA, 25 bp, Mus musculus
tcttttcaggagatggtttgcccat

SEQ ID NO: 840939 - DNA, 25 bp, Mus musculus
tcttttcaggagttggtttgcccat

SEQ ID NO: 840940 - DNA, 25 bp, Mus musculus
tcttttcatcacacagacttgttga

SEQ ID NO: 840941 - DNA, 25 bp, Mus musculus
tcttttcatcactcagacttgttga

SEQ ID NO: 840942 - DNA, 25 bp, Mus musculus
tcttttcatccaacgcgtcactagc

SEQ ID NO: 840943 - DNA, 25 bp, Mus musculus
tcttttcatccatcgcgtcactagc

SEQ ID NO: 840944 - DNA, 25 bp, Mus musculus
tcttttcatcttcctatctaaacag

SEQ ID NO: 840945 - DNA, 25 bp, Mus musculus
tcttttcatcttgctatctaaacag

SEQ ID NO: 840946 - DNA, 25 bp, Mus musculus
tcttttcatttcctaggtactaatt

SEQ ID NO: 840947 - DNA, 25 bp, Mus musculus
tcttttcatttcgtaggtactaatt

SEQ ID NO: 840948 - DNA, 25 bp, Mus musculus
tcttttccaaataaccactagggtg

SEQ ID NO: 840949 - DNA, 25 bp, Mus musculus
tcttttccaaattaccactagggtg

SEQ ID NO: 840950 - DNA, 25 bp, Mus musculus
tcttttccacatactagctgagctc

SEQ ID NO: 840951 - DNA, 25 bp, Mus musculus
tcttttccacattctagctgagctc

SEQ ID NO: 840952 - DNA, 25 bp, Mus musculus
tcttttccacctcttttgataaaat

SEQ ID NO: 840953 - DNA, 25 bp, Mus musculus
tcttttccacctgttttgataaaat

SEQ ID NO: 840954 - DNA, 25 bp, Mus musculus
tcttttccactactagttgcagcta

SEQ ID NO: 840955 - DNA, 25 bp, Mus musculus
tcttttccactagtagttgcagcta

SEQ ID NO: 840956 - DNA, 25 bp, Mus musculus
tcttttccattactctttctcttaa

SEQ ID NO: 840957 - DNA, 25 bp, Mus musculus
tcttttccattagtctttctcttaa

SEQ ID NO: 840958 - DNA, 25 bp, Mus musculus
tcttttcccactaaggctaggatat

SEQ ID NO: 840959 - DNA, 25 bp, Mus musculus
tcttttcccacttaggctaggatat

SEQ ID NO: 840960 - DNA, 25 bp, Mus musculus
tcttttcccctacgatagacccttg

SEQ ID NO: 840961 - DNA, 25 bp, Mus musculus
tcttttcccctaggatagacccttg

SEQ ID NO: 840962 - DNA, 25 bp, Mus musculus
tcttttccctccaattaaacagatg

SEQ ID NO: 840963 - DNA, 25 bp, Mus musculus
tcttttccctcctattaaacagatg

SEQ ID NO: 840964 - DNA, 25 bp, Mus musculus
tcttttccctgcagagccgaggaag

SEQ ID NO: 840965 - DNA, 25 bp, Mus musculus
tcttttccctgctgagccgaggaag

SEQ ID NO: 840966 - DNA, 25 bp, Mus musculus
tcttttccgtgtatactctatgaat

SEQ ID NO: 840967 - DNA, 25 bp, Mus musculus
tcttttccgtgtttactctatgaat

SEQ ID NO: 840968 - DNA, 25 bp, Mus musculus
tcttttcctagcaattctagcctaa

SEQ ID NO: 840969 - DNA, 25 bp, Mus musculus
tcttttcctagctattctagcctaa

SEQ ID NO: 840970 - DNA, 25 bp, Mus musculus
tcttttcctattagccttcggaact

SEQ ID NO: 840971 - DNA, 25 bp, Mus musculus
tcttttcctatttgccttcggaact

SEQ ID NO: 840972 - DNA, 25 bp, Mus musculus
tcttttcctccaattccagtagttt

SEQ ID NO: 840973 - DNA, 25 bp, Mus musculus
tcttttcctccatttccagtagttt

SEQ ID NO: 840974 - DNA, 25 bp, Mus musculus
tcttttcctctcaggtaaccgggag

SEQ ID NO: 840975 - DNA, 25 bp, Mus musculus
tcttttcctctctggtaaccgggag

SEQ ID NO: 840976 - DNA, 25 bp, Mus musculus
tcttttcggaaaaatattgcaaccc

SEQ ID NO: 840977 - DNA, 25 bp, Mus musculus
tcttttcggaaatatattgcaaccc

SEQ ID NO: 840978 - DNA, 25 bp, Mus musculus
tcttttcgtaggatccgggttcaat

SEQ ID NO: 840979 - DNA, 25 bp, Mus musculus
tcttttcgtaggttccgggttcaat

SEQ ID NO: 840980 - DNA, 25 bp, Mus musculus
tcttttctaaatcacgactccgtgt

SEQ ID NO: 840981 - DNA, 25 bp, Mus musculus
tcttttctaaatgacgactccgtgt

SEQ ID NO: 840982 - DNA, 25 bp, Mus musculus
tcttttctagagcagtacagtgact

SEQ ID NO: 840983 - DNA, 25 bp, Mus musculus
tcttttctagaggagtacagtgact

SEQ ID NO: 840984 - DNA, 25 bp, Mus musculus
tcttttctagctctacctagtttac

SEQ ID NO: 840985 - DNA, 25 bp, Mus musculus
tcttttctagctgtacctagtttac

SEQ ID NO: 840986 - DNA, 25 bp, Mus musculus
tcttttctcatcaacatgtaataaa

SEQ ID NO: 840987 - DNA, 25 bp, Mus musculus
tcttttctcatcagataccatttct

SEQ ID NO: 840988 - DNA, 25 bp, Mus musculus
tcttttctcatctacatgtaataaa

SEQ ID NO: 840989 - DNA, 25 bp, Mus musculus
tcttttctcatctgataccatttct

SEQ ID NO: 840990 - DNA, 25 bp, Mus musculus
tcttttctcccaataacatcctaat

SEQ ID NO: 840991 - DNA, 25 bp, Mus musculus
tcttttctcccattaacatcctaat

SEQ ID NO: 840992 - DNA, 25 bp, Mus musculus
tcttttctccccaacagacttgatt

SEQ ID NO: 840993 - DNA, 25 bp, Mus musculus
tcttttctcccctacagacttgatt

SEQ ID NO: 840994 - DNA, 25 bp, Mus musculus
tcttttctccctaacttatctctta

SEQ ID NO: 840995 - DNA, 25 bp, Mus musculus
tcttttctcccttacttatctctta

SEQ ID NO: 840996 - DNA, 25 bp, Mus musculus
tcttttctctagatgatgaaggttc

SEQ ID NO: 840997 - DNA, 25 bp, Mus musculus
tcttttctctagttgatgaaggttc

SEQ ID NO: 840998 - DNA, 25 bp, Mus musculus
tcttttctgcaaacgtctccctttt

SEQ ID NO: 840999 - DNA, 25 bp, Mus musculus
tcttttctgcaatcgtctccctttt

SEQ ID NO: 841000 - DNA, 25 bp, Mus musculus
tcttttctgcctagattatattact

SEQ ID NO: 841001 - DNA, 25 bp, Mus musculus
tcttttctgccttgattatattact

SEQ ID NO: 841002 - DNA, 25 bp, Mus musculus
tcttttctgctgctctctagagtat

SEQ ID NO: 841003 - DNA, 25 bp, Mus musculus
tcttttctgctggtctctagagtat

SEQ ID NO: 841004 - DNA, 25 bp, Mus musculus
tcttttctggaaaactcgtccgatg

SEQ ID NO: 841005 - DNA, 25 bp, Mus musculus
tcttttctggaatactcgtccgatg

SEQ ID NO: 841006 - DNA, 25 bp, Mus musculus
tcttttctggtgatggtctctatct

SEQ ID NO: 841007 - DNA, 25 bp, Mus musculus
tcttttctggtgttggtctctatct

SEQ ID NO: 841008 - DNA, 25 bp, Mus musculus
tcttttctgtcaattcccagttaga

SEQ ID NO: 841009 - DNA, 25 bp, Mus musculus
tcttttctgtcatttcccagttaga

SEQ ID NO: 841010 - DNA, 25 bp, Mus musculus
tcttttcttagtcccgaggcgtctg

SEQ ID NO: 841011 - DNA, 25 bp, Mus musculus
tcttttcttagtgccgaggcgtctg

SEQ ID NO: 841012 - DNA, 25 bp, Mus musculus
tcttttcttcatcgccaggtggaga

SEQ ID NO: 841013 - DNA, 25 bp, Mus musculus
tcttttcttcatggccaggtggaga

SEQ ID NO: 841014 - DNA, 25 bp, Mus musculus
tcttttcttctacttgggactgatt

SEQ ID NO: 841015 - DNA, 25 bp, Mus musculus
tcttttcttctagttgggactgatt

SEQ ID NO: 841016 - DNA, 25 bp, Mus musculus
tcttttcttgagcatttgtttcagt

SEQ ID NO: 841017 - DNA, 25 bp, Mus musculus
tcttttcttgaggatttgtttcagt

SEQ ID NO: 841018 - DNA, 25 bp, Mus musculus
tcttttcttgttctttttgtgctca

SEQ ID NO: 841019 - DNA, 25 bp, Mus musculus
tcttttcttgttgtttttgtgctca

SEQ ID NO: 841020 - DNA, 25 bp, Mus musculus
tcttttctttccagacagaaccata

SEQ ID NO: 841021 - DNA, 25 bp, Mus musculus
tcttttctttcctgacagaaccata

SEQ ID NO: 841022 - DNA, 25 bp, Mus musculus
tcttttctttctagagtctaacatg

SEQ ID NO: 841023 - DNA, 25 bp, Mus musculus
tcttttctttcttgagtctaacatg

SEQ ID NO: 841024 - DNA, 25 bp, Mus musculus
tcttttctttgtacaccattgggtg

SEQ ID NO: 841025 - DNA, 25 bp, Mus musculus
tcttttctttgttcaccattgggtg

SEQ ID NO: 841026 - DNA, 25 bp, Mus musculus
tcttttgaaattcgtttgttacgat

SEQ ID NO: 841027 - DNA, 25 bp, Mus musculus
tcttttgaaattggtttgttacgat

SEQ ID NO: 841028 - DNA, 25 bp, Mus musculus
tcttttgaaggtaattgtgttctta

SEQ ID NO: 841029 - DNA, 25 bp, Mus musculus
tcttttgaaggttattgtgttctta

SEQ ID NO: 841030 - DNA, 25 bp, Mus musculus
tcttttgaatgtatcctgtgcaggg

SEQ ID NO: 841031 - DNA, 25 bp, Mus musculus
tcttttgaatgtttcctgtgcaggg

SEQ ID NO: 841032 - DNA, 25 bp, Mus musculus
tcttttgaatttaataccctgatgt

SEQ ID NO: 841033 - DNA, 25 bp, Mus musculus
tcttttgaattttataccctgatgt

SEQ ID NO: 841034 - DNA, 25 bp, Mus musculus
tcttttgacatgattactgagtttc

SEQ ID NO: 841035 - DNA, 25 bp, Mus musculus
tcttttgacatgtttactgagtttc

SEQ ID NO: 841036 - DNA, 25 bp, Mus musculus
tcttttgaccctctgcagagttgga

SEQ ID NO: 841037 - DNA, 25 bp, Mus musculus
tcttttgaccctgtgcagagttgga

SEQ ID NO: 841038 - DNA, 25 bp, Mus musculus
tcttttgacctaatgttatcttccc

SEQ ID NO: 841039 - DNA, 25 bp, Mus musculus
tcttttgacctattgttatcttccc

SEQ ID NO: 841040 - DNA, 25 bp, Mus musculus
tcttttgactaaccattgcccttaa

SEQ ID NO: 841041 - DNA, 25 bp, Mus musculus
tcttttgactaagcattgcccttaa

SEQ ID NO: 841042 - DNA, 25 bp, Mus musculus
tcttttgacttcattgggaacagct

SEQ ID NO: 841043 - DNA, 25 bp, Mus musculus
tcttttgacttctttgggaacagct

SEQ ID NO: 841044 - DNA, 25 bp, Mus musculus
tcttttgagagacttgttttggatg

SEQ ID NO: 841045 - DNA, 25 bp, Mus musculus
tcttttgagagagttgttttggatg

SEQ ID NO: 841046 - DNA, 25 bp, Mus musculus
tcttttgagccaccttccattttcc

SEQ ID NO: 841047 - DNA, 25 bp, Mus musculus
tcttttgagccagcttccattttcc

SEQ ID NO: 841048 - DNA, 25 bp, Mus musculus
tcttttgagcccatgttttgttctt

SEQ ID NO: 841049 - DNA, 25 bp, Mus musculus
tcttttgagcccttgttttgttctt

SEQ ID NO: 841050 - DNA, 25 bp, Mus musculus
tcttttgagtaccatcacagttgta

SEQ ID NO: 841051 - DNA, 25 bp, Mus musculus
tcttttgagtacgatcacagttgta

SEQ ID NO: 841052 - DNA, 25 bp, Mus musculus
tcttttgatattcacctggaggaaa

SEQ ID NO: 841053 - DNA, 25 bp, Mus musculus
tcttttgatattgacctggaggaaa

SEQ ID NO: 841054 - DNA, 25 bp, Mus musculus
tcttttgcacctattgctttccaga

SEQ ID NO: 841055 - DNA, 25 bp, Mus musculus
tcttttgcaccttttgctttccaga

SEQ ID NO: 841056 - DNA, 25 bp, Mus musculus
tcttttgcatgaagcctgacactga

SEQ ID NO: 841057 - DNA, 25 bp, Mus musculus
tcttttgcatgatgcctgacactga

SEQ ID NO: 841058 - DNA, 25 bp, Mus musculus
tcttttgccaagaagtagcgccttt

SEQ ID NO: 841059 - DNA, 25 bp, Mus musculus
tcttttgccaagtagtagcgccttt

SEQ ID NO: 841060 - DNA, 25 bp, Mus musculus
tcttttgcccagcattaaactattt

SEQ ID NO: 841061 - DNA, 25 bp, Mus musculus
tcttttgcccaggattaaactattt

SEQ ID NO: 841062 - DNA, 25 bp, Mus musculus
tcttttgcccttaggatactttcct

SEQ ID NO: 841063 - DNA, 25 bp, Mus musculus
tcttttgccctttggatactttcct

SEQ ID NO: 841064 - DNA, 25 bp, Mus musculus
tcttttgccggtacactccagtggt

SEQ ID NO: 841065 - DNA, 25 bp, Mus musculus
tcttttgccggttcactccagtggt

SEQ ID NO: 841066 - DNA, 25 bp, Mus musculus
tcttttgcctacactcaagatggtt

SEQ ID NO: 841067 - DNA, 25 bp, Mus musculus
tcttttgcctactctcaagatggtt

SEQ ID NO: 841068 - DNA, 25 bp, Mus musculus
tcttttgcctgtatgggttgttgct

SEQ ID NO: 841069 - DNA, 25 bp, Mus musculus
tcttttgcctgtttgggttgttgct

SEQ ID NO: 841070 - DNA, 25 bp, Mus musculus
tcttttgcgggaaacattctgcact

SEQ ID NO: 841071 - DNA, 25 bp, Mus musculus
tcttttgcgggatacattctgcact

SEQ ID NO: 841072 - DNA, 25 bp, Mus musculus
tcttttgctccactcaatgctacta

SEQ ID NO: 841073 - DNA, 25 bp, Mus musculus
tcttttgctccagtcaatgctacta

SEQ ID NO: 841074 - DNA, 25 bp, Mus musculus
tcttttgctctgcagtttggtgaac

SEQ ID NO: 841075 - DNA, 25 bp, Mus musculus
tcttttgctctgcatttcaagtttt

SEQ ID NO: 841076 - DNA, 25 bp, Mus musculus
tcttttgctctggagtttggtgaac

SEQ ID NO: 841077 - DNA, 25 bp, Mus musculus
tcttttgctctggatttcaagtttt

SEQ ID NO: 841078 - DNA, 25 bp, Mus musculus
tcttttgctcttcctagtggcaccc

SEQ ID NO: 841079 - DNA, 25 bp, Mus musculus
tcttttgctcttgctagtggcaccc

SEQ ID NO: 841080 - DNA, 25 bp, Mus musculus
tcttttgctgcaaagggtttcctgg

SEQ ID NO: 841081 - DNA, 25 bp, Mus musculus
tcttttgctgcatagggtttcctgg

SEQ ID NO: 841082 - DNA, 25 bp, Mus musculus
tcttttggaaatctcaccgagtgtt

SEQ ID NO: 841083 - DNA, 25 bp, Mus musculus
tcttttggaaatgtcaccgagtgtt

SEQ ID NO: 841084 - DNA, 25 bp, Mus musculus
tcttttggaacgagtgtgtgtgtgt

SEQ ID NO: 841085 - DNA, 25 bp, Mus musculus
tcttttggaacgtgtgtgtgtgtgt

SEQ ID NO: 841086 - DNA, 25 bp, Mus musculus
tcttttggaatcaccctgtggcaga

SEQ ID NO: 841087 - DNA, 25 bp, Mus musculus
tcttttggaatctccctgtggcaga

SEQ ID NO: 841088 - DNA, 25 bp, Mus musculus
tcttttggacctagctctctagaga

SEQ ID NO: 841089 - DNA, 25 bp, Mus musculus
tcttttggaccttgctctctagaga

SEQ ID NO: 841090 - DNA, 25 bp, Mus musculus
tcttttggagaaaggtacttacggg

SEQ ID NO: 841091 - DNA, 25 bp, Mus musculus
tcttttggagaatggtacttacggg

SEQ ID NO: 841092 - DNA, 25 bp, Mus musculus
tcttttggagagcttgttccgggaa

SEQ ID NO: 841093 - DNA, 25 bp, Mus musculus
tcttttggagaggttgttccgggaa

SEQ ID NO: 841094 - DNA, 25 bp, Mus musculus
tcttttggagataggaaaacatgct

SEQ ID NO: 841095 - DNA, 25 bp, Mus musculus
tcttttggagattggaaaacatgct

SEQ ID NO: 841096 - DNA, 25 bp, Mus musculus
tcttttggcattaggatcacatcag

SEQ ID NO: 841097 - DNA, 25 bp, Mus musculus
tcttttggcatttggatcacatcag

SEQ ID NO: 841098 - DNA, 25 bp, Mus musculus
tcttttggccaccatcaaatgatgc

SEQ ID NO: 841099 - DNA, 25 bp, Mus musculus
tcttttggccacgatcaaatgatgc

SEQ ID NO: 841100 - DNA, 25 bp, Mus musculus
tcttttggcttacaacaccctatga

SEQ ID NO: 841101 - DNA, 25 bp, Mus musculus
tcttttggcttagaacaccctatga

SEQ ID NO: 841102 - DNA, 25 bp, Mus musculus
tcttttgtattactccatggttcac

SEQ ID NO: 841103 - DNA, 25 bp, Mus musculus
tcttttgtattagtccatggttcac

SEQ ID NO: 841104 - DNA, 25 bp, Mus musculus
tcttttgtccaactgttaactgtta

SEQ ID NO: 841105 - DNA, 25 bp, Mus musculus
tcttttgtccaagtgttaactgtta

SEQ ID NO: 841106 - DNA, 25 bp, Mus musculus
tcttttgtcctcaaactctattggg

SEQ ID NO: 841107 - DNA, 25 bp, Mus musculus
tcttttgtcctcacctttatccttt

SEQ ID NO: 841108 - DNA, 25 bp, Mus musculus
tcttttgtcctctaactctattggg

SEQ ID NO: 841109 - DNA, 25 bp, Mus musculus
tcttttgtcctctcctttatccttt

SEQ ID NO: 841110 - DNA, 25 bp, Mus musculus
tcttttgtctagatccccagtgaag

SEQ ID NO: 841111 - DNA, 25 bp, Mus musculus
tcttttgtctagttccccagtgaag

SEQ ID NO: 841112 - DNA, 25 bp, Mus musculus
tcttttgtctgtcattttgggcata

SEQ ID NO: 841113 - DNA, 25 bp, Mus musculus
tcttttgtctgtgattttgggcata

SEQ ID NO: 841114 - DNA, 25 bp, Mus musculus
tcttttgtcttcacgagagtctgct

SEQ ID NO: 841115 - DNA, 25 bp, Mus musculus
tcttttgtcttctcgagagtctgct

SEQ ID NO: 841116 - DNA, 25 bp, Mus musculus
tcttttgtgggtaatatgctagtct

SEQ ID NO: 841117 - DNA, 25 bp, Mus musculus
tcttttgtgggttatatgctagtct

SEQ ID NO: 841118 - DNA, 25 bp, Mus musculus
tcttttgtgtcaactacgaagctgt

SEQ ID NO: 841119 - DNA, 25 bp, Mus musculus
tcttttgtgtcatctacgaagctgt

SEQ ID NO: 841120 - DNA, 25 bp, Mus musculus
tcttttgtgttgagttcactgagaa

SEQ ID NO: 841121 - DNA, 25 bp, Mus musculus
tcttttgtgttgtgttcactgagaa

SEQ ID NO: 841122 - DNA, 25 bp, Mus musculus
tcttttgttccacgtatgtttgtga

SEQ ID NO: 841123 - DNA, 25 bp, Mus musculus
tcttttgttccacgtggttgcaacc

SEQ ID NO: 841124 - DNA, 25 bp, Mus musculus
tcttttgttccaggtatgtttgtga

SEQ ID NO: 841125 - DNA, 25 bp, Mus musculus
tcttttgttccaggtggttgcaacc

SEQ ID NO: 841126 - DNA, 25 bp, Mus musculus
tcttttgttcccattgccagtgtct

SEQ ID NO: 841127 - DNA, 25 bp, Mus musculus
tcttttgttccctttgccagtgtct

SEQ ID NO: 841128 - DNA, 25 bp, Mus musculus
tcttttgttcttaccgcatcacaac

SEQ ID NO: 841129 - DNA, 25 bp, Mus musculus
tcttttgttctttccgcatcacaac

SEQ ID NO: 841130 - DNA, 25 bp, Mus musculus
tcttttgttgagcagtccccggtat

SEQ ID NO: 841131 - DNA, 25 bp, Mus musculus
tcttttgttgaggagtccccggtat

SEQ ID NO: 841132 - DNA, 25 bp, Mus musculus
tctttttaaaatctctcgcatcgat

SEQ ID NO: 841133 - DNA, 25 bp, Mus musculus
tctttttaaaatgtctcgcatcgat

SEQ ID NO: 841134 - DNA, 25 bp, Mus musculus
tctttttaaatgactcccggacaca

SEQ ID NO: 841135 - DNA, 25 bp, Mus musculus
tctttttaaatgtctcccggacaca

SEQ ID NO: 841136 - DNA, 25 bp, Mus musculus
tctttttaacgacttcaagtgaacg

SEQ ID NO: 841137 - DNA, 25 bp, Mus musculus
tctttttaacgagttcaagtgaacg

SEQ ID NO: 841138 - DNA, 25 bp, Mus musculus
tctttttactacatgtttcaggctc

SEQ ID NO: 841139 - DNA, 25 bp, Mus musculus
tctttttactacttgtttcaggctc

SEQ ID NO: 841140 - DNA, 25 bp, Mus musculus
tctttttagcttacgatccctccaa

SEQ ID NO: 841141 - DNA, 25 bp, Mus musculus
tctttttagctttcgatccctccaa

SEQ ID NO: 841142 - DNA, 25 bp, Mus musculus
tctttttagtcactggcctttgggc

SEQ ID NO: 841143 - DNA, 25 bp, Mus musculus
tctttttagtcagtggcctttgggc

SEQ ID NO: 841144 - DNA, 25 bp, Mus musculus
tctttttagtctaagaacttgctga

SEQ ID NO: 841145 - DNA, 25 bp, Mus musculus
tctttttagtcttagaacttgctga

SEQ ID NO: 841146 - DNA, 25 bp, Mus musculus
tctttttagtggacagcctggctgg

SEQ ID NO: 841147 - DNA, 25 bp, Mus musculus
tctttttagtggtcagcctggctgg

SEQ ID NO: 841148 - DNA, 25 bp, Mus musculus
tctttttattctcaggtcaatcggt

SEQ ID NO: 841149 - DNA, 25 bp, Mus musculus
tctttttattctgaggtcaatcggt

SEQ ID NO: 841150 - DNA, 25 bp, Mus musculus
tctttttcagaacgttgcctccaaa

SEQ ID NO: 841151 - DNA, 25 bp, Mus musculus
tctttttcagaaggttgcctccaaa

SEQ ID NO: 841152 - DNA, 25 bp, Mus musculus
tctttttcatcccgcttcacgacag

SEQ ID NO: 841153 - DNA, 25 bp, Mus musculus
tctttttcatccggcttcacgacag

SEQ ID NO: 841154 - DNA, 25 bp, Mus musculus
tctttttcatgcactggtcacccaa

SEQ ID NO: 841155 - DNA, 25 bp, Mus musculus
tctttttcatgctctggtcacccaa

SEQ ID NO: 841156 - DNA, 25 bp, Mus musculus
tctttttcccacatcgagattttag

SEQ ID NO: 841157 - DNA, 25 bp, Mus musculus
tctttttcccacttcgagattttag

SEQ ID NO: 841158 - DNA, 25 bp, Mus musculus
tctttttcctaacaagtggtcttca

SEQ ID NO: 841159 - DNA, 25 bp, Mus musculus
tctttttcctaagaagtggtcttca

SEQ ID NO: 841160 - DNA, 25 bp, Mus musculus
tctttttcctaccacatgatgagtt

SEQ ID NO: 841161 - DNA, 25 bp, Mus musculus
tctttttcctacgacatgatgagtt

SEQ ID NO: 841162 - DNA, 25 bp, Mus musculus
tctttttcctctattgtagactagg

SEQ ID NO: 841163 - DNA, 25 bp, Mus musculus
tctttttcctcttttgtagactagg

SEQ ID NO: 841164 - DNA, 25 bp, Mus musculus
tctttttccttcagtctgggtcagg

SEQ ID NO: 841165 - DNA, 25 bp, Mus musculus
tctttttccttctgtctgggtcagg

SEQ ID NO: 841166 - DNA, 25 bp, Mus musculus
tctttttccttgcagtctgtctgaa

SEQ ID NO: 841167 - DNA, 25 bp, Mus musculus
tctttttccttggagtctgtctgaa

SEQ ID NO: 841168 - DNA, 25 bp, Mus musculus
tctttttcgaaaaccattccagagg

SEQ ID NO: 841169 - DNA, 25 bp, Mus musculus
tctttttcgaaatccattccagagg

SEQ ID NO: 841170 - DNA, 25 bp, Mus musculus
tctttttcggccatcctaagaccaa

SEQ ID NO: 841171 - DNA, 25 bp, Mus musculus
tctttttcggccttcctaagaccaa

SEQ ID NO: 841172 - DNA, 25 bp, Mus musculus
tctttttctaaacgccagtactggc

SEQ ID NO: 841173 - DNA, 25 bp, Mus musculus
tctttttctaaaggccagtactggc

SEQ ID NO: 841174 - DNA, 25 bp, Mus musculus
tctttttctccaatggtttctagaa

SEQ ID NO: 841175 - DNA, 25 bp, Mus musculus
tctttttctccattggtttctagaa

SEQ ID NO: 841176 - DNA, 25 bp, Mus musculus
tctttttctctgatgctatcttgtt

SEQ ID NO: 841177 - DNA, 25 bp, Mus musculus
tctttttctctgttgctatcttgtt

SEQ ID NO: 841178 - DNA, 25 bp, Mus musculus
tctttttctgctaacatgaaggtgt

SEQ ID NO: 841179 - DNA, 25 bp, Mus musculus
tctttttctgcttacatgaaggtgt

SEQ ID NO: 841180 - DNA, 25 bp, Mus musculus
tctttttctgttacagctgttgctt

SEQ ID NO: 841181 - DNA, 25 bp, Mus musculus
tctttttctgtttcagctgttgctt

SEQ ID NO: 841182 - DNA, 25 bp, Mus musculus
tctttttcttacaggagcctcaaaa

SEQ ID NO: 841183 - DNA, 25 bp, Mus musculus
tctttttcttactggagcctcaaaa

SEQ ID NO: 841184 - DNA, 25 bp, Mus musculus
tctttttcttcacgggcaggaccca

SEQ ID NO: 841185 - DNA, 25 bp, Mus musculus
tctttttcttcaggggcaggaccca

SEQ ID NO: 841186 - DNA, 25 bp, Mus musculus
tctttttcttctctacccatactac

SEQ ID NO: 841187 - DNA, 25 bp, Mus musculus
tctttttcttctgtacccatactac

SEQ ID NO: 841188 - DNA, 25 bp, Mus musculus
tctttttcttggatctctccctggt

SEQ ID NO: 841189 - DNA, 25 bp, Mus musculus
tctttttcttggctgtacagtggaa

SEQ ID NO: 841190 - DNA, 25 bp, Mus musculus
tctttttcttgggtgtacagtggaa

SEQ ID NO: 841191 - DNA, 25 bp, Mus musculus
tctttttcttggttctctccctggt

SEQ ID NO: 841192 - DNA, 25 bp, Mus musculus
tctttttctttaccttgtgcaagtg

SEQ ID NO: 841193 - DNA, 25 bp, Mus musculus
tctttttctttagcttgtgcaagtg

SEQ ID NO: 841194 - DNA, 25 bp, Mus musculus
tctttttgcctccactggtaccagg

SEQ ID NO: 841195 - DNA, 25 bp, Mus musculus
tctttttgcctcgactggtaccagg

SEQ ID NO: 841196 - DNA, 25 bp, Mus musculus
tctttttgctgtccagatcctcagc

SEQ ID NO: 841197 - DNA, 25 bp, Mus musculus
tctttttgctgtgcagatcctcagc

SEQ ID NO: 841198 - DNA, 25 bp, Mus musculus
tctttttgctttctctggaatgtag

SEQ ID NO: 841199 - DNA, 25 bp, Mus musculus
tctttttgctttgtctggaatgtag

SEQ ID NO: 841200 - DNA, 25 bp, Mus musculus
tctttttgtgagatagctttttcct

SEQ ID NO: 841201 - DNA, 25 bp, Mus musculus
tctttttgtgagttagctttttcct

SEQ ID NO: 841202 - DNA, 25 bp, Mus musculus
tctttttgttccattgtgtgagtta

SEQ ID NO: 841203 - DNA, 25 bp, Mus musculus
tctttttgttcctttgtgtgagtta

SEQ ID NO: 841204 - DNA, 25 bp, Mus musculus
tcttttttacaaacacgaccattga

SEQ ID NO: 841205 - DNA, 25 bp, Mus musculus
tcttttttacaatcacgaccattga

SEQ ID NO: 841206 - DNA, 25 bp, Mus musculus
tcttttttatgcaggtattctcact

SEQ ID NO: 841207 - DNA, 25 bp, Mus musculus
tcttttttatgctggtattctcact

SEQ ID NO: 841208 - DNA, 25 bp, Mus musculus
tcttttttcaagattcaggcttctg

SEQ ID NO: 841209 - DNA, 25 bp, Mus musculus
tcttttttcaagtttcaggcttctg

SEQ ID NO: 841210 - DNA, 25 bp, Mus musculus
tcttttttccaaatgctgctccaag

SEQ ID NO: 841211 - DNA, 25 bp, Mus musculus
tcttttttccaattgctgctccaag

SEQ ID NO: 841212 - DNA, 25 bp, Mus musculus
tcttttttccacagtctcttgagtg

SEQ ID NO: 841213 - DNA, 25 bp, Mus musculus
tcttttttccactgtctcttgagtg

SEQ ID NO: 841214 - DNA, 25 bp, Mus musculus
tcttttttcctacctgtgcaattgt

SEQ ID NO: 841215 - DNA, 25 bp, Mus musculus
tcttttttcctagctgtgcaattgt

SEQ ID NO: 841216 - DNA, 25 bp, Mus musculus
tcttttttggaccaccacggccacg

SEQ ID NO: 841217 - DNA, 25 bp, Mus musculus
tcttttttggacgaccacggccacg

SEQ ID NO: 841218 - DNA, 25 bp, Mus musculus
tgaaaaaaacttcttccttgttgtg

SEQ ID NO: 841219 - DNA, 25 bp, Mus musculus
tgaaaaaaacttgttccttgttgtg

SEQ ID NO: 841220 - DNA, 25 bp, Mus musculus
tgaaaaaaccctcgctggcttacct

SEQ ID NO: 841221 - DNA, 25 bp, Mus musculus
tgaaaaaaccctggctggcttacct

SEQ ID NO: 841222 - DNA, 25 bp, Mus musculus
tgaaaaaactatctgcagctagcaa

SEQ ID NO: 841223 - DNA, 25 bp, Mus musculus
tgaaaaaactatgtgcagctagcaa

SEQ ID NO: 841224 - DNA, 25 bp, Mus musculus
tgaaaaaagtctatcattccccagg

SEQ ID NO: 841225 - DNA, 25 bp, Mus musculus
tgaaaaaagtctttcattccccagg

SEQ ID NO: 841226 - DNA, 25 bp, Mus musculus
tgaaaaaccaaaatgcccagaccta

SEQ ID NO: 841227 - DNA, 25 bp, Mus musculus
tgaaaaaccaaattgcccagaccta

SEQ ID NO: 841228 - DNA, 25 bp, Mus musculus
tgaaaaaccacgagtgtcccacctt

SEQ ID NO: 841229 - DNA, 25 bp, Mus musculus
tgaaaaaccacgtgtgtcccacctt

SEQ ID NO: 841230 - DNA, 25 bp, Mus musculus
tgaaaaacccacattccagtgcttg

SEQ ID NO: 841231 - DNA, 25 bp, Mus musculus
tgaaaaacccactttccagtgcttg

SEQ ID NO: 841232 - DNA, 25 bp, Mus musculus
tgaaaaaccccacgcatggtgctgc

SEQ ID NO: 841233 - DNA, 25 bp, Mus musculus
tgaaaaaccccaggcatggtgctgc

SEQ ID NO: 841234 - DNA, 25 bp, Mus musculus
tgaaaaaccctccattagctcatgc

SEQ ID NO: 841235 - DNA, 25 bp, Mus musculus
tgaaaaaccctcgattagctcatgc

SEQ ID NO: 841236 - DNA, 25 bp, Mus musculus
tgaaaaaccgaaacaacctatctga

SEQ ID NO: 841237 - DNA, 25 bp, Mus musculus
tgaaaaaccgaatcaacctatctga

SEQ ID NO: 841238 - DNA, 25 bp, Mus musculus
tgaaaaacctggagcttgtcccaag

SEQ ID NO: 841239 - DNA, 25 bp, Mus musculus
tgaaaaacctggtgcttgtcccaag

SEQ ID NO: 841240 - DNA, 25 bp, Mus musculus
tgaaaaacctgtctccgttcacaca

SEQ ID NO: 841241 - DNA, 25 bp, Mus musculus
tgaaaaacctgtgtccgttcacaca

SEQ ID NO: 841242 - DNA, 25 bp, Mus musculus
tgaaaaaccttacccaccagcttga

SEQ ID NO: 841243 - DNA, 25 bp, Mus musculus
tgaaaaaccttagccaccagcttga

SEQ ID NO: 841244 - DNA, 25 bp, Mus musculus
tgaaaaactcaaccaaatcccagtt

SEQ ID NO: 841245 - DNA, 25 bp, Mus musculus
tgaaaaactcaagcaaatcccagtt

SEQ ID NO: 841246 - DNA, 25 bp, Mus musculus
tgaaaaacttctactttgcaccctc

SEQ ID NO: 841247 - DNA, 25 bp, Mus musculus
tgaaaaacttcttctttgcaccctc

SEQ ID NO: 841248 - DNA, 25 bp, Mus musculus
tgaaaaagaccgagcctgccgctgg

SEQ ID NO: 841249 - DNA, 25 bp, Mus musculus
tgaaaaagaccgtgcctgccgctgg

SEQ ID NO: 841250 - DNA, 25 bp, Mus musculus
tgaaaaagatctcgccactttgtgt

SEQ ID NO: 841251 - DNA, 25 bp, Mus musculus
tgaaaaagatctggccactttgtgt

SEQ ID NO: 841252 - DNA, 25 bp, Mus musculus
tgaaaaagccgcatgcaaacttctt

SEQ ID NO: 841253 - DNA, 25 bp, Mus musculus
tgaaaaagccgcttgcaaacttctt

SEQ ID NO: 841254 - DNA, 25 bp, Mus musculus
tgaaaaagccgtcaccaaccgtagt

SEQ ID NO: 841255 - DNA, 25 bp, Mus musculus
tgaaaaagccgtgaccaaccgtagt

SEQ ID NO: 841256 - DNA, 25 bp, Mus musculus
tgaaaaaggccaccgtaagtgacaa

SEQ ID NO: 841257 - DNA, 25 bp, Mus musculus
tgaaaaaggccagcgtaagtgacaa

SEQ ID NO: 841258 - DNA, 25 bp, Mus musculus
tgaaaaagtcccagcatggccacca

SEQ ID NO: 841259 - DNA, 25 bp, Mus musculus
tgaaaaagtccctgcatggccacca

SEQ ID NO: 841260 - DNA, 25 bp, Mus musculus
tgaaaaagttgtcaacttcccctct

SEQ ID NO: 841261 - DNA, 25 bp, Mus musculus
tgaaaaagttgtgaacttcccctct

SEQ ID NO: 841262 - DNA, 25 bp, Mus musculus
tgaaaaagtttcaaggctgcctgcc

SEQ ID NO: 841263 - DNA, 25 bp, Mus musculus
tgaaaaagtttctaggctgcctgcc

SEQ ID NO: 841264 - DNA, 25 bp, Mus musculus
tgaaaaataactcgcaccgctccct

SEQ ID NO: 841265 - DNA, 25 bp, Mus musculus
tgaaaaataactggcaccgctccct

SEQ ID NO: 841266 - DNA, 25 bp, Mus musculus
tgaaaaatccctacctgctagcaag

SEQ ID NO: 841267 - DNA, 25 bp, Mus musculus
tgaaaaatcccttcctgctagcaag

SEQ ID NO: 841268 - DNA, 25 bp, Mus musculus
tgaaaaatgtcccattcgggactac

SEQ ID NO: 841269 - DNA, 25 bp, Mus musculus
tgaaaaatgtccgattcgggactac

SEQ ID NO: 841270 - DNA, 25 bp, Mus musculus
tgaaaaattctacccggatggctcc

SEQ ID NO: 841271 - DNA, 25 bp, Mus musculus
tgaaaaattctagccggatggctcc

SEQ ID NO: 841272 - DNA, 25 bp, Mus musculus
tgaaaacaaccactccgctggagaa

SEQ ID NO: 841273 - DNA, 25 bp, Mus musculus
tgaaaacaaccagtccgctggagaa

SEQ ID NO: 841274 - DNA, 25 bp, Mus musculus
tgaaaacaagttcccaaaattctct

SEQ ID NO: 841275 - DNA, 25 bp, Mus musculus
tgaaaacaagttgccaaaattctct

SEQ ID NO: 841276 - DNA, 25 bp, Mus musculus
tgaaaacaatatatgctgcctaacc

SEQ ID NO: 841277 - DNA, 25 bp, Mus musculus
tgaaaacaatatttgctgcctaacc

SEQ ID NO: 841278 - DNA, 25 bp, Mus musculus
tgaaaacaatttattaggccccgtg

SEQ ID NO: 841279 - DNA, 25 bp, Mus musculus
tgaaaacaattttttaggccccgtg

SEQ ID NO: 841280 - DNA, 25 bp, Mus musculus
tgaaaacacacaagcgtgatcgcca

SEQ ID NO: 841281 - DNA, 25 bp, Mus musculus
tgaaaacacacactcacctttttct

SEQ ID NO: 841282 - DNA, 25 bp, Mus musculus
tgaaaacacacagtcacctttttct

SEQ ID NO: 841283 - DNA, 25 bp, Mus musculus
tgaaaacacacatgcgtgatcgcca

SEQ ID NO: 841284 - DNA, 25 bp, Mus musculus
tgaaaacacctgcacagatgctgtg

SEQ ID NO: 841285 - DNA, 25 bp, Mus musculus
tgaaaacacctggacagatgctgtg

SEQ ID NO: 841286 - DNA, 25 bp, Mus musculus
tgaaaacacttgactaagcctctgt

SEQ ID NO: 841287 - DNA, 25 bp, Mus musculus
tgaaaacacttgtctaagcctctgt

SEQ ID NO: 841288 - DNA, 25 bp, Mus musculus
tgaaaacactttatcctcatcctta

SEQ ID NO: 841289 - DNA, 25 bp, Mus musculus
tgaaaacactttttcctcatcctta

SEQ ID NO: 841290 - DNA, 25 bp, Mus musculus
tgaaaacatgctcccaagtcaggtc

SEQ ID NO: 841291 - DNA, 25 bp, Mus musculus
tgaaaacatgctgccaagtcaggtc

SEQ ID NO: 841292 - DNA, 25 bp, Mus musculus
tgaaaaccaccacaagcttgaagaa

SEQ ID NO: 841293 - DNA, 25 bp, Mus musculus
tgaaaaccaccagaagcttgaagaa

SEQ ID NO: 841294 - DNA, 25 bp, Mus musculus
tgaaaaccatataggacatcgatca

SEQ ID NO: 841295 - DNA, 25 bp, Mus musculus
tgaaaaccatattggacatcgatca

SEQ ID NO: 841296 - DNA, 25 bp, Mus musculus
tgaaaaccatcgagagtcagcccat

SEQ ID NO: 841297 - DNA, 25 bp, Mus musculus
tgaaaaccatcgtgagtcagcccat

SEQ ID NO: 841298 - DNA, 25 bp, Mus musculus
tgaaaaccatttccatgctcagcgt

SEQ ID NO: 841299 - DNA, 25 bp, Mus musculus
tgaaaaccatttgcatgctcagcgt

SEQ ID NO: 841300 - DNA, 25 bp, Mus musculus
tgaaaacccagaaccatgagacccc

SEQ ID NO: 841301 - DNA, 25 bp, Mus musculus
tgaaaacccagatccatgagacccc

SEQ ID NO: 841302 - DNA, 25 bp, Mus musculus
tgaaaacccatgcttaatctccaca

SEQ ID NO: 841303 - DNA, 25 bp, Mus musculus
tgaaaacccatggttaatctccaca

SEQ ID NO: 841304 - DNA, 25 bp, Mus musculus
tgaaaaccctatattgtcttttgag

SEQ ID NO: 841305 - DNA, 25 bp, Mus musculus
tgaaaaccctattttgtcttttgag

SEQ ID NO: 841306 - DNA, 25 bp, Mus musculus
tgaaaaccctctcaagtacctctac

SEQ ID NO: 841307 - DNA, 25 bp, Mus musculus
tgaaaaccctctgaagtacctctac

SEQ ID NO: 841308 - DNA, 25 bp, Mus musculus
tgaaaaccgctaactaccgtataac

SEQ ID NO: 841309 - DNA, 25 bp, Mus musculus
tgaaaaccgctatctaccgtataac

SEQ ID NO: 841310 - DNA, 25 bp, Mus musculus
tgaaaacctagacctcaccttcatc

SEQ ID NO: 841311 - DNA, 25 bp, Mus musculus
tgaaaacctagagctcaccttcatc

SEQ ID NO: 841312 - DNA, 25 bp, Mus musculus
tgaaaacctccaacagatcttccag

SEQ ID NO: 841313 - DNA, 25 bp, Mus musculus
tgaaaacctccatcagatcttccag

SEQ ID NO: 841314 - DNA, 25 bp, Mus musculus
tgaaaacctgagctacttggccgta

SEQ ID NO: 841315 - DNA, 25 bp, Mus musculus
tgaaaacctgaggtacttggccgta

SEQ ID NO: 841316 - DNA, 25 bp, Mus musculus
tgaaaacctggacttcacttctcag

SEQ ID NO: 841317 - DNA, 25 bp, Mus musculus
tgaaaacctggagttcacttctcag

SEQ ID NO: 841318 - DNA, 25 bp, Mus musculus
tgaaaacctggccaataataaaggt

SEQ ID NO: 841319 - DNA, 25 bp, Mus musculus
tgaaaacctggcgaataataaaggt

SEQ ID NO: 841320 - DNA, 25 bp, Mus musculus
tgaaaacctgtgagagcctgcgctt

SEQ ID NO: 841321 - DNA, 25 bp, Mus musculus
tgaaaacctgtgtgagcctgcgctt

SEQ ID NO: 841322 - DNA, 25 bp, Mus musculus
tgaaaaccttacacccaatacaagt

SEQ ID NO: 841323 - DNA, 25 bp, Mus musculus
tgaaaaccttactcccaatacaagt

SEQ ID NO: 841324 - DNA, 25 bp, Mus musculus
tgaaaaccttgacccagcctggcac

SEQ ID NO: 841325 - DNA, 25 bp, Mus musculus
tgaaaaccttgagccagcctggcac

SEQ ID NO: 841326 - DNA, 25 bp, Mus musculus
tgaaaacctttcaggcactgtgtct

SEQ ID NO: 841327 - DNA, 25 bp, Mus musculus
tgaaaacctttctggcactgtgtct

SEQ ID NO: 841328 - DNA, 25 bp, Mus musculus
tgaaaacgaatcactccctgaacca

SEQ ID NO: 841329 - DNA, 25 bp, Mus musculus
tgaaaacgaatctctccctgaacca

SEQ ID NO: 841330 - DNA, 25 bp, Mus musculus
tgaaaacgagctcgcggtcaacggc

SEQ ID NO: 841331 - DNA, 25 bp, Mus musculus
tgaaaacgagctggcggtcaacggc

SEQ ID NO: 841332 - DNA, 25 bp, Mus musculus
tgaaaacgcccacgcacaacaacag

SEQ ID NO: 841333 - DNA, 25 bp, Mus musculus
tgaaaacgcccaggcacaacaacag

SEQ ID NO: 841334 - DNA, 25 bp, Mus musculus
tgaaaacgctgtccccaagattctg

SEQ ID NO: 841335 - DNA, 25 bp, Mus musculus
tgaaaacgctgtgcccaagattctg

SEQ ID NO: 841336 - DNA, 25 bp, Mus musculus
tgaaaacggtccctcttgccatgtg

SEQ ID NO: 841337 - DNA, 25 bp, Mus musculus
tgaaaacggtccgtcttgccatgtg

SEQ ID NO: 841338 - DNA, 25 bp, Mus musculus
tgaaaacggtgcattgttcctgctg

SEQ ID NO: 841339 - DNA, 25 bp, Mus musculus
tgaaaacggtgctttgttcctgctg

SEQ ID NO: 841340 - DNA, 25 bp, Mus musculus
tgaaaactaagcctttctgcctcaa

SEQ ID NO: 841341 - DNA, 25 bp, Mus musculus
tgaaaactaagcgtttctgcctcaa

SEQ ID NO: 841342 - DNA, 25 bp, Mus musculus
tgaaaactacacacacctgtgggca

SEQ ID NO: 841343 - DNA, 25 bp, Mus musculus
tgaaaactacactcacctgtgggca

SEQ ID NO: 841344 - DNA, 25 bp, Mus musculus
tgaaaactagggatcccaggagaaa

SEQ ID NO: 841345 - DNA, 25 bp, Mus musculus
tgaaaactagggttcccaggagaaa

SEQ ID NO: 841346 - DNA, 25 bp, Mus musculus
tgaaaactcacaaggttcaccccaa

SEQ ID NO: 841347 - DNA, 25 bp, Mus musculus
tgaaaactcacatggttcaccccaa

SEQ ID NO: 841348 - DNA, 25 bp, Mus musculus
tgaaaactcagaacatcccacagat

SEQ ID NO: 841349 - DNA, 25 bp, Mus musculus
tgaaaactcagatcatcccacagat

SEQ ID NO: 841350 - DNA, 25 bp, Mus musculus
tgaaaactcgatatccgatcccatt

SEQ ID NO: 841351 - DNA, 25 bp, Mus musculus
tgaaaactcgatttccgatcccatt

SEQ ID NO: 841352 - DNA, 25 bp, Mus musculus
tgaaaactctgccatgtggtcccca

SEQ ID NO: 841353 - DNA, 25 bp, Mus musculus
tgaaaactctgcgatgtggtcccca

SEQ ID NO: 841354 - DNA, 25 bp, Mus musculus
tgaaaactgactcttacacaccctt

SEQ ID NO: 841355 - DNA, 25 bp, Mus musculus
tgaaaactgactgttacacaccctt

SEQ ID NO: 841356 - DNA, 25 bp, Mus musculus
tgaaaactgcccatcttccatacta

SEQ ID NO: 841357 - DNA, 25 bp, Mus musculus
tgaaaactgcccttcttccatacta

SEQ ID NO: 841358 - DNA, 25 bp, Mus musculus
tgaaaactgcctacatcctgacttg

SEQ ID NO: 841359 - DNA, 25 bp, Mus musculus
tgaaaactgccttcatcctgacttg

SEQ ID NO: 841360 - DNA, 25 bp, Mus musculus
tgaaaactgcttctttattctctct

SEQ ID NO: 841361 - DNA, 25 bp, Mus musculus
tgaaaactgcttgtttattctctct

SEQ ID NO: 841362 - DNA, 25 bp, Mus musculus
tgaaaactggtaactttttgcttct

SEQ ID NO: 841363 - DNA, 25 bp, Mus musculus
tgaaaactggtatctttttgcttct

SEQ ID NO: 841364 - DNA, 25 bp, Mus musculus
tgaaaacttgccctgttgcagcatc

SEQ ID NO: 841365 - DNA, 25 bp, Mus musculus
tgaaaacttgccgtgttgcagcatc

SEQ ID NO: 841366 - DNA, 25 bp, Mus musculus
tgaaaactttacagtgcaacactta

SEQ ID NO: 841367 - DNA, 25 bp, Mus musculus
tgaaaactttactgtgcaacactta

SEQ ID NO: 841368 - DNA, 25 bp, Mus musculus
tgaaaactttcaaagacgactagca

SEQ ID NO: 841369 - DNA, 25 bp, Mus musculus
tgaaaactttcatagacgactagca

SEQ ID NO: 841370 - DNA, 25 bp, Mus musculus
tgaaaactttccaccccagtctggg

SEQ ID NO: 841371 - DNA, 25 bp, Mus musculus
tgaaaactttcccttgcccacagga

SEQ ID NO: 841372 - DNA, 25 bp, Mus musculus
tgaaaactttccgttgcccacagga

SEQ ID NO: 841373 - DNA, 25 bp, Mus musculus
tgaaaactttcctccccagtctggg

SEQ ID NO: 841374 - DNA, 25 bp, Mus musculus
tgaaaactttttaatagcctagctg

SEQ ID NO: 841375 - DNA, 25 bp, Mus musculus
tgaaaacttttttatagcctagctg

SEQ ID NO: 841376 - DNA, 25 bp, Mus musculus
tgaaaagaaaccaccttctgcagct

SEQ ID NO: 841377 - DNA, 25 bp, Mus musculus
tgaaaagaaacctccttctgcagct

SEQ ID NO: 841378 - DNA, 25 bp, Mus musculus
tgaaaagacactcgcctatgttctc

SEQ ID NO: 841379 - DNA, 25 bp, Mus musculus
tgaaaagacactggcctatgttctc

SEQ ID NO: 841380 - DNA, 25 bp, Mus musculus
tgaaaagcacaaccactaccagaag

SEQ ID NO: 841381 - DNA, 25 bp, Mus musculus
tgaaaagcacaagcactaccagaag

SEQ ID NO: 841382 - DNA, 25 bp, Mus musculus
tgaaaagcacatccatccattctac

SEQ ID NO: 841383 - DNA, 25 bp, Mus musculus
tgaaaagcacatgcatccattctac

SEQ ID NO: 841384 - DNA, 25 bp, Mus musculus
tgaaaagcagacacgcggtgctctg

SEQ ID NO: 841385 - DNA, 25 bp, Mus musculus
tgaaaagcagactcgcggtgctctg

SEQ ID NO: 841386 - DNA, 25 bp, Mus musculus
tgaaaagcatcaacgactaccagat

SEQ ID NO: 841387 - DNA, 25 bp, Mus musculus
tgaaaagcatcatcgactaccagat

SEQ ID NO: 841388 - DNA, 25 bp, Mus musculus
tgaaaagcatccaccatgagaccac

SEQ ID NO: 841389 - DNA, 25 bp, Mus musculus
tgaaaagcatcctccatgagaccac

SEQ ID NO: 841390 - DNA, 25 bp, Mus musculus
tgaaaagcatggctcctcctgcgaa

SEQ ID NO: 841391 - DNA, 25 bp, Mus musculus
tgaaaagcatgggtcctcctgcgaa

SEQ ID NO: 841392 - DNA, 25 bp, Mus musculus
tgaaaagcccctcctgtctgtggcc

SEQ ID NO: 841393 - DNA, 25 bp, Mus musculus
tgaaaagcccctgctgtctgtggcc

SEQ ID NO: 841394 - DNA, 25 bp, Mus musculus
tgaaaagcctaaccagcctgagtca

SEQ ID NO: 841395 - DNA, 25 bp, Mus musculus
tgaaaagcctaagcagcctgagtca

SEQ ID NO: 841396 - DNA, 25 bp, Mus musculus
tgaaaagcctccatttgtatacatt

SEQ ID NO: 841397 - DNA, 25 bp, Mus musculus
tgaaaagcctccttttgtatacatt

SEQ ID NO: 841398 - DNA, 25 bp, Mus musculus
tgaaaagcctttcttggcccttgaa

SEQ ID NO: 841399 - DNA, 25 bp, Mus musculus
tgaaaagcctttgttggcccttgaa

SEQ ID NO: 841400 - DNA, 25 bp, Mus musculus
tgaaaagcggccaggttcagcatct

SEQ ID NO: 841401 - DNA, 25 bp, Mus musculus
tgaaaagcggcctggttcagcatct

SEQ ID NO: 841402 - DNA, 25 bp, Mus musculus
tgaaaagctaatcccattctggcct

SEQ ID NO: 841403 - DNA, 25 bp, Mus musculus
tgaaaagctaatgccattctggcct

SEQ ID NO: 841404 - DNA, 25 bp, Mus musculus
tgaaaagctaggattttctcaccca

SEQ ID NO: 841405 - DNA, 25 bp, Mus musculus
tgaaaagctaggtttttctcaccca

SEQ ID NO: 841406 - DNA, 25 bp, Mus musculus
tgaaaagctcatcacctttcgacac

SEQ ID NO: 841407 - DNA, 25 bp, Mus musculus
tgaaaagctcatgacctttcgacac

SEQ ID NO: 841408 - DNA, 25 bp, Mus musculus
tgaaaagctgggacactgccgtggc

SEQ ID NO: 841409 - DNA, 25 bp, Mus musculus
tgaaaagctgggtcactgccgtggc

SEQ ID NO: 841410 - DNA, 25 bp, Mus musculus
tgaaaaggaccaactgctttaggtt

SEQ ID NO: 841411 - DNA, 25 bp, Mus musculus
tgaaaaggaccatctgctttaggtt

SEQ ID NO: 841412 - DNA, 25 bp, Mus musculus
tgaaaaggacctcgtaggccggcta

SEQ ID NO: 841413 - DNA, 25 bp, Mus musculus
tgaaaaggacctggtaggccggcta

SEQ ID NO: 841414 - DNA, 25 bp, Mus musculus
tgaaaaggactcagcgactgtgggt

SEQ ID NO: 841415 - DNA, 25 bp, Mus musculus
tgaaaaggactctgcgactgtgggt

SEQ ID NO: 841416 - DNA, 25 bp, Mus musculus
tgaaaaggacttccgccttctctga

SEQ ID NO: 841417 - DNA, 25 bp, Mus musculus
tgaaaaggacttgcgccttctctga

SEQ ID NO: 841418 - DNA, 25 bp, Mus musculus
tgaaaaggcactacaagcccacact

SEQ ID NO: 841419 - DNA, 25 bp, Mus musculus
tgaaaaggcacttcaagcccacact

SEQ ID NO: 841420 - DNA, 25 bp, Mus musculus
tgaaaaggcgccatttggacctcac

SEQ ID NO: 841421 - DNA, 25 bp, Mus musculus
tgaaaaggcgccttttggacctcac

SEQ ID NO: 841422 - DNA, 25 bp, Mus musculus
tgaaaagggccacaaaatccaccca

SEQ ID NO: 841423 - DNA, 25 bp, Mus musculus
tgaaaagggccagaaaatccaccca

SEQ ID NO: 841424 - DNA, 25 bp, Mus musculus
tgaaaagggcctacagcacactgct

SEQ ID NO: 841425 - DNA, 25 bp, Mus musculus
tgaaaagggccttcagcacactgct

SEQ ID NO: 841426 - DNA, 25 bp, Mus musculus
tgaaaagggctcattccagtcgtaa

SEQ ID NO: 841427 - DNA, 25 bp, Mus musculus
tgaaaagggctctttccagtcgtaa

SEQ ID NO: 841428 - DNA, 25 bp, Mus musculus
tgaaaagggtggcagttctctcttc

SEQ ID NO: 841429 - DNA, 25 bp, Mus musculus
tgaaaagggtgggagttctctcttc

SEQ ID NO: 841430 - DNA, 25 bp, Mus musculus
tgaaaaggtaataacttgccagtat

SEQ ID NO: 841431 - DNA, 25 bp, Mus musculus
tgaaaaggtaattacttgccagtat

SEQ ID NO: 841432 - DNA, 25 bp, Mus musculus
tgaaaaggtaggatttatgtcttct

SEQ ID NO: 841433 - DNA, 25 bp, Mus musculus
tgaaaaggtaggttttatgtcttct

SEQ ID NO: 841434 - DNA, 25 bp, Mus musculus
tgaaaaggttggacgcaccaggctg

SEQ ID NO: 841435 - DNA, 25 bp, Mus musculus
tgaaaaggttggtcgcaccaggctg

SEQ ID NO: 841436 - DNA, 25 bp, Mus musculus
tgaaaagtaccaatccttaattgtt

SEQ ID NO: 841437 - DNA, 25 bp, Mus musculus
tgaaaagtaccattccttaattgtt

SEQ ID NO: 841438 - DNA, 25 bp, Mus musculus
tgaaaagtacttctctgtcccccga

SEQ ID NO: 841439 - DNA, 25 bp, Mus musculus
tgaaaagtacttgtctgtcccccga

SEQ ID NO: 841440 - DNA, 25 bp, Mus musculus
tgaaaagtcaccacacctgcgagaa

SEQ ID NO: 841441 - DNA, 25 bp, Mus musculus
tgaaaagtcacctcacctgcgagaa

SEQ ID NO: 841442 - DNA, 25 bp, Mus musculus
tgaaaagtcactagggcacactccc

SEQ ID NO: 841443 - DNA, 25 bp, Mus musculus
tgaaaagtcacttgggcacactccc

SEQ ID NO: 841444 - DNA, 25 bp, Mus musculus
tgaaaagtctggaacagcgcctgac

SEQ ID NO: 841445 - DNA, 25 bp, Mus musculus
tgaaaagtctggtacagcgcctgac

SEQ ID NO: 841446 - DNA, 25 bp, Mus musculus
tgaaaagttccccagtattctcctg

SEQ ID NO: 841447 - DNA, 25 bp, Mus musculus
tgaaaagttcccgagtattctcctg

SEQ ID NO: 841448 - DNA, 25 bp, Mus musculus
tgaaaagttctcaagggtaccctgg

SEQ ID NO: 841449 - DNA, 25 bp, Mus musculus
tgaaaagttctctagggtaccctgg

SEQ ID NO: 841450 - DNA, 25 bp, Mus musculus
tgaaaagttgccatcctggatatgt

SEQ ID NO: 841451 - DNA, 25 bp, Mus musculus
tgaaaagttgccttcctggatatgt

SEQ ID NO: 841452 - DNA, 25 bp, Mus musculus
tgaaaataagccacgtccactgggt

SEQ ID NO: 841453 - DNA, 25 bp, Mus musculus
tgaaaataagcctcgtccactgggt

SEQ ID NO: 841454 - DNA, 25 bp, Mus musculus
tgaaaataatagcatgtgccaggca

SEQ ID NO: 841455 - DNA, 25 bp, Mus musculus
tgaaaataataggatgtgccaggca

SEQ ID NO: 841456 - DNA, 25 bp, Mus musculus
tgaaaataatgcactattatgcagc

SEQ ID NO: 841457 - DNA, 25 bp, Mus musculus
tgaaaataatgctctattatgcagc

SEQ ID NO: 841458 - DNA, 25 bp, Mus musculus
tgaaaataccatctctctacctgtt

SEQ ID NO: 841459 - DNA, 25 bp, Mus musculus
tgaaaataccatgtctctacctgtt

SEQ ID NO: 841460 - DNA, 25 bp, Mus musculus
tgaaaatacccactgttaaccgagg

SEQ ID NO: 841461 - DNA, 25 bp, Mus musculus
tgaaaatacccagtgttaaccgagg

SEQ ID NO: 841462 - DNA, 25 bp, Mus musculus
tgaaaataccgcctagccctatggt

SEQ ID NO: 841463 - DNA, 25 bp, Mus musculus
tgaaaataccgcgtagccctatggt

SEQ ID NO: 841464 - DNA, 25 bp, Mus musculus
tgaaaatagaggcactcccttcacc

SEQ ID NO: 841465 - DNA, 25 bp, Mus musculus
tgaaaatagagggactcccttcacc

SEQ ID NO: 841466 - DNA, 25 bp, Mus musculus
tgaaaatatcagaactacacactgc

SEQ ID NO: 841467 - DNA, 25 bp, Mus musculus
tgaaaatatcagtactacacactgc

SEQ ID NO: 841468 - DNA, 25 bp, Mus musculus
tgaaaatcactcattggagctggag

SEQ ID NO: 841469 - DNA, 25 bp, Mus musculus
tgaaaatcactctttggagctggag

SEQ ID NO: 841470 - DNA, 25 bp, Mus musculus
tgaaaatcatgtctgacttaggctt

SEQ ID NO: 841471 - DNA, 25 bp, Mus musculus
tgaaaatcatgtgtgacttaggctt

SEQ ID NO: 841472 - DNA, 25 bp, Mus musculus
tgaaaatccacaagtagtacctgag

SEQ ID NO: 841473 - DNA, 25 bp, Mus musculus
tgaaaatccacacatgccacaacgc

SEQ ID NO: 841474 - DNA, 25 bp, Mus musculus
tgaaaatccacagatgccacaacgc

SEQ ID NO: 841475 - DNA, 25 bp, Mus musculus
tgaaaatccacatgtagtacctgag

SEQ ID NO: 841476 - DNA, 25 bp, Mus musculus
tgaaaatccagtccattctccctac

SEQ ID NO: 841477 - DNA, 25 bp, Mus musculus
tgaaaatccagtgcattctccctac

SEQ ID NO: 841478 - DNA, 25 bp, Mus musculus
tgaaaatccatgataacggcagttc

SEQ ID NO: 841479 - DNA, 25 bp, Mus musculus
tgaaaatccatgttaacggcagttc

SEQ ID NO: 841480 - DNA, 25 bp, Mus musculus
tgaaaatccctgactcagcatcttc

SEQ ID NO: 841481 - DNA, 25 bp, Mus musculus
tgaaaatccctgtctcagcatcttc

SEQ ID NO: 841482 - DNA, 25 bp, Mus musculus
tgaaaatcctcaataccagtctcca

SEQ ID NO: 841483 - DNA, 25 bp, Mus musculus
tgaaaatcctcattaccagtctcca

SEQ ID NO: 841484 - DNA, 25 bp, Mus musculus
tgaaaatcctttcctttatgccctg

SEQ ID NO: 841485 - DNA, 25 bp, Mus musculus
tgaaaatcctttgctttatgccctg

SEQ ID NO: 841486 - DNA, 25 bp, Mus musculus
tgaaaatctccacttcaaccctgat

SEQ ID NO: 841487 - DNA, 25 bp, Mus musculus
tgaaaatctccagttcaaccctgat

SEQ ID NO: 841488 - DNA, 25 bp, Mus musculus
tgaaaatgccagaggtccatcccct

SEQ ID NO: 841489 - DNA, 25 bp, Mus musculus
tgaaaatgccagtggtccatcccct

SEQ ID NO: 841490 - DNA, 25 bp, Mus musculus
tgaaaatgccttcagggccccttga

SEQ ID NO: 841491 - DNA, 25 bp, Mus musculus
tgaaaatgccttgagggccccttga

SEQ ID NO: 841492 - DNA, 25 bp, Mus musculus
tgaaaatgcgttctcttgcttctgc

SEQ ID NO: 841493 - DNA, 25 bp, Mus musculus
tgaaaatgcgttgtcttgcttctgc

SEQ ID NO: 841494 - DNA, 25 bp, Mus musculus
tgaaaatgctatagcccaagtggct

SEQ ID NO: 841495 - DNA, 25 bp, Mus musculus
tgaaaatgctattgcccaagtggct

SEQ ID NO: 841496 - DNA, 25 bp, Mus musculus
tgaaaatgctttatgtcctcattgt

SEQ ID NO: 841497 - DNA, 25 bp, Mus musculus
tgaaaatgctttttgtcctcattgt

SEQ ID NO: 841498 - DNA, 25 bp, Mus musculus
tgaaaatggccacaactcgcctttc

SEQ ID NO: 841499 - DNA, 25 bp, Mus musculus
tgaaaatggccacttgtaaaaattc

SEQ ID NO: 841500 - DNA, 25 bp, Mus musculus
tgaaaatggccagaactcgcctttc

SEQ ID NO: 841501 - DNA, 25 bp, Mus musculus
tgaaaatggccagttgtaaaaattc

SEQ ID NO: 841502 - DNA, 25 bp, Mus musculus
tgaaaatggctcaggcatccgtcag

SEQ ID NO: 841503 - DNA, 25 bp, Mus musculus
tgaaaatggctctggcatccgtcag

SEQ ID NO: 841504 - DNA, 25 bp, Mus musculus
tgaaaatgggctatttcttactagt

SEQ ID NO: 841505 - DNA, 25 bp, Mus musculus
tgaaaatgggctttttcttactagt

SEQ ID NO: 841506 - DNA, 25 bp, Mus musculus
tgaaaatgtaccatggtgcacccct

SEQ ID NO: 841507 - DNA, 25 bp, Mus musculus
tgaaaatgtaccttggtgcacccct

SEQ ID NO: 841508 - DNA, 25 bp, Mus musculus
tgaaaatgtccaagtctgcaccctg

SEQ ID NO: 841509 - DNA, 25 bp, Mus musculus
tgaaaatgtccatgtctgcaccctg

SEQ ID NO: 841510 - DNA, 25 bp, Mus musculus
tgaaaatgtcctcccggatattccg

SEQ ID NO: 841511 - DNA, 25 bp, Mus musculus
tgaaaatgtcctgccggatattccg

SEQ ID NO: 841512 - DNA, 25 bp, Mus musculus
tgaaaattgcttagatcgcgcatga

SEQ ID NO: 841513 - DNA, 25 bp, Mus musculus
tgaaaattgctttgatcgcgcatga

SEQ ID NO: 841514 - DNA, 25 bp, Mus musculus
tgaaaattgtcgctcacctcatggg

SEQ ID NO: 841515 - DNA, 25 bp, Mus musculus
tgaaaattgtcggtcacctcatggg

SEQ ID NO: 841516 - DNA, 25 bp, Mus musculus
tgaaaattgtttcgccctttggagc

SEQ ID NO: 841517 - DNA, 25 bp, Mus musculus
tgaaaattgtttggccctttggagc

SEQ ID NO: 841518 - DNA, 25 bp, Mus musculus
tgaaaatttaacatgccagccaggc

SEQ ID NO: 841519 - DNA, 25 bp, Mus musculus
tgaaaatttaacttgccagccaggc

SEQ ID NO: 841520 - DNA, 25 bp, Mus musculus
tgaaacaaagcaaccttcactccca

SEQ ID NO: 841521 - DNA, 25 bp, Mus musculus
tgaaacaaagcatccttcactccca

SEQ ID NO: 841522 - DNA, 25 bp, Mus musculus
tgaaacaaaggacatcccaccagct

SEQ ID NO: 841523 - DNA, 25 bp, Mus musculus
tgaaacaaaggagatcccaccagct

SEQ ID NO: 841524 - DNA, 25 bp, Mus musculus
tgaaacaacacaatccctgaccttt

SEQ ID NO: 841525 - DNA, 25 bp, Mus musculus
tgaaacaacacattccctgaccttt

SEQ ID NO: 841526 - DNA, 25 bp, Mus musculus
tgaaacaactggacgatctgaaggt

SEQ ID NO: 841527 - DNA, 25 bp, Mus musculus
tgaaacaactggtcgatctgaaggt

SEQ ID NO: 841528 - DNA, 25 bp, Mus musculus
tgaaacaataaccatggctttactg

SEQ ID NO: 841529 - DNA, 25 bp, Mus musculus
tgaaacaataacgatggctttactg

SEQ ID NO: 841530 - DNA, 25 bp, Mus musculus
tgaaacaataatcccagatccagct

SEQ ID NO: 841531 - DNA, 25 bp, Mus musculus
tgaaacaataatgccagatccagct

SEQ ID NO: 841532 - DNA, 25 bp, Mus musculus
tgaaacaatcacacccgtttctggc

SEQ ID NO: 841533 - DNA, 25 bp, Mus musculus
tgaaacaatcactcccgtttctggc

SEQ ID NO: 841534 - DNA, 25 bp, Mus musculus
tgaaacaatccaattctcttggaaa

SEQ ID NO: 841535 - DNA, 25 bp, Mus musculus
tgaaacaatccatttctcttggaaa

SEQ ID NO: 841536 - DNA, 25 bp, Mus musculus
tgaaacaattaacaaaggaccctct

SEQ ID NO: 841537 - DNA, 25 bp, Mus musculus
tgaaacaattaagaaaggaccctct

SEQ ID NO: 841538 - DNA, 25 bp, Mus musculus
tgaaacacagcgacgttgctggact

SEQ ID NO: 841539 - DNA, 25 bp, Mus musculus
tgaaacacagcgtcgttgctggact

SEQ ID NO: 841540 - DNA, 25 bp, Mus musculus
tgaaacaccagtcagggtcctacct

SEQ ID NO: 841541 - DNA, 25 bp, Mus musculus
tgaaacaccagtgagggtcctacct

SEQ ID NO: 841542 - DNA, 25 bp, Mus musculus
tgaaacaccattagctgttgtttgc

SEQ ID NO: 841543 - DNA, 25 bp, Mus musculus
tgaaacaccatttgctgttgtttgc

SEQ ID NO: 841544 - DNA, 25 bp, Mus musculus
tgaaacacccctcgcatgtttggag

SEQ ID NO: 841545 - DNA, 25 bp, Mus musculus
tgaaacacccctggcatgtttggag

SEQ ID NO: 841546 - DNA, 25 bp, Mus musculus
tgaaacacctgtcactttgactttg

SEQ ID NO: 841547 - DNA, 25 bp, Mus musculus
tgaaacacctgtgactttgactttg

SEQ ID NO: 841548 - DNA, 25 bp, Mus musculus
tgaaacacgccaagatataatgatc

SEQ ID NO: 841549 - DNA, 25 bp, Mus musculus
tgaaacacgccatgatataatgatc

SEQ ID NO: 841550 - DNA, 25 bp, Mus musculus
tgaaacactcagaaaaacggtggag

SEQ ID NO: 841551 - DNA, 25 bp, Mus musculus
tgaaacactcagtaaaacggtggag

SEQ ID NO: 841552 - DNA, 25 bp, Mus musculus
tgaaacactccaactatcccatggg

SEQ ID NO: 841553 - DNA, 25 bp, Mus musculus
tgaaacactccatctatcccatggg

SEQ ID NO: 841554 - DNA, 25 bp, Mus musculus
tgaaacactgagacttgaagctgcc

SEQ ID NO: 841555 - DNA, 25 bp, Mus musculus
tgaaacactgagtcttgaagctgcc

SEQ ID NO: 841556 - DNA, 25 bp, Mus musculus
tgaaacactgtgcaagacactcaga

SEQ ID NO: 841557 - DNA, 25 bp, Mus musculus
tgaaacactgtggaagacactcaga

SEQ ID NO: 841558 - DNA, 25 bp, Mus musculus
tgaaacacttctcaccaatagcaca

SEQ ID NO: 841559 - DNA, 25 bp, Mus musculus
tgaaacacttctgaccaatagcaca

SEQ ID NO: 841560 - DNA, 25 bp, Mus musculus
tgaaacagaacactcactcccagct

SEQ ID NO: 841561 - DNA, 25 bp, Mus musculus
tgaaacagaacagtcactcccagct

SEQ ID NO: 841562 - DNA, 25 bp, Mus musculus
tgaaacagagctccgaaacctgtcc

SEQ ID NO: 841563 - DNA, 25 bp, Mus musculus
tgaaacagagctgcgaaacctgtcc

SEQ ID NO: 841564 - DNA, 25 bp, Mus musculus
tgaaacagataacccagctgctgcc

SEQ ID NO: 841565 - DNA, 25 bp, Mus musculus
tgaaacagataagccagctgctgcc

SEQ ID NO: 841566 - DNA, 25 bp, Mus musculus
tgaaacagcattctcaggcagccac

SEQ ID NO: 841567 - DNA, 25 bp, Mus musculus
tgaaacagcattgtcaggcagccac

SEQ ID NO: 841568 - DNA, 25 bp, Mus musculus
tgaaacagccgacacaagagaacct

SEQ ID NO: 841569 - DNA, 25 bp, Mus musculus
tgaaacagccgagacaagagaacct

SEQ ID NO: 841570 - DNA, 25 bp, Mus musculus
tgaaacagggtcacgctaattccag

SEQ ID NO: 841571 - DNA, 25 bp, Mus musculus
tgaaacagggtctcgctaattccag

SEQ ID NO: 841572 - DNA, 25 bp, Mus musculus
tgaaacagtacaacacatagttcct

SEQ ID NO: 841573 - DNA, 25 bp, Mus musculus
tgaaacagtacatcacatagttcct

SEQ ID NO: 841574 - DNA, 25 bp, Mus musculus
tgaaacataaaacgaccgcctccgc

SEQ ID NO: 841575 - DNA, 25 bp, Mus musculus
tgaaacataaaaggaccgcctccgc

SEQ ID NO: 841576 - DNA, 25 bp, Mus musculus
tgaaacataccccatatttaaaact

SEQ ID NO: 841577 - DNA, 25 bp, Mus musculus
tgaaacatacccgatatttaaaact

SEQ ID NO: 841578 - DNA, 25 bp, Mus musculus
tgaaacatccctcccagtacagtgg

SEQ ID NO: 841579 - DNA, 25 bp, Mus musculus
tgaaacatccctgccagtacagtgg

SEQ ID NO: 841580 - DNA, 25 bp, Mus musculus
tgaaacatctcaaatgcctttttat

SEQ ID NO: 841581 - DNA, 25 bp, Mus musculus
tgaaacatctcatatgcctttttat

SEQ ID NO: 841582 - DNA, 25 bp, Mus musculus
tgaaacatgattctgctagccttag

SEQ ID NO: 841583 - DNA, 25 bp, Mus musculus
tgaaacatgattgtgctagccttag

SEQ ID NO: 841584 - DNA, 25 bp, Mus musculus
tgaaacattaccctttggcggacct

SEQ ID NO: 841585 - DNA, 25 bp, Mus musculus
tgaaacattaccgtttggcggacct

SEQ ID NO: 841586 - DNA, 25 bp, Mus musculus
tgaaacatttctcctcctgtgagta

SEQ ID NO: 841587 - DNA, 25 bp, Mus musculus
tgaaacatttctgctcctgtgagta

SEQ ID NO: 841588 - DNA, 25 bp, Mus musculus
tgaaacattttccagctagcacctc

SEQ ID NO: 841589 - DNA, 25 bp, Mus musculus
tgaaacattttcgagctagcacctc

SEQ ID NO: 841590 - DNA, 25 bp, Mus musculus
tgaaaccaaacgactggactccggt

SEQ ID NO: 841591 - DNA, 25 bp, Mus musculus
tgaaaccaaacgtctggactccggt

SEQ ID NO: 841592 - DNA, 25 bp, Mus musculus
tgaaaccaagagcacaattcccatt

SEQ ID NO: 841593 - DNA, 25 bp, Mus musculus
tgaaaccaagaggacaattcccatt

SEQ ID NO: 841594 - DNA, 25 bp, Mus musculus
tgaaaccaagctcaccacaggctgg

SEQ ID NO: 841595 - DNA, 25 bp, Mus musculus
tgaaaccaagctgaccacaggctgg

SEQ ID NO: 841596 - DNA, 25 bp, Mus musculus
tgaaaccaaggcaaaatgatttact

SEQ ID NO: 841597 - DNA, 25 bp, Mus musculus
tgaaaccaaggctaaatgatttact

SEQ ID NO: 841598 - DNA, 25 bp, Mus musculus
tgaaaccaatatcctgtcttatttt

SEQ ID NO: 841599 - DNA, 25 bp, Mus musculus
tgaaaccaatatgctgtcttatttt

SEQ ID NO: 841600 - DNA, 25 bp, Mus musculus
tgaaaccacacaagtatggccactt

SEQ ID NO: 841601 - DNA, 25 bp, Mus musculus
tgaaaccacacatgtatggccactt

SEQ ID NO: 841602 - DNA, 25 bp, Mus musculus
tgaaaccacccacaaacctaataat

SEQ ID NO: 841603 - DNA, 25 bp, Mus musculus
tgaaaccacccagaaacctaataat

SEQ ID NO: 841604 - DNA, 25 bp, Mus musculus
tgaaaccaccgtagcttaaaacaat

SEQ ID NO: 841605 - DNA, 25 bp, Mus musculus
tgaaaccaccgttgcttaaaacaat

SEQ ID NO: 841606 - DNA, 25 bp, Mus musculus
tgaaaccagccaacctaattacccg

SEQ ID NO: 841607 - DNA, 25 bp, Mus musculus
tgaaaccagccatcctaattacccg

SEQ ID NO: 841608 - DNA, 25 bp, Mus musculus
tgaaaccagggcacatggccagagc

SEQ ID NO: 841609 - DNA, 25 bp, Mus musculus
tgaaaccagggctcatggccagagc

SEQ ID NO: 841610 - DNA, 25 bp, Mus musculus
tgaaaccattccacccatagtcaat

SEQ ID NO: 841611 - DNA, 25 bp, Mus musculus
tgaaaccattcctcccatagtcaat

SEQ ID NO: 841612 - DNA, 25 bp, Mus musculus
tgaaaccattttacctccttggaca

SEQ ID NO: 841613 - DNA, 25 bp, Mus musculus
tgaaaccatttttcctccttggaca

SEQ ID NO: 841614 - DNA, 25 bp, Mus musculus
tgaaacccaaccaactggaaccaca

SEQ ID NO: 841615 - DNA, 25 bp, Mus musculus
tgaaacccaacctactggaaccaca

SEQ ID NO: 841616 - DNA, 25 bp, Mus musculus
tgaaacccaagaattcctccatagc

SEQ ID NO: 841617 - DNA, 25 bp, Mus musculus
tgaaacccaagatttcctccatagc

SEQ ID NO: 841618 - DNA, 25 bp, Mus musculus
tgaaacccagaccagagcccctgta

SEQ ID NO: 841619 - DNA, 25 bp, Mus musculus
tgaaacccagacgagagcccctgta

SEQ ID NO: 841620 - DNA, 25 bp, Mus musculus
tgaaacccatcaagccacatactgt

SEQ ID NO: 841621 - DNA, 25 bp, Mus musculus
tgaaacccatcatgccacatactgt

SEQ ID NO: 841622 - DNA, 25 bp, Mus musculus
tgaaacccattgagtatcagggatt

SEQ ID NO: 841623 - DNA, 25 bp, Mus musculus
tgaaacccattgtgtatcagggatt

SEQ ID NO: 841624 - DNA, 25 bp, Mus musculus
tgaaaccccagacaagcggcaggcc

SEQ ID NO: 841625 - DNA, 25 bp, Mus musculus
tgaaaccccagagaagcggcaggcc

SEQ ID NO: 841626 - DNA, 25 bp, Mus musculus
tgaaaccccaggacttcgagtacat

SEQ ID NO: 841627 - DNA, 25 bp, Mus musculus
tgaaaccccaggtcttcgagtacat

SEQ ID NO: 841628 - DNA, 25 bp, Mus musculus
tgaaaccccatcctgcaacttggtt

SEQ ID NO: 841629 - DNA, 25 bp, Mus musculus
tgaaaccccatcgtgcaacttggtt

SEQ ID NO: 841630 - DNA, 25 bp, Mus musculus
tgaaacccctttcccacaggaatgg

SEQ ID NO: 841631 - DNA, 25 bp, Mus musculus
tgaaacccctttgccacaggaatgg

SEQ ID NO: 841632 - DNA, 25 bp, Mus musculus
tgaaaccctgagaaaagacccatgt

SEQ ID NO: 841633 - DNA, 25 bp, Mus musculus
tgaaaccctgagtaaagacccatgt

SEQ ID NO: 841634 - DNA, 25 bp, Mus musculus
tgaaaccctgttccccacagaaagg

SEQ ID NO: 841635 - DNA, 25 bp, Mus musculus
tgaaaccctgttgcccacagaaagg

SEQ ID NO: 841636 - DNA, 25 bp, Mus musculus
tgaaacccttcacctttgcaactaa

SEQ ID NO: 841637 - DNA, 25 bp, Mus musculus
tgaaacccttcagctttgcaactaa

SEQ ID NO: 841638 - DNA, 25 bp, Mus musculus
tgaaaccggtgaaaccagtgaaact

SEQ ID NO: 841639 - DNA, 25 bp, Mus musculus
tgaaaccggtgataccagtgaaact

SEQ ID NO: 841640 - DNA, 25 bp, Mus musculus
tgaaacctaggacctgtggctgtct

SEQ ID NO: 841641 - DNA, 25 bp, Mus musculus
tgaaacctaggagctgtggctgtct

SEQ ID NO: 841642 - DNA, 25 bp, Mus musculus
tgaaacctcactcacggccacattg

SEQ ID NO: 841643 - DNA, 25 bp, Mus musculus
tgaaacctcactgacggccacattg

SEQ ID NO: 841644 - DNA, 25 bp, Mus musculus
tgaaacctcaggaacctatccacag

SEQ ID NO: 841645 - DNA, 25 bp, Mus musculus
tgaaacctcaggtacctatccacag

SEQ ID NO: 841646 - DNA, 25 bp, Mus musculus
tgaaacctctacaccgtatgcagtt

SEQ ID NO: 841647 - DNA, 25 bp, Mus musculus
tgaaacctctactccgtatgcagtt

SEQ ID NO: 841648 - DNA, 25 bp, Mus musculus
tgaaacctcttcagccatgcctcta

SEQ ID NO: 841649 - DNA, 25 bp, Mus musculus
tgaaacctcttctgccatgcctcta

SEQ ID NO: 841650 - DNA, 25 bp, Mus musculus
tgaaacctgactccgaggtgcaatt

SEQ ID NO: 841651 - DNA, 25 bp, Mus musculus
tgaaacctgactgcgaggtgcaatt

SEQ ID NO: 841652 - DNA, 25 bp, Mus musculus
tgaaacctgccactaagacaacctg

SEQ ID NO: 841653 - DNA, 25 bp, Mus musculus
tgaaacctgccagtaagacaacctg

SEQ ID NO: 841654 - DNA, 25 bp, Mus musculus
tgaaacctggacattgctttctgag

SEQ ID NO: 841655 - DNA, 25 bp, Mus musculus
tgaaacctggactttgctttctgag

SEQ ID NO: 841656 - DNA, 25 bp, Mus musculus
tgaaacctgtcacttactcccttta

SEQ ID NO: 841657 - DNA, 25 bp, Mus musculus
tgaaacctgtcagttactcccttta

SEQ ID NO: 841658 - DNA, 25 bp, Mus musculus
tgaaaccttaaccttctcagggagt

SEQ ID NO: 841659 - DNA, 25 bp, Mus musculus
tgaaaccttaacgttctcagggagt

SEQ ID NO: 841660 - DNA, 25 bp, Mus musculus
tgaaaccttattcctagtacctaga

SEQ ID NO: 841661 - DNA, 25 bp, Mus musculus
tgaaaccttattgctagtacctaga

SEQ ID NO: 841662 - DNA, 25 bp, Mus musculus
tgaaaccttgaacttaccaggccca

SEQ ID NO: 841663 - DNA, 25 bp, Mus musculus
tgaaaccttgaagttaccaggccca

SEQ ID NO: 841664 - DNA, 25 bp, Mus musculus
tgaaaccttgtgattatagaacgga

SEQ ID NO: 841665 - DNA, 25 bp, Mus musculus
tgaaaccttgtgtttatagaacgga

SEQ ID NO: 841666 - DNA, 25 bp, Mus musculus
tgaaacctttatcaactcctgacct

SEQ ID NO: 841667 - DNA, 25 bp, Mus musculus
tgaaacctttatgaactcctgacct

SEQ ID NO: 841668 - DNA, 25 bp, Mus musculus
tgaaacctttctccgacaagtgggt

SEQ ID NO: 841669 - DNA, 25 bp, Mus musculus
tgaaacctttctgcgacaagtgggt

SEQ ID NO: 841670 - DNA, 25 bp, Mus musculus
tgaaacctttgacacaaccgggagc

SEQ ID NO: 841671 - DNA, 25 bp, Mus musculus
tgaaacctttgagacaaccgggagc

SEQ ID NO: 841672 - DNA, 25 bp, Mus musculus
tgaaacctttggactgactctccat

SEQ ID NO: 841673 - DNA, 25 bp, Mus musculus
tgaaacctttggtctgactctccat

SEQ ID NO: 841674 - DNA, 25 bp, Mus musculus
tgaaacctttgtcacagcatcactc

SEQ ID NO: 841675 - DNA, 25 bp, Mus musculus
tgaaacctttgtgacagcatcactc

SEQ ID NO: 841676 - DNA, 25 bp, Mus musculus
tgaaacgaataaagtctgacatcag

SEQ ID NO: 841677 - DNA, 25 bp, Mus musculus
tgaaacgaataatgtctgacatcag

SEQ ID NO: 841678 - DNA, 25 bp, Mus musculus
tgaaacgacaatccccatttgcctc

SEQ ID NO: 841679 - DNA, 25 bp, Mus musculus
tgaaacgacaatgcccatttgcctc

SEQ ID NO: 841680 - DNA, 25 bp, Mus musculus
tgaaacgcacggcaccagttgagcc

SEQ ID NO: 841681 - DNA, 25 bp, Mus musculus
tgaaacgcacgggaccagttgagcc

SEQ ID NO: 841682 - DNA, 25 bp, Mus musculus
tgaaacgcagcaagctaggcccgta

SEQ ID NO: 841683 - DNA, 25 bp, Mus musculus
tgaaacgcagcatgctaggcccgta

SEQ ID NO: 841684 - DNA, 25 bp, Mus musculus
tgaaacggattcaagctgctccacg

SEQ ID NO: 841685 - DNA, 25 bp, Mus musculus
tgaaacggattctagctgctccacg

SEQ ID NO: 841686 - DNA, 25 bp, Mus musculus
tgaaacggccctaggagggtcgctc

SEQ ID NO: 841687 - DNA, 25 bp, Mus musculus
tgaaacggcccttggagggtcgctc

SEQ ID NO: 841688 - DNA, 25 bp, Mus musculus
tgaaacgggccgctcccctggactg

SEQ ID NO: 841689 - DNA, 25 bp, Mus musculus
tgaaacgggccggtcccctggactg

SEQ ID NO: 841690 - DNA, 25 bp, Mus musculus
tgaaacggtaccaccacagttaggg

SEQ ID NO: 841691 - DNA, 25 bp, Mus musculus
tgaaacggtacctccacagttaggg

SEQ ID NO: 841692 - DNA, 25 bp, Mus musculus
tgaaacgtcacaaggcacggccact

SEQ ID NO: 841693 - DNA, 25 bp, Mus musculus
tgaaacgtcacatggcacggccact

SEQ ID NO: 841694 - DNA, 25 bp, Mus musculus
tgaaacgttctgagtaaggcaatat

SEQ ID NO: 841695 - DNA, 25 bp, Mus musculus
tgaaacgttctgtgtaaggcaatat

SEQ ID NO: 841696 - DNA, 25 bp, Mus musculus
tgaaactaaagccaaagcccaagga

SEQ ID NO: 841697 - DNA, 25 bp, Mus musculus
tgaaactaaagcgaaagcccaagga

SEQ ID NO: 841698 - DNA, 25 bp, Mus musculus
tgaaactaaatgcttctgttgctta

SEQ ID NO: 841699 - DNA, 25 bp, Mus musculus
tgaaactaaatggttctgttgctta

SEQ ID NO: 841700 - DNA, 25 bp, Mus musculus
tgaaactagcaaactgtcgtatact

SEQ ID NO: 841701 - DNA, 25 bp, Mus musculus
tgaaactagcaatctgtcgtatact

SEQ ID NO: 841702 - DNA, 25 bp, Mus musculus
tgaaactagctaagccttccttttt

SEQ ID NO: 841703 - DNA, 25 bp, Mus musculus
tgaaactagctatgccttccttttt

SEQ ID NO: 841704 - DNA, 25 bp, Mus musculus
tgaaactagttgctgctgggctttt

SEQ ID NO: 841705 - DNA, 25 bp, Mus musculus
tgaaactagttggtgctgggctttt

SEQ ID NO: 841706 - DNA, 25 bp, Mus musculus
tgaaactcagaacccgaaggtccct

SEQ ID NO: 841707 - DNA, 25 bp, Mus musculus
tgaaactcagaagccgaaggtccct

SEQ ID NO: 841708 - DNA, 25 bp, Mus musculus
tgaaactcattcactgctcatccta

SEQ ID NO: 841709 - DNA, 25 bp, Mus musculus
tgaaactcattctctgctcatccta

SEQ ID NO: 841710 - DNA, 25 bp, Mus musculus
tgaaactccaaaccagcagatacag

SEQ ID NO: 841711 - DNA, 25 bp, Mus musculus
tgaaactccaaagcagcagatacag

SEQ ID NO: 841712 - DNA, 25 bp, Mus musculus
tgaaactccgccctttcagattttg

SEQ ID NO: 841713 - DNA, 25 bp, Mus musculus
tgaaactccgccgtttcagattttg

SEQ ID NO: 841714 - DNA, 25 bp, Mus musculus
tgaaactcctcaccaaagtgctggc

SEQ ID NO: 841715 - DNA, 25 bp, Mus musculus
tgaaactcctcagcaaagtgctggc

SEQ ID NO: 841716 - DNA, 25 bp, Mus musculus
tgaaactctaggactcttctttttt

SEQ ID NO: 841717 - DNA, 25 bp, Mus musculus
tgaaactctaggtctcttctttttt

SEQ ID NO: 841718 - DNA, 25 bp, Mus musculus
tgaaactcttctcgcctatcagtac

SEQ ID NO: 841719 - DNA, 25 bp, Mus musculus
tgaaactcttctggcctatcagtac

SEQ ID NO: 841720 - DNA, 25 bp, Mus musculus
tgaaactcttttcctcaggtgcctc

SEQ ID NO: 841721 - DNA, 25 bp, Mus musculus
tgaaactcttttgctcaggtgcctc

SEQ ID NO: 841722 - DNA, 25 bp, Mus musculus
tgaaactgaagtacccgatgcctac

SEQ ID NO: 841723 - DNA, 25 bp, Mus musculus
tgaaactgaagttcccgatgcctac

SEQ ID NO: 841724 - DNA, 25 bp, Mus musculus
tgaaactgagcgcattccccaggcc

SEQ ID NO: 841725 - DNA, 25 bp, Mus musculus
tgaaactgagcggattccccaggcc

SEQ ID NO: 841726 - DNA, 25 bp, Mus musculus
tgaaactgatctaacctggcttctg

SEQ ID NO: 841727 - DNA, 25 bp, Mus musculus
tgaaactgatcttacctggcttctg

SEQ ID NO: 841728 - DNA, 25 bp, Mus musculus
tgaaactgattacctgagacactgg

SEQ ID NO: 841729 - DNA, 25 bp, Mus musculus
tgaaactgattagctgagacactgg

SEQ ID NO: 841730 - DNA, 25 bp, Mus musculus
tgaaactgcaagaccctgtcaaatt

SEQ ID NO: 841731 - DNA, 25 bp, Mus musculus
tgaaactgcaagtccctgtcaaatt

SEQ ID NO: 841732 - DNA, 25 bp, Mus musculus
tgaaactgctatctacgacccatcc

SEQ ID NO: 841733 - DNA, 25 bp, Mus musculus
tgaaactgctatgtacgacccatcc

SEQ ID NO: 841734 - DNA, 25 bp, Mus musculus
tgaaactgcttgaggcaggttcagt

SEQ ID NO: 841735 - DNA, 25 bp, Mus musculus
tgaaactgcttgtggcaggttcagt

SEQ ID NO: 841736 - DNA, 25 bp, Mus musculus
tgaaactggagaacaagactgaccc

SEQ ID NO: 841737 - DNA, 25 bp, Mus musculus
tgaaactggagatcaagactgaccc

SEQ ID NO: 841738 - DNA, 25 bp, Mus musculus
tgaaactggcatctgctgacattac

SEQ ID NO: 841739 - DNA, 25 bp, Mus musculus
tgaaactggcatgtgctgacattac

SEQ ID NO: 841740 - DNA, 25 bp, Mus musculus
tgaaactggccgagactgtgtccca

SEQ ID NO: 841741 - DNA, 25 bp, Mus musculus
tgaaactggccgtgactgtgtccca

SEQ ID NO: 841742 - DNA, 25 bp, Mus musculus
tgaaactgtgaaccaggttttcttc

SEQ ID NO: 841743 - DNA, 25 bp, Mus musculus
tgaaactgtgaagcaggttttcttc

SEQ ID NO: 841744 - DNA, 25 bp, Mus musculus
tgaaactgtgcgcatggcagccatc

SEQ ID NO: 841745 - DNA, 25 bp, Mus musculus
tgaaactgtgcggatggcagccatc

SEQ ID NO: 841746 - DNA, 25 bp, Mus musculus
tgaaactgttccaaatccacctgct

SEQ ID NO: 841747 - DNA, 25 bp, Mus musculus
tgaaactgttcctaatccacctgct

SEQ ID NO: 841748 - DNA, 25 bp, Mus musculus
tgaaactgttttagtcctaacctca

SEQ ID NO: 841749 - DNA, 25 bp, Mus musculus
tgaaactgtttttgtcctaacctca

SEQ ID NO: 841750 - DNA, 25 bp, Mus musculus
tgaaacttcataatttgcagcatct

SEQ ID NO: 841751 - DNA, 25 bp, Mus musculus
tgaaacttcatattttgcagcatct

SEQ ID NO: 841752 - DNA, 25 bp, Mus musculus
tgaaacttccaaccgttccaactgg

SEQ ID NO: 841753 - DNA, 25 bp, Mus musculus
tgaaacttccaagcgttccaactgg

SEQ ID NO: 841754 - DNA, 25 bp, Mus musculus
tgaaacttccttaccgatggctggg

SEQ ID NO: 841755 - DNA, 25 bp, Mus musculus
tgaaacttcctttccgatggctggg

SEQ ID NO: 841756 - DNA, 25 bp, Mus musculus
tgaaacttcgccaagcatgtacctt

SEQ ID NO: 841757 - DNA, 25 bp, Mus musculus
tgaaacttcgcctagcatgtacctt

SEQ ID NO: 841758 - DNA, 25 bp, Mus musculus
tgaaacttgaatctcccttccaact

SEQ ID NO: 841759 - DNA, 25 bp, Mus musculus
tgaaacttgaatgtcccttccaact

SEQ ID NO: 841760 - DNA, 25 bp, Mus musculus
tgaaacttgaccctgattgcatcct

SEQ ID NO: 841761 - DNA, 25 bp, Mus musculus
tgaaacttgaccgtgattgcatcct

SEQ ID NO: 841762 - DNA, 25 bp, Mus musculus
tgaaacttgccgactagcatttttt

SEQ ID NO: 841763 - DNA, 25 bp, Mus musculus
tgaaacttgccgtctagcatttttt

SEQ ID NO: 841764 - DNA, 25 bp, Mus musculus
tgaaacttgctacacaacctcacat

SEQ ID NO: 841765 - DNA, 25 bp, Mus musculus
tgaaacttgctagacaacctcacat

SEQ ID NO: 841766 - DNA, 25 bp, Mus musculus
tgaaacttgtctctctccatgtaca

SEQ ID NO: 841767 - DNA, 25 bp, Mus musculus
tgaaacttgtctgtctccatgtaca

SEQ ID NO: 841768 - DNA, 25 bp, Mus musculus
tgaaacttgttcaaatcaaggactg

SEQ ID NO: 841769 - DNA, 25 bp, Mus musculus
tgaaacttgttctaatcaaggactg

SEQ ID NO: 841770 - DNA, 25 bp, Mus musculus
tgaaactttacgcaagccccagtta

SEQ ID NO: 841771 - DNA, 25 bp, Mus musculus
tgaaactttacggaagccccagtta

SEQ ID NO: 841772 - DNA, 25 bp, Mus musculus
tgaaactttcatcgctattgtatct

SEQ ID NO: 841773 - DNA, 25 bp, Mus musculus
tgaaactttcatggctattgtatct

SEQ ID NO: 841774 - DNA, 25 bp, Mus musculus
tgaaactttccaacacgaaatcatc

SEQ ID NO: 841775 - DNA, 25 bp, Mus musculus
tgaaactttccatcacgaaatcatc

SEQ ID NO: 841776 - DNA, 25 bp, Mus musculus
tgaaactttctacctctcaaatcct

SEQ ID NO: 841777 - DNA, 25 bp, Mus musculus
tgaaactttctagctctcaaatcct

SEQ ID NO: 841778 - DNA, 25 bp, Mus musculus
tgaaactttctgacacggtgaccta

SEQ ID NO: 841779 - DNA, 25 bp, Mus musculus
tgaaactttctgtcacggtgaccta

SEQ ID NO: 841780 - DNA, 25 bp, Mus musculus
tgaaacttttcacctctttgtacca

SEQ ID NO: 841781 - DNA, 25 bp, Mus musculus
tgaaacttttcagctctttgtacca

SEQ ID NO: 841782 - DNA, 25 bp, Mus musculus
tgaaacttttcccagcttagcacat

SEQ ID NO: 841783 - DNA, 25 bp, Mus musculus
tgaaacttttccgagcttagcacat

SEQ ID NO: 841784 - DNA, 25 bp, Mus musculus
tgaaacttttggctatctttagaca

SEQ ID NO: 841785 - DNA, 25 bp, Mus musculus
tgaaacttttgggtatctttagaca

SEQ ID NO: 841786 - DNA, 25 bp, Mus musculus
tgaaagaaacgcctcttccgtactg

SEQ ID NO: 841787 - DNA, 25 bp, Mus musculus
tgaaagaaacgcgtcttccgtactg

SEQ ID NO: 841788 - DNA, 25 bp, Mus musculus
tgaaagaacacccagacaccacaaa

SEQ ID NO: 841789 - DNA, 25 bp, Mus musculus
tgaaagaacaccgagacaccacaaa

SEQ ID NO: 841790 - DNA, 25 bp, Mus musculus
tgaaagaagaccactccgagttccc

SEQ ID NO: 841791 - DNA, 25 bp, Mus musculus
tgaaagaagacctctccgagttccc

SEQ ID NO: 841792 - DNA, 25 bp, Mus musculus
tgaaagaattgcaggtaacctcggc

SEQ ID NO: 841793 - DNA, 25 bp, Mus musculus
tgaaagaattgctggtaacctcggc

SEQ ID NO: 841794 - DNA, 25 bp, Mus musculus
tgaaagacaccccaaacagcttact

SEQ ID NO: 841795 - DNA, 25 bp, Mus musculus
tgaaagacacccgaaacagcttact

SEQ ID NO: 841796 - DNA, 25 bp, Mus musculus
tgaaagacaccgaggtcttcatctg

SEQ ID NO: 841797 - DNA, 25 bp, Mus musculus
tgaaagacaccgtggtcttcatctg

SEQ ID NO: 841798 - DNA, 25 bp, Mus musculus
tgaaagacagtgcactccctcaagt

SEQ ID NO: 841799 - DNA, 25 bp, Mus musculus
tgaaagacagtggactccctcaagt

SEQ ID NO: 841800 - DNA, 25 bp, Mus musculus
tgaaagaccaagctaccctctgaag

SEQ ID NO: 841801 - DNA, 25 bp, Mus musculus
tgaaagaccaaggtaccctctgaag

SEQ ID NO: 841802 - DNA, 25 bp, Mus musculus
tgaaagaccatcactccgtctagtc

SEQ ID NO: 841803 - DNA, 25 bp, Mus musculus
tgaaagaccatctctccgtctagtc

SEQ ID NO: 841804 - DNA, 25 bp, Mus musculus
tgaaagacccagagtgatatccacc

SEQ ID NO: 841805 - DNA, 25 bp, Mus musculus
tgaaagacccagtgtgatatccacc

SEQ ID NO: 841806 - DNA, 25 bp, Mus musculus
tgaaagacctgaatgccctgtcggc

SEQ ID NO: 841807 - DNA, 25 bp, Mus musculus
tgaaagacctgattgccctgtcggc

SEQ ID NO: 841808 - DNA, 25 bp, Mus musculus
tgaaagacctggcttctaggtgaag

SEQ ID NO: 841809 - DNA, 25 bp, Mus musculus
tgaaagacctgggttctaggtgaag

SEQ ID NO: 841810 - DNA, 25 bp, Mus musculus
tgaaagacgatcacgggccatcagt

SEQ ID NO: 841811 - DNA, 25 bp, Mus musculus
tgaaagacgatctcgggccatcagt

SEQ ID NO: 841812 - DNA, 25 bp, Mus musculus
tgaaagacgcacagctcgtagccgc

SEQ ID NO: 841813 - DNA, 25 bp, Mus musculus
tgaaagacgcactgctcgtagccgc

SEQ ID NO: 841814 - DNA, 25 bp, Mus musculus
tgaaagactatcaccttctcattaa

SEQ ID NO: 841815 - DNA, 25 bp, Mus musculus
tgaaagactatctccttctcattaa

SEQ ID NO: 841816 - DNA, 25 bp, Mus musculus
tgaaagacttagcacacggcactgt

SEQ ID NO: 841817 - DNA, 25 bp, Mus musculus
tgaaagacttaggacacggcactgt

SEQ ID NO: 841818 - DNA, 25 bp, Mus musculus
tgaaagacttctagaccacaccatt

SEQ ID NO: 841819 - DNA, 25 bp, Mus musculus
tgaaagacttctcagcccaatgcta

SEQ ID NO: 841820 - DNA, 25 bp, Mus musculus
tgaaagacttctgagcccaatgcta

SEQ ID NO: 841821 - DNA, 25 bp, Mus musculus
tgaaagacttcttgaccacaccatt

SEQ ID NO: 841822 - DNA, 25 bp, Mus musculus
tgaaagagacccatatgcctgtgta

SEQ ID NO: 841823 - DNA, 25 bp, Mus musculus
tgaaagagacccttatgcctgtgta

SEQ ID NO: 841824 - DNA, 25 bp, Mus musculus
tgaaagagcagcctctggcctcatc

SEQ ID NO: 841825 - DNA, 25 bp, Mus musculus
tgaaagagcagcgtctggcctcatc

SEQ ID NO: 841826 - DNA, 25 bp, Mus musculus
tgaaagagcattcctgggttttgtt

SEQ ID NO: 841827 - DNA, 25 bp, Mus musculus
tgaaagagcattgctgggttttgtt

SEQ ID NO: 841828 - DNA, 25 bp, Mus musculus
tgaaagagccgtccatagatgtgag

SEQ ID NO: 841829 - DNA, 25 bp, Mus musculus
tgaaagagccgtgcatagatgtgag

SEQ ID NO: 841830 - DNA, 25 bp, Mus musculus
tgaaagagcctcaagcatggccctc

SEQ ID NO: 841831 - DNA, 25 bp, Mus musculus
tgaaagagcctccttaaaaatactc

SEQ ID NO: 841832 - DNA, 25 bp, Mus musculus
tgaaagagcctcgttaaaaatactc

SEQ ID NO: 841833 - DNA, 25 bp, Mus musculus
tgaaagagcctctagcatggccctc

SEQ ID NO: 841834 - DNA, 25 bp, Mus musculus
tgaaagaggctaccacccagtccaa

SEQ ID NO: 841835 - DNA, 25 bp, Mus musculus
tgaaagaggctagcacccagtccaa

SEQ ID NO: 841836 - DNA, 25 bp, Mus musculus
tgaaagaggctgagacccgagcaga

SEQ ID NO: 841837 - DNA, 25 bp, Mus musculus
tgaaagaggctgtgacccgagcaga

SEQ ID NO: 841838 - DNA, 25 bp, Mus musculus
tgaaagagtcgccttcccatgagtc

SEQ ID NO: 841839 - DNA, 25 bp, Mus musculus
tgaaagagtcgcgttcccatgagtc

SEQ ID NO: 841840 - DNA, 25 bp, Mus musculus
tgaaagagttatacaacgaccccaa

SEQ ID NO: 841841 - DNA, 25 bp, Mus musculus
tgaaagagttattcaacgaccccaa

SEQ ID NO: 841842 - DNA, 25 bp, Mus musculus
tgaaagataattcccaaaaagtcaa

SEQ ID NO: 841843 - DNA, 25 bp, Mus musculus
tgaaagataattgccaaaaagtcaa

SEQ ID NO: 841844 - DNA, 25 bp, Mus musculus
tgaaagatacacaattacagcagat

SEQ ID NO: 841845 - DNA, 25 bp, Mus musculus
tgaaagatacactattacagcagat

SEQ ID NO: 841846 - DNA, 25 bp, Mus musculus
tgaaagatccaccttttttattgac

SEQ ID NO: 841847 - DNA, 25 bp, Mus musculus
tgaaagatccacgttttttattgac

SEQ ID NO: 841848 - DNA, 25 bp, Mus musculus
tgaaagatcctacttttcagtccac

SEQ ID NO: 841849 - DNA, 25 bp, Mus musculus
tgaaagatcctagttttcagtccac

SEQ ID NO: 841850 - DNA, 25 bp, Mus musculus
tgaaagatcctcaacagctcagcct

SEQ ID NO: 841851 - DNA, 25 bp, Mus musculus
tgaaagatcctcctagtgaagctaa

SEQ ID NO: 841852 - DNA, 25 bp, Mus musculus
tgaaagatcctcgtagtgaagctaa

SEQ ID NO: 841853 - DNA, 25 bp, Mus musculus
tgaaagatcctctacagctcagcct

SEQ ID NO: 841854 - DNA, 25 bp, Mus musculus
tgaaagatctccaggcctctctgca

SEQ ID NO: 841855 - DNA, 25 bp, Mus musculus
tgaaagatctcctggcctctctgca

SEQ ID NO: 841856 - DNA, 25 bp, Mus musculus
tgaaagatctctccaggacctactt

SEQ ID NO: 841857 - DNA, 25 bp, Mus musculus
tgaaagatctctgcaggacctactt

SEQ ID NO: 841858 - DNA, 25 bp, Mus musculus
tgaaagatggaaatctagctctctt

SEQ ID NO: 841859 - DNA, 25 bp, Mus musculus
tgaaagatggaattctagctctctt

SEQ ID NO: 841860 - DNA, 25 bp, Mus musculus
tgaaagatggcaccacctgtggagt

SEQ ID NO: 841861 - DNA, 25 bp, Mus musculus
tgaaagatggcagcacctgtggagt

SEQ ID NO: 841862 - DNA, 25 bp, Mus musculus
tgaaagatgggtctcttttcatttc

SEQ ID NO: 841863 - DNA, 25 bp, Mus musculus
tgaaagatgggtgtcttttcatttc

SEQ ID NO: 841864 - DNA, 25 bp, Mus musculus
tgaaagattccgagactgccgttgt

SEQ ID NO: 841865 - DNA, 25 bp, Mus musculus
tgaaagattccgtgactgccgttgt

SEQ ID NO: 841866 - DNA, 25 bp, Mus musculus
tgaaagcaactcaacctgacttccg

SEQ ID NO: 841867 - DNA, 25 bp, Mus musculus
tgaaagcaactctacctgacttccg

SEQ ID NO: 841868 - DNA, 25 bp, Mus musculus
tgaaagcaagcacccacaagagact

SEQ ID NO: 841869 - DNA, 25 bp, Mus musculus
tgaaagcaagcagccacaagagact

SEQ ID NO: 841870 - DNA, 25 bp, Mus musculus
tgaaagcaaggtcgtcctcaaacaa

SEQ ID NO: 841871 - DNA, 25 bp, Mus musculus
tgaaagcaaggtggtcctcaaacaa

SEQ ID NO: 841872 - DNA, 25 bp, Mus musculus
tgaaagcaagttcggctcctcggag

SEQ ID NO: 841873 - DNA, 25 bp, Mus musculus
tgaaagcaagttgggctcctcggag

SEQ ID NO: 841874 - DNA, 25 bp, Mus musculus
tgaaagcacatccttaagagttcct

SEQ ID NO: 841875 - DNA, 25 bp, Mus musculus
tgaaagcacatcgttaagagttcct

SEQ ID NO: 841876 - DNA, 25 bp, Mus musculus
tgaaagcaccttctcggacgtaaac

SEQ ID NO: 841877 - DNA, 25 bp, Mus musculus
tgaaagcaccttgtcggacgtaaac

SEQ ID NO: 841878 - DNA, 25 bp, Mus musculus
tgaaagcagcctaagagccctctct

SEQ ID NO: 841879 - DNA, 25 bp, Mus musculus
tgaaagcagccttagagccctctct

SEQ ID NO: 841880 - DNA, 25 bp, Mus musculus
tgaaagcagtatcctctggccaact

SEQ ID NO: 841881 - DNA, 25 bp, Mus musculus
tgaaagcagtatgctctggccaact

SEQ ID NO: 841882 - DNA, 25 bp, Mus musculus
tgaaagcatcttatggacacatgag

SEQ ID NO: 841883 - DNA, 25 bp, Mus musculus
tgaaagcatcttttggacacatgag

SEQ ID NO: 841884 - DNA, 25 bp, Mus musculus
tgaaagccaaccatagcacaactct

SEQ ID NO: 841885 - DNA, 25 bp, Mus musculus
tgaaagccaaccttagcacaactct

SEQ ID NO: 841886 - DNA, 25 bp, Mus musculus
tgaaagccactcagattcgagccat

SEQ ID NO: 841887 - DNA, 25 bp, Mus musculus
tgaaagccactctgattcgagccat

SEQ ID NO: 841888 - DNA, 25 bp, Mus musculus
tgaaagccagccacctaagttcatg

SEQ ID NO: 841889 - DNA, 25 bp, Mus musculus
tgaaagccagcctcctaagttcatg

SEQ ID NO: 841890 - DNA, 25 bp, Mus musculus
tgaaagccagtacttaggtctaagc

SEQ ID NO: 841891 - DNA, 25 bp, Mus musculus
tgaaagccagtagttaggtctaagc

SEQ ID NO: 841892 - DNA, 25 bp, Mus musculus
tgaaagccatgaccgggtgttcagc

SEQ ID NO: 841893 - DNA, 25 bp, Mus musculus
tgaaagccatgagcgggtgttcagc

SEQ ID NO: 841894 - DNA, 25 bp, Mus musculus
tgaaagcccaccataatttttatat

SEQ ID NO: 841895 - DNA, 25 bp, Mus musculus
tgaaagcccaccttaatttttatat

SEQ ID NO: 841896 - DNA, 25 bp, Mus musculus
tgaaagcccagacgctgctgttgcg

SEQ ID NO: 841897 - DNA, 25 bp, Mus musculus
tgaaagcccagaggctgctgttgcg

SEQ ID NO: 841898 - DNA, 25 bp, Mus musculus
tgaaagccctcaccatggtctcaga

SEQ ID NO: 841899 - DNA, 25 bp, Mus musculus
tgaaagccctcagcatggtctcaga

SEQ ID NO: 841900 - DNA, 25 bp, Mus musculus
tgaaagccgttactttgctagataa

SEQ ID NO: 841901 - DNA, 25 bp, Mus musculus
tgaaagccgttagtttgctagataa

SEQ ID NO: 841902 - DNA, 25 bp, Mus musculus
tgaaagcctcccactgtacatggac

SEQ ID NO: 841903 - DNA, 25 bp, Mus musculus
tgaaagcctccctctgtacatggac

SEQ ID NO: 841904 - DNA, 25 bp, Mus musculus
tgaaagcctcgccttctaagaaacg

SEQ ID NO: 841905 - DNA, 25 bp, Mus musculus
tgaaagcctcgcgttctaagaaacg

SEQ ID NO: 841906 - DNA, 25 bp, Mus musculus
tgaaagcctggtcacagtcagagac

SEQ ID NO: 841907 - DNA, 25 bp, Mus musculus
tgaaagcctggtgacagtcagagac

SEQ ID NO: 841908 - DNA, 25 bp, Mus musculus
tgaaagcctttgagtgcctacctct

SEQ ID NO: 841909 - DNA, 25 bp, Mus musculus
tgaaagcctttgtgtgcctacctct

SEQ ID NO: 841910 - DNA, 25 bp, Mus musculus
tgaaagcgctctcattttaatctgc

SEQ ID NO: 841911 - DNA, 25 bp, Mus musculus
tgaaagcgctctgattttaatctgc

SEQ ID NO: 841912 - DNA, 25 bp, Mus musculus
tgaaagcgttacagctcccacagta

SEQ ID NO: 841913 - DNA, 25 bp, Mus musculus
tgaaagcgttactgctcccacagta

SEQ ID NO: 841914 - DNA, 25 bp, Mus musculus
tgaaagctattaccccgacttgaca

SEQ ID NO: 841915 - DNA, 25 bp, Mus musculus
tgaaagctattagcccgacttgaca

SEQ ID NO: 841916 - DNA, 25 bp, Mus musculus
tgaaagctccttacttgttgaaaca

SEQ ID NO: 841917 - DNA, 25 bp, Mus musculus
tgaaagctcctttcttgttgaaaca

SEQ ID NO: 841918 - DNA, 25 bp, Mus musculus
tgaaagctcgctaacaaaaaacgat

SEQ ID NO: 841919 - DNA, 25 bp, Mus musculus
tgaaagctcgcttacaaaaaacgat

SEQ ID NO: 841920 - DNA, 25 bp, Mus musculus
tgaaagctgccgatagcgatctgca

SEQ ID NO: 841921 - DNA, 25 bp, Mus musculus
tgaaagctgccgttagcgatctgca

SEQ ID NO: 841922 - DNA, 25 bp, Mus musculus
tgaaagctgcgtactccttctacaa

SEQ ID NO: 841923 - DNA, 25 bp, Mus musculus
tgaaagctgcgttctccttctacaa

SEQ ID NO: 841924 - DNA, 25 bp, Mus musculus
tgaaagctgcttctagaacctagta

SEQ ID NO: 841925 - DNA, 25 bp, Mus musculus
tgaaagctgcttgtagaacctagta

SEQ ID NO: 841926 - DNA, 25 bp, Mus musculus
tgaaagcttgtcaggtttttaacct

SEQ ID NO: 841927 - DNA, 25 bp, Mus musculus
tgaaagcttgtctggtttttaacct

SEQ ID NO: 841928 - DNA, 25 bp, Mus musculus
tgaaagctttccagccagtcttagg

SEQ ID NO: 841929 - DNA, 25 bp, Mus musculus
tgaaagctttcctgccagtcttagg

SEQ ID NO: 841930 - DNA, 25 bp, Mus musculus
tgaaaggaaactactgcagcctgcc

SEQ ID NO: 841931 - DNA, 25 bp, Mus musculus
tgaaaggaaacttctgcagcctgcc

SEQ ID NO: 841932 - DNA, 25 bp, Mus musculus
tgaaaggaagacaagcaggaggttt

SEQ ID NO: 841933 - DNA, 25 bp, Mus musculus
tgaaaggaagactagcaggaggttt

SEQ ID NO: 841934 - DNA, 25 bp, Mus musculus
tgaaaggagaataggtactgtgccc

SEQ ID NO: 841935 - DNA, 25 bp, Mus musculus
tgaaaggagaattggtactgtgccc

SEQ ID NO: 841936 - DNA, 25 bp, Mus musculus
tgaaaggaggttacctctcattcct

SEQ ID NO: 841937 - DNA, 25 bp, Mus musculus
tgaaaggaggtttcctctcattcct

SEQ ID NO: 841938 - DNA, 25 bp, Mus musculus
tgaaaggatccgaagccttcccagc

SEQ ID NO: 841939 - DNA, 25 bp, Mus musculus
tgaaaggatccgtagccttcccagc

SEQ ID NO: 841940 - DNA, 25 bp, Mus musculus
tgaaaggatgcaaaggagtctagct

SEQ ID NO: 841941 - DNA, 25 bp, Mus musculus
tgaaaggatgcataggagtctagct

SEQ ID NO: 841942 - DNA, 25 bp, Mus musculus
tgaaaggcaagactccacggtgatg

SEQ ID NO: 841943 - DNA, 25 bp, Mus musculus
tgaaaggcaagagtccacggtgatg

SEQ ID NO: 841944 - DNA, 25 bp, Mus musculus
tgaaaggcacagaccgtgttccctg

SEQ ID NO: 841945 - DNA, 25 bp, Mus musculus
tgaaaggcacagtccgtgttccctg

SEQ ID NO: 841946 - DNA, 25 bp, Mus musculus
tgaaaggcactacaagttcagacta

SEQ ID NO: 841947 - DNA, 25 bp, Mus musculus
tgaaaggcactagaagttcagacta

SEQ ID NO: 841948 - DNA, 25 bp, Mus musculus
tgaaaggcagcaccatcagcacaaa

SEQ ID NO: 841949 - DNA, 25 bp, Mus musculus
tgaaaggcagcagcatcagcacaaa

SEQ ID NO: 841950 - DNA, 25 bp, Mus musculus
tgaaaggcccctataagtacagttt

SEQ ID NO: 841951 - DNA, 25 bp, Mus musculus
tgaaaggcccctttaagtacagttt

SEQ ID NO: 841952 - DNA, 25 bp, Mus musculus
tgaaaggccctgagctggtggacaa

SEQ ID NO: 841953 - DNA, 25 bp, Mus musculus
tgaaaggccctgtgctggtggacaa

SEQ ID NO: 841954 - DNA, 25 bp, Mus musculus
tgaaaggcgggtcttcttagcacac

SEQ ID NO: 841955 - DNA, 25 bp, Mus musculus
tgaaaggcgggtgttcttagcacac

SEQ ID NO: 841956 - DNA, 25 bp, Mus musculus
tgaaaggctgaacctcagggctcca

SEQ ID NO: 841957 - DNA, 25 bp, Mus musculus
tgaaaggctgaagctcagggctcca

SEQ ID NO: 841958 - DNA, 25 bp, Mus musculus
tgaaaggctggcaccccttttcctg

SEQ ID NO: 841959 - DNA, 25 bp, Mus musculus
tgaaaggctggctccccttttcctg

SEQ ID NO: 841960 - DNA, 25 bp, Mus musculus
tgaaaggcttccagcattccactaa

SEQ ID NO: 841961 - DNA, 25 bp, Mus musculus
tgaaaggcttcctgcattccactaa

SEQ ID NO: 841962 - DNA, 25 bp, Mus musculus
tgaaaggcttttcacctccttatgc

SEQ ID NO: 841963 - DNA, 25 bp, Mus musculus
tgaaaggcttttgacctccttatgc

SEQ ID NO: 841964 - DNA, 25 bp, Mus musculus
tgaaagggagctcgccgtgcctaaa

SEQ ID NO: 841965 - DNA, 25 bp, Mus musculus
tgaaagggagctggccgtgcctaaa

SEQ ID NO: 841966 - DNA, 25 bp, Mus musculus
tgaaagggccaaagcacacccactt

SEQ ID NO: 841967 - DNA, 25 bp, Mus musculus
tgaaagggccaatgcacacccactt

SEQ ID NO: 841968 - DNA, 25 bp, Mus musculus
tgaaagggccgcacagttcagccag

SEQ ID NO: 841969 - DNA, 25 bp, Mus musculus
tgaaagggccgctcagttcagccag

SEQ ID NO: 841970 - DNA, 25 bp, Mus musculus
tgaaagggctaactgctcctactcg

SEQ ID NO: 841971 - DNA, 25 bp, Mus musculus
tgaaagggctaagtgctcctactcg

SEQ ID NO: 841972 - DNA, 25 bp, Mus musculus
tgaaagggctgacacttccagggaa

SEQ ID NO: 841973 - DNA, 25 bp, Mus musculus
tgaaagggctgagacttccagggaa

SEQ ID NO: 841974 - DNA, 25 bp, Mus musculus
tgaaagggctgcctagactacagag

SEQ ID NO: 841975 - DNA, 25 bp, Mus musculus
tgaaagggctgcgtagactacagag

SEQ ID NO: 841976 - DNA, 25 bp, Mus musculus
tgaaaggtatccctttgcagcctgt

SEQ ID NO: 841977 - DNA, 25 bp, Mus musculus
tgaaaggtatccgtttgcagcctgt

SEQ ID NO: 841978 - DNA, 25 bp, Mus musculus
tgaaaggtatctatccgctcttctc

SEQ ID NO: 841979 - DNA, 25 bp, Mus musculus
tgaaaggtatctttccgctcttctc

SEQ ID NO: 841980 - DNA, 25 bp, Mus musculus
tgaaaggtcatgacttgtgctcagc

SEQ ID NO: 841981 - DNA, 25 bp, Mus musculus
tgaaaggtcatgtcttgtgctcagc

SEQ ID NO: 841982 - DNA, 25 bp, Mus musculus
tgaaaggtgagtccctcctgcagta

SEQ ID NO: 841983 - DNA, 25 bp, Mus musculus
tgaaaggtgagtgcctcctgcagta

SEQ ID NO: 841984 - DNA, 25 bp, Mus musculus
tgaaaggtgcccctatcttgcctgg

SEQ ID NO: 841985 - DNA, 25 bp, Mus musculus
tgaaaggtgcccgtatcttgcctgg

SEQ ID NO: 841986 - DNA, 25 bp, Mus musculus
tgaaaggtgctcacaaacccttctc

SEQ ID NO: 841987 - DNA, 25 bp, Mus musculus
tgaaaggtgctctcaaacccttctc

SEQ ID NO: 841988 - DNA, 25 bp, Mus musculus
tgaaaggtgtccacactgccaaatg

SEQ ID NO: 841989 - DNA, 25 bp, Mus musculus
tgaaaggtgtcctcactgccaaatg

SEQ ID NO: 841990 - DNA, 25 bp, Mus musculus
tgaaaggttcagcattcccatgcct

SEQ ID NO: 841991 - DNA, 25 bp, Mus musculus
tgaaaggttcaggattcccatgcct

SEQ ID NO: 841992 - DNA, 25 bp, Mus musculus
tgaaaggttcccctccttggacgca

SEQ ID NO: 841993 - DNA, 25 bp, Mus musculus
tgaaaggttcccgtccttggacgca

SEQ ID NO: 841994 - DNA, 25 bp, Mus musculus
tgaaaggttctcacagtcggcggaa

SEQ ID NO: 841995 - DNA, 25 bp, Mus musculus
tgaaaggttctcacttctacagtct

SEQ ID NO: 841996 - DNA, 25 bp, Mus musculus
tgaaaggttctctcagtcggcggaa

SEQ ID NO: 841997 - DNA, 25 bp, Mus musculus
tgaaaggttctctcttctacagtct

SEQ ID NO: 841998 - DNA, 25 bp, Mus musculus
tgaaaggttcttctggaacccgtgt

SEQ ID NO: 841999 - DNA, 25 bp, Mus musculus
tgaaaggttcttgtggaacccgtgt

SEQ ID NO: 842000 - DNA, 25 bp, Mus musculus
tgaaaggttggcacttgctttcttt

SEQ ID NO: 842001 - DNA, 25 bp, Mus musculus
tgaaaggttggctcttgctttcttt

SEQ ID NO: 842002 - DNA, 25 bp, Mus musculus
tgaaagtaccttacagatgccaaat

SEQ ID NO: 842003 - DNA, 25 bp, Mus musculus
tgaaagtacctttcagatgccaaat

SEQ ID NO: 842004 - DNA, 25 bp, Mus musculus
tgaaagtacttgatttgcctctttt

SEQ ID NO: 842005 - DNA, 25 bp, Mus musculus
tgaaagtacttgttttgcctctttt

SEQ ID NO: 842006 - DNA, 25 bp, Mus musculus
tgaaagtagaaaaggtctccccagg

SEQ ID NO: 842007 - DNA, 25 bp, Mus musculus
tgaaagtagaaatggtctccccagg

SEQ ID NO: 842008 - DNA, 25 bp, Mus musculus
tgaaagtaggagactcctgtcccca

SEQ ID NO: 842009 - DNA, 25 bp, Mus musculus
tgaaagtaggagtctcctgtcccca

SEQ ID NO: 842010 - DNA, 25 bp, Mus musculus
tgaaagtagtttacccagccgttga

SEQ ID NO: 842011 - DNA, 25 bp, Mus musculus
tgaaagtagttttcccagccgttga

SEQ ID NO: 842012 - DNA, 25 bp, Mus musculus
tgaaagtatctgagtgtccacaagc

SEQ ID NO: 842013 - DNA, 25 bp, Mus musculus
tgaaagtatctgtgtgtccacaagc

SEQ ID NO: 842014 - DNA, 25 bp, Mus musculus
tgaaagtatgctaccaatgacctac

SEQ ID NO: 842015 - DNA, 25 bp, Mus musculus
tgaaagtatgcttccaatgacctac

SEQ ID NO: 842016 - DNA, 25 bp, Mus musculus
tgaaagtattggacactggtgatgt

SEQ ID NO: 842017 - DNA, 25 bp, Mus musculus
tgaaagtattggtcactggtgatgt

SEQ ID NO: 842018 - DNA, 25 bp, Mus musculus
tgaaagtcaaccatcctatgtctcc

SEQ ID NO: 842019 - DNA, 25 bp, Mus musculus
tgaaagtcaaccttcctatgtctcc

SEQ ID NO: 842020 - DNA, 25 bp, Mus musculus
tgaaagtcaccaaactctcctgtaa

SEQ ID NO: 842021 - DNA, 25 bp, Mus musculus
tgaaagtcaccatactctcctgtaa

SEQ ID NO: 842022 - DNA, 25 bp, Mus musculus
tgaaagtccactcttcatgtccagc

SEQ ID NO: 842023 - DNA, 25 bp, Mus musculus
tgaaagtccactgttcatgtccagc

SEQ ID NO: 842024 - DNA, 25 bp, Mus musculus
tgaaagtcgcagatcctcaagaagg

SEQ ID NO: 842025 - DNA, 25 bp, Mus musculus
tgaaagtcgcagttcctcaagaagg

SEQ ID NO: 842026 - DNA, 25 bp, Mus musculus
tgaaagtcgctaaacgcatcctgtt

SEQ ID NO: 842027 - DNA, 25 bp, Mus musculus
tgaaagtcgctatacgcatcctgtt

SEQ ID NO: 842028 - DNA, 25 bp, Mus musculus
tgaaagtcggttcctagcctggtta

SEQ ID NO: 842029 - DNA, 25 bp, Mus musculus
tgaaagtcggttgctagcctggtta

SEQ ID NO: 842030 - DNA, 25 bp, Mus musculus
tgaaagtctgctacattgtaagcta

SEQ ID NO: 842031 - DNA, 25 bp, Mus musculus
tgaaagtctgcttcattgtaagcta

SEQ ID NO: 842032 - DNA, 25 bp, Mus musculus
tgaaagtctgtgacacctggtgact

SEQ ID NO: 842033 - DNA, 25 bp, Mus musculus
tgaaagtctgtgtcacctggtgact

SEQ ID NO: 842034 - DNA, 25 bp, Mus musculus
tgaaagtcttagatgctcccaggct

SEQ ID NO: 842035 - DNA, 25 bp, Mus musculus
tgaaagtcttagttgctcccaggct

SEQ ID NO: 842036 - DNA, 25 bp, Mus musculus
tgaaagtcttccactagatgcccaa

SEQ ID NO: 842037 - DNA, 25 bp, Mus musculus
tgaaagtcttcctctagatgcccaa

SEQ ID NO: 842038 - DNA, 25 bp, Mus musculus
tgaaagtgaccaatcatctcctggg

SEQ ID NO: 842039 - DNA, 25 bp, Mus musculus
tgaaagtgaccattcatctcctggg

SEQ ID NO: 842040 - DNA, 25 bp, Mus musculus
tgaaagtgagtcaggctcctccata

SEQ ID NO: 842041 - DNA, 25 bp, Mus musculus
tgaaagtgagtctggctcctccata

SEQ ID NO: 842042 - DNA, 25 bp, Mus musculus
tgaaagtgcagaacgccgtggccaa

SEQ ID NO: 842043 - DNA, 25 bp, Mus musculus
tgaaagtgcagatcgccgtggccaa

SEQ ID NO: 842044 - DNA, 25 bp, Mus musculus
tgaaagtgctgcctgttcttctgca

SEQ ID NO: 842045 - DNA, 25 bp, Mus musculus
tgaaagtgctgcgtgttcttctgca

SEQ ID NO: 842046 - DNA, 25 bp, Mus musculus
tgaaagtgggtactatcacgcgtcc

SEQ ID NO: 842047 - DNA, 25 bp, Mus musculus
tgaaagtgggtagtatcacgcgtcc

SEQ ID NO: 842048 - DNA, 25 bp, Mus musculus
tgaaagtgtcccagaaggccagcca

SEQ ID NO: 842049 - DNA, 25 bp, Mus musculus
tgaaagtgtccctgaaggccagcca

SEQ ID NO: 842050 - DNA, 25 bp, Mus musculus
tgaaagtgtgcaacacggcagctgg

SEQ ID NO: 842051 - DNA, 25 bp, Mus musculus
tgaaagtgtgcaatggaaaacacaa

SEQ ID NO: 842052 - DNA, 25 bp, Mus musculus
tgaaagtgtgcaccaaccacgccag

SEQ ID NO: 842053 - DNA, 25 bp, Mus musculus
tgaaagtgtgcagcaaccacgccag

SEQ ID NO: 842054 - DNA, 25 bp, Mus musculus
tgaaagtgtgcatcacggcagctgg

SEQ ID NO: 842055 - DNA, 25 bp, Mus musculus
tgaaagtgtgcattggaaaacacaa

SEQ ID NO: 842056 - DNA, 25 bp, Mus musculus
tgaaagtgttttccaaggctctgca

SEQ ID NO: 842057 - DNA, 25 bp, Mus musculus
tgaaagtgttttgcaaggctctgca

SEQ ID NO: 842058 - DNA, 25 bp, Mus musculus
tgaaagttaaaacctgaccgctcaa

SEQ ID NO: 842059 - DNA, 25 bp, Mus musculus
tgaaagttaaaagctgaccgctcaa

SEQ ID NO: 842060 - DNA, 25 bp, Mus musculus
tgaaagttagtcctggctctcatca

SEQ ID NO: 842061 - DNA, 25 bp, Mus musculus
tgaaagttagtcgtggctctcatca

SEQ ID NO: 842062 - DNA, 25 bp, Mus musculus
tgaaagttagttctctccgcattct

SEQ ID NO: 842063 - DNA, 25 bp, Mus musculus
tgaaagttagttgtctccgcattct

SEQ ID NO: 842064 - DNA, 25 bp, Mus musculus
tgaaagttcagtccatctccagtag

SEQ ID NO: 842065 - DNA, 25 bp, Mus musculus
tgaaagttcagtgcatctccagtag

SEQ ID NO: 842066 - DNA, 25 bp, Mus musculus
tgaaagttctccctcctggtgaagg

SEQ ID NO: 842067 - DNA, 25 bp, Mus musculus
tgaaagttctccgtcctggtgaagg

SEQ ID NO: 842068 - DNA, 25 bp, Mus musculus
tgaaagttcttaagtttgtggccaa

SEQ ID NO: 842069 - DNA, 25 bp, Mus musculus
tgaaagttcttatgtttgtggccaa

SEQ ID NO: 842070 - DNA, 25 bp, Mus musculus
tgaaagttggacacacagctggtct

SEQ ID NO: 842071 - DNA, 25 bp, Mus musculus
tgaaagttggactcacagctggtct

SEQ ID NO: 842072 - DNA, 25 bp, Mus musculus
tgaaagtttacaatgcagtagcatt

SEQ ID NO: 842073 - DNA, 25 bp, Mus musculus
tgaaagtttacattgcagtagcatt

SEQ ID NO: 842074 - DNA, 25 bp, Mus musculus
tgaaagtttcccaccaagtattttg

SEQ ID NO: 842075 - DNA, 25 bp, Mus musculus
tgaaagtttccctccaagtattttg

SEQ ID NO: 842076 - DNA, 25 bp, Mus musculus
tgaaagttttaacaccttaacattg

SEQ ID NO: 842077 - DNA, 25 bp, Mus musculus
tgaaagttttaagaccttaacattg

SEQ ID NO: 842078 - DNA, 25 bp, Mus musculus
tgaaagttttcacttctcccatttt

SEQ ID NO: 842079 - DNA, 25 bp, Mus musculus
tgaaagttttcagttctcccatttt

SEQ ID NO: 842080 - DNA, 25 bp, Mus musculus
tgaaagtttttcctagaaggtagtg

SEQ ID NO: 842081 - DNA, 25 bp, Mus musculus
tgaaagtttttcgtagaaggtagtg

SEQ ID NO: 842082 - DNA, 25 bp, Mus musculus
tgaaataaacctccgactgccattc

SEQ ID NO: 842083 - DNA, 25 bp, Mus musculus
tgaaataaacctgcgactgccattc

SEQ ID NO: 842084 - DNA, 25 bp, Mus musculus
tgaaataacactccactccgtctag

SEQ ID NO: 842085 - DNA, 25 bp, Mus musculus
tgaaataacactgcactccgtctag

SEQ ID NO: 842086 - DNA, 25 bp, Mus musculus
tgaaataacctgcattctctatggg

SEQ ID NO: 842087 - DNA, 25 bp, Mus musculus
tgaaataacctggattctctatggg

SEQ ID NO: 842088 - DNA, 25 bp, Mus musculus
tgaaataacttaccccatcactcct

SEQ ID NO: 842089 - DNA, 25 bp, Mus musculus
tgaaataacttagcccatcactcct

SEQ ID NO: 842090 - DNA, 25 bp, Mus musculus
tgaaataacttcaacctgagcctct

SEQ ID NO: 842091 - DNA, 25 bp, Mus musculus
tgaaataacttctacctgagcctct

SEQ ID NO: 842092 - DNA, 25 bp, Mus musculus
tgaaataagactactacttcctcct

SEQ ID NO: 842093 - DNA, 25 bp, Mus musculus
tgaaataagacttctacttcctcct

SEQ ID NO: 842094 - DNA, 25 bp, Mus musculus
tgaaataaggtcaacatagtcctgg

SEQ ID NO: 842095 - DNA, 25 bp, Mus musculus
tgaaataaggtctacatagtcctgg

SEQ ID NO: 842096 - DNA, 25 bp, Mus musculus
tgaaataagtttcttctcccaccca

SEQ ID NO: 842097 - DNA, 25 bp, Mus musculus
tgaaataagtttgttctcccaccca

SEQ ID NO: 842098 - DNA, 25 bp, Mus musculus
tgaaataataatccctggagcattt

SEQ ID NO: 842099 - DNA, 25 bp, Mus musculus
tgaaataataatgcctggagcattt

SEQ ID NO: 842100 - DNA, 25 bp, Mus musculus
tgaaatacaagtctctacctcaggg

SEQ ID NO: 842101 - DNA, 25 bp, Mus musculus
tgaaatacaagtgtctacctcaggg

SEQ ID NO: 842102 - DNA, 25 bp, Mus musculus
tgaaatacactcactcacctttact

SEQ ID NO: 842103 - DNA, 25 bp, Mus musculus
tgaaatacactctctcacctttact

SEQ ID NO: 842104 - DNA, 25 bp, Mus musculus
tgaaatacagaacaagttttgggtt

SEQ ID NO: 842105 - DNA, 25 bp, Mus musculus
tgaaatacagaagaagttttgggtt

SEQ ID NO: 842106 - DNA, 25 bp, Mus musculus
tgaaatacaggaatacccagcaact

SEQ ID NO: 842107 - DNA, 25 bp, Mus musculus
tgaaatacaggattacccagcaact

SEQ ID NO: 842108 - DNA, 25 bp, Mus musculus
tgaaataccaaaccttttttgttct

SEQ ID NO: 842109 - DNA, 25 bp, Mus musculus
tgaaataccaaagcttttttgttct

SEQ ID NO: 842110 - DNA, 25 bp, Mus musculus
tgaaataccacaagccagtaggcaa

SEQ ID NO: 842111 - DNA, 25 bp, Mus musculus
tgaaataccacatgccagtaggcaa

SEQ ID NO: 842112 - DNA, 25 bp, Mus musculus
tgaaatacccagacactcccgtagc

SEQ ID NO: 842113 - DNA, 25 bp, Mus musculus
tgaaatacccagtcactcccgtagc

SEQ ID NO: 842114 - DNA, 25 bp, Mus musculus
tgaaatacgtcccagcagccgtcta

SEQ ID NO: 842115 - DNA, 25 bp, Mus musculus
tgaaatacgtccgagcagccgtcta

SEQ ID NO: 842116 - DNA, 25 bp, Mus musculus
tgaaatactaacaccagaccaggca

SEQ ID NO: 842117 - DNA, 25 bp, Mus musculus
tgaaatactaactccagaccaggca

SEQ ID NO: 842118 - DNA, 25 bp, Mus musculus
tgaaatactctactccaaacctgac

SEQ ID NO: 842119 - DNA, 25 bp, Mus musculus
tgaaatactctagtccaaacctgac

SEQ ID NO: 842120 - DNA, 25 bp, Mus musculus
tgaaatactgtgactgcctgtcttc

SEQ ID NO: 842121 - DNA, 25 bp, Mus musculus
tgaaatactgtgtctgcctgtcttc

SEQ ID NO: 842122 - DNA, 25 bp, Mus musculus
tgaaatactttgataccccaggcac

SEQ ID NO: 842123 - DNA, 25 bp, Mus musculus
tgaaatactttgttaccccaggcac

SEQ ID NO: 842124 - DNA, 25 bp, Mus musculus
tgaaataggagaatcttccaactac

SEQ ID NO: 842125 - DNA, 25 bp, Mus musculus
tgaaataggagattcttccaactac

SEQ ID NO: 842126 - DNA, 25 bp, Mus musculus
tgaaataggcctacgttctcattat

SEQ ID NO: 842127 - DNA, 25 bp, Mus musculus
tgaaataggccttcgttctcattat

SEQ ID NO: 842128 - DNA, 25 bp, Mus musculus
tgaaataggtacagccttctctggg

SEQ ID NO: 842129 - DNA, 25 bp, Mus musculus
tgaaataggtactgccttctctggg

SEQ ID NO: 842130 - DNA, 25 bp, Mus musculus
tgaaatagtctcagtggcctcctag

SEQ ID NO: 842131 - DNA, 25 bp, Mus musculus
tgaaatagtctctgtggcctcctag

SEQ ID NO: 842132 - DNA, 25 bp, Mus musculus
tgaaatataatcaggtggccggccg

SEQ ID NO: 842133 - DNA, 25 bp, Mus musculus
tgaaatataatctggtggccggccg

SEQ ID NO: 842134 - DNA, 25 bp, Mus musculus
tgaaatatattcctcatagccttgg

SEQ ID NO: 842135 - DNA, 25 bp, Mus musculus
tgaaatatattcgtcatagccttgg

SEQ ID NO: 842136 - DNA, 25 bp, Mus musculus
tgaaatatgcctcccaaattgtgta

SEQ ID NO: 842137 - DNA, 25 bp, Mus musculus
tgaaatatgcctgccaaattgtgta

SEQ ID NO: 842138 - DNA, 25 bp, Mus musculus
tgaaatatggccactcaggctgaag

SEQ ID NO: 842139 - DNA, 25 bp, Mus musculus
tgaaatatggcctctcaggctgaag

SEQ ID NO: 842140 - DNA, 25 bp, Mus musculus
tgaaatattcccaatcactgacata

SEQ ID NO: 842141 - DNA, 25 bp, Mus musculus
tgaaatattccctatcactgacata

SEQ ID NO: 842142 - DNA, 25 bp, Mus musculus
tgaaatattcctaccgtttccatcc

SEQ ID NO: 842143 - DNA, 25 bp, Mus musculus
tgaaatattccttccgtttccatcc

SEQ ID NO: 842144 - DNA, 25 bp, Mus musculus
tgaaatattctgacttcatttctgt

SEQ ID NO: 842145 - DNA, 25 bp, Mus musculus
tgaaatattctgtcttcatttctgt

SEQ ID NO: 842146 - DNA, 25 bp, Mus musculus
tgaaatcaacgccttgggtctgctg

SEQ ID NO: 842147 - DNA, 25 bp, Mus musculus
tgaaatcaacgcgttgggtctgctg

SEQ ID NO: 842148 - DNA, 25 bp, Mus musculus
tgaaatcacaccattctagaggagg

SEQ ID NO: 842149 - DNA, 25 bp, Mus musculus
tgaaatcacacctttctagaggagg

SEQ ID NO: 842150 - DNA, 25 bp, Mus musculus
tgaaatcacagaccaggaccctcct

SEQ ID NO: 842151 - DNA, 25 bp, Mus musculus
tgaaatcacagagcaggaccctcct

SEQ ID NO: 842152 - DNA, 25 bp, Mus musculus
tgaaatcacagtactttggaggtgt

SEQ ID NO: 842153 - DNA, 25 bp, Mus musculus
tgaaatcacagttctttggaggtgt

SEQ ID NO: 842154 - DNA, 25 bp, Mus musculus
tgaaatcacatcaagctcatgcaag

SEQ ID NO: 842155 - DNA, 25 bp, Mus musculus
tgaaatcacatctagctcatgcaag

SEQ ID NO: 842156 - DNA, 25 bp, Mus musculus
tgaaatcaccctaacctggcagagg

SEQ ID NO: 842157 - DNA, 25 bp, Mus musculus
tgaaatcacccttacctggcagagg

SEQ ID NO: 842158 - DNA, 25 bp, Mus musculus
tgaaatcacctaagggagccccact

SEQ ID NO: 842159 - DNA, 25 bp, Mus musculus
tgaaatcacctatgggagccccact

SEQ ID NO: 842160 - DNA, 25 bp, Mus musculus
tgaaatcactcaaaggcctagacct

SEQ ID NO: 842161 - DNA, 25 bp, Mus musculus
tgaaatcactcataggcctagacct

SEQ ID NO: 842162 - DNA, 25 bp, Mus musculus
tgaaatcactctagggactgccgtc

SEQ ID NO: 842163 - DNA, 25 bp, Mus musculus
tgaaatcactcttgggactgccgtc

SEQ ID NO: 842164 - DNA, 25 bp, Mus musculus
tgaaatcactgcactcatggctcca

SEQ ID NO: 842165 - DNA, 25 bp, Mus musculus
tgaaatcactgctctcatggctcca

SEQ ID NO: 842166 - DNA, 25 bp, Mus musculus
tgaaatcactttcggcagcagtgtc

SEQ ID NO: 842167 - DNA, 25 bp, Mus musculus
tgaaatcactttgggcagcagtgtc

SEQ ID NO: 842168 - DNA, 25 bp, Mus musculus
tgaaatcagaacattagggagctgg

SEQ ID NO: 842169 - DNA, 25 bp, Mus musculus
tgaaatcagaactttagggagctgg

SEQ ID NO: 842170 - DNA, 25 bp, Mus musculus
tgaaatcagtaccaaaagagtctct

SEQ ID NO: 842171 - DNA, 25 bp, Mus musculus
tgaaatcagtacgaaaagagtctct

SEQ ID NO: 842172 - DNA, 25 bp, Mus musculus
tgaaatcatgaccaaattcccgtgt

SEQ ID NO: 842173 - DNA, 25 bp, Mus musculus
tgaaatcatgacgaaattcccgtgt

SEQ ID NO: 842174 - DNA, 25 bp, Mus musculus
tgaaatccaaaacatgttcacacta

SEQ ID NO: 842175 - DNA, 25 bp, Mus musculus
tgaaatccaaaagatgttcacacta

SEQ ID NO: 842176 - DNA, 25 bp, Mus musculus
tgaaatccacaaactggttcctccc

SEQ ID NO: 842177 - DNA, 25 bp, Mus musculus
tgaaatccacaatctggttcctccc

SEQ ID NO: 842178 - DNA, 25 bp, Mus musculus
tgaaatccaggtctcgggtctgatt

SEQ ID NO: 842179 - DNA, 25 bp, Mus musculus
tgaaatccaggtgtcgggtctgatt

SEQ ID NO: 842180 - DNA, 25 bp, Mus musculus
tgaaatccatagattgctctgccct

SEQ ID NO: 842181 - DNA, 25 bp, Mus musculus
tgaaatccatagtttgctctgccct

SEQ ID NO: 842182 - DNA, 25 bp, Mus musculus
tgaaatccatcactgccaagagcat

SEQ ID NO: 842183 - DNA, 25 bp, Mus musculus
tgaaatccatcagtgccaagagcat

SEQ ID NO: 842184 - DNA, 25 bp, Mus musculus
tgaaatccatcgcttcttccaaacc

SEQ ID NO: 842185 - DNA, 25 bp, Mus musculus
tgaaatccatcggttcttccaaacc

SEQ ID NO: 842186 - DNA, 25 bp, Mus musculus
tgaaatccatttctcctgagcctgc

SEQ ID NO: 842187 - DNA, 25 bp, Mus musculus
tgaaatccatttgtcctgagcctgc

SEQ ID NO: 842188 - DNA, 25 bp, Mus musculus
tgaaatcccaatcccagcactggtg

SEQ ID NO: 842189 - DNA, 25 bp, Mus musculus
tgaaatcccaatgccagcactggtg

SEQ ID NO: 842190 - DNA, 25 bp, Mus musculus
tgaaatcccactattgtgaggacac

SEQ ID NO: 842191 - DNA, 25 bp, Mus musculus
tgaaatcccacttttgtgaggacac

SEQ ID NO: 842192 - DNA, 25 bp, Mus musculus
tgaaatcccagccagggagccattg

SEQ ID NO: 842193 - DNA, 25 bp, Mus musculus
tgaaatcccagcgagggagccattg

SEQ ID NO: 842194 - DNA, 25 bp, Mus musculus
tgaaatcccatgctcacaagaactc

SEQ ID NO: 842195 - DNA, 25 bp, Mus musculus
tgaaatcccatggtcacaagaactc

SEQ ID NO: 842196 - DNA, 25 bp, Mus musculus
tgaaatcccggacaagagcctggga

SEQ ID NO: 842197 - DNA, 25 bp, Mus musculus
tgaaatcccggagaagagcctggga

SEQ ID NO: 842198 - DNA, 25 bp, Mus musculus
tgaaatccctccatcctaataaatg

SEQ ID NO: 842199 - DNA, 25 bp, Mus musculus
tgaaatccctccttcctaataaatg

SEQ ID NO: 842200 - DNA, 25 bp, Mus musculus
tgaaatcccttcagtcagtctgagg

SEQ ID NO: 842201 - DNA, 25 bp, Mus musculus
tgaaatcccttctgtcagtctgagg

SEQ ID NO: 842202 - DNA, 25 bp, Mus musculus
tgaaatccgaaaattcttgggtgaa

SEQ ID NO: 842203 - DNA, 25 bp, Mus musculus
tgaaatccgaaatttcttgggtgaa

SEQ ID NO: 842204 - DNA, 25 bp, Mus musculus
tgaaatcctagcagttgggtggcag

SEQ ID NO: 842205 - DNA, 25 bp, Mus musculus
tgaaatcctagctgttgggtggcag

SEQ ID NO: 842206 - DNA, 25 bp, Mus musculus
tgaaatcctgatcgcccttatctgt

SEQ ID NO: 842207 - DNA, 25 bp, Mus musculus
tgaaatcctgatggcccttatctgt

SEQ ID NO: 842208 - DNA, 25 bp, Mus musculus
tgaaatcctggcattttgagaataa

SEQ ID NO: 842209 - DNA, 25 bp, Mus musculus
tgaaatcctggctttttgagaataa

SEQ ID NO: 842210 - DNA, 25 bp, Mus musculus
tgaaatcctgtaattctccttatgg

SEQ ID NO: 842211 - DNA, 25 bp, Mus musculus
tgaaatcctgtatttctccttatgg

SEQ ID NO: 842212 - DNA, 25 bp, Mus musculus
tgaaatccttcacgcatatcagctg

SEQ ID NO: 842213 - DNA, 25 bp, Mus musculus
tgaaatccttcaggcatatcagctg

SEQ ID NO: 842214 - DNA, 25 bp, Mus musculus
tgaaatctaataaatgccgtgccat

SEQ ID NO: 842215 - DNA, 25 bp, Mus musculus
tgaaatctaatatatgccgtgccat

SEQ ID NO: 842216 - DNA, 25 bp, Mus musculus
tgaaatctacccaggatcttctggc

SEQ ID NO: 842217 - DNA, 25 bp, Mus musculus
tgaaatctaccctggatcttctggc

SEQ ID NO: 842218 - DNA, 25 bp, Mus musculus
tgaaatctgagaaaagtgcggctaa

SEQ ID NO: 842219 - DNA, 25 bp, Mus musculus
tgaaatctgagataagtgcggctaa

SEQ ID NO: 842220 - DNA, 25 bp, Mus musculus
tgaaatctgcaacgctcattaagaa

SEQ ID NO: 842221 - DNA, 25 bp, Mus musculus
tgaaatctgcaaggctcattaagaa

SEQ ID NO: 842222 - DNA, 25 bp, Mus musculus
tgaaatctgcctccaacattgacga

SEQ ID NO: 842223 - DNA, 25 bp, Mus musculus
tgaaatctgcctgcaacattgacga

SEQ ID NO: 842224 - DNA, 25 bp, Mus musculus
tgaaatctggaaccccttgctgatg

SEQ ID NO: 842225 - DNA, 25 bp, Mus musculus
tgaaatctggaagcccttgctgatg

SEQ ID NO: 842226 - DNA, 25 bp, Mus musculus
tgaaatctgtgcaaccaagtgccta

SEQ ID NO: 842227 - DNA, 25 bp, Mus musculus
tgaaatctgtgctaccaagtgccta

SEQ ID NO: 842228 - DNA, 25 bp, Mus musculus
tgaaatcttccaacatgttagtgat

SEQ ID NO: 842229 - DNA, 25 bp, Mus musculus
tgaaatcttccatcatgttagtgat

SEQ ID NO: 842230 - DNA, 25 bp, Mus musculus
tgaaatcttcctagtaagtactcaa

SEQ ID NO: 842231 - DNA, 25 bp, Mus musculus
tgaaatcttccttgtaagtactcaa

SEQ ID NO: 842232 - DNA, 25 bp, Mus musculus
tgaaatcttgacatacccagtcccc

SEQ ID NO: 842233 - DNA, 25 bp, Mus musculus
tgaaatcttgacttacccagtcccc

SEQ ID NO: 842234 - DNA, 25 bp, Mus musculus
tgaaatcttgccacaggaacagaac

SEQ ID NO: 842235 - DNA, 25 bp, Mus musculus
tgaaatcttgcctcaggaacagaac

SEQ ID NO: 842236 - DNA, 25 bp, Mus musculus
tgaaatctttctatgttgtatgtat

SEQ ID NO: 842237 - DNA, 25 bp, Mus musculus
tgaaatctttctttgttgtatgtat

SEQ ID NO: 842238 - DNA, 25 bp, Mus musculus
tgaaatgaacaactgaacagagcct

SEQ ID NO: 842239 - DNA, 25 bp, Mus musculus
tgaaatgaacaagtgaacagagcct

SEQ ID NO: 842240 - DNA, 25 bp, Mus musculus
tgaaatgaacccagtatggactagt

SEQ ID NO: 842241 - DNA, 25 bp, Mus musculus
tgaaatgaaccctgtatggactagt

SEQ ID NO: 842242 - DNA, 25 bp, Mus musculus
tgaaatgacagtcccagtaccctct

SEQ ID NO: 842243 - DNA, 25 bp, Mus musculus
tgaaatgacagtgccagtaccctct

SEQ ID NO: 842244 - DNA, 25 bp, Mus musculus
tgaaatgaccacaccgtaatagaac

SEQ ID NO: 842245 - DNA, 25 bp, Mus musculus
tgaaatgaccactccgtaatagaac

SEQ ID NO: 842246 - DNA, 25 bp, Mus musculus
tgaaatgacccaccacactgagcag

SEQ ID NO: 842247 - DNA, 25 bp, Mus musculus
tgaaatgacccagcacactgagcag

SEQ ID NO: 842248 - DNA, 25 bp, Mus musculus
tgaaatgagggcactcaccatcccg

SEQ ID NO: 842249 - DNA, 25 bp, Mus musculus
tgaaatgagggctctcaccatcccg

SEQ ID NO: 842250 - DNA, 25 bp, Mus musculus
tgaaatgcaacgaaggcgccatatt

SEQ ID NO: 842251 - DNA, 25 bp, Mus musculus
tgaaatgcaacgtaggcgccatatt

SEQ ID NO: 842252 - DNA, 25 bp, Mus musculus
tgaaatgcagatcttacctaagtct

SEQ ID NO: 842253 - DNA, 25 bp, Mus musculus
tgaaatgcagatgttacctaagtct

SEQ ID NO: 842254 - DNA, 25 bp, Mus musculus
tgaaatgcattgagtccctcgcagc

SEQ ID NO: 842255 - DNA, 25 bp, Mus musculus
tgaaatgcattgtgtccctcgcagc

SEQ ID NO: 842256 - DNA, 25 bp, Mus musculus
tgaaatgcccacacagctgtctgca

SEQ ID NO: 842257 - DNA, 25 bp, Mus musculus
tgaaatgcccactcagctgtctgca

SEQ ID NO: 842258 - DNA, 25 bp, Mus musculus
tgaaatgcctgcattaccagctgct

SEQ ID NO: 842259 - DNA, 25 bp, Mus musculus
tgaaatgcctgctttaccagctgct

SEQ ID NO: 842260 - DNA, 25 bp, Mus musculus
tgaaatgctgcgaattaacaggttt

SEQ ID NO: 842261 - DNA, 25 bp, Mus musculus
tgaaatgctgcgtattaacaggttt

SEQ ID NO: 842262 - DNA, 25 bp, Mus musculus
tgaaatggaattacgcccctggtgc

SEQ ID NO: 842263 - DNA, 25 bp, Mus musculus
tgaaatggaatttcgcccctggtgc

SEQ ID NO: 842264 - DNA, 25 bp, Mus musculus
tgaaatggcaatatatttgctttca

SEQ ID NO: 842265 - DNA, 25 bp, Mus musculus
tgaaatggcaatttatttgctttca

SEQ ID NO: 842266 - DNA, 25 bp, Mus musculus
tgaaatgtaagcaagcgtgtacctt

SEQ ID NO: 842267 - DNA, 25 bp, Mus musculus
tgaaatgtaagctagcgtgtacctt

SEQ ID NO: 842268 - DNA, 25 bp, Mus musculus
tgaaatgtaccccaaaggcgttgtc

SEQ ID NO: 842269 - DNA, 25 bp, Mus musculus
tgaaatgtacccgaaaggcgttgtc

SEQ ID NO: 842270 - DNA, 25 bp, Mus musculus
tgaaatgtacctcacgtgctccatc

SEQ ID NO: 842271 - DNA, 25 bp, Mus musculus
tgaaatgtacctgacgtgctccatc

SEQ ID NO: 842272 - DNA, 25 bp, Mus musculus
tgaaatgtatgcatatggctatcat

SEQ ID NO: 842273 - DNA, 25 bp, Mus musculus
tgaaatgtatgcttatggctatcat

SEQ ID NO: 842274 - DNA, 25 bp, Mus musculus
tgaaatgtcacgactcagcaaaccc

SEQ ID NO: 842275 - DNA, 25 bp, Mus musculus
tgaaatgtcacgtctcagcaaaccc

SEQ ID NO: 842276 - DNA, 25 bp, Mus musculus
tgaaatgtcactatctccatcttcc

SEQ ID NO: 842277 - DNA, 25 bp, Mus musculus
tgaaatgtcactttctccatcttcc

SEQ ID NO: 842278 - DNA, 25 bp, Mus musculus
tgaaatgtcagcagtgtccacgtgt

SEQ ID NO: 842279 - DNA, 25 bp, Mus musculus
tgaaatgtcagctgtgtccacgtgt

SEQ ID NO: 842280 - DNA, 25 bp, Mus musculus
tgaaatgtcagtctctgcccttagg

SEQ ID NO: 842281 - DNA, 25 bp, Mus musculus
tgaaatgtcagtgtctgcccttagg

SEQ ID NO: 842282 - DNA, 25 bp, Mus musculus
tgaaatgtccgcaccacactgtcct

SEQ ID NO: 842283 - DNA, 25 bp, Mus musculus
tgaaatgtccgctccacactgtcct

SEQ ID NO: 842284 - DNA, 25 bp, Mus musculus
tgaaatgtctcacactgaacgtccc

SEQ ID NO: 842285 - DNA, 25 bp, Mus musculus
tgaaatgtctcagactgaacgtccc

SEQ ID NO: 842286 - DNA, 25 bp, Mus musculus
tgaaatgtctccctggcctgggtgt

SEQ ID NO: 842287 - DNA, 25 bp, Mus musculus
tgaaatgtctccgtggcctgggtgt

SEQ ID NO: 842288 - DNA, 25 bp, Mus musculus
tgaaatgtcttgattcaagtgaaac

SEQ ID NO: 842289 - DNA, 25 bp, Mus musculus
tgaaatgtcttgtttcaagtgaaac

SEQ ID NO: 842290 - DNA, 25 bp, Mus musculus
tgaaatgtgatgaactccaatcttt

SEQ ID NO: 842291 - DNA, 25 bp, Mus musculus
tgaaatgtgatgtactccaatcttt

SEQ ID NO: 842292 - DNA, 25 bp, Mus musculus
tgaaatgtgccacgatgcccctttt

SEQ ID NO: 842293 - DNA, 25 bp, Mus musculus
tgaaatgtgccaggatgcccctttt

SEQ ID NO: 842294 - DNA, 25 bp, Mus musculus
tgaaatgtgggtatccacgctccct

SEQ ID NO: 842295 - DNA, 25 bp, Mus musculus
tgaaatgtgggtttccacgctccct

SEQ ID NO: 842296 - DNA, 25 bp, Mus musculus
tgaaatgtgttcctttatccttaaa

SEQ ID NO: 842297 - DNA, 25 bp, Mus musculus
tgaaatgtgttcgtttatccttaaa

SEQ ID NO: 842298 - DNA, 25 bp, Mus musculus
tgaaatgttactactacccttccca

SEQ ID NO: 842299 - DNA, 25 bp, Mus musculus
tgaaatgttacttctacccttccca

SEQ ID NO: 842300 - DNA, 25 bp, Mus musculus
tgaaatgttcacacttagttccttt

SEQ ID NO: 842301 - DNA, 25 bp, Mus musculus
tgaaatgttcactcttagttccttt

SEQ ID NO: 842302 - DNA, 25 bp, Mus musculus
tgaaatgttgacagatgttacttct

SEQ ID NO: 842303 - DNA, 25 bp, Mus musculus
tgaaatgttgactgatgttacttct

SEQ ID NO: 842304 - DNA, 25 bp, Mus musculus
tgaaatgttttcagagccttggcat

SEQ ID NO: 842305 - DNA, 25 bp, Mus musculus
tgaaatgttttcatacctcattctg

SEQ ID NO: 842306 - DNA, 25 bp, Mus musculus
tgaaatgttttctgagccttggcat

SEQ ID NO: 842307 - DNA, 25 bp, Mus musculus
tgaaatgttttcttacctcattctg

SEQ ID NO: 842308 - DNA, 25 bp, Mus musculus
tgaaatgtttttcagtccacgagaa

SEQ ID NO: 842309 - DNA, 25 bp, Mus musculus
tgaaatgtttttgagtccacgagaa

SEQ ID NO: 842310 - DNA, 25 bp, Mus musculus
tgaaattaagagcatctgtccatca

SEQ ID NO: 842311 - DNA, 25 bp, Mus musculus
tgaaattaagaggatctgtccatca

SEQ ID NO: 842312 - DNA, 25 bp, Mus musculus
tgaaattacccacaccttcttagag

SEQ ID NO: 842313 - DNA, 25 bp, Mus musculus
tgaaattacccagaccttcttagag

SEQ ID NO: 842314 - DNA, 25 bp, Mus musculus
tgaaattagaggcacctggcccact

SEQ ID NO: 842315 - DNA, 25 bp, Mus musculus
tgaaattagagggacctggcccact

SEQ ID NO: 842316 - DNA, 25 bp, Mus musculus
tgaaattagccacacgccagagaat

SEQ ID NO: 842317 - DNA, 25 bp, Mus musculus
tgaaattagccagacgccagagaat

SEQ ID NO: 842318 - DNA, 25 bp, Mus musculus
tgaaattagccccaggtcctttcca

SEQ ID NO: 842319 - DNA, 25 bp, Mus musculus
tgaaattagcccgaggtcctttcca

SEQ ID NO: 842320 - DNA, 25 bp, Mus musculus
tgaaattatcttatattccttcctt

SEQ ID NO: 842321 - DNA, 25 bp, Mus musculus
tgaaattatcttttattccttcctt

SEQ ID NO: 842322 - DNA, 25 bp, Mus musculus
tgaaattattgacgtggccacctct

SEQ ID NO: 842323 - DNA, 25 bp, Mus musculus
tgaaattattgaggtggccacctct

SEQ ID NO: 842324 - DNA, 25 bp, Mus musculus
tgaaattatttcaggtgacctcatc

SEQ ID NO: 842325 - DNA, 25 bp, Mus musculus
tgaaattatttcctgatcccttccc

SEQ ID NO: 842326 - DNA, 25 bp, Mus musculus
tgaaattatttcgtgatcccttccc

SEQ ID NO: 842327 - DNA, 25 bp, Mus musculus
tgaaattatttctggtgacctcatc

SEQ ID NO: 842328 - DNA, 25 bp, Mus musculus
tgaaattcacaaagtccccacattc

SEQ ID NO: 842329 - DNA, 25 bp, Mus musculus
tgaaattcacaatgtccccacattc

SEQ ID NO: 842330 - DNA, 25 bp, Mus musculus
tgaaattcacatcggttcctcactt

SEQ ID NO: 842331 - DNA, 25 bp, Mus musculus
tgaaattcacatgggttcctcactt

SEQ ID NO: 842332 - DNA, 25 bp, Mus musculus
tgaaattcacctaacttgcgactag

SEQ ID NO: 842333 - DNA, 25 bp, Mus musculus
tgaaattcaccttacttgcgactag

SEQ ID NO: 842334 - DNA, 25 bp, Mus musculus
tgaaattcagctcaccagcatcagc

SEQ ID NO: 842335 - DNA, 25 bp, Mus musculus
tgaaattcagctcgaaagcattttc

SEQ ID NO: 842336 - DNA, 25 bp, Mus musculus
tgaaattcagctgaccagcatcagc

SEQ ID NO: 842337 - DNA, 25 bp, Mus musculus
tgaaattcagctggaaagcattttc

SEQ ID NO: 842338 - DNA, 25 bp, Mus musculus
tgaaattcattgcaaccacgtaaga

SEQ ID NO: 842339 - DNA, 25 bp, Mus musculus
tgaaattcattggaaccacgtaaga

SEQ ID NO: 842340 - DNA, 25 bp, Mus musculus
tgaaattccaccctcctttcttact

SEQ ID NO: 842341 - DNA, 25 bp, Mus musculus
tgaaattccaccgtcctttcttact

SEQ ID NO: 842342 - DNA, 25 bp, Mus musculus
tgaaattccaggaacttcctctctc

SEQ ID NO: 842343 - DNA, 25 bp, Mus musculus
tgaaattccaggtacttcctctctc

SEQ ID NO: 842344 - DNA, 25 bp, Mus musculus
tgaaattccctcagactacacccat

SEQ ID NO: 842345 - DNA, 25 bp, Mus musculus
tgaaattccctctgactacacccat

SEQ ID NO: 842346 - DNA, 25 bp, Mus musculus
tgaaattccgcaatttctcatgaat

SEQ ID NO: 842347 - DNA, 25 bp, Mus musculus
tgaaattccgcattttctcatgaat

SEQ ID NO: 842348 - DNA, 25 bp, Mus musculus
tgaaattcctcaagggatagcccct

SEQ ID NO: 842349 - DNA, 25 bp, Mus musculus
tgaaattcctcatgggatagcccct

SEQ ID NO: 842350 - DNA, 25 bp, Mus musculus
tgaaattcctctagagtgctcctcc

SEQ ID NO: 842351 - DNA, 25 bp, Mus musculus
tgaaattcctcttgagtgctcctcc

SEQ ID NO: 842352 - DNA, 25 bp, Mus musculus
tgaaattcctgaacgagctttactc

SEQ ID NO: 842353 - DNA, 25 bp, Mus musculus
tgaaattcctgatcgagctttactc

SEQ ID NO: 842354 - DNA, 25 bp, Mus musculus
tgaaattcgcaacgacccgggagaa

SEQ ID NO: 842355 - DNA, 25 bp, Mus musculus
tgaaattcgcaaggacccgggagaa

SEQ ID NO: 842356 - DNA, 25 bp, Mus musculus
tgaaattcgcttatgtctgcacact

SEQ ID NO: 842357 - DNA, 25 bp, Mus musculus
tgaaattcgcttttgtctgcacact

SEQ ID NO: 842358 - DNA, 25 bp, Mus musculus
tgaaattctattctggctgccacca

SEQ ID NO: 842359 - DNA, 25 bp, Mus musculus
tgaaattctattgtggctgccacca

SEQ ID NO: 842360 - DNA, 25 bp, Mus musculus
tgaaattctgctcattgtgccctac

SEQ ID NO: 842361 - DNA, 25 bp, Mus musculus
tgaaattctgctgattgtgccctac

SEQ ID NO: 842362 - DNA, 25 bp, Mus musculus
tgaaattcttgaagtgcctctgtgt

SEQ ID NO: 842363 - DNA, 25 bp, Mus musculus
tgaaattcttgatgtgcctctgtgt

SEQ ID NO: 842364 - DNA, 25 bp, Mus musculus
tgaaattctttcacagccttctcaa

SEQ ID NO: 842365 - DNA, 25 bp, Mus musculus
tgaaattctttctcagccttctcaa

SEQ ID NO: 842366 - DNA, 25 bp, Mus musculus
tgaaattgcacaccagctccgagag

SEQ ID NO: 842367 - DNA, 25 bp, Mus musculus
tgaaattgcacagcagctccgagag

SEQ ID NO: 842368 - DNA, 25 bp, Mus musculus
tgaaattgcccacgttattgcttcc

SEQ ID NO: 842369 - DNA, 25 bp, Mus musculus
tgaaattgcccaggttattgcttcc

SEQ ID NO: 842370 - DNA, 25 bp, Mus musculus
tgaaattgccccatcacacatgaat

SEQ ID NO: 842371 - DNA, 25 bp, Mus musculus
tgaaattgccccttcacacatgaat

SEQ ID NO: 842372 - DNA, 25 bp, Mus musculus
tgaaattgctgcacctgtgcttttc

SEQ ID NO: 842373 - DNA, 25 bp, Mus musculus
tgaaattgctgctcctgtgcttttc

SEQ ID NO: 842374 - DNA, 25 bp, Mus musculus
tgaaattgcttaccaatatccaagt

SEQ ID NO: 842375 - DNA, 25 bp, Mus musculus
tgaaattgcttagcaatatccaagt

SEQ ID NO: 842376 - DNA, 25 bp, Mus musculus
tgaaattggaaaactcagcatcctg

SEQ ID NO: 842377 - DNA, 25 bp, Mus musculus
tgaaattggaaatctcagcatcctg

SEQ ID NO: 842378 - DNA, 25 bp, Mus musculus
tgaaatttataacctgtttccattt

SEQ ID NO: 842379 - DNA, 25 bp, Mus musculus
tgaaatttataagctgtttccattt

SEQ ID NO: 842380 - DNA, 25 bp, Mus musculus
tgaaatttatctcggtatcacgttt

SEQ ID NO: 842381 - DNA, 25 bp, Mus musculus
tgaaatttatctgggtatcacgttt

SEQ ID NO: 842382 - DNA, 25 bp, Mus musculus
tgaaatttcaacaggcttgcccttg

SEQ ID NO: 842383 - DNA, 25 bp, Mus musculus
tgaaatttcaactggcttgcccttg

SEQ ID NO: 842384 - DNA, 25 bp, Mus musculus
tgaaatttcataccaggcacagatt

SEQ ID NO: 842385 - DNA, 25 bp, Mus musculus
tgaaatttcatagcaggcacagatt

SEQ ID NO: 842386 - DNA, 25 bp, Mus musculus
tgaaatttcctactctttacaaaat

SEQ ID NO: 842387 - DNA, 25 bp, Mus musculus
tgaaatttcctagtctttacaaaat

SEQ ID NO: 842388 - DNA, 25 bp, Mus musculus
tgaaatttcgatcggcaatggtggt

SEQ ID NO: 842389 - DNA, 25 bp, Mus musculus
tgaaatttcgatgggcaatggtggt

SEQ ID NO: 842390 - DNA, 25 bp, Mus musculus
tgaaatttcttaccctcagcactat

SEQ ID NO: 842391 - DNA, 25 bp, Mus musculus
tgaaatttcttagcctcagcactat

SEQ ID NO: 842392 - DNA, 25 bp, Mus musculus
tgaaatttgcacagacccggccgag

SEQ ID NO: 842393 - DNA, 25 bp, Mus musculus
tgaaatttgcactgacccggccgag

SEQ ID NO: 842394 - DNA, 25 bp, Mus musculus
tgaaatttggttctggtcttgcttt

SEQ ID NO: 842395 - DNA, 25 bp, Mus musculus
tgaaatttggttgtggtcttgcttt

SEQ ID NO: 842396 - DNA, 25 bp, Mus musculus
tgaaatttgtccattgcttgtgatg

SEQ ID NO: 842397 - DNA, 25 bp, Mus musculus
tgaaatttgtcctttgcttgtgatg

SEQ ID NO: 842398 - DNA, 25 bp, Mus musculus
tgaaattttccccagtggcctaaca

SEQ ID NO: 842399 - DNA, 25 bp, Mus musculus
tgaaattttcccgagtggcctaaca

SEQ ID NO: 842400 - DNA, 25 bp, Mus musculus
tgaaatttttccagtgtgttcttaa

SEQ ID NO: 842401 - DNA, 25 bp, Mus musculus
tgaaatttttcccaatctcaccttc

SEQ ID NO: 842402 - DNA, 25 bp, Mus musculus
tgaaatttttccgaatctcaccttc

SEQ ID NO: 842403 - DNA, 25 bp, Mus musculus
tgaaatttttcctgtgtgttcttaa

SEQ ID NO: 842404 - DNA, 25 bp, Mus musculus
tgaacaaacaggatcgccaggccca

SEQ ID NO: 842405 - DNA, 25 bp, Mus musculus
tgaacaaacaggttcgccaggccca

SEQ ID NO: 842406 - DNA, 25 bp, Mus musculus
tgaacaaacgccagtgatctttctt

SEQ ID NO: 842407 - DNA, 25 bp, Mus musculus
tgaacaaacgcctgtgatctttctt

SEQ ID NO: 842408 - DNA, 25 bp, Mus musculus
tgaacaaagctgcttccgtccgtct

SEQ ID NO: 842409 - DNA, 25 bp, Mus musculus
tgaacaaagctggttccgtccgtct

SEQ ID NO: 842410 - DNA, 25 bp, Mus musculus
tgaacaaatgtcacgcaggccacct

SEQ ID NO: 842411 - DNA, 25 bp, Mus musculus
tgaacaaatgtcaggatacccaatg

SEQ ID NO: 842412 - DNA, 25 bp, Mus musculus
tgaacaaatgtctcgcaggccacct

SEQ ID NO: 842413 - DNA, 25 bp, Mus musculus
tgaacaaatgtctggatacccaatg

SEQ ID NO: 842414 - DNA, 25 bp, Mus musculus
tgaacaacaacaccccttctggaaa

SEQ ID NO: 842415 - DNA, 25 bp, Mus musculus
tgaacaacaacagcccttctggaaa

SEQ ID NO: 842416 - DNA, 25 bp, Mus musculus
tgaacaacaatcaaactcctacccg

SEQ ID NO: 842417 - DNA, 25 bp, Mus musculus
tgaacaacaatctaactcctacccg

SEQ ID NO: 842418 - DNA, 25 bp, Mus musculus
tgaacaacacagcacagcttgtctg

SEQ ID NO: 842419 - DNA, 25 bp, Mus musculus
tgaacaacacaggacagcttgtctg

SEQ ID NO: 842420 - DNA, 25 bp, Mus musculus
tgaacaaccaggagccctacacagg

SEQ ID NO: 842421 - DNA, 25 bp, Mus musculus
tgaacaaccaggtgccctacacagg

SEQ ID NO: 842422 - DNA, 25 bp, Mus musculus
tgaacaaccatgcaagtcttccctg

SEQ ID NO: 842423 - DNA, 25 bp, Mus musculus
tgaacaaccatggaagtcttccctg

SEQ ID NO: 842424 - DNA, 25 bp, Mus musculus
tgaacaacccacaccctaaattagg

SEQ ID NO: 842425 - DNA, 25 bp, Mus musculus
tgaacaacccactccctaaattagg

SEQ ID NO: 842426 - DNA, 25 bp, Mus musculus
tgaacaacctatctctctgtcggtg

SEQ ID NO: 842427 - DNA, 25 bp, Mus musculus
tgaacaacctatgtctctgtcggtg

SEQ ID NO: 842428 - DNA, 25 bp, Mus musculus
tgaacaacctgaaattactccctta

SEQ ID NO: 842429 - DNA, 25 bp, Mus musculus
tgaacaacctgatattactccctta

SEQ ID NO: 842430 - DNA, 25 bp, Mus musculus
tgaacaaccttacgtgaccacagca

SEQ ID NO: 842431 - DNA, 25 bp, Mus musculus
tgaacaaccttaggtgaccacagca

SEQ ID NO: 842432 - DNA, 25 bp, Mus musculus
tgaacaaccttcagggtttttctca

SEQ ID NO: 842433 - DNA, 25 bp, Mus musculus
tgaacaaccttctgggtttttctca

SEQ ID NO: 842434 - DNA, 25 bp, Mus musculus
tgaacaacgcccactgttactgtgg

SEQ ID NO: 842435 - DNA, 25 bp, Mus musculus
tgaacaacgccctctgttactgtgg

SEQ ID NO: 842436 - DNA, 25 bp, Mus musculus
tgaacaactcatcaaggtgggctgc

SEQ ID NO: 842437 - DNA, 25 bp, Mus musculus
tgaacaactcatgaaggtgggctgc

SEQ ID NO: 842438 - DNA, 25 bp, Mus musculus
tgaacaactttcagacttcttcctc

SEQ ID NO: 842439 - DNA, 25 bp, Mus musculus
tgaacaactttctgacttcttcctc

SEQ ID NO: 842440 - DNA, 25 bp, Mus musculus
tgaacaagaagccacagcgtcactt

SEQ ID NO: 842441 - DNA, 25 bp, Mus musculus
tgaacaagaagcgacagcgtcactt

SEQ ID NO: 842442 - DNA, 25 bp, Mus musculus
tgaacaagaccgacagccagaccct

SEQ ID NO: 842443 - DNA, 25 bp, Mus musculus
tgaacaagaccgtcagccagaccct

SEQ ID NO: 842444 - DNA, 25 bp, Mus musculus
tgaacaagagagctgcaagctcaat

SEQ ID NO: 842445 - DNA, 25 bp, Mus musculus
tgaacaagagaggtgcaagctcaat

SEQ ID NO: 842446 - DNA, 25 bp, Mus musculus
tgaacaagagtacagcctcctgact

SEQ ID NO: 842447 - DNA, 25 bp, Mus musculus
tgaacaagagtagagcctcctgact

SEQ ID NO: 842448 - DNA, 25 bp, Mus musculus
tgaacaagcccaaactctctagaca

SEQ ID NO: 842449 - DNA, 25 bp, Mus musculus
tgaacaagcccatactctctagaca

SEQ ID NO: 842450 - DNA, 25 bp, Mus musculus
tgaacaagctgtccagtgagggcct

SEQ ID NO: 842451 - DNA, 25 bp, Mus musculus
tgaacaagctgtgcagtgagggcct

SEQ ID NO: 842452 - DNA, 25 bp, Mus musculus
tgaacaagggccctgctgcagagcc

SEQ ID NO: 842453 - DNA, 25 bp, Mus musculus
tgaacaagggccgtgctgcagagcc

SEQ ID NO: 842454 - DNA, 25 bp, Mus musculus
tgaacaagtcttcccagtcgcctag

SEQ ID NO: 842455 - DNA, 25 bp, Mus musculus
tgaacaagtcttgccagtcgcctag

SEQ ID NO: 842456 - DNA, 25 bp, Mus musculus
tgaacaagtgggaaccgcagagaga

SEQ ID NO: 842457 - DNA, 25 bp, Mus musculus
tgaacaagtgggtaccgcagagaga

SEQ ID NO: 842458 - DNA, 25 bp, Mus musculus
tgaacaagttctcctatgccatggg

SEQ ID NO: 842459 - DNA, 25 bp, Mus musculus
tgaacaagttctgctatgccatggg

SEQ ID NO: 842460 - DNA, 25 bp, Mus musculus
tgaacaatgattatccaagcagtat

SEQ ID NO: 842461 - DNA, 25 bp, Mus musculus
tgaacaatgattttccaagcagtat

SEQ ID NO: 842462 - DNA, 25 bp, Mus musculus
tgaacaatgcccaagagcagcactt

SEQ ID NO: 842463 - DNA, 25 bp, Mus musculus
tgaacaatgccctagagcagcactt

SEQ ID NO: 842464 - DNA, 25 bp, Mus musculus
tgaacaatgcctcatagccaaagat

SEQ ID NO: 842465 - DNA, 25 bp, Mus musculus
tgaacaatgcctgatagccaaagat

SEQ ID NO: 842466 - DNA, 25 bp, Mus musculus
tgaacaattccgagaccggtcactt

SEQ ID NO: 842467 - DNA, 25 bp, Mus musculus
tgaacaattccgtgaccggtcactt

SEQ ID NO: 842468 - DNA, 25 bp, Mus musculus
tgaacacaacacagcctctgtctgt

SEQ ID NO: 842469 - DNA, 25 bp, Mus musculus
tgaacacaacactgcctctgtctgt

SEQ ID NO: 842470 - DNA, 25 bp, Mus musculus
tgaacacaatcacacgacggcgaag

SEQ ID NO: 842471 - DNA, 25 bp, Mus musculus
tgaacacaatcagacgacggcgaag

SEQ ID NO: 842472 - DNA, 25 bp, Mus musculus
tgaacacacagcagcagggtcctgt

SEQ ID NO: 842473 - DNA, 25 bp, Mus musculus
tgaacacacagctgcagggtcctgt

SEQ ID NO: 842474 - DNA, 25 bp, Mus musculus
tgaacacacatgcttgtctgacctg

SEQ ID NO: 842475 - DNA, 25 bp, Mus musculus
tgaacacacatggttgtctgacctg

SEQ ID NO: 842476 - DNA, 25 bp, Mus musculus
tgaacacaccagcttctgtgggcaa

SEQ ID NO: 842477 - DNA, 25 bp, Mus musculus
tgaacacaccaggttctgtgggcaa

SEQ ID NO: 842478 - DNA, 25 bp, Mus musculus
tgaacacaccggctagtgtatgctt

SEQ ID NO: 842479 - DNA, 25 bp, Mus musculus
tgaacacaccgggtagtgtatgctt

SEQ ID NO: 842480 - DNA, 25 bp, Mus musculus
tgaacacacgtgactacgctgctta

SEQ ID NO: 842481 - DNA, 25 bp, Mus musculus
tgaacacacgtgtctacgctgctta

SEQ ID NO: 842482 - DNA, 25 bp, Mus musculus
tgaacacacttcattctgaaacatt

SEQ ID NO: 842483 - DNA, 25 bp, Mus musculus
tgaacacacttctttctgaaacatt

SEQ ID NO: 842484 - DNA, 25 bp, Mus musculus
tgaacacagataccacaagcagtct

SEQ ID NO: 842485 - DNA, 25 bp, Mus musculus
tgaacacagatagcacaagcagtct

SEQ ID NO: 842486 - DNA, 25 bp, Mus musculus
tgaacacagcctacgggcgagtgcg

SEQ ID NO: 842487 - DNA, 25 bp, Mus musculus
tgaacacagccttcgggcgagtgcg

SEQ ID NO: 842488 - DNA, 25 bp, Mus musculus
tgaacacagctaagagcccagtccc

SEQ ID NO: 842489 - DNA, 25 bp, Mus musculus
tgaacacagctatgagcccagtccc

SEQ ID NO: 842490 - DNA, 25 bp, Mus musculus
tgaacacagggcatagctccattcc

SEQ ID NO: 842491 - DNA, 25 bp, Mus musculus
tgaacacagggcttagctccattcc

SEQ ID NO: 842492 - DNA, 25 bp, Mus musculus
tgaacacatagccatgactcttggc

SEQ ID NO: 842493 - DNA, 25 bp, Mus musculus
tgaacacatagcgatgactcttggc

SEQ ID NO: 842494 - DNA, 25 bp, Mus musculus
tgaacacatgccaataatgccacag

SEQ ID NO: 842495 - DNA, 25 bp, Mus musculus
tgaacacatgcctataatgccacag

SEQ ID NO: 842496 - DNA, 25 bp, Mus musculus
tgaacacatttacccacagctgaaa

SEQ ID NO: 842497 - DNA, 25 bp, Mus musculus
tgaacacatttagccacagctgaaa

SEQ ID NO: 842498 - DNA, 25 bp, Mus musculus
tgaacaccaagaaataagcgcacag

SEQ ID NO: 842499 - DNA, 25 bp, Mus musculus
tgaacaccaagatataagcgcacag

SEQ ID NO: 842500 - DNA, 25 bp, Mus musculus
tgaacaccacatacagcttcagctg

SEQ ID NO: 842501 - DNA, 25 bp, Mus musculus
tgaacaccacattcagcttcagctg

SEQ ID NO: 842502 - DNA, 25 bp, Mus musculus
tgaacaccaggacttgctagcaccg

SEQ ID NO: 842503 - DNA, 25 bp, Mus musculus
tgaacaccaggagttgctagcaccg

SEQ ID NO: 842504 - DNA, 25 bp, Mus musculus
tgaacaccatgaagtgtacatgtgt

SEQ ID NO: 842505 - DNA, 25 bp, Mus musculus
tgaacaccatgatgtgtacatgtgt

SEQ ID NO: 842506 - DNA, 25 bp, Mus musculus
tgaacacccaaaacttccagtcagt

SEQ ID NO: 842507 - DNA, 25 bp, Mus musculus
tgaacacccaaatcttccagtcagt

SEQ ID NO: 842508 - DNA, 25 bp, Mus musculus
tgaacacccatgatctacacctgaa

SEQ ID NO: 842509 - DNA, 25 bp, Mus musculus
tgaacacccatgttctacacctgaa

SEQ ID NO: 842510 - DNA, 25 bp, Mus musculus
tgaacacccggacccaggagacata

SEQ ID NO: 842511 - DNA, 25 bp, Mus musculus
tgaacacccggagccaggagacata

SEQ ID NO: 842512 - DNA, 25 bp, Mus musculus
tgaacaccgaatccccaaagaacag

SEQ ID NO: 842513 - DNA, 25 bp, Mus musculus
tgaacaccgaatgcccaaagaacag

SEQ ID NO: 842514 - DNA, 25 bp, Mus musculus
tgaacaccgatcctgtttgtagcga

SEQ ID NO: 842515 - DNA, 25 bp, Mus musculus
tgaacaccgatcgtgtttgtagcga

SEQ ID NO: 842516 - DNA, 25 bp, Mus musculus
tgaacacctaagagccttctgtttg

SEQ ID NO: 842517 - DNA, 25 bp, Mus musculus
tgaacacctaagtgccttctgtttg

SEQ ID NO: 842518 - DNA, 25 bp, Mus musculus
tgaacacctggcctgctgtgagcca

SEQ ID NO: 842519 - DNA, 25 bp, Mus musculus
tgaacacctggcgtgctgtgagcca

SEQ ID NO: 842520 - DNA, 25 bp, Mus musculus
tgaacacctgttacctaatgatggg

SEQ ID NO: 842521 - DNA, 25 bp, Mus musculus
tgaacacctgtttcctaatgatggg

SEQ ID NO: 842522 - DNA, 25 bp, Mus musculus
tgaacacctttgctaatgctcacag

SEQ ID NO: 842523 - DNA, 25 bp, Mus musculus
tgaacacctttggtaatgctcacag

SEQ ID NO: 842524 - DNA, 25 bp, Mus musculus
tgaacacggctcatgtctacagcat

SEQ ID NO: 842525 - DNA, 25 bp, Mus musculus
tgaacacggctcttgtctacagcat

SEQ ID NO: 842526 - DNA, 25 bp, Mus musculus
tgaacacgggaaactttacaagctc

SEQ ID NO: 842527 - DNA, 25 bp, Mus musculus
tgaacacgggaatctttacaagctc

SEQ ID NO: 842528 - DNA, 25 bp, Mus musculus
tgaacacgttaaagaagggctccct

SEQ ID NO: 842529 - DNA, 25 bp, Mus musculus
tgaacacgttaatgaagggctccct

SEQ ID NO: 842530 - DNA, 25 bp, Mus musculus
tgaacacgttaccactccagattac

SEQ ID NO: 842531 - DNA, 25 bp, Mus musculus
tgaacacgttacgactccagattac

SEQ ID NO: 842532 - DNA, 25 bp, Mus musculus
tgaacactacccaaggaggaagcct

SEQ ID NO: 842533 - DNA, 25 bp, Mus musculus
tgaacactaccctaggaggaagcct

SEQ ID NO: 842534 - DNA, 25 bp, Mus musculus
tgaacactatcaagctccctctatg

SEQ ID NO: 842535 - DNA, 25 bp, Mus musculus
tgaacactatcatgctccctctatg

SEQ ID NO: 842536 - DNA, 25 bp, Mus musculus
tgaacactccaacacacactgatat

SEQ ID NO: 842537 - DNA, 25 bp, Mus musculus
tgaacactccaagacacactgatat

SEQ ID NO: 842538 - DNA, 25 bp, Mus musculus
tgaacactcctgaacactccaataa

SEQ ID NO: 842539 - DNA, 25 bp, Mus musculus
tgaacactcctgtacactccaataa

SEQ ID NO: 842540 - DNA, 25 bp, Mus musculus
tgaacactgcatctctcagagttgt

SEQ ID NO: 842541 - DNA, 25 bp, Mus musculus
tgaacactgcatgtctcagagttgt

SEQ ID NO: 842542 - DNA, 25 bp, Mus musculus
tgaacactgccaacgagttcctcta

SEQ ID NO: 842543 - DNA, 25 bp, Mus musculus
tgaacactgccatcgagttcctcta

SEQ ID NO: 842544 - DNA, 25 bp, Mus musculus
tgaacactgctcacttgactgtcag

SEQ ID NO: 842545 - DNA, 25 bp, Mus musculus
tgaacactgctctcttgactgtcag

SEQ ID NO: 842546 - DNA, 25 bp, Mus musculus
tgaacactgtcaatctcattctgcc

SEQ ID NO: 842547 - DNA, 25 bp, Mus musculus
tgaacactgtcattctcattctgcc

SEQ ID NO: 842548 - DNA, 25 bp, Mus musculus
tgaacactgtctccagaggccttgc

SEQ ID NO: 842549 - DNA, 25 bp, Mus musculus
tgaacactgtctgcagaggccttgc

SEQ ID NO: 842550 - DNA, 25 bp, Mus musculus
tgaacacttcgccactatcatagct

SEQ ID NO: 842551 - DNA, 25 bp, Mus musculus
tgaacacttcgcgactatcatagct

SEQ ID NO: 842552 - DNA, 25 bp, Mus musculus
tgaacacttggtcgccagtcgatgc

SEQ ID NO: 842553 - DNA, 25 bp, Mus musculus
tgaacacttggtggccagtcgatgc

SEQ ID NO: 842554 - DNA, 25 bp, Mus musculus
tgaacacttgttactttagcacttt

SEQ ID NO: 842555 - DNA, 25 bp, Mus musculus
tgaacacttgtttctttagcacttt

SEQ ID NO: 842556 - DNA, 25 bp, Mus musculus
tgaacactttagactcatcatgaat

SEQ ID NO: 842557 - DNA, 25 bp, Mus musculus
tgaacactttagtctcatcatgaat

SEQ ID NO: 842558 - DNA, 25 bp, Mus musculus
tgaacactttcaatagagactgggt

SEQ ID NO: 842559 - DNA, 25 bp, Mus musculus
tgaacactttcattagagactgggt

SEQ ID NO: 842560 - DNA, 25 bp, Mus musculus
tgaacacttttgactccgagaggtc

SEQ ID NO: 842561 - DNA, 25 bp, Mus musculus
tgaacacttttgtctccgagaggtc

SEQ ID NO: 842562 - DNA, 25 bp, Mus musculus
tgaacagaaacgcaatgctgaggct

SEQ ID NO: 842563 - DNA, 25 bp, Mus musculus
tgaacagaaacggaatgctgaggct

SEQ ID NO: 842564 - DNA, 25 bp, Mus musculus
tgaacagaaaggactctcagcgccg

SEQ ID NO: 842565 - DNA, 25 bp, Mus musculus
tgaacagaaaggtctctcagcgccg

SEQ ID NO: 842566 - DNA, 25 bp, Mus musculus
tgaacagaacccatcctagtgaagt

SEQ ID NO: 842567 - DNA, 25 bp, Mus musculus
tgaacagaacccttcctagtgaagt

SEQ ID NO: 842568 - DNA, 25 bp, Mus musculus
tgaacagaagtcagcctccagaacc

SEQ ID NO: 842569 - DNA, 25 bp, Mus musculus
tgaacagaagtctgcctccagaacc

SEQ ID NO: 842570 - DNA, 25 bp, Mus musculus
tgaacagaatctacacacaatgaca

SEQ ID NO: 842571 - DNA, 25 bp, Mus musculus
tgaacagaatcttcacacaatgaca

SEQ ID NO: 842572 - DNA, 25 bp, Mus musculus
tgaacagacaatcctgagccccagc

SEQ ID NO: 842573 - DNA, 25 bp, Mus musculus
tgaacagacaatgctgagccccagc

SEQ ID NO: 842574 - DNA, 25 bp, Mus musculus
tgaacagacatgaaatcccagtact

SEQ ID NO: 842575 - DNA, 25 bp, Mus musculus
tgaacagacatgtaatcccagtact

SEQ ID NO: 842576 - DNA, 25 bp, Mus musculus
tgaacagacccgaaggaatcctcca

SEQ ID NO: 842577 - DNA, 25 bp, Mus musculus
tgaacagacccgtaggaatcctcca

SEQ ID NO: 842578 - DNA, 25 bp, Mus musculus
tgaacagacgacatatcaccagcac

SEQ ID NO: 842579 - DNA, 25 bp, Mus musculus
tgaacagacgacttatcaccagcac

SEQ ID NO: 842580 - DNA, 25 bp, Mus musculus
tgaacagactgtcccctatggactg

SEQ ID NO: 842581 - DNA, 25 bp, Mus musculus
tgaacagactgtgccctatggactg

SEQ ID NO: 842582 - DNA, 25 bp, Mus musculus
tgaacagacttcctgctgctggtgt

SEQ ID NO: 842583 - DNA, 25 bp, Mus musculus
tgaacagacttcgtgctgctggtgt

SEQ ID NO: 842584 - DNA, 25 bp, Mus musculus
tgaacagactttcggagacagcaga

SEQ ID NO: 842585 - DNA, 25 bp, Mus musculus
tgaacagactttgggagacagcaga

SEQ ID NO: 842586 - DNA, 25 bp, Mus musculus
tgaacagagaccaccgccgaatcat

SEQ ID NO: 842587 - DNA, 25 bp, Mus musculus
tgaacagagacctccgccgaatcat

SEQ ID NO: 842588 - DNA, 25 bp, Mus musculus
tgaacagagagaaccaacggcatgt

SEQ ID NO: 842589 - DNA, 25 bp, Mus musculus
tgaacagagagatccaacggcatgt

SEQ ID NO: 842590 - DNA, 25 bp, Mus musculus
tgaacagagcatagacatttggtat

SEQ ID NO: 842591 - DNA, 25 bp, Mus musculus
tgaacagagcatcccatgccagttg

SEQ ID NO: 842592 - DNA, 25 bp, Mus musculus
tgaacagagcatgccatgccagttg

SEQ ID NO: 842593 - DNA, 25 bp, Mus musculus
tgaacagagcattgacatttggtat

SEQ ID NO: 842594 - DNA, 25 bp, Mus musculus
tgaacagagcctcctcaaggtgcct

SEQ ID NO: 842595 - DNA, 25 bp, Mus musculus
tgaacagagcctgctcaaggtgcct

SEQ ID NO: 842596 - DNA, 25 bp, Mus musculus
tgaacagcactaagtttgatgagct

SEQ ID NO: 842597 - DNA, 25 bp, Mus musculus
tgaacagcactatgtttgatgagct

SEQ ID NO: 842598 - DNA, 25 bp, Mus musculus
tgaacagcactgaccccaacagtgt

SEQ ID NO: 842599 - DNA, 25 bp, Mus musculus
tgaacagcactgtccccaacagtgt

SEQ ID NO: 842600 - DNA, 25 bp, Mus musculus
tgaacagcatccctgaatcttcaca

SEQ ID NO: 842601 - DNA, 25 bp, Mus musculus
tgaacagcatccgtgaatcttcaca

SEQ ID NO: 842602 - DNA, 25 bp, Mus musculus
tgaacagccaagaagtcagcaaaaa

SEQ ID NO: 842603 - DNA, 25 bp, Mus musculus
tgaacagccaagtagtcagcaaaaa

SEQ ID NO: 842604 - DNA, 25 bp, Mus musculus
tgaacagccaggctcagagccagga

SEQ ID NO: 842605 - DNA, 25 bp, Mus musculus
tgaacagccagggtcagagccagga

SEQ ID NO: 842606 - DNA, 25 bp, Mus musculus
tgaacagcccttatccttgtgaaag

SEQ ID NO: 842607 - DNA, 25 bp, Mus musculus
tgaacagcccttttccttgtgaaag

SEQ ID NO: 842608 - DNA, 25 bp, Mus musculus
tgaacagccgcgagtatgtcacact

SEQ ID NO: 842609 - DNA, 25 bp, Mus musculus
tgaacagccgcgtgtatgtcacact

SEQ ID NO: 842610 - DNA, 25 bp, Mus musculus
tgaacagcctatcaccaaaatggag

SEQ ID NO: 842611 - DNA, 25 bp, Mus musculus
tgaacagcctatgaccaaaatggag

SEQ ID NO: 842612 - DNA, 25 bp, Mus musculus
tgaacagcctggagcacacagtcaa

SEQ ID NO: 842613 - DNA, 25 bp, Mus musculus
tgaacagcctggtgcacacagtcaa

SEQ ID NO: 842614 - DNA, 25 bp, Mus musculus
tgaacagcctgtctgaccttctttt

SEQ ID NO: 842615 - DNA, 25 bp, Mus musculus
tgaacagcctgtgtgaccttctttt

SEQ ID NO: 842616 - DNA, 25 bp, Mus musculus
tgaacagcgctgagccatttgtaga

SEQ ID NO: 842617 - DNA, 25 bp, Mus musculus
tgaacagcgctgtgccatttgtaga

SEQ ID NO: 842618 - DNA, 25 bp, Mus musculus
tgaacagctatcaagactcctggct

SEQ ID NO: 842619 - DNA, 25 bp, Mus musculus
tgaacagctatctagactcctggct

SEQ ID NO: 842620 - DNA, 25 bp, Mus musculus
tgaacagctcatccgaggaccttga

SEQ ID NO: 842621 - DNA, 25 bp, Mus musculus
tgaacagctcatgcgaggaccttga

SEQ ID NO: 842622 - DNA, 25 bp, Mus musculus
tgaacagctggcctatctgagtccc

SEQ ID NO: 842623 - DNA, 25 bp, Mus musculus
tgaacagctggcgtatctgagtccc

SEQ ID NO: 842624 - DNA, 25 bp, Mus musculus
tgaacagctgtgcttcctgcattag

SEQ ID NO: 842625 - DNA, 25 bp, Mus musculus
tgaacagctgtggttcctgcattag

SEQ ID NO: 842626 - DNA, 25 bp, Mus musculus
tgaacagcttccagggttactccac

SEQ ID NO: 842627 - DNA, 25 bp, Mus musculus
tgaacagcttcctgggttactccac

SEQ ID NO: 842628 - DNA, 25 bp, Mus musculus
tgaacagcttggatacctctcagtg

SEQ ID NO: 842629 - DNA, 25 bp, Mus musculus
tgaacagcttggttacctctcagtg

SEQ ID NO: 842630 - DNA, 25 bp, Mus musculus
tgaacaggacctcaccaagcttctc

SEQ ID NO: 842631 - DNA, 25 bp, Mus musculus
tgaacaggacctctctgctgggaga

SEQ ID NO: 842632 - DNA, 25 bp, Mus musculus
tgaacaggacctgaccaagcttctc

SEQ ID NO: 842633 - DNA, 25 bp, Mus musculus
tgaacaggacctgtctgctgggaga

SEQ ID NO: 842634 - DNA, 25 bp, Mus musculus
tgaacaggagctcgccgtctgtgca

SEQ ID NO: 842635 - DNA, 25 bp, Mus musculus
tgaacaggagctggccgtctgtgca

SEQ ID NO: 842636 - DNA, 25 bp, Mus musculus
tgaacaggaggcaggacatcagaca

SEQ ID NO: 842637 - DNA, 25 bp, Mus musculus
tgaacaggaggcatcaggctcccac

SEQ ID NO: 842638 - DNA, 25 bp, Mus musculus
tgaacaggaggctggacatcagaca

SEQ ID NO: 842639 - DNA, 25 bp, Mus musculus
tgaacaggaggcttcaggctcccac

SEQ ID NO: 842640 - DNA, 25 bp, Mus musculus
tgaacaggatggagcttcagctgat

SEQ ID NO: 842641 - DNA, 25 bp, Mus musculus
tgaacaggatggtgcttcagctgat

SEQ ID NO: 842642 - DNA, 25 bp, Mus musculus
tgaacaggatttccctgacatgcct

SEQ ID NO: 842643 - DNA, 25 bp, Mus musculus
tgaacaggatttgcctgacatgcct

SEQ ID NO: 842644 - DNA, 25 bp, Mus musculus
tgaacaggccggcttgtcgttgtaa

SEQ ID NO: 842645 - DNA, 25 bp, Mus musculus
tgaacaggccgggttgtcgttgtaa

SEQ ID NO: 842646 - DNA, 25 bp, Mus musculus
tgaacaggcctaagctcccacgtgt

SEQ ID NO: 842647 - DNA, 25 bp, Mus musculus
tgaacaggcctatgctcccacgtgt

SEQ ID NO: 842648 - DNA, 25 bp, Mus musculus
tgaacaggccttacgggaccagtgg

SEQ ID NO: 842649 - DNA, 25 bp, Mus musculus
tgaacaggcctttcgggaccagtgg

SEQ ID NO: 842650 - DNA, 25 bp, Mus musculus
tgaacaggctcaagcatccgatcga

SEQ ID NO: 842651 - DNA, 25 bp, Mus musculus
tgaacaggctcatgcatccgatcga

SEQ ID NO: 842652 - DNA, 25 bp, Mus musculus
tgaacaggctcgaaggcagcggctt

SEQ ID NO: 842653 - DNA, 25 bp, Mus musculus
tgaacaggctcgtaggcagcggctt

SEQ ID NO: 842654 - DNA, 25 bp, Mus musculus
tgaacaggctgcatctgactaacct

SEQ ID NO: 842655 - DNA, 25 bp, Mus musculus
tgaacaggctgcttctgactaacct

SEQ ID NO: 842656 - DNA, 25 bp, Mus musculus
tgaacaggctgtattgctccagcca

SEQ ID NO: 842657 - DNA, 25 bp, Mus musculus
tgaacaggctgttttgctccagcca

SEQ ID NO: 842658 - DNA, 25 bp, Mus musculus
tgaacaggcttcacaaaattgtaca

SEQ ID NO: 842659 - DNA, 25 bp, Mus musculus
tgaacaggcttctcaaaattgtaca

SEQ ID NO: 842660 - DNA, 25 bp, Mus musculus
tgaacagggaagcatcctactcggg

SEQ ID NO: 842661 - DNA, 25 bp, Mus musculus
tgaacagggaaggatcctactcggg

SEQ ID NO: 842662 - DNA, 25 bp, Mus musculus
tgaacagggtcacgctacttctcag

SEQ ID NO: 842663 - DNA, 25 bp, Mus musculus
tgaacagggtcaggctacttctcag

SEQ ID NO: 842664 - DNA, 25 bp, Mus musculus
tgaacaggtgctcgagtcggcgcgc

SEQ ID NO: 842665 - DNA, 25 bp, Mus musculus
tgaacaggtgctggagtcggcgcgc

SEQ ID NO: 842666 - DNA, 25 bp, Mus musculus
tgaacaggtgtccttcactgggcac

SEQ ID NO: 842667 - DNA, 25 bp, Mus musculus
tgaacaggtgtcgttcactgggcac

SEQ ID NO: 842668 - DNA, 25 bp, Mus musculus
tgaacagtattgaagctcccaacag

SEQ ID NO: 842669 - DNA, 25 bp, Mus musculus
tgaacagtattgtagctcccaacag

SEQ ID NO: 842670 - DNA, 25 bp, Mus musculus
tgaacagtatttcccttccttctcc

SEQ ID NO: 842671 - DNA, 25 bp, Mus musculus
tgaacagtatttgccttccttctcc

SEQ ID NO: 842672 - DNA, 25 bp, Mus musculus
tgaacagtcgcaacatcacccacaa

SEQ ID NO: 842673 - DNA, 25 bp, Mus musculus
tgaacagtcgcatcatcacccacaa

SEQ ID NO: 842674 - DNA, 25 bp, Mus musculus
tgaacagtctcaacctaccaagtat

SEQ ID NO: 842675 - DNA, 25 bp, Mus musculus
tgaacagtctcatcctaccaagtat

SEQ ID NO: 842676 - DNA, 25 bp, Mus musculus
tgaacagtgatccatgactgcctct

SEQ ID NO: 842677 - DNA, 25 bp, Mus musculus
tgaacagtgatcgatgactgcctct

SEQ ID NO: 842678 - DNA, 25 bp, Mus musculus
tgaacagtgcacacgcatccataaa

SEQ ID NO: 842679 - DNA, 25 bp, Mus musculus
tgaacagtgcactcgcatccataaa

SEQ ID NO: 842680 - DNA, 25 bp, Mus musculus
tgaacagtgtcccaatcacacaaag

SEQ ID NO: 842681 - DNA, 25 bp, Mus musculus
tgaacagtgtccgaatcacacaaag

SEQ ID NO: 842682 - DNA, 25 bp, Mus musculus
tgaacagtgtgcacacttagacctc

SEQ ID NO: 842683 - DNA, 25 bp, Mus musculus
tgaacagtgtgctcacttagacctc

SEQ ID NO: 842684 - DNA, 25 bp, Mus musculus
tgaacagtgtgtcctagtagaccat

SEQ ID NO: 842685 - DNA, 25 bp, Mus musculus
tgaacagtgtgtgctagtagaccat

SEQ ID NO: 842686 - DNA, 25 bp, Mus musculus
tgaacagttagtcagtaaaacatct

SEQ ID NO: 842687 - DNA, 25 bp, Mus musculus
tgaacagttagtgagtaaaacatct

SEQ ID NO: 842688 - DNA, 25 bp, Mus musculus
tgaacagttcccacggcaagtattg

SEQ ID NO: 842689 - DNA, 25 bp, Mus musculus
tgaacagttccctcggcaagtattg

SEQ ID NO: 842690 - DNA, 25 bp, Mus musculus
tgaacagttccgacatgccatctgg

SEQ ID NO: 842691 - DNA, 25 bp, Mus musculus
tgaacagttccgtcatgccatctgg

SEQ ID NO: 842692 - DNA, 25 bp, Mus musculus
tgaacagttgtgagagccggtgcct

SEQ ID NO: 842693 - DNA, 25 bp, Mus musculus
tgaacagttgtgtgagccggtgcct

SEQ ID NO: 842694 - DNA, 25 bp, Mus musculus
tgaacagtttctccccatgatgcaa

SEQ ID NO: 842695 - DNA, 25 bp, Mus musculus
tgaacagtttctgcccatgatgcaa

SEQ ID NO: 842696 - DNA, 25 bp, Mus musculus
tgaacagtttgacagcagccaggga

SEQ ID NO: 842697 - DNA, 25 bp, Mus musculus
tgaacagtttgagagcagccaggga

SEQ ID NO: 842698 - DNA, 25 bp, Mus musculus
tgaacagtttgcaccgacactgctg

SEQ ID NO: 842699 - DNA, 25 bp, Mus musculus
tgaacagtttgctccgacactgctg

SEQ ID NO: 842700 - DNA, 25 bp, Mus musculus
tgaacataaccccaaggtcctcttg

SEQ ID NO: 842701 - DNA, 25 bp, Mus musculus
tgaacataacccgaaggtcctcttg

SEQ ID NO: 842702 - DNA, 25 bp, Mus musculus
tgaacataacgaagtttgtgcactt

SEQ ID NO: 842703 - DNA, 25 bp, Mus musculus
tgaacataacgatgtttgtgcactt

SEQ ID NO: 842704 - DNA, 25 bp, Mus musculus
tgaacatacactacaggaccccagc

SEQ ID NO: 842705 - DNA, 25 bp, Mus musculus
tgaacatacacttcaggaccccagc

SEQ ID NO: 842706 - DNA, 25 bp, Mus musculus
tgaacatacgctactcggtgtgagt

SEQ ID NO: 842707 - DNA, 25 bp, Mus musculus
tgaacatacgcttctcggtgtgagt

SEQ ID NO: 842708 - DNA, 25 bp, Mus musculus
tgaacatactgccttgctatcacca

SEQ ID NO: 842709 - DNA, 25 bp, Mus musculus
tgaacatactgcgttgctatcacca

SEQ ID NO: 842710 - DNA, 25 bp, Mus musculus
tgaacatcaaataaggtcctgctct

SEQ ID NO: 842711 - DNA, 25 bp, Mus musculus
tgaacatcaaattaggtcctgctct

SEQ ID NO: 842712 - DNA, 25 bp, Mus musculus
tgaacatcaaccattggtccacgtt

SEQ ID NO: 842713 - DNA, 25 bp, Mus musculus
tgaacatcaacctttggtccacgtt

SEQ ID NO: 842714 - DNA, 25 bp, Mus musculus
tgaacatcagcaccttggtcctcag

SEQ ID NO: 842715 - DNA, 25 bp, Mus musculus
tgaacatcagcactgggcggagact

SEQ ID NO: 842716 - DNA, 25 bp, Mus musculus
tgaacatcagcagcttggtcctcag

SEQ ID NO: 842717 - DNA, 25 bp, Mus musculus
tgaacatcagcagtgggcggagact

SEQ ID NO: 842718 - DNA, 25 bp, Mus musculus
tgaacatccaaacctgcctgcgatt

SEQ ID NO: 842719 - DNA, 25 bp, Mus musculus
tgaacatccaaagctgcctgcgatt

SEQ ID NO: 842720 - DNA, 25 bp, Mus musculus
tgaacatcccacagcagtctcagtc

SEQ ID NO: 842721 - DNA, 25 bp, Mus musculus
tgaacatcccactgcagtctcagtc

SEQ ID NO: 842722 - DNA, 25 bp, Mus musculus
tgaacatccctgatctcatccgaga

SEQ ID NO: 842723 - DNA, 25 bp, Mus musculus
tgaacatccctgttctcatccgaga

SEQ ID NO: 842724 - DNA, 25 bp, Mus musculus
tgaacatcccttcttgggacagctg

SEQ ID NO: 842725 - DNA, 25 bp, Mus musculus
tgaacatcccttgttgggacagctg

SEQ ID NO: 842726 - DNA, 25 bp, Mus musculus
tgaacatcctttctaaccctgttaa

SEQ ID NO: 842727 - DNA, 25 bp, Mus musculus
tgaacatcctttgtaaccctgttaa

SEQ ID NO: 842728 - DNA, 25 bp, Mus musculus
tgaacatcgtgcaccagcacatcga

SEQ ID NO: 842729 - DNA, 25 bp, Mus musculus
tgaacatcgtgctccagcacatcga

SEQ ID NO: 842730 - DNA, 25 bp, Mus musculus
tgaacatctcatatcacatagactg

SEQ ID NO: 842731 - DNA, 25 bp, Mus musculus
tgaacatctcatttcacatagactg

SEQ ID NO: 842732 - DNA, 25 bp, Mus musculus
tgaacatctggcagctgggttccat

SEQ ID NO: 842733 - DNA, 25 bp, Mus musculus
tgaacatctggctgctgggttccat

SEQ ID NO: 842734 - DNA, 25 bp, Mus musculus
tgaacatgaaaccagggatgtccct

SEQ ID NO: 842735 - DNA, 25 bp, Mus musculus
tgaacatgaaacgagggatgtccct

SEQ ID NO: 842736 - DNA, 25 bp, Mus musculus
tgaacatgagtgaccacgcgctata

SEQ ID NO: 842737 - DNA, 25 bp, Mus musculus
tgaacatgagtgtccacgcgctata

SEQ ID NO: 842738 - DNA, 25 bp, Mus musculus
tgaacatgcacaatgacgtgcctcc

SEQ ID NO: 842739 - DNA, 25 bp, Mus musculus
tgaacatgcacattgacgtgcctcc

SEQ ID NO: 842740 - DNA, 25 bp, Mus musculus
tgaacatggcacagctgttcccttc

SEQ ID NO: 842741 - DNA, 25 bp, Mus musculus
tgaacatggcactgctgttcccttc

SEQ ID NO: 842742 - DNA, 25 bp, Mus musculus
tgaacatggccaagcattcatccca

SEQ ID NO: 842743 - DNA, 25 bp, Mus musculus
tgaacatggccatgcattcatccca

SEQ ID NO: 842744 - DNA, 25 bp, Mus musculus
tgaacatgggctagaactcagtaag

SEQ ID NO: 842745 - DNA, 25 bp, Mus musculus
tgaacatgggcttgaactcagtaag

SEQ ID NO: 842746 - DNA, 25 bp, Mus musculus
tgaacatggtagctaaacacttttt

SEQ ID NO: 842747 - DNA, 25 bp, Mus musculus
tgaacatggtaggtaaacacttttt

SEQ ID NO: 842748 - DNA, 25 bp, Mus musculus
tgaacatgtatcagaatctcttcta

SEQ ID NO: 842749 - DNA, 25 bp, Mus musculus
tgaacatgtatctgaatctcttcta

SEQ ID NO: 842750 - DNA, 25 bp, Mus musculus
tgaacatgtcataggccctgtggta

SEQ ID NO: 842751 - DNA, 25 bp, Mus musculus
tgaacatgtcattggccctgtggta

SEQ ID NO: 842752 - DNA, 25 bp, Mus musculus
tgaacatgtgacacaggacctacgg

SEQ ID NO: 842753 - DNA, 25 bp, Mus musculus
tgaacatgtgactcaggacctacgg

SEQ ID NO: 842754 - DNA, 25 bp, Mus musculus
tgaacatgtgatactttccccaagc

SEQ ID NO: 842755 - DNA, 25 bp, Mus musculus
tgaacatgtgattctttccccaagc

SEQ ID NO: 842756 - DNA, 25 bp, Mus musculus
tgaacattagggatccttttcttct

SEQ ID NO: 842757 - DNA, 25 bp, Mus musculus
tgaacattagggttccttttcttct

SEQ ID NO: 842758 - DNA, 25 bp, Mus musculus
tgaacattcaaaaaccagtggaaag

SEQ ID NO: 842759 - DNA, 25 bp, Mus musculus
tgaacattcaaataccagtggaaag

SEQ ID NO: 842760 - DNA, 25 bp, Mus musculus
tgaacattccacaagcctgagctga

SEQ ID NO: 842761 - DNA, 25 bp, Mus musculus
tgaacattccactagcctgagctga

SEQ ID NO: 842762 - DNA, 25 bp, Mus musculus
tgaacattgccactaaagcccacgt

SEQ ID NO: 842763 - DNA, 25 bp, Mus musculus
tgaacattgccagtaaagcccacgt

SEQ ID NO: 842764 - DNA, 25 bp, Mus musculus
tgaacattgttcagctcaagagact

SEQ ID NO: 842765 - DNA, 25 bp, Mus musculus
tgaacattgttctgctcaagagact

SEQ ID NO: 842766 - DNA, 25 bp, Mus musculus
tgaacatttcccacacaatttctat

SEQ ID NO: 842767 - DNA, 25 bp, Mus musculus
tgaacatttccctcacaatttctat

SEQ ID NO: 842768 - DNA, 25 bp, Mus musculus
tgaacatttcgacagctcttttaat

SEQ ID NO: 842769 - DNA, 25 bp, Mus musculus
tgaacatttcgagagctcttttaat

SEQ ID NO: 842770 - DNA, 25 bp, Mus musculus
tgaacattttctaatttctcgtatg

SEQ ID NO: 842771 - DNA, 25 bp, Mus musculus
tgaacattttcttatttctcgtatg

SEQ ID NO: 842772 - DNA, 25 bp, Mus musculus
tgaacatttttaaagacccactctc

SEQ ID NO: 842773 - DNA, 25 bp, Mus musculus
tgaacatttttatagacccactctc

SEQ ID NO: 842774 - DNA, 25 bp, Mus musculus
tgaaccaaagcacttcctcttttgt

SEQ ID NO: 842775 - DNA, 25 bp, Mus musculus
tgaaccaaagcagttcctcttttgt

SEQ ID NO: 842776 - DNA, 25 bp, Mus musculus
tgaaccaaaggacccaaagccccag

SEQ ID NO: 842777 - DNA, 25 bp, Mus musculus
tgaaccaaaggagccaaagccccag

SEQ ID NO: 842778 - DNA, 25 bp, Mus musculus
tgaaccaaccatccaatagcacttc

SEQ ID NO: 842779 - DNA, 25 bp, Mus musculus
tgaaccaaccatgcaatagcacttc

SEQ ID NO: 842780 - DNA, 25 bp, Mus musculus
tgaaccaactcaagaacatccgcac

SEQ ID NO: 842781 - DNA, 25 bp, Mus musculus
tgaaccaactcatgaacatccgcac

SEQ ID NO: 842782 - DNA, 25 bp, Mus musculus
tgaaccaactctctgtcaacctatg

SEQ ID NO: 842783 - DNA, 25 bp, Mus musculus
tgaaccaactctgtgtcaacctatg

SEQ ID NO: 842784 - DNA, 25 bp, Mus musculus
tgaaccaagcccaacagagtttgca

SEQ ID NO: 842785 - DNA, 25 bp, Mus musculus
tgaaccaagccctacagagtttgca

SEQ ID NO: 842786 - DNA, 25 bp, Mus musculus
tgaaccaagctcctgtctgtgtgaa

SEQ ID NO: 842787 - DNA, 25 bp, Mus musculus
tgaaccaagctcgtgtctgtgtgaa

SEQ ID NO: 842788 - DNA, 25 bp, Mus musculus
tgaaccaagtggaggacgtccggac

SEQ ID NO: 842789 - DNA, 25 bp, Mus musculus
tgaaccaagtggtggacgtccggac

SEQ ID NO: 842790 - DNA, 25 bp, Mus musculus
tgaaccaatcagcaacttcttattt

SEQ ID NO: 842791 - DNA, 25 bp, Mus musculus
tgaaccaatcaggaacttcttattt

SEQ ID NO: 842792 - DNA, 25 bp, Mus musculus
tgaaccaattacattttgctctgtc

SEQ ID NO: 842793 - DNA, 25 bp, Mus musculus
tgaaccaattactttttgctctgtc

SEQ ID NO: 842794 - DNA, 25 bp, Mus musculus
tgaaccacagtaagatgcgactccc

SEQ ID NO: 842795 - DNA, 25 bp, Mus musculus
tgaaccacagtatgatgcgactccc

SEQ ID NO: 842796 - DNA, 25 bp, Mus musculus
tgaaccacagtccatgtcagtccat

SEQ ID NO: 842797 - DNA, 25 bp, Mus musculus
tgaaccacagtcgatgtcagtccat

SEQ ID NO: 842798 - DNA, 25 bp, Mus musculus
tgaaccacatgcagagtctacgctt

SEQ ID NO: 842799 - DNA, 25 bp, Mus musculus
tgaaccacatgctgagtctacgctt

SEQ ID NO: 842800 - DNA, 25 bp, Mus musculus
tgaaccaccaatatgttctggaaca

SEQ ID NO: 842801 - DNA, 25 bp, Mus musculus
tgaaccaccaatttgttctggaaca

SEQ ID NO: 842802 - DNA, 25 bp, Mus musculus
tgaaccaccattcagggcgtttaag

SEQ ID NO: 842803 - DNA, 25 bp, Mus musculus
tgaaccaccattgagggcgtttaag

SEQ ID NO: 842804 - DNA, 25 bp, Mus musculus
tgaaccacccaaaggacctggcttt

SEQ ID NO: 842805 - DNA, 25 bp, Mus musculus
tgaaccacccaatggacctggcttt

SEQ ID NO: 842806 - DNA, 25 bp, Mus musculus
tgaaccaccggaacagtggctttct

SEQ ID NO: 842807 - DNA, 25 bp, Mus musculus
tgaaccaccggatcagtggctttct

SEQ ID NO: 842808 - DNA, 25 bp, Mus musculus
tgaaccaccgtgaactggctggcaa

SEQ ID NO: 842809 - DNA, 25 bp, Mus musculus
tgaaccaccgtgtactggctggcaa

SEQ ID NO: 842810 - DNA, 25 bp, Mus musculus
tgaaccactgcaaccccaaatgaag

SEQ ID NO: 842811 - DNA, 25 bp, Mus musculus
tgaaccactgcatccccaaatgaag

SEQ ID NO: 842812 - DNA, 25 bp, Mus musculus
tgaaccactggcaagtaagtcatca

SEQ ID NO: 842813 - DNA, 25 bp, Mus musculus
tgaaccactggctagtaagtcatca

SEQ ID NO: 842814 - DNA, 25 bp, Mus musculus
tgaaccactggtctgcacacacata

SEQ ID NO: 842815 - DNA, 25 bp, Mus musculus
tgaaccactggtgtgcacacacata

SEQ ID NO: 842816 - DNA, 25 bp, Mus musculus
tgaaccacttcaattgccagctatc

SEQ ID NO: 842817 - DNA, 25 bp, Mus musculus
tgaaccacttcatttgccagctatc

SEQ ID NO: 842818 - DNA, 25 bp, Mus musculus
tgaaccacttgacagctacacctgt

SEQ ID NO: 842819 - DNA, 25 bp, Mus musculus
tgaaccacttgagagctacacctgt

SEQ ID NO: 842820 - DNA, 25 bp, Mus musculus
tgaaccagacatacctgagtcctga

SEQ ID NO: 842821 - DNA, 25 bp, Mus musculus
tgaaccagacattcctgagtcctga

SEQ ID NO: 842822 - DNA, 25 bp, Mus musculus
tgaaccagaccacggaggccaacgt

SEQ ID NO: 842823 - DNA, 25 bp, Mus musculus
tgaaccagaccagggaggccaacgt

SEQ ID NO: 842824 - DNA, 25 bp, Mus musculus
tgaaccagagcacctacctaaaagt

SEQ ID NO: 842825 - DNA, 25 bp, Mus musculus
tgaaccagagcacctgtaccaacta

SEQ ID NO: 842826 - DNA, 25 bp, Mus musculus
tgaaccagagcagctacctaaaagt

SEQ ID NO: 842827 - DNA, 25 bp, Mus musculus
tgaaccagagcagctgtaccaacta

SEQ ID NO: 842828 - DNA, 25 bp, Mus musculus
tgaaccagatgcaccgcttaggccc

SEQ ID NO: 842829 - DNA, 25 bp, Mus musculus
tgaaccagatgctccgcttaggccc

SEQ ID NO: 842830 - DNA, 25 bp, Mus musculus
tgaaccagcacccagaaacaacatc

SEQ ID NO: 842831 - DNA, 25 bp, Mus musculus
tgaaccagcaccgagaaacaacatc

SEQ ID NO: 842832 - DNA, 25 bp, Mus musculus
tgaaccagcagcacgtggcagcgtg

SEQ ID NO: 842833 - DNA, 25 bp, Mus musculus
tgaaccagcagctcgtggcagcgtg

SEQ ID NO: 842834 - DNA, 25 bp, Mus musculus
tgaaccagcctcatgacctgtgact

SEQ ID NO: 842835 - DNA, 25 bp, Mus musculus
tgaaccagcctcttgacctgtgact

SEQ ID NO: 842836 - DNA, 25 bp, Mus musculus
tgaaccagccttacagatcaggtag

SEQ ID NO: 842837 - DNA, 25 bp, Mus musculus
tgaaccagcctttcagatcaggtag

SEQ ID NO: 842838 - DNA, 25 bp, Mus musculus
tgaaccagcgtcagcttgtgttctg

SEQ ID NO: 842839 - DNA, 25 bp, Mus musculus
tgaaccagcgtctgcttgtgttctg

SEQ ID NO: 842840 - DNA, 25 bp, Mus musculus
tgaaccagcgttcacaggcatgttt

SEQ ID NO: 842841 - DNA, 25 bp, Mus musculus
tgaaccagcgttgacaggcatgttt

SEQ ID NO: 842842 - DNA, 25 bp, Mus musculus
tgaaccaggactccttctgagtgct

SEQ ID NO: 842843 - DNA, 25 bp, Mus musculus
tgaaccaggactgcttctgagtgct

SEQ ID NO: 842844 - DNA, 25 bp, Mus musculus
tgaaccaggcagagcttaccggagc

SEQ ID NO: 842845 - DNA, 25 bp, Mus musculus
tgaaccaggcagtgcttaccggagc

SEQ ID NO: 842846 - DNA, 25 bp, Mus musculus
tgaaccagggccacccttgaacatg

SEQ ID NO: 842847 - DNA, 25 bp, Mus musculus
tgaaccagggcctcccttgaacatg

SEQ ID NO: 842848 - DNA, 25 bp, Mus musculus
tgaaccaggtagactttccaccggt

SEQ ID NO: 842849 - DNA, 25 bp, Mus musculus
tgaaccaggtagtctttccaccggt

SEQ ID NO: 842850 - DNA, 25 bp, Mus musculus
tgaaccaggttacctttttattttg

SEQ ID NO: 842851 - DNA, 25 bp, Mus musculus
tgaaccaggttagctttttattttg

SEQ ID NO: 842852 - DNA, 25 bp, Mus musculus
tgaaccagtccaatgtacggcgcat

SEQ ID NO: 842853 - DNA, 25 bp, Mus musculus
tgaaccagtccattgtacggcgcat

SEQ ID NO: 842854 - DNA, 25 bp, Mus musculus
tgaaccagtgcacggcctcaaacat

SEQ ID NO: 842855 - DNA, 25 bp, Mus musculus
tgaaccagtgcagggcctcaaacat

SEQ ID NO: 842856 - DNA, 25 bp, Mus musculus
tgaaccagttcccaagtcttgtttg

SEQ ID NO: 842857 - DNA, 25 bp, Mus musculus
tgaaccagttccgaagtcttgtttg

SEQ ID NO: 842858 - DNA, 25 bp, Mus musculus
tgaaccatcacgaggccctgatttg

SEQ ID NO: 842859 - DNA, 25 bp, Mus musculus
tgaaccatcacgtggccctgatttg

SEQ ID NO: 842860 - DNA, 25 bp, Mus musculus
tgaaccatcagccaacagcatttgt

SEQ ID NO: 842861 - DNA, 25 bp, Mus musculus
tgaaccatcagcgaacagcatttgt

SEQ ID NO: 842862 - DNA, 25 bp, Mus musculus
tgaaccatcctgaactccattgcaa

SEQ ID NO: 842863 - DNA, 25 bp, Mus musculus
tgaaccatcctgtactccattgcaa

SEQ ID NO: 842864 - DNA, 25 bp, Mus musculus
tgaaccatcttacctgtaataaaac

SEQ ID NO: 842865 - DNA, 25 bp, Mus musculus
tgaaccatcttagctgtaataaaac

SEQ ID NO: 842866 - DNA, 25 bp, Mus musculus
tgaaccatcttccacattcaagatt

SEQ ID NO: 842867 - DNA, 25 bp, Mus musculus
tgaaccatcttcgacattcaagatt

SEQ ID NO: 842868 - DNA, 25 bp, Mus musculus
tgaaccatgccactgaggatctact

SEQ ID NO: 842869 - DNA, 25 bp, Mus musculus
tgaaccatgccagtgaggatctact

SEQ ID NO: 842870 - DNA, 25 bp, Mus musculus
tgaaccatgcctaggacctctacaa

SEQ ID NO: 842871 - DNA, 25 bp, Mus musculus
tgaaccatgccttggacctctacaa

SEQ ID NO: 842872 - DNA, 25 bp, Mus musculus
tgaaccatggaaagcacacaacggt

SEQ ID NO: 842873 - DNA, 25 bp, Mus musculus
tgaaccatggaatgcacacaacggt

SEQ ID NO: 842874 - DNA, 25 bp, Mus musculus
tgaaccatggatcaatgcaccccag

SEQ ID NO: 842875 - DNA, 25 bp, Mus musculus
tgaaccatggatgaatgcaccccag

SEQ ID NO: 842876 - DNA, 25 bp, Mus musculus
tgaaccatgtgaccggagtcgccag

SEQ ID NO: 842877 - DNA, 25 bp, Mus musculus
tgaaccatgtgagcggagtcgccag

SEQ ID NO: 842878 - DNA, 25 bp, Mus musculus
tgaaccatgttcctagcccatataa

SEQ ID NO: 842879 - DNA, 25 bp, Mus musculus
tgaaccatgttcgtagcccatataa

SEQ ID NO: 842880 - DNA, 25 bp, Mus musculus
tgaaccattccgaaatctggccaat

SEQ ID NO: 842881 - DNA, 25 bp, Mus musculus
tgaaccattccgtaatctggccaat

SEQ ID NO: 842882 - DNA, 25 bp, Mus musculus
tgaaccattgatactccacgagatg

SEQ ID NO: 842883 - DNA, 25 bp, Mus musculus
tgaaccattgattctccacgagatg

SEQ ID NO: 842884 - DNA, 25 bp, Mus musculus
tgaaccattgtacggccatgaaatt

SEQ ID NO: 842885 - DNA, 25 bp, Mus musculus
tgaaccattgtagggccatgaaatt

SEQ ID NO: 842886 - DNA, 25 bp, Mus musculus
tgaacccaaatgatgtgcatgcaaa

SEQ ID NO: 842887 - DNA, 25 bp, Mus musculus
tgaacccaaatgttgtgcatgcaaa

SEQ ID NO: 842888 - DNA, 25 bp, Mus musculus
tgaacccacacaccatatacatctt

SEQ ID NO: 842889 - DNA, 25 bp, Mus musculus
tgaacccacacagcatatacatctt

SEQ ID NO: 842890 - DNA, 25 bp, Mus musculus
tgaacccacaccacagcatggaaag

SEQ ID NO: 842891 - DNA, 25 bp, Mus musculus
tgaacccacacctcagcatggaaag

SEQ ID NO: 842892 - DNA, 25 bp, Mus musculus
tgaacccaccctaacctggaggagc

SEQ ID NO: 842893 - DNA, 25 bp, Mus musculus
tgaacccacccttacctggaggagc

SEQ ID NO: 842894 - DNA, 25 bp, Mus musculus
tgaacccactatcttttggccttaa

SEQ ID NO: 842895 - DNA, 25 bp, Mus musculus
tgaacccactatgttttggccttaa

SEQ ID NO: 842896 - DNA, 25 bp, Mus musculus
tgaacccagaagcatttatttaaaa

SEQ ID NO: 842897 - DNA, 25 bp, Mus musculus
tgaacccagaaggatttatttaaaa

SEQ ID NO: 842898 - DNA, 25 bp, Mus musculus
tgaacccagacgctccagaaacaag

SEQ ID NO: 842899 - DNA, 25 bp, Mus musculus
tgaacccagacggtccagaaacaag

SEQ ID NO: 842900 - DNA, 25 bp, Mus musculus
tgaacccagagcctctgacatgctt

SEQ ID NO: 842901 - DNA, 25 bp, Mus musculus
tgaacccagagcgtctgacatgctt

SEQ ID NO: 842902 - DNA, 25 bp, Mus musculus
tgaacccagatcacgagacctttct

SEQ ID NO: 842903 - DNA, 25 bp, Mus musculus
tgaacccagatctcgagacctttct

SEQ ID NO: 842904 - DNA, 25 bp, Mus musculus
tgaacccagcataccttccagaaca

SEQ ID NO: 842905 - DNA, 25 bp, Mus musculus
tgaacccagcattccttccagaaca

SEQ ID NO: 842906 - DNA, 25 bp, Mus musculus
tgaacccaggaacagtaagaaacgg

SEQ ID NO: 842907 - DNA, 25 bp, Mus musculus
tgaacccaggaagagtaagaaacgg

SEQ ID NO: 842908 - DNA, 25 bp, Mus musculus
tgaacccaggcacactttgtgcatt

SEQ ID NO: 842909 - DNA, 25 bp, Mus musculus
tgaacccaggcagactttgtgcatt

SEQ ID NO: 842910 - DNA, 25 bp, Mus musculus
tgaacccagttcacaccagttcttg

SEQ ID NO: 842911 - DNA, 25 bp, Mus musculus
tgaacccagttctcaccagttcttg

SEQ ID NO: 842912 - DNA, 25 bp, Mus musculus
tgaacccatctgcataccaaaggac

SEQ ID NO: 842913 - DNA, 25 bp, Mus musculus
tgaacccatctggataccaaaggac

SEQ ID NO: 842914 - DNA, 25 bp, Mus musculus
tgaacccatcttagtttctcaacca

SEQ ID NO: 842915 - DNA, 25 bp, Mus musculus
tgaacccatctttgtttctcaacca

SEQ ID NO: 842916 - DNA, 25 bp, Mus musculus
tgaacccatttcactggcgagtaga

SEQ ID NO: 842917 - DNA, 25 bp, Mus musculus
tgaacccatttctctggcgagtaga

SEQ ID NO: 842918 - DNA, 25 bp, Mus musculus
tgaaccccaaatctttccattcttc

SEQ ID NO: 842919 - DNA, 25 bp, Mus musculus
tgaaccccaaatgtttccattcttc

SEQ ID NO: 842920 - DNA, 25 bp, Mus musculus
tgaaccccaaggcagtctacattgt

SEQ ID NO: 842921 - DNA, 25 bp, Mus musculus
tgaaccccaagggagtctacattgt

SEQ ID NO: 842922 - DNA, 25 bp, Mus musculus
tgaaccccagagatggtccagcatc

SEQ ID NO: 842923 - DNA, 25 bp, Mus musculus
tgaaccccagagttggtccagcatc

SEQ ID NO: 842924 - DNA, 25 bp, Mus musculus
tgaaccccagatacttcagttcttc

SEQ ID NO: 842925 - DNA, 25 bp, Mus musculus
tgaaccccagattcttcagttcttc

SEQ ID NO: 842926 - DNA, 25 bp, Mus musculus
tgaaccccaggcaaggtagttacct

SEQ ID NO: 842927 - DNA, 25 bp, Mus musculus
tgaaccccaggctaggtagttacct

SEQ ID NO: 842928 - DNA, 25 bp, Mus musculus
tgaaccccagtgctcttattatata

SEQ ID NO: 842929 - DNA, 25 bp, Mus musculus
tgaaccccagtggtcttattatata

SEQ ID NO: 842930 - DNA, 25 bp, Mus musculus
tgaaccccataaactacacctttag

SEQ ID NO: 842931 - DNA, 25 bp, Mus musculus
tgaaccccataatctacacctttag

SEQ ID NO: 842932 - DNA, 25 bp, Mus musculus
tgaaccccatctccacgtggtgtgt

SEQ ID NO: 842933 - DNA, 25 bp, Mus musculus
tgaaccccatctgcacgtggtgtgt

SEQ ID NO: 842934 - DNA, 25 bp, Mus musculus
tgaaccccccatatcgtaatatctt

SEQ ID NO: 842935 - DNA, 25 bp, Mus musculus
tgaaccccccatttcgtaatatctt

SEQ ID NO: 842936 - DNA, 25 bp, Mus musculus
tgaacccctagcctcttagaatatg

SEQ ID NO: 842937 - DNA, 25 bp, Mus musculus
tgaacccctagcgtcttagaatatg

SEQ ID NO: 842938 - DNA, 25 bp, Mus musculus
tgaacccctccaagttgggagccgc

SEQ ID NO: 842939 - DNA, 25 bp, Mus musculus
tgaacccctccatgttgggagccgc

SEQ ID NO: 842940 - DNA, 25 bp, Mus musculus
tgaaccccttaaactacaacatcac

SEQ ID NO: 842941 - DNA, 25 bp, Mus musculus
tgaaccccttaatctacaacatcac

SEQ ID NO: 842942 - DNA, 25 bp, Mus musculus
tgaaccccttcccagaaatggagag

SEQ ID NO: 842943 - DNA, 25 bp, Mus musculus
tgaaccccttccgagaaatggagag

SEQ ID NO: 842944 - DNA, 25 bp, Mus musculus
tgaacccgcagcactggcaaaggac

SEQ ID NO: 842945 - DNA, 25 bp, Mus musculus
tgaacccgcagctctggcaaaggac

SEQ ID NO: 842946 - DNA, 25 bp, Mus musculus
tgaacccggccgctgattcttttga

SEQ ID NO: 842947 - DNA, 25 bp, Mus musculus
tgaacccggccggtgattcttttga

SEQ ID NO: 842948 - DNA, 25 bp, Mus musculus
tgaacccgttcactttacaacgaca

SEQ ID NO: 842949 - DNA, 25 bp, Mus musculus
tgaacccgttcagtttacaacgaca

SEQ ID NO: 842950 - DNA, 25 bp, Mus musculus
tgaaccctacataggcagatgaact

SEQ ID NO: 842951 - DNA, 25 bp, Mus musculus
tgaaccctacattggcagatgaact

SEQ ID NO: 842952 - DNA, 25 bp, Mus musculus
tgaaccctcaaaactgtccccaatg

SEQ ID NO: 842953 - DNA, 25 bp, Mus musculus
tgaaccctcaaatctgtccccaatg

SEQ ID NO: 842954 - DNA, 25 bp, Mus musculus
tgaaccctcctgatgtgtttaccaa

SEQ ID NO: 842955 - DNA, 25 bp, Mus musculus
tgaaccctcctgttgtgtttaccaa

SEQ ID NO: 842956 - DNA, 25 bp, Mus musculus
tgaaccctcggcatagtactttctg

SEQ ID NO: 842957 - DNA, 25 bp, Mus musculus
tgaaccctcggcttagtactttctg

SEQ ID NO: 842958 - DNA, 25 bp, Mus musculus
tgaaccctcgggaattcaaggaaga

SEQ ID NO: 842959 - DNA, 25 bp, Mus musculus
tgaaccctcgggtattcaaggaaga

SEQ ID NO: 842960 - DNA, 25 bp, Mus musculus
tgaaccctgataacaatgccccata

SEQ ID NO: 842961 - DNA, 25 bp, Mus musculus
tgaaccctgatatcaatgccccata

SEQ ID NO: 842962 - DNA, 25 bp, Mus musculus
tgaaccctgctgacattgagtctct

SEQ ID NO: 842963 - DNA, 25 bp, Mus musculus
tgaaccctgctgtcattgagtctct

SEQ ID NO: 842964 - DNA, 25 bp, Mus musculus
tgaaccctggcaatctctggagtga

SEQ ID NO: 842965 - DNA, 25 bp, Mus musculus
tgaaccctggcattctctggagtga

SEQ ID NO: 842966 - DNA, 25 bp, Mus musculus
tgaaccctgggtattcatcacaccc

SEQ ID NO: 842967 - DNA, 25 bp, Mus musculus
tgaaccctgggttttcatcacaccc

SEQ ID NO: 842968 - DNA, 25 bp, Mus musculus
tgaacccttcaaccatttgaaaact

SEQ ID NO: 842969 - DNA, 25 bp, Mus musculus
tgaacccttcaagcatttgaaaact

SEQ ID NO: 842970 - DNA, 25 bp, Mus musculus
tgaacccttctaaatacccatcctt

SEQ ID NO: 842971 - DNA, 25 bp, Mus musculus
tgaacccttctatatacccatcctt

SEQ ID NO: 842972 - DNA, 25 bp, Mus musculus
tgaacccttggtcaaatttccttgg

SEQ ID NO: 842973 - DNA, 25 bp, Mus musculus
tgaacccttggtgaaatttccttgg

SEQ ID NO: 842974 - DNA, 25 bp, Mus musculus
tgaaccgaagccctataagttttgg

SEQ ID NO: 842975 - DNA, 25 bp, Mus musculus
tgaaccgaagccgtataagttttgg

SEQ ID NO: 842976 - DNA, 25 bp, Mus musculus
tgaaccgaatccaaacagtccagcc

SEQ ID NO: 842977 - DNA, 25 bp, Mus musculus
tgaaccgaatcctaacagtccagcc

SEQ ID NO: 842978 - DNA, 25 bp, Mus musculus
tgaaccgaatttctccaatgctctc

SEQ ID NO: 842979 - DNA, 25 bp, Mus musculus
tgaaccgaatttgtccaatgctctc

SEQ ID NO: 842980 - DNA, 25 bp, Mus musculus
tgaaccgacatcatgaatctcctag

SEQ ID NO: 842981 - DNA, 25 bp, Mus musculus
tgaaccgacatcttgaatctcctag

SEQ ID NO: 842982 - DNA, 25 bp, Mus musculus
tgaaccgactacctttcttcaccaa

SEQ ID NO: 842983 - DNA, 25 bp, Mus musculus
tgaaccgactacgtttcttcaccaa

SEQ ID NO: 842984 - DNA, 25 bp, Mus musculus
tgaaccgactcaagcgggagctttt

SEQ ID NO: 842985 - DNA, 25 bp, Mus musculus
tgaaccgactcatgcgggagctttt

SEQ ID NO: 842986 - DNA, 25 bp, Mus musculus
tgaaccgagtccaggccaacctgtt

SEQ ID NO: 842987 - DNA, 25 bp, Mus musculus
tgaaccgagtcctggccaacctgtt

SEQ ID NO: 842988 - DNA, 25 bp, Mus musculus
tgaaccgcacaacggaacctgagag

SEQ ID NO: 842989 - DNA, 25 bp, Mus musculus
tgaaccgcacaagggaacctgagag

SEQ ID NO: 842990 - DNA, 25 bp, Mus musculus
tgaaccgccaccagtagctaggctg

SEQ ID NO: 842991 - DNA, 25 bp, Mus musculus
tgaaccgccacctgtagctaggctg

SEQ ID NO: 842992 - DNA, 25 bp, Mus musculus
tgaaccgcccggactggtgacaggc

SEQ ID NO: 842993 - DNA, 25 bp, Mus musculus
tgaaccgcccggtctggtgacaggc

SEQ ID NO: 842994 - DNA, 25 bp, Mus musculus
tgaaccgcgaggaattctgggagat

SEQ ID NO: 842995 - DNA, 25 bp, Mus musculus
tgaaccgcgaggtattctgggagat

SEQ ID NO: 842996 - DNA, 25 bp, Mus musculus
tgaaccgctgtcactacacatttta

SEQ ID NO: 842997 - DNA, 25 bp, Mus musculus
tgaaccgctgtctctacacatttta

SEQ ID NO: 842998 - DNA, 25 bp, Mus musculus
tgaaccgcttcaagccactgaatac

SEQ ID NO: 842999 - DNA, 25 bp, Mus musculus
tgaaccgcttcatgccactgaatac

SEQ ID NO: 843000 - DNA, 25 bp, Mus musculus
tgaaccgctttcagagggccaactg

SEQ ID NO: 843001 - DNA, 25 bp, Mus musculus
tgaaccgctttctgagggccaactg

SEQ ID NO: 843002 - DNA, 25 bp, Mus musculus
tgaaccgctttgaccgaacagacag

SEQ ID NO: 843003 - DNA, 25 bp, Mus musculus
tgaaccgctttgagctcagggtcac

SEQ ID NO: 843004 - DNA, 25 bp, Mus musculus
tgaaccgctttgtccgaacagacag

SEQ ID NO: 843005 - DNA, 25 bp, Mus musculus
tgaaccgctttgtgctcagggtcac

SEQ ID NO: 843006 - DNA, 25 bp, Mus musculus
tgaaccggacaacctgcaatctgcg

SEQ ID NO: 843007 - DNA, 25 bp, Mus musculus
tgaaccggacaagctgcaatctgcg

SEQ ID NO: 843008 - DNA, 25 bp, Mus musculus
tgaaccggatgtctcggcattaatc

SEQ ID NO: 843009 - DNA, 25 bp, Mus musculus
tgaaccggatgtgtcggcattaatc

SEQ ID NO: 843010 - DNA, 25 bp, Mus musculus
tgaaccgggctacccaaagcattga

SEQ ID NO: 843011 - DNA, 25 bp, Mus musculus
tgaaccgggctagccaaagcattga

SEQ ID NO: 843012 - DNA, 25 bp, Mus musculus
tgaaccggtcaacaatgcatattcc

SEQ ID NO: 843013 - DNA, 25 bp, Mus musculus
tgaaccggtcaagaatgcatattcc

SEQ ID NO: 843014 - DNA, 25 bp, Mus musculus
tgaaccgtagccatgacactggaca

SEQ ID NO: 843015 - DNA, 25 bp, Mus musculus
tgaaccgtagccttgacactggaca

SEQ ID NO: 843016 - DNA, 25 bp, Mus musculus
tgaaccgtgactactgtaaacccag

SEQ ID NO: 843017 - DNA, 25 bp, Mus musculus
tgaaccgtgacttctgtaaacccag

SEQ ID NO: 843018 - DNA, 25 bp, Mus musculus
tgaacctaaacaccctgaattttga

SEQ ID NO: 843019 - DNA, 25 bp, Mus musculus
tgaacctaaacagcctgaattttga

SEQ ID NO: 843020 - DNA, 25 bp, Mus musculus
tgaacctaagaaataagtcaccttt

SEQ ID NO: 843021 - DNA, 25 bp, Mus musculus
tgaacctaagaattaagtcaccttt

SEQ ID NO: 843022 - DNA, 25 bp, Mus musculus
tgaacctaagcacccattagtggcc

SEQ ID NO: 843023 - DNA, 25 bp, Mus musculus
tgaacctaagcagccattagtggcc

SEQ ID NO: 843024 - DNA, 25 bp, Mus musculus
tgaacctacgggagacacttcacat

SEQ ID NO: 843025 - DNA, 25 bp, Mus musculus
tgaacctacgggtgacacttcacat

SEQ ID NO: 843026 - DNA, 25 bp, Mus musculus
tgaacctagaccctcatacatgcta

SEQ ID NO: 843027 - DNA, 25 bp, Mus musculus
tgaacctagaccgtcatacatgcta

SEQ ID NO: 843028 - DNA, 25 bp, Mus musculus
tgaacctagattccaagcccgggag

SEQ ID NO: 843029 - DNA, 25 bp, Mus musculus
tgaacctagattgcaagcccgggag

SEQ ID NO: 843030 - DNA, 25 bp, Mus musculus
tgaacctatgttaaatccgagagtg

SEQ ID NO: 843031 - DNA, 25 bp, Mus musculus
tgaacctatgttagcccaatccaga

SEQ ID NO: 843032 - DNA, 25 bp, Mus musculus
tgaacctatgtttaatccgagagtg

SEQ ID NO: 843033 - DNA, 25 bp, Mus musculus
tgaacctatgtttgcccaatccaga

SEQ ID NO: 843034 - DNA, 25 bp, Mus musculus
tgaacctattatctcagcataactt

SEQ ID NO: 843035 - DNA, 25 bp, Mus musculus
tgaacctattatgtcagcataactt

SEQ ID NO: 843036 - DNA, 25 bp, Mus musculus
tgaacctattctcctgtatgcattt

SEQ ID NO: 843037 - DNA, 25 bp, Mus musculus
tgaacctattctgctgtatgcattt

SEQ ID NO: 843038 - DNA, 25 bp, Mus musculus
tgaacctattggaactcatcaggaa

SEQ ID NO: 843039 - DNA, 25 bp, Mus musculus
tgaacctattggtactcatcaggaa

SEQ ID NO: 843040 - DNA, 25 bp, Mus musculus
tgaacctcaaccatgccagggtggc

SEQ ID NO: 843041 - DNA, 25 bp, Mus musculus
tgaacctcaaccttgccagggtggc

SEQ ID NO: 843042 - DNA, 25 bp, Mus musculus
tgaacctcaactactttacctttga

SEQ ID NO: 843043 - DNA, 25 bp, Mus musculus
tgaacctcaacttctttacctttga

SEQ ID NO: 843044 - DNA, 25 bp, Mus musculus
tgaacctcacgccactgcaatagtg

SEQ ID NO: 843045 - DNA, 25 bp, Mus musculus
tgaacctcacgcgactgcaatagtg

SEQ ID NO: 843046 - DNA, 25 bp, Mus musculus
tgaacctcactaagtattacacaga

SEQ ID NO: 843047 - DNA, 25 bp, Mus musculus
tgaacctcactatgtattacacaga

SEQ ID NO: 843048 - DNA, 25 bp, Mus musculus
tgaacctcagttaattagaagcaca

SEQ ID NO: 843049 - DNA, 25 bp, Mus musculus
tgaacctcagtttattagaagcaca

SEQ ID NO: 843050 - DNA, 25 bp, Mus musculus
tgaacctcatgtcctgtgcgtgtgg

SEQ ID NO: 843051 - DNA, 25 bp, Mus musculus
tgaacctcatgtgctgtgcgtgtgg

SEQ ID NO: 843052 - DNA, 25 bp, Mus musculus
tgaacctccacacacgggcatatat

SEQ ID NO: 843053 - DNA, 25 bp, Mus musculus
tgaacctccacagacgggcatatat

SEQ ID NO: 843054 - DNA, 25 bp, Mus musculus
tgaacctccatgctgctgcaagtta

SEQ ID NO: 843055 - DNA, 25 bp, Mus musculus
tgaacctccatggtgctgcaagtta

SEQ ID NO: 843056 - DNA, 25 bp, Mus musculus
tgaacctccattctaccttcattgt

SEQ ID NO: 843057 - DNA, 25 bp, Mus musculus
tgaacctccattgtaccttcattgt

SEQ ID NO: 843058 - DNA, 25 bp, Mus musculus
tgaacctccggaattcattacgcgt

SEQ ID NO: 843059 - DNA, 25 bp, Mus musculus
tgaacctccggatttcattacgcgt

SEQ ID NO: 843060 - DNA, 25 bp, Mus musculus
tgaacctcctcaccctaagagtcaa

SEQ ID NO: 843061 - DNA, 25 bp, Mus musculus
tgaacctcctcagcctaagagtcaa

SEQ ID NO: 843062 - DNA, 25 bp, Mus musculus
tgaacctcgagtcaacagtcatgcc

SEQ ID NO: 843063 - DNA, 25 bp, Mus musculus
tgaacctcgagtgaacagtcatgcc

SEQ ID NO: 843064 - DNA, 25 bp, Mus musculus
tgaacctcgcgcatagtgcactcta

SEQ ID NO: 843065 - DNA, 25 bp, Mus musculus
tgaacctcgcgcttagtgcactcta

SEQ ID NO: 843066 - DNA, 25 bp, Mus musculus
tgaacctcgctcactccaagataag

SEQ ID NO: 843067 - DNA, 25 bp, Mus musculus
tgaacctcgctctctccaagataag

SEQ ID NO: 843068 - DNA, 25 bp, Mus musculus
tgaacctcgtgcctggcctgtcagt

SEQ ID NO: 843069 - DNA, 25 bp, Mus musculus
tgaacctcgtgcgtggcctgtcagt

SEQ ID NO: 843070 - DNA, 25 bp, Mus musculus
tgaacctctatcaactctttgcatt

SEQ ID NO: 843071 - DNA, 25 bp, Mus musculus
tgaacctctatctactctttgcatt

SEQ ID NO: 843072 - DNA, 25 bp, Mus musculus
tgaacctctcacctaaagggacttc

SEQ ID NO: 843073 - DNA, 25 bp, Mus musculus
tgaacctctcacgtaaagggacttc

SEQ ID NO: 843074 - DNA, 25 bp, Mus musculus
tgaacctctcatcctgaaatggagt

SEQ ID NO: 843075 - DNA, 25 bp, Mus musculus
tgaacctctcatgctgaaatggagt

SEQ ID NO: 843076 - DNA, 25 bp, Mus musculus
tgaacctctcctactatgagctttg

SEQ ID NO: 843077 - DNA, 25 bp, Mus musculus
tgaacctctccttctatgagctttg

SEQ ID NO: 843078 - DNA, 25 bp, Mus musculus
tgaacctctcttcagtggatttggg

SEQ ID NO: 843079 - DNA, 25 bp, Mus musculus
tgaacctctcttgagtggatttggg

SEQ ID NO: 843080 - DNA, 25 bp, Mus musculus
tgaacctctgcaagagcgaccaatt

SEQ ID NO: 843081 - DNA, 25 bp, Mus musculus
tgaacctctgcatgagcgaccaatt

SEQ ID NO: 843082 - DNA, 25 bp, Mus musculus
tgaacctcttttagtgtcttctctc

SEQ ID NO: 843083 - DNA, 25 bp, Mus musculus
tgaacctctttttgtgtcttctctc

SEQ ID NO: 843084 - DNA, 25 bp, Mus musculus
tgaacctgaagaagcgcggccactt

SEQ ID NO: 843085 - DNA, 25 bp, Mus musculus
tgaacctgaagatgcgcggccactt

SEQ ID NO: 843086 - DNA, 25 bp, Mus musculus
tgaacctgacagcatggagcccctc

SEQ ID NO: 843087 - DNA, 25 bp, Mus musculus
tgaacctgacaggatggagcccctc

SEQ ID NO: 843088 - DNA, 25 bp, Mus musculus
tgaacctgagatacatcactacaga

SEQ ID NO: 843089 - DNA, 25 bp, Mus musculus
tgaacctgagattcatcactacaga

SEQ ID NO: 843090 - DNA, 25 bp, Mus musculus
tgaacctgaggtaacttccattgtt

SEQ ID NO: 843091 - DNA, 25 bp, Mus musculus
tgaacctgaggttacttccattgtt

SEQ ID NO: 843092 - DNA, 25 bp, Mus musculus
tgaacctgagtaattggcacatgat

SEQ ID NO: 843093 - DNA, 25 bp, Mus musculus
tgaacctgagtatttggcacatgat

SEQ ID NO: 843094 - DNA, 25 bp, Mus musculus
tgaacctgagtgactgcagagaatg

SEQ ID NO: 843095 - DNA, 25 bp, Mus musculus
tgaacctgagtgtctgcagagaatg

SEQ ID NO: 843096 - DNA, 25 bp, Mus musculus
tgaacctgatggacacttctccggc

SEQ ID NO: 843097 - DNA, 25 bp, Mus musculus
tgaacctgatggtcacttctccggc

SEQ ID NO: 843098 - DNA, 25 bp, Mus musculus
tgaacctgatgtccttgctgcggag

SEQ ID NO: 843099 - DNA, 25 bp, Mus musculus
tgaacctgatgtgcttgctgcggag

SEQ ID NO: 843100 - DNA, 25 bp, Mus musculus
tgaacctgccaaatactagtagaat

SEQ ID NO: 843101 - DNA, 25 bp, Mus musculus
tgaacctgccaattactagtagaat

SEQ ID NO: 843102 - DNA, 25 bp, Mus musculus
tgaacctgccacagcacaccttgag

SEQ ID NO: 843103 - DNA, 25 bp, Mus musculus
tgaacctgccacatgcagacaggag

SEQ ID NO: 843104 - DNA, 25 bp, Mus musculus
tgaacctgccactgcacaccttgag

SEQ ID NO: 843105 - DNA, 25 bp, Mus musculus
tgaacctgccacttgcagacaggag

SEQ ID NO: 843106 - DNA, 25 bp, Mus musculus
tgaacctgccagaccgcggaatgtg

SEQ ID NO: 843107 - DNA, 25 bp, Mus musculus
tgaacctgccagtccgcggaatgtg

SEQ ID NO: 843108 - DNA, 25 bp, Mus musculus
tgaacctgctgcattcagcgtgaga

SEQ ID NO: 843109 - DNA, 25 bp, Mus musculus
tgaacctgctgctttcagcgtgaga

SEQ ID NO: 843110 - DNA, 25 bp, Mus musculus
tgaacctggctgaatgtgcatgctc

SEQ ID NO: 843111 - DNA, 25 bp, Mus musculus
tgaacctggctgtatgtgcatgctc

SEQ ID NO: 843112 - DNA, 25 bp, Mus musculus
tgaacctgggcactgttcagcccct

SEQ ID NO: 843113 - DNA, 25 bp, Mus musculus
tgaacctgggcagtgttcagcccct

SEQ ID NO: 843114 - DNA, 25 bp, Mus musculus
tgaacctggtggaagccggccgcac

SEQ ID NO: 843115 - DNA, 25 bp, Mus musculus
tgaacctggtggtagccggccgcac

SEQ ID NO: 843116 - DNA, 25 bp, Mus musculus
tgaacctggttcattgcaagagcca

SEQ ID NO: 843117 - DNA, 25 bp, Mus musculus
tgaacctggttctttgcaagagcca

SEQ ID NO: 843118 - DNA, 25 bp, Mus musculus
tgaacctgtcttagggtcatccata

SEQ ID NO: 843119 - DNA, 25 bp, Mus musculus
tgaacctgtctttgggtcatccata

SEQ ID NO: 843120 - DNA, 25 bp, Mus musculus
tgaacctgtgagctgttgggcttat

SEQ ID NO: 843121 - DNA, 25 bp, Mus musculus
tgaacctgtgaggtgttgggcttat

SEQ ID NO: 843122 - DNA, 25 bp, Mus musculus
tgaacctgttctaatggactgctgg

SEQ ID NO: 843123 - DNA, 25 bp, Mus musculus
tgaacctgttcttatggactgctgg

SEQ ID NO: 843124 - DNA, 25 bp, Mus musculus
tgaaccttagcactccttttgtgga

SEQ ID NO: 843125 - DNA, 25 bp, Mus musculus
tgaaccttagcagtccttttgtgga

SEQ ID NO: 843126 - DNA, 25 bp, Mus musculus
tgaaccttatcgcatgccctttgga

SEQ ID NO: 843127 - DNA, 25 bp, Mus musculus
tgaaccttatcggatgccctttgga

SEQ ID NO: 843128 - DNA, 25 bp, Mus musculus
tgaaccttcacaaccacagtatata

SEQ ID NO: 843129 - DNA, 25 bp, Mus musculus
tgaaccttcacatccacagtatata

SEQ ID NO: 843130 - DNA, 25 bp, Mus musculus
tgaaccttctcccaacaagttttga

SEQ ID NO: 843131 - DNA, 25 bp, Mus musculus
tgaaccttctccgaacaagttttga

SEQ ID NO: 843132 - DNA, 25 bp, Mus musculus
tgaaccttgcatatccttcatctct

SEQ ID NO: 843133 - DNA, 25 bp, Mus musculus
tgaaccttgcatttccttcatctct

SEQ ID NO: 843134 - DNA, 25 bp, Mus musculus
tgaaccttgcttcataccaggctgg

SEQ ID NO: 843135 - DNA, 25 bp, Mus musculus
tgaaccttgcttgataccaggctgg

SEQ ID NO: 843136 - DNA, 25 bp, Mus musculus
tgaaccttgggcacttgacccttgg

SEQ ID NO: 843137 - DNA, 25 bp, Mus musculus
tgaaccttgggctcttgacccttgg

SEQ ID NO: 843138 - DNA, 25 bp, Mus musculus
tgaaccttgggtcggtggtcctcta

SEQ ID NO: 843139 - DNA, 25 bp, Mus musculus
tgaaccttgggtgggtggtcctcta

SEQ ID NO: 843140 - DNA, 25 bp, Mus musculus
tgaacctttgcaactcagcttttgg

SEQ ID NO: 843141 - DNA, 25 bp, Mus musculus
tgaacctttgcaattttctcacctg

SEQ ID NO: 843142 - DNA, 25 bp, Mus musculus
tgaacctttgcatctcagcttttgg

SEQ ID NO: 843143 - DNA, 25 bp, Mus musculus
tgaacctttgcatttttctcacctg

SEQ ID NO: 843144 - DNA, 25 bp, Mus musculus
tgaacctttgctctcacccgtctaa

SEQ ID NO: 843145 - DNA, 25 bp, Mus musculus
tgaacctttgctgtcacccgtctaa

SEQ ID NO: 843146 - DNA, 25 bp, Mus musculus
tgaacctttggtaggaagcccctga

SEQ ID NO: 843147 - DNA, 25 bp, Mus musculus
tgaacctttggttggaagcccctga

SEQ ID NO: 843148 - DNA, 25 bp, Mus musculus
tgaaccttttaccaccgtgtcgatt

SEQ ID NO: 843149 - DNA, 25 bp, Mus musculus
tgaaccttttacgaccgtgtcgatt

SEQ ID NO: 843150 - DNA, 25 bp, Mus musculus
tgaacctttttcaacgtgcacatgc

SEQ ID NO: 843151 - DNA, 25 bp, Mus musculus
tgaacctttttctacgtgcacatgc

SEQ ID NO: 843152 - DNA, 25 bp, Mus musculus
tgaacgaaactgactgcaatcccct

SEQ ID NO: 843153 - DNA, 25 bp, Mus musculus
tgaacgaaactgtctgcaatcccct

SEQ ID NO: 843154 - DNA, 25 bp, Mus musculus
tgaacgaagcttatgcccctcagtt

SEQ ID NO: 843155 - DNA, 25 bp, Mus musculus
tgaacgaagcttttgcccctcagtt

SEQ ID NO: 843156 - DNA, 25 bp, Mus musculus
tgaacgaatgaacgcctgtctgtgg

SEQ ID NO: 843157 - DNA, 25 bp, Mus musculus
tgaacgaatgaaggcctgtctgtgg

SEQ ID NO: 843158 - DNA, 25 bp, Mus musculus
tgaacgacactgctggaaacacctc

SEQ ID NO: 843159 - DNA, 25 bp, Mus musculus
tgaacgacactggtggaaacacctc

SEQ ID NO: 843160 - DNA, 25 bp, Mus musculus
tgaacgaccaggacctccacagcgg

SEQ ID NO: 843161 - DNA, 25 bp, Mus musculus
tgaacgaccaggtcctccacagcgg

SEQ ID NO: 843162 - DNA, 25 bp, Mus musculus
tgaacgagacagaggaccccttatc

SEQ ID NO: 843163 - DNA, 25 bp, Mus musculus
tgaacgagacagtggaccccttatc

SEQ ID NO: 843164 - DNA, 25 bp, Mus musculus
tgaacgagcgtgaccgtctgatcaa

SEQ ID NO: 843165 - DNA, 25 bp, Mus musculus
tgaacgagcgtgtccgtctgatcaa

SEQ ID NO: 843166 - DNA, 25 bp, Mus musculus
tgaacgagggtcaactttcatcaaa

SEQ ID NO: 843167 - DNA, 25 bp, Mus musculus
tgaacgagggtctactttcatcaaa

SEQ ID NO: 843168 - DNA, 25 bp, Mus musculus
tgaacgagtacccagactcctgtgc

SEQ ID NO: 843169 - DNA, 25 bp, Mus musculus
tgaacgagtaccgagactcctgtgc

SEQ ID NO: 843170 - DNA, 25 bp, Mus musculus
tgaacgatcagtacttggagctcct

SEQ ID NO: 843171 - DNA, 25 bp, Mus musculus
tgaacgatcagttcttggagctcct

SEQ ID NO: 843172 - DNA, 25 bp, Mus musculus
tgaacgatggccacagcgaggccat

SEQ ID NO: 843173 - DNA, 25 bp, Mus musculus
tgaacgatggcctcagcgaggccat

SEQ ID NO: 843174 - DNA, 25 bp, Mus musculus
tgaacgcaactcaggcgcggaggct

SEQ ID NO: 843175 - DNA, 25 bp, Mus musculus
tgaacgcaactctggcgcggaggct

SEQ ID NO: 843176 - DNA, 25 bp, Mus musculus
tgaacgcagcccatcactagaaaat

SEQ ID NO: 843177 - DNA, 25 bp, Mus musculus
tgaacgcagcccttcactagaaaat

SEQ ID NO: 843178 - DNA, 25 bp, Mus musculus
tgaacgcaggcgaaatagccctttc

SEQ ID NO: 843179 - DNA, 25 bp, Mus musculus
tgaacgcaggcgtaatagccctttc

SEQ ID NO: 843180 - DNA, 25 bp, Mus musculus
tgaacgcagtatctgggtgccagtt

SEQ ID NO: 843181 - DNA, 25 bp, Mus musculus
tgaacgcagtatgtgggtgccagtt

SEQ ID NO: 843182 - DNA, 25 bp, Mus musculus
tgaacgcattgcaatcgggacagat

SEQ ID NO: 843183 - DNA, 25 bp, Mus musculus
tgaacgcattgctatcgggacagat

SEQ ID NO: 843184 - DNA, 25 bp, Mus musculus
tgaacgccacctattatagacacca

SEQ ID NO: 843185 - DNA, 25 bp, Mus musculus
tgaacgccaccttttatagacacca

SEQ ID NO: 843186 - DNA, 25 bp, Mus musculus
tgaacgccactgaccatcgaatgtg

SEQ ID NO: 843187 - DNA, 25 bp, Mus musculus
tgaacgccactgtccatcgaatgtg

SEQ ID NO: 843188 - DNA, 25 bp, Mus musculus
tgaacgccagggacattcgaaacct

SEQ ID NO: 843189 - DNA, 25 bp, Mus musculus
tgaacgccagggtcattcgaaacct

SEQ ID NO: 843190 - DNA, 25 bp, Mus musculus
tgaacgccatggaggacctgaacgc

SEQ ID NO: 843191 - DNA, 25 bp, Mus musculus
tgaacgccatggtggacctgaacgc

SEQ ID NO: 843192 - DNA, 25 bp, Mus musculus
tgaacgcccgctccgcagatatttt

SEQ ID NO: 843193 - DNA, 25 bp, Mus musculus
tgaacgcccgctgcgcagatatttt

SEQ ID NO: 843194 - DNA, 25 bp, Mus musculus
tgaacgccgactcacccagtgggtc

SEQ ID NO: 843195 - DNA, 25 bp, Mus musculus
tgaacgccgactgacccagtgggtc

SEQ ID NO: 843196 - DNA, 25 bp, Mus musculus
tgaacgccgcctactcgggctacgt

SEQ ID NO: 843197 - DNA, 25 bp, Mus musculus
tgaacgccgccttctcgggctacgt

SEQ ID NO: 843198 - DNA, 25 bp, Mus musculus
tgaacgccttttataacaacaccat

SEQ ID NO: 843199 - DNA, 25 bp, Mus musculus
tgaacgccttttttaacaacaccat

SEQ ID NO: 843200 - DNA, 25 bp, Mus musculus
tgaacgcgttcaaggagcagcatat

SEQ ID NO: 843201 - DNA, 25 bp, Mus musculus
tgaacgcgttcacaggcatcggatc

SEQ ID NO: 843202 - DNA, 25 bp, Mus musculus
tgaacgcgttcagaggcatcggatc

SEQ ID NO: 843203 - DNA, 25 bp, Mus musculus
tgaacgcgttcatggagcagcatat

SEQ ID NO: 843204 - DNA, 25 bp, Mus musculus
tgaacgctactcacacgggattgtg

SEQ ID NO: 843205 - DNA, 25 bp, Mus musculus
tgaacgctactctcacgggattgtg

SEQ ID NO: 843206 - DNA, 25 bp, Mus musculus
tgaacgctgagactggccagcccct

SEQ ID NO: 843207 - DNA, 25 bp, Mus musculus
tgaacgctgagagtggccagcccct

SEQ ID NO: 843208 - DNA, 25 bp, Mus musculus
tgaacgctggatacgtatggctaac

SEQ ID NO: 843209 - DNA, 25 bp, Mus musculus
tgaacgctggattcgtatggctaac

SEQ ID NO: 843210 - DNA, 25 bp, Mus musculus
tgaacgctgtcaagatgcacggccg

SEQ ID NO: 843211 - DNA, 25 bp, Mus musculus
tgaacgctgtcatgatgcacggccg

SEQ ID NO: 843212 - DNA, 25 bp, Mus musculus
tgaacgctgtctacacatgttcctg

SEQ ID NO: 843213 - DNA, 25 bp, Mus musculus
tgaacgctgtcttcacatgttcctg

SEQ ID NO: 843214 - DNA, 25 bp, Mus musculus
tgaacggaaggcatccctcggcgtc

SEQ ID NO: 843215 - DNA, 25 bp, Mus musculus
tgaacggaaggcttccctcggcgtc

SEQ ID NO: 843216 - DNA, 25 bp, Mus musculus
tgaacggaccatctgcaattgtgct

SEQ ID NO: 843217 - DNA, 25 bp, Mus musculus
tgaacggaccatgtgcaattgtgct

SEQ ID NO: 843218 - DNA, 25 bp, Mus musculus
tgaacggactcgcagtcccaagtca

SEQ ID NO: 843219 - DNA, 25 bp, Mus musculus
tgaacggactcggagtcccaagtca

SEQ ID NO: 843220 - DNA, 25 bp, Mus musculus
tgaacggagcacaactcttttctct

SEQ ID NO: 843221 - DNA, 25 bp, Mus musculus
tgaacggagcactactcttttctct

SEQ ID NO: 843222 - DNA, 25 bp, Mus musculus
tgaacggagtctccttttttgctct

SEQ ID NO: 843223 - DNA, 25 bp, Mus musculus
tgaacggagtctgcttttttgctct

SEQ ID NO: 843224 - DNA, 25 bp, Mus musculus
tgaacggatgttccacaccactggg

SEQ ID NO: 843225 - DNA, 25 bp, Mus musculus
tgaacggatgttgcacaccactggg

SEQ ID NO: 843226 - DNA, 25 bp, Mus musculus
tgaacggcaccccagatgcatatac

SEQ ID NO: 843227 - DNA, 25 bp, Mus musculus
tgaacggcacccgagatgcatatac

SEQ ID NO: 843228 - DNA, 25 bp, Mus musculus
tgaacggccttcagaataacagggt

SEQ ID NO: 843229 - DNA, 25 bp, Mus musculus
tgaacggccttctgaataacagggt

SEQ ID NO: 843230 - DNA, 25 bp, Mus musculus
tgaacggcgagaacagtgccttggc

SEQ ID NO: 843231 - DNA, 25 bp, Mus musculus
tgaacggcgagatcagtgccttggc

SEQ ID NO: 843232 - DNA, 25 bp, Mus musculus
tgaacggctgcgaaacaacacccaa

SEQ ID NO: 843233 - DNA, 25 bp, Mus musculus
tgaacggctgcgtaacaacacccaa

SEQ ID NO: 843234 - DNA, 25 bp, Mus musculus
tgaacggtactcacggtacttctgt

SEQ ID NO: 843235 - DNA, 25 bp, Mus musculus
tgaacggtactctcggtacttctgt

SEQ ID NO: 843236 - DNA, 18 bp, Mus musculus
tgaacggtagcatcttga

SEQ ID NO: 843237 - DNA, 25 bp, Mus musculus
tgaacggtcatcctggcggaatgct

SEQ ID NO: 843238 - DNA, 25 bp, Mus musculus
tgaacggtcatcgtggcggaatgct

SEQ ID NO: 843239 - DNA, 25 bp, Mus musculus
tgaacggtctgacttacccgttggg

SEQ ID NO: 843240 - DNA, 25 bp, Mus musculus
tgaacggtctgagttacccgttggg

SEQ ID NO: 843241 - DNA, 25 bp, Mus musculus
tgaacggtgactatccagccactag

SEQ ID NO: 843242 - DNA, 25 bp, Mus musculus
tgaacggtgactttccagccactag

SEQ ID NO: 843243 - DNA, 25 bp, Mus musculus
tgaacggtgaggatctgctgctgac

SEQ ID NO: 843244 - DNA, 25 bp, Mus musculus
tgaacggtgaggttctgctgctgac

SEQ ID NO: 843245 - DNA, 25 bp, Mus musculus
tgaacggtggaacttagtagtccct

SEQ ID NO: 843246 - DNA, 25 bp, Mus musculus
tgaacggtggaagttagtagtccct

SEQ ID NO: 843247 - DNA, 25 bp, Mus musculus
tgaacggtttcacgacagttgtttt

SEQ ID NO: 843248 - DNA, 25 bp, Mus musculus
tgaacggtttcaggacagttgtttt

SEQ ID NO: 843249 - DNA, 25 bp, Mus musculus
tgaacgtacagcaatgctcttgcct

SEQ ID NO: 843250 - DNA, 25 bp, Mus musculus
tgaacgtacagctatgctcttgcct

SEQ ID NO: 843251 - DNA, 25 bp, Mus musculus
tgaacgtacattcctcttctttttt

SEQ ID NO: 843252 - DNA, 25 bp, Mus musculus
tgaacgtacattgctcttctttttt

SEQ ID NO: 843253 - DNA, 25 bp, Mus musculus
tgaacgtatgcaaccttaagaaaga

SEQ ID NO: 843254 - DNA, 25 bp, Mus musculus
tgaacgtatgcatccttaagaaaga

SEQ ID NO: 843255 - DNA, 25 bp, Mus musculus
tgaacgtattacagcctgctgcctt

SEQ ID NO: 843256 - DNA, 25 bp, Mus musculus
tgaacgtattactgcctgctgcctt

SEQ ID NO: 843257 - DNA, 25 bp, Mus musculus
tgaacgtccatcaccctgtgggttg

SEQ ID NO: 843258 - DNA, 25 bp, Mus musculus
tgaacgtccatcattttacttgctt

SEQ ID NO: 843259 - DNA, 25 bp, Mus musculus
tgaacgtccatctccctgtgggttg

SEQ ID NO: 843260 - DNA, 25 bp, Mus musculus
tgaacgtccatctttttacttgctt

SEQ ID NO: 843261 - DNA, 25 bp, Mus musculus
tgaacgtccctaacctaaagttctg

SEQ ID NO: 843262 - DNA, 25 bp, Mus musculus
tgaacgtccctatcctaaagttctg

SEQ ID NO: 843263 - DNA, 25 bp, Mus musculus
tgaacgtcccttcggacttgttgcc

SEQ ID NO: 843264 - DNA, 25 bp, Mus musculus
tgaacgtcccttgggacttgttgcc

SEQ ID NO: 843265 - DNA, 25 bp, Mus musculus
tgaacgtcctgcactacgacatgaa

SEQ ID NO: 843266 - DNA, 25 bp, Mus musculus
tgaacgtcctgctctacgacatgaa

SEQ ID NO: 843267 - DNA, 25 bp, Mus musculus
tgaacgtcggctactatccatatgc

SEQ ID NO: 843268 - DNA, 25 bp, Mus musculus
tgaacgtcggcttctatccatatgc

SEQ ID NO: 843269 - DNA, 25 bp, Mus musculus
tgaacgtgacacaagctcgattagc

SEQ ID NO: 843270 - DNA, 25 bp, Mus musculus
tgaacgtgacactagctcgattagc

SEQ ID NO: 843271 - DNA, 25 bp, Mus musculus
tgaacgtgtcttctgaggccggaac

SEQ ID NO: 843272 - DNA, 25 bp, Mus musculus
tgaacgtgtcttgtgaggccggaac

SEQ ID NO: 843273 - DNA, 25 bp, Mus musculus
tgaacgtgtgatcttcctgaagcta

SEQ ID NO: 843274 - DNA, 25 bp, Mus musculus
tgaacgtgtgatgttcctgaagcta

SEQ ID NO: 843275 - DNA, 25 bp, Mus musculus
tgaacgtgttctaactgggcaggaa

SEQ ID NO: 843276 - DNA, 25 bp, Mus musculus
tgaacgtgttcttactgggcaggaa

SEQ ID NO: 843277 - DNA, 25 bp, Mus musculus
tgaacgttccttaggttgctcacaa

SEQ ID NO: 843278 - DNA, 25 bp, Mus musculus
tgaacgttcctttggttgctcacaa

SEQ ID NO: 843279 - DNA, 25 bp, Mus musculus
tgaacgttttccacatgggtagccc

SEQ ID NO: 843280 - DNA, 25 bp, Mus musculus
tgaacgttttcctcatgggtagccc

SEQ ID NO: 843281 - DNA, 25 bp, Mus musculus
tgaacgttttgtcgatcagcgcctc

SEQ ID NO: 843282 - DNA, 25 bp, Mus musculus
tgaacgttttgtggatcagcgcctc

SEQ ID NO: 843283 - DNA, 25 bp, Mus musculus
tgaactaacatacacagctcaggat

SEQ ID NO: 843284 - DNA, 25 bp, Mus musculus
tgaactaacatagacagctcaggat

SEQ ID NO: 843285 - DNA, 25 bp, Mus musculus
tgaactaagagcaggttgccacccc

SEQ ID NO: 843286 - DNA, 25 bp, Mus musculus
tgaactaagagctggttgccacccc

SEQ ID NO: 843287 - DNA, 25 bp, Mus musculus
tgaactacaaccagctgctgctaga

SEQ ID NO: 843288 - DNA, 25 bp, Mus musculus
tgaactacaacctgctgctgctaga

SEQ ID NO: 843289 - DNA, 25 bp, Mus musculus
tgaactacaataccaactccagcca

SEQ ID NO: 843290 - DNA, 25 bp, Mus musculus
tgaactacaatagcaactccagcca

SEQ ID NO: 843291 - DNA, 25 bp, Mus musculus
tgaactacacgtatgtgcccgtcaa

SEQ ID NO: 843292 - DNA, 25 bp, Mus musculus
tgaactacacgtttgtgcccgtcaa

SEQ ID NO: 843293 - DNA, 25 bp, Mus musculus
tgaactaccattaactctgccagaa

SEQ ID NO: 843294 - DNA, 25 bp, Mus musculus
tgaactaccatttactctgccagaa

SEQ ID NO: 843295 - DNA, 25 bp, Mus musculus
tgaactacccagaccaaggtattta

SEQ ID NO: 843296 - DNA, 25 bp, Mus musculus
tgaactacccagtccaaggtattta

SEQ ID NO: 843297 - DNA, 25 bp, Mus musculus
tgaactaccgagattgaaagcttcc

SEQ ID NO: 843298 - DNA, 25 bp, Mus musculus
tgaactaccgagtttgaaagcttcc

SEQ ID NO: 843299 - DNA, 25 bp, Mus musculus
tgaactacctgcagttttctgatga

SEQ ID NO: 843300 - DNA, 25 bp, Mus musculus
tgaactacctgctgttttctgatga

SEQ ID NO: 843301 - DNA, 25 bp, Mus musculus
tgaactactatgagattgcttctgt

SEQ ID NO: 843302 - DNA, 25 bp, Mus musculus
tgaactactatgtgattgcttctgt

SEQ ID NO: 843303 - DNA, 25 bp, Mus musculus
tgaactactggacgccaatcctaaa

SEQ ID NO: 843304 - DNA, 25 bp, Mus musculus
tgaactactggaggccaatcctaaa

SEQ ID NO: 843305 - DNA, 25 bp, Mus musculus
tgaactactggcacatcatccgatt

SEQ ID NO: 843306 - DNA, 25 bp, Mus musculus
tgaactactggctcatcatccgatt

SEQ ID NO: 843307 - DNA, 25 bp, Mus musculus
tgaactactgttatgggtcctgtgg

SEQ ID NO: 843308 - DNA, 25 bp, Mus musculus
tgaactactgttttgggtcctgtgg

SEQ ID NO: 843309 - DNA, 25 bp, Mus musculus
tgaactacttcaatggtggctgcgc

SEQ ID NO: 843310 - DNA, 25 bp, Mus musculus
tgaactacttcattggtggctgcgc

SEQ ID NO: 843311 - DNA, 25 bp, Mus musculus
tgaactacttccactaaaaataaca

SEQ ID NO: 843312 - DNA, 25 bp, Mus musculus
tgaactacttcctctaaaaataaca

SEQ ID NO: 843313 - DNA, 25 bp, Mus musculus
tgaactagagtaagcagccactgtg

SEQ ID NO: 843314 - DNA, 25 bp, Mus musculus
tgaactagagtatgcagccactgtg

SEQ ID NO: 843315 - DNA, 25 bp, Mus musculus
tgaactagcatcccaccatcagcat

SEQ ID NO: 843316 - DNA, 25 bp, Mus musculus
tgaactagcatcgcaccatcagcat

SEQ ID NO: 843317 - DNA, 25 bp, Mus musculus
tgaactagccaccatatctctgttt

SEQ ID NO: 843318 - DNA, 25 bp, Mus musculus
tgaactagccacgatatctctgttt

SEQ ID NO: 843319 - DNA, 25 bp, Mus musculus
tgaactaggtaacccagagccactg

SEQ ID NO: 843320 - DNA, 25 bp, Mus musculus
tgaactaggtaagccagagccactg

SEQ ID NO: 843321 - DNA, 25 bp, Mus musculus
tgaactagttgactcgctgcgcaca

SEQ ID NO: 843322 - DNA, 25 bp, Mus musculus
tgaactagttgagtcgctgcgcaca

SEQ ID NO: 843323 - DNA, 25 bp, Mus musculus
tgaactatccctaagtggatcccca

SEQ ID NO: 843324 - DNA, 25 bp, Mus musculus
tgaactatcccttagtggatcccca

SEQ ID NO: 843325 - DNA, 25 bp, Mus musculus
tgaactatgagtagggaccctgtct

SEQ ID NO: 843326 - DNA, 25 bp, Mus musculus
tgaactatgagttgggaccctgtct

SEQ ID NO: 843327 - DNA, 25 bp, Mus musculus
tgaactatgtctccagcctgtgatt

SEQ ID NO: 843328 - DNA, 25 bp, Mus musculus
tgaactatgtctgcagcctgtgatt

SEQ ID NO: 843329 - DNA, 25 bp, Mus musculus
tgaactattggaagatcagcagcac

SEQ ID NO: 843330 - DNA, 25 bp, Mus musculus
tgaactattggatgatcagcagcac

SEQ ID NO: 843331 - DNA, 25 bp, Mus musculus
tgaactatttccaacctccatttag

SEQ ID NO: 843332 - DNA, 25 bp, Mus musculus
tgaactatttcctacctccatttag

SEQ ID NO: 843333 - DNA, 25 bp, Mus musculus
tgaactcaaaagaaacttcaagagg

SEQ ID NO: 843334 - DNA, 25 bp, Mus musculus
tgaactcaaaagtaacttcaagagg

SEQ ID NO: 843335 - DNA, 25 bp, Mus musculus
tgaactcaacgcctcgaggctggac

SEQ ID NO: 843336 - DNA, 25 bp, Mus musculus
tgaactcaacgcgtcgaggctggac

SEQ ID NO: 843337 - DNA, 25 bp, Mus musculus
tgaactcaatcacccaatccagcaa

SEQ ID NO: 843338 - DNA, 25 bp, Mus musculus
tgaactcaatcagccaatccagcaa

SEQ ID NO: 843339 - DNA, 25 bp, Mus musculus
tgaactcacatcatccaagtgctgg

SEQ ID NO: 843340 - DNA, 25 bp, Mus musculus
tgaactcacatcttccaagtgctgg

SEQ ID NO: 843341 - DNA, 25 bp, Mus musculus
tgaactcaccaaatagccaaacatg

SEQ ID NO: 843342 - DNA, 25 bp, Mus musculus
tgaactcaccaattagccaaacatg

SEQ ID NO: 843343 - DNA, 25 bp, Mus musculus
tgaactcacgccagcctagcatatc

SEQ ID NO: 843344 - DNA, 25 bp, Mus musculus
tgaactcacgcctgcctagcatatc

SEQ ID NO: 843345 - DNA, 25 bp, Mus musculus
tgaactcacgtgcttgtgacagcat

SEQ ID NO: 843346 - DNA, 25 bp, Mus musculus
tgaactcacgtggttgtgacagcat

SEQ ID NO: 843347 - DNA, 25 bp, Mus musculus
tgaactcagagtacacctctccagc

SEQ ID NO: 843348 - DNA, 25 bp, Mus musculus
tgaactcagagttcacctctccagc

SEQ ID NO: 843349 - DNA, 25 bp, Mus musculus
tgaactcagatcaacgtgcatccca

SEQ ID NO: 843350 - DNA, 25 bp, Mus musculus
tgaactcagatctacgtgcatccca

SEQ ID NO: 843351 - DNA, 25 bp, Mus musculus
tgaactcagatgaccagtcctggtg

SEQ ID NO: 843352 - DNA, 25 bp, Mus musculus
tgaactcagatgtccagtcctggtg

SEQ ID NO: 843353 - DNA, 25 bp, Mus musculus
tgaactcagctacgcagggcactaa

SEQ ID NO: 843354 - DNA, 25 bp, Mus musculus
tgaactcagctaggcagggcactaa

SEQ ID NO: 843355 - DNA, 25 bp, Mus musculus
tgaactcaggacattatgctagcac

SEQ ID NO: 843356 - DNA, 25 bp, Mus musculus
tgaactcaggactttatgctagcac

SEQ ID NO: 843357 - DNA, 25 bp, Mus musculus
tgaactcaggatctaccagcctcag

SEQ ID NO: 843358 - DNA, 25 bp, Mus musculus
tgaactcaggatgtaccagcctcag

SEQ ID NO: 843359 - DNA, 25 bp, Mus musculus
tgaactcaggtaattaggcttttgt

SEQ ID NO: 843360 - DNA, 25 bp, Mus musculus
tgaactcaggtatttaggcttttgt

SEQ ID NO: 843361 - DNA, 25 bp, Mus musculus
tgaactcagttcatccaccacagag

SEQ ID NO: 843362 - DNA, 25 bp, Mus musculus
tgaactcagttcttccaccacagag

SEQ ID NO: 843363 - DNA, 25 bp, Mus musculus
tgaactcatctcctcgaagccataa

SEQ ID NO: 843364 - DNA, 25 bp, Mus musculus
tgaactcatctcgtcgaagccataa

SEQ ID NO: 843365 - DNA, 25 bp, Mus musculus
tgaactcatggcaattctctttcct

SEQ ID NO: 843366 - DNA, 25 bp, Mus musculus
tgaactcatggctattctctttcct

SEQ ID NO: 843367 - DNA, 25 bp, Mus musculus
tgaactcatgtgaatattcctcccc

SEQ ID NO: 843368 - DNA, 25 bp, Mus musculus
tgaactcatgtgtatattcctcccc

SEQ ID NO: 843369 - DNA, 25 bp, Mus musculus
tgaactcattatctcccgatgcatc

SEQ ID NO: 843370 - DNA, 25 bp, Mus musculus
tgaactcattatgtcccgatgcatc

SEQ ID NO: 843371 - DNA, 25 bp, Mus musculus
tgaactcattcaccttttcccaaga

SEQ ID NO: 843372 - DNA, 25 bp, Mus musculus
tgaactcattcagcttttcccaaga

SEQ ID NO: 843373 - DNA, 25 bp, Mus musculus
tgaactcatttacaagacctcgctc

SEQ ID NO: 843374 - DNA, 25 bp, Mus musculus
tgaactcatttagaagacctcgctc

SEQ ID NO: 843375 - DNA, 25 bp, Mus musculus
tgaactcattttctggtccaggccc

SEQ ID NO: 843376 - DNA, 25 bp, Mus musculus
tgaactcattttgtggtccaggccc

SEQ ID NO: 843377 - DNA, 25 bp, Mus musculus
tgaactccacgtatgcagtgagaaa

SEQ ID NO: 843378 - DNA, 25 bp, Mus musculus
tgaactccacgtttgcagtgagaaa

SEQ ID NO: 843379 - DNA, 25 bp, Mus musculus
tgaactccaggaccacggatggcag

SEQ ID NO: 843380 - DNA, 25 bp, Mus musculus
tgaactccaggagcacggatggcag

SEQ ID NO: 843381 - DNA, 25 bp, Mus musculus
tgaactccaggcactccaaaagtga

SEQ ID NO: 843382 - DNA, 25 bp, Mus musculus
tgaactccaggctctccaaaagtga

SEQ ID NO: 843383 - DNA, 25 bp, Mus musculus
tgaactcccaagctggctactccag

SEQ ID NO: 843384 - DNA, 25 bp, Mus musculus
tgaactcccaaggtggctactccag

SEQ ID NO: 843385 - DNA, 25 bp, Mus musculus
tgaactcccaggagaaagcaccccg

SEQ ID NO: 843386 - DNA, 25 bp, Mus musculus
tgaactcccaggtgaaagcaccccg

SEQ ID NO: 843387 - DNA, 25 bp, Mus musculus
tgaactcccgcaaatttcaaccgta

SEQ ID NO: 843388 - DNA, 25 bp, Mus musculus
tgaactcccgcatatttcaaccgta

SEQ ID NO: 843389 - DNA, 25 bp, Mus musculus
tgaactccctccattgctgaataag

SEQ ID NO: 843390 - DNA, 25 bp, Mus musculus
tgaactccctcctttgctgaataag

SEQ ID NO: 843391 - DNA, 25 bp, Mus musculus
tgaactccgtagcacactgagacct

SEQ ID NO: 843392 - DNA, 25 bp, Mus musculus
tgaactccgtaggacactgagacct

SEQ ID NO: 843393 - DNA, 25 bp, Mus musculus
tgaactcctttactcacctttggca

SEQ ID NO: 843394 - DNA, 25 bp, Mus musculus
tgaactcctttagtcacctttggca

SEQ ID NO: 843395 - DNA, 25 bp, Mus musculus
tgaactcgatcccaaacaggtgttt

SEQ ID NO: 843396 - DNA, 25 bp, Mus musculus
tgaactcgatccgaaacaggtgttt

SEQ ID NO: 843397 - DNA, 25 bp, Mus musculus
tgaactcggagcacgtcgggttaca

SEQ ID NO: 843398 - DNA, 25 bp, Mus musculus
tgaactcggagctcgtcgggttaca

SEQ ID NO: 843399 - DNA, 25 bp, Mus musculus
tgaactcgtcagacagagcaccgca

SEQ ID NO: 843400 - DNA, 25 bp, Mus musculus
tgaactcgtcagtcagagcaccgca

SEQ ID NO: 843401 - DNA, 25 bp, Mus musculus
tgaactcgtgctacactctctttgg

SEQ ID NO: 843402 - DNA, 25 bp, Mus musculus
tgaactcgtgcttcactctctttgg

SEQ ID NO: 843403 - DNA, 25 bp, Mus musculus
tgaactctaatcaagcctgcaacca

SEQ ID NO: 843404 - DNA, 25 bp, Mus musculus
tgaactctaatctagcctgcaacca

SEQ ID NO: 843405 - DNA, 25 bp, Mus musculus
tgaactctacatctgctacagccca

SEQ ID NO: 843406 - DNA, 25 bp, Mus musculus
tgaactctacatgtgctacagccca

SEQ ID NO: 843407 - DNA, 25 bp, Mus musculus
tgaactctagccagcacagtgacag

SEQ ID NO: 843408 - DNA, 25 bp, Mus musculus
tgaactctagccatgccttagctgg

SEQ ID NO: 843409 - DNA, 25 bp, Mus musculus
tgaactctagcctgcacagtgacag

SEQ ID NO: 843410 - DNA, 25 bp, Mus musculus
tgaactctagccttgccttagctgg

SEQ ID NO: 843411 - DNA, 25 bp, Mus musculus
tgaactctaggtcagctgggatgca

SEQ ID NO: 843412 - DNA, 25 bp, Mus musculus
tgaactctaggtgagctgggatgca

SEQ ID NO: 843413 - DNA, 25 bp, Mus musculus
tgaactctcaccagtagaactcagg

SEQ ID NO: 843414 - DNA, 25 bp, Mus musculus
tgaactctcacctgtagaactcagg

SEQ ID NO: 843415 - DNA, 25 bp, Mus musculus
tgaactctctcactgattacttgat

SEQ ID NO: 843416 - DNA, 25 bp, Mus musculus
tgaactctctcagtgattacttgat

SEQ ID NO: 843417 - DNA, 25 bp, Mus musculus
tgaactctctgtaggtctcacggat

SEQ ID NO: 843418 - DNA, 25 bp, Mus musculus
tgaactctctgttggtctcacggat

SEQ ID NO: 843419 - DNA, 25 bp, Mus musculus
tgaactctgacacggtgacagggac

SEQ ID NO: 843420 - DNA, 25 bp, Mus musculus
tgaactctgacagggtgacagggac

SEQ ID NO: 843421 - DNA, 25 bp, Mus musculus
tgaactctgaccacaggaggctctg

SEQ ID NO: 843422 - DNA, 25 bp, Mus musculus
tgaactctgacctcaggaggctctg

SEQ ID NO: 843423 - DNA, 25 bp, Mus musculus
tgaactctgatacagttcttcagta

SEQ ID NO: 843424 - DNA, 25 bp, Mus musculus
tgaactctgatagagttcttcagta

SEQ ID NO: 843425 - DNA, 25 bp, Mus musculus
tgaactctgcaccaagtccttttaa

SEQ ID NO: 843426 - DNA, 25 bp, Mus musculus
tgaactctgcacgaagtccttttaa

SEQ ID NO: 843427 - DNA, 25 bp, Mus musculus
tgaactctgcctagggccagtacca

SEQ ID NO: 843428 - DNA, 25 bp, Mus musculus
tgaactctgcctcaagggccttaac

SEQ ID NO: 843429 - DNA, 25 bp, Mus musculus
tgaactctgcctgaagggccttaac

SEQ ID NO: 843430 - DNA, 25 bp, Mus musculus
tgaactctgccttgggccagtacca

SEQ ID NO: 843431 - DNA, 25 bp, Mus musculus
tgaactctgggactgctgttgccta

SEQ ID NO: 843432 - DNA, 25 bp, Mus musculus
tgaactctgggagtgctgttgccta

SEQ ID NO: 843433 - DNA, 25 bp, Mus musculus
tgaactctgggcctttcttgctggg

SEQ ID NO: 843434 - DNA, 25 bp, Mus musculus
tgaactctgggcgtttcttgctggg

SEQ ID NO: 843435 - DNA, 25 bp, Mus musculus
tgaactctggtaacagccactgctg

SEQ ID NO: 843436 - DNA, 25 bp, Mus musculus
tgaactctggtatcagccactgctg

SEQ ID NO: 843437 - DNA, 25 bp, Mus musculus
tgaactcttacccaggctcactgtc

SEQ ID NO: 843438 - DNA, 25 bp, Mus musculus
tgaactcttaccgaggctcactgtc

SEQ ID NO: 843439 - DNA, 25 bp, Mus musculus
tgaactcttcagaaacagacttcct

SEQ ID NO: 843440 - DNA, 25 bp, Mus musculus
tgaactcttcagaatgctcagcgct

SEQ ID NO: 843441 - DNA, 25 bp, Mus musculus
tgaactcttcagtaacagacttcct

SEQ ID NO: 843442 - DNA, 25 bp, Mus musculus
tgaactcttcagtatgctcagcgct

SEQ ID NO: 843443 - DNA, 25 bp, Mus musculus
tgaactcttgacatgctatttgatg

SEQ ID NO: 843444 - DNA, 25 bp, Mus musculus
tgaactcttgacttgctatttgatg

SEQ ID NO: 843445 - DNA, 25 bp, Mus musculus
tgaactcttggcactctgttactta

SEQ ID NO: 843446 - DNA, 25 bp, Mus musculus
tgaactcttggctctctgttactta

SEQ ID NO: 843447 - DNA, 25 bp, Mus musculus
tgaactcttgtgatcagtctttcta

SEQ ID NO: 843448 - DNA, 25 bp, Mus musculus
tgaactcttgtgttcagtctttcta

SEQ ID NO: 843449 - DNA, 25 bp, Mus musculus
tgaactcttttaaccttccaagtgt

SEQ ID NO: 843450 - DNA, 25 bp, Mus musculus
tgaactcttttatccttccaagtgt

SEQ ID NO: 843451 - DNA, 25 bp, Mus musculus
tgaactctttttcaggcccatcatt

SEQ ID NO: 843452 - DNA, 25 bp, Mus musculus
tgaactctttttgaggcccatcatt

SEQ ID NO: 843453 - DNA, 25 bp, Mus musculus
tgaactgaaacgcacacttgaacaa

SEQ ID NO: 843454 - DNA, 25 bp, Mus musculus
tgaactgaaacggacacttgaacaa

SEQ ID NO: 843455 - DNA, 25 bp, Mus musculus
tgaactgaaagaaaattcccaaaaa

SEQ ID NO: 843456 - DNA, 25 bp, Mus musculus
tgaactgaaagataattcccaaaaa

SEQ ID NO: 843457 - DNA, 25 bp, Mus musculus
tgaactgaacggctcccttgggatt

SEQ ID NO: 843458 - DNA, 25 bp, Mus musculus
tgaactgaacgggtcccttgggatt

SEQ ID NO: 843459 - DNA, 25 bp, Mus musculus
tgaactgaagagatgttgtctactt

SEQ ID NO: 843460 - DNA, 25 bp, Mus musculus
tgaactgaagagttgttgtctactt

SEQ ID NO: 843461 - DNA, 25 bp, Mus musculus
tgaactgaaggcaggagtcacatgg

SEQ ID NO: 843462 - DNA, 25 bp, Mus musculus
tgaactgaaggctggagtcacatgg

SEQ ID NO: 843463 - DNA, 25 bp, Mus musculus
tgaactgacaacacctacctttcag

SEQ ID NO: 843464 - DNA, 25 bp, Mus musculus
tgaactgacaactcctacctttcag

SEQ ID NO: 843465 - DNA, 25 bp, Mus musculus
tgaactgactcaagtagccatctcc

SEQ ID NO: 843466 - DNA, 25 bp, Mus musculus
tgaactgactcatgtagccatctcc

SEQ ID NO: 843467 - DNA, 25 bp, Mus musculus
tgaactgactggactcaagcctacg

SEQ ID NO: 843468 - DNA, 25 bp, Mus musculus
tgaactgactggtctcaagcctacg

SEQ ID NO: 843469 - DNA, 25 bp, Mus musculus
tgaactgagactcttctggagaagg

SEQ ID NO: 843470 - DNA, 25 bp, Mus musculus
tgaactgagactgttctggagaagg

SEQ ID NO: 843471 - DNA, 25 bp, Mus musculus
tgaactgagtaccttccacctcttg

SEQ ID NO: 843472 - DNA, 25 bp, Mus musculus
tgaactgagtacgttccacctcttg

SEQ ID NO: 843473 - DNA, 25 bp, Mus musculus
tgaactgagtagatgctgtggccct

SEQ ID NO: 843474 - DNA, 25 bp, Mus musculus
tgaactgagtagttgctgtggccct

SEQ ID NO: 843475 - DNA, 25 bp, Mus musculus
tgaactgagtgacgcggctctcgct

SEQ ID NO: 843476 - DNA, 25 bp, Mus musculus
tgaactgagtgaggcggctctcgct

SEQ ID NO: 843477 - DNA, 25 bp, Mus musculus
tgaactgagtgccatttccatgttg

SEQ ID NO: 843478 - DNA, 25 bp, Mus musculus
tgaactgagtgcgatttccatgttg

SEQ ID NO: 843479 - DNA, 25 bp, Mus musculus
tgaactgatcacaccacagggctat

SEQ ID NO: 843480 - DNA, 25 bp, Mus musculus
tgaactgatcactccacagggctat

SEQ ID NO: 843481 - DNA, 25 bp, Mus musculus
tgaactgatcttcccttgacgatat

SEQ ID NO: 843482 - DNA, 25 bp, Mus musculus
tgaactgatcttgccttgacgatat

SEQ ID NO: 843483 - DNA, 25 bp, Mus musculus
tgaactgcacagactctgagccatc

SEQ ID NO: 843484 - DNA, 25 bp, Mus musculus
tgaactgcacagtctctgagccatc

SEQ ID NO: 843485 - DNA, 25 bp, Mus musculus
tgaactgcatcaagactccaatcct

SEQ ID NO: 843486 - DNA, 25 bp, Mus musculus
tgaactgcatcatgactccaatcct

SEQ ID NO: 843487 - DNA, 25 bp, Mus musculus
tgaactgcatgacgcgtttcgcgaa

SEQ ID NO: 843488 - DNA, 25 bp, Mus musculus
tgaactgcatgaggcgtttcgcgaa

SEQ ID NO: 843489 - DNA, 25 bp, Mus musculus
tgaactgcatgtcgctattcctggg

SEQ ID NO: 843490 - DNA, 25 bp, Mus musculus
tgaactgcatgtggctattcctggg

SEQ ID NO: 843491 - DNA, 25 bp, Mus musculus
tgaactgcatttctctcctttgcat

SEQ ID NO: 843492 - DNA, 25 bp, Mus musculus
tgaactgcatttgtctcctttgcat

SEQ ID NO: 843493 - DNA, 25 bp, Mus musculus
tgaactgccaagagcctgcttagga

SEQ ID NO: 843494 - DNA, 25 bp, Mus musculus
tgaactgccaagtgcctgcttagga

SEQ ID NO: 843495 - DNA, 25 bp, Mus musculus
tgaactgccccacattctgtagcca

SEQ ID NO: 843496 - DNA, 25 bp, Mus musculus
tgaactgccccagattctgtagcca

SEQ ID NO: 843497 - DNA, 25 bp, Mus musculus
tgaactgccctcagagtgctcatat

SEQ ID NO: 843498 - DNA, 25 bp, Mus musculus
tgaactgccctctgagtgctcatat

SEQ ID NO: 843499 - DNA, 25 bp, Mus musculus
tgaactgccctgagggtggaagctc

SEQ ID NO: 843500 - DNA, 25 bp, Mus musculus
tgaactgccctgcagatcatggcca

SEQ ID NO: 843501 - DNA, 25 bp, Mus musculus
tgaactgccctggagatcatggcca

SEQ ID NO: 843502 - DNA, 25 bp, Mus musculus
tgaactgccctgtgggtggaagctc

SEQ ID NO: 843503 - DNA, 25 bp, Mus musculus
tgaactgccgtgcttaacccgggct

SEQ ID NO: 843504 - DNA, 25 bp, Mus musculus
tgaactgccgtggttaacccgggct

SEQ ID NO: 843505 - DNA, 25 bp, Mus musculus
tgaactgccttgcatcagtgatcac

SEQ ID NO: 843506 - DNA, 25 bp, Mus musculus
tgaactgccttggatcagtgatcac

SEQ ID NO: 843507 - DNA, 25 bp, Mus musculus
tgaactgctcggaaagccctggtat

SEQ ID NO: 843508 - DNA, 25 bp, Mus musculus
tgaactgctcggtaagccctggtat

SEQ ID NO: 843509 - DNA, 25 bp, Mus musculus
tgaactgctgagatctacatctata

SEQ ID NO: 843510 - DNA, 25 bp, Mus musculus
tgaactgctgagttctacatctata

SEQ ID NO: 843511 - DNA, 25 bp, Mus musculus
tgaactgctgctactatggaatttt

SEQ ID NO: 843512 - DNA, 25 bp, Mus musculus
tgaactgctgcttctatggaatttt

SEQ ID NO: 843513 - DNA, 25 bp, Mus musculus
tgaactgctgtcactaccagctgag

SEQ ID NO: 843514 - DNA, 25 bp, Mus musculus
tgaactgctgtctctaccagctgag

SEQ ID NO: 843515 - DNA, 25 bp, Mus musculus
tgaactgcttctatattcttgctgt

SEQ ID NO: 843516 - DNA, 25 bp, Mus musculus
tgaactgcttctttattcttgctgt

SEQ ID NO: 843517 - DNA, 25 bp, Mus musculus
tgaactgctttaaatgggtttccaa

SEQ ID NO: 843518 - DNA, 25 bp, Mus musculus
tgaactgctttatatgggtttccaa

SEQ ID NO: 843519 - DNA, 25 bp, Mus musculus
tgaactggaatgactccgtctgatg

SEQ ID NO: 843520 - DNA, 25 bp, Mus musculus
tgaactggaatgtctccgtctgatg

SEQ ID NO: 843521 - DNA, 25 bp, Mus musculus
tgaactggacagagaacctacccct

SEQ ID NO: 843522 - DNA, 25 bp, Mus musculus
tgaactggacagtgaacctacccct

SEQ ID NO: 843523 - DNA, 25 bp, Mus musculus
tgaactggagtaaggcacacctgca

SEQ ID NO: 843524 - DNA, 25 bp, Mus musculus
tgaactggagtatggcacacctgca

SEQ ID NO: 843525 - DNA, 25 bp, Mus musculus
tgaactggcagcacgccgaaggaga

SEQ ID NO: 843526 - DNA, 25 bp, Mus musculus
tgaactggcagctcgccgaaggaga

SEQ ID NO: 843527 - DNA, 25 bp, Mus musculus
tgaactgggaatagaggcccacagt

SEQ ID NO: 843528 - DNA, 25 bp, Mus musculus
tgaactgggaattgaggcccacagt

SEQ ID NO: 843529 - DNA, 25 bp, Mus musculus
tgaactgggtaaacccctttcgcat

SEQ ID NO: 843530 - DNA, 25 bp, Mus musculus
tgaactgggtaatcccctttcgcat

SEQ ID NO: 843531 - DNA, 25 bp, Mus musculus
tgaactgggtacctcctatcttgat

SEQ ID NO: 843532 - DNA, 25 bp, Mus musculus
tgaactgggtacgtcctatcttgat

SEQ ID NO: 843533 - DNA, 25 bp, Mus musculus
tgaactgggtggatacctccagcct

SEQ ID NO: 843534 - DNA, 25 bp, Mus musculus
tgaactgggtggttacctccagcct

SEQ ID NO: 843535 - DNA, 25 bp, Mus musculus
tgaactgggtttcaaaacatgccaa

SEQ ID NO: 843536 - DNA, 25 bp, Mus musculus
tgaactgggtttgaaaacatgccaa

SEQ ID NO: 843537 - DNA, 25 bp, Mus musculus
tgaactggtcgcatggttttatttt

SEQ ID NO: 843538 - DNA, 25 bp, Mus musculus
tgaactggtcgcttggttttatttt

SEQ ID NO: 843539 - DNA, 25 bp, Mus musculus
tgaactggtcttctttcttagtttt

SEQ ID NO: 843540 - DNA, 25 bp, Mus musculus
tgaactggtcttgtttcttagtttt

SEQ ID NO: 843541 - DNA, 25 bp, Mus musculus
tgaactggtgatcgcccaggccaat

SEQ ID NO: 843542 - DNA, 25 bp, Mus musculus
tgaactggtgatggcccaggccaat

SEQ ID NO: 843543 - DNA, 25 bp, Mus musculus
tgaactgtactgagcgcctcgtgca

SEQ ID NO: 843544 - DNA, 25 bp, Mus musculus
tgaactgtactgtgcgcctcgtgca

SEQ ID NO: 843545 - DNA, 25 bp, Mus musculus
tgaactgtagtcactgagatgggaa

SEQ ID NO: 843546 - DNA, 25 bp, Mus musculus
tgaactgtagtctctgagatgggaa

SEQ ID NO: 843547 - DNA, 25 bp, Mus musculus
tgaactgtcactaacacaccacatg

SEQ ID NO: 843548 - DNA, 25 bp, Mus musculus
tgaactgtcacttacacaccacatg

SEQ ID NO: 843549 - DNA, 25 bp, Mus musculus
tgaactgtcagtctggtctgcctca

SEQ ID NO: 843550 - DNA, 25 bp, Mus musculus
tgaactgtcagtgtggtctgcctca

SEQ ID NO: 843551 - DNA, 25 bp, Mus musculus
tgaactgtccacaaaccatcacaaa

SEQ ID NO: 843552 - DNA, 25 bp, Mus musculus
tgaactgtccactaaccatcacaaa

SEQ ID NO: 843553 - DNA, 25 bp, Mus musculus
tgaactgtccctcggtgtatcaacc

SEQ ID NO: 843554 - DNA, 25 bp, Mus musculus
tgaactgtccctgggtgtatcaacc

SEQ ID NO: 843555 - DNA, 25 bp, Mus musculus
tgaactgtcctcatgctctgtcttt

SEQ ID NO: 843556 - DNA, 25 bp, Mus musculus
tgaactgtcctcttgctctgtcttt

SEQ ID NO: 843557 - DNA, 25 bp, Mus musculus
tgaactgtctatcctgttgttttgt

SEQ ID NO: 843558 - DNA, 25 bp, Mus musculus
tgaactgtctatgctgttgttttgt

SEQ ID NO: 843559 - DNA, 25 bp, Mus musculus
tgaactgtctgcactagcttgctca

SEQ ID NO: 843560 - DNA, 25 bp, Mus musculus
tgaactgtctgctctagcttgctca

SEQ ID NO: 843561 - DNA, 25 bp, Mus musculus
tgaactgtgacaagctgccgaacca

SEQ ID NO: 843562 - DNA, 25 bp, Mus musculus
tgaactgtgacatgctgccgaacca

SEQ ID NO: 843563 - DNA, 25 bp, Mus musculus
tgaactgtgcaccatacccgaggcg

SEQ ID NO: 843564 - DNA, 25 bp, Mus musculus
tgaactgtgcacgatacccgaggcg

SEQ ID NO: 843565 - DNA, 25 bp, Mus musculus
tgaactgtgccaccttcacagcggg

SEQ ID NO: 843566 - DNA, 25 bp, Mus musculus
tgaactgtgccagcttcacagcggg

SEQ ID NO: 843567 - DNA, 25 bp, Mus musculus
tgaactgtgcccagtactgcggtca

SEQ ID NO: 843568 - DNA, 25 bp, Mus musculus
tgaactgtgccctgtactgcggtca

SEQ ID NO: 843569 - DNA, 25 bp, Mus musculus
tgaactgtgctgcttactggctgcc

SEQ ID NO: 843570 - DNA, 25 bp, Mus musculus
tgaactgtgctggttactggctgcc

SEQ ID NO: 843571 - DNA, 25 bp, Mus musculus
tgaactgtggccacgatggactgca

SEQ ID NO: 843572 - DNA, 25 bp, Mus musculus
tgaactgtggcctcgatggactgca

SEQ ID NO: 843573 - DNA, 25 bp, Mus musculus
tgaactgtggctccagtcctaaggc

SEQ ID NO: 843574 - DNA, 25 bp, Mus musculus
tgaactgtggctgcagtcctaaggc

SEQ ID NO: 843575 - DNA, 25 bp, Mus musculus
tgaactgtggtgatacccctagcag

SEQ ID NO: 843576 - DNA, 25 bp, Mus musculus
tgaactgtggtgttacccctagcag

SEQ ID NO: 843577 - DNA, 25 bp, Mus musculus
tgaactgtgtataccatgctagctg

SEQ ID NO: 843578 - DNA, 25 bp, Mus musculus
tgaactgtgtattccatgctagctg

SEQ ID NO: 843579 - DNA, 25 bp, Mus musculus
tgaactgtgttgagcctttgggctc

SEQ ID NO: 843580 - DNA, 25 bp, Mus musculus
tgaactgtgttgtgcctttgggctc

SEQ ID NO: 843581 - DNA, 25 bp, Mus musculus
tgaactgttaatctctctgggattt

SEQ ID NO: 843582 - DNA, 25 bp, Mus musculus
tgaactgttaatgtctctgggattt

SEQ ID NO: 843583 - DNA, 25 bp, Mus musculus
tgaactgttcctagttccacctaaa

SEQ ID NO: 843584 - DNA, 25 bp, Mus musculus
tgaactgttccttgttccacctaaa

SEQ ID NO: 843585 - DNA, 25 bp, Mus musculus
tgaactgttcggctctgtaagatct

SEQ ID NO: 843586 - DNA, 25 bp, Mus musculus
tgaactgttcgggtctgtaagatct

SEQ ID NO: 843587 - DNA, 25 bp, Mus musculus
tgaactgttctcagaacctctctca

SEQ ID NO: 843588 - DNA, 25 bp, Mus musculus
tgaactgttctcctggacttttcct

SEQ ID NO: 843589 - DNA, 25 bp, Mus musculus
tgaactgttctcgtggacttttcct

SEQ ID NO: 843590 - DNA, 25 bp, Mus musculus
tgaactgttctctgaacctctctca

SEQ ID NO: 843591 - DNA, 25 bp, Mus musculus
tgaactgtttgcacacagacatggc

SEQ ID NO: 843592 - DNA, 25 bp, Mus musculus
tgaactgtttgctcacagacatggc

SEQ ID NO: 843593 - DNA, 25 bp, Mus musculus
tgaactgtttgtatccactctgttc

SEQ ID NO: 843594 - DNA, 25 bp, Mus musculus
tgaactgtttgtttccactctgttc

SEQ ID NO: 843595 - DNA, 25 bp, Mus musculus
tgaacttaaagacgaactacccgag

SEQ ID NO: 843596 - DNA, 25 bp, Mus musculus
tgaacttaaagaggaactacccgag

SEQ ID NO: 843597 - DNA, 25 bp, Mus musculus
tgaacttaaatcagactttgtctca

SEQ ID NO: 843598 - DNA, 25 bp, Mus musculus
tgaacttaaatctgactttgtctca

SEQ ID NO: 843599 - DNA, 25 bp, Mus musculus
tgaacttaagggattagacgtagat

SEQ ID NO: 843600 - DNA, 25 bp, Mus musculus
tgaacttaagggtttagacgtagat

SEQ ID NO: 843601 - DNA, 25 bp, Mus musculus
tgaacttacaggctcagggcatact

SEQ ID NO: 843602 - DNA, 25 bp, Mus musculus
tgaacttacagggtcagggcatact

SEQ ID NO: 843603 - DNA, 25 bp, Mus musculus
tgaacttaccccaaggaactcgaca

SEQ ID NO: 843604 - DNA, 25 bp, Mus musculus
tgaacttacccctaggaactcgaca

SEQ ID NO: 843605 - DNA, 25 bp, Mus musculus
tgaacttagaagaggaatctcctct

SEQ ID NO: 843606 - DNA, 25 bp, Mus musculus
tgaacttagaagtggaatctcctct

SEQ ID NO: 843607 - DNA, 25 bp, Mus musculus
tgaacttagccaccacttgacgagt

SEQ ID NO: 843608 - DNA, 25 bp, Mus musculus
tgaacttagccagcacttgacgagt

SEQ ID NO: 843609 - DNA, 25 bp, Mus musculus
tgaacttatgacaaaccccagacaa

SEQ ID NO: 843610 - DNA, 25 bp, Mus musculus
tgaacttatgactaaccccagacaa

SEQ ID NO: 843611 - DNA, 25 bp, Mus musculus
tgaacttattatccggtcccttctg

SEQ ID NO: 843612 - DNA, 25 bp, Mus musculus
tgaacttattatgcggtcccttctg

SEQ ID NO: 843613 - DNA, 25 bp, Mus musculus
tgaacttcaactcctgcatggaccc

SEQ ID NO: 843614 - DNA, 25 bp, Mus musculus
tgaacttcaactgctgcatggaccc

SEQ ID NO: 843615 - DNA, 25 bp, Mus musculus
tgaacttcaatacctgccttcctca

SEQ ID NO: 843616 - DNA, 25 bp, Mus musculus
tgaacttcaatagctgccttcctca

SEQ ID NO: 843617 - DNA, 25 bp, Mus musculus
tgaacttcagatacatccctgtgct

SEQ ID NO: 843618 - DNA, 25 bp, Mus musculus
tgaacttcagattcatccctgtgct

SEQ ID NO: 843619 - DNA, 25 bp, Mus musculus
tgaacttcagccagggtcgccctct

SEQ ID NO: 843620 - DNA, 25 bp, Mus musculus
tgaacttcagcctgggtcgccctct

SEQ ID NO: 843621 - DNA, 25 bp, Mus musculus
tgaacttcagtcaaacctttttctg

SEQ ID NO: 843622 - DNA, 25 bp, Mus musculus
tgaacttcagtctaacctttttctg

SEQ ID NO: 843623 - DNA, 25 bp, Mus musculus
tgaacttcagtgcttacacaggccc

SEQ ID NO: 843624 - DNA, 25 bp, Mus musculus
tgaacttcagtggttacacaggccc

SEQ ID NO: 843625 - DNA, 25 bp, Mus musculus
tgaacttcatctcaatggccctctg

SEQ ID NO: 843626 - DNA, 25 bp, Mus musculus
tgaacttcatctgaatggccctctg

SEQ ID NO: 843627 - DNA, 25 bp, Mus musculus
tgaacttccagaaaccttggttgat

SEQ ID NO: 843628 - DNA, 25 bp, Mus musculus
tgaacttccagataccttggttgat

SEQ ID NO: 843629 - DNA, 25 bp, Mus musculus
tgaacttccagtcttgcctcagctg

SEQ ID NO: 843630 - DNA, 25 bp, Mus musculus
tgaacttccagtgttgcctcagctg

SEQ ID NO: 843631 - DNA, 25 bp, Mus musculus
tgaacttcccatccaatgtccaagg

SEQ ID NO: 843632 - DNA, 25 bp, Mus musculus
tgaacttcccatgcaatgtccaagg

SEQ ID NO: 843633 - DNA, 25 bp, Mus musculus
tgaacttcctcacttggtggcactt

SEQ ID NO: 843634 - DNA, 25 bp, Mus musculus
tgaacttcctcagttggtggcactt

SEQ ID NO: 843635 - DNA, 25 bp, Mus musculus
tgaacttcctctcatgacacaatcc

SEQ ID NO: 843636 - DNA, 25 bp, Mus musculus
tgaacttcctctgatgacacaatcc

SEQ ID NO: 843637 - DNA, 25 bp, Mus musculus
tgaacttccttcatataggctctta

SEQ ID NO: 843638 - DNA, 25 bp, Mus musculus
tgaacttccttcctgggcataactg

SEQ ID NO: 843639 - DNA, 25 bp, Mus musculus
tgaacttccttcgtgggcataactg

SEQ ID NO: 843640 - DNA, 25 bp, Mus musculus
tgaacttccttcttataggctctta

SEQ ID NO: 843641 - DNA, 25 bp, Mus musculus
tgaacttcgtagcagatctctctct

SEQ ID NO: 843642 - DNA, 25 bp, Mus musculus
tgaacttcgtaggagatctctctct

SEQ ID NO: 843643 - DNA, 25 bp, Mus musculus
tgaacttctgaaccttctcccacca

SEQ ID NO: 843644 - DNA, 25 bp, Mus musculus
tgaacttctgaagcttctcccacca

SEQ ID NO: 843645 - DNA, 25 bp, Mus musculus
tgaacttctggaacagtcgcagcat

SEQ ID NO: 843646 - DNA, 25 bp, Mus musculus
tgaacttctggatcagtcgcagcat

SEQ ID NO: 843647 - DNA, 25 bp, Mus musculus
tgaacttctgtgctgggatctccgg

SEQ ID NO: 843648 - DNA, 25 bp, Mus musculus
tgaacttctgtggtgggatctccgg

SEQ ID NO: 843649 - DNA, 25 bp, Mus musculus
tgaacttcttaaacagcggctggga

SEQ ID NO: 843650 - DNA, 25 bp, Mus musculus
tgaacttcttaatcagcggctggga

SEQ ID NO: 843651 - DNA, 25 bp, Mus musculus
tgaacttcttatcgccattttccaa

SEQ ID NO: 843652 - DNA, 25 bp, Mus musculus
tgaacttcttatggccattttccaa

SEQ ID NO: 843653 - DNA, 25 bp, Mus musculus
tgaacttcttcacacgtgcttcacg

SEQ ID NO: 843654 - DNA, 25 bp, Mus musculus
tgaacttcttcagacgtgcttcacg

SEQ ID NO: 843655 - DNA, 25 bp, Mus musculus
tgaacttcttgacagtgcccaggca

SEQ ID NO: 843656 - DNA, 25 bp, Mus musculus
tgaacttcttgagagtgcccaggca

SEQ ID NO: 843657 - DNA, 25 bp, Mus musculus
tgaacttcttgtaacatttaccttt

SEQ ID NO: 843658 - DNA, 25 bp, Mus musculus
tgaacttcttgttacatttaccttt

SEQ ID NO: 843659 - DNA, 25 bp, Mus musculus
tgaacttctttccaagatctccagc

SEQ ID NO: 843660 - DNA, 25 bp, Mus musculus
tgaacttctttcgaagatctccagc

SEQ ID NO: 843661 - DNA, 25 bp, Mus musculus
tgaacttgaaatcacagccctgcca

SEQ ID NO: 843662 - DNA, 25 bp, Mus musculus
tgaacttgaaatgacagccctgcca

SEQ ID NO: 843663 - DNA, 25 bp, Mus musculus
tgaacttgacccctgtgacttctac

SEQ ID NO: 843664 - DNA, 25 bp, Mus musculus
tgaacttgacccgtgtgacttctac

SEQ ID NO: 843665 - DNA, 25 bp, Mus musculus
tgaacttgagaaatggacggcctac

SEQ ID NO: 843666 - DNA, 25 bp, Mus musculus
tgaacttgagaattggacggcctac

SEQ ID NO: 843667 - DNA, 25 bp, Mus musculus
tgaacttgagagagagagggcacat

SEQ ID NO: 843668 - DNA, 25 bp, Mus musculus
tgaacttgagagtgagagggcacat

SEQ ID NO: 843669 - DNA, 25 bp, Mus musculus
tgaacttgcaatcagcctcctcttg

SEQ ID NO: 843670 - DNA, 25 bp, Mus musculus
tgaacttgcaatgagcctcctcttg

SEQ ID NO: 843671 - DNA, 25 bp, Mus musculus
tgaacttgcctgcagagatcagaga

SEQ ID NO: 843672 - DNA, 25 bp, Mus musculus
tgaacttgcctggagagatcagaga

SEQ ID NO: 843673 - DNA, 25 bp, Mus musculus
tgaacttgctatccttccatctctg

SEQ ID NO: 843674 - DNA, 25 bp, Mus musculus
tgaacttgctatgcttccatctctg

SEQ ID NO: 843675 - DNA, 25 bp, Mus musculus
tgaacttgctccactatacttgcag

SEQ ID NO: 843676 - DNA, 25 bp, Mus musculus
tgaacttgctcctctatacttgcag

SEQ ID NO: 843677 - DNA, 25 bp, Mus musculus
tgaacttggaacataccctggaggg

SEQ ID NO: 843678 - DNA, 25 bp, Mus musculus
tgaacttggaacttaccctggaggg

SEQ ID NO: 843679 - DNA, 25 bp, Mus musculus
tgaacttggacgaggtgctaacccc

SEQ ID NO: 843680 - DNA, 25 bp, Mus musculus
tgaacttggacgtggtgctaacccc

SEQ ID NO: 843681 - DNA, 25 bp, Mus musculus
tgaacttggactcttccttcctgga

SEQ ID NO: 843682 - DNA, 25 bp, Mus musculus
tgaacttggactgttccttcctgga

SEQ ID NO: 843683 - DNA, 25 bp, Mus musculus
tgaacttggattcttcccaaccagg

SEQ ID NO: 843684 - DNA, 25 bp, Mus musculus
tgaacttggattgttcccaaccagg

SEQ ID NO: 843685 - DNA, 25 bp, Mus musculus
tgaacttggcaacattcctaggaat

SEQ ID NO: 843686 - DNA, 25 bp, Mus musculus
tgaacttggcaagattcctaggaat

SEQ ID NO: 843687 - DNA, 25 bp, Mus musculus
tgaacttggcttctgtcactaaaag

SEQ ID NO: 843688 - DNA, 25 bp, Mus musculus
tgaacttggcttgtgtcactaaaag

SEQ ID NO: 843689 - DNA, 25 bp, Mus musculus
tgaacttgggccaggtaatgacttt

SEQ ID NO: 843690 - DNA, 25 bp, Mus musculus
tgaacttgggcctggtaatgacttt

SEQ ID NO: 843691 - DNA, 25 bp, Mus musculus
tgaacttggttcagccctagtcagt

SEQ ID NO: 843692 - DNA, 25 bp, Mus musculus
tgaacttggttctgccctagtcagt

SEQ ID NO: 843693 - DNA, 25 bp, Mus musculus
tgaacttgtagcacatcccaatgat

SEQ ID NO: 843694 - DNA, 25 bp, Mus musculus
tgaacttgtagctcatcccaatgat

SEQ ID NO: 843695 - DNA, 25 bp, Mus musculus
tgaacttgtgagagctataacttac

SEQ ID NO: 843696 - DNA, 25 bp, Mus musculus
tgaacttgtgagtgctataacttac

SEQ ID NO: 843697 - DNA, 25 bp, Mus musculus
tgaacttgtggtctttccgcctcta

SEQ ID NO: 843698 - DNA, 25 bp, Mus musculus
tgaacttgtggtgtttccgcctcta

SEQ ID NO: 843699 - DNA, 25 bp, Mus musculus
tgaacttgtgttctactctgtagaa

SEQ ID NO: 843700 - DNA, 25 bp, Mus musculus
tgaacttgtgttgtactctgtagaa

SEQ ID NO: 843701 - DNA, 25 bp, Mus musculus
tgaacttgttccaaaaattcaccaa

SEQ ID NO: 843702 - DNA, 25 bp, Mus musculus
tgaacttgttcctaaaattcaccaa

SEQ ID NO: 843703 - DNA, 25 bp, Mus musculus
tgaacttgttttcttctgttccttc

SEQ ID NO: 843704 - DNA, 25 bp, Mus musculus
tgaacttgttttgttctgttccttc

SEQ ID NO: 843705 - DNA, 25 bp, Mus musculus
tgaactttaaatattgcctccacct

SEQ ID NO: 843706 - DNA, 25 bp, Mus musculus
tgaactttaaattttgcctccacct

SEQ ID NO: 843707 - DNA, 25 bp, Mus musculus
tgaactttaagcctgaaggatgtgt

SEQ ID NO: 843708 - DNA, 25 bp, Mus musculus
tgaactttaagcgtgaaggatgtgt

SEQ ID NO: 843709 - DNA, 25 bp, Mus musculus
tgaactttaatccttgcttccagcc

SEQ ID NO: 843710 - DNA, 25 bp, Mus musculus
tgaactttaatcgttgcttccagcc

SEQ ID NO: 843711 - DNA, 25 bp, Mus musculus
tgaactttagacatcctctgtgtgt

SEQ ID NO: 843712 - DNA, 25 bp, Mus musculus
tgaactttagacttcctctgtgtgt

SEQ ID NO: 843713 - DNA, 25 bp, Mus musculus
tgaactttatacctcagtccatgag

SEQ ID NO: 843714 - DNA, 25 bp, Mus musculus
tgaactttatacgtcagtccatgag

SEQ ID NO: 843715 - DNA, 25 bp, Mus musculus
tgaactttatggacttagctgacaa

SEQ ID NO: 843716 - DNA, 25 bp, Mus musculus
tgaactttatggtcttagctgacaa

SEQ ID NO: 843717 - DNA, 25 bp, Mus musculus
tgaactttccaaactcttaacctat

SEQ ID NO: 843718 - DNA, 25 bp, Mus musculus
tgaactttccaatctcttaacctat

SEQ ID NO: 843719 - DNA, 25 bp, Mus musculus
tgaactttcccactagcttggtttt

SEQ ID NO: 843720 - DNA, 25 bp, Mus musculus
tgaactttcccagtagcttggtttt

SEQ ID NO: 843721 - DNA, 25 bp, Mus musculus
tgaactttccctattgttcattgaa

SEQ ID NO: 843722 - DNA, 25 bp, Mus musculus
tgaactttcccttttgttcattgaa

SEQ ID NO: 843723 - DNA, 25 bp, Mus musculus
tgaactttcctaaattgaatcccag

SEQ ID NO: 843724 - DNA, 25 bp, Mus musculus
tgaactttcctatattgaatcccag

SEQ ID NO: 843725 - DNA, 25 bp, Mus musculus
tgaactttctgacgcttggatctga

SEQ ID NO: 843726 - DNA, 25 bp, Mus musculus
tgaactttctgaggcttggatctga

SEQ ID NO: 843727 - DNA, 25 bp, Mus musculus
tgaactttgatcatcttagctggaa

SEQ ID NO: 843728 - DNA, 25 bp, Mus musculus
tgaactttgatcttcttagctggaa

SEQ ID NO: 843729 - DNA, 25 bp, Mus musculus
tgaactttgattagcctggctggtg

SEQ ID NO: 843730 - DNA, 25 bp, Mus musculus
tgaactttgatttgcctggctggtg

SEQ ID NO: 843731 - DNA, 25 bp, Mus musculus
tgaactttgcaaatggcatctctgt

SEQ ID NO: 843732 - DNA, 25 bp, Mus musculus
tgaactttgcaattggcatctctgt

SEQ ID NO: 843733 - DNA, 25 bp, Mus musculus
tgaactttgcacaaggcccatgcag

SEQ ID NO: 843734 - DNA, 25 bp, Mus musculus
tgaactttgcactaggcccatgcag

SEQ ID NO: 843735 - DNA, 25 bp, Mus musculus
tgaactttggtcacccttgcctaag

SEQ ID NO: 843736 - DNA, 25 bp, Mus musculus
tgaactttggtctcccttgcctaag

SEQ ID NO: 843737 - DNA, 25 bp, Mus musculus
tgaactttgtatattgggtccagcg

SEQ ID NO: 843738 - DNA, 25 bp, Mus musculus
tgaactttgtattttgggtccagcg

SEQ ID NO: 843739 - DNA, 25 bp, Mus musculus
tgaactttgtcaccatccctgagac

SEQ ID NO: 843740 - DNA, 25 bp, Mus musculus
tgaactttgtcagcatccctgagac

SEQ ID NO: 843741 - DNA, 25 bp, Mus musculus
tgaactttgtgcagcttcggtcaga

SEQ ID NO: 843742 - DNA, 25 bp, Mus musculus
tgaactttgtgctgcttcggtcaga

SEQ ID NO: 843743 - DNA, 25 bp, Mus musculus
tgaactttgtgtctctcagcagcag

SEQ ID NO: 843744 - DNA, 25 bp, Mus musculus
tgaactttgtgtgtctcagcagcag

SEQ ID NO: 843745 - DNA, 25 bp, Mus musculus
tgaactttgttaaagtttccccaat

SEQ ID NO: 843746 - DNA, 25 bp, Mus musculus
tgaactttgttatagtttccccaat

SEQ ID NO: 843747 - DNA, 25 bp, Mus musculus
tgaactttgttcatgcctctctcgg

SEQ ID NO: 843748 - DNA, 25 bp, Mus musculus
tgaactttgttcttgcctctctcgg

SEQ ID NO: 843749 - DNA, 25 bp, Mus musculus
tgaacttttagacggctttcctgga

SEQ ID NO: 843750 - DNA, 25 bp, Mus musculus
tgaacttttagagggctttcctgga

SEQ ID NO: 843751 - DNA, 25 bp, Mus musculus
tgaacttttattcctcagtgggcct

SEQ ID NO: 843752 - DNA, 25 bp, Mus musculus
tgaacttttattgctcagtgggcct

SEQ ID NO: 843753 - DNA, 25 bp, Mus musculus
tgaacttttggtcctcctgtctaca

SEQ ID NO: 843754 - DNA, 25 bp, Mus musculus
tgaacttttggtgctcctgtctaca

SEQ ID NO: 843755 - DNA, 25 bp, Mus musculus
tgaagaaaaaccatcagtctttgta

SEQ ID NO: 843756 - DNA, 25 bp, Mus musculus
tgaagaaaaaccttcagtctttgta

SEQ ID NO: 843757 - DNA, 25 bp, Mus musculus
tgaagaaaacaaagccccgagatcc

SEQ ID NO: 843758 - DNA, 25 bp, Mus musculus
tgaagaaaacaatgccccgagatcc

SEQ ID NO: 843759 - DNA, 25 bp, Mus musculus
tgaagaaaacccacccaaatacact

SEQ ID NO: 843760 - DNA, 25 bp, Mus musculus
tgaagaaaaccctcccaaatacact

SEQ ID NO: 843761 - DNA, 25 bp, Mus musculus
tgaagaaaaccgagacgcaggagaa

SEQ ID NO: 843762 - DNA, 25 bp, Mus musculus
tgaagaaaaccgtgacgcaggagaa

SEQ ID NO: 843763 - DNA, 25 bp, Mus musculus
tgaagaaaatatatgggccccatga

SEQ ID NO: 843764 - DNA, 25 bp, Mus musculus
tgaagaaaatatttgggccccatga

SEQ ID NO: 843765 - DNA, 25 bp, Mus musculus
tgaagaaaattcacattgtcttttt

SEQ ID NO: 843766 - DNA, 25 bp, Mus musculus
tgaagaaaattctcattgtcttttt

SEQ ID NO: 843767 - DNA, 25 bp, Mus musculus
tgaagaaaattgctaccctgtactt

SEQ ID NO: 843768 - DNA, 25 bp, Mus musculus
tgaagaaaattggtaccctgtactt

SEQ ID NO: 843769 - DNA, 25 bp, Mus musculus
tgaagaaaccataagtcctgcccct

SEQ ID NO: 843770 - DNA, 25 bp, Mus musculus
tgaagaaaccatccccagtacagat

SEQ ID NO: 843771 - DNA, 25 bp, Mus musculus
tgaagaaaccatgcccagtacagat

SEQ ID NO: 843772 - DNA, 25 bp, Mus musculus
tgaagaaaccattagtcctgcccct

SEQ ID NO: 843773 - DNA, 25 bp, Mus musculus
tgaagaaaccgcagagcccatttcc

SEQ ID NO: 843774 - DNA, 25 bp, Mus musculus
tgaagaaaccgctgagcccatttcc

SEQ ID NO: 843775 - DNA, 25 bp, Mus musculus
tgaagaaacctcctactttcatcca

SEQ ID NO: 843776 - DNA, 25 bp, Mus musculus
tgaagaaacctcgtactttcatcca

SEQ ID NO: 843777 - DNA, 25 bp, Mus musculus
tgaagaaaccttccattcctgtgac

SEQ ID NO: 843778 - DNA, 25 bp, Mus musculus
tgaagaaaccttgcattcctgtgac

SEQ ID NO: 843779 - DNA, 25 bp, Mus musculus
tgaagaaacgcaacgcacggagcaa

SEQ ID NO: 843780 - DNA, 25 bp, Mus musculus
tgaagaaacgcatcgcacggagcaa

SEQ ID NO: 843781 - DNA, 25 bp, Mus musculus
tgaagaaagataacccaatacagtc

SEQ ID NO: 843782 - DNA, 25 bp, Mus musculus
tgaagaaagatatcccaatacagtc

SEQ ID NO: 843783 - DNA, 25 bp, Mus musculus
tgaagaaagcacatttaagggtcct

SEQ ID NO: 843784 - DNA, 25 bp, Mus musculus
tgaagaaagcacttttaagggtcct

SEQ ID NO: 843785 - DNA, 25 bp, Mus musculus
tgaagaaagtcgctgcctcctgcag

SEQ ID NO: 843786 - DNA, 25 bp, Mus musculus
tgaagaaagtcggtgcctcctgcag

SEQ ID NO: 843787 - DNA, 25 bp, Mus musculus
tgaagaaataccagccctcggatcc

SEQ ID NO: 843788 - DNA, 25 bp, Mus musculus
tgaagaaatacctgccctcggatcc

SEQ ID NO: 843789 - DNA, 25 bp, Mus musculus
tgaagaaatctaccaggacctgctg

SEQ ID NO: 843790 - DNA, 25 bp, Mus musculus
tgaagaaatctagcaggacctgctg

SEQ ID NO: 843791 - DNA, 25 bp, Mus musculus
tgaagaaatggccagctgtactctt

SEQ ID NO: 843792 - DNA, 25 bp, Mus musculus
tgaagaaatggcgagctgtactctt

SEQ ID NO: 843793 - DNA, 25 bp, Mus musculus
tgaagaaatgtaatttcaccgggaa

SEQ ID NO: 843794 - DNA, 25 bp, Mus musculus
tgaagaaatgtattttcaccgggaa

SEQ ID NO: 843795 - DNA, 25 bp, Mus musculus
tgaagaacacatcgccgtgcttggt

SEQ ID NO: 843796 - DNA, 25 bp, Mus musculus
tgaagaacacatggccgtgcttggt

SEQ ID NO: 843797 - DNA, 25 bp, Mus musculus
tgaagaacacccactgtttgagcgt

SEQ ID NO: 843798 - DNA, 25 bp, Mus musculus
tgaagaacaccctctgtttgagcgt

SEQ ID NO: 843799 - DNA, 25 bp, Mus musculus
tgaagaacacggaaccagcctcgtc

SEQ ID NO: 843800 - DNA, 25 bp, Mus musculus
tgaagaacacggtaccagcctcgtc

SEQ ID NO: 843801 - DNA, 25 bp, Mus musculus
tgaagaacagatccctcagagtaag

SEQ ID NO: 843802 - DNA, 25 bp, Mus musculus
tgaagaacagatgcctcagagtaag

SEQ ID NO: 843803 - DNA, 25 bp, Mus musculus
tgaagaacagcacccagaccagatg

SEQ ID NO: 843804 - DNA, 25 bp, Mus musculus
tgaagaacagcagccagaccagatg

SEQ ID NO: 843805 - DNA, 25 bp, Mus musculus
tgaagaaccctgactgggactctgg

SEQ ID NO: 843806 - DNA, 25 bp, Mus musculus
tgaagaaccctgtctgggactctgg

SEQ ID NO: 843807 - DNA, 25 bp, Mus musculus
tgaagaacctaaaagccagagccat

SEQ ID NO: 843808 - DNA, 25 bp, Mus musculus
tgaagaacctaatagccagagccat

SEQ ID NO: 843809 - DNA, 25 bp, Mus musculus
tgaagaacgtctaccaccctggagt

SEQ ID NO: 843810 - DNA, 25 bp, Mus musculus
tgaagaacgtcttccaccctggagt

SEQ ID NO: 843811 - DNA, 25 bp, Mus musculus
tgaagaactaatccccaaacatcca

SEQ ID NO: 843812 - DNA, 25 bp, Mus musculus
tgaagaactaatgcccaaacatcca

SEQ ID NO: 843813 - DNA, 25 bp, Mus musculus
tgaagaactcaacgaactctacggg

SEQ ID NO: 843814 - DNA, 25 bp, Mus musculus
tgaagaactcaaggaactctacggg

SEQ ID NO: 843815 - DNA, 25 bp, Mus musculus
tgaagaactcctcgttctcgaactt

SEQ ID NO: 843816 - DNA, 25 bp, Mus musculus
tgaagaactcctggttctcgaactt

SEQ ID NO: 843817 - DNA, 25 bp, Mus musculus
tgaagaactcttcaggtcctgttcc

SEQ ID NO: 843818 - DNA, 25 bp, Mus musculus
tgaagaactcttgaggtcctgttcc

SEQ ID NO: 843819 - DNA, 25 bp, Mus musculus
tgaagaactgaaaccctaccatttt

SEQ ID NO: 843820 - DNA, 25 bp, Mus musculus
tgaagaactgaatccctaccatttt

SEQ ID NO: 843821 - DNA, 25 bp, Mus musculus
tgaagaactgcgattcctaccgaga

SEQ ID NO: 843822 - DNA, 25 bp, Mus musculus
tgaagaactgcgtttcctaccgaga

SEQ ID NO: 843823 - DNA, 25 bp, Mus musculus
tgaagaactgggatggctacgtgat

SEQ ID NO: 843824 - DNA, 25 bp, Mus musculus
tgaagaactgggttggctacgtgat

SEQ ID NO: 843825 - DNA, 25 bp, Mus musculus
tgaagaactgttcccacattagcac

SEQ ID NO: 843826 - DNA, 25 bp, Mus musculus
tgaagaactgttgccacattagcac

SEQ ID NO: 843827 - DNA, 25 bp, Mus musculus
tgaagaagaccaccctttattagct

SEQ ID NO: 843828 - DNA, 25 bp, Mus musculus
tgaagaagaccagcctttattagct

SEQ ID NO: 843829 - DNA, 25 bp, Mus musculus
tgaagaagaccccactaccaatttt

SEQ ID NO: 843830 - DNA, 25 bp, Mus musculus
tgaagaagacccgactaccaatttt

SEQ ID NO: 843831 - DNA, 25 bp, Mus musculus
tgaagaagatccctgcttttctgcc

SEQ ID NO: 843832 - DNA, 25 bp, Mus musculus
tgaagaagatccgtgcttttctgcc

SEQ ID NO: 843833 - DNA, 25 bp, Mus musculus
tgaagaagccaaagaccaacacccc

SEQ ID NO: 843834 - DNA, 25 bp, Mus musculus
tgaagaagccaatgaccaacacccc

SEQ ID NO: 843835 - DNA, 25 bp, Mus musculus
tgaagaagccacaaccacagtaagt

SEQ ID NO: 843836 - DNA, 25 bp, Mus musculus
tgaagaagccactaccacagtaagt

SEQ ID NO: 843837 - DNA, 25 bp, Mus musculus
tgaagaagccctacgggtttctgag

SEQ ID NO: 843838 - DNA, 25 bp, Mus musculus
tgaagaagcccttcgggtttctgag

SEQ ID NO: 843839 - DNA, 25 bp, Mus musculus
tgaagaagccgtcagctgtcactca

SEQ ID NO: 843840 - DNA, 25 bp, Mus musculus
tgaagaagccgtgagctgtcactca

SEQ ID NO: 843841 - DNA, 25 bp, Mus musculus
tgaagaagcgcaccacgcgcgcgta

SEQ ID NO: 843842 - DNA, 25 bp, Mus musculus
tgaagaagcgcagcacgcgcgcgta

SEQ ID NO: 843843 - DNA, 25 bp, Mus musculus
tgaagaagctctcactcttgtctct
